United States Patent 7,655,785 (BIOINFORMATICALLY DETECTABLE GROUP OF NOVEL REGULATORY OLIGONUCLEOTIDES AND USES THEREOF) - sequence listing, part 46

SEQ ID NO: 1903432 - RNA, 17 nt, Homo sapiens
uaaaucuuaagcaauau

SEQ ID NO: 1903433 - RNA, 20 nt, Homo sapiens
agagggggggccgggccagg

SEQ ID NO: 1903434 - RNA, 12 nt, Homo sapiens
uuauaaucuacu

SEQ ID NO: 1903435 - RNA, 23 nt, Homo sapiens
cuguuaaccucuuaucacuaaga

SEQ ID NO: 1903436 - RNA, 15 nt, Homo sapiens
aggaauacauuuuau

SEQ ID NO: 1903437 - RNA, 17 nt, Homo sapiens
agcuuguaaauagcuca

SEQ ID NO: 1903438 - RNA, 12 nt, Homo sapiens
aaagaguauuaa

SEQ ID NO: 1903439 - RNA, 12 nt, Homo sapiens
uucggccuccau

SEQ ID NO: 1903440 - RNA, 20 nt, Homo sapiens
gccgcugcuugaguggacag

SEQ ID NO: 1903441 - RNA, 18 nt, Homo sapiens
aaaugccaagacucuaug

SEQ ID NO: 1903442 - RNA, 20 nt, Homo sapiens
gcccauuccucccauucaag

SEQ ID NO: 1903443 - RNA, 19 nt, Homo sapiens
gucuuaccuggcagcaaac

SEQ ID NO: 1903444 - RNA, 13 nt, Homo sapiens
gaccuaacauacc

SEQ ID NO: 1903445 - RNA, 15 nt, Homo sapiens
cuuggcccuccucag

SEQ ID NO: 1903446 - RNA, 23 nt, Homo sapiens
accccacacuugcagagcugcug

SEQ ID NO: 1903447 - RNA, 13 nt, Homo sapiens
aaagaaauaaucu

SEQ ID NO: 1903448 - RNA, 16 nt, Homo sapiens
cugcccuagagcacac

SEQ ID NO: 1903449 - RNA, 16 nt, Homo sapiens
agaaaagccugaaacu

SEQ ID NO: 1903450 - RNA, 15 nt, Homo sapiens
ucuaguacacuuuua

SEQ ID NO: 1903451 - RNA, 13 nt, Homo sapiens
cuaucaguaauag

SEQ ID NO: 1903452 - RNA, 16 nt, Homo sapiens
ucuuguugagugccag

SEQ ID NO: 1903453 - RNA, 18 nt, Homo sapiens
ccucuuuaccuguucaaa

SEQ ID NO: 1903454 - RNA, 19 nt, Homo sapiens
auucaugcaaguauucuca

SEQ ID NO: 1903455 - RNA, 22 nt, Homo sapiens
uaagcuguaaccgauaugcacu

SEQ ID NO: 1903456 - RNA, 15 nt, Homo sapiens
agaacaucaagauac

SEQ ID NO: 1903457 - RNA, 20 nt, Homo sapiens
ucuggagaagcucccaggaa

SEQ ID NO: 1903458 - RNA, 23 nt, Homo sapiens
auuugaaaaaaacuucauucucg

SEQ ID NO: 1903459 - RNA, 22 nt, Homo sapiens
agcuccagauccaguaucuugu

SEQ ID NO: 1903460 - RNA, 17 nt, Homo sapiens
cuaccaaauaauuucau

SEQ ID NO: 1903461 - RNA, 17 nt, Homo sapiens
cuaacauuauacuucau

SEQ ID NO: 1903462 - RNA, 14 nt, Homo sapiens
uuguauuuggacua

SEQ ID NO: 1903463 - RNA, 20 nt, Homo sapiens
gagaguucaauggcugcuga

SEQ ID NO: 1903464 - RNA, 20 nt, Homo sapiens
ugcucaguuggugcugcuuu

SEQ ID NO: 1903465 - RNA, 17 nt, Homo sapiens
uagcuguaaggcaugaa

SEQ ID NO: 1903466 - RNA, 17 nt, Homo sapiens
aaaguagaaaaagauuc

SEQ ID NO: 1903467 - RNA, 18 nt, Homo sapiens
agaaguagcuaguagcaa

SEQ ID NO: 1903468 - RNA, 15 nt, Homo sapiens
agaccuucugaucuc

SEQ ID NO: 1903469 - RNA, 21 nt, Homo sapiens
agaugaggaacaccacuaucu

SEQ ID NO: 1903470 - RNA, 18 nt, Homo sapiens
aaugcaugauuuuauaca

SEQ ID NO: 1903471 - RNA, 15 nt, Homo sapiens
cauugauacaaagua

SEQ ID NO: 1903472 - RNA, 14 nt, Homo sapiens
ugucauuauauucu

SEQ ID NO: 1903473 - RNA, 15 nt, Homo sapiens
gggguccaggcaugu

SEQ ID NO: 1903474 - RNA, 16 nt, Homo sapiens
ucuaaguguacuucau

SEQ ID NO: 1903475 - RNA, 22 nt, Homo sapiens
cacccaucagcacucuguaaaa

SEQ ID NO: 1903476 - RNA, 15 nt, Homo sapiens
cuuucuaaauugcau

SEQ ID NO: 1903477 - RNA, 19 nt, Homo sapiens
gugccaaaaaucuuuucau

SEQ ID NO: 1903478 - RNA, 20 nt, Homo sapiens
cagucugacccuuacagccu

SEQ ID NO: 1903479 - RNA, 13 nt, Homo sapiens
aauguagcacuua

SEQ ID NO: 1903480 - RNA, 20 nt, Homo sapiens
cacacugagacuugaaucaa

SEQ ID NO: 1903481 - RNA, 20 nt, Homo sapiens
uccggccuccugucccucau

SEQ ID NO: 1903482 - RNA, 18 nt, Homo sapiens
uagaugcauuugggucca

SEQ ID NO: 1903483 - RNA, 12 nt, Homo sapiens
cccugucugcuu

SEQ ID NO: 1903484 - RNA, 22 nt, Homo sapiens
gcuguagcucccgagcuacucu

SEQ ID NO: 1903485 - RNA, 17 nt, Homo sapiens
caguuggcagaaaggau

SEQ ID NO: 1903486 - RNA, 15 nt, Homo sapiens
cugaagguguuaaau

SEQ ID NO: 1903487 - RNA, 18 nt, Homo sapiens
gccacugcaccugaccug

SEQ ID NO: 1903488 - RNA, 13 nt, Homo sapiens
acccagccuguuu

SEQ ID NO: 1903489 - RNA, 14 nt, Homo sapiens
agaggugagaccaa

SEQ ID NO: 1903490 - RNA, 20 nt, Homo sapiens
cucccuacccaaugucuccc

SEQ ID NO: 1903491 - RNA, 16 nt, Homo sapiens
ugcuauccccaucucc

SEQ ID NO: 1903492 - RNA, 18 nt, Homo sapiens
uccauccggcuccuguca

SEQ ID NO: 1903493 - RNA, 16 nt, Homo sapiens
ccuuugggcccagcgg

SEQ ID NO: 1903494 - RNA, 20 nt, Homo sapiens
caaaauucauuugcuugcaa

SEQ ID NO: 1903495 - RNA, 15 nt, Homo sapiens
cuacugcaagagcca

SEQ ID NO: 1903496 - RNA, 22 nt, Homo sapiens
acauucauagucuuuggagaaa

SEQ ID NO: 1903497 - RNA, 18 nt, Homo sapiens
cagucacgcaccaagcag

SEQ ID NO: 1903498 - RNA, 23 nt, Homo sapiens
auggucccaggcuucccaaaagu

SEQ ID NO: 1903499 - RNA, 19 nt, Homo sapiens
cuucucaaagcugggauua

SEQ ID NO: 1903500 - RNA, 18 nt, Homo sapiens
auuguuccaguacuaugg

SEQ ID NO: 1903501 - RNA, 23 nt, Homo sapiens
gaaaacgauuuaauuuauucuaa

SEQ ID NO: 1903502 - RNA, 20 nt, Homo sapiens
aucuaaggccuucccuguca

SEQ ID NO: 1903503 - RNA, 14 nt, Homo sapiens
cuuaaaucaaaaga

SEQ ID NO: 1903504 - RNA, 20 nt, Homo sapiens
gccucuuaggcagaaaaccu

SEQ ID NO: 1903505 - RNA, 12 nt, Homo sapiens
gugauacauuua

SEQ ID NO: 1903506 - RNA, 12 nt, Homo sapiens
uuuauacaguga

SEQ ID NO: 1903507 - RNA, 15 nt, Homo sapiens
uguauuaugauuaaa

SEQ ID NO: 1903508 - RNA, 18 nt, Homo sapiens
uuaucauauugauacaaa

SEQ ID NO: 1903509 - RNA, 13 nt, Homo sapiens
ucaaauaaacuca

SEQ ID NO: 1903510 - RNA, 13 nt, Homo sapiens
ugaauuaaagucu

SEQ ID NO: 1903511 - RNA, 15 nt, Homo sapiens
caaguaugacaaccu

SEQ ID NO: 1903512 - RNA, 15 nt, Homo sapiens
ucccugcagaagcca

SEQ ID NO: 1903513 - RNA, 17 nt, Homo sapiens
caguuucccacucugaa

SEQ ID NO: 1903514 - RNA, 14 nt, Homo sapiens
gcacuccuggugca

SEQ ID NO: 1903515 - RNA, 12 nt, Homo sapiens
uauuugagacag

SEQ ID NO: 1903516 - RNA, 22 nt, Homo sapiens
ucuagugagucaacauccauaa

SEQ ID NO: 1903517 - RNA, 23 nt, Homo sapiens
ugcaagcuucuuuuaguuguauc

SEQ ID NO: 1903518 - RNA, 12 nt, Homo sapiens
ccagugccauuc

SEQ ID NO: 1903519 - RNA, 19 nt, Homo sapiens
caccuccauuaaccaagaa

SEQ ID NO: 1903520 - RNA, 15 nt, Homo sapiens
acucuguaucuccag

SEQ ID NO: 1903521 - RNA, 20 nt, Homo sapiens
ugggaugcgggcauuuugaa

SEQ ID NO: 1903522 - RNA, 16 nt, Homo sapiens
aaggacugucccagac

SEQ ID NO: 1903523 - RNA, 14 nt, Homo sapiens
cagucaauuuucac

SEQ ID NO: 1903524 - RNA, 17 nt, Homo sapiens
auuugaagaagaguuuc

SEQ ID NO: 1903525 - RNA, 16 nt, Homo sapiens
uaaagauauuguucaa

SEQ ID NO: 1903526 - RNA, 19 nt, Homo sapiens
ugaagaucauauacgugaa

SEQ ID NO: 1903527 - RNA, 14 nt, Homo sapiens
aggcaggggugaga

SEQ ID NO: 1903528 - RNA, 15 nt, Homo sapiens
aagcauguagccagu

SEQ ID NO: 1903529 - RNA, 15 nt, Homo sapiens
uguauaaugugauuu

SEQ ID NO: 1903530 - RNA, 19 nt, Homo sapiens
gaagguagcccagcacugu

SEQ ID NO: 1903531 - RNA, 21 nt, Homo sapiens
agauucuuuuuuucugucagu

SEQ ID NO: 1903532 - RNA, 18 nt, Homo sapiens
ccacgucccugcacucuc

SEQ ID NO: 1903533 - RNA, 21 nt, Homo sapiens
caguaguaccuuguuuugcca

SEQ ID NO: 1903534 - RNA, 13 nt, Homo sapiens
gccauccaugugc

SEQ ID NO: 1903535 - RNA, 19 nt, Homo sapiens
uccugacuuagcccgucac

SEQ ID NO: 1903536 - RNA, 15 nt, Homo sapiens
aaagcugacuacuug

SEQ ID NO: 1903537 - RNA, 22 nt, Homo sapiens
ucaagaaucuagaagaugugua

SEQ ID NO: 1903538 - RNA, 17 nt, Homo sapiens
acuucagugagauuaag

SEQ ID NO: 1903539 - RNA, 12 nt, Homo sapiens
accccacagacu

SEQ ID NO: 1903540 - RNA, 16 nt, Homo sapiens
ccaagagucuaaagau

SEQ ID NO: 1903541 - RNA, 18 nt, Homo sapiens
gccuuuaaaucugugaug

SEQ ID NO: 1903542 - RNA, 17 nt, Homo sapiens
ucugcagauagugccuc

SEQ ID NO: 1903543 - RNA, 13 nt, Homo sapiens
gcaguguucucac

SEQ ID NO: 1903544 - RNA, 14 nt, Homo sapiens
gaguagggggagca

SEQ ID NO: 1903545 - RNA, 12 nt, Homo sapiens
gcugcagcugug

SEQ ID NO: 1903546 - RNA, 16 nt, Homo sapiens
cugacugugaaaccuu

SEQ ID NO: 1903547 - RNA, 21 nt, Homo sapiens
agguuucuauuuucucugaua

SEQ ID NO: 1903548 - RNA, 18 nt, Homo sapiens
aagccucaaagucccuug

SEQ ID NO: 1903549 - RNA, 21 nt, Homo sapiens
uagccucaggggucugagcuc

SEQ ID NO: 1903550 - RNA, 18 nt, Homo sapiens
gacaaguucacucgccuc

SEQ ID NO: 1903551 - RNA, 18 nt, Homo sapiens
guguauuagucauaaaac

SEQ ID NO: 1903552 - RNA, 18 nt, Homo sapiens
ccgcugcccuuuggccaa

SEQ ID NO: 1903553 - RNA, 10 nt, Homo sapiens
ucacuacuga

SEQ ID NO: 1903554 - RNA, 14 nt, Homo sapiens
ccuggauuuugccc

SEQ ID NO: 1903555 - RNA, 21 nt, Homo sapiens
uuccuugguguucaaaaacca

SEQ ID NO: 1903556 - RNA, 16 nt, Homo sapiens
cuccacccaccaguca

SEQ ID NO: 1903557 - RNA, 13 nt, Homo sapiens
ccaucuacucuuu

SEQ ID NO: 1903558 - RNA, 17 nt, Homo sapiens
ucugcuucucuuucaca

SEQ ID NO: 1903559 - RNA, 16 nt, Homo sapiens
uuugugaagugauuga

SEQ ID NO: 1903560 - RNA, 12 nt, Homo sapiens
gguguguuacac

SEQ ID NO: 1903561 - RNA, 16 nt, Homo sapiens
accuuucaaaggauau

SEQ ID NO: 1903562 - RNA, 15 nt, Homo sapiens
ccauggggaagggau

SEQ ID NO: 1903563 - RNA, 17 nt, Homo sapiens
uuguaauaugucugcca

SEQ ID NO: 1903564 - RNA, 17 nt, Homo sapiens
auuuaguuggaauauca

SEQ ID NO: 1903565 - RNA, 21 nt, Homo sapiens
acauaauugugaccaauacau

SEQ ID NO: 1903566 - RNA, 16 nt, Homo sapiens
aaggucacacuaccau

SEQ ID NO: 1903567 - RNA, 19 nt, Homo sapiens
uucacaccgcugcacucaa

SEQ ID NO: 1903568 - RNA, 19 nt, Homo sapiens
uaagcuaugucacuacccu

SEQ ID NO: 1903569 - RNA, 21 nt, Homo sapiens
ccagaggagccaccaguucuc

SEQ ID NO: 1903570 - RNA, 21 nt, Homo sapiens
augcugccugccaugugugag

SEQ ID NO: 1903571 - RNA, 15 nt, Homo sapiens
auuuauucauucagu

SEQ ID NO: 1903572 - RNA, 15 nt, Homo sapiens
agccgugcagcuggg

SEQ ID NO: 1903573 - RNA, 16 nt, Homo sapiens
cagauaacaccaaacc

SEQ ID NO: 1903574 - RNA, 15 nt, Homo sapiens
ucuugucuaauuuuc

SEQ ID NO: 1903575 - RNA, 18 nt, Homo sapiens
aggaagauggagguuuac

SEQ ID NO: 1903576 - RNA, 19 nt, Homo sapiens
cuuaauccaauauuuugcc

SEQ ID NO: 1903577 - RNA, 22 nt, Homo sapiens
ucuuccuggcuccaacacugcu

SEQ ID NO: 1903578 - RNA, 20 nt, Homo sapiens
ggcgaccccgucacagccuc

SEQ ID NO: 1903579 - RNA, 22 nt, Homo sapiens
gggacacguuaggaauguccag

SEQ ID NO: 1903580 - RNA, 19 nt, Homo sapiens
cuugggauagcaaacucca

SEQ ID NO: 1903581 - RNA, 14 nt, Homo sapiens
ggaagaaacuuucu

SEQ ID NO: 1903582 - RNA, 16 nt, Homo sapiens
auuauuaauacuaugc

SEQ ID NO: 1903583 - RNA, 21 nt, Homo sapiens
uaagaagccuuaauuugcaca

SEQ ID NO: 1903584 - RNA, 15 nt, Homo sapiens
agaagucaacgccuc

SEQ ID NO: 1903585 - RNA, 19 nt, Homo sapiens
uguaagccaucacaccugg

SEQ ID NO: 1903586 - RNA, 21 nt, Homo sapiens
accacacgcccccacaggcuc

SEQ ID NO: 1903587 - RNA, 22 nt, Homo sapiens
aauuaauaacuuucucugugaa

SEQ ID NO: 1903588 - RNA, 14 nt, Homo sapiens
uggcaggacuccag

SEQ ID NO: 1903589 - RNA, 14 nt, Homo sapiens
ugcuaugacuguau

SEQ ID NO: 1903590 - RNA, 21 nt, Homo sapiens
agacggggucucccuguguua

SEQ ID NO: 1903591 - RNA, 16 nt, Homo sapiens
gagcacuuuaaaaaca

SEQ ID NO: 1903592 - RNA, 19 nt, Homo sapiens
agcccauuucuccagaacc

SEQ ID NO: 1903593 - RNA, 15 nt, Homo sapiens
ggccagcauuuucau

SEQ ID NO: 1903594 - RNA, 18 nt, Homo sapiens
aaaagcagaaguucaugg

SEQ ID NO: 1903595 - RNA, 12 nt, Homo sapiens
ggcagugccaca

SEQ ID NO: 1903596 - RNA, 15 nt, Homo sapiens
auccucccaccucag

SEQ ID NO: 1903597 - RNA, 19 nt, Homo sapiens
ugccauguggucauacucu

SEQ ID NO: 1903598 - RNA, 14 nt, Homo sapiens
aaaccagacucacu

SEQ ID NO: 1903599 - RNA, 23 nt, Homo sapiens
acaguaucuacuugcauguguau

SEQ ID NO: 1903600 - RNA, 16 nt, Homo sapiens
ccagauaaccaaguga

SEQ ID NO: 1903601 - RNA, 15 nt, Homo sapiens
acaucugugucuugu

SEQ ID NO: 1903602 - RNA, 18 nt, Homo sapiens
agcucucccuuguuuacu

SEQ ID NO: 1903603 - RNA, 23 nt, Homo sapiens
aauuccuuagcuuagaccucagc

SEQ ID NO: 1903604 - RNA, 22 nt, Homo sapiens
gagaccugacccauccaguucu

SEQ ID NO: 1903605 - RNA, 20 nt, Homo sapiens
cuugauaggacuuccuuaag

SEQ ID NO: 1903606 - RNA, 15 nt, Homo sapiens
aagcaacuugcuucu

SEQ ID NO: 1903607 - RNA, 12 nt, Homo sapiens
ggaaccacagau

SEQ ID NO: 1903608 - RNA, 14 nt, Homo sapiens
uuacugaagccagg

SEQ ID NO: 1903609 - RNA, 13 nt, Homo sapiens
agugucaucucaa

SEQ ID NO: 1903610 - RNA, 16 nt, Homo sapiens
cugcaagcacaucugc

SEQ ID NO: 1903611 - RNA, 16 nt, Homo sapiens
ggcuggagguggcgcc

SEQ ID NO: 1903612 - RNA, 18 nt, Homo sapiens
aguucugggacuacaggc

SEQ ID NO: 1903613 - RNA, 22 nt, Homo sapiens
cuaagaggcugcccuccugugc

SEQ ID NO: 1903614 - RNA, 16 nt, Homo sapiens
gccaaguuccaaaaua

SEQ ID NO: 1903615 - RNA, 22 nt, Homo sapiens
cuuucauuaggcaaaguacaaa

SEQ ID NO: 1903616 - RNA, 15 nt, Homo sapiens
gaaauaucugugaag

SEQ ID NO: 1903617 - RNA, 18 nt, Homo sapiens
cccagcaaggaccaguga

SEQ ID NO: 1903618 - RNA, 16 nt, Homo sapiens
augaaauacuuaauga

SEQ ID NO: 1903619 - RNA, 15 nt, Homo sapiens
acacuucccaacuua

SEQ ID NO: 1903620 - RNA, 16 nt, Homo sapiens
uccuggugcccacucc

SEQ ID NO: 1903621 - RNA, 17 nt, Homo sapiens
guuaaucacauuccuac

SEQ ID NO: 1903622 - RNA, 21 nt, Homo sapiens
ucuugcggcugaagugucaca

SEQ ID NO: 1903623 - RNA, 15 nt, Homo sapiens
gaauagccuggccac

SEQ ID NO: 1903624 - RNA, 18 nt, Homo sapiens
gggcaaagaaaagccaga

SEQ ID NO: 1903625 - RNA, 16 nt, Homo sapiens
cuuggugccacagagg

SEQ ID NO: 1903626 - RNA, 15 nt, Homo sapiens
ugcagcccaugccca

SEQ ID NO: 1903627 - RNA, 20 nt, Homo sapiens
ggccaagaucacaguggcca

SEQ ID NO: 1903628 - RNA, 19 nt, Homo sapiens
ugucaugauuucaaugauu

SEQ ID NO: 1903629 - RNA, 16 nt, Homo sapiens
uaaaauuucuacuaca

SEQ ID NO: 1903630 - RNA, 14 nt, Homo sapiens
caguucuugcaaua

SEQ ID NO: 1903631 - RNA, 13 nt, Homo sapiens
cacuggcucccug

SEQ ID NO: 1903632 - RNA, 20 nt, Homo sapiens
uggucuggaauggacugggu

SEQ ID NO: 1903633 - RNA, 23 nt, Homo sapiens
uuaacauuaucuaguucauugaa

SEQ ID NO: 1903634 - RNA, 15 nt, Homo sapiens
ucuuauagaugcaaa

SEQ ID NO: 1903635 - RNA, 20 nt, Homo sapiens
cuucuagcuuagugcuaugu

SEQ ID NO: 1903636 - RNA, 19 nt, Homo sapiens
cuuuacauuuugugcagug

SEQ ID NO: 1903637 - RNA, 18 nt, Homo sapiens
aaaggugguguuucugua

SEQ ID NO: 1903638 - RNA, 19 nt, Homo sapiens
cgagaaccaggcugcugca

SEQ ID NO: 1903639 - RNA, 15 nt, Homo sapiens
ucuaaagguaccaaa

SEQ ID NO: 1903640 - RNA, 13 nt, Homo sapiens
aaacaguguggau

SEQ ID NO: 1903641 - RNA, 19 nt, Homo sapiens
cccaaucuccaucugucaa

SEQ ID NO: 1903642 - RNA, 16 nt, Homo sapiens
gcugagggaccagcca

SEQ ID NO: 1903643 - RNA, 20 nt, Homo sapiens
gaaaaaaugcagggugauuu

SEQ ID NO: 1903644 - RNA, 18 nt, Homo sapiens
aauaaagcaaugugguag

SEQ ID NO: 1903645 - RNA, 11 nt, Homo sapiens
accaugaaguc

SEQ ID NO: 1903646 - RNA, 23 nt, Homo sapiens
agcuccaugagggcaggcacaug

SEQ ID NO: 1903647 - RNA, 16 nt, Homo sapiens
cucgugaccuacaggg

SEQ ID NO: 1903648 - RNA, 13 nt, Homo sapiens
acaguaacuguga

SEQ ID NO: 1903649 - RNA, 15 nt, Homo sapiens
gccuugugguccaaa

SEQ ID NO: 1903650 - RNA, 15 nt, Homo sapiens
cccaagccaugguga

SEQ ID NO: 1903651 - RNA, 13 nt, Homo sapiens
accagagcugccg

SEQ ID NO: 1903652 - RNA, 23 nt, Homo sapiens
uggccacacacugaguugcacau

SEQ ID NO: 1903653 - RNA, 21 nt, Homo sapiens
cuccuuuaccacccagaaauc

SEQ ID NO: 1903654 - RNA, 15 nt, Homo sapiens
gaaaagcaacauuca

SEQ ID NO: 1903655 - RNA, 22 nt, Homo sapiens
aucggguaacauuggcuacaaa

SEQ ID NO: 1903656 - RNA, 14 nt, Homo sapiens
auugacuuccucca

SEQ ID NO: 1903657 - RNA, 14 nt, Homo sapiens
cuacccaugcaauu

SEQ ID NO: 1903658 - RNA, 18 nt, Homo sapiens
aaagcauucaauuuauuc

SEQ ID NO: 1903659 - RNA, 18 nt, Homo sapiens
uggccucuucugagcuua

SEQ ID NO: 1903660 - RNA, 22 nt, Homo sapiens
aacaauaaaagacguugccuau

SEQ ID NO: 1903661 - RNA, 23 nt, Homo sapiens
gucugaaucauccgaggcaaaga

SEQ ID NO: 1903662 - RNA, 20 nt, Homo sapiens
auaauuucaucccuauuuau

SEQ ID NO: 1903663 - RNA, 22 nt, Homo sapiens
acguaucccaccugacaugucc

SEQ ID NO: 1903664 - RNA, 19 nt, Homo sapiens
agcaggucaaaaaggccaa

SEQ ID NO: 1903665 - RNA, 20 nt, Homo sapiens
caugcuccacuauuuuauua

SEQ ID NO: 1903666 - RNA, 22 nt, Homo sapiens
aacuguuaaggagcuucaggga

SEQ ID NO: 1903667 - RNA, 14 nt, Homo sapiens
acugacaaccugug

SEQ ID NO: 1903668 - RNA, 15 nt, Homo sapiens
ccugcaaacugggaa

SEQ ID NO: 1903669 - RNA, 21 nt, Homo sapiens
acugacauguacgauucacuc

SEQ ID NO: 1903670 - RNA, 14 nt, Homo sapiens
auguucuagugauu

SEQ ID NO: 1903671 - RNA, 14 nt, Homo sapiens
auggagauucugau

SEQ ID NO: 1903672 - RNA, 22 nt, Homo sapiens
gccuagauaugaagaaucugcu

SEQ ID NO: 1903673 - RNA, 23 nt, Homo sapiens
aaaguagcagugugaaguacaau

SEQ ID NO: 1903674 - RNA, 18 nt, Homo sapiens
ucugccuggggugcauuu

SEQ ID NO: 1903675 - RNA, 22 nt, Homo sapiens
gggagagaacuuaaaaaagcaa

SEQ ID NO: 1903676 - RNA, 20 nt, Homo sapiens
auacugcaauuaaagugaua

SEQ ID NO: 1903677 - RNA, 14 nt, Homo sapiens
uucuggugccauuu

SEQ ID NO: 1903678 - RNA, 14 nt, Homo sapiens
auacauugucucua

SEQ ID NO: 1903679 - RNA, 13 nt, Homo sapiens
aauuggcuuccuu

SEQ ID NO: 1903680 - RNA, 12 nt, Homo sapiens
augugcauuaaa

SEQ ID NO: 1903681 - RNA, 14 nt, Homo sapiens
ucuuuccacuuugu

SEQ ID NO: 1903682 - RNA, 16 nt, Homo sapiens
cucuaccaagacauaa

SEQ ID NO: 1903683 - RNA, 12 nt, Homo sapiens
cacucccagcgu

SEQ ID NO: 1903684 - RNA, 16 nt, Homo sapiens
ucucaaacccuguuua

SEQ ID NO: 1903685 - RNA, 17 nt, Homo sapiens
acccaucacuuuggaca

SEQ ID NO: 1903686 - RNA, 14 nt, Homo sapiens
augugcacuuuauc

SEQ ID NO: 1903687 - RNA, 20 nt, Homo sapiens
ugaaaauucuggaaggaaug

SEQ ID NO: 1903688 - RNA, 21 nt, Homo sapiens
ccugguuaaauuugaauuuca

SEQ ID NO: 1903689 - RNA, 13 nt, Homo sapiens
guuaugaacaaag

SEQ ID NO: 1903690 - RNA, 14 nt, Homo sapiens
uccacucugccauu

SEQ ID NO: 1903691 - RNA, 14 nt, Homo sapiens
uuaacacuguaaua

SEQ ID NO: 1903692 - RNA, 17 nt, Homo sapiens
uauuucaggaaggucuu

SEQ ID NO: 1903693 - RNA, 14 nt, Homo sapiens
guuuccagugacac

SEQ ID NO: 1903694 - RNA, 14 nt, Homo sapiens
guacccaguguuac

SEQ ID NO: 1903695 - RNA, 21 nt, Homo sapiens
accacuuaugcauagauauau

SEQ ID NO: 1903696 - RNA, 22 nt, Homo sapiens
uuccaggaaagcaacugcuuug

SEQ ID NO: 1903697 - RNA, 16 nt, Homo sapiens
uuuauggaccaugaaa

SEQ ID NO: 1903698 - RNA, 19 nt, Homo sapiens
gaccaauugugcugccauu

SEQ ID NO: 1903699 - RNA, 22 nt, Homo sapiens
ugagaucguaccuauugcacuc

SEQ ID NO: 1903700 - RNA, 18 nt, Homo sapiens
cacaaaucaugguaauaa

SEQ ID NO: 1903701 - RNA, 14 nt, Homo sapiens
uuccagacuuugaa

SEQ ID NO: 1903702 - RNA, 22 nt, Homo sapiens
aauggcaagagaucauauccuc

SEQ ID NO: 1903703 - RNA, 17 nt, Homo sapiens
uuaggaaacacugauua

SEQ ID NO: 1903704 - RNA, 16 nt, Homo sapiens
gccaagcugaagugaa

SEQ ID NO: 1903705 - RNA, 16 nt, Homo sapiens
caaggggugggccaca

SEQ ID NO: 1903706 - RNA, 13 nt, Homo sapiens
cuaagaaaaggca

SEQ ID NO: 1903707 - RNA, 14 nt, Homo sapiens
caugcuuuugccac

SEQ ID NO: 1903708 - RNA, 21 nt, Homo sapiens
cuucuugcuauaugauuuagc

SEQ ID NO: 1903709 - RNA, 14 nt, Homo sapiens
acacggaggcaucu

SEQ ID NO: 1903710 - RNA, 18 nt, Homo sapiens
auguacuuagcuguacua

SEQ ID NO: 1903711 - RNA, 17 nt, Homo sapiens
cuaaagccaguggcagu

SEQ ID NO: 1903712 - RNA, 19 nt, Homo sapiens
acuuaucuuggaaucaugc

SEQ ID NO: 1903713 - RNA, 13 nt, Homo sapiens
guucucucucauu

SEQ ID NO: 1903714 - RNA, 21 nt, Homo sapiens
caggcagccaccaguggaccu

SEQ ID NO: 1903715 - RNA, 18 nt, Homo sapiens
aagucuuuacucugacuu

SEQ ID NO: 1903716 - RNA, 19 nt, Homo sapiens
cccucaacccuugagauga

SEQ ID NO: 1903717 - RNA, 17 nt, Homo sapiens
acuuuacaaaaguauua

SEQ ID NO: 1903718 - RNA, 18 nt, Homo sapiens
guguuaggauuacaggca

SEQ ID NO: 1903719 - RNA, 19 nt, Homo sapiens
uaauauauggaccuagcuu

SEQ ID NO: 1903720 - RNA, 20 nt, Homo sapiens
acuugccugcuagggaccuc

SEQ ID NO: 1903721 - RNA, 14 nt, Homo sapiens
uccagucagugugc

SEQ ID NO: 1903722 - RNA, 15 nt, Homo sapiens
uucucuaacacuguc

SEQ ID NO: 1903723 - RNA, 15 nt, Homo sapiens
cauuccaaauaugag

SEQ ID NO: 1903724 - RNA, 18 nt, Homo sapiens
caugcugccugccaugug

SEQ ID NO: 1903725 - RNA, 18 nt, Homo sapiens
agcccacuuccauccucu

SEQ ID NO: 1903726 - RNA, 19 nt, Homo sapiens
aaagaucauugcugagaaa

SEQ ID NO: 1903727 - RNA, 21 nt, Homo sapiens
guggguuucuaaagcugccag

SEQ ID NO: 1903728 - RNA, 23 nt, Homo sapiens
cucuugcggaugcuugguacugu

SEQ ID NO: 1903729 - RNA, 23 nt, Homo sapiens
agaaagccauauuccagcaguga

SEQ ID NO: 1903730 - RNA, 16 nt, Homo sapiens
ggaauaacuuuuacac

SEQ ID NO: 1903731 - RNA, 22 nt, Homo sapiens
cuuuauagagugucucagggug

SEQ ID NO: 1903732 - RNA, 20 nt, Homo sapiens
auuuguccaaauaaauucaa

SEQ ID NO: 1903733 - RNA, 17 nt, Homo sapiens
gucuuuuuuauguuaaa

SEQ ID NO: 1903734 - RNA, 12 nt, Homo sapiens
guaacuugccau

SEQ ID NO: 1903735 - RNA, 19 nt, Homo sapiens
caacugcugaucaaugaaa

SEQ ID NO: 1903736 - RNA, 15 nt, Homo sapiens
ucuuggcuuugccac

SEQ ID NO: 1903737 - RNA, 23 nt, Homo sapiens
cuggugugaggaccaugcuguga

SEQ ID NO: 1903738 - RNA, 19 nt, Homo sapiens
uccucacccaucaaaagca

SEQ ID NO: 1903739 - RNA, 13 nt, Homo sapiens
aauaaaccuugau

SEQ ID NO: 1903740 - RNA, 16 nt, Homo sapiens
gagucuggguccaggc

SEQ ID NO: 1903741 - RNA, 19 nt, Homo sapiens
ccagguugccugggccacg

SEQ ID NO: 1903742 - RNA, 22 nt, Homo sapiens
uguuuccuaugacauuacugua

SEQ ID NO: 1903743 - RNA, 20 nt, Homo sapiens
accaaugugaagacacuaca

SEQ ID NO: 1903744 - RNA, 17 nt, Homo sapiens
ugcugaagacauucaaa

SEQ ID NO: 1903745 - RNA, 24 nt, Homo sapiens
uaauaugauuuuuuaagucuaugu

SEQ ID NO: 1903746 - RNA, 14 nt, Homo sapiens
uguggcccugccau

SEQ ID NO: 1903747 - RNA, 14 nt, Homo sapiens
aggcccauucuuca

SEQ ID NO: 1903748 - RNA, 12 nt, Homo sapiens
ugauacauauaa

SEQ ID NO: 1903749 - RNA, 16 nt, Homo sapiens
aacauucugggccuuu

SEQ ID NO: 1903750 - RNA, 18 nt, Homo sapiens
cauguguaauaugcacaa

SEQ ID NO: 1903751 - RNA, 19 nt, Homo sapiens
ucaaaucaaggcaaaagga

SEQ ID NO: 1903752 - RNA, 23 nt, Homo sapiens
augccacucugggcagucuuuug

SEQ ID NO: 1903753 - RNA, 15 nt, Homo sapiens
acaucauuacuauaa

SEQ ID NO: 1903754 - RNA, 20 nt, Homo sapiens
gaagaagacaaaugacagau

SEQ ID NO: 1903755 - RNA, 17 nt, Homo sapiens
ggcggcccugaccaaug

SEQ ID NO: 1903756 - RNA, 19 nt, Homo sapiens
uguuuucauaauaccucac

SEQ ID NO: 1903757 - RNA, 13 nt, Homo sapiens
ugcccguuuccau

SEQ ID NO: 1903758 - RNA, 13 nt, Homo sapiens
uggaacagggaug

SEQ ID NO: 1903759 - RNA, 23 nt, Homo sapiens
gaaaagaaucggcaauguuucaa

SEQ ID NO: 1903760 - RNA, 14 nt, Homo sapiens
uuucccuugcugua

SEQ ID NO: 1903761 - RNA, 18 nt, Homo sapiens
ccauccccuggacuggga

SEQ ID NO: 1903762 - RNA, 21 nt, Homo sapiens
caugaaaaauugcuaugacua

SEQ ID NO: 1903763 - RNA, 19 nt, Homo sapiens
gaauguguuuacgcuguuu

SEQ ID NO: 1903764 - RNA, 11 nt, Homo sapiens
ucauccuccau

SEQ ID NO: 1903765 - RNA, 23 nt, Homo sapiens
acucagcauggucuuaugcacag

SEQ ID NO: 1903766 - RNA, 23 nt, Homo sapiens
cccugcuuaucugaaacuuccca

SEQ ID NO: 1903767 - RNA, 23 nt, Homo sapiens
ucuacccuauuccucaaucuuuu

SEQ ID NO: 1903768 - RNA, 18 nt, Homo sapiens
ccuagucucuacccagua

SEQ ID NO: 1903769 - RNA, 12 nt, Homo sapiens
ugccaugcucag

SEQ ID NO: 1903770 - RNA, 15 nt, Homo sapiens
ggagaaaagcacuua

SEQ ID NO: 1903771 - RNA, 13 nt, Homo sapiens
cugcuaccuugcc

SEQ ID NO: 1903772 - RNA, 16 nt, Homo sapiens
uggcugcuuuguucaa

SEQ ID NO: 1903773 - RNA, 21 nt, Homo sapiens
ucccucgggcuggugucuuga

SEQ ID NO: 1903774 - RNA, 18 nt, Homo sapiens
guccagaagagggguccg

SEQ ID NO: 1903775 - RNA, 18 nt, Homo sapiens
ucccuugggaagggcagg

SEQ ID NO: 1903776 - RNA, 19 nt, Homo sapiens
ugugaagcuaaugaacucu

SEQ ID NO: 1903777 - RNA, 22 nt, Homo sapiens
augucucuuguuaaaugagcuu

SEQ ID NO: 1903778 - RNA, 21 nt, Homo sapiens
aagucacggcugcgcacugug

SEQ ID NO: 1903779 - RNA, 18 nt, Homo sapiens
uaauacauuauauuucua

SEQ ID NO: 1903780 - RNA, 13 nt, Homo sapiens
gcaugcugaaugc

SEQ ID NO: 1903781 - RNA, 13 nt, Homo sapiens
accaucaguauau

SEQ ID NO: 1903782 - RNA, 19 nt, Homo sapiens
gauuaugugacuugcaaua

SEQ ID NO: 1903783 - RNA, 19 nt, Homo sapiens
acuaagaugaaauugccaa

SEQ ID NO: 1903784 - RNA, 14 nt, Homo sapiens
ccauggaccugcac

SEQ ID NO: 1903785 - RNA, 19 nt, Homo sapiens
agaaacacuauuugugacu

SEQ ID NO: 1903786 - RNA, 13 nt, Homo sapiens
ucagcuugcacau

SEQ ID NO: 1903787 - RNA, 14 nt, Homo sapiens
guuuaaacauuucu

SEQ ID NO: 1903788 - RNA, 20 nt, Homo sapiens
ucucccuggcauuguuucca

SEQ ID NO: 1903789 - RNA, 14 nt, Homo sapiens
ucuuaaauauuucc

SEQ ID NO: 1903790 - RNA, 22 nt, Homo sapiens
ccaacuugguucugcuucaaua

SEQ ID NO: 1903791 - RNA, 17 nt, Homo sapiens
ucacauucccucucauc

SEQ ID NO: 1903792 - RNA, 18 nt, Homo sapiens
aagguuuugaaaucccau

SEQ ID NO: 1903793 - RNA, 18 nt, Homo sapiens
guagcucucugaccuccu

SEQ ID NO: 1903794 - RNA, 17 nt, Homo sapiens
agagucaucuaccugag

SEQ ID NO: 1903795 - RNA, 15 nt, Homo sapiens
gugcccugguggaga

SEQ ID NO: 1903796 - RNA, 18 nt, Homo sapiens
ccaaaauacuccaaagau

SEQ ID NO: 1903797 - RNA, 12 nt, Homo sapiens
gugaucuauacc

SEQ ID NO: 1903798 - RNA, 22 nt, Homo sapiens
ugcacauuugaauucauuugcu

SEQ ID NO: 1903799 - RNA, 19 nt, Homo sapiens
gugcuggugaacacuguga

SEQ ID NO: 1903800 - RNA, 23 nt, Homo sapiens
cuuuugacugcuuucccaaaggc

SEQ ID NO: 1903801 - RNA, 17 nt, Homo sapiens
aggccugcugccagugc

SEQ ID NO: 1903802 - RNA, 18 nt, Homo sapiens
ucuucuuuaagccauaga

SEQ ID NO: 1903803 - RNA, 21 nt, Homo sapiens
gaauuuuuuaaauugacaguu

SEQ ID NO: 1903804 - RNA, 21 nt, Homo sapiens
ggcagagccuuccacagugaa

SEQ ID NO: 1903805 - RNA, 16 nt, Homo sapiens
cuaugggagaguguca

SEQ ID NO: 1903806 - RNA, 19 nt, Homo sapiens
uucuuucagaaagcuuuga

SEQ ID NO: 1903807 - RNA, 21 nt, Homo sapiens
cugccuugccaugucuuguuc

SEQ ID NO: 1903808 - RNA, 22 nt, Homo sapiens
agugauaucccccagccucaag

SEQ ID NO: 1903809 - RNA, 22 nt, Homo sapiens
aucacagcucccuagguaggca

SEQ ID NO: 1903810 - RNA, 23 nt, Homo sapiens
gacuucgggggcggcucugggaa

SEQ ID NO: 1903811 - RNA, 22 nt, Homo sapiens
aucacagcuuucaaaagcaaga

SEQ ID NO: 1903812 - RNA, 16 nt, Homo sapiens
aauauaagaccucugg

SEQ ID NO: 1903813 - RNA, 18 nt, Homo sapiens
aauuaagcucauuuuuag

SEQ ID NO: 1903814 - RNA, 17 nt, Homo sapiens
cuccuugacuccaagaa

SEQ ID NO: 1903815 - RNA, 11 nt, Homo sapiens
uguuugucagc

SEQ ID NO: 1903816 - RNA, 21 nt, Homo sapiens
uggggccugccuggucucuag

SEQ ID NO: 1903817 - RNA, 23 nt, Homo sapiens
aggugggauaucccuaugcugcc

SEQ ID NO: 1903818 - RNA, 18 nt, Homo sapiens
ucuguuaugcaagcacaa

SEQ ID NO: 1903819 - RNA, 13 nt, Homo sapiens
ccaggcaaagcaa

SEQ ID NO: 1903820 - RNA, 14 nt, Homo sapiens
gcgaccauguggcc

SEQ ID NO: 1903821 - RNA, 21 nt, Homo sapiens
aggagucccugccaucauguu

SEQ ID NO: 1903822 - RNA, 21 nt, Homo sapiens
augaacuauuuacauuuucca

SEQ ID NO: 1903823 - RNA, 23 nt, Homo sapiens
gccacuuucauuggacccugacu

SEQ ID NO: 1903824 - RNA, 14 nt, Homo sapiens
aaugcuaugucauu

SEQ ID NO: 1903825 - RNA, 14 nt, Homo sapiens
uuuguuauugcaaa

SEQ ID NO: 1903826 - RNA, 19 nt, Homo sapiens
uuguucaaaauaaugaagu

SEQ ID NO: 1903827 - RNA, 14 nt, Homo sapiens
aauugugugucaca

SEQ ID NO: 1903828 - RNA, 18 nt, Homo sapiens
acaauguucuggcacuau

SEQ ID NO: 1903829 - RNA, 13 nt, Homo sapiens
uuaaauuauaucu

SEQ ID NO: 1903830 - RNA, 13 nt, Homo sapiens
uaaauuuauuuca

SEQ ID NO: 1903831 - RNA, 12 nt, Homo sapiens
acuccuggagaa

SEQ ID NO: 1903832 - RNA, 17 nt, Homo sapiens
gagagggugcuauccau

SEQ ID NO: 1903833 - RNA, 15 nt, Homo sapiens
accauuccucaagau

SEQ ID NO: 1903834 - RNA, 15 nt, Homo sapiens
uauaucaagaagucu

SEQ ID NO: 1903835 - RNA, 14 nt, Homo sapiens
gagaagaaauccau

SEQ ID NO: 1903836 - RNA, 22 nt, Homo sapiens
agagcuaaggccaaugggcuag

SEQ ID NO: 1903837 - RNA, 19 nt, Homo sapiens
ccauuuguaaaacauucca

SEQ ID NO: 1903838 - RNA, 15 nt, Homo sapiens
augaaguuguaagaa

SEQ ID NO: 1903839 - RNA, 14 nt, Homo sapiens
ugagugaagcaaaa

SEQ ID NO: 1903840 - RNA, 14 nt, Homo sapiens
aacucaaugcauga

SEQ ID NO: 1903841 - RNA, 13 nt, Homo sapiens
auuccuuuccucu

SEQ ID NO: 1903842 - RNA, 13 nt, Homo sapiens
uacuuagugguau

SEQ ID NO: 1903843 - RNA, 18 nt, Homo sapiens
guuauaaauuuuguacau

SEQ ID NO: 1903844 - RNA, 14 nt, Homo sapiens
uagacaaaaucagu

SEQ ID NO: 1903845 - RNA, 16 nt, Homo sapiens
acauggcuugccacag

SEQ ID NO: 1903846 - RNA, 16 nt, Homo sapiens
aaagcugaacacauuu

SEQ ID NO: 1903847 - RNA, 13 nt, Homo sapiens
guuuccuccccau

SEQ ID NO: 1903848 - RNA, 13 nt, Homo sapiens
cuacccuguccua

SEQ ID NO: 1903849 - RNA, 22 nt, Homo sapiens
auuaaauguagaaagugaucca

SEQ ID NO: 1903850 - RNA, 16 nt, Homo sapiens
uauguuuucacaguca

SEQ ID NO: 1903851 - RNA, 22 nt, Homo sapiens
gggagcacugcguuuuccuagc

SEQ ID NO: 1903852 - RNA, 23 nt, Homo sapiens
caagcuuuggcuuuuuccaucuc

SEQ ID NO: 1903853 - RNA, 19 nt, Homo sapiens
cugaaaaccaauguucucu

SEQ ID NO: 1903854 - RNA, 21 nt, Homo sapiens
gcuucauaaaugaagcagcuu

SEQ ID NO: 1903855 - RNA, 16 nt, Homo sapiens
uacaaccauacuuuau

SEQ ID NO: 1903856 - RNA, 23 nt, Homo sapiens
uuggcuucuguugucaccuucac

SEQ ID NO: 1903857 - RNA, 22 nt, Homo sapiens
aagcagaacucucaugcgugac

SEQ ID NO: 1903858 - RNA, 15 nt, Homo sapiens
gaugcaaugugcuac

SEQ ID NO: 1903859 - RNA, 15 nt, Homo sapiens
auauuuauagcaauc

SEQ ID NO: 1903860 - RNA, 19 nt, Homo sapiens
aaagagcacuucacacaga

SEQ ID NO: 1903861 - RNA, 20 nt, Homo sapiens
ugccauggucaccaaacagg

SEQ ID NO: 1903862 - RNA, 19 nt, Homo sapiens
aaaauguuaugauaaucuu

SEQ ID NO: 1903863 - RNA, 19 nt, Homo sapiens
uucagugcaccugccucag

SEQ ID NO: 1903864 - RNA, 13 nt, Homo sapiens
auacaagacuguu

SEQ ID NO: 1903865 - RNA, 22 nt, Homo sapiens
ugccgcaugcucccuccucucc

SEQ ID NO: 1903866 - RNA, 21 nt, Homo sapiens
aacauccguuuucauuguuca

SEQ ID NO: 1903867 - RNA, 20 nt, Homo sapiens
aacaggccuugagcacaaaa

SEQ ID NO: 1903868 - RNA, 20 nt, Homo sapiens
ggacauuuggguugguucca

SEQ ID NO: 1903869 - RNA, 17 nt, Homo sapiens
agauuuugucaaaaacu

SEQ ID NO: 1903870 - RNA, 14 nt, Homo sapiens
cuacuugaaggaca

SEQ ID NO: 1903871 - RNA, 12 nt, Homo sapiens
uaccacaguguc

SEQ ID NO: 1903872 - RNA, 12 nt, Homo sapiens
ugcuacaguauu

SEQ ID NO: 1903873 - RNA, 22 nt, Homo sapiens
aggcaaccugauuguaaacuuc

SEQ ID NO: 1903874 - RNA, 16 nt, Homo sapiens
gcuggucuucagcaaa

SEQ ID NO: 1903875 - RNA, 14 nt, Homo sapiens
cauauuuauucaug

SEQ ID NO: 1903876 - RNA, 21 nt, Homo sapiens
cagacaauuggucaaaaugaa

SEQ ID NO: 1903877 - RNA, 15 nt, Homo sapiens
gaaaguuugcacugu

SEQ ID NO: 1903878 - RNA, 20 nt, Homo sapiens
gauguuuuuaaaaguuucaa

SEQ ID NO: 1903879 - RNA, 23 nt, Homo sapiens
aauucauccucacucaguccagc

SEQ ID NO: 1903880 - RNA, 22 nt, Homo sapiens
ccuuuugcaacaagacaaagca

SEQ ID NO: 1903881 - RNA, 22 nt, Homo sapiens
cacuuauaagaaagaucaaaga

SEQ ID NO: 1903882 - RNA, 18 nt, Homo sapiens
aggcacuguucaucucag

SEQ ID NO: 1903883 - RNA, 18 nt, Homo sapiens
aagcaacaucgucugcuu

SEQ ID NO: 1903884 - RNA, 19 nt, Homo sapiens
ggcacagccuuugcccaaa

SEQ ID NO: 1903885 - RNA, 19 nt, Homo sapiens
gucaucacuccucugucau

SEQ ID NO: 1903886 - RNA, 21 nt, Homo sapiens
ggucauagcccagaucagcuc

SEQ ID NO: 1903887 - RNA, 19 nt, Homo sapiens
gaagcagccaucacaugau

SEQ ID NO: 1903888 - RNA, 22 nt, Homo sapiens
aggacaaaauaaaccguguauu

SEQ ID NO: 1903889 - RNA, 23 nt, Homo sapiens
acuguagaaaugaugauguggaa

SEQ ID NO: 1903890 - RNA, 15 nt, Homo sapiens
uucuccaugucugua

SEQ ID NO: 1903891 - RNA, 17 nt, Homo sapiens
cucauguuuuuggaaac

SEQ ID NO: 1903892 - RNA, 23 nt, Homo sapiens
ucugcacggugggagaccugcug

SEQ ID NO: 1903893 - RNA, 18 nt, Homo sapiens
ccuaaaguacugggauua

SEQ ID NO: 1903894 - RNA, 18 nt, Homo sapiens
cacucuuuaagugaagga

SEQ ID NO: 1903895 - RNA, 16 nt, Homo sapiens
uucuuuacuacugcaa

SEQ ID NO: 1903896 - RNA, 19 nt, Homo sapiens
ugagcagugagcagaaagc

SEQ ID NO: 1903897 - RNA, 13 nt, Homo sapiens
uaaaaaagcuaua

SEQ ID NO: 1903898 - RNA, 15 nt, Homo sapiens
gccuggcccaaagca

SEQ ID NO: 1903899 - RNA, 21 nt, Homo sapiens
aauuccuccagagacacugag

SEQ ID NO: 1903900 - RNA, 13 nt, Homo sapiens
ugaaucugucuau

SEQ ID NO: 1903901 - RNA, 16 nt, Homo sapiens
cagagacaggaaaauc

SEQ ID NO: 1903902 - RNA, 19 nt, Homo sapiens
caagcauuacuuuaaccuc

SEQ ID NO: 1903903 - RNA, 17 nt, Homo sapiens
uauuugcacuucaccuu

SEQ ID NO: 1903904 - RNA, 13 nt, Homo sapiens
cuccccaggacuu

SEQ ID NO: 1903905 - RNA, 13 nt, Homo sapiens
gucuucagcaccc

SEQ ID NO: 1903906 - RNA, 16 nt, Homo sapiens
auuaacugaauucuga

SEQ ID NO: 1903907 - RNA, 17 nt, Homo sapiens
cugggaccacuggguac

SEQ ID NO: 1903908 - RNA, 16 nt, Homo sapiens
caaaggcuuccugaaa

SEQ ID NO: 1903909 - RNA, 16 nt, Homo sapiens
uccuaaaacaaaagcu

SEQ ID NO: 1903910 - RNA, 22 nt, Homo sapiens
acauuuguuccgugucuggcca

SEQ ID NO: 1903911 - RNA, 13 nt, Homo sapiens
cccaaaugcucuc

SEQ ID NO: 1903912 - RNA, 19 nt, Homo sapiens
cugaagcaaagaagggaau

SEQ ID NO: 1903913 - RNA, 19 nt, Homo sapiens
caguaaggcagcucugucg

SEQ ID NO: 1903914 - RNA, 17 nt, Homo sapiens
uauucucuaagauauau

SEQ ID NO: 1903915 - RNA, 21 nt, Homo sapiens
cuggagacuaaccccaccaca

SEQ ID NO: 1903916 - RNA, 15 nt, Homo sapiens
ccacaacugacacag

SEQ ID NO: 1903917 - RNA, 12 nt, Homo sapiens
gugaccaugcaa

SEQ ID NO: 1903918 - RNA, 12 nt, Homo sapiens
cuguccauccau

SEQ ID NO: 1903919 - RNA, 15 nt, Homo sapiens
cucuguuguccuccc

SEQ ID NO: 1903920 - RNA, 18 nt, Homo sapiens
cucaucagaaacucaaaa

SEQ ID NO: 1903921 - RNA, 22 nt, Homo sapiens
ccaaaggggcugcuggggcaug

SEQ ID NO: 1903922 - RNA, 22 nt, Homo sapiens
uuuggaagugaggcauugcaca

SEQ ID NO: 1903923 - RNA, 15 nt, Homo sapiens
caaugcuucugcaua

SEQ ID NO: 1903924 - RNA, 23 nt, Homo sapiens
gauccagggauagccccgucugg

SEQ ID NO: 1903925 - RNA, 13 nt, Homo sapiens
acauucagggaaa

SEQ ID NO: 1903926 - RNA, 20 nt, Homo sapiens
uguagccuggucugugcauu

SEQ ID NO: 1903927 - RNA, 17 nt, Homo sapiens
uucuuccaaacaggcuc

SEQ ID NO: 1903928 - RNA, 23 nt, Homo sapiens
guguaaauggagcuuguacauau

SEQ ID NO: 1903929 - RNA, 16 nt, Homo sapiens
cagugguaccagcuca

SEQ ID NO: 1903930 - RNA, 18 nt, Homo sapiens
gccgguaccagccugacu

SEQ ID NO: 1903931 - RNA, 19 nt, Homo sapiens
agcuccugagcuugaucuu

SEQ ID NO: 1903932 - RNA, 15 nt, Homo sapiens
cucacaguucugcag

SEQ ID NO: 1903933 - RNA, 14 nt, Homo sapiens
gauccucuugccac

SEQ ID NO: 1903934 - RNA, 19 nt, Homo sapiens
aguuccaugaagaccacau

SEQ ID NO: 1903935 - RNA, 20 nt, Homo sapiens
uaacuguaaaucacuuguaa

SEQ ID NO: 1903936 - RNA, 16 nt, Homo sapiens
gcaaagucaucaaaga

SEQ ID NO: 1903937 - RNA, 17 nt, Homo sapiens
gagcuuucucaaugucu

SEQ ID NO: 1903938 - RNA, 22 nt, Homo sapiens
gccuccucucucccugccucac

SEQ ID NO: 1903939 - RNA, 22 nt, Homo sapiens
aggcaagcguguucucagcaca

SEQ ID NO: 1903940 - RNA, 19 nt, Homo sapiens
aacauagaugcuacaguau

SEQ ID NO: 1903941 - RNA, 17 nt, Homo sapiens
caggcugggcugagcca

SEQ ID NO: 1903942 - RNA, 23 nt, Homo sapiens
aaagagacuguggggagggucau

SEQ ID NO: 1903943 - RNA, 14 nt, Homo sapiens
auacaaauuccaca

SEQ ID NO: 1903944 - RNA, 21 nt, Homo sapiens
guuauuuuugcuuguuucuga

SEQ ID NO: 1903945 - RNA, 18 nt, Homo sapiens
ucugggcucagacaucca

SEQ ID NO: 1903946 - RNA, 21 nt, Homo sapiens
gaauauuguaaauguucaagu

SEQ ID NO: 1903947 - RNA, 16 nt, Homo sapiens
aauggauaaguagaau

SEQ ID NO: 1903948 - RNA, 23 nt, Homo sapiens
gccaguguuuagaagagccugac

SEQ ID NO: 1903949 - RNA, 19 nt, Homo sapiens
aaucuucagcauguucuca

SEQ ID NO: 1903950 - RNA, 16 nt, Homo sapiens
agcuccuaguuugugg

SEQ ID NO: 1903951 - RNA, 23 nt, Homo sapiens
acuccagugcccaucagccuugu

SEQ ID NO: 1903952 - RNA, 14 nt, Homo sapiens
ggaaugagcagcuu

SEQ ID NO: 1903953 - RNA, 18 nt, Homo sapiens
gacaggcagacacaugcu

SEQ ID NO: 1903954 - RNA, 15 nt, Homo sapiens
auaaucccauacucu

SEQ ID NO: 1903955 - RNA, 17 nt, Homo sapiens
guagaacaauguacaag

SEQ ID NO: 1903956 - RNA, 14 nt, Homo sapiens
uaaaaauacaagca

SEQ ID NO: 1903957 - RNA, 14 nt, Homo sapiens
uauaaauacaugca

SEQ ID NO: 1903958 - RNA, 16 nt, Homo sapiens
ggagaccucaugccau

SEQ ID NO: 1903959 - RNA, 19 nt, Homo sapiens
ugaaccagaggguguggcu

SEQ ID NO: 1903960 - RNA, 22 nt, Homo sapiens
aagcagaauucugcauggugac

SEQ ID NO: 1903961 - RNA, 22 nt, Homo sapiens
auaauucacucaagcacugaua

SEQ ID NO: 1903962 - RNA, 13 nt, Homo sapiens
aacagugccauug

SEQ ID NO: 1903963 - RNA, 22 nt, Homo sapiens
gauuugcuuccauuuuccuaca

SEQ ID NO: 1903964 - RNA, 23 nt, Homo sapiens
aagaugcauuuuguguacaguaa

SEQ ID NO: 1903965 - RNA, 18 nt, Homo sapiens
cauuucuuuucuuucuug

SEQ ID NO: 1903966 - RNA, 18 nt, Homo sapiens
ugagcuccccagaucucc

SEQ ID NO: 1903967 - RNA, 18 nt, Homo sapiens
aaauauuuugaucuucaa

SEQ ID NO: 1903968 - RNA, 18 nt, Homo sapiens
uguuguucccucccucaa

SEQ ID NO: 1903969 - RNA, 16 nt, Homo sapiens
gaaaguauuuacuuuu

SEQ ID NO: 1903970 - RNA, 13 nt, Homo sapiens
caugaaugugcug

SEQ ID NO: 1903971 - RNA, 14 nt, Homo sapiens
gucuuacugugauc

SEQ ID NO: 1903972 - RNA, 20 nt, Homo sapiens
gauuguagauaacacugacu

SEQ ID NO: 1903973 - RNA, 14 nt, Homo sapiens
cauauauuguuauu

SEQ ID NO: 1903974 - RNA, 17 nt, Homo sapiens
aucacuucuuccacugu

SEQ ID NO: 1903975 - RNA, 15 nt, Homo sapiens
auauacaaagggaua

SEQ ID NO: 1903976 - RNA, 16 nt, Homo sapiens
cauuugucucuacuuu

SEQ ID NO: 1903977 - RNA, 17 nt, Homo sapiens
uuuauuauuuucaccug

SEQ ID NO: 1903978 - RNA, 17 nt, Homo sapiens
gcccucaccccaauccc

SEQ ID NO: 1903979 - RNA, 18 nt, Homo sapiens
cucuuauagaaaguucaa

SEQ ID NO: 1903980 - RNA, 19 nt, Homo sapiens
ggagugaauuaaagccuuu

SEQ ID NO: 1903981 - RNA, 15 nt, Homo sapiens
uuguagcagugauuc

SEQ ID NO: 1903982 - RNA, 23 nt, Homo sapiens
ccuuauuguguuaaccauggugg

SEQ ID NO: 1903983 - RNA, 16 nt, Homo sapiens
aaugcucuuuacuuca

SEQ ID NO: 1903984 - RNA, 14 nt, Homo sapiens
uacccucaccuguc

SEQ ID NO: 1903985 - RNA, 14 nt, Homo sapiens
uuagugcagccaag

SEQ ID NO: 1903986 - RNA, 12 nt, Homo sapiens
accgaugcacac

SEQ ID NO: 1903987 - RNA, 15 nt, Homo sapiens
aucauuucauauaaa

SEQ ID NO: 1903988 - RNA, 15 nt, Homo sapiens
gaaaagguugccuga

SEQ ID NO: 1903989 - RNA, 19 nt, Homo sapiens
uucgcagugcccagugaug

SEQ ID NO: 1903990 - RNA, 21 nt, Homo sapiens
aucucuuucucuuuaauggaa

SEQ ID NO: 1903991 - RNA, 15 nt, Homo sapiens
ugaccacucuuggcu

SEQ ID NO: 1903992 - RNA, 19 nt, Homo sapiens
ugcccagcucagugccaca

SEQ ID NO: 1903993 - RNA, 20 nt, Homo sapiens
acguaaaucuguucaaggaa

SEQ ID NO: 1903994 - RNA, 16 nt, Homo sapiens
aguaaccauuugcacu

SEQ ID NO: 1903995 - RNA, 15 nt, Homo sapiens
cauuauauagcagua

SEQ ID NO: 1903996 - RNA, 18 nt, Homo sapiens
ccuagaagaagcuauguc

SEQ ID NO: 1903997 - RNA, 17 nt, Homo sapiens
gaaaacuugugcccuug

SEQ ID NO: 1903998 - RNA, 18 nt, Homo sapiens
ccaaacuggagcuugaaa

SEQ ID NO: 1903999 - RNA, 15 nt, Homo sapiens
gcccgcuagcauuag

SEQ ID NO: 1904000 - RNA, 20 nt, Homo sapiens
uccuucuuacagaaguauuu

SEQ ID NO: 1904001 - RNA, 20 nt, Homo sapiens
uggagcguguacuaccccag

SEQ ID NO: 1904002 - RNA, 22 nt, Homo sapiens
aucuugauaucucgaacuuuca

SEQ ID NO: 1904003 - RNA, 15 nt, Homo sapiens
ugagcuaugacuuaa

SEQ ID NO: 1904004 - RNA, 17 nt, Homo sapiens
cucugcaguccuacuca

SEQ ID NO: 1904005 - RNA, 21 nt, Homo sapiens
uaacuuggccauguucuccau

SEQ ID NO: 1904006 - RNA, 13 nt, Homo sapiens
caagguuaauuca

SEQ ID NO: 1904007 - RNA, 20 nt, Homo sapiens
aggaacgugccaccaugacu

SEQ ID NO: 1904008 - RNA, 17 nt, Homo sapiens
acgacugcaacauacag

SEQ ID NO: 1904009 - RNA, 22 nt, Homo sapiens
aggaaggacuuuggcaagugau

SEQ ID NO: 1904010 - RNA, 15 nt, Homo sapiens
augaaaaugagcccu

SEQ ID NO: 1904011 - RNA, 14 nt, Homo sapiens
gugaggcuguaaag

SEQ ID NO: 1904012 - RNA, 23 nt, Homo sapiens
cugccugaauugagaauuuugau

SEQ ID NO: 1904013 - RNA, 22 nt, Homo sapiens
agagcaugaaaaucacacuguc

SEQ ID NO: 1904014 - RNA, 18 nt, Homo sapiens
aacggugagcauuguggc

SEQ ID NO: 1904015 - RNA, 16 nt, Homo sapiens
cuacguuggugcaagu

SEQ ID NO: 1904016 - RNA, 21 nt, Homo sapiens
uccaugggcuggcauggugag

SEQ ID NO: 1904017 - RNA, 21 nt, Homo sapiens
guuuggaaaccacagucagug

SEQ ID NO: 1904018 - RNA, 20 nt, Homo sapiens
gcuuuaagcgcaacauuucu

SEQ ID NO: 1904019 - RNA, 22 nt, Homo sapiens
ucuaaaucaaaccaggugcaau

SEQ ID NO: 1904020 - RNA, 18 nt, Homo sapiens
gcaaagaccuaccuccag

SEQ ID NO: 1904021 - RNA, 22 nt, Homo sapiens
ccugaggaucuagcuucaugcc

SEQ ID NO: 1904022 - RNA, 15 nt, Homo sapiens
guaauuguaauucca

SEQ ID NO: 1904023 - RNA, 23 nt, Homo sapiens
ccuccccagguggaggugccagg

SEQ ID NO: 1904024 - RNA, 14 nt, Homo sapiens
uuaguguacaugaa

SEQ ID NO: 1904025 - RNA, 13 nt, Homo sapiens
gaacucacagaaa

SEQ ID NO: 1904026 - RNA, 18 nt, Homo sapiens
ugccuggcccaugugccc

SEQ ID NO: 1904027 - RNA, 23 nt, Homo sapiens
aguuucgacguuugacuagccau

SEQ ID NO: 1904028 - RNA, 15 nt, Homo sapiens
cuguaaagugccuua

SEQ ID NO: 1904029 - RNA, 14 nt, Homo sapiens
uugcccaccacagc

SEQ ID NO: 1904030 - RNA, 14 nt, Homo sapiens
augggcucuuccaa

SEQ ID NO: 1904031 - RNA, 14 nt, Homo sapiens
uaucauaaauacaa

SEQ ID NO: 1904032 - RNA, 21 nt, Homo sapiens
gacaagaauaauucaauuuua

SEQ ID NO: 1904033 - RNA, 15 nt, Homo sapiens
aagcgaacaucuuca

SEQ ID NO: 1904034 - RNA, 22 nt, Homo sapiens
aacucuuacggcuaucuaguug

SEQ ID NO: 1904035 - RNA, 18 nt, Homo sapiens
uccuguuuuuagugcuga

SEQ ID NO: 1904036 - RNA, 21 nt, Homo sapiens
ugcguguguguucacguguuc

SEQ ID NO: 1904037 - RNA, 15 nt, Homo sapiens
gccagacaugccaca

SEQ ID NO: 1904038 - RNA, 22 nt, Homo sapiens
caugugcaaaugugcuggucac

SEQ ID NO: 1904039 - RNA, 16 nt, Homo sapiens
auuccucucaguccuu

SEQ ID NO: 1904040 - RNA, 12 nt, Homo sapiens
uugaacauacuu

SEQ ID NO: 1904041 - RNA, 12 nt, Homo sapiens
ucuaacauaugu

SEQ ID NO: 1904042 - RNA, 19 nt, Homo sapiens
ucgaacuccugaccucagg

SEQ ID NO: 1904043 - RNA, 18 nt, Homo sapiens
cuccuccaucucuggcca

SEQ ID NO: 1904044 - RNA, 21 nt, Homo sapiens
cagaugccauggccugugcug

SEQ ID NO: 1904045 - RNA, 14 nt, Homo sapiens
agacuaugauuuac

SEQ ID NO: 1904046 - RNA, 14 nt, Homo sapiens
cagcagacauccac

SEQ ID NO: 1904047 - RNA, 19 nt, Homo sapiens
uacaucuuauaaacugacu

SEQ ID NO: 1904048 - RNA, 16 nt, Homo sapiens
ggccauccacugugac

SEQ ID NO: 1904049 - RNA, 22 nt, Homo sapiens
gacucaauaaauacauguuaaa

SEQ ID NO: 1904050 - RNA, 16 nt, Homo sapiens
gugacacaaucucagc

SEQ ID NO: 1904051 - RNA, 23 nt, Homo sapiens
uagucauuaacccaucucugaac

SEQ ID NO: 1904052 - RNA, 23 nt, Homo sapiens
aggucaugaaggacacucugcag

SEQ ID NO: 1904053 - RNA, 21 nt, Homo sapiens
agugcugggauuacaggugug

SEQ ID NO: 1904054 - RNA, 13 nt, Homo sapiens
uggaaacugucaa

SEQ ID NO: 1904055 - RNA, 13 nt, Homo sapiens
gggacacuuucac

SEQ ID NO: 1904056 - RNA, 12 nt, Homo sapiens
aaaaccacuuuu

SEQ ID NO: 1904057 - RNA, 16 nt, Homo sapiens
guucacuuucuaucuu

SEQ ID NO: 1904058 - RNA, 14 nt, Homo sapiens
agauucuaccacac

SEQ ID NO: 1904059 - RNA, 18 nt, Homo sapiens
cucccaaguuuugaaagg

SEQ ID NO: 1904060 - RNA, 22 nt, Homo sapiens
ucacaaggcacaccagugcaag

SEQ ID NO: 1904061 - RNA, 16 nt, Homo sapiens
acuaugaucacaguga

SEQ ID NO: 1904062 - RNA, 15 nt, Homo sapiens
uccccuaaaccaaaa

SEQ ID NO: 1904063 - RNA, 16 nt, Homo sapiens
ugagaauuuugugagg

SEQ ID NO: 1904064 - RNA, 19 nt, Homo sapiens
uaacccaacugacuuguau

SEQ ID NO: 1904065 - RNA, 19 nt, Homo sapiens
ugucuccuggacucagggu

SEQ ID NO: 1904066 - RNA, 22 nt, Homo sapiens
cuuccugacccuccgcugcaga

SEQ ID NO: 1904067 - RNA, 23 nt, Homo sapiens
ucuaaauuugaauguuaagcaga

SEQ ID NO: 1904068 - RNA, 23 nt, Homo sapiens
cagaccuugggggaagacuuuaa

SEQ ID NO: 1904069 - RNA, 17 nt, Homo sapiens
cccuccuaaccuagaga

SEQ ID NO: 1904070 - RNA, 23 nt, Homo sapiens
ucacacaaccaugacgcacugcu

SEQ ID NO: 1904071 - RNA, 19 nt, Homo sapiens
aucaauaaaaaacaaauau

SEQ ID NO: 1904072 - RNA, 13 nt, Homo sapiens
cuccgggggccaa

SEQ ID NO: 1904073 - RNA, 14 nt, Homo sapiens
uacuuagacaguau

SEQ ID NO: 1904074 - RNA, 19 nt, Homo sapiens
uuccccucccuggguucag

SEQ ID NO: 1904075 - RNA, 21 nt, Homo sapiens
aucacuguauagacaugcuac

SEQ ID NO: 1904076 - RNA, 15 nt, Homo sapiens
aacuuuuugccaaau

SEQ ID NO: 1904077 - RNA, 18 nt, Homo sapiens
acugaacaaucaaagcac

SEQ ID NO: 1904078 - RNA, 22 nt, Homo sapiens
agccaguuuggguaaaauacuu

SEQ ID NO: 1904079 - RNA, 21 nt, Homo sapiens
ugggaaacacuuugaggacau

SEQ ID NO: 1904080 - RNA, 19 nt, Homo sapiens
cuaauucucagaaaggcaa

SEQ ID NO: 1904081 - RNA, 17 nt, Homo sapiens
ugagccaaccagaauaa

SEQ ID NO: 1904082 - RNA, 20 nt, Homo sapiens
ucagcaugaaggaugccaua

SEQ ID NO: 1904083 - RNA, 14 nt, Homo sapiens
acugggaagcauua

SEQ ID NO: 1904084 - RNA, 13 nt, Homo sapiens
uaguucagccauu

SEQ ID NO: 1904085 - RNA, 21 nt, Homo sapiens
uccccuguucaaagaugcauu

SEQ ID NO: 1904086 - RNA, 15 nt, Homo sapiens
auaagccacauaucu

SEQ ID NO: 1904087 - RNA, 21 nt, Homo sapiens
ucaagguucccucccacucua

SEQ ID NO: 1904088 - RNA, 22 nt, Homo sapiens
gaggaugcagaggggugcugcu

SEQ ID NO: 1904089 - RNA, 14 nt, Homo sapiens
gccaaccuguaaua

SEQ ID NO: 1904090 - RNA, 19 nt, Homo sapiens
aucagcccugccagguggg

SEQ ID NO: 1904091 - RNA, 18 nt, Homo sapiens
augaugugggucaaggaa

SEQ ID NO: 1904092 - RNA, 16 nt, Homo sapiens
aaaucauucagaucau

SEQ ID NO: 1904093 - RNA, 19 nt, Homo sapiens
gccuggauggcugccucac

SEQ ID NO: 1904094 - RNA, 17 nt, Homo sapiens
caggaugcccacauacu

SEQ ID NO: 1904095 - RNA, 21 nt, Homo sapiens
ccacugcccccugcugccaug

SEQ ID NO: 1904096 - RNA, 23 nt, Homo sapiens
cacuuaugaagucagugcuaaag

SEQ ID NO: 1904097 - RNA, 23 nt, Homo sapiens
uucugacgucagcgcaccaaaac

SEQ ID NO: 1904098 - RNA, 14 nt, Homo sapiens
augcugugugagac

SEQ ID NO: 1904099 - RNA, 18 nt, Homo sapiens
uuauaguccaugguccau

SEQ ID NO: 1904100 - RNA, 18 nt, Homo sapiens
gacuugucccucucucag

SEQ ID NO: 1904101 - RNA, 13 nt, Homo sapiens
uucaggugcuuuu

SEQ ID NO: 1904102 - RNA, 18 nt, Homo sapiens
gguugcuuugguggcacg

SEQ ID NO: 1904103 - RNA, 15 nt, Homo sapiens
uacaguacacagaua

SEQ ID NO: 1904104 - RNA, 21 nt, Homo sapiens
guuuuuggcucuuucagagag

SEQ ID NO: 1904105 - RNA, 17 nt, Homo sapiens
ccuuuucuccuugccuu

SEQ ID NO: 1904106 - RNA, 22 nt, Homo sapiens
uacaaaugaggaaaccaagaua

SEQ ID NO: 1904107 - RNA, 21 nt, Homo sapiens
cguccacuccuccuacuguau

SEQ ID NO: 1904108 - RNA, 19 nt, Homo sapiens
cuuuacuguuucucaagug

SEQ ID NO: 1904109 - RNA, 20 nt, Homo sapiens
uucaaaaacgaugucguauu

SEQ ID NO: 1904110 - RNA, 22 nt, Homo sapiens
gccuugguaaaaacugcagugu

SEQ ID NO: 1904111 - RNA, 19 nt, Homo sapiens
aguugucaucaaacauaau

SEQ ID NO: 1904112 - RNA, 12 nt, Homo sapiens
cauugcuuucaa

SEQ ID NO: 1904113 - RNA, 12 nt, Homo sapiens
caaagcuuucuu

SEQ ID NO: 1904114 - RNA, 22 nt, Homo sapiens
gccuuuaaaaaugcaccacuuu

SEQ ID NO: 1904115 - RNA, 16 nt, Homo sapiens
acagcuuagaagccau

SEQ ID NO: 1904116 - RNA, 21 nt, Homo sapiens
uguuaagaauuucaauaucaa

SEQ ID NO: 1904117 - RNA, 15 nt, Homo sapiens
cuuacacagguuuca

SEQ ID NO: 1904118 - RNA, 20 nt, Homo sapiens
ggaguugucguuuuuagcuu

SEQ ID NO: 1904119 - RNA, 12 nt, Homo sapiens
auugccaugugg

SEQ ID NO: 1904120 - RNA, 21 nt, Homo sapiens
accagaagacaaaggcccaaa

SEQ ID NO: 1904121 - RNA, 17 nt, Homo sapiens
aagguagccaucccaug

SEQ ID NO: 1904122 - RNA, 21 nt, Homo sapiens
aggaccaggacuugugcagac

SEQ ID NO: 1904123 - RNA, 20 nt, Homo sapiens
gugcccaaguggguccaagu

SEQ ID NO: 1904124 - RNA, 15 nt, Homo sapiens
auuuucuugauguca

SEQ ID NO: 1904125 - RNA, 18 nt, Homo sapiens
aaauauuuuuaugugcaa

SEQ ID NO: 1904126 - RNA, 19 nt, Homo sapiens
gcuccaucccaaccaggca

SEQ ID NO: 1904127 - RNA, 17 nt, Homo sapiens
gaagcugcagcuggucu

SEQ ID NO: 1904128 - RNA, 14 nt, Homo sapiens
cagugugagcauuu

SEQ ID NO: 1904129 - RNA, 17 nt, Homo sapiens
gccguaguaccucccag

SEQ ID NO: 1904130 - RNA, 12 nt, Homo sapiens
uagcucugagaa

SEQ ID NO: 1904131 - RNA, 16 nt, Homo sapiens
gucagggccagacugg

SEQ ID NO: 1904132 - RNA, 16 nt, Homo sapiens
gaagcaagcagaugaa

SEQ ID NO: 1904133 - RNA, 14 nt, Homo sapiens
cuuugcugccugag

SEQ ID NO: 1904134 - RNA, 16 nt, Homo sapiens
aacauuccaaugcauu

SEQ ID NO: 1904135 - RNA, 19 nt, Homo sapiens
uccugcuaauaauuugcca

SEQ ID NO: 1904136 - RNA, 18 nt, Homo sapiens
cccgcggccugcaccgac

SEQ ID NO: 1904137 - RNA, 19 nt, Homo sapiens
ccacugcacccaccuacuu

SEQ ID NO: 1904138 - RNA, 21 nt, Homo sapiens
ugauacugucucuccagugaa

SEQ ID NO: 1904139 - RNA, 16 nt, Homo sapiens
ugucucaguccaugaa

SEQ ID NO: 1904140 - RNA, 21 nt, Homo sapiens
uuuccauaaucacucagugau

SEQ ID NO: 1904141 - RNA, 12 nt, Homo sapiens
ugggaugcacuc

SEQ ID NO: 1904142 - RNA, 16 nt, Homo sapiens
uagauuugccauagag

SEQ ID NO: 1904143 - RNA, 13 nt, Homo sapiens
acuggugcaugac

SEQ ID NO: 1904144 - RNA, 13 nt, Homo sapiens
agcccucuuccau

SEQ ID NO: 1904145 - RNA, 20 nt, Homo sapiens
caaccuuuucucuggacacu

SEQ ID NO: 1904146 - RNA, 21 nt, Homo sapiens
cauggugaaacccccaucucu

SEQ ID NO: 1904147 - RNA, 16 nt, Homo sapiens
uggugcuaauaugaca

SEQ ID NO: 1904148 - RNA, 22 nt, Homo sapiens
cugaaacaugaacccaaaaaga

SEQ ID NO: 1904149 - RNA, 21 nt, Homo sapiens
ugcucuguuaauaaucucaca

SEQ ID NO: 1904150 - RNA, 18 nt, Homo sapiens
ccuguguguaagucccaa

SEQ ID NO: 1904151 - RNA, 23 nt, Homo sapiens
gcagccagagcugugccugcuca

SEQ ID NO: 1904152 - RNA, 17 nt, Homo sapiens
caugaugaaaccccauc

SEQ ID NO: 1904153 - RNA, 23 nt, Homo sapiens
caagcauuuugugaacuagggaa

SEQ ID NO: 1904154 - RNA, 15 nt, Homo sapiens
acgcggccaccucac

SEQ ID NO: 1904155 - RNA, 15 nt, Homo sapiens
agguguuuaguugca

SEQ ID NO: 1904156 - RNA, 14 nt, Homo sapiens
aaaguuuugccuau

SEQ ID NO: 1904157 - RNA, 14 nt, Homo sapiens
cuuggaugugguuu

SEQ ID NO: 1904158 - RNA, 22 nt, Homo sapiens
ggccugggggcagugacuggca

SEQ ID NO: 1904159 - RNA, 15 nt, Homo sapiens
aacuguggucaaucc

SEQ ID NO: 1904160 - RNA, 23 nt, Homo sapiens
ugcugauggcuugacaugugcaa

SEQ ID NO: 1904161 - RNA, 22 nt, Homo sapiens
gcuggccucacccaccccugca

SEQ ID NO: 1904162 - RNA, 21 nt, Homo sapiens
aaauaaaaguaccuauugaac

SEQ ID NO: 1904163 - RNA, 18 nt, Homo sapiens
uuauuaugagcuacaaca

SEQ ID NO: 1904164 - RNA, 20 nt, Homo sapiens
cuuauuacugagagugcaaa

SEQ ID NO: 1904165 - RNA, 21 nt, Homo sapiens
uaagaaagcccuaaaauacua

SEQ ID NO: 1904166 - RNA, 17 nt, Homo sapiens
uaacaacacuaauacac

SEQ ID NO: 1904167 - RNA, 15 nt, Homo sapiens
accuguugcuuacaa

SEQ ID NO: 1904168 - RNA, 16 nt, Homo sapiens
cuaaaugaacucaaua

SEQ ID NO: 1904169 - RNA, 13 nt, Homo sapiens
gccgcuaccuccc

SEQ ID NO: 1904170 - RNA, 17 nt, Homo sapiens
acgcgugccguggcacc

SEQ ID NO: 1904171 - RNA, 12 nt, Homo sapiens
gcacaugcagau

SEQ ID NO: 1904172 - RNA, 20 nt, Homo sapiens
aauaaccuuuauaugauaua

SEQ ID NO: 1904173 - RNA, 17 nt, Homo sapiens
ccaggcuggacugcaau

SEQ ID NO: 1904174 - RNA, 14 nt, Homo sapiens
aacauuugccaagu

SEQ ID NO: 1904175 - RNA, 23 nt, Homo sapiens
aucaccuacucacacaggcauuu

SEQ ID NO: 1904176 - RNA, 22 nt, Homo sapiens
uugaccacucuuccugaguuca

SEQ ID NO: 1904177 - RNA, 18 nt, Homo sapiens
caggggugcuccugugcu

SEQ ID NO: 1904178 - RNA, 18 nt, Homo sapiens
augcuauggacugcacaa

SEQ ID NO: 1904179 - RNA, 16 nt, Homo sapiens
acagagugaauuucag

SEQ ID NO: 1904180 - RNA, 16 nt, Homo sapiens
ugauugagggugugau

SEQ ID NO: 1904181 - RNA, 15 nt, Homo sapiens
acugagggcagagag

SEQ ID NO: 1904182 - RNA, 23 nt, Homo sapiens
auuucagauucauauaaccacaa

SEQ ID NO: 1904183 - RNA, 16 nt, Homo sapiens
uugaggugaaaugggg

SEQ ID NO: 1904184 - RNA, 23 nt, Homo sapiens
gagaggauuuggcucgcuguggu

SEQ ID NO: 1904185 - RNA, 23 nt, Homo sapiens
caacaggccauugugaaccaaug

SEQ ID NO: 1904186 - RNA, 19 nt, Homo sapiens
auaaacuuuuuauucucag

SEQ ID NO: 1904187 - RNA, 19 nt, Homo sapiens
uauuucuuaaguaucucaa

SEQ ID NO: 1904188 - RNA, 19 nt, Homo sapiens
ccuuggggcugaugcaguu

SEQ ID NO: 1904189 - RNA, 19 nt, Homo sapiens
guucccuuaucuguuuucu

SEQ ID NO: 1904190 - RNA, 22 nt, Homo sapiens
ggagccugguucagacacagcu

SEQ ID NO: 1904191 - RNA, 18 nt, Homo sapiens
auaauguauuuucagcuc

SEQ ID NO: 1904192 - RNA, 19 nt, Homo sapiens
aguauaaagggacuugaag

SEQ ID NO: 1904193 - RNA, 13 nt, Homo sapiens
cugagcccuggca

SEQ ID NO: 1904194 - RNA, 17 nt, Homo sapiens
uauuaacgggcauguau

SEQ ID NO: 1904195 - RNA, 15 nt, Homo sapiens
agaguuuguuaccua

SEQ ID NO: 1904196 - RNA, 15 nt, Homo sapiens
aucuggcacacuccc

SEQ ID NO: 1904197 - RNA, 16 nt, Homo sapiens
accuugugaacaucag

SEQ ID NO: 1904198 - RNA, 19 nt, Homo sapiens
ucaugccucagccucucaa

SEQ ID NO: 1904199 - RNA, 22 nt, Homo sapiens
accagagaagggcuuggacuca

SEQ ID NO: 1904200 - RNA, 20 nt, Homo sapiens
aaaagacaaauauguagaau

SEQ ID NO: 1904201 - RNA, 19 nt, Homo sapiens
ggucaccgcggacgugcug

SEQ ID NO: 1904202 - RNA, 17 nt, Homo sapiens
aacaaacucagaucuca

SEQ ID NO: 1904203 - RNA, 21 nt, Homo sapiens
aaaacagacccucccacuggu

SEQ ID NO: 1904204 - RNA, 22 nt, Homo sapiens
aaauguccaguaagaucacugu

SEQ ID NO: 1904205 - RNA, 14 nt, Homo sapiens
aguggggugaucuc

SEQ ID NO: 1904206 - RNA, 17 nt, Homo sapiens
ucagguggcccuacugg

SEQ ID NO: 1904207 - RNA, 23 nt, Homo sapiens
uugccaaaaagggguaugucuuu

SEQ ID NO: 1904208 - RNA, 14 nt, Homo sapiens
cauggagagguuug

SEQ ID NO: 1904209 - RNA, 12 nt, Homo sapiens
cuccacauucau

SEQ ID NO: 1904210 - RNA, 23 nt, Homo sapiens
gaagugacgguuccuacacagga

SEQ ID NO: 1904211 - RNA, 14 nt, Homo sapiens
aggcccacauugcc

SEQ ID NO: 1904212 - RNA, 22 nt, Homo sapiens
ggugggcccucugaacuugccu

SEQ ID NO: 1904213 - RNA, 16 nt, Homo sapiens
aguccucugccuccau

SEQ ID NO: 1904214 - RNA, 21 nt, Homo sapiens
aagacuggaagcuaauuugca

SEQ ID NO: 1904215 - RNA, 22 nt, Homo sapiens
cauuggggugguugucauguga

SEQ ID NO: 1904216 - RNA, 23 nt, Homo sapiens
acuaucaauaauacaaagcaaau

SEQ ID NO: 1904217 - RNA, 14 nt, Homo sapiens
cgggggcugucuca

SEQ ID NO: 1904218 - RNA, 20 nt, Homo sapiens
gcuggaugugcaucuggccu

SEQ ID NO: 1904219 - RNA, 14 nt, Homo sapiens
cugaguguccguga

SEQ ID NO: 1904220 - RNA, 13 nt, Homo sapiens
augcaagugagaa

SEQ ID NO: 1904221 - RNA, 19 nt, Homo sapiens
uaacaugcccuguucagcu

SEQ ID NO: 1904222 - RNA, 14 nt, Homo sapiens
gugacaaagccaga

SEQ ID NO: 1904223 - RNA, 18 nt, Homo sapiens
uguguauccgacucuaag

SEQ ID NO: 1904224 - RNA, 14 nt, Homo sapiens
ccugaacuccagag

SEQ ID NO: 1904225 - RNA, 16 nt, Homo sapiens
gcucagagcuuuguca

SEQ ID NO: 1904226 - RNA, 21 nt, Homo sapiens
acagacgauuaacacaccaca

SEQ ID NO: 1904227 - RNA, 23 nt, Homo sapiens
cuccagcgaguaccccagccacu

SEQ ID NO: 1904228 - RNA, 15 nt, Homo sapiens
ggaugaccauaugca

SEQ ID NO: 1904229 - RNA, 14 nt, Homo sapiens
auuuuuaaucagca

SEQ ID NO: 1904230 - RNA, 20 nt, Homo sapiens
aauggcacaaucucggcuca

SEQ ID NO: 1904231 - RNA, 11 nt, Homo sapiens
aaaaugaaggu

SEQ ID NO: 1904232 - RNA, 16 nt, Homo sapiens
gaguggcccaccgugg

SEQ ID NO: 1904233 - RNA, 18 nt, Homo sapiens
agacaacugguccacuca

SEQ ID NO: 1904234 - RNA, 17 nt, Homo sapiens
aagccccucguugccca

SEQ ID NO: 1904235 - RNA, 10 nt, Homo sapiens
aucaccacug

SEQ ID NO: 1904236 - RNA, 16 nt, Homo sapiens
aaaauacgaaguggag

SEQ ID NO: 1904237 - RNA, 17 nt, Homo sapiens
ucucgccucauuacugu

SEQ ID NO: 1904238 - RNA, 20 nt, Homo sapiens
auuuaaauaaaguuacuuga

SEQ ID NO: 1904239 - RNA, 18 nt, Homo sapiens
acacagugcaguacucag

SEQ ID NO: 1904240 - RNA, 20 nt, Homo sapiens
ccagccugggcgacagagca

SEQ ID NO: 1904241 - RNA, 18 nt, Homo sapiens
ucaauaugaaccaaguag

SEQ ID NO: 1904242 - RNA, 17 nt, Homo sapiens
gacacaggucuuuccua

SEQ ID NO: 1904243 - RNA, 18 nt, Homo sapiens
cccaggaaggaaacagau

SEQ ID NO: 1904244 - RNA, 15 nt, Homo sapiens
gucccgcacagugga

SEQ ID NO: 1904245 - RNA, 20 nt, Homo sapiens
gcagcugauuccagaacaaa

SEQ ID NO: 1904246 - RNA, 14 nt, Homo sapiens
ccaaggucacucuu

SEQ ID NO: 1904247 - RNA, 20 nt, Homo sapiens
ucuugaaccccuggccucaa

SEQ ID NO: 1904248 - RNA, 17 nt, Homo sapiens
cacuucccagagcaucu

SEQ ID NO: 1904249 - RNA, 15 nt, Homo sapiens
gaacaagaaauggau

SEQ ID NO: 1904250 - RNA, 23 nt, Homo sapiens
agaccauacauaauaaccaaaca

SEQ ID NO: 1904251 - RNA, 23 nt, Homo sapiens
accugcuccuuggccuagucaga

SEQ ID NO: 1904252 - RNA, 13 nt, Homo sapiens
uggcccccagugg

SEQ ID NO: 1904253 - RNA, 17 nt, Homo sapiens
ggacagcagaagccucc

SEQ ID NO: 1904254 - RNA, 16 nt, Homo sapiens
ugccgggcgcaggaac

SEQ ID NO: 1904255 - RNA, 21 nt, Homo sapiens
caucucaacaauauauguccu

SEQ ID NO: 1904256 - RNA, 21 nt, Homo sapiens
gcccccgagcugggggccaug

SEQ ID NO: 1904257 - RNA, 22 nt, Homo sapiens
uuucuuagaauugaccaaauaa

SEQ ID NO: 1904258 - RNA, 17 nt, Homo sapiens
ucaauuucccugacucc

SEQ ID NO: 1904259 - RNA, 17 nt, Homo sapiens
gcuauccagcagaucau

SEQ ID NO: 1904260 - RNA, 22 nt, Homo sapiens
ccaaagcaugauugugaccucc

SEQ ID NO: 1904261 - RNA, 13 nt, Homo sapiens
gauacugaaggac

SEQ ID NO: 1904262 - RNA, 23 nt, Homo sapiens
agcaauuccccuacaucaaaugc

SEQ ID NO: 1904263 - RNA, 17 nt, Homo sapiens
cucucagcugaccauca

SEQ ID NO: 1904264 - RNA, 23 nt, Homo sapiens
caccugcagcccuuuuaguggug

SEQ ID NO: 1904265 - RNA, 21 nt, Homo sapiens
gcugugguagggggugucuca

SEQ ID NO: 1904266 - RNA, 12 nt, Homo sapiens
uugcuguucuac

SEQ ID NO: 1904267 - RNA, 16 nt, Homo sapiens
uaggcauagcuacgug

SEQ ID NO: 1904268 - RNA, 20 nt, Homo sapiens
caaagaguggcuugaauaua

SEQ ID NO: 1904269 - RNA, 14 nt, Homo sapiens
ggcaucugcaaagg

SEQ ID NO: 1904270 - RNA, 17 nt, Homo sapiens
ucugagaaggugagaua

SEQ ID NO: 1904271 - RNA, 15 nt, Homo sapiens
cagccuuuggugcuu

SEQ ID NO: 1904272 - RNA, 13 nt, Homo sapiens
aggcaucuucccu

SEQ ID NO: 1904273 - RNA, 15 nt, Homo sapiens
ccccucacucuguca

SEQ ID NO: 1904274 - RNA, 21 nt, Homo sapiens
ccaggaggaggauugugcuga

SEQ ID NO: 1904275 - RNA, 12 nt, Homo sapiens
aucccucagauc

SEQ ID NO: 1904276 - RNA, 20 nt, Homo sapiens
ccaauagaacaguuuacuug

SEQ ID NO: 1904277 - RNA, 20 nt, Homo sapiens
uuaacuuggcuaacauagca

SEQ ID NO: 1904278 - RNA, 13 nt, Homo sapiens
uuuuccagcauuu

SEQ ID NO: 1904279 - RNA, 20 nt, Homo sapiens
uauguggcagcuggggagca

SEQ ID NO: 1904280 - RNA, 14 nt, Homo sapiens
cucaaguuccaugc

SEQ ID NO: 1904281 - RNA, 16 nt, Homo sapiens
auguugaaauaugcau

SEQ ID NO: 1904282 - RNA, 17 nt, Homo sapiens
uucagagcaagcacugg

SEQ ID NO: 1904283 - RNA, 21 nt, Homo sapiens
guuugcugcucuauauuacaa

SEQ ID NO: 1904284 - RNA, 16 nt, Homo sapiens
aaaucuccaauccaca

SEQ ID NO: 1904285 - RNA, 18 nt, Homo sapiens
aacuuuucugcugauaag

SEQ ID NO: 1904286 - RNA, 15 nt, Homo sapiens
auauauuuaacaugu

SEQ ID NO: 1904287 - RNA, 17 nt, Homo sapiens
agguacaggaaaacucc

SEQ ID NO: 1904288 - RNA, 19 nt, Homo sapiens
ccucagggcagggauacaa

SEQ ID NO: 1904289 - RNA, 14 nt, Homo sapiens
aauaaagacucuug

SEQ ID NO: 1904290 - RNA, 21 nt, Homo sapiens
uccugggagcccccaccacaa

SEQ ID NO: 1904291 - RNA, 18 nt, Homo sapiens
ccuacguuggugcaagug

SEQ ID NO: 1904292 - RNA, 17 nt, Homo sapiens
ggaagcucugaagucac

SEQ ID NO: 1904293 - RNA, 11 nt, Homo sapiens
gggcaggugac

SEQ ID NO: 1904294 - RNA, 16 nt, Homo sapiens
cucagccugagccucu

SEQ ID NO: 1904295 - RNA, 17 nt, Homo sapiens
cauguaauaaaucugag

SEQ ID NO: 1904296 - RNA, 18 nt, Homo sapiens
cccuugaggaaacaacag

SEQ ID NO: 1904297 - RNA, 22 nt, Homo sapiens
caugauaaaauaaguaacauau

SEQ ID NO: 1904298 - RNA, 21 nt, Homo sapiens
ucucuuuaguauaauugaccu

SEQ ID NO: 1904299 - RNA, 21 nt, Homo sapiens
ccuguucuuucuuacacaaga

SEQ ID NO: 1904300 - RNA, 14 nt, Homo sapiens
gauuaaaauuccua

SEQ ID NO: 1904301 - RNA, 18 nt, Homo sapiens
aaaucugccaugagcaca

SEQ ID NO: 1904302 - RNA, 18 nt, Homo sapiens
guaguagcgaacugcacu

SEQ ID NO: 1904303 - RNA, 18 nt, Homo sapiens
caaccuucgccaccuggg

SEQ ID NO: 1904304 - RNA, 14 nt, Homo sapiens
uauugcgcugcuac

SEQ ID NO: 1904305 - RNA, 13 nt, Homo sapiens
cacagagacauuc

SEQ ID NO: 1904306 - RNA, 21 nt, Homo sapiens
ccauauauaacagauacauuu

SEQ ID NO: 1904307 - RNA, 21 nt, Homo sapiens
uucagucucugcaguguccau

SEQ ID NO: 1904308 - RNA, 17 nt, Homo sapiens
uuuuagcacaucacuga

SEQ ID NO: 1904309 - RNA, 14 nt, Homo sapiens
cagcuggcacuguc

SEQ ID NO: 1904310 - RNA, 11 nt, Homo sapiens
cucagcacugu

SEQ ID NO: 1904311 - RNA, 14 nt, Homo sapiens
gaggcucaaaaacu

SEQ ID NO: 1904312 - RNA, 22 nt, Homo sapiens
gcucgagugccccugcagggga

SEQ ID NO: 1904313 - RNA, 14 nt, Homo sapiens
aggaaguacuucca

SEQ ID NO: 1904314 - RNA, 18 nt, Homo sapiens
ggcccucuguggucacag

SEQ ID NO: 1904315 - RNA, 22 nt, Homo sapiens
cauggcccuaccagacacugcu

SEQ ID NO: 1904316 - RNA, 12 nt, Homo sapiens
aacagccagcuu

SEQ ID NO: 1904317 - RNA, 16 nt, Homo sapiens
ccagaauucugggcaa

SEQ ID NO: 1904318 - RNA, 12 nt, Homo sapiens
cuugccugauga

SEQ ID NO: 1904319 - RNA, 12 nt, Homo sapiens
cacacccauggc

SEQ ID NO: 1904320 - RNA, 22 nt, Homo sapiens
aggguacacaauggguaucuaa

SEQ ID NO: 1904321 - RNA, 23 nt, Homo sapiens
ccuggcauuauguccacugugua

SEQ ID NO: 1904322 - RNA, 21 nt, Homo sapiens
auaucauccugccuucaugga

SEQ ID NO: 1904323 - RNA, 14 nt, Homo sapiens
ccuugagucuguca

SEQ ID NO: 1904324 - RNA, 14 nt, Homo sapiens
caggagacugaguu

SEQ ID NO: 1904325 - RNA, 23 nt, Homo sapiens
gauuacaaggcuuuaucucaggg

SEQ ID NO: 1904326 - RNA, 21 nt, Homo sapiens
auauuuuacugaucucuuuaa

SEQ ID NO: 1904327 - RNA, 13 nt, Homo sapiens
agcuaaugucuuc

SEQ ID NO: 1904328 - RNA, 18 nt, Homo sapiens
gcuucgucuacuccuuuc

SEQ ID NO: 1904329 - RNA, 21 nt, Homo sapiens
uaaugaacuuuauuggagcau

SEQ ID NO: 1904330 - RNA, 18 nt, Homo sapiens
uguauugagggccaguga

SEQ ID NO: 1904331 - RNA, 16 nt, Homo sapiens
uacaaggcccagaugu

SEQ ID NO: 1904332 - RNA, 18 nt, Homo sapiens
ccaaaggcauaagacccu

SEQ ID NO: 1904333 - RNA, 22 nt, Homo sapiens
cuaauguuugugagaagcuucu

SEQ ID NO: 1904334 - RNA, 21 nt, Homo sapiens
uuaauaaaaacaaccuugcau

SEQ ID NO: 1904335 - RNA, 16 nt, Homo sapiens
cuuugugugauugaau

SEQ ID NO: 1904336 - RNA, 23 nt, Homo sapiens
ucuguggaugaugugauuguccu

SEQ ID NO: 1904337 - RNA, 21 nt, Homo sapiens
gccugaaacuuugaggauaac

SEQ ID NO: 1904338 - RNA, 14 nt, Homo sapiens
ccucacuguuugca

SEQ ID NO: 1904339 - RNA, 22 nt, Homo sapiens
gcuuuguuuuuugugcuauuag

SEQ ID NO: 1904340 - RNA, 23 nt, Homo sapiens
aacaauuuuuuuuuuccucuuca

SEQ ID NO: 1904341 - RNA, 20 nt, Homo sapiens
acuuucugucuagguuaaag

SEQ ID NO: 1904342 - RNA, 14 nt, Homo sapiens
cuuauaauuacaau

SEQ ID NO: 1904343 - RNA, 12 nt, Homo sapiens
uguaaauggaac

SEQ ID NO: 1904344 - RNA, 19 nt, Homo sapiens
cuuaaugucuuuuguuauu

SEQ ID NO: 1904345 - RNA, 20 nt, Homo sapiens
caaaaguuacauguuugcac

SEQ ID NO: 1904346 - RNA, 13 nt, Homo sapiens
auucauacauuau

SEQ ID NO: 1904347 - RNA, 13 nt, Homo sapiens
auuaauacauucu

SEQ ID NO: 1904348 - RNA, 12 nt, Homo sapiens
cugcaaagcuuu

SEQ ID NO: 1904349 - RNA, 19 nt, Homo sapiens
aagaaaucaaaagaaucua

SEQ ID NO: 1904350 - RNA, 20 nt, Homo sapiens
guaaaugacacuuucuaugc

SEQ ID NO: 1904351 - RNA, 20 nt, Homo sapiens
agacagauuuaaagcacaug

SEQ ID NO: 1904352 - RNA, 18 nt, Homo sapiens
cuuaauuuauuauuaaca

SEQ ID NO: 1904353 - RNA, 16 nt, Homo sapiens
cugacacuuucugcug

SEQ ID NO: 1904354 - RNA, 16 nt, Homo sapiens
ugaacuuuuguacuga

SEQ ID NO: 1904355 - RNA, 22 nt, Homo sapiens
agcacuucaaaggaacuggaau

SEQ ID NO: 1904356 - RNA, 15 nt, Homo sapiens
ccacuccaccuccac

SEQ ID NO: 1904357 - RNA, 19 nt, Homo sapiens
cuagagcaagcaggaauca

SEQ ID NO: 1904358 - RNA, 17 nt, Homo sapiens
cauaaaacggugcuuuc

SEQ ID NO: 1904359 - RNA, 12 nt, Homo sapiens
gucugcacucua

SEQ ID NO: 1904360 - RNA, 15 nt, Homo sapiens
caccacugauaucau

SEQ ID NO: 1904361 - RNA, 19 nt, Homo sapiens
aaaagcaggaaagauccca

SEQ ID NO: 1904362 - RNA, 22 nt, Homo sapiens
gucaggcugauggagacaguaa

SEQ ID NO: 1904363 - RNA, 13 nt, Homo sapiens
uaauaugcugcaa

SEQ ID NO: 1904364 - RNA, 18 nt, Homo sapiens
acagagcagaacuuucac

SEQ ID NO: 1904365 - RNA, 17 nt, Homo sapiens
auuaaguguuguacaau

SEQ ID NO: 1904366 - RNA, 22 nt, Homo sapiens
caaaccggccaacacuuaggga

SEQ ID NO: 1904367 - RNA, 13 nt, Homo sapiens
cuaaaacaguccu

SEQ ID NO: 1904368 - RNA, 12 nt, Homo sapiens
cacccucacauc

SEQ ID NO: 1904369 - RNA, 15 nt, Homo sapiens
uguguugcaagauau

SEQ ID NO: 1904370 - RNA, 15 nt, Homo sapiens
agggauggagcugaa

SEQ ID NO: 1904371 - RNA, 15 nt, Homo sapiens
uaggaagguacugua

SEQ ID NO: 1904372 - RNA, 22 nt, Homo sapiens
cgaacucaucccuguuccucaa

SEQ ID NO: 1904373 - RNA, 23 nt, Homo sapiens
ugaguuccucugcaguuuugaca

SEQ ID NO: 1904374 - RNA, 20 nt, Homo sapiens
agcaauacccaugucuacac

SEQ ID NO: 1904375 - RNA, 19 nt, Homo sapiens
ucccugacuuuucugugga

SEQ ID NO: 1904376 - RNA, 17 nt, Homo sapiens
accccacaccugcagug

SEQ ID NO: 1904377 - RNA, 19 nt, Homo sapiens
ggccacuguguuucugugc

SEQ ID NO: 1904378 - RNA, 18 nt, Homo sapiens
caguuagaaacaccagcc

SEQ ID NO: 1904379 - RNA, 15 nt, Homo sapiens
uauguacauuucuca

SEQ ID NO: 1904380 - RNA, 10 nt, Homo sapiens
gaaguauuua

SEQ ID NO: 1904381 - RNA, 17 nt, Homo sapiens
uguacucuuauucuugg

SEQ ID NO: 1904382 - RNA, 21 nt, Homo sapiens
cuucagugccaaaaacaacaa

SEQ ID NO: 1904383 - RNA, 17 nt, Homo sapiens
uccagagucaucucagc

SEQ ID NO: 1904384 - RNA, 16 nt, Homo sapiens
cuacuguaaaccccaa

SEQ ID NO: 1904385 - RNA, 19 nt, Homo sapiens
acagaugcacaacacuccu

SEQ ID NO: 1904386 - RNA, 19 nt, Homo sapiens
ugccccucgcacacagggc

SEQ ID NO: 1904387 - RNA, 16 nt, Homo sapiens
cuugguucccauuugc

SEQ ID NO: 1904388 - RNA, 13 nt, Homo sapiens
ugcugcccugggg

SEQ ID NO: 1904389 - RNA, 16 nt, Homo sapiens
gccaaguccacugucc

SEQ ID NO: 1904390 - RNA, 21 nt, Homo sapiens
cuaugcaggguagcacuggga

SEQ ID NO: 1904391 - RNA, 11 nt, Homo sapiens
gacucucaggu

SEQ ID NO: 1904392 - RNA, 21 nt, Homo sapiens
auaauuuguauacccuguccu

SEQ ID NO: 1904393 - RNA, 16 nt, Homo sapiens
guugaauauuuagcau

SEQ ID NO: 1904394 - RNA, 15 nt, Homo sapiens
cacccacgcauacac

SEQ ID NO: 1904395 - RNA, 13 nt, Homo sapiens
aaacuacauugac

SEQ ID NO: 1904396 - RNA, 16 nt, Homo sapiens
gugcccgccaccacgc

SEQ ID NO: 1904397 - RNA, 21 nt, Homo sapiens
augacccggaugaacucaaug

SEQ ID NO: 1904398 - RNA, 15 nt, Homo sapiens
aaauaauaucucuaa

SEQ ID NO: 1904399 - RNA, 14 nt, Homo sapiens
cugcucuuguucua

SEQ ID NO: 1904400 - RNA, 14 nt, Homo sapiens
cugcccuuguucca

SEQ ID NO: 1904401 - RNA, 12 nt, Homo sapiens
agcagaugcaau

SEQ ID NO: 1904402 - RNA, 12 nt, Homo sapiens
cuggacugcaau

SEQ ID NO: 1904403 - RNA, 12 nt, Homo sapiens
uguuauuuacac

SEQ ID NO: 1904404 - RNA, 16 nt, Homo sapiens
aucuacaccaaugaaa

SEQ ID NO: 1904405 - RNA, 11 nt, Homo sapiens
gauuucuggga

SEQ ID NO: 1904406 - RNA, 17 nt, Homo sapiens
aaucuggcuuagugcca

SEQ ID NO: 1904407 - RNA, 18 nt, Homo sapiens
gugacagggaagcuacag

SEQ ID NO: 1904408 - RNA, 14 nt, Homo sapiens
ugccauagaacaag

SEQ ID NO: 1904409 - RNA, 15 nt, Homo sapiens
cuaaagcaauaugca

SEQ ID NO: 1904410 - RNA, 21 nt, Homo sapiens
uccucacuagaacucauccga

SEQ ID NO: 1904411 - RNA, 17 nt, Homo sapiens
auauuacugacauuucu

SEQ ID NO: 1904412 - RNA, 15 nt, Homo sapiens
aagcuucuguccugc

SEQ ID NO: 1904413 - RNA, 23 nt, Homo sapiens
guuguucuuuucccccaaagugg

SEQ ID NO: 1904414 - RNA, 15 nt, Homo sapiens
auuaaggcuucucuu

SEQ ID NO: 1904415 - RNA, 22 nt, Homo sapiens
uuaaaauuuugcuaccaaagaa

SEQ ID NO: 1904416 - RNA, 14 nt, Homo sapiens
cagaaagugcagca

SEQ ID NO: 1904417 - RNA, 17 nt, Homo sapiens
aaugcaauuuccaacac

SEQ ID NO: 1904418 - RNA, 19 nt, Homo sapiens
uucaaucaaagcuaccuuu

SEQ ID NO: 1904419 - RNA, 17 nt, Homo sapiens
aaaaaagauacuauuua

SEQ ID NO: 1904420 - RNA, 16 nt, Homo sapiens
auuuuaaggauaugau

SEQ ID NO: 1904421 - RNA, 19 nt, Homo sapiens
aaugccuccaagccauuca

SEQ ID NO: 1904422 - RNA, 19 nt, Homo sapiens
acaaagauugagaagccau

SEQ ID NO: 1904423 - RNA, 17 nt, Homo sapiens
uuuguugagacuaucaa

SEQ ID NO: 1904424 - RNA, 23 nt, Homo sapiens
auuuguucucccaaaacagauua

SEQ ID NO: 1904425 - RNA, 21 nt, Homo sapiens
accuguauugucugacuucuc

SEQ ID NO: 1904426 - RNA, 20 nt, Homo sapiens
gaugaccagcuagacuccca

SEQ ID NO: 1904427 - RNA, 22 nt, Homo sapiens
uggcuaauucccagagugugaa

SEQ ID NO: 1904428 - RNA, 19 nt, Homo sapiens
uguuuuacauaacugauaa

SEQ ID NO: 1904429 - RNA, 11 nt, Homo sapiens
uugucucagga

SEQ ID NO: 1904430 - RNA, 18 nt, Homo sapiens
acacuuguuguccaguug

SEQ ID NO: 1904431 - RNA, 17 nt, Homo sapiens
auuauuaaucauuccau

SEQ ID NO: 1904432 - RNA, 13 nt, Homo sapiens
cucuccacuccau

SEQ ID NO: 1904433 - RNA, 13 nt, Homo sapiens
aaucugagccagu

SEQ ID NO: 1904434 - RNA, 14 nt, Homo sapiens
aggaaagcccuccc

SEQ ID NO: 1904435 - RNA, 12 nt, Homo sapiens
gaggagggaugu

SEQ ID NO: 1904436 - RNA, 20 nt, Homo sapiens
gggccuggcuggcugagggc

SEQ ID NO: 1904437 - RNA, 14 nt, Homo sapiens
agcuuagauuuccc

SEQ ID NO: 1904438 - RNA, 23 nt, Homo sapiens
cugcaaaccuuaaaccugcaaaa

SEQ ID NO: 1904439 - RNA, 19 nt, Homo sapiens
aacauuuuuuagucuguaa

SEQ ID NO: 1904440 - RNA, 13 nt, Homo sapiens
ccaccacauuuag

SEQ ID NO: 1904441 - RNA, 16 nt, Homo sapiens
caaaggcccucaguga

SEQ ID NO: 1904442 - RNA, 14 nt, Homo sapiens
gucaacggagggag

SEQ ID NO: 1904443 - RNA, 22 nt, Homo sapiens
agaucacgccauugcacuccag

SEQ ID NO: 1904444 - RNA, 21 nt, Homo sapiens
cccuaguuauuuucugaaaaa

SEQ ID NO: 1904445 - RNA, 19 nt, Homo sapiens
gucuuauuaagacuggcuu

SEQ ID NO: 1904446 - RNA, 18 nt, Homo sapiens
uuagccgcccaugcacug

SEQ ID NO: 1904447 - RNA, 18 nt, Homo sapiens
aauauuuaagcaauaaaa

SEQ ID NO: 1904448 - RNA, 12 nt, Homo sapiens
gcggucuugggc

SEQ ID NO: 1904449 - RNA, 17 nt, Homo sapiens
aagccagccagaggcau

SEQ ID NO: 1904450 - RNA, 24 nt, Homo sapiens
agauuuccugugaguaaucuugca

SEQ ID NO: 1904451 - RNA, 22 nt, Homo sapiens
gagaugccacuucucacucacc

SEQ ID NO: 1904452 - RNA, 20 nt, Homo sapiens
uaauacccacauuacaggau

SEQ ID NO: 1904453 - RNA, 21 nt, Homo sapiens
cuccagccuggcuacagggcg

SEQ ID NO: 1904454 - RNA, 18 nt, Homo sapiens
uguugcaccaggcacugc

SEQ ID NO: 1904455 - RNA, 19 nt, Homo sapiens
uguagguggagagguggaa

SEQ ID NO: 1904456 - RNA, 11 nt, Homo sapiens
guuaacaucau

SEQ ID NO: 1904457 - RNA, 14 nt, Homo sapiens
gauucaccuaagag

SEQ ID NO: 1904458 - RNA, 17 nt, Homo sapiens
gcucaggcuggucuuga

SEQ ID NO: 1904459 - RNA, 18 nt, Homo sapiens
cauccaacuaacuccaga

SEQ ID NO: 1904460 - RNA, 16 nt, Homo sapiens
ccugguuguuccucuc

SEQ ID NO: 1904461 - RNA, 22 nt, Homo sapiens
augcauucuuuugcacaccugu

SEQ ID NO: 1904462 - RNA, 21 nt, Homo sapiens
acauuuuugucagagugcaca

SEQ ID NO: 1904463 - RNA, 18 nt, Homo sapiens
auaugggacugagccugg

SEQ ID NO: 1904464 - RNA, 17 nt, Homo sapiens
uggaauagggaacugua

SEQ ID NO: 1904465 - RNA, 19 nt, Homo sapiens
ucaacugaugauagacuuc

SEQ ID NO: 1904466 - RNA, 21 nt, Homo sapiens
uggcuuugaaugcggcccaac

SEQ ID NO: 1904467 - RNA, 13 nt, Homo sapiens
uacuaaucuuucu

SEQ ID NO: 1904468 - RNA, 14 nt, Homo sapiens
uaugccuacuugua

SEQ ID NO: 1904469 - RNA, 21 nt, Homo sapiens
uaaguauuaagaauaucuaau

SEQ ID NO: 1904470 - RNA, 21 nt, Homo sapiens
uaggccuccuggcccagguga

SEQ ID NO: 1904471 - RNA, 10 nt, Homo sapiens
ggucaucuca

SEQ ID NO: 1904472 - RNA, 16 nt, Homo sapiens
gaccccauucugggac

SEQ ID NO: 1904473 - RNA, 14 nt, Homo sapiens
cuccugacagccac

SEQ ID NO: 1904474 - RNA, 21 nt, Homo sapiens
uccucuagcccacucccugcc

SEQ ID NO: 1904475 - RNA, 19 nt, Homo sapiens
uuauauuauggaggcagga

SEQ ID NO: 1904476 - RNA, 14 nt, Homo sapiens
uuccucacuuugaa

SEQ ID NO: 1904477 - RNA, 11 nt, Homo sapiens
aagaguuacac

SEQ ID NO: 1904478 - RNA, 13 nt, Homo sapiens
caaaccuguagau

SEQ ID NO: 1904479 - RNA, 16 nt, Homo sapiens
ucccuguguggaugcu

SEQ ID NO: 1904480 - RNA, 13 nt, Homo sapiens
augcauaaagcca

SEQ ID NO: 1904481 - RNA, 13 nt, Homo sapiens
uggauuaauucau

SEQ ID NO: 1904482 - RNA, 23 nt, Homo sapiens
gaccacuuuccccgugggccaug

SEQ ID NO: 1904483 - RNA, 20 nt, Homo sapiens
uaucacuguugcauauacca

SEQ ID NO: 1904484 - RNA, 20 nt, Homo sapiens
ugaagucaugaccuccaggg

SEQ ID NO: 1904485 - RNA, 16 nt, Homo sapiens
uguuuacucaaagucu

SEQ ID NO: 1904486 - RNA, 21 nt, Homo sapiens
ccuacuccguuccuggcauuu

SEQ ID NO: 1904487 - RNA, 13 nt, Homo sapiens
ugcaaagcaacua

SEQ ID NO: 1904488 - RNA, 15 nt, Homo sapiens
agaaaguacaaacuu

SEQ ID NO: 1904489 - RNA, 17 nt, Homo sapiens
cagaaugacuucugaca

SEQ ID NO: 1904490 - RNA, 14 nt, Homo sapiens
cugugcaaagggaa

SEQ ID NO: 1904491 - RNA, 20 nt, Homo sapiens
uacaucuagcacagcuguga

SEQ ID NO: 1904492 - RNA, 16 nt, Homo sapiens
aaaugcucucucuucu

SEQ ID NO: 1904493 - RNA, 23 nt, Homo sapiens
acauggugugaguccaaagaagg

SEQ ID NO: 1904494 - RNA, 13 nt, Homo sapiens
uggcaaaagacau

SEQ ID NO: 1904495 - RNA, 12 nt, Homo sapiens
ccugauuuacua

SEQ ID NO: 1904496 - RNA, 19 nt, Homo sapiens
caacugcaucaagauguga

SEQ ID NO: 1904497 - RNA, 15 nt, Homo sapiens
ucuugaacucuuggc

SEQ ID NO: 1904498 - RNA, 21 nt, Homo sapiens
uuaccuuguuuugccagugau

SEQ ID NO: 1904499 - RNA, 23 nt, Homo sapiens
ucacucuguaguuacugugguca

SEQ ID NO: 1904500 - RNA, 21 nt, Homo sapiens
uuuauucccaaguaugccuua

SEQ ID NO: 1904501 - RNA, 16 nt, Homo sapiens
cacaccgauguacaca

SEQ ID NO: 1904502 - RNA, 15 nt, Homo sapiens
ucagcacaaagacac

SEQ ID NO: 1904503 - RNA, 18 nt, Homo sapiens
uccauuccaauuguccac

SEQ ID NO: 1904504 - RNA, 22 nt, Homo sapiens
acuguggccaucaggacuuucc

SEQ ID NO: 1904505 - RNA, 21 nt, Homo sapiens
accaccgcauccucacugggc

SEQ ID NO: 1904506 - RNA, 21 nt, Homo sapiens
agaguggacuguucccugagg

SEQ ID NO: 1904507 - RNA, 13 nt, Homo sapiens
gauaaagggccaa

SEQ ID NO: 1904508 - RNA, 14 nt, Homo sapiens
cagcuuagaguucu

SEQ ID NO: 1904509 - RNA, 19 nt, Homo sapiens
uccucuccuccagcccaga

SEQ ID NO: 1904510 - RNA, 20 nt, Homo sapiens
gaauacugcauuuacagugu

SEQ ID NO: 1904511 - RNA, 21 nt, Homo sapiens
agcaaccuguaagacugauaa

SEQ ID NO: 1904512 - RNA, 21 nt, Homo sapiens
ccucuccagaugagaguacac

SEQ ID NO: 1904513 - RNA, 14 nt, Homo sapiens
uuguucacacuccu

SEQ ID NO: 1904514 - RNA, 18 nt, Homo sapiens
ugagaaccaaccaaguaa

SEQ ID NO: 1904515 - RNA, 22 nt, Homo sapiens
ccaaaucuuguuuacaaaauau

SEQ ID NO: 1904516 - RNA, 15 nt, Homo sapiens
uguaacaucagggac

SEQ ID NO: 1904517 - RNA, 20 nt, Homo sapiens
gaagccacugaagcugggau

SEQ ID NO: 1904518 - RNA, 15 nt, Homo sapiens
ucauauuguucaaua

SEQ ID NO: 1904519 - RNA, 12 nt, Homo sapiens
ggcuccuggaaa

SEQ ID NO: 1904520 - RNA, 15 nt, Homo sapiens
guccaggcucugggc

SEQ ID NO: 1904521 - RNA, 13 nt, Homo sapiens
accugacuuccac

SEQ ID NO: 1904522 - RNA, 15 nt, Homo sapiens
uaaaugaagccaagu

SEQ ID NO: 1904523 - RNA, 21 nt, Homo sapiens
caggaaacccucuucuucccu

SEQ ID NO: 1904524 - RNA, 20 nt, Homo sapiens
auuucucugcaucaggugua

SEQ ID NO: 1904525 - RNA, 14 nt, Homo sapiens
uccuucuugcccug

SEQ ID NO: 1904526 - RNA, 18 nt, Homo sapiens
agugucaagguguggaag

SEQ ID NO: 1904527 - RNA, 18 nt, Homo sapiens
acccuguagggugccauu

SEQ ID NO: 1904528 - RNA, 16 nt, Homo sapiens
uaaacacaugccuuaa

SEQ ID NO: 1904529 - RNA, 19 nt, Homo sapiens
ugcaggcaugcaugugcuu

SEQ ID NO: 1904530 - RNA, 15 nt, Homo sapiens
aaguuaagcagccuu

SEQ ID NO: 1904531 - RNA, 13 nt, Homo sapiens
gccuaaacuuaau

SEQ ID NO: 1904532 - RNA, 21 nt, Homo sapiens
ugccuggacaccccacgggag

SEQ ID NO: 1904533 - RNA, 18 nt, Homo sapiens
accacagauucagacuug

SEQ ID NO: 1904534 - RNA, 13 nt, Homo sapiens
auauaacaugcaa

SEQ ID NO: 1904535 - RNA, 17 nt, Homo sapiens
ggaaaguguacacuauu

SEQ ID NO: 1904536 - RNA, 20 nt, Homo sapiens
ccauucaggucuuucuuucc

SEQ ID NO: 1904537 - RNA, 15 nt, Homo sapiens
uaacauaucuuuauc

SEQ ID NO: 1904538 - RNA, 22 nt, Homo sapiens
gauucccuccucgucagucucu

SEQ ID NO: 1904539 - RNA, 18 nt, Homo sapiens
ccaaaaucggaucugggg

SEQ ID NO: 1904540 - RNA, 19 nt, Homo sapiens
cauuuuuuuuuaacacugu

SEQ ID NO: 1904541 - RNA, 23 nt, Homo sapiens
agaguugaggauguggcacaaag

SEQ ID NO: 1904542 - RNA, 16 nt, Homo sapiens
uaugcacacacagaug

SEQ ID NO: 1904543 - RNA, 17 nt, Homo sapiens
ucagaauuuguguugaa

SEQ ID NO: 1904544 - RNA, 21 nt, Homo sapiens
acuacgugccaggcacuguug

SEQ ID NO: 1904545 - RNA, 22 nt, Homo sapiens
uggucaccaaaucagcugcuac

SEQ ID NO: 1904546 - RNA, 20 nt, Homo sapiens
ugaaaucugaggaaggugcu

SEQ ID NO: 1904547 - RNA, 15 nt, Homo sapiens
agagcuguggcacag

SEQ ID NO: 1904548 - RNA, 13 nt, Homo sapiens
guugccgcagcgg

SEQ ID NO: 1904549 - RNA, 21 nt, Homo sapiens
auuucacuugaccccugccca

SEQ ID NO: 1904550 - RNA, 19 nt, Homo sapiens
cagugcccugagccagggu

SEQ ID NO: 1904551 - RNA, 14 nt, Homo sapiens
ucugccuggagccu

SEQ ID NO: 1904552 - RNA, 12 nt, Homo sapiens
caagagccacag

SEQ ID NO: 1904553 - RNA, 19 nt, Homo sapiens
ugcaccaacaggcaugaca

SEQ ID NO: 1904554 - RNA, 16 nt, Homo sapiens
uucuaacuucuuucac

SEQ ID NO: 1904555 - RNA, 11 nt, Homo sapiens
ugaaaaacugc

SEQ ID NO: 1904556 - RNA, 13 nt, Homo sapiens
gcccggcugugau

SEQ ID NO: 1904557 - RNA, 22 nt, Homo sapiens
agugagcauaggugauccaugu

SEQ ID NO: 1904558 - RNA, 21 nt, Homo sapiens
uugaaacuuaacuccuaaugu

SEQ ID NO: 1904559 - RNA, 13 nt, Homo sapiens
accugagaccucc

SEQ ID NO: 1904560 - RNA, 19 nt, Homo sapiens
uuauggugaugucacucac

SEQ ID NO: 1904561 - RNA, 19 nt, Homo sapiens
caaaccaaaucauacuuuu

SEQ ID NO: 1904562 - RNA, 17 nt, Homo sapiens
uuccuuuggcaauauca

SEQ ID NO: 1904563 - RNA, 13 nt, Homo sapiens
aaucuugggucuu

SEQ ID NO: 1904564 - RNA, 15 nt, Homo sapiens
uguccuuccaagaau

SEQ ID NO: 1904565 - RNA, 19 nt, Homo sapiens
acugccaggagggacaaag

SEQ ID NO: 1904566 - RNA, 15 nt, Homo sapiens
uaucugucauacauc

SEQ ID NO: 1904567 - RNA, 13 nt, Homo sapiens
ugaaaaauuccac

SEQ ID NO: 1904568 - RNA, 14 nt, Homo sapiens
uaguauacugccca

SEQ ID NO: 1904569 - RNA, 15 nt, Homo sapiens
agacuuggggccagc

SEQ ID NO: 1904570 - RNA, 16 nt, Homo sapiens
aagugcucacuacuca

SEQ ID NO: 1904571 - RNA, 13 nt, Homo sapiens
aauguguggaaug

SEQ ID NO: 1904572 - RNA, 17 nt, Homo sapiens
caggaagcauucagaga

SEQ ID NO: 1904573 - RNA, 19 nt, Homo sapiens
ccaagcuguguucauccag

SEQ ID NO: 1904574 - RNA, 24 nt, Homo sapiens
cuuauugcaucccaaaccacgccu

SEQ ID NO: 1904575 - RNA, 14 nt, Homo sapiens
acaagaacaauuca

SEQ ID NO: 1904576 - RNA, 19 nt, Homo sapiens
uaucuugcaccccaaagcu

SEQ ID NO: 1904577 - RNA, 23 nt, Homo sapiens
cuaaaugcuguucuuacacauaa

SEQ ID NO: 1904578 - RNA, 15 nt, Homo sapiens
uccaguuuucuccuc

SEQ ID NO: 1904579 - RNA, 15 nt, Homo sapiens
cuguacuaaggagca

SEQ ID NO: 1904580 - RNA, 17 nt, Homo sapiens
uccaaacauuucauccg

SEQ ID NO: 1904581 - RNA, 22 nt, Homo sapiens
aacacuucaauaauuguccaug

SEQ ID NO: 1904582 - RNA, 16 nt, Homo sapiens
caucagucaacaacuu

SEQ ID NO: 1904583 - RNA, 21 nt, Homo sapiens
gcuccaucgcugucaucucag

SEQ ID NO: 1904584 - RNA, 13 nt, Homo sapiens
aauuacaauggaa

SEQ ID NO: 1904585 - RNA, 21 nt, Homo sapiens
aauaaccuauaaaguguuuau

SEQ ID NO: 1904586 - RNA, 15 nt, Homo sapiens
uugagacugauucag

SEQ ID NO: 1904587 - RNA, 18 nt, Homo sapiens
agcaguucaauaacaaag

SEQ ID NO: 1904588 - RNA, 15 nt, Homo sapiens
acccagagcugccua

SEQ ID NO: 1904589 - RNA, 19 nt, Homo sapiens
uggacuuccacugccaucc

SEQ ID NO: 1904590 - RNA, 21 nt, Homo sapiens
auuuagcccgagaucuggucu

SEQ ID NO: 1904591 - RNA, 17 nt, Homo sapiens
gaacccucugucccacc

SEQ ID NO: 1904592 - RNA, 21 nt, Homo sapiens
uggcaaguuugcagaugucau

SEQ ID NO: 1904593 - RNA, 16 nt, Homo sapiens
uuuguaucauuaugaa

SEQ ID NO: 1904594 - RNA, 14 nt, Homo sapiens
aagaacgagaagca

SEQ ID NO: 1904595 - RNA, 22 nt, Homo sapiens
uaacucaaauucaaugcuucua

SEQ ID NO: 1904596 - RNA, 23 nt, Homo sapiens
ccaggucuguggaaaguggugca

SEQ ID NO: 1904597 - RNA, 20 nt, Homo sapiens
uugcuaaaggaaaaaaccau

SEQ ID NO: 1904598 - RNA, 15 nt, Homo sapiens
ccuugaaaguaggau

SEQ ID NO: 1904599 - RNA, 14 nt, Homo sapiens
gaaaggagacuaga

SEQ ID NO: 1904600 - RNA, 12 nt, Homo sapiens
aacuguuggaua

SEQ ID NO: 1904601 - RNA, 12 nt, Homo sapiens
aucaguugguuu

SEQ ID NO: 1904602 - RNA, 21 nt, Homo sapiens
uuacuaagcuuugccagcugc

SEQ ID NO: 1904603 - RNA, 21 nt, Homo sapiens
auuccugcucucccacugcac

SEQ ID NO: 1904604 - RNA, 23 nt, Homo sapiens
ucauugucuguuuggaagaccag

SEQ ID NO: 1904605 - RNA, 15 nt, Homo sapiens
uuacaaauagguaga

SEQ ID NO: 1904606 - RNA, 12 nt, Homo sapiens
uguagcacuuac

SEQ ID NO: 1904607 - RNA, 23 nt, Homo sapiens
ugucaagggcagcuuugcucaua

SEQ ID NO: 1904608 - RNA, 20 nt, Homo sapiens
uguaaaaacuuuuaagccau

SEQ ID NO: 1904609 - RNA, 15 nt, Homo sapiens
gacucaguccagcca

SEQ ID NO: 1904610 - RNA, 16 nt, Homo sapiens
ugcaacacaacauuug

SEQ ID NO: 1904611 - RNA, 19 nt, Homo sapiens
cuuaugacuuuucaugcag

SEQ ID NO: 1904612 - RNA, 13 nt, Homo sapiens
cagucauuuccua

SEQ ID NO: 1904613 - RNA, 19 nt, Homo sapiens
uagauauucauacuuucca

SEQ ID NO: 1904614 - RNA, 23 nt, Homo sapiens
uucuuuaaggagauagacggguu

SEQ ID NO: 1904615 - RNA, 12 nt, Homo sapiens
cuucagugcaga

SEQ ID NO: 1904616 - RNA, 16 nt, Homo sapiens
agcaaagggccaggca

SEQ ID NO: 1904617 - RNA, 13 nt, Homo sapiens
uuucuuccuccaa

SEQ ID NO: 1904618 - RNA, 12 nt, Homo sapiens
aaguccagugac

SEQ ID NO: 1904619 - RNA, 13 nt, Homo sapiens
agauuugggagag

SEQ ID NO: 1904620 - RNA, 15 nt, Homo sapiens
accugggcaaagccu

SEQ ID NO: 1904621 - RNA, 23 nt, Homo sapiens
auucccaagccaaaaaccuuagc

SEQ ID NO: 1904622 - RNA, 17 nt, Homo sapiens
auuucaagucuuccuga

SEQ ID NO: 1904623 - RNA, 20 nt, Homo sapiens
ccccgugaggaugucacuca

SEQ ID NO: 1904624 - RNA, 20 nt, Homo sapiens
gccagauguuguuccuggcu

SEQ ID NO: 1904625 - RNA, 21 nt, Homo sapiens
uuccuuuuuauuuguuugcaa

SEQ ID NO: 1904626 - RNA, 13 nt, Homo sapiens
cuacacacucuga

SEQ ID NO: 1904627 - RNA, 21 nt, Homo sapiens
aacauuaaauggugccuccaa

SEQ ID NO: 1904628 - RNA, 21 nt, Homo sapiens
cugguuuuuaaguacucacua

SEQ ID NO: 1904629 - RNA, 12 nt, Homo sapiens
agagacacugag

SEQ ID NO: 1904630 - RNA, 16 nt, Homo sapiens
uguccaugccuuccau

SEQ ID NO: 1904631 - RNA, 12 nt, Homo sapiens
aaucuaagugau

SEQ ID NO: 1904632 - RNA, 20 nt, Homo sapiens
ugucauaacauuuaaagaga

SEQ ID NO: 1904633 - RNA, 15 nt, Homo sapiens
gaacuggacucagga

SEQ ID NO: 1904634 - RNA, 17 nt, Homo sapiens
cuuagagucaugaguuu

SEQ ID NO: 1904635 - RNA, 18 nt, Homo sapiens
uacaauuuuuuaucaugc

SEQ ID NO: 1904636 - RNA, 11 nt, Homo sapiens
cauaagccuac

SEQ ID NO: 1904637 - RNA, 20 nt, Homo sapiens
aguuccuaugacacaguuau

SEQ ID NO: 1904638 - RNA, 14 nt, Homo sapiens
guaaagaaaaccau

SEQ ID NO: 1904639 - RNA, 21 nt, Homo sapiens
gcagaguacaaaguaagccau

SEQ ID NO: 1904640 - RNA, 20 nt, Homo sapiens
uugaguaucccuuauccaaa

SEQ ID NO: 1904641 - RNA, 14 nt, Homo sapiens
agcaccucuugaag

SEQ ID NO: 1904642 - RNA, 16 nt, Homo sapiens
gcccacagaggacagu

SEQ ID NO: 1904643 - RNA, 22 nt, Homo sapiens
aaaggcuuugcccugcugcccu

SEQ ID NO: 1904644 - RNA, 18 nt, Homo sapiens
uaaaucuuccuugugagg

SEQ ID NO: 1904645 - RNA, 13 nt, Homo sapiens
augauuagcuuug

SEQ ID NO: 1904646 - RNA, 16 nt, Homo sapiens
ccuaaauuaugacugc

SEQ ID NO: 1904647 - RNA, 23 nt, Homo sapiens
gguaaucauuccagguguguuca

SEQ ID NO: 1904648 - RNA, 13 nt, Homo sapiens
ucugagcugugca

SEQ ID NO: 1904649 - RNA, 14 nt, Homo sapiens
uccucucugcaaau

SEQ ID NO: 1904650 - RNA, 17 nt, Homo sapiens
guccaguaagaucacug

SEQ ID NO: 1904651 - RNA, 15 nt, Homo sapiens
aagugacacuuugac

SEQ ID NO: 1904652 - RNA, 16 nt, Homo sapiens
cuccuuccacauguac

SEQ ID NO: 1904653 - RNA, 13 nt, Homo sapiens
uuaacccaaagaa

SEQ ID NO: 1904654 - RNA, 12 nt, Homo sapiens
uaauagucauca

SEQ ID NO: 1904655 - RNA, 18 nt, Homo sapiens
ucccccaccgguccagcu

SEQ ID NO: 1904656 - RNA, 17 nt, Homo sapiens
gcaccucuccugugagu

SEQ ID NO: 1904657 - RNA, 16 nt, Homo sapiens
acuuguggggcuaagg

SEQ ID NO: 1904658 - RNA, 12 nt, Homo sapiens
cgaggugguuca

SEQ ID NO: 1904659 - RNA, 21 nt, Homo sapiens
auucucccaaaguaccuugaa

SEQ ID NO: 1904660 - RNA, 18 nt, Homo sapiens
acuuggagcuaaaacugg

SEQ ID NO: 1904661 - RNA, 16 nt, Homo sapiens
caucagauguguuccu

SEQ ID NO: 1904662 - RNA, 16 nt, Homo sapiens
ccuuuuaauggauggu

SEQ ID NO: 1904663 - RNA, 13 nt, Homo sapiens
aaaaaaucuucca

SEQ ID NO: 1904664 - RNA, 15 nt, Homo sapiens
ugucaugucagcucc

SEQ ID NO: 1904665 - RNA, 21 nt, Homo sapiens
guagagagguuuuucuuggga

SEQ ID NO: 1904666 - RNA, 15 nt, Homo sapiens
cggagccccaagacu

SEQ ID NO: 1904667 - RNA, 13 nt, Homo sapiens
cauuucaaugugu

SEQ ID NO: 1904668 - RNA, 20 nt, Homo sapiens
ccacccacaaucacaagaag

SEQ ID NO: 1904669 - RNA, 19 nt, Homo sapiens
cauggacaccccuuaucca

SEQ ID NO: 1904670 - RNA, 20 nt, Homo sapiens
cugugguuacaagaaacagc

SEQ ID NO: 1904671 - RNA, 20 nt, Homo sapiens
gggcucacuacaugggccag

SEQ ID NO: 1904672 - RNA, 12 nt, Homo sapiens
ucaccaagccca

SEQ ID NO: 1904673 - RNA, 19 nt, Homo sapiens
uuucaaauuauaaucucau

SEQ ID NO: 1904674 - RNA, 17 nt, Homo sapiens
aaaccuccggugugaga

SEQ ID NO: 1904675 - RNA, 14 nt, Homo sapiens
gaacacgcuuucac

SEQ ID NO: 1904676 - RNA, 15 nt, Homo sapiens
ugagaacaaaaucac

SEQ ID NO: 1904677 - RNA, 15 nt, Homo sapiens
ugagaagaaaaucag

SEQ ID NO: 1904678 - RNA, 22 nt, Homo sapiens
guuuaacugggagugauaugau

SEQ ID NO: 1904679 - RNA, 16 nt, Homo sapiens
uaauuaucugugaugg

SEQ ID NO: 1904680 - RNA, 22 nt, Homo sapiens
uauugugauuauuggauucaca

SEQ ID NO: 1904681 - RNA, 19 nt, Homo sapiens
agcacaugucucauuuuaa

SEQ ID NO: 1904682 - RNA, 22 nt, Homo sapiens
uuugcuuaccuuguuuugccag

SEQ ID NO: 1904683 - RNA, 17 nt, Homo sapiens
uuuaggcuacagugucu

SEQ ID NO: 1904684 - RNA, 23 nt, Homo sapiens
uucuggggacagacaaggugccu

SEQ ID NO: 1904685 - RNA, 19 nt, Homo sapiens
ugaaccgccguccuucaau

SEQ ID NO: 1904686 - RNA, 15 nt, Homo sapiens
acuugccuaucugac

SEQ ID NO: 1904687 - RNA, 18 nt, Homo sapiens
cccaggauggagugcagu

SEQ ID NO: 1904688 - RNA, 12 nt, Homo sapiens
cauuuauacuaa

SEQ ID NO: 1904689 - RNA, 22 nt, Homo sapiens
caacacaggauggucucugcca

SEQ ID NO: 1904690 - RNA, 16 nt, Homo sapiens
auuaaaucuuccucau

SEQ ID NO: 1904691 - RNA, 23 nt, Homo sapiens
accguucauucaggcaacgcaca

SEQ ID NO: 1904692 - RNA, 21 nt, Homo sapiens
aaaucauuucaguaucaucuc

SEQ ID NO: 1904693 - RNA, 15 nt, Homo sapiens
cauccuugacuccuu

SEQ ID NO: 1904694 - RNA, 18 nt, Homo sapiens
ucucagcgcaacagcugu

SEQ ID NO: 1904695 - RNA, 17 nt, Homo sapiens
uguguaggaaaucugaa

SEQ ID NO: 1904696 - RNA, 20 nt, Homo sapiens
ccaagccuuggggauucuuc

SEQ ID NO: 1904697 - RNA, 22 nt, Homo sapiens
aaaucccuaagugcaacugcaa

SEQ ID NO: 1904698 - RNA, 12 nt, Homo sapiens
gaaaagcacugg

SEQ ID NO: 1904699 - RNA, 19 nt, Homo sapiens
ccaacuggaaauuccagga

SEQ ID NO: 1904700 - RNA, 15 nt, Homo sapiens
ccaccaugauugaug

SEQ ID NO: 1904701 - RNA, 20 nt, Homo sapiens
aggguccccagcugguccag

SEQ ID NO: 1904702 - RNA, 16 nt, Homo sapiens
cacuggaguucacuuu

SEQ ID NO: 1904703 - RNA, 18 nt, Homo sapiens
ccagauggcucuuucuau

SEQ ID NO: 1904704 - RNA, 14 nt, Homo sapiens
gucaaggccagcaa

SEQ ID NO: 1904705 - RNA, 23 nt, Homo sapiens
acugggacccccaacauucugcc

SEQ ID NO: 1904706 - RNA, 20 nt, Homo sapiens
uuaugugagagaaaguguga

SEQ ID NO: 1904707 - RNA, 12 nt, Homo sapiens
uaccauguugcc

SEQ ID NO: 1904708 - RNA, 12 nt, Homo sapiens
agaaucuugacu

SEQ ID NO: 1904709 - RNA, 18 nt, Homo sapiens
aaagccagaguuccaugu

SEQ ID NO: 1904710 - RNA, 23 nt, Homo sapiens
uugcugcccuggcuauggucaca

SEQ ID NO: 1904711 - RNA, 18 nt, Homo sapiens
ucuaaaacagggauuuug

SEQ ID NO: 1904712 - RNA, 17 nt, Homo sapiens
ugugcauugugugucac

SEQ ID NO: 1904713 - RNA, 14 nt, Homo sapiens
gucaggggcagcug

SEQ ID NO: 1904714 - RNA, 16 nt, Homo sapiens
ggcuauugaccaugug

SEQ ID NO: 1904715 - RNA, 19 nt, Homo sapiens
ccuucuauuuauuugacug

SEQ ID NO: 1904716 - RNA, 12 nt, Homo sapiens
ggcccugugguc

SEQ ID NO: 1904717 - RNA, 12 nt, Homo sapiens
guuacuguguca

SEQ ID NO: 1904718 - RNA, 11 nt, Homo sapiens
uaaacauuuau

SEQ ID NO: 1904719 - RNA, 21 nt, Homo sapiens
cugacaaguuaaaaaggucua

SEQ ID NO: 1904720 - RNA, 13 nt, Homo sapiens
cugaauucucugc

SEQ ID NO: 1904721 - RNA, 19 nt, Homo sapiens
auccuaucucuccaaccag

SEQ ID NO: 1904722 - RNA, 20 nt, Homo sapiens
cgaagaacuggcuuuacuua

SEQ ID NO: 1904723 - RNA, 21 nt, Homo sapiens
aaugauuuugacauacaggag

SEQ ID NO: 1904724 - RNA, 13 nt, Homo sapiens
acauccugugaug

SEQ ID NO: 1904725 - RNA, 19 nt, Homo sapiens
acugcaggugacuuuggca

SEQ ID NO: 1904726 - RNA, 23 nt, Homo sapiens
cuugaauguuuguauacauguua

SEQ ID NO: 1904727 - RNA, 11 nt, Homo sapiens
cugaaccacaa

SEQ ID NO: 1904728 - RNA, 11 nt, Homo sapiens
aaaaaccaaug

SEQ ID NO: 1904729 - RNA, 11 nt, Homo sapiens
cagaaccacua

SEQ ID NO: 1904730 - RNA, 18 nt, Homo sapiens
uucagcaacugucuuauu

SEQ ID NO: 1904731 - RNA, 20 nt, Homo sapiens
caggcgccuauaaucccagc

SEQ ID NO: 1904732 - RNA, 18 nt, Homo sapiens
ccuugggagaacuaagua

SEQ ID NO: 1904733 - RNA, 20 nt, Homo sapiens
cccacuuucaccaguuucug

SEQ ID NO: 1904734 - RNA, 14 nt, Homo sapiens
augaucaguaugaa

SEQ ID NO: 1904735 - RNA, 13 nt, Homo sapiens
cguccacucuuca

SEQ ID NO: 1904736 - RNA, 18 nt, Homo sapiens
auuauuggacuuccauuu

SEQ ID NO: 1904737 - RNA, 20 nt, Homo sapiens
cauaauguuuucacaguucc

SEQ ID NO: 1904738 - RNA, 13 nt, Homo sapiens
accagugagcacu

SEQ ID NO: 1904739 - RNA, 15 nt, Homo sapiens
gaggggcggggccag

SEQ ID NO: 1904740 - RNA, 22 nt, Homo sapiens
agggacugcagguugugcccug

SEQ ID NO: 1904741 - RNA, 22 nt, Homo sapiens
aaucagucuuggaauacuugaa

SEQ ID NO: 1904742 - RNA, 13 nt, Homo sapiens
ccaggcauggugg

SEQ ID NO: 1904743 - RNA, 14 nt, Homo sapiens
uuuuucuugguuuc

SEQ ID NO: 1904744 - RNA, 14 nt, Homo sapiens
aguagcuaaugaaa

SEQ ID NO: 1904745 - RNA, 16 nt, Homo sapiens
caaaaaugugacaaua

SEQ ID NO: 1904746 - RNA, 22 nt, Homo sapiens
aagauggcccauccugugguca

SEQ ID NO: 1904747 - RNA, 18 nt, Homo sapiens
gacuuaacugguucauau

SEQ ID NO: 1904748 - RNA, 14 nt, Homo sapiens
aguuucuuuaccua

SEQ ID NO: 1904749 - RNA, 17 nt, Homo sapiens
ugaagaguggaaauggg

SEQ ID NO: 1904750 - RNA, 20 nt, Homo sapiens
uccaggaggaguuagccaaa

SEQ ID NO: 1904751 - RNA, 22 nt, Homo sapiens
uguauugggcagcagacugugu

SEQ ID NO: 1904752 - RNA, 17 nt, Homo sapiens
auuugaaugcuuaauuc

SEQ ID NO: 1904753 - RNA, 20 nt, Homo sapiens
uccuaucugugccucuucag

SEQ ID NO: 1904754 - RNA, 16 nt, Homo sapiens
auuuuacccaaauacu

SEQ ID NO: 1904755 - RNA, 23 nt, Homo sapiens
uagagaaguccaagcaacagccu

SEQ ID NO: 1904756 - RNA, 14 nt, Homo sapiens
caguuuugucauug

SEQ ID NO: 1904757 - RNA, 19 nt, Homo sapiens
cccacaguucagaccaaug

SEQ ID NO: 1904758 - RNA, 20 nt, Homo sapiens
agaaagacaucugaggaaaa

SEQ ID NO: 1904759 - RNA, 21 nt, Homo sapiens
guuaggacaaggcugugccag

SEQ ID NO: 1904760 - RNA, 17 nt, Homo sapiens
auaauaaaaagcuucag

SEQ ID NO: 1904761 - RNA, 13 nt, Homo sapiens
uauuuauuuacug

SEQ ID NO: 1904762 - RNA, 18 nt, Homo sapiens
uagauguguuauuacuuc

SEQ ID NO: 1904763 - RNA, 21 nt, Homo sapiens
gguauccuuaucuaguguuug

SEQ ID NO: 1904764 - RNA, 22 nt, Homo sapiens
ucuaagacauucaccaacaaca

SEQ ID NO: 1904765 - RNA, 20 nt, Homo sapiens
cagcagaaagguuaguauca

SEQ ID NO: 1904766 - RNA, 19 nt, Homo sapiens
ucucucuugcuuacaaaug

SEQ ID NO: 1904767 - RNA, 14 nt, Homo sapiens
caguuacacaggaa

SEQ ID NO: 1904768 - RNA, 19 nt, Homo sapiens
ucaacaaaauggucaucca

SEQ ID NO: 1904769 - RNA, 12 nt, Homo sapiens
aaaaccagcucc

SEQ ID NO: 1904770 - RNA, 18 nt, Homo sapiens
aaccccccacacuccacu

SEQ ID NO: 1904771 - RNA, 19 nt, Homo sapiens
aucacaaccacaaccaaca

SEQ ID NO: 1904772 - RNA, 15 nt, Homo sapiens
gccaguccugcuacc

SEQ ID NO: 1904773 - RNA, 14 nt, Homo sapiens
cuuaguaucaguca

SEQ ID NO: 1904774 - RNA, 15 nt, Homo sapiens
uuacuagcuucagaa

SEQ ID NO: 1904775 - RNA, 13 nt, Homo sapiens
uggaggaccugag

SEQ ID NO: 1904776 - RNA, 21 nt, Homo sapiens
caauguuuaugcaaggaagga

SEQ ID NO: 1904777 - RNA, 11 nt, Homo sapiens
acugaccagcc

SEQ ID NO: 1904778 - RNA, 19 nt, Homo sapiens
cccgagagcugggacucag

SEQ ID NO: 1904779 - RNA, 16 nt, Homo sapiens
agcagaggcagcauuu

SEQ ID NO: 1904780 - RNA, 18 nt, Homo sapiens
aucugccgcuaccuggac

SEQ ID NO: 1904781 - RNA, 16 nt, Homo sapiens
ucucagagccuuccau

SEQ ID NO: 1904782 - RNA, 14 nt, Homo sapiens
aauucagaguccuu

SEQ ID NO: 1904783 - RNA, 14 nt, Homo sapiens
cacucuuugcacac

SEQ ID NO: 1904784 - RNA, 16 nt, Homo sapiens
agcagcugaugcugua

SEQ ID NO: 1904785 - RNA, 23 nt, Homo sapiens
acagagggcaggaacuugcacaa

SEQ ID NO: 1904786 - RNA, 14 nt, Homo sapiens
aaacuaagauuuau

SEQ ID NO: 1904787 - RNA, 18 nt, Homo sapiens
ugacccugauacaggcau

SEQ ID NO: 1904788 - RNA, 22 nt, Homo sapiens
acaauucauuuacccauuuacu

SEQ ID NO: 1904789 - RNA, 16 nt, Homo sapiens
aggcaagcuggcagga

SEQ ID NO: 1904790 - RNA, 16 nt, Homo sapiens
gcaauuaggcagauca

SEQ ID NO: 1904791 - RNA, 21 nt, Homo sapiens
guaaacagauggcacuuugaa

SEQ ID NO: 1904792 - RNA, 17 nt, Homo sapiens
uggcauuuccuggucag

SEQ ID NO: 1904793 - RNA, 18 nt, Homo sapiens
cagaaacuacagacaaag

SEQ ID NO: 1904794 - RNA, 20 nt, Homo sapiens
uuuuugaaaucaguaaacac

SEQ ID NO: 1904795 - RNA, 15 nt, Homo sapiens
ccugaggguuuccac

SEQ ID NO: 1904796 - RNA, 18 nt, Homo sapiens
uauguacauacauauaua

SEQ ID NO: 1904797 - RNA, 23 nt, Homo sapiens
caucaucuguucgauugaaauuu

SEQ ID NO: 1904798 - RNA, 22 nt, Homo sapiens
aucucucagccccaaacaccca

SEQ ID NO: 1904799 - RNA, 23 nt, Homo sapiens
aguauagccacaaaugccuugaa

SEQ ID NO: 1904800 - RNA, 23 nt, Homo sapiens
uccuaaugugcugugugacauug

SEQ ID NO: 1904801 - RNA, 16 nt, Homo sapiens
ccccauuagaauguga

SEQ ID NO: 1904802 - RNA, 13 nt, Homo sapiens
uaaagaagcaauc

SEQ ID NO: 1904803 - RNA, 20 nt, Homo sapiens
acuaaagcuauguuacaugg

SEQ ID NO: 1904804 - RNA, 20 nt, Homo sapiens
caaauuagaaacaccauuca

SEQ ID NO: 1904805 - RNA, 23 nt, Homo sapiens
accugcugagccagauuccccag

SEQ ID NO: 1904806 - RNA, 21 nt, Homo sapiens
aagugauggucauucauauca

SEQ ID NO: 1904807 - RNA, 14 nt, Homo sapiens
cauuacaguguaaa

SEQ ID NO: 1904808 - RNA, 15 nt, Homo sapiens
caagccacuaccuuc

SEQ ID NO: 1904809 - RNA, 18 nt, Homo sapiens
gacaagagugagacucca

SEQ ID NO: 1904810 - RNA, 22 nt, Homo sapiens
caagagaaagaaagaacguucc

SEQ ID NO: 1904811 - RNA, 13 nt, Homo sapiens
acuauggugcugu

SEQ ID NO: 1904812 - RNA, 23 nt, Homo sapiens
uaaccccuuccagaucacugcca

SEQ ID NO: 1904813 - RNA, 18 nt, Homo sapiens
acccuuggacaagacaaa

SEQ ID NO: 1904814 - RNA, 16 nt, Homo sapiens
cauagauaauaguaca

SEQ ID NO: 1904815 - RNA, 21 nt, Homo sapiens
ucucuuuaaauggcuuuaugc

SEQ ID NO: 1904816 - RNA, 14 nt, Homo sapiens
acuguguacuguau

SEQ ID NO: 1904817 - RNA, 17 nt, Homo sapiens
gccccugccccaagucc

SEQ ID NO: 1904818 - RNA, 22 nt, Homo sapiens
cucacucaggaacccuggagac

SEQ ID NO: 1904819 - RNA, 18 nt, Homo sapiens
ucuuagcauacauucaga

SEQ ID NO: 1904820 - RNA, 23 nt, Homo sapiens
acuccugacgucugaagcuugac

SEQ ID NO: 1904821 - RNA, 22 nt, Homo sapiens
ccagcuguguucacacuguaaa

SEQ ID NO: 1904822 - RNA, 19 nt, Homo sapiens
uacccaguauuacugcugc

SEQ ID NO: 1904823 - RNA, 23 nt, Homo sapiens
gcugcccccuuccccagcccuua

SEQ ID NO: 1904824 - RNA, 12 nt, Homo sapiens
uucuucucaggc

SEQ ID NO: 1904825 - RNA, 13 nt, Homo sapiens
caguuugcaaaua

SEQ ID NO: 1904826 - RNA, 22 nt, Homo sapiens
aucagacugaacuuacacugua

SEQ ID NO: 1904827 - RNA, 19 nt, Homo sapiens
ccaccaggugccuuucaaa

SEQ ID NO: 1904828 - RNA, 16 nt, Homo sapiens
gucccucucucuggaa

SEQ ID NO: 1904829 - RNA, 22 nt, Homo sapiens
uccccucacuuaaccaccccau

SEQ ID NO: 1904830 - RNA, 18 nt, Homo sapiens
accucauguccacucagu

SEQ ID NO: 1904831 - RNA, 20 nt, Homo sapiens
caauuaauaaucagacugga

SEQ ID NO: 1904832 - RNA, 22 nt, Homo sapiens
ccaguguggaguggguaaucca

SEQ ID NO: 1904833 - RNA, 21 nt, Homo sapiens
auuuaugugcuguuagaauau

SEQ ID NO: 1904834 - RNA, 15 nt, Homo sapiens
uagaacgacauguua

SEQ ID NO: 1904835 - RNA, 15 nt, Homo sapiens
gcuuuguguaauaua

SEQ ID NO: 1904836 - RNA, 19 nt, Homo sapiens
agucuuagagcuuuaccua

SEQ ID NO: 1904837 - RNA, 20 nt, Homo sapiens
uggcuuagaaggcacuggga

SEQ ID NO: 1904838 - RNA, 16 nt, Homo sapiens
guuuuauccuuacaau

SEQ ID NO: 1904839 - RNA, 23 nt, Homo sapiens
aucucuacccauccccugaugcc

SEQ ID NO: 1904840 - RNA, 22 nt, Homo sapiens
cuuaaacuccuggccucaagca

SEQ ID NO: 1904841 - RNA, 14 nt, Homo sapiens
ucacuagacugugc

SEQ ID NO: 1904842 - RNA, 17 nt, Homo sapiens
gguuaccuuuguuccca

SEQ ID NO: 1904843 - RNA, 23 nt, Homo sapiens
cagauugcaguucugauucauuu

SEQ ID NO: 1904844 - RNA, 18 nt, Homo sapiens
uaauuaacuaugugaugu

SEQ ID NO: 1904845 - RNA, 23 nt, Homo sapiens
cgccuggaggagacgcuggacuu

SEQ ID NO: 1904846 - RNA, 14 nt, Homo sapiens
ugucgucuuuaugu

SEQ ID NO: 1904847 - RNA, 14 nt, Homo sapiens
gaagcaaucuuuga

SEQ ID NO: 1904848 - RNA, 18 nt, Homo sapiens
auacugaaccaggccaga

SEQ ID NO: 1904849 - RNA, 18 nt, Homo sapiens
gucacaggagucuuugua

SEQ ID NO: 1904850 - RNA, 14 nt, Homo sapiens
accccuuucacuua

SEQ ID NO: 1904851 - RNA, 13 nt, Homo sapiens
gaccucuugccuc

SEQ ID NO: 1904852 - RNA, 16 nt, Homo sapiens
cauggcuggugccuga

SEQ ID NO: 1904853 - RNA, 14 nt, Homo sapiens
uuggccucccaaag

SEQ ID NO: 1904854 - RNA, 11 nt, Homo sapiens
aaaaacuaaaa

SEQ ID NO: 1904855 - RNA, 21 nt, Homo sapiens
acuaagccagacgugguggcu

SEQ ID NO: 1904856 - RNA, 19 nt, Homo sapiens
ucuaugaaauaucaugcuc

SEQ ID NO: 1904857 - RNA, 13 nt, Homo sapiens
aaccaacagagaa

SEQ ID NO: 1904858 - RNA, 15 nt, Homo sapiens
cacuggagaucacca

SEQ ID NO: 1904859 - RNA, 20 nt, Homo sapiens
gagaucguuguuuacagugu

SEQ ID NO: 1904860 - RNA, 21 nt, Homo sapiens
gccagaggaauccuggcagcc

SEQ ID NO: 1904861 - RNA, 14 nt, Homo sapiens
uuaaaaagcccaac

SEQ ID NO: 1904862 - RNA, 14 nt, Homo sapiens
agacucucuuaggg

SEQ ID NO: 1904863 - RNA, 20 nt, Homo sapiens
ugugcaggcaccugauacuu

SEQ ID NO: 1904864 - RNA, 14 nt, Homo sapiens
cauauacuagggaa

SEQ ID NO: 1904865 - RNA, 16 nt, Homo sapiens
ccaucuaccccuggau

SEQ ID NO: 1904866 - RNA, 17 nt, Homo sapiens
aguaucucuacuuuccu

SEQ ID NO: 1904867 - RNA, 14 nt, Homo sapiens
aaccuguccuugca

SEQ ID NO: 1904868 - RNA, 19 nt, Homo sapiens
uuuggucuuagcuuuacau

SEQ ID NO: 1904869 - RNA, 21 nt, Homo sapiens
gucagcuucucccaagcccac

SEQ ID NO: 1904870 - RNA, 19 nt, Homo sapiens
ugucaagaugucacuuucu

SEQ ID NO: 1904871 - RNA, 16 nt, Homo sapiens
guggugcauuuugcuu

SEQ ID NO: 1904872 - RNA, 18 nt, Homo sapiens
ccuauuuuggacguguga

SEQ ID NO: 1904873 - RNA, 19 nt, Homo sapiens
gugugccugucuguuacac

SEQ ID NO: 1904874 - RNA, 17 nt, Homo sapiens
aggaucgccugagccca

SEQ ID NO: 1904875 - RNA, 18 nt, Homo sapiens
uuuuuggccuaaagccag

SEQ ID NO: 1904876 - RNA, 23 nt, Homo sapiens
ucuguuuuucaccacuucacuga

SEQ ID NO: 1904877 - RNA, 17 nt, Homo sapiens
accuuacucugagcuca

SEQ ID NO: 1904878 - RNA, 11 nt, Homo sapiens
cauuuggucuc

SEQ ID NO: 1904879 - RNA, 18 nt, Homo sapiens
cuaaagaagaggagaaaa

SEQ ID NO: 1904880 - RNA, 14 nt, Homo sapiens
gccugguggcagcu

SEQ ID NO: 1904881 - RNA, 22 nt, Homo sapiens
acagaugccuucccuuguagca

SEQ ID NO: 1904882 - RNA, 16 nt, Homo sapiens
gagaauuuaaacaaug

SEQ ID NO: 1904883 - RNA, 21 nt, Homo sapiens
gacaggccuuccuccucucaa

SEQ ID NO: 1904884 - RNA, 16 nt, Homo sapiens
uuuugaagacaucaaa

SEQ ID NO: 1904885 - RNA, 22 nt, Homo sapiens
uuuccuaucuguaugucugccu

SEQ ID NO: 1904886 - RNA, 17 nt, Homo sapiens
auaaaccugucaugugc

SEQ ID NO: 1904887 - RNA, 14 nt, Homo sapiens
caacagauaccucu

SEQ ID NO: 1904888 - RNA, 18 nt, Homo sapiens
gcccaucauacgcauggu

SEQ ID NO: 1904889 - RNA, 21 nt, Homo sapiens
ugcccagaauucccagcuguc

SEQ ID NO: 1904890 - RNA, 21 nt, Homo sapiens
aaaacaaaggaauaaaaccau

SEQ ID NO: 1904891 - RNA, 17 nt, Homo sapiens
uucaucuggaaguauuu

SEQ ID NO: 1904892 - RNA, 17 nt, Homo sapiens
auucucagguggugaua

SEQ ID NO: 1904893 - RNA, 17 nt, Homo sapiens
auaccgugucuucuaaa

SEQ ID NO: 1904894 - RNA, 19 nt, Homo sapiens
ugauggucauugggguggu

SEQ ID NO: 1904895 - RNA, 13 nt, Homo sapiens
caauaaacaacuu

SEQ ID NO: 1904896 - RNA, 18 nt, Homo sapiens
cuuuugugaugaacauau

SEQ ID NO: 1904897 - RNA, 22 nt, Homo sapiens
acugcaaccuccacaucccaug

SEQ ID NO: 1904898 - RNA, 19 nt, Homo sapiens
ggacuggaggugggcaugc

SEQ ID NO: 1904899 - RNA, 22 nt, Homo sapiens
auuuauaguagugguguucaca

SEQ ID NO: 1904900 - RNA, 20 nt, Homo sapiens
uaugucauauaucaaaucau

SEQ ID NO: 1904901 - RNA, 22 nt, Homo sapiens
gaagucuugucucaagaagaaa

SEQ ID NO: 1904902 - RNA, 15 nt, Homo sapiens
agcugcucacuaccu

SEQ ID NO: 1904903 - RNA, 16 nt, Homo sapiens
aaacugcagcugggaa

SEQ ID NO: 1904904 - RNA, 22 nt, Homo sapiens
uauuugacaacaauccaaaaaa

SEQ ID NO: 1904905 - RNA, 15 nt, Homo sapiens
gcagaauggcauuug

SEQ ID NO: 1904906 - RNA, 16 nt, Homo sapiens
ugaaaguugcuuuuau

SEQ ID NO: 1904907 - RNA, 23 nt, Homo sapiens
accuucugucguccccagaccag

SEQ ID NO: 1904908 - RNA, 19 nt, Homo sapiens
uuuccuuuauccacuuuuc

SEQ ID NO: 1904909 - RNA, 17 nt, Homo sapiens
ugggauuacagguguga

SEQ ID NO: 1904910 - RNA, 19 nt, Homo sapiens
gcaggccggaaccacaggg

SEQ ID NO: 1904911 - RNA, 15 nt, Homo sapiens
agcacuguuccagcc

SEQ ID NO: 1904912 - RNA, 22 nt, Homo sapiens
cuggcagguaggucggcacuug

SEQ ID NO: 1904913 - RNA, 12 nt, Homo sapiens
ccgcguggaaug

SEQ ID NO: 1904914 - RNA, 23 nt, Homo sapiens
aauauccaccucuccuuuuugcc

SEQ ID NO: 1904915 - RNA, 12 nt, Homo sapiens
gggaggcccaau

SEQ ID NO: 1904916 - RNA, 19 nt, Homo sapiens
ugagaaggcuaaagaagac

SEQ ID NO: 1904917 - RNA, 17 nt, Homo sapiens
caucgccgggacuccag

SEQ ID NO: 1904918 - RNA, 14 nt, Homo sapiens
aacuuuaagucuca

SEQ ID NO: 1904919 - RNA, 14 nt, Homo sapiens
aaauaaaagcacuu

SEQ ID NO: 1904920 - RNA, 18 nt, Homo sapiens
uaaaaccaucauaguaca

SEQ ID NO: 1904921 - RNA, 17 nt, Homo sapiens
ggcugaagaaacacagc

SEQ ID NO: 1904922 - RNA, 12 nt, Homo sapiens
guguguccaaaa

SEQ ID NO: 1904923 - RNA, 15 nt, Homo sapiens
gccaagucauuugag

SEQ ID NO: 1904924 - RNA, 18 nt, Homo sapiens
aacuugggaauaaaucau

SEQ ID NO: 1904925 - RNA, 14 nt, Homo sapiens
gcuuauauuuagaa

SEQ ID NO: 1904926 - RNA, 23 nt, Homo sapiens
aaagccuuaucaagugucuucca

SEQ ID NO: 1904927 - RNA, 16 nt, Homo sapiens
caccuggcacauucau

SEQ ID NO: 1904928 - RNA, 14 nt, Homo sapiens
gcuggccgcaugac

SEQ ID NO: 1904929 - RNA, 18 nt, Homo sapiens
gauaccauggcacugaca

SEQ ID NO: 1904930 - RNA, 16 nt, Homo sapiens
uguaccaagugaaauu

SEQ ID NO: 1904931 - RNA, 14 nt, Homo sapiens
ccaaauaugcacuu

SEQ ID NO: 1904932 - RNA, 14 nt, Homo sapiens
cuuaauauguucuu

SEQ ID NO: 1904933 - RNA, 22 nt, Homo sapiens
aaugggccacugaaaucuguca

SEQ ID NO: 1904934 - RNA, 14 nt, Homo sapiens
augagugauuccag

SEQ ID NO: 1904935 - RNA, 21 nt, Homo sapiens
cagugagcugagaucaugcca

SEQ ID NO: 1904936 - RNA, 21 nt, Homo sapiens
uucuucuaaugagucgacuuu

SEQ ID NO: 1904937 - RNA, 22 nt, Homo sapiens
cuagauacucuuauuuuacuga

SEQ ID NO: 1904938 - RNA, 17 nt, Homo sapiens
gguuaagaaagcacuua

SEQ ID NO: 1904939 - RNA, 16 nt, Homo sapiens
auuggaacucuacuca

SEQ ID NO: 1904940 - RNA, 21 nt, Homo sapiens
caggacuccaucucuuaaaaa

SEQ ID NO: 1904941 - RNA, 21 nt, Homo sapiens
uucucccgugagccaggcaaa

SEQ ID NO: 1904942 - RNA, 18 nt, Homo sapiens
cagagggaugaaaugcca

SEQ ID NO: 1904943 - RNA, 11 nt, Homo sapiens
guuaaugccau

SEQ ID NO: 1904944 - RNA, 11 nt, Homo sapiens
gauaaugccuu

SEQ ID NO: 1904945 - RNA, 11 nt, Homo sapiens
gucaaugccac

SEQ ID NO: 1904946 - RNA, 14 nt, Homo sapiens
agacuacuuuuaga

SEQ ID NO: 1904947 - RNA, 18 nt, Homo sapiens
ugcaauaacucagcaguu

SEQ ID NO: 1904948 - RNA, 20 nt, Homo sapiens
ccagucugugaagucaagaa

SEQ ID NO: 1904949 - RNA, 18 nt, Homo sapiens
gcccagcaaucugcauuu

SEQ ID NO: 1904950 - RNA, 22 nt, Homo sapiens
cugauaauauguuugagguuaa

SEQ ID NO: 1904951 - RNA, 15 nt, Homo sapiens
gccagugugggaaug

SEQ ID NO: 1904952 - RNA, 20 nt, Homo sapiens
gcccucagaagaaaacuuuu

SEQ ID NO: 1904953 - RNA, 22 nt, Homo sapiens
gcccuaccccgccccaguauca

SEQ ID NO: 1904954 - RNA, 13 nt, Homo sapiens
cauguagcuucuu

SEQ ID NO: 1904955 - RNA, 12 nt, Homo sapiens
cauucucuccau

SEQ ID NO: 1904956 - RNA, 19 nt, Homo sapiens
ucuuaaaauucagugagau

SEQ ID NO: 1904957 - RNA, 12 nt, Homo sapiens
aucauaccaguu

SEQ ID NO: 1904958 - RNA, 15 nt, Homo sapiens
uaacuaaucaagaaa

SEQ ID NO: 1904959 - RNA, 18 nt, Homo sapiens
uucaagguguaaaauauc

SEQ ID NO: 1904960 - RNA, 20 nt, Homo sapiens
ucugaaucuguuucuauguc

SEQ ID NO: 1904961 - RNA, 22 nt, Homo sapiens
cauuuaugucucagaccacuau

SEQ ID NO: 1904962 - RNA, 16 nt, Homo sapiens
acauaaaucugugaac

SEQ ID NO: 1904963 - RNA, 18 nt, Homo sapiens
aggggagcuacagccagc

SEQ ID NO: 1904964 - RNA, 22 nt, Homo sapiens
ccugaaauaauacauugcagca

SEQ ID NO: 1904965 - RNA, 22 nt, Homo sapiens
cugucacaauaaauggccagug

SEQ ID NO: 1904966 - RNA, 15 nt, Homo sapiens
cuggauuaaugaacu

SEQ ID NO: 1904967 - RNA, 22 nt, Homo sapiens
cgggaggguuccgccacuccag

SEQ ID NO: 1904968 - RNA, 12 nt, Homo sapiens
accaaccacugc

SEQ ID NO: 1904969 - RNA, 23 nt, Homo sapiens
cacaauauacgaaaagccagcuu

SEQ ID NO: 1904970 - RNA, 22 nt, Homo sapiens
ccaggggcaggcagcuaggcag

SEQ ID NO: 1904971 - RNA, 14 nt, Homo sapiens
uaaccaaaugcugu

SEQ ID NO: 1904972 - RNA, 13 nt, Homo sapiens
gugccaagcacag

SEQ ID NO: 1904973 - RNA, 14 nt, Homo sapiens
uucccccagacaga

SEQ ID NO: 1904974 - RNA, 19 nt, Homo sapiens
aggcaggcucccccugccu

SEQ ID NO: 1904975 - RNA, 23 nt, Homo sapiens
gacaucuaauucaagauuacaac

SEQ ID NO: 1904976 - RNA, 19 nt, Homo sapiens
uguaucacucacugccaaa

SEQ ID NO: 1904977 - RNA, 18 nt, Homo sapiens
ugccaugucugcagugug

SEQ ID NO: 1904978 - RNA, 22 nt, Homo sapiens
ucaaagggagagagugcuauug

SEQ ID NO: 1904979 - RNA, 16 nt, Homo sapiens
gccauuucacucucaa

SEQ ID NO: 1904980 - RNA, 15 nt, Homo sapiens
cuggugugaccugag

SEQ ID NO: 1904981 - RNA, 15 nt, Homo sapiens
gccugggaugaugca

SEQ ID NO: 1904982 - RNA, 19 nt, Homo sapiens
aagauaaaugugcugaaug

SEQ ID NO: 1904983 - RNA, 21 nt, Homo sapiens
auccccgucugaccaagggcu

SEQ ID NO: 1904984 - RNA, 20 nt, Homo sapiens
cugcccaggcuagagugcag

SEQ ID NO: 1904985 - RNA, 20 nt, Homo sapiens
ccagaggggcucaggucaca

SEQ ID NO: 1904986 - RNA, 16 nt, Homo sapiens
aaugaagaugaugcua

SEQ ID NO: 1904987 - RNA, 19 nt, Homo sapiens
ugcuguagauucacauaca

SEQ ID NO: 1904988 - RNA, 19 nt, Homo sapiens
aauucccaucugcuuuauu

SEQ ID NO: 1904989 - RNA, 16 nt, Homo sapiens
aggccagcaagcucuu

SEQ ID NO: 1904990 - RNA, 17 nt, Homo sapiens
aucugcaggugggauga

SEQ ID NO: 1904991 - RNA, 16 nt, Homo sapiens
cucauucuguugccca

SEQ ID NO: 1904992 - RNA, 23 nt, Homo sapiens
aaagaccuaccuagaugcuccuu

SEQ ID NO: 1904993 - RNA, 10 nt, Homo sapiens
aaugcagugg

SEQ ID NO: 1904994 - RNA, 19 nt, Homo sapiens
uaaauacuauuauuugcua

SEQ ID NO: 1904995 - RNA, 23 nt, Homo sapiens
agaaggccacuguuugucucacc

SEQ ID NO: 1904996 - RNA, 16 nt, Homo sapiens
gacguggguugcacug

SEQ ID NO: 1904997 - RNA, 14 nt, Homo sapiens
caccaucacagcuu

SEQ ID NO: 1904998 - RNA, 14 nt, Homo sapiens
cucucucuacagag

SEQ ID NO: 1904999 - RNA, 14 nt, Homo sapiens
uguugaaacacuuu

SEQ ID NO: 1905000 - RNA, 12 nt, Homo sapiens
aaguuacuuugu

SEQ ID NO: 1905001 - RNA, 12 nt, Homo sapiens
uauuuacuauuu

SEQ ID NO: 1905002 - RNA, 18 nt, Homo sapiens
ucucauguuugugcaugu

SEQ ID NO: 1905003 - RNA, 17 nt, Homo sapiens
aaauguuauuguccuca

SEQ ID NO: 1905004 - RNA, 20 nt, Homo sapiens
ccuguuaaauggggagacaa

SEQ ID NO: 1905005 - RNA, 18 nt, Homo sapiens
cuauugcucuuacuugaa

SEQ ID NO: 1905006 - RNA, 15 nt, Homo sapiens
auauaauuacuuaau

SEQ ID NO: 1905007 - RNA, 15 nt, Homo sapiens
auaaauauacuaaua

SEQ ID NO: 1905008 - RNA, 16 nt, Homo sapiens
aaaaugacaaacauga

SEQ ID NO: 1905009 - RNA, 16 nt, Homo sapiens
ccacugacccaaauga

SEQ ID NO: 1905010 - RNA, 14 nt, Homo sapiens
cagcugauuugcag

SEQ ID NO: 1905011 - RNA, 12 nt, Homo sapiens
ccacacugggac

SEQ ID NO: 1905012 - RNA, 17 nt, Homo sapiens
cugaaacccaaagcccu

SEQ ID NO: 1905013 - RNA, 16 nt, Homo sapiens
auuucauguacugcau

SEQ ID NO: 1905014 - RNA, 22 nt, Homo sapiens
ggaaggagaggagaggggcaca

SEQ ID NO: 1905015 - RNA, 20 nt, Homo sapiens
cauggcaccugucgcccagu

SEQ ID NO: 1905016 - RNA, 12 nt, Homo sapiens
cagguaucuuuu

SEQ ID NO: 1905017 - RNA, 12 nt, Homo sapiens
gaauaaggccuu

SEQ ID NO: 1905018 - RNA, 15 nt, Homo sapiens
cuccuguagcacaaa

SEQ ID NO: 1905019 - RNA, 17 nt, Homo sapiens
cuauuuugcaugcugaa

SEQ ID NO: 1905020 - RNA, 16 nt, Homo sapiens
ucauuuauucaaguau

SEQ ID NO: 1905021 - RNA, 22 nt, Homo sapiens
aauaaaugaccaguuuaccuga

SEQ ID NO: 1905022 - RNA, 14 nt, Homo sapiens
gacuuaucugaucu

SEQ ID NO: 1905023 - RNA, 21 nt, Homo sapiens
uuuauuguaaaacagcuaaau

SEQ ID NO: 1905024 - RNA, 22 nt, Homo sapiens
ccauggagacaagggcaucauc

SEQ ID NO: 1905025 - RNA, 18 nt, Homo sapiens
auguucagacauuuaugu

SEQ ID NO: 1905026 - RNA, 17 nt, Homo sapiens
aauguuuuguaaacuuu

SEQ ID NO: 1905027 - RNA, 22 nt, Homo sapiens
accugccuuaacacacacaccu

SEQ ID NO: 1905028 - RNA, 21 nt, Homo sapiens
cugaguccuuuccaggggcca

SEQ ID NO: 1905029 - RNA, 16 nt, Homo sapiens
accuaacccucuguca

SEQ ID NO: 1905030 - RNA, 16 nt, Homo sapiens
accaaacacucagucc

SEQ ID NO: 1905031 - RNA, 17 nt, Homo sapiens
ucaagaagucacuguca

SEQ ID NO: 1905032 - RNA, 17 nt, Homo sapiens
ucauguauaguuuuccc

SEQ ID NO: 1905033 - RNA, 19 nt, Homo sapiens
cugccccccuccuuuccaa

SEQ ID NO: 1905034 - RNA, 16 nt, Homo sapiens
cguuuugaagacgugg

SEQ ID NO: 1905035 - RNA, 20 nt, Homo sapiens
guuauaagcagcaagacaaa

SEQ ID NO: 1905036 - RNA, 13 nt, Homo sapiens
aaucaaagccacu

SEQ ID NO: 1905037 - RNA, 13 nt, Homo sapiens
ucuuggugaagau

SEQ ID NO: 1905038 - RNA, 16 nt, Homo sapiens
cauccaucaugcaaaa

SEQ ID NO: 1905039 - RNA, 18 nt, Homo sapiens
auaaauugguuccugaga

SEQ ID NO: 1905040 - RNA, 17 nt, Homo sapiens
agcgaugggcaucacac

SEQ ID NO: 1905041 - RNA, 23 nt, Homo sapiens
ucuucucaaguucuaagauucua

SEQ ID NO: 1905042 - RNA, 16 nt, Homo sapiens
acacgccuucaugcca

SEQ ID NO: 1905043 - RNA, 14 nt, Homo sapiens
auacuccuaguaau

SEQ ID NO: 1905044 - RNA, 13 nt, Homo sapiens
aggaaacaguucu

SEQ ID NO: 1905045 - RNA, 19 nt, Homo sapiens
acauuucuuaaaacuuuau

SEQ ID NO: 1905046 - RNA, 13 nt, Homo sapiens
aaaguacagaaaa

SEQ ID NO: 1905047 - RNA, 21 nt, Homo sapiens
auugagcgucugcagaaagaa

SEQ ID NO: 1905048 - RNA, 21 nt, Homo sapiens
cugcagcgagccccccaugua

SEQ ID NO: 1905049 - RNA, 12 nt, Homo sapiens
cauuccaugacu

SEQ ID NO: 1905050 - RNA, 20 nt, Homo sapiens
aggaggaacugguccaggcc

SEQ ID NO: 1905051 - RNA, 19 nt, Homo sapiens
ccugcauuucucuucucag

SEQ ID NO: 1905052 - RNA, 15 nt, Homo sapiens
cuuuuacagcucuug

SEQ ID NO: 1905053 - RNA, 19 nt, Homo sapiens
uccaaaaauagucaaaaau

SEQ ID NO: 1905054 - RNA, 12 nt, Homo sapiens
cuuggcuuuaug

SEQ ID NO: 1905055 - RNA, 15 nt, Homo sapiens
gcggggaucugauga

SEQ ID NO: 1905056 - RNA, 14 nt, Homo sapiens
uaugaaaagaauuu

SEQ ID NO: 1905057 - RNA, 12 nt, Homo sapiens
ucaaaagaucaa

SEQ ID NO: 1905058 - RNA, 18 nt, Homo sapiens
ucaaaacauugugccaug

SEQ ID NO: 1905059 - RNA, 17 nt, Homo sapiens
uggaaaucaacccucuc

SEQ ID NO: 1905060 - RNA, 19 nt, Homo sapiens
uagaaagcauuuugggauc

SEQ ID NO: 1905061 - RNA, 12 nt, Homo sapiens
uauuuuaaauac

SEQ ID NO: 1905062 - RNA, 21 nt, Homo sapiens
gccaccacccacaaucacaag

SEQ ID NO: 1905063 - RNA, 20 nt, Homo sapiens
uggcgagugaaugccagugu

SEQ ID NO: 1905064 - RNA, 14 nt, Homo sapiens
gcaaaucagucuca

SEQ ID NO: 1905065 - RNA, 20 nt, Homo sapiens
aagaaguuguuugaggcaaa

SEQ ID NO: 1905066 - RNA, 13 nt, Homo sapiens
cuaagaguuuucu

SEQ ID NO: 1905067 - RNA, 23 nt, Homo sapiens
cagggagcaacucuccacuccau

SEQ ID NO: 1905068 - RNA, 15 nt, Homo sapiens
uaacuuagcacuacu

SEQ ID NO: 1905069 - RNA, 17 nt, Homo sapiens
acuuaaagcuacuguag

SEQ ID NO: 1905070 - RNA, 17 nt, Homo sapiens
ccucauccaugcacuuu

SEQ ID NO: 1905071 - RNA, 20 nt, Homo sapiens
ucguaauggguauauugaua

SEQ ID NO: 1905072 - RNA, 18 nt, Homo sapiens
gaugagggaauccuguca

SEQ ID NO: 1905073 - RNA, 17 nt, Homo sapiens
uaaaaagaaaugugauu

SEQ ID NO: 1905074 - RNA, 14 nt, Homo sapiens
cagcccaugugcac

SEQ ID NO: 1905075 - RNA, 22 nt, Homo sapiens
uaggcgggaugggcucgcugaa

SEQ ID NO: 1905076 - RNA, 21 nt, Homo sapiens
auuguucacuucuaaaccaaa

SEQ ID NO: 1905077 - RNA, 23 nt, Homo sapiens
caagucuuaguacauccucacuu

SEQ ID NO: 1905078 - RNA, 23 nt, Homo sapiens
uggauccuccccgacuguggcua

SEQ ID NO: 1905079 - RNA, 23 nt, Homo sapiens
uuacuguucuaaggcugugccau

SEQ ID NO: 1905080 - RNA, 20 nt, Homo sapiens
uccauuuauucuuugaucuu

SEQ ID NO: 1905081 - RNA, 12 nt, Homo sapiens
ggaucacagaca

SEQ ID NO: 1905082 - RNA, 17 nt, Homo sapiens
ccugagcuggggaagcc

SEQ ID NO: 1905083 - RNA, 17 nt, Homo sapiens
uuauuauggcacaucag

SEQ ID NO: 1905084 - RNA, 16 nt, Homo sapiens
uauguagauauuuggc

SEQ ID NO: 1905085 - RNA, 20 nt, Homo sapiens
ugcagaacaaacaaggcauu

SEQ ID NO: 1905086 - RNA, 22 nt, Homo sapiens
gggcaguucgcagccacccuga

SEQ ID NO: 1905087 - RNA, 21 nt, Homo sapiens
ggaucagccuccgccauucca

SEQ ID NO: 1905088 - RNA, 14 nt, Homo sapiens
ccuuucucauccca

SEQ ID NO: 1905089 - RNA, 19 nt, Homo sapiens
gaaugcaaaguagcaauuu

SEQ ID NO: 1905090 - RNA, 22 nt, Homo sapiens
agcuccuggccaggauaauaua

SEQ ID NO: 1905091 - RNA, 19 nt, Homo sapiens
gccuauuugcugaccacac

SEQ ID NO: 1905092 - RNA, 13 nt, Homo sapiens
acaaaccaaccau

SEQ ID NO: 1905093 - RNA, 20 nt, Homo sapiens
uacacacauauauauuacaa

SEQ ID NO: 1905094 - RNA, 20 nt, Homo sapiens
cguaccaccaugcacuguaa

SEQ ID NO: 1905095 - RNA, 16 nt, Homo sapiens
gugcugccaguccucu

SEQ ID NO: 1905096 - RNA, 21 nt, Homo sapiens
cccuguguguuugacauguga

SEQ ID NO: 1905097 - RNA, 23 nt, Homo sapiens
ccuuggauauaccuagauuccau

SEQ ID NO: 1905098 - RNA, 23 nt, Homo sapiens
caauccuaagcaaaaagaacaaa

SEQ ID NO: 1905099 - RNA, 22 nt, Homo sapiens
aauuugacugguucaccugugu

SEQ ID NO: 1905100 - RNA, 18 nt, Homo sapiens
uauguaacuuccugugga

SEQ ID NO: 1905101 - RNA, 15 nt, Homo sapiens
guauuuuguuagcau

SEQ ID NO: 1905102 - RNA, 16 nt, Homo sapiens
uugucuuaaggucaua

SEQ ID NO: 1905103 - RNA, 18 nt, Homo sapiens
acgcucugcugugggcac

SEQ ID NO: 1905104 - RNA, 18 nt, Homo sapiens
ccuaaggacuucuuuaau

SEQ ID NO: 1905105 - RNA, 20 nt, Homo sapiens
uuucaauaacaaagcacaua

SEQ ID NO: 1905106 - RNA, 16 nt, Homo sapiens
gcccgcugcgugccau

SEQ ID NO: 1905107 - RNA, 14 nt, Homo sapiens
uugcccaugugaaa

SEQ ID NO: 1905108 - RNA, 17 nt, Homo sapiens
cagugccucaccuucca

SEQ ID NO: 1905109 - RNA, 15 nt, Homo sapiens
uucaaaucuguaauu

SEQ ID NO: 1905110 - RNA, 23 nt, Homo sapiens
aaacucuguccacgauucacuca

SEQ ID NO: 1905111 - RNA, 18 nt, Homo sapiens
aaguuaaacuuuaucuca

SEQ ID NO: 1905112 - RNA, 13 nt, Homo sapiens
auguaguauacac

SEQ ID NO: 1905113 - RNA, 16 nt, Homo sapiens
uauuauguuccucaag

SEQ ID NO: 1905114 - RNA, 21 nt, Homo sapiens
cuggaccugcccugggccaca

SEQ ID NO: 1905115 - RNA, 13 nt, Homo sapiens
guggaccugugua

SEQ ID NO: 1905116 - RNA, 18 nt, Homo sapiens
auaaacaucugaucugua

SEQ ID NO: 1905117 - RNA, 14 nt, Homo sapiens
agcucuucugggca

SEQ ID NO: 1905118 - RNA, 21 nt, Homo sapiens
cugauauugccgcacuagggg

SEQ ID NO: 1905119 - RNA, 13 nt, Homo sapiens
aucccugccacug

SEQ ID NO: 1905120 - RNA, 17 nt, Homo sapiens
aagccucagaaagggau

SEQ ID NO: 1905121 - RNA, 21 nt, Homo sapiens
agggcggccagggacccaaag

SEQ ID NO: 1905122 - RNA, 16 nt, Homo sapiens
guaucucucuguggug

SEQ ID NO: 1905123 - RNA, 17 nt, Homo sapiens
caugaucaucacaauca

SEQ ID NO: 1905124 - RNA, 14 nt, Homo sapiens
gagcaacucuccac

SEQ ID NO: 1905125 - RNA, 23 nt, Homo sapiens
acauuaggggguuuguugcacag

SEQ ID NO: 1905126 - RNA, 17 nt, Homo sapiens
accaacuggagcacuga

SEQ ID NO: 1905127 - RNA, 19 nt, Homo sapiens
cagugugcauaauuuugcc

SEQ ID NO: 1905128 - RNA, 14 nt, Homo sapiens
uuugauucagacag

SEQ ID NO: 1905129 - RNA, 14 nt, Homo sapiens
uucaaucuguaaac

SEQ ID NO: 1905130 - RNA, 14 nt, Homo sapiens
cuaaagguuaccug

SEQ ID NO: 1905131 - RNA, 13 nt, Homo sapiens
cacaugggaucaa

SEQ ID NO: 1905132 - RNA, 19 nt, Homo sapiens
aguggcuggugcccaugaa

SEQ ID NO: 1905133 - RNA, 21 nt, Homo sapiens
guggcaucagugucuuuccac

SEQ ID NO: 1905134 - RNA, 15 nt, Homo sapiens
augacaaacccagga

SEQ ID NO: 1905135 - RNA, 22 nt, Homo sapiens
ugcggugccuccucuugacuuc

SEQ ID NO: 1905136 - RNA, 18 nt, Homo sapiens
aagaaaucauggcauuca

SEQ ID NO: 1905137 - RNA, 16 nt, Homo sapiens
cuaguuucuuacacac

SEQ ID NO: 1905138 - RNA, 20 nt, Homo sapiens
agccggcugcggcacugugc

SEQ ID NO: 1905139 - RNA, 17 nt, Homo sapiens
ccuccuagacucuguga

SEQ ID NO: 1905140 - RNA, 12 nt, Homo sapiens
uagcauucugug

SEQ ID NO: 1905141 - RNA, 21 nt, Homo sapiens
cuuucacacuuccaccagccu

SEQ ID NO: 1905142 - RNA, 18 nt, Homo sapiens
guugaggggcuccuggaa

SEQ ID NO: 1905143 - RNA, 16 nt, Homo sapiens
uuaaauuaauauugau

SEQ ID NO: 1905144 - RNA, 15 nt, Homo sapiens
agaucuaauaccauc

SEQ ID NO: 1905145 - RNA, 12 nt, Homo sapiens
gucagcaucuuu

SEQ ID NO: 1905146 - RNA, 22 nt, Homo sapiens
uucaagguuuguucaacaucua

SEQ ID NO: 1905147 - RNA, 12 nt, Homo sapiens
agucuugcucug

SEQ ID NO: 1905148 - RNA, 14 nt, Homo sapiens
uaacccuuauucca

SEQ ID NO: 1905149 - RNA, 16 nt, Homo sapiens
ucuggaagucaucuca

SEQ ID NO: 1905150 - RNA, 18 nt, Homo sapiens
aaaaugccucaguguauu

SEQ ID NO: 1905151 - RNA, 12 nt, Homo sapiens
cugaauguucug

SEQ ID NO: 1905152 - RNA, 16 nt, Homo sapiens
uggauggacagaauga

SEQ ID NO: 1905153 - RNA, 15 nt, Homo sapiens
uccuuucucuguaua

SEQ ID NO: 1905154 - RNA, 16 nt, Homo sapiens
uggaacuguacacuug

SEQ ID NO: 1905155 - RNA, 13 nt, Homo sapiens
cccggaguucagu

SEQ ID NO: 1905156 - RNA, 20 nt, Homo sapiens
gagggggccuucacagugac

SEQ ID NO: 1905157 - RNA, 14 nt, Homo sapiens
ccucugcuuccuga

SEQ ID NO: 1905158 - RNA, 16 nt, Homo sapiens
uguaacaugaagcaaa

SEQ ID NO: 1905159 - RNA, 17 nt, Homo sapiens
gggccaggggugggagc

SEQ ID NO: 1905160 - RNA, 14 nt, Homo sapiens
guuuaccaucugaa

SEQ ID NO: 1905161 - RNA, 21 nt, Homo sapiens
uaggcucuuaugugugccuuu

SEQ ID NO: 1905162 - RNA, 11 nt, Homo sapiens
guugcucugac

SEQ ID NO: 1905163 - RNA, 13 nt, Homo sapiens
aguccugacacug

SEQ ID NO: 1905164 - RNA, 14 nt, Homo sapiens
ccauuagccggacu

SEQ ID NO: 1905165 - RNA, 19 nt, Homo sapiens
gcaccugcagccaagcaaa

SEQ ID NO: 1905166 - RNA, 19 nt, Homo sapiens
uaagaauucuguacuucca

SEQ ID NO: 1905167 - RNA, 18 nt, Homo sapiens
ccuucaaccccacuuccu

SEQ ID NO: 1905168 - RNA, 22 nt, Homo sapiens
ccuggaggacagagggagacag

SEQ ID NO: 1905169 - RNA, 17 nt, Homo sapiens
cacagggccaacuugag

SEQ ID NO: 1905170 - RNA, 15 nt, Homo sapiens
ccaaaagcaguaaau

SEQ ID NO: 1905171 - RNA, 14 nt, Homo sapiens
auaaaagcacuuau

SEQ ID NO: 1905172 - RNA, 12 nt, Homo sapiens
acugccaaaaag

SEQ ID NO: 1905173 - RNA, 13 nt, Homo sapiens
cacacgcaguauu

SEQ ID NO: 1905174 - RNA, 17 nt, Homo sapiens
ucucuccacuuucagcu

SEQ ID NO: 1905175 - RNA, 18 nt, Homo sapiens
cugguguaugcacagggu

SEQ ID NO: 1905176 - RNA, 16 nt, Homo sapiens
caccaaacccggccug

SEQ ID NO: 1905177 - RNA, 20 nt, Homo sapiens
gcuccgacugccgcugagaa

SEQ ID NO: 1905178 - RNA, 16 nt, Homo sapiens
ugggcaaugaaaccaa

SEQ ID NO: 1905179 - RNA, 11 nt, Homo sapiens
cuuuucuugcc

SEQ ID NO: 1905180 - RNA, 21 nt, Homo sapiens
uaggcaucugcuguaauaaua

SEQ ID NO: 1905181 - RNA, 21 nt, Homo sapiens
caggggguaggagagcacugc

SEQ ID NO: 1905182 - RNA, 18 nt, Homo sapiens
caaauuagguuuuguaca

SEQ ID NO: 1905183 - RNA, 13 nt, Homo sapiens
gcaggaccgccau

SEQ ID NO: 1905184 - RNA, 23 nt, Homo sapiens
cgugauggcaggugccuguaauc

SEQ ID NO: 1905185 - RNA, 22 nt, Homo sapiens
agcaguuuaugagacagcugag

SEQ ID NO: 1905186 - RNA, 12 nt, Homo sapiens
aggacuuucauu

SEQ ID NO: 1905187 - RNA, 23 nt, Homo sapiens
cuccagugaguaccugcaaaaau

SEQ ID NO: 1905188 - RNA, 16 nt, Homo sapiens
ccguggccuaccuggg

SEQ ID NO: 1905189 - RNA, 18 nt, Homo sapiens
guuugugcucuacuguua

SEQ ID NO: 1905190 - RNA, 20 nt, Homo sapiens
ucuuaauucaacuaguacca

SEQ ID NO: 1905191 - RNA, 22 nt, Homo sapiens
acaugcaaaaagaaaugacuaa

SEQ ID NO: 1905192 - RNA, 23 nt, Homo sapiens
cugcaggcuguuuauauguucac

SEQ ID NO: 1905193 - RNA, 19 nt, Homo sapiens
cauuuccacacuaauguau

SEQ ID NO: 1905194 - RNA, 21 nt, Homo sapiens
ccuuugauugcugagagccau

SEQ ID NO: 1905195 - RNA, 13 nt, Homo sapiens
aaaguuugcugua

SEQ ID NO: 1905196 - RNA, 13 nt, Homo sapiens
cauauucuuucac

SEQ ID NO: 1905197 - RNA, 22 nt, Homo sapiens
uggcuguggaccacccuagcac

SEQ ID NO: 1905198 - RNA, 12 nt, Homo sapiens
cacaguuugcaa

SEQ ID NO: 1905199 - RNA, 13 nt, Homo sapiens
caauuauguuaaa

SEQ ID NO: 1905200 - RNA, 21 nt, Homo sapiens
ugacaccccccuucugaauga

SEQ ID NO: 1905201 - RNA, 13 nt, Homo sapiens
gggaccucaggcc

SEQ ID NO: 1905202 - RNA, 21 nt, Homo sapiens
gccacugccuuucagaaguga

SEQ ID NO: 1905203 - RNA, 21 nt, Homo sapiens
aucgugcuguuugccuuggcu

SEQ ID NO: 1905204 - RNA, 15 nt, Homo sapiens
uuuugcucugcucug

SEQ ID NO: 1905205 - RNA, 13 nt, Homo sapiens
guaugaccugggu

SEQ ID NO: 1905206 - RNA, 19 nt, Homo sapiens
augcuuguugcaauugccu

SEQ ID NO: 1905207 - RNA, 23 nt, Homo sapiens
uuaaacaauguccucuuugagaa

SEQ ID NO: 1905208 - RNA, 20 nt, Homo sapiens
aauuuaucaaacccuagccu

SEQ ID NO: 1905209 - RNA, 18 nt, Homo sapiens
aacucacuagaugccaau

SEQ ID NO: 1905210 - RNA, 13 nt, Homo sapiens
aauaccaauguuc

SEQ ID NO: 1905211 - RNA, 13 nt, Homo sapiens
uacaucaaagcuu

SEQ ID NO: 1905212 - RNA, 15 nt, Homo sapiens
augcaaaugcacuca

SEQ ID NO: 1905213 - RNA, 22 nt, Homo sapiens
gggcgguccuacugcugugagc

SEQ ID NO: 1905214 - RNA, 22 nt, Homo sapiens
cgauugaaauuuugcaccagcg

SEQ ID NO: 1905215 - RNA, 13 nt, Homo sapiens
acacacagucuca

SEQ ID NO: 1905216 - RNA, 19 nt, Homo sapiens
ucaggccuugccugggaua

SEQ ID NO: 1905217 - RNA, 22 nt, Homo sapiens
uuucuacuuugaagucauacca

SEQ ID NO: 1905218 - RNA, 14 nt, Homo sapiens
aaaagaacuguauu

SEQ ID NO: 1905219 - RNA, 13 nt, Homo sapiens
aaguggcauuucu

SEQ ID NO: 1905220 - RNA, 16 nt, Homo sapiens
uggcacuuuaaugaua

SEQ ID NO: 1905221 - RNA, 18 nt, Homo sapiens
aauauaaguaaugaaggc

SEQ ID NO: 1905222 - RNA, 17 nt, Homo sapiens
agucuuuuucaguuccu

SEQ ID NO: 1905223 - RNA, 15 nt, Homo sapiens
ugcuucgccagccag

SEQ ID NO: 1905224 - RNA, 22 nt, Homo sapiens
cuaggacuuaaccuugaaaugg

SEQ ID NO: 1905225 - RNA, 15 nt, Homo sapiens
gagagcaccuggugg

SEQ ID NO: 1905226 - RNA, 20 nt, Homo sapiens
uuacaacccagggugugaac

SEQ ID NO: 1905227 - RNA, 23 nt, Homo sapiens
uuagaguggauagaaaauuaugc

SEQ ID NO: 1905228 - RNA, 21 nt, Homo sapiens
aaccaaaaggccguguguuua

SEQ ID NO: 1905229 - RNA, 18 nt, Homo sapiens
augauaguaggccuucaa

SEQ ID NO: 1905230 - RNA, 18 nt, Homo sapiens
gccaccucucacacuggc

SEQ ID NO: 1905231 - RNA, 18 nt, Homo sapiens
auaaacaguaaugacucu

SEQ ID NO: 1905232 - RNA, 18 nt, Homo sapiens
cuuaggcagggcucucuu

SEQ ID NO: 1905233 - RNA, 15 nt, Homo sapiens
auugauguuuaguuu

SEQ ID NO: 1905234 - RNA, 14 nt, Homo sapiens
aacuuucccuccac

SEQ ID NO: 1905235 - RNA, 20 nt, Homo sapiens
caugauuucugugaagcaaa

SEQ ID NO: 1905236 - RNA, 21 nt, Homo sapiens
acuauucaaucuuuacacaau

SEQ ID NO: 1905237 - RNA, 20 nt, Homo sapiens
ucuaaaguugcuccauacaa

SEQ ID NO: 1905238 - RNA, 16 nt, Homo sapiens
ggauaacucacuggaa

SEQ ID NO: 1905239 - RNA, 17 nt, Homo sapiens
agauauugauuacuauc

SEQ ID NO: 1905240 - RNA, 20 nt, Homo sapiens
uucgucuucgcccucugaaa

SEQ ID NO: 1905241 - RNA, 18 nt, Homo sapiens
ucaaauuuuuacugagaa

SEQ ID NO: 1905242 - RNA, 18 nt, Homo sapiens
uaguaagggaacuaugga

SEQ ID NO: 1905243 - RNA, 18 nt, Homo sapiens
cugauucagcacuuugcu

SEQ ID NO: 1905244 - RNA, 19 nt, Homo sapiens
ugugaggauagagacuugc

SEQ ID NO: 1905245 - RNA, 18 nt, Homo sapiens
guuaaugucccauuucac

SEQ ID NO: 1905246 - RNA, 20 nt, Homo sapiens
gucugccagcauaugcagag

SEQ ID NO: 1905247 - RNA, 21 nt, Homo sapiens
aaugcuagcugcaagugacau

SEQ ID NO: 1905248 - RNA, 13 nt, Homo sapiens
ucgcuugcuggaa

SEQ ID NO: 1905249 - RNA, 18 nt, Homo sapiens
acaggcauuccagaauua

SEQ ID NO: 1905250 - RNA, 15 nt, Homo sapiens
cuggucuauaccuua

SEQ ID NO: 1905251 - RNA, 23 nt, Homo sapiens
gcuuggcucccgaaugucgcauu

SEQ ID NO: 1905252 - RNA, 22 nt, Homo sapiens
aagaucauugccaucaccauuu

SEQ ID NO: 1905253 - RNA, 20 nt, Homo sapiens
agggagaacuugaaacagau

SEQ ID NO: 1905254 - RNA, 22 nt, Homo sapiens
cuagcuauuggccucccaaaag

SEQ ID NO: 1905255 - RNA, 17 nt, Homo sapiens
gacugcuaccucugaga

SEQ ID NO: 1905256 - RNA, 14 nt, Homo sapiens
cuuccucccauuca

SEQ ID NO: 1905257 - RNA, 22 nt, Homo sapiens
auuaugaagaauacccaggaag

SEQ ID NO: 1905258 - RNA, 16 nt, Homo sapiens
aggagacacaacaacu

SEQ ID NO: 1905259 - RNA, 14 nt, Homo sapiens
uuuaaaaaaccaug

SEQ ID NO: 1905260 - RNA, 14 nt, Homo sapiens
acucugaauuccaa

SEQ ID NO: 1905261 - RNA, 13 nt, Homo sapiens
aucucucuacucc

SEQ ID NO: 1905262 - RNA, 14 nt, Homo sapiens
uacaaccugaaugg

SEQ ID NO: 1905263 - RNA, 22 nt, Homo sapiens
uggccgaaccccccacucccug

SEQ ID NO: 1905264 - RNA, 19 nt, Homo sapiens
cuuauccguuagccguggu

SEQ ID NO: 1905265 - RNA, 16 nt, Homo sapiens
acuuguauugcuaaaa

SEQ ID NO: 1905266 - RNA, 15 nt, Homo sapiens
gcucuccuucacucu

SEQ ID NO: 1905267 - RNA, 15 nt, Homo sapiens
ucaaaacugcuaaau

SEQ ID NO: 1905268 - RNA, 22 nt, Homo sapiens
gguuugagaauguuuuuagcug

SEQ ID NO: 1905269 - RNA, 16 nt, Homo sapiens
cucaauccauguucua

SEQ ID NO: 1905270 - RNA, 16 nt, Homo sapiens
ccacccccaaugcaca

SEQ ID NO: 1905271 - RNA, 10 nt, Homo sapiens
uugggcuccg

SEQ ID NO: 1905272 - RNA, 10 nt, Homo sapiens
uggggcuccu

SEQ ID NO: 1905273 - RNA, 12 nt, Homo sapiens
ggaugagucaga

SEQ ID NO: 1905274 - RNA, 14 nt, Homo sapiens
caccugaagugaga

SEQ ID NO: 1905275 - RNA, 19 nt, Homo sapiens
uggaaauucugaaaacuga

SEQ ID NO: 1905276 - RNA, 18 nt, Homo sapiens
gcaagucaaauaccacau

SEQ ID NO: 1905277 - RNA, 17 nt, Homo sapiens
cuguccccacacugacc

SEQ ID NO: 1905278 - RNA, 16 nt, Homo sapiens
aauaaagucaaaucaa

SEQ ID NO: 1905279 - RNA, 13 nt, Homo sapiens
auuaggaugguga

SEQ ID NO: 1905280 - RNA, 19 nt, Homo sapiens
caccaauuaaguguugaaa

SEQ ID NO: 1905281 - RNA, 22 nt, Homo sapiens
uguucccccuaaacauggcugu

SEQ ID NO: 1905282 - RNA, 18 nt, Homo sapiens
gagggcagaggugaucac

SEQ ID NO: 1905283 - RNA, 15 nt, Homo sapiens
aaaauaaaaccacca

SEQ ID NO: 1905284 - RNA, 21 nt, Homo sapiens
aggaaaaauucaauaguaaua

SEQ ID NO: 1905285 - RNA, 16 nt, Homo sapiens
aauucaaugucuuaaa

SEQ ID NO: 1905286 - RNA, 19 nt, Homo sapiens
gauggggaaggugugugaa

SEQ ID NO: 1905287 - RNA, 15 nt, Homo sapiens
uagaacaagccagag

SEQ ID NO: 1905288 - RNA, 22 nt, Homo sapiens
uaaauaaaacagcagcagcaaa

SEQ ID NO: 1905289 - RNA, 18 nt, Homo sapiens
aauaaagccacuuuccuc

SEQ ID NO: 1905290 - RNA, 17 nt, Homo sapiens
uccucacugcugauuau

SEQ ID NO: 1905291 - RNA, 23 nt, Homo sapiens
gguuguggcaaaagccacauuac

SEQ ID NO: 1905292 - RNA, 16 nt, Homo sapiens
aucuauaguucacuga

SEQ ID NO: 1905293 - RNA, 20 nt, Homo sapiens
guuuauuugaggagauaaca

SEQ ID NO: 1905294 - RNA, 14 nt, Homo sapiens
gugucugggcucaa

SEQ ID NO: 1905295 - RNA, 23 nt, Homo sapiens
gagagggagucagucuucacuug

SEQ ID NO: 1905296 - RNA, 18 nt, Homo sapiens
uuuagcaggguacauauu

SEQ ID NO: 1905297 - RNA, 19 nt, Homo sapiens
auaggccaucaauaucaca

SEQ ID NO: 1905298 - RNA, 15 nt, Homo sapiens
aaguaaguaguuucc

SEQ ID NO: 1905299 - RNA, 19 nt, Homo sapiens
cuucugcuuaaucugagaa

SEQ ID NO: 1905300 - RNA, 15 nt, Homo sapiens
agucucucauucuag

SEQ ID NO: 1905301 - RNA, 21 nt, Homo sapiens
acacugucaauggacugcacc

SEQ ID NO: 1905302 - RNA, 20 nt, Homo sapiens
aaucuaucuaguacuuccca

SEQ ID NO: 1905303 - RNA, 19 nt, Homo sapiens
cucugaacuaggugaucuc

SEQ ID NO: 1905304 - RNA, 22 nt, Homo sapiens
ggugcagaguguuuaccuggug

SEQ ID NO: 1905305 - RNA, 16 nt, Homo sapiens
uuaaguaaaaaauaua

SEQ ID NO: 1905306 - RNA, 20 nt, Homo sapiens
uguaacuguuaccauuggaa

SEQ ID NO: 1905307 - RNA, 17 nt, Homo sapiens
gaaaaguacuaauagaa

SEQ ID NO: 1905308 - RNA, 17 nt, Homo sapiens
ugggcaacauagugaga

SEQ ID NO: 1905309 - RNA, 21 nt, Homo sapiens
aucaguuagagcugacacaaa

SEQ ID NO: 1905310 - RNA, 13 nt, Homo sapiens
aacaagccugaaa

SEQ ID NO: 1905311 - RNA, 22 nt, Homo sapiens
acauguuuuagacagagacaau

SEQ ID NO: 1905312 - RNA, 19 nt, Homo sapiens
aauaaaauguuuauagcau

SEQ ID NO: 1905313 - RNA, 23 nt, Homo sapiens
uacaacccgguucacucuucuca

SEQ ID NO: 1905314 - RNA, 16 nt, Homo sapiens
cucuauuuuuacauuu

SEQ ID NO: 1905315 - RNA, 23 nt, Homo sapiens
uauaugauggggcaugugccaua

SEQ ID NO: 1905316 - RNA, 20 nt, Homo sapiens
uauauuaaaauaagcacugu

SEQ ID NO: 1905317 - RNA, 20 nt, Homo sapiens
caucuuuguuggcucagaaa

SEQ ID NO: 1905318 - RNA, 14 nt, Homo sapiens
cccuuauacagugg

SEQ ID NO: 1905319 - RNA, 18 nt, Homo sapiens
aucaccauguaacaacca

SEQ ID NO: 1905320 - RNA, 18 nt, Homo sapiens
cugugucauuaaccaucu

SEQ ID NO: 1905321 - RNA, 18 nt, Homo sapiens
aacuuuagcaacaguuau

SEQ ID NO: 1905322 - RNA, 21 nt, Homo sapiens
uauuuucagugcuuugcccuu

SEQ ID NO: 1905323 - RNA, 12 nt, Homo sapiens
ugugcuuucauc

SEQ ID NO: 1905324 - RNA, 17 nt, Homo sapiens
cucugagucaaauccag

SEQ ID NO: 1905325 - RNA, 19 nt, Homo sapiens
gcagcaaccagagcacugu

SEQ ID NO: 1905326 - RNA, 17 nt, Homo sapiens
uccucaguuacacaaag

SEQ ID NO: 1905327 - RNA, 14 nt, Homo sapiens
gccaggaccauggc

SEQ ID NO: 1905328 - RNA, 16 nt, Homo sapiens
gauugaaauuccaguu

SEQ ID NO: 1905329 - RNA, 13 nt, Homo sapiens
uccuggacaguuu

SEQ ID NO: 1905330 - RNA, 14 nt, Homo sapiens
gcuugcaugccaaa

SEQ ID NO: 1905331 - RNA, 13 nt, Homo sapiens
aaccaaaacagag

SEQ ID NO: 1905332 - RNA, 20 nt, Homo sapiens
ucauggacuccaggauccuc

SEQ ID NO: 1905333 - RNA, 18 nt, Homo sapiens
ggcuguggccuaaccugc

SEQ ID NO: 1905334 - RNA, 18 nt, Homo sapiens
ugagaaagacuauucaaa

SEQ ID NO: 1905335 - RNA, 10 nt, Homo sapiens
ugcaugcaca

SEQ ID NO: 1905336 - RNA, 12 nt, Homo sapiens
agaguagucaug

SEQ ID NO: 1905337 - RNA, 14 nt, Homo sapiens
gccagguaccuucu

SEQ ID NO: 1905338 - RNA, 21 nt, Homo sapiens
cuccaagcugcauggcaaguu

SEQ ID NO: 1905339 - RNA, 17 nt, Homo sapiens
caauaauugcagaacua

SEQ ID NO: 1905340 - RNA, 20 nt, Homo sapiens
ccaaagaaccccaggcaaua

SEQ ID NO: 1905341 - RNA, 24 nt, Homo sapiens
gguccagauuguagcucuuagucc

SEQ ID NO: 1905342 - RNA, 22 nt, Homo sapiens
cauuaucuugcagcuguaaaca

SEQ ID NO: 1905343 - RNA, 18 nt, Homo sapiens
aagauuuuugaaaauccu

SEQ ID NO: 1905344 - RNA, 17 nt, Homo sapiens
accagccccacugccag

SEQ ID NO: 1905345 - RNA, 16 nt, Homo sapiens
uuauuuguagucuaau

SEQ ID NO: 1905346 - RNA, 16 nt, Homo sapiens
ugccuucaacacagcu

SEQ ID NO: 1905347 - RNA, 20 nt, Homo sapiens
cugccgcagggguccgggau

SEQ ID NO: 1905348 - RNA, 14 nt, Homo sapiens
aggcaauauggcca

SEQ ID NO: 1905349 - RNA, 20 nt, Homo sapiens
ugccuguucccauucuugca

SEQ ID NO: 1905350 - RNA, 16 nt, Homo sapiens
aaaaggaugugaaaau

SEQ ID NO: 1905351 - RNA, 14 nt, Homo sapiens
uccuggggcuggaa

SEQ ID NO: 1905352 - RNA, 18 nt, Homo sapiens
auacauuguauaggccau

SEQ ID NO: 1905353 - RNA, 21 nt, Homo sapiens
guuuucuucuaaucauaacau

SEQ ID NO: 1905354 - RNA, 19 nt, Homo sapiens
aauguccugacaccugcuu

SEQ ID NO: 1905355 - RNA, 12 nt, Homo sapiens
ugacucacauag

SEQ ID NO: 1905356 - RNA, 13 nt, Homo sapiens
gcuuucucuacua

SEQ ID NO: 1905357 - RNA, 23 nt, Homo sapiens
gccacacccaggggaaggcccug

SEQ ID NO: 1905358 - RNA, 23 nt, Homo sapiens
agugauuuucaaaccucaaauau

SEQ ID NO: 1905359 - RNA, 23 nt, Homo sapiens
cuguccccucuuccuacccugcc

SEQ ID NO: 1905360 - RNA, 15 nt, Homo sapiens
caagugccaucccac

SEQ ID NO: 1905361 - RNA, 13 nt, Homo sapiens
ucauguauguuau

SEQ ID NO: 1905362 - RNA, 23 nt, Homo sapiens
ccagucauuuuauuuuguaauau

SEQ ID NO: 1905363 - RNA, 16 nt, Homo sapiens
aucugccaagcuccuc

SEQ ID NO: 1905364 - RNA, 11 nt, Homo sapiens
auggcacuuuu

SEQ ID NO: 1905365 - RNA, 20 nt, Homo sapiens
auccucaacaacaaaccaaa

SEQ ID NO: 1905366 - RNA, 11 nt, Homo sapiens
agaccuuccac

SEQ ID NO: 1905367 - RNA, 16 nt, Homo sapiens
uagcggaucucacuca

SEQ ID NO: 1905368 - RNA, 15 nt, Homo sapiens
acucauuacugcaaa

SEQ ID NO: 1905369 - RNA, 21 nt, Homo sapiens
ccuuaaagaaaauugcaugaa

SEQ ID NO: 1905370 - RNA, 16 nt, Homo sapiens
aacugugcuccucacu

SEQ ID NO: 1905371 - RNA, 21 nt, Homo sapiens
acccuuuggccccacuuugaa

SEQ ID NO: 1905372 - RNA, 17 nt, Homo sapiens
ucucugaacuaggugau

SEQ ID NO: 1905373 - RNA, 17 nt, Homo sapiens
agaaaaauaaaucuguu

SEQ ID NO: 1905374 - RNA, 21 nt, Homo sapiens
caacaauaaaaaccaaauuau

SEQ ID NO: 1905375 - RNA, 14 nt, Homo sapiens
ucaagauauggaag

SEQ ID NO: 1905376 - RNA, 16 nt, Homo sapiens
guaaagaaaaaaacuu

SEQ ID NO: 1905377 - RNA, 19 nt, Homo sapiens
cacccccaugauccaauca

SEQ ID NO: 1905378 - RNA, 19 nt, Homo sapiens
agugacagcuuucugggau

SEQ ID NO: 1905379 - RNA, 18 nt, Homo sapiens
acugcuuucuguuccaaa

SEQ ID NO: 1905380 - RNA, 18 nt, Homo sapiens
guccccguaccaccaugc

SEQ ID NO: 1905381 - RNA, 20 nt, Homo sapiens
cuccaaaaggcccuuuucag

SEQ ID NO: 1905382 - RNA, 20 nt, Homo sapiens
gauauuuauugauguuuuca

SEQ ID NO: 1905383 - RNA, 22 nt, Homo sapiens
caucugugcucuccguguuccu

SEQ ID NO: 1905384 - RNA, 15 nt, Homo sapiens
uggcucccaggacac

SEQ ID NO: 1905385 - RNA, 22 nt, Homo sapiens
aggagacagacacacacuggcu

SEQ ID NO: 1905386 - RNA, 23 nt, Homo sapiens
ugcuucuggccuuguaucuugca

SEQ ID NO: 1905387 - RNA, 17 nt, Homo sapiens
ccauugcccuagccagg

SEQ ID NO: 1905388 - RNA, 23 nt, Homo sapiens
gagaaccuaauaagugcuacuuu

SEQ ID NO: 1905389 - RNA, 14 nt, Homo sapiens
cccaacagcacuuu

SEQ ID NO: 1905390 - RNA, 14 nt, Homo sapiens
accaagaucuccaa

SEQ ID NO: 1905391 - RNA, 21 nt, Homo sapiens
gcaaaggaugcgugaguaugu

SEQ ID NO: 1905392 - RNA, 12 nt, Homo sapiens
auguaaccaagc

SEQ ID NO: 1905393 - RNA, 17 nt, Homo sapiens
ugggggugggggguccc

SEQ ID NO: 1905394 - RNA, 16 nt, Homo sapiens
gcugcugagugacagc

SEQ ID NO: 1905395 - RNA, 16 nt, Homo sapiens
gccauggcuccccuuu

SEQ ID NO: 1905396 - RNA, 22 nt, Homo sapiens
agccucagaaggccccagagag

SEQ ID NO: 1905397 - RNA, 16 nt, Homo sapiens
cucagccuccucagua

SEQ ID NO: 1905398 - RNA, 23 nt, Homo sapiens
gaaguggggaccccaccccucau

SEQ ID NO: 1905399 - RNA, 15 nt, Homo sapiens
uacacgucacaaaga

SEQ ID NO: 1905400 - RNA, 15 nt, Homo sapiens
uaacccucacccaca

SEQ ID NO: 1905401 - RNA, 13 nt, Homo sapiens
ucacuuuacuguc

SEQ ID NO: 1905402 - RNA, 18 nt, Homo sapiens
auaucuauaguagucaau

SEQ ID NO: 1905403 - RNA, 17 nt, Homo sapiens
cuaucagcaauacucau

SEQ ID NO: 1905404 - RNA, 10 nt, Homo sapiens
caucagaaag

SEQ ID NO: 1905405 - RNA, 20 nt, Homo sapiens
accaacugcugcugugcaca

SEQ ID NO: 1905406 - RNA, 21 nt, Homo sapiens
uccucugacugaugcuuucag

SEQ ID NO: 1905407 - RNA, 20 nt, Homo sapiens
aucacgucagugcucagaaa

SEQ ID NO: 1905408 - RNA, 18 nt, Homo sapiens
gccugggggcagccucuc

SEQ ID NO: 1905409 - RNA, 18 nt, Homo sapiens
cgggcugggagcucugca

SEQ ID NO: 1905410 - RNA, 19 nt, Homo sapiens
gaacugcuugugcacugga

SEQ ID NO: 1905411 - RNA, 14 nt, Homo sapiens
uugaauuugggaua

SEQ ID NO: 1905412 - RNA, 19 nt, Homo sapiens
auuagcccuuccuugccag

SEQ ID NO: 1905413 - RNA, 22 nt, Homo sapiens
guguauuuauuuuacagcucau

SEQ ID NO: 1905414 - RNA, 15 nt, Homo sapiens
caaaaauguaaaaaa

SEQ ID NO: 1905415 - RNA, 18 nt, Homo sapiens
cagaaccauaaagcauau

SEQ ID NO: 1905416 - RNA, 21 nt, Homo sapiens
augucuuuaagguagcaucau

SEQ ID NO: 1905417 - RNA, 16 nt, Homo sapiens
auaggcugcauaugag

SEQ ID NO: 1905418 - RNA, 19 nt, Homo sapiens
caggaagaucccccagaaa

SEQ ID NO: 1905419 - RNA, 23 nt, Homo sapiens
aagggacuuuggaauucugcuuc

SEQ ID NO: 1905420 - RNA, 23 nt, Homo sapiens
uacuuucccugcacccaucugcu

SEQ ID NO: 1905421 - RNA, 16 nt, Homo sapiens
cuugaccguacucuca

SEQ ID NO: 1905422 - RNA, 14 nt, Homo sapiens
gugauuaugccauu

SEQ ID NO: 1905423 - RNA, 20 nt, Homo sapiens
gauuauuauguuuauuacaa

SEQ ID NO: 1905424 - RNA, 23 nt, Homo sapiens
guguaccucaguucccucuugcu

SEQ ID NO: 1905425 - RNA, 13 nt, Homo sapiens
acacucaugaagc

SEQ ID NO: 1905426 - RNA, 21 nt, Homo sapiens
uaaccaggcugggcucagcuc

SEQ ID NO: 1905427 - RNA, 12 nt, Homo sapiens
cagggagcaccu

SEQ ID NO: 1905428 - RNA, 23 nt, Homo sapiens
cccaucgccagcugaugacucaa

SEQ ID NO: 1905429 - RNA, 16 nt, Homo sapiens
acgagagagucuucca

SEQ ID NO: 1905430 - RNA, 13 nt, Homo sapiens
aaugaagugcaau

SEQ ID NO: 1905431 - RNA, 13 nt, Homo sapiens
aauaaagugcagu

SEQ ID NO: 1905432 - RNA, 14 nt, Homo sapiens
ugaacauauguaau

SEQ ID NO: 1905433 - RNA, 12 nt, Homo sapiens
augacaaugaag

SEQ ID NO: 1905434 - RNA, 19 nt, Homo sapiens
caaaagaaaauauagucac

SEQ ID NO: 1905435 - RNA, 19 nt, Homo sapiens
accuaaaauaauugguucu

SEQ ID NO: 1905436 - RNA, 15 nt, Homo sapiens
aaccaaacucugugu

SEQ ID NO: 1905437 - RNA, 20 nt, Homo sapiens
cacaauuuagaaaacauuca

SEQ ID NO: 1905438 - RNA, 18 nt, Homo sapiens
cccaccauaaugugaaua

SEQ ID NO: 1905439 - RNA, 19 nt, Homo sapiens
ccaacgagacacauugccu

SEQ ID NO: 1905440 - RNA, 15 nt, Homo sapiens
cuuguugagugccag

SEQ ID NO: 1905441 - RNA, 16 nt, Homo sapiens
acugaacuucagagca

SEQ ID NO: 1905442 - RNA, 20 nt, Homo sapiens
agaaauaaaaucuaauuaau

SEQ ID NO: 1905443 - RNA, 22 nt, Homo sapiens
aaacuuguaaagacacaucuua

SEQ ID NO: 1905444 - RNA, 20 nt, Homo sapiens
auacagaaggcaacaggggc

SEQ ID NO: 1905445 - RNA, 22 nt, Homo sapiens
gcuaccaaaucucaaaauaucc

SEQ ID NO: 1905446 - RNA, 23 nt, Homo sapiens
cacgccgcucuucacugugguca

SEQ ID NO: 1905447 - RNA, 16 nt, Homo sapiens
aacauuaguugcacua

SEQ ID NO: 1905448 - RNA, 13 nt, Homo sapiens
cuuccuacucuuc

SEQ ID NO: 1905449 - RNA, 18 nt, Homo sapiens
ccuggaagccaaacaaag

SEQ ID NO: 1905450 - RNA, 20 nt, Homo sapiens
uggcaaaggucccugagcuc

SEQ ID NO: 1905451 - RNA, 14 nt, Homo sapiens
uguucuacugagaa

SEQ ID NO: 1905452 - RNA, 22 nt, Homo sapiens
uggagggguggcccagagccau

SEQ ID NO: 1905453 - RNA, 23 nt, Homo sapiens
cugaaaaccauccaucuguggaa

SEQ ID NO: 1905454 - RNA, 19 nt, Homo sapiens
aauauaaagaggacuugaa

SEQ ID NO: 1905455 - RNA, 22 nt, Homo sapiens
ccccagaggucacacagccugu

SEQ ID NO: 1905456 - RNA, 21 nt, Homo sapiens
ggacuacaggugcaagccacu

SEQ ID NO: 1905457 - RNA, 12 nt, Homo sapiens
aauuacaaagaa

SEQ ID NO: 1905458 - RNA, 20 nt, Homo sapiens
ugugcuccauggcugccauc

SEQ ID NO: 1905459 - RNA, 17 nt, Homo sapiens
uguuaaaauacucagug

SEQ ID NO: 1905460 - RNA, 11 nt, Homo sapiens
ccaaugcuuug

SEQ ID NO: 1905461 - RNA, 17 nt, Homo sapiens
auauuggguuccauucu

SEQ ID NO: 1905462 - RNA, 16 nt, Homo sapiens
guggcucugaugcuga

SEQ ID NO: 1905463 - RNA, 17 nt, Homo sapiens
aaaauuaauacauucua

SEQ ID NO: 1905464 - RNA, 19 nt, Homo sapiens
ugugcccguguguguguau

SEQ ID NO: 1905465 - RNA, 22 nt, Homo sapiens
cccaggcuggauacuaagcaca

SEQ ID NO: 1905466 - RNA, 21 nt, Homo sapiens
ccuugcugcugcugcacccaa

SEQ ID NO: 1905467 - RNA, 15 nt, Homo sapiens
gcaacuacagaauuu

SEQ ID NO: 1905468 - RNA, 20 nt, Homo sapiens
agacagauccccguuccuga

SEQ ID NO: 1905469 - RNA, 15 nt, Homo sapiens
gacucuaguccuugg

SEQ ID NO: 1905470 - RNA, 19 nt, Homo sapiens
agcucuuccuauccuguag

SEQ ID NO: 1905471 - RNA, 19 nt, Homo sapiens
uuuggagauucccaucuga

SEQ ID NO: 1905472 - RNA, 21 nt, Homo sapiens
acagagucucacucuguugcc

SEQ ID NO: 1905473 - RNA, 21 nt, Homo sapiens
aaacuuuaaaucgccccagag

SEQ ID NO: 1905474 - RNA, 16 nt, Homo sapiens
ugagaucacagccucc

SEQ ID NO: 1905475 - RNA, 22 nt, Homo sapiens
gcccaaagagcacaaacauuuu

SEQ ID NO: 1905476 - RNA, 11 nt, Homo sapiens
aaaaguaucag

SEQ ID NO: 1905477 - RNA, 19 nt, Homo sapiens
gagccauauuaauugccug

SEQ ID NO: 1905478 - RNA, 18 nt, Homo sapiens
cagcaggugccagagcua

SEQ ID NO: 1905479 - RNA, 23 nt, Homo sapiens
cccuaugugggugggaccacaga

SEQ ID NO: 1905480 - RNA, 15 nt, Homo sapiens
auaauccuugucaga

SEQ ID NO: 1905481 - RNA, 18 nt, Homo sapiens
ucuuccagugauguugaa

SEQ ID NO: 1905482 - RNA, 20 nt, Homo sapiens
aucuauggauuggguaucaa

SEQ ID NO: 1905483 - RNA, 14 nt, Homo sapiens
uagaguggugcugc

SEQ ID NO: 1905484 - RNA, 16 nt, Homo sapiens
uucuauauuccuccag

SEQ ID NO: 1905485 - RNA, 14 nt, Homo sapiens
cagugaagauuuac

SEQ ID NO: 1905486 - RNA, 22 nt, Homo sapiens
uuacuccuuugcauuccaugau

SEQ ID NO: 1905487 - RNA, 15 nt, Homo sapiens
uggcacacucuccaa

SEQ ID NO: 1905488 - RNA, 18 nt, Homo sapiens
accuggaaagccagguug

SEQ ID NO: 1905489 - RNA, 23 nt, Homo sapiens
agugcaguggcgugaucucagcu

SEQ ID NO: 1905490 - RNA, 21 nt, Homo sapiens
acacggcagcugcuggcugug

SEQ ID NO: 1905491 - RNA, 22 nt, Homo sapiens
ugaggacccgugugacucgcca

SEQ ID NO: 1905492 - RNA, 15 nt, Homo sapiens
auaaucuugcucaca

SEQ ID NO: 1905493 - RNA, 18 nt, Homo sapiens
gcuacuguaauuuuauau

SEQ ID NO: 1905494 - RNA, 18 nt, Homo sapiens
agagcugcacagcaaaag

SEQ ID NO: 1905495 - RNA, 13 nt, Homo sapiens
acugccccugcac

SEQ ID NO: 1905496 - RNA, 12 nt, Homo sapiens
cgaucaguggug

SEQ ID NO: 1905497 - RNA, 11 nt, Homo sapiens
aguaugguggg

SEQ ID NO: 1905498 - RNA, 18 nt, Homo sapiens
gaaaacuguagucucuga

SEQ ID NO: 1905499 - RNA, 17 nt, Homo sapiens
acccucggcucccgggu

SEQ ID NO: 1905500 - RNA, 23 nt, Homo sapiens
aauggacauugagauacuaucau

SEQ ID NO: 1905501 - RNA, 13 nt, Homo sapiens
aauuaaaacagcu

SEQ ID NO: 1905502 - RNA, 21 nt, Homo sapiens
ugggcgcucucccuaccuugc

SEQ ID NO: 1905503 - RNA, 14 nt, Homo sapiens
gcuguuaccugaga

SEQ ID NO: 1905504 - RNA, 15 nt, Homo sapiens
aagccuguugcugaa

SEQ ID NO: 1905505 - RNA, 22 nt, Homo sapiens
ggaguuccggaauuauucugug

SEQ ID NO: 1905506 - RNA, 15 nt, Homo sapiens
aacugucgugucaua

SEQ ID NO: 1905507 - RNA, 24 nt, Homo sapiens
agcagcuccaaaacuggaccacca

SEQ ID NO: 1905508 - RNA, 21 nt, Homo sapiens
cagguaggggcacagugaaug

SEQ ID NO: 1905509 - RNA, 21 nt, Homo sapiens
aggccacccugccucuaccca

SEQ ID NO: 1905510 - RNA, 22 nt, Homo sapiens
ucacaccacaaaucugaaugug

SEQ ID NO: 1905511 - RNA, 11 nt, Homo sapiens
ugggucuugcc

SEQ ID NO: 1905512 - RNA, 13 nt, Homo sapiens
aagaaaagccaga

SEQ ID NO: 1905513 - RNA, 14 nt, Homo sapiens
ucauuucugccaug

SEQ ID NO: 1905514 - RNA, 19 nt, Homo sapiens
cagaaaacuggcagugcac

SEQ ID NO: 1905515 - RNA, 17 nt, Homo sapiens
gaauaugguggaaaaua

SEQ ID NO: 1905516 - RNA, 23 nt, Homo sapiens
auauaugauauauaaaugugauu

SEQ ID NO: 1905517 - RNA, 14 nt, Homo sapiens
agcuagcuucugca

SEQ ID NO: 1905518 - RNA, 19 nt, Homo sapiens
aacugauggguaucaugcu

SEQ ID NO: 1905519 - RNA, 22 nt, Homo sapiens
uggggagggggucgggguccca

SEQ ID NO: 1905520 - RNA, 16 nt, Homo sapiens
cccaguaaaaauccac

SEQ ID NO: 1905521 - RNA, 20 nt, Homo sapiens
uucagaaauaaaaugaaaug

SEQ ID NO: 1905522 - RNA, 16 nt, Homo sapiens
uacccugaagaacucu

SEQ ID NO: 1905523 - RNA, 15 nt, Homo sapiens
aaagaaaacauucca

SEQ ID NO: 1905524 - RNA, 18 nt, Homo sapiens
agucccaguauaccucau

SEQ ID NO: 1905525 - RNA, 18 nt, Homo sapiens
cuggaaggucugaucucc

SEQ ID NO: 1905526 - RNA, 17 nt, Homo sapiens
gcaagaccuaguccccu

SEQ ID NO: 1905527 - RNA, 20 nt, Homo sapiens
gcugugcuaucaugauggaa

SEQ ID NO: 1905528 - RNA, 17 nt, Homo sapiens
acugugguccaucucca

SEQ ID NO: 1905529 - RNA, 14 nt, Homo sapiens
gagagcgaaggggg

SEQ ID NO: 1905530 - RNA, 12 nt, Homo sapiens
uggggaacucaa

SEQ ID NO: 1905531 - RNA, 19 nt, Homo sapiens
aguaguauuuuguacuauc

SEQ ID NO: 1905532 - RNA, 12 nt, Homo sapiens
caaaugcuauau

SEQ ID NO: 1905533 - RNA, 14 nt, Homo sapiens
uuugucacugcugu

SEQ ID NO: 1905534 - RNA, 23 nt, Homo sapiens
agaaagccgggcaugacggcuca

SEQ ID NO: 1905535 - RNA, 22 nt, Homo sapiens
ucugcccccgucuucucuccau

SEQ ID NO: 1905536 - RNA, 19 nt, Homo sapiens
cugaacagcagaaacccau

SEQ ID NO: 1905537 - RNA, 16 nt, Homo sapiens
uuaguaauuucuugcu

SEQ ID NO: 1905538 - RNA, 18 nt, Homo sapiens
uccuggggaacauagaac

SEQ ID NO: 1905539 - RNA, 20 nt, Homo sapiens
gcuggucucgaacugcugga

SEQ ID NO: 1905540 - RNA, 22 nt, Homo sapiens
uaaaaaucaguuuguuguucag

SEQ ID NO: 1905541 - RNA, 21 nt, Homo sapiens
aggaagguagaaauaucugaa

SEQ ID NO: 1905542 - RNA, 17 nt, Homo sapiens
acaacugccagcucucu

SEQ ID NO: 1905543 - RNA, 17 nt, Homo sapiens
caguggcuggugcccau

SEQ ID NO: 1905544 - RNA, 16 nt, Homo sapiens
uauuugaguugugauu

SEQ ID NO: 1905545 - RNA, 23 nt, Homo sapiens
gugcaaucacagcucacugcagc

SEQ ID NO: 1905546 - RNA, 13 nt, Homo sapiens
uggaaggacccug

SEQ ID NO: 1905547 - RNA, 20 nt, Homo sapiens
ugugugcaagugugugcaca

SEQ ID NO: 1905548 - RNA, 13 nt, Homo sapiens
ggcaggccagugu

SEQ ID NO: 1905549 - RNA, 14 nt, Homo sapiens
guauacuuccuuau

SEQ ID NO: 1905550 - RNA, 17 nt, Homo sapiens
acauggaacgcuuucau

SEQ ID NO: 1905551 - RNA, 15 nt, Homo sapiens
acuuauccugacaca

SEQ ID NO: 1905552 - RNA, 18 nt, Homo sapiens
agaugauccuugcacaga

SEQ ID NO: 1905553 - RNA, 20 nt, Homo sapiens
uagaauucacugaguuuugu

SEQ ID NO: 1905554 - RNA, 23 nt, Homo sapiens
cacacauuggcuuaugugaaacu

SEQ ID NO: 1905555 - RNA, 24 nt, Homo sapiens
cacugcuuaacuucacauauugau

SEQ ID NO: 1905556 - RNA, 21 nt, Homo sapiens
uugaguuguuuggaugauuaa

SEQ ID NO: 1905557 - RNA, 16 nt, Homo sapiens
cuaguuuuuuugaaau

SEQ ID NO: 1905558 - RNA, 18 nt, Homo sapiens
cagaaucuccaucccuga

SEQ ID NO: 1905559 - RNA, 20 nt, Homo sapiens
caaucaugcuguguaauauc

SEQ ID NO: 1905560 - RNA, 18 nt, Homo sapiens
ccauucuccggccucagu

SEQ ID NO: 1905561 - RNA, 18 nt, Homo sapiens
cuauacuuucucacaugu

SEQ ID NO: 1905562 - RNA, 16 nt, Homo sapiens
uaaauguacagacaua

SEQ ID NO: 1905563 - RNA, 19 nt, Homo sapiens
ccccaaagacacuaccacu

SEQ ID NO: 1905564 - RNA, 19 nt, Homo sapiens
agugucugucuucuuucac

SEQ ID NO: 1905565 - RNA, 23 nt, Homo sapiens
uuccugggccuucucagcucucc

SEQ ID NO: 1905566 - RNA, 18 nt, Homo sapiens
cauauauuaaacauccac

SEQ ID NO: 1905567 - RNA, 18 nt, Homo sapiens
cucugcuccgugugucuc

SEQ ID NO: 1905568 - RNA, 16 nt, Homo sapiens
acuuccauuaacuuag

SEQ ID NO: 1905569 - RNA, 22 nt, Homo sapiens
uuuaagacuuuucuuuccuuaa

SEQ ID NO: 1905570 - RNA, 16 nt, Homo sapiens
cacuaccuagagucaa

SEQ ID NO: 1905571 - RNA, 16 nt, Homo sapiens
agccagcuuugcucag

SEQ ID NO: 1905572 - RNA, 21 nt, Homo sapiens
aaagacugucuuaauuugcau

SEQ ID NO: 1905573 - RNA, 17 nt, Homo sapiens
ugacuuucuagcuuccc

SEQ ID NO: 1905574 - RNA, 16 nt, Homo sapiens
cauccagcugccccuc

SEQ ID NO: 1905575 - RNA, 13 nt, Homo sapiens
caucaugcaaaau

SEQ ID NO: 1905576 - RNA, 14 nt, Homo sapiens
uggucagagugaau

SEQ ID NO: 1905577 - RNA, 13 nt, Homo sapiens
accgggcaugucu

SEQ ID NO: 1905578 - RNA, 20 nt, Homo sapiens
ccuuugguuaguguacuuug

SEQ ID NO: 1905579 - RNA, 13 nt, Homo sapiens
acccccuuccuuc

SEQ ID NO: 1905580 - RNA, 17 nt, Homo sapiens
agagcaggaagcauuca

SEQ ID NO: 1905581 - RNA, 22 nt, Homo sapiens
ccuccugggaacacaucuggcu

SEQ ID NO: 1905582 - RNA, 18 nt, Homo sapiens
guacucugcagacugaaa

SEQ ID NO: 1905583 - RNA, 20 nt, Homo sapiens
uaagaugaaaugcacuguau

SEQ ID NO: 1905584 - RNA, 23 nt, Homo sapiens
cccuggaaauaacugagcacuuu

SEQ ID NO: 1905585 - RNA, 21 nt, Homo sapiens
gacaauuagauaaauguccau

SEQ ID NO: 1905586 - RNA, 23 nt, Homo sapiens
aaucauagcaauaucauaauuaa

SEQ ID NO: 1905587 - RNA, 20 nt, Homo sapiens
uuccuaaaagagaauggaaa

SEQ ID NO: 1905588 - RNA, 15 nt, Homo sapiens
agcuccucugugaag

SEQ ID NO: 1905589 - RNA, 18 nt, Homo sapiens
guuucugugaaauucuca

SEQ ID NO: 1905590 - RNA, 13 nt, Homo sapiens
uuagaacagucca

SEQ ID NO: 1905591 - RNA, 16 nt, Homo sapiens
uuggcagcucuacucu

SEQ ID NO: 1905592 - RNA, 18 nt, Homo sapiens
agcaucucuguguaccca

SEQ ID NO: 1905593 - RNA, 18 nt, Homo sapiens
guuugugucuuaaacuag

SEQ ID NO: 1905594 - RNA, 19 nt, Homo sapiens
cauucuucugagcacuguu

SEQ ID NO: 1905595 - RNA, 20 nt, Homo sapiens
agcuugaguuuuuaguggaa

SEQ ID NO: 1905596 - RNA, 19 nt, Homo sapiens
ucuuuaucaugaagcacau

SEQ ID NO: 1905597 - RNA, 17 nt, Homo sapiens
uuaguuaagucauccac

SEQ ID NO: 1905598 - RNA, 21 nt, Homo sapiens
gugccuguacaagcugauguu

SEQ ID NO: 1905599 - RNA, 15 nt, Homo sapiens
guuuaauuguacuca

SEQ ID NO: 1905600 - RNA, 18 nt, Homo sapiens
uuaaaacguguaaaugaa

SEQ ID NO: 1905601 - RNA, 15 nt, Homo sapiens
gaacugugcucuccc

SEQ ID NO: 1905602 - RNA, 22 nt, Homo sapiens
gguuuucuuugucagcaauaau

SEQ ID NO: 1905603 - RNA, 14 nt, Homo sapiens
uucaugcuugacau

SEQ ID NO: 1905604 - RNA, 22 nt, Homo sapiens
aaaguuucuuaaggaaauggug

SEQ ID NO: 1905605 - RNA, 19 nt, Homo sapiens
ugccacuaaccuuccaaaa

SEQ ID NO: 1905606 - RNA, 16 nt, Homo sapiens
aaccuggagcacuuac

SEQ ID NO: 1905607 - RNA, 16 nt, Homo sapiens
uggcgaagauggucuc

SEQ ID NO: 1905608 - RNA, 18 nt, Homo sapiens
aaucuuaagauucuuugu

SEQ ID NO: 1905609 - RNA, 18 nt, Homo sapiens
agcccuccccaccugcuc

SEQ ID NO: 1905610 - RNA, 21 nt, Homo sapiens
ccaaaguccucugcuccagca

SEQ ID NO: 1905611 - RNA, 19 nt, Homo sapiens
uacgugaccucugcaagac

SEQ ID NO: 1905612 - RNA, 18 nt, Homo sapiens
aagaauaaaauauguagu

SEQ ID NO: 1905613 - RNA, 16 nt, Homo sapiens
caagugaaaccagcuu

SEQ ID NO: 1905614 - RNA, 23 nt, Homo sapiens
ugacacucuauaagauuccaaaa

SEQ ID NO: 1905615 - RNA, 21 nt, Homo sapiens
ucaucgaaaauucauuucaca

SEQ ID NO: 1905616 - RNA, 19 nt, Homo sapiens
cugacucuaagaauucucu

SEQ ID NO: 1905617 - RNA, 19 nt, Homo sapiens
ucaaugugaugguauuuga

SEQ ID NO: 1905618 - RNA, 15 nt, Homo sapiens
ccugcugcucaucca

SEQ ID NO: 1905619 - RNA, 22 nt, Homo sapiens
aaguuuuguuuguucacacucc

SEQ ID NO: 1905620 - RNA, 13 nt, Homo sapiens
uguggcauucaua

SEQ ID NO: 1905621 - RNA, 23 nt, Homo sapiens
acaggcuucugagcacagcugca

SEQ ID NO: 1905622 - RNA, 16 nt, Homo sapiens
acuauauguacagcuc

SEQ ID NO: 1905623 - RNA, 18 nt, Homo sapiens
cacuaugggaagcucugu

SEQ ID NO: 1905624 - RNA, 13 nt, Homo sapiens
aaauacuugcauc

SEQ ID NO: 1905625 - RNA, 23 nt, Homo sapiens
ggacccagggagaggcugugucc

SEQ ID NO: 1905626 - RNA, 20 nt, Homo sapiens
gagcugccauccagggaugc

SEQ ID NO: 1905627 - RNA, 13 nt, Homo sapiens
uuaaaucugaauu

SEQ ID NO: 1905628 - RNA, 13 nt, Homo sapiens
uuuuuucugauaa

SEQ ID NO: 1905629 - RNA, 23 nt, Homo sapiens
ugaaaaugcaucacaugaugaaa

SEQ ID NO: 1905630 - RNA, 16 nt, Homo sapiens
accaggggugcacaau

SEQ ID NO: 1905631 - RNA, 12 nt, Homo sapiens
uuucacugacac

SEQ ID NO: 1905632 - RNA, 23 nt, Homo sapiens
cguagguauuagugcuagucuca

SEQ ID NO: 1905633 - RNA, 20 nt, Homo sapiens
aaccaaauacuuuaauguau

SEQ ID NO: 1905634 - RNA, 20 nt, Homo sapiens
ugcucaggccucccuagcac

SEQ ID NO: 1905635 - RNA, 11 nt, Homo sapiens
auauguucuca

SEQ ID NO: 1905636 - RNA, 15 nt, Homo sapiens
ccugaacucugcaac

SEQ ID NO: 1905637 - RNA, 17 nt, Homo sapiens
auuuagaaaauguucac

SEQ ID NO: 1905638 - RNA, 20 nt, Homo sapiens
cugcuuucuccccaaugaga

SEQ ID NO: 1905639 - RNA, 18 nt, Homo sapiens
ggggucgcccuuugcuca

SEQ ID NO: 1905640 - RNA, 18 nt, Homo sapiens
guacuaaaaacacuggau

SEQ ID NO: 1905641 - RNA, 21 nt, Homo sapiens
gucaucucucacacauuccag

SEQ ID NO: 1905642 - RNA, 19 nt, Homo sapiens
uugcuguuccuuacuuuac

SEQ ID NO: 1905643 - RNA, 20 nt, Homo sapiens
ccugggcagaugucccccac

SEQ ID NO: 1905644 - RNA, 21 nt, Homo sapiens
aaugcugcgcuucgcuuggug

SEQ ID NO: 1905645 - RNA, 20 nt, Homo sapiens
cccaaucaauacccuuguga

SEQ ID NO: 1905646 - RNA, 12 nt, Homo sapiens
ucuguagcaccu

SEQ ID NO: 1905647 - RNA, 12 nt, Homo sapiens
uccagacucuca

SEQ ID NO: 1905648 - RNA, 12 nt, Homo sapiens
uuuugacuccuu

SEQ ID NO: 1905649 - RNA, 15 nt, Homo sapiens
uugcaguugcucuga

SEQ ID NO: 1905650 - RNA, 21 nt, Homo sapiens
cagaugggaugggcuuucuca

SEQ ID NO: 1905651 - RNA, 13 nt, Homo sapiens
uucaccuguaaac

SEQ ID NO: 1905652 - RNA, 17 nt, Homo sapiens
cuaaccaguuaccacac

SEQ ID NO: 1905653 - RNA, 19 nt, Homo sapiens
ugaaagcugagaacuccug

SEQ ID NO: 1905654 - RNA, 22 nt, Homo sapiens
acgaacacaagaauugaauagu

SEQ ID NO: 1905655 - RNA, 22 nt, Homo sapiens
cagcagugugucaggugcugca

SEQ ID NO: 1905656 - RNA, 19 nt, Homo sapiens
ugagggccaggaugcuccc

SEQ ID NO: 1905657 - RNA, 16 nt, Homo sapiens
agaauuauaagucaca

SEQ ID NO: 1905658 - RNA, 19 nt, Homo sapiens
ggacuuuugauaguucuau

SEQ ID NO: 1905659 - RNA, 15 nt, Homo sapiens
acacugccucugagu

SEQ ID NO: 1905660 - RNA, 16 nt, Homo sapiens
cgcaucgugguguguc

SEQ ID NO: 1905661 - RNA, 14 nt, Homo sapiens
gguccuuuggacag

SEQ ID NO: 1905662 - RNA, 13 nt, Homo sapiens
aguaugaaucuag

SEQ ID NO: 1905663 - RNA, 18 nt, Homo sapiens
agccuacauugaugccaa

SEQ ID NO: 1905664 - RNA, 15 nt, Homo sapiens
aaacccugcugaaca

SEQ ID NO: 1905665 - RNA, 15 nt, Homo sapiens
aaggcuugaagcugu

SEQ ID NO: 1905666 - RNA, 19 nt, Homo sapiens
aggucuacauuacaaaaga

SEQ ID NO: 1905667 - RNA, 17 nt, Homo sapiens
uaacucaaaccaugcaa

SEQ ID NO: 1905668 - RNA, 18 nt, Homo sapiens
ucucaagaucugcuucua

SEQ ID NO: 1905669 - RNA, 19 nt, Homo sapiens
auuccuggagcccgaggca

SEQ ID NO: 1905670 - RNA, 20 nt, Homo sapiens
ugagagaagggacacauuca

SEQ ID NO: 1905671 - RNA, 18 nt, Homo sapiens
guacuuuuaaaaacauaa

SEQ ID NO: 1905672 - RNA, 19 nt, Homo sapiens
agaaauggauguaagccug

SEQ ID NO: 1905673 - RNA, 16 nt, Homo sapiens
ccagugcaaaccacuu

SEQ ID NO: 1905674 - RNA, 11 nt, Homo sapiens
uugacaccugc

SEQ ID NO: 1905675 - RNA, 20 nt, Homo sapiens
gggucucaccauguugccca

SEQ ID NO: 1905676 - RNA, 19 nt, Homo sapiens
aaagcacagauuucaacag

SEQ ID NO: 1905677 - RNA, 16 nt, Homo sapiens
uguuagcauaauguga

SEQ ID NO: 1905678 - RNA, 16 nt, Homo sapiens
ucuuuugcugaucuuu

SEQ ID NO: 1905679 - RNA, 11 nt, Homo sapiens
uuaaauucuga

SEQ ID NO: 1905680 - RNA, 18 nt, Homo sapiens
cccagaagaagauggcug

SEQ ID NO: 1905681 - RNA, 16 nt, Homo sapiens
gcacuuggcagccuug

SEQ ID NO: 1905682 - RNA, 20 nt, Homo sapiens
caaagaaaacuuccaaaaag

SEQ ID NO: 1905683 - RNA, 15 nt, Homo sapiens
guaacaucagccauu

SEQ ID NO: 1905684 - RNA, 13 nt, Homo sapiens
cuguauacauuac

SEQ ID NO: 1905685 - RNA, 13 nt, Homo sapiens
cagaauacaauuc

SEQ ID NO: 1905686 - RNA, 19 nt, Homo sapiens
cugcacucuccacugggac

SEQ ID NO: 1905687 - RNA, 15 nt, Homo sapiens
caguugauuuccaac

SEQ ID NO: 1905688 - RNA, 16 nt, Homo sapiens
aguccuuggcuugcca

SEQ ID NO: 1905689 - RNA, 18 nt, Homo sapiens
ugccaacuguccuacuca

SEQ ID NO: 1905690 - RNA, 13 nt, Homo sapiens
ccaggacacugcc

SEQ ID NO: 1905691 - RNA, 16 nt, Homo sapiens
uaacaauaaaagacaa

SEQ ID NO: 1905692 - RNA, 22 nt, Homo sapiens
agugacagagacccagaucuca

SEQ ID NO: 1905693 - RNA, 14 nt, Homo sapiens
uccugcucucuauc

SEQ ID NO: 1905694 - RNA, 23 nt, Homo sapiens
uugcaaccucuuugcucaacaga

SEQ ID NO: 1905695 - RNA, 18 nt, Homo sapiens
ugugccccuuccccaugc

SEQ ID NO: 1905696 - RNA, 13 nt, Homo sapiens
cuguagaccuuuc

SEQ ID NO: 1905697 - RNA, 19 nt, Homo sapiens
ccuguccuaagcacuuuau

SEQ ID NO: 1905698 - RNA, 14 nt, Homo sapiens
uaaggccuugccag

SEQ ID NO: 1905699 - RNA, 16 nt, Homo sapiens
cccauucacaccacac

SEQ ID NO: 1905700 - RNA, 17 nt, Homo sapiens
gaucuaggaagacuuug

SEQ ID NO: 1905701 - RNA, 22 nt, Homo sapiens
ccauacuagaguucauggauau

SEQ ID NO: 1905702 - RNA, 24 nt, Homo sapiens
cuugguaaaauaaucaguguuucc

SEQ ID NO: 1905703 - RNA, 22 nt, Homo sapiens
caguucugcacccagccaaaca

SEQ ID NO: 1905704 - RNA, 23 nt, Homo sapiens
cuauuucugcugaauuuucacau

SEQ ID NO: 1905705 - RNA, 14 nt, Homo sapiens
aggcaucugagugu

SEQ ID NO: 1905706 - RNA, 21 nt, Homo sapiens
acagcuucacaaauucucaca

SEQ ID NO: 1905707 - RNA, 16 nt, Homo sapiens
agacauaucacucaau

SEQ ID NO: 1905708 - RNA, 11 nt, Homo sapiens
ucauucuugcc

SEQ ID NO: 1905709 - RNA, 21 nt, Homo sapiens
accaaagagacuggagcaucu

SEQ ID NO: 1905710 - RNA, 20 nt, Homo sapiens
agcguuuuggaagaggaaaa

SEQ ID NO: 1905711 - RNA, 17 nt, Homo sapiens
gaaaaauaugugcuuga

SEQ ID NO: 1905712 - RNA, 17 nt, Homo sapiens
uuucucccuauuaggga

SEQ ID NO: 1905713 - RNA, 15 nt, Homo sapiens
aggguucagggcaug

SEQ ID NO: 1905714 - RNA, 15 nt, Homo sapiens
agugaaggcucuccu

SEQ ID NO: 1905715 - RNA, 16 nt, Homo sapiens
ccucaaguaaacuccc

SEQ ID NO: 1905716 - RNA, 17 nt, Homo sapiens
caaccccuuuccacgag

SEQ ID NO: 1905717 - RNA, 15 nt, Homo sapiens
cuuuacaugacacag

SEQ ID NO: 1905718 - RNA, 16 nt, Homo sapiens
cugggacaaccucauc

SEQ ID NO: 1905719 - RNA, 12 nt, Homo sapiens
uacugacuuuuu

SEQ ID NO: 1905720 - RNA, 18 nt, Homo sapiens
uauaggauuuucacacau

SEQ ID NO: 1905721 - RNA, 18 nt, Homo sapiens
cagugacugaauucugcc

SEQ ID NO: 1905722 - RNA, 20 nt, Homo sapiens
acacuacaaauuuauucuug

SEQ ID NO: 1905723 - RNA, 20 nt, Homo sapiens
gcuguuggaugcagcaauaa

SEQ ID NO: 1905724 - RNA, 21 nt, Homo sapiens
cgcccuguguccacagugauu

SEQ ID NO: 1905725 - RNA, 18 nt, Homo sapiens
uaagcuauauuauacaaa

SEQ ID NO: 1905726 - RNA, 14 nt, Homo sapiens
ugaguuuauacuca

SEQ ID NO: 1905727 - RNA, 13 nt, Homo sapiens
uacacuggucuaa

SEQ ID NO: 1905728 - RNA, 21 nt, Homo sapiens
auuucaauaguacccaaccaa

SEQ ID NO: 1905729 - RNA, 16 nt, Homo sapiens
ggauuauuuaauaaca

SEQ ID NO: 1905730 - RNA, 16 nt, Homo sapiens
gacaacgaugaugcuu

SEQ ID NO: 1905731 - RNA, 19 nt, Homo sapiens
aggcuguggcuggugagcc

SEQ ID NO: 1905732 - RNA, 14 nt, Homo sapiens
ccaccccaagagaa

SEQ ID NO: 1905733 - RNA, 14 nt, Homo sapiens
aacauaacugugcu

SEQ ID NO: 1905734 - RNA, 18 nt, Homo sapiens
cugcaggccaggccagcu

SEQ ID NO: 1905735 - RNA, 22 nt, Homo sapiens
ucaaaugauacagucaggacac

SEQ ID NO: 1905736 - RNA, 17 nt, Homo sapiens
uaggaaaaugcuucugu

SEQ ID NO: 1905737 - RNA, 20 nt, Homo sapiens
auauaguuuucuaacuccug

SEQ ID NO: 1905738 - RNA, 17 nt, Homo sapiens
cuguaauccuagcacuu

SEQ ID NO: 1905739 - RNA, 14 nt, Homo sapiens
uaagcaaaaccacu

SEQ ID NO: 1905740 - RNA, 18 nt, Homo sapiens
ggcacaggacugauucug

SEQ ID NO: 1905741 - RNA, 23 nt, Homo sapiens
aaaguauuuucuucucugugaga

SEQ ID NO: 1905742 - RNA, 16 nt, Homo sapiens
agaaggaaucuucuca

SEQ ID NO: 1905743 - RNA, 20 nt, Homo sapiens
cucagaucacuacugcaguc

SEQ ID NO: 1905744 - RNA, 19 nt, Homo sapiens
uuuauacugauuaugucuu

SEQ ID NO: 1905745 - RNA, 14 nt, Homo sapiens
acugguuucucaga

SEQ ID NO: 1905746 - RNA, 14 nt, Homo sapiens
agucaggaccuccg

SEQ ID NO: 1905747 - RNA, 23 nt, Homo sapiens
caaucauguguguuaacccagug

SEQ ID NO: 1905748 - RNA, 13 nt, Homo sapiens
guuuggggagaaa

SEQ ID NO: 1905749 - RNA, 16 nt, Homo sapiens
aagaaaauuauguauu

SEQ ID NO: 1905750 - RNA, 20 nt, Homo sapiens
uguacacagaaauacaguua

SEQ ID NO: 1905751 - RNA, 18 nt, Homo sapiens
ugcagagcuuucaaggau

SEQ ID NO: 1905752 - RNA, 19 nt, Homo sapiens
ugcaaggcaaauguuuauu

SEQ ID NO: 1905753 - RNA, 17 nt, Homo sapiens
ucacugauauuuuaguc

SEQ ID NO: 1905754 - RNA, 19 nt, Homo sapiens
cgguugauugaaauaucag

SEQ ID NO: 1905755 - RNA, 15 nt, Homo sapiens
caccucccugaaauu

SEQ ID NO: 1905756 - RNA, 16 nt, Homo sapiens
uaggacucugaggcuc

SEQ ID NO: 1905757 - RNA, 17 nt, Homo sapiens
cauuuucugccacccaa

SEQ ID NO: 1905758 - RNA, 22 nt, Homo sapiens
acacaugugcugauguuuacaa

SEQ ID NO: 1905759 - RNA, 14 nt, Homo sapiens
acauccucuuccau

SEQ ID NO: 1905760 - RNA, 14 nt, Homo sapiens
gcuacuauauguca

SEQ ID NO: 1905761 - RNA, 15 nt, Homo sapiens
auaauagguauauag

SEQ ID NO: 1905762 - RNA, 15 nt, Homo sapiens
ucugcaggugggaug

SEQ ID NO: 1905763 - RNA, 12 nt, Homo sapiens
ucaacauaugca

SEQ ID NO: 1905764 - RNA, 21 nt, Homo sapiens
cuaggaaaggcagaaacacaa

SEQ ID NO: 1905765 - RNA, 18 nt, Homo sapiens
aauaguuacaagcauuga

SEQ ID NO: 1905766 - RNA, 15 nt, Homo sapiens
uaugaacuugcaaac

SEQ ID NO: 1905767 - RNA, 19 nt, Homo sapiens
cucguacuuucacaucucu

SEQ ID NO: 1905768 - RNA, 17 nt, Homo sapiens
ucuaugaaauaucaugc

SEQ ID NO: 1905769 - RNA, 20 nt, Homo sapiens
acuugagguaccaguuguau

SEQ ID NO: 1905770 - RNA, 23 nt, Homo sapiens
cacugugagugaaaauuuuuaca

SEQ ID NO: 1905771 - RNA, 18 nt, Homo sapiens
cucugguuguuuaugcaa

SEQ ID NO: 1905772 - RNA, 11 nt, Homo sapiens
ucccuccacuc

SEQ ID NO: 1905773 - RNA, 19 nt, Homo sapiens
aaauguauauacacauaua

SEQ ID NO: 1905774 - RNA, 13 nt, Homo sapiens
uuucuuugcuuca

SEQ ID NO: 1905775 - RNA, 13 nt, Homo sapiens
uauauuugcauaa

SEQ ID NO: 1905776 - RNA, 13 nt, Homo sapiens
accacagggccag

SEQ ID NO: 1905777 - RNA, 19 nt, Homo sapiens
ccuugccucaaugccagua

SEQ ID NO: 1905778 - RNA, 22 nt, Homo sapiens
ugaggaaauucggagcuauaca

SEQ ID NO: 1905779 - RNA, 18 nt, Homo sapiens
gcuugggaggaaaccuga

SEQ ID NO: 1905780 - RNA, 12 nt, Homo sapiens
uuugaacaaagg

SEQ ID NO: 1905781 - RNA, 18 nt, Homo sapiens
uuucagcuguuucaccau

SEQ ID NO: 1905782 - RNA, 20 nt, Homo sapiens
ggccucacacccagagggua

SEQ ID NO: 1905783 - RNA, 17 nt, Homo sapiens
gcaaguauaaauucaau

SEQ ID NO: 1905784 - RNA, 20 nt, Homo sapiens
cagucucuaauccaccccaa

SEQ ID NO: 1905785 - RNA, 14 nt, Homo sapiens
aaaggcccucugcu

SEQ ID NO: 1905786 - RNA, 20 nt, Homo sapiens
uguguaagucaacucuucag

SEQ ID NO: 1905787 - RNA, 21 nt, Homo sapiens
acaggucggggaccaaaggcu

SEQ ID NO: 1905788 - RNA, 14 nt, Homo sapiens
guaugcaauggauu

SEQ ID NO: 1905789 - RNA, 19 nt, Homo sapiens
ucagaugauggccauuucu

SEQ ID NO: 1905790 - RNA, 16 nt, Homo sapiens
cagagagaaaaagaga

SEQ ID NO: 1905791 - RNA, 22 nt, Homo sapiens
uggucaaaaugaacuccauugc

SEQ ID NO: 1905792 - RNA, 14 nt, Homo sapiens
gggaacauguccua

SEQ ID NO: 1905793 - RNA, 20 nt, Homo sapiens
gcccacagcagcaauaugcu

SEQ ID NO: 1905794 - RNA, 16 nt, Homo sapiens
aucaaagccacacucu

SEQ ID NO: 1905795 - RNA, 15 nt, Homo sapiens
aauugaggacacuga

SEQ ID NO: 1905796 - RNA, 11 nt, Homo sapiens
ucccuaauccu

SEQ ID NO: 1905797 - RNA, 22 nt, Homo sapiens
cuggauauucgguaauaucauu

SEQ ID NO: 1905798 - RNA, 16 nt, Homo sapiens
gccucagagacaucag

SEQ ID NO: 1905799 - RNA, 12 nt, Homo sapiens
acaggcacucaa

SEQ ID NO: 1905800 - RNA, 17 nt, Homo sapiens
gaugaucagggauccaa

SEQ ID NO: 1905801 - RNA, 19 nt, Homo sapiens
ugagagacaggacuagcug

SEQ ID NO: 1905802 - RNA, 23 nt, Homo sapiens
uaggcuggaaaugguuucacuug

SEQ ID NO: 1905803 - RNA, 13 nt, Homo sapiens
uaaaauuauuuca

SEQ ID NO: 1905804 - RNA, 22 nt, Homo sapiens
uuuuucuaaggaguaacuugca

SEQ ID NO: 1905805 - RNA, 21 nt, Homo sapiens
auuuuauuuaugcguaauuua

SEQ ID NO: 1905806 - RNA, 18 nt, Homo sapiens
ugccucagccaguggcac

SEQ ID NO: 1905807 - RNA, 23 nt, Homo sapiens
uggcaaucucagaugcaguuugg

SEQ ID NO: 1905808 - RNA, 18 nt, Homo sapiens
uuaugcaaauacaaucag

SEQ ID NO: 1905809 - RNA, 16 nt, Homo sapiens
uaaguccaacuacuaa

SEQ ID NO: 1905810 - RNA, 20 nt, Homo sapiens
cuugugauguuugcucagag

SEQ ID NO: 1905811 - RNA, 23 nt, Homo sapiens
ucucugcccccagccucuguccc

SEQ ID NO: 1905812 - RNA, 21 nt, Homo sapiens
uuauucuggagucugccaaaa

SEQ ID NO: 1905813 - RNA, 22 nt, Homo sapiens
aaaguaaccugaacuaaucuga

SEQ ID NO: 1905814 - RNA, 22 nt, Homo sapiens
agacaagcagaguaacaggauc

SEQ ID NO: 1905815 - RNA, 22 nt, Homo sapiens
agguuugguuugguuuuggaca

SEQ ID NO: 1905816 - RNA, 18 nt, Homo sapiens
cucagucagacauggcca

SEQ ID NO: 1905817 - RNA, 13 nt, Homo sapiens
uugcuuugcccag

SEQ ID NO: 1905818 - RNA, 16 nt, Homo sapiens
aaagaagaccugagaa

SEQ ID NO: 1905819 - RNA, 21 nt, Homo sapiens
aacauuccucagaaaccaaag

SEQ ID NO: 1905820 - RNA, 17 nt, Homo sapiens
auuguaaauuauuucau

SEQ ID NO: 1905821 - RNA, 16 nt, Homo sapiens
caucaguagcaucugu

SEQ ID NO: 1905822 - RNA, 18 nt, Homo sapiens
ucucucaccaugugacac

SEQ ID NO: 1905823 - RNA, 21 nt, Homo sapiens
gcugagauugcaccacugcac

SEQ ID NO: 1905824 - RNA, 21 nt, Homo sapiens
acacagauggucacacagaga

SEQ ID NO: 1905825 - RNA, 15 nt, Homo sapiens
uguucugucaccaau

SEQ ID NO: 1905826 - RNA, 15 nt, Homo sapiens
uacauacagagguaa

SEQ ID NO: 1905827 - RNA, 21 nt, Homo sapiens
auguuggaugaugaaacauuc

SEQ ID NO: 1905828 - RNA, 16 nt, Homo sapiens
cugaaaggcacacuuu

SEQ ID NO: 1905829 - RNA, 22 nt, Homo sapiens
gaaaagcacagccucagaauaa

SEQ ID NO: 1905830 - RNA, 22 nt, Homo sapiens
aaacccauguugaucuuucuca

SEQ ID NO: 1905831 - RNA, 16 nt, Homo sapiens
gaaucacuugcacucc

SEQ ID NO: 1905832 - RNA, 23 nt, Homo sapiens
agcauagggucacuuugccauua

SEQ ID NO: 1905833 - RNA, 15 nt, Homo sapiens
uauuaagccaggaaa

SEQ ID NO: 1905834 - RNA, 19 nt, Homo sapiens
agcucaauuuaauuuugca

SEQ ID NO: 1905835 - RNA, 16 nt, Homo sapiens
ugcaagcagaugacaa

SEQ ID NO: 1905836 - RNA, 17 nt, Homo sapiens
uuuuuagggauuaccuu

SEQ ID NO: 1905837 - RNA, 13 nt, Homo sapiens
cugcuuccugucu

SEQ ID NO: 1905838 - RNA, 13 nt, Homo sapiens
gagccgguggugc

SEQ ID NO: 1905839 - RNA, 14 nt, Homo sapiens
aaguuacuacugau

SEQ ID NO: 1905840 - RNA, 14 nt, Homo sapiens
caugugcacuugaa

SEQ ID NO: 1905841 - RNA, 18 nt, Homo sapiens
aagauauccacuuaccug

SEQ ID NO: 1905842 - RNA, 17 nt, Homo sapiens
ggagggccagcgcugug

SEQ ID NO: 1905843 - RNA, 21 nt, Homo sapiens
ucccugagagccacaggugcc

SEQ ID NO: 1905844 - RNA, 15 nt, Homo sapiens
uucuccagacuuaaa

SEQ ID NO: 1905845 - RNA, 18 nt, Homo sapiens
ggcagccaggcuggcaga

SEQ ID NO: 1905846 - RNA, 14 nt, Homo sapiens
gaacgcaugcaggg

SEQ ID NO: 1905847 - RNA, 12 nt, Homo sapiens
uuugaaacacaa

SEQ ID NO: 1905848 - RNA, 21 nt, Homo sapiens
uguccccuuuuauugcugcuu

SEQ ID NO: 1905849 - RNA, 16 nt, Homo sapiens
ccuuggggagcacuug

SEQ ID NO: 1905850 - RNA, 16 nt, Homo sapiens
cccuuccucucccauu

SEQ ID NO: 1905851 - RNA, 20 nt, Homo sapiens
gcaaucuucucagaaggcaa

SEQ ID NO: 1905852 - RNA, 13 nt, Homo sapiens
gcucccugcucag

SEQ ID NO: 1905853 - RNA, 22 nt, Homo sapiens
ucuguaucuccagccacuccaa

SEQ ID NO: 1905854 - RNA, 22 nt, Homo sapiens
agcaggauaaacauuccagaga

SEQ ID NO: 1905855 - RNA, 21 nt, Homo sapiens
cacuucuuacaauaauucuau

SEQ ID NO: 1905856 - RNA, 22 nt, Homo sapiens
ucuaccaacuggaagcacagaa

SEQ ID NO: 1905857 - RNA, 13 nt, Homo sapiens
cuuccacaaagaa

SEQ ID NO: 1905858 - RNA, 12 nt, Homo sapiens
acagcauaugca

SEQ ID NO: 1905859 - RNA, 15 nt, Homo sapiens
gauaaagcacccugu

SEQ ID NO: 1905860 - RNA, 21 nt, Homo sapiens
ccaggaaaagcccucaucuuc

SEQ ID NO: 1905861 - RNA, 21 nt, Homo sapiens
uauaaaagaauaaaauugcac

SEQ ID NO: 1905862 - RNA, 16 nt, Homo sapiens
ugcuuaguauugacaa

SEQ ID NO: 1905863 - RNA, 22 nt, Homo sapiens
gauaccugcacuguccugacca

SEQ ID NO: 1905864 - RNA, 17 nt, Homo sapiens
cauucagcaugagauuu

SEQ ID NO: 1905865 - RNA, 22 nt, Homo sapiens
ugggaaggggccuuugucuugu

SEQ ID NO: 1905866 - RNA, 16 nt, Homo sapiens
guaaucaauaauuuaa

SEQ ID NO: 1905867 - RNA, 16 nt, Homo sapiens
cuuugaacacaccucu

SEQ ID NO: 1905868 - RNA, 15 nt, Homo sapiens
ucauuuauucaagua

SEQ ID NO: 1905869 - RNA, 23 nt, Homo sapiens
cacauucuacuucagcuuuggau

SEQ ID NO: 1905870 - RNA, 23 nt, Homo sapiens
acauucugcaagcacaucugcau

SEQ ID NO: 1905871 - RNA, 16 nt, Homo sapiens
gaaaaucuccaucuca

SEQ ID NO: 1905872 - RNA, 15 nt, Homo sapiens
uucuuauuccauauu

SEQ ID NO: 1905873 - RNA, 22 nt, Homo sapiens
cuccugccauaggguccugaau

SEQ ID NO: 1905874 - RNA, 15 nt, Homo sapiens
accuuagacauaaag

SEQ ID NO: 1905875 - RNA, 19 nt, Homo sapiens
uuauguguugccaaaacca

SEQ ID NO: 1905876 - RNA, 20 nt, Homo sapiens
aggggucguaccuugcuuua

SEQ ID NO: 1905877 - RNA, 21 nt, Homo sapiens
ucaaacagcaucaaaauacaa

SEQ ID NO: 1905878 - RNA, 18 nt, Homo sapiens
aacagaaaacaucccacu

SEQ ID NO: 1905879 - RNA, 13 nt, Homo sapiens
gaagaaaggccau

SEQ ID NO: 1905880 - RNA, 22 nt, Homo sapiens
uaccccacacacaguccaacuc

SEQ ID NO: 1905881 - RNA, 21 nt, Homo sapiens
gccaccgagcaggggcagcuu

SEQ ID NO: 1905882 - RNA, 15 nt, Homo sapiens
aaaaauaacacugua

SEQ ID NO: 1905883 - RNA, 23 nt, Homo sapiens
uucacaguucucuccuucuuccc

SEQ ID NO: 1905884 - RNA, 22 nt, Homo sapiens
ccuuuguguauuuuucaauaau

SEQ ID NO: 1905885 - RNA, 22 nt, Homo sapiens
acuaauuuauucuucacugagg

SEQ ID NO: 1905886 - RNA, 21 nt, Homo sapiens
cauacaccuaugucauuucau

SEQ ID NO: 1905887 - RNA, 21 nt, Homo sapiens
ccaccuucccuccucaugccu

SEQ ID NO: 1905888 - RNA, 21 nt, Homo sapiens
uguuaaaagaaaacacuguca

SEQ ID NO: 1905889 - RNA, 16 nt, Homo sapiens
ugaaggagacagcagc

SEQ ID NO: 1905890 - RNA, 18 nt, Homo sapiens
gauggcccauagaccuga

SEQ ID NO: 1905891 - RNA, 18 nt, Homo sapiens
auuuauuuuuauguucuu

SEQ ID NO: 1905892 - RNA, 17 nt, Homo sapiens
cuugcucccugacuggg

SEQ ID NO: 1905893 - RNA, 15 nt, Homo sapiens
auacgugcacagggu

SEQ ID NO: 1905894 - RNA, 21 nt, Homo sapiens
cauuuuggugugcaacccugu

SEQ ID NO: 1905895 - RNA, 13 nt, Homo sapiens
uguuucuugcugc

SEQ ID NO: 1905896 - RNA, 21 nt, Homo sapiens
gccuaccucuccacaagggga

SEQ ID NO: 1905897 - RNA, 14 nt, Homo sapiens
gugcucgagacaca

SEQ ID NO: 1905898 - RNA, 15 nt, Homo sapiens
aaaugugaauuucaa

SEQ ID NO: 1905899 - RNA, 22 nt, Homo sapiens
cacgccuguaaucccaacacuu

SEQ ID NO: 1905900 - RNA, 11 nt, Homo sapiens
accucaucucc

SEQ ID NO: 1905901 - RNA, 21 nt, Homo sapiens
cuugauagaaaugccaagcac

SEQ ID NO: 1905902 - RNA, 11 nt, Homo sapiens
ugucacuaaac

SEQ ID NO: 1905903 - RNA, 14 nt, Homo sapiens
uauuucaagcucug

SEQ ID NO: 1905904 - RNA, 13 nt, Homo sapiens
acuuuaaugggag

SEQ ID NO: 1905905 - RNA, 20 nt, Homo sapiens
uugaauaguucuauacaaau

SEQ ID NO: 1905906 - RNA, 18 nt, Homo sapiens
caaaauuaaauacauaaa

SEQ ID NO: 1905907 - RNA, 23 nt, Homo sapiens
agccccuggccugugccuuccaa

SEQ ID NO: 1905908 - RNA, 20 nt, Homo sapiens
acauuccugagauucuggga

SEQ ID NO: 1905909 - RNA, 17 nt, Homo sapiens
ccuccuggaaucaguau

SEQ ID NO: 1905910 - RNA, 23 nt, Homo sapiens
uacccuuccuacagauagucaaa

SEQ ID NO: 1905911 - RNA, 18 nt, Homo sapiens
agccaagcuggcacaaaa

SEQ ID NO: 1905912 - RNA, 12 nt, Homo sapiens
ugugcuauugaa

SEQ ID NO: 1905913 - RNA, 12 nt, Homo sapiens
gaugcuaugaaa

SEQ ID NO: 1905914 - RNA, 14 nt, Homo sapiens
ggugugucaaugcc

SEQ ID NO: 1905915 - RNA, 13 nt, Homo sapiens
gauaauuggugca

SEQ ID NO: 1905916 - RNA, 16 nt, Homo sapiens
agggcgcacuuuccac

SEQ ID NO: 1905917 - RNA, 21 nt, Homo sapiens
uaaucuauaacaaaugcuuua

SEQ ID NO: 1905918 - RNA, 19 nt, Homo sapiens
aaguauuauuuauuugaau

SEQ ID NO: 1905919 - RNA, 20 nt, Homo sapiens
aaguguucacaacagugaaa

SEQ ID NO: 1905920 - RNA, 21 nt, Homo sapiens
aagagauucugccucagccuc

SEQ ID NO: 1905921 - RNA, 16 nt, Homo sapiens
acgacauacaugcuac

SEQ ID NO: 1905922 - RNA, 22 nt, Homo sapiens
ugaaaagagaggauauguucac

SEQ ID NO: 1905923 - RNA, 17 nt, Homo sapiens
gggaaggcugcugugua

SEQ ID NO: 1905924 - RNA, 18 nt, Homo sapiens
uaggaaugcuaacaguuc

SEQ ID NO: 1905925 - RNA, 20 nt, Homo sapiens
agacaguuuaccauccucaa

SEQ ID NO: 1905926 - RNA, 15 nt, Homo sapiens
aaauuaagugugcau

SEQ ID NO: 1905927 - RNA, 19 nt, Homo sapiens
guccaggauguacaaagaa

SEQ ID NO: 1905928 - RNA, 16 nt, Homo sapiens
uuauuggucuugcccu

SEQ ID NO: 1905929 - RNA, 13 nt, Homo sapiens
cagcaaaagacca

SEQ ID NO: 1905930 - RNA, 21 nt, Homo sapiens
gaguuuuacucuuguugccca

SEQ ID NO: 1905931 - RNA, 16 nt, Homo sapiens
acagcccaucaccucu

SEQ ID NO: 1905932 - RNA, 13 nt, Homo sapiens
ccugaaaaaucua

SEQ ID NO: 1905933 - RNA, 19 nt, Homo sapiens
agcaaaaucccuuaaucua

SEQ ID NO: 1905934 - RNA, 13 nt, Homo sapiens
uugcucccugcaa

SEQ ID NO: 1905935 - RNA, 22 nt, Homo sapiens
aaggcuggcugaaaaucacuau

SEQ ID NO: 1905936 - RNA, 14 nt, Homo sapiens
uguuccaccaaaua

SEQ ID NO: 1905937 - RNA, 15 nt, Homo sapiens
gucggugacuccuga

SEQ ID NO: 1905938 - RNA, 18 nt, Homo sapiens
guccagagggacagucag

SEQ ID NO: 1905939 - RNA, 12 nt, Homo sapiens
cccuugcauuag

SEQ ID NO: 1905940 - RNA, 17 nt, Homo sapiens
agaacaggacauagcac

SEQ ID NO: 1905941 - RNA, 20 nt, Homo sapiens
agaauaaaauuccuaucuca

SEQ ID NO: 1905942 - RNA, 20 nt, Homo sapiens
aagggaauuucuucaacucc

SEQ ID NO: 1905943 - RNA, 18 nt, Homo sapiens
ugcaauaauccaccccca

SEQ ID NO: 1905944 - RNA, 22 nt, Homo sapiens
cuacgucaaacaugaagugugu

SEQ ID NO: 1905945 - RNA, 17 nt, Homo sapiens
augaaagaacaauauag

SEQ ID NO: 1905946 - RNA, 17 nt, Homo sapiens
ugaggaaaaaacccagc

SEQ ID NO: 1905947 - RNA, 20 nt, Homo sapiens
agaaagaaaccaagugcgcu

SEQ ID NO: 1905948 - RNA, 16 nt, Homo sapiens
uccugcccuguagaag

SEQ ID NO: 1905949 - RNA, 21 nt, Homo sapiens
aacacauaauugcuuauguau

SEQ ID NO: 1905950 - RNA, 17 nt, Homo sapiens
uaaauguuuuacucaga

SEQ ID NO: 1905951 - RNA, 14 nt, Homo sapiens
acuuauaauuugca

SEQ ID NO: 1905952 - RNA, 18 nt, Homo sapiens
ucacuugcuuuugaauug

SEQ ID NO: 1905953 - RNA, 22 nt, Homo sapiens
cagccacacucacccagccucu

SEQ ID NO: 1905954 - RNA, 18 nt, Homo sapiens
gcaauuuccggccaacag

SEQ ID NO: 1905955 - RNA, 18 nt, Homo sapiens
caucacgccugugcagug

SEQ ID NO: 1905956 - RNA, 14 nt, Homo sapiens
ugucuaguuucuag

SEQ ID NO: 1905957 - RNA, 18 nt, Homo sapiens
aaucaugccuaguuauuc

SEQ ID NO: 1905958 - RNA, 19 nt, Homo sapiens
acugaagagcucuuggccc

SEQ ID NO: 1905959 - RNA, 15 nt, Homo sapiens
cugugggcagcaccc

SEQ ID NO: 1905960 - RNA, 13 nt, Homo sapiens
ccauuccuaccca

SEQ ID NO: 1905961 - RNA, 18 nt, Homo sapiens
auuaauuacuucacuaua

SEQ ID NO: 1905962 - RNA, 16 nt, Homo sapiens
acagggacgugacaga

SEQ ID NO: 1905963 - RNA, 21 nt, Homo sapiens
gcccaggagcgcagcugcauu

SEQ ID NO: 1905964 - RNA, 19 nt, Homo sapiens
cugcaagaauuaaaacuga

SEQ ID NO: 1905965 - RNA, 19 nt, Homo sapiens
guuuauuuuuccacuauua

SEQ ID NO: 1905966 - RNA, 22 nt, Homo sapiens
ggcccucccucccuagcccuuc

SEQ ID NO: 1905967 - RNA, 23 nt, Homo sapiens
aguaaggaaauauuaagagcuau

SEQ ID NO: 1905968 - RNA, 17 nt, Homo sapiens
uguauauacauuucaua

SEQ ID NO: 1905969 - RNA, 12 nt, Homo sapiens
cagaacacacuc

SEQ ID NO: 1905970 - RNA, 13 nt, Homo sapiens
cuccugccacaac

SEQ ID NO: 1905971 - RNA, 21 nt, Homo sapiens
agccaugccuaucaguaaaaa

SEQ ID NO: 1905972 - RNA, 15 nt, Homo sapiens
ucaagcauaaaucac

SEQ ID NO: 1905973 - RNA, 19 nt, Homo sapiens
ccuccuggagcucuguggg

SEQ ID NO: 1905974 - RNA, 19 nt, Homo sapiens
aagauaccaaaaccacagu

SEQ ID NO: 1905975 - RNA, 21 nt, Homo sapiens
cuuugccauaaccacauuuaa

SEQ ID NO: 1905976 - RNA, 22 nt, Homo sapiens
aaucaucuauuuugaugcagca

SEQ ID NO: 1905977 - RNA, 14 nt, Homo sapiens
ugccaagugccaua

SEQ ID NO: 1905978 - RNA, 16 nt, Homo sapiens
agcggcucuagccacu

SEQ ID NO: 1905979 - RNA, 15 nt, Homo sapiens
gagagacauugccuc

SEQ ID NO: 1905980 - RNA, 16 nt, Homo sapiens
aagaacuuauuuguac

SEQ ID NO: 1905981 - RNA, 16 nt, Homo sapiens
gggccucccaccagag

SEQ ID NO: 1905982 - RNA, 12 nt, Homo sapiens
ucaaaaugacag

SEQ ID NO: 1905983 - RNA, 20 nt, Homo sapiens
auuuucauuuaacuacaaau

SEQ ID NO: 1905984 - RNA, 16 nt, Homo sapiens
gaugcugacaucauuu

SEQ ID NO: 1905985 - RNA, 16 nt, Homo sapiens
caguaaacacuccaca

SEQ ID NO: 1905986 - RNA, 14 nt, Homo sapiens
ugaagaacugcacu

SEQ ID NO: 1905987 - RNA, 13 nt, Homo sapiens
gagugaucuuucc

SEQ ID NO: 1905988 - RNA, 18 nt, Homo sapiens
aacuuauggaaagcccau

SEQ ID NO: 1905989 - RNA, 20 nt, Homo sapiens
uaacaccaucgaucaugaug

SEQ ID NO: 1905990 - RNA, 18 nt, Homo sapiens
gaagccaggaauuuccca

SEQ ID NO: 1905991 - RNA, 15 nt, Homo sapiens
ccuucuauacuuucu

SEQ ID NO: 1905992 - RNA, 13 nt, Homo sapiens
ccuuuuuugccag

SEQ ID NO: 1905993 - RNA, 23 nt, Homo sapiens
gauacuuacauguucccaaaaca

SEQ ID NO: 1905994 - RNA, 18 nt, Homo sapiens
uuuaguacuuguucccuc

SEQ ID NO: 1905995 - RNA, 23 nt, Homo sapiens
ccagugauggcauuacucugcac

SEQ ID NO: 1905996 - RNA, 20 nt, Homo sapiens
ucgguagaggauuucuaguu

SEQ ID NO: 1905997 - RNA, 17 nt, Homo sapiens
gauaccuccaacccugc

SEQ ID NO: 1905998 - RNA, 17 nt, Homo sapiens
ccaaccuggcucccucc

SEQ ID NO: 1905999 - RNA, 20 nt, Homo sapiens
cugucacguggcuucaucag

SEQ ID NO: 1906000 - RNA, 18 nt, Homo sapiens
uuuguaagagugagcucu

SEQ ID NO: 1906001 - RNA, 21 nt, Homo sapiens
ucuuuaaaccacuaaaauaca

SEQ ID NO: 1906002 - RNA, 20 nt, Homo sapiens
uuuccuguuauguuuaacuu

SEQ ID NO: 1906003 - RNA, 12 nt, Homo sapiens
auuuaaacuaaa

SEQ ID NO: 1906004 - RNA, 21 nt, Homo sapiens
uuccucucucuaccagucuau

SEQ ID NO: 1906005 - RNA, 23 nt, Homo sapiens
gcaguggcucaugcccauaaucc

SEQ ID NO: 1906006 - RNA, 11 nt, Homo sapiens
uaugugcaaua

SEQ ID NO: 1906007 - RNA, 14 nt, Homo sapiens
ccuuucacacugug

SEQ ID NO: 1906008 - RNA, 23 nt, Homo sapiens
ggcuucugguugaugccugugaa

SEQ ID NO: 1906009 - RNA, 18 nt, Homo sapiens
cauaauuuacaugcaaua

SEQ ID NO: 1906010 - RNA, 17 nt, Homo sapiens
cucaagaacgagaagca

SEQ ID NO: 1906011 - RNA, 14 nt, Homo sapiens
cccacacgugcaua

SEQ ID NO: 1906012 - RNA, 15 nt, Homo sapiens
uuguauuuauuccau

SEQ ID NO: 1906013 - RNA, 22 nt, Homo sapiens
auaucaauguuuguccuguaua

SEQ ID NO: 1906014 - RNA, 22 nt, Homo sapiens
ccaagagaacucgcgcucagua

SEQ ID NO: 1906015 - RNA, 18 nt, Homo sapiens
cuggaugcugcuguacaa

SEQ ID NO: 1906016 - RNA, 21 nt, Homo sapiens
acacugcacagggaaaauugc

SEQ ID NO: 1906017 - RNA, 15 nt, Homo sapiens
aacugcaacacugga

SEQ ID NO: 1906018 - RNA, 20 nt, Homo sapiens
gcgcuccucugcagccugag

SEQ ID NO: 1906019 - RNA, 19 nt, Homo sapiens
aaaucacguugcugguggu

SEQ ID NO: 1906020 - RNA, 15 nt, Homo sapiens
cacugugaaaccccc

SEQ ID NO: 1906021 - RNA, 19 nt, Homo sapiens
guuauacuuauuuguauau

SEQ ID NO: 1906022 - RNA, 14 nt, Homo sapiens
uccacagagacugu

SEQ ID NO: 1906023 - RNA, 16 nt, Homo sapiens
ucacucccuccaucaa

SEQ ID NO: 1906024 - RNA, 19 nt, Homo sapiens
uguguguuuugacacugag

SEQ ID NO: 1906025 - RNA, 23 nt, Homo sapiens
ucuggcaucacgucagugcucag

SEQ ID NO: 1906026 - RNA, 17 nt, Homo sapiens
aggcagccacuccuagc

SEQ ID NO: 1906027 - RNA, 11 nt, Homo sapiens
cauccaugaaa

SEQ ID NO: 1906028 - RNA, 15 nt, Homo sapiens
caaggcuuuaucuca

SEQ ID NO: 1906029 - RNA, 13 nt, Homo sapiens
uaacauuugccuu

SEQ ID NO: 1906030 - RNA, 12 nt, Homo sapiens
uagacuaguuuc

SEQ ID NO: 1906031 - RNA, 15 nt, Homo sapiens
uaaaaccacagcagu

SEQ ID NO: 1906032 - RNA, 14 nt, Homo sapiens
aauuccauagugga

SEQ ID NO: 1906033 - RNA, 20 nt, Homo sapiens
cugcaugcccagagacccag

SEQ ID NO: 1906034 - RNA, 10 nt, Homo sapiens
uucacaagcu

SEQ ID NO: 1906035 - RNA, 20 nt, Homo sapiens
gccaaggcagcgaccccagg

SEQ ID NO: 1906036 - RNA, 11 nt, Homo sapiens
ccucuguggac

SEQ ID NO: 1906037 - RNA, 13 nt, Homo sapiens
auuuccacaaaau

SEQ ID NO: 1906038 - RNA, 17 nt, Homo sapiens
uccacagugacuccacu

SEQ ID NO: 1906039 - RNA, 24 nt, Homo sapiens
gagcaggccggaaccacagggcca

SEQ ID NO: 1906040 - RNA, 20 nt, Homo sapiens
caacaacuucuccauccuuu

SEQ ID NO: 1906041 - RNA, 15 nt, Homo sapiens
ggcaugacucuugac

SEQ ID NO: 1906042 - RNA, 23 nt, Homo sapiens
ucucaauaacaaacuggcugcuu

SEQ ID NO: 1906043 - RNA, 17 nt, Homo sapiens
guuaauggucaaugcua

SEQ ID NO: 1906044 - RNA, 13 nt, Homo sapiens
gaagcaacauuuu

SEQ ID NO: 1906045 - RNA, 13 nt, Homo sapiens
ugcagucugggug

SEQ ID NO: 1906046 - RNA, 13 nt, Homo sapiens
uugucucugucac

SEQ ID NO: 1906047 - RNA, 12 nt, Homo sapiens
gcaccuucaaua

SEQ ID NO: 1906048 - RNA, 13 nt, Homo sapiens
uaugaccacuggg

SEQ ID NO: 1906049 - RNA, 21 nt, Homo sapiens
gguuucauuuauucauguuau

SEQ ID NO: 1906050 - RNA, 21 nt, Homo sapiens
aguuauaaacuuauaaucaau

SEQ ID NO: 1906051 - RNA, 21 nt, Homo sapiens
ggcccuuggcgggcacgggug

SEQ ID NO: 1906052 - RNA, 17 nt, Homo sapiens
caaaacuggagucccaa

SEQ ID NO: 1906053 - RNA, 12 nt, Homo sapiens
cagagccaguga

SEQ ID NO: 1906054 - RNA, 18 nt, Homo sapiens
agagccggagccuccagc

SEQ ID NO: 1906055 - RNA, 15 nt, Homo sapiens
ccucaggggacuuga

SEQ ID NO: 1906056 - RNA, 13 nt, Homo sapiens
uucuacuuugcca

SEQ ID NO: 1906057 - RNA, 18 nt, Homo sapiens
uagccaucucucuacucc

SEQ ID NO: 1906058 - RNA, 22 nt, Homo sapiens
gcaaagucccagccgcacuggg

SEQ ID NO: 1906059 - RNA, 15 nt, Homo sapiens
ggagagcagcuggcu

SEQ ID NO: 1906060 - RNA, 15 nt, Homo sapiens
agaggacggcuuccc

SEQ ID NO: 1906061 - RNA, 14 nt, Homo sapiens
cauucugccaaagu

SEQ ID NO: 1906062 - RNA, 20 nt, Homo sapiens
uccaacagaguggugucuag

SEQ ID NO: 1906063 - RNA, 18 nt, Homo sapiens
aaaaaccuguucaagucu

SEQ ID NO: 1906064 - RNA, 22 nt, Homo sapiens
uuccggggagaaacccagagau

SEQ ID NO: 1906065 - RNA, 14 nt, Homo sapiens
uuugaaccaaaaca

SEQ ID NO: 1906066 - RNA, 16 nt, Homo sapiens
agccuuuuauacugau

SEQ ID NO: 1906067 - RNA, 13 nt, Homo sapiens
aucugcuggauau

SEQ ID NO: 1906068 - RNA, 19 nt, Homo sapiens
aauccuaugucauuucuac

SEQ ID NO: 1906069 - RNA, 22 nt, Homo sapiens
aaauauguuuggaauauuccac

SEQ ID NO: 1906070 - RNA, 13 nt, Homo sapiens
uaugcacauuucu

SEQ ID NO: 1906071 - RNA, 12 nt, Homo sapiens
uucaccaguuuc

SEQ ID NO: 1906072 - RNA, 15 nt, Homo sapiens
gcacauagcagacua

SEQ ID NO: 1906073 - RNA, 22 nt, Homo sapiens
uggaccagucccgucgugcagu

SEQ ID NO: 1906074 - RNA, 21 nt, Homo sapiens
aguuuuguuuguucacacucc

SEQ ID NO: 1906075 - RNA, 16 nt, Homo sapiens
uuauccuguaguacaa

SEQ ID NO: 1906076 - RNA, 21 nt, Homo sapiens
ucaaaauuguuacaaauugua

SEQ ID NO: 1906077 - RNA, 22 nt, Homo sapiens
uagaauacucagggaaagcauu

SEQ ID NO: 1906078 - RNA, 14 nt, Homo sapiens
acugucccuugccu

SEQ ID NO: 1906079 - RNA, 16 nt, Homo sapiens
cugcagagauuucuca

SEQ ID NO: 1906080 - RNA, 13 nt, Homo sapiens
gauguauauccau

SEQ ID NO: 1906081 - RNA, 20 nt, Homo sapiens
cucccuguagcucugccucc

SEQ ID NO: 1906082 - RNA, 13 nt, Homo sapiens
uucuugugccuca

SEQ ID NO: 1906083 - RNA, 14 nt, Homo sapiens
caauguagucucau

SEQ ID NO: 1906084 - RNA, 20 nt, Homo sapiens
gcucuaauucacagugcucu

SEQ ID NO: 1906085 - RNA, 18 nt, Homo sapiens
aucuauuuuugugugcug

SEQ ID NO: 1906086 - RNA, 18 nt, Homo sapiens
agauaccucucagugugu

SEQ ID NO: 1906087 - RNA, 16 nt, Homo sapiens
caaaaagaagacauua

SEQ ID NO: 1906088 - RNA, 17 nt, Homo sapiens
uguucucuuaugaucac

SEQ ID NO: 1906089 - RNA, 20 nt, Homo sapiens
aauuaaugaguuuuauccaa

SEQ ID NO: 1906090 - RNA, 23 nt, Homo sapiens
cucccacaccgucagguacuccu

SEQ ID NO: 1906091 - RNA, 15 nt, Homo sapiens
ccaaccucacugaca

SEQ ID NO: 1906092 - RNA, 14 nt, Homo sapiens
ugcaaacaaaaucc

SEQ ID NO: 1906093 - RNA, 22 nt, Homo sapiens
uggaaaagcaaaacuguagggg

SEQ ID NO: 1906094 - RNA, 14 nt, Homo sapiens
cccccuuacugugc

SEQ ID NO: 1906095 - RNA, 13 nt, Homo sapiens
uguccguccucag

SEQ ID NO: 1906096 - RNA, 12 nt, Homo sapiens
cuuaagcacuuu

SEQ ID NO: 1906097 - RNA, 18 nt, Homo sapiens
aauuaucuugauacauuc

SEQ ID NO: 1906098 - RNA, 16 nt, Homo sapiens
cuauuacuauuacuau

SEQ ID NO: 1906099 - RNA, 16 nt, Homo sapiens
uuauuggcuucuuaac

SEQ ID NO: 1906100 - RNA, 22 nt, Homo sapiens
cagaaugcggccucugagacau

SEQ ID NO: 1906101 - RNA, 22 nt, Homo sapiens
cccagagauaacacgaugcgua

SEQ ID NO: 1906102 - RNA, 18 nt, Homo sapiens
auuuauuguucgaugccu

SEQ ID NO: 1906103 - RNA, 22 nt, Homo sapiens
cugauaaacauuaaacacugua

SEQ ID NO: 1906104 - RNA, 15 nt, Homo sapiens
gacaugugacauuua

SEQ ID NO: 1906105 - RNA, 18 nt, Homo sapiens
caggguggaugaucucaa

SEQ ID NO: 1906106 - RNA, 15 nt, Homo sapiens
ugcauuaaaaaugca

SEQ ID NO: 1906107 - RNA, 16 nt, Homo sapiens
agguagccaucccaug

SEQ ID NO: 1906108 - RNA, 14 nt, Homo sapiens
uccaugugaucuca

SEQ ID NO: 1906109 - RNA, 21 nt, Homo sapiens
ccucgggcgagucacugccuc

SEQ ID NO: 1906110 - RNA, 13 nt, Homo sapiens
caacuugcaauuu

SEQ ID NO: 1906111 - RNA, 15 nt, Homo sapiens
aggccaucaccacag

SEQ ID NO: 1906112 - RNA, 13 nt, Homo sapiens
cgggccucagugc

SEQ ID NO: 1906113 - RNA, 16 nt, Homo sapiens
guuuacuucucuaaaa

SEQ ID NO: 1906114 - RNA, 17 nt, Homo sapiens
cccuuccaugugccuuu

SEQ ID NO: 1906115 - RNA, 22 nt, Homo sapiens
ccauuugcuuagaaagucugau

SEQ ID NO: 1906116 - RNA, 23 nt, Homo sapiens
acgguggcaguaggggaaccuag

SEQ ID NO: 1906117 - RNA, 17 nt, Homo sapiens
aaggugaguuugagcug

SEQ ID NO: 1906118 - RNA, 14 nt, Homo sapiens
ccuucuguugagaa

SEQ ID NO: 1906119 - RNA, 14 nt, Homo sapiens
cuaccucagaauua

SEQ ID NO: 1906120 - RNA, 14 nt, Homo sapiens
cuucuucagauuca

SEQ ID NO: 1906121 - RNA, 23 nt, Homo sapiens
uuuaacauuuuguuaagaggaua

SEQ ID NO: 1906122 - RNA, 16 nt, Homo sapiens
cuguuucaaucacugu

SEQ ID NO: 1906123 - RNA, 17 nt, Homo sapiens
aauauuuaucauauuga

SEQ ID NO: 1906124 - RNA, 21 nt, Homo sapiens
cucggccucccaaaaugcugg

SEQ ID NO: 1906125 - RNA, 16 nt, Homo sapiens
ccuucaguccaccaca

SEQ ID NO: 1906126 - RNA, 18 nt, Homo sapiens
ugauggcguggcaacccu

SEQ ID NO: 1906127 - RNA, 21 nt, Homo sapiens
cuuuuaugauauauauaugcu

SEQ ID NO: 1906128 - RNA, 19 nt, Homo sapiens
uggccuagucagauggaug

SEQ ID NO: 1906129 - RNA, 18 nt, Homo sapiens
ucgaauuuuucagaugau

SEQ ID NO: 1906130 - RNA, 23 nt, Homo sapiens
ugagcacuuagcaggcaccgcca

SEQ ID NO: 1906131 - RNA, 21 nt, Homo sapiens
cucaggccuaggugcgcagug

SEQ ID NO: 1906132 - RNA, 19 nt, Homo sapiens
uuuacuuaauucagucuca

SEQ ID NO: 1906133 - RNA, 21 nt, Homo sapiens
aaacauauuuuuauacuuuau

SEQ ID NO: 1906134 - RNA, 22 nt, Homo sapiens
cuggggaagagaaaagcccaag

SEQ ID NO: 1906135 - RNA, 13 nt, Homo sapiens
accucacagugac

SEQ ID NO: 1906136 - RNA, 12 nt, Homo sapiens
ugagaguauuua

SEQ ID NO: 1906137 - RNA, 10 nt, Homo sapiens
ccagacuguu

SEQ ID NO: 1906138 - RNA, 16 nt, Homo sapiens
aaggaauagaagcaaa

SEQ ID NO: 1906139 - RNA, 14 nt, Homo sapiens
caucuugcuaccag

SEQ ID NO: 1906140 - RNA, 19 nt, Homo sapiens
aaccaaagaaaguggguca

SEQ ID NO: 1906141 - RNA, 12 nt, Homo sapiens
aaauaacauugc

SEQ ID NO: 1906142 - RNA, 21 nt, Homo sapiens
uacuggguagguucugaacag

SEQ ID NO: 1906143 - RNA, 18 nt, Homo sapiens
ugagcaagacauacuuaa

SEQ ID NO: 1906144 - RNA, 17 nt, Homo sapiens
cagugagucucuucaga

SEQ ID NO: 1906145 - RNA, 12 nt, Homo sapiens
ucucaagagcca

SEQ ID NO: 1906146 - RNA, 14 nt, Homo sapiens
ccaagcacccagag

SEQ ID NO: 1906147 - RNA, 16 nt, Homo sapiens
cucuuucuuugcaaca

SEQ ID NO: 1906148 - RNA, 14 nt, Homo sapiens
acccaggaguccag

SEQ ID NO: 1906149 - RNA, 15 nt, Homo sapiens
cccugguaugugccu

SEQ ID NO: 1906150 - RNA, 15 nt, Homo sapiens
gagcccccaccggaa

SEQ ID NO: 1906151 - RNA, 20 nt, Homo sapiens
aguguauaccaccuguacau

SEQ ID NO: 1906152 - RNA, 16 nt, Homo sapiens
agacugggacuauggc

SEQ ID NO: 1906153 - RNA, 19 nt, Homo sapiens
uugacaaaaguaaauggga

SEQ ID NO: 1906154 - RNA, 20 nt, Homo sapiens
uccuagacucacuuguucuc

SEQ ID NO: 1906155 - RNA, 20 nt, Homo sapiens
uacagaagccccacccugcc

SEQ ID NO: 1906156 - RNA, 19 nt, Homo sapiens
caaccaggcagaguucugu

SEQ ID NO: 1906157 - RNA, 23 nt, Homo sapiens
gugccugucuggagcucacccaa

SEQ ID NO: 1906158 - RNA, 13 nt, Homo sapiens
cacaccagucaca

SEQ ID NO: 1906159 - RNA, 18 nt, Homo sapiens
ugcgggugaacaaagcag

SEQ ID NO: 1906160 - RNA, 15 nt, Homo sapiens
aggugcuacugacuu

SEQ ID NO: 1906161 - RNA, 17 nt, Homo sapiens
ccucugugaaauuugua

SEQ ID NO: 1906162 - RNA, 23 nt, Homo sapiens
ccccugcagcuaguccuagugaa

SEQ ID NO: 1906163 - RNA, 22 nt, Homo sapiens
acaguaguuagaauuauaucac

SEQ ID NO: 1906164 - RNA, 19 nt, Homo sapiens
caaaauucagggcuuuaaa

SEQ ID NO: 1906165 - RNA, 22 nt, Homo sapiens
ugucgugaugaaaacuuucuaa

SEQ ID NO: 1906166 - RNA, 12 nt, Homo sapiens
auguccaugaaa

SEQ ID NO: 1906167 - RNA, 12 nt, Homo sapiens
ugugggaccagg

SEQ ID NO: 1906168 - RNA, 23 nt, Homo sapiens
ucucucccacuuccuccuaccug

SEQ ID NO: 1906169 - RNA, 23 nt, Homo sapiens
ugucuugucauuccaggugccag

SEQ ID NO: 1906170 - RNA, 14 nt, Homo sapiens
ggugggguggcacc

SEQ ID NO: 1906171 - RNA, 13 nt, Homo sapiens
uagugcauccagu

SEQ ID NO: 1906172 - RNA, 14 nt, Homo sapiens
uguuugagguuaaa

SEQ ID NO: 1906173 - RNA, 23 nt, Homo sapiens
ccaaaccaggccuccaagccagg

SEQ ID NO: 1906174 - RNA, 17 nt, Homo sapiens
cucgagcucuguagccu

SEQ ID NO: 1906175 - RNA, 21 nt, Homo sapiens
aggcaaagacugcaguaucca

SEQ ID NO: 1906176 - RNA, 16 nt, Homo sapiens
uuuauaagagugccgu

SEQ ID NO: 1906177 - RNA, 16 nt, Homo sapiens
ugagcucccaggugca

SEQ ID NO: 1906178 - RNA, 22 nt, Homo sapiens
auguuauccacaagcaauggac

SEQ ID NO: 1906179 - RNA, 12 nt, Homo sapiens
cucucaccacuu

SEQ ID NO: 1906180 - RNA, 15 nt, Homo sapiens
uuuccacucauuaga

SEQ ID NO: 1906181 - RNA, 20 nt, Homo sapiens
aggagagcuagcagcaggga

SEQ ID NO: 1906182 - RNA, 18 nt, Homo sapiens
aacugcucagagcuuuaa

SEQ ID NO: 1906183 - RNA, 23 nt, Homo sapiens
ugaaccccuggccucaagcaauc

SEQ ID NO: 1906184 - RNA, 20 nt, Homo sapiens
auggaaaaucagcugcucag

SEQ ID NO: 1906185 - RNA, 22 nt, Homo sapiens
ugugcaauuuguaaauauugcu

SEQ ID NO: 1906186 - RNA, 14 nt, Homo sapiens
gugaggagcacagc

SEQ ID NO: 1906187 - RNA, 20 nt, Homo sapiens
uaaacagauggcacuuugaa

SEQ ID NO: 1906188 - RNA, 22 nt, Homo sapiens
gaacuugccuuaaacacucacc

SEQ ID NO: 1906189 - RNA, 21 nt, Homo sapiens
aggaggggaaaaaacaaaauc

SEQ ID NO: 1906190 - RNA, 21 nt, Homo sapiens
ucugagcucuggcuuugccuu

SEQ ID NO: 1906191 - RNA, 17 nt, Homo sapiens
ccgagauccaccagauc

SEQ ID NO: 1906192 - RNA, 16 nt, Homo sapiens
ggaguuggaagugaag

SEQ ID NO: 1906193 - RNA, 17 nt, Homo sapiens
cuuugcagugcacuuug

SEQ ID NO: 1906194 - RNA, 16 nt, Homo sapiens
aaauagaacuaauacu

SEQ ID NO: 1906195 - RNA, 21 nt, Homo sapiens
cagaagaacguggauugugaa

SEQ ID NO: 1906196 - RNA, 13 nt, Homo sapiens
uuauauggaugau

SEQ ID NO: 1906197 - RNA, 18 nt, Homo sapiens
uacaauuggcacuaaaga

SEQ ID NO: 1906198 - RNA, 21 nt, Homo sapiens
ucaaucugcaaacaugccagg

SEQ ID NO: 1906199 - RNA, 22 nt, Homo sapiens
uaaucaaaacuuucguuguuau

SEQ ID NO: 1906200 - RNA, 15 nt, Homo sapiens
guggcuucugaugaa

SEQ ID NO: 1906201 - RNA, 20 nt, Homo sapiens
uccucgcacagggcaugccu

SEQ ID NO: 1906202 - RNA, 17 nt, Homo sapiens
cauuacaacaguagaga

SEQ ID NO: 1906203 - RNA, 18 nt, Homo sapiens
aggaauuauagaccucua

SEQ ID NO: 1906204 - RNA, 19 nt, Homo sapiens
acaucuuagcaagcaccaa

SEQ ID NO: 1906205 - RNA, 16 nt, Homo sapiens
caccauugcugcuccu

SEQ ID NO: 1906206 - RNA, 15 nt, Homo sapiens
uuugaaaacugacau

SEQ ID NO: 1906207 - RNA, 22 nt, Homo sapiens
guguucaauccagagagcuuaa

SEQ ID NO: 1906208 - RNA, 13 nt, Homo sapiens
gcuguauauucaa

SEQ ID NO: 1906209 - RNA, 18 nt, Homo sapiens
gccuuucuuauggaagaa

SEQ ID NO: 1906210 - RNA, 16 nt, Homo sapiens
ccauggugaagugcuu

SEQ ID NO: 1906211 - RNA, 23 nt, Homo sapiens
ucauguucucuucccaggccuuu

SEQ ID NO: 1906212 - RNA, 13 nt, Homo sapiens
uguuggcaaaaga

SEQ ID NO: 1906213 - RNA, 22 nt, Homo sapiens
cugauuucuuaggggaaggaga

SEQ ID NO: 1906214 - RNA, 21 nt, Homo sapiens
cagaguauuggucuccucuca

SEQ ID NO: 1906215 - RNA, 19 nt, Homo sapiens
acagcuggagaaauggcau

SEQ ID NO: 1906216 - RNA, 21 nt, Homo sapiens
ccugccuugaugaagccugug

SEQ ID NO: 1906217 - RNA, 13 nt, Homo sapiens
agacuuuucccaa

SEQ ID NO: 1906218 - RNA, 23 nt, Homo sapiens
ucagugguuagaagcaugucucu

SEQ ID NO: 1906219 - RNA, 23 nt, Homo sapiens
gaagcaaaucagaaacuugugaa

SEQ ID NO: 1906220 - RNA, 21 nt, Homo sapiens
cauauagcugauaaagccuaa

SEQ ID NO: 1906221 - RNA, 19 nt, Homo sapiens
acucaucccuaaugcugca

SEQ ID NO: 1906222 - RNA, 17 nt, Homo sapiens
gccuugugggugugagc

SEQ ID NO: 1906223 - RNA, 15 nt, Homo sapiens
cacagcugcauuaaa

SEQ ID NO: 1906224 - RNA, 15 nt, Homo sapiens
agaaggcucuugcca

SEQ ID NO: 1906225 - RNA, 14 nt, Homo sapiens
ugggcccuagagga

SEQ ID NO: 1906226 - RNA, 14 nt, Homo sapiens
acgucacuucaugc

SEQ ID NO: 1906227 - RNA, 14 nt, Homo sapiens
uuaaugaaugaguc

SEQ ID NO: 1906228 - RNA, 23 nt, Homo sapiens
cagagaccagcccaccccugugc

SEQ ID NO: 1906229 - RNA, 20 nt, Homo sapiens
auauucuaagccaguuuuca

SEQ ID NO: 1906230 - RNA, 20 nt, Homo sapiens
ggaaucauucuggcuuaaac

SEQ ID NO: 1906231 - RNA, 23 nt, Homo sapiens
acacauuaagccuuccacacuca

SEQ ID NO: 1906232 - RNA, 19 nt, Homo sapiens
gcccaagggcagaccuuuc

SEQ ID NO: 1906233 - RNA, 23 nt, Homo sapiens
agucuauuuccacugaacaaaac

SEQ ID NO: 1906234 - RNA, 20 nt, Homo sapiens
uauccaugccccaaguguua

SEQ ID NO: 1906235 - RNA, 11 nt, Homo sapiens
gcaaaggcccc

SEQ ID NO: 1906236 - RNA, 16 nt, Homo sapiens
cuauucauugacugau

SEQ ID NO: 1906237 - RNA, 20 nt, Homo sapiens
uagacugauggaacagaaua

SEQ ID NO: 1906238 - RNA, 20 nt, Homo sapiens
cagguccuuuccacccugag

SEQ ID NO: 1906239 - RNA, 21 nt, Homo sapiens
ccaugacauuucaucugggug

SEQ ID NO: 1906240 - RNA, 22 nt, Homo sapiens
guuugggaucccugucuuuccu

SEQ ID NO: 1906241 - RNA, 13 nt, Homo sapiens
uggaguucagaga

SEQ ID NO: 1906242 - RNA, 22 nt, Homo sapiens
gcucaaccacuguggcguucug

SEQ ID NO: 1906243 - RNA, 15 nt, Homo sapiens
cuuuuauuucauuca

SEQ ID NO: 1906244 - RNA, 21 nt, Homo sapiens
ggucacuucaaacaugcccuc

SEQ ID NO: 1906245 - RNA, 20 nt, Homo sapiens
agcuaguuaaacagugccau

SEQ ID NO: 1906246 - RNA, 12 nt, Homo sapiens
uggugggaauca

SEQ ID NO: 1906247 - RNA, 14 nt, Homo sapiens
caaaaguuacaugu

SEQ ID NO: 1906248 - RNA, 17 nt, Homo sapiens
aaggacagccaccaaga

SEQ ID NO: 1906249 - RNA, 22 nt, Homo sapiens
uggcccuggcggguggcugcaa

SEQ ID NO: 1906250 - RNA, 17 nt, Homo sapiens
uauuugaacacuuggug

SEQ ID NO: 1906251 - RNA, 17 nt, Homo sapiens
gccuccuuugcuggcau

SEQ ID NO: 1906252 - RNA, 19 nt, Homo sapiens
ucugacccucccagucuca

SEQ ID NO: 1906253 - RNA, 18 nt, Homo sapiens
cuccuuccccccaccaga

SEQ ID NO: 1906254 - RNA, 21 nt, Homo sapiens
aaugcugugugaugcaccugc

SEQ ID NO: 1906255 - RNA, 20 nt, Homo sapiens
aacuccaucugcugccauga

SEQ ID NO: 1906256 - RNA, 18 nt, Homo sapiens
gguguguguucaccuuca

SEQ ID NO: 1906257 - RNA, 22 nt, Homo sapiens
accuagggcacuuuaagucagu

SEQ ID NO: 1906258 - RNA, 16 nt, Homo sapiens
ucaaucaaguuuacau

SEQ ID NO: 1906259 - RNA, 15 nt, Homo sapiens
aaugacaggaaccca

SEQ ID NO: 1906260 - RNA, 15 nt, Homo sapiens
gaagaaugaauccau

SEQ ID NO: 1906261 - RNA, 22 nt, Homo sapiens
agcaguucagagcugcccucuc

SEQ ID NO: 1906262 - RNA, 17 nt, Homo sapiens
ucugaauuacugcaaag

SEQ ID NO: 1906263 - RNA, 17 nt, Homo sapiens
gaugccaaaaugacuuu

SEQ ID NO: 1906264 - RNA, 15 nt, Homo sapiens
uaaauucaugcacuu

SEQ ID NO: 1906265 - RNA, 18 nt, Homo sapiens
aaauugcagauaccauuu

SEQ ID NO: 1906266 - RNA, 12 nt, Homo sapiens
ccuaacaaaaga

SEQ ID NO: 1906267 - RNA, 20 nt, Homo sapiens
cuucuaaagugcugggauua

SEQ ID NO: 1906268 - RNA, 21 nt, Homo sapiens
gcuccugccuggaagaauucc

SEQ ID NO: 1906269 - RNA, 16 nt, Homo sapiens
augugcuagucacugg

SEQ ID NO: 1906270 - RNA, 17 nt, Homo sapiens
gggucaacauuuccaaa

SEQ ID NO: 1906271 - RNA, 15 nt, Homo sapiens
uuaaaauguuuacug

SEQ ID NO: 1906272 - RNA, 18 nt, Homo sapiens
guaauuuccccacucuga

SEQ ID NO: 1906273 - RNA, 20 nt, Homo sapiens
ggauuguguuugugccauau

SEQ ID NO: 1906274 - RNA, 17 nt, Homo sapiens
auugaguccagcuuucc

SEQ ID NO: 1906275 - RNA, 20 nt, Homo sapiens
uccaagacucuagaguccaa

SEQ ID NO: 1906276 - RNA, 18 nt, Homo sapiens
aggcaaagugcaccucaa

SEQ ID NO: 1906277 - RNA, 13 nt, Homo sapiens
ccaaacaauuuaa

SEQ ID NO: 1906278 - RNA, 18 nt, Homo sapiens
cacagcuuagauuucaua

SEQ ID NO: 1906279 - RNA, 20 nt, Homo sapiens
aagugcugggauuacuggca

SEQ ID NO: 1906280 - RNA, 24 nt, Homo sapiens
gcagggaauugauccacuucuuaa

SEQ ID NO: 1906281 - RNA, 18 nt, Homo sapiens
uguccagguuaguuuacu

SEQ ID NO: 1906282 - RNA, 15 nt, Homo sapiens
acuucuaaaugaagu

SEQ ID NO: 1906283 - RNA, 21 nt, Homo sapiens
gccuaccucaaguucuuggac

SEQ ID NO: 1906284 - RNA, 21 nt, Homo sapiens
ucgcuacuggcaucuguuauc

SEQ ID NO: 1906285 - RNA, 12 nt, Homo sapiens
auuccaucuuac

SEQ ID NO: 1906286 - RNA, 13 nt, Homo sapiens
uggcacccaagac

SEQ ID NO: 1906287 - RNA, 20 nt, Homo sapiens
gaugccacgcacuuccucuc

SEQ ID NO: 1906288 - RNA, 22 nt, Homo sapiens
cuuuggucuauuuucugcagaa

SEQ ID NO: 1906289 - RNA, 18 nt, Homo sapiens
uccacaaaugcuauucag

SEQ ID NO: 1906290 - RNA, 19 nt, Homo sapiens
guacaaucaugaacagcuc

SEQ ID NO: 1906291 - RNA, 20 nt, Homo sapiens
gcgucaugacgugcaugaga

SEQ ID NO: 1906292 - RNA, 17 nt, Homo sapiens
auagaauaaaagcuaua

SEQ ID NO: 1906293 - RNA, 13 nt, Homo sapiens
aacaucuuuucac

SEQ ID NO: 1906294 - RNA, 13 nt, Homo sapiens
aaugccuuuuugu

SEQ ID NO: 1906295 - RNA, 13 nt, Homo sapiens
accuaguuugcac

SEQ ID NO: 1906296 - RNA, 18 nt, Homo sapiens
ggaaggcugugauaacca

SEQ ID NO: 1906297 - RNA, 17 nt, Homo sapiens
agccuguggugcuugaa

SEQ ID NO: 1906298 - RNA, 14 nt, Homo sapiens
aguucccaaaggga

SEQ ID NO: 1906299 - RNA, 20 nt, Homo sapiens
uuggacauuaagcaucacaa

SEQ ID NO: 1906300 - RNA, 24 nt, Homo sapiens
cauauaggggcaaaaauuugacau

SEQ ID NO: 1906301 - RNA, 14 nt, Homo sapiens
uucaaggaaaguga

SEQ ID NO: 1906302 - RNA, 13 nt, Homo sapiens
cauggacauucau

SEQ ID NO: 1906303 - RNA, 22 nt, Homo sapiens
uauucaugcugaggugauucag

SEQ ID NO: 1906304 - RNA, 21 nt, Homo sapiens
aaggagccagacuuguucuca

SEQ ID NO: 1906305 - RNA, 19 nt, Homo sapiens
ugaaaugcucuuuugcaca

SEQ ID NO: 1906306 - RNA, 23 nt, Homo sapiens
ccgugcccuguuuccaaugccaa

SEQ ID NO: 1906307 - RNA, 17 nt, Homo sapiens
guccucugcacugggaa

SEQ ID NO: 1906308 - RNA, 19 nt, Homo sapiens
acuucagaaagacagugac

SEQ ID NO: 1906309 - RNA, 14 nt, Homo sapiens
ugaguuaaagcagu

SEQ ID NO: 1906310 - RNA, 19 nt, Homo sapiens
uagccauguuaacaugaca

SEQ ID NO: 1906311 - RNA, 13 nt, Homo sapiens
ugggcuuccuccc

SEQ ID NO: 1906312 - RNA, 17 nt, Homo sapiens
acuccuggccucaagca

SEQ ID NO: 1906313 - RNA, 12 nt, Homo sapiens
aagccucugggu

SEQ ID NO: 1906314 - RNA, 15 nt, Homo sapiens
ggagaccugugcuag

SEQ ID NO: 1906315 - RNA, 15 nt, Homo sapiens
cuaaagaagguuuca

SEQ ID NO: 1906316 - RNA, 16 nt, Homo sapiens
auaaaccuggagauau

SEQ ID NO: 1906317 - RNA, 16 nt, Homo sapiens
gguggcggcugcacaa

SEQ ID NO: 1906318 - RNA, 16 nt, Homo sapiens
gaaaguauaauuugcu

SEQ ID NO: 1906319 - RNA, 13 nt, Homo sapiens
ggggcagagccag

SEQ ID NO: 1906320 - RNA, 17 nt, Homo sapiens
auuuguccaugugcaaa

SEQ ID NO: 1906321 - RNA, 19 nt, Homo sapiens
cccacggggugcaccgaac

SEQ ID NO: 1906322 - RNA, 17 nt, Homo sapiens
cuggucaccuugcacuc

SEQ ID NO: 1906323 - RNA, 19 nt, Homo sapiens
cgcacuucugauguccgua

SEQ ID NO: 1906324 - RNA, 23 nt, Homo sapiens
auuuacuguuuuaggucuagccu

SEQ ID NO: 1906325 - RNA, 21 nt, Homo sapiens
aggccauccauucacagccag

SEQ ID NO: 1906326 - RNA, 19 nt, Homo sapiens
ugcucacugccagugcaga

SEQ ID NO: 1906327 - RNA, 23 nt, Homo sapiens
auucauaaaguaaugaugaaauc

SEQ ID NO: 1906328 - RNA, 17 nt, Homo sapiens
cuaaaauucugucaggg

SEQ ID NO: 1906329 - RNA, 23 nt, Homo sapiens
uaauaggaauucaauuuggcaaa

SEQ ID NO: 1906330 - RNA, 14 nt, Homo sapiens
cccaaaacaaagua

SEQ ID NO: 1906331 - RNA, 20 nt, Homo sapiens
ggacaccccuuauccaggac

SEQ ID NO: 1906332 - RNA, 19 nt, Homo sapiens
aggaaaaaaacugggauaa

SEQ ID NO: 1906333 - RNA, 13 nt, Homo sapiens
gaacacucaaagg

SEQ ID NO: 1906334 - RNA, 17 nt, Homo sapiens
cucaaauucaaugauuc

SEQ ID NO: 1906335 - RNA, 16 nt, Homo sapiens
cacucccuaaagcccu

SEQ ID NO: 1906336 - RNA, 20 nt, Homo sapiens
ccaggcucuccgggccuuuc

SEQ ID NO: 1906337 - RNA, 14 nt, Homo sapiens
caauuccaccaaga

SEQ ID NO: 1906338 - RNA, 22 nt, Homo sapiens
aucaggaguccacugccuccau

SEQ ID NO: 1906339 - RNA, 19 nt, Homo sapiens
cuucugcauuccuguaacu

SEQ ID NO: 1906340 - RNA, 15 nt, Homo sapiens
cagccuuguuccuca

SEQ ID NO: 1906341 - RNA, 17 nt, Homo sapiens
augccuguaaucccaga

SEQ ID NO: 1906342 - RNA, 13 nt, Homo sapiens
ccugucccaugga

SEQ ID NO: 1906343 - RNA, 18 nt, Homo sapiens
uuauuguauuuauuccau

SEQ ID NO: 1906344 - RNA, 16 nt, Homo sapiens
aggcacugacugagca

SEQ ID NO: 1906345 - RNA, 13 nt, Homo sapiens
gugaaacaaaaaa

SEQ ID NO: 1906346 - RNA, 11 nt, Homo sapiens
aggacucuucc

SEQ ID NO: 1906347 - RNA, 22 nt, Homo sapiens
agacaaugauaugcaagugcaa

SEQ ID NO: 1906348 - RNA, 19 nt, Homo sapiens
agcaauucuccugccucag

SEQ ID NO: 1906349 - RNA, 19 nt, Homo sapiens
uggagcccacauauuucaa

SEQ ID NO: 1906350 - RNA, 10 nt, Homo sapiens
cucuucucaa

SEQ ID NO: 1906351 - RNA, 23 nt, Homo sapiens
aggcaauaauaagugaugugcug

SEQ ID NO: 1906352 - RNA, 19 nt, Homo sapiens
uaaucuuuaacugaacucu

SEQ ID NO: 1906353 - RNA, 19 nt, Homo sapiens
guucuuacacauuccaucu

SEQ ID NO: 1906354 - RNA, 16 nt, Homo sapiens
uagauggaauuuggaa

SEQ ID NO: 1906355 - RNA, 22 nt, Homo sapiens
gaagugugcugugacaagccaa

SEQ ID NO: 1906356 - RNA, 11 nt, Homo sapiens
ggcugggcuag

SEQ ID NO: 1906357 - RNA, 22 nt, Homo sapiens
cccuauuggguagaugagggga

SEQ ID NO: 1906358 - RNA, 15 nt, Homo sapiens
ucaggccagugccag

SEQ ID NO: 1906359 - RNA, 12 nt, Homo sapiens
caggucuuucaa

SEQ ID NO: 1906360 - RNA, 12 nt, Homo sapiens
cagaucuuucag

SEQ ID NO: 1906361 - RNA, 14 nt, Homo sapiens
gacauggagguucu

SEQ ID NO: 1906362 - RNA, 22 nt, Homo sapiens
cuaugaaaaauguguuccauug

SEQ ID NO: 1906363 - RNA, 17 nt, Homo sapiens
ucaaaaagauauuguug

SEQ ID NO: 1906364 - RNA, 20 nt, Homo sapiens
auuaauauggggaugcagca

SEQ ID NO: 1906365 - RNA, 13 nt, Homo sapiens
cagauggcugugg

SEQ ID NO: 1906366 - RNA, 23 nt, Homo sapiens
uccaaauuuauugugcauauucu

SEQ ID NO: 1906367 - RNA, 13 nt, Homo sapiens
aaggagaacaaga

SEQ ID NO: 1906368 - RNA, 22 nt, Homo sapiens
ucacagugugaguggucugugu

SEQ ID NO: 1906369 - RNA, 17 nt, Homo sapiens
cuccccucagauuccac

SEQ ID NO: 1906370 - RNA, 20 nt, Homo sapiens
uggaggaccagauugcucug

SEQ ID NO: 1906371 - RNA, 20 nt, Homo sapiens
ucuaagaaaaugaucuuaau

SEQ ID NO: 1906372 - RNA, 22 nt, Homo sapiens
cucccugguuuuaccccagcuc

SEQ ID NO: 1906373 - RNA, 21 nt, Homo sapiens
acuggagccugcaauaaggga

SEQ ID NO: 1906374 - RNA, 19 nt, Homo sapiens
cauucuguggccagccaaa

SEQ ID NO: 1906375 - RNA, 20 nt, Homo sapiens
ucccugcgcuucaucucaug

SEQ ID NO: 1906376 - RNA, 15 nt, Homo sapiens
ucauauaacugagau

SEQ ID NO: 1906377 - RNA, 14 nt, Homo sapiens
cucaucacuaccuu

SEQ ID NO: 1906378 - RNA, 22 nt, Homo sapiens
uucaaaauauguauucaguguu

SEQ ID NO: 1906379 - RNA, 11 nt, Homo sapiens
ggcagugcagu

SEQ ID NO: 1906380 - RNA, 12 nt, Homo sapiens
cucagggaccaa

SEQ ID NO: 1906381 - RNA, 21 nt, Homo sapiens
aguuccuaaagcaugggaucu

SEQ ID NO: 1906382 - RNA, 13 nt, Homo sapiens
guuaagagcucac

SEQ ID NO: 1906383 - RNA, 14 nt, Homo sapiens
ugaaaggcuuuuaa

SEQ ID NO: 1906384 - RNA, 17 nt, Homo sapiens
uuuuuguaaaggaaaua

SEQ ID NO: 1906385 - RNA, 21 nt, Homo sapiens
ucaccaaagcccacugccaug

SEQ ID NO: 1906386 - RNA, 17 nt, Homo sapiens
uuguuuugaaaaccuaa

SEQ ID NO: 1906387 - RNA, 21 nt, Homo sapiens
gagcccagaucgcaccacugc

SEQ ID NO: 1906388 - RNA, 20 nt, Homo sapiens
cuugaaaaaugcauguugcc

SEQ ID NO: 1906389 - RNA, 11 nt, Homo sapiens
gacaccaaauu

SEQ ID NO: 1906390 - RNA, 11 nt, Homo sapiens
gucaccaaaau

SEQ ID NO: 1906391 - RNA, 18 nt, Homo sapiens
uuaacucccuccaccagc

SEQ ID NO: 1906392 - RNA, 19 nt, Homo sapiens
ggauuuguccuuggggaca

SEQ ID NO: 1906393 - RNA, 22 nt, Homo sapiens
cagacuggcaauaaacuccuac

SEQ ID NO: 1906394 - RNA, 17 nt, Homo sapiens
uauuggauuuucacaga

SEQ ID NO: 1906395 - RNA, 15 nt, Homo sapiens
ggugaggagggcagu

SEQ ID NO: 1906396 - RNA, 15 nt, Homo sapiens
gaagucugagggaaa

SEQ ID NO: 1906397 - RNA, 13 nt, Homo sapiens
ggcccucuguggu

SEQ ID NO: 1906398 - RNA, 18 nt, Homo sapiens
cacccucuccuccagugu

SEQ ID NO: 1906399 - RNA, 13 nt, Homo sapiens
gcuuuucucccag

SEQ ID NO: 1906400 - RNA, 16 nt, Homo sapiens
ccagagcccacuucca

SEQ ID NO: 1906401 - RNA, 20 nt, Homo sapiens
uucagaauaacagcacguga

SEQ ID NO: 1906402 - RNA, 22 nt, Homo sapiens
ggccuccuaaagugcugggauu

SEQ ID NO: 1906403 - RNA, 18 nt, Homo sapiens
cuucaguacucaaauuca

SEQ ID NO: 1906404 - RNA, 22 nt, Homo sapiens
ccaguuauugugaaaacagaag

SEQ ID NO: 1906405 - RNA, 19 nt, Homo sapiens
augcacaaaaauaauguga

SEQ ID NO: 1906406 - RNA, 13 nt, Homo sapiens
gaagaaaaauaau

SEQ ID NO: 1906407 - RNA, 15 nt, Homo sapiens
ucaggccugaacuca

SEQ ID NO: 1906408 - RNA, 18 nt, Homo sapiens
cggcacccugauccucac

SEQ ID NO: 1906409 - RNA, 17 nt, Homo sapiens
gacaggaacccaucacu

SEQ ID NO: 1906410 - RNA, 17 nt, Homo sapiens
uguaagcaagucacuua

SEQ ID NO: 1906411 - RNA, 17 nt, Homo sapiens
cuagaggagacagccug

SEQ ID NO: 1906412 - RNA, 20 nt, Homo sapiens
auuuugagaucaucagugau

SEQ ID NO: 1906413 - RNA, 13 nt, Homo sapiens
aggagcagcccug

SEQ ID NO: 1906414 - RNA, 16 nt, Homo sapiens
acaaugcaugugcugu

SEQ ID NO: 1906415 - RNA, 18 nt, Homo sapiens
auggcuccuugcccucaa

SEQ ID NO: 1906416 - RNA, 15 nt, Homo sapiens
guccagcucguucuc

SEQ ID NO: 1906417 - RNA, 15 nt, Homo sapiens
agggcugagugucca

SEQ ID NO: 1906418 - RNA, 17 nt, Homo sapiens
cacaccugacaaaugga

SEQ ID NO: 1906419 - RNA, 20 nt, Homo sapiens
ccagagcuggaccugagcua

SEQ ID NO: 1906420 - RNA, 23 nt, Homo sapiens
acacugcugagguuuuauacuca

SEQ ID NO: 1906421 - RNA, 21 nt, Homo sapiens
uagcuuuccuuuacagcuguu

SEQ ID NO: 1906422 - RNA, 22 nt, Homo sapiens
gaguccauguggacugugccau

SEQ ID NO: 1906423 - RNA, 18 nt, Homo sapiens
uucauaaggauucaggga

SEQ ID NO: 1906424 - RNA, 23 nt, Homo sapiens
ugagccuggcuggagagcugcua

SEQ ID NO: 1906425 - RNA, 18 nt, Homo sapiens
uuccaugucugaaguuug

SEQ ID NO: 1906426 - RNA, 15 nt, Homo sapiens
caaggacucuuccac

SEQ ID NO: 1906427 - RNA, 14 nt, Homo sapiens
uauuguccauauca

SEQ ID NO: 1906428 - RNA, 16 nt, Homo sapiens
caauuauuugaagauu

SEQ ID NO: 1906429 - RNA, 14 nt, Homo sapiens
aguucccuccugca

SEQ ID NO: 1906430 - RNA, 15 nt, Homo sapiens
cuacaaccagagccc

SEQ ID NO: 1906431 - RNA, 21 nt, Homo sapiens
agaauggauucaacacugugc

SEQ ID NO: 1906432 - RNA, 17 nt, Homo sapiens
uuuguaaagcccuugca

SEQ ID NO: 1906433 - RNA, 14 nt, Homo sapiens
aguaaauucucucc

SEQ ID NO: 1906434 - RNA, 22 nt, Homo sapiens
auguuuaaggaaaugugcagga

SEQ ID NO: 1906435 - RNA, 21 nt, Homo sapiens
ggccauucuuuuuuucuuggc

SEQ ID NO: 1906436 - RNA, 14 nt, Homo sapiens
cagccuuccagugg

SEQ ID NO: 1906437 - RNA, 23 nt, Homo sapiens
acuccccuguuucaaucacuguc

SEQ ID NO: 1906438 - RNA, 16 nt, Homo sapiens
gccauggccugugcug

SEQ ID NO: 1906439 - RNA, 17 nt, Homo sapiens
auggcuuaaaagcaagu

SEQ ID NO: 1906440 - RNA, 20 nt, Homo sapiens
caauaggaacaacaaaaaga

SEQ ID NO: 1906441 - RNA, 18 nt, Homo sapiens
acuccagauacauacccc

SEQ ID NO: 1906442 - RNA, 15 nt, Homo sapiens
auugacaagguguuu

SEQ ID NO: 1906443 - RNA, 14 nt, Homo sapiens
aauuuugcacugaa

SEQ ID NO: 1906444 - RNA, 13 nt, Homo sapiens
uaguaaacugugc

SEQ ID NO: 1906445 - RNA, 15 nt, Homo sapiens
uacgggcugcucuac

SEQ ID NO: 1906446 - RNA, 20 nt, Homo sapiens
agagcgaaacuccaucucaa

SEQ ID NO: 1906447 - RNA, 20 nt, Homo sapiens
agagcaaaacuccgucucaa

SEQ ID NO: 1906448 - RNA, 15 nt, Homo sapiens
aguaauaacuguuag

SEQ ID NO: 1906449 - RNA, 13 nt, Homo sapiens
uauucacaggaca

SEQ ID NO: 1906450 - RNA, 23 nt, Homo sapiens
accucaagugcaaggaccaaagg

SEQ ID NO: 1906451 - RNA, 13 nt, Homo sapiens
ucuuaaccuaccu

SEQ ID NO: 1906452 - RNA, 16 nt, Homo sapiens
uuugaagauagaaggu

SEQ ID NO: 1906453 - RNA, 24 nt, Homo sapiens
auauguguguaaaaugugaauaau

SEQ ID NO: 1906454 - RNA, 16 nt, Homo sapiens
ccagagaccugcucca

SEQ ID NO: 1906455 - RNA, 18 nt, Homo sapiens
cggcagccccccccucaa

SEQ ID NO: 1906456 - RNA, 19 nt, Homo sapiens
gcccugggccccaccaccu

SEQ ID NO: 1906457 - RNA, 13 nt, Homo sapiens
gaaggcaugccua

SEQ ID NO: 1906458 - RNA, 16 nt, Homo sapiens
aauaaccugccagucc

SEQ ID NO: 1906459 - RNA, 15 nt, Homo sapiens
ucagauucagcauuu

SEQ ID NO: 1906460 - RNA, 16 nt, Homo sapiens
augccccaaggacaag

SEQ ID NO: 1906461 - RNA, 23 nt, Homo sapiens
agugugcuguugcccuacacugc

SEQ ID NO: 1906462 - RNA, 22 nt, Homo sapiens
gacagcccuuccucccauuucc

SEQ ID NO: 1906463 - RNA, 21 nt, Homo sapiens
aguuuauauuuuuucucaaaa

SEQ ID NO: 1906464 - RNA, 14 nt, Homo sapiens
ugugaacguguaug

SEQ ID NO: 1906465 - RNA, 15 nt, Homo sapiens
ccacugcuguuuuca

SEQ ID NO: 1906466 - RNA, 12 nt, Homo sapiens
aauucauucucu

SEQ ID NO: 1906467 - RNA, 15 nt, Homo sapiens
cugaauuaaauaugg

SEQ ID NO: 1906468 - RNA, 17 nt, Homo sapiens
ugguuauuggaaggcaa

SEQ ID NO: 1906469 - RNA, 14 nt, Homo sapiens
gcacccucccaguu

SEQ ID NO: 1906470 - RNA, 17 nt, Homo sapiens
gagucacugagaccaag

SEQ ID NO: 1906471 - RNA, 20 nt, Homo sapiens
ugcaaggugauauauaauca

SEQ ID NO: 1906472 - RNA, 17 nt, Homo sapiens
augaaauacugagaugc

SEQ ID NO: 1906473 - RNA, 16 nt, Homo sapiens
augagcaauguggaua

SEQ ID NO: 1906474 - RNA, 15 nt, Homo sapiens
aaaauguacaauuaa

SEQ ID NO: 1906475 - RNA, 16 nt, Homo sapiens
uguguuugggagaaaa

SEQ ID NO: 1906476 - RNA, 13 nt, Homo sapiens
agcaguaagcuau

SEQ ID NO: 1906477 - RNA, 19 nt, Homo sapiens
aagucuaguuaccuacuuu

SEQ ID NO: 1906478 - RNA, 20 nt, Homo sapiens
gucuuaggaauugaauuaau

SEQ ID NO: 1906479 - RNA, 18 nt, Homo sapiens
cuccaucccaacagccau

SEQ ID NO: 1906480 - RNA, 21 nt, Homo sapiens
cugacccccaucgcucugagc

SEQ ID NO: 1906481 - RNA, 17 nt, Homo sapiens
ccaccgggccugaacca

SEQ ID NO: 1906482 - RNA, 23 nt, Homo sapiens
gccuccacuucuccccucaagaa

SEQ ID NO: 1906483 - RNA, 14 nt, Homo sapiens
acacaacaucugag

SEQ ID NO: 1906484 - RNA, 17 nt, Homo sapiens
uggagagccccugcuaa

SEQ ID NO: 1906485 - RNA, 22 nt, Homo sapiens
gaaguauuuuccuccaggcaaa

SEQ ID NO: 1906486 - RNA, 13 nt, Homo sapiens
guaaaauguuuca

SEQ ID NO: 1906487 - RNA, 13 nt, Homo sapiens
gcuuuugugucua

SEQ ID NO: 1906488 - RNA, 21 nt, Homo sapiens
augucguuugaaucacaguau

SEQ ID NO: 1906489 - RNA, 11 nt, Homo sapiens
uaaucucagga

SEQ ID NO: 1906490 - RNA, 21 nt, Homo sapiens
gauaaggcuguuaacauuaca

SEQ ID NO: 1906491 - RNA, 15 nt, Homo sapiens
cugucgucuuagcaa

SEQ ID NO: 1906492 - RNA, 22 nt, Homo sapiens
uccaccucauggauugccacag

SEQ ID NO: 1906493 - RNA, 14 nt, Homo sapiens
ugccaaccuguaau

SEQ ID NO: 1906494 - RNA, 17 nt, Homo sapiens
caucuggcugccuuugc

SEQ ID NO: 1906495 - RNA, 16 nt, Homo sapiens
ccaggggaacucgcca

SEQ ID NO: 1906496 - RNA, 13 nt, Homo sapiens
ccagcuaucuuuc

SEQ ID NO: 1906497 - RNA, 13 nt, Homo sapiens
auuuuuauacagu

SEQ ID NO: 1906498 - RNA, 21 nt, Homo sapiens
gagaacacaagccacgccugc

SEQ ID NO: 1906499 - RNA, 13 nt, Homo sapiens
uguggguguccug

SEQ ID NO: 1906500 - RNA, 21 nt, Homo sapiens
cuggccucuagaacacccacu

SEQ ID NO: 1906501 - RNA, 15 nt, Homo sapiens
augugcgcacacaca

SEQ ID NO: 1906502 - RNA, 19 nt, Homo sapiens
cuucaccgugacauuccag

SEQ ID NO: 1906503 - RNA, 16 nt, Homo sapiens
ucuguucuugaagcag

SEQ ID NO: 1906504 - RNA, 23 nt, Homo sapiens
acaccacuuucccacacugugaa

SEQ ID NO: 1906505 - RNA, 14 nt, Homo sapiens
acucgggagcugca

SEQ ID NO: 1906506 - RNA, 19 nt, Homo sapiens
cagggaggaagaagcuuag

SEQ ID NO: 1906507 - RNA, 17 nt, Homo sapiens
auugagaaugugcuuug

SEQ ID NO: 1906508 - RNA, 18 nt, Homo sapiens
ugaguauuccuagcaaau

SEQ ID NO: 1906509 - RNA, 16 nt, Homo sapiens
agcauuaagaacacuu

SEQ ID NO: 1906510 - RNA, 16 nt, Homo sapiens
cccguuagucucugaa

SEQ ID NO: 1906511 - RNA, 14 nt, Homo sapiens
gguuuccaggccac

SEQ ID NO: 1906512 - RNA, 22 nt, Homo sapiens
uuuggaguaaauauauauguca

SEQ ID NO: 1906513 - RNA, 22 nt, Homo sapiens
gcaauguguggcugaagacuuu

SEQ ID NO: 1906514 - RNA, 21 nt, Homo sapiens
acuaaggcugaaaaugugcau

SEQ ID NO: 1906515 - RNA, 16 nt, Homo sapiens
ccagacauugcucuca

SEQ ID NO: 1906516 - RNA, 15 nt, Homo sapiens
ccauuuuggugcuua

SEQ ID NO: 1906517 - RNA, 15 nt, Homo sapiens
aauugcuucuucuuc

SEQ ID NO: 1906518 - RNA, 18 nt, Homo sapiens
cugucacugcuugaggga

SEQ ID NO: 1906519 - RNA, 17 nt, Homo sapiens
uauucuuacuaaucuga

SEQ ID NO: 1906520 - RNA, 17 nt, Homo sapiens
cuaauuuaaaccagcag

SEQ ID NO: 1906521 - RNA, 17 nt, Homo sapiens
ucugcuuaccaaaacau

SEQ ID NO: 1906522 - RNA, 14 nt, Homo sapiens
uacaaagaccuaga

SEQ ID NO: 1906523 - RNA, 18 nt, Homo sapiens
ugucucccagcucagggc

SEQ ID NO: 1906524 - RNA, 20 nt, Homo sapiens
ucaaugcugcaggauggacu

SEQ ID NO: 1906525 - RNA, 14 nt, Homo sapiens
acaacaacauguac

SEQ ID NO: 1906526 - RNA, 16 nt, Homo sapiens
ccugacacucaauaaa

SEQ ID NO: 1906527 - RNA, 20 nt, Homo sapiens
cacagagaagcggauuucca

SEQ ID NO: 1906528 - RNA, 14 nt, Homo sapiens
uaaauaccuucuug

SEQ ID NO: 1906529 - RNA, 13 nt, Homo sapiens
ucagagaccagca

SEQ ID NO: 1906530 - RNA, 20 nt, Homo sapiens
caaaucuacgguuaugaagg

SEQ ID NO: 1906531 - RNA, 13 nt, Homo sapiens
ccgagaccccauc

SEQ ID NO: 1906532 - RNA, 11 nt, Homo sapiens
gucaacaaacu

SEQ ID NO: 1906533 - RNA, 21 nt, Homo sapiens
uuugccaacagaaacaugcca

SEQ ID NO: 1906534 - RNA, 14 nt, Homo sapiens
agaccuaacuguga

SEQ ID NO: 1906535 - RNA, 22 nt, Homo sapiens
gggcagggcuggcaccucucaa

SEQ ID NO: 1906536 - RNA, 19 nt, Homo sapiens
ugacaauuugccauagcag

SEQ ID NO: 1906537 - RNA, 18 nt, Homo sapiens
cuaaugcauaagcuuuuu

SEQ ID NO: 1906538 - RNA, 18 nt, Homo sapiens
ccauaugaccucaugcau

SEQ ID NO: 1906539 - RNA, 16 nt, Homo sapiens
uauaaucucuucuuau

SEQ ID NO: 1906540 - RNA, 12 nt, Homo sapiens
uugguucacuuu

SEQ ID NO: 1906541 - RNA, 20 nt, Homo sapiens
aauaauuucuccucauuuaa

SEQ ID NO: 1906542 - RNA, 15 nt, Homo sapiens
auuuggauugcuaau

SEQ ID NO: 1906543 - RNA, 13 nt, Homo sapiens
uguacacaguuua

SEQ ID NO: 1906544 - RNA, 22 nt, Homo sapiens
uuugggaggcugaggcaggaga

SEQ ID NO: 1906545 - RNA, 14 nt, Homo sapiens
gcacccuugcgcuu

SEQ ID NO: 1906546 - RNA, 14 nt, Homo sapiens
cugguuuucuagcc

SEQ ID NO: 1906547 - RNA, 19 nt, Homo sapiens
gaaucacauacagugcugc

SEQ ID NO: 1906548 - RNA, 19 nt, Homo sapiens
aagggcacucccaacccug

SEQ ID NO: 1906549 - RNA, 11 nt, Homo sapiens
auaacucugug

SEQ ID NO: 1906550 - RNA, 13 nt, Homo sapiens
auucuuuccccag

SEQ ID NO: 1906551 - RNA, 14 nt, Homo sapiens
gcucaccguggauu

SEQ ID NO: 1906552 - RNA, 21 nt, Homo sapiens
ccuuauuguaccucucuuaua

SEQ ID NO: 1906553 - RNA, 18 nt, Homo sapiens
cuacauguaaugacacuu

SEQ ID NO: 1906554 - RNA, 19 nt, Homo sapiens
ccaggguuccagacagggu

SEQ ID NO: 1906555 - RNA, 21 nt, Homo sapiens
augacaauaaauuuuaucuca

SEQ ID NO: 1906556 - RNA, 22 nt, Homo sapiens
agacuacauauugucacugaca

SEQ ID NO: 1906557 - RNA, 23 nt, Homo sapiens
uugaggucaaguaagaagacaug

SEQ ID NO: 1906558 - RNA, 21 nt, Homo sapiens
caaccuugacuucugcccaaa

SEQ ID NO: 1906559 - RNA, 19 nt, Homo sapiens
auguaggugauguuuccag

SEQ ID NO: 1906560 - RNA, 23 nt, Homo sapiens
uguuuauuucaggcauuggauau

SEQ ID NO: 1906561 - RNA, 23 nt, Homo sapiens
aaaacagcauaguacuggcacaa

SEQ ID NO: 1906562 - RNA, 11 nt, Homo sapiens
ggucucaaagu

SEQ ID NO: 1906563 - RNA, 16 nt, Homo sapiens
ugaaacauguacuuug

SEQ ID NO: 1906564 - RNA, 20 nt, Homo sapiens
gagccuuuucuuauauaaga

SEQ ID NO: 1906565 - RNA, 13 nt, Homo sapiens
gggccaggggacc

SEQ ID NO: 1906566 - RNA, 12 nt, Homo sapiens
auauaccaaauu

SEQ ID NO: 1906567 - RNA, 23 nt, Homo sapiens
ugagcuugaucuuuuucugccau

SEQ ID NO: 1906568 - RNA, 17 nt, Homo sapiens
cagagacacuguugaua

SEQ ID NO: 1906569 - RNA, 23 nt, Homo sapiens
agaauuaagcugugcaauuacug

SEQ ID NO: 1906570 - RNA, 22 nt, Homo sapiens
caaauaucauacuguucaaugg

SEQ ID NO: 1906571 - RNA, 16 nt, Homo sapiens
aauuauaaacaucaca

SEQ ID NO: 1906572 - RNA, 19 nt, Homo sapiens
auaugacuccuuucucuau

SEQ ID NO: 1906573 - RNA, 19 nt, Homo sapiens
caucuuccaacccacuggc

SEQ ID NO: 1906574 - RNA, 21 nt, Homo sapiens
cuuugaggcucugucacugag

SEQ ID NO: 1906575 - RNA, 21 nt, Homo sapiens
cacuccaggauauugacaaga

SEQ ID NO: 1906576 - RNA, 16 nt, Homo sapiens
agauuuguacauauua

SEQ ID NO: 1906577 - RNA, 16 nt, Homo sapiens
ugggacuggagucaga

SEQ ID NO: 1906578 - RNA, 15 nt, Homo sapiens
gccucaucuccuuua

SEQ ID NO: 1906579 - RNA, 13 nt, Homo sapiens
auuccacuggacu

SEQ ID NO: 1906580 - RNA, 13 nt, Homo sapiens
auuuaaagcauuu

SEQ ID NO: 1906581 - RNA, 18 nt, Homo sapiens
agaugccaaaccacaaga

SEQ ID NO: 1906582 - RNA, 13 nt, Homo sapiens
auacuuagauuag

SEQ ID NO: 1906583 - RNA, 17 nt, Homo sapiens
uuacuaugaucucagga

SEQ ID NO: 1906584 - RNA, 9 nt, Homo sapiens
ggaacuuua

SEQ ID NO: 1906585 - RNA, 21 nt, Homo sapiens
uaaccgagccagcagcugaag

SEQ ID NO: 1906586 - RNA, 13 nt, Homo sapiens
uacaucucagugc

SEQ ID NO: 1906587 - RNA, 13 nt, Homo sapiens
cuugauggugaca

SEQ ID NO: 1906588 - RNA, 18 nt, Homo sapiens
cauauaacgucaugugca

SEQ ID NO: 1906589 - RNA, 22 nt, Homo sapiens
aggcuaaaaaacggauuuccuc

SEQ ID NO: 1906590 - RNA, 17 nt, Homo sapiens
gaaaaacucaaccaaau

SEQ ID NO: 1906591 - RNA, 21 nt, Homo sapiens
caccaaugggccuccagagac

SEQ ID NO: 1906592 - RNA, 15 nt, Homo sapiens
uccuaagccauaaaa

SEQ ID NO: 1906593 - RNA, 23 nt, Homo sapiens
auucucucuuauuguucuuucau

SEQ ID NO: 1906594 - RNA, 16 nt, Homo sapiens
cugugugaucuucagu

SEQ ID NO: 1906595 - RNA, 16 nt, Homo sapiens
cuuagacuucgacuca

SEQ ID NO: 1906596 - RNA, 19 nt, Homo sapiens
gaagcauacaaagcaguuu

SEQ ID NO: 1906597 - RNA, 18 nt, Homo sapiens
aagacuaaaugcacauuu

SEQ ID NO: 1906598 - RNA, 22 nt, Homo sapiens
cucccugucucugcaucugacu

SEQ ID NO: 1906599 - RNA, 15 nt, Homo sapiens
agcacgguggugccc

SEQ ID NO: 1906600 - RNA, 11 nt, Homo sapiens
uuugcacagaa

SEQ ID NO: 1906601 - RNA, 14 nt, Homo sapiens
aucauaguuauuaa

SEQ ID NO: 1906602 - RNA, 14 nt, Homo sapiens
cagcuaagcucaaa

SEQ ID NO: 1906603 - RNA, 23 nt, Homo sapiens
acauauuuuuauacuuuauugaa

SEQ ID NO: 1906604 - RNA, 19 nt, Homo sapiens
cccggcucguguauuuauu

SEQ ID NO: 1906605 - RNA, 11 nt, Homo sapiens
auaaauccaac

SEQ ID NO: 1906606 - RNA, 23 nt, Homo sapiens
uauugugaccacugaauucacuc

SEQ ID NO: 1906607 - RNA, 15 nt, Homo sapiens
agcccuggugcugua

SEQ ID NO: 1906608 - RNA, 16 nt, Homo sapiens
ugacccagaacaggac

SEQ ID NO: 1906609 - RNA, 16 nt, Homo sapiens
auacacaacuguuccc

SEQ ID NO: 1906610 - RNA, 22 nt, Homo sapiens
gccaggauggucuugaucuccu

SEQ ID NO: 1906611 - RNA, 15 nt, Homo sapiens
uaggccacacagcac

SEQ ID NO: 1906612 - RNA, 15 nt, Homo sapiens
gaccucccacugccc

SEQ ID NO: 1906613 - RNA, 21 nt, Homo sapiens
agaggagugggaaauugauua

SEQ ID NO: 1906614 - RNA, 14 nt, Homo sapiens
cuccugagccugug

SEQ ID NO: 1906615 - RNA, 23 nt, Homo sapiens
ucuauuauuuggagccugccaag

SEQ ID NO: 1906616 - RNA, 15 nt, Homo sapiens
cuguacggacacugu

SEQ ID NO: 1906617 - RNA, 11 nt, Homo sapiens
auuccaaggaa

SEQ ID NO: 1906618 - RNA, 17 nt, Homo sapiens
auuuuccuguccucuuu

SEQ ID NO: 1906619 - RNA, 13 nt, Homo sapiens
aauacgugucaaa

SEQ ID NO: 1906620 - RNA, 13 nt, Homo sapiens
acaaaguguauac

SEQ ID NO: 1906621 - RNA, 21 nt, Homo sapiens
uacugcaggaccuccagcuga

SEQ ID NO: 1906622 - RNA, 18 nt, Homo sapiens
guuuguugccccauuccu

SEQ ID NO: 1906623 - RNA, 20 nt, Homo sapiens
uucucuuuguauuucaucuc

SEQ ID NO: 1906624 - RNA, 18 nt, Homo sapiens
cucccguacaaacuugga

SEQ ID NO: 1906625 - RNA, 18 nt, Homo sapiens
aagagugauugcagcuuu

SEQ ID NO: 1906626 - RNA, 12 nt, Homo sapiens
acauuagccuug

SEQ ID NO: 1906627 - RNA, 22 nt, Homo sapiens
uuucucuucucagcucuuccau

SEQ ID NO: 1906628 - RNA, 23 nt, Homo sapiens
agugugugucuuuccucccugaa

SEQ ID NO: 1906629 - RNA, 17 nt, Homo sapiens
uaaacaagcugugguau

SEQ ID NO: 1906630 - RNA, 20 nt, Homo sapiens
ugccaaccugcccagcugcu

SEQ ID NO: 1906631 - RNA, 13 nt, Homo sapiens
auugacagcaauu

SEQ ID NO: 1906632 - RNA, 19 nt, Homo sapiens
aacuuucccuccaccagug

SEQ ID NO: 1906633 - RNA, 20 nt, Homo sapiens
ugugguacugucauugauaa

SEQ ID NO: 1906634 - RNA, 20 nt, Homo sapiens
gaggcugcacccacccagga

SEQ ID NO: 1906635 - RNA, 20 nt, Homo sapiens
ugaccaauugugcugccauu

SEQ ID NO: 1906636 - RNA, 16 nt, Homo sapiens
gugcagaugggcuguu

SEQ ID NO: 1906637 - RNA, 18 nt, Homo sapiens
ugcauuuaugaugcaguu

SEQ ID NO: 1906638 - RNA, 19 nt, Homo sapiens
aucuagcuucaugccucag

SEQ ID NO: 1906639 - RNA, 15 nt, Homo sapiens
uuaaucaccacucaa

SEQ ID NO: 1906640 - RNA, 15 nt, Homo sapiens
ugcaacagugccaug

SEQ ID NO: 1906641 - RNA, 15 nt, Homo sapiens
agcauagaaaccacu

SEQ ID NO: 1906642 - RNA, 19 nt, Homo sapiens
ucaggaggccguugcagac

SEQ ID NO: 1906643 - RNA, 12 nt, Homo sapiens
cagacuccaugg

SEQ ID NO: 1906644 - RNA, 16 nt, Homo sapiens
uuaaaaucugugaaga

SEQ ID NO: 1906645 - RNA, 20 nt, Homo sapiens
ugacuggacagcgguuguaa

SEQ ID NO: 1906646 - RNA, 20 nt, Homo sapiens
cuuuuuuuucuucaccucac

SEQ ID NO: 1906647 - RNA, 12 nt, Homo sapiens
ugccagacaugu

SEQ ID NO: 1906648 - RNA, 12 nt, Homo sapiens
uggcagacaucu

SEQ ID NO: 1906649 - RNA, 17 nt, Homo sapiens
gcuuucccugaacuggg

SEQ ID NO: 1906650 - RNA, 16 nt, Homo sapiens
acacauuucaaaugag

SEQ ID NO: 1906651 - RNA, 18 nt, Homo sapiens
cagcuuugggcacaugua

SEQ ID NO: 1906652 - RNA, 14 nt, Homo sapiens
cgcccccucccuau

SEQ ID NO: 1906653 - RNA, 14 nt, Homo sapiens
ccauguccaaagag

SEQ ID NO: 1906654 - RNA, 22 nt, Homo sapiens
ggugcauguccccugcuugaac

SEQ ID NO: 1906655 - RNA, 16 nt, Homo sapiens
uugcccuugugcucca

SEQ ID NO: 1906656 - RNA, 16 nt, Homo sapiens
ucauuagcugugauuu

SEQ ID NO: 1906657 - RNA, 22 nt, Homo sapiens
caauucaaauccauagauuucg

SEQ ID NO: 1906658 - RNA, 21 nt, Homo sapiens
uggggaagugucccugugauc

SEQ ID NO: 1906659 - RNA, 21 nt, Homo sapiens
cauagguuagauucucauuca

SEQ ID NO: 1906660 - RNA, 20 nt, Homo sapiens
uaagagguugcuaaugccuu

SEQ ID NO: 1906661 - RNA, 18 nt, Homo sapiens
gaaaauaaaauuaagaau

SEQ ID NO: 1906662 - RNA, 21 nt, Homo sapiens
caaucucgccuuccugcaguc

SEQ ID NO: 1906663 - RNA, 18 nt, Homo sapiens
uauuuuggaggugcuuga

SEQ ID NO: 1906664 - RNA, 23 nt, Homo sapiens
cuagugcaguuuuuuucuugucu

SEQ ID NO: 1906665 - RNA, 18 nt, Homo sapiens
aacggaugaggucauuuc

SEQ ID NO: 1906666 - RNA, 17 nt, Homo sapiens
uacacaaagggaugugu

SEQ ID NO: 1906667 - RNA, 20 nt, Homo sapiens
gcccaugccuccagcuacaa

SEQ ID NO: 1906668 - RNA, 23 nt, Homo sapiens
uagcuuugcagugagugcugcuc

SEQ ID NO: 1906669 - RNA, 21 nt, Homo sapiens
caucauccugccccuguggca

SEQ ID NO: 1906670 - RNA, 12 nt, Homo sapiens
agcaugaugaaa

SEQ ID NO: 1906671 - RNA, 16 nt, Homo sapiens
ugcaagcacucggggu

SEQ ID NO: 1906672 - RNA, 17 nt, Homo sapiens
cauuaaauucacuuuca

SEQ ID NO: 1906673 - RNA, 16 nt, Homo sapiens
caguugccagugauaa

SEQ ID NO: 1906674 - RNA, 20 nt, Homo sapiens
ucuggccaaccaaagacacu

SEQ ID NO: 1906675 - RNA, 19 nt, Homo sapiens
agaauucacagaaccuacu

SEQ ID NO: 1906676 - RNA, 22 nt, Homo sapiens
aucuauuugaaaguucucagag

SEQ ID NO: 1906677 - RNA, 19 nt, Homo sapiens
cacggccaccacugcagcc

SEQ ID NO: 1906678 - RNA, 22 nt, Homo sapiens
auauuuacauccagcuucucau

SEQ ID NO: 1906679 - RNA, 23 nt, Homo sapiens
ucuccauuuucuucucugugaag

SEQ ID NO: 1906680 - RNA, 21 nt, Homo sapiens
aaagcuuguggccccuuuuac

SEQ ID NO: 1906681 - RNA, 17 nt, Homo sapiens
acagcaggacuccaucu

SEQ ID NO: 1906682 - RNA, 22 nt, Homo sapiens
cugugaauugccuguaacacau

SEQ ID NO: 1906683 - RNA, 16 nt, Homo sapiens
uaagccauguguucca

SEQ ID NO: 1906684 - RNA, 19 nt, Homo sapiens
uccaacaacgacacauuca

SEQ ID NO: 1906685 - RNA, 11 nt, Homo sapiens
uuaaacuguag

SEQ ID NO: 1906686 - RNA, 11 nt, Homo sapiens
cuaaacugcag

SEQ ID NO: 1906687 - RNA, 21 nt, Homo sapiens
ucuguggaucagagaugcacc

SEQ ID NO: 1906688 - RNA, 15 nt, Homo sapiens
agguaacuacugcua

SEQ ID NO: 1906689 - RNA, 14 nt, Homo sapiens
agcuguggacaaaa

SEQ ID NO: 1906690 - RNA, 22 nt, Homo sapiens
cccgacugugaaaguaugugau

SEQ ID NO: 1906691 - RNA, 17 nt, Homo sapiens
cugcagcucuacaggug

SEQ ID NO: 1906692 - RNA, 19 nt, Homo sapiens
ccauggaagucucaaagau

SEQ ID NO: 1906693 - RNA, 13 nt, Homo sapiens
aguaaucuuggcu

SEQ ID NO: 1906694 - RNA, 15 nt, Homo sapiens
cuguaccauccaugg

SEQ ID NO: 1906695 - RNA, 14 nt, Homo sapiens
cuuccagauuuccu

SEQ ID NO: 1906696 - RNA, 14 nt, Homo sapiens
cggccugauggcca

SEQ ID NO: 1906697 - RNA, 17 nt, Homo sapiens
ugccaccggaaauacca

SEQ ID NO: 1906698 - RNA, 13 nt, Homo sapiens
ggugacacucuau

SEQ ID NO: 1906699 - RNA, 14 nt, Homo sapiens
cuuuuuuaauuucc

SEQ ID NO: 1906700 - RNA, 23 nt, Homo sapiens
cucaacuuguguuuuguauuuaa

SEQ ID NO: 1906701 - RNA, 15 nt, Homo sapiens
uggaugaggagacag

SEQ ID NO: 1906702 - RNA, 21 nt, Homo sapiens
caaggguucuuggugaugcug

SEQ ID NO: 1906703 - RNA, 18 nt, Homo sapiens
cugcuucauccaauguga

SEQ ID NO: 1906704 - RNA, 12 nt, Homo sapiens
cccaaaucucaa

SEQ ID NO: 1906705 - RNA, 14 nt, Homo sapiens
aacagaaauuguau

SEQ ID NO: 1906706 - RNA, 20 nt, Homo sapiens
cugaggaaucuaauucagac

SEQ ID NO: 1906707 - RNA, 15 nt, Homo sapiens
agaauuucacaagcu

SEQ ID NO: 1906708 - RNA, 22 nt, Homo sapiens
ugcgaguccauuguggagccaa

SEQ ID NO: 1906709 - RNA, 21 nt, Homo sapiens
cugugccuuggugugcuguau

SEQ ID NO: 1906710 - RNA, 16 nt, Homo sapiens
acagccggagcaguug

SEQ ID NO: 1906711 - RNA, 21 nt, Homo sapiens
aaggcaagagaaacauucuuu

SEQ ID NO: 1906712 - RNA, 23 nt, Homo sapiens
uggagauuaccaggcagaugaua

SEQ ID NO: 1906713 - RNA, 19 nt, Homo sapiens
agacgcauuucgguugaga

SEQ ID NO: 1906714 - RNA, 13 nt, Homo sapiens
uguguggugcuac

SEQ ID NO: 1906715 - RNA, 16 nt, Homo sapiens
uauccugcuagcugua

SEQ ID NO: 1906716 - RNA, 16 nt, Homo sapiens
ugaaaaccuacauauu

SEQ ID NO: 1906717 - RNA, 16 nt, Homo sapiens
guggcaccaaccuugc

SEQ ID NO: 1906718 - RNA, 17 nt, Homo sapiens
acuuccucugcaaaaag

SEQ ID NO: 1906719 - RNA, 15 nt, Homo sapiens
ugauuauuacuucug

SEQ ID NO: 1906720 - RNA, 17 nt, Homo sapiens
aagcagauuuaacaauu

SEQ ID NO: 1906721 - RNA, 16 nt, Homo sapiens
uacuggauuugacuuc

SEQ ID NO: 1906722 - RNA, 12 nt, Homo sapiens
gaguauguguau

SEQ ID NO: 1906723 - RNA, 14 nt, Homo sapiens
ugcacuccaugagu

SEQ ID NO: 1906724 - RNA, 12 nt, Homo sapiens
uuaaugcuugua

SEQ ID NO: 1906725 - RNA, 23 nt, Homo sapiens
cuauccuaaaggcccacuggcau

SEQ ID NO: 1906726 - RNA, 17 nt, Homo sapiens
gcaucucccagcaagac

SEQ ID NO: 1906727 - RNA, 19 nt, Homo sapiens
ccuguguccuuagugaugu

SEQ ID NO: 1906728 - RNA, 16 nt, Homo sapiens
caggucuacagugaua

SEQ ID NO: 1906729 - RNA, 17 nt, Homo sapiens
uugaagaggagaacaaa

SEQ ID NO: 1906730 - RNA, 18 nt, Homo sapiens
auuagcugggaagaccaa

SEQ ID NO: 1906731 - RNA, 18 nt, Homo sapiens
gaccccuaaugucagcuu

SEQ ID NO: 1906732 - RNA, 19 nt, Homo sapiens
gugcaagugugugcacaug

SEQ ID NO: 1906733 - RNA, 14 nt, Homo sapiens
uuugacauuuacug

SEQ ID NO: 1906734 - RNA, 17 nt, Homo sapiens
gugcagaaaacauuguu

SEQ ID NO: 1906735 - RNA, 20 nt, Homo sapiens
agguagugauuaacugugaa

SEQ ID NO: 1906736 - RNA, 14 nt, Homo sapiens
guagugucacucaa

SEQ ID NO: 1906737 - RNA, 19 nt, Homo sapiens
caguuauguuuuauacucu

SEQ ID NO: 1906738 - RNA, 13 nt, Homo sapiens
aauuacagaagag

SEQ ID NO: 1906739 - RNA, 21 nt, Homo sapiens
cugugcauuguggcugucaaa

SEQ ID NO: 1906740 - RNA, 21 nt, Homo sapiens
gcuacauacuccaacugaaau

SEQ ID NO: 1906741 - RNA, 22 nt, Homo sapiens
acuacucucuuccuccacuuca

SEQ ID NO: 1906742 - RNA, 10 nt, Homo sapiens
guuccagguu

SEQ ID NO: 1906743 - RNA, 21 nt, Homo sapiens
cugaggaucacugacaaaaaa

SEQ ID NO: 1906744 - RNA, 16 nt, Homo sapiens
acaacugguccacuca

SEQ ID NO: 1906745 - RNA, 18 nt, Homo sapiens
gcugcauggcacugaccg

SEQ ID NO: 1906746 - RNA, 17 nt, Homo sapiens
agcugagcacuaaagga

SEQ ID NO: 1906747 - RNA, 19 nt, Homo sapiens
ugggcuuggccuuguguca

SEQ ID NO: 1906748 - RNA, 15 nt, Homo sapiens
uggcagucacaucuc

SEQ ID NO: 1906749 - RNA, 18 nt, Homo sapiens
ucaccuggaugugcagcc

SEQ ID NO: 1906750 - RNA, 13 nt, Homo sapiens
ugggacagaggag

SEQ ID NO: 1906751 - RNA, 23 nt, Homo sapiens
cauuuugucucucucacauuaag

SEQ ID NO: 1906752 - RNA, 17 nt, Homo sapiens
aucuagcacacucuucu

SEQ ID NO: 1906753 - RNA, 15 nt, Homo sapiens
uauuguucucacuua

SEQ ID NO: 1906754 - RNA, 18 nt, Homo sapiens
acuuaaccgcaucagaag

SEQ ID NO: 1906755 - RNA, 12 nt, Homo sapiens
uagcugagcuca

SEQ ID NO: 1906756 - RNA, 19 nt, Homo sapiens
augagcccaccauuguuca

SEQ ID NO: 1906757 - RNA, 13 nt, Homo sapiens
auaccacugcacc

SEQ ID NO: 1906758 - RNA, 21 nt, Homo sapiens
aagcaccuuugcucucagcca

SEQ ID NO: 1906759 - RNA, 11 nt, Homo sapiens
caacacuuugg

SEQ ID NO: 1906760 - RNA, 16 nt, Homo sapiens
acccaacuccacaggg

SEQ ID NO: 1906761 - RNA, 13 nt, Homo sapiens
gccuuuugcaaau

SEQ ID NO: 1906762 - RNA, 22 nt, Homo sapiens
ucccccuaaacauggcuguuaa

SEQ ID NO: 1906763 - RNA, 17 nt, Homo sapiens
gcugagcugaguggcca

SEQ ID NO: 1906764 - RNA, 16 nt, Homo sapiens
ccucugaggggcacuc

SEQ ID NO: 1906765 - RNA, 21 nt, Homo sapiens
ugggucccagauuggcucaca

SEQ ID NO: 1906766 - RNA, 13 nt, Homo sapiens
ccuacuacuuugu

SEQ ID NO: 1906767 - RNA, 13 nt, Homo sapiens
ccuguuacuuuac

SEQ ID NO: 1906768 - RNA, 16 nt, Homo sapiens
acgcuggacagcacuc

SEQ ID NO: 1906769 - RNA, 16 nt, Homo sapiens
ucuaagccaguuuuca

SEQ ID NO: 1906770 - RNA, 19 nt, Homo sapiens
ugagauuacagagaucuca

SEQ ID NO: 1906771 - RNA, 21 nt, Homo sapiens
aggaggcuccgugagcccuug

SEQ ID NO: 1906772 - RNA, 18 nt, Homo sapiens
aaaaucccuguucugcca

SEQ ID NO: 1906773 - RNA, 13 nt, Homo sapiens
uccaacuuaacau

SEQ ID NO: 1906774 - RNA, 17 nt, Homo sapiens
uagaacuucauggauca

SEQ ID NO: 1906775 - RNA, 23 nt, Homo sapiens
gaaaggaagaccucaagaaaaau

SEQ ID NO: 1906776 - RNA, 18 nt, Homo sapiens
uucaguuuuacucugcug

SEQ ID NO: 1906777 - RNA, 14 nt, Homo sapiens
caaucacaagaaga

SEQ ID NO: 1906778 - RNA, 14 nt, Homo sapiens
gcuuccaucugccc

SEQ ID NO: 1906779 - RNA, 16 nt, Homo sapiens
aagaccaguauuucag

SEQ ID NO: 1906780 - RNA, 23 nt, Homo sapiens
agucaauucuguuaaaacucaag

SEQ ID NO: 1906781 - RNA, 15 nt, Homo sapiens
cuuuucuacauacau

SEQ ID NO: 1906782 - RNA, 18 nt, Homo sapiens
caacagacuucugaaaua

SEQ ID NO: 1906783 - RNA, 14 nt, Homo sapiens
ugauuucugcccuu

SEQ ID NO: 1906784 - RNA, 23 nt, Homo sapiens
acaguggggaagagugacucucc

SEQ ID NO: 1906785 - RNA, 19 nt, Homo sapiens
cgugauuuugcuguagaag

SEQ ID NO: 1906786 - RNA, 16 nt, Homo sapiens
ugagucaucaaaaaga

SEQ ID NO: 1906787 - RNA, 15 nt, Homo sapiens
ucccucauguucuca

SEQ ID NO: 1906788 - RNA, 16 nt, Homo sapiens
cuagaaauacauggac

SEQ ID NO: 1906789 - RNA, 22 nt, Homo sapiens
gcucuguuaugcaagcacaaau

SEQ ID NO: 1906790 - RNA, 20 nt, Homo sapiens
gcaguauguacuucagugca

SEQ ID NO: 1906791 - RNA, 18 nt, Homo sapiens
guauucaaacaauuugaa

SEQ ID NO: 1906792 - RNA, 22 nt, Homo sapiens
cagggacacuccaacucuacac

SEQ ID NO: 1906793 - RNA, 20 nt, Homo sapiens
cagugagacacagaguggag

SEQ ID NO: 1906794 - RNA, 16 nt, Homo sapiens
ucacacugucuucuga

SEQ ID NO: 1906795 - RNA, 18 nt, Homo sapiens
agcuuauauauuacuugu

SEQ ID NO: 1906796 - RNA, 17 nt, Homo sapiens
auuuaccuucuaccucu

SEQ ID NO: 1906797 - RNA, 14 nt, Homo sapiens
ugguaccagcucac

SEQ ID NO: 1906798 - RNA, 21 nt, Homo sapiens
agcaccuuagacagucccugc

SEQ ID NO: 1906799 - RNA, 18 nt, Homo sapiens
cacuuccucuccacagga

SEQ ID NO: 1906800 - RNA, 14 nt, Homo sapiens
aaaccagugugaac

SEQ ID NO: 1906801 - RNA, 22 nt, Homo sapiens
ccaacagcuggacccugaccag

SEQ ID NO: 1906802 - RNA, 20 nt, Homo sapiens
acacugugucacaucacgaa

SEQ ID NO: 1906803 - RNA, 20 nt, Homo sapiens
acauuacaguuagagauuuu

SEQ ID NO: 1906804 - RNA, 19 nt, Homo sapiens
cauuaccgcguuguaaaau

SEQ ID NO: 1906805 - RNA, 19 nt, Homo sapiens
ucgggaauacuagggagaa

SEQ ID NO: 1906806 - RNA, 14 nt, Homo sapiens
aauauccagucaaa

SEQ ID NO: 1906807 - RNA, 21 nt, Homo sapiens
uggcuucauacccacucccug

SEQ ID NO: 1906808 - RNA, 18 nt, Homo sapiens
cucccuuccguccauccc

SEQ ID NO: 1906809 - RNA, 12 nt, Homo sapiens
uaauucuuuauc

SEQ ID NO: 1906810 - RNA, 12 nt, Homo sapiens
guucucuuguau

SEQ ID NO: 1906811 - RNA, 14 nt, Homo sapiens
uccaccccccagaa

SEQ ID NO: 1906812 - RNA, 20 nt, Homo sapiens
ucuguccugcccccaaggag

SEQ ID NO: 1906813 - RNA, 15 nt, Homo sapiens
augaaacuuguuuca

SEQ ID NO: 1906814 - RNA, 20 nt, Homo sapiens
caacuauuuuuccaaaauaa

SEQ ID NO: 1906815 - RNA, 14 nt, Homo sapiens
ugccuguaaucaca

SEQ ID NO: 1906816 - RNA, 15 nt, Homo sapiens
agaagugccaucuca

SEQ ID NO: 1906817 - RNA, 22 nt, Homo sapiens
acuccaucuugguaguucugug

SEQ ID NO: 1906818 - RNA, 12 nt, Homo sapiens
cuguuucuugcu

SEQ ID NO: 1906819 - RNA, 14 nt, Homo sapiens
uugccuaaacccua

SEQ ID NO: 1906820 - RNA, 20 nt, Homo sapiens
auaaagcacuguuuggauau

SEQ ID NO: 1906821 - RNA, 19 nt, Homo sapiens
aauuaguguggcuaaccaa

SEQ ID NO: 1906822 - RNA, 21 nt, Homo sapiens
cuggcagccauggccauggca

SEQ ID NO: 1906823 - RNA, 23 nt, Homo sapiens
cauuauuuuauuauaacauccac

SEQ ID NO: 1906824 - RNA, 16 nt, Homo sapiens
ugagcuuucuuugcac

SEQ ID NO: 1906825 - RNA, 14 nt, Homo sapiens
cugcuuucagugcc

SEQ ID NO: 1906826 - RNA, 20 nt, Homo sapiens
cuaauuuuaguauucauucu

SEQ ID NO: 1906827 - RNA, 16 nt, Homo sapiens
cauuuguguagcugag

SEQ ID NO: 1906828 - RNA, 20 nt, Homo sapiens
guuaaaauuaugaaucugau

SEQ ID NO: 1906829 - RNA, 14 nt, Homo sapiens
aaagaccaauguga

SEQ ID NO: 1906830 - RNA, 15 nt, Homo sapiens
ucccagaaguccaca

SEQ ID NO: 1906831 - RNA, 19 nt, Homo sapiens
uggccucacuaccagaaga

SEQ ID NO: 1906832 - RNA, 23 nt, Homo sapiens
acagauuccuggcagagccaugg

SEQ ID NO: 1906833 - RNA, 16 nt, Homo sapiens
cuuucaaccuauacaa

SEQ ID NO: 1906834 - RNA, 18 nt, Homo sapiens
aagcauguacaaauuaua

SEQ ID NO: 1906835 - RNA, 19 nt, Homo sapiens
aagaauuuuugaagugacu

SEQ ID NO: 1906836 - RNA, 12 nt, Homo sapiens
gucucacacucc

SEQ ID NO: 1906837 - RNA, 19 nt, Homo sapiens
aucucucacacauuccagg

SEQ ID NO: 1906838 - RNA, 13 nt, Homo sapiens
ugaaaauucuuga

SEQ ID NO: 1906839 - RNA, 23 nt, Homo sapiens
guuagguccaccugcuaaucaca

SEQ ID NO: 1906840 - RNA, 17 nt, Homo sapiens
ucuuaaccucaaaccua

SEQ ID NO: 1906841 - RNA, 19 nt, Homo sapiens
uccagggucugagugcaag

SEQ ID NO: 1906842 - RNA, 16 nt, Homo sapiens
cagaacacugucuuga

SEQ ID NO: 1906843 - RNA, 17 nt, Homo sapiens
cugagucagagccaugu

SEQ ID NO: 1906844 - RNA, 19 nt, Homo sapiens
ugggcuggugucaccugaa

SEQ ID NO: 1906845 - RNA, 15 nt, Homo sapiens
uauuucauaccaugg

SEQ ID NO: 1906846 - RNA, 19 nt, Homo sapiens
gaugggcuuagagcucuca

SEQ ID NO: 1906847 - RNA, 19 nt, Homo sapiens
gacccacaaacugccuguu

SEQ ID NO: 1906848 - RNA, 14 nt, Homo sapiens
cucaucccaugaga

SEQ ID NO: 1906849 - RNA, 14 nt, Homo sapiens
aagagucucuauua

SEQ ID NO: 1906850 - RNA, 22 nt, Homo sapiens
ugacccuuuucaugauuuuaag

SEQ ID NO: 1906851 - RNA, 17 nt, Homo sapiens
caaccccccaccugcca

SEQ ID NO: 1906852 - RNA, 23 nt, Homo sapiens
agaauacaagauauuauguauaa

SEQ ID NO: 1906853 - RNA, 14 nt, Homo sapiens
accaccucugucac

SEQ ID NO: 1906854 - RNA, 15 nt, Homo sapiens
ccagaaaaacauuug

SEQ ID NO: 1906855 - RNA, 16 nt, Homo sapiens
acuggugugagccacu

SEQ ID NO: 1906856 - RNA, 14 nt, Homo sapiens
accauguuggucag

SEQ ID NO: 1906857 - RNA, 14 nt, Homo sapiens
uuccugacugggaa

SEQ ID NO: 1906858 - RNA, 13 nt, Homo sapiens
ugggaacuucuaa

SEQ ID NO: 1906859 - RNA, 14 nt, Homo sapiens
gaugcugugccucc

SEQ ID NO: 1906860 - RNA, 20 nt, Homo sapiens
ucugugugguggagccaggg

SEQ ID NO: 1906861 - RNA, 21 nt, Homo sapiens
acauggucuaauuauuuacuc

SEQ ID NO: 1906862 - RNA, 16 nt, Homo sapiens
cucugaaccagagaaa

SEQ ID NO: 1906863 - RNA, 20 nt, Homo sapiens
aaauugcaugcugcuuuaau

SEQ ID NO: 1906864 - RNA, 14 nt, Homo sapiens
ggcugacucuccag

SEQ ID NO: 1906865 - RNA, 23 nt, Homo sapiens
uuugacacaccccuaaguacaag

SEQ ID NO: 1906866 - RNA, 22 nt, Homo sapiens
agcuaaauuuucugaaacugca

SEQ ID NO: 1906867 - RNA, 16 nt, Homo sapiens
accuugaaagacauuu

SEQ ID NO: 1906868 - RNA, 14 nt, Homo sapiens
guauuaccaaagca

SEQ ID NO: 1906869 - RNA, 15 nt, Homo sapiens
gaugacucucuccaa

SEQ ID NO: 1906870 - RNA, 22 nt, Homo sapiens
cauaugaccucaugcaucucca

SEQ ID NO: 1906871 - RNA, 13 nt, Homo sapiens
uacugacugauga

SEQ ID NO: 1906872 - RNA, 21 nt, Homo sapiens
guguguguuacauacacagaa

SEQ ID NO: 1906873 - RNA, 17 nt, Homo sapiens
ucacucaccuagacaac

SEQ ID NO: 1906874 - RNA, 21 nt, Homo sapiens
caugcuuugacaaauuacaaa

SEQ ID NO: 1906875 - RNA, 21 nt, Homo sapiens
ggcucccuccuggagcauccc

SEQ ID NO: 1906876 - RNA, 14 nt, Homo sapiens
aucuaagugauaua

SEQ ID NO: 1906877 - RNA, 19 nt, Homo sapiens
cgagauaggguggcacauc

SEQ ID NO: 1906878 - RNA, 18 nt, Homo sapiens
acguguucucacacuggu

SEQ ID NO: 1906879 - RNA, 15 nt, Homo sapiens
gguaauagaauagca

SEQ ID NO: 1906880 - RNA, 22 nt, Homo sapiens
uaauacaggauuauuuugauua

SEQ ID NO: 1906881 - RNA, 20 nt, Homo sapiens
ggaagccagcaggcucucag

SEQ ID NO: 1906882 - RNA, 14 nt, Homo sapiens
caccuuauacauca

SEQ ID NO: 1906883 - RNA, 16 nt, Homo sapiens
cucuccuggugcucca

SEQ ID NO: 1906884 - RNA, 11 nt, Homo sapiens
uuuacaguguu

SEQ ID NO: 1906885 - RNA, 13 nt, Homo sapiens
uaaaggaaucuag

SEQ ID NO: 1906886 - RNA, 16 nt, Homo sapiens
ccugucgugccagucc

SEQ ID NO: 1906887 - RNA, 18 nt, Homo sapiens
auuuugccauaaagucaa

SEQ ID NO: 1906888 - RNA, 21 nt, Homo sapiens
cguugaauugaugaugcaguu

SEQ ID NO: 1906889 - RNA, 18 nt, Homo sapiens
ccccagccccuuggaugu

SEQ ID NO: 1906890 - RNA, 21 nt, Homo sapiens
gagguguacacuaacauuucc

SEQ ID NO: 1906891 - RNA, 14 nt, Homo sapiens
ucuuacacuacauu

SEQ ID NO: 1906892 - RNA, 18 nt, Homo sapiens
caaacuaagcuaugugaa

SEQ ID NO: 1906893 - RNA, 15 nt, Homo sapiens
gccaugcccaaggcc

SEQ ID NO: 1906894 - RNA, 20 nt, Homo sapiens
guggccacugagcuggcuga

SEQ ID NO: 1906895 - RNA, 18 nt, Homo sapiens
augagucaaugugcagug

SEQ ID NO: 1906896 - RNA, 22 nt, Homo sapiens
gagguaacgggugccugcugcg

SEQ ID NO: 1906897 - RNA, 15 nt, Homo sapiens
agucuguccuggaac

SEQ ID NO: 1906898 - RNA, 22 nt, Homo sapiens
ccaggaggcagcuguugcagug

SEQ ID NO: 1906899 - RNA, 12 nt, Homo sapiens
aagugcugcuau

SEQ ID NO: 1906900 - RNA, 13 nt, Homo sapiens
ccauucaguuuua

SEQ ID NO: 1906901 - RNA, 12 nt, Homo sapiens
ugguuuguucuc

SEQ ID NO: 1906902 - RNA, 18 nt, Homo sapiens
ugaaucuauuuaucuuca

SEQ ID NO: 1906903 - RNA, 15 nt, Homo sapiens
ucccuugaaagggaa

SEQ ID NO: 1906904 - RNA, 15 nt, Homo sapiens
gaagaaggcaaccca

SEQ ID NO: 1906905 - RNA, 17 nt, Homo sapiens
gcuauuuuuauacacug

SEQ ID NO: 1906906 - RNA, 17 nt, Homo sapiens
aauauucaucuacauaa

SEQ ID NO: 1906907 - RNA, 13 nt, Homo sapiens
gcauuagugcuga

SEQ ID NO: 1906908 - RNA, 23 nt, Homo sapiens
uucuuaaugaaccuuagaaagac

SEQ ID NO: 1906909 - RNA, 14 nt, Homo sapiens
guuaacaugacauu

SEQ ID NO: 1906910 - RNA, 22 nt, Homo sapiens
auccaucauacauuagugccau

SEQ ID NO: 1906911 - RNA, 14 nt, Homo sapiens
uagaagauggcacu

SEQ ID NO: 1906912 - RNA, 21 nt, Homo sapiens
uauguagaauauauuuccuua

SEQ ID NO: 1906913 - RNA, 17 nt, Homo sapiens
ucugucauacauccuag

SEQ ID NO: 1906914 - RNA, 18 nt, Homo sapiens
cuguggcuccugccuuga

SEQ ID NO: 1906915 - RNA, 14 nt, Homo sapiens
cuaaaaugaguuac

SEQ ID NO: 1906916 - RNA, 17 nt, Homo sapiens
ggcagacuacacaggau

SEQ ID NO: 1906917 - RNA, 15 nt, Homo sapiens
aauacuacaauaguu

SEQ ID NO: 1906918 - RNA, 15 nt, Homo sapiens
acugcaacacuggau

SEQ ID NO: 1906919 - RNA, 17 nt, Homo sapiens
auacaaagcaaacaaac

SEQ ID NO: 1906920 - RNA, 17 nt, Homo sapiens
cagaccuacugcacuga

SEQ ID NO: 1906921 - RNA, 20 nt, Homo sapiens
agaguauuaaugaaaagcac

SEQ ID NO: 1906922 - RNA, 19 nt, Homo sapiens
accaagcauuccugcucaa

SEQ ID NO: 1906923 - RNA, 15 nt, Homo sapiens
uccuuccugagaaac

SEQ ID NO: 1906924 - RNA, 15 nt, Homo sapiens
gcauguuugugauug

SEQ ID NO: 1906925 - RNA, 18 nt, Homo sapiens
caauugcuucugugcaau

SEQ ID NO: 1906926 - RNA, 14 nt, Homo sapiens
aaucucugccuaga

SEQ ID NO: 1906927 - RNA, 13 nt, Homo sapiens
agcaaacaaguug

SEQ ID NO: 1906928 - RNA, 23 nt, Homo sapiens
uggggugggagggcgucaggcag

SEQ ID NO: 1906929 - RNA, 21 nt, Homo sapiens
uuuuaauuuaaacaccuccuc

SEQ ID NO: 1906930 - RNA, 12 nt, Homo sapiens
cuguucacagag

SEQ ID NO: 1906931 - RNA, 19 nt, Homo sapiens
uuuaaucauuuugccucuu

SEQ ID NO: 1906932 - RNA, 15 nt, Homo sapiens
aaucugggagaauuu

SEQ ID NO: 1906933 - RNA, 13 nt, Homo sapiens
acuccacuuggac

SEQ ID NO: 1906934 - RNA, 18 nt, Homo sapiens
gcaaaaacggccagguac

SEQ ID NO: 1906935 - RNA, 20 nt, Homo sapiens
gggcauugcuggacugaugg

SEQ ID NO: 1906936 - RNA, 21 nt, Homo sapiens
cugccuuucaagcggugccua

SEQ ID NO: 1906937 - RNA, 20 nt, Homo sapiens
ggaauuugcuuuaucuacuu

SEQ ID NO: 1906938 - RNA, 18 nt, Homo sapiens
aucuuaaaacaaauucau

SEQ ID NO: 1906939 - RNA, 21 nt, Homo sapiens
aucuagucugguggauaaaga

SEQ ID NO: 1906940 - RNA, 20 nt, Homo sapiens
aucacucaaccauaacacuu

SEQ ID NO: 1906941 - RNA, 20 nt, Homo sapiens
cccaaaauuagggagcucuu

SEQ ID NO: 1906942 - RNA, 22 nt, Homo sapiens
uccagguaguguugagacccag

SEQ ID NO: 1906943 - RNA, 23 nt, Homo sapiens
ucaguccugggagacccauguaa

SEQ ID NO: 1906944 - RNA, 19 nt, Homo sapiens
uccggccuccugucccuca

SEQ ID NO: 1906945 - RNA, 13 nt, Homo sapiens
ucaaaacauucuc

SEQ ID NO: 1906946 - RNA, 20 nt, Homo sapiens
guaaagaauaaaugaaucuu

SEQ ID NO: 1906947 - RNA, 21 nt, Homo sapiens
uaagaaccuuauuuugauaaa

SEQ ID NO: 1906948 - RNA, 23 nt, Homo sapiens
agccccgccccagcccucaguca

SEQ ID NO: 1906949 - RNA, 20 nt, Homo sapiens
acaaugauacaguugcaugu

SEQ ID NO: 1906950 - RNA, 13 nt, Homo sapiens
ugacccuguucuc

SEQ ID NO: 1906951 - RNA, 18 nt, Homo sapiens
auaucaugguagucacua

SEQ ID NO: 1906952 - RNA, 15 nt, Homo sapiens
gacccagacauauug

SEQ ID NO: 1906953 - RNA, 14 nt, Homo sapiens
acccaugcuuucau

SEQ ID NO: 1906954 - RNA, 22 nt, Homo sapiens
aagauaucuaugacuguguuua

SEQ ID NO: 1906955 - RNA, 18 nt, Homo sapiens
caaagaaucaacagugaa

SEQ ID NO: 1906956 - RNA, 16 nt, Homo sapiens
cauuuuacagaagcau

SEQ ID NO: 1906957 - RNA, 16 nt, Homo sapiens
uuagauuauauauucc

SEQ ID NO: 1906958 - RNA, 22 nt, Homo sapiens
aaugcugcacaccaguuacugu

SEQ ID NO: 1906959 - RNA, 23 nt, Homo sapiens
cuggaauugauauugaaugaugu

SEQ ID NO: 1906960 - RNA, 20 nt, Homo sapiens
aaaccuuacucugagcucau

SEQ ID NO: 1906961 - RNA, 15 nt, Homo sapiens
aaaucugucucccca

SEQ ID NO: 1906962 - RNA, 23 nt, Homo sapiens
aguugucaguauuauucuacuau

SEQ ID NO: 1906963 - RNA, 15 nt, Homo sapiens
acucaguucuuggcc

SEQ ID NO: 1906964 - RNA, 15 nt, Homo sapiens
acucagcucuuggcu

SEQ ID NO: 1906965 - RNA, 21 nt, Homo sapiens
guacuuuguuaaaaacacugc

SEQ ID NO: 1906966 - RNA, 18 nt, Homo sapiens
uccuccugcugcucacuc

SEQ ID NO: 1906967 - RNA, 20 nt, Homo sapiens
uauucuuucuaaacuacaac

SEQ ID NO: 1906968 - RNA, 14 nt, Homo sapiens
caauuuaaaacaau

SEQ ID NO: 1906969 - RNA, 15 nt, Homo sapiens
cguaaucguuccuga

SEQ ID NO: 1906970 - RNA, 22 nt, Homo sapiens
gccgaaccccccacucccugcc

SEQ ID NO: 1906971 - RNA, 23 nt, Homo sapiens
cauguguaggagucugggcacaa

SEQ ID NO: 1906972 - RNA, 20 nt, Homo sapiens
cuaaaggaaaaaacuuugac

SEQ ID NO: 1906973 - RNA, 21 nt, Homo sapiens
auucucuugaaggugcugcca

SEQ ID NO: 1906974 - RNA, 20 nt, Homo sapiens
uggucaacuaaguucaggga

SEQ ID NO: 1906975 - RNA, 14 nt, Homo sapiens
aacaaguuguuaaa

SEQ ID NO: 1906976 - RNA, 23 nt, Homo sapiens
ugggagcauagcagaggggccag

SEQ ID NO: 1906977 - RNA, 22 nt, Homo sapiens
ugggcccuuccuggcuaggacu

SEQ ID NO: 1906978 - RNA, 19 nt, Homo sapiens
ugaggaaaauuaauaucac

SEQ ID NO: 1906979 - RNA, 15 nt, Homo sapiens
uccucuugaaccaca

SEQ ID NO: 1906980 - RNA, 22 nt, Homo sapiens
accuuugucucacgauuccagu

SEQ ID NO: 1906981 - RNA, 12 nt, Homo sapiens
gaauuaagacgg

SEQ ID NO: 1906982 - RNA, 20 nt, Homo sapiens
gaagccuucuuagaacucug

SEQ ID NO: 1906983 - RNA, 16 nt, Homo sapiens
ccucagccaguggcac

SEQ ID NO: 1906984 - RNA, 14 nt, Homo sapiens
gcagcuaagccaca

SEQ ID NO: 1906985 - RNA, 19 nt, Homo sapiens
cugcccaaagcagcacuua

SEQ ID NO: 1906986 - RNA, 13 nt, Homo sapiens
uugaaagaauuag

SEQ ID NO: 1906987 - RNA, 20 nt, Homo sapiens
uuucuauuuuuaugaugaca

SEQ ID NO: 1906988 - RNA, 14 nt, Homo sapiens
cuaugcaaucugag

SEQ ID NO: 1906989 - RNA, 15 nt, Homo sapiens
uucucauaaauuucu

SEQ ID NO: 1906990 - RNA, 17 nt, Homo sapiens
ugcagacucacuguggg

SEQ ID NO: 1906991 - RNA, 18 nt, Homo sapiens
aggcuuaaucacaccguc

SEQ ID NO: 1906992 - RNA, 15 nt, Homo sapiens
gagcagugagcacug

SEQ ID NO: 1906993 - RNA, 19 nt, Homo sapiens
cauauguuuuccacauaaa

SEQ ID NO: 1906994 - RNA, 15 nt, Homo sapiens
uagaugggacuacag

SEQ ID NO: 1906995 - RNA, 19 nt, Homo sapiens
aacgaucacaaaugacuuu

SEQ ID NO: 1906996 - RNA, 14 nt, Homo sapiens
aacauagugauacc

SEQ ID NO: 1906997 - RNA, 21 nt, Homo sapiens
ucccaauguuugggauauuaa

SEQ ID NO: 1906998 - RNA, 14 nt, Homo sapiens
agcccccucuuccu

SEQ ID NO: 1906999 - RNA, 18 nt, Homo sapiens
cuuccuggacacacucuc

SEQ ID NO: 1907000 - RNA, 15 nt, Homo sapiens
uccuacugcugugag

SEQ ID NO: 1907001 - RNA, 19 nt, Homo sapiens
uuuguacauuuuugaucaa

SEQ ID NO: 1907002 - RNA, 15 nt, Homo sapiens
cucucuacagugcca

SEQ ID NO: 1907003 - RNA, 16 nt, Homo sapiens
gguaauauuaauuucc

SEQ ID NO: 1907004 - RNA, 14 nt, Homo sapiens
aaacaaaauuccau

SEQ ID NO: 1907005 - RNA, 20 nt, Homo sapiens
ccaugcugggccacugggga

SEQ ID NO: 1907006 - RNA, 20 nt, Homo sapiens
ccgcaggcuucugugugcug

SEQ ID NO: 1907007 - RNA, 16 nt, Homo sapiens
augaaggaaggacuau

SEQ ID NO: 1907008 - RNA, 17 nt, Homo sapiens
cagccgaggccacagaa

SEQ ID NO: 1907009 - RNA, 13 nt, Homo sapiens
ugacuugauugcc

SEQ ID NO: 1907010 - RNA, 18 nt, Homo sapiens
uuuucgcaaacguuucac

SEQ ID NO: 1907011 - RNA, 15 nt, Homo sapiens
agaaaucuaaucucu

SEQ ID NO: 1907012 - RNA, 18 nt, Homo sapiens
gugauguguuuacauuua

SEQ ID NO: 1907013 - RNA, 20 nt, Homo sapiens
uuggcaaaauuacaguucac

SEQ ID NO: 1907014 - RNA, 20 nt, Homo sapiens
ggccacucuguugguggccu

SEQ ID NO: 1907015 - RNA, 17 nt, Homo sapiens
gugcaagugugugcaca

SEQ ID NO: 1907016 - RNA, 19 nt, Homo sapiens
aauugagagccucuaugug

SEQ ID NO: 1907017 - RNA, 21 nt, Homo sapiens
ugcagaggggcccaugaaaga

SEQ ID NO: 1907018 - RNA, 15 nt, Homo sapiens
uuguuuuagcuccuu

SEQ ID NO: 1907019 - RNA, 14 nt, Homo sapiens
aaucaucaagagaa

SEQ ID NO: 1907020 - RNA, 15 nt, Homo sapiens
auucucuuacugcuu

SEQ ID NO: 1907021 - RNA, 23 nt, Homo sapiens
gaacuggaaaccaggaacucugg

SEQ ID NO: 1907022 - RNA, 10 nt, Homo sapiens
aaaaucaaaa

SEQ ID NO: 1907023 - RNA, 16 nt, Homo sapiens
ccgacuggcugugaga

SEQ ID NO: 1907024 - RNA, 23 nt, Homo sapiens
gauuauugcuucuuuccuugcau

SEQ ID NO: 1907025 - RNA, 16 nt, Homo sapiens
agagaauguuccagac

SEQ ID NO: 1907026 - RNA, 17 nt, Homo sapiens
uugcuggcaacaacaga

SEQ ID NO: 1907027 - RNA, 21 nt, Homo sapiens
gaggaauaacaucaccacugu

SEQ ID NO: 1907028 - RNA, 22 nt, Homo sapiens
caccugcguguccccgugcagu

SEQ ID NO: 1907029 - RNA, 17 nt, Homo sapiens
ggcaaucuuugccuuua

SEQ ID NO: 1907030 - RNA, 18 nt, Homo sapiens
uuucaauguccagugagu

SEQ ID NO: 1907031 - RNA, 23 nt, Homo sapiens
uguuauuuaaagaagaaacgucu

SEQ ID NO: 1907032 - RNA, 15 nt, Homo sapiens
agcccaacugugaga

SEQ ID NO: 1907033 - RNA, 18 nt, Homo sapiens
ggagaagagcuguucaca

SEQ ID NO: 1907034 - RNA, 15 nt, Homo sapiens
cauugcaguuuaaga

SEQ ID NO: 1907035 - RNA, 15 nt, Homo sapiens
uuauacagcaaagga

SEQ ID NO: 1907036 - RNA, 19 nt, Homo sapiens
aguuucucuuaagcugccc

SEQ ID NO: 1907037 - RNA, 14 nt, Homo sapiens
uaucugaaccaaga

SEQ ID NO: 1907038 - RNA, 16 nt, Homo sapiens
ugacuaauucagggaa

SEQ ID NO: 1907039 - RNA, 15 nt, Homo sapiens
agucccuccaaaggg

SEQ ID NO: 1907040 - RNA, 17 nt, Homo sapiens
auccgcugccagccuug

SEQ ID NO: 1907041 - RNA, 17 nt, Homo sapiens
cucuagaacagccagac

SEQ ID NO: 1907042 - RNA, 18 nt, Homo sapiens
gagacuuaauagacauuu

SEQ ID NO: 1907043 - RNA, 18 nt, Homo sapiens
aucucaacucacugcaag

SEQ ID NO: 1907044 - RNA, 19 nt, Homo sapiens
agccuuggggauucuucca

SEQ ID NO: 1907045 - RNA, 15 nt, Homo sapiens
ucaccaaacuaguaa

SEQ ID NO: 1907046 - RNA, 15 nt, Homo sapiens
ucuguaaacuuccaa

SEQ ID NO: 1907047 - RNA, 12 nt, Homo sapiens
gcuuuuuugcca

SEQ ID NO: 1907048 - RNA, 12 nt, Homo sapiens
ccuuuuuuccca

SEQ ID NO: 1907049 - RNA, 20 nt, Homo sapiens
aauccuaagacacaaaugca

SEQ ID NO: 1907050 - RNA, 18 nt, Homo sapiens
cuuaugucucuacauggu

SEQ ID NO: 1907051 - RNA, 19 nt, Homo sapiens
uaagccacguuaaguccaa

SEQ ID NO: 1907052 - RNA, 20 nt, Homo sapiens
gcacacacacacacaugcac

SEQ ID NO: 1907053 - RNA, 12 nt, Homo sapiens
uuauagauucua

SEQ ID NO: 1907054 - RNA, 17 nt, Homo sapiens
acaugcauaaaaauuaa

SEQ ID NO: 1907055 - RNA, 19 nt, Homo sapiens
acccccugugagcagggau

SEQ ID NO: 1907056 - RNA, 22 nt, Homo sapiens
cgccaacugcugaucaaugaaa

SEQ ID NO: 1907057 - RNA, 21 nt, Homo sapiens
acucagaagaaagcucagagu

SEQ ID NO: 1907058 - RNA, 21 nt, Homo sapiens
aucccacugggagcacuuugu

SEQ ID NO: 1907059 - RNA, 22 nt, Homo sapiens
gaaaacacacucaaaagacaaa

SEQ ID NO: 1907060 - RNA, 15 nt, Homo sapiens
uagcauuaugcaauu

SEQ ID NO: 1907061 - RNA, 14 nt, Homo sapiens
cuucccauguccca

SEQ ID NO: 1907062 - RNA, 16 nt, Homo sapiens
aguagccuucuucccu

SEQ ID NO: 1907063 - RNA, 14 nt, Homo sapiens
cauuuaaagaccaa

SEQ ID NO: 1907064 - RNA, 14 nt, Homo sapiens
agcucuacugaggu

SEQ ID NO: 1907065 - RNA, 20 nt, Homo sapiens
gggaacugggaagaugcugg

SEQ ID NO: 1907066 - RNA, 17 nt, Homo sapiens
ucugagaugcugguaau

SEQ ID NO: 1907067 - RNA, 18 nt, Homo sapiens
ccaaucagcgcucuguag

SEQ ID NO: 1907068 - RNA, 18 nt, Homo sapiens
ccaaucagcacucuguaa

SEQ ID NO: 1907069 - RNA, 15 nt, Homo sapiens
accuuggcuuguuau

SEQ ID NO: 1907070 - RNA, 20 nt, Homo sapiens
aaccugggagguggagguug

SEQ ID NO: 1907071 - RNA, 20 nt, Homo sapiens
uauuuacuguacuaauuaga

SEQ ID NO: 1907072 - RNA, 21 nt, Homo sapiens
auggaaaucacauuuacaaaa

SEQ ID NO: 1907073 - RNA, 21 nt, Homo sapiens
uuggccuccauauugcucuca

SEQ ID NO: 1907074 - RNA, 13 nt, Homo sapiens
guguauccaugca

SEQ ID NO: 1907075 - RNA, 13 nt, Homo sapiens
ugaaaacuuugua

SEQ ID NO: 1907076 - RNA, 17 nt, Homo sapiens
cuccauccuuucugccu

SEQ ID NO: 1907077 - RNA, 15 nt, Homo sapiens
gagcaagauuccugu

SEQ ID NO: 1907078 - RNA, 19 nt, Homo sapiens
gagaaggucagauuagggc

SEQ ID NO: 1907079 - RNA, 19 nt, Homo sapiens
uaaagaauaaaugaaucuu

SEQ ID NO: 1907080 - RNA, 22 nt, Homo sapiens
ccugccucucucauggcuuggg

SEQ ID NO: 1907081 - RNA, 18 nt, Homo sapiens
cacaugacauagcacuug

SEQ ID NO: 1907082 - RNA, 17 nt, Homo sapiens
gauaaucaucucuguca

SEQ ID NO: 1907083 - RNA, 17 nt, Homo sapiens
aauauguagcucauccu

SEQ ID NO: 1907084 - RNA, 17 nt, Homo sapiens
aauccagugagcacuag

SEQ ID NO: 1907085 - RNA, 24 nt, Homo sapiens
aacagccaagcuggcacaaaagac

SEQ ID NO: 1907086 - RNA, 12 nt, Homo sapiens
aaguauuagcca

SEQ ID NO: 1907087 - RNA, 22 nt, Homo sapiens
gggccccuggccauccacaaac

SEQ ID NO: 1907088 - RNA, 21 nt, Homo sapiens
uggucacccuggggcugcuua

SEQ ID NO: 1907089 - RNA, 20 nt, Homo sapiens
acauacuggccucugugauu

SEQ ID NO: 1907090 - RNA, 20 nt, Homo sapiens
caagaucgcaccauugcacu

SEQ ID NO: 1907091 - RNA, 19 nt, Homo sapiens
agcagcuccaccacugugc

SEQ ID NO: 1907092 - RNA, 14 nt, Homo sapiens
auacaauauaacac

SEQ ID NO: 1907093 - RNA, 20 nt, Homo sapiens
cuacuuuaaguauacaaucu

SEQ ID NO: 1907094 - RNA, 15 nt, Homo sapiens
cuuuacagugccacg

SEQ ID NO: 1907095 - RNA, 22 nt, Homo sapiens
cugugacuauaaagcuguuauu

SEQ ID NO: 1907096 - RNA, 23 nt, Homo sapiens
augugcgcacacacagauaugca

SEQ ID NO: 1907097 - RNA, 21 nt, Homo sapiens
uacaucaauuuaaaaagcaaa

SEQ ID NO: 1907098 - RNA, 20 nt, Homo sapiens
cucagccucucaaguagcug

SEQ ID NO: 1907099 - RNA, 15 nt, Homo sapiens
accucacuagcuccc

SEQ ID NO: 1907100 - RNA, 23 nt, Homo sapiens
uagaggcaugaacacacauggau

SEQ ID NO: 1907101 - RNA, 13 nt, Homo sapiens
ggagagaaguuuc

SEQ ID NO: 1907102 - RNA, 13 nt, Homo sapiens
uuagagaauguuc

SEQ ID NO: 1907103 - RNA, 16 nt, Homo sapiens
ugugaccccacugcca

SEQ ID NO: 1907104 - RNA, 17 nt, Homo sapiens
aggcccacaggaggcaa

SEQ ID NO: 1907105 - RNA, 9 nt, Homo sapiens
gacuuggaa

SEQ ID NO: 1907106 - RNA, 19 nt, Homo sapiens
ucagugcucggcagucaua

SEQ ID NO: 1907107 - RNA, 13 nt, Homo sapiens
aaugcuacugucu

SEQ ID NO: 1907108 - RNA, 15 nt, Homo sapiens
aggcagucauaucaa

SEQ ID NO: 1907109 - RNA, 18 nt, Homo sapiens
acuuaagggaacugaauc

SEQ ID NO: 1907110 - RNA, 18 nt, Homo sapiens
uguccuugaagcuuguau

SEQ ID NO: 1907111 - RNA, 14 nt, Homo sapiens
cuuuuauucuccag

SEQ ID NO: 1907112 - RNA, 18 nt, Homo sapiens
acaggacuuaaaaugaca

SEQ ID NO: 1907113 - RNA, 12 nt, Homo sapiens
uuuugugcuuua

SEQ ID NO: 1907114 - RNA, 15 nt, Homo sapiens
uaccaccgacauuuu

SEQ ID NO: 1907115 - RNA, 12 nt, Homo sapiens
uuguaacauauu

SEQ ID NO: 1907116 - RNA, 18 nt, Homo sapiens
cagagacagauaccucca

SEQ ID NO: 1907117 - RNA, 20 nt, Homo sapiens
acuaccccagaacgcaugca

SEQ ID NO: 1907118 - RNA, 13 nt, Homo sapiens
cauagacugcaaa

SEQ ID NO: 1907119 - RNA, 15 nt, Homo sapiens
cugaguuuacgugga

SEQ ID NO: 1907120 - RNA, 21 nt, Homo sapiens
acaauguaacggaugaccaua

SEQ ID NO: 1907121 - RNA, 14 nt, Homo sapiens
aauuuaaaaauccu

SEQ ID NO: 1907122 - RNA, 22 nt, Homo sapiens
augaauauuguaaauguucaag

SEQ ID NO: 1907123 - RNA, 23 nt, Homo sapiens
caggagggcccggagaaacugag

SEQ ID NO: 1907124 - RNA, 18 nt, Homo sapiens
cugugacuuaucuaccau

SEQ ID NO: 1907125 - RNA, 18 nt, Homo sapiens
cuaaugucaaacuugagu

SEQ ID NO: 1907126 - RNA, 22 nt, Homo sapiens
aggaccugcauccuuccugggg

SEQ ID NO: 1907127 - RNA, 13 nt, Homo sapiens
caauuauauaaau

SEQ ID NO: 1907128 - RNA, 16 nt, Homo sapiens
uggcuuucuggcugcu

SEQ ID NO: 1907129 - RNA, 14 nt, Homo sapiens
uccuuucuccugau

SEQ ID NO: 1907130 - RNA, 17 nt, Homo sapiens
augcaaauacaaucagc

SEQ ID NO: 1907131 - RNA, 21 nt, Homo sapiens
auaagacuucuggugcugcug

SEQ ID NO: 1907132 - RNA, 14 nt, Homo sapiens
cacccccagugcag

SEQ ID NO: 1907133 - RNA, 13 nt, Homo sapiens
aacauuucuuggu

SEQ ID NO: 1907134 - RNA, 14 nt, Homo sapiens
ccugacaaauggaa

SEQ ID NO: 1907135 - RNA, 14 nt, Homo sapiens
cugaacaaacuaaa

SEQ ID NO: 1907136 - RNA, 19 nt, Homo sapiens
uuugcucagaauugcacau

SEQ ID NO: 1907137 - RNA, 17 nt, Homo sapiens
uacacguaaaugcagaa

SEQ ID NO: 1907138 - RNA, 18 nt, Homo sapiens
cagacauacgaaacacaa

SEQ ID NO: 1907139 - RNA, 15 nt, Homo sapiens
uaaccuagauguuua

SEQ ID NO: 1907140 - RNA, 19 nt, Homo sapiens
cucugugagccguuuccaa

SEQ ID NO: 1907141 - RNA, 21 nt, Homo sapiens
cuccucagaucugaacacagu

SEQ ID NO: 1907142 - RNA, 19 nt, Homo sapiens
ucuggacagcagcaggaau

SEQ ID NO: 1907143 - RNA, 17 nt, Homo sapiens
cugaagaaaguuauucu

SEQ ID NO: 1907144 - RNA, 21 nt, Homo sapiens
aauguucuccagucauuaugu

SEQ ID NO: 1907145 - RNA, 18 nt, Homo sapiens
accaaugaaaacauguac

SEQ ID NO: 1907146 - RNA, 18 nt, Homo sapiens
caccuguuaaaauguaca

SEQ ID NO: 1907147 - RNA, 13 nt, Homo sapiens
accugcacacucc

SEQ ID NO: 1907148 - RNA, 15 nt, Homo sapiens
augcaaaagguuuau

SEQ ID NO: 1907149 - RNA, 18 nt, Homo sapiens
uuuaaggugaaccaaaga

SEQ ID NO: 1907150 - RNA, 14 nt, Homo sapiens
aauugcucaugcau

SEQ ID NO: 1907151 - RNA, 22 nt, Homo sapiens
gcuggagauauguaaagaaaaa

SEQ ID NO: 1907152 - RNA, 21 nt, Homo sapiens
ucgacaaaagcaguggagaag

SEQ ID NO: 1907153 - RNA, 14 nt, Homo sapiens
ucaaaauauuucuc

SEQ ID NO: 1907154 - RNA, 12 nt, Homo sapiens
cccacuggaguc

SEQ ID NO: 1907155 - RNA, 19 nt, Homo sapiens
guuuguuauuuacacuggu

SEQ ID NO: 1907156 - RNA, 23 nt, Homo sapiens
uagaggugggcagcugggcccca

SEQ ID NO: 1907157 - RNA, 16 nt, Homo sapiens
gugcauaauuuugcca

SEQ ID NO: 1907158 - RNA, 14 nt, Homo sapiens
ugucugugccaagg

SEQ ID NO: 1907159 - RNA, 14 nt, Homo sapiens
ugucuuugccaagu

SEQ ID NO: 1907160 - RNA, 12 nt, Homo sapiens
aauauacucagg

SEQ ID NO: 1907161 - RNA, 15 nt, Homo sapiens
gaucugcugcugaga

SEQ ID NO: 1907162 - RNA, 17 nt, Homo sapiens
auuucacagaguacaaa

SEQ ID NO: 1907163 - RNA, 19 nt, Homo sapiens
ggccaagcaauuccucuga

SEQ ID NO: 1907164 - RNA, 14 nt, Homo sapiens
cagacuacacagga

SEQ ID NO: 1907165 - RNA, 19 nt, Homo sapiens
aaaggacagaguaugaaca

SEQ ID NO: 1907166 - RNA, 14 nt, Homo sapiens
acaauguaacuuug

SEQ ID NO: 1907167 - RNA, 15 nt, Homo sapiens
agcaucaacaagugg

SEQ ID NO: 1907168 - RNA, 15 nt, Homo sapiens
cagcacauagcuugc

SEQ ID NO: 1907169 - RNA, 17 nt, Homo sapiens
caggcacccaccaucau

SEQ ID NO: 1907170 - RNA, 18 nt, Homo sapiens
uuuauagaugucaggaaa

SEQ ID NO: 1907171 - RNA, 22 nt, Homo sapiens
agacacuguucccagcuaccag

SEQ ID NO: 1907172 - RNA, 16 nt, Homo sapiens
augacaaguacuguau

SEQ ID NO: 1907173 - RNA, 18 nt, Homo sapiens
agggagcaccuggugagu

SEQ ID NO: 1907174 - RNA, 17 nt, Homo sapiens
caaaaacuuucaugccu

SEQ ID NO: 1907175 - RNA, 19 nt, Homo sapiens
agacugaacuuacacugua

SEQ ID NO: 1907176 - RNA, 14 nt, Homo sapiens
ugugcuacaauuca

SEQ ID NO: 1907177 - RNA, 22 nt, Homo sapiens
gacuccuuagagacaucaaaau

SEQ ID NO: 1907178 - RNA, 14 nt, Homo sapiens
augaccucaaggaa

SEQ ID NO: 1907179 - RNA, 13 nt, Homo sapiens
gacaucacuggca

SEQ ID NO: 1907180 - RNA, 16 nt, Homo sapiens
aauggccaaagcacau

SEQ ID NO: 1907181 - RNA, 16 nt, Homo sapiens
auggagaggacagagc

SEQ ID NO: 1907182 - RNA, 13 nt, Homo sapiens
cagggaagacaca

SEQ ID NO: 1907183 - RNA, 13 nt, Homo sapiens
ucauuuagcuuuu

SEQ ID NO: 1907184 - RNA, 13 nt, Homo sapiens
cuaccuagucucc

SEQ ID NO: 1907185 - RNA, 23 nt, Homo sapiens
agucucaccuccugccauagggu

SEQ ID NO: 1907186 - RNA, 17 nt, Homo sapiens
uccauaaauccuugaug

SEQ ID NO: 1907187 - RNA, 15 nt, Homo sapiens
uguugucauguguau

SEQ ID NO: 1907188 - RNA, 14 nt, Homo sapiens
agugaugacggggu

SEQ ID NO: 1907189 - RNA, 15 nt, Homo sapiens
acauauucaaauucc

SEQ ID NO: 1907190 - RNA, 15 nt, Homo sapiens
aaaccaggccuccaa

SEQ ID NO: 1907191 - RNA, 22 nt, Homo sapiens
ccaggcugcugcauggcacuga

SEQ ID NO: 1907192 - RNA, 16 nt, Homo sapiens
gggccauguccaaaga

SEQ ID NO: 1907193 - RNA, 19 nt, Homo sapiens
agccuugguacuaggcagu

SEQ ID NO: 1907194 - RNA, 17 nt, Homo sapiens
cugaauucaaauauucu

SEQ ID NO: 1907195 - RNA, 22 nt, Homo sapiens
ggaaggaggccaagcagugccu

SEQ ID NO: 1907196 - RNA, 19 nt, Homo sapiens
cagccuccaccuugcucuu

SEQ ID NO: 1907197 - RNA, 19 nt, Homo sapiens
ccucccauuucuguugcug

SEQ ID NO: 1907198 - RNA, 14 nt, Homo sapiens
uggucacugucagu

SEQ ID NO: 1907199 - RNA, 15 nt, Homo sapiens
agucuccccacucca

SEQ ID NO: 1907200 - RNA, 16 nt, Homo sapiens
gauaacuuccacaggg

SEQ ID NO: 1907201 - RNA, 17 nt, Homo sapiens
ucuggacuuuccagaga

SEQ ID NO: 1907202 - RNA, 14 nt, Homo sapiens
agcagccagucuca

SEQ ID NO: 1907203 - RNA, 19 nt, Homo sapiens
uagaauugccuuaaggcca

SEQ ID NO: 1907204 - RNA, 16 nt, Homo sapiens
agcucuuccuguguuu

SEQ ID NO: 1907205 - RNA, 15 nt, Homo sapiens
auauugaauguuaaa

SEQ ID NO: 1907206 - RNA, 21 nt, Homo sapiens
uaaacucagaauauacccauc

SEQ ID NO: 1907207 - RNA, 18 nt, Homo sapiens
aagguaauuguagcacau

SEQ ID NO: 1907208 - RNA, 17 nt, Homo sapiens
cccacaaccuuccagcu

SEQ ID NO: 1907209 - RNA, 22 nt, Homo sapiens
ugcacacagcacgggggccaag

SEQ ID NO: 1907210 - RNA, 11 nt, Homo sapiens
acucacugugg

SEQ ID NO: 1907211 - RNA, 15 nt, Homo sapiens
uaaaugaaagcuauu

SEQ ID NO: 1907212 - RNA, 14 nt, Homo sapiens
guuuguggccucag

SEQ ID NO: 1907213 - RNA, 18 nt, Homo sapiens
cgcagcuucagcaucucc

SEQ ID NO: 1907214 - RNA, 18 nt, Homo sapiens
caauaaacauagcuugua

SEQ ID NO: 1907215 - RNA, 17 nt, Homo sapiens
ccaucccaguccugugg

SEQ ID NO: 1907216 - RNA, 16 nt, Homo sapiens
aaaggacucuccagcc

SEQ ID NO: 1907217 - RNA, 13 nt, Homo sapiens
gacugagcagaac

SEQ ID NO: 1907218 - RNA, 10 nt, Homo sapiens
guaacaaaua

SEQ ID NO: 1907219 - RNA, 20 nt, Homo sapiens
cuucacuuacccauuagcca

SEQ ID NO: 1907220 - RNA, 15 nt, Homo sapiens
cuaaacuguuuucau

SEQ ID NO: 1907221 - RNA, 21 nt, Homo sapiens
gauccugucuggccuucaguu

SEQ ID NO: 1907222 - RNA, 19 nt, Homo sapiens
agaaauguuucugugucau

SEQ ID NO: 1907223 - RNA, 18 nt, Homo sapiens
ucaauuagggaugcucaa

SEQ ID NO: 1907224 - RNA, 11 nt, Homo sapiens
aacaguucaaa

SEQ ID NO: 1907225 - RNA, 18 nt, Homo sapiens
uuuuaguuuguucuucag

SEQ ID NO: 1907226 - RNA, 14 nt, Homo sapiens
uagcuauugcaugu

SEQ ID NO: 1907227 - RNA, 14 nt, Homo sapiens
gcuccccucagaca

SEQ ID NO: 1907228 - RNA, 19 nt, Homo sapiens
gaggcauggaaaccaaaag

SEQ ID NO: 1907229 - RNA, 17 nt, Homo sapiens
aauaguaccuucaauac

SEQ ID NO: 1907230 - RNA, 18 nt, Homo sapiens
guauaguuuuauuuacuu

SEQ ID NO: 1907231 - RNA, 20 nt, Homo sapiens
aaguagcugagacuacaggu

SEQ ID NO: 1907232 - RNA, 19 nt, Homo sapiens
aacagaacauuucucaugu

SEQ ID NO: 1907233 - RNA, 16 nt, Homo sapiens
guccuugaaugccaua

SEQ ID NO: 1907234 - RNA, 17 nt, Homo sapiens
cugggccugcugcugag

SEQ ID NO: 1907235 - RNA, 17 nt, Homo sapiens
ugauucucuccuacugu

SEQ ID NO: 1907236 - RNA, 22 nt, Homo sapiens
cugaggcccagugcauaugcaa

SEQ ID NO: 1907237 - RNA, 13 nt, Homo sapiens
uugacucaguucc

SEQ ID NO: 1907238 - RNA, 15 nt, Homo sapiens
agaagggccagcccu

SEQ ID NO: 1907239 - RNA, 22 nt, Homo sapiens
agcucucugagccagucccuca

SEQ ID NO: 1907240 - RNA, 11 nt, Homo sapiens
cacgucacuug

SEQ ID NO: 1907241 - RNA, 19 nt, Homo sapiens
cauucaauagcauaucaca

SEQ ID NO: 1907242 - RNA, 14 nt, Homo sapiens
cuuuccaaccggcu

SEQ ID NO: 1907243 - RNA, 17 nt, Homo sapiens
ggcaaaauaaagugaca

SEQ ID NO: 1907244 - RNA, 22 nt, Homo sapiens
aggaaaaacagaacauuucuca

SEQ ID NO: 1907245 - RNA, 18 nt, Homo sapiens
cuguaaguuacagucaca

SEQ ID NO: 1907246 - RNA, 23 nt, Homo sapiens
ccaugugaggguuuucagcauug

SEQ ID NO: 1907247 - RNA, 13 nt, Homo sapiens
guagacucuugcu

SEQ ID NO: 1907248 - RNA, 20 nt, Homo sapiens
ccaaaucuucuucagauuca

SEQ ID NO: 1907249 - RNA, 14 nt, Homo sapiens
cgugcagucaggug

SEQ ID NO: 1907250 - RNA, 16 nt, Homo sapiens
ugcaaaaauccaaaua

SEQ ID NO: 1907251 - RNA, 16 nt, Homo sapiens
uccaaauaugcaaaaa

SEQ ID NO: 1907252 - RNA, 15 nt, Homo sapiens
cuacuagccauuggg

SEQ ID NO: 1907253 - RNA, 22 nt, Homo sapiens
auuuucaaggccuucaguuuau

SEQ ID NO: 1907254 - RNA, 22 nt, Homo sapiens
acauguacugaugacacaccau

SEQ ID NO: 1907255 - RNA, 16 nt, Homo sapiens
cccuauuguguggucg

SEQ ID NO: 1907256 - RNA, 17 nt, Homo sapiens
ucagguagacuuuuaau

SEQ ID NO: 1907257 - RNA, 17 nt, Homo sapiens
agagggagaguuugaaa

SEQ ID NO: 1907258 - RNA, 19 nt, Homo sapiens
ccuacucuauguaugcauc

SEQ ID NO: 1907259 - RNA, 17 nt, Homo sapiens
auuucucuuuacuugaa

SEQ ID NO: 1907260 - RNA, 18 nt, Homo sapiens
gguagcaaugccuggaua

SEQ ID NO: 1907261 - RNA, 15 nt, Homo sapiens
caucucaauaacaaa

SEQ ID NO: 1907262 - RNA, 16 nt, Homo sapiens
uuuugacacuauaucu

SEQ ID NO: 1907263 - RNA, 16 nt, Homo sapiens
ugugaaaucucagaau

SEQ ID NO: 1907264 - RNA, 20 nt, Homo sapiens
cuuaucuaccaguuuauucc

SEQ ID NO: 1907265 - RNA, 16 nt, Homo sapiens
uggcugccugcaucua

SEQ ID NO: 1907266 - RNA, 23 nt, Homo sapiens
gcucuaaagcagagauguauuau

SEQ ID NO: 1907267 - RNA, 19 nt, Homo sapiens
augaauaagcuuucucuca

SEQ ID NO: 1907268 - RNA, 19 nt, Homo sapiens
aauccagcuacgaauauag

SEQ ID NO: 1907269 - RNA, 23 nt, Homo sapiens
cagauuuguaugguuccaaagac

SEQ ID NO: 1907270 - RNA, 21 nt, Homo sapiens
uagagcagauucaguguuaca

SEQ ID NO: 1907271 - RNA, 23 nt, Homo sapiens
uggauaugcuagcauuuuagcug

SEQ ID NO: 1907272 - RNA, 14 nt, Homo sapiens
gccucacuccucag

SEQ ID NO: 1907273 - RNA, 21 nt, Homo sapiens
uuucaggaggaauacugaaca

SEQ ID NO: 1907274 - RNA, 23 nt, Homo sapiens
uggauuugcaggugaacagccuc

SEQ ID NO: 1907275 - RNA, 17 nt, Homo sapiens
cugcacaaugcauugaa

SEQ ID NO: 1907276 - RNA, 16 nt, Homo sapiens
auucucuauuuuacuu

SEQ ID NO: 1907277 - RNA, 15 nt, Homo sapiens
uucaaccucauugac

SEQ ID NO: 1907278 - RNA, 21 nt, Homo sapiens
ucaaucuuaucauauuucaaa

SEQ ID NO: 1907279 - RNA, 22 nt, Homo sapiens
aauguuggcuagucugugccuc

SEQ ID NO: 1907280 - RNA, 14 nt, Homo sapiens
caaggguuuuccag

SEQ ID NO: 1907281 - RNA, 20 nt, Homo sapiens
uaugcauuugcauuugcucu

SEQ ID NO: 1907282 - RNA, 19 nt, Homo sapiens
uacccauucuucagugccu

SEQ ID NO: 1907283 - RNA, 17 nt, Homo sapiens
agauuugaugggccaca

SEQ ID NO: 1907284 - RNA, 16 nt, Homo sapiens
cuguguuccuggcaau

SEQ ID NO: 1907285 - RNA, 20 nt, Homo sapiens
ucaaauuuugcauuguguga

SEQ ID NO: 1907286 - RNA, 16 nt, Homo sapiens
cuagcuuacugauaaa

SEQ ID NO: 1907287 - RNA, 14 nt, Homo sapiens
uccuggaugggaca

SEQ ID NO: 1907288 - RNA, 12 nt, Homo sapiens
acucugucuugu

SEQ ID NO: 1907289 - RNA, 17 nt, Homo sapiens
caucaaaagcaccagca

SEQ ID NO: 1907290 - RNA, 18 nt, Homo sapiens
aggacgguuaacuuguau

SEQ ID NO: 1907291 - RNA, 17 nt, Homo sapiens
aagacaagacagcauuu

SEQ ID NO: 1907292 - RNA, 22 nt, Homo sapiens
auugaugaaugaggaacaauca

SEQ ID NO: 1907293 - RNA, 19 nt, Homo sapiens
cugccuuaccuucacuuaa

SEQ ID NO: 1907294 - RNA, 16 nt, Homo sapiens
acugcaguauggccau

SEQ ID NO: 1907295 - RNA, 18 nt, Homo sapiens
guuucaguaauagcugaa

SEQ ID NO: 1907296 - RNA, 14 nt, Homo sapiens
augaaaaagauuau

SEQ ID NO: 1907297 - RNA, 23 nt, Homo sapiens
uccugcuacucuguuccuucaca

SEQ ID NO: 1907298 - RNA, 16 nt, Homo sapiens
cggccuccaugaccug

SEQ ID NO: 1907299 - RNA, 13 nt, Homo sapiens
ggguuuuagagag

SEQ ID NO: 1907300 - RNA, 18 nt, Homo sapiens
aaauuccauuuguaggua

SEQ ID NO: 1907301 - RNA, 19 nt, Homo sapiens
cugccuaaaauaugauguu

SEQ ID NO: 1907302 - RNA, 23 nt, Homo sapiens
gagcuggcauuggucugcugacc

SEQ ID NO: 1907303 - RNA, 19 nt, Homo sapiens
guuccucccaagaggccag

SEQ ID NO: 1907304 - RNA, 18 nt, Homo sapiens
aauugucuauuccugagu

SEQ ID NO: 1907305 - RNA, 13 nt, Homo sapiens
cauggaucugauc

SEQ ID NO: 1907306 - RNA, 19 nt, Homo sapiens
cuagucacaaagacuccuu

SEQ ID NO: 1907307 - RNA, 19 nt, Homo sapiens
ugaaaauauagacauucuc

SEQ ID NO: 1907308 - RNA, 21 nt, Homo sapiens
uugaaauaauuuucaagcaaa

SEQ ID NO: 1907309 - RNA, 14 nt, Homo sapiens
ucugcugcuugaaa

SEQ ID NO: 1907310 - RNA, 14 nt, Homo sapiens
gugacaaagcaauu

SEQ ID NO: 1907311 - RNA, 19 nt, Homo sapiens
cuuucuugcuguccaauuu

SEQ ID NO: 1907312 - RNA, 13 nt, Homo sapiens
ugggacagccauu

SEQ ID NO: 1907313 - RNA, 14 nt, Homo sapiens
cauuuuuuuucucu

SEQ ID NO: 1907314 - RNA, 19 nt, Homo sapiens
uaauuaaaauucauacugu

SEQ ID NO: 1907315 - RNA, 14 nt, Homo sapiens
auuuuaauuaucuu

SEQ ID NO: 1907316 - RNA, 19 nt, Homo sapiens
cuuccuuugucguguuucu

SEQ ID NO: 1907317 - RNA, 21 nt, Homo sapiens
ucugccgcccuccacaccucu

SEQ ID NO: 1907318 - RNA, 23 nt, Homo sapiens
gcgguuccucaucugagaggcuc

SEQ ID NO: 1907319 - RNA, 23 nt, Homo sapiens
guccauuuaccuggaaaccagaa

SEQ ID NO: 1907320 - RNA, 19 nt, Homo sapiens
auugccuuuagugaucaca

SEQ ID NO: 1907321 - RNA, 22 nt, Homo sapiens
gucugccaggcccccaccacac

SEQ ID NO: 1907322 - RNA, 17 nt, Homo sapiens
caucgauucaaacugcu

SEQ ID NO: 1907323 - RNA, 17 nt, Homo sapiens
cauucuucccuugaugg

SEQ ID NO: 1907324 - RNA, 16 nt, Homo sapiens
uccagaaaaacauuug

SEQ ID NO: 1907325 - RNA, 13 nt, Homo sapiens
ugcauuugcuggu

SEQ ID NO: 1907326 - RNA, 15 nt, Homo sapiens
uagacugugccagag

SEQ ID NO: 1907327 - RNA, 15 nt, Homo sapiens
gcugggaacauguac

SEQ ID NO: 1907328 - RNA, 13 nt, Homo sapiens
gauuaacuccucc

SEQ ID NO: 1907329 - RNA, 16 nt, Homo sapiens
auggauuccacugaaa

SEQ ID NO: 1907330 - RNA, 18 nt, Homo sapiens
augauccccaagugugaa

SEQ ID NO: 1907331 - RNA, 18 nt, Homo sapiens
agcuuuuuccuuacuuuu

SEQ ID NO: 1907332 - RNA, 16 nt, Homo sapiens
cugaggccaucagggc

SEQ ID NO: 1907333 - RNA, 16 nt, Homo sapiens
aguguuaaaacaugaa

SEQ ID NO: 1907334 - RNA, 20 nt, Homo sapiens
auccuguacaagugcucagu

SEQ ID NO: 1907335 - RNA, 17 nt, Homo sapiens
cuacagggcuuaggacu

SEQ ID NO: 1907336 - RNA, 15 nt, Homo sapiens
aaugugcccaaagcu

SEQ ID NO: 1907337 - RNA, 18 nt, Homo sapiens
augcaaaguagcaauuuc

SEQ ID NO: 1907338 - RNA, 16 nt, Homo sapiens
uuugcuguacucuugc

SEQ ID NO: 1907339 - RNA, 23 nt, Homo sapiens
cccguuucauuuagucaugugac

SEQ ID NO: 1907340 - RNA, 19 nt, Homo sapiens
uggaaauaaaccuggagau

SEQ ID NO: 1907341 - RNA, 21 nt, Homo sapiens
aggaagggccauuuuggugcu

SEQ ID NO: 1907342 - RNA, 18 nt, Homo sapiens
caaugguaaaaugaguga

SEQ ID NO: 1907343 - RNA, 19 nt, Homo sapiens
cgcccagcugcaccugcca

SEQ ID NO: 1907344 - RNA, 21 nt, Homo sapiens
gcccaggcuggagugcaaugg

SEQ ID NO: 1907345 - RNA, 15 nt, Homo sapiens
uccuaaaaaguucca

SEQ ID NO: 1907346 - RNA, 18 nt, Homo sapiens
uacauaucaaaacauccc

SEQ ID NO: 1907347 - RNA, 18 nt, Homo sapiens
agaagccacagugcccac

SEQ ID NO: 1907348 - RNA, 22 nt, Homo sapiens
uugcccaggugagggaaggaga

SEQ ID NO: 1907349 - RNA, 18 nt, Homo sapiens
ugaaguacaaacaugaaa

SEQ ID NO: 1907350 - RNA, 15 nt, Homo sapiens
ugaaucucccaagga

SEQ ID NO: 1907351 - RNA, 23 nt, Homo sapiens
gacauuuggugggcuuuggagcu

SEQ ID NO: 1907352 - RNA, 12 nt, Homo sapiens
ccuccaccuacc

SEQ ID NO: 1907353 - RNA, 18 nt, Homo sapiens
aaaugcaagcucuggaaa

SEQ ID NO: 1907354 - RNA, 13 nt, Homo sapiens
ucaucacuaccuu

SEQ ID NO: 1907355 - RNA, 17 nt, Homo sapiens
cuggggagcccacugag

SEQ ID NO: 1907356 - RNA, 21 nt, Homo sapiens
agcaauucuccugccucagcc

SEQ ID NO: 1907357 - RNA, 15 nt, Homo sapiens
auuggcagcucaaag

SEQ ID NO: 1907358 - RNA, 20 nt, Homo sapiens
aguugcagccagggccagug

SEQ ID NO: 1907359 - RNA, 19 nt, Homo sapiens
ucauccauccugagccaaa

SEQ ID NO: 1907360 - RNA, 15 nt, Homo sapiens
ucccaugaggcacga

SEQ ID NO: 1907361 - RNA, 18 nt, Homo sapiens
gccccauggggcaucucu

SEQ ID NO: 1907362 - RNA, 22 nt, Homo sapiens
ccacaaaguuucagaaauucuc

SEQ ID NO: 1907363 - RNA, 21 nt, Homo sapiens
cacacuauuucccucuacuga

SEQ ID NO: 1907364 - RNA, 22 nt, Homo sapiens
auaggcccuggaugugcccaca

SEQ ID NO: 1907365 - RNA, 16 nt, Homo sapiens
ccuuguggcaucguca

SEQ ID NO: 1907366 - RNA, 14 nt, Homo sapiens
cauccacugugcca

SEQ ID NO: 1907367 - RNA, 19 nt, Homo sapiens
aaugaucagaugaacucau

SEQ ID NO: 1907368 - RNA, 18 nt, Homo sapiens
caggcugacuggcaggaa

SEQ ID NO: 1907369 - RNA, 22 nt, Homo sapiens
caagaggacugagacuggcacu

SEQ ID NO: 1907370 - RNA, 21 nt, Homo sapiens
guuuggacccaguucagugag

SEQ ID NO: 1907371 - RNA, 22 nt, Homo sapiens
cuucaguuguggccucauucag

SEQ ID NO: 1907372 - RNA, 11 nt, Homo sapiens
aaauacaauaa

SEQ ID NO: 1907373 - RNA, 17 nt, Homo sapiens
ugcucccugaagccagc

SEQ ID NO: 1907374 - RNA, 13 nt, Homo sapiens
acuucauauuaau

SEQ ID NO: 1907375 - RNA, 12 nt, Homo sapiens
uucagaacauaa

SEQ ID NO: 1907376 - RNA, 18 nt, Homo sapiens
auuccagcauugucugac

SEQ ID NO: 1907377 - RNA, 18 nt, Homo sapiens
aacgacucaaaaugacag

SEQ ID NO: 1907378 - RNA, 22 nt, Homo sapiens
aucauuuauuuacaucuaugua

SEQ ID NO: 1907379 - RNA, 15 nt, Homo sapiens
uggggucuuuuuaug

SEQ ID NO: 1907380 - RNA, 17 nt, Homo sapiens
acgcaugugugcugcag

SEQ ID NO: 1907381 - RNA, 13 nt, Homo sapiens
uuaaaguaccugu

SEQ ID NO: 1907382 - RNA, 14 nt, Homo sapiens
agaacuccuaccug

SEQ ID NO: 1907383 - RNA, 14 nt, Homo sapiens
guuguuuaaaguau

SEQ ID NO: 1907384 - RNA, 16 nt, Homo sapiens
auugugcaugcuagug

SEQ ID NO: 1907385 - RNA, 13 nt, Homo sapiens
acauuuggugggc

SEQ ID NO: 1907386 - RNA, 16 nt, Homo sapiens
augauaaggcucugaa

SEQ ID NO: 1907387 - RNA, 13 nt, Homo sapiens
ugcgcugugccaa

SEQ ID NO: 1907388 - RNA, 21 nt, Homo sapiens
ccagaggcuagucucuucuca

SEQ ID NO: 1907389 - RNA, 14 nt, Homo sapiens
auacagaacucuaa

SEQ ID NO: 1907390 - RNA, 16 nt, Homo sapiens
uaugcugcuguuuaca

SEQ ID NO: 1907391 - RNA, 22 nt, Homo sapiens
caauguguguauauggacaaaa

SEQ ID NO: 1907392 - RNA, 19 nt, Homo sapiens
aggagcuugggugugcuga

SEQ ID NO: 1907393 - RNA, 18 nt, Homo sapiens
acuugauuugcauggauu

SEQ ID NO: 1907394 - RNA, 15 nt, Homo sapiens
ccauucagagacugu

SEQ ID NO: 1907395 - RNA, 15 nt, Homo sapiens
aacccuuaacugaca

SEQ ID NO: 1907396 - RNA, 13 nt, Homo sapiens
aauggccaugcag

SEQ ID NO: 1907397 - RNA, 23 nt, Homo sapiens
cauaauuuaaaaaucuccauuaa

SEQ ID NO: 1907398 - RNA, 22 nt, Homo sapiens
auccccaggccuggcacgucaa

SEQ ID NO: 1907399 - RNA, 22 nt, Homo sapiens
uucagauagagauauuuugggu

SEQ ID NO: 1907400 - RNA, 23 nt, Homo sapiens
acaauuuccauauagucuauuca

SEQ ID NO: 1907401 - RNA, 15 nt, Homo sapiens
ggaccuuuucccaau

SEQ ID NO: 1907402 - RNA, 19 nt, Homo sapiens
gcccucaugaucauucuca

SEQ ID NO: 1907403 - RNA, 19 nt, Homo sapiens
cagggucuaccucugucac

SEQ ID NO: 1907404 - RNA, 14 nt, Homo sapiens
agugccuuaccucc

SEQ ID NO: 1907405 - RNA, 15 nt, Homo sapiens
acuaaaauuccacuc

SEQ ID NO: 1907406 - RNA, 16 nt, Homo sapiens
cauccagguucagcuu

SEQ ID NO: 1907407 - RNA, 15 nt, Homo sapiens
ccuuaaggaaaagua

SEQ ID NO: 1907408 - RNA, 21 nt, Homo sapiens
ccacaguggaaagacagcuuc

SEQ ID NO: 1907409 - RNA, 16 nt, Homo sapiens
acccagcaaaugggca

SEQ ID NO: 1907410 - RNA, 17 nt, Homo sapiens
cacgauggaauguaaaa

SEQ ID NO: 1907411 - RNA, 14 nt, Homo sapiens
aucuuacugaaggu

SEQ ID NO: 1907412 - RNA, 19 nt, Homo sapiens
agcauauguuccaugccug

SEQ ID NO: 1907413 - RNA, 17 nt, Homo sapiens
guuucugauaccacugc

SEQ ID NO: 1907414 - RNA, 18 nt, Homo sapiens
uacaaaagauguauccuu

SEQ ID NO: 1907415 - RNA, 16 nt, Homo sapiens
ugugccuuguucaagg

SEQ ID NO: 1907416 - RNA, 22 nt, Homo sapiens
ugguggccaucacuuucauuca

SEQ ID NO: 1907417 - RNA, 12 nt, Homo sapiens
acccucucacua

SEQ ID NO: 1907418 - RNA, 14 nt, Homo sapiens
ugcaauacucagua

SEQ ID NO: 1907419 - RNA, 16 nt, Homo sapiens
uccagcuucacuguca

SEQ ID NO: 1907420 - RNA, 20 nt, Homo sapiens
caggcucuugacuacuugga

SEQ ID NO: 1907421 - RNA, 14 nt, Homo sapiens
cugggggccaugag

SEQ ID NO: 1907422 - RNA, 14 nt, Homo sapiens
aaaaacaaccuugc

SEQ ID NO: 1907423 - RNA, 12 nt, Homo sapiens
aaccugaacuuu

SEQ ID NO: 1907424 - RNA, 14 nt, Homo sapiens
aacccggagagugc

SEQ ID NO: 1907425 - RNA, 13 nt, Homo sapiens
gcgugauucaaug

SEQ ID NO: 1907426 - RNA, 17 nt, Homo sapiens
uuauguggacaagccau

SEQ ID NO: 1907427 - RNA, 23 nt, Homo sapiens
ugcauuucuggaccuugagcauc

SEQ ID NO: 1907428 - RNA, 22 nt, Homo sapiens
ucaccaugcaaugccucuggaa

SEQ ID NO: 1907429 - RNA, 18 nt, Homo sapiens
ucuggagugugugggggu

SEQ ID NO: 1907430 - RNA, 13 nt, Homo sapiens
ucccugaaguauu

SEQ ID NO: 1907431 - RNA, 16 nt, Homo sapiens
ucuaaaggacauacau

SEQ ID NO: 1907432 - RNA, 11 nt, Homo sapiens
guagcugugcg

SEQ ID NO: 1907433 - RNA, 22 nt, Homo sapiens
uaccuuauucuacaucauuaac

SEQ ID NO: 1907434 - RNA, 19 nt, Homo sapiens
cugcuaggccagagccaug

SEQ ID NO: 1907435 - RNA, 20 nt, Homo sapiens
aauacaguuuauaaagccaa

SEQ ID NO: 1907436 - RNA, 14 nt, Homo sapiens
uuucaaaguucucu

SEQ ID NO: 1907437 - RNA, 19 nt, Homo sapiens
gaaauaacuaagagauucu

SEQ ID NO: 1907438 - RNA, 13 nt, Homo sapiens
uaauguugcuuag

SEQ ID NO: 1907439 - RNA, 12 nt, Homo sapiens
aaagucaugcaa

SEQ ID NO: 1907440 - RNA, 12 nt, Homo sapiens
cucaagggccau

SEQ ID NO: 1907441 - RNA, 16 nt, Homo sapiens
aaacuauggcuuuaaa

SEQ ID NO: 1907442 - RNA, 21 nt, Homo sapiens
ccugcuuccuccagggaaccc

SEQ ID NO: 1907443 - RNA, 17 nt, Homo sapiens
agaucuuucaggaaaga

SEQ ID NO: 1907444 - RNA, 19 nt, Homo sapiens
cuuagauuucuagcaguau

SEQ ID NO: 1907445 - RNA, 15 nt, Homo sapiens
ucuucacaccauuca

SEQ ID NO: 1907446 - RNA, 18 nt, Homo sapiens
gcacuagagaaugcacag

SEQ ID NO: 1907447 - RNA, 15 nt, Homo sapiens
ucaggccacugccca

SEQ ID NO: 1907448 - RNA, 11 nt, Homo sapiens
gccugagcaac

SEQ ID NO: 1907449 - RNA, 19 nt, Homo sapiens
aucacugguauuaacuuua

SEQ ID NO: 1907450 - RNA, 18 nt, Homo sapiens
ccuuuggaugcacuuuau

SEQ ID NO: 1907451 - RNA, 15 nt, Homo sapiens
uuuuauugugcuuca

SEQ ID NO: 1907452 - RNA, 20 nt, Homo sapiens
caaguguucuaaaaugaaau

SEQ ID NO: 1907453 - RNA, 24 nt, Homo sapiens
ccuuucucucuccucucugcuuca

SEQ ID NO: 1907454 - RNA, 22 nt, Homo sapiens
cucuuccuggaaugcauucacu

SEQ ID NO: 1907455 - RNA, 18 nt, Homo sapiens
augguagcauacuuuaua

SEQ ID NO: 1907456 - RNA, 19 nt, Homo sapiens
uaaauugcuuauucuaggu

SEQ ID NO: 1907457 - RNA, 12 nt, Homo sapiens
cuuccaccugua

SEQ ID NO: 1907458 - RNA, 20 nt, Homo sapiens
uucuuuauaauccucuguaa

SEQ ID NO: 1907459 - RNA, 15 nt, Homo sapiens
agccuaucaaaggaa

SEQ ID NO: 1907460 - RNA, 16 nt, Homo sapiens
auggaggcacacagcu

SEQ ID NO: 1907461 - RNA, 20 nt, Homo sapiens
aguuaaccccauguccucag

SEQ ID NO: 1907462 - RNA, 17 nt, Homo sapiens
agcaaacacacucucac

SEQ ID NO: 1907463 - RNA, 18 nt, Homo sapiens
gcaaagacuagauccuuu

SEQ ID NO: 1907464 - RNA, 19 nt, Homo sapiens
gcugccagacacugagcuu

SEQ ID NO: 1907465 - RNA, 20 nt, Homo sapiens
ucagccagcucccagccaca

SEQ ID NO: 1907466 - RNA, 17 nt, Homo sapiens
gcagucgugccuguguc

SEQ ID NO: 1907467 - RNA, 17 nt, Homo sapiens
acuaaacagacuauuua

SEQ ID NO: 1907468 - RNA, 19 nt, Homo sapiens
gauacaggaaaagcugcug

SEQ ID NO: 1907469 - RNA, 17 nt, Homo sapiens
uccaggaucuccacuga

SEQ ID NO: 1907470 - RNA, 16 nt, Homo sapiens
caagaaaacucaaaga

SEQ ID NO: 1907471 - RNA, 17 nt, Homo sapiens
cgucaucaucacauuca

SEQ ID NO: 1907472 - RNA, 17 nt, Homo sapiens
ugccacuucaccaagga

SEQ ID NO: 1907473 - RNA, 22 nt, Homo sapiens
ugaaguauaucucuagaugcaa

SEQ ID NO: 1907474 - RNA, 22 nt, Homo sapiens
cacagagggccccucucuccac

SEQ ID NO: 1907475 - RNA, 22 nt, Homo sapiens
cuagggcuggagggacagggag

SEQ ID NO: 1907476 - RNA, 17 nt, Homo sapiens
gcccagccuacauucac

SEQ ID NO: 1907477 - RNA, 15 nt, Homo sapiens
cugcugugucuuuag

SEQ ID NO: 1907478 - RNA, 16 nt, Homo sapiens
augucagugucacugg

SEQ ID NO: 1907479 - RNA, 22 nt, Homo sapiens
guggagccuuuuaacugugcaa

SEQ ID NO: 1907480 - RNA, 15 nt, Homo sapiens
accuaucacuuccac

SEQ ID NO: 1907481 - RNA, 17 nt, Homo sapiens
gggaacaaggaaggaaa

SEQ ID NO: 1907482 - RNA, 15 nt, Homo sapiens
agaguccugcacagu

SEQ ID NO: 1907483 - RNA, 21 nt, Homo sapiens
ccuggaguuuaauacagugag

SEQ ID NO: 1907484 - RNA, 15 nt, Homo sapiens
uugcaagaaucauua

SEQ ID NO: 1907485 - RNA, 20 nt, Homo sapiens
agacuuggaugucauaucuu

SEQ ID NO: 1907486 - RNA, 13 nt, Homo sapiens
gccacccacugac

SEQ ID NO: 1907487 - RNA, 19 nt, Homo sapiens
cauuauuaaauguuucuca

SEQ ID NO: 1907488 - RNA, 21 nt, Homo sapiens
cuucuacuacccccacagacc

SEQ ID NO: 1907489 - RNA, 20 nt, Homo sapiens
ucaguuucauuaacugguga

SEQ ID NO: 1907490 - RNA, 13 nt, Homo sapiens
acauuguauauau

SEQ ID NO: 1907491 - RNA, 19 nt, Homo sapiens
caugagaugauacauccaa

SEQ ID NO: 1907492 - RNA, 17 nt, Homo sapiens
agcucucaucacuaccu

SEQ ID NO: 1907493 - RNA, 22 nt, Homo sapiens
ucagccagcccucuucugacac

SEQ ID NO: 1907494 - RNA, 12 nt, Homo sapiens
ucauuacauuuc

SEQ ID NO: 1907495 - RNA, 14 nt, Homo sapiens
aguucuaugcagaa

SEQ ID NO: 1907496 - RNA, 23 nt, Homo sapiens
ucacucaucaauggggccaguca

SEQ ID NO: 1907497 - RNA, 16 nt, Homo sapiens
ucccacucuucuugca

SEQ ID NO: 1907498 - RNA, 18 nt, Homo sapiens
agacucccuccauagcga

SEQ ID NO: 1907499 - RNA, 21 nt, Homo sapiens
ugugcugcccugcucugggga

SEQ ID NO: 1907500 - RNA, 22 nt, Homo sapiens
cuccucguuccucuccuggaug

SEQ ID NO: 1907501 - RNA, 17 nt, Homo sapiens
agccucagcaacccagg

SEQ ID NO: 1907502 - RNA, 20 nt, Homo sapiens
gagaaaaggacuccucagaa

SEQ ID NO: 1907503 - RNA, 15 nt, Homo sapiens
ccaacaccugccaua

SEQ ID NO: 1907504 - RNA, 13 nt, Homo sapiens
agccuggccagac

SEQ ID NO: 1907505 - RNA, 14 nt, Homo sapiens
agaugauugaauaa

SEQ ID NO: 1907506 - RNA, 19 nt, Homo sapiens
cuucaauaaccaugaugac

SEQ ID NO: 1907507 - RNA, 20 nt, Homo sapiens
augcuccauuuuuaaccacu

SEQ ID NO: 1907508 - RNA, 19 nt, Homo sapiens
aaacuggacuugucuuccu

SEQ ID NO: 1907509 - RNA, 20 nt, Homo sapiens
gaugaucacugaucuuguca

SEQ ID NO: 1907510 - RNA, 21 nt, Homo sapiens
acugcacuauagccuagguga

SEQ ID NO: 1907511 - RNA, 15 nt, Homo sapiens
cuaaaguuacaaaca

SEQ ID NO: 1907512 - RNA, 12 nt, Homo sapiens
cacacacugugu

SEQ ID NO: 1907513 - RNA, 21 nt, Homo sapiens
cuaaagguagaucaucuugaa

SEQ ID NO: 1907514 - RNA, 22 nt, Homo sapiens
auucccuaucaaaacauaucaa

SEQ ID NO: 1907515 - RNA, 21 nt, Homo sapiens
acaguggauugcucaucucag

SEQ ID NO: 1907516 - RNA, 14 nt, Homo sapiens
uuauaucagccuga

SEQ ID NO: 1907517 - RNA, 16 nt, Homo sapiens
uguauauguagcaaaa

SEQ ID NO: 1907518 - RNA, 20 nt, Homo sapiens
acuggaaguucauaccuaag

SEQ ID NO: 1907519 - RNA, 19 nt, Homo sapiens
gguccuucuguagugccau

SEQ ID NO: 1907520 - RNA, 13 nt, Homo sapiens
ugagggacucuga

SEQ ID NO: 1907521 - RNA, 12 nt, Homo sapiens
guauuuugccac

SEQ ID NO: 1907522 - RNA, 23 nt, Homo sapiens
cugagugcccagaccccauucca

SEQ ID NO: 1907523 - RNA, 17 nt, Homo sapiens
gacagaccgccaaauaa

SEQ ID NO: 1907524 - RNA, 19 nt, Homo sapiens
uuuugaaauaccacaguug

SEQ ID NO: 1907525 - RNA, 19 nt, Homo sapiens
cuucuuguaguagucucau

SEQ ID NO: 1907526 - RNA, 18 nt, Homo sapiens
ugcccaccacaacuaaca

SEQ ID NO: 1907527 - RNA, 16 nt, Homo sapiens
caauggguaucuaaua

SEQ ID NO: 1907528 - RNA, 17 nt, Homo sapiens
ucucaugauaccaccuu

SEQ ID NO: 1907529 - RNA, 17 nt, Homo sapiens
gcucccuuccuccucaa

SEQ ID NO: 1907530 - RNA, 18 nt, Homo sapiens
cuaauagggccacagucc

SEQ ID NO: 1907531 - RNA, 14 nt, Homo sapiens
cccgucgugcaguc

SEQ ID NO: 1907532 - RNA, 21 nt, Homo sapiens
caguauauucuuuccucaaaa

SEQ ID NO: 1907533 - RNA, 20 nt, Homo sapiens
caaagcccacuuuguucgca

SEQ ID NO: 1907534 - RNA, 15 nt, Homo sapiens
aggagagacacuggu

SEQ ID NO: 1907535 - RNA, 15 nt, Homo sapiens
gccugggaucagugg

SEQ ID NO: 1907536 - RNA, 14 nt, Homo sapiens
uuuucacaaauaaa

SEQ ID NO: 1907537 - RNA, 18 nt, Homo sapiens
gccaaccggucacccagg

SEQ ID NO: 1907538 - RNA, 14 nt, Homo sapiens
uuuugauagcuuua

SEQ ID NO: 1907539 - RNA, 19 nt, Homo sapiens
ugauguagagauuuaccug

SEQ ID NO: 1907540 - RNA, 18 nt, Homo sapiens
ucuuuagagcauugccau

SEQ ID NO: 1907541 - RNA, 19 nt, Homo sapiens
uauaaccauaugauacuau

SEQ ID NO: 1907542 - RNA, 13 nt, Homo sapiens
aaaagauugccaa

SEQ ID NO: 1907543 - RNA, 16 nt, Homo sapiens
acugggacagcccagg

SEQ ID NO: 1907544 - RNA, 19 nt, Homo sapiens
gccauggauggaaaacgcu

SEQ ID NO: 1907545 - RNA, 16 nt, Homo sapiens
cgugggucauuacaaa

SEQ ID NO: 1907546 - RNA, 18 nt, Homo sapiens
uuugcuagugacauguac

SEQ ID NO: 1907547 - RNA, 18 nt, Homo sapiens
aauaccuggccucauuua

SEQ ID NO: 1907548 - RNA, 22 nt, Homo sapiens
cagaaugagaccaaacgcagcc

SEQ ID NO: 1907549 - RNA, 21 nt, Homo sapiens
gagacuuucuucuagugcuuu

SEQ ID NO: 1907550 - RNA, 17 nt, Homo sapiens
ucccaagaaauggaauc

SEQ ID NO: 1907551 - RNA, 16 nt, Homo sapiens
agugccacacaugccc

SEQ ID NO: 1907552 - RNA, 13 nt, Homo sapiens
augugcaggcacc

SEQ ID NO: 1907553 - RNA, 19 nt, Homo sapiens
uugucuuuucaaaauauua

SEQ ID NO: 1907554 - RNA, 21 nt, Homo sapiens
cacuucuggauauagcuaggu

SEQ ID NO: 1907555 - RNA, 22 nt, Homo sapiens
auguguuguguauuccacuuag

SEQ ID NO: 1907556 - RNA, 16 nt, Homo sapiens
agaggcuuucuccagg

SEQ ID NO: 1907557 - RNA, 22 nt, Homo sapiens
ugcuccaggagguuugcaggga

SEQ ID NO: 1907558 - RNA, 21 nt, Homo sapiens
auagagaaaaaaauucaugca

SEQ ID NO: 1907559 - RNA, 13 nt, Homo sapiens
gcuugagucacca

SEQ ID NO: 1907560 - RNA, 22 nt, Homo sapiens
uuggaacuuuucuccugcaugu

SEQ ID NO: 1907561 - RNA, 19 nt, Homo sapiens
gcgugccuguagugccagc

SEQ ID NO: 1907562 - RNA, 14 nt, Homo sapiens
gacuacacccaagc

SEQ ID NO: 1907563 - RNA, 13 nt, Homo sapiens
cagugcuuuucac

SEQ ID NO: 1907564 - RNA, 14 nt, Homo sapiens
cuucauugccuuaa

SEQ ID NO: 1907565 - RNA, 17 nt, Homo sapiens
ccagaggguagggcaca

SEQ ID NO: 1907566 - RNA, 16 nt, Homo sapiens
uaucccuuacuccaga

SEQ ID NO: 1907567 - RNA, 19 nt, Homo sapiens
uucaggagaaugugcagug

SEQ ID NO: 1907568 - RNA, 16 nt, Homo sapiens
augcagcuuauacgaa

SEQ ID NO: 1907569 - RNA, 23 nt, Homo sapiens
aaugacaaaugacgucuucacca

SEQ ID NO: 1907570 - RNA, 15 nt, Homo sapiens
acugagguaaccuua

SEQ ID NO: 1907571 - RNA, 19 nt, Homo sapiens
gcauaagcuuaugcuuaaa

SEQ ID NO: 1907572 - RNA, 12 nt, Homo sapiens
auguaacuauaa

SEQ ID NO: 1907573 - RNA, 10 nt, Homo sapiens
uugggcuccu

SEQ ID NO: 1907574 - RNA, 20 nt, Homo sapiens
cuggagggaaguuggggaaa

SEQ ID NO: 1907575 - RNA, 22 nt, Homo sapiens
gauucauauauccgaacuacug

SEQ ID NO: 1907576 - RNA, 18 nt, Homo sapiens
uuaaguucuaucagugac

SEQ ID NO: 1907577 - RNA, 19 nt, Homo sapiens
cucuaaauaccauucccuu

SEQ ID NO: 1907578 - RNA, 19 nt, Homo sapiens
agccagcaggcucucaggc

SEQ ID NO: 1907579 - RNA, 15 nt, Homo sapiens
caauccaaguacaug

SEQ ID NO: 1907580 - RNA, 22 nt, Homo sapiens
uauacacauacauauauacaca

SEQ ID NO: 1907581 - RNA, 16 nt, Homo sapiens
acacuugggagcaaaa

SEQ ID NO: 1907582 - RNA, 16 nt, Homo sapiens
cugcucacauucccuc

SEQ ID NO: 1907583 - RNA, 14 nt, Homo sapiens
aaugcugcuucucc

SEQ ID NO: 1907584 - RNA, 13 nt, Homo sapiens
caauaaacacuug

SEQ ID NO: 1907585 - RNA, 21 nt, Homo sapiens
guaggaaaucaggcaguuccc

SEQ ID NO: 1907586 - RNA, 12 nt, Homo sapiens
uucuuucacuug

SEQ ID NO: 1907587 - RNA, 12 nt, Homo sapiens
cauccaacacug

SEQ ID NO: 1907588 - RNA, 20 nt, Homo sapiens
accagcaggauggcaggggc

SEQ ID NO: 1907589 - RNA, 18 nt, Homo sapiens
uggauuuauagcuaugaa

SEQ ID NO: 1907590 - RNA, 18 nt, Homo sapiens
ugcacuuauacccaugaa

SEQ ID NO: 1907591 - RNA, 21 nt, Homo sapiens
agguaguuuugguuuccugau

SEQ ID NO: 1907592 - RNA, 13 nt, Homo sapiens
cugagccuagcua

SEQ ID NO: 1907593 - RNA, 17 nt, Homo sapiens
auauguagauugccuuu

SEQ ID NO: 1907594 - RNA, 22 nt, Homo sapiens
uccagggggcagcccaguggaa

SEQ ID NO: 1907595 - RNA, 14 nt, Homo sapiens
uucaucaaacauug

SEQ ID NO: 1907596 - RNA, 13 nt, Homo sapiens
uagaauacuguau

SEQ ID NO: 1907597 - RNA, 12 nt, Homo sapiens
ccugugugaccc

SEQ ID NO: 1907598 - RNA, 15 nt, Homo sapiens
acacugaaguuaaca

SEQ ID NO: 1907599 - RNA, 19 nt, Homo sapiens
ccacagcugggcaggguga

SEQ ID NO: 1907600 - RNA, 21 nt, Homo sapiens
gcuagaagugugaagugcaga

SEQ ID NO: 1907601 - RNA, 16 nt, Homo sapiens
ucucaucaguccauug

SEQ ID NO: 1907602 - RNA, 22 nt, Homo sapiens
cccauugcaaacauuauuccaa

SEQ ID NO: 1907603 - RNA, 19 nt, Homo sapiens
ugcuaauaacagugcauau

SEQ ID NO: 1907604 - RNA, 22 nt, Homo sapiens
gaauuugaaaaaugcauaauaa

SEQ ID NO: 1907605 - RNA, 15 nt, Homo sapiens
caucagucaacaacu

SEQ ID NO: 1907606 - RNA, 16 nt, Homo sapiens
gcaguucacaggguau

SEQ ID NO: 1907607 - RNA, 19 nt, Homo sapiens
uguucuccucguccaucag

SEQ ID NO: 1907608 - RNA, 15 nt, Homo sapiens
ugggauuuggaguca

SEQ ID NO: 1907609 - RNA, 13 nt, Homo sapiens
aguacacagguag

SEQ ID NO: 1907610 - RNA, 18 nt, Homo sapiens
aaggggauggaggccaga

SEQ ID NO: 1907611 - RNA, 13 nt, Homo sapiens
ccuuccacccagg

SEQ ID NO: 1907612 - RNA, 17 nt, Homo sapiens
uucuccaacccaaagua

SEQ ID NO: 1907613 - RNA, 21 nt, Homo sapiens
uaaucagcaagaauuugaucg

SEQ ID NO: 1907614 - RNA, 14 nt, Homo sapiens
cucuccucagaguc

SEQ ID NO: 1907615 - RNA, 15 nt, Homo sapiens
auucugcaagcuuuu

SEQ ID NO: 1907616 - RNA, 20 nt, Homo sapiens
guguucucuggcucuugucc

SEQ ID NO: 1907617 - RNA, 16 nt, Homo sapiens
guuuugaaaugcagaa

SEQ ID NO: 1907618 - RNA, 16 nt, Homo sapiens
ucacugcaaccuccac

SEQ ID NO: 1907619 - RNA, 15 nt, Homo sapiens
cacugccucauggca

SEQ ID NO: 1907620 - RNA, 17 nt, Homo sapiens
uuagagaaugcuugaau

SEQ ID NO: 1907621 - RNA, 24 nt, Homo sapiens
aaauguuugcugagugagugauga

SEQ ID NO: 1907622 - RNA, 17 nt, Homo sapiens
aaccacuguguacugga

SEQ ID NO: 1907623 - RNA, 12 nt, Homo sapiens
gcaucugacaca

SEQ ID NO: 1907624 - RNA, 15 nt, Homo sapiens
aauucggugugcacc

SEQ ID NO: 1907625 - RNA, 14 nt, Homo sapiens
cuguguaaccucca

SEQ ID NO: 1907626 - RNA, 14 nt, Homo sapiens
ucuuucaacauuuc

SEQ ID NO: 1907627 - RNA, 15 nt, Homo sapiens
uccgugaauugcuuu

SEQ ID NO: 1907628 - RNA, 16 nt, Homo sapiens
uauggccucaagauca

SEQ ID NO: 1907629 - RNA, 23 nt, Homo sapiens
uguauauguagauguaugcacac

SEQ ID NO: 1907630 - RNA, 12 nt, Homo sapiens
ucuauugccaug

SEQ ID NO: 1907631 - RNA, 12 nt, Homo sapiens
ucaguugccaaa

SEQ ID NO: 1907632 - RNA, 16 nt, Homo sapiens
cucuggugugugguga

SEQ ID NO: 1907633 - RNA, 12 nt, Homo sapiens
cuugacaugugc

SEQ ID NO: 1907634 - RNA, 14 nt, Homo sapiens
cugcaauacauuaa

SEQ ID NO: 1907635 - RNA, 16 nt, Homo sapiens
aacaugacacauuuga

SEQ ID NO: 1907636 - RNA, 22 nt, Homo sapiens
gcucaggcuggucuugaacucc

SEQ ID NO: 1907637 - RNA, 16 nt, Homo sapiens
caccauaaaaaggaau

SEQ ID NO: 1907638 - RNA, 17 nt, Homo sapiens
caauaaaguuguugcau

SEQ ID NO: 1907639 - RNA, 17 nt, Homo sapiens
aagaaauaaugccucca

SEQ ID NO: 1907640 - RNA, 14 nt, Homo sapiens
aaaagugccucaag

SEQ ID NO: 1907641 - RNA, 13 nt, Homo sapiens
agacaacauuucu

SEQ ID NO: 1907642 - RNA, 21 nt, Homo sapiens
acauggaaucgaaguguuuau

SEQ ID NO: 1907643 - RNA, 14 nt, Homo sapiens
agggcugcuuccag

SEQ ID NO: 1907644 - RNA, 21 nt, Homo sapiens
cccugacaucuggaaucugga

SEQ ID NO: 1907645 - RNA, 16 nt, Homo sapiens
ccagccugaccaaaau

SEQ ID NO: 1907646 - RNA, 19 nt, Homo sapiens
gaguauguuaagcucuuua

SEQ ID NO: 1907647 - RNA, 18 nt, Homo sapiens
caggcaccaccaggagca

SEQ ID NO: 1907648 - RNA, 22 nt, Homo sapiens
gugguguccugaagcugcugga

SEQ ID NO: 1907649 - RNA, 22 nt, Homo sapiens
aaagggaggaggugcacagcac

SEQ ID NO: 1907650 - RNA, 18 nt, Homo sapiens
ccuguaaucucagcacuu

SEQ ID NO: 1907651 - RNA, 21 nt, Homo sapiens
cugccugcugaagcuggugac

SEQ ID NO: 1907652 - RNA, 22 nt, Homo sapiens
augacaaggauuagaacacuca

SEQ ID NO: 1907653 - RNA, 18 nt, Homo sapiens
guaggaagaguagcauuu

SEQ ID NO: 1907654 - RNA, 14 nt, Homo sapiens
guuuuugcagagaa

SEQ ID NO: 1907655 - RNA, 15 nt, Homo sapiens
gaaacacaauaccua

SEQ ID NO: 1907656 - RNA, 15 nt, Homo sapiens
agugccuuuaucuca

SEQ ID NO: 1907657 - RNA, 22 nt, Homo sapiens
auguguucuaagcaaugcaaau

SEQ ID NO: 1907658 - RNA, 13 nt, Homo sapiens
cgugacccugugc

SEQ ID NO: 1907659 - RNA, 11 nt, Homo sapiens
ggacacugaga

SEQ ID NO: 1907660 - RNA, 11 nt, Homo sapiens
agccacugggc

SEQ ID NO: 1907661 - RNA, 22 nt, Homo sapiens
ugcugaaacaucauuacagauu

SEQ ID NO: 1907662 - RNA, 18 nt, Homo sapiens
cucauccccacagcuggc

SEQ ID NO: 1907663 - RNA, 17 nt, Homo sapiens
gucucugccucccucac

SEQ ID NO: 1907664 - RNA, 13 nt, Homo sapiens
cugcuggugugag

SEQ ID NO: 1907665 - RNA, 23 nt, Homo sapiens
uggagccccagugccaagcacag

SEQ ID NO: 1907666 - RNA, 15 nt, Homo sapiens
uucaugccccggcug

SEQ ID NO: 1907667 - RNA, 24 nt, Homo sapiens
cuacuuuauaaucaagacaagugu

SEQ ID NO: 1907668 - RNA, 16 nt, Homo sapiens
ggaauaagaagcaaau

SEQ ID NO: 1907669 - RNA, 13 nt, Homo sapiens
ccucccuguucaa

SEQ ID NO: 1907670 - RNA, 21 nt, Homo sapiens
caucugccaccggaaauacca

SEQ ID NO: 1907671 - RNA, 15 nt, Homo sapiens
gcaaaggugccucau

SEQ ID NO: 1907672 - RNA, 13 nt, Homo sapiens
cacugugcuacug

SEQ ID NO: 1907673 - RNA, 11 nt, Homo sapiens
gccugcacugg

SEQ ID NO: 1907674 - RNA, 16 nt, Homo sapiens
accccaggcagccacu

SEQ ID NO: 1907675 - RNA, 21 nt, Homo sapiens
guggagaaauuccuugauuca

SEQ ID NO: 1907676 - RNA, 15 nt, Homo sapiens
cagacacuaccccau

SEQ ID NO: 1907677 - RNA, 15 nt, Homo sapiens
gaaaacugucauuua

SEQ ID NO: 1907678 - RNA, 15 nt, Homo sapiens
ccuucacugugcucc

SEQ ID NO: 1907679 - RNA, 20 nt, Homo sapiens
agugcccugcccccuggcug

SEQ ID NO: 1907680 - RNA, 15 nt, Homo sapiens
gaacaauauugacuu

SEQ ID NO: 1907681 - RNA, 23 nt, Homo sapiens
ucuugccccagugugguuugcau

SEQ ID NO: 1907682 - RNA, 19 nt, Homo sapiens
aggaaaaugcuuauugaug

SEQ ID NO: 1907683 - RNA, 20 nt, Homo sapiens
gccacgccugcgauggugcu

SEQ ID NO: 1907684 - RNA, 17 nt, Homo sapiens
aaugucuggucugucca

SEQ ID NO: 1907685 - RNA, 16 nt, Homo sapiens
uaacugaagcauguga

SEQ ID NO: 1907686 - RNA, 19 nt, Homo sapiens
gaaacauuuggaagcccca

SEQ ID NO: 1907687 - RNA, 16 nt, Homo sapiens
ccucauuuuguuccuu

SEQ ID NO: 1907688 - RNA, 13 nt, Homo sapiens
uugguuucacuga

SEQ ID NO: 1907689 - RNA, 13 nt, Homo sapiens
auugaaaucugga

SEQ ID NO: 1907690 - RNA, 19 nt, Homo sapiens
aaacccugagccaccgugu

SEQ ID NO: 1907691 - RNA, 18 nt, Homo sapiens
aaguuagagauuuuacaa

SEQ ID NO: 1907692 - RNA, 16 nt, Homo sapiens
uauuuucuacuugcca

SEQ ID NO: 1907693 - RNA, 14 nt, Homo sapiens
gugucagagcuggg

SEQ ID NO: 1907694 - RNA, 18 nt, Homo sapiens
ugacagaucaagcuguga

SEQ ID NO: 1907695 - RNA, 23 nt, Homo sapiens
aagugugccucugccuuaucuca

SEQ ID NO: 1907696 - RNA, 16 nt, Homo sapiens
cuccaguucugaugag

SEQ ID NO: 1907697 - RNA, 18 nt, Homo sapiens
ucccacucaguacuguac

SEQ ID NO: 1907698 - RNA, 11 nt, Homo sapiens
aggucucucaa

SEQ ID NO: 1907699 - RNA, 14 nt, Homo sapiens
uccaacaaaccaca

SEQ ID NO: 1907700 - RNA, 22 nt, Homo sapiens
ugagacuuucuucuagugcuuu

SEQ ID NO: 1907701 - RNA, 12 nt, Homo sapiens
gaguaagccagu

SEQ ID NO: 1907702 - RNA, 14 nt, Homo sapiens
gccuguucccugag

SEQ ID NO: 1907703 - RNA, 14 nt, Homo sapiens
ggaccccugcccuu

SEQ ID NO: 1907704 - RNA, 17 nt, Homo sapiens
uuguagcaaagcacaua

SEQ ID NO: 1907705 - RNA, 15 nt, Homo sapiens
ucauguugaagucaa

SEQ ID NO: 1907706 - RNA, 12 nt, Homo sapiens
auguccagugag

SEQ ID NO: 1907707 - RNA, 23 nt, Homo sapiens
aucuaaugacaugccuauaugag

SEQ ID NO: 1907708 - RNA, 14 nt, Homo sapiens
augaagacacucaa

SEQ ID NO: 1907709 - RNA, 12 nt, Homo sapiens
ccuuaugacucc

SEQ ID NO: 1907710 - RNA, 19 nt, Homo sapiens
cagccugggcaacauacca

SEQ ID NO: 1907711 - RNA, 19 nt, Homo sapiens
ucccuuccggagucuuuga

SEQ ID NO: 1907712 - RNA, 17 nt, Homo sapiens
gguguuacuaaagucac

SEQ ID NO: 1907713 - RNA, 23 nt, Homo sapiens
acagccucuuuccuaacuuccuu

SEQ ID NO: 1907714 - RNA, 19 nt, Homo sapiens
cacugccccagacacagug

SEQ ID NO: 1907715 - RNA, 17 nt, Homo sapiens
cuccacccacuagguga

SEQ ID NO: 1907716 - RNA, 21 nt, Homo sapiens
agaauuauuuugugaugcaaa

SEQ ID NO: 1907717 - RNA, 13 nt, Homo sapiens
cucuaggcccaca

SEQ ID NO: 1907718 - RNA, 12 nt, Homo sapiens
cugccuucucag

SEQ ID NO: 1907719 - RNA, 11 nt, Homo sapiens
uacaaaacugc

SEQ ID NO: 1907720 - RNA, 11 nt, Homo sapiens
uagaaaacugg

SEQ ID NO: 1907721 - RNA, 16 nt, Homo sapiens
auuuuuaaccaacaga

SEQ ID NO: 1907722 - RNA, 22 nt, Homo sapiens
uuacccuuuggccccacuuuga

SEQ ID NO: 1907723 - RNA, 18 nt, Homo sapiens
uagaggcauaaaccugug

SEQ ID NO: 1907724 - RNA, 23 nt, Homo sapiens
uuguucuggguuuugguuuucuu

SEQ ID NO: 1907725 - RNA, 21 nt, Homo sapiens
aaaucuugcuucagaccauca

SEQ ID NO: 1907726 - RNA, 17 nt, Homo sapiens
ggacagucagcauuucu

SEQ ID NO: 1907727 - RNA, 19 nt, Homo sapiens
cuauuguagauaacacuau

SEQ ID NO: 1907728 - RNA, 13 nt, Homo sapiens
cuucagcacuuua

SEQ ID NO: 1907729 - RNA, 15 nt, Homo sapiens
gccagggcagaggaa

SEQ ID NO: 1907730 - RNA, 18 nt, Homo sapiens
ucuuuagcuauuacugga

SEQ ID NO: 1907731 - RNA, 19 nt, Homo sapiens
ucuccacuauggcaacuaa

SEQ ID NO: 1907732 - RNA, 19 nt, Homo sapiens
aguuggggguguggcucug

SEQ ID NO: 1907733 - RNA, 17 nt, Homo sapiens
uauguaauguaaaccag

SEQ ID NO: 1907734 - RNA, 20 nt, Homo sapiens
agaaacagauaacaccaaac

SEQ ID NO: 1907735 - RNA, 13 nt, Homo sapiens
cucaucaaucaaa

SEQ ID NO: 1907736 - RNA, 16 nt, Homo sapiens
caucauucauucauuc

SEQ ID NO: 1907737 - RNA, 16 nt, Homo sapiens
aagggaaacugggaaa

SEQ ID NO: 1907738 - RNA, 16 nt, Homo sapiens
aaguguaccuguguac

SEQ ID NO: 1907739 - RNA, 13 nt, Homo sapiens
ccagggcgccagg

SEQ ID NO: 1907740 - RNA, 13 nt, Homo sapiens
cuaauggcuuuca

SEQ ID NO: 1907741 - RNA, 18 nt, Homo sapiens
uggccaugcccuccaugu

SEQ ID NO: 1907742 - RNA, 13 nt, Homo sapiens
ucaaaagccaaaa

SEQ ID NO: 1907743 - RNA, 17 nt, Homo sapiens
agauacgaaaucaguuu

SEQ ID NO: 1907744 - RNA, 18 nt, Homo sapiens
aauucacaaauacauaac

SEQ ID NO: 1907745 - RNA, 10 nt, Homo sapiens
cccugagguu

SEQ ID NO: 1907746 - RNA, 19 nt, Homo sapiens
gaacuaacuuacuguccac

SEQ ID NO: 1907747 - RNA, 16 nt, Homo sapiens
agaacuugaaccugaa

SEQ ID NO: 1907748 - RNA, 20 nt, Homo sapiens
uagcagagaagccugucugu

SEQ ID NO: 1907749 - RNA, 16 nt, Homo sapiens
aagaugcguuugccuc

SEQ ID NO: 1907750 - RNA, 12 nt, Homo sapiens
aaaaaacagugg

SEQ ID NO: 1907751 - RNA, 23 nt, Homo sapiens
gcacagagagggggccaccuccc

SEQ ID NO: 1907752 - RNA, 17 nt, Homo sapiens
cugcaagucacaaagga

SEQ ID NO: 1907753 - RNA, 20 nt, Homo sapiens
caagaaguucuuguucuuca

SEQ ID NO: 1907754 - RNA, 18 nt, Homo sapiens
cacuuagcuaucagaaga

SEQ ID NO: 1907755 - RNA, 19 nt, Homo sapiens
caguauucuguaaagcuua

SEQ ID NO: 1907756 - RNA, 21 nt, Homo sapiens
gugcaguuucuaagcauguag

SEQ ID NO: 1907757 - RNA, 15 nt, Homo sapiens
gccuaaagugcugca

SEQ ID NO: 1907758 - RNA, 17 nt, Homo sapiens
auacuugaguaacauuu

SEQ ID NO: 1907759 - RNA, 17 nt, Homo sapiens
ucuggggcaacugagag

SEQ ID NO: 1907760 - RNA, 11 nt, Homo sapiens
aguacagugag

SEQ ID NO: 1907761 - RNA, 23 nt, Homo sapiens
cccuuuugggccuagaauucuga

SEQ ID NO: 1907762 - RNA, 15 nt, Homo sapiens
acacuggguucugcu

SEQ ID NO: 1907763 - RNA, 18 nt, Homo sapiens
uuucccuguuucuuccac

SEQ ID NO: 1907764 - RNA, 16 nt, Homo sapiens
uucugaaguguuucac

SEQ ID NO: 1907765 - RNA, 20 nt, Homo sapiens
aaggagggcagaucacuuca

SEQ ID NO: 1907766 - RNA, 19 nt, Homo sapiens
cauguuucccuacaccucu

SEQ ID NO: 1907767 - RNA, 20 nt, Homo sapiens
gcagcucauccaagcuugua

SEQ ID NO: 1907768 - RNA, 15 nt, Homo sapiens
uccccuacagaauuu

SEQ ID NO: 1907769 - RNA, 15 nt, Homo sapiens
guaaggcacacccaa

SEQ ID NO: 1907770 - RNA, 14 nt, Homo sapiens
ggaccaacccuguu

SEQ ID NO: 1907771 - RNA, 19 nt, Homo sapiens
agagaaucaagauaccuuu

SEQ ID NO: 1907772 - RNA, 19 nt, Homo sapiens
caauuuacgaaaccaaaaa

SEQ ID NO: 1907773 - RNA, 12 nt, Homo sapiens
acaucuccaugg

SEQ ID NO: 1907774 - RNA, 15 nt, Homo sapiens
aacaguuuccaguca

SEQ ID NO: 1907775 - RNA, 12 nt, Homo sapiens
aaaugaccaaga

SEQ ID NO: 1907776 - RNA, 13 nt, Homo sapiens
uauaucaguuuga

SEQ ID NO: 1907777 - RNA, 13 nt, Homo sapiens
uuugucaguauaa

SEQ ID NO: 1907778 - RNA, 15 nt, Homo sapiens
accaacccucagggc

SEQ ID NO: 1907779 - RNA, 19 nt, Homo sapiens
ugaaaccauuccaguagga

SEQ ID NO: 1907780 - RNA, 23 nt, Homo sapiens
ugcuaagcuaaagaaacugcuua

SEQ ID NO: 1907781 - RNA, 17 nt, Homo sapiens
caaugcuuuguccauga

SEQ ID NO: 1907782 - RNA, 16 nt, Homo sapiens
acaccuguccuucuca

SEQ ID NO: 1907783 - RNA, 21 nt, Homo sapiens
ugagccaaagcuuaugugaca

SEQ ID NO: 1907784 - RNA, 12 nt, Homo sapiens
caauugcagugg

SEQ ID NO: 1907785 - RNA, 13 nt, Homo sapiens
gcaucaguucacu

SEQ ID NO: 1907786 - RNA, 12 nt, Homo sapiens
uaaugcauuugu

SEQ ID NO: 1907787 - RNA, 12 nt, Homo sapiens
gaaugcaugugu

SEQ ID NO: 1907788 - RNA, 16 nt, Homo sapiens
uuccagcguacuauaa

SEQ ID NO: 1907789 - RNA, 14 nt, Homo sapiens
uguucauuccgaaa

SEQ ID NO: 1907790 - RNA, 17 nt, Homo sapiens
aaugcuucuucucaggc

SEQ ID NO: 1907791 - RNA, 19 nt, Homo sapiens
uacccgagaagcacuugag

SEQ ID NO: 1907792 - RNA, 18 nt, Homo sapiens
ugaaggcuuugugauagu

SEQ ID NO: 1907793 - RNA, 14 nt, Homo sapiens
ccucuugcaauuca

SEQ ID NO: 1907794 - RNA, 16 nt, Homo sapiens
ccccuccccugcugca

SEQ ID NO: 1907795 - RNA, 22 nt, Homo sapiens
cugucagaaucaugcuguucuc

SEQ ID NO: 1907796 - RNA, 13 nt, Homo sapiens
aaugcccagugag

SEQ ID NO: 1907797 - RNA, 23 nt, Homo sapiens
auucagaucaaaaugccuuucag

SEQ ID NO: 1907798 - RNA, 17 nt, Homo sapiens
uuagggaaaacauucca

SEQ ID NO: 1907799 - RNA, 12 nt, Homo sapiens
ggaagguacaaa

SEQ ID NO: 1907800 - RNA, 20 nt, Homo sapiens
auuuccuuccacuguagcua

SEQ ID NO: 1907801 - RNA, 22 nt, Homo sapiens
uauugucuuccuguaagaccuu

SEQ ID NO: 1907802 - RNA, 21 nt, Homo sapiens
aagcacacuaaaccaaguuau

SEQ ID NO: 1907803 - RNA, 19 nt, Homo sapiens
ccaacgcaccccugcacua

SEQ ID NO: 1907804 - RNA, 21 nt, Homo sapiens
guauaaccuucaugaugaauu

SEQ ID NO: 1907805 - RNA, 22 nt, Homo sapiens
ucuagaaugucugaaguacaaa

SEQ ID NO: 1907806 - RNA, 18 nt, Homo sapiens
acaguuagguagcuuuag

SEQ ID NO: 1907807 - RNA, 22 nt, Homo sapiens
gcuggggccugggacaacugcu

SEQ ID NO: 1907808 - RNA, 13 nt, Homo sapiens
cuguguccuccac

SEQ ID NO: 1907809 - RNA, 19 nt, Homo sapiens
caagacuccaucucaaaaa

SEQ ID NO: 1907810 - RNA, 22 nt, Homo sapiens
aguggaaagacagcuucucauc

SEQ ID NO: 1907811 - RNA, 18 nt, Homo sapiens
ugugcagcucccauuugg

SEQ ID NO: 1907812 - RNA, 13 nt, Homo sapiens
ugacuuauggcau

SEQ ID NO: 1907813 - RNA, 21 nt, Homo sapiens
agcaagggcuugauggugaca

SEQ ID NO: 1907814 - RNA, 14 nt, Homo sapiens
cugucuucucaggc

SEQ ID NO: 1907815 - RNA, 13 nt, Homo sapiens
ucagaauagccac

SEQ ID NO: 1907816 - RNA, 18 nt, Homo sapiens
ucaccuaaguacuuaaaa

SEQ ID NO: 1907817 - RNA, 20 nt, Homo sapiens
guugacuuuauuucugagca

SEQ ID NO: 1907818 - RNA, 20 nt, Homo sapiens
aucacaugugcccucugcca

SEQ ID NO: 1907819 - RNA, 19 nt, Homo sapiens
acacccaguguccuuccau

SEQ ID NO: 1907820 - RNA, 20 nt, Homo sapiens
uaguccccagccugcucccu

SEQ ID NO: 1907821 - RNA, 20 nt, Homo sapiens
gagcugucuaaaaguuacau

SEQ ID NO: 1907822 - RNA, 13 nt, Homo sapiens
ccgggaaggggaa

SEQ ID NO: 1907823 - RNA, 13 nt, Homo sapiens
ggaagaagccaga

SEQ ID NO: 1907824 - RNA, 20 nt, Homo sapiens
aauccaggcgugguggcaca

SEQ ID NO: 1907825 - RNA, 15 nt, Homo sapiens
cagcgugcuuagccu

SEQ ID NO: 1907826 - RNA, 18 nt, Homo sapiens
acauuucaccccacucug

SEQ ID NO: 1907827 - RNA, 22 nt, Homo sapiens
uuggaagccagguacaggagag

SEQ ID NO: 1907828 - RNA, 15 nt, Homo sapiens
gucaacacaaagaca

SEQ ID NO: 1907829 - RNA, 22 nt, Homo sapiens
uaauauaaaaagcuuccaugau

SEQ ID NO: 1907830 - RNA, 19 nt, Homo sapiens
gucccauggacacuccagu

SEQ ID NO: 1907831 - RNA, 19 nt, Homo sapiens
gauuucagcacaugcacua

SEQ ID NO: 1907832 - RNA, 15 nt, Homo sapiens
auuuucagagccaaa

SEQ ID NO: 1907833 - RNA, 12 nt, Homo sapiens
cgaagggaaaua

SEQ ID NO: 1907834 - RNA, 15 nt, Homo sapiens
aaauauaaacuguga

SEQ ID NO: 1907835 - RNA, 17 nt, Homo sapiens
guagaguucacuguugu

SEQ ID NO: 1907836 - RNA, 17 nt, Homo sapiens
cccggcgccgggcacca

SEQ ID NO: 1907837 - RNA, 20 nt, Homo sapiens
ugguagcaucauguauauau

SEQ ID NO: 1907838 - RNA, 17 nt, Homo sapiens
ugugaugggcuguuuaa

SEQ ID NO: 1907839 - RNA, 13 nt, Homo sapiens
cacauaguuugau

SEQ ID NO: 1907840 - RNA, 23 nt, Homo sapiens
gaacaauuguggucucucuuaac

SEQ ID NO: 1907841 - RNA, 13 nt, Homo sapiens
ccguucuugacau

SEQ ID NO: 1907842 - RNA, 18 nt, Homo sapiens
uacccccuccucucugcc

SEQ ID NO: 1907843 - RNA, 21 nt, Homo sapiens
gccuggagucggaucuagcca

SEQ ID NO: 1907844 - RNA, 18 nt, Homo sapiens
uccauagaguaacaguaa

SEQ ID NO: 1907845 - RNA, 23 nt, Homo sapiens
cuccaccccauuuuacagaggag

SEQ ID NO: 1907846 - RNA, 20 nt, Homo sapiens
uaaccguuuccuuucauuua

SEQ ID NO: 1907847 - RNA, 22 nt, Homo sapiens
ucucaaaaauccuuaugcauga

SEQ ID NO: 1907848 - RNA, 22 nt, Homo sapiens
cagccugugguuacagugcaga

SEQ ID NO: 1907849 - RNA, 16 nt, Homo sapiens
uaacaggauacaggug

SEQ ID NO: 1907850 - RNA, 17 nt, Homo sapiens
agaggaauccagugaau

SEQ ID NO: 1907851 - RNA, 22 nt, Homo sapiens
guauauagagauuguacauuua

SEQ ID NO: 1907852 - RNA, 18 nt, Homo sapiens
aaaagcacacucaucccc

SEQ ID NO: 1907853 - RNA, 11 nt, Homo sapiens
ggccugaccuc

SEQ ID NO: 1907854 - RNA, 22 nt, Homo sapiens
gcacaugguucaccaugcagug

SEQ ID NO: 1907855 - RNA, 18 nt, Homo sapiens
ucaauaaauaugguuuga

SEQ ID NO: 1907856 - RNA, 19 nt, Homo sapiens
uucuucacauguuuaacuu

SEQ ID NO: 1907857 - RNA, 13 nt, Homo sapiens
aacuuacuauuca

SEQ ID NO: 1907858 - RNA, 14 nt, Homo sapiens
cucugguccauaga

SEQ ID NO: 1907859 - RNA, 12 nt, Homo sapiens
guccccuacccc

SEQ ID NO: 1907860 - RNA, 20 nt, Homo sapiens
acucacauccugaccuugca

SEQ ID NO: 1907861 - RNA, 21 nt, Homo sapiens
guuguaccaaaauucaucugu

SEQ ID NO: 1907862 - RNA, 12 nt, Homo sapiens
cugaaagugaaa

SEQ ID NO: 1907863 - RNA, 19 nt, Homo sapiens
aucucacucuguugcccag

SEQ ID NO: 1907864 - RNA, 14 nt, Homo sapiens
agcuauaacuaagc

SEQ ID NO: 1907865 - RNA, 18 nt, Homo sapiens
gcuauguaaacaaaccac

SEQ ID NO: 1907866 - RNA, 23 nt, Homo sapiens
ccauugucucaauucaaauccau

SEQ ID NO: 1907867 - RNA, 12 nt, Homo sapiens
gcguuuuuuaca

SEQ ID NO: 1907868 - RNA, 20 nt, Homo sapiens
ccucaagccccauuuccuca

SEQ ID NO: 1907869 - RNA, 20 nt, Homo sapiens
acacacuaccgaaugugucu

SEQ ID NO: 1907870 - RNA, 23 nt, Homo sapiens
ucaguagugcuaucucaugacaa

SEQ ID NO: 1907871 - RNA, 18 nt, Homo sapiens
uucaaacuuccagugcaa

SEQ ID NO: 1907872 - RNA, 17 nt, Homo sapiens
uaauauuuuagauuaca

SEQ ID NO: 1907873 - RNA, 15 nt, Homo sapiens
gcauccugugcuucu

SEQ ID NO: 1907874 - RNA, 20 nt, Homo sapiens
agcaccaaaucaaaaucucu

SEQ ID NO: 1907875 - RNA, 23 nt, Homo sapiens
uuccucucugaguggacuggccu

SEQ ID NO: 1907876 - RNA, 23 nt, Homo sapiens
gaaccaagcggugccagccacga

SEQ ID NO: 1907877 - RNA, 13 nt, Homo sapiens
cauagcagauuug

SEQ ID NO: 1907878 - RNA, 16 nt, Homo sapiens
aauacaucauauguua

SEQ ID NO: 1907879 - RNA, 20 nt, Homo sapiens
ccugugcucauuuugcaauu

SEQ ID NO: 1907880 - RNA, 23 nt, Homo sapiens
uugaccacucuuccugaguucag

SEQ ID NO: 1907881 - RNA, 19 nt, Homo sapiens
uggauuccucgaaacugcc

SEQ ID NO: 1907882 - RNA, 22 nt, Homo sapiens
agccgccguggcuauaccuggg

SEQ ID NO: 1907883 - RNA, 20 nt, Homo sapiens
uaugugagcacuaucuuuca

SEQ ID NO: 1907884 - RNA, 16 nt, Homo sapiens
uaaaaacaagauggag

SEQ ID NO: 1907885 - RNA, 13 nt, Homo sapiens
cuuccucacacca

SEQ ID NO: 1907886 - RNA, 19 nt, Homo sapiens
aauucugaccuuacaaaag

SEQ ID NO: 1907887 - RNA, 19 nt, Homo sapiens
aaauuucccccaccugcag

SEQ ID NO: 1907888 - RNA, 24 nt, Homo sapiens
ugaugauucuacuugcuguagaug

SEQ ID NO: 1907889 - RNA, 16 nt, Homo sapiens
auucugaaucucaaga

SEQ ID NO: 1907890 - RNA, 21 nt, Homo sapiens
uguuguaaccugcugugauac

SEQ ID NO: 1907891 - RNA, 21 nt, Homo sapiens
ggcagagucguuggagacuga

SEQ ID NO: 1907892 - RNA, 18 nt, Homo sapiens
uacacacucagugacauu

SEQ ID NO: 1907893 - RNA, 23 nt, Homo sapiens
caaauggagaaguucaggaaggu

SEQ ID NO: 1907894 - RNA, 12 nt, Homo sapiens
gcuaugucucau

SEQ ID NO: 1907895 - RNA, 19 nt, Homo sapiens
uaauuaggaugcauguuga

SEQ ID NO: 1907896 - RNA, 22 nt, Homo sapiens
ggaggaaugugugccuuguuca

SEQ ID NO: 1907897 - RNA, 23 nt, Homo sapiens
uucccuaggaaacucacacuccc

SEQ ID NO: 1907898 - RNA, 20 nt, Homo sapiens
caaaugcccaaggaugccuu

SEQ ID NO: 1907899 - RNA, 15 nt, Homo sapiens
acucguuaaagcaaa

SEQ ID NO: 1907900 - RNA, 23 nt, Homo sapiens
aggggcuguugaauuucccacau

SEQ ID NO: 1907901 - RNA, 15 nt, Homo sapiens
augaaaauacaucuu

SEQ ID NO: 1907902 - RNA, 15 nt, Homo sapiens
gagggacacaugccc

SEQ ID NO: 1907903 - RNA, 15 nt, Homo sapiens
gaauuuugagucuau

SEQ ID NO: 1907904 - RNA, 19 nt, Homo sapiens
caaagacaugcuuuccauu

SEQ ID NO: 1907905 - RNA, 21 nt, Homo sapiens
ugagcugagacagauaagaga

SEQ ID NO: 1907906 - RNA, 21 nt, Homo sapiens
agccaggguguggcccugcca

SEQ ID NO: 1907907 - RNA, 12 nt, Homo sapiens
gucuguucucac

SEQ ID NO: 1907908 - RNA, 19 nt, Homo sapiens
ugggcccucccugccacac

SEQ ID NO: 1907909 - RNA, 21 nt, Homo sapiens
agagcauugcuauuuaucuca

SEQ ID NO: 1907910 - RNA, 19 nt, Homo sapiens
agaccaaaauaugaaagac

SEQ ID NO: 1907911 - RNA, 15 nt, Homo sapiens
uugcucuggugucaa

SEQ ID NO: 1907912 - RNA, 22 nt, Homo sapiens
ucuguuaaccaaauaaaacaua

SEQ ID NO: 1907913 - RNA, 17 nt, Homo sapiens
gcagauccugucccaug

SEQ ID NO: 1907914 - RNA, 19 nt, Homo sapiens
agugacccacaugccauuu

SEQ ID NO: 1907915 - RNA, 16 nt, Homo sapiens
ugacaugggugugcca

SEQ ID NO: 1907916 - RNA, 19 nt, Homo sapiens
gucaggaaaacuguuccaa

SEQ ID NO: 1907917 - RNA, 20 nt, Homo sapiens
agcuaugucucuagcaguga

SEQ ID NO: 1907918 - RNA, 18 nt, Homo sapiens
ggagcugucccaccugca

SEQ ID NO: 1907919 - RNA, 18 nt, Homo sapiens
caaggcugggcagugucc

SEQ ID NO: 1907920 - RNA, 17 nt, Homo sapiens
auguaauaaugugaauc

SEQ ID NO: 1907921 - RNA, 17 nt, Homo sapiens
caugaguuuaugggaau

SEQ ID NO: 1907922 - RNA, 19 nt, Homo sapiens
aagaaagccagacaacuuc

SEQ ID NO: 1907923 - RNA, 17 nt, Homo sapiens
acauuaaaauagcacau

SEQ ID NO: 1907924 - RNA, 20 nt, Homo sapiens
cuuucaagucugacucucca

SEQ ID NO: 1907925 - RNA, 16 nt, Homo sapiens
uccugagagcccagaa

SEQ ID NO: 1907926 - RNA, 16 nt, Homo sapiens
aaagaaaaucaaugaa

SEQ ID NO: 1907927 - RNA, 22 nt, Homo sapiens
agcuagucuaucagcaucugac

SEQ ID NO: 1907928 - RNA, 15 nt, Homo sapiens
auuuaaaagucugcc

SEQ ID NO: 1907929 - RNA, 21 nt, Homo sapiens
ucauccuauuacuuaugauuu

SEQ ID NO: 1907930 - RNA, 14 nt, Homo sapiens
ucccuaaugcucac

SEQ ID NO: 1907931 - RNA, 14 nt, Homo sapiens
uccgaaaugcuguc

SEQ ID NO: 1907932 - RNA, 13 nt, Homo sapiens
cuaggaaaucaca

SEQ ID NO: 1907933 - RNA, 18 nt, Homo sapiens
cugacacuaaaacaccuc

SEQ ID NO: 1907934 - RNA, 14 nt, Homo sapiens
ccguaacaccugau

SEQ ID NO: 1907935 - RNA, 18 nt, Homo sapiens
uaugccccugcacugaag

SEQ ID NO: 1907936 - RNA, 15 nt, Homo sapiens
gcaugucgcacaaug

SEQ ID NO: 1907937 - RNA, 20 nt, Homo sapiens
ucagaacccaggacagccac

SEQ ID NO: 1907938 - RNA, 14 nt, Homo sapiens
cccauagcacuggg

SEQ ID NO: 1907939 - RNA, 14 nt, Homo sapiens
uacacagcugagca

SEQ ID NO: 1907940 - RNA, 13 nt, Homo sapiens
cugauauuggugu

SEQ ID NO: 1907941 - RNA, 13 nt, Homo sapiens
aucaguggcugcc

SEQ ID NO: 1907942 - RNA, 16 nt, Homo sapiens
auuuuuuaaauuuaca

SEQ ID NO: 1907943 - RNA, 11 nt, Homo sapiens
cuaaaauccau

SEQ ID NO: 1907944 - RNA, 14 nt, Homo sapiens
ggguuuagccagcc

SEQ ID NO: 1907945 - RNA, 14 nt, Homo sapiens
ucauaucagcuuua

SEQ ID NO: 1907946 - RNA, 10 nt, Homo sapiens
cccacaccca

SEQ ID NO: 1907947 - RNA, 18 nt, Homo sapiens
cuguucugcgcuguguac

SEQ ID NO: 1907948 - RNA, 15 nt, Homo sapiens
aaagcaaaauccaac

SEQ ID NO: 1907949 - RNA, 14 nt, Homo sapiens
uucuaguagcacaa

SEQ ID NO: 1907950 - RNA, 21 nt, Homo sapiens
augcagugcucgcuguugcug

SEQ ID NO: 1907951 - RNA, 15 nt, Homo sapiens
ggcuggagacuggac

SEQ ID NO: 1907952 - RNA, 14 nt, Homo sapiens
agaguuuaaacaaa

SEQ ID NO: 1907953 - RNA, 15 nt, Homo sapiens
agcugcccccagugg

SEQ ID NO: 1907954 - RNA, 15 nt, Homo sapiens
auuacagagaucuca

SEQ ID NO: 1907955 - RNA, 20 nt, Homo sapiens
cacaugacgcaccaguuaca

SEQ ID NO: 1907956 - RNA, 19 nt, Homo sapiens
uuagaagcugagacacaaa

SEQ ID NO: 1907957 - RNA, 20 nt, Homo sapiens
guuuauacacaacuuugcaa

SEQ ID NO: 1907958 - RNA, 18 nt, Homo sapiens
gcacugcccgaaaagcau

SEQ ID NO: 1907959 - RNA, 22 nt, Homo sapiens
ucccagguucaagcgauucuca

SEQ ID NO: 1907960 - RNA, 18 nt, Homo sapiens
aacugccacaagcacaau

SEQ ID NO: 1907961 - RNA, 14 nt, Homo sapiens
uggacagcacucug

SEQ ID NO: 1907962 - RNA, 18 nt, Homo sapiens
ucuuuggacagaagcagc

SEQ ID NO: 1907963 - RNA, 21 nt, Homo sapiens
auaccaacuguacaaaauaac

SEQ ID NO: 1907964 - RNA, 21 nt, Homo sapiens
gcaguuugguccuggggacca

SEQ ID NO: 1907965 - RNA, 22 nt, Homo sapiens
agcuuuugugggggacuguaag

SEQ ID NO: 1907966 - RNA, 22 nt, Homo sapiens
gccaguccaucucaagugccau

SEQ ID NO: 1907967 - RNA, 19 nt, Homo sapiens
uacgugauuuggcugcacu

SEQ ID NO: 1907968 - RNA, 22 nt, Homo sapiens
gccuuuuuuuuaaggagcaaaa

SEQ ID NO: 1907969 - RNA, 18 nt, Homo sapiens
auaaguguguacaagcau

SEQ ID NO: 1907970 - RNA, 23 nt, Homo sapiens
uguccucaguguaccacuacuua

SEQ ID NO: 1907971 - RNA, 21 nt, Homo sapiens
aauauuuauaggucacuuugu

SEQ ID NO: 1907972 - RNA, 20 nt, Homo sapiens
cuccaacuuucccuccacca

SEQ ID NO: 1907973 - RNA, 18 nt, Homo sapiens
caacuagacauucugucg

SEQ ID NO: 1907974 - RNA, 16 nt, Homo sapiens
ugcaaguaaacaccug

SEQ ID NO: 1907975 - RNA, 16 nt, Homo sapiens
uagcuaauggaaaaug

SEQ ID NO: 1907976 - RNA, 17 nt, Homo sapiens
agugcuuguuccucuca

SEQ ID NO: 1907977 - RNA, 23 nt, Homo sapiens
aaagauccagccucauaccuaca

SEQ ID NO: 1907978 - RNA, 19 nt, Homo sapiens
ggcagcccaacagcacuuu

SEQ ID NO: 1907979 - RNA, 15 nt, Homo sapiens
ugaaguuuccuuggc

SEQ ID NO: 1907980 - RNA, 22 nt, Homo sapiens
aagucauccccuugggcucuca

SEQ ID NO: 1907981 - RNA, 15 nt, Homo sapiens
auuaguuucaggcaa

SEQ ID NO: 1907982 - RNA, 10 nt, Homo sapiens
ugaaccugug

SEQ ID NO: 1907983 - RNA, 17 nt, Homo sapiens
uuuaagauuuuucucaa

SEQ ID NO: 1907984 - RNA, 16 nt, Homo sapiens
uauaacuaggcaaaaa

SEQ ID NO: 1907985 - RNA, 20 nt, Homo sapiens
agcacacauaaaagcacaaa

SEQ ID NO: 1907986 - RNA, 18 nt, Homo sapiens
gccuuacuucaaagugcc

SEQ ID NO: 1907987 - RNA, 20 nt, Homo sapiens
uagagugggacaguuccuga

SEQ ID NO: 1907988 - RNA, 15 nt, Homo sapiens
aaguugcugugaaua

SEQ ID NO: 1907989 - RNA, 20 nt, Homo sapiens
gcauugucacagcuaccaaa

SEQ ID NO: 1907990 - RNA, 16 nt, Homo sapiens
acaaaacaaucucuca

SEQ ID NO: 1907991 - RNA, 21 nt, Homo sapiens
cuuaaacauaauaaaucacac

SEQ ID NO: 1907992 - RNA, 14 nt, Homo sapiens
ugagugucaucuca

SEQ ID NO: 1907993 - RNA, 21 nt, Homo sapiens
ugcuccauuuuucaucaucua

SEQ ID NO: 1907994 - RNA, 19 nt, Homo sapiens
cuacuuccucugcaaaaag

SEQ ID NO: 1907995 - RNA, 19 nt, Homo sapiens
aguacaugaagagcagcug

SEQ ID NO: 1907996 - RNA, 15 nt, Homo sapiens
ucaggugauucgccc

SEQ ID NO: 1907997 - RNA, 20 nt, Homo sapiens
augauuguuugacacaccau

SEQ ID NO: 1907998 - RNA, 23 nt, Homo sapiens
accccagauggccgggacaugca

SEQ ID NO: 1907999 - RNA, 20 nt, Homo sapiens
cagccuccugaguagcugag

SEQ ID NO: 1908000 - RNA, 12 nt, Homo sapiens
cugccacuuugc

SEQ ID NO: 1908001 - RNA, 20 nt, Homo sapiens
gccuucagaggccaucugau

SEQ ID NO: 1908002 - RNA, 14 nt, Homo sapiens
auguucugggacac

SEQ ID NO: 1908003 - RNA, 18 nt, Homo sapiens
acuggguguaaacacauc

SEQ ID NO: 1908004 - RNA, 15 nt, Homo sapiens
ucgcgcgacugagaa

SEQ ID NO: 1908005 - RNA, 18 nt, Homo sapiens
guaacuuuuuacauuaca

SEQ ID NO: 1908006 - RNA, 19 nt, Homo sapiens
uuuguuuguucacauauga

SEQ ID NO: 1908007 - RNA, 13 nt, Homo sapiens
auagucacccggg

SEQ ID NO: 1908008 - RNA, 21 nt, Homo sapiens
aggggcaaagaaaagccagag

SEQ ID NO: 1908009 - RNA, 14 nt, Homo sapiens
uuguuccgugccag

SEQ ID NO: 1908010 - RNA, 14 nt, Homo sapiens
ccaaaugaagggac

SEQ ID NO: 1908011 - RNA, 15 nt, Homo sapiens
gaugugacaggaauu

SEQ ID NO: 1908012 - RNA, 15 nt, Homo sapiens
ccaugaaucaaagac

SEQ ID NO: 1908013 - RNA, 12 nt, Homo sapiens
ugccgugagcag

SEQ ID NO: 1908014 - RNA, 22 nt, Homo sapiens
ugauauucaaucuuaacaaaag

SEQ ID NO: 1908015 - RNA, 22 nt, Homo sapiens
cucaaucacacugaagccacag

SEQ ID NO: 1908016 - RNA, 15 nt, Homo sapiens
aggcuaaggcaggaa

SEQ ID NO: 1908017 - RNA, 19 nt, Homo sapiens
aaacuguuugacuucucaa

SEQ ID NO: 1908018 - RNA, 21 nt, Homo sapiens
agacuuguguccccaccucag

SEQ ID NO: 1908019 - RNA, 14 nt, Homo sapiens
uuugcauauugcau

SEQ ID NO: 1908020 - RNA, 22 nt, Homo sapiens
gcauggaggguuuuaaauggag

SEQ ID NO: 1908021 - RNA, 15 nt, Homo sapiens
cuaaaucaaucugca

SEQ ID NO: 1908022 - RNA, 15 nt, Homo sapiens
gaaagauaggacuaa

SEQ ID NO: 1908023 - RNA, 11 nt, Homo sapiens
agagagccugc

SEQ ID NO: 1908024 - RNA, 13 nt, Homo sapiens
cugcuucucagcg

SEQ ID NO: 1908025 - RNA, 17 nt, Homo sapiens
guggaucuaaauggaag

SEQ ID NO: 1908026 - RNA, 20 nt, Homo sapiens
uuggacuauguaaaccacau

SEQ ID NO: 1908027 - RNA, 15 nt, Homo sapiens
ggcuucaaguggcag

SEQ ID NO: 1908028 - RNA, 16 nt, Homo sapiens
gagacggccaagugaa

SEQ ID NO: 1908029 - RNA, 15 nt, Homo sapiens
ugcaaaaggagagac

SEQ ID NO: 1908030 - RNA, 15 nt, Homo sapiens
uaaagcuucucucug

SEQ ID NO: 1908031 - RNA, 17 nt, Homo sapiens
uuccccacacaugccua

SEQ ID NO: 1908032 - RNA, 22 nt, Homo sapiens
auagcuugucuucguccaucug

SEQ ID NO: 1908033 - RNA, 17 nt, Homo sapiens
gcggcuggaaucaguca

SEQ ID NO: 1908034 - RNA, 20 nt, Homo sapiens
ugaaaauaaacauguauaaa

SEQ ID NO: 1908035 - RNA, 16 nt, Homo sapiens
ucaggaugcagcacug

SEQ ID NO: 1908036 - RNA, 13 nt, Homo sapiens
cagcucugaugag

SEQ ID NO: 1908037 - RNA, 22 nt, Homo sapiens
cuuagggggagcccuggugcua

SEQ ID NO: 1908038 - RNA, 20 nt, Homo sapiens
agaaucagucuauccacaga

SEQ ID NO: 1908039 - RNA, 14 nt, Homo sapiens
caggugugugugaa

SEQ ID NO: 1908040 - RNA, 16 nt, Homo sapiens
cuaggcagugacagug

SEQ ID NO: 1908041 - RNA, 18 nt, Homo sapiens
cagccagaguuggauaag

SEQ ID NO: 1908042 - RNA, 22 nt, Homo sapiens
ugaaugucucgauuagacucca

SEQ ID NO: 1908043 - RNA, 13 nt, Homo sapiens
cacaaaugcauga

SEQ ID NO: 1908044 - RNA, 13 nt, Homo sapiens
uguguaugugcau

SEQ ID NO: 1908045 - RNA, 21 nt, Homo sapiens
uggcauucuuugcaauacugc

SEQ ID NO: 1908046 - RNA, 13 nt, Homo sapiens
aggauuccaccuu

SEQ ID NO: 1908047 - RNA, 23 nt, Homo sapiens
uccaggucaggaugcacauuucu

SEQ ID NO: 1908048 - RNA, 20 nt, Homo sapiens
acccucccucccugaucccg

SEQ ID NO: 1908049 - RNA, 14 nt, Homo sapiens
aacuccuccuugcc

SEQ ID NO: 1908050 - RNA, 13 nt, Homo sapiens
aaaugugauucua

SEQ ID NO: 1908051 - RNA, 13 nt, Homo sapiens
cucacacagaauu

SEQ ID NO: 1908052 - RNA, 15 nt, Homo sapiens
auccacuucucucag

SEQ ID NO: 1908053 - RNA, 12 nt, Homo sapiens
cggagcacugca

SEQ ID NO: 1908054 - RNA, 17 nt, Homo sapiens
caggacuuggucugauu

SEQ ID NO: 1908055 - RNA, 16 nt, Homo sapiens
ucaguagaccuaauga

SEQ ID NO: 1908056 - RNA, 21 nt, Homo sapiens
gcugggauguuucugucacau

SEQ ID NO: 1908057 - RNA, 21 nt, Homo sapiens
uacaguucuaugcagaacagu

SEQ ID NO: 1908058 - RNA, 21 nt, Homo sapiens
acugcuuguaaaggugcuccu

SEQ ID NO: 1908059 - RNA, 22 nt, Homo sapiens
accucacagaguaugaucucag

SEQ ID NO: 1908060 - RNA, 19 nt, Homo sapiens
uaagcagaagcacauauga

SEQ ID NO: 1908061 - RNA, 22 nt, Homo sapiens
agaagagccccuccuuccuuca

SEQ ID NO: 1908062 - RNA, 13 nt, Homo sapiens
auuugugaacuca

SEQ ID NO: 1908063 - RNA, 19 nt, Homo sapiens
cugcagcugggccccaugc

SEQ ID NO: 1908064 - RNA, 19 nt, Homo sapiens
uaaccuaauaucacuuaaa

SEQ ID NO: 1908065 - RNA, 23 nt, Homo sapiens
gggcagaguggagcccagggugc

SEQ ID NO: 1908066 - RNA, 16 nt, Homo sapiens
augacgaugccuucaa

SEQ ID NO: 1908067 - RNA, 22 nt, Homo sapiens
aguccuccuauuccagugucca

SEQ ID NO: 1908068 - RNA, 12 nt, Homo sapiens
caguuucuugca

SEQ ID NO: 1908069 - RNA, 15 nt, Homo sapiens
ugacccauaggcuca

SEQ ID NO: 1908070 - RNA, 23 nt, Homo sapiens
gaacucuucuuugcugcauuccu

SEQ ID NO: 1908071 - RNA, 21 nt, Homo sapiens
aacagaauuaaaaugucuagc

SEQ ID NO: 1908072 - RNA, 19 nt, Homo sapiens
auuuuuccucucugcaaau

SEQ ID NO: 1908073 - RNA, 23 nt, Homo sapiens
guaguugcuuugcggcaucucca

SEQ ID NO: 1908074 - RNA, 15 nt, Homo sapiens
cuugaaugugucacu

SEQ ID NO: 1908075 - RNA, 15 nt, Homo sapiens
agaaggaguguauga

SEQ ID NO: 1908076 - RNA, 22 nt, Homo sapiens
ccagccaucccauuggcaaaag

SEQ ID NO: 1908077 - RNA, 16 nt, Homo sapiens
auauguauuuaccaaa

SEQ ID NO: 1908078 - RNA, 19 nt, Homo sapiens
gauuuaaagggacaccccu

SEQ ID NO: 1908079 - RNA, 22 nt, Homo sapiens
gcccacuucaccguacuaacca

SEQ ID NO: 1908080 - RNA, 20 nt, Homo sapiens
ccacaguucacaugccacaa

SEQ ID NO: 1908081 - RNA, 15 nt, Homo sapiens
acagauucacacugu

SEQ ID NO: 1908082 - RNA, 15 nt, Homo sapiens
aaaguuacaaacaga

SEQ ID NO: 1908083 - RNA, 13 nt, Homo sapiens
cacaaacauaugu

SEQ ID NO: 1908084 - RNA, 21 nt, Homo sapiens
agacccaggaguccagccccu

SEQ ID NO: 1908085 - RNA, 22 nt, Homo sapiens
uuugcccugucuaauuuugccc

SEQ ID NO: 1908086 - RNA, 15 nt, Homo sapiens
gccaucuuucuuugg

SEQ ID NO: 1908087 - RNA, 12 nt, Homo sapiens
gacuauuuccac

SEQ ID NO: 1908088 - RNA, 19 nt, Homo sapiens
aggagccuugcugggccag

SEQ ID NO: 1908089 - RNA, 18 nt, Homo sapiens
gaaacuucccaacuuccc

SEQ ID NO: 1908090 - RNA, 18 nt, Homo sapiens
cagaauaucagaauauga

SEQ ID NO: 1908091 - RNA, 15 nt, Homo sapiens
ugcgugugugcaagu

SEQ ID NO: 1908092 - RNA, 12 nt, Homo sapiens
augaauuuccac

SEQ ID NO: 1908093 - RNA, 14 nt, Homo sapiens
ccuggaagugcuaa

SEQ ID NO: 1908094 - RNA, 18 nt, Homo sapiens
aagcaaaacaauaaacua

SEQ ID NO: 1908095 - RNA, 20 nt, Homo sapiens
auuuaugauuucaacaugga

SEQ ID NO: 1908096 - RNA, 13 nt, Homo sapiens
cagugccuaacuc

SEQ ID NO: 1908097 - RNA, 13 nt, Homo sapiens
gacaccaccaucu

SEQ ID NO: 1908098 - RNA, 18 nt, Homo sapiens
gaacagcugugagccaug

SEQ ID NO: 1908099 - RNA, 21 nt, Homo sapiens
aaacagguuauaacaguguuu

SEQ ID NO: 1908100 - RNA, 15 nt, Homo sapiens
auauccacaguacuc

SEQ ID NO: 1908101 - RNA, 15 nt, Homo sapiens
gcagggcagacugca

SEQ ID NO: 1908102 - RNA, 21 nt, Homo sapiens
guuccauacccccacaugcca

SEQ ID NO: 1908103 - RNA, 18 nt, Homo sapiens
caaagugagacaguccag

SEQ ID NO: 1908104 - RNA, 15 nt, Homo sapiens
guccuugucgcugug

SEQ ID NO: 1908105 - RNA, 20 nt, Homo sapiens
gagcuuuuuaauagcacuaa

SEQ ID NO: 1908106 - RNA, 22 nt, Homo sapiens
caggguccacgccucugcugua

SEQ ID NO: 1908107 - RNA, 18 nt, Homo sapiens
gagaugagggaugggccu

SEQ ID NO: 1908108 - RNA, 23 nt, Homo sapiens
ucacaaagaguucuggaaaagaa

SEQ ID NO: 1908109 - RNA, 17 nt, Homo sapiens
agacaugauuuccuuga

SEQ ID NO: 1908110 - RNA, 22 nt, Homo sapiens
uguucucaaucauugucagaga

SEQ ID NO: 1908111 - RNA, 13 nt, Homo sapiens
aauguaugugcuc

SEQ ID NO: 1908112 - RNA, 15 nt, Homo sapiens
aguguaauuagcuuu

SEQ ID NO: 1908113 - RNA, 20 nt, Homo sapiens
cuuuccucuuaaugucucaa

SEQ ID NO: 1908114 - RNA, 23 nt, Homo sapiens
cuggugcaauuacagcaaaaagg

SEQ ID NO: 1908115 - RNA, 18 nt, Homo sapiens
cuuuccagcaguauccuc

SEQ ID NO: 1908116 - RNA, 15 nt, Homo sapiens
auacccauauguccu

SEQ ID NO: 1908117 - RNA, 18 nt, Homo sapiens
uugauggagcuacuuuaa

SEQ ID NO: 1908118 - RNA, 13 nt, Homo sapiens
cacacacacagau

SEQ ID NO: 1908119 - RNA, 17 nt, Homo sapiens
uuuguaagaaaaccaaa

SEQ ID NO: 1908120 - RNA, 18 nt, Homo sapiens
aaaaccuuccuucccugg

SEQ ID NO: 1908121 - RNA, 21 nt, Homo sapiens
ucuaagacucaaauguucuaa

SEQ ID NO: 1908122 - RNA, 21 nt, Homo sapiens
cacccuccgguuauguugcuc

SEQ ID NO: 1908123 - RNA, 20 nt, Homo sapiens
cgcaguuuggagucacugua

SEQ ID NO: 1908124 - RNA, 19 nt, Homo sapiens
caugcauugagcucucuca

SEQ ID NO: 1908125 - RNA, 18 nt, Homo sapiens
gccuccccgugccaaaaa

SEQ ID NO: 1908126 - RNA, 23 nt, Homo sapiens
ccagucucauuuucaucuucuuc

SEQ ID NO: 1908127 - RNA, 20 nt, Homo sapiens
ucugcuuucacucuuuagaa

SEQ ID NO: 1908128 - RNA, 17 nt, Homo sapiens
cagaacagugagccaaa

SEQ ID NO: 1908129 - RNA, 18 nt, Homo sapiens
uuucaaaaugcaugugau

SEQ ID NO: 1908130 - RNA, 23 nt, Homo sapiens
ucuucccuuauucuaaagcugcc

SEQ ID NO: 1908131 - RNA, 20 nt, Homo sapiens
cagaccugugugugccucca

SEQ ID NO: 1908132 - RNA, 12 nt, Homo sapiens
aauuaguucucc

SEQ ID NO: 1908133 - RNA, 18 nt, Homo sapiens
ugaaacuggcacugaauu

SEQ ID NO: 1908134 - RNA, 17 nt, Homo sapiens
acugucacuuugcucug

SEQ ID NO: 1908135 - RNA, 18 nt, Homo sapiens
acuuagcgucaagacauu

SEQ ID NO: 1908136 - RNA, 19 nt, Homo sapiens
ucuucuuuuuuugugaugu

SEQ ID NO: 1908137 - RNA, 19 nt, Homo sapiens
aaaucaugccauugcacuc

SEQ ID NO: 1908138 - RNA, 15 nt, Homo sapiens
cugccgagaguccau

SEQ ID NO: 1908139 - RNA, 18 nt, Homo sapiens
uuuuaugaaacauuacag

SEQ ID NO: 1908140 - RNA, 22 nt, Homo sapiens
cugagaaaauguaaggauucug

SEQ ID NO: 1908141 - RNA, 15 nt, Homo sapiens
ggacaugaaacucca

SEQ ID NO: 1908142 - RNA, 15 nt, Homo sapiens
accucuucuuacccu

SEQ ID NO: 1908143 - RNA, 11 nt, Homo sapiens
uugcugccaau

SEQ ID NO: 1908144 - RNA, 14 nt, Homo sapiens
uccagggacagcaa

SEQ ID NO: 1908145 - RNA, 18 nt, Homo sapiens
aaucuguuucucugcugu

SEQ ID NO: 1908146 - RNA, 23 nt, Homo sapiens
gacgguaccaauucagugucugu

SEQ ID NO: 1908147 - RNA, 23 nt, Homo sapiens
caugccgcugugucuaugaacua

SEQ ID NO: 1908148 - RNA, 16 nt, Homo sapiens
uuacuggggaaagugc

SEQ ID NO: 1908149 - RNA, 13 nt, Homo sapiens
gucaggacuguga

SEQ ID NO: 1908150 - RNA, 23 nt, Homo sapiens
aaauugcagaauucaaaagugau

SEQ ID NO: 1908151 - RNA, 20 nt, Homo sapiens
caggacugugccagcacaaa

SEQ ID NO: 1908152 - RNA, 21 nt, Homo sapiens
aauggcagggauacccaguga

SEQ ID NO: 1908153 - RNA, 22 nt, Homo sapiens
gaagguguguccuugaacugag

SEQ ID NO: 1908154 - RNA, 21 nt, Homo sapiens
auguuagaauuuggagggaau

SEQ ID NO: 1908155 - RNA, 14 nt, Homo sapiens
cagauggaccaaaa

SEQ ID NO: 1908156 - RNA, 19 nt, Homo sapiens
gagcguuagaggggccagc

SEQ ID NO: 1908157 - RNA, 17 nt, Homo sapiens
cagaccccuagggauuu

SEQ ID NO: 1908158 - RNA, 22 nt, Homo sapiens
ggagucucugccacccacucag

SEQ ID NO: 1908159 - RNA, 21 nt, Homo sapiens
aaagugcuuuuucacugccua

SEQ ID NO: 1908160 - RNA, 21 nt, Homo sapiens
ggcgagacacagcuaccucug

SEQ ID NO: 1908161 - RNA, 22 nt, Homo sapiens
caugguagacugugacacagcu

SEQ ID NO: 1908162 - RNA, 12 nt, Homo sapiens
agaggacucucc

SEQ ID NO: 1908163 - RNA, 23 nt, Homo sapiens
uuguucaaacaauaucauaucau

SEQ ID NO: 1908164 - RNA, 15 nt, Homo sapiens
uagcacuauggacau

SEQ ID NO: 1908165 - RNA, 22 nt, Homo sapiens
acagauagaugcagguccauuc

SEQ ID NO: 1908166 - RNA, 16 nt, Homo sapiens
ucccagggcucugcag

SEQ ID NO: 1908167 - RNA, 19 nt, Homo sapiens
agacucccaugaagccuuu

SEQ ID NO: 1908168 - RNA, 15 nt, Homo sapiens
uauuuugcacccacu

SEQ ID NO: 1908169 - RNA, 18 nt, Homo sapiens
ucuuaaaggaaaagucaa

SEQ ID NO: 1908170 - RNA, 18 nt, Homo sapiens
ucucaaaugcacaucuca

SEQ ID NO: 1908171 - RNA, 14 nt, Homo sapiens
caaggagcugagaa

SEQ ID NO: 1908172 - RNA, 16 nt, Homo sapiens
auuaccagacaaaaaa

SEQ ID NO: 1908173 - RNA, 20 nt, Homo sapiens
ucccgggacaccuaggcuag

SEQ ID NO: 1908174 - RNA, 16 nt, Homo sapiens
uugagucucugaacau

SEQ ID NO: 1908175 - RNA, 14 nt, Homo sapiens
cgcagccaugugau

SEQ ID NO: 1908176 - RNA, 20 nt, Homo sapiens
gacaccuguacauucuucca

SEQ ID NO: 1908177 - RNA, 19 nt, Homo sapiens
ggguaaaaaugaagcagaa

SEQ ID NO: 1908178 - RNA, 15 nt, Homo sapiens
aacgguacacagacu

SEQ ID NO: 1908179 - RNA, 11 nt, Homo sapiens
agaggggacag

SEQ ID NO: 1908180 - RNA, 19 nt, Homo sapiens
auuucugcugaauuuucac

SEQ ID NO: 1908181 - RNA, 21 nt, Homo sapiens
ccucacaggagcuuacuggca

SEQ ID NO: 1908182 - RNA, 17 nt, Homo sapiens
agaaacaaagauguuau

SEQ ID NO: 1908183 - RNA, 20 nt, Homo sapiens
ucccccucccugugugaaau

SEQ ID NO: 1908184 - RNA, 15 nt, Homo sapiens
uaauuucauguauau

SEQ ID NO: 1908185 - RNA, 11 nt, Homo sapiens
guacugggauu

SEQ ID NO: 1908186 - RNA, 20 nt, Homo sapiens
uuggugucugguuucugucc

SEQ ID NO: 1908187 - RNA, 16 nt, Homo sapiens
ccauucacagugcaag

SEQ ID NO: 1908188 - RNA, 13 nt, Homo sapiens
guuccuacuggag

SEQ ID NO: 1908189 - RNA, 17 nt, Homo sapiens
uugcugugcguggaaug

SEQ ID NO: 1908190 - RNA, 16 nt, Homo sapiens
cucuguucccuuccuc

SEQ ID NO: 1908191 - RNA, 19 nt, Homo sapiens
aaaagcuucugcaauauua

SEQ ID NO: 1908192 - RNA, 17 nt, Homo sapiens
ucugaaaaagacauaaa

SEQ ID NO: 1908193 - RNA, 20 nt, Homo sapiens
uuuaaaaccauaaacuguac

SEQ ID NO: 1908194 - RNA, 19 nt, Homo sapiens
ccugcugggaaugcuccca

SEQ ID NO: 1908195 - RNA, 19 nt, Homo sapiens
ggaugcgaggaccacuuug

SEQ ID NO: 1908196 - RNA, 21 nt, Homo sapiens
agaucaguauuucacugauac

SEQ ID NO: 1908197 - RNA, 13 nt, Homo sapiens
cagaagcuaugga

SEQ ID NO: 1908198 - RNA, 23 nt, Homo sapiens
acagccuuugcccaaaacuguca

SEQ ID NO: 1908199 - RNA, 14 nt, Homo sapiens
ccauccccuccggc

SEQ ID NO: 1908200 - RNA, 19 nt, Homo sapiens
uagaaggacucaguauuau

SEQ ID NO: 1908201 - RNA, 20 nt, Homo sapiens
gaacauacacugugaacuca

SEQ ID NO: 1908202 - RNA, 14 nt, Homo sapiens
ucacccuucugggc

SEQ ID NO: 1908203 - RNA, 20 nt, Homo sapiens
ucuugcuggaucuguaguga

SEQ ID NO: 1908204 - RNA, 19 nt, Homo sapiens
uaguacuuacaucaggaaa

SEQ ID NO: 1908205 - RNA, 20 nt, Homo sapiens
ccuaccccuggcuguacugc

SEQ ID NO: 1908206 - RNA, 16 nt, Homo sapiens
cuuucuucuuuagcaa

SEQ ID NO: 1908207 - RNA, 19 nt, Homo sapiens
agacaagagggacaagugg

SEQ ID NO: 1908208 - RNA, 12 nt, Homo sapiens
gaaaagccagau

SEQ ID NO: 1908209 - RNA, 22 nt, Homo sapiens
gaucucggcucauguagccuca

SEQ ID NO: 1908210 - RNA, 14 nt, Homo sapiens
gaacugagcuugga

SEQ ID NO: 1908211 - RNA, 21 nt, Homo sapiens
uucauugcacuuuccuuucaa

SEQ ID NO: 1908212 - RNA, 15 nt, Homo sapiens
ugcccaguucauccc

SEQ ID NO: 1908213 - RNA, 16 nt, Homo sapiens
aauuguugacugcuga

SEQ ID NO: 1908214 - RNA, 19 nt, Homo sapiens
uggagaauacuuugcuuca

SEQ ID NO: 1908215 - RNA, 19 nt, Homo sapiens
cugcagcaggccacugggg

SEQ ID NO: 1908216 - RNA, 22 nt, Homo sapiens
agcuaaagcaguguuugcucca

SEQ ID NO: 1908217 - RNA, 17 nt, Homo sapiens
uagcuggagugccaugg

SEQ ID NO: 1908218 - RNA, 24 nt, Homo sapiens
gggaugggcuuucucagugucagc

SEQ ID NO: 1908219 - RNA, 21 nt, Homo sapiens
uuuuaaaaguuucaaugugau

SEQ ID NO: 1908220 - RNA, 21 nt, Homo sapiens
uuggagcaggggugcugggac

SEQ ID NO: 1908221 - RNA, 18 nt, Homo sapiens
gugagggaucacugccaa

SEQ ID NO: 1908222 - RNA, 19 nt, Homo sapiens
uugugaucucacacacaga

SEQ ID NO: 1908223 - RNA, 15 nt, Homo sapiens
acaggaccaccuccu

SEQ ID NO: 1908224 - RNA, 19 nt, Homo sapiens
acuguuuuucucuaaugcu

SEQ ID NO: 1908225 - RNA, 20 nt, Homo sapiens
cuaauuugucacuggaaccu

SEQ ID NO: 1908226 - RNA, 21 nt, Homo sapiens
cacaugcuucuggcaaaucuc

SEQ ID NO: 1908227 - RNA, 20 nt, Homo sapiens
ucaucaccuguuaucugugu

SEQ ID NO: 1908228 - RNA, 17 nt, Homo sapiens
uuaucuguaaguuuuga

SEQ ID NO: 1908229 - RNA, 23 nt, Homo sapiens
uauuccagcagugaaacuugugc

SEQ ID NO: 1908230 - RNA, 22 nt, Homo sapiens
cucuaagauaucuuugcugcuu

SEQ ID NO: 1908231 - RNA, 14 nt, Homo sapiens
acaacagugagaaa

SEQ ID NO: 1908232 - RNA, 20 nt, Homo sapiens
gugccgugugagugugacag

SEQ ID NO: 1908233 - RNA, 23 nt, Homo sapiens
uaaccucgcucgaugacugugaa

SEQ ID NO: 1908234 - RNA, 23 nt, Homo sapiens
gucacgcuggggcucucugagac

SEQ ID NO: 1908235 - RNA, 22 nt, Homo sapiens
ugcuaugacagaggugugaaua

SEQ ID NO: 1908236 - RNA, 21 nt, Homo sapiens
aauccagguacgcacagacag

SEQ ID NO: 1908237 - RNA, 12 nt, Homo sapiens
cagcaagccaug

SEQ ID NO: 1908238 - RNA, 22 nt, Homo sapiens
aggguucaccaggucagggaga

SEQ ID NO: 1908239 - RNA, 20 nt, Homo sapiens
aaccaggaaggaaaauguga

SEQ ID NO: 1908240 - RNA, 20 nt, Homo sapiens
uuugacguggagcugcucaa

SEQ ID NO: 1908241 - RNA, 19 nt, Homo sapiens
gaaggcuucuuagcgcagu

SEQ ID NO: 1908242 - RNA, 17 nt, Homo sapiens
uggagccccacugcccu

SEQ ID NO: 1908243 - RNA, 17 nt, Homo sapiens
cagaauggagcuaugga

SEQ ID NO: 1908244 - RNA, 22 nt, Homo sapiens
uucugacuuugaauuuauauaa

SEQ ID NO: 1908245 - RNA, 19 nt, Homo sapiens
cugcauuuauaaaugugug

SEQ ID NO: 1908246 - RNA, 19 nt, Homo sapiens
aaguagaaaggggcccagu

SEQ ID NO: 1908247 - RNA, 21 nt, Homo sapiens
uuagccauugaaaugucaaau

SEQ ID NO: 1908248 - RNA, 16 nt, Homo sapiens
cuggcuccaaacccuc

SEQ ID NO: 1908249 - RNA, 22 nt, Homo sapiens
acaagaccaucuacauacacag

SEQ ID NO: 1908250 - RNA, 18 nt, Homo sapiens
aagggccccacucaggga

SEQ ID NO: 1908251 - RNA, 15 nt, Homo sapiens
cagaagaugaacaga

SEQ ID NO: 1908252 - RNA, 14 nt, Homo sapiens
cuaauuugaucaca

SEQ ID NO: 1908253 - RNA, 21 nt, Homo sapiens
ccuggagacguggaaccucug

SEQ ID NO: 1908254 - RNA, 15 nt, Homo sapiens
caggaccuccaagcc

SEQ ID NO: 1908255 - RNA, 19 nt, Homo sapiens
gcacuggguuguccaggga

SEQ ID NO: 1908256 - RNA, 16 nt, Homo sapiens
acuauaaacuacugua

SEQ ID NO: 1908257 - RNA, 21 nt, Homo sapiens
gucuaaccugcgucauuucag

SEQ ID NO: 1908258 - RNA, 15 nt, Homo sapiens
caaguagcauuuacu

SEQ ID NO: 1908259 - RNA, 13 nt, Homo sapiens
gaaaaaaaccaaa

SEQ ID NO: 1908260 - RNA, 12 nt, Homo sapiens
gcuaaagugauc

SEQ ID NO: 1908261 - RNA, 23 nt, Homo sapiens
gcugugggacagggaccgggccu

SEQ ID NO: 1908262 - RNA, 19 nt, Homo sapiens
uaacaaagcccuuauucuc

SEQ ID NO: 1908263 - RNA, 17 nt, Homo sapiens
ucaggggccucagggga

SEQ ID NO: 1908264 - RNA, 14 nt, Homo sapiens
cuccugggcuauau

SEQ ID NO: 1908265 - RNA, 17 nt, Homo sapiens
uaauuuauuuuguccau

SEQ ID NO: 1908266 - RNA, 13 nt, Homo sapiens
aauuauaccauga

SEQ ID NO: 1908267 - RNA, 17 nt, Homo sapiens
gagaauacuuugcuuca

SEQ ID NO: 1908268 - RNA, 15 nt, Homo sapiens
cacccugggcuccac

SEQ ID NO: 1908269 - RNA, 21 nt, Homo sapiens
guucucuuugcugacacugug

SEQ ID NO: 1908270 - RNA, 14 nt, Homo sapiens
augaaugcccagug

SEQ ID NO: 1908271 - RNA, 17 nt, Homo sapiens
ugaagauauuacuacuu

SEQ ID NO: 1908272 - RNA, 20 nt, Homo sapiens
ucaguucccuuggccucaga

SEQ ID NO: 1908273 - RNA, 16 nt, Homo sapiens
ugcuagcugucucucu

SEQ ID NO: 1908274 - RNA, 21 nt, Homo sapiens
uaacugcuuucuguuccaaau

SEQ ID NO: 1908275 - RNA, 18 nt, Homo sapiens
acacagggugguggcaca

SEQ ID NO: 1908276 - RNA, 15 nt, Homo sapiens
caacucacagcuucu

SEQ ID NO: 1908277 - RNA, 17 nt, Homo sapiens
aaugcccccugagugac

SEQ ID NO: 1908278 - RNA, 15 nt, Homo sapiens
cccaugccaccgcuu

SEQ ID NO: 1908279 - RNA, 21 nt, Homo sapiens
aacauggaggaacaguauuac

SEQ ID NO: 1908280 - RNA, 20 nt, Homo sapiens
uuggcgcaccaagaucucca

SEQ ID NO: 1908281 - RNA, 17 nt, Homo sapiens
cacgcaugugugcugca

SEQ ID NO: 1908282 - RNA, 21 nt, Homo sapiens
ucccuggauguggauuucaca

SEQ ID NO: 1908283 - RNA, 16 nt, Homo sapiens
gggaggucagugcuuc

SEQ ID NO: 1908284 - RNA, 13 nt, Homo sapiens
aagcagagcucac

SEQ ID NO: 1908285 - RNA, 20 nt, Homo sapiens
uucaugcauucuagugcaga

SEQ ID NO: 1908286 - RNA, 13 nt, Homo sapiens
uccacaugcucug

SEQ ID NO: 1908287 - RNA, 13 nt, Homo sapiens
augucuuaagauu

SEQ ID NO: 1908288 - RNA, 20 nt, Homo sapiens
cagaucugacaugauuccuu

SEQ ID NO: 1908289 - RNA, 20 nt, Homo sapiens
cuaucggggucacuugcaau

SEQ ID NO: 1908290 - RNA, 15 nt, Homo sapiens
aucacugguccaggu

SEQ ID NO: 1908291 - RNA, 15 nt, Homo sapiens
ccaacugcugcuuaa

SEQ ID NO: 1908292 - RNA, 17 nt, Homo sapiens
uccauggugucaugcca

SEQ ID NO: 1908293 - RNA, 14 nt, Homo sapiens
ugcuuugaagcagu

SEQ ID NO: 1908294 - RNA, 21 nt, Homo sapiens
cccccaaugcccggccaggcu

SEQ ID NO: 1908295 - RNA, 21 nt, Homo sapiens
aagggaaaccccccagucacc

SEQ ID NO: 1908296 - RNA, 18 nt, Homo sapiens
ucucaaauuguaauuaau

SEQ ID NO: 1908297 - RNA, 17 nt, Homo sapiens
ccuaggggacacuuccc

SEQ ID NO: 1908298 - RNA, 23 nt, Homo sapiens
gagucuuuaauuuuuccugauga

SEQ ID NO: 1908299 - RNA, 13 nt, Homo sapiens
ccccuucagcuuu

SEQ ID NO: 1908300 - RNA, 11 nt, Homo sapiens
cugcuucucag

SEQ ID NO: 1908301 - RNA, 20 nt, Homo sapiens
agcugacccccugcugccau

SEQ ID NO: 1908302 - RNA, 23 nt, Homo sapiens
acucccugccaacuccaugacca

SEQ ID NO: 1908303 - RNA, 17 nt, Homo sapiens
auucuggcaggaccuca

SEQ ID NO: 1908304 - RNA, 20 nt, Homo sapiens
gcgaacauguguuuucauca

SEQ ID NO: 1908305 - RNA, 20 nt, Homo sapiens
caucaaacauuggauuuuuc

SEQ ID NO: 1908306 - RNA, 19 nt, Homo sapiens
ccucaacuauucuguucca

SEQ ID NO: 1908307 - RNA, 13 nt, Homo sapiens
ugaauaaccacuu

SEQ ID NO: 1908308 - RNA, 21 nt, Homo sapiens
cucagccuggagguagggggc

SEQ ID NO: 1908309 - RNA, 13 nt, Homo sapiens
aaauacugugccu

SEQ ID NO: 1908310 - RNA, 21 nt, Homo sapiens
uugaaauaccagugaaccaaa

SEQ ID NO: 1908311 - RNA, 12 nt, Homo sapiens
gugaugagcacu

SEQ ID NO: 1908312 - RNA, 16 nt, Homo sapiens
gaccuuuuucacugug

SEQ ID NO: 1908313 - RNA, 20 nt, Homo sapiens
auaccaacccacuggcacau

SEQ ID NO: 1908314 - RNA, 23 nt, Homo sapiens
auugagccuucgaguggccagcu

SEQ ID NO: 1908315 - RNA, 16 nt, Homo sapiens
uacaagaucuuuccaa

SEQ ID NO: 1908316 - RNA, 17 nt, Homo sapiens
aauucuaggcaucccag

SEQ ID NO: 1908317 - RNA, 19 nt, Homo sapiens
aaggcggguggaucacuug

SEQ ID NO: 1908318 - RNA, 17 nt, Homo sapiens
augaauaaagcauccaa

SEQ ID NO: 1908319 - RNA, 20 nt, Homo sapiens
aacauuuuguuauugggcaa

SEQ ID NO: 1908320 - RNA, 19 nt, Homo sapiens
cccagaucaccaccugaac

SEQ ID NO: 1908321 - RNA, 17 nt, Homo sapiens
ugugcaaaggcaucuga

SEQ ID NO: 1908322 - RNA, 17 nt, Homo sapiens
acagugcagugcgcugu

SEQ ID NO: 1908323 - RNA, 17 nt, Homo sapiens
cuugugugcacauaucc

SEQ ID NO: 1908324 - RNA, 17 nt, Homo sapiens
agucucacuggccaaga

SEQ ID NO: 1908325 - RNA, 15 nt, Homo sapiens
aauuuuaaagaggaa

SEQ ID NO: 1908326 - RNA, 15 nt, Homo sapiens
aaagacguuuuccca

SEQ ID NO: 1908327 - RNA, 20 nt, Homo sapiens
gaaagugagcaguguuagcu

SEQ ID NO: 1908328 - RNA, 16 nt, Homo sapiens
uggugaaagcugagaa

SEQ ID NO: 1908329 - RNA, 14 nt, Homo sapiens
agccagggucucac

SEQ ID NO: 1908330 - RNA, 23 nt, Homo sapiens
uagggaguuagaggcuguacaag

SEQ ID NO: 1908331 - RNA, 16 nt, Homo sapiens
cgaaccaggaaaugga

SEQ ID NO: 1908332 - RNA, 23 nt, Homo sapiens
uuccaaggguaugggaagccaua

SEQ ID NO: 1908333 - RNA, 21 nt, Homo sapiens
agccaauguuuuccacccaua

SEQ ID NO: 1908334 - RNA, 24 nt, Homo sapiens
ggcucucccucucugcaccugucu

SEQ ID NO: 1908335 - RNA, 19 nt, Homo sapiens
gauggaggggugguccuga

SEQ ID NO: 1908336 - RNA, 24 nt, Homo sapiens
uaaagucaggaguccaagaccaga

SEQ ID NO: 1908337 - RNA, 15 nt, Homo sapiens
guaaucucagcacuu

SEQ ID NO: 1908338 - RNA, 19 nt, Homo sapiens
ucaguguuaauacugagaa

SEQ ID NO: 1908339 - RNA, 18 nt, Homo sapiens
ccuucugcacccagaaau

SEQ ID NO: 1908340 - RNA, 16 nt, Homo sapiens
cuagagaaggcuguga

SEQ ID NO: 1908341 - RNA, 21 nt, Homo sapiens
uuucuuugaauuuaggugaua

SEQ ID NO: 1908342 - RNA, 22 nt, Homo sapiens
auuccuaugcugcaauacauua

SEQ ID NO: 1908343 - RNA, 14 nt, Homo sapiens
ccuucugaggagcu

SEQ ID NO: 1908344 - RNA, 20 nt, Homo sapiens
ucaccagaagcagaugccag

SEQ ID NO: 1908345 - RNA, 20 nt, Homo sapiens
ccauugccccagaccuggaa

SEQ ID NO: 1908346 - RNA, 20 nt, Homo sapiens
ucuugaagucuguacagauu

SEQ ID NO: 1908347 - RNA, 18 nt, Homo sapiens
caccuaucccuaacaggc

SEQ ID NO: 1908348 - RNA, 13 nt, Homo sapiens
gccgggagccaac

SEQ ID NO: 1908349 - RNA, 17 nt, Homo sapiens
aaauaaaaggacuguga

SEQ ID NO: 1908350 - RNA, 18 nt, Homo sapiens
uaaagauaauugcuauuu

SEQ ID NO: 1908351 - RNA, 20 nt, Homo sapiens
uccuuaccgugggcacugaa

SEQ ID NO: 1908352 - RNA, 19 nt, Homo sapiens
uaaugcuuucccacucuca

SEQ ID NO: 1908353 - RNA, 15 nt, Homo sapiens
uccacccagugcugc

SEQ ID NO: 1908354 - RNA, 13 nt, Homo sapiens
ccaggugguuggg

SEQ ID NO: 1908355 - RNA, 21 nt, Homo sapiens
agaugaggacaagagggacaa

SEQ ID NO: 1908356 - RNA, 17 nt, Homo sapiens
aauuaacugcuccaaau

SEQ ID NO: 1908357 - RNA, 17 nt, Homo sapiens
uguaauguuauuuccac

SEQ ID NO: 1908358 - RNA, 17 nt, Homo sapiens
accuccaaaagcccuga

SEQ ID NO: 1908359 - RNA, 16 nt, Homo sapiens
auguuuagcagauuua

SEQ ID NO: 1908360 - RNA, 22 nt, Homo sapiens
ugguguacaaaauggaauucau

SEQ ID NO: 1908361 - RNA, 21 nt, Homo sapiens
agaaguguaacucaccagccu

SEQ ID NO: 1908362 - RNA, 18 nt, Homo sapiens
aaaugacgucuucaccaa

SEQ ID NO: 1908363 - RNA, 21 nt, Homo sapiens
ugacaggcagcagagacuugg

SEQ ID NO: 1908364 - RNA, 17 nt, Homo sapiens
uccagccuggggacccc

SEQ ID NO: 1908365 - RNA, 14 nt, Homo sapiens
aguuuuaaucaaga

SEQ ID NO: 1908366 - RNA, 20 nt, Homo sapiens
aggcuccugaaugugacugg

SEQ ID NO: 1908367 - RNA, 18 nt, Homo sapiens
ggugauuuuccugugucc

SEQ ID NO: 1908368 - RNA, 21 nt, Homo sapiens
gcuuugaauacccccagagac

SEQ ID NO: 1908369 - RNA, 23 nt, Homo sapiens
aaacuuugugccuuugaccaucu

SEQ ID NO: 1908370 - RNA, 20 nt, Homo sapiens
auuucagaucauauuucaca

SEQ ID NO: 1908371 - RNA, 17 nt, Homo sapiens
cuacaucccgggccuca

SEQ ID NO: 1908372 - RNA, 17 nt, Homo sapiens
uagagcccagugagguc

SEQ ID NO: 1908373 - RNA, 14 nt, Homo sapiens
ugacaugccaucca

SEQ ID NO: 1908374 - RNA, 23 nt, Homo sapiens
gucauucgcuacuaugauuuaau

SEQ ID NO: 1908375 - RNA, 20 nt, Homo sapiens
uuucauacuguaacauucag

SEQ ID NO: 1908376 - RNA, 21 nt, Homo sapiens
gagcuaugauccacaaaaaca

SEQ ID NO: 1908377 - RNA, 21 nt, Homo sapiens
aauuaaaaaguuaaucuucau

SEQ ID NO: 1908378 - RNA, 16 nt, Homo sapiens
auacauucugcuuuca

SEQ ID NO: 1908379 - RNA, 20 nt, Homo sapiens
agccugugaauaaaaacccu

SEQ ID NO: 1908380 - RNA, 15 nt, Homo sapiens
cugugcucacuaccu

SEQ ID NO: 1908381 - RNA, 17 nt, Homo sapiens
cuuccugaaacuauauu

SEQ ID NO: 1908382 - RNA, 17 nt, Homo sapiens
aguuuguuuauuacuua

SEQ ID NO: 1908383 - RNA, 13 nt, Homo sapiens
ugggaaccagcau

SEQ ID NO: 1908384 - RNA, 23 nt, Homo sapiens
cauuggagaaucucaacaugucu

SEQ ID NO: 1908385 - RNA, 21 nt, Homo sapiens
gcagaugccugcagugccacu

SEQ ID NO: 1908386 - RNA, 18 nt, Homo sapiens
uacaauacaacacauuga

SEQ ID NO: 1908387 - RNA, 23 nt, Homo sapiens
cuucugaaguaauuuguaaaaaa

SEQ ID NO: 1908388 - RNA, 21 nt, Homo sapiens
agcuuucccugccacauccag

SEQ ID NO: 1908389 - RNA, 19 nt, Homo sapiens
gagccuggaacugcaucag

SEQ ID NO: 1908390 - RNA, 15 nt, Homo sapiens
aggcugauaccuuug

SEQ ID NO: 1908391 - RNA, 13 nt, Homo sapiens
ugucaguucuugg

SEQ ID NO: 1908392 - RNA, 17 nt, Homo sapiens
guaugguauaugcacaa

SEQ ID NO: 1908393 - RNA, 20 nt, Homo sapiens
uacccucuccaggcauuuau

SEQ ID NO: 1908394 - RNA, 19 nt, Homo sapiens
ggaggucauacaugcauac

SEQ ID NO: 1908395 - RNA, 20 nt, Homo sapiens
acaaacucaaguuaugucau

SEQ ID NO: 1908396 - RNA, 17 nt, Homo sapiens
uuuaccuuauguuuaau

SEQ ID NO: 1908397 - RNA, 18 nt, Homo sapiens
uaacacucagaagccugg

SEQ ID NO: 1908398 - RNA, 12 nt, Homo sapiens
uccccuugccug

SEQ ID NO: 1908399 - RNA, 16 nt, Homo sapiens
accaaaucauacuuuu

SEQ ID NO: 1908400 - RNA, 15 nt, Homo sapiens
ggaccagcucaggac

SEQ ID NO: 1908401 - RNA, 21 nt, Homo sapiens
ggaaaaaugcugcuucuccuc

SEQ ID NO: 1908402 - RNA, 22 nt, Homo sapiens
ugaaagaacauggucuguggug

SEQ ID NO: 1908403 - RNA, 23 nt, Homo sapiens
uaagcaaacccagugucaggaug

SEQ ID NO: 1908404 - RNA, 22 nt, Homo sapiens
aauggauucaacacugugcacg

SEQ ID NO: 1908405 - RNA, 15 nt, Homo sapiens
caacuuuguuuucca

SEQ ID NO: 1908406 - RNA, 16 nt, Homo sapiens
aaucugccuccuucac

SEQ ID NO: 1908407 - RNA, 21 nt, Homo sapiens
uguaauaaagugaacuuuguu

SEQ ID NO: 1908408 - RNA, 16 nt, Homo sapiens
acacuccuaaaauugc

SEQ ID NO: 1908409 - RNA, 21 nt, Homo sapiens
gugccacauggccgcugccca

SEQ ID NO: 1908410 - RNA, 15 nt, Homo sapiens
gugaccucacuggcc

SEQ ID NO: 1908411 - RNA, 15 nt, Homo sapiens
aggagucccugccau

SEQ ID NO: 1908412 - RNA, 14 nt, Homo sapiens
gaaaggucucugga

SEQ ID NO: 1908413 - RNA, 16 nt, Homo sapiens
ucagacuagcuuucag

SEQ ID NO: 1908414 - RNA, 20 nt, Homo sapiens
gcccuggcuggaguucagug

SEQ ID NO: 1908415 - RNA, 18 nt, Homo sapiens
aaugcauacucugugcaa

SEQ ID NO: 1908416 - RNA, 19 nt, Homo sapiens
aaagcagccuuuuucacca

SEQ ID NO: 1908417 - RNA, 18 nt, Homo sapiens
ucaauaaaguacugcaaa

SEQ ID NO: 1908418 - RNA, 22 nt, Homo sapiens
agaaucucagucugucacccag

SEQ ID NO: 1908419 - RNA, 19 nt, Homo sapiens
cuuuuuauucccugcccaa

SEQ ID NO: 1908420 - RNA, 18 nt, Homo sapiens
cagccagacccuggagag

SEQ ID NO: 1908421 - RNA, 20 nt, Homo sapiens
guucaccucuguacagacca

SEQ ID NO: 1908422 - RNA, 20 nt, Homo sapiens
cucccuuuggcccugaacca

SEQ ID NO: 1908423 - RNA, 22 nt, Homo sapiens
aaccaagguuuugaaaucccau

SEQ ID NO: 1908424 - RNA, 17 nt, Homo sapiens
guuacucauaaggcaua

SEQ ID NO: 1908425 - RNA, 16 nt, Homo sapiens
uuaaaugugacauucu

SEQ ID NO: 1908426 - RNA, 18 nt, Homo sapiens
aguuuuccccuggccuca

SEQ ID NO: 1908427 - RNA, 20 nt, Homo sapiens
ccuggcguggggggagcucu

SEQ ID NO: 1908428 - RNA, 15 nt, Homo sapiens
cuuuguaugcacuuu

SEQ ID NO: 1908429 - RNA, 15 nt, Homo sapiens
gcaugcuucuucuca

SEQ ID NO: 1908430 - RNA, 14 nt, Homo sapiens
ucugugucaaugug

SEQ ID NO: 1908431 - RNA, 22 nt, Homo sapiens
gucuuuggauaauaggaauuca

SEQ ID NO: 1908432 - RNA, 22 nt, Homo sapiens
uuuguagaagucacauuccuga

SEQ ID NO: 1908433 - RNA, 13 nt, Homo sapiens
aggacugaauuau

SEQ ID NO: 1908434 - RNA, 18 nt, Homo sapiens
ggccauuuuggugcuuau

SEQ ID NO: 1908435 - RNA, 17 nt, Homo sapiens
uuuuuuguuugccucuu

SEQ ID NO: 1908436 - RNA, 21 nt, Homo sapiens
acggagcugaagcugggagcu

SEQ ID NO: 1908437 - RNA, 23 nt, Homo sapiens
cucuuggcuuccagaaggcagca

SEQ ID NO: 1908438 - RNA, 18 nt, Homo sapiens
accgucugugauugccau

SEQ ID NO: 1908439 - RNA, 19 nt, Homo sapiens
uggaaguggauucuggaug

SEQ ID NO: 1908440 - RNA, 17 nt, Homo sapiens
agcaggagggacaauga

SEQ ID NO: 1908441 - RNA, 22 nt, Homo sapiens
gucaaauaucucagaggcuaua

SEQ ID NO: 1908442 - RNA, 19 nt, Homo sapiens
auugcgcucaggggcucca

SEQ ID NO: 1908443 - RNA, 19 nt, Homo sapiens
augccgccguguuuccuca

SEQ ID NO: 1908444 - RNA, 18 nt, Homo sapiens
ccgaagagaguucuggau

SEQ ID NO: 1908445 - RNA, 21 nt, Homo sapiens
auucaguuuucaguagaagaa

SEQ ID NO: 1908446 - RNA, 18 nt, Homo sapiens
acacucaaccaugaccuc

SEQ ID NO: 1908447 - RNA, 23 nt, Homo sapiens
cuugauuaagauuuuacaaaaga

SEQ ID NO: 1908448 - RNA, 13 nt, Homo sapiens
cagaagcuuaaaa

SEQ ID NO: 1908449 - RNA, 17 nt, Homo sapiens
aagguuccaacuggaaa

SEQ ID NO: 1908450 - RNA, 23 nt, Homo sapiens
aaccuggaccccuucggcagcua

SEQ ID NO: 1908451 - RNA, 21 nt, Homo sapiens
aauugagcuggaccucaccaa

SEQ ID NO: 1908452 - RNA, 13 nt, Homo sapiens
accuguguagucu

SEQ ID NO: 1908453 - RNA, 16 nt, Homo sapiens
aaaugguauuuugaua

SEQ ID NO: 1908454 - RNA, 14 nt, Homo sapiens
uucuuaauaggcuu

SEQ ID NO: 1908455 - RNA, 21 nt, Homo sapiens
auggauuugaaugaaaugcca

SEQ ID NO: 1908456 - RNA, 21 nt, Homo sapiens
cucaguuugcaguauacacac

SEQ ID NO: 1908457 - RNA, 22 nt, Homo sapiens
ccacagggugggaugagccucu

SEQ ID NO: 1908458 - RNA, 17 nt, Homo sapiens
cugugcagcacgucuca

SEQ ID NO: 1908459 - RNA, 14 nt, Homo sapiens
aggggcuggcacug

SEQ ID NO: 1908460 - RNA, 14 nt, Homo sapiens
uacaggaaguacug

SEQ ID NO: 1908461 - RNA, 18 nt, Homo sapiens
cacacagcacaugcacac

SEQ ID NO: 1908462 - RNA, 10 nt, Homo sapiens
gcuugcucuu

SEQ ID NO: 1908463 - RNA, 18 nt, Homo sapiens
ucacauuuauucugcuca

SEQ ID NO: 1908464 - RNA, 19 nt, Homo sapiens
ugcaggccacugugagcgc

SEQ ID NO: 1908465 - RNA, 17 nt, Homo sapiens
caggacugugaccaaag

SEQ ID NO: 1908466 - RNA, 17 nt, Homo sapiens
gagccaagcuucaaccc

SEQ ID NO: 1908467 - RNA, 17 nt, Homo sapiens
cucccuaaguacccgcu

SEQ ID NO: 1908468 - RNA, 19 nt, Homo sapiens
acauaaaaacaacuuuaua

SEQ ID NO: 1908469 - RNA, 18 nt, Homo sapiens
uuaucagcucuaugucaa

SEQ ID NO: 1908470 - RNA, 18 nt, Homo sapiens
guucuguggucacaguga

SEQ ID NO: 1908471 - RNA, 18 nt, Homo sapiens
ucccuggggcugugcauu

SEQ ID NO: 1908472 - RNA, 21 nt, Homo sapiens
acaaauucuuuuucacacuga

SEQ ID NO: 1908473 - RNA, 20 nt, Homo sapiens
ugccaggauugucacuccaa

SEQ ID NO: 1908474 - RNA, 15 nt, Homo sapiens
gucauauacccagcu

SEQ ID NO: 1908475 - RNA, 19 nt, Homo sapiens
aaguggaguccacccucau

SEQ ID NO: 1908476 - RNA, 21 nt, Homo sapiens
ugggugauuacauaaucugua

SEQ ID NO: 1908477 - RNA, 22 nt, Homo sapiens
acucuauguuuggcuucagugu

SEQ ID NO: 1908478 - RNA, 14 nt, Homo sapiens
agaauuauuacauc

SEQ ID NO: 1908479 - RNA, 21 nt, Homo sapiens
gccuaaucaagucaaauggag

SEQ ID NO: 1908480 - RNA, 21 nt, Homo sapiens
cuaucauacuacugaaacaga

SEQ ID NO: 1908481 - RNA, 14 nt, Homo sapiens
acuuucacugaaua

SEQ ID NO: 1908482 - RNA, 15 nt, Homo sapiens
ucuugccccuugucc

SEQ ID NO: 1908483 - RNA, 19 nt, Homo sapiens
accgcgccuggccaggcug

SEQ ID NO: 1908484 - RNA, 14 nt, Homo sapiens
gcaaguaaguuaua

SEQ ID NO: 1908485 - RNA, 21 nt, Homo sapiens
agagugagcaaccagcuggaa

SEQ ID NO: 1908486 - RNA, 19 nt, Homo sapiens
uucacauaguuuauuucaa

SEQ ID NO: 1908487 - RNA, 22 nt, Homo sapiens
gaugcucccuugauggggucca

SEQ ID NO: 1908488 - RNA, 21 nt, Homo sapiens
cacuggccguaucugagggcu

SEQ ID NO: 1908489 - RNA, 16 nt, Homo sapiens
cuaaauugaacugcca

SEQ ID NO: 1908490 - RNA, 14 nt, Homo sapiens
gggaggucccugcc

SEQ ID NO: 1908491 - RNA, 20 nt, Homo sapiens
auuugcuuagaaagucugau

SEQ ID NO: 1908492 - RNA, 23 nt, Homo sapiens
cagcucacugcugcugccucuga

SEQ ID NO: 1908493 - RNA, 19 nt, Homo sapiens
auacauucuaaaucacuuu

SEQ ID NO: 1908494 - RNA, 14 nt, Homo sapiens
uccauaucagcucu

SEQ ID NO: 1908495 - RNA, 18 nt, Homo sapiens
acucaucugaaauguuac

SEQ ID NO: 1908496 - RNA, 16 nt, Homo sapiens
uguggaugcgugugaa

SEQ ID NO: 1908497 - RNA, 17 nt, Homo sapiens
cuaugcaagcaaacaca

SEQ ID NO: 1908498 - RNA, 14 nt, Homo sapiens
uaggaaaaauccau

SEQ ID NO: 1908499 - RNA, 19 nt, Homo sapiens
cuauaccaauaaagugacc

SEQ ID NO: 1908500 - RNA, 13 nt, Homo sapiens
uccucccauuucu

SEQ ID NO: 1908501 - RNA, 22 nt, Homo sapiens
auucccgacgacacauauacau

SEQ ID NO: 1908502 - RNA, 23 nt, Homo sapiens
aagagcuuugugauauacugguu

SEQ ID NO: 1908503 - RNA, 18 nt, Homo sapiens
auugcucugaauauguca

SEQ ID NO: 1908504 - RNA, 15 nt, Homo sapiens
aagaauugucuugca

SEQ ID NO: 1908505 - RNA, 17 nt, Homo sapiens
auuuagaugcacuacca

SEQ ID NO: 1908506 - RNA, 19 nt, Homo sapiens
gcagagcggguaaagugca

SEQ ID NO: 1908507 - RNA, 22 nt, Homo sapiens
cagcauuacacgccacaacucc

SEQ ID NO: 1908508 - RNA, 18 nt, Homo sapiens
aaauaugauucuccucuc

SEQ ID NO: 1908509 - RNA, 22 nt, Homo sapiens
uccuuuucugguguuacacaua

SEQ ID NO: 1908510 - RNA, 16 nt, Homo sapiens
gcuccauucaaaguga

SEQ ID NO: 1908511 - RNA, 22 nt, Homo sapiens
cuaguaggucugcacacauaac

SEQ ID NO: 1908512 - RNA, 17 nt, Homo sapiens
aauucugcucagauaga

SEQ ID NO: 1908513 - RNA, 15 nt, Homo sapiens
gguuucacuguguua

SEQ ID NO: 1908514 - RNA, 21 nt, Homo sapiens
gacugaagcgaacaucuucau

SEQ ID NO: 1908515 - RNA, 20 nt, Homo sapiens
uuucuaguuguaauguguau

SEQ ID NO: 1908516 - RNA, 18 nt, Homo sapiens
ggucaacuugacaccacu

SEQ ID NO: 1908517 - RNA, 13 nt, Homo sapiens
cccuucucagaaa

SEQ ID NO: 1908518 - RNA, 17 nt, Homo sapiens
aguaacacaccaagugg

SEQ ID NO: 1908519 - RNA, 13 nt, Homo sapiens
ugaauuuugccau

SEQ ID NO: 1908520 - RNA, 18 nt, Homo sapiens
cagcuauuuuuaugacua

SEQ ID NO: 1908521 - RNA, 19 nt, Homo sapiens
ggcagaccgugaccaucuu

SEQ ID NO: 1908522 - RNA, 18 nt, Homo sapiens
cugaagaaucacaauaau

SEQ ID NO: 1908523 - RNA, 15 nt, Homo sapiens
caaggaagaaauuaa

SEQ ID NO: 1908524 - RNA, 21 nt, Homo sapiens
uaugucugccuucgaccacag

SEQ ID NO: 1908525 - RNA, 14 nt, Homo sapiens
agacccugucucaa

SEQ ID NO: 1908526 - RNA, 23 nt, Homo sapiens
guuucucccccuuuccaaaaacu

SEQ ID NO: 1908527 - RNA, 22 nt, Homo sapiens
agaugauugaauaacaguaguc

SEQ ID NO: 1908528 - RNA, 23 nt, Homo sapiens
gucaguucauccugcaugggaaa

SEQ ID NO: 1908529 - RNA, 14 nt, Homo sapiens
auuauuuccagugu

SEQ ID NO: 1908530 - RNA, 21 nt, Homo sapiens
gagcucccaggugcagccaga

SEQ ID NO: 1908531 - RNA, 16 nt, Homo sapiens
gcuccaucuccagugg

SEQ ID NO: 1908532 - RNA, 14 nt, Homo sapiens
cccucaaaucugag

SEQ ID NO: 1908533 - RNA, 20 nt, Homo sapiens
aaagaccaauauucaaaugc

SEQ ID NO: 1908534 - RNA, 20 nt, Homo sapiens
gacuggucaccuugcacucc

SEQ ID NO: 1908535 - RNA, 15 nt, Homo sapiens
aacucuucaguuaau

SEQ ID NO: 1908536 - RNA, 13 nt, Homo sapiens
agggugagugcaa

SEQ ID NO: 1908537 - RNA, 22 nt, Homo sapiens
aaaaagccugguuuuucucaau

SEQ ID NO: 1908538 - RNA, 17 nt, Homo sapiens
cuuuuuuucuguaccag

SEQ ID NO: 1908539 - RNA, 19 nt, Homo sapiens
gccauguacuauaauguga

SEQ ID NO: 1908540 - RNA, 21 nt, Homo sapiens
aacccagccacugccaagcuu

SEQ ID NO: 1908541 - RNA, 18 nt, Homo sapiens
ugucagcagcucugagac

SEQ ID NO: 1908542 - RNA, 20 nt, Homo sapiens
gccucauuuuuuuccuugca

SEQ ID NO: 1908543 - RNA, 20 nt, Homo sapiens
gcaaugugaguuaucacuuc

SEQ ID NO: 1908544 - RNA, 14 nt, Homo sapiens
cauuuguuccauga

SEQ ID NO: 1908545 - RNA, 21 nt, Homo sapiens
cagcuuggcacuuuaaagcau

SEQ ID NO: 1908546 - RNA, 15 nt, Homo sapiens
uggcacuacaggcac

SEQ ID NO: 1908547 - RNA, 15 nt, Homo sapiens
ucagucaauagccau

SEQ ID NO: 1908548 - RNA, 16 nt, Homo sapiens
gaaaaggcacgcuggc

SEQ ID NO: 1908549 - RNA, 14 nt, Homo sapiens
uaugcacauucacg

SEQ ID NO: 1908550 - RNA, 20 nt, Homo sapiens
aguggccaugccacccuguu

SEQ ID NO: 1908551 - RNA, 20 nt, Homo sapiens
aggcugaaaccauccgcaac

SEQ ID NO: 1908552 - RNA, 16 nt, Homo sapiens
uccuugauggcuggau

SEQ ID NO: 1908553 - RNA, 22 nt, Homo sapiens
agcugaccccuucgugguuaua

SEQ ID NO: 1908554 - RNA, 23 nt, Homo sapiens
uaauucuagagucucuguuacug

SEQ ID NO: 1908555 - RNA, 18 nt, Homo sapiens
cauuguccugugaaauau

SEQ ID NO: 1908556 - RNA, 15 nt, Homo sapiens
guuauaaaccaauga

SEQ ID NO: 1908557 - RNA, 19 nt, Homo sapiens
agggccaccacaccugacu

SEQ ID NO: 1908558 - RNA, 20 nt, Homo sapiens
caucagucccccugugcaua

SEQ ID NO: 1908559 - RNA, 20 nt, Homo sapiens
auauagagaauaaggcacaa

SEQ ID NO: 1908560 - RNA, 13 nt, Homo sapiens
cuguaccuccaaa

SEQ ID NO: 1908561 - RNA, 21 nt, Homo sapiens
caggcugaucgggcaauggga

SEQ ID NO: 1908562 - RNA, 15 nt, Homo sapiens
aaugugggaucucag

SEQ ID NO: 1908563 - RNA, 14 nt, Homo sapiens
ugccccagugcuac

SEQ ID NO: 1908564 - RNA, 22 nt, Homo sapiens
accuucguuuacuaugccugug

SEQ ID NO: 1908565 - RNA, 21 nt, Homo sapiens
acuucgucuucgcccucugaa

SEQ ID NO: 1908566 - RNA, 15 nt, Homo sapiens
acucugcaguuaaau

SEQ ID NO: 1908567 - RNA, 21 nt, Homo sapiens
aucauagguacaaucuuucac

SEQ ID NO: 1908568 - RNA, 21 nt, Homo sapiens
uccuucuuugauaauguuaaa

SEQ ID NO: 1908569 - RNA, 22 nt, Homo sapiens
auacgucuugaucagacauuca

SEQ ID NO: 1908570 - RNA, 18 nt, Homo sapiens
cuuuuauaccaucaugag

SEQ ID NO: 1908571 - RNA, 20 nt, Homo sapiens
ucaugcuuuuucagccaugu

SEQ ID NO: 1908572 - RNA, 19 nt, Homo sapiens
aaaagguuuucuucauuca

SEQ ID NO: 1908573 - RNA, 15 nt, Homo sapiens
accaaugagccuuag

SEQ ID NO: 1908574 - RNA, 15 nt, Homo sapiens
gacuuagaaacaaug

SEQ ID NO: 1908575 - RNA, 17 nt, Homo sapiens
uucucuuaaucacuacu

SEQ ID NO: 1908576 - RNA, 13 nt, Homo sapiens
aguggcuuuuuaa

SEQ ID NO: 1908577 - RNA, 20 nt, Homo sapiens
cuaucucucaagagugcuga

SEQ ID NO: 1908578 - RNA, 20 nt, Homo sapiens
ccacgucugcuaacuuggag

SEQ ID NO: 1908579 - RNA, 22 nt, Homo sapiens
uauaggaucauuuguuggaaug

SEQ ID NO: 1908580 - RNA, 15 nt, Homo sapiens
gcccacauauucuau

SEQ ID NO: 1908581 - RNA, 22 nt, Homo sapiens
cacgauuagcuuuauuauggcu

SEQ ID NO: 1908582 - RNA, 22 nt, Homo sapiens
cuuaucauuagaaucuuaccuu

SEQ ID NO: 1908583 - RNA, 17 nt, Homo sapiens
ccuuuaaugacauugau

SEQ ID NO: 1908584 - RNA, 15 nt, Homo sapiens
acaauauccaaugaa

SEQ ID NO: 1908585 - RNA, 12 nt, Homo sapiens
ccccuccagugc

SEQ ID NO: 1908586 - RNA, 20 nt, Homo sapiens
caccaucgucuucuuggcca

SEQ ID NO: 1908587 - RNA, 20 nt, Homo sapiens
aacauaaaagagcccaucuu

SEQ ID NO: 1908588 - RNA, 15 nt, Homo sapiens
aguuuauaagacugg

SEQ ID NO: 1908589 - RNA, 23 nt, Homo sapiens
uccugagaaugaaugaguaggaa

SEQ ID NO: 1908590 - RNA, 16 nt, Homo sapiens
cugagugucaucucaa

SEQ ID NO: 1908591 - RNA, 21 nt, Homo sapiens
gaaggucccgaauggagucca

SEQ ID NO: 1908592 - RNA, 22 nt, Homo sapiens
uucuuauagaguauugucuuua

SEQ ID NO: 1908593 - RNA, 15 nt, Homo sapiens
gccgcgugugcgugg

SEQ ID NO: 1908594 - RNA, 17 nt, Homo sapiens
ccgauguacacacacag

SEQ ID NO: 1908595 - RNA, 15 nt, Homo sapiens
cccgggccaucccac

SEQ ID NO: 1908596 - RNA, 14 nt, Homo sapiens
uguuucaccuucca

SEQ ID NO: 1908597 - RNA, 16 nt, Homo sapiens
agucaaguaauggagg

SEQ ID NO: 1908598 - RNA, 21 nt, Homo sapiens
gaugaaauaaaccccagucuc

SEQ ID NO: 1908599 - RNA, 20 nt, Homo sapiens
ccuggcccuccucuggucac

SEQ ID NO: 1908600 - RNA, 18 nt, Homo sapiens
ccuuccuuguagccuuuu

SEQ ID NO: 1908601 - RNA, 12 nt, Homo sapiens
ccacuaagugug

SEQ ID NO: 1908602 - RNA, 21 nt, Homo sapiens
gaccacaggugcccgccacca

SEQ ID NO: 1908603 - RNA, 19 nt, Homo sapiens
uaggccuuaacacacuggc

SEQ ID NO: 1908604 - RNA, 12 nt, Homo sapiens
ccaagugcaaua

SEQ ID NO: 1908605 - RNA, 16 nt, Homo sapiens
gggcccugggccucag

SEQ ID NO: 1908606 - RNA, 15 nt, Homo sapiens
uacagccuggaccac

SEQ ID NO: 1908607 - RNA, 16 nt, Homo sapiens
acaaauuaauauuugu

SEQ ID NO: 1908608 - RNA, 16 nt, Homo sapiens
caggggcugcugugau

SEQ ID NO: 1908609 - RNA, 13 nt, Homo sapiens
uccauuuuacaca

SEQ ID NO: 1908610 - RNA, 19 nt, Homo sapiens
auaaagacugugcugagaa

SEQ ID NO: 1908611 - RNA, 16 nt, Homo sapiens
uaagaagucugauggu

SEQ ID NO: 1908612 - RNA, 20 nt, Homo sapiens
uccauccuuucugccucuca

SEQ ID NO: 1908613 - RNA, 15 nt, Homo sapiens
ggcagccccagagag

SEQ ID NO: 1908614 - RNA, 21 nt, Homo sapiens
caagguuuugaaaucccauca

SEQ ID NO: 1908615 - RNA, 19 nt, Homo sapiens
aaauaaaaugcaaaugcac

SEQ ID NO: 1908616 - RNA, 23 nt, Homo sapiens
gaguuguguuuacuaugcauugu

SEQ ID NO: 1908617 - RNA, 22 nt, Homo sapiens
aaguaauuucuuugaucuggac

SEQ ID NO: 1908618 - RNA, 21 nt, Homo sapiens
ugcugaaucaucauaucuacu

SEQ ID NO: 1908619 - RNA, 10 nt, Homo sapiens
gcacaccucu

SEQ ID NO: 1908620 - RNA, 22 nt, Homo sapiens
guuugcgggaaaauaaaccacu

SEQ ID NO: 1908621 - RNA, 17 nt, Homo sapiens
agauguuauacaaccau

SEQ ID NO: 1908622 - RNA, 13 nt, Homo sapiens
caggcaagcaccu

SEQ ID NO: 1908623 - RNA, 20 nt, Homo sapiens
uucagcacccugggugccau

SEQ ID NO: 1908624 - RNA, 18 nt, Homo sapiens
uuccaaguuuauugcccu

SEQ ID NO: 1908625 - RNA, 14 nt, Homo sapiens
ccggcuccugucau

SEQ ID NO: 1908626 - RNA, 19 nt, Homo sapiens
uaugccugacuaauuuugu

SEQ ID NO: 1908627 - RNA, 23 nt, Homo sapiens
agucuauugucuccuugguuaua

SEQ ID NO: 1908628 - RNA, 21 nt, Homo sapiens
gugccacugcccgagcuggug

SEQ ID NO: 1908629 - RNA, 17 nt, Homo sapiens
gcuccguguuccucggu

SEQ ID NO: 1908630 - RNA, 18 nt, Homo sapiens
cgagacaacagcacacag

SEQ ID NO: 1908631 - RNA, 18 nt, Homo sapiens
aaacuuuaugcuaaguga

SEQ ID NO: 1908632 - RNA, 15 nt, Homo sapiens
agacccccauccagc

SEQ ID NO: 1908633 - RNA, 15 nt, Homo sapiens
auccagccagacccc

SEQ ID NO: 1908634 - RNA, 16 nt, Homo sapiens
gcucagauuauuuaaa

SEQ ID NO: 1908635 - RNA, 23 nt, Homo sapiens
ugcacaucuugucuaauuuucac

SEQ ID NO: 1908636 - RNA, 18 nt, Homo sapiens
uuucacuuguguuuuaaa

SEQ ID NO: 1908637 - RNA, 16 nt, Homo sapiens
uuccucccccaguucc

SEQ ID NO: 1908638 - RNA, 15 nt, Homo sapiens
auugccaaggcaucc

SEQ ID NO: 1908639 - RNA, 22 nt, Homo sapiens
cuaggugggucaacuccaaggc

SEQ ID NO: 1908640 - RNA, 14 nt, Homo sapiens
uucggauuugccau

SEQ ID NO: 1908641 - RNA, 13 nt, Homo sapiens
uucaaagucucac

SEQ ID NO: 1908642 - RNA, 15 nt, Homo sapiens
uuuugaacagaacug

SEQ ID NO: 1908643 - RNA, 18 nt, Homo sapiens
uugcagaaaauucugugc

SEQ ID NO: 1908644 - RNA, 19 nt, Homo sapiens
aggugagcaaaaugcugcu

SEQ ID NO: 1908645 - RNA, 18 nt, Homo sapiens
cuuaacagcccagcacuu

SEQ ID NO: 1908646 - RNA, 19 nt, Homo sapiens
caagugcucaagcagcaaa

SEQ ID NO: 1908647 - RNA, 22 nt, Homo sapiens
ccaccuagagcuagaugugucu

SEQ ID NO: 1908648 - RNA, 22 nt, Homo sapiens
acagauuuuuuuaacgagaaaa

SEQ ID NO: 1908649 - RNA, 17 nt, Homo sapiens
cccgaauuuagucacac

SEQ ID NO: 1908650 - RNA, 19 nt, Homo sapiens
uugcugaauuaaggaucau

SEQ ID NO: 1908651 - RNA, 20 nt, Homo sapiens
ugagagcccaaucacugccu

SEQ ID NO: 1908652 - RNA, 14 nt, Homo sapiens
aggccucagccuca

SEQ ID NO: 1908653 - RNA, 19 nt, Homo sapiens
cagccaagggcagaucaca

SEQ ID NO: 1908654 - RNA, 19 nt, Homo sapiens
acagucccccacccaccuc

SEQ ID NO: 1908655 - RNA, 20 nt, Homo sapiens
caaagggcaugggucgggag

SEQ ID NO: 1908656 - RNA, 14 nt, Homo sapiens
uauaugcacauaua

SEQ ID NO: 1908657 - RNA, 21 nt, Homo sapiens
ucccgguguaugcagugguga

SEQ ID NO: 1908658 - RNA, 14 nt, Homo sapiens
aacaacaaaggaag

SEQ ID NO: 1908659 - RNA, 16 nt, Homo sapiens
caaaugugcugucaaa

SEQ ID NO: 1908660 - RNA, 16 nt, Homo sapiens
gaauaaagcccuugaa

SEQ ID NO: 1908661 - RNA, 15 nt, Homo sapiens
aauagguagagucau

SEQ ID NO: 1908662 - RNA, 18 nt, Homo sapiens
cauaaaagccgcccagug

SEQ ID NO: 1908663 - RNA, 19 nt, Homo sapiens
aagcuagaugccccugcag

SEQ ID NO: 1908664 - RNA, 13 nt, Homo sapiens
cugaaaauugcaa

SEQ ID NO: 1908665 - RNA, 19 nt, Homo sapiens
uaaggauuauaaacaaccu

SEQ ID NO: 1908666 - RNA, 22 nt, Homo sapiens
aauaugugaugauuaauacaau

SEQ ID NO: 1908667 - RNA, 14 nt, Homo sapiens
uuauguacuugaua

SEQ ID NO: 1908668 - RNA, 14 nt, Homo sapiens
aaauuuacaagaga

SEQ ID NO: 1908669 - RNA, 18 nt, Homo sapiens
uggaacauuggaauguuc

SEQ ID NO: 1908670 - RNA, 21 nt, Homo sapiens
uucuuaaccauucuacugugu

SEQ ID NO: 1908671 - RNA, 17 nt, Homo sapiens
cucaaaauauccuaaga

SEQ ID NO: 1908672 - RNA, 14 nt, Homo sapiens
acacauacaacuuc

SEQ ID NO: 1908673 - RNA, 16 nt, Homo sapiens
ucagaaggagcuacaa

SEQ ID NO: 1908674 - RNA, 19 nt, Homo sapiens
uugaaaaccaacaccauca

SEQ ID NO: 1908675 - RNA, 13 nt, Homo sapiens
uucuccuuugcac

SEQ ID NO: 1908676 - RNA, 21 nt, Homo sapiens
ccucaucaggaguuccagugc

SEQ ID NO: 1908677 - RNA, 16 nt, Homo sapiens
uccuuauuucacugaa

SEQ ID NO: 1908678 - RNA, 23 nt, Homo sapiens
uguaacuugaagguggcuacaaa

SEQ ID NO: 1908679 - RNA, 21 nt, Homo sapiens
ugacaaccgagaagguuuauc

SEQ ID NO: 1908680 - RNA, 16 nt, Homo sapiens
cauuagagaguggcaa

SEQ ID NO: 1908681 - RNA, 15 nt, Homo sapiens
cacuaugagcuuuca

SEQ ID NO: 1908682 - RNA, 18 nt, Homo sapiens
cauaauugcuuauguaug

SEQ ID NO: 1908683 - RNA, 21 nt, Homo sapiens
uggagacccaccccaccugca

SEQ ID NO: 1908684 - RNA, 19 nt, Homo sapiens
ucaggcaguucccuguuga

SEQ ID NO: 1908685 - RNA, 15 nt, Homo sapiens
uauaucuuguuuaca

SEQ ID NO: 1908686 - RNA, 19 nt, Homo sapiens
cuggggccccuaagcuccu

SEQ ID NO: 1908687 - RNA, 18 nt, Homo sapiens
acacacagauaugcacac

SEQ ID NO: 1908688 - RNA, 21 nt, Homo sapiens
uucccuaucucgaacauggaa

SEQ ID NO: 1908689 - RNA, 17 nt, Homo sapiens
cugaaauaaaauucauu

SEQ ID NO: 1908690 - RNA, 14 nt, Homo sapiens
ggcaggccagggga

SEQ ID NO: 1908691 - RNA, 18 nt, Homo sapiens
augguccuggaggaugac

SEQ ID NO: 1908692 - RNA, 16 nt, Homo sapiens
caaguuguguuugaua

SEQ ID NO: 1908693 - RNA, 19 nt, Homo sapiens
uuaaugcugucuuugugga

SEQ ID NO: 1908694 - RNA, 17 nt, Homo sapiens
cacacaccgaugugcgc

SEQ ID NO: 1908695 - RNA, 18 nt, Homo sapiens
ccgugaagauacuuugua

SEQ ID NO: 1908696 - RNA, 19 nt, Homo sapiens
ugaacucacccccaugauc

SEQ ID NO: 1908697 - RNA, 15 nt, Homo sapiens
ugacaaugcugccau

SEQ ID NO: 1908698 - RNA, 20 nt, Homo sapiens
ugauuucuccaaccacucau

SEQ ID NO: 1908699 - RNA, 18 nt, Homo sapiens
cucuccaaauagcauuag

SEQ ID NO: 1908700 - RNA, 13 nt, Homo sapiens
uuuacaugugaug

SEQ ID NO: 1908701 - RNA, 17 nt, Homo sapiens
uccugaaaaaugcucaa

SEQ ID NO: 1908702 - RNA, 13 nt, Homo sapiens
auaaguaggccau

SEQ ID NO: 1908703 - RNA, 15 nt, Homo sapiens
gaaacaugugccccu

SEQ ID NO: 1908704 - RNA, 13 nt, Homo sapiens
ggcuuuaugcaaa

SEQ ID NO: 1908705 - RNA, 13 nt, Homo sapiens
ucauauauugcau

SEQ ID NO: 1908706 - RNA, 14 nt, Homo sapiens
aguccucuacugcu

SEQ ID NO: 1908707 - RNA, 14 nt, Homo sapiens
agagaucuacacau

SEQ ID NO: 1908708 - RNA, 19 nt, Homo sapiens
uguaaaugagacacauaca

SEQ ID NO: 1908709 - RNA, 12 nt, Homo sapiens
aauggugcaaaa

SEQ ID NO: 1908710 - RNA, 17 nt, Homo sapiens
guaaugcagacauuuac

SEQ ID NO: 1908711 - RNA, 18 nt, Homo sapiens
aggagccagccaggacuc

SEQ ID NO: 1908712 - RNA, 20 nt, Homo sapiens
cagagugaacacucuuggua

SEQ ID NO: 1908713 - RNA, 23 nt, Homo sapiens
gccuguucuuuuaccacugacag

SEQ ID NO: 1908714 - RNA, 18 nt, Homo sapiens
uugaauaaagccugcuuu

SEQ ID NO: 1908715 - RNA, 23 nt, Homo sapiens
uuuaccuuguggaugcuagugcu

SEQ ID NO: 1908716 - RNA, 16 nt, Homo sapiens
aucagccauuugccau

SEQ ID NO: 1908717 - RNA, 15 nt, Homo sapiens
accaaauacaugaua

SEQ ID NO: 1908718 - RNA, 12 nt, Homo sapiens
uuagaguuuacu

SEQ ID NO: 1908719 - RNA, 16 nt, Homo sapiens
agggacgaucuuugaa

SEQ ID NO: 1908720 - RNA, 16 nt, Homo sapiens
uccauucucuuucaau

SEQ ID NO: 1908721 - RNA, 13 nt, Homo sapiens
ccuccccaguuca

SEQ ID NO: 1908722 - RNA, 13 nt, Homo sapiens
cuuccccagcuca

SEQ ID NO: 1908723 - RNA, 16 nt, Homo sapiens
gcacacggaugcacag

SEQ ID NO: 1908724 - RNA, 18 nt, Homo sapiens
aucugggaaagacaucca

SEQ ID NO: 1908725 - RNA, 20 nt, Homo sapiens
uaaagaaaaauaugauacuc

SEQ ID NO: 1908726 - RNA, 21 nt, Homo sapiens
uugccugaaguuggagugagu

SEQ ID NO: 1908727 - RNA, 18 nt, Homo sapiens
aacaucauaacccaugaa

SEQ ID NO: 1908728 - RNA, 20 nt, Homo sapiens
gugauaaugccccaaggaca

SEQ ID NO: 1908729 - RNA, 15 nt, Homo sapiens
gacauugaaagugaa

SEQ ID NO: 1908730 - RNA, 17 nt, Homo sapiens
ccugaccucaggugaug

SEQ ID NO: 1908731 - RNA, 15 nt, Homo sapiens
agucuggugcuccag

SEQ ID NO: 1908732 - RNA, 12 nt, Homo sapiens
acuuuaagcauu

SEQ ID NO: 1908733 - RNA, 19 nt, Homo sapiens
gagcaccuuugcacaggau

SEQ ID NO: 1908734 - RNA, 14 nt, Homo sapiens
guugaaacugcuau

SEQ ID NO: 1908735 - RNA, 13 nt, Homo sapiens
agaaaaacaauaa

SEQ ID NO: 1908736 - RNA, 20 nt, Homo sapiens
ucugcucacauaucugucau

SEQ ID NO: 1908737 - RNA, 22 nt, Homo sapiens
caggugagcugaagacaaacca

SEQ ID NO: 1908738 - RNA, 22 nt, Homo sapiens
gucuggggacgaaggguuggac

SEQ ID NO: 1908739 - RNA, 17 nt, Homo sapiens
gcccuggcuccuugcag

SEQ ID NO: 1908740 - RNA, 18 nt, Homo sapiens
gacaaucuagcacuuuaa

SEQ ID NO: 1908741 - RNA, 18 nt, Homo sapiens
cccaauuaagaaauucca

SEQ ID NO: 1908742 - RNA, 15 nt, Homo sapiens
uggaguuucucuguu

SEQ ID NO: 1908743 - RNA, 12 nt, Homo sapiens
ugcaucuacuca

SEQ ID NO: 1908744 - RNA, 21 nt, Homo sapiens
ccuagagaugggcagggccua

SEQ ID NO: 1908745 - RNA, 17 nt, Homo sapiens
cgucauguguuuugcca

SEQ ID NO: 1908746 - RNA, 16 nt, Homo sapiens
caaucagcacucugua

SEQ ID NO: 1908747 - RNA, 12 nt, Homo sapiens
ggcgagcuguuc

SEQ ID NO: 1908748 - RNA, 13 nt, Homo sapiens
agcugaguggcag

SEQ ID NO: 1908749 - RNA, 16 nt, Homo sapiens
ccuggggugcugccuc

SEQ ID NO: 1908750 - RNA, 19 nt, Homo sapiens
cugucaaagaaucaaucca

SEQ ID NO: 1908751 - RNA, 19 nt, Homo sapiens
cccaagcagagaagcucuc

SEQ ID NO: 1908752 - RNA, 18 nt, Homo sapiens
ucauguaaauaauacauu

SEQ ID NO: 1908753 - RNA, 15 nt, Homo sapiens
aaguacuuuaccuga

SEQ ID NO: 1908754 - RNA, 12 nt, Homo sapiens
uuuggaagacca

SEQ ID NO: 1908755 - RNA, 22 nt, Homo sapiens
aaauuucugcccugagcccucc

SEQ ID NO: 1908756 - RNA, 22 nt, Homo sapiens
cuaugcgggggugccuaaggag

SEQ ID NO: 1908757 - RNA, 19 nt, Homo sapiens
gaaggugaaagugcaguuc

SEQ ID NO: 1908758 - RNA, 14 nt, Homo sapiens
auguauaucauucu

SEQ ID NO: 1908759 - RNA, 16 nt, Homo sapiens
ccagcguggcgcagug

SEQ ID NO: 1908760 - RNA, 18 nt, Homo sapiens
aacugggaaaacagugaa

SEQ ID NO: 1908761 - RNA, 11 nt, Homo sapiens
aaugcucucuc

SEQ ID NO: 1908762 - RNA, 22 nt, Homo sapiens
gcauuaaaccugucuccacugu

SEQ ID NO: 1908763 - RNA, 19 nt, Homo sapiens
auguuuacaggaacccagc

SEQ ID NO: 1908764 - RNA, 15 nt, Homo sapiens
guaaauaugacuccu

SEQ ID NO: 1908765 - RNA, 22 nt, Homo sapiens
aaucucuaauagaggcauuacu

SEQ ID NO: 1908766 - RNA, 23 nt, Homo sapiens
ggaagaccagcuuugcagugaca

SEQ ID NO: 1908767 - RNA, 18 nt, Homo sapiens
ucaaccugggcaaagccu

SEQ ID NO: 1908768 - RNA, 18 nt, Homo sapiens
aguuacuagguaacuuca

SEQ ID NO: 1908769 - RNA, 17 nt, Homo sapiens
uaagccuaaaugccuua

SEQ ID NO: 1908770 - RNA, 17 nt, Homo sapiens
aaacauuuuaucauuaa

SEQ ID NO: 1908771 - RNA, 15 nt, Homo sapiens
augugaggguuugua

SEQ ID NO: 1908772 - RNA, 23 nt, Homo sapiens
cuaagaauguacaguugagcuca

SEQ ID NO: 1908773 - RNA, 13 nt, Homo sapiens
auaaguuauccaa

SEQ ID NO: 1908774 - RNA, 16 nt, Homo sapiens
ucccaacaagugcucu

SEQ ID NO: 1908775 - RNA, 18 nt, Homo sapiens
uagcacaaagaugugcaa

SEQ ID NO: 1908776 - RNA, 17 nt, Homo sapiens
cucccuccucagucuuu

SEQ ID NO: 1908777 - RNA, 19 nt, Homo sapiens
uuauauuccugagaaugaa

SEQ ID NO: 1908778 - RNA, 21 nt, Homo sapiens
gccugcagcaggaguggugca

SEQ ID NO: 1908779 - RNA, 16 nt, Homo sapiens
gagaaauuaccaaaau

SEQ ID NO: 1908780 - RNA, 17 nt, Homo sapiens
aaaguaauuucuucuca

SEQ ID NO: 1908781 - RNA, 14 nt, Homo sapiens
caagguauuacacu

SEQ ID NO: 1908782 - RNA, 17 nt, Homo sapiens
ugcucuuuuauacugua

SEQ ID NO: 1908783 - RNA, 15 nt, Homo sapiens
ccugcuuugaauaaa

SEQ ID NO: 1908784 - RNA, 17 nt, Homo sapiens
aggccauggauggaaaa

SEQ ID NO: 1908785 - RNA, 19 nt, Homo sapiens
cacuaugaagauguuucaa

SEQ ID NO: 1908786 - RNA, 22 nt, Homo sapiens
gaaggaacauugcagagcuaag

SEQ ID NO: 1908787 - RNA, 20 nt, Homo sapiens
ugucauuuacccugguggag

SEQ ID NO: 1908788 - RNA, 15 nt, Homo sapiens
cuaaaauauuucauu

SEQ ID NO: 1908789 - RNA, 18 nt, Homo sapiens
cuugcaccucugaccuau

SEQ ID NO: 1908790 - RNA, 20 nt, Homo sapiens
cuccuugagagaccaggcaa

SEQ ID NO: 1908791 - RNA, 15 nt, Homo sapiens
auucccauguggaac

SEQ ID NO: 1908792 - RNA, 16 nt, Homo sapiens
ccaagacagagacaga

SEQ ID NO: 1908793 - RNA, 20 nt, Homo sapiens
uagagaguugagacuugcca

SEQ ID NO: 1908794 - RNA, 18 nt, Homo sapiens
agauaccagaauguugcu

SEQ ID NO: 1908795 - RNA, 16 nt, Homo sapiens
gggccugcagaaggaa

SEQ ID NO: 1908796 - RNA, 19 nt, Homo sapiens
aacuagauaacauacuucu

SEQ ID NO: 1908797 - RNA, 23 nt, Homo sapiens
cucagagcuccacagaagacacg

SEQ ID NO: 1908798 - RNA, 22 nt, Homo sapiens
cuugaauuccauggaauuucua

SEQ ID NO: 1908799 - RNA, 15 nt, Homo sapiens
uaguccugacacuga

SEQ ID NO: 1908800 - RNA, 16 nt, Homo sapiens
cccagugcugcuguaa

SEQ ID NO: 1908801 - RNA, 16 nt, Homo sapiens
auccagcuaugaauau

SEQ ID NO: 1908802 - RNA, 18 nt, Homo sapiens
ugcaccaaguacagccuu

SEQ ID NO: 1908803 - RNA, 21 nt, Homo sapiens
gccugaauuggcuaugcagua

SEQ ID NO: 1908804 - RNA, 13 nt, Homo sapiens
cuguuuugagcca

SEQ ID NO: 1908805 - RNA, 19 nt, Homo sapiens
gaggcugcuuuccaaagcc

SEQ ID NO: 1908806 - RNA, 15 nt, Homo sapiens
uaggaggcuggccaa

SEQ ID NO: 1908807 - RNA, 11 nt, Homo sapiens
auaaagacagg

SEQ ID NO: 1908808 - RNA, 20 nt, Homo sapiens
auuuuaaguguucucgggga

SEQ ID NO: 1908809 - RNA, 22 nt, Homo sapiens
cuuguuuuaacguucugcugcu

SEQ ID NO: 1908810 - RNA, 21 nt, Homo sapiens
aucacauuauuugcauguuac

SEQ ID NO: 1908811 - RNA, 22 nt, Homo sapiens
uguaauaaacucauuucuagca

SEQ ID NO: 1908812 - RNA, 12 nt, Homo sapiens
uacaaccuguga

SEQ ID NO: 1908813 - RNA, 15 nt, Homo sapiens
cugaaugagacuuaa

SEQ ID NO: 1908814 - RNA, 16 nt, Homo sapiens
ugacuaccagcuaacu

SEQ ID NO: 1908815 - RNA, 17 nt, Homo sapiens
uaugcaaauacaaucag

SEQ ID NO: 1908816 - RNA, 17 nt, Homo sapiens
agcugggccugugcacu

SEQ ID NO: 1908817 - RNA, 16 nt, Homo sapiens
ucccauggucaaugca

SEQ ID NO: 1908818 - RNA, 13 nt, Homo sapiens
ccuuccuugaacc

SEQ ID NO: 1908819 - RNA, 17 nt, Homo sapiens
cugaaagccacagacaa

SEQ ID NO: 1908820 - RNA, 22 nt, Homo sapiens
ggcucagcuccuucaugagauc

SEQ ID NO: 1908821 - RNA, 16 nt, Homo sapiens
augccucaauucacau

SEQ ID NO: 1908822 - RNA, 15 nt, Homo sapiens
uucucacgucuccua

SEQ ID NO: 1908823 - RNA, 12 nt, Homo sapiens
agaaccaaaaaa

SEQ ID NO: 1908824 - RNA, 16 nt, Homo sapiens
aagaaaggaacugagg

SEQ ID NO: 1908825 - RNA, 20 nt, Homo sapiens
cuuuaguguauuuucuguca

SEQ ID NO: 1908826 - RNA, 14 nt, Homo sapiens
gguuacaauuagaa

SEQ ID NO: 1908827 - RNA, 23 nt, Homo sapiens
caacauggucuaauuauuuacuc

SEQ ID NO: 1908828 - RNA, 18 nt, Homo sapiens
guugauuuuaaugaaugc

SEQ ID NO: 1908829 - RNA, 17 nt, Homo sapiens
cauugcgugauucaaug

SEQ ID NO: 1908830 - RNA, 15 nt, Homo sapiens
accacuucuccaugc

SEQ ID NO: 1908831 - RNA, 22 nt, Homo sapiens
ucucuagggcuaguagaacugg

SEQ ID NO: 1908832 - RNA, 13 nt, Homo sapiens
uagaccuaaaaua

SEQ ID NO: 1908833 - RNA, 18 nt, Homo sapiens
uggauuuugcauguaaua

SEQ ID NO: 1908834 - RNA, 14 nt, Homo sapiens
uggguggaaagugc

SEQ ID NO: 1908835 - RNA, 16 nt, Homo sapiens
ccucugagccacugga

SEQ ID NO: 1908836 - RNA, 20 nt, Homo sapiens
uguuacaacuuguauuucca

SEQ ID NO: 1908837 - RNA, 22 nt, Homo sapiens
cuucuauugacccacaaaguuu

SEQ ID NO: 1908838 - RNA, 12 nt, Homo sapiens
cuaggaccucau

SEQ ID NO: 1908839 - RNA, 18 nt, Homo sapiens
ugguggaacaaccugcug

SEQ ID NO: 1908840 - RNA, 21 nt, Homo sapiens
cuuuugaugaugucuacagaa

SEQ ID NO: 1908841 - RNA, 13 nt, Homo sapiens
agauaauuggcaa

SEQ ID NO: 1908842 - RNA, 22 nt, Homo sapiens
cuuuguacacgaagaccaucca

SEQ ID NO: 1908843 - RNA, 16 nt, Homo sapiens
uacugcugcacuuuca

SEQ ID NO: 1908844 - RNA, 18 nt, Homo sapiens
ucccaugguagacuguga

SEQ ID NO: 1908845 - RNA, 16 nt, Homo sapiens
ucucuuagcaacucag

SEQ ID NO: 1908846 - RNA, 20 nt, Homo sapiens
aacagccccucuggacacag

SEQ ID NO: 1908847 - RNA, 18 nt, Homo sapiens
aaacucagaucugaucaa

SEQ ID NO: 1908848 - RNA, 20 nt, Homo sapiens
uuagacccucaugcugccaa

SEQ ID NO: 1908849 - RNA, 22 nt, Homo sapiens
ggaaagagccuaacaucuccau

SEQ ID NO: 1908850 - RNA, 12 nt, Homo sapiens
aaacuccauuga

SEQ ID NO: 1908851 - RNA, 22 nt, Homo sapiens
cacucacgaauauuaugcccag

SEQ ID NO: 1908852 - RNA, 18 nt, Homo sapiens
cuguauguuuuuacugaa

SEQ ID NO: 1908853 - RNA, 16 nt, Homo sapiens
aguauuuacugugcua

SEQ ID NO: 1908854 - RNA, 21 nt, Homo sapiens
acacgccagcuccucucugaa

SEQ ID NO: 1908855 - RNA, 22 nt, Homo sapiens
uaccaguauaagcaucugccau

SEQ ID NO: 1908856 - RNA, 23 nt, Homo sapiens
aaaaauucagugaugugccuaaa

SEQ ID NO: 1908857 - RNA, 14 nt, Homo sapiens
cuucagcaucucac

SEQ ID NO: 1908858 - RNA, 14 nt, Homo sapiens
cguuuuaaggacau

SEQ ID NO: 1908859 - RNA, 11 nt, Homo sapiens
aggucuugccu

SEQ ID NO: 1908860 - RNA, 21 nt, Homo sapiens
uaagauauuuuucagcuacag

SEQ ID NO: 1908861 - RNA, 16 nt, Homo sapiens
cugggcccaagacaga

SEQ ID NO: 1908862 - RNA, 14 nt, Homo sapiens
gcuaggaagugacc

SEQ ID NO: 1908863 - RNA, 22 nt, Homo sapiens
accgugauucuugaaaggugua

SEQ ID NO: 1908864 - RNA, 16 nt, Homo sapiens
cacagucacauuccaa

SEQ ID NO: 1908865 - RNA, 22 nt, Homo sapiens
gcagccaccagggaguggccau

SEQ ID NO: 1908866 - RNA, 11 nt, Homo sapiens
acugaccaguu

SEQ ID NO: 1908867 - RNA, 18 nt, Homo sapiens
uaaaccguggucucaugu

SEQ ID NO: 1908868 - RNA, 17 nt, Homo sapiens
ucccugggcagugcucc

SEQ ID NO: 1908869 - RNA, 20 nt, Homo sapiens
cacauccucugucuauuuga

SEQ ID NO: 1908870 - RNA, 19 nt, Homo sapiens
uggaacaguguuuacuuua

SEQ ID NO: 1908871 - RNA, 18 nt, Homo sapiens
agugcugccaguuuccca

SEQ ID NO: 1908872 - RNA, 22 nt, Homo sapiens
cuccaaggcaaauguccaagca

SEQ ID NO: 1908873 - RNA, 13 nt, Homo sapiens
gcuggaagggaaa

SEQ ID NO: 1908874 - RNA, 16 nt, Homo sapiens
aagugccuuuaucuca

SEQ ID NO: 1908875 - RNA, 17 nt, Homo sapiens
uccacaguuuugccuua

SEQ ID NO: 1908876 - RNA, 16 nt, Homo sapiens
ucccaucugauuuacu

SEQ ID NO: 1908877 - RNA, 21 nt, Homo sapiens
aaggaaacuagcuuacaugag

SEQ ID NO: 1908878 - RNA, 22 nt, Homo sapiens
acagccauaaaaaggaacaaga

SEQ ID NO: 1908879 - RNA, 17 nt, Homo sapiens
agguuucaagacuugau

SEQ ID NO: 1908880 - RNA, 14 nt, Homo sapiens
gauuucucuuugaa

SEQ ID NO: 1908881 - RNA, 17 nt, Homo sapiens
caaaaaucaaacuuuac

SEQ ID NO: 1908882 - RNA, 19 nt, Homo sapiens
gagcuuguggaguugauga

SEQ ID NO: 1908883 - RNA, 20 nt, Homo sapiens
ucagugccuucaacaacgug

SEQ ID NO: 1908884 - RNA, 19 nt, Homo sapiens
cauacacacguuaccagac

SEQ ID NO: 1908885 - RNA, 19 nt, Homo sapiens
uaaggcccucuugaaucuc

SEQ ID NO: 1908886 - RNA, 19 nt, Homo sapiens
accgaccccuccccagugc

SEQ ID NO: 1908887 - RNA, 14 nt, Homo sapiens
ccccgacuucaucc

SEQ ID NO: 1908888 - RNA, 11 nt, Homo sapiens
cuuaaaagcca

SEQ ID NO: 1908889 - RNA, 16 nt, Homo sapiens
ccuggccccagugacc

SEQ ID NO: 1908890 - RNA, 21 nt, Homo sapiens
cucaugugcuuuguagcuuaa

SEQ ID NO: 1908891 - RNA, 15 nt, Homo sapiens
ucaucuguaccucug

SEQ ID NO: 1908892 - RNA, 22 nt, Homo sapiens
agacagcuuacugcagcacugu

SEQ ID NO: 1908893 - RNA, 23 nt, Homo sapiens
uuucuggggaaagacacugccug

SEQ ID NO: 1908894 - RNA, 14 nt, Homo sapiens
ugcacuaaaaguga

SEQ ID NO: 1908895 - RNA, 17 nt, Homo sapiens
aaugggaaucauuccac

SEQ ID NO: 1908896 - RNA, 17 nt, Homo sapiens
uguagaugacaaccucc

SEQ ID NO: 1908897 - RNA, 22 nt, Homo sapiens
ugggauggggcuucacugcugu

SEQ ID NO: 1908898 - RNA, 16 nt, Homo sapiens
auauaugcaggaaaga

SEQ ID NO: 1908899 - RNA, 22 nt, Homo sapiens
uugagguaauaaugacacuccu

SEQ ID NO: 1908900 - RNA, 16 nt, Homo sapiens
aauuuauacuuaaaaa

SEQ ID NO: 1908901 - RNA, 23 nt, Homo sapiens
uggagccuuuuaacugugcaaua

SEQ ID NO: 1908902 - RNA, 20 nt, Homo sapiens
ugauacaagaagcacugaca

SEQ ID NO: 1908903 - RNA, 17 nt, Homo sapiens
agcuuaggaaagaacau

SEQ ID NO: 1908904 - RNA, 20 nt, Homo sapiens
gauaagcacuagaucucccu

SEQ ID NO: 1908905 - RNA, 22 nt, Homo sapiens
uaggcauuaaaugcaaaaauau

SEQ ID NO: 1908906 - RNA, 23 nt, Homo sapiens
ugcaaaauacuguacauugugaa

SEQ ID NO: 1908907 - RNA, 23 nt, Homo sapiens
uuacaaucgagacugcaauguga

SEQ ID NO: 1908908 - RNA, 13 nt, Homo sapiens
uuggccaaaaaga

SEQ ID NO: 1908909 - RNA, 19 nt, Homo sapiens
guccaagugugugugcgug

SEQ ID NO: 1908910 - RNA, 13 nt, Homo sapiens
acagaauuccacc

SEQ ID NO: 1908911 - RNA, 17 nt, Homo sapiens
cccugaaaacccagaga

SEQ ID NO: 1908912 - RNA, 15 nt, Homo sapiens
aaaacagaacaauua

SEQ ID NO: 1908913 - RNA, 19 nt, Homo sapiens
uuucauuaguagcuaggug

SEQ ID NO: 1908914 - RNA, 22 nt, Homo sapiens
uaaaaagaaacaaaaucuauaa

SEQ ID NO: 1908915 - RNA, 17 nt, Homo sapiens
uucuuuuaaugaugcca

SEQ ID NO: 1908916 - RNA, 16 nt, Homo sapiens
cugcacucuaaacugc

SEQ ID NO: 1908917 - RNA, 15 nt, Homo sapiens
aagaauuacauauga

SEQ ID NO: 1908918 - RNA, 16 nt, Homo sapiens
gaugaaauugccaaaa

SEQ ID NO: 1908919 - RNA, 22 nt, Homo sapiens
caaauaaaggaaacccagcuca

SEQ ID NO: 1908920 - RNA, 14 nt, Homo sapiens
cauuccccagcucc

SEQ ID NO: 1908921 - RNA, 12 nt, Homo sapiens
caauaaugcagu

SEQ ID NO: 1908922 - RNA, 22 nt, Homo sapiens
augcacaguacaauaauguacu

SEQ ID NO: 1908923 - RNA, 16 nt, Homo sapiens
uuucaucuuuguggau

SEQ ID NO: 1908924 - RNA, 19 nt, Homo sapiens
uguccccuccacugucaca

SEQ ID NO: 1908925 - RNA, 23 nt, Homo sapiens
ucuaucugaaaucccaacaaaaa

SEQ ID NO: 1908926 - RNA, 16 nt, Homo sapiens
gacgcacagugcaguu

SEQ ID NO: 1908927 - RNA, 21 nt, Homo sapiens
ccugaauaccacuuaccucaa

SEQ ID NO: 1908928 - RNA, 18 nt, Homo sapiens
augauuacuauaugcaaa

SEQ ID NO: 1908929 - RNA, 22 nt, Homo sapiens
uaaaauaaaaguaccuauugaa

SEQ ID NO: 1908930 - RNA, 17 nt, Homo sapiens
uagcauaucugccuuua

SEQ ID NO: 1908931 - RNA, 13 nt, Homo sapiens
uuaccaacuacau

SEQ ID NO: 1908932 - RNA, 12 nt, Homo sapiens
ccaauccccucc

SEQ ID NO: 1908933 - RNA, 17 nt, Homo sapiens
acuaccaauuucuuuua

SEQ ID NO: 1908934 - RNA, 16 nt, Homo sapiens
ccauuugugaagcuua

SEQ ID NO: 1908935 - RNA, 17 nt, Homo sapiens
ggcagggcccacgugua

SEQ ID NO: 1908936 - RNA, 13 nt, Homo sapiens
gggggccaacuca

SEQ ID NO: 1908937 - RNA, 11 nt, Homo sapiens
uaaagacagag

SEQ ID NO: 1908938 - RNA, 17 nt, Homo sapiens
auggagggugcccagca

SEQ ID NO: 1908939 - RNA, 18 nt, Homo sapiens
ugaccccagaaacugaac

SEQ ID NO: 1908940 - RNA, 14 nt, Homo sapiens
gagucaugucaaau

SEQ ID NO: 1908941 - RNA, 17 nt, Homo sapiens
uuagaguugcucuacaa

SEQ ID NO: 1908942 - RNA, 16 nt, Homo sapiens
agauggacagcgauga

SEQ ID NO: 1908943 - RNA, 15 nt, Homo sapiens
caauaagccauucua

SEQ ID NO: 1908944 - RNA, 14 nt, Homo sapiens
agugagaacaugca

SEQ ID NO: 1908945 - RNA, 17 nt, Homo sapiens
aagguagagucuuacaa

SEQ ID NO: 1908946 - RNA, 18 nt, Homo sapiens
aagucaguaucauauuau

SEQ ID NO: 1908947 - RNA, 16 nt, Homo sapiens
auucaguaaauuuugg

SEQ ID NO: 1908948 - RNA, 14 nt, Homo sapiens
cccuuugccuucau

SEQ ID NO: 1908949 - RNA, 23 nt, Homo sapiens
uagaagagacguuuaaaagccau

SEQ ID NO: 1908950 - RNA, 12 nt, Homo sapiens
gaacacuggggg

SEQ ID NO: 1908951 - RNA, 19 nt, Homo sapiens
acuauaauugagaacuaca

SEQ ID NO: 1908952 - RNA, 17 nt, Homo sapiens
gguaacuuggcugcauu

SEQ ID NO: 1908953 - RNA, 17 nt, Homo sapiens
ccaagugugugugcgug

SEQ ID NO: 1908954 - RNA, 16 nt, Homo sapiens
uugguaauagauuuaa

SEQ ID NO: 1908955 - RNA, 20 nt, Homo sapiens
acaagucauaccuacauuca

SEQ ID NO: 1908956 - RNA, 15 nt, Homo sapiens
accagagugggacca

SEQ ID NO: 1908957 - RNA, 15 nt, Homo sapiens
guuaguaauaccucu

SEQ ID NO: 1908958 - RNA, 15 nt, Homo sapiens
cagugccaagcacag

SEQ ID NO: 1908959 - RNA, 15 nt, Homo sapiens
cuguauagcugcuuc

SEQ ID NO: 1908960 - RNA, 13 nt, Homo sapiens
gucaccugugcua

SEQ ID NO: 1908961 - RNA, 15 nt, Homo sapiens
aauccugucauauaa

SEQ ID NO: 1908962 - RNA, 20 nt, Homo sapiens
acauaaaggcuaacuaugag

SEQ ID NO: 1908963 - RNA, 22 nt, Homo sapiens
uaguuucccuacugaacccugc

SEQ ID NO: 1908964 - RNA, 16 nt, Homo sapiens
agaaucaacagaucaa

SEQ ID NO: 1908965 - RNA, 14 nt, Homo sapiens
augugaugaucuac

SEQ ID NO: 1908966 - RNA, 14 nt, Homo sapiens
cucagcugcugaaa

SEQ ID NO: 1908967 - RNA, 19 nt, Homo sapiens
gacagucccugccaaugga

SEQ ID NO: 1908968 - RNA, 17 nt, Homo sapiens
ccacccuguguugacac

SEQ ID NO: 1908969 - RNA, 21 nt, Homo sapiens
cugauuuaagguccuaaauuc

SEQ ID NO: 1908970 - RNA, 14 nt, Homo sapiens
uucaauacaaacaa

SEQ ID NO: 1908971 - RNA, 19 nt, Homo sapiens
ucaucaguaaaguaccuuu

SEQ ID NO: 1908972 - RNA, 23 nt, Homo sapiens
aacauccauguccuaugugugac

SEQ ID NO: 1908973 - RNA, 15 nt, Homo sapiens
cccugcccaaugaga

SEQ ID NO: 1908974 - RNA, 19 nt, Homo sapiens
ggaaggccuugcugucaug

SEQ ID NO: 1908975 - RNA, 16 nt, Homo sapiens
ugauugggauuuccau

SEQ ID NO: 1908976 - RNA, 11 nt, Homo sapiens
aaaccaagaag

SEQ ID NO: 1908977 - RNA, 21 nt, Homo sapiens
aacaaggcauugaaucucuaa

SEQ ID NO: 1908978 - RNA, 23 nt, Homo sapiens
caaccuccccugguccugcacug

SEQ ID NO: 1908979 - RNA, 19 nt, Homo sapiens
aaacuugaggcagagucuu

SEQ ID NO: 1908980 - RNA, 20 nt, Homo sapiens
aagcaaacaaauauugccaa

SEQ ID NO: 1908981 - RNA, 14 nt, Homo sapiens
accaucucugugau

SEQ ID NO: 1908982 - RNA, 20 nt, Homo sapiens
cacugccuggaggcucugua

SEQ ID NO: 1908983 - RNA, 13 nt, Homo sapiens
uuuccugugacaa

SEQ ID NO: 1908984 - RNA, 13 nt, Homo sapiens
guuccuguuacaa

SEQ ID NO: 1908985 - RNA, 15 nt, Homo sapiens
cuacugaacuguuac

SEQ ID NO: 1908986 - RNA, 15 nt, Homo sapiens
aauauugaaaugcug

SEQ ID NO: 1908987 - RNA, 14 nt, Homo sapiens
uauguuugcacuuu

SEQ ID NO: 1908988 - RNA, 14 nt, Homo sapiens
aacccuuacaguga

SEQ ID NO: 1908989 - RNA, 18 nt, Homo sapiens
ggcugggugagcugagau

SEQ ID NO: 1908990 - RNA, 13 nt, Homo sapiens
auaguacuggcau

SEQ ID NO: 1908991 - RNA, 13 nt, Homo sapiens
agcacacuguagc

SEQ ID NO: 1908992 - RNA, 23 nt, Homo sapiens
ugaauaguuuauuucugugaaag

SEQ ID NO: 1908993 - RNA, 13 nt, Homo sapiens
gauucuugcugcu

SEQ ID NO: 1908994 - RNA, 22 nt, Homo sapiens
guagauucccuugcacuguauc

SEQ ID NO: 1908995 - RNA, 23 nt, Homo sapiens
caugucaccucagcugauauuau

SEQ ID NO: 1908996 - RNA, 13 nt, Homo sapiens
ggcucccucugcu

SEQ ID NO: 1908997 - RNA, 17 nt, Homo sapiens
accuuuuuucaccccac

SEQ ID NO: 1908998 - RNA, 23 nt, Homo sapiens
auuuaggacuggguuccccacag

SEQ ID NO: 1908999 - RNA, 23 nt, Homo sapiens
acauaacucugcugaauguaaaa

SEQ ID NO: 1909000 - RNA, 20 nt, Homo sapiens
aaccuugugccuggcucaga

SEQ ID NO: 1909001 - RNA, 21 nt, Homo sapiens
aaccaauuuuaaauacauucu

SEQ ID NO: 1909002 - RNA, 20 nt, Homo sapiens
cauuuuguuaaaaucuacuu

SEQ ID NO: 1909003 - RNA, 11 nt, Homo sapiens
guauccaaaaa

SEQ ID NO: 1909004 - RNA, 15 nt, Homo sapiens
ucuaggcagaagaag

SEQ ID NO: 1909005 - RNA, 19 nt, Homo sapiens
ugccccuuuauaaauccaa

SEQ ID NO: 1909006 - RNA, 21 nt, Homo sapiens
cuguggggcccuugggccacg

SEQ ID NO: 1909007 - RNA, 22 nt, Homo sapiens
uuguuugguuagugacugaugu

SEQ ID NO: 1909008 - RNA, 23 nt, Homo sapiens
ucacuauucccgacccaaagggu

SEQ ID NO: 1909009 - RNA, 16 nt, Homo sapiens
acccagggugugaaca

SEQ ID NO: 1909010 - RNA, 12 nt, Homo sapiens
uuguaagccaga

SEQ ID NO: 1909011 - RNA, 19 nt, Homo sapiens
ucugugggcuccauguaga

SEQ ID NO: 1909012 - RNA, 21 nt, Homo sapiens
uugcaauucauaacuaaugaa

SEQ ID NO: 1909013 - RNA, 16 nt, Homo sapiens
ucaagagagauuugau

SEQ ID NO: 1909014 - RNA, 17 nt, Homo sapiens
ucuuugguuugugcuag

SEQ ID NO: 1909015 - RNA, 14 nt, Homo sapiens
cuucagauguuucc

SEQ ID NO: 1909016 - RNA, 12 nt, Homo sapiens
gcuuaacaguuu

SEQ ID NO: 1909017 - RNA, 18 nt, Homo sapiens
caauggaguggcugccau

SEQ ID NO: 1909018 - RNA, 23 nt, Homo sapiens
ugcccuguuguguauagaugcaa

SEQ ID NO: 1909019 - RNA, 21 nt, Homo sapiens
cccuuccucccauuucccauu

SEQ ID NO: 1909020 - RNA, 14 nt, Homo sapiens
cccaacaagugcuc

SEQ ID NO: 1909021 - RNA, 17 nt, Homo sapiens
agacucaaauguucuaa

SEQ ID NO: 1909022 - RNA, 18 nt, Homo sapiens
cauuacccagcuaaauaa

SEQ ID NO: 1909023 - RNA, 18 nt, Homo sapiens
accaucaguucuuuuguc

SEQ ID NO: 1909024 - RNA, 15 nt, Homo sapiens
aucuguaaugauacu

SEQ ID NO: 1909025 - RNA, 22 nt, Homo sapiens
gcucuaugucaauugauauuuc

SEQ ID NO: 1909026 - RNA, 13 nt, Homo sapiens
augaaucugcuca

SEQ ID NO: 1909027 - RNA, 15 nt, Homo sapiens
uuccgacauacauca

SEQ ID NO: 1909028 - RNA, 15 nt, Homo sapiens
cuguuaaaugaacuu

SEQ ID NO: 1909029 - RNA, 15 nt, Homo sapiens
auuuaaaauucaauu

SEQ ID NO: 1909030 - RNA, 19 nt, Homo sapiens
ucugaaaucuccuuuagcc

SEQ ID NO: 1909031 - RNA, 23 nt, Homo sapiens
uuguaaguggucgcuuacuuuga

SEQ ID NO: 1909032 - RNA, 19 nt, Homo sapiens
aucauaagggcacugagcc

SEQ ID NO: 1909033 - RNA, 17 nt, Homo sapiens
aggucuuuuuacauugu

SEQ ID NO: 1909034 - RNA, 17 nt, Homo sapiens
uaucuugcaacuuguua

SEQ ID NO: 1909035 - RNA, 16 nt, Homo sapiens
agcaaaaagacuggau

SEQ ID NO: 1909036 - RNA, 20 nt, Homo sapiens
caaggcugcuucuguuaacu

SEQ ID NO: 1909037 - RNA, 14 nt, Homo sapiens
uguguucugcaaua

SEQ ID NO: 1909038 - RNA, 14 nt, Homo sapiens
auguaaagugucag

SEQ ID NO: 1909039 - RNA, 13 nt, Homo sapiens
aaacaauccaaaa

SEQ ID NO: 1909040 - RNA, 16 nt, Homo sapiens
cucccaacccauucac

SEQ ID NO: 1909041 - RNA, 12 nt, Homo sapiens
gcugggcagcug

SEQ ID NO: 1909042 - RNA, 15 nt, Homo sapiens
guucuguuucagagc

SEQ ID NO: 1909043 - RNA, 12 nt, Homo sapiens
uguuuaaaccca

SEQ ID NO: 1909044 - RNA, 22 nt, Homo sapiens
acuuuaucaaagauuggccaug

SEQ ID NO: 1909045 - RNA, 20 nt, Homo sapiens
uugccuuauuggcagcucua

SEQ ID NO: 1909046 - RNA, 18 nt, Homo sapiens
cauuucagguugugcauu

SEQ ID NO: 1909047 - RNA, 15 nt, Homo sapiens
cucagagcaggcuca

SEQ ID NO: 1909048 - RNA, 19 nt, Homo sapiens
aguuccucagggaguuuga

SEQ ID NO: 1909049 - RNA, 17 nt, Homo sapiens
uggguggggucagggaa

SEQ ID NO: 1909050 - RNA, 14 nt, Homo sapiens
uuuaacugcuucaa

SEQ ID NO: 1909051 - RNA, 16 nt, Homo sapiens
gcacgucuugcuauuu

SEQ ID NO: 1909052 - RNA, 21 nt, Homo sapiens
auuugcuguucacccacaucu

SEQ ID NO: 1909053 - RNA, 20 nt, Homo sapiens
gugagugacaaagccucuga

SEQ ID NO: 1909054 - RNA, 13 nt, Homo sapiens
gccuugugaucac

SEQ ID NO: 1909055 - RNA, 20 nt, Homo sapiens
cccuuacuaugaucucagga

SEQ ID NO: 1909056 - RNA, 15 nt, Homo sapiens
gcaaguuaagagaaa

SEQ ID NO: 1909057 - RNA, 12 nt, Homo sapiens
cggggugcuccu

SEQ ID NO: 1909058 - RNA, 12 nt, Homo sapiens
ggucuaugcaga

SEQ ID NO: 1909059 - RNA, 23 nt, Homo sapiens
agcuaucucucagugaacuguga

SEQ ID NO: 1909060 - RNA, 19 nt, Homo sapiens
ugcuucuuaaaauagccau

SEQ ID NO: 1909061 - RNA, 14 nt, Homo sapiens
ccgaccacuuccag

SEQ ID NO: 1909062 - RNA, 20 nt, Homo sapiens
cacauuggaaggcucccuaa

SEQ ID NO: 1909063 - RNA, 18 nt, Homo sapiens
ugugugaauaccccaaga

SEQ ID NO: 1909064 - RNA, 23 nt, Homo sapiens
uucaacuuggaaaugacacagac

SEQ ID NO: 1909065 - RNA, 11 nt, Homo sapiens
ggacuccucaa

SEQ ID NO: 1909066 - RNA, 23 nt, Homo sapiens
gguuccuggcugcugccaugucu

SEQ ID NO: 1909067 - RNA, 23 nt, Homo sapiens
gugauaaggggccuugcucugag

SEQ ID NO: 1909068 - RNA, 20 nt, Homo sapiens
accuggagcuucagccaggu

SEQ ID NO: 1909069 - RNA, 19 nt, Homo sapiens
caaaggguuuuaagccagg

SEQ ID NO: 1909070 - RNA, 20 nt, Homo sapiens
ccaggcuggcgugcaguggu

SEQ ID NO: 1909071 - RNA, 15 nt, Homo sapiens
cguggaauugacccc

SEQ ID NO: 1909072 - RNA, 19 nt, Homo sapiens
ucgccuuuugacagcugug

SEQ ID NO: 1909073 - RNA, 19 nt, Homo sapiens
aaacucacacaaccaugac

SEQ ID NO: 1909074 - RNA, 17 nt, Homo sapiens
caucaagagacugaguc

SEQ ID NO: 1909075 - RNA, 22 nt, Homo sapiens
uagcuaccucacuaugcugcuu

SEQ ID NO: 1909076 - RNA, 21 nt, Homo sapiens
acccucggucauuccugucaa

SEQ ID NO: 1909077 - RNA, 12 nt, Homo sapiens
uuguugaacacu

SEQ ID NO: 1909078 - RNA, 19 nt, Homo sapiens
agguggcagggaagggugc

SEQ ID NO: 1909079 - RNA, 16 nt, Homo sapiens
aggcugcugccaucca

SEQ ID NO: 1909080 - RNA, 21 nt, Homo sapiens
ugcauauuuuguaacuuccau

SEQ ID NO: 1909081 - RNA, 20 nt, Homo sapiens
gaugccaaccagacaccucc

SEQ ID NO: 1909082 - RNA, 19 nt, Homo sapiens
ccgggaggcagccacaggg

SEQ ID NO: 1909083 - RNA, 18 nt, Homo sapiens
ggaacuggaggcagggaa

SEQ ID NO: 1909084 - RNA, 15 nt, Homo sapiens
cacaaugcagugccu

SEQ ID NO: 1909085 - RNA, 16 nt, Homo sapiens
ccccaggccccaggaa

SEQ ID NO: 1909086 - RNA, 12 nt, Homo sapiens
ccugugcacugu

SEQ ID NO: 1909087 - RNA, 22 nt, Homo sapiens
uuaagaauugaguaauggugua

SEQ ID NO: 1909088 - RNA, 19 nt, Homo sapiens
acuugaucgugcagcugcu

SEQ ID NO: 1909089 - RNA, 22 nt, Homo sapiens
accacuuuccccgugggccaug

SEQ ID NO: 1909090 - RNA, 16 nt, Homo sapiens
ccaaucagaacuggcu

SEQ ID NO: 1909091 - RNA, 19 nt, Homo sapiens
uucaccccuacacugugaa

SEQ ID NO: 1909092 - RNA, 15 nt, Homo sapiens
cugcagaccaugcca

SEQ ID NO: 1909093 - RNA, 20 nt, Homo sapiens
uaggagacugcgucaagcaa

SEQ ID NO: 1909094 - RNA, 17 nt, Homo sapiens
aaucuaccucugaaaaa

SEQ ID NO: 1909095 - RNA, 12 nt, Homo sapiens
gugaucuaccca

SEQ ID NO: 1909096 - RNA, 21 nt, Homo sapiens
aaauacagucuuccauuugca

SEQ ID NO: 1909097 - RNA, 21 nt, Homo sapiens
aaacccuuccacguguaugca

SEQ ID NO: 1909098 - RNA, 23 nt, Homo sapiens
uccaguagcuccgcgugucucau

SEQ ID NO: 1909099 - RNA, 19 nt, Homo sapiens
cagcccugcaccaugcugc

SEQ ID NO: 1909100 - RNA, 20 nt, Homo sapiens
cuucuagcauuuagaucuac

SEQ ID NO: 1909101 - RNA, 17 nt, Homo sapiens
gauugaggagcugcacu

SEQ ID NO: 1909102 - RNA, 20 nt, Homo sapiens
cagcccugaguuccuagcca

SEQ ID NO: 1909103 - RNA, 16 nt, Homo sapiens
caaaaaacuacuucuu

SEQ ID NO: 1909104 - RNA, 16 nt, Homo sapiens
gcuccuggguuucaug

SEQ ID NO: 1909105 - RNA, 15 nt, Homo sapiens
accuucaauuccugg

SEQ ID NO: 1909106 - RNA, 16 nt, Homo sapiens
aguuccauucuuggca

SEQ ID NO: 1909107 - RNA, 11 nt, Homo sapiens
ggucagccagc

SEQ ID NO: 1909108 - RNA, 17 nt, Homo sapiens
acauuucugcacauggu

SEQ ID NO: 1909109 - RNA, 14 nt, Homo sapiens
ccucagccagagaa

SEQ ID NO: 1909110 - RNA, 17 nt, Homo sapiens
cuugcucuguuacccag

SEQ ID NO: 1909111 - RNA, 15 nt, Homo sapiens
uccuuugcacuguuu

SEQ ID NO: 1909112 - RNA, 19 nt, Homo sapiens
aggugcuaucgcaccacug

SEQ ID NO: 1909113 - RNA, 20 nt, Homo sapiens
acccguugauaacucagugg

SEQ ID NO: 1909114 - RNA, 23 nt, Homo sapiens
gcuccccugaggaauaugucaua

SEQ ID NO: 1909115 - RNA, 17 nt, Homo sapiens
cugacuuucugauuacu

SEQ ID NO: 1909116 - RNA, 19 nt, Homo sapiens
ugagugugugugcauggaa

SEQ ID NO: 1909117 - RNA, 20 nt, Homo sapiens
auccccagaggugacccaau

SEQ ID NO: 1909118 - RNA, 23 nt, Homo sapiens
aaguguucuuagguuuacuguga

SEQ ID NO: 1909119 - RNA, 23 nt, Homo sapiens
acccaugcccaggaaaauaacag

SEQ ID NO: 1909120 - RNA, 17 nt, Homo sapiens
cuggacagcacucugcc

SEQ ID NO: 1909121 - RNA, 19 nt, Homo sapiens
accacuuuuaacagaacag

SEQ ID NO: 1909122 - RNA, 20 nt, Homo sapiens
ugcugugccucgcauccuau

SEQ ID NO: 1909123 - RNA, 17 nt, Homo sapiens
auaucaaaacaucccaa

SEQ ID NO: 1909124 - RNA, 21 nt, Homo sapiens
ugucugauucuaugccuguau

SEQ ID NO: 1909125 - RNA, 22 nt, Homo sapiens
aaggauuuuucuguaacuguca

SEQ ID NO: 1909126 - RNA, 19 nt, Homo sapiens
acuaucuacucuccucauc

SEQ ID NO: 1909127 - RNA, 17 nt, Homo sapiens
aggagccaccuugccac

SEQ ID NO: 1909128 - RNA, 18 nt, Homo sapiens
gaucuccccgaaucucaa

SEQ ID NO: 1909129 - RNA, 23 nt, Homo sapiens
cgaaagggugagacuccaucuca

SEQ ID NO: 1909130 - RNA, 21 nt, Homo sapiens
aaguaauugguuaguuaacac

SEQ ID NO: 1909131 - RNA, 20 nt, Homo sapiens
ggauaucaauuaauuugaaa

SEQ ID NO: 1909132 - RNA, 23 nt, Homo sapiens
ugaauagccuggccaccagccau

SEQ ID NO: 1909133 - RNA, 16 nt, Homo sapiens
gacauacccucuaaaa

SEQ ID NO: 1909134 - RNA, 15 nt, Homo sapiens
uaaaaauguucucaa

SEQ ID NO: 1909135 - RNA, 20 nt, Homo sapiens
ucucugcuccuacauccagc

SEQ ID NO: 1909136 - RNA, 12 nt, Homo sapiens
gcgaugcucccu

SEQ ID NO: 1909137 - RNA, 20 nt, Homo sapiens
ggguugcuaggaaaagaaau

SEQ ID NO: 1909138 - RNA, 21 nt, Homo sapiens
ccacccugaggagucugaggu

SEQ ID NO: 1909139 - RNA, 13 nt, Homo sapiens
ucuguaaauaucc

SEQ ID NO: 1909140 - RNA, 21 nt, Homo sapiens
uagacacaauuucauuuccag

SEQ ID NO: 1909141 - RNA, 15 nt, Homo sapiens
cugccagggcaccua

SEQ ID NO: 1909142 - RNA, 16 nt, Homo sapiens
cagcugggaucugacu

SEQ ID NO: 1909143 - RNA, 21 nt, Homo sapiens
ccggcugagggugggaggcaa

SEQ ID NO: 1909144 - RNA, 16 nt, Homo sapiens
gcaaauggugcuucaa

SEQ ID NO: 1909145 - RNA, 21 nt, Homo sapiens
uaggagcuaaggcucuaugag

SEQ ID NO: 1909146 - RNA, 23 nt, Homo sapiens
ugcucaagaggaaaauccaaaag

SEQ ID NO: 1909147 - RNA, 20 nt, Homo sapiens
uuucaacucuuaaagacauc

SEQ ID NO: 1909148 - RNA, 17 nt, Homo sapiens
gucaagugauugacaac

SEQ ID NO: 1909149 - RNA, 23 nt, Homo sapiens
ucccagagggauugcugugaaau

SEQ ID NO: 1909150 - RNA, 17 nt, Homo sapiens
aguugucuuuccuggca

SEQ ID NO: 1909151 - RNA, 18 nt, Homo sapiens
gcaaucagugcuccugua

SEQ ID NO: 1909152 - RNA, 19 nt, Homo sapiens
cuggagcuggcuuugccaa

SEQ ID NO: 1909153 - RNA, 14 nt, Homo sapiens
cugugauacacuga

SEQ ID NO: 1909154 - RNA, 14 nt, Homo sapiens
ccacacaaauucag

SEQ ID NO: 1909155 - RNA, 21 nt, Homo sapiens
ugaggcccauucuucacucug

SEQ ID NO: 1909156 - RNA, 22 nt, Homo sapiens
acuugguaagaugacucugaga

SEQ ID NO: 1909157 - RNA, 17 nt, Homo sapiens
auaauguuuugggaaac

SEQ ID NO: 1909158 - RNA, 20 nt, Homo sapiens
cugcagcccagagaccuuca

SEQ ID NO: 1909159 - RNA, 17 nt, Homo sapiens
gacucuacuauuaaguu

SEQ ID NO: 1909160 - RNA, 15 nt, Homo sapiens
uuaauuucagugccu

SEQ ID NO: 1909161 - RNA, 22 nt, Homo sapiens
uuuguugcuauggcuuuaccua

SEQ ID NO: 1909162 - RNA, 14 nt, Homo sapiens
uuuagaagagccug

SEQ ID NO: 1909163 - RNA, 20 nt, Homo sapiens
cagcacauucacugacauga

SEQ ID NO: 1909164 - RNA, 18 nt, Homo sapiens
aggccacccuagaaagaa

SEQ ID NO: 1909165 - RNA, 17 nt, Homo sapiens
gaucgcgccacugcacu

SEQ ID NO: 1909166 - RNA, 13 nt, Homo sapiens
ccauuuaucuuuu

SEQ ID NO: 1909167 - RNA, 16 nt, Homo sapiens
ucauagguuacuaccu

SEQ ID NO: 1909168 - RNA, 17 nt, Homo sapiens
auauauuuauaaggaaa

SEQ ID NO: 1909169 - RNA, 14 nt, Homo sapiens
ggaguaacuugcaa

SEQ ID NO: 1909170 - RNA, 13 nt, Homo sapiens
uccaggacuguuu

SEQ ID NO: 1909171 - RNA, 13 nt, Homo sapiens
guagaaguggcau

SEQ ID NO: 1909172 - RNA, 16 nt, Homo sapiens
auauacucauuuggau

SEQ ID NO: 1909173 - RNA, 13 nt, Homo sapiens
ggcaaaguguagu

SEQ ID NO: 1909174 - RNA, 14 nt, Homo sapiens
uaucuuacuugcaa

SEQ ID NO: 1909175 - RNA, 15 nt, Homo sapiens
caacaaaaagaacaa

SEQ ID NO: 1909176 - RNA, 13 nt, Homo sapiens
gaaaggugcccuu

SEQ ID NO: 1909177 - RNA, 22 nt, Homo sapiens
caaagauuuuggaggagaagga

SEQ ID NO: 1909178 - RNA, 17 nt, Homo sapiens
acuuugugacugucacu

SEQ ID NO: 1909179 - RNA, 12 nt, Homo sapiens
ggcccugcugaa

SEQ ID NO: 1909180 - RNA, 20 nt, Homo sapiens
uuacaggaagucccuugcca

SEQ ID NO: 1909181 - RNA, 17 nt, Homo sapiens
ggacuacaggcacccac

SEQ ID NO: 1909182 - RNA, 16 nt, Homo sapiens
ggaaagaaguucacau

SEQ ID NO: 1909183 - RNA, 13 nt, Homo sapiens
uuucuucucucca

SEQ ID NO: 1909184 - RNA, 21 nt, Homo sapiens
accauuucuagagagucuccu

SEQ ID NO: 1909185 - RNA, 14 nt, Homo sapiens
cguuuagugccaau

SEQ ID NO: 1909186 - RNA, 18 nt, Homo sapiens
ggugcagaugguacugcu

SEQ ID NO: 1909187 - RNA, 22 nt, Homo sapiens
acugucucucuugucacaugga

SEQ ID NO: 1909188 - RNA, 17 nt, Homo sapiens
aggagggcaguggugga

SEQ ID NO: 1909189 - RNA, 14 nt, Homo sapiens
ggcaggaaagccac

SEQ ID NO: 1909190 - RNA, 14 nt, Homo sapiens
uaccuggaguuuaa

SEQ ID NO: 1909191 - RNA, 20 nt, Homo sapiens
uccuuaguuaucaguccugu

SEQ ID NO: 1909192 - RNA, 19 nt, Homo sapiens
uuauguaaaauuuugccua

SEQ ID NO: 1909193 - RNA, 13 nt, Homo sapiens
aacccacaugggg

SEQ ID NO: 1909194 - RNA, 20 nt, Homo sapiens
caaaccucacauuugugaac

SEQ ID NO: 1909195 - RNA, 21 nt, Homo sapiens
uccacauugcaauguucaaug

SEQ ID NO: 1909196 - RNA, 13 nt, Homo sapiens
gaaaaaauucuuu

SEQ ID NO: 1909197 - RNA, 13 nt, Homo sapiens
uaaauaaugcuua

SEQ ID NO: 1909198 - RNA, 20 nt, Homo sapiens
ccagacaacuuguccugacu

SEQ ID NO: 1909199 - RNA, 14 nt, Homo sapiens
caacugucagggag

SEQ ID NO: 1909200 - RNA, 18 nt, Homo sapiens
gggguauaaaacuuuccu

SEQ ID NO: 1909201 - RNA, 16 nt, Homo sapiens
agguccuggugguauu

SEQ ID NO: 1909202 - RNA, 22 nt, Homo sapiens
ucacagggguucccuucucuca

SEQ ID NO: 1909203 - RNA, 18 nt, Homo sapiens
accucaccccuccuuggu

SEQ ID NO: 1909204 - RNA, 18 nt, Homo sapiens
agagacaaggucaccugg

SEQ ID NO: 1909205 - RNA, 16 nt, Homo sapiens
uuuaauagaauauaau

SEQ ID NO: 1909206 - RNA, 23 nt, Homo sapiens
cugaggagaagcgggaguggcug

SEQ ID NO: 1909207 - RNA, 18 nt, Homo sapiens
uccaaugccaauucaucu

SEQ ID NO: 1909208 - RNA, 13 nt, Homo sapiens
uuccuucuggccu

SEQ ID NO: 1909209 - RNA, 21 nt, Homo sapiens
uccuucaccccuauggugcuc

SEQ ID NO: 1909210 - RNA, 19 nt, Homo sapiens
uugcccccuccccacuuuu

SEQ ID NO: 1909211 - RNA, 22 nt, Homo sapiens
caaaguguuaggauuacaggca

SEQ ID NO: 1909212 - RNA, 14 nt, Homo sapiens
ugcaauucucuggc

SEQ ID NO: 1909213 - RNA, 19 nt, Homo sapiens
ucccuccaucccagacauu

SEQ ID NO: 1909214 - RNA, 14 nt, Homo sapiens
cuaauaaauacuua

SEQ ID NO: 1909215 - RNA, 23 nt, Homo sapiens
cuugggaaggaaggcagugccug

SEQ ID NO: 1909216 - RNA, 18 nt, Homo sapiens
cuaugauaauuacaauac

SEQ ID NO: 1909217 - RNA, 22 nt, Homo sapiens
uuccaucacaagaaagucauua

SEQ ID NO: 1909218 - RNA, 15 nt, Homo sapiens
cauuguuauaaagac

SEQ ID NO: 1909219 - RNA, 16 nt, Homo sapiens
acacccaauucaaauu

SEQ ID NO: 1909220 - RNA, 14 nt, Homo sapiens
ugccuucuggccuu

SEQ ID NO: 1909221 - RNA, 20 nt, Homo sapiens
aguaacuuucaaccuugcca

SEQ ID NO: 1909222 - RNA, 17 nt, Homo sapiens
ggucuuggguuccugua

SEQ ID NO: 1909223 - RNA, 22 nt, Homo sapiens
cuaaaauacaaacaagcacaga

SEQ ID NO: 1909224 - RNA, 22 nt, Homo sapiens
aauaguauuucagauacuugaa

SEQ ID NO: 1909225 - RNA, 17 nt, Homo sapiens
aaacccaauucagucuc

SEQ ID NO: 1909226 - RNA, 14 nt, Homo sapiens
aaaauuaucaccuu

SEQ ID NO: 1909227 - RNA, 14 nt, Homo sapiens
acccacauccaaac

SEQ ID NO: 1909228 - RNA, 20 nt, Homo sapiens
aggcugcuuuccaaagccaa

SEQ ID NO: 1909229 - RNA, 15 nt, Homo sapiens
gagguccacuucccu

SEQ ID NO: 1909230 - RNA, 16 nt, Homo sapiens
gggugggguacuggag

SEQ ID NO: 1909231 - RNA, 16 nt, Homo sapiens
uggccuaugacccugu

SEQ ID NO: 1909232 - RNA, 23 nt, Homo sapiens
cagggaccaggccagcgcugcaa

SEQ ID NO: 1909233 - RNA, 23 nt, Homo sapiens
guuuuaaaaugugaggcaauaag

SEQ ID NO: 1909234 - RNA, 13 nt, Homo sapiens
ccaccuugcacua

SEQ ID NO: 1909235 - RNA, 12 nt, Homo sapiens
aacaaaauccuc

SEQ ID NO: 1909236 - RNA, 20 nt, Homo sapiens
ccaaagaaauggaaauugau

SEQ ID NO: 1909237 - RNA, 18 nt, Homo sapiens
agcucuugaagacacuga

SEQ ID NO: 1909238 - RNA, 13 nt, Homo sapiens
uucucuuaccacu

SEQ ID NO: 1909239 - RNA, 16 nt, Homo sapiens
gcauacucugugcaag

SEQ ID NO: 1909240 - RNA, 17 nt, Homo sapiens
uaaagaagugcaugaaa

SEQ ID NO: 1909241 - RNA, 15 nt, Homo sapiens
acacacacaguuuga

SEQ ID NO: 1909242 - RNA, 19 nt, Homo sapiens
gggcaccccagcugaccug

SEQ ID NO: 1909243 - RNA, 12 nt, Homo sapiens
uuccuccugaca

SEQ ID NO: 1909244 - RNA, 14 nt, Homo sapiens
caguauuguagaaa

SEQ ID NO: 1909245 - RNA, 18 nt, Homo sapiens
agaugaagacaacagcau

SEQ ID NO: 1909246 - RNA, 14 nt, Homo sapiens
uagccaucuugauc

SEQ ID NO: 1909247 - RNA, 15 nt, Homo sapiens
caacugcauaaccuu

SEQ ID NO: 1909248 - RNA, 21 nt, Homo sapiens
ggccgcagaggauccaucaca

SEQ ID NO: 1909249 - RNA, 12 nt, Homo sapiens
auccccaucucc

SEQ ID NO: 1909250 - RNA, 17 nt, Homo sapiens
uuguguagaaagccaaa

SEQ ID NO: 1909251 - RNA, 14 nt, Homo sapiens
aaagcugcucaggg

SEQ ID NO: 1909252 - RNA, 18 nt, Homo sapiens
caggaaucuugcuccaau

SEQ ID NO: 1909253 - RNA, 14 nt, Homo sapiens
ugagcuaacugaga

SEQ ID NO: 1909254 - RNA, 22 nt, Homo sapiens
cuauuuuuaaugaaacuucaaa

SEQ ID NO: 1909255 - RNA, 21 nt, Homo sapiens
gcugucaucugugcacugccc

SEQ ID NO: 1909256 - RNA, 17 nt, Homo sapiens
guaccugcuggcacuau

SEQ ID NO: 1909257 - RNA, 17 nt, Homo sapiens
aaaagugaaccaucuca

SEQ ID NO: 1909258 - RNA, 14 nt, Homo sapiens
agaacugcacauga

SEQ ID NO: 1909259 - RNA, 11 nt, Homo sapiens
agcaguucugu

SEQ ID NO: 1909260 - RNA, 22 nt, Homo sapiens
cucaucaacaaagaaauauuau

SEQ ID NO: 1909261 - RNA, 18 nt, Homo sapiens
ccaggaguagugagcugu

SEQ ID NO: 1909262 - RNA, 19 nt, Homo sapiens
uagucuaguuauuggauca

SEQ ID NO: 1909263 - RNA, 22 nt, Homo sapiens
ugagcagaacccagacccugag

SEQ ID NO: 1909264 - RNA, 17 nt, Homo sapiens
uuaggcccggagcugcc

SEQ ID NO: 1909265 - RNA, 18 nt, Homo sapiens
aaguacuucuccacccug

SEQ ID NO: 1909266 - RNA, 23 nt, Homo sapiens
cuaccugggagaccagggaccac

SEQ ID NO: 1909267 - RNA, 18 nt, Homo sapiens
gagagggaacggaaauaa

SEQ ID NO: 1909268 - RNA, 20 nt, Homo sapiens
aauuccaagacagugcccau

SEQ ID NO: 1909269 - RNA, 15 nt, Homo sapiens
uacaguuugcuuauu

SEQ ID NO: 1909270 - RNA, 13 nt, Homo sapiens
gagagcuggccaa

SEQ ID NO: 1909271 - RNA, 14 nt, Homo sapiens
cuccccacacucca

SEQ ID NO: 1909272 - RNA, 22 nt, Homo sapiens
cuaugaaaugacuucuuaaaua

SEQ ID NO: 1909273 - RNA, 20 nt, Homo sapiens
gaacugccccaucuccuccc

SEQ ID NO: 1909274 - RNA, 14 nt, Homo sapiens
gucaccauucugca

SEQ ID NO: 1909275 - RNA, 15 nt, Homo sapiens
aaagacuaagccaga

SEQ ID NO: 1909276 - RNA, 19 nt, Homo sapiens
cagagggucuuacuguucc

SEQ ID NO: 1909277 - RNA, 23 nt, Homo sapiens
gccugguggcccagcuauuacca

SEQ ID NO: 1909278 - RNA, 22 nt, Homo sapiens
gcauguacuuuauauuuucuau

SEQ ID NO: 1909279 - RNA, 18 nt, Homo sapiens
ccugcuguucgugacuca

SEQ ID NO: 1909280 - RNA, 16 nt, Homo sapiens
acagaagccaggagca

SEQ ID NO: 1909281 - RNA, 18 nt, Homo sapiens
aucaucuagggaguauga

SEQ ID NO: 1909282 - RNA, 22 nt, Homo sapiens
agguccuucuguagugccaugg

SEQ ID NO: 1909283 - RNA, 18 nt, Homo sapiens
agguacagaaaacauguu

SEQ ID NO: 1909284 - RNA, 14 nt, Homo sapiens
aagcacacuggaau

SEQ ID NO: 1909285 - RNA, 18 nt, Homo sapiens
uuuaauuuugacacugaa

SEQ ID NO: 1909286 - RNA, 19 nt, Homo sapiens
acuuuuucucgaguccaaa

SEQ ID NO: 1909287 - RNA, 14 nt, Homo sapiens
ggucccccaugcca

SEQ ID NO: 1909288 - RNA, 13 nt, Homo sapiens
cccuccgccaugg

SEQ ID NO: 1909289 - RNA, 15 nt, Homo sapiens
ucaagaagacacuuc

SEQ ID NO: 1909290 - RNA, 23 nt, Homo sapiens
ccuaaacuuacauuuaaaagaca

SEQ ID NO: 1909291 - RNA, 21 nt, Homo sapiens
ucuuacaaguuagauguuacu

SEQ ID NO: 1909292 - RNA, 20 nt, Homo sapiens
aguggcacaaucucagcuca

SEQ ID NO: 1909293 - RNA, 20 nt, Homo sapiens
aguggcgcaaucucggcuca

SEQ ID NO: 1909294 - RNA, 17 nt, Homo sapiens
aaaaggcucccauguga

SEQ ID NO: 1909295 - RNA, 21 nt, Homo sapiens
gcugcuccccuggaggacaga

SEQ ID NO: 1909296 - RNA, 22 nt, Homo sapiens
agcccauggugagcucugggaa

SEQ ID NO: 1909297 - RNA, 13 nt, Homo sapiens
uuguucauccuuu

SEQ ID NO: 1909298 - RNA, 23 nt, Homo sapiens
gcuggagagagauucuguugcau

SEQ ID NO: 1909299 - RNA, 14 nt, Homo sapiens
agugguagcaagaa

SEQ ID NO: 1909300 - RNA, 18 nt, Homo sapiens
aaccagaucguacuugaa

SEQ ID NO: 1909301 - RNA, 16 nt, Homo sapiens
gucuucguacugggaa

SEQ ID NO: 1909302 - RNA, 19 nt, Homo sapiens
agaacgagaagcagcauuu

SEQ ID NO: 1909303 - RNA, 23 nt, Homo sapiens
auucacucugugguccagaguca

SEQ ID NO: 1909304 - RNA, 14 nt, Homo sapiens
cacccucuggagaa

SEQ ID NO: 1909305 - RNA, 23 nt, Homo sapiens
cuacauuaguacacagcaccaga

SEQ ID NO: 1909306 - RNA, 15 nt, Homo sapiens
caacuagauaucaug

SEQ ID NO: 1909307 - RNA, 15 nt, Homo sapiens
gaaggacacagugau

SEQ ID NO: 1909308 - RNA, 14 nt, Homo sapiens
acaucaagcaucau

SEQ ID NO: 1909309 - RNA, 17 nt, Homo sapiens
caaucuuauguuuccaa

SEQ ID NO: 1909310 - RNA, 11 nt, Homo sapiens
uagcugcuacc

SEQ ID NO: 1909311 - RNA, 11 nt, Homo sapiens
ccuauuugcac

SEQ ID NO: 1909312 - RNA, 21 nt, Homo sapiens
acacuugggguuuaaauaucc

SEQ ID NO: 1909313 - RNA, 16 nt, Homo sapiens
guugugcuuucuagca

SEQ ID NO: 1909314 - RNA, 12 nt, Homo sapiens
ucucugcuugcu

SEQ ID NO: 1909315 - RNA, 16 nt, Homo sapiens
uguggaaugcauccaa

SEQ ID NO: 1909316 - RNA, 20 nt, Homo sapiens
uugauguuuuacgugcaaac

SEQ ID NO: 1909317 - RNA, 19 nt, Homo sapiens
uucagugccuccccugcuc

SEQ ID NO: 1909318 - RNA, 14 nt, Homo sapiens
augccacuuugcag

SEQ ID NO: 1909319 - RNA, 14 nt, Homo sapiens
uuuugacauaacua

SEQ ID NO: 1909320 - RNA, 20 nt, Homo sapiens
ggaaauugggacuaguuuau

SEQ ID NO: 1909321 - RNA, 21 nt, Homo sapiens
cguguagacccuaacccggag

SEQ ID NO: 1909322 - RNA, 13 nt, Homo sapiens
gcaaguuacucug

SEQ ID NO: 1909323 - RNA, 18 nt, Homo sapiens
ucagacauacagcugccu

SEQ ID NO: 1909324 - RNA, 21 nt, Homo sapiens
auuucccauuaaagagccagu

SEQ ID NO: 1909325 - RNA, 11 nt, Homo sapiens
ccugcauguac

SEQ ID NO: 1909326 - RNA, 13 nt, Homo sapiens
uauuuaagaucac

SEQ ID NO: 1909327 - RNA, 18 nt, Homo sapiens
ugccucuaaauagcacuu

SEQ ID NO: 1909328 - RNA, 17 nt, Homo sapiens
uuugugccauguucaaa

SEQ ID NO: 1909329 - RNA, 13 nt, Homo sapiens
ucuccuccuugag

SEQ ID NO: 1909330 - RNA, 23 nt, Homo sapiens
cuccaucuccaagaaugcugaaa

SEQ ID NO: 1909331 - RNA, 17 nt, Homo sapiens
cuaaacccgcaccccag

SEQ ID NO: 1909332 - RNA, 17 nt, Homo sapiens
uccacugccuccaugau

SEQ ID NO: 1909333 - RNA, 21 nt, Homo sapiens
caaacuuaagaaacacugacu

SEQ ID NO: 1909334 - RNA, 16 nt, Homo sapiens
ccuaaggcaugaauau

SEQ ID NO: 1909335 - RNA, 18 nt, Homo sapiens
ucccaagcucccaagagc

SEQ ID NO: 1909336 - RNA, 20 nt, Homo sapiens
agguacgauuauacuugaga

SEQ ID NO: 1909337 - RNA, 21 nt, Homo sapiens
cgggaagaggagaugacagga

SEQ ID NO: 1909338 - RNA, 20 nt, Homo sapiens
agaucacuuucucaguuuuc

SEQ ID NO: 1909339 - RNA, 15 nt, Homo sapiens
uaauucuaugagaua

SEQ ID NO: 1909340 - RNA, 18 nt, Homo sapiens
agcucuguugcagguguc

SEQ ID NO: 1909341 - RNA, 19 nt, Homo sapiens
gaggaguucuuuggcucua

SEQ ID NO: 1909342 - RNA, 20 nt, Homo sapiens
ugaagaagguggaccuuuua

SEQ ID NO: 1909343 - RNA, 20 nt, Homo sapiens
uggcaacaaaaaguaaugaa

SEQ ID NO: 1909344 - RNA, 21 nt, Homo sapiens
ugcagaagccccaacugugau

SEQ ID NO: 1909345 - RNA, 14 nt, Homo sapiens
caguggauugcuca

SEQ ID NO: 1909346 - RNA, 20 nt, Homo sapiens
aacucuuucuggccugccuu

SEQ ID NO: 1909347 - RNA, 14 nt, Homo sapiens
uuccaagugccaau

SEQ ID NO: 1909348 - RNA, 14 nt, Homo sapiens
uuaaaagugcacau

SEQ ID NO: 1909349 - RNA, 18 nt, Homo sapiens
uuagaggggccagcggcc

SEQ ID NO: 1909350 - RNA, 23 nt, Homo sapiens
gaauuguaccuauuucugaugau

SEQ ID NO: 1909351 - RNA, 17 nt, Homo sapiens
caggacggcaguacuca

SEQ ID NO: 1909352 - RNA, 18 nt, Homo sapiens
gaaaggucacacuaccau

SEQ ID NO: 1909353 - RNA, 14 nt, Homo sapiens
ccgccuguaaaaug

SEQ ID NO: 1909354 - RNA, 13 nt, Homo sapiens
ugcuauacuggau

SEQ ID NO: 1909355 - RNA, 13 nt, Homo sapiens
ccccaaggacaag

SEQ ID NO: 1909356 - RNA, 13 nt, Homo sapiens
aaaauaaauuaca

SEQ ID NO: 1909357 - RNA, 17 nt, Homo sapiens
uucgcacugggggacau

SEQ ID NO: 1909358 - RNA, 21 nt, Homo sapiens
ggaaucauuaaagugcuuuca

SEQ ID NO: 1909359 - RNA, 20 nt, Homo sapiens
aacaugcgcguggaguucaa

SEQ ID NO: 1909360 - RNA, 21 nt, Homo sapiens
caauuuucuuaugaacagaua

SEQ ID NO: 1909361 - RNA, 14 nt, Homo sapiens
cauacaauuucagc

SEQ ID NO: 1909362 - RNA, 20 nt, Homo sapiens
uccuggccggccgcccacau

SEQ ID NO: 1909363 - RNA, 17 nt, Homo sapiens
gguuuacucucccggac

SEQ ID NO: 1909364 - RNA, 22 nt, Homo sapiens
uugaaugaaucaacaaaccaca

SEQ ID NO: 1909365 - RNA, 13 nt, Homo sapiens
auagcgacaggaa

SEQ ID NO: 1909366 - RNA, 19 nt, Homo sapiens
ugggaguuuagugugauaa

SEQ ID NO: 1909367 - RNA, 20 nt, Homo sapiens
ucaugauggugguuggggug

SEQ ID NO: 1909368 - RNA, 15 nt, Homo sapiens
agcgugaaagcagau

SEQ ID NO: 1909369 - RNA, 13 nt, Homo sapiens
uccacacagccaa

SEQ ID NO: 1909370 - RNA, 16 nt, Homo sapiens
ugucagucagggacaa

SEQ ID NO: 1909371 - RNA, 17 nt, Homo sapiens
uguacauguucuuguca

SEQ ID NO: 1909372 - RNA, 17 nt, Homo sapiens
cauucauguucuagucu

SEQ ID NO: 1909373 - RNA, 16 nt, Homo sapiens
gagcugaaaugcugca

SEQ ID NO: 1909374 - RNA, 17 nt, Homo sapiens
cagagggccucaucuca

SEQ ID NO: 1909375 - RNA, 22 nt, Homo sapiens
aacuggaaaacagaacacuuau

SEQ ID NO: 1909376 - RNA, 15 nt, Homo sapiens
agagcagccucuguc

SEQ ID NO: 1909377 - RNA, 21 nt, Homo sapiens
cuggauccccucugucuacaa

SEQ ID NO: 1909378 - RNA, 13 nt, Homo sapiens
ucccuuucauaca

SEQ ID NO: 1909379 - RNA, 20 nt, Homo sapiens
aaucagcugcuacuacuccu

SEQ ID NO: 1909380 - RNA, 18 nt, Homo sapiens
guuuagugugauugugaa

SEQ ID NO: 1909381 - RNA, 14 nt, Homo sapiens
ggaaccagcucucu

SEQ ID NO: 1909382 - RNA, 15 nt, Homo sapiens
cacacacacaccaau

SEQ ID NO: 1909383 - RNA, 15 nt, Homo sapiens
cagcgccagccucag

SEQ ID NO: 1909384 - RNA, 13 nt, Homo sapiens
gcuuuagggcaau

SEQ ID NO: 1909385 - RNA, 13 nt, Homo sapiens
cuggcugcugcca

SEQ ID NO: 1909386 - RNA, 15 nt, Homo sapiens
gaacagcaugcugcu

SEQ ID NO: 1909387 - RNA, 18 nt, Homo sapiens
aaaaccaucucugugauu

SEQ ID NO: 1909388 - RNA, 19 nt, Homo sapiens
acucugucuucacuauuca

SEQ ID NO: 1909389 - RNA, 12 nt, Homo sapiens
ucccuuccgucc

SEQ ID NO: 1909390 - RNA, 12 nt, Homo sapiens
guuuuuccucuu

SEQ ID NO: 1909391 - RNA, 18 nt, Homo sapiens
ugacauugaaaucuagga

SEQ ID NO: 1909392 - RNA, 20 nt, Homo sapiens
ccugaccaucgcacaccggc

SEQ ID NO: 1909393 - RNA, 20 nt, Homo sapiens
gauauaaagaaauaccugag

SEQ ID NO: 1909394 - RNA, 17 nt, Homo sapiens
auauuugaaaaccauau

SEQ ID NO: 1909395 - RNA, 14 nt, Homo sapiens
acuugcaagccuca

SEQ ID NO: 1909396 - RNA, 14 nt, Homo sapiens
aaaggaaaccaaag

SEQ ID NO: 1909397 - RNA, 20 nt, Homo sapiens
ccagauguuuacagacugug

SEQ ID NO: 1909398 - RNA, 15 nt, Homo sapiens
agaagaaagcucaga

SEQ ID NO: 1909399 - RNA, 14 nt, Homo sapiens
uuagaggcaaagaa

SEQ ID NO: 1909400 - RNA, 17 nt, Homo sapiens
ugcucuucccaguucag

SEQ ID NO: 1909401 - RNA, 18 nt, Homo sapiens
gaccccgcacccggcucg

SEQ ID NO: 1909402 - RNA, 23 nt, Homo sapiens
uggcuaauggaggugacggcacu

SEQ ID NO: 1909403 - RNA, 21 nt, Homo sapiens
agugcuuuucagugauacuca

SEQ ID NO: 1909404 - RNA, 22 nt, Homo sapiens
acccccaguccucccuagcucu

SEQ ID NO: 1909405 - RNA, 15 nt, Homo sapiens
ugcauggaaauuccc

SEQ ID NO: 1909406 - RNA, 19 nt, Homo sapiens
gaccagcucucuuccuguc

SEQ ID NO: 1909407 - RNA, 20 nt, Homo sapiens
uacugaauuggcuuccagau

SEQ ID NO: 1909408 - RNA, 20 nt, Homo sapiens
caucaaaugucaguccuuga

SEQ ID NO: 1909409 - RNA, 20 nt, Homo sapiens
aggaggcggagguugcagug

SEQ ID NO: 1909410 - RNA, 21 nt, Homo sapiens
auacauuaagccucuugucua

SEQ ID NO: 1909411 - RNA, 17 nt, Homo sapiens
uguaaagacacaucuua

SEQ ID NO: 1909412 - RNA, 17 nt, Homo sapiens
ucucugaguugcccuga

SEQ ID NO: 1909413 - RNA, 21 nt, Homo sapiens
aggaaacugcuacuuguggac

SEQ ID NO: 1909414 - RNA, 15 nt, Homo sapiens
cucaggcucuugacu

SEQ ID NO: 1909415 - RNA, 13 nt, Homo sapiens
cgugugugcaagu

SEQ ID NO: 1909416 - RNA, 20 nt, Homo sapiens
aacuuauguagauauuuggc

SEQ ID NO: 1909417 - RNA, 17 nt, Homo sapiens
auucucugccuuuacua

SEQ ID NO: 1909418 - RNA, 16 nt, Homo sapiens
cagaaaauaugauaua

SEQ ID NO: 1909419 - RNA, 20 nt, Homo sapiens
uauaaauaacuaaugucucu

SEQ ID NO: 1909420 - RNA, 12 nt, Homo sapiens
aaccuauuccac

SEQ ID NO: 1909421 - RNA, 19 nt, Homo sapiens
gcucacauucugagaaaca

SEQ ID NO: 1909422 - RNA, 22 nt, Homo sapiens
gaaaugucuccacccgugucca

SEQ ID NO: 1909423 - RNA, 21 nt, Homo sapiens
accuguguccccgaugcugac

SEQ ID NO: 1909424 - RNA, 16 nt, Homo sapiens
guuaacacgugacacu

SEQ ID NO: 1909425 - RNA, 21 nt, Homo sapiens
aagcucuucacugaaacuggu

SEQ ID NO: 1909426 - RNA, 12 nt, Homo sapiens
gugcagucacug

SEQ ID NO: 1909427 - RNA, 18 nt, Homo sapiens
ugcccccauccagccacg

SEQ ID NO: 1909428 - RNA, 22 nt, Homo sapiens
guucugauauuaauuuaucaga

SEQ ID NO: 1909429 - RNA, 20 nt, Homo sapiens
guaucaggacugugaccaaa

SEQ ID NO: 1909430 - RNA, 16 nt, Homo sapiens
gaaaaagccugugaaa

SEQ ID NO: 1909431 - RNA, 17 nt, Homo sapiens
uccucccccagcuaucu

SEQ ID NO: 1909432 - RNA, 11 nt, Homo sapiens
guaucacuggu

SEQ ID NO: 1909433 - RNA, 21 nt, Homo sapiens
aaguccuccagacaacccuca

SEQ ID NO: 1909434 - RNA, 19 nt, Homo sapiens
uguuacugagaugucuuca

SEQ ID NO: 1909435 - RNA, 17 nt, Homo sapiens
gccgucagagcagugac

SEQ ID NO: 1909436 - RNA, 12 nt, Homo sapiens
uccuuccugacc

SEQ ID NO: 1909437 - RNA, 19 nt, Homo sapiens
uaauuauuauuuccagugu

SEQ ID NO: 1909438 - RNA, 16 nt, Homo sapiens
ccaauaaaaaguucag

SEQ ID NO: 1909439 - RNA, 18 nt, Homo sapiens
agaagaccuugggccaag

SEQ ID NO: 1909440 - RNA, 17 nt, Homo sapiens
ucauaauuuuauguuca

SEQ ID NO: 1909441 - RNA, 17 nt, Homo sapiens
auacaguuacuuaauga

SEQ ID NO: 1909442 - RNA, 22 nt, Homo sapiens
uugcuuccuguguaacaucugc

SEQ ID NO: 1909443 - RNA, 15 nt, Homo sapiens
ucucuguucuucauc

SEQ ID NO: 1909444 - RNA, 17 nt, Homo sapiens
uuuaugacauuacaauc

SEQ ID NO: 1909445 - RNA, 23 nt, Homo sapiens
uccucuuucaaagguagccauca

SEQ ID NO: 1909446 - RNA, 14 nt, Homo sapiens
agagucacccugag

SEQ ID NO: 1909447 - RNA, 18 nt, Homo sapiens
uuaacuggcauaggaaau

SEQ ID NO: 1909448 - RNA, 13 nt, Homo sapiens
ucccuaggccuga

SEQ ID NO: 1909449 - RNA, 19 nt, Homo sapiens
gguaggggcacagugaaug

SEQ ID NO: 1909450 - RNA, 14 nt, Homo sapiens
cacagcaugugcaa

SEQ ID NO: 1909451 - RNA, 16 nt, Homo sapiens
gcuguggcauccagag

SEQ ID NO: 1909452 - RNA, 23 nt, Homo sapiens
acuguagccacagcugcuguucu

SEQ ID NO: 1909453 - RNA, 16 nt, Homo sapiens
gcaaggcacugacuga

SEQ ID NO: 1909454 - RNA, 12 nt, Homo sapiens
aaaugcuuucuc

SEQ ID NO: 1909455 - RNA, 16 nt, Homo sapiens
gugcuugcuggugccu

SEQ ID NO: 1909456 - RNA, 12 nt, Homo sapiens
uguccugugcuu

SEQ ID NO: 1909457 - RNA, 23 nt, Homo sapiens
uaucugauuuccuaaugucagag

SEQ ID NO: 1909458 - RNA, 14 nt, Homo sapiens
aaugcauucagggg

SEQ ID NO: 1909459 - RNA, 21 nt, Homo sapiens
acgacagugcauuugccuugu

SEQ ID NO: 1909460 - RNA, 14 nt, Homo sapiens
cacagaggacacag

SEQ ID NO: 1909461 - RNA, 16 nt, Homo sapiens
agagacuuuguguuua

SEQ ID NO: 1909462 - RNA, 22 nt, Homo sapiens
aaggaccugcauuuuccuacau

SEQ ID NO: 1909463 - RNA, 20 nt, Homo sapiens
uuuccaaauauuuugcuuua

SEQ ID NO: 1909464 - RNA, 17 nt, Homo sapiens
acuguaaauauccacag

SEQ ID NO: 1909465 - RNA, 18 nt, Homo sapiens
ucaaaauuucagcauuau

SEQ ID NO: 1909466 - RNA, 17 nt, Homo sapiens
aggcugaggcaugagaa

SEQ ID NO: 1909467 - RNA, 23 nt, Homo sapiens
ucagaaagggagggcucugaggc

SEQ ID NO: 1909468 - RNA, 19 nt, Homo sapiens
ugaaaagauuaugaucuca

SEQ ID NO: 1909469 - RNA, 14 nt, Homo sapiens
auauucuacuaugc

SEQ ID NO: 1909470 - RNA, 20 nt, Homo sapiens
cuuugcugcauuuuacacau

SEQ ID NO: 1909471 - RNA, 20 nt, Homo sapiens
acacuccuacaagauuuaga

SEQ ID NO: 1909472 - RNA, 13 nt, Homo sapiens
uggaacauggacu

SEQ ID NO: 1909473 - RNA, 22 nt, Homo sapiens
guccaggaaaugugcacaaaau

SEQ ID NO: 1909474 - RNA, 12 nt, Homo sapiens
uguagccauccu

SEQ ID NO: 1909475 - RNA, 23 nt, Homo sapiens
uauccugggaggguguggugcuu

SEQ ID NO: 1909476 - RNA, 17 nt, Homo sapiens
ugggcaggaacacagac

SEQ ID NO: 1909477 - RNA, 17 nt, Homo sapiens
caucuauucaagcacuu

SEQ ID NO: 1909478 - RNA, 17 nt, Homo sapiens
ugauuaguugacaguau

SEQ ID NO: 1909479 - RNA, 20 nt, Homo sapiens
agagucucacuuuguugccc

SEQ ID NO: 1909480 - RNA, 19 nt, Homo sapiens
cuguccuagucuccuuuga

SEQ ID NO: 1909481 - RNA, 22 nt, Homo sapiens
caucacgcugcaucccauugcu

SEQ ID NO: 1909482 - RNA, 19 nt, Homo sapiens
cuagcagaaaaaugaaaga

SEQ ID NO: 1909483 - RNA, 14 nt, Homo sapiens
acugacacaggaaa

SEQ ID NO: 1909484 - RNA, 22 nt, Homo sapiens
agaccaucucucccuccuggug

SEQ ID NO: 1909485 - RNA, 23 nt, Homo sapiens
cuccguacaccccagcuccuagg

SEQ ID NO: 1909486 - RNA, 19 nt, Homo sapiens
cuccugguaacguggcucc

SEQ ID NO: 1909487 - RNA, 21 nt, Homo sapiens
aacccuggucuccguggcacu

SEQ ID NO: 1909488 - RNA, 19 nt, Homo sapiens
cagguacuuccucagucug

SEQ ID NO: 1909489 - RNA, 19 nt, Homo sapiens
ugaagaguccucugaauga

SEQ ID NO: 1909490 - RNA, 13 nt, Homo sapiens
aauccgaagggaa

SEQ ID NO: 1909491 - RNA, 21 nt, Homo sapiens
auguugguuuuaauacuugau

SEQ ID NO: 1909492 - RNA, 20 nt, Homo sapiens
gcugagauugugccacugua

SEQ ID NO: 1909493 - RNA, 20 nt, Homo sapiens
gcugagauugcgccacugca

SEQ ID NO: 1909494 - RNA, 23 nt, Homo sapiens
ggaaugauuucuaugaacuuguc

SEQ ID NO: 1909495 - RNA, 22 nt, Homo sapiens
gauucuauuuauuaugcuuuau

SEQ ID NO: 1909496 - RNA, 20 nt, Homo sapiens
ggccagguacaacaccuuuu

SEQ ID NO: 1909497 - RNA, 18 nt, Homo sapiens
aauuuguaaugucuugag

SEQ ID NO: 1909498 - RNA, 18 nt, Homo sapiens
acauauauauacuauuaa

SEQ ID NO: 1909499 - RNA, 15 nt, Homo sapiens
uagccaccagugucc

SEQ ID NO: 1909500 - RNA, 19 nt, Homo sapiens
uaaagacccaacuugccaa

SEQ ID NO: 1909501 - RNA, 17 nt, Homo sapiens
cuuuaucaccucauucu

SEQ ID NO: 1909502 - RNA, 21 nt, Homo sapiens
aucaggcuauguauggaauac

SEQ ID NO: 1909503 - RNA, 12 nt, Homo sapiens
cucagcauaccu

SEQ ID NO: 1909504 - RNA, 21 nt, Homo sapiens
aaugcuguagaaugcuuggca

SEQ ID NO: 1909505 - RNA, 12 nt, Homo sapiens
ucugaagccaca

SEQ ID NO: 1909506 - RNA, 21 nt, Homo sapiens
uuuagaagagccugacugugu

SEQ ID NO: 1909507 - RNA, 22 nt, Homo sapiens
aaguggggaccccaccccucau

SEQ ID NO: 1909508 - RNA, 22 nt, Homo sapiens
uguuacccauucaaccauuuua

SEQ ID NO: 1909509 - RNA, 21 nt, Homo sapiens
cuaauauugaaaaugucacug

SEQ ID NO: 1909510 - RNA, 22 nt, Homo sapiens
caaccugggauguagcggugaa

SEQ ID NO: 1909511 - RNA, 17 nt, Homo sapiens
aguugagcuaugacuua

SEQ ID NO: 1909512 - RNA, 15 nt, Homo sapiens
agugccccuagcuua

SEQ ID NO: 1909513 - RNA, 22 nt, Homo sapiens
ccuucucacacacaacugucca

SEQ ID NO: 1909514 - RNA, 16 nt, Homo sapiens
acuguccccaucauca

SEQ ID NO: 1909515 - RNA, 22 nt, Homo sapiens
ucucaaacgguacacagacuau

SEQ ID NO: 1909516 - RNA, 20 nt, Homo sapiens
uuuguaauaaacucucuagg

SEQ ID NO: 1909517 - RNA, 19 nt, Homo sapiens
augguccauuucaugugau

SEQ ID NO: 1909518 - RNA, 21 nt, Homo sapiens
cauauuaggugguucucuuca

SEQ ID NO: 1909519 - RNA, 20 nt, Homo sapiens
caggugaggucagcacaucu

SEQ ID NO: 1909520 - RNA, 13 nt, Homo sapiens
ugcuuugugauuu

SEQ ID NO: 1909521 - RNA, 15 nt, Homo sapiens
uucacucagagggaa

SEQ ID NO: 1909522 - RNA, 14 nt, Homo sapiens
gggugaaucugucu

SEQ ID NO: 1909523 - RNA, 23 nt, Homo sapiens
uaauccuguaggaagguacugua

SEQ ID NO: 1909524 - RNA, 15 nt, Homo sapiens
aggaggagauggcca

SEQ ID NO: 1909525 - RNA, 23 nt, Homo sapiens
ugauuuccccuuuugcauucucc

SEQ ID NO: 1909526 - RNA, 16 nt, Homo sapiens
ccacuccugcucugcu

SEQ ID NO: 1909527 - RNA, 13 nt, Homo sapiens
acacuguguaaga

SEQ ID NO: 1909528 - RNA, 16 nt, Homo sapiens
caaguuuuucugucaa

SEQ ID NO: 1909529 - RNA, 16 nt, Homo sapiens
caaauuuuucuaucaa

SEQ ID NO: 1909530 - RNA, 17 nt, Homo sapiens
cuuuuuuuaaguguucu

SEQ ID NO: 1909531 - RNA, 18 nt, Homo sapiens
uaaagacagagauaccau

SEQ ID NO: 1909532 - RNA, 19 nt, Homo sapiens
aacaccugaucuggcccaa

SEQ ID NO: 1909533 - RNA, 20 nt, Homo sapiens
gcuucugaaugcugcuacuu

SEQ ID NO: 1909534 - RNA, 20 nt, Homo sapiens
cauuucauugucuuagucaa

SEQ ID NO: 1909535 - RNA, 23 nt, Homo sapiens
uuucccuucccuuccacugccuc

SEQ ID NO: 1909536 - RNA, 15 nt, Homo sapiens
gcuagggaaggcggg

SEQ ID NO: 1909537 - RNA, 20 nt, Homo sapiens
auaguuggggaauugugaga

SEQ ID NO: 1909538 - RNA, 17 nt, Homo sapiens
caggugaccccuaggag

SEQ ID NO: 1909539 - RNA, 23 nt, Homo sapiens
ugaguggcuugugauucugggau

SEQ ID NO: 1909540 - RNA, 9 nt, Homo sapiens
cuucccaaa

SEQ ID NO: 1909541 - RNA, 16 nt, Homo sapiens
auacaugcacagucau

SEQ ID NO: 1909542 - RNA, 22 nt, Homo sapiens
acuuuuguaaaaucaaaucauc

SEQ ID NO: 1909543 - RNA, 17 nt, Homo sapiens
cugcuugggacccuagc

SEQ ID NO: 1909544 - RNA, 18 nt, Homo sapiens
augcauucacaaggugac

SEQ ID NO: 1909545 - RNA, 17 nt, Homo sapiens
cacguggcagaccguga

SEQ ID NO: 1909546 - RNA, 20 nt, Homo sapiens
aaguaaaaggcacugcacau

SEQ ID NO: 1909547 - RNA, 22 nt, Homo sapiens
cgugaagggauuuuagucacac

SEQ ID NO: 1909548 - RNA, 23 nt, Homo sapiens
gggucugggaaaugagcagggau

SEQ ID NO: 1909549 - RNA, 23 nt, Homo sapiens
auauggaugauucagaaauugga

SEQ ID NO: 1909550 - RNA, 17 nt, Homo sapiens
ugcaggcaagugggaua

SEQ ID NO: 1909551 - RNA, 15 nt, Homo sapiens
aaacagaugccccag

SEQ ID NO: 1909552 - RNA, 16 nt, Homo sapiens
ccucccagcugcacuu

SEQ ID NO: 1909553 - RNA, 16 nt, Homo sapiens
gaauaauuacagugcc

SEQ ID NO: 1909554 - RNA, 18 nt, Homo sapiens
ugugaacugggcauuuca

SEQ ID NO: 1909555 - RNA, 15 nt, Homo sapiens
caggacccgccugcu

SEQ ID NO: 1909556 - RNA, 21 nt, Homo sapiens
gaccaauuacugcacucuuaa

SEQ ID NO: 1909557 - RNA, 14 nt, Homo sapiens
acccauugugauug

SEQ ID NO: 1909558 - RNA, 16 nt, Homo sapiens
uugauuaaguauaucu

SEQ ID NO: 1909559 - RNA, 18 nt, Homo sapiens
agcgcaguguuuugcaag

SEQ ID NO: 1909560 - RNA, 17 nt, Homo sapiens
ucgcuauucccaggcag

SEQ ID NO: 1909561 - RNA, 19 nt, Homo sapiens
gcuuggguucacagugcau

SEQ ID NO: 1909562 - RNA, 22 nt, Homo sapiens
acccaggagccuaguacaauau

SEQ ID NO: 1909563 - RNA, 12 nt, Homo sapiens
gggccucugaaa

SEQ ID NO: 1909564 - RNA, 14 nt, Homo sapiens
uaauuggcuuuacu

SEQ ID NO: 1909565 - RNA, 19 nt, Homo sapiens
aauguuuaagauaaacaga

SEQ ID NO: 1909566 - RNA, 12 nt, Homo sapiens
aaaccaaaaaga

SEQ ID NO: 1909567 - RNA, 18 nt, Homo sapiens
gcuccggaggacucacca

SEQ ID NO: 1909568 - RNA, 13 nt, Homo sapiens
aagauaacuucau

SEQ ID NO: 1909569 - RNA, 20 nt, Homo sapiens
guuaggcauuuccugcugaa

SEQ ID NO: 1909570 - RNA, 17 nt, Homo sapiens
uacuguaaucgugcuau

SEQ ID NO: 1909571 - RNA, 16 nt, Homo sapiens
uggaaaguacuaugaa

SEQ ID NO: 1909572 - RNA, 14 nt, Homo sapiens
gaauaccaguguua

SEQ ID NO: 1909573 - RNA, 22 nt, Homo sapiens
gaggugguaguaaaacacagag

SEQ ID NO: 1909574 - RNA, 17 nt, Homo sapiens
guaacguguuacuggaa

SEQ ID NO: 1909575 - RNA, 10 nt, Homo sapiens
ccaacacuuu

SEQ ID NO: 1909576 - RNA, 18 nt, Homo sapiens
acugcaggcaucacagcu

SEQ ID NO: 1909577 - RNA, 16 nt, Homo sapiens
uccauaauugcaaggg

SEQ ID NO: 1909578 - RNA, 20 nt, Homo sapiens
cugaaaacuaauguacugua

SEQ ID NO: 1909579 - RNA, 22 nt, Homo sapiens
uuaagaugggguauucuuucac

SEQ ID NO: 1909580 - RNA, 17 nt, Homo sapiens
cccgcaagcaccauccc

SEQ ID NO: 1909581 - RNA, 19 nt, Homo sapiens
acuauuuuuguaaaagaca

SEQ ID NO: 1909582 - RNA, 13 nt, Homo sapiens
cauuacacuccag

SEQ ID NO: 1909583 - RNA, 15 nt, Homo sapiens
acgugcccauuucac

SEQ ID NO: 1909584 - RNA, 15 nt, Homo sapiens
uuuaaauuauacugu

SEQ ID NO: 1909585 - RNA, 15 nt, Homo sapiens
uuucacagucacuga

SEQ ID NO: 1909586 - RNA, 22 nt, Homo sapiens
ccagggucuugggcuacuggca

SEQ ID NO: 1909587 - RNA, 16 nt, Homo sapiens
ugccaggcuugucaaa

SEQ ID NO: 1909588 - RNA, 15 nt, Homo sapiens
aaaccuuuuacguua

SEQ ID NO: 1909589 - RNA, 15 nt, Homo sapiens
ugagcuauagccuuu

SEQ ID NO: 1909590 - RNA, 17 nt, Homo sapiens
guauuuuuauuuuugca

SEQ ID NO: 1909591 - RNA, 18 nt, Homo sapiens
ucagauuguuaucuauca

SEQ ID NO: 1909592 - RNA, 14 nt, Homo sapiens
agcaucugacucac

SEQ ID NO: 1909593 - RNA, 19 nt, Homo sapiens
augcaccucauuccaguca

SEQ ID NO: 1909594 - RNA, 22 nt, Homo sapiens
guaacuuuguugcauuuuggca

SEQ ID NO: 1909595 - RNA, 15 nt, Homo sapiens
aaaggaguuuugcaa

SEQ ID NO: 1909596 - RNA, 14 nt, Homo sapiens
auuuucuuugacuc

SEQ ID NO: 1909597 - RNA, 12 nt, Homo sapiens
uuguuauauccu

SEQ ID NO: 1909598 - RNA, 23 nt, Homo sapiens
uauucauaauaaacuagauacug

SEQ ID NO: 1909599 - RNA, 19 nt, Homo sapiens
cauggagcagccagcguua

SEQ ID NO: 1909600 - RNA, 19 nt, Homo sapiens
cccuccgaccucucucggc

SEQ ID NO: 1909601 - RNA, 14 nt, Homo sapiens
guucuccaacagag

SEQ ID NO: 1909602 - RNA, 21 nt, Homo sapiens
cucagacaucuccagugugcc

SEQ ID NO: 1909603 - RNA, 14 nt, Homo sapiens
acccacugcugcac

SEQ ID NO: 1909604 - RNA, 16 nt, Homo sapiens
aaagcugccugugcca

SEQ ID NO: 1909605 - RNA, 22 nt, Homo sapiens
uuucuugaacauacuugguuuc

SEQ ID NO: 1909606 - RNA, 15 nt, Homo sapiens
uggagauucucauaa

SEQ ID NO: 1909607 - RNA, 19 nt, Homo sapiens
aaacucacaacucucuggu

SEQ ID NO: 1909608 - RNA, 16 nt, Homo sapiens
cacaaccacucauuca

SEQ ID NO: 1909609 - RNA, 24 nt, Homo sapiens
ucuagaauuauaagucacaaagag

SEQ ID NO: 1909610 - RNA, 13 nt, Homo sapiens
cuuuccaaaaccu

SEQ ID NO: 1909611 - RNA, 17 nt, Homo sapiens
ugaaguaauaugcacac

SEQ ID NO: 1909612 - RNA, 20 nt, Homo sapiens
ucaacacaaagacauggaag

SEQ ID NO: 1909613 - RNA, 18 nt, Homo sapiens
gaccgugggccgagguga

SEQ ID NO: 1909614 - RNA, 16 nt, Homo sapiens
cucuaaaauucuaguc

SEQ ID NO: 1909615 - RNA, 16 nt, Homo sapiens
cuuuaaucacuuaaca

SEQ ID NO: 1909616 - RNA, 15 nt, Homo sapiens
auaagauacacagcu

SEQ ID NO: 1909617 - RNA, 15 nt, Homo sapiens
aacccauacuacccu

SEQ ID NO: 1909618 - RNA, 22 nt, Homo sapiens
acuucacagugacacuggacca

SEQ ID NO: 1909619 - RNA, 18 nt, Homo sapiens
augaaaaauguaaauacu

SEQ ID NO: 1909620 - RNA, 21 nt, Homo sapiens
acuguuugucacgucuucuga

SEQ ID NO: 1909621 - RNA, 24 nt, Homo sapiens
aauacauaaaguaugugcauauuu

SEQ ID NO: 1909622 - RNA, 16 nt, Homo sapiens
uguaacguggcacugg

SEQ ID NO: 1909623 - RNA, 23 nt, Homo sapiens
cuaaaaaaauuuauuuuacacau

SEQ ID NO: 1909624 - RNA, 16 nt, Homo sapiens
uaaccauggcacugag

SEQ ID NO: 1909625 - RNA, 14 nt, Homo sapiens
uaaaagaccacaga

SEQ ID NO: 1909626 - RNA, 23 nt, Homo sapiens
ugcgugggugugugcguguuugg

SEQ ID NO: 1909627 - RNA, 18 nt, Homo sapiens
aaaauauugaauaaugcg

SEQ ID NO: 1909628 - RNA, 13 nt, Homo sapiens
gaguuuucugacc

SEQ ID NO: 1909629 - RNA, 22 nt, Homo sapiens
agaaaagcccugcuuaugugug

SEQ ID NO: 1909630 - RNA, 16 nt, Homo sapiens
accagagcgguaucuc

SEQ ID NO: 1909631 - RNA, 21 nt, Homo sapiens
gaguccauguggacugugcca

SEQ ID NO: 1909632 - RNA, 13 nt, Homo sapiens
ccuuuaaucugca

SEQ ID NO: 1909633 - RNA, 13 nt, Homo sapiens
gcccacaccaucu

SEQ ID NO: 1909634 - RNA, 23 nt, Homo sapiens
auauuuaugcuuauaaguuugca

SEQ ID NO: 1909635 - RNA, 14 nt, Homo sapiens
aaggagagcauagg

SEQ ID NO: 1909636 - RNA, 17 nt, Homo sapiens
aaaagggcagaggcaag

SEQ ID NO: 1909637 - RNA, 12 nt, Homo sapiens
uugggugccuuu

SEQ ID NO: 1909638 - RNA, 15 nt, Homo sapiens
cuuuauuagcagcug

SEQ ID NO: 1909639 - RNA, 21 nt, Homo sapiens
gaaaguuuuguucuguauauu

SEQ ID NO: 1909640 - RNA, 23 nt, Homo sapiens
agcucguucucugggccuucuca

SEQ ID NO: 1909641 - RNA, 23 nt, Homo sapiens
ggucaccuuccugggcagcccag

SEQ ID NO: 1909642 - RNA, 20 nt, Homo sapiens
aauuagagagcaucugcaac

SEQ ID NO: 1909643 - RNA, 16 nt, Homo sapiens
acagcacccucuccag

SEQ ID NO: 1909644 - RNA, 17 nt, Homo sapiens
gggcuggguaccaaugc

SEQ ID NO: 1909645 - RNA, 21 nt, Homo sapiens
cccucgucaucaggugcauag

SEQ ID NO: 1909646 - RNA, 23 nt, Homo sapiens
ggaggucuaccugaugaaccuga

SEQ ID NO: 1909647 - RNA, 22 nt, Homo sapiens
gucuuccugaguggugccaaac

SEQ ID NO: 1909648 - RNA, 17 nt, Homo sapiens
acugcaggaccuccagc

SEQ ID NO: 1909649 - RNA, 16 nt, Homo sapiens
aauacaauauugcauu

SEQ ID NO: 1909650 - RNA, 21 nt, Homo sapiens
cugggugguguacaagcauuu

SEQ ID NO: 1909651 - RNA, 17 nt, Homo sapiens
cuaagaagagauuucuc

SEQ ID NO: 1909652 - RNA, 21 nt, Homo sapiens
uaagcuccaugugcauauaaa

SEQ ID NO: 1909653 - RNA, 16 nt, Homo sapiens
ggaacaucacauuccu

SEQ ID NO: 1909654 - RNA, 19 nt, Homo sapiens
acuagcaggcaaugcugua

SEQ ID NO: 1909655 - RNA, 16 nt, Homo sapiens
cucuugccaaccugua

SEQ ID NO: 1909656 - RNA, 20 nt, Homo sapiens
aagagaccacccauaucaug

SEQ ID NO: 1909657 - RNA, 17 nt, Homo sapiens
cacccaggcaucugcuu

SEQ ID NO: 1909658 - RNA, 15 nt, Homo sapiens
ugggauuugcuccug

SEQ ID NO: 1909659 - RNA, 14 nt, Homo sapiens
uauuugguaccaug

SEQ ID NO: 1909660 - RNA, 16 nt, Homo sapiens
cugcagccuccgcuuc

SEQ ID NO: 1909661 - RNA, 21 nt, Homo sapiens
ucuauaauggaaacauuuaca

SEQ ID NO: 1909662 - RNA, 18 nt, Homo sapiens
aaaguguauuuguguaua

SEQ ID NO: 1909663 - RNA, 19 nt, Homo sapiens
acuuauuucauaaacaacu

SEQ ID NO: 1909664 - RNA, 19 nt, Homo sapiens
aauuaacaaagaauuucag

SEQ ID NO: 1909665 - RNA, 14 nt, Homo sapiens
augcagacaaacaa

SEQ ID NO: 1909666 - RNA, 22 nt, Homo sapiens
uuucugauaacagaauugccaa

SEQ ID NO: 1909667 - RNA, 21 nt, Homo sapiens
ccuaaagcccucuucaggggu

SEQ ID NO: 1909668 - RNA, 19 nt, Homo sapiens
gcagcaccguucugugcac

SEQ ID NO: 1909669 - RNA, 23 nt, Homo sapiens
auuaaacuuugaagcaacuguga

SEQ ID NO: 1909670 - RNA, 18 nt, Homo sapiens
uucuucaugaaauguguu

SEQ ID NO: 1909671 - RNA, 22 nt, Homo sapiens
auacaagcuuuuaguauccaca

SEQ ID NO: 1909672 - RNA, 16 nt, Homo sapiens
cagcuucaaaugcaaa

SEQ ID NO: 1909673 - RNA, 13 nt, Homo sapiens
uaauaaugugcaa

SEQ ID NO: 1909674 - RNA, 21 nt, Homo sapiens
cggggaggcagggguccugca

SEQ ID NO: 1909675 - RNA, 21 nt, Homo sapiens
cuuccccauugccuucugggg

SEQ ID NO: 1909676 - RNA, 15 nt, Homo sapiens
cugggccucaguuca

SEQ ID NO: 1909677 - RNA, 15 nt, Homo sapiens
cacgugcucucugga

SEQ ID NO: 1909678 - RNA, 15 nt, Homo sapiens
ugccaggggcaguga

SEQ ID NO: 1909679 - RNA, 15 nt, Homo sapiens
accuaaaugaccuca

SEQ ID NO: 1909680 - RNA, 17 nt, Homo sapiens
ccuugugcucgccucau

SEQ ID NO: 1909681 - RNA, 13 nt, Homo sapiens
aguauuaaaacau

SEQ ID NO: 1909682 - RNA, 15 nt, Homo sapiens
aguuccacuuaacac

SEQ ID NO: 1909683 - RNA, 17 nt, Homo sapiens
aagauauuauguauaaa

SEQ ID NO: 1909684 - RNA, 15 nt, Homo sapiens
uccucugaagggaaa

SEQ ID NO: 1909685 - RNA, 20 nt, Homo sapiens
guuucaccucuuugcucccu

SEQ ID NO: 1909686 - RNA, 21 nt, Homo sapiens
uugggauuuacuaguagccaa

SEQ ID NO: 1909687 - RNA, 14 nt, Homo sapiens
auauauguaaauag

SEQ ID NO: 1909688 - RNA, 19 nt, Homo sapiens
aaacacccaaaaauaucuc

SEQ ID NO: 1909689 - RNA, 20 nt, Homo sapiens
gcacuaccacgccaagcuaa

SEQ ID NO: 1909690 - RNA, 22 nt, Homo sapiens
ugguaaaaacugcagugucuuu

SEQ ID NO: 1909691 - RNA, 16 nt, Homo sapiens
gauaccaaauaccaug

SEQ ID NO: 1909692 - RNA, 15 nt, Homo sapiens
ccagugccauuccac

SEQ ID NO: 1909693 - RNA, 18 nt, Homo sapiens
cauaaaggaaaagacaca

SEQ ID NO: 1909694 - RNA, 18 nt, Homo sapiens
acuaggggacaaagcaaa

SEQ ID NO: 1909695 - RNA, 23 nt, Homo sapiens
augcaaccauuuuuaggaagcua

SEQ ID NO: 1909696 - RNA, 17 nt, Homo sapiens
uuuagugcuuaucuaau

SEQ ID NO: 1909697 - RNA, 21 nt, Homo sapiens
uuacauuagcugaaaagagaa

SEQ ID NO: 1909698 - RNA, 23 nt, Homo sapiens
uuugccuuccuuucuccaggacc

SEQ ID NO: 1909699 - RNA, 14 nt, Homo sapiens
uucuggaacagcuu

SEQ ID NO: 1909700 - RNA, 11 nt, Homo sapiens
ggaagccagag

SEQ ID NO: 1909701 - RNA, 15 nt, Homo sapiens
cuguguagcugugac

SEQ ID NO: 1909702 - RNA, 22 nt, Homo sapiens
gggccccucacccccagcugga

SEQ ID NO: 1909703 - RNA, 14 nt, Homo sapiens
auccccauccucca

SEQ ID NO: 1909704 - RNA, 23 nt, Homo sapiens
ucagcauuuucuucucugcacuu

SEQ ID NO: 1909705 - RNA, 21 nt, Homo sapiens
cuuuggccccucgacccugug

SEQ ID NO: 1909706 - RNA, 14 nt, Homo sapiens
uuccuugucccagg

SEQ ID NO: 1909707 - RNA, 20 nt, Homo sapiens
guuuaaaagccaucaaacac

SEQ ID NO: 1909708 - RNA, 17 nt, Homo sapiens
gacgagcagggugguga

SEQ ID NO: 1909709 - RNA, 18 nt, Homo sapiens
ucuacucaggcuggugga

SEQ ID NO: 1909710 - RNA, 14 nt, Homo sapiens
ucaccggagcuuuc

SEQ ID NO: 1909711 - RNA, 14 nt, Homo sapiens
ugggcucuccuagg

SEQ ID NO: 1909712 - RNA, 13 nt, Homo sapiens
acucuuucuuuca

SEQ ID NO: 1909713 - RNA, 16 nt, Homo sapiens
cccaaguuccacugcu

SEQ ID NO: 1909714 - RNA, 18 nt, Homo sapiens
gugcugcagccaggagga

SEQ ID NO: 1909715 - RNA, 20 nt, Homo sapiens
uauuaggaaauucugaugag

SEQ ID NO: 1909716 - RNA, 14 nt, Homo sapiens
cucccuggauuuuu

SEQ ID NO: 1909717 - RNA, 14 nt, Homo sapiens
uaucuuucaaagag

SEQ ID NO: 1909718 - RNA, 19 nt, Homo sapiens
gccaucuguaaauauccca

SEQ ID NO: 1909719 - RNA, 16 nt, Homo sapiens
ugggaggcccuggcag

SEQ ID NO: 1909720 - RNA, 13 nt, Homo sapiens
guuagcugcugaa

SEQ ID NO: 1909721 - RNA, 15 nt, Homo sapiens
uucauuccauugacu

SEQ ID NO: 1909722 - RNA, 18 nt, Homo sapiens
cuuacagucagcacagaa

SEQ ID NO: 1909723 - RNA, 20 nt, Homo sapiens
caagcaugaaccuuguuuaa

SEQ ID NO: 1909724 - RNA, 20 nt, Homo sapiens
cuucuucucuccacauggaa

SEQ ID NO: 1909725 - RNA, 21 nt, Homo sapiens
guccauaucacacacauugcu

SEQ ID NO: 1909726 - RNA, 18 nt, Homo sapiens
ucccagguuaucugggca

SEQ ID NO: 1909727 - RNA, 21 nt, Homo sapiens
cccaaggacagucagcauuuc

SEQ ID NO: 1909728 - RNA, 13 nt, Homo sapiens
gcccccccagugg

SEQ ID NO: 1909729 - RNA, 20 nt, Homo sapiens
ugucuaggcaggcaagagaa

SEQ ID NO: 1909730 - RNA, 20 nt, Homo sapiens
gcaacaaugagcagaccaac

SEQ ID NO: 1909731 - RNA, 18 nt, Homo sapiens
agacuuggacaucucucu

SEQ ID NO: 1909732 - RNA, 21 nt, Homo sapiens
gucagcuuuacuagugccaaa

SEQ ID NO: 1909733 - RNA, 21 nt, Homo sapiens
aguaaguaguaaugauucuca

SEQ ID NO: 1909734 - RNA, 15 nt, Homo sapiens
aauucacacaaagac

SEQ ID NO: 1909735 - RNA, 21 nt, Homo sapiens
uaaagaaauaacgugcaugcu

SEQ ID NO: 1909736 - RNA, 16 nt, Homo sapiens
uugauauugugaacau

SEQ ID NO: 1909737 - RNA, 18 nt, Homo sapiens
accuccgagaggcagcca

SEQ ID NO: 1909738 - RNA, 21 nt, Homo sapiens
aaaaaacaggcccccaugugc

SEQ ID NO: 1909739 - RNA, 18 nt, Homo sapiens
uccuauuuuaaaaccaug

SEQ ID NO: 1909740 - RNA, 19 nt, Homo sapiens
uauuaagugccugagacac

SEQ ID NO: 1909741 - RNA, 20 nt, Homo sapiens
ucaucuuuuagaguaaacua

SEQ ID NO: 1909742 - RNA, 20 nt, Homo sapiens
cuucaucgaacaaacugaug

SEQ ID NO: 1909743 - RNA, 13 nt, Homo sapiens
cucaacguuacau

SEQ ID NO: 1909744 - RNA, 16 nt, Homo sapiens
ucaugacuccuacuuu

SEQ ID NO: 1909745 - RNA, 20 nt, Homo sapiens
uuaacacuaccaauuuccca

SEQ ID NO: 1909746 - RNA, 23 nt, Homo sapiens
gacuguugaugccuuugaguuuu

SEQ ID NO: 1909747 - RNA, 20 nt, Homo sapiens
cugauuccccuccaccaaac

SEQ ID NO: 1909748 - RNA, 20 nt, Homo sapiens
gcaauacugagugugccuca

SEQ ID NO: 1909749 - RNA, 18 nt, Homo sapiens
gacauuuccaagcuguua

SEQ ID NO: 1909750 - RNA, 16 nt, Homo sapiens
cugaggggcaucugcc

SEQ ID NO: 1909751 - RNA, 20 nt, Homo sapiens
auacuuuuaaagccuauuca

SEQ ID NO: 1909752 - RNA, 20 nt, Homo sapiens
gagguagcacuacaaacaca

SEQ ID NO: 1909753 - RNA, 16 nt, Homo sapiens
cagauuuaaaaaaaga

SEQ ID NO: 1909754 - RNA, 15 nt, Homo sapiens
aacaguuugaaaaga

SEQ ID NO: 1909755 - RNA, 14 nt, Homo sapiens
agccugcuucccac

SEQ ID NO: 1909756 - RNA, 19 nt, Homo sapiens
gauaagagauguugacucu

SEQ ID NO: 1909757 - RNA, 17 nt, Homo sapiens
cuugaaggacuaauaga

SEQ ID NO: 1909758 - RNA, 16 nt, Homo sapiens
ccugcagggagcagca

SEQ ID NO: 1909759 - RNA, 19 nt, Homo sapiens
agucacacuguaaccucag

SEQ ID NO: 1909760 - RNA, 13 nt, Homo sapiens
uccugccuguggg

SEQ ID NO: 1909761 - RNA, 14 nt, Homo sapiens
cccaggaaucucaa

SEQ ID NO: 1909762 - RNA, 15 nt, Homo sapiens
gucuuacaauggaca

SEQ ID NO: 1909763 - RNA, 15 nt, Homo sapiens
cccagccagcaguuc

SEQ ID NO: 1909764 - RNA, 21 nt, Homo sapiens
ccuggaggacagagggagaca

SEQ ID NO: 1909765 - RNA, 16 nt, Homo sapiens
gcuuguuguuugcgca

SEQ ID NO: 1909766 - RNA, 18 nt, Homo sapiens
gagauugugguggugcua

SEQ ID NO: 1909767 - RNA, 22 nt, Homo sapiens
ccuguuaucuguguuugcugag

SEQ ID NO: 1909768 - RNA, 18 nt, Homo sapiens
gaaguuucuaacuuacaa

SEQ ID NO: 1909769 - RNA, 19 nt, Homo sapiens
agaugacccccagguauug

SEQ ID NO: 1909770 - RNA, 16 nt, Homo sapiens
ggaggccaaggugggc

SEQ ID NO: 1909771 - RNA, 17 nt, Homo sapiens
ucauaaaacggugcuuu

SEQ ID NO: 1909772 - RNA, 12 nt, Homo sapiens
uacguugugcau

SEQ ID NO: 1909773 - RNA, 12 nt, Homo sapiens
gagaaaugcugc

SEQ ID NO: 1909774 - RNA, 16 nt, Homo sapiens
cuuuaagcugugaugu

SEQ ID NO: 1909775 - RNA, 13 nt, Homo sapiens
gacccacacugcc

SEQ ID NO: 1909776 - RNA, 14 nt, Homo sapiens
uauccuuuaaacuc

SEQ ID NO: 1909777 - RNA, 13 nt, Homo sapiens
uuucuuccaacau

SEQ ID NO: 1909778 - RNA, 13 nt, Homo sapiens
uccucacuggucu

SEQ ID NO: 1909779 - RNA, 22 nt, Homo sapiens
aggugaacuguuuccacauuca

SEQ ID NO: 1909780 - RNA, 13 nt, Homo sapiens
gaaucaauccagc

SEQ ID NO: 1909781 - RNA, 17 nt, Homo sapiens
ugagcagcaacuguguc

SEQ ID NO: 1909782 - RNA, 21 nt, Homo sapiens
auuuuaaaugacgcacaaacu

SEQ ID NO: 1909783 - RNA, 17 nt, Homo sapiens
auaugcccucaucaucc

SEQ ID NO: 1909784 - RNA, 19 nt, Homo sapiens
cauccauaaagcaagcuca

SEQ ID NO: 1909785 - RNA, 20 nt, Homo sapiens
agcaguucagcuccuuccac

SEQ ID NO: 1909786 - RNA, 17 nt, Homo sapiens
cuaaauugaacugccaa

SEQ ID NO: 1909787 - RNA, 18 nt, Homo sapiens
ccccugguccugcacugu

SEQ ID NO: 1909788 - RNA, 10 nt, Homo sapiens
agggacacac

SEQ ID NO: 1909789 - RNA, 22 nt, Homo sapiens
ccuucaggguuuaauagacuga

SEQ ID NO: 1909790 - RNA, 16 nt, Homo sapiens
ggcgucccuuccaacc

SEQ ID NO: 1909791 - RNA, 17 nt, Homo sapiens
aaggcucuucuuccuca

SEQ ID NO: 1909792 - RNA, 21 nt, Homo sapiens
aaacugagacaggcaguuuca

SEQ ID NO: 1909793 - RNA, 16 nt, Homo sapiens
agccaugaucaugcca

SEQ ID NO: 1909794 - RNA, 21 nt, Homo sapiens
gguaauauugacuuguauauu

SEQ ID NO: 1909795 - RNA, 22 nt, Homo sapiens
aaaguucggugcuacuccaguu

SEQ ID NO: 1909796 - RNA, 15 nt, Homo sapiens
cuuguuaacagugga

SEQ ID NO: 1909797 - RNA, 23 nt, Homo sapiens
ucggaacagcagauaacaaugca

SEQ ID NO: 1909798 - RNA, 19 nt, Homo sapiens
ucagccacauauugagaug

SEQ ID NO: 1909799 - RNA, 16 nt, Homo sapiens
cuggauucaaauguca

SEQ ID NO: 1909800 - RNA, 20 nt, Homo sapiens
guuuacaaccuugugagcaa

SEQ ID NO: 1909801 - RNA, 13 nt, Homo sapiens
uagagguccucau

SEQ ID NO: 1909802 - RNA, 13 nt, Homo sapiens
ugagaucacccca

SEQ ID NO: 1909803 - RNA, 22 nt, Homo sapiens
ucuuuaagguagcaucauugau

SEQ ID NO: 1909804 - RNA, 14 nt, Homo sapiens
uccauaaacuaaga

SEQ ID NO: 1909805 - RNA, 23 nt, Homo sapiens
ucucauaucaugguagucacuaa

SEQ ID NO: 1909806 - RNA, 18 nt, Homo sapiens
aaagauguaaaaccuaac

SEQ ID NO: 1909807 - RNA, 22 nt, Homo sapiens
aguccaaccugccugugcauga

SEQ ID NO: 1909808 - RNA, 15 nt, Homo sapiens
acacagcagcaguua

SEQ ID NO: 1909809 - RNA, 16 nt, Homo sapiens
aauguccauuugcuga

SEQ ID NO: 1909810 - RNA, 18 nt, Homo sapiens
caaaaaguaaucauauau

SEQ ID NO: 1909811 - RNA, 17 nt, Homo sapiens
gaauuaaaacuuuguag

SEQ ID NO: 1909812 - RNA, 22 nt, Homo sapiens
gauaccauucuauucuccagac

SEQ ID NO: 1909813 - RNA, 18 nt, Homo sapiens
aucccaaagcaaggagau

SEQ ID NO: 1909814 - RNA, 14 nt, Homo sapiens
cacaguuccuugca

SEQ ID NO: 1909815 - RNA, 16 nt, Homo sapiens
aagaagcccuggccaa

SEQ ID NO: 1909816 - RNA, 20 nt, Homo sapiens
auguaauauauacauauuca

SEQ ID NO: 1909817 - RNA, 11 nt, Homo sapiens
gcaagggccag

SEQ ID NO: 1909818 - RNA, 18 nt, Homo sapiens
uguagauuaggucuugcu

SEQ ID NO: 1909819 - RNA, 11 nt, Homo sapiens
gcaauauuugg

SEQ ID NO: 1909820 - RNA, 19 nt, Homo sapiens
guacgucugguguucucaa

SEQ ID NO: 1909821 - RNA, 18 nt, Homo sapiens
acucugagaacuccucau

SEQ ID NO: 1909822 - RNA, 21 nt, Homo sapiens
ggaucucuccugaacucccac

SEQ ID NO: 1909823 - RNA, 12 nt, Homo sapiens
uacagcuguaua

SEQ ID NO: 1909824 - RNA, 22 nt, Homo sapiens
caaggaucuccagcucuaacaa

SEQ ID NO: 1909825 - RNA, 16 nt, Homo sapiens
aaaaauagcucuugcu

SEQ ID NO: 1909826 - RNA, 12 nt, Homo sapiens
aagcgugaaggc

SEQ ID NO: 1909827 - RNA, 15 nt, Homo sapiens
gaacacaagugcccc

SEQ ID NO: 1909828 - RNA, 19 nt, Homo sapiens
ucgcucccauauuuauccc

SEQ ID NO: 1909829 - RNA, 16 nt, Homo sapiens
aaaccuguuucugcag

SEQ ID NO: 1909830 - RNA, 22 nt, Homo sapiens
cuuacauccaaggcacugucac

SEQ ID NO: 1909831 - RNA, 18 nt, Homo sapiens
uccuuagcuuagaccuca

SEQ ID NO: 1909832 - RNA, 21 nt, Homo sapiens
caggcuccuguggcugucuug

SEQ ID NO: 1909833 - RNA, 18 nt, Homo sapiens
uuaacuggagaccagaaa

SEQ ID NO: 1909834 - RNA, 21 nt, Homo sapiens
aagaagaguuggagugagaug

SEQ ID NO: 1909835 - RNA, 16 nt, Homo sapiens
guuccgccacuccagu

SEQ ID NO: 1909836 - RNA, 18 nt, Homo sapiens
caccaaccuuccaagugu

SEQ ID NO: 1909837 - RNA, 17 nt, Homo sapiens
gggaacaagcauucucc

SEQ ID NO: 1909838 - RNA, 21 nt, Homo sapiens
cugaugacacugagaacagau

SEQ ID NO: 1909839 - RNA, 23 nt, Homo sapiens
agcuucaacccucagccuugaaa

SEQ ID NO: 1909840 - RNA, 20 nt, Homo sapiens
uggcuuggguucacagugca

SEQ ID NO: 1909841 - RNA, 21 nt, Homo sapiens
caaaaaagaaaaaaaaacugg

SEQ ID NO: 1909842 - RNA, 20 nt, Homo sapiens
auagcagagggguaagagag

SEQ ID NO: 1909843 - RNA, 14 nt, Homo sapiens
ucagaaacacuggg

SEQ ID NO: 1909844 - RNA, 15 nt, Homo sapiens
auaccuuccuucccu

SEQ ID NO: 1909845 - RNA, 12 nt, Homo sapiens
gagaaugugcag

SEQ ID NO: 1909846 - RNA, 13 nt, Homo sapiens
ugaggcuccgccc

SEQ ID NO: 1909847 - RNA, 13 nt, Homo sapiens
uugugugaugcgc

SEQ ID NO: 1909848 - RNA, 18 nt, Homo sapiens
ucugcuucuccuucaaaa

SEQ ID NO: 1909849 - RNA, 11 nt, Homo sapiens
gucacaugacc

SEQ ID NO: 1909850 - RNA, 15 nt, Homo sapiens
cucccccaggugcag

SEQ ID NO: 1909851 - RNA, 14 nt, Homo sapiens
cagggacugugaac

SEQ ID NO: 1909852 - RNA, 15 nt, Homo sapiens
agucugguguucuga

SEQ ID NO: 1909853 - RNA, 16 nt, Homo sapiens
aguccucgacuuauca

SEQ ID NO: 1909854 - RNA, 20 nt, Homo sapiens
ccuagauccaauugcauuua

SEQ ID NO: 1909855 - RNA, 15 nt, Homo sapiens
uauauuaaaauacca

SEQ ID NO: 1909856 - RNA, 15 nt, Homo sapiens
aaugacacagucuug

SEQ ID NO: 1909857 - RNA, 22 nt, Homo sapiens
aaccaacaaaaagaacaaauca

SEQ ID NO: 1909858 - RNA, 22 nt, Homo sapiens
aguguuggcaaacgagacuuuc

SEQ ID NO: 1909859 - RNA, 15 nt, Homo sapiens
guuaccugucuugcu

SEQ ID NO: 1909860 - RNA, 20 nt, Homo sapiens
gccaaugacaggacauuuga

SEQ ID NO: 1909861 - RNA, 20 nt, Homo sapiens
ucagccaugaaacugacuca

SEQ ID NO: 1909862 - RNA, 17 nt, Homo sapiens
uggggaugguccacugu

SEQ ID NO: 1909863 - RNA, 21 nt, Homo sapiens
cuuccacuuggcuacacaggg

SEQ ID NO: 1909864 - RNA, 14 nt, Homo sapiens
ugcccuccaucuca

SEQ ID NO: 1909865 - RNA, 22 nt, Homo sapiens
cauuuaaucauuuccagcaaaa

SEQ ID NO: 1909866 - RNA, 21 nt, Homo sapiens
uccaccuuggaccucagugac

SEQ ID NO: 1909867 - RNA, 13 nt, Homo sapiens
guuggucaguauu

SEQ ID NO: 1909868 - RNA, 19 nt, Homo sapiens
uccaguggaacagucuucc

SEQ ID NO: 1909869 - RNA, 16 nt, Homo sapiens
ucucaaacuucacuaa

SEQ ID NO: 1909870 - RNA, 22 nt, Homo sapiens
uaucaccagagagggacugaca

SEQ ID NO: 1909871 - RNA, 20 nt, Homo sapiens
cagguacagaaaacauguuu

SEQ ID NO: 1909872 - RNA, 20 nt, Homo sapiens
agacagaaaaaacugagaug

SEQ ID NO: 1909873 - RNA, 16 nt, Homo sapiens
auauuucccaauacau

SEQ ID NO: 1909874 - RNA, 19 nt, Homo sapiens
guggccuaggcuaccucaa

SEQ ID NO: 1909875 - RNA, 14 nt, Homo sapiens
uggugggaagcaag

SEQ ID NO: 1909876 - RNA, 13 nt, Homo sapiens
gguggcacacugg

SEQ ID NO: 1909877 - RNA, 23 nt, Homo sapiens
ucagucuaaggucucaugcuguu

SEQ ID NO: 1909878 - RNA, 17 nt, Homo sapiens
ucuagaacagccagacc

SEQ ID NO: 1909879 - RNA, 13 nt, Homo sapiens
auaaacuaaagaa

SEQ ID NO: 1909880 - RNA, 13 nt, Homo sapiens
guuuuaaagcuaa

SEQ ID NO: 1909881 - RNA, 20 nt, Homo sapiens
uuauucaguccuucagcuca

SEQ ID NO: 1909882 - RNA, 20 nt, Homo sapiens
ugacuccccccaucccugcc

SEQ ID NO: 1909883 - RNA, 23 nt, Homo sapiens
cagacuuggaguaaaacuguaua

SEQ ID NO: 1909884 - RNA, 23 nt, Homo sapiens
gcucuagccccagcgccaaagga

SEQ ID NO: 1909885 - RNA, 20 nt, Homo sapiens
aagauucuuaaaaauugaau

SEQ ID NO: 1909886 - RNA, 17 nt, Homo sapiens
ucuggaaaagcacuuua

SEQ ID NO: 1909887 - RNA, 12 nt, Homo sapiens
ucucauuuggag

SEQ ID NO: 1909888 - RNA, 18 nt, Homo sapiens
aucuguugaguugcugcc

SEQ ID NO: 1909889 - RNA, 21 nt, Homo sapiens
cccuagagauuaaguccagaa

SEQ ID NO: 1909890 - RNA, 12 nt, Homo sapiens
augaaaaauugg

SEQ ID NO: 1909891 - RNA, 21 nt, Homo sapiens
uaacccuuuucaugauuucaa

SEQ ID NO: 1909892 - RNA, 19 nt, Homo sapiens
auuuuguaaauaugcaaau

SEQ ID NO: 1909893 - RNA, 22 nt, Homo sapiens
cucaacggcuccaucaccagcc

SEQ ID NO: 1909894 - RNA, 14 nt, Homo sapiens
agagucucauuauu

SEQ ID NO: 1909895 - RNA, 17 nt, Homo sapiens
cucaccaaaaagcuuua

SEQ ID NO: 1909896 - RNA, 16 nt, Homo sapiens
auaaaugggaaaucag

SEQ ID NO: 1909897 - RNA, 16 nt, Homo sapiens
ggcacaugaucuggcc

SEQ ID NO: 1909898 - RNA, 20 nt, Homo sapiens
acucgggaggcugaggcaca

SEQ ID NO: 1909899 - RNA, 17 nt, Homo sapiens
agcauuguaaaugugcu

SEQ ID NO: 1909900 - RNA, 16 nt, Homo sapiens
uguugccauggugaug

SEQ ID NO: 1909901 - RNA, 12 nt, Homo sapiens
cucaacagcagg

SEQ ID NO: 1909902 - RNA, 16 nt, Homo sapiens
acaaaagauuaaucuu

SEQ ID NO: 1909903 - RNA, 12 nt, Homo sapiens
guauaauggggc

SEQ ID NO: 1909904 - RNA, 12 nt, Homo sapiens
aggcaaugauau

SEQ ID NO: 1909905 - RNA, 16 nt, Homo sapiens
uccaaaugaaugaccu

SEQ ID NO: 1909906 - RNA, 22 nt, Homo sapiens
uuuuaagaaacaaaagugcaua

SEQ ID NO: 1909907 - RNA, 19 nt, Homo sapiens
ucacucgaggucaggaguu

SEQ ID NO: 1909908 - RNA, 18 nt, Homo sapiens
uuccugccccaaccacaa

SEQ ID NO: 1909909 - RNA, 18 nt, Homo sapiens
aacauaauguaucaugaa

SEQ ID NO: 1909910 - RNA, 14 nt, Homo sapiens
uggcuaaauucaug

SEQ ID NO: 1909911 - RNA, 18 nt, Homo sapiens
uuguaaccauuucucacu

SEQ ID NO: 1909912 - RNA, 19 nt, Homo sapiens
acuccuaaaccuuugcccc

SEQ ID NO: 1909913 - RNA, 19 nt, Homo sapiens
uucaccauguuggccaggc

SEQ ID NO: 1909914 - RNA, 23 nt, Homo sapiens
cuuccugguugagcuucugcuaa

SEQ ID NO: 1909915 - RNA, 15 nt, Homo sapiens
gcugggccccuucca

SEQ ID NO: 1909916 - RNA, 18 nt, Homo sapiens
uaauugcuuugagcacaa

SEQ ID NO: 1909917 - RNA, 22 nt, Homo sapiens
uccuuuccauaaauccuugaug

SEQ ID NO: 1909918 - RNA, 19 nt, Homo sapiens
agucagcaaacuccacaaa

SEQ ID NO: 1909919 - RNA, 20 nt, Homo sapiens
ugaauaaaaauauguacaag

SEQ ID NO: 1909920 - RNA, 20 nt, Homo sapiens
gccaggagcuggacaccuac

SEQ ID NO: 1909921 - RNA, 23 nt, Homo sapiens
cagugccaccuaugccuguggug

SEQ ID NO: 1909922 - RNA, 18 nt, Homo sapiens
uccaaugugcccagucau

SEQ ID NO: 1909923 - RNA, 15 nt, Homo sapiens
gccgaucccaggugc

SEQ ID NO: 1909924 - RNA, 15 nt, Homo sapiens
cggacucccuacccc

SEQ ID NO: 1909925 - RNA, 13 nt, Homo sapiens
uccugacaucaca

SEQ ID NO: 1909926 - RNA, 14 nt, Homo sapiens
ggcauuucaggaag

SEQ ID NO: 1909927 - RNA, 13 nt, Homo sapiens
aaaacaauggaau

SEQ ID NO: 1909928 - RNA, 19 nt, Homo sapiens
uucccagagauguugagaa

SEQ ID NO: 1909929 - RNA, 20 nt, Homo sapiens
uuuccucuaaaagccuugga

SEQ ID NO: 1909930 - RNA, 11 nt, Homo sapiens
uguauccucca

SEQ ID NO: 1909931 - RNA, 13 nt, Homo sapiens
uugaaaccaaaga

SEQ ID NO: 1909932 - RNA, 19 nt, Homo sapiens
aacuacaauguagucucau

SEQ ID NO: 1909933 - RNA, 19 nt, Homo sapiens
acuccaucuccugcucacc

SEQ ID NO: 1909934 - RNA, 16 nt, Homo sapiens
uagaguucacuguugu

SEQ ID NO: 1909935 - RNA, 16 nt, Homo sapiens
uuggucccccuuccau

SEQ ID NO: 1909936 - RNA, 20 nt, Homo sapiens
uuaggcagugguuucuuaga

SEQ ID NO: 1909937 - RNA, 20 nt, Homo sapiens
uuucacacaauacaauaagu

SEQ ID NO: 1909938 - RNA, 23 nt, Homo sapiens
uaccaaugggguuguuagcuuuu

SEQ ID NO: 1909939 - RNA, 17 nt, Homo sapiens
uuguauccaaggaaaua

SEQ ID NO: 1909940 - RNA, 15 nt, Homo sapiens
ugauaaagcaguauu

SEQ ID NO: 1909941 - RNA, 23 nt, Homo sapiens
cuaaguguggaauuaccugauaa

SEQ ID NO: 1909942 - RNA, 19 nt, Homo sapiens
cccguuccugacaucacag

SEQ ID NO: 1909943 - RNA, 19 nt, Homo sapiens
gagaccuuccagaaauacu

SEQ ID NO: 1909944 - RNA, 16 nt, Homo sapiens
cugccugggaguuuug

SEQ ID NO: 1909945 - RNA, 22 nt, Homo sapiens
auaucauuggaacaacugauac

SEQ ID NO: 1909946 - RNA, 18 nt, Homo sapiens
uuauuaagcuuuuuggaa

SEQ ID NO: 1909947 - RNA, 21 nt, Homo sapiens
caggagaauuuuacuguguuu

SEQ ID NO: 1909948 - RNA, 18 nt, Homo sapiens
caaaacaauuaaucauuu

SEQ ID NO: 1909949 - RNA, 18 nt, Homo sapiens
cccaaucugccuuugaau

SEQ ID NO: 1909950 - RNA, 21 nt, Homo sapiens
cccaagacaugacauucuuag

SEQ ID NO: 1909951 - RNA, 18 nt, Homo sapiens
acugccuaugccaagucc

SEQ ID NO: 1909952 - RNA, 16 nt, Homo sapiens
uaaguuucucuucacc

SEQ ID NO: 1909953 - RNA, 16 nt, Homo sapiens
cugcuuguacuaagcc

SEQ ID NO: 1909954 - RNA, 18 nt, Homo sapiens
aaauaccagagccuucaa

SEQ ID NO: 1909955 - RNA, 14 nt, Homo sapiens
caaagggauguuca

SEQ ID NO: 1909956 - RNA, 12 nt, Homo sapiens
caucaguucccc

SEQ ID NO: 1909957 - RNA, 13 nt, Homo sapiens
cuuccaucuggcu

SEQ ID NO: 1909958 - RNA, 23 nt, Homo sapiens
uggcaucaaacagggcaaagugu

SEQ ID NO: 1909959 - RNA, 15 nt, Homo sapiens
ccaugguaauguaac

SEQ ID NO: 1909960 - RNA, 13 nt, Homo sapiens
ugauccauacuga

SEQ ID NO: 1909961 - RNA, 13 nt, Homo sapiens
gcucugaaauaua

SEQ ID NO: 1909962 - RNA, 21 nt, Homo sapiens
accuccccuguacuuaccugu

SEQ ID NO: 1909963 - RNA, 18 nt, Homo sapiens
acgaaacacaaaccacaa

SEQ ID NO: 1909964 - RNA, 21 nt, Homo sapiens
auauguagccuucacacagau

SEQ ID NO: 1909965 - RNA, 21 nt, Homo sapiens
uccuugucaacaaagugcuuu

SEQ ID NO: 1909966 - RNA, 14 nt, Homo sapiens
acgaugcacuuugg

SEQ ID NO: 1909967 - RNA, 19 nt, Homo sapiens
uugcuccuauacuauugaa

SEQ ID NO: 1909968 - RNA, 20 nt, Homo sapiens
aggggagcaacagaggacau

SEQ ID NO: 1909969 - RNA, 14 nt, Homo sapiens
ucuucccgugugua

SEQ ID NO: 1909970 - RNA, 13 nt, Homo sapiens
auacagugauaug

SEQ ID NO: 1909971 - RNA, 18 nt, Homo sapiens
acaccagacccucagcga

SEQ ID NO: 1909972 - RNA, 21 nt, Homo sapiens
auguucaagauaucagcauau

SEQ ID NO: 1909973 - RNA, 15 nt, Homo sapiens
gugcccaccaacauc

SEQ ID NO: 1909974 - RNA, 21 nt, Homo sapiens
uucucaucccccagccacagu

SEQ ID NO: 1909975 - RNA, 20 nt, Homo sapiens
aaccuugaaugcugccagug

SEQ ID NO: 1909976 - RNA, 18 nt, Homo sapiens
uuccuaaguucuuagaua

SEQ ID NO: 1909977 - RNA, 18 nt, Homo sapiens
uauaacuuauuugcccua

SEQ ID NO: 1909978 - RNA, 19 nt, Homo sapiens
cucgagguuucucaaagaa

SEQ ID NO: 1909979 - RNA, 21 nt, Homo sapiens
auccuccccagcgccaucugu

SEQ ID NO: 1909980 - RNA, 15 nt, Homo sapiens
auucucaaccuacca

SEQ ID NO: 1909981 - RNA, 20 nt, Homo sapiens
acugcacuccagucugggug

SEQ ID NO: 1909982 - RNA, 13 nt, Homo sapiens
ugcucagcccagg

SEQ ID NO: 1909983 - RNA, 21 nt, Homo sapiens
cugucucauaugauugugcac

SEQ ID NO: 1909984 - RNA, 14 nt, Homo sapiens
cacagcagcauuuu

SEQ ID NO: 1909985 - RNA, 14 nt, Homo sapiens
cacaguagcauuuc

SEQ ID NO: 1909986 - RNA, 18 nt, Homo sapiens
accuaugccagugcucaa

SEQ ID NO: 1909987 - RNA, 14 nt, Homo sapiens
ugccagacaugugg

SEQ ID NO: 1909988 - RNA, 18 nt, Homo sapiens
cugucuggcaaugccaca

SEQ ID NO: 1909989 - RNA, 20 nt, Homo sapiens
cuaagaaaaaaagcacaaag

SEQ ID NO: 1909990 - RNA, 18 nt, Homo sapiens
gaagguggggauugccca

SEQ ID NO: 1909991 - RNA, 13 nt, Homo sapiens
aucaagcgaugaa

SEQ ID NO: 1909992 - RNA, 13 nt, Homo sapiens
aguagcaccaaau

SEQ ID NO: 1909993 - RNA, 19 nt, Homo sapiens
uaaacagauggcacuuuga

SEQ ID NO: 1909994 - RNA, 22 nt, Homo sapiens
cagcagagguuugcugacaggu

SEQ ID NO: 1909995 - RNA, 20 nt, Homo sapiens
gugcugagugagcuggugac

SEQ ID NO: 1909996 - RNA, 19 nt, Homo sapiens
acauuauuacuccuugcca

SEQ ID NO: 1909997 - RNA, 14 nt, Homo sapiens
auucucaccaggaa

SEQ ID NO: 1909998 - RNA, 21 nt, Homo sapiens
ccugggguguccuacagugac

SEQ ID NO: 1909999 - RNA, 15 nt, Homo sapiens
cugaauucagcacca

SEQ ID NO: 1910000 - RNA, 18 nt, Homo sapiens
cgcuacccacuucuaaau

SEQ ID NO: 1910001 - RNA, 14 nt, Homo sapiens
agauuuccacagag

SEQ ID NO: 1910002 - RNA, 18 nt, Homo sapiens
aauuggugcuauuugaag

SEQ ID NO: 1910003 - RNA, 12 nt, Homo sapiens
cugacgccugaa

SEQ ID NO: 1910004 - RNA, 17 nt, Homo sapiens
aauuuugucauauaccc

SEQ ID NO: 1910005 - RNA, 15 nt, Homo sapiens
gcucaagugaucuuc

SEQ ID NO: 1910006 - RNA, 19 nt, Homo sapiens
gugcugggauuacaggugu

SEQ ID NO: 1910007 - RNA, 16 nt, Homo sapiens
gccuuuaaaucuguga

SEQ ID NO: 1910008 - RNA, 12 nt, Homo sapiens
gccgugccuugu

SEQ ID NO: 1910009 - RNA, 19 nt, Homo sapiens
cucugugcagucacuggag

SEQ ID NO: 1910010 - RNA, 16 nt, Homo sapiens
ggaggagggaggcgcu

SEQ ID NO: 1910011 - RNA, 22 nt, Homo sapiens
gagccuuuccucaaaacuggag

SEQ ID NO: 1910012 - RNA, 16 nt, Homo sapiens
cagcaaccccugcaug

SEQ ID NO: 1910013 - RNA, 14 nt, Homo sapiens
aagacguugccuau

SEQ ID NO: 1910014 - RNA, 20 nt, Homo sapiens
ucuugaaaagaagcaaggaa

SEQ ID NO: 1910015 - RNA, 17 nt, Homo sapiens
gucccaguacaaaaagg

SEQ ID NO: 1910016 - RNA, 21 nt, Homo sapiens
agaagauggcacuguccaggg

SEQ ID NO: 1910017 - RNA, 19 nt, Homo sapiens
ucucuucuacacagcaaua

SEQ ID NO: 1910018 - RNA, 19 nt, Homo sapiens
cugacaguaacagcaucuu

SEQ ID NO: 1910019 - RNA, 21 nt, Homo sapiens
cuccccauuugggacaucaag

SEQ ID NO: 1910020 - RNA, 20 nt, Homo sapiens
ucccaaagugcugggauuac

SEQ ID NO: 1910021 - RNA, 13 nt, Homo sapiens
uuaagccucagaa

SEQ ID NO: 1910022 - RNA, 20 nt, Homo sapiens
cccucaggagccucugcucc

SEQ ID NO: 1910023 - RNA, 17 nt, Homo sapiens
aauaggagagagaucau

SEQ ID NO: 1910024 - RNA, 17 nt, Homo sapiens
gggggaauaaagacaga

SEQ ID NO: 1910025 - RNA, 19 nt, Homo sapiens
cucacuugauucugcaguc

SEQ ID NO: 1910026 - RNA, 17 nt, Homo sapiens
aucauuccuucuggccu

SEQ ID NO: 1910027 - RNA, 23 nt, Homo sapiens
uggaaucagugaagccaaaggga

SEQ ID NO: 1910028 - RNA, 20 nt, Homo sapiens
uacgcugccucaacacugaa

SEQ ID NO: 1910029 - RNA, 16 nt, Homo sapiens
uugcugaguuguucua

SEQ ID NO: 1910030 - RNA, 18 nt, Homo sapiens
gaccaccuuuuugaguga

SEQ ID NO: 1910031 - RNA, 15 nt, Homo sapiens
ccucccggguucaca

SEQ ID NO: 1910032 - RNA, 23 nt, Homo sapiens
aggugcuucgaagaauguugccc

SEQ ID NO: 1910033 - RNA, 20 nt, Homo sapiens
ucuacaccuggaccauuuga

SEQ ID NO: 1910034 - RNA, 22 nt, Homo sapiens
aacuuucagaggcaauagguaa

SEQ ID NO: 1910035 - RNA, 15 nt, Homo sapiens
gaaaugacuuuucca

SEQ ID NO: 1910036 - RNA, 13 nt, Homo sapiens
uguugauguaucu

SEQ ID NO: 1910037 - RNA, 20 nt, Homo sapiens
aaugcauaauaacuacuucc

SEQ ID NO: 1910038 - RNA, 16 nt, Homo sapiens
gggggccacagcagcg

SEQ ID NO: 1910039 - RNA, 21 nt, Homo sapiens
uggaaaucugccaugagcaca

SEQ ID NO: 1910040 - RNA, 15 nt, Homo sapiens
ccugcuggggcugaa

SEQ ID NO: 1910041 - RNA, 23 nt, Homo sapiens
ggagagcaugcuaucccacggga

SEQ ID NO: 1910042 - RNA, 15 nt, Homo sapiens
uguagaccacugucc

SEQ ID NO: 1910043 - RNA, 12 nt, Homo sapiens
gaucuacaccca

SEQ ID NO: 1910044 - RNA, 18 nt, Homo sapiens
caaguguuccuauuuccc

SEQ ID NO: 1910045 - RNA, 15 nt, Homo sapiens
cuacaggugccccac

SEQ ID NO: 1910046 - RNA, 19 nt, Homo sapiens
auaaacaggcugacuggca

SEQ ID NO: 1910047 - RNA, 20 nt, Homo sapiens
augaaggacgugucucagga

SEQ ID NO: 1910048 - RNA, 22 nt, Homo sapiens
cucugguguaguuucugcauuu

SEQ ID NO: 1910049 - RNA, 13 nt, Homo sapiens
acucuuugcuaca

SEQ ID NO: 1910050 - RNA, 14 nt, Homo sapiens
agccucggccuccc

SEQ ID NO: 1910051 - RNA, 20 nt, Homo sapiens
agaugugcugcuuugauaua

SEQ ID NO: 1910052 - RNA, 20 nt, Homo sapiens
gaacacugggggaggggaca

SEQ ID NO: 1910053 - RNA, 21 nt, Homo sapiens
uggaauuagagggccuugcuu

SEQ ID NO: 1910054 - RNA, 16 nt, Homo sapiens
uugguggcuaccaugc

SEQ ID NO: 1910055 - RNA, 20 nt, Homo sapiens
ucacaggcuacaguugaaca

SEQ ID NO: 1910056 - RNA, 22 nt, Homo sapiens
uaaccuaccacuacauugcaca

SEQ ID NO: 1910057 - RNA, 22 nt, Homo sapiens
ugacucuggaaaaggcauauau

SEQ ID NO: 1910058 - RNA, 17 nt, Homo sapiens
uuuuuguacauuuggaa

SEQ ID NO: 1910059 - RNA, 23 nt, Homo sapiens
ucaucuuuauccuaaaaaucugg

SEQ ID NO: 1910060 - RNA, 20 nt, Homo sapiens
cuucagaacuuucugcaguu

SEQ ID NO: 1910061 - RNA, 18 nt, Homo sapiens
agucaaugggcagagcca

SEQ ID NO: 1910062 - RNA, 13 nt, Homo sapiens
cccagacacauuc

SEQ ID NO: 1910063 - RNA, 20 nt, Homo sapiens
ccacgacuguuguacaagcu

SEQ ID NO: 1910064 - RNA, 15 nt, Homo sapiens
guuuccugguuugua

SEQ ID NO: 1910065 - RNA, 21 nt, Homo sapiens
ggggcugacuucaauccaugu

SEQ ID NO: 1910066 - RNA, 23 nt, Homo sapiens
cuuguuuacaacauuuuugcaaa

SEQ ID NO: 1910067 - RNA, 17 nt, Homo sapiens
ggcagagaggacuguug

SEQ ID NO: 1910068 - RNA, 21 nt, Homo sapiens
acccugcgcaugaaccuggac

SEQ ID NO: 1910069 - RNA, 20 nt, Homo sapiens
gaaguugcugcugugaaucu

SEQ ID NO: 1910070 - RNA, 14 nt, Homo sapiens
uagacuuggagcug

SEQ ID NO: 1910071 - RNA, 17 nt, Homo sapiens
uacugcccaauaugcag

SEQ ID NO: 1910072 - RNA, 12 nt, Homo sapiens
ugcaaagcugcu

SEQ ID NO: 1910073 - RNA, 12 nt, Homo sapiens
cugaaagccugu

SEQ ID NO: 1910074 - RNA, 22 nt, Homo sapiens
agcugauuucagugcugcugaa

SEQ ID NO: 1910075 - RNA, 14 nt, Homo sapiens
accugaacucugca

SEQ ID NO: 1910076 - RNA, 20 nt, Homo sapiens
gagccuuaguuucagcugac

SEQ ID NO: 1910077 - RNA, 20 nt, Homo sapiens
uaugaugagcauacacacag

SEQ ID NO: 1910078 - RNA, 18 nt, Homo sapiens
auaagcuuuuaaugcucc

SEQ ID NO: 1910079 - RNA, 20 nt, Homo sapiens
ugaaagaggggugggaucca

SEQ ID NO: 1910080 - RNA, 19 nt, Homo sapiens
ugaugccuguguacugccu

SEQ ID NO: 1910081 - RNA, 17 nt, Homo sapiens
gcauaauacuugcuuug

SEQ ID NO: 1910082 - RNA, 14 nt, Homo sapiens
ucccagcacuuuga

SEQ ID NO: 1910083 - RNA, 14 nt, Homo sapiens
ucccaacacuuugg

SEQ ID NO: 1910084 - RNA, 17 nt, Homo sapiens
gggaaauucacacugug

SEQ ID NO: 1910085 - RNA, 23 nt, Homo sapiens
aucaaugauggcaccuacuuuug

SEQ ID NO: 1910086 - RNA, 13 nt, Homo sapiens
acuccugcaaaau

SEQ ID NO: 1910087 - RNA, 16 nt, Homo sapiens
uccaacgauuagcuuu

SEQ ID NO: 1910088 - RNA, 21 nt, Homo sapiens
gaggagaugaccagugccuug

SEQ ID NO: 1910089 - RNA, 15 nt, Homo sapiens
ccucccaagcacuuc

SEQ ID NO: 1910090 - RNA, 18 nt, Homo sapiens
auucaaccuuaccaaaaa

SEQ ID NO: 1910091 - RNA, 14 nt, Homo sapiens
cauggaggccaaga

SEQ ID NO: 1910092 - RNA, 16 nt, Homo sapiens
aaagguuuuacuauua

SEQ ID NO: 1910093 - RNA, 19 nt, Homo sapiens
agcuucaucuugagccuga

SEQ ID NO: 1910094 - RNA, 19 nt, Homo sapiens
acauccaaagcagacagcu

SEQ ID NO: 1910095 - RNA, 19 nt, Homo sapiens
ugggugcuccucuucugcc

SEQ ID NO: 1910096 - RNA, 11 nt, Homo sapiens
guuaaucugau

SEQ ID NO: 1910097 - RNA, 21 nt, Homo sapiens
ucuuagauggugaucugggau

SEQ ID NO: 1910098 - RNA, 17 nt, Homo sapiens
ucuuggcuuaaucauuu

SEQ ID NO: 1910099 - RNA, 23 nt, Homo sapiens
uaggcuacaauuuucucccagga

SEQ ID NO: 1910100 - RNA, 15 nt, Homo sapiens
gaauccccacaggga

SEQ ID NO: 1910101 - RNA, 15 nt, Homo sapiens
aucaugaacagcucu

SEQ ID NO: 1910102 - RNA, 18 nt, Homo sapiens
aguaaauuaguaauguac

SEQ ID NO: 1910103 - RNA, 20 nt, Homo sapiens
uccaggcgaugugcaagugu

SEQ ID NO: 1910104 - RNA, 19 nt, Homo sapiens
cuccuuccacauguacaua

SEQ ID NO: 1910105 - RNA, 18 nt, Homo sapiens
gcugccgugccugugucc

SEQ ID NO: 1910106 - RNA, 17 nt, Homo sapiens
aagcucccaagggaugg

SEQ ID NO: 1910107 - RNA, 23 nt, Homo sapiens
uccuaauuccacagcugcucaau

SEQ ID NO: 1910108 - RNA, 15 nt, Homo sapiens
uguggcagugguuuu

SEQ ID NO: 1910109 - RNA, 19 nt, Homo sapiens
ccaguuccacagcaguguc

SEQ ID NO: 1910110 - RNA, 17 nt, Homo sapiens
aauacuaccucacuacu

SEQ ID NO: 1910111 - RNA, 13 nt, Homo sapiens
cagggaggcgaug

SEQ ID NO: 1910112 - RNA, 13 nt, Homo sapiens
uaucagugugcaa

SEQ ID NO: 1910113 - RNA, 14 nt, Homo sapiens
auuugagacaggga

SEQ ID NO: 1910114 - RNA, 21 nt, Homo sapiens
ccaugaagcgaaacacagaga

SEQ ID NO: 1910115 - RNA, 14 nt, Homo sapiens
cacucccaguccaa

SEQ ID NO: 1910116 - RNA, 12 nt, Homo sapiens
ccuugcuaccug

SEQ ID NO: 1910117 - RNA, 14 nt, Homo sapiens
cugccagacugaag

SEQ ID NO: 1910118 - RNA, 15 nt, Homo sapiens
gccacacccagguga

SEQ ID NO: 1910119 - RNA, 17 nt, Homo sapiens
aagggcaauaaaugccc

SEQ ID NO: 1910120 - RNA, 22 nt, Homo sapiens
ccauauugcacaacucuacugu

SEQ ID NO: 1910121 - RNA, 21 nt, Homo sapiens
cuggggggcaccggcucagga

SEQ ID NO: 1910122 - RNA, 19 nt, Homo sapiens
uguaaauaauuugcacuga

SEQ ID NO: 1910123 - RNA, 19 nt, Homo sapiens
aaugaugucguuugaauca

SEQ ID NO: 1910124 - RNA, 14 nt, Homo sapiens
aggaggaucacuuu

SEQ ID NO: 1910125 - RNA, 16 nt, Homo sapiens
gaaaguuauugauaag

SEQ ID NO: 1910126 - RNA, 13 nt, Homo sapiens
guuaauccaguga

SEQ ID NO: 1910127 - RNA, 23 nt, Homo sapiens
uuauggaaggacuacagcagcau

SEQ ID NO: 1910128 - RNA, 17 nt, Homo sapiens
auuuuuaugacuauccu

SEQ ID NO: 1910129 - RNA, 15 nt, Homo sapiens
aaugaagaugucuaa

SEQ ID NO: 1910130 - RNA, 13 nt, Homo sapiens
aacuauugcugcu

SEQ ID NO: 1910131 - RNA, 19 nt, Homo sapiens
ugucaccguggaccuuccu

SEQ ID NO: 1910132 - RNA, 18 nt, Homo sapiens
agagagggaccauguguc

SEQ ID NO: 1910133 - RNA, 23 nt, Homo sapiens
aauguuagauauugcuacuauaa

SEQ ID NO: 1910134 - RNA, 18 nt, Homo sapiens
cauauauuuaauauguca

SEQ ID NO: 1910135 - RNA, 16 nt, Homo sapiens
ccugggccccacugga

SEQ ID NO: 1910136 - RNA, 12 nt, Homo sapiens
uuaaaaauaugu

SEQ ID NO: 1910137 - RNA, 22 nt, Homo sapiens
cacccaggcccgcaccgcuggg

SEQ ID NO: 1910138 - RNA, 21 nt, Homo sapiens
ggccuuggcaggcugcuggaa

SEQ ID NO: 1910139 - RNA, 22 nt, Homo sapiens
caaagaaaaugaaaugcauauu

SEQ ID NO: 1910140 - RNA, 19 nt, Homo sapiens
agacuccuuugcuaaugcu

SEQ ID NO: 1910141 - RNA, 23 nt, Homo sapiens
aacuguaccaugugcuacagggg

SEQ ID NO: 1910142 - RNA, 16 nt, Homo sapiens
aaaggaucagagauuc

SEQ ID NO: 1910143 - RNA, 14 nt, Homo sapiens
aaaauggacauauu

SEQ ID NO: 1910144 - RNA, 16 nt, Homo sapiens
gauagaaugauguuuu

SEQ ID NO: 1910145 - RNA, 20 nt, Homo sapiens
aucaacuuguguacugauaa

SEQ ID NO: 1910146 - RNA, 14 nt, Homo sapiens
auguaaaagcacau

SEQ ID NO: 1910147 - RNA, 18 nt, Homo sapiens
caacagaaaccagaaaag

SEQ ID NO: 1910148 - RNA, 19 nt, Homo sapiens
guuucuauuuucucugaua

SEQ ID NO: 1910149 - RNA, 19 nt, Homo sapiens
gaagcccccucuuccuccc

SEQ ID NO: 1910150 - RNA, 11 nt, Homo sapiens
ccuugaaccag

SEQ ID NO: 1910151 - RNA, 21 nt, Homo sapiens
caucacagcugaacuuguuga

SEQ ID NO: 1910152 - RNA, 20 nt, Homo sapiens
aggaagauuaaaaccacaga

SEQ ID NO: 1910153 - RNA, 22 nt, Homo sapiens
cacucaguggcccauggcauuu

SEQ ID NO: 1910154 - RNA, 22 nt, Homo sapiens
gacccugcucccacgccugcuu

SEQ ID NO: 1910155 - RNA, 19 nt, Homo sapiens
acaaaaagccuuuuccaga

SEQ ID NO: 1910156 - RNA, 17 nt, Homo sapiens
agagaaggggugcagag

SEQ ID NO: 1910157 - RNA, 17 nt, Homo sapiens
auagaagguuugcagau

SEQ ID NO: 1910158 - RNA, 17 nt, Homo sapiens
uaacuuucauaccacuu

SEQ ID NO: 1910159 - RNA, 23 nt, Homo sapiens
ugaaauucuuucagcuaucagua

SEQ ID NO: 1910160 - RNA, 22 nt, Homo sapiens
ugcaaaaauauauauguagcca

SEQ ID NO: 1910161 - RNA, 14 nt, Homo sapiens
uauuguauuugaga

SEQ ID NO: 1910162 - RNA, 14 nt, Homo sapiens
ucccuuaguacucu

SEQ ID NO: 1910163 - RNA, 18 nt, Homo sapiens
uggagaaaagcacaauca

SEQ ID NO: 1910164 - RNA, 16 nt, Homo sapiens
aacacaaugccuacuu

SEQ ID NO: 1910165 - RNA, 22 nt, Homo sapiens
aaacgauaaaauguggauuaaa

SEQ ID NO: 1910166 - RNA, 14 nt, Homo sapiens
cugagaagccucau

SEQ ID NO: 1910167 - RNA, 19 nt, Homo sapiens
ggcauucucgguacuucug

SEQ ID NO: 1910168 - RNA, 14 nt, Homo sapiens
aacaaggucugcuc

SEQ ID NO: 1910169 - RNA, 17 nt, Homo sapiens
cugacuucaucuggggu

SEQ ID NO: 1910170 - RNA, 18 nt, Homo sapiens
cccaaaacucaagcaaga

SEQ ID NO: 1910171 - RNA, 20 nt, Homo sapiens
ccagaacuuucuguccuaau

SEQ ID NO: 1910172 - RNA, 17 nt, Homo sapiens
agaccagcuuugcagug

SEQ ID NO: 1910173 - RNA, 13 nt, Homo sapiens
uaugaacuugagg

SEQ ID NO: 1910174 - RNA, 14 nt, Homo sapiens
ugaaauacucaggg

SEQ ID NO: 1910175 - RNA, 14 nt, Homo sapiens
uugggaaagcccag

SEQ ID NO: 1910176 - RNA, 21 nt, Homo sapiens
aguacuugugaaacacagcug

SEQ ID NO: 1910177 - RNA, 21 nt, Homo sapiens
ugaaagaagccaggugcaaaa

SEQ ID NO: 1910178 - RNA, 17 nt, Homo sapiens
gaacaagaauugcuaaa

SEQ ID NO: 1910179 - RNA, 16 nt, Homo sapiens
accucagacuuaccag

SEQ ID NO: 1910180 - RNA, 19 nt, Homo sapiens
cagaaacggucuuuaugaa

SEQ ID NO: 1910181 - RNA, 12 nt, Homo sapiens
uaugucugccua

SEQ ID NO: 1910182 - RNA, 14 nt, Homo sapiens
gauauacuuacuca

SEQ ID NO: 1910183 - RNA, 16 nt, Homo sapiens
uaaaaagauugccaau

SEQ ID NO: 1910184 - RNA, 14 nt, Homo sapiens
cccacgugcauuca

SEQ ID NO: 1910185 - RNA, 22 nt, Homo sapiens
acagagggucucagauggacga

SEQ ID NO: 1910186 - RNA, 17 nt, Homo sapiens
cagaguaugggcacuca

SEQ ID NO: 1910187 - RNA, 17 nt, Homo sapiens
caaagauagauggcuga

SEQ ID NO: 1910188 - RNA, 15 nt, Homo sapiens
agaaggcauuccagg

SEQ ID NO: 1910189 - RNA, 18 nt, Homo sapiens
aaaucaggaaccacagau

SEQ ID NO: 1910190 - RNA, 17 nt, Homo sapiens
uuagaguuagacuguug

SEQ ID NO: 1910191 - RNA, 14 nt, Homo sapiens
cucugcacccagug

SEQ ID NO: 1910192 - RNA, 22 nt, Homo sapiens
aggcagccuccuuaaauguuuu

SEQ ID NO: 1910193 - RNA, 14 nt, Homo sapiens
agauacuucccaaa

SEQ ID NO: 1910194 - RNA, 13 nt, Homo sapiens
aacugucuuggcu

SEQ ID NO: 1910195 - RNA, 15 nt, Homo sapiens
gggccccuuugcuga

SEQ ID NO: 1910196 - RNA, 14 nt, Homo sapiens
ccagaggacaaaag

SEQ ID NO: 1910197 - RNA, 14 nt, Homo sapiens
gaaggagagcaaga

SEQ ID NO: 1910198 - RNA, 19 nt, Homo sapiens
acaggaugcuggccuuugc

SEQ ID NO: 1910199 - RNA, 13 nt, Homo sapiens
uggauugugcuuu

SEQ ID NO: 1910200 - RNA, 18 nt, Homo sapiens
uugcuuuaaaacaaaggg

SEQ ID NO: 1910201 - RNA, 15 nt, Homo sapiens
gaggaugcugugccu

SEQ ID NO: 1910202 - RNA, 15 nt, Homo sapiens
aaaaucuuacuuugu

SEQ ID NO: 1910203 - RNA, 21 nt, Homo sapiens
ccuugcgauucugcagccaca

SEQ ID NO: 1910204 - RNA, 16 nt, Homo sapiens
cugcagcucugaccca

SEQ ID NO: 1910205 - RNA, 23 nt, Homo sapiens
cuuguaguauuuugggagcaaaa

SEQ ID NO: 1910206 - RNA, 23 nt, Homo sapiens
gcauucuagagugcauauauuua

SEQ ID NO: 1910207 - RNA, 16 nt, Homo sapiens
gcaagcaccuguuaau

SEQ ID NO: 1910208 - RNA, 16 nt, Homo sapiens
ucuuguguuaccugaa

SEQ ID NO: 1910209 - RNA, 19 nt, Homo sapiens
augucaguuccaaugaggu

SEQ ID NO: 1910210 - RNA, 19 nt, Homo sapiens
ucuuaaccuuugcuaugua

SEQ ID NO: 1910211 - RNA, 19 nt, Homo sapiens
ucucccuccccugccauuu

SEQ ID NO: 1910212 - RNA, 17 nt, Homo sapiens
acuuaauguaauucagg

SEQ ID NO: 1910213 - RNA, 14 nt, Homo sapiens
ucuguaaggaacug

SEQ ID NO: 1910214 - RNA, 18 nt, Homo sapiens
cggccuccugucccucau

SEQ ID NO: 1910215 - RNA, 17 nt, Homo sapiens
aagcaucuaaacuuuaa

SEQ ID NO: 1910216 - RNA, 15 nt, Homo sapiens
agaugguugccaagc

SEQ ID NO: 1910217 - RNA, 13 nt, Homo sapiens
uguugacugugau

SEQ ID NO: 1910218 - RNA, 14 nt, Homo sapiens
aagacacucccacc

SEQ ID NO: 1910219 - RNA, 19 nt, Homo sapiens
aaaaacuuucucuuugcca

SEQ ID NO: 1910220 - RNA, 20 nt, Homo sapiens
uggaggcagugucauuugcu

SEQ ID NO: 1910221 - RNA, 18 nt, Homo sapiens
gauuaacacucauuucca

SEQ ID NO: 1910222 - RNA, 15 nt, Homo sapiens
caaaauauauauuaa

SEQ ID NO: 1910223 - RNA, 13 nt, Homo sapiens
cugaaugcuccau

SEQ ID NO: 1910224 - RNA, 17 nt, Homo sapiens
guuuccaucagacugaa

SEQ ID NO: 1910225 - RNA, 20 nt, Homo sapiens
uuccuaguggguuaguguga

SEQ ID NO: 1910226 - RNA, 14 nt, Homo sapiens
acugucucagccaa

SEQ ID NO: 1910227 - RNA, 12 nt, Homo sapiens
gaugaacauuca

SEQ ID NO: 1910228 - RNA, 17 nt, Homo sapiens
aaagcaaggacugcccu

SEQ ID NO: 1910229 - RNA, 16 nt, Homo sapiens
cuugagaccauuucaa

SEQ ID NO: 1910230 - RNA, 16 nt, Homo sapiens
ucuuguuacugcugau

SEQ ID NO: 1910231 - RNA, 17 nt, Homo sapiens
augggggaacucagauc

SEQ ID NO: 1910232 - RNA, 12 nt, Homo sapiens
ggaaguugcuga

SEQ ID NO: 1910233 - RNA, 18 nt, Homo sapiens
acuauauuuauacuguau

SEQ ID NO: 1910234 - RNA, 18 nt, Homo sapiens
gccaucaccauaaccucu

SEQ ID NO: 1910235 - RNA, 14 nt, Homo sapiens
caggcugggccaug

SEQ ID NO: 1910236 - RNA, 21 nt, Homo sapiens
acagcagucccaguauucuca

SEQ ID NO: 1910237 - RNA, 20 nt, Homo sapiens
cuauguuuauuuuuguacau

SEQ ID NO: 1910238 - RNA, 13 nt, Homo sapiens
agaguuuccugaa

SEQ ID NO: 1910239 - RNA, 23 nt, Homo sapiens
gaguuccaugaagaccacaucca

SEQ ID NO: 1910240 - RNA, 14 nt, Homo sapiens
aaauuacacuuuga

SEQ ID NO: 1910241 - RNA, 17 nt, Homo sapiens
uguuauuuuucaaggaa

SEQ ID NO: 1910242 - RNA, 14 nt, Homo sapiens
acgaaucagacuca

SEQ ID NO: 1910243 - RNA, 15 nt, Homo sapiens
aauaaaccaguguga

SEQ ID NO: 1910244 - RNA, 20 nt, Homo sapiens
uuuagcaacacaucuaccaa

SEQ ID NO: 1910245 - RNA, 20 nt, Homo sapiens
gcaaugugcccccagacgca

SEQ ID NO: 1910246 - RNA, 18 nt, Homo sapiens
ccaacagaagcagacuuu

SEQ ID NO: 1910247 - RNA, 16 nt, Homo sapiens
caauaaaguacuuuac

SEQ ID NO: 1910248 - RNA, 21 nt, Homo sapiens
auuccuguacaauuucauccc

SEQ ID NO: 1910249 - RNA, 23 nt, Homo sapiens
cauuucaauuagggaugcucaaa

SEQ ID NO: 1910250 - RNA, 22 nt, Homo sapiens
acaaagccacccuaccaugaau

SEQ ID NO: 1910251 - RNA, 18 nt, Homo sapiens
gacuuuguaucuucacug

SEQ ID NO: 1910252 - RNA, 23 nt, Homo sapiens
gggagacugacacgaagccagca

SEQ ID NO: 1910253 - RNA, 13 nt, Homo sapiens
uguggaagugugu

SEQ ID NO: 1910254 - RNA, 13 nt, Homo sapiens
ugcagaagugcau

SEQ ID NO: 1910255 - RNA, 13 nt, Homo sapiens
cacagaagcacau

SEQ ID NO: 1910256 - RNA, 19 nt, Homo sapiens
aaauacaaacaagcacaga

SEQ ID NO: 1910257 - RNA, 16 nt, Homo sapiens
cucuuaaguuucucag

SEQ ID NO: 1910258 - RNA, 20 nt, Homo sapiens
uaaauauauauuauucucau

SEQ ID NO: 1910259 - RNA, 18 nt, Homo sapiens
aacuaugcuuuagaacuu

SEQ ID NO: 1910260 - RNA, 17 nt, Homo sapiens
cuacaugaaauaaugca

SEQ ID NO: 1910261 - RNA, 14 nt, Homo sapiens
ugcucacucaggac

SEQ ID NO: 1910262 - RNA, 18 nt, Homo sapiens
uguccucagccuugccag

SEQ ID NO: 1910263 - RNA, 21 nt, Homo sapiens
cuguaccacguggguccucuu

SEQ ID NO: 1910264 - RNA, 19 nt, Homo sapiens
uaccacuugugauucaaac

SEQ ID NO: 1910265 - RNA, 14 nt, Homo sapiens
aauggaagcaaaga

SEQ ID NO: 1910266 - RNA, 14 nt, Homo sapiens
agauagaauucaau

SEQ ID NO: 1910267 - RNA, 15 nt, Homo sapiens
cagccuggacauaga

SEQ ID NO: 1910268 - RNA, 16 nt, Homo sapiens
ugcccucuccaaaggc

SEQ ID NO: 1910269 - RNA, 14 nt, Homo sapiens
ccagcucugacuga

SEQ ID NO: 1910270 - RNA, 21 nt, Homo sapiens
gcaucacuggggaggacguga

SEQ ID NO: 1910271 - RNA, 18 nt, Homo sapiens
uuaaaaucuacagaacua

SEQ ID NO: 1910272 - RNA, 17 nt, Homo sapiens
cuuagguuggcaaaaag

SEQ ID NO: 1910273 - RNA, 17 nt, Homo sapiens
uacauuccuaucuuauu

SEQ ID NO: 1910274 - RNA, 14 nt, Homo sapiens
ccuuucagauucag

SEQ ID NO: 1910275 - RNA, 17 nt, Homo sapiens
aaaucugggcauugagc

SEQ ID NO: 1910276 - RNA, 17 nt, Homo sapiens
cagugcacugaaaguca

SEQ ID NO: 1910277 - RNA, 13 nt, Homo sapiens
acauacaaugaag

SEQ ID NO: 1910278 - RNA, 16 nt, Homo sapiens
uauuuucaaagacuua

SEQ ID NO: 1910279 - RNA, 20 nt, Homo sapiens
auucacacaccccucaaaaa

SEQ ID NO: 1910280 - RNA, 21 nt, Homo sapiens
cucuucuuggggcccagugca

SEQ ID NO: 1910281 - RNA, 15 nt, Homo sapiens
gaguucaacuuugag

SEQ ID NO: 1910282 - RNA, 17 nt, Homo sapiens
augacgugccuaccucu

SEQ ID NO: 1910283 - RNA, 13 nt, Homo sapiens
uaagcaacaucua

SEQ ID NO: 1910284 - RNA, 13 nt, Homo sapiens
uuagauugccacu

SEQ ID NO: 1910285 - RNA, 15 nt, Homo sapiens
agccucacaauccca

SEQ ID NO: 1910286 - RNA, 16 nt, Homo sapiens
cccaggcuggucuuga

SEQ ID NO: 1910287 - RNA, 16 nt, Homo sapiens
agggggcuauucccug

SEQ ID NO: 1910288 - RNA, 23 nt, Homo sapiens
agucugcucaacacgacugcaag

SEQ ID NO: 1910289 - RNA, 23 nt, Homo sapiens
aauguuggaugaugaaacauuca

SEQ ID NO: 1910290 - RNA, 23 nt, Homo sapiens
acagagaugcgaaccacccaaaa

SEQ ID NO: 1910291 - RNA, 17 nt, Homo sapiens
gguccccucugccccac

SEQ ID NO: 1910292 - RNA, 20 nt, Homo sapiens
gaauauuuguuuuaauacca

SEQ ID NO: 1910293 - RNA, 14 nt, Homo sapiens
aagcaacaauacag

SEQ ID NO: 1910294 - RNA, 18 nt, Homo sapiens
auggaaacugaaugcucc

SEQ ID NO: 1910295 - RNA, 23 nt, Homo sapiens
uguacuaaaccaccucagaaagg

SEQ ID NO: 1910296 - RNA, 19 nt, Homo sapiens
uuucugcuuacaaagacaa

SEQ ID NO: 1910297 - RNA, 20 nt, Homo sapiens
ugccugagaauguuaccaga

SEQ ID NO: 1910298 - RNA, 22 nt, Homo sapiens
gcugucucuccuaccugucuuc

SEQ ID NO: 1910299 - RNA, 12 nt, Homo sapiens
uuuuauugcucg

SEQ ID NO: 1910300 - RNA, 20 nt, Homo sapiens
acuccugaccucaggugaug

SEQ ID NO: 1910301 - RNA, 22 nt, Homo sapiens
acagaacugcuaaauacuguac

SEQ ID NO: 1910302 - RNA, 12 nt, Homo sapiens
cucagguguguu

SEQ ID NO: 1910303 - RNA, 21 nt, Homo sapiens
cuagaaaaauguucuuuaaag

SEQ ID NO: 1910304 - RNA, 23 nt, Homo sapiens
ugcuggucuucaauuaccaagaa

SEQ ID NO: 1910305 - RNA, 23 nt, Homo sapiens
caggugguuuuugguuacaugga

SEQ ID NO: 1910306 - RNA, 22 nt, Homo sapiens
uggccuguucuucuauggguug

SEQ ID NO: 1910307 - RNA, 12 nt, Homo sapiens
uugcucugccac

SEQ ID NO: 1910308 - RNA, 18 nt, Homo sapiens
ucucgcuccucaaccccu

SEQ ID NO: 1910309 - RNA, 18 nt, Homo sapiens
cacacggggcacccagcc

SEQ ID NO: 1910310 - RNA, 22 nt, Homo sapiens
cagagagacuguuaucaggacu

SEQ ID NO: 1910311 - RNA, 17 nt, Homo sapiens
gucucagaccacuauuc

SEQ ID NO: 1910312 - RNA, 17 nt, Homo sapiens
gucuuaguacaccauaa

SEQ ID NO: 1910313 - RNA, 14 nt, Homo sapiens
cagcuggcucugca

SEQ ID NO: 1910314 - RNA, 14 nt, Homo sapiens
augaugugcaaaac

SEQ ID NO: 1910315 - RNA, 17 nt, Homo sapiens
guuaauguuauaucaua

SEQ ID NO: 1910316 - RNA, 17 nt, Homo sapiens
cuuuagagucuaagaaa

SEQ ID NO: 1910317 - RNA, 21 nt, Homo sapiens
uauaugcagaacacauuucaa

SEQ ID NO: 1910318 - RNA, 17 nt, Homo sapiens
cccaagaugucaaaaca

SEQ ID NO: 1910319 - RNA, 13 nt, Homo sapiens
gagagaaaacugc

SEQ ID NO: 1910320 - RNA, 20 nt, Homo sapiens
ucugaaauuggucacuuucc

SEQ ID NO: 1910321 - RNA, 21 nt, Homo sapiens
ucauuguaaauuauuucauac

SEQ ID NO: 1910322 - RNA, 20 nt, Homo sapiens
ccugcccugaggagggcccu

SEQ ID NO: 1910323 - RNA, 15 nt, Homo sapiens
agggcagacagcaga

SEQ ID NO: 1910324 - RNA, 20 nt, Homo sapiens
ugcccccaaccauuuccuca

SEQ ID NO: 1910325 - RNA, 13 nt, Homo sapiens
auggccaugcccu

SEQ ID NO: 1910326 - RNA, 17 nt, Homo sapiens
uuucuagccuuaguucc

SEQ ID NO: 1910327 - RNA, 15 nt, Homo sapiens
accaacuuuuuccaa

SEQ ID NO: 1910328 - RNA, 14 nt, Homo sapiens
uaaacagaugaaua

SEQ ID NO: 1910329 - RNA, 21 nt, Homo sapiens
uacacuuggaguuugcauucu

SEQ ID NO: 1910330 - RNA, 12 nt, Homo sapiens
augucuucuccc

SEQ ID NO: 1910331 - RNA, 16 nt, Homo sapiens
augcugagccaacugc

SEQ ID NO: 1910332 - RNA, 15 nt, Homo sapiens
aucuccuuuacuaga

SEQ ID NO: 1910333 - RNA, 13 nt, Homo sapiens
aagcccacaagau

SEQ ID NO: 1910334 - RNA, 15 nt, Homo sapiens
uggcauuaucucuuu

SEQ ID NO: 1910335 - RNA, 15 nt, Homo sapiens
cuuucccugccacau

SEQ ID NO: 1910336 - RNA, 13 nt, Homo sapiens
uggaaauccagau

SEQ ID NO: 1910337 - RNA, 18 nt, Homo sapiens
aaugaaguaaaggucagu

SEQ ID NO: 1910338 - RNA, 16 nt, Homo sapiens
aaacaaaugugauaca

SEQ ID NO: 1910339 - RNA, 16 nt, Homo sapiens
aaaaucaagugcaccu

SEQ ID NO: 1910340 - RNA, 17 nt, Homo sapiens
gugguuuucccaucuca

SEQ ID NO: 1910341 - RNA, 15 nt, Homo sapiens
uagccagaaucucau

SEQ ID NO: 1910342 - RNA, 14 nt, Homo sapiens
cccccugcccagag

SEQ ID NO: 1910343 - RNA, 15 nt, Homo sapiens
uggcugcaagugguu

SEQ ID NO: 1910344 - RNA, 23 nt, Homo sapiens
ccaaggcauugauugcacuugau

SEQ ID NO: 1910345 - RNA, 23 nt, Homo sapiens
cuugagccccagaggcagagguu

SEQ ID NO: 1910346 - RNA, 15 nt, Homo sapiens
accacccugggcaac

SEQ ID NO: 1910347 - RNA, 23 nt, Homo sapiens
acguuguuuugguuguacuuugg

SEQ ID NO: 1910348 - RNA, 15 nt, Homo sapiens
caaguuaguucaauc

SEQ ID NO: 1910349 - RNA, 15 nt, Homo sapiens
acuacucagugcaua

SEQ ID NO: 1910350 - RNA, 14 nt, Homo sapiens
agccuccaccugau

SEQ ID NO: 1910351 - RNA, 20 nt, Homo sapiens
uauuccagacagucacaaau

SEQ ID NO: 1910352 - RNA, 20 nt, Homo sapiens
cgugcgucugugugugccug

SEQ ID NO: 1910353 - RNA, 22 nt, Homo sapiens
uucuaauuugcauugugucaga

SEQ ID NO: 1910354 - RNA, 15 nt, Homo sapiens
ucuugcucuaucuca

SEQ ID NO: 1910355 - RNA, 16 nt, Homo sapiens
cgcuauccaguugcag

SEQ ID NO: 1910356 - RNA, 17 nt, Homo sapiens
uuguaccauuuucuauc

SEQ ID NO: 1910357 - RNA, 16 nt, Homo sapiens
ggacuacacagcuccu

SEQ ID NO: 1910358 - RNA, 17 nt, Homo sapiens
uguaaacaagcaauaau

SEQ ID NO: 1910359 - RNA, 16 nt, Homo sapiens
ugacagccuugcccac

SEQ ID NO: 1910360 - RNA, 15 nt, Homo sapiens
ugcauccccuuccag

SEQ ID NO: 1910361 - RNA, 10 nt, Homo sapiens
ccagcccaga

SEQ ID NO: 1910362 - RNA, 16 nt, Homo sapiens
uggaaauaauacccca

SEQ ID NO: 1910363 - RNA, 15 nt, Homo sapiens
caugagacucagugc

SEQ ID NO: 1910364 - RNA, 21 nt, Homo sapiens
ucagugcacacggaugcacag

SEQ ID NO: 1910365 - RNA, 19 nt, Homo sapiens
guauuuucugucacuguag

SEQ ID NO: 1910366 - RNA, 18 nt, Homo sapiens
uucauuaauacagggcau

SEQ ID NO: 1910367 - RNA, 22 nt, Homo sapiens
gcacccaggacuuccauuugcu

SEQ ID NO: 1910368 - RNA, 12 nt, Homo sapiens
aauguacauguu

SEQ ID NO: 1910369 - RNA, 21 nt, Homo sapiens
augucugucagaagacacuaa

SEQ ID NO: 1910370 - RNA, 19 nt, Homo sapiens
uccuauuccuucacacagu

SEQ ID NO: 1910371 - RNA, 22 nt, Homo sapiens
gaccguauacuuaaaaugacaa

SEQ ID NO: 1910372 - RNA, 21 nt, Homo sapiens
guacuauucugagcauacuca

SEQ ID NO: 1910373 - RNA, 12 nt, Homo sapiens
gccacaauguga

SEQ ID NO: 1910374 - RNA, 16 nt, Homo sapiens
ggcuuaggacuuucca

SEQ ID NO: 1910375 - RNA, 17 nt, Homo sapiens
auuuaccagcagcccug

SEQ ID NO: 1910376 - RNA, 22 nt, Homo sapiens
gcucuugaccaaguaugacaac

SEQ ID NO: 1910377 - RNA, 13 nt, Homo sapiens
agcugugcugggu

SEQ ID NO: 1910378 - RNA, 12 nt, Homo sapiens
gcuccuccaugg

SEQ ID NO: 1910379 - RNA, 21 nt, Homo sapiens
acaugccccuugguccuggca

SEQ ID NO: 1910380 - RNA, 17 nt, Homo sapiens
cugguugaaaaauggca

SEQ ID NO: 1910381 - RNA, 23 nt, Homo sapiens
uggagaagcucaucagaaacuca

SEQ ID NO: 1910382 - RNA, 21 nt, Homo sapiens
cucaaauguucuaaguuucua

SEQ ID NO: 1910383 - RNA, 16 nt, Homo sapiens
auacacgucacaaaga

SEQ ID NO: 1910384 - RNA, 18 nt, Homo sapiens
aacacagcaugugccaag

SEQ ID NO: 1910385 - RNA, 20 nt, Homo sapiens
caucagcucucugcaaagau

SEQ ID NO: 1910386 - RNA, 21 nt, Homo sapiens
cuugaugacugccuugccucc

SEQ ID NO: 1910387 - RNA, 18 nt, Homo sapiens
ugacaauacugcugccuu

SEQ ID NO: 1910388 - RNA, 13 nt, Homo sapiens
gaaaagucuuccu

SEQ ID NO: 1910389 - RNA, 22 nt, Homo sapiens
acuuaaucauacaguaagcuga

SEQ ID NO: 1910390 - RNA, 13 nt, Homo sapiens
cucccccaguucc

SEQ ID NO: 1910391 - RNA, 18 nt, Homo sapiens
acaaaggagauaaaucua

SEQ ID NO: 1910392 - RNA, 23 nt, Homo sapiens
cagacaacaguugcacagugccu

SEQ ID NO: 1910393 - RNA, 22 nt, Homo sapiens
aacccucuccuguuuacugaaa

SEQ ID NO: 1910394 - RNA, 17 nt, Homo sapiens
acagcaaugacauuuau

SEQ ID NO: 1910395 - RNA, 13 nt, Homo sapiens
uacaauagucaaa

SEQ ID NO: 1910396 - RNA, 14 nt, Homo sapiens
ucaagggcauuaca

SEQ ID NO: 1910397 - RNA, 20 nt, Homo sapiens
ucugguggccacuucauucc

SEQ ID NO: 1910398 - RNA, 22 nt, Homo sapiens
ucuccuaacaaaagaacuaaga

SEQ ID NO: 1910399 - RNA, 19 nt, Homo sapiens
gugguugaagagcaaugug

SEQ ID NO: 1910400 - RNA, 11 nt, Homo sapiens
aagaaagcuau

SEQ ID NO: 1910401 - RNA, 20 nt, Homo sapiens
acugugaaagcuagacugaa

SEQ ID NO: 1910402 - RNA, 18 nt, Homo sapiens
cacaccuguuauugccaa

SEQ ID NO: 1910403 - RNA, 20 nt, Homo sapiens
aaauucaaugcuugauguua

SEQ ID NO: 1910404 - RNA, 20 nt, Homo sapiens
ccaggcucucgcacaccucu

SEQ ID NO: 1910405 - RNA, 19 nt, Homo sapiens
uugucaacaaaccaagcau

SEQ ID NO: 1910406 - RNA, 19 nt, Homo sapiens
gugcugacgagcagggugg

SEQ ID NO: 1910407 - RNA, 18 nt, Homo sapiens
cugccaaugauuccagac

SEQ ID NO: 1910408 - RNA, 13 nt, Homo sapiens
cuuaccugugcuu

SEQ ID NO: 1910409 - RNA, 19 nt, Homo sapiens
gggcagcgcaugugugcau

SEQ ID NO: 1910410 - RNA, 20 nt, Homo sapiens
cucgggaagccccauccaac

SEQ ID NO: 1910411 - RNA, 13 nt, Homo sapiens
aauagaacuacaa

SEQ ID NO: 1910412 - RNA, 18 nt, Homo sapiens
aauauauaaaaaagccac

SEQ ID NO: 1910413 - RNA, 21 nt, Homo sapiens
cuuuucucugucuacuccuua

SEQ ID NO: 1910414 - RNA, 17 nt, Homo sapiens
aguuugcuguaccacaa

SEQ ID NO: 1910415 - RNA, 19 nt, Homo sapiens
caugcacuuggcugcauaa

SEQ ID NO: 1910416 - RNA, 14 nt, Homo sapiens
caucagcacaaaga

SEQ ID NO: 1910417 - RNA, 13 nt, Homo sapiens
cccucgugaccua

SEQ ID NO: 1910418 - RNA, 13 nt, Homo sapiens
ccucauuagcauu

SEQ ID NO: 1910419 - RNA, 20 nt, Homo sapiens
cugucccccuacccaccgau

SEQ ID NO: 1910420 - RNA, 22 nt, Homo sapiens
auggucagaaccuuuggacaag

SEQ ID NO: 1910421 - RNA, 20 nt, Homo sapiens
agagaaccuaacuguaucuu

SEQ ID NO: 1910422 - RNA, 23 nt, Homo sapiens
ccaggcuggauacuaagcacaaa

SEQ ID NO: 1910423 - RNA, 20 nt, Homo sapiens
aaggggcuucuaaugaccca

SEQ ID NO: 1910424 - RNA, 14 nt, Homo sapiens
cugguucugaugau

SEQ ID NO: 1910425 - RNA, 23 nt, Homo sapiens
guuuugucucgcuauacugcacu

SEQ ID NO: 1910426 - RNA, 23 nt, Homo sapiens
caaaauaauggugauacauucua

SEQ ID NO: 1910427 - RNA, 23 nt, Homo sapiens
caaaauuuugcuccccagugaag

SEQ ID NO: 1910428 - RNA, 16 nt, Homo sapiens
uguacagucuuguauu

SEQ ID NO: 1910429 - RNA, 13 nt, Homo sapiens
ugccuuccuaaau

SEQ ID NO: 1910430 - RNA, 15 nt, Homo sapiens
gucaugaagugcaca

SEQ ID NO: 1910431 - RNA, 22 nt, Homo sapiens
ccccacgauugguaugaugcug

SEQ ID NO: 1910432 - RNA, 20 nt, Homo sapiens
aauugcugcaccaaugcacu

SEQ ID NO: 1910433 - RNA, 17 nt, Homo sapiens
aauuaaaaugugcagua

SEQ ID NO: 1910434 - RNA, 13 nt, Homo sapiens
caaccagcaaaac

SEQ ID NO: 1910435 - RNA, 16 nt, Homo sapiens
uaccacgaggaaaaga

SEQ ID NO: 1910436 - RNA, 14 nt, Homo sapiens
cagaaugacuccac

SEQ ID NO: 1910437 - RNA, 22 nt, Homo sapiens
cuuagacccucaugcugccaau

SEQ ID NO: 1910438 - RNA, 14 nt, Homo sapiens
gugccugagacacc

SEQ ID NO: 1910439 - RNA, 14 nt, Homo sapiens
gcuuagccugccuc

SEQ ID NO: 1910440 - RNA, 17 nt, Homo sapiens
ugccuccaccccccaga

SEQ ID NO: 1910441 - RNA, 23 nt, Homo sapiens
uucagaugaaaagaaaacuuaaa

SEQ ID NO: 1910442 - RNA, 22 nt, Homo sapiens
cacagccugacacagugcucga

SEQ ID NO: 1910443 - RNA, 14 nt, Homo sapiens
cuauucagaauuga

SEQ ID NO: 1910444 - RNA, 20 nt, Homo sapiens
cuuuggaaacaggaccacaa

SEQ ID NO: 1910445 - RNA, 22 nt, Homo sapiens
uagugcuuguggagaucacagc

SEQ ID NO: 1910446 - RNA, 22 nt, Homo sapiens
acaagguaaggagggucacugg

SEQ ID NO: 1910447 - RNA, 22 nt, Homo sapiens
aucaaucuuguuacugcugauu

SEQ ID NO: 1910448 - RNA, 19 nt, Homo sapiens
gauugcuuucuucuuaacc

SEQ ID NO: 1910449 - RNA, 14 nt, Homo sapiens
agcugaguaaaaug

SEQ ID NO: 1910450 - RNA, 16 nt, Homo sapiens
ucagugaccaccaaca

SEQ ID NO: 1910451 - RNA, 21 nt, Homo sapiens
uucccauaccacccaaugcug

SEQ ID NO: 1910452 - RNA, 14 nt, Homo sapiens
ugccauccaugugc

SEQ ID NO: 1910453 - RNA, 19 nt, Homo sapiens
uaaauaggcuggcaagaua

SEQ ID NO: 1910454 - RNA, 20 nt, Homo sapiens
aagcuaaugaacucuuucaa

SEQ ID NO: 1910455 - RNA, 12 nt, Homo sapiens
cuaagucucaac

SEQ ID NO: 1910456 - RNA, 22 nt, Homo sapiens
ugaaaagcacagccucagaaua

SEQ ID NO: 1910457 - RNA, 17 nt, Homo sapiens
cugagugcaggcccacc

SEQ ID NO: 1910458 - RNA, 22 nt, Homo sapiens
gguggaugaaaugucaguggaa

SEQ ID NO: 1910459 - RNA, 17 nt, Homo sapiens
gccauccucccaagggg

SEQ ID NO: 1910460 - RNA, 15 nt, Homo sapiens
ugccucagcuuccca

SEQ ID NO: 1910461 - RNA, 21 nt, Homo sapiens
aaauuaaggguuaaaucagag

SEQ ID NO: 1910462 - RNA, 14 nt, Homo sapiens
aacaugcaaagauc

SEQ ID NO: 1910463 - RNA, 17 nt, Homo sapiens
acuggaguggagcauug

SEQ ID NO: 1910464 - RNA, 15 nt, Homo sapiens
gaaagguaauggacu

SEQ ID NO: 1910465 - RNA, 16 nt, Homo sapiens
uggagucguguuguca

SEQ ID NO: 1910466 - RNA, 22 nt, Homo sapiens
gacuuugagcugagugcugaaa

SEQ ID NO: 1910467 - RNA, 14 nt, Homo sapiens
uaccuacugcugag

SEQ ID NO: 1910468 - RNA, 19 nt, Homo sapiens
uaaaaauggccauuugcuu

SEQ ID NO: 1910469 - RNA, 14 nt, Homo sapiens
gaaucuugcguuuu

SEQ ID NO: 1910470 - RNA, 23 nt, Homo sapiens
ugcauuuucacaaauuauacuuu

SEQ ID NO: 1910471 - RNA, 21 nt, Homo sapiens
gaaaauuggacuguaaucaua

SEQ ID NO: 1910472 - RNA, 14 nt, Homo sapiens
ugcuagaggugcuc

SEQ ID NO: 1910473 - RNA, 18 nt, Homo sapiens
gagagguggggaguaaua

SEQ ID NO: 1910474 - RNA, 17 nt, Homo sapiens
gugugaguaaugcucag

SEQ ID NO: 1910475 - RNA, 15 nt, Homo sapiens
ugcuccaucgcgcca

SEQ ID NO: 1910476 - RNA, 18 nt, Homo sapiens
accauuaggucacuuaag

SEQ ID NO: 1910477 - RNA, 22 nt, Homo sapiens
cccagagcacaaguuccagcug

SEQ ID NO: 1910478 - RNA, 12 nt, Homo sapiens
aauguuccauuc

SEQ ID NO: 1910479 - RNA, 16 nt, Homo sapiens
aauagaucagcaucca

SEQ ID NO: 1910480 - RNA, 19 nt, Homo sapiens
gaugguuuuaucuucccuu

SEQ ID NO: 1910481 - RNA, 20 nt, Homo sapiens
aguucacuugcaguggaaga

SEQ ID NO: 1910482 - RNA, 16 nt, Homo sapiens
ugcgagcaacagugcc

SEQ ID NO: 1910483 - RNA, 23 nt, Homo sapiens
caaauuguacaagguauuuacac

SEQ ID NO: 1910484 - RNA, 12 nt, Homo sapiens
aacagauuugcu

SEQ ID NO: 1910485 - RNA, 17 nt, Homo sapiens
aaggucccugagcucuu

SEQ ID NO: 1910486 - RNA, 22 nt, Homo sapiens
ugugugcacccaacgugaugcu

SEQ ID NO: 1910487 - RNA, 23 nt, Homo sapiens
ugauucaaaagaugccauucaua

SEQ ID NO: 1910488 - RNA, 16 nt, Homo sapiens
gaucucagagcauuuc

SEQ ID NO: 1910489 - RNA, 22 nt, Homo sapiens
gcaugucuacucagcauuugau

SEQ ID NO: 1910490 - RNA, 19 nt, Homo sapiens
aagaacucugcacagcaac

SEQ ID NO: 1910491 - RNA, 23 nt, Homo sapiens
accugaaguucaccuaucccauu

SEQ ID NO: 1910492 - RNA, 22 nt, Homo sapiens
uggcuucuuuacuuaguucaag

SEQ ID NO: 1910493 - RNA, 21 nt, Homo sapiens
ucuccagccaaccucauugca

SEQ ID NO: 1910494 - RNA, 18 nt, Homo sapiens
uuuugguuccacaaucuc

SEQ ID NO: 1910495 - RNA, 20 nt, Homo sapiens
uguugaaacuaaagcacuuc

SEQ ID NO: 1910496 - RNA, 12 nt, Homo sapiens
ccgugacagggc

SEQ ID NO: 1910497 - RNA, 18 nt, Homo sapiens
aauguccuacugagacag

SEQ ID NO: 1910498 - RNA, 15 nt, Homo sapiens
ucaccuacuccagag

SEQ ID NO: 1910499 - RNA, 23 nt, Homo sapiens
gagccuguccagguuaguuuacu

SEQ ID NO: 1910500 - RNA, 18 nt, Homo sapiens
uggcaaagagagguccag

SEQ ID NO: 1910501 - RNA, 23 nt, Homo sapiens
ugagaaaugggacuuaacuccuu

SEQ ID NO: 1910502 - RNA, 15 nt, Homo sapiens
uauuuauuaccgaua

SEQ ID NO: 1910503 - RNA, 16 nt, Homo sapiens
cuuaaauaauuugggu

SEQ ID NO: 1910504 - RNA, 19 nt, Homo sapiens
gucaucaaccgaugguccu

SEQ ID NO: 1910505 - RNA, 17 nt, Homo sapiens
uagacuuuugcuuuaug

SEQ ID NO: 1910506 - RNA, 14 nt, Homo sapiens
ggucuucaggcauu

SEQ ID NO: 1910507 - RNA, 14 nt, Homo sapiens
uacaaacauaucaa

SEQ ID NO: 1910508 - RNA, 16 nt, Homo sapiens
gaggcaggagaaucac

SEQ ID NO: 1910509 - RNA, 14 nt, Homo sapiens
cugagaaaugaugg

SEQ ID NO: 1910510 - RNA, 22 nt, Homo sapiens
aaccaucuggcagacuuacaaa

SEQ ID NO: 1910511 - RNA, 16 nt, Homo sapiens
cuugaccagcagaucc

SEQ ID NO: 1910512 - RNA, 21 nt, Homo sapiens
cuuuuuacauaacugccuuga

SEQ ID NO: 1910513 - RNA, 22 nt, Homo sapiens
aauaaauguugcaaugcaugau

SEQ ID NO: 1910514 - RNA, 18 nt, Homo sapiens
gggauccucucuccaggc

SEQ ID NO: 1910515 - RNA, 22 nt, Homo sapiens
uuucugacaggcgcaacuccuc

SEQ ID NO: 1910516 - RNA, 18 nt, Homo sapiens
ggagaagaagucagagag

SEQ ID NO: 1910517 - RNA, 17 nt, Homo sapiens
gagcauuucucaucagu

SEQ ID NO: 1910518 - RNA, 14 nt, Homo sapiens
uugcaaaguacugu

SEQ ID NO: 1910519 - RNA, 14 nt, Homo sapiens
uuuaaccagcaaca

SEQ ID NO: 1910520 - RNA, 22 nt, Homo sapiens
gugauguauguuauuugaugac

SEQ ID NO: 1910521 - RNA, 21 nt, Homo sapiens
uuucaggaaaauguauugauu

SEQ ID NO: 1910522 - RNA, 17 nt, Homo sapiens
aggugccuccaggugug

SEQ ID NO: 1910523 - RNA, 16 nt, Homo sapiens
auguuugucucauccc

SEQ ID NO: 1910524 - RNA, 17 nt, Homo sapiens
ccucaugcucucuauag

SEQ ID NO: 1910525 - RNA, 13 nt, Homo sapiens
aucucagcacuuu

SEQ ID NO: 1910526 - RNA, 19 nt, Homo sapiens
cucaaguucuaagauucua

SEQ ID NO: 1910527 - RNA, 18 nt, Homo sapiens
accuuggacuccucccac

SEQ ID NO: 1910528 - RNA, 19 nt, Homo sapiens
aaggaacaugaaaagcaaa

SEQ ID NO: 1910529 - RNA, 13 nt, Homo sapiens
ucuggaaaccacg

SEQ ID NO: 1910530 - RNA, 13 nt, Homo sapiens
caagaaaauauca

SEQ ID NO: 1910531 - RNA, 23 nt, Homo sapiens
gcuucuaaauggugcugcagauu

SEQ ID NO: 1910532 - RNA, 22 nt, Homo sapiens
auugcacuucggauaauuuuca

SEQ ID NO: 1910533 - RNA, 18 nt, Homo sapiens
cgagucugucucugucau

SEQ ID NO: 1910534 - RNA, 17 nt, Homo sapiens
aagaaaucccugagaca

SEQ ID NO: 1910535 - RNA, 13 nt, Homo sapiens
auggaagcuucca

SEQ ID NO: 1910536 - RNA, 18 nt, Homo sapiens
ugaauuauugacacugaa

SEQ ID NO: 1910537 - RNA, 18 nt, Homo sapiens
aaguugggauuugcaaau

SEQ ID NO: 1910538 - RNA, 16 nt, Homo sapiens
uggcuggccugagcaa

SEQ ID NO: 1910539 - RNA, 22 nt, Homo sapiens
uucccuugaggaaaaaugucca

SEQ ID NO: 1910540 - RNA, 19 nt, Homo sapiens
uggagccccauccuguguu

SEQ ID NO: 1910541 - RNA, 16 nt, Homo sapiens
acagaaugauggacuu

SEQ ID NO: 1910542 - RNA, 13 nt, Homo sapiens
aaaaugugcagua

SEQ ID NO: 1910543 - RNA, 17 nt, Homo sapiens
uggccugaacagaugua

SEQ ID NO: 1910544 - RNA, 20 nt, Homo sapiens
cauacauuuguggucugacu

SEQ ID NO: 1910545 - RNA, 16 nt, Homo sapiens
auuuugaaaaaugaga

SEQ ID NO: 1910546 - RNA, 14 nt, Homo sapiens
aagagaauagggga

SEQ ID NO: 1910547 - RNA, 20 nt, Homo sapiens
guuuguaguuggaaagcaaa

SEQ ID NO: 1910548 - RNA, 21 nt, Homo sapiens
aggccauggcagaauaaucuu

SEQ ID NO: 1910549 - RNA, 16 nt, Homo sapiens
cugaaugaaaauaacu

SEQ ID NO: 1910550 - RNA, 15 nt, Homo sapiens
cuaagguacggugag

SEQ ID NO: 1910551 - RNA, 18 nt, Homo sapiens
cuugugacagauuauaca

SEQ ID NO: 1910552 - RNA, 23 nt, Homo sapiens
ccucacacacacagcugggcaaa

SEQ ID NO: 1910553 - RNA, 16 nt, Homo sapiens
caccccagcugaccug

SEQ ID NO: 1910554 - RNA, 23 nt, Homo sapiens
aagauuagcuuuuaaaaacugaa

SEQ ID NO: 1910555 - RNA, 16 nt, Homo sapiens
cuccuccccugcuacc

SEQ ID NO: 1910556 - RNA, 15 nt, Homo sapiens
gucucuguuuuacaa

SEQ ID NO: 1910557 - RNA, 17 nt, Homo sapiens
auacuggccucugugau

SEQ ID NO: 1910558 - RNA, 13 nt, Homo sapiens
cccaggaggucug

SEQ ID NO: 1910559 - RNA, 20 nt, Homo sapiens
acucaugaugagaaauggau

SEQ ID NO: 1910560 - RNA, 21 nt, Homo sapiens
cucgggcacucccuaagucca

SEQ ID NO: 1910561 - RNA, 13 nt, Homo sapiens
guacagugucuuu

SEQ ID NO: 1910562 - RNA, 21 nt, Homo sapiens
caccagccccacuucuggguc

SEQ ID NO: 1910563 - RNA, 17 nt, Homo sapiens
auuacaaccgguuauca

SEQ ID NO: 1910564 - RNA, 16 nt, Homo sapiens
ccccuccggccugggc

SEQ ID NO: 1910565 - RNA, 14 nt, Homo sapiens
ugaagccaauucag

SEQ ID NO: 1910566 - RNA, 20 nt, Homo sapiens
ccagacacagacuggcaaua

SEQ ID NO: 1910567 - RNA, 20 nt, Homo sapiens
acugaauuuuaaauguucac

SEQ ID NO: 1910568 - RNA, 23 nt, Homo sapiens
augagaguuucuguuaaucaugu

SEQ ID NO: 1910569 - RNA, 21 nt, Homo sapiens
caagaucgcgccacugcacuc

SEQ ID NO: 1910570 - RNA, 22 nt, Homo sapiens
cugguauuauuuacaaugcaga

SEQ ID NO: 1910571 - RNA, 13 nt, Homo sapiens
gccaagaaguuua

SEQ ID NO: 1910572 - RNA, 15 nt, Homo sapiens
uuauuauaugacuag

SEQ ID NO: 1910573 - RNA, 13 nt, Homo sapiens
gggcacugguggc

SEQ ID NO: 1910574 - RNA, 20 nt, Homo sapiens
uugccuucuccacuuuggga

SEQ ID NO: 1910575 - RNA, 18 nt, Homo sapiens
agacaccuugacagggca

SEQ ID NO: 1910576 - RNA, 12 nt, Homo sapiens
ggugcauauacg

SEQ ID NO: 1910577 - RNA, 17 nt, Homo sapiens
uuuuuauacagugauaa

SEQ ID NO: 1910578 - RNA, 21 nt, Homo sapiens
gaauugcuuuuaucaguguua

SEQ ID NO: 1910579 - RNA, 16 nt, Homo sapiens
ugcagccuugaccucc

SEQ ID NO: 1910580 - RNA, 20 nt, Homo sapiens
ccugugaaaaagaaacugaa

SEQ ID NO: 1910581 - RNA, 22 nt, Homo sapiens
cuaggaaacccaaggaacaaga

SEQ ID NO: 1910582 - RNA, 22 nt, Homo sapiens
aauaaucugguguucuugcuaa

SEQ ID NO: 1910583 - RNA, 22 nt, Homo sapiens
gccaucucaacgccucuccuca

SEQ ID NO: 1910584 - RNA, 16 nt, Homo sapiens
ugguuucuaucugcaa

SEQ ID NO: 1910585 - RNA, 23 nt, Homo sapiens
uauuaccuugguauaucauacug

SEQ ID NO: 1910586 - RNA, 13 nt, Homo sapiens
auucacaguguga

SEQ ID NO: 1910587 - RNA, 14 nt, Homo sapiens
acccuauggccacu

SEQ ID NO: 1910588 - RNA, 16 nt, Homo sapiens
cuucuuaaucuuuuca

SEQ ID NO: 1910589 - RNA, 23 nt, Homo sapiens
guaaacuaagguagacuacuuug

SEQ ID NO: 1910590 - RNA, 19 nt, Homo sapiens
guuucuaaaguguuggcaa

SEQ ID NO: 1910591 - RNA, 17 nt, Homo sapiens
accuugcauagugccug

SEQ ID NO: 1910592 - RNA, 16 nt, Homo sapiens
accuuauuuuacagaa

SEQ ID NO: 1910593 - RNA, 20 nt, Homo sapiens
aguguaccauucucaggugg

SEQ ID NO: 1910594 - RNA, 14 nt, Homo sapiens
aguuucuucaugca

SEQ ID NO: 1910595 - RNA, 22 nt, Homo sapiens
cauccgaagaugguggccacag

SEQ ID NO: 1910596 - RNA, 18 nt, Homo sapiens
cagugccuccugggacca

SEQ ID NO: 1910597 - RNA, 18 nt, Homo sapiens
guuuacauuuuguauauu

SEQ ID NO: 1910598 - RNA, 18 nt, Homo sapiens
ucucagcgagguguaaag

SEQ ID NO: 1910599 - RNA, 15 nt, Homo sapiens
acauuccugcauuca

SEQ ID NO: 1910600 - RNA, 23 nt, Homo sapiens
cucuagucccuguguucugcaca

SEQ ID NO: 1910601 - RNA, 15 nt, Homo sapiens
agaauuuucugcauu

SEQ ID NO: 1910602 - RNA, 19 nt, Homo sapiens
cacucauuuauuuccauau

SEQ ID NO: 1910603 - RNA, 16 nt, Homo sapiens
aagaguuucuucucau

SEQ ID NO: 1910604 - RNA, 15 nt, Homo sapiens
cugccaagacuccuc

SEQ ID NO: 1910605 - RNA, 20 nt, Homo sapiens
gcucguggugggugcucaag

SEQ ID NO: 1910606 - RNA, 14 nt, Homo sapiens
gagauaaacuaaug

SEQ ID NO: 1910607 - RNA, 12 nt, Homo sapiens
uuuugacaucaa

SEQ ID NO: 1910608 - RNA, 21 nt, Homo sapiens
ugccugcccuuucucccaaaa

SEQ ID NO: 1910609 - RNA, 18 nt, Homo sapiens
aaaacgguggaggccagg

SEQ ID NO: 1910610 - RNA, 17 nt, Homo sapiens
uugcaaggcugauuuau

SEQ ID NO: 1910611 - RNA, 23 nt, Homo sapiens
cuacucgggaggcugaggcacaa

SEQ ID NO: 1910612 - RNA, 18 nt, Homo sapiens
cagauuuucuaagaacca

SEQ ID NO: 1910613 - RNA, 18 nt, Homo sapiens
aaauggcaccgagacaau

SEQ ID NO: 1910614 - RNA, 17 nt, Homo sapiens
ccucccccagaccucca

SEQ ID NO: 1910615 - RNA, 12 nt, Homo sapiens
aaguugcucugu

SEQ ID NO: 1910616 - RNA, 13 nt, Homo sapiens
cccucaaccuccu

SEQ ID NO: 1910617 - RNA, 15 nt, Homo sapiens
gcuuugcauguucca

SEQ ID NO: 1910618 - RNA, 13 nt, Homo sapiens
gcugccugggauc

SEQ ID NO: 1910619 - RNA, 13 nt, Homo sapiens
acugacugagaua

SEQ ID NO: 1910620 - RNA, 15 nt, Homo sapiens
ucuuaaaacacauga

SEQ ID NO: 1910621 - RNA, 11 nt, Homo sapiens
ccucugcaguc

SEQ ID NO: 1910622 - RNA, 18 nt, Homo sapiens
aaauauuuucuacaucuu

SEQ ID NO: 1910623 - RNA, 16 nt, Homo sapiens
cuaacuaucaaauaga

SEQ ID NO: 1910624 - RNA, 21 nt, Homo sapiens
agauauuugguaccauggugu

SEQ ID NO: 1910625 - RNA, 22 nt, Homo sapiens
ugaaggccggguaaugagccau

SEQ ID NO: 1910626 - RNA, 14 nt, Homo sapiens
accaggaagcacag

SEQ ID NO: 1910627 - RNA, 18 nt, Homo sapiens
acuaaaguaucugagauu

SEQ ID NO: 1910628 - RNA, 18 nt, Homo sapiens
caaacagccuacagccag

SEQ ID NO: 1910629 - RNA, 20 nt, Homo sapiens
accauucaggucuuucuuuc

SEQ ID NO: 1910630 - RNA, 23 nt, Homo sapiens
acauguagguaggaagcacugaa

SEQ ID NO: 1910631 - RNA, 13 nt, Homo sapiens
aaauacaucagcu

SEQ ID NO: 1910632 - RNA, 19 nt, Homo sapiens
uguguaauuuaagugacac

SEQ ID NO: 1910633 - RNA, 16 nt, Homo sapiens
uaggaaaacauugcaa

SEQ ID NO: 1910634 - RNA, 13 nt, Homo sapiens
uuaaaauaucucu

SEQ ID NO: 1910635 - RNA, 19 nt, Homo sapiens
auggcuggggccgcugggg

SEQ ID NO: 1910636 - RNA, 19 nt, Homo sapiens
agaaccuguccaacauguu

SEQ ID NO: 1910637 - RNA, 17 nt, Homo sapiens
cagucauuaauuuucaa

SEQ ID NO: 1910638 - RNA, 17 nt, Homo sapiens
ugauguuggcugggaac

SEQ ID NO: 1910639 - RNA, 16 nt, Homo sapiens
gggaggggggagccag

SEQ ID NO: 1910640 - RNA, 22 nt, Homo sapiens
cugcuguggggaccacacugau

SEQ ID NO: 1910641 - RNA, 16 nt, Homo sapiens
aaaacauguaaagggg

SEQ ID NO: 1910642 - RNA, 14 nt, Homo sapiens
uuauuccuccagga

SEQ ID NO: 1910643 - RNA, 17 nt, Homo sapiens
ccugggggaugugcacg

SEQ ID NO: 1910644 - RNA, 17 nt, Homo sapiens
auccauguaguagauau

SEQ ID NO: 1910645 - RNA, 22 nt, Homo sapiens
ucuugcuugacucuacuauuaa

SEQ ID NO: 1910646 - RNA, 24 nt, Homo sapiens
gccaaaaacaaaaaauagcuuuca

SEQ ID NO: 1910647 - RNA, 21 nt, Homo sapiens
aaggauauggacuauugcaau

SEQ ID NO: 1910648 - RNA, 24 nt, Homo sapiens
guacccuccucccgacugaccacu

SEQ ID NO: 1910649 - RNA, 20 nt, Homo sapiens
ucagacugaacuuacacugu

SEQ ID NO: 1910650 - RNA, 22 nt, Homo sapiens
uucauggugauugucauguaag

SEQ ID NO: 1910651 - RNA, 20 nt, Homo sapiens
cugauaugucagucccuggc

SEQ ID NO: 1910652 - RNA, 18 nt, Homo sapiens
ccuugucaauacugagcc

SEQ ID NO: 1910653 - RNA, 23 nt, Homo sapiens
cuuguaaaccaucgcgugcaaug

SEQ ID NO: 1910654 - RNA, 19 nt, Homo sapiens
ccggagggcccugagcuga

SEQ ID NO: 1910655 - RNA, 21 nt, Homo sapiens
uuaacugguauauacauauau

SEQ ID NO: 1910656 - RNA, 20 nt, Homo sapiens
gcauaugcagccaaccaaga

SEQ ID NO: 1910657 - RNA, 14 nt, Homo sapiens
aggacacaauggca

SEQ ID NO: 1910658 - RNA, 16 nt, Homo sapiens
uaaaauauccugugua

SEQ ID NO: 1910659 - RNA, 16 nt, Homo sapiens
cagucuugucuuugau

SEQ ID NO: 1910660 - RNA, 18 nt, Homo sapiens
gcagaaauauagugcaau

SEQ ID NO: 1910661 - RNA, 17 nt, Homo sapiens
aggggcugaggacgaga

SEQ ID NO: 1910662 - RNA, 14 nt, Homo sapiens
auaauaauuuuccu

SEQ ID NO: 1910663 - RNA, 15 nt, Homo sapiens
aggcaggucugcaag

SEQ ID NO: 1910664 - RNA, 15 nt, Homo sapiens
agagagaucuagaaa

SEQ ID NO: 1910665 - RNA, 17 nt, Homo sapiens
aauuuucagucaucuca

SEQ ID NO: 1910666 - RNA, 19 nt, Homo sapiens
uuuuccagcuccucaucca

SEQ ID NO: 1910667 - RNA, 21 nt, Homo sapiens
uggagagugagcuacagagcc

SEQ ID NO: 1910668 - RNA, 13 nt, Homo sapiens
aauuguccaugag

SEQ ID NO: 1910669 - RNA, 15 nt, Homo sapiens
gaauuagacuuguau

SEQ ID NO: 1910670 - RNA, 22 nt, Homo sapiens
cuuaaaugaaaaaaaugaucua

SEQ ID NO: 1910671 - RNA, 15 nt, Homo sapiens
ugcacgcccaugugu

SEQ ID NO: 1910672 - RNA, 17 nt, Homo sapiens
ugggccauagucauucu

SEQ ID NO: 1910673 - RNA, 19 nt, Homo sapiens
cuuauauggaaauucugcu

SEQ ID NO: 1910674 - RNA, 21 nt, Homo sapiens
cuugcauugaauuuagucauu

SEQ ID NO: 1910675 - RNA, 19 nt, Homo sapiens
uaaaugauaccuacauucu

SEQ ID NO: 1910676 - RNA, 20 nt, Homo sapiens
acacaugccacaacauggau

SEQ ID NO: 1910677 - RNA, 22 nt, Homo sapiens
caggcucggaggacccuggaaa

SEQ ID NO: 1910678 - RNA, 13 nt, Homo sapiens
ugaauagucucau

SEQ ID NO: 1910679 - RNA, 17 nt, Homo sapiens
auuguacaaccugugau

SEQ ID NO: 1910680 - RNA, 20 nt, Homo sapiens
acagaaaucguagacaagca

SEQ ID NO: 1910681 - RNA, 22 nt, Homo sapiens
ccagucacgagcccgcucugca

SEQ ID NO: 1910682 - RNA, 20 nt, Homo sapiens
acaugucuagccacugauca

SEQ ID NO: 1910683 - RNA, 18 nt, Homo sapiens
cucuggcuaaauucaugc

SEQ ID NO: 1910684 - RNA, 17 nt, Homo sapiens
cuauuuucuuuuccauu

SEQ ID NO: 1910685 - RNA, 17 nt, Homo sapiens
gacuugagccacuccuu

SEQ ID NO: 1910686 - RNA, 16 nt, Homo sapiens
auaaauauuacaguga

SEQ ID NO: 1910687 - RNA, 15 nt, Homo sapiens
uauaauacuugcaac

SEQ ID NO: 1910688 - RNA, 17 nt, Homo sapiens
ccuucaaguauccaauu

SEQ ID NO: 1910689 - RNA, 19 nt, Homo sapiens
agccacagggagccacaca

SEQ ID NO: 1910690 - RNA, 17 nt, Homo sapiens
acaacuuuccacugaca

SEQ ID NO: 1910691 - RNA, 21 nt, Homo sapiens
cugaaaccccagggcuugugu

SEQ ID NO: 1910692 - RNA, 22 nt, Homo sapiens
cuccuccccuccccucacuucu

SEQ ID NO: 1910693 - RNA, 14 nt, Homo sapiens
aaaauuacuuugaa

SEQ ID NO: 1910694 - RNA, 13 nt, Homo sapiens
agcaucugugaug

SEQ ID NO: 1910695 - RNA, 21 nt, Homo sapiens
agaccaugugguuugcuguua

SEQ ID NO: 1910696 - RNA, 19 nt, Homo sapiens
ccuggagauugugcucugc

SEQ ID NO: 1910697 - RNA, 19 nt, Homo sapiens
agugugacucaucaggcag

SEQ ID NO: 1910698 - RNA, 22 nt, Homo sapiens
uugcacaaauugggccaaagaa

SEQ ID NO: 1910699 - RNA, 23 nt, Homo sapiens
caaaagaagacaacauuucucaa

SEQ ID NO: 1910700 - RNA, 18 nt, Homo sapiens
uuacagcugagcacauuc

SEQ ID NO: 1910701 - RNA, 16 nt, Homo sapiens
ccuggucccucugcag

SEQ ID NO: 1910702 - RNA, 13 nt, Homo sapiens
auuugugaagcuu

SEQ ID NO: 1910703 - RNA, 15 nt, Homo sapiens
agaagaaaacauaua

SEQ ID NO: 1910704 - RNA, 15 nt, Homo sapiens
aaauugggcugugaa

SEQ ID NO: 1910705 - RNA, 14 nt, Homo sapiens
aacacgcugaaggg

SEQ ID NO: 1910706 - RNA, 19 nt, Homo sapiens
aggagacuuucaugcagcc

SEQ ID NO: 1910707 - RNA, 22 nt, Homo sapiens
cagucugggccccaucauuaaa

SEQ ID NO: 1910708 - RNA, 15 nt, Homo sapiens
ggaauccucuguguc

SEQ ID NO: 1910709 - RNA, 15 nt, Homo sapiens
ccuugcuuucucuuc

SEQ ID NO: 1910710 - RNA, 20 nt, Homo sapiens
cacagaucugcuugaucaau

SEQ ID NO: 1910711 - RNA, 19 nt, Homo sapiens
cagccuaguuaucaagggg

SEQ ID NO: 1910712 - RNA, 21 nt, Homo sapiens
ggcuggaaugcuggguaugcu

SEQ ID NO: 1910713 - RNA, 18 nt, Homo sapiens
aauagcuuagcggcaaga

SEQ ID NO: 1910714 - RNA, 22 nt, Homo sapiens
gugcucauucauuuaacagagc

SEQ ID NO: 1910715 - RNA, 15 nt, Homo sapiens
ucuuaccgaauaagg

SEQ ID NO: 1910716 - RNA, 21 nt, Homo sapiens
caguguacguuuuauuacuua

SEQ ID NO: 1910717 - RNA, 17 nt, Homo sapiens
gagggcccacuucaggg

SEQ ID NO: 1910718 - RNA, 16 nt, Homo sapiens
auguuacuacaugcac

SEQ ID NO: 1910719 - RNA, 18 nt, Homo sapiens
gccaagagggacaucaga

SEQ ID NO: 1910720 - RNA, 18 nt, Homo sapiens
guuuaaaugauacaguau

SEQ ID NO: 1910721 - RNA, 17 nt, Homo sapiens
cuaaacucucuagcuua

SEQ ID NO: 1910722 - RNA, 16 nt, Homo sapiens
auauaacuuccuggcu

SEQ ID NO: 1910723 - RNA, 15 nt, Homo sapiens
aucucaugcucucug

SEQ ID NO: 1910724 - RNA, 19 nt, Homo sapiens
ugaugacuugccauuaaaa

SEQ ID NO: 1910725 - RNA, 21 nt, Homo sapiens
cccuggaaggugcuguuaucc

SEQ ID NO: 1910726 - RNA, 18 nt, Homo sapiens
gcagcaccaaccacagca

SEQ ID NO: 1910727 - RNA, 15 nt, Homo sapiens
agaaauuucugugcu

SEQ ID NO: 1910728 - RNA, 18 nt, Homo sapiens
cagcucagcagugacugu

SEQ ID NO: 1910729 - RNA, 20 nt, Homo sapiens
agaacuucuccuacuguagc

SEQ ID NO: 1910730 - RNA, 23 nt, Homo sapiens
gcccagcuuauugugugcgcugc

SEQ ID NO: 1910731 - RNA, 15 nt, Homo sapiens
uaugugacuugcaau

SEQ ID NO: 1910732 - RNA, 18 nt, Homo sapiens
acaguuaauuaugugcau

SEQ ID NO: 1910733 - RNA, 16 nt, Homo sapiens
gguccagcggggguca

SEQ ID NO: 1910734 - RNA, 13 nt, Homo sapiens
aaaguauauacag

SEQ ID NO: 1910735 - RNA, 20 nt, Homo sapiens
agcuuccuagaaaguucugu

SEQ ID NO: 1910736 - RNA, 19 nt, Homo sapiens
gaagcugcaggcuuugcca

SEQ ID NO: 1910737 - RNA, 14 nt, Homo sapiens
cgcuccacagagau

SEQ ID NO: 1910738 - RNA, 16 nt, Homo sapiens
uccacccagugauccc

SEQ ID NO: 1910739 - RNA, 20 nt, Homo sapiens
gaccuggaaccagagccaca

SEQ ID NO: 1910740 - RNA, 19 nt, Homo sapiens
ucagugguggucuucaaga

SEQ ID NO: 1910741 - RNA, 15 nt, Homo sapiens
ccuugggaccugaau

SEQ ID NO: 1910742 - RNA, 12 nt, Homo sapiens
caaccacugugg

SEQ ID NO: 1910743 - RNA, 15 nt, Homo sapiens
acaaaugagugauuc

SEQ ID NO: 1910744 - RNA, 22 nt, Homo sapiens
ugaaugcgugugcgugcaagca

SEQ ID NO: 1910745 - RNA, 13 nt, Homo sapiens
aaggccuuuagua

SEQ ID NO: 1910746 - RNA, 15 nt, Homo sapiens
ucccccaaagaacca

SEQ ID NO: 1910747 - RNA, 11 nt, Homo sapiens
cacugcugcau

SEQ ID NO: 1910748 - RNA, 14 nt, Homo sapiens
gucauacaauccau

SEQ ID NO: 1910749 - RNA, 10 nt, Homo sapiens
guacaguuuu

SEQ ID NO: 1910750 - RNA, 23 nt, Homo sapiens
guauucuucugacagagccauau

SEQ ID NO: 1910751 - RNA, 17 nt, Homo sapiens
ucaaaugacccaaagac

SEQ ID NO: 1910752 - RNA, 22 nt, Homo sapiens
uaccaaguaaauccaggcuuua

SEQ ID NO: 1910753 - RNA, 17 nt, Homo sapiens
caugaaucucucaauua

SEQ ID NO: 1910754 - RNA, 22 nt, Homo sapiens
gaauaacauggugugcuucuua

SEQ ID NO: 1910755 - RNA, 22 nt, Homo sapiens
uaugacaauuucaaaaugcaug

SEQ ID NO: 1910756 - RNA, 18 nt, Homo sapiens
ugggaccaucacugagag

SEQ ID NO: 1910757 - RNA, 21 nt, Homo sapiens
acccgaccggugcaugaugcu

SEQ ID NO: 1910758 - RNA, 13 nt, Homo sapiens
cauaggucugaaa

SEQ ID NO: 1910759 - RNA, 21 nt, Homo sapiens
aaaguaucccggaagcucaca

SEQ ID NO: 1910760 - RNA, 23 nt, Homo sapiens
aguaagacagugcagugcucagu

SEQ ID NO: 1910761 - RNA, 23 nt, Homo sapiens
cagcagcauauguuguugcuugu

SEQ ID NO: 1910762 - RNA, 17 nt, Homo sapiens
cagcacccccacccacc

SEQ ID NO: 1910763 - RNA, 19 nt, Homo sapiens
gcuuuacuuucuguguuga

SEQ ID NO: 1910764 - RNA, 13 nt, Homo sapiens
agucugaaacugg

SEQ ID NO: 1910765 - RNA, 13 nt, Homo sapiens
uuaaaaccaaaga

SEQ ID NO: 1910766 - RNA, 13 nt, Homo sapiens
uuaauaccaaagu

SEQ ID NO: 1910767 - RNA, 16 nt, Homo sapiens
agcugagggcauugcu

SEQ ID NO: 1910768 - RNA, 15 nt, Homo sapiens
auccaccacugcuua

SEQ ID NO: 1910769 - RNA, 18 nt, Homo sapiens
aucuuuagcuaauaaaga

SEQ ID NO: 1910770 - RNA, 20 nt, Homo sapiens
guaccccagcucugcuugcc

SEQ ID NO: 1910771 - RNA, 14 nt, Homo sapiens
ggcucuuccuugaa

SEQ ID NO: 1910772 - RNA, 17 nt, Homo sapiens
aaaauugugaugcuccu

SEQ ID NO: 1910773 - RNA, 16 nt, Homo sapiens
acaagcugccucugac

SEQ ID NO: 1910774 - RNA, 20 nt, Homo sapiens
uucgaugaaccugacaaaaa

SEQ ID NO: 1910775 - RNA, 20 nt, Homo sapiens
ccuuccccacuucugugcca

SEQ ID NO: 1910776 - RNA, 21 nt, Homo sapiens
ugagagacacugggacacugu

SEQ ID NO: 1910777 - RNA, 22 nt, Homo sapiens
cguuaagggaaggaacucuggc

SEQ ID NO: 1910778 - RNA, 20 nt, Homo sapiens
ugagccccuggaggcacuga

SEQ ID NO: 1910779 - RNA, 15 nt, Homo sapiens
cugcagugauucagc

SEQ ID NO: 1910780 - RNA, 22 nt, Homo sapiens
cacuucucuccuccacucugag

SEQ ID NO: 1910781 - RNA, 19 nt, Homo sapiens
ccgucaaaagagucuuaau

SEQ ID NO: 1910782 - RNA, 18 nt, Homo sapiens
acauuagauugaugugca

SEQ ID NO: 1910783 - RNA, 23 nt, Homo sapiens
gacuuuguauaguucacuuacuc

SEQ ID NO: 1910784 - RNA, 19 nt, Homo sapiens
uccaacagugagucuguca

SEQ ID NO: 1910785 - RNA, 19 nt, Homo sapiens
ucaaauuuugaguuauucc

SEQ ID NO: 1910786 - RNA, 17 nt, Homo sapiens
guggagcuugcagugag

SEQ ID NO: 1910787 - RNA, 17 nt, Homo sapiens
ugaucuaucaauaguca

SEQ ID NO: 1910788 - RNA, 16 nt, Homo sapiens
uccagcaguuguucca

SEQ ID NO: 1910789 - RNA, 17 nt, Homo sapiens
auugcugccaaggugga

SEQ ID NO: 1910790 - RNA, 22 nt, Homo sapiens
guuauaauacgcugcugaucua

SEQ ID NO: 1910791 - RNA, 16 nt, Homo sapiens
gagccaaauucauccu

SEQ ID NO: 1910792 - RNA, 16 nt, Homo sapiens
aacauacaugagauaa

SEQ ID NO: 1910793 - RNA, 16 nt, Homo sapiens
ucugagcuaacuuaua

SEQ ID NO: 1910794 - RNA, 13 nt, Homo sapiens
aggacaaacagac

SEQ ID NO: 1910795 - RNA, 14 nt, Homo sapiens
auuucuagagacaa

SEQ ID NO: 1910796 - RNA, 18 nt, Homo sapiens
guguauauuuaagguaua

SEQ ID NO: 1910797 - RNA, 13 nt, Homo sapiens
agcugcuguccag

SEQ ID NO: 1910798 - RNA, 19 nt, Homo sapiens
aucucagguugucuaagug

SEQ ID NO: 1910799 - RNA, 20 nt, Homo sapiens
gauccucacccgaaucuccu

SEQ ID NO: 1910800 - RNA, 16 nt, Homo sapiens
uucucuauugcugcuc

SEQ ID NO: 1910801 - RNA, 12 nt, Homo sapiens
ucacuugaucuc

SEQ ID NO: 1910802 - RNA, 14 nt, Homo sapiens
aagcagaucuuuag

SEQ ID NO: 1910803 - RNA, 21 nt, Homo sapiens
cacagccucuaagcgugcuga

SEQ ID NO: 1910804 - RNA, 16 nt, Homo sapiens
uaguauuggagcacau

SEQ ID NO: 1910805 - RNA, 14 nt, Homo sapiens
caucggcaggcagu

SEQ ID NO: 1910806 - RNA, 15 nt, Homo sapiens
aaggaaacuuugcca

SEQ ID NO: 1910807 - RNA, 19 nt, Homo sapiens
cuguaacaauuauguuuuc

SEQ ID NO: 1910808 - RNA, 16 nt, Homo sapiens
gaagcuauuucauuug

SEQ ID NO: 1910809 - RNA, 19 nt, Homo sapiens
uccacuugagugucaagcu

SEQ ID NO: 1910810 - RNA, 23 nt, Homo sapiens
uuccaagacucuagaguccaagg

SEQ ID NO: 1910811 - RNA, 15 nt, Homo sapiens
cuccuggcagugacc

SEQ ID NO: 1910812 - RNA, 11 nt, Homo sapiens
cagcagucaca

SEQ ID NO: 1910813 - RNA, 20 nt, Homo sapiens
acgucucuucucuguggaac

SEQ ID NO: 1910814 - RNA, 16 nt, Homo sapiens
aaagcguuuggaaaac

SEQ ID NO: 1910815 - RNA, 21 nt, Homo sapiens
uauguaacagucaaauaucau

SEQ ID NO: 1910816 - RNA, 18 nt, Homo sapiens
ucacuuuaaagucuuucc

SEQ ID NO: 1910817 - RNA, 19 nt, Homo sapiens
gaucccuagcugugaccuc

SEQ ID NO: 1910818 - RNA, 22 nt, Homo sapiens
aucagauccugggcacauucuu

SEQ ID NO: 1910819 - RNA, 16 nt, Homo sapiens
gaaaaaaaaauuauuu

SEQ ID NO: 1910820 - RNA, 14 nt, Homo sapiens
aaagccaacaacca

SEQ ID NO: 1910821 - RNA, 19 nt, Homo sapiens
ggcucagcagggcugguca

SEQ ID NO: 1910822 - RNA, 13 nt, Homo sapiens
cuuaccugugaca

SEQ ID NO: 1910823 - RNA, 14 nt, Homo sapiens
acuuaaauuccaaa

SEQ ID NO: 1910824 - RNA, 20 nt, Homo sapiens
ccuuuaaauccuuccaugaa

SEQ ID NO: 1910825 - RNA, 12 nt, Homo sapiens
ugcagagucaau

SEQ ID NO: 1910826 - RNA, 14 nt, Homo sapiens
gucuugccaugugc

SEQ ID NO: 1910827 - RNA, 15 nt, Homo sapiens
aguuggcacauuuca

SEQ ID NO: 1910828 - RNA, 20 nt, Homo sapiens
caucucaacaauauaugucc

SEQ ID NO: 1910829 - RNA, 23 nt, Homo sapiens
uuggcccccgagcugggggccau

SEQ ID NO: 1910830 - RNA, 20 nt, Homo sapiens
ccucaauauuuacuauuuca

SEQ ID NO: 1910831 - RNA, 17 nt, Homo sapiens
agucauggcuaauuuaa

SEQ ID NO: 1910832 - RNA, 19 nt, Homo sapiens
aggugcauagcaagugaaa

SEQ ID NO: 1910833 - RNA, 11 nt, Homo sapiens
gucaaacugua

SEQ ID NO: 1910834 - RNA, 20 nt, Homo sapiens
aggcaggagaaucucuugaa

SEQ ID NO: 1910835 - RNA, 14 nt, Homo sapiens
ugcauuuauugccu

SEQ ID NO: 1910836 - RNA, 23 nt, Homo sapiens
agucagccaguggcuagcgcaag

SEQ ID NO: 1910837 - RNA, 16 nt, Homo sapiens
ucuacucuuaagccau

SEQ ID NO: 1910838 - RNA, 15 nt, Homo sapiens
ucgcaggaccaaggg

SEQ ID NO: 1910839 - RNA, 22 nt, Homo sapiens
uuccagaaggccacaggccacu

SEQ ID NO: 1910840 - RNA, 13 nt, Homo sapiens
acaaucuuagaca

SEQ ID NO: 1910841 - RNA, 18 nt, Homo sapiens
agacaacagcauaacuaa

SEQ ID NO: 1910842 - RNA, 21 nt, Homo sapiens
uauguacauaccggggcuccu

SEQ ID NO: 1910843 - RNA, 21 nt, Homo sapiens
acaacuuguauuuccaaaccu

SEQ ID NO: 1910844 - RNA, 23 nt, Homo sapiens
aguuuccuugggaguugucauua

SEQ ID NO: 1910845 - RNA, 15 nt, Homo sapiens
ugccaccugcugcug

SEQ ID NO: 1910846 - RNA, 17 nt, Homo sapiens
gccauuggcuacugacu

SEQ ID NO: 1910847 - RNA, 12 nt, Homo sapiens
accacaaggaaa

SEQ ID NO: 1910848 - RNA, 15 nt, Homo sapiens
aauucucucacuuaa

SEQ ID NO: 1910849 - RNA, 18 nt, Homo sapiens
uuccccaucccaaggcaa

SEQ ID NO: 1910850 - RNA, 17 nt, Homo sapiens
gagagugugcucucccc

SEQ ID NO: 1910851 - RNA, 18 nt, Homo sapiens
caguguuccccaucuggg

SEQ ID NO: 1910852 - RNA, 20 nt, Homo sapiens
agccagcuuccugugcagaa

SEQ ID NO: 1910853 - RNA, 13 nt, Homo sapiens
aaauucacuuuca

SEQ ID NO: 1910854 - RNA, 15 nt, Homo sapiens
cuuuuuccaucucaa

SEQ ID NO: 1910855 - RNA, 16 nt, Homo sapiens
cuuucucucuaauuca

SEQ ID NO: 1910856 - RNA, 13 nt, Homo sapiens
ccuuccaaaccuc

SEQ ID NO: 1910857 - RNA, 13 nt, Homo sapiens
uuucaccauuuga

SEQ ID NO: 1910858 - RNA, 14 nt, Homo sapiens
cugccuguggugag

SEQ ID NO: 1910859 - RNA, 14 nt, Homo sapiens
gcgucugcacugau

SEQ ID NO: 1910860 - RNA, 18 nt, Homo sapiens
cuaaaaccuuccauguca

SEQ ID NO: 1910861 - RNA, 21 nt, Homo sapiens
cuuaaaaauauuuuuucugua

SEQ ID NO: 1910862 - RNA, 16 nt, Homo sapiens
gccucccaccaggaau

SEQ ID NO: 1910863 - RNA, 15 nt, Homo sapiens
uuuguaagguacuga

SEQ ID NO: 1910864 - RNA, 10 nt, Homo sapiens
uaagaacaag

SEQ ID NO: 1910865 - RNA, 14 nt, Homo sapiens
guggcaacugcuga

SEQ ID NO: 1910866 - RNA, 16 nt, Homo sapiens
uuacauguuguguaug

SEQ ID NO: 1910867 - RNA, 15 nt, Homo sapiens
acacuacaacauaug

SEQ ID NO: 1910868 - RNA, 22 nt, Homo sapiens
ccaugcaggggucagugcagca

SEQ ID NO: 1910869 - RNA, 14 nt, Homo sapiens
agccacaggugccu

SEQ ID NO: 1910870 - RNA, 16 nt, Homo sapiens
agucaugaacacauca

SEQ ID NO: 1910871 - RNA, 20 nt, Homo sapiens
gcacuaugguuuguugccua

SEQ ID NO: 1910872 - RNA, 12 nt, Homo sapiens
ucaucacuguaa

SEQ ID NO: 1910873 - RNA, 22 nt, Homo sapiens
ucugggaaaaucuauuccugcc

SEQ ID NO: 1910874 - RNA, 19 nt, Homo sapiens
cuaagacuaaugcuuucug

SEQ ID NO: 1910875 - RNA, 23 nt, Homo sapiens
acuuguagccagaaugcccuguu

SEQ ID NO: 1910876 - RNA, 14 nt, Homo sapiens
uacaccaaugccca

SEQ ID NO: 1910877 - RNA, 16 nt, Homo sapiens
gaucacuuggagccag

SEQ ID NO: 1910878 - RNA, 16 nt, Homo sapiens
guuuucaggaugagau

SEQ ID NO: 1910879 - RNA, 19 nt, Homo sapiens
acugcuuuugagagcucuu

SEQ ID NO: 1910880 - RNA, 23 nt, Homo sapiens
augugccuguagucccaggcuga

SEQ ID NO: 1910881 - RNA, 14 nt, Homo sapiens
agaagucaagccca

SEQ ID NO: 1910882 - RNA, 20 nt, Homo sapiens
agcucagaggagucugggaa

SEQ ID NO: 1910883 - RNA, 20 nt, Homo sapiens
cagugcagggaaccgugaua

SEQ ID NO: 1910884 - RNA, 15 nt, Homo sapiens
auuuucugaccaaaa

SEQ ID NO: 1910885 - RNA, 23 nt, Homo sapiens
agcuaaaaccuacucacuuagca

SEQ ID NO: 1910886 - RNA, 21 nt, Homo sapiens
ggucauuuuccuuucuguauu

SEQ ID NO: 1910887 - RNA, 18 nt, Homo sapiens
uccuuaccauugugauua

SEQ ID NO: 1910888 - RNA, 17 nt, Homo sapiens
augguaccaagcauuua

SEQ ID NO: 1910889 - RNA, 18 nt, Homo sapiens
ggaggaaaaggugucuug

SEQ ID NO: 1910890 - RNA, 18 nt, Homo sapiens
uaaaaucaagugcaccua

SEQ ID NO: 1910891 - RNA, 17 nt, Homo sapiens
acuccaaaccuuacucu

SEQ ID NO: 1910892 - RNA, 21 nt, Homo sapiens
cugacagcaucacgcugcauc

SEQ ID NO: 1910893 - RNA, 18 nt, Homo sapiens
gaucucggcucucugcaa

SEQ ID NO: 1910894 - RNA, 14 nt, Homo sapiens
uuauauuucacuau

SEQ ID NO: 1910895 - RNA, 18 nt, Homo sapiens
auaccccuguuaagcaau

SEQ ID NO: 1910896 - RNA, 13 nt, Homo sapiens
aagagaaaaugua

SEQ ID NO: 1910897 - RNA, 14 nt, Homo sapiens
uuaacccucacugg

SEQ ID NO: 1910898 - RNA, 14 nt, Homo sapiens
uguaguuacugugg

SEQ ID NO: 1910899 - RNA, 13 nt, Homo sapiens
caaaaaccaaaug

SEQ ID NO: 1910900 - RNA, 20 nt, Homo sapiens
uugcuaaaccuauuucacaa

SEQ ID NO: 1910901 - RNA, 17 nt, Homo sapiens
cagcuagggacuacuua

SEQ ID NO: 1910902 - RNA, 15 nt, Homo sapiens
caucugagaggcucu

SEQ ID NO: 1910903 - RNA, 18 nt, Homo sapiens
cucccagcguguguaucc

SEQ ID NO: 1910904 - RNA, 12 nt, Homo sapiens
uucucugagauc

SEQ ID NO: 1910905 - RNA, 15 nt, Homo sapiens
ugccuugaacauaua

SEQ ID NO: 1910906 - RNA, 14 nt, Homo sapiens
cuuuucguuuagaa

SEQ ID NO: 1910907 - RNA, 22 nt, Homo sapiens
cagcaaggaacaucccugagaa

SEQ ID NO: 1910908 - RNA, 14 nt, Homo sapiens
caaaccuucacaca

SEQ ID NO: 1910909 - RNA, 17 nt, Homo sapiens
uuaacaaauacauucaa

SEQ ID NO: 1910910 - RNA, 19 nt, Homo sapiens
caagaguuucaaaacauac

SEQ ID NO: 1910911 - RNA, 22 nt, Homo sapiens
uauuaucuaaaagaaaccuucc

SEQ ID NO: 1910912 - RNA, 16 nt, Homo sapiens
uguacauauauauucu

SEQ ID NO: 1910913 - RNA, 15 nt, Homo sapiens
ugcuaacuggguuaa

SEQ ID NO: 1910914 - RNA, 17 nt, Homo sapiens
gagagguggauccugua

SEQ ID NO: 1910915 - RNA, 23 nt, Homo sapiens
aaacauuuaaauuauacaaucau

SEQ ID NO: 1910916 - RNA, 15 nt, Homo sapiens
cguucaucaccugcu

SEQ ID NO: 1910917 - RNA, 16 nt, Homo sapiens
gaaggcaaaugaugcc

SEQ ID NO: 1910918 - RNA, 18 nt, Homo sapiens
caugaauuauuacagugu

SEQ ID NO: 1910919 - RNA, 16 nt, Homo sapiens
agagaguccucuggau

SEQ ID NO: 1910920 - RNA, 14 nt, Homo sapiens
uugucccucugccc

SEQ ID NO: 1910921 - RNA, 22 nt, Homo sapiens
gaagucagugcuaaagcuggag

SEQ ID NO: 1910922 - RNA, 19 nt, Homo sapiens
ggacacgguguccaccauc

SEQ ID NO: 1910923 - RNA, 16 nt, Homo sapiens
acaccucaguucccuu

SEQ ID NO: 1910924 - RNA, 18 nt, Homo sapiens
guuugguugugcugauag

SEQ ID NO: 1910925 - RNA, 15 nt, Homo sapiens
ccugugccacuuuga

SEQ ID NO: 1910926 - RNA, 14 nt, Homo sapiens
uuacaaaugcaauu

SEQ ID NO: 1910927 - RNA, 15 nt, Homo sapiens
ccagauacaugguga

SEQ ID NO: 1910928 - RNA, 22 nt, Homo sapiens
cugugaauugugcucuguugua

SEQ ID NO: 1910929 - RNA, 19 nt, Homo sapiens
uagccaggcaugguggcac

SEQ ID NO: 1910930 - RNA, 22 nt, Homo sapiens
aacgugaggaagcaagugacaa

SEQ ID NO: 1910931 - RNA, 12 nt, Homo sapiens
ccgaaaugccac

SEQ ID NO: 1910932 - RNA, 14 nt, Homo sapiens
ugagacauguguca

SEQ ID NO: 1910933 - RNA, 16 nt, Homo sapiens
gauuacagagaucuca

SEQ ID NO: 1910934 - RNA, 19 nt, Homo sapiens
ugcagcuugaauuucaaau

SEQ ID NO: 1910935 - RNA, 13 nt, Homo sapiens
agccuccucugga

SEQ ID NO: 1910936 - RNA, 17 nt, Homo sapiens
uugaacuccuagacuca

SEQ ID NO: 1910937 - RNA, 14 nt, Homo sapiens
uuagggcuguagac

SEQ ID NO: 1910938 - RNA, 14 nt, Homo sapiens
ccacugugcugguu

SEQ ID NO: 1910939 - RNA, 17 nt, Homo sapiens
ucggaggaaagggauug

SEQ ID NO: 1910940 - RNA, 16 nt, Homo sapiens
uuugaccagugcaguu

SEQ ID NO: 1910941 - RNA, 12 nt, Homo sapiens
acuccaacugaa

SEQ ID NO: 1910942 - RNA, 23 nt, Homo sapiens
uuggguuaagcauuaccacucag

SEQ ID NO: 1910943 - RNA, 13 nt, Homo sapiens
gacucccacaaca

SEQ ID NO: 1910944 - RNA, 15 nt, Homo sapiens
uccagcaaccuauaa

SEQ ID NO: 1910945 - RNA, 15 nt, Homo sapiens
cauagaaauacauca

SEQ ID NO: 1910946 - RNA, 15 nt, Homo sapiens
ccaaaacaagagccu

SEQ ID NO: 1910947 - RNA, 14 nt, Homo sapiens
gagauggagaaaau

SEQ ID NO: 1910948 - RNA, 18 nt, Homo sapiens
cagcacuuuccuguugca

SEQ ID NO: 1910949 - RNA, 21 nt, Homo sapiens
ccugugaggcagccuucugau

SEQ ID NO: 1910950 - RNA, 23 nt, Homo sapiens
uaugucugugccauuucucaggg

SEQ ID NO: 1910951 - RNA, 21 nt, Homo sapiens
cuguggagacaaugucugcag

SEQ ID NO: 1910952 - RNA, 15 nt, Homo sapiens
uuguaagguacugaa

SEQ ID NO: 1910953 - RNA, 12 nt, Homo sapiens
aggcagaacucu

SEQ ID NO: 1910954 - RNA, 20 nt, Homo sapiens
ucagauuuuaccuaauacag

SEQ ID NO: 1910955 - RNA, 23 nt, Homo sapiens
ucagaagcaucgcuccucuccag

SEQ ID NO: 1910956 - RNA, 19 nt, Homo sapiens
uaucaaauacuaguauuaa

SEQ ID NO: 1910957 - RNA, 16 nt, Homo sapiens
acauaaaauaaacacu

SEQ ID NO: 1910958 - RNA, 19 nt, Homo sapiens
auggcaucauugcauucca

SEQ ID NO: 1910959 - RNA, 21 nt, Homo sapiens
uccuuggggagcacuugucca

SEQ ID NO: 1910960 - RNA, 20 nt, Homo sapiens
ccuacagagcagccaggugg

SEQ ID NO: 1910961 - RNA, 16 nt, Homo sapiens
aauaacagauuucuca

SEQ ID NO: 1910962 - RNA, 20 nt, Homo sapiens
uccccaacaccccacugagc

SEQ ID NO: 1910963 - RNA, 22 nt, Homo sapiens
caagaaccaggcagcccugcca

SEQ ID NO: 1910964 - RNA, 14 nt, Homo sapiens
aucacacugaauua

SEQ ID NO: 1910965 - RNA, 17 nt, Homo sapiens
uccauauagacaccaag

SEQ ID NO: 1910966 - RNA, 22 nt, Homo sapiens
aacuauuggugcuugacucuca

SEQ ID NO: 1910967 - RNA, 19 nt, Homo sapiens
aaucuuaauucaacuagua

SEQ ID NO: 1910968 - RNA, 21 nt, Homo sapiens
auuuacggaggcguugugaau

SEQ ID NO: 1910969 - RNA, 21 nt, Homo sapiens
ucaacaagaacgauucaccug

SEQ ID NO: 1910970 - RNA, 19 nt, Homo sapiens
guucaaaacaaccacuuuc

SEQ ID NO: 1910971 - RNA, 20 nt, Homo sapiens
gacacuuaguuauuuaccaa

SEQ ID NO: 1910972 - RNA, 19 nt, Homo sapiens
acccagaaagaauguucag

SEQ ID NO: 1910973 - RNA, 15 nt, Homo sapiens
ucuuuccucccugaa

SEQ ID NO: 1910974 - RNA, 15 nt, Homo sapiens
uccggaauccugucc

SEQ ID NO: 1910975 - RNA, 23 nt, Homo sapiens
cugggcacacgccucccacuggg

SEQ ID NO: 1910976 - RNA, 21 nt, Homo sapiens
cccaucggguaagaugcuccu

SEQ ID NO: 1910977 - RNA, 22 nt, Homo sapiens
ccucaccucccgaagccaccau

SEQ ID NO: 1910978 - RNA, 15 nt, Homo sapiens
ucugaaugcaugacc

SEQ ID NO: 1910979 - RNA, 15 nt, Homo sapiens
ccaggaaggcagcug

SEQ ID NO: 1910980 - RNA, 12 nt, Homo sapiens
agagagggcaaa

SEQ ID NO: 1910981 - RNA, 22 nt, Homo sapiens
cugcauuucaagaagacuggca

SEQ ID NO: 1910982 - RNA, 16 nt, Homo sapiens
auucaccgugaaauag

SEQ ID NO: 1910983 - RNA, 19 nt, Homo sapiens
gcccuagcccagacucuga

SEQ ID NO: 1910984 - RNA, 19 nt, Homo sapiens
uucaccuuuguagcacuca

SEQ ID NO: 1910985 - RNA, 23 nt, Homo sapiens
cugccucucucauccacuuucca

SEQ ID NO: 1910986 - RNA, 20 nt, Homo sapiens
acuuggacuagaugacucuc

SEQ ID NO: 1910987 - RNA, 20 nt, Homo sapiens
auacuguucaaugguucuga

SEQ ID NO: 1910988 - RNA, 21 nt, Homo sapiens
ugaaaaaucugaauuucuaaa

SEQ ID NO: 1910989 - RNA, 13 nt, Homo sapiens
agggguuccucaa

SEQ ID NO: 1910990 - RNA, 13 nt, Homo sapiens
aucccagcacuuu

SEQ ID NO: 1910991 - RNA, 23 nt, Homo sapiens
gacucaagccuuucacauacuga

SEQ ID NO: 1910992 - RNA, 13 nt, Homo sapiens
aaaacacacauac

SEQ ID NO: 1910993 - RNA, 16 nt, Homo sapiens
cuuggaugcccugugg

SEQ ID NO: 1910994 - RNA, 17 nt, Homo sapiens
uuggaaagaaauucuga

SEQ ID NO: 1910995 - RNA, 18 nt, Homo sapiens
agcuggucaguugccaaa

SEQ ID NO: 1910996 - RNA, 23 nt, Homo sapiens
caagggguggccgggcacagugg

SEQ ID NO: 1910997 - RNA, 22 nt, Homo sapiens
auaaacaaucuuagacauuuau

SEQ ID NO: 1910998 - RNA, 18 nt, Homo sapiens
aggccaaacucaccugcc

SEQ ID NO: 1910999 - RNA, 20 nt, Homo sapiens
aauggcucagggauucagcc

SEQ ID NO: 1911000 - RNA, 17 nt, Homo sapiens
uaacauuggugcaaaga

SEQ ID NO: 1911001 - RNA, 22 nt, Homo sapiens
cuagucacucauccauccccug

SEQ ID NO: 1911002 - RNA, 18 nt, Homo sapiens
ggcaauggugaacuguca

SEQ ID NO: 1911003 - RNA, 14 nt, Homo sapiens
cuggucugugcauu

SEQ ID NO: 1911004 - RNA, 16 nt, Homo sapiens
ucacuugccaauguac

SEQ ID NO: 1911005 - RNA, 22 nt, Homo sapiens
uucaauucuguaauuacauauu

SEQ ID NO: 1911006 - RNA, 15 nt, Homo sapiens
uggaacccaggaccu

SEQ ID NO: 1911007 - RNA, 23 nt, Homo sapiens
aagcaacagauggauagucuguc

SEQ ID NO: 1911008 - RNA, 15 nt, Homo sapiens
uucagacaacauuau

SEQ ID NO: 1911009 - RNA, 12 nt, Homo sapiens
ugaaaacauaca

SEQ ID NO: 1911010 - RNA, 19 nt, Homo sapiens
gugggcgaggccugacaca

SEQ ID NO: 1911011 - RNA, 18 nt, Homo sapiens
cuccaucauaugccugac

SEQ ID NO: 1911012 - RNA, 17 nt, Homo sapiens
accuaagcaaugagcca

SEQ ID NO: 1911013 - RNA, 14 nt, Homo sapiens
cuaugugauuacaa

SEQ ID NO: 1911014 - RNA, 22 nt, Homo sapiens
cucaugcagaagccugagcuca

SEQ ID NO: 1911015 - RNA, 16 nt, Homo sapiens
aggcagauagcacugg

SEQ ID NO: 1911016 - RNA, 18 nt, Homo sapiens
aggacuguugacauccaa

SEQ ID NO: 1911017 - RNA, 15 nt, Homo sapiens
aacauugcaauagaa

SEQ ID NO: 1911018 - RNA, 21 nt, Homo sapiens
gugcacagaucacacacaugc

SEQ ID NO: 1911019 - RNA, 16 nt, Homo sapiens
aggugaggagggcagu

SEQ ID NO: 1911020 - RNA, 20 nt, Homo sapiens
aauuacuauauucuuacccu

SEQ ID NO: 1911021 - RNA, 17 nt, Homo sapiens
agauacuugaacacugu

SEQ ID NO: 1911022 - RNA, 13 nt, Homo sapiens
ccucuaagccacu

SEQ ID NO: 1911023 - RNA, 18 nt, Homo sapiens
gcaaauguuucugcagua

SEQ ID NO: 1911024 - RNA, 22 nt, Homo sapiens
caacacaucuaauuaaauguag

SEQ ID NO: 1911025 - RNA, 15 nt, Homo sapiens
ucaaauugcugcuug

SEQ ID NO: 1911026 - RNA, 17 nt, Homo sapiens
gcaagacuccgucucaa

SEQ ID NO: 1911027 - RNA, 13 nt, Homo sapiens
aaaaacauuucau

SEQ ID NO: 1911028 - RNA, 16 nt, Homo sapiens
guaauugacacuauau

SEQ ID NO: 1911029 - RNA, 22 nt, Homo sapiens
acccuuaggccagcaccaucuc

SEQ ID NO: 1911030 - RNA, 23 nt, Homo sapiens
ccacuuuucaugucauuugacau

SEQ ID NO: 1911031 - RNA, 16 nt, Homo sapiens
ccuuaucauaaauuca

SEQ ID NO: 1911032 - RNA, 19 nt, Homo sapiens
uuugcaaagauaugugggu

SEQ ID NO: 1911033 - RNA, 15 nt, Homo sapiens
gcacccucccuagcu

SEQ ID NO: 1911034 - RNA, 11 nt, Homo sapiens
uaaaaugaagg

SEQ ID NO: 1911035 - RNA, 14 nt, Homo sapiens
uuccaacaugugau

SEQ ID NO: 1911036 - RNA, 14 nt, Homo sapiens
aaucccaccugcca

SEQ ID NO: 1911037 - RNA, 20 nt, Homo sapiens
aagcugggcauggucgcuca

SEQ ID NO: 1911038 - RNA, 18 nt, Homo sapiens
gaacauugcagagcuaag

SEQ ID NO: 1911039 - RNA, 17 nt, Homo sapiens
cuaaaaauaaagcacaa

SEQ ID NO: 1911040 - RNA, 15 nt, Homo sapiens
uuccaguauccugaa

SEQ ID NO: 1911041 - RNA, 20 nt, Homo sapiens
uccaacucuuccaccucugg

SEQ ID NO: 1911042 - RNA, 15 nt, Homo sapiens
uuuuaagugccuuua

SEQ ID NO: 1911043 - RNA, 16 nt, Homo sapiens
caccauuauaaugaau

SEQ ID NO: 1911044 - RNA, 19 nt, Homo sapiens
uuucagugaaagcaucacu

SEQ ID NO: 1911045 - RNA, 22 nt, Homo sapiens
ugaaagcacuccucccugaugu

SEQ ID NO: 1911046 - RNA, 13 nt, Homo sapiens
agacaaggugcua

SEQ ID NO: 1911047 - RNA, 14 nt, Homo sapiens
caccaucugauuaa

SEQ ID NO: 1911048 - RNA, 20 nt, Homo sapiens
agcuuuugaggggcugacuu

SEQ ID NO: 1911049 - RNA, 18 nt, Homo sapiens
uucucuggcucuugucca

SEQ ID NO: 1911050 - RNA, 13 nt, Homo sapiens
ugcgcuguguaca

SEQ ID NO: 1911051 - RNA, 17 nt, Homo sapiens
uggugggaacauucgag

SEQ ID NO: 1911052 - RNA, 12 nt, Homo sapiens
uuacauuuacaa

SEQ ID NO: 1911053 - RNA, 18 nt, Homo sapiens
ucugccugcugaccauaa

SEQ ID NO: 1911054 - RNA, 18 nt, Homo sapiens
caacaugacauccagaga

SEQ ID NO: 1911055 - RNA, 18 nt, Homo sapiens
ucggccucccacagugcu

SEQ ID NO: 1911056 - RNA, 17 nt, Homo sapiens
uuaaagaaaauaugcau

SEQ ID NO: 1911057 - RNA, 22 nt, Homo sapiens
aguccuugucuuguaauugugg

SEQ ID NO: 1911058 - RNA, 14 nt, Homo sapiens
aauuuuauugcaaa

SEQ ID NO: 1911059 - RNA, 15 nt, Homo sapiens
gccucuaugugcaac

SEQ ID NO: 1911060 - RNA, 19 nt, Homo sapiens
acccaugcuggucagagac

SEQ ID NO: 1911061 - RNA, 22 nt, Homo sapiens
caaaugggggaaaaguuaguca

SEQ ID NO: 1911062 - RNA, 23 nt, Homo sapiens
guuguaauguguaugucugguaa

SEQ ID NO: 1911063 - RNA, 20 nt, Homo sapiens
auuuaauuguaauugucuca

SEQ ID NO: 1911064 - RNA, 19 nt, Homo sapiens
aagaucuuuaaacugcuuu

SEQ ID NO: 1911065 - RNA, 22 nt, Homo sapiens
guuguagacuauggaaugucag

SEQ ID NO: 1911066 - RNA, 15 nt, Homo sapiens
cauucagaccaguga

SEQ ID NO: 1911067 - RNA, 20 nt, Homo sapiens
gugacuuuuuagccagugac

SEQ ID NO: 1911068 - RNA, 18 nt, Homo sapiens
auacgcaccacaucucua

SEQ ID NO: 1911069 - RNA, 16 nt, Homo sapiens
uaguucugccaggaga

SEQ ID NO: 1911070 - RNA, 22 nt, Homo sapiens
cagaggaugaggugggcugaag

SEQ ID NO: 1911071 - RNA, 12 nt, Homo sapiens
aaagcaugugcu

SEQ ID NO: 1911072 - RNA, 22 nt, Homo sapiens
aggggccuggaggucuggcuga

SEQ ID NO: 1911073 - RNA, 18 nt, Homo sapiens
guccuaaagaugcugacu

SEQ ID NO: 1911074 - RNA, 15 nt, Homo sapiens
ugccccuugggagac

SEQ ID NO: 1911075 - RNA, 19 nt, Homo sapiens
ugcauuuucuucacagugc

SEQ ID NO: 1911076 - RNA, 13 nt, Homo sapiens
agaagaaguucau

SEQ ID NO: 1911077 - RNA, 17 nt, Homo sapiens
ucagauuugccauucaa

SEQ ID NO: 1911078 - RNA, 17 nt, Homo sapiens
ccaaaggaaaaagcaca

SEQ ID NO: 1911079 - RNA, 22 nt, Homo sapiens
cuuucuuuuuuaaauaggguug

SEQ ID NO: 1911080 - RNA, 20 nt, Homo sapiens
cuccuucagcagcuacugac

SEQ ID NO: 1911081 - RNA, 21 nt, Homo sapiens
gcuuaucaguaguaucaauga

SEQ ID NO: 1911082 - RNA, 16 nt, Homo sapiens
cagagagcaacucuga

SEQ ID NO: 1911083 - RNA, 16 nt, Homo sapiens
acuauaccugcuucag

SEQ ID NO: 1911084 - RNA, 18 nt, Homo sapiens
uuuuugaaaaaagcucau

SEQ ID NO: 1911085 - RNA, 16 nt, Homo sapiens
gaacaaaagaagcagc

SEQ ID NO: 1911086 - RNA, 22 nt, Homo sapiens
gagacaugggccucccacuccu

SEQ ID NO: 1911087 - RNA, 15 nt, Homo sapiens
uuauuaauacuaugc

SEQ ID NO: 1911088 - RNA, 14 nt, Homo sapiens
agcacccucuccag

SEQ ID NO: 1911089 - RNA, 20 nt, Homo sapiens
uagugggcaccccacugcaa

SEQ ID NO: 1911090 - RNA, 21 nt, Homo sapiens
caguaguuuugacacuuccca

SEQ ID NO: 1911091 - RNA, 23 nt, Homo sapiens
cuaaggaaaaaacuaguauuccc

SEQ ID NO: 1911092 - RNA, 16 nt, Homo sapiens
auaaauguugcaaugc

SEQ ID NO: 1911093 - RNA, 16 nt, Homo sapiens
agaacuuuuucacuuc

SEQ ID NO: 1911094 - RNA, 18 nt, Homo sapiens
aggccugccuucucaggg

SEQ ID NO: 1911095 - RNA, 22 nt, Homo sapiens
ucuguacccuuuuccaucaugu

SEQ ID NO: 1911096 - RNA, 20 nt, Homo sapiens
gaagaaacuuugccucaaga

SEQ ID NO: 1911097 - RNA, 17 nt, Homo sapiens
uccuccaccgucuuucu

SEQ ID NO: 1911098 - RNA, 19 nt, Homo sapiens
aaauggaagacacauugaa

SEQ ID NO: 1911099 - RNA, 13 nt, Homo sapiens
aaggcagugcagu

SEQ ID NO: 1911100 - RNA, 21 nt, Homo sapiens
agcuauggcccagaaacaaca

SEQ ID NO: 1911101 - RNA, 22 nt, Homo sapiens
gauccacauuguuaggugcuga

SEQ ID NO: 1911102 - RNA, 14 nt, Homo sapiens
uacuugcacuguua

SEQ ID NO: 1911103 - RNA, 23 nt, Homo sapiens
auuuaauccgucacauucaucuc

SEQ ID NO: 1911104 - RNA, 19 nt, Homo sapiens
agcaucauuaaugcacauc

SEQ ID NO: 1911105 - RNA, 20 nt, Homo sapiens
auuuacauuuuuaauuuagu

SEQ ID NO: 1911106 - RNA, 16 nt, Homo sapiens
ugucucagaccacuau

SEQ ID NO: 1911107 - RNA, 17 nt, Homo sapiens
ccuuuuauacugacaaa

SEQ ID NO: 1911108 - RNA, 18 nt, Homo sapiens
ccagugggcugaugcugg

SEQ ID NO: 1911109 - RNA, 16 nt, Homo sapiens
gaugccuccucugucc

SEQ ID NO: 1911110 - RNA, 13 nt, Homo sapiens
ccugccaccuuca

SEQ ID NO: 1911111 - RNA, 16 nt, Homo sapiens
aaucugcacacuccag

SEQ ID NO: 1911112 - RNA, 18 nt, Homo sapiens
cagaacucccauuacaac

SEQ ID NO: 1911113 - RNA, 18 nt, Homo sapiens
caauauuuaagagauuaa

SEQ ID NO: 1911114 - RNA, 16 nt, Homo sapiens
gcaucagagagacugu

SEQ ID NO: 1911115 - RNA, 20 nt, Homo sapiens
aguuuauauggaaaugcaaa

SEQ ID NO: 1911116 - RNA, 17 nt, Homo sapiens
uuagaaauucagcauuu

SEQ ID NO: 1911117 - RNA, 20 nt, Homo sapiens
ugauaaauccucuauugacu

SEQ ID NO: 1911118 - RNA, 18 nt, Homo sapiens
caguagaacugucuguga

SEQ ID NO: 1911119 - RNA, 21 nt, Homo sapiens
acacugugaacuaaugacaag

SEQ ID NO: 1911120 - RNA, 17 nt, Homo sapiens
gcauuuuuaaucugugu

SEQ ID NO: 1911121 - RNA, 20 nt, Homo sapiens
gucaccuaacccucugucac

SEQ ID NO: 1911122 - RNA, 21 nt, Homo sapiens
cauucacaaaguauaacaauu

SEQ ID NO: 1911123 - RNA, 14 nt, Homo sapiens
cgucuaacuggaaa

SEQ ID NO: 1911124 - RNA, 15 nt, Homo sapiens
cagugacacaacuca

SEQ ID NO: 1911125 - RNA, 18 nt, Homo sapiens
acgcugacggaggagcua

SEQ ID NO: 1911126 - RNA, 15 nt, Homo sapiens
uggaggaaucacugg

SEQ ID NO: 1911127 - RNA, 22 nt, Homo sapiens
ugagauuuugaaaaucuaccaa

SEQ ID NO: 1911128 - RNA, 13 nt, Homo sapiens
ucaggccagccca

SEQ ID NO: 1911129 - RNA, 20 nt, Homo sapiens
uucccaacuucccuguucuu

SEQ ID NO: 1911130 - RNA, 16 nt, Homo sapiens
cucccugcagagccaa

SEQ ID NO: 1911131 - RNA, 19 nt, Homo sapiens
uguuauuauuaccagcauu

SEQ ID NO: 1911132 - RNA, 15 nt, Homo sapiens
auugcauuaguccaa

SEQ ID NO: 1911133 - RNA, 13 nt, Homo sapiens
uuguuuuccacuc

SEQ ID NO: 1911134 - RNA, 18 nt, Homo sapiens
aacacuuauguuauacaa

SEQ ID NO: 1911135 - RNA, 21 nt, Homo sapiens
aagcucaccuguugcuuacaa

SEQ ID NO: 1911136 - RNA, 21 nt, Homo sapiens
aacaaguauuuguuaauuuag

SEQ ID NO: 1911137 - RNA, 17 nt, Homo sapiens
ccaacuuaaguuuagaa

SEQ ID NO: 1911138 - RNA, 22 nt, Homo sapiens
cuuccuuccacucccuuugcca

SEQ ID NO: 1911139 - RNA, 21 nt, Homo sapiens
cauugaagauccgagugugau

SEQ ID NO: 1911140 - RNA, 17 nt, Homo sapiens
auuuccagccagggcug

SEQ ID NO: 1911141 - RNA, 12 nt, Homo sapiens
ugugugugcaag

SEQ ID NO: 1911142 - RNA, 15 nt, Homo sapiens
aaauucaaccacaga

SEQ ID NO: 1911143 - RNA, 14 nt, Homo sapiens
gaagaacuugcaug

SEQ ID NO: 1911144 - RNA, 19 nt, Homo sapiens
uuaaaauaauuauaugaag

SEQ ID NO: 1911145 - RNA, 15 nt, Homo sapiens
uagaaccaugaauuc

SEQ ID NO: 1911146 - RNA, 23 nt, Homo sapiens
ccagagccucccuccggacaaug

SEQ ID NO: 1911147 - RNA, 18 nt, Homo sapiens
aaaaaccaacagguuuau

SEQ ID NO: 1911148 - RNA, 16 nt, Homo sapiens
gcucuacuaccuguac

SEQ ID NO: 1911149 - RNA, 21 nt, Homo sapiens
cuccgcgugucucauuugcca

SEQ ID NO: 1911150 - RNA, 18 nt, Homo sapiens
ccuuguuggggagugggu

SEQ ID NO: 1911151 - RNA, 23 nt, Homo sapiens
uggcuucaggcuaagaagagauu

SEQ ID NO: 1911152 - RNA, 19 nt, Homo sapiens
aggcaugagccaccaugcc

SEQ ID NO: 1911153 - RNA, 22 nt, Homo sapiens
caggcauuuguucacugaaggu

SEQ ID NO: 1911154 - RNA, 16 nt, Homo sapiens
gaagcagcauccucca

SEQ ID NO: 1911155 - RNA, 18 nt, Homo sapiens
ccucagagccugaccuga

SEQ ID NO: 1911156 - RNA, 14 nt, Homo sapiens
aaagaaaccuucca

SEQ ID NO: 1911157 - RNA, 16 nt, Homo sapiens
uguagagcuucuggca

SEQ ID NO: 1911158 - RNA, 20 nt, Homo sapiens
gauuucauagcgaguuuucu

SEQ ID NO: 1911159 - RNA, 14 nt, Homo sapiens
caaugaugauuaaa

SEQ ID NO: 1911160 - RNA, 21 nt, Homo sapiens
cuuauacuucggguaaccuug

SEQ ID NO: 1911161 - RNA, 19 nt, Homo sapiens
aaucuuuuagcacaugugu

SEQ ID NO: 1911162 - RNA, 15 nt, Homo sapiens
acagcaugugcaaua

SEQ ID NO: 1911163 - RNA, 18 nt, Homo sapiens
gauucuaaaggggacaga

SEQ ID NO: 1911164 - RNA, 23 nt, Homo sapiens
cagacacugccgggccucccucc

SEQ ID NO: 1911165 - RNA, 15 nt, Homo sapiens
aucagcccaucucaa

SEQ ID NO: 1911166 - RNA, 22 nt, Homo sapiens
cgguuggaaauagaaauuucca

SEQ ID NO: 1911167 - RNA, 15 nt, Homo sapiens
ugaauucauuugcug

SEQ ID NO: 1911168 - RNA, 16 nt, Homo sapiens
cucuugacuggcucaa

SEQ ID NO: 1911169 - RNA, 16 nt, Homo sapiens
ggcaggaccagguggc

SEQ ID NO: 1911170 - RNA, 17 nt, Homo sapiens
aggacuguugacaucca

SEQ ID NO: 1911171 - RNA, 15 nt, Homo sapiens
caguggcacgaucuc

SEQ ID NO: 1911172 - RNA, 12 nt, Homo sapiens
agagcugggaaa

SEQ ID NO: 1911173 - RNA, 23 nt, Homo sapiens
agcauuuuuaauuuucacaaaau

SEQ ID NO: 1911174 - RNA, 21 nt, Homo sapiens
aaguucuccagcuucagcuca

SEQ ID NO: 1911175 - RNA, 15 nt, Homo sapiens
ucuuguaauugugga

SEQ ID NO: 1911176 - RNA, 21 nt, Homo sapiens
auugacaucucuuuugagcua

SEQ ID NO: 1911177 - RNA, 17 nt, Homo sapiens
uguaaaaagacaaaaac

SEQ ID NO: 1911178 - RNA, 18 nt, Homo sapiens
ucacaaggcaacugugag

SEQ ID NO: 1911179 - RNA, 13 nt, Homo sapiens
cagagaugggcaa

SEQ ID NO: 1911180 - RNA, 17 nt, Homo sapiens
auggagaacuugcucaa

SEQ ID NO: 1911181 - RNA, 13 nt, Homo sapiens
acauuucugccac

SEQ ID NO: 1911182 - RNA, 16 nt, Homo sapiens
acagaugcguucagca

SEQ ID NO: 1911183 - RNA, 15 nt, Homo sapiens
aggguuuugacacuu

SEQ ID NO: 1911184 - RNA, 12 nt, Homo sapiens
cagcacugccag

SEQ ID NO: 1911185 - RNA, 13 nt, Homo sapiens
agcgcacuugaug

SEQ ID NO: 1911186 - RNA, 13 nt, Homo sapiens
aucugacuuuagc

SEQ ID NO: 1911187 - RNA, 18 nt, Homo sapiens
uggaacucagcugucugu

SEQ ID NO: 1911188 - RNA, 21 nt, Homo sapiens
ucugauuguugucaggccaua

SEQ ID NO: 1911189 - RNA, 17 nt, Homo sapiens
uuaauucauaaaucaca

SEQ ID NO: 1911190 - RNA, 15 nt, Homo sapiens
gcuuuuugcuucuug

SEQ ID NO: 1911191 - RNA, 20 nt, Homo sapiens
gagcuccccaccaccccagc

SEQ ID NO: 1911192 - RNA, 18 nt, Homo sapiens
uugguuuuccuguggcau

SEQ ID NO: 1911193 - RNA, 14 nt, Homo sapiens
cccuccacugucac

SEQ ID NO: 1911194 - RNA, 15 nt, Homo sapiens
cuuuaaagugacuaa

SEQ ID NO: 1911195 - RNA, 16 nt, Homo sapiens
ugaagggacggcugug

SEQ ID NO: 1911196 - RNA, 15 nt, Homo sapiens
gccauaggugcaguu

SEQ ID NO: 1911197 - RNA, 22 nt, Homo sapiens
cugauauaacaaacuacaugua

SEQ ID NO: 1911198 - RNA, 22 nt, Homo sapiens
caagcucucugcaucuacuccc

SEQ ID NO: 1911199 - RNA, 22 nt, Homo sapiens
ccacagcuuuuacguaguaaaa

SEQ ID NO: 1911200 - RNA, 17 nt, Homo sapiens
ccauggcugccaucuca

SEQ ID NO: 1911201 - RNA, 15 nt, Homo sapiens
guggcagcucaaaau

SEQ ID NO: 1911202 - RNA, 22 nt, Homo sapiens
ugucccuugccucaaugccagu

SEQ ID NO: 1911203 - RNA, 23 nt, Homo sapiens
auccaggacugugccagcacaaa

SEQ ID NO: 1911204 - RNA, 23 nt, Homo sapiens
cuccugcccagcuccucacauac

SEQ ID NO: 1911205 - RNA, 12 nt, Homo sapiens
gauguucaccuu

SEQ ID NO: 1911206 - RNA, 16 nt, Homo sapiens
caaguuucauaccaaa

SEQ ID NO: 1911207 - RNA, 15 nt, Homo sapiens
uaccacuuaccucaa

SEQ ID NO: 1911208 - RNA, 15 nt, Homo sapiens
aaacccuuucauaaa

SEQ ID NO: 1911209 - RNA, 24 nt, Homo sapiens
uuucucauagcuuuacagauguag

SEQ ID NO: 1911210 - RNA, 14 nt, Homo sapiens
gcucagcaaggcca

SEQ ID NO: 1911211 - RNA, 20 nt, Homo sapiens
caauaaaaccaaacaugcuu

SEQ ID NO: 1911212 - RNA, 16 nt, Homo sapiens
agacaacagaagucau

SEQ ID NO: 1911213 - RNA, 18 nt, Homo sapiens
cuuaugccuauaccugaa

SEQ ID NO: 1911214 - RNA, 19 nt, Homo sapiens
ucuguggauuggccuuuaa

SEQ ID NO: 1911215 - RNA, 11 nt, Homo sapiens
ugugacauuua

SEQ ID NO: 1911216 - RNA, 13 nt, Homo sapiens
gcacgaucucagu

SEQ ID NO: 1911217 - RNA, 19 nt, Homo sapiens
gagguggagguugcaguga

SEQ ID NO: 1911218 - RNA, 14 nt, Homo sapiens
gugacgcugcugac

SEQ ID NO: 1911219 - RNA, 23 nt, Homo sapiens
aaguaugaucuaugcuauauuca

SEQ ID NO: 1911220 - RNA, 16 nt, Homo sapiens
gauaaagaugcaagga

SEQ ID NO: 1911221 - RNA, 14 nt, Homo sapiens
ucucaauuugcagu

SEQ ID NO: 1911222 - RNA, 23 nt, Homo sapiens
caccuaccuuagaaaacaaguau

SEQ ID NO: 1911223 - RNA, 19 nt, Homo sapiens
uucccaauaaauacuugcc

SEQ ID NO: 1911224 - RNA, 15 nt, Homo sapiens
aggauauuaacaaca

SEQ ID NO: 1911225 - RNA, 13 nt, Homo sapiens
gagcaucucugcc

SEQ ID NO: 1911226 - RNA, 23 nt, Homo sapiens
auaaaauugcaguuucauguaug

SEQ ID NO: 1911227 - RNA, 22 nt, Homo sapiens
cuccccuuuuauaccugcucuu

SEQ ID NO: 1911228 - RNA, 22 nt, Homo sapiens
cccucuuuucugaucugcaguu

SEQ ID NO: 1911229 - RNA, 17 nt, Homo sapiens
guucaugaaagauucaa

SEQ ID NO: 1911230 - RNA, 13 nt, Homo sapiens
gccuuccuggguu

SEQ ID NO: 1911231 - RNA, 21 nt, Homo sapiens
cauagcagaccacacagaagg

SEQ ID NO: 1911232 - RNA, 22 nt, Homo sapiens
ucaccaauaaguauucuguguu

SEQ ID NO: 1911233 - RNA, 17 nt, Homo sapiens
ggccuccugggggaccu

SEQ ID NO: 1911234 - RNA, 15 nt, Homo sapiens
caucuuccacagaga

SEQ ID NO: 1911235 - RNA, 17 nt, Homo sapiens
ccaccucccugcaauaa

SEQ ID NO: 1911236 - RNA, 13 nt, Homo sapiens
uguauuguucuaa

SEQ ID NO: 1911237 - RNA, 20 nt, Homo sapiens
uguuacuccauuacugugau

SEQ ID NO: 1911238 - RNA, 23 nt, Homo sapiens
cucuucuaaaaaaugauacacac

SEQ ID NO: 1911239 - RNA, 20 nt, Homo sapiens
ggguucaccaggucagggag

SEQ ID NO: 1911240 - RNA, 12 nt, Homo sapiens
gcaaaaccaaau

SEQ ID NO: 1911241 - RNA, 21 nt, Homo sapiens
agaagccuccaagccugccuc

SEQ ID NO: 1911242 - RNA, 17 nt, Homo sapiens
acaaaggauuugaugcu

SEQ ID NO: 1911243 - RNA, 13 nt, Homo sapiens
gugauuucucucc

SEQ ID NO: 1911244 - RNA, 13 nt, Homo sapiens
gccugugccaggu

SEQ ID NO: 1911245 - RNA, 15 nt, Homo sapiens
aggagaugggugcaa

SEQ ID NO: 1911246 - RNA, 14 nt, Homo sapiens
auauguucaggaaa

SEQ ID NO: 1911247 - RNA, 13 nt, Homo sapiens
gagcaaaaugcuc

SEQ ID NO: 1911248 - RNA, 20 nt, Homo sapiens
caggcagcuuuuucucuccc

SEQ ID NO: 1911249 - RNA, 15 nt, Homo sapiens
uggucugcuccgccu

SEQ ID NO: 1911250 - RNA, 16 nt, Homo sapiens
ggcuuacuaguaucac

SEQ ID NO: 1911251 - RNA, 18 nt, Homo sapiens
uauaaaauauaaacaaag

SEQ ID NO: 1911252 - RNA, 13 nt, Homo sapiens
ucuccccucugca

SEQ ID NO: 1911253 - RNA, 17 nt, Homo sapiens
gccuuccugcccuacag

SEQ ID NO: 1911254 - RNA, 16 nt, Homo sapiens
aaaggccccugcaaug

SEQ ID NO: 1911255 - RNA, 18 nt, Homo sapiens
cgaguacuaauaugcaau

SEQ ID NO: 1911256 - RNA, 23 nt, Homo sapiens
aaaaucaugcuuauaagcaacau

SEQ ID NO: 1911257 - RNA, 19 nt, Homo sapiens
ggagguagagguugcacug

SEQ ID NO: 1911258 - RNA, 17 nt, Homo sapiens
uugugaguuuaccuugu

SEQ ID NO: 1911259 - RNA, 19 nt, Homo sapiens
uauauaguuaguaucuuua

SEQ ID NO: 1911260 - RNA, 17 nt, Homo sapiens
ucugucacuugcauucc

SEQ ID NO: 1911261 - RNA, 18 nt, Homo sapiens
uccugucucuaagucaau

SEQ ID NO: 1911262 - RNA, 15 nt, Homo sapiens
ucauauaagcuauau

SEQ ID NO: 1911263 - RNA, 19 nt, Homo sapiens
accugaggcccccaucucc

SEQ ID NO: 1911264 - RNA, 12 nt, Homo sapiens
gcucacagauuu

SEQ ID NO: 1911265 - RNA, 23 nt, Homo sapiens
cuaccccucccagcugacagucc

SEQ ID NO: 1911266 - RNA, 22 nt, Homo sapiens
ccauuuuugucagucugaguca

SEQ ID NO: 1911267 - RNA, 22 nt, Homo sapiens
gaauaaaaaaugggaacauaca

SEQ ID NO: 1911268 - RNA, 15 nt, Homo sapiens
aggaauucuuugcau

SEQ ID NO: 1911269 - RNA, 18 nt, Homo sapiens
uuuucaaagauguguugc

SEQ ID NO: 1911270 - RNA, 14 nt, Homo sapiens
cuagauacaauaaa

SEQ ID NO: 1911271 - RNA, 13 nt, Homo sapiens
acuaucugugcca

SEQ ID NO: 1911272 - RNA, 20 nt, Homo sapiens
uggugcugggagaugcucuc

SEQ ID NO: 1911273 - RNA, 17 nt, Homo sapiens
ucauccuauucuuucga

SEQ ID NO: 1911274 - RNA, 17 nt, Homo sapiens
gaauuagguguacugua

SEQ ID NO: 1911275 - RNA, 16 nt, Homo sapiens
cccugccccacuucuc

SEQ ID NO: 1911276 - RNA, 13 nt, Homo sapiens
ucaggcugcugga

SEQ ID NO: 1911277 - RNA, 15 nt, Homo sapiens
ggcugaucucaggga

SEQ ID NO: 1911278 - RNA, 21 nt, Homo sapiens
auaaauccucucuaucacauc

SEQ ID NO: 1911279 - RNA, 23 nt, Homo sapiens
agccuuauguggaagaacuguga

SEQ ID NO: 1911280 - RNA, 13 nt, Homo sapiens
ccacuccuaauau

SEQ ID NO: 1911281 - RNA, 13 nt, Homo sapiens
ugauaugacuguu

SEQ ID NO: 1911282 - RNA, 12 nt, Homo sapiens
uauaaugugcuu

SEQ ID NO: 1911283 - RNA, 12 nt, Homo sapiens
gaaaauguucau

SEQ ID NO: 1911284 - RNA, 20 nt, Homo sapiens
aaugucaagaucacaaagac

SEQ ID NO: 1911285 - RNA, 20 nt, Homo sapiens
auuauaccuggaugauucag

SEQ ID NO: 1911286 - RNA, 16 nt, Homo sapiens
aacacuguaguaaaua

SEQ ID NO: 1911287 - RNA, 20 nt, Homo sapiens
auugugaguuuucuauuuca

SEQ ID NO: 1911288 - RNA, 20 nt, Homo sapiens
uuucaaagaaaauagauuag

SEQ ID NO: 1911289 - RNA, 15 nt, Homo sapiens
gaaaaauaaaaugca

SEQ ID NO: 1911290 - RNA, 17 nt, Homo sapiens
gucuucuagcugcagau

SEQ ID NO: 1911291 - RNA, 20 nt, Homo sapiens
gaacuacggggcuuacagga

SEQ ID NO: 1911292 - RNA, 14 nt, Homo sapiens
guucagggucauag

SEQ ID NO: 1911293 - RNA, 21 nt, Homo sapiens
auacgccuguaguccuagcca

SEQ ID NO: 1911294 - RNA, 14 nt, Homo sapiens
cuccauacuuugaa

SEQ ID NO: 1911295 - RNA, 17 nt, Homo sapiens
ucaguuaauucuuagau

SEQ ID NO: 1911296 - RNA, 16 nt, Homo sapiens
uaacauuuauuugagu

SEQ ID NO: 1911297 - RNA, 15 nt, Homo sapiens
cgcagacagugcaca

SEQ ID NO: 1911298 - RNA, 22 nt, Homo sapiens
cagagugagacccagcccucau

SEQ ID NO: 1911299 - RNA, 21 nt, Homo sapiens
gucuuuccacuccuccuagcc

SEQ ID NO: 1911300 - RNA, 20 nt, Homo sapiens
uagaauacuuuuaauuucac

SEQ ID NO: 1911301 - RNA, 18 nt, Homo sapiens
ggugagagugauuguguu

SEQ ID NO: 1911302 - RNA, 21 nt, Homo sapiens
gaggguuuccuucggggacca

SEQ ID NO: 1911303 - RNA, 22 nt, Homo sapiens
ccccugcagcuccucugccuuu

SEQ ID NO: 1911304 - RNA, 23 nt, Homo sapiens
cagcaugugggugucagugucau

SEQ ID NO: 1911305 - RNA, 13 nt, Homo sapiens
ucacaccaaggaa

SEQ ID NO: 1911306 - RNA, 21 nt, Homo sapiens
agacccuuuuaucugcuguug

SEQ ID NO: 1911307 - RNA, 23 nt, Homo sapiens
uccagaccaaaauaauacaacaa

SEQ ID NO: 1911308 - RNA, 13 nt, Homo sapiens
auaccauguggau

SEQ ID NO: 1911309 - RNA, 20 nt, Homo sapiens
agagaaaccguggagaucgc

SEQ ID NO: 1911310 - RNA, 15 nt, Homo sapiens
aucaauuuugucuau

SEQ ID NO: 1911311 - RNA, 21 nt, Homo sapiens
cuacuuagagauauguaucau

SEQ ID NO: 1911312 - RNA, 15 nt, Homo sapiens
gcucacgucugugag

SEQ ID NO: 1911313 - RNA, 17 nt, Homo sapiens
aaaaaugcugaacauug

SEQ ID NO: 1911314 - RNA, 19 nt, Homo sapiens
cauuaauccacauguuuca

SEQ ID NO: 1911315 - RNA, 20 nt, Homo sapiens
cuaguaucuucaaacuuuca

SEQ ID NO: 1911316 - RNA, 18 nt, Homo sapiens
ugcucaaugccauugugc

SEQ ID NO: 1911317 - RNA, 20 nt, Homo sapiens
ugggguugucagcucucauc

SEQ ID NO: 1911318 - RNA, 15 nt, Homo sapiens
ucgcgccacugcacu

SEQ ID NO: 1911319 - RNA, 17 nt, Homo sapiens
auucuguuguguucacc

SEQ ID NO: 1911320 - RNA, 23 nt, Homo sapiens
cauacaauuauuuuuacaguucu

SEQ ID NO: 1911321 - RNA, 22 nt, Homo sapiens
ucucugggaugcagaacuuccc

SEQ ID NO: 1911322 - RNA, 17 nt, Homo sapiens
auggaaagguccugcug

SEQ ID NO: 1911323 - RNA, 14 nt, Homo sapiens
cauucugcuacuuc

SEQ ID NO: 1911324 - RNA, 16 nt, Homo sapiens
caugccgaaugccaca

SEQ ID NO: 1911325 - RNA, 13 nt, Homo sapiens
auugaaugauaau

SEQ ID NO: 1911326 - RNA, 23 nt, Homo sapiens
ucauugaugagcaagacauacuu

SEQ ID NO: 1911327 - RNA, 20 nt, Homo sapiens
cugcucuuggcuggacccag

SEQ ID NO: 1911328 - RNA, 16 nt, Homo sapiens
ccccucaaagucugca

SEQ ID NO: 1911329 - RNA, 13 nt, Homo sapiens
ucccacaccaggu

SEQ ID NO: 1911330 - RNA, 18 nt, Homo sapiens
aggugucgggacaugguu

SEQ ID NO: 1911331 - RNA, 15 nt, Homo sapiens
gucauccugccaacu

SEQ ID NO: 1911332 - RNA, 22 nt, Homo sapiens
ugugcauacuuucccucaucca

SEQ ID NO: 1911333 - RNA, 18 nt, Homo sapiens
aauuuuauaucauuuuaa

SEQ ID NO: 1911334 - RNA, 13 nt, Homo sapiens
uggugacuuuaua

SEQ ID NO: 1911335 - RNA, 19 nt, Homo sapiens
ugcaacaggaagacacugg

SEQ ID NO: 1911336 - RNA, 20 nt, Homo sapiens
acagugaaaccccgucucua

SEQ ID NO: 1911337 - RNA, 17 nt, Homo sapiens
gaaacaugccacuugaa

SEQ ID NO: 1911338 - RNA, 20 nt, Homo sapiens
caacugauccucgcaucuca

SEQ ID NO: 1911339 - RNA, 17 nt, Homo sapiens
caucacuggacugcaug

SEQ ID NO: 1911340 - RNA, 13 nt, Homo sapiens
cgggaaacacaca

SEQ ID NO: 1911341 - RNA, 18 nt, Homo sapiens
auuuugucaacuacccac

SEQ ID NO: 1911342 - RNA, 22 nt, Homo sapiens
ccaagggcugacuucuccagga

SEQ ID NO: 1911343 - RNA, 23 nt, Homo sapiens
cacauacauaagcagcauuucau

SEQ ID NO: 1911344 - RNA, 19 nt, Homo sapiens
cagagacugcccuucucac

SEQ ID NO: 1911345 - RNA, 20 nt, Homo sapiens
gaugaaaaugaaucuucaca

SEQ ID NO: 1911346 - RNA, 13 nt, Homo sapiens
uucuacauguaau

SEQ ID NO: 1911347 - RNA, 19 nt, Homo sapiens
caggcacaaaaugugacau

SEQ ID NO: 1911348 - RNA, 13 nt, Homo sapiens
aucuucaggccau

SEQ ID NO: 1911349 - RNA, 15 nt, Homo sapiens
auccauuaccuccau

SEQ ID NO: 1911350 - RNA, 16 nt, Homo sapiens
gaaaucuguugugcau

SEQ ID NO: 1911351 - RNA, 22 nt, Homo sapiens
uagagaugggguuucacugugu

SEQ ID NO: 1911352 - RNA, 16 nt, Homo sapiens
uugcauuuauugcagu

SEQ ID NO: 1911353 - RNA, 18 nt, Homo sapiens
uuaagaauaauugaacaa

SEQ ID NO: 1911354 - RNA, 19 nt, Homo sapiens
gugaaagggagaagugaca

SEQ ID NO: 1911355 - RNA, 17 nt, Homo sapiens
cugcuuuccaaagccaa

SEQ ID NO: 1911356 - RNA, 18 nt, Homo sapiens
auuuucaguauacugugu

SEQ ID NO: 1911357 - RNA, 21 nt, Homo sapiens
ccuagcugcccacagagggca

SEQ ID NO: 1911358 - RNA, 12 nt, Homo sapiens
guacuaccccag

SEQ ID NO: 1911359 - RNA, 23 nt, Homo sapiens
cuugggcuguaguuuggagacaa

SEQ ID NO: 1911360 - RNA, 20 nt, Homo sapiens
ccagagacauacuugaaggg

SEQ ID NO: 1911361 - RNA, 20 nt, Homo sapiens
cuuuaaaaaaaauccuucua

SEQ ID NO: 1911362 - RNA, 21 nt, Homo sapiens
aaugacggcaaacucagucau

SEQ ID NO: 1911363 - RNA, 16 nt, Homo sapiens
ucccagccucuuccau

SEQ ID NO: 1911364 - RNA, 16 nt, Homo sapiens
ugacaaacauauccuu

SEQ ID NO: 1911365 - RNA, 17 nt, Homo sapiens
auuguaacuuaugaacc

SEQ ID NO: 1911366 - RNA, 22 nt, Homo sapiens
gcugagggaggcagaaagggaa

SEQ ID NO: 1911367 - RNA, 17 nt, Homo sapiens
gcccagguuacaaagac

SEQ ID NO: 1911368 - RNA, 16 nt, Homo sapiens
cucugggcacaagcag

SEQ ID NO: 1911369 - RNA, 12 nt, Homo sapiens
uuguaaauacuc

SEQ ID NO: 1911370 - RNA, 23 nt, Homo sapiens
cacuuacuaaccugguccuaacc

SEQ ID NO: 1911371 - RNA, 20 nt, Homo sapiens
uuuuacuccccuugagcuga

SEQ ID NO: 1911372 - RNA, 14 nt, Homo sapiens
caaggaaauagagg

SEQ ID NO: 1911373 - RNA, 22 nt, Homo sapiens
agacggagcccuggcaugucaa

SEQ ID NO: 1911374 - RNA, 14 nt, Homo sapiens
cuccugccccggcc

SEQ ID NO: 1911375 - RNA, 16 nt, Homo sapiens
uuuaaaguuguuugcu

SEQ ID NO: 1911376 - RNA, 19 nt, Homo sapiens
cuuguccaaguuguuucau

SEQ ID NO: 1911377 - RNA, 22 nt, Homo sapiens
gaaagcagcccaaguagguuau

SEQ ID NO: 1911378 - RNA, 18 nt, Homo sapiens
ggauuuagagauacuguu

SEQ ID NO: 1911379 - RNA, 16 nt, Homo sapiens
agcucagccagugggg

SEQ ID NO: 1911380 - RNA, 18 nt, Homo sapiens
gucucucuaaacccaaau

SEQ ID NO: 1911381 - RNA, 16 nt, Homo sapiens
cagugagaugagggau

SEQ ID NO: 1911382 - RNA, 15 nt, Homo sapiens
aaaaauuggcauuuu

SEQ ID NO: 1911383 - RNA, 23 nt, Homo sapiens
cggcgcaugccugcaaucccagc

SEQ ID NO: 1911384 - RNA, 15 nt, Homo sapiens
uaaaauuauuauaua

SEQ ID NO: 1911385 - RNA, 15 nt, Homo sapiens
uaacauugugacuuu

SEQ ID NO: 1911386 - RNA, 11 nt, Homo sapiens
accuagcuuua

SEQ ID NO: 1911387 - RNA, 23 nt, Homo sapiens
ccacuggaucuucagaaggcuag

SEQ ID NO: 1911388 - RNA, 20 nt, Homo sapiens
auugcuuuuguugugacuuu

SEQ ID NO: 1911389 - RNA, 17 nt, Homo sapiens
gccaucaaauagugaau

SEQ ID NO: 1911390 - RNA, 14 nt, Homo sapiens
gacucccacaacaa

SEQ ID NO: 1911391 - RNA, 15 nt, Homo sapiens
ugugcagacuguggc

SEQ ID NO: 1911392 - RNA, 17 nt, Homo sapiens
gugcacugagagugaag

SEQ ID NO: 1911393 - RNA, 18 nt, Homo sapiens
uguuccuuauauuuacuc

SEQ ID NO: 1911394 - RNA, 17 nt, Homo sapiens
uagauguauauauuucc

SEQ ID NO: 1911395 - RNA, 17 nt, Homo sapiens
cacaaugagaugcauga

SEQ ID NO: 1911396 - RNA, 12 nt, Homo sapiens
augcaacauuug

SEQ ID NO: 1911397 - RNA, 19 nt, Homo sapiens
ugggcaacaacagcaaaac

SEQ ID NO: 1911398 - RNA, 15 nt, Homo sapiens
guaaacuguaucaaa

SEQ ID NO: 1911399 - RNA, 14 nt, Homo sapiens
ccuacugcacugag

SEQ ID NO: 1911400 - RNA, 20 nt, Homo sapiens
ggaauuuccucuauugaugu

SEQ ID NO: 1911401 - RNA, 21 nt, Homo sapiens
aagacuugauacugcaauaaa

SEQ ID NO: 1911402 - RNA, 12 nt, Homo sapiens
ucuaugacucac

SEQ ID NO: 1911403 - RNA, 13 nt, Homo sapiens
uggaaagucacag

SEQ ID NO: 1911404 - RNA, 19 nt, Homo sapiens
aauaccuucugaacuacac

SEQ ID NO: 1911405 - RNA, 22 nt, Homo sapiens
agcaauuuaauauuuugcacag

SEQ ID NO: 1911406 - RNA, 21 nt, Homo sapiens
cugaguagucauuuugcccau

SEQ ID NO: 1911407 - RNA, 15 nt, Homo sapiens
cagagcgugcuuuca

SEQ ID NO: 1911408 - RNA, 13 nt, Homo sapiens
cauccugucacca

SEQ ID NO: 1911409 - RNA, 18 nt, Homo sapiens
ccugagcaguguacacug

SEQ ID NO: 1911410 - RNA, 17 nt, Homo sapiens
uugccgcgucgcccucc

SEQ ID NO: 1911411 - RNA, 23 nt, Homo sapiens
auuacugaguuuuuuauuccagu

SEQ ID NO: 1911412 - RNA, 22 nt, Homo sapiens
ccagccaccucccaaggacuuu

SEQ ID NO: 1911413 - RNA, 20 nt, Homo sapiens
augggcucuccggggccauu

SEQ ID NO: 1911414 - RNA, 17 nt, Homo sapiens
ucagcaugucucagauu

SEQ ID NO: 1911415 - RNA, 18 nt, Homo sapiens
auuuucuccgaaaggcaa

SEQ ID NO: 1911416 - RNA, 13 nt, Homo sapiens
gaguggaucugga

SEQ ID NO: 1911417 - RNA, 18 nt, Homo sapiens
augugcuauacacacaca

SEQ ID NO: 1911418 - RNA, 19 nt, Homo sapiens
ucaauuuuuauacauauca

SEQ ID NO: 1911419 - RNA, 14 nt, Homo sapiens
aagaaauggcauaa

SEQ ID NO: 1911420 - RNA, 20 nt, Homo sapiens
uucaagccuggcccagugag

SEQ ID NO: 1911421 - RNA, 21 nt, Homo sapiens
cugcuacaggaggggucucau

SEQ ID NO: 1911422 - RNA, 17 nt, Homo sapiens
accugugcaccccauga

SEQ ID NO: 1911423 - RNA, 13 nt, Homo sapiens
cuucugcuucccu

SEQ ID NO: 1911424 - RNA, 16 nt, Homo sapiens
ucuacauaaguccuuu

SEQ ID NO: 1911425 - RNA, 12 nt, Homo sapiens
gaaggugcccaa

SEQ ID NO: 1911426 - RNA, 19 nt, Homo sapiens
acaagguuggcaccccagc

SEQ ID NO: 1911427 - RNA, 18 nt, Homo sapiens
aguuuucuauucuuggag

SEQ ID NO: 1911428 - RNA, 18 nt, Homo sapiens
aaggcggcuacaugccuc

SEQ ID NO: 1911429 - RNA, 20 nt, Homo sapiens
cuuccuggcuccuucacuga

SEQ ID NO: 1911430 - RNA, 14 nt, Homo sapiens
aaucucuaagccaa

SEQ ID NO: 1911431 - RNA, 14 nt, Homo sapiens
uauaucuaugcaaa

SEQ ID NO: 1911432 - RNA, 17 nt, Homo sapiens
aacgcccagagaacaag

SEQ ID NO: 1911433 - RNA, 14 nt, Homo sapiens
uucuguaaauggaa

SEQ ID NO: 1911434 - RNA, 18 nt, Homo sapiens
cuucccuacacagggccu

SEQ ID NO: 1911435 - RNA, 18 nt, Homo sapiens
aggcuguuugagaaccau

SEQ ID NO: 1911436 - RNA, 17 nt, Homo sapiens
uuucaguucacuguuca

SEQ ID NO: 1911437 - RNA, 20 nt, Homo sapiens
uggacuacacccaagccuga

SEQ ID NO: 1911438 - RNA, 17 nt, Homo sapiens
acaggcaugcaccagug

SEQ ID NO: 1911439 - RNA, 15 nt, Homo sapiens
uuccuuucaggccaa

SEQ ID NO: 1911440 - RNA, 15 nt, Homo sapiens
uugacaucagcauua

SEQ ID NO: 1911441 - RNA, 21 nt, Homo sapiens
augugacuugagcccagagug

SEQ ID NO: 1911442 - RNA, 13 nt, Homo sapiens
aacucaagauuug

SEQ ID NO: 1911443 - RNA, 21 nt, Homo sapiens
uauacuuguggucccagauac

SEQ ID NO: 1911444 - RNA, 12 nt, Homo sapiens
ccacguagcaaa

SEQ ID NO: 1911445 - RNA, 16 nt, Homo sapiens
cuaggacuccacaguu

SEQ ID NO: 1911446 - RNA, 19 nt, Homo sapiens
aagcuguuauuucuucccu

SEQ ID NO: 1911447 - RNA, 15 nt, Homo sapiens
aucucaggaacauca

SEQ ID NO: 1911448 - RNA, 12 nt, Homo sapiens
aguacuuaaaac

SEQ ID NO: 1911449 - RNA, 17 nt, Homo sapiens
aaagcuaguguaccucc

SEQ ID NO: 1911450 - RNA, 17 nt, Homo sapiens
ggagagagaaagccagg

SEQ ID NO: 1911451 - RNA, 13 nt, Homo sapiens
auuuuuaaagcaa

SEQ ID NO: 1911452 - RNA, 18 nt, Homo sapiens
auuguaaaguagcuguaa

SEQ ID NO: 1911453 - RNA, 17 nt, Homo sapiens
gcgcugcucaaccucuc

SEQ ID NO: 1911454 - RNA, 16 nt, Homo sapiens
cuaucugugccucuuc

SEQ ID NO: 1911455 - RNA, 17 nt, Homo sapiens
ccuauaagccaaaauua

SEQ ID NO: 1911456 - RNA, 18 nt, Homo sapiens
agggagcugcaggggcau

SEQ ID NO: 1911457 - RNA, 20 nt, Homo sapiens
agcugucgggggccacugug

SEQ ID NO: 1911458 - RNA, 23 nt, Homo sapiens
guuuucggcaggggccuugucuc

SEQ ID NO: 1911459 - RNA, 13 nt, Homo sapiens
guuccuccacugg

SEQ ID NO: 1911460 - RNA, 16 nt, Homo sapiens
aguauuacacaucaga

SEQ ID NO: 1911461 - RNA, 17 nt, Homo sapiens
agaacacggcagcugcu

SEQ ID NO: 1911462 - RNA, 19 nt, Homo sapiens
ucucagacccuuuagccaa

SEQ ID NO: 1911463 - RNA, 21 nt, Homo sapiens
cucccaguauuacccuggaug

SEQ ID NO: 1911464 - RNA, 18 nt, Homo sapiens
ggacacugccuuugcugc

SEQ ID NO: 1911465 - RNA, 20 nt, Homo sapiens
guguacguggagagggauga

SEQ ID NO: 1911466 - RNA, 15 nt, Homo sapiens
cuggaagaauucuag

SEQ ID NO: 1911467 - RNA, 17 nt, Homo sapiens
cuaggaucagaauauca

SEQ ID NO: 1911468 - RNA, 18 nt, Homo sapiens
gcaaaucaacacuuucug

SEQ ID NO: 1911469 - RNA, 13 nt, Homo sapiens
uauguauauauac

SEQ ID NO: 1911470 - RNA, 18 nt, Homo sapiens
ucuauggcacccaugcac

SEQ ID NO: 1911471 - RNA, 14 nt, Homo sapiens
ucucacuucgcuuc

SEQ ID NO: 1911472 - RNA, 13 nt, Homo sapiens
agaauucccugug

SEQ ID NO: 1911473 - RNA, 13 nt, Homo sapiens
acaguuugaugcu

SEQ ID NO: 1911474 - RNA, 18 nt, Homo sapiens
gcaugguggcucaugccu

SEQ ID NO: 1911475 - RNA, 14 nt, Homo sapiens
uuauguacaggaug

SEQ ID NO: 1911476 - RNA, 21 nt, Homo sapiens
ggacgaggaguaauggcauuu

SEQ ID NO: 1911477 - RNA, 21 nt, Homo sapiens
cuaggggugggaggaagcaaa

SEQ ID NO: 1911478 - RNA, 16 nt, Homo sapiens
uucuagucuuggccag

SEQ ID NO: 1911479 - RNA, 22 nt, Homo sapiens
accuccacccccuccugucacc

SEQ ID NO: 1911480 - RNA, 17 nt, Homo sapiens
gccugucgcaugagaac

SEQ ID NO: 1911481 - RNA, 18 nt, Homo sapiens
aguuuucugugagaauaa

SEQ ID NO: 1911482 - RNA, 19 nt, Homo sapiens
cauaugaaaggugccaugg

SEQ ID NO: 1911483 - RNA, 18 nt, Homo sapiens
uccaugaauuaguucucc

SEQ ID NO: 1911484 - RNA, 16 nt, Homo sapiens
auaacucaagaaauca

SEQ ID NO: 1911485 - RNA, 16 nt, Homo sapiens
cuuacuuuuccaaaau

SEQ ID NO: 1911486 - RNA, 17 nt, Homo sapiens
agcaggcccaugggagg

SEQ ID NO: 1911487 - RNA, 19 nt, Homo sapiens
aggcacugcucaucuguac

SEQ ID NO: 1911488 - RNA, 20 nt, Homo sapiens
uugccugccuggugugccuc

SEQ ID NO: 1911489 - RNA, 18 nt, Homo sapiens
agccucccaaguagcugg

SEQ ID NO: 1911490 - RNA, 19 nt, Homo sapiens
acaaaauaaagcuguucuc

SEQ ID NO: 1911491 - RNA, 15 nt, Homo sapiens
cgucgucaccaaauc

SEQ ID NO: 1911492 - RNA, 15 nt, Homo sapiens
acuaguaaagacaua

SEQ ID NO: 1911493 - RNA, 19 nt, Homo sapiens
aaaacaagaaaccaagugg

SEQ ID NO: 1911494 - RNA, 22 nt, Homo sapiens
ugcucagggaauaauccagaaa

SEQ ID NO: 1911495 - RNA, 14 nt, Homo sapiens
ccuaaauguuaacu

SEQ ID NO: 1911496 - RNA, 18 nt, Homo sapiens
aagagacagaacugucca

SEQ ID NO: 1911497 - RNA, 23 nt, Homo sapiens
uucaacagcucaccaacuacaga

SEQ ID NO: 1911498 - RNA, 21 nt, Homo sapiens
ucaaggccgagggccaggcag

SEQ ID NO: 1911499 - RNA, 20 nt, Homo sapiens
ggcugguguaugcacagggu

SEQ ID NO: 1911500 - RNA, 14 nt, Homo sapiens
acauauauguauau

SEQ ID NO: 1911501 - RNA, 14 nt, Homo sapiens
acaucuauguaucu

SEQ ID NO: 1911502 - RNA, 16 nt, Homo sapiens
ucuggaacccagaaga

SEQ ID NO: 1911503 - RNA, 19 nt, Homo sapiens
ccuuagaaaacaaguauug

SEQ ID NO: 1911504 - RNA, 14 nt, Homo sapiens
uugcugaugcuccu

SEQ ID NO: 1911505 - RNA, 23 nt, Homo sapiens
guaaaaugcuguguccacggggu

SEQ ID NO: 1911506 - RNA, 24 nt, Homo sapiens
ucuugggggguuuuuacuccagug

SEQ ID NO: 1911507 - RNA, 22 nt, Homo sapiens
ccuguuaaaucguaacaagcaa

SEQ ID NO: 1911508 - RNA, 21 nt, Homo sapiens
cauuagcauugcaggccaaac

SEQ ID NO: 1911509 - RNA, 20 nt, Homo sapiens
uaauuggcagcacccacuca

SEQ ID NO: 1911510 - RNA, 16 nt, Homo sapiens
aaaugucaggccuucc

SEQ ID NO: 1911511 - RNA, 13 nt, Homo sapiens
ccuacuuuugcca

SEQ ID NO: 1911512 - RNA, 17 nt, Homo sapiens
uggaaagacauagccaa

SEQ ID NO: 1911513 - RNA, 20 nt, Homo sapiens
ucuuagaucugguguccagc

SEQ ID NO: 1911514 - RNA, 17 nt, Homo sapiens
augccccuaaucccagc

SEQ ID NO: 1911515 - RNA, 14 nt, Homo sapiens
gagccucgggacau

SEQ ID NO: 1911516 - RNA, 19 nt, Homo sapiens
cauuucuccguugagucau

SEQ ID NO: 1911517 - RNA, 18 nt, Homo sapiens
uguugaauaaauguaucu

SEQ ID NO: 1911518 - RNA, 19 nt, Homo sapiens
ggcauuuuacuguacagac

SEQ ID NO: 1911519 - RNA, 20 nt, Homo sapiens
ggugcacgccaccacaccug

SEQ ID NO: 1911520 - RNA, 15 nt, Homo sapiens
uacaauacaucugag

SEQ ID NO: 1911521 - RNA, 13 nt, Homo sapiens
uuaaacuugaauu

SEQ ID NO: 1911522 - RNA, 14 nt, Homo sapiens
acaucggccuccau

SEQ ID NO: 1911523 - RNA, 18 nt, Homo sapiens
gacauuuuaugucuuucu

SEQ ID NO: 1911524 - RNA, 18 nt, Homo sapiens
cagugaaguacucaguaa

SEQ ID NO: 1911525 - RNA, 14 nt, Homo sapiens
cgguuaccucugca

SEQ ID NO: 1911526 - RNA, 22 nt, Homo sapiens
gaugcacuaccauugcuguucu

SEQ ID NO: 1911527 - RNA, 19 nt, Homo sapiens
aggaucuuauuuugugaac

SEQ ID NO: 1911528 - RNA, 23 nt, Homo sapiens
uuggcacagccauacggcacuga

SEQ ID NO: 1911529 - RNA, 19 nt, Homo sapiens
cauggcacugacaaugggc

SEQ ID NO: 1911530 - RNA, 24 nt, Homo sapiens
aguacucaguuaggcagugcagua

SEQ ID NO: 1911531 - RNA, 15 nt, Homo sapiens
acaaauacuauccaa

SEQ ID NO: 1911532 - RNA, 16 nt, Homo sapiens
gaaaagguccuugacu

SEQ ID NO: 1911533 - RNA, 15 nt, Homo sapiens
gcccaaccuauccug

SEQ ID NO: 1911534 - RNA, 17 nt, Homo sapiens
ccaggguggcugccagc

SEQ ID NO: 1911535 - RNA, 16 nt, Homo sapiens
uaaagauaaaauaucc

SEQ ID NO: 1911536 - RNA, 17 nt, Homo sapiens
auuuuuagagcauuaaa

SEQ ID NO: 1911537 - RNA, 16 nt, Homo sapiens
gaagacccacgugcua

SEQ ID NO: 1911538 - RNA, 17 nt, Homo sapiens
auagaaaacccacaccc

SEQ ID NO: 1911539 - RNA, 15 nt, Homo sapiens
ggacuccaugcuccu

SEQ ID NO: 1911540 - RNA, 15 nt, Homo sapiens
cucuuucaaagcuaa

SEQ ID NO: 1911541 - RNA, 16 nt, Homo sapiens
ggacaguaaacacucc

SEQ ID NO: 1911542 - RNA, 23 nt, Homo sapiens
ggcucuguuaugcaagcacaaau

SEQ ID NO: 1911543 - RNA, 23 nt, Homo sapiens
auugcauuuuuauuaaagcauuu

SEQ ID NO: 1911544 - RNA, 14 nt, Homo sapiens
aaaguaacagagca

SEQ ID NO: 1911545 - RNA, 19 nt, Homo sapiens
uugugugugugugcaguga

SEQ ID NO: 1911546 - RNA, 14 nt, Homo sapiens
ucacuaaacaagaa

SEQ ID NO: 1911547 - RNA, 19 nt, Homo sapiens
agaauauacaaauagcaaa

SEQ ID NO: 1911548 - RNA, 16 nt, Homo sapiens
caucagcugcucagau

SEQ ID NO: 1911549 - RNA, 15 nt, Homo sapiens
uguggucauccugcc

SEQ ID NO: 1911550 - RNA, 23 nt, Homo sapiens
guaagaggacuacucagcacugu

SEQ ID NO: 1911551 - RNA, 15 nt, Homo sapiens
acccaagaagggcac

SEQ ID NO: 1911552 - RNA, 21 nt, Homo sapiens
agcucuggcccuuugaauaug

SEQ ID NO: 1911553 - RNA, 20 nt, Homo sapiens
ggcaacacugcuguccacau

SEQ ID NO: 1911554 - RNA, 18 nt, Homo sapiens
agcuuuuaaaaauguccu

SEQ ID NO: 1911555 - RNA, 18 nt, Homo sapiens
cuauagaaaacaauacag

SEQ ID NO: 1911556 - RNA, 14 nt, Homo sapiens
gagggccucaucuc

SEQ ID NO: 1911557 - RNA, 17 nt, Homo sapiens
auuuuacagaagcauuu

SEQ ID NO: 1911558 - RNA, 19 nt, Homo sapiens
gaacaugcuuuuacuuuau

SEQ ID NO: 1911559 - RNA, 15 nt, Homo sapiens
ccaaccacaagcaca

SEQ ID NO: 1911560 - RNA, 20 nt, Homo sapiens
ugguuggaaaacacuuucau

SEQ ID NO: 1911561 - RNA, 20 nt, Homo sapiens
ugccuuaaaggaccuuccca

SEQ ID NO: 1911562 - RNA, 14 nt, Homo sapiens
gccugggcaccagc

SEQ ID NO: 1911563 - RNA, 16 nt, Homo sapiens
cuauaaccauguucua

SEQ ID NO: 1911564 - RNA, 16 nt, Homo sapiens
cugccuucucagggac

SEQ ID NO: 1911565 - RNA, 20 nt, Homo sapiens
gcauucaggcuucucaggug

SEQ ID NO: 1911566 - RNA, 23 nt, Homo sapiens
cucucagcaagugcccaguggag

SEQ ID NO: 1911567 - RNA, 19 nt, Homo sapiens
cccuuacauguccuccuaa

SEQ ID NO: 1911568 - RNA, 14 nt, Homo sapiens
ggccaagcccagga

SEQ ID NO: 1911569 - RNA, 20 nt, Homo sapiens
ugccagcaucugcagccacu

SEQ ID NO: 1911570 - RNA, 19 nt, Homo sapiens
aagcaaauauaaacagcaa

SEQ ID NO: 1911571 - RNA, 18 nt, Homo sapiens
uucucaggacacaggccu

SEQ ID NO: 1911572 - RNA, 21 nt, Homo sapiens
ucacccucuguaccccaugac

SEQ ID NO: 1911573 - RNA, 20 nt, Homo sapiens
agagagaaguucauacaaag

SEQ ID NO: 1911574 - RNA, 13 nt, Homo sapiens
uucagcaauuaaa

SEQ ID NO: 1911575 - RNA, 22 nt, Homo sapiens
uaaguuuuauguuaaaucaaua

SEQ ID NO: 1911576 - RNA, 19 nt, Homo sapiens
augguggaaaagaacugua

SEQ ID NO: 1911577 - RNA, 16 nt, Homo sapiens
aaucuaugccuaaaaa

SEQ ID NO: 1911578 - RNA, 16 nt, Homo sapiens
cagccucgcaugccag

SEQ ID NO: 1911579 - RNA, 18 nt, Homo sapiens
ugaacaagcaaacccaga

SEQ ID NO: 1911580 - RNA, 23 nt, Homo sapiens
cuggaagaaaaaaaccacacaaa

SEQ ID NO: 1911581 - RNA, 21 nt, Homo sapiens
ccugaauguauuaaaaacuaa

SEQ ID NO: 1911582 - RNA, 20 nt, Homo sapiens
aacugaaggcuaaaaagcaa

SEQ ID NO: 1911583 - RNA, 16 nt, Homo sapiens
cugccaagaguccaag

SEQ ID NO: 1911584 - RNA, 19 nt, Homo sapiens
uuuggagaacucauuucaa

SEQ ID NO: 1911585 - RNA, 18 nt, Homo sapiens
auuuucgacguuugacua

SEQ ID NO: 1911586 - RNA, 16 nt, Homo sapiens
aauguagcuuuuaugu

SEQ ID NO: 1911587 - RNA, 15 nt, Homo sapiens
ugaagugcagcucag

SEQ ID NO: 1911588 - RNA, 19 nt, Homo sapiens
aggggugcugcagguggca

SEQ ID NO: 1911589 - RNA, 16 nt, Homo sapiens
ugaggaagugaacauu

SEQ ID NO: 1911590 - RNA, 22 nt, Homo sapiens
uuaugacuguuuuuguaguggu

SEQ ID NO: 1911591 - RNA, 17 nt, Homo sapiens
augaaaugaaugucuga

SEQ ID NO: 1911592 - RNA, 19 nt, Homo sapiens
gaggcaaugugggaucuca

SEQ ID NO: 1911593 - RNA, 14 nt, Homo sapiens
uaaacuuacuacaa

SEQ ID NO: 1911594 - RNA, 20 nt, Homo sapiens
cccaacagugaugaugcaug

SEQ ID NO: 1911595 - RNA, 16 nt, Homo sapiens
guaucaguucugcuga

SEQ ID NO: 1911596 - RNA, 16 nt, Homo sapiens
caaagaaaagccagag

SEQ ID NO: 1911597 - RNA, 20 nt, Homo sapiens
caaggccuuucuguguguga

SEQ ID NO: 1911598 - RNA, 15 nt, Homo sapiens
uuuauguaaaaccaa

SEQ ID NO: 1911599 - RNA, 14 nt, Homo sapiens
aaaugauuaucucc

SEQ ID NO: 1911600 - RNA, 15 nt, Homo sapiens
cagaagucagguguc

SEQ ID NO: 1911601 - RNA, 11 nt, Homo sapiens
agugggagcaa

SEQ ID NO: 1911602 - RNA, 13 nt, Homo sapiens
ucuaugccuguau

SEQ ID NO: 1911603 - RNA, 13 nt, Homo sapiens
acagggccagagg

SEQ ID NO: 1911604 - RNA, 13 nt, Homo sapiens
agaaagccacaaa

SEQ ID NO: 1911605 - RNA, 21 nt, Homo sapiens
cauugucccugaaugcuccau

SEQ ID NO: 1911606 - RNA, 23 nt, Homo sapiens
gcuauucugugucaaacaccucu

SEQ ID NO: 1911607 - RNA, 14 nt, Homo sapiens
gcccuggccaggac

SEQ ID NO: 1911608 - RNA, 18 nt, Homo sapiens
cucccacuucuucagcuu

SEQ ID NO: 1911609 - RNA, 22 nt, Homo sapiens
guguuuuugcuaucacacagug

SEQ ID NO: 1911610 - RNA, 21 nt, Homo sapiens
uaagaagcagauaaugguguu

SEQ ID NO: 1911611 - RNA, 17 nt, Homo sapiens
uaacaugucuaaaguua

SEQ ID NO: 1911612 - RNA, 21 nt, Homo sapiens
auuugauaaacuaaaagcaua

SEQ ID NO: 1911613 - RNA, 22 nt, Homo sapiens
aacaugugacuaauuggaagaa

SEQ ID NO: 1911614 - RNA, 19 nt, Homo sapiens
acugggccuccaaccaugu

SEQ ID NO: 1911615 - RNA, 13 nt, Homo sapiens
cacuucaaauuca

SEQ ID NO: 1911616 - RNA, 16 nt, Homo sapiens
ggauucugaaucucaa

SEQ ID NO: 1911617 - RNA, 21 nt, Homo sapiens
cccuguaggguccaaccagac

SEQ ID NO: 1911618 - RNA, 13 nt, Homo sapiens
gcaggcuucucag

SEQ ID NO: 1911619 - RNA, 15 nt, Homo sapiens
ugggggaacuuguag

SEQ ID NO: 1911620 - RNA, 21 nt, Homo sapiens
caucucccagauaaugugaaa

SEQ ID NO: 1911621 - RNA, 16 nt, Homo sapiens
ucaccgcauggacaag

SEQ ID NO: 1911622 - RNA, 15 nt, Homo sapiens
uuauccaaugguguu

SEQ ID NO: 1911623 - RNA, 15 nt, Homo sapiens
aagcgggccgucucc

SEQ ID NO: 1911624 - RNA, 17 nt, Homo sapiens
ggaugcuaaaaauguca

SEQ ID NO: 1911625 - RNA, 18 nt, Homo sapiens
cagaucaacaauaccuuu

SEQ ID NO: 1911626 - RNA, 21 nt, Homo sapiens
ugcucagccuuccaugcugug

SEQ ID NO: 1911627 - RNA, 19 nt, Homo sapiens
agauaaccucaagucacau

SEQ ID NO: 1911628 - RNA, 19 nt, Homo sapiens
gucaacuuuugacuaagaa

SEQ ID NO: 1911629 - RNA, 23 nt, Homo sapiens
aauguaaaacccaaaacaguaaa

SEQ ID NO: 1911630 - RNA, 19 nt, Homo sapiens
acuguagucagaccucagc

SEQ ID NO: 1911631 - RNA, 23 nt, Homo sapiens
uuaucaucggaguugacagugaa

SEQ ID NO: 1911632 - RNA, 17 nt, Homo sapiens
augaaacaaauaaucac

SEQ ID NO: 1911633 - RNA, 14 nt, Homo sapiens
aaagaauacagaaa

SEQ ID NO: 1911634 - RNA, 13 nt, Homo sapiens
cucccuaccaccu

SEQ ID NO: 1911635 - RNA, 20 nt, Homo sapiens
uccucuuaggauguuucacc

SEQ ID NO: 1911636 - RNA, 14 nt, Homo sapiens
aaauuaugugacau

SEQ ID NO: 1911637 - RNA, 24 nt, Homo sapiens
uugcuugguggaugaaaugucagu

SEQ ID NO: 1911638 - RNA, 22 nt, Homo sapiens
caacgagugaaacuccgucuca

SEQ ID NO: 1911639 - RNA, 19 nt, Homo sapiens
auugaaaagagcugaaggu

SEQ ID NO: 1911640 - RNA, 19 nt, Homo sapiens
uauaacucauggcaggcau

SEQ ID NO: 1911641 - RNA, 19 nt, Homo sapiens
aggccauugugaaccaaug

SEQ ID NO: 1911642 - RNA, 16 nt, Homo sapiens
gaucucacaagcacuu

SEQ ID NO: 1911643 - RNA, 20 nt, Homo sapiens
gcuggagugcaguggugcua

SEQ ID NO: 1911644 - RNA, 17 nt, Homo sapiens
cuuauaacuguuuuaga

SEQ ID NO: 1911645 - RNA, 18 nt, Homo sapiens
aggcaugugccaccacgc

SEQ ID NO: 1911646 - RNA, 20 nt, Homo sapiens
uuaauaccacaaacacugug

SEQ ID NO: 1911647 - RNA, 22 nt, Homo sapiens
accagccuguccaacaugguga

SEQ ID NO: 1911648 - RNA, 18 nt, Homo sapiens
uauuauccuucuacuugu

SEQ ID NO: 1911649 - RNA, 20 nt, Homo sapiens
uaagcauuaccacucaggca

SEQ ID NO: 1911650 - RNA, 12 nt, Homo sapiens
auaccugugagg

SEQ ID NO: 1911651 - RNA, 19 nt, Homo sapiens
gaauagaaccaacccaaac

SEQ ID NO: 1911652 - RNA, 19 nt, Homo sapiens
aaggcauuguccugugaaa

SEQ ID NO: 1911653 - RNA, 12 nt, Homo sapiens
auucuccagaau

SEQ ID NO: 1911654 - RNA, 13 nt, Homo sapiens
uucacauugcacu

SEQ ID NO: 1911655 - RNA, 22 nt, Homo sapiens
acaguugaaaaacagcugaggg

SEQ ID NO: 1911656 - RNA, 18 nt, Homo sapiens
augaaaagucauucaguu

SEQ ID NO: 1911657 - RNA, 17 nt, Homo sapiens
uugccuggagugugaac

SEQ ID NO: 1911658 - RNA, 21 nt, Homo sapiens
ugggguuguucacaccacagg

SEQ ID NO: 1911659 - RNA, 20 nt, Homo sapiens
uuaaggccaggcaugguggu

SEQ ID NO: 1911660 - RNA, 22 nt, Homo sapiens
uuuuaaaaguuucaaugugauu

SEQ ID NO: 1911661 - RNA, 12 nt, Homo sapiens
uuugcacuuugu

SEQ ID NO: 1911662 - RNA, 23 nt, Homo sapiens
uaccaugucguaguuacucucag

SEQ ID NO: 1911663 - RNA, 13 nt, Homo sapiens
gacaucucagggg

SEQ ID NO: 1911664 - RNA, 18 nt, Homo sapiens
agauauuaggucccauca

SEQ ID NO: 1911665 - RNA, 15 nt, Homo sapiens
aauuuauuggcuuuu

SEQ ID NO: 1911666 - RNA, 15 nt, Homo sapiens
aaguuucauacucaa

SEQ ID NO: 1911667 - RNA, 17 nt, Homo sapiens
uaaagcuuaacacuuga

SEQ ID NO: 1911668 - RNA, 19 nt, Homo sapiens
ccaauaaagugaucugugu

SEQ ID NO: 1911669 - RNA, 16 nt, Homo sapiens
ucacuuuaauucucau

SEQ ID NO: 1911670 - RNA, 16 nt, Homo sapiens
accaauauuaccaucu

SEQ ID NO: 1911671 - RNA, 15 nt, Homo sapiens
aagagaagaaauagc

SEQ ID NO: 1911672 - RNA, 15 nt, Homo sapiens
cuguaaaccagagag

SEQ ID NO: 1911673 - RNA, 19 nt, Homo sapiens
cuuaaccagcacauuucuc

SEQ ID NO: 1911674 - RNA, 14 nt, Homo sapiens
caguuuccaucccc

SEQ ID NO: 1911675 - RNA, 19 nt, Homo sapiens
uguaauagugaacauaugg

SEQ ID NO: 1911676 - RNA, 15 nt, Homo sapiens
ugacuguaucugugu

SEQ ID NO: 1911677 - RNA, 18 nt, Homo sapiens
ugccaucauuuacuuuua

SEQ ID NO: 1911678 - RNA, 22 nt, Homo sapiens
uugaaaauaauaaaguggcauu

SEQ ID NO: 1911679 - RNA, 20 nt, Homo sapiens
guaaagauccuauagcucuu

SEQ ID NO: 1911680 - RNA, 23 nt, Homo sapiens
uucuguaauggggacacuacaaa

SEQ ID NO: 1911681 - RNA, 15 nt, Homo sapiens
uuucauucugccaaa

SEQ ID NO: 1911682 - RNA, 13 nt, Homo sapiens
uauaaauauguga

SEQ ID NO: 1911683 - RNA, 19 nt, Homo sapiens
aggccuuggugcccugaac

SEQ ID NO: 1911684 - RNA, 20 nt, Homo sapiens
uacuugucaccugagugaug

SEQ ID NO: 1911685 - RNA, 15 nt, Homo sapiens
gaagccaguuaguaa

SEQ ID NO: 1911686 - RNA, 22 nt, Homo sapiens
ugauuauauaaaauacauaaua

SEQ ID NO: 1911687 - RNA, 12 nt, Homo sapiens
ggcccucaccag

SEQ ID NO: 1911688 - RNA, 18 nt, Homo sapiens
aagcugcugaaugcauuc

SEQ ID NO: 1911689 - RNA, 20 nt, Homo sapiens
uaggcaaaagaaaagcucag

SEQ ID NO: 1911690 - RNA, 17 nt, Homo sapiens
ccaccuguguagucucu

SEQ ID NO: 1911691 - RNA, 19 nt, Homo sapiens
gcuuugauuguucauauca

SEQ ID NO: 1911692 - RNA, 16 nt, Homo sapiens
aucucucugccuauuu

SEQ ID NO: 1911693 - RNA, 16 nt, Homo sapiens
ugggcugcugcaguga

SEQ ID NO: 1911694 - RNA, 18 nt, Homo sapiens
auccauucucucugccca

SEQ ID NO: 1911695 - RNA, 13 nt, Homo sapiens
cgaaagcaacuca

SEQ ID NO: 1911696 - RNA, 18 nt, Homo sapiens
gugggggguggacacaga

SEQ ID NO: 1911697 - RNA, 14 nt, Homo sapiens
aaauaaaugacaau

SEQ ID NO: 1911698 - RNA, 17 nt, Homo sapiens
auauuaggaaacuggga

SEQ ID NO: 1911699 - RNA, 17 nt, Homo sapiens
ugcuggaaccugcaaaa

SEQ ID NO: 1911700 - RNA, 14 nt, Homo sapiens
ugcugguagcacuu

SEQ ID NO: 1911701 - RNA, 16 nt, Homo sapiens
agcaaagcugaugaca

SEQ ID NO: 1911702 - RNA, 22 nt, Homo sapiens
auguuguacaggcuggucucaa

SEQ ID NO: 1911703 - RNA, 17 nt, Homo sapiens
agaacugccccaucucc

SEQ ID NO: 1911704 - RNA, 10 nt, Homo sapiens
agcagucauc

SEQ ID NO: 1911705 - RNA, 13 nt, Homo sapiens
cacagugugaaua

SEQ ID NO: 1911706 - RNA, 16 nt, Homo sapiens
auauaagcccaauauc

SEQ ID NO: 1911707 - RNA, 14 nt, Homo sapiens
acauugagcaaaua

SEQ ID NO: 1911708 - RNA, 22 nt, Homo sapiens
aagcaagacccauaaccauuau

SEQ ID NO: 1911709 - RNA, 20 nt, Homo sapiens
aauggacauugagauacuau

SEQ ID NO: 1911710 - RNA, 18 nt, Homo sapiens
auuugaccggaucuacac

SEQ ID NO: 1911711 - RNA, 16 nt, Homo sapiens
uaaggagccuuuccag

SEQ ID NO: 1911712 - RNA, 21 nt, Homo sapiens
uaauugcuccuauacuauuga

SEQ ID NO: 1911713 - RNA, 15 nt, Homo sapiens
cguucucccaaagau

SEQ ID NO: 1911714 - RNA, 15 nt, Homo sapiens
guagcuucugcaguu

SEQ ID NO: 1911715 - RNA, 16 nt, Homo sapiens
guucacucccaaccug

SEQ ID NO: 1911716 - RNA, 12 nt, Homo sapiens
ccaggagcugcu

SEQ ID NO: 1911717 - RNA, 20 nt, Homo sapiens
ccccuacaucaaaugcucaa

SEQ ID NO: 1911718 - RNA, 18 nt, Homo sapiens
cucccaacucaagguucu

SEQ ID NO: 1911719 - RNA, 14 nt, Homo sapiens
uauuccuuuuccca

SEQ ID NO: 1911720 - RNA, 22 nt, Homo sapiens
cuuacguauguuuguacuuggu

SEQ ID NO: 1911721 - RNA, 22 nt, Homo sapiens
ccaauuugguaaaaaugcugcu

SEQ ID NO: 1911722 - RNA, 17 nt, Homo sapiens
ugguauauuuguguaug

SEQ ID NO: 1911723 - RNA, 19 nt, Homo sapiens
uaggcaguaauguuccucc

SEQ ID NO: 1911724 - RNA, 15 nt, Homo sapiens
auagaagaaaaucca

SEQ ID NO: 1911725 - RNA, 16 nt, Homo sapiens
aucauuuuguggauau

SEQ ID NO: 1911726 - RNA, 15 nt, Homo sapiens
gauuaagaguugcca

SEQ ID NO: 1911727 - RNA, 17 nt, Homo sapiens
gccgucacgcuuucaug

SEQ ID NO: 1911728 - RNA, 21 nt, Homo sapiens
uaucaugaugugcaaccagca

SEQ ID NO: 1911729 - RNA, 14 nt, Homo sapiens
caaauuugccauga

SEQ ID NO: 1911730 - RNA, 11 nt, Homo sapiens
ggaugggacaa

SEQ ID NO: 1911731 - RNA, 22 nt, Homo sapiens
ugggacuggacagcuuugcucc

SEQ ID NO: 1911732 - RNA, 20 nt, Homo sapiens
cagaggccuuggguguucca

SEQ ID NO: 1911733 - RNA, 22 nt, Homo sapiens
aucugucacauaaaagucugug

SEQ ID NO: 1911734 - RNA, 22 nt, Homo sapiens
aaaugagaccccuuuaaacugu

SEQ ID NO: 1911735 - RNA, 14 nt, Homo sapiens
guuuguuacuuuga

SEQ ID NO: 1911736 - RNA, 14 nt, Homo sapiens
gcugauuaccugaa

SEQ ID NO: 1911737 - RNA, 12 nt, Homo sapiens
uauuaucacugc

SEQ ID NO: 1911738 - RNA, 21 nt, Homo sapiens
agacuggcauggacaucagca

SEQ ID NO: 1911739 - RNA, 18 nt, Homo sapiens
aaggauuagaacacucau

SEQ ID NO: 1911740 - RNA, 23 nt, Homo sapiens
ugugaaacgucccacacuuugaa

SEQ ID NO: 1911741 - RNA, 14 nt, Homo sapiens
cacuggaucuucag

SEQ ID NO: 1911742 - RNA, 19 nt, Homo sapiens
agcacccguugaguccuuu

SEQ ID NO: 1911743 - RNA, 20 nt, Homo sapiens
augccuauguacucuacgcc

SEQ ID NO: 1911744 - RNA, 13 nt, Homo sapiens
ccuuuguucucuc

SEQ ID NO: 1911745 - RNA, 15 nt, Homo sapiens
ucuggacacacuguu

SEQ ID NO: 1911746 - RNA, 18 nt, Homo sapiens
aaaaauugcucuguguau

SEQ ID NO: 1911747 - RNA, 22 nt, Homo sapiens
gagaagagcuguucacagccag

SEQ ID NO: 1911748 - RNA, 13 nt, Homo sapiens
cuuggacuugucc

SEQ ID NO: 1911749 - RNA, 16 nt, Homo sapiens
auucucaaaugcuggc

SEQ ID NO: 1911750 - RNA, 21 nt, Homo sapiens
gcacuugaacauuuuaauauu

SEQ ID NO: 1911751 - RNA, 18 nt, Homo sapiens
gcccacucuccaccucac

SEQ ID NO: 1911752 - RNA, 16 nt, Homo sapiens
accccuccuuccuuga

SEQ ID NO: 1911753 - RNA, 14 nt, Homo sapiens
cucagccacuguca

SEQ ID NO: 1911754 - RNA, 17 nt, Homo sapiens
gcucccugcccugaccu

SEQ ID NO: 1911755 - RNA, 17 nt, Homo sapiens
acuccaguguacauagu

SEQ ID NO: 1911756 - RNA, 16 nt, Homo sapiens
aaauauaaaauuucug

SEQ ID NO: 1911757 - RNA, 13 nt, Homo sapiens
uuggcacccaaga

SEQ ID NO: 1911758 - RNA, 16 nt, Homo sapiens
cagguggcaucucuaa

SEQ ID NO: 1911759 - RNA, 22 nt, Homo sapiens
ccugccagagcccaagugccau

SEQ ID NO: 1911760 - RNA, 18 nt, Homo sapiens
cagggcggaacucucagg

SEQ ID NO: 1911761 - RNA, 14 nt, Homo sapiens
gaguggaaggucua

SEQ ID NO: 1911762 - RNA, 12 nt, Homo sapiens
auaaagccaugu

SEQ ID NO: 1911763 - RNA, 17 nt, Homo sapiens
caaagugccuugcucau

SEQ ID NO: 1911764 - RNA, 17 nt, Homo sapiens
ucagugaagaugcugua

SEQ ID NO: 1911765 - RNA, 16 nt, Homo sapiens
acauauaaaauaaugc

SEQ ID NO: 1911766 - RNA, 23 nt, Homo sapiens
aagcacauuccaauugugcagug

SEQ ID NO: 1911767 - RNA, 13 nt, Homo sapiens
ccaucucauuaca

SEQ ID NO: 1911768 - RNA, 21 nt, Homo sapiens
aacaaggucugcucugcuccu

SEQ ID NO: 1911769 - RNA, 18 nt, Homo sapiens
gauugucuuacuguugca

SEQ ID NO: 1911770 - RNA, 22 nt, Homo sapiens
uccauuugagugaguucccuua

SEQ ID NO: 1911771 - RNA, 19 nt, Homo sapiens
ccagauggaacacuggaac

SEQ ID NO: 1911772 - RNA, 9 nt, Homo sapiens
uaaucugca

SEQ ID NO: 1911773 - RNA, 16 nt, Homo sapiens
aacucgccaccugccc

SEQ ID NO: 1911774 - RNA, 15 nt, Homo sapiens
auuguuaauuaugua

SEQ ID NO: 1911775 - RNA, 17 nt, Homo sapiens
guagguaccauggccau

SEQ ID NO: 1911776 - RNA, 21 nt, Homo sapiens
guaacucagacauuccaaggg

SEQ ID NO: 1911777 - RNA, 15 nt, Homo sapiens
ccaaauaagugcauu

SEQ ID NO: 1911778 - RNA, 17 nt, Homo sapiens
uggucaggcuggucuca

SEQ ID NO: 1911779 - RNA, 16 nt, Homo sapiens
aacagguuuguucuca

SEQ ID NO: 1911780 - RNA, 18 nt, Homo sapiens
agcugguguagcuacaga

SEQ ID NO: 1911781 - RNA, 22 nt, Homo sapiens
gcauucuccuccuauugccucc

SEQ ID NO: 1911782 - RNA, 14 nt, Homo sapiens
gagggcuccuccau

SEQ ID NO: 1911783 - RNA, 12 nt, Homo sapiens
gcuuugcucaaa

SEQ ID NO: 1911784 - RNA, 19 nt, Homo sapiens
cacaugauuuuacucauau

SEQ ID NO: 1911785 - RNA, 19 nt, Homo sapiens
ugccagccccuuugccaua

SEQ ID NO: 1911786 - RNA, 19 nt, Homo sapiens
cugguuguguacaucggcu

SEQ ID NO: 1911787 - RNA, 14 nt, Homo sapiens
uucccuuccuccau

SEQ ID NO: 1911788 - RNA, 16 nt, Homo sapiens
uuauuuguauuugcca

SEQ ID NO: 1911789 - RNA, 18 nt, Homo sapiens
guccacuguucuguucuc

SEQ ID NO: 1911790 - RNA, 19 nt, Homo sapiens
cuucaccccuacacuguga

SEQ ID NO: 1911791 - RNA, 13 nt, Homo sapiens
agccacagcacuc

SEQ ID NO: 1911792 - RNA, 21 nt, Homo sapiens
ugaagaagaaaucguucauca

SEQ ID NO: 1911793 - RNA, 14 nt, Homo sapiens
uugaacuccugacc

SEQ ID NO: 1911794 - RNA, 17 nt, Homo sapiens
gaagcaaauaaauauca

SEQ ID NO: 1911795 - RNA, 17 nt, Homo sapiens
cugauauucagaauuau

SEQ ID NO: 1911796 - RNA, 15 nt, Homo sapiens
cuguucaaaccucug

SEQ ID NO: 1911797 - RNA, 14 nt, Homo sapiens
agagcucugaccca

SEQ ID NO: 1911798 - RNA, 13 nt, Homo sapiens
uuucucucuggcu

SEQ ID NO: 1911799 - RNA, 16 nt, Homo sapiens
ucauguacauuggucu

SEQ ID NO: 1911800 - RNA, 18 nt, Homo sapiens
cuauccugauuccaaaua

SEQ ID NO: 1911801 - RNA, 22 nt, Homo sapiens
gcaauaaacauacgugugcaug

SEQ ID NO: 1911802 - RNA, 23 nt, Homo sapiens
ccacgagguuaaagaagcugcau

SEQ ID NO: 1911803 - RNA, 14 nt, Homo sapiens
auuuuucuaaagaa

SEQ ID NO: 1911804 - RNA, 22 nt, Homo sapiens
uuguauucaaauuugugucaua

SEQ ID NO: 1911805 - RNA, 23 nt, Homo sapiens
ccaggcaggggugggagagccag

SEQ ID NO: 1911806 - RNA, 20 nt, Homo sapiens
uuuguauuuugcauacucaa

SEQ ID NO: 1911807 - RNA, 15 nt, Homo sapiens
acaaucagcccagug

SEQ ID NO: 1911808 - RNA, 19 nt, Homo sapiens
cuuucccaugauccagaac

SEQ ID NO: 1911809 - RNA, 14 nt, Homo sapiens
aagacccaggaggc

SEQ ID NO: 1911810 - RNA, 13 nt, Homo sapiens
guucuuaguguca

SEQ ID NO: 1911811 - RNA, 13 nt, Homo sapiens
aaaauguugaaua

SEQ ID NO: 1911812 - RNA, 14 nt, Homo sapiens
cagcuagugccuuu

SEQ ID NO: 1911813 - RNA, 13 nt, Homo sapiens
uaugaucauguaa

SEQ ID NO: 1911814 - RNA, 18 nt, Homo sapiens
uuaaaagaugucucugca

SEQ ID NO: 1911815 - RNA, 14 nt, Homo sapiens
cucaaaugcaguau

SEQ ID NO: 1911816 - RNA, 20 nt, Homo sapiens
agcuuuagcuucucugccaa

SEQ ID NO: 1911817 - RNA, 16 nt, Homo sapiens
ugccuuugaccaucuc

SEQ ID NO: 1911818 - RNA, 17 nt, Homo sapiens
cuucacugaacaugccu

SEQ ID NO: 1911819 - RNA, 18 nt, Homo sapiens
aacaagccacguugcaga

SEQ ID NO: 1911820 - RNA, 20 nt, Homo sapiens
ugcuccuggaucucccugag

SEQ ID NO: 1911821 - RNA, 16 nt, Homo sapiens
ugggccgcacuggggc

SEQ ID NO: 1911822 - RNA, 15 nt, Homo sapiens
caggaagccagagcc

SEQ ID NO: 1911823 - RNA, 17 nt, Homo sapiens
agucuccuuugcacuga

SEQ ID NO: 1911824 - RNA, 14 nt, Homo sapiens
uauuugcugccaga

SEQ ID NO: 1911825 - RNA, 18 nt, Homo sapiens
ccacauuuagaacuuugg

SEQ ID NO: 1911826 - RNA, 16 nt, Homo sapiens
gaacuugcaauaccaa

SEQ ID NO: 1911827 - RNA, 22 nt, Homo sapiens
ccacagggagcuccgucagcuu

SEQ ID NO: 1911828 - RNA, 16 nt, Homo sapiens
ccugaagaacugucua

SEQ ID NO: 1911829 - RNA, 22 nt, Homo sapiens
uucuccuguuggcucacagggc

SEQ ID NO: 1911830 - RNA, 16 nt, Homo sapiens
ggagucuuuucuguua

SEQ ID NO: 1911831 - RNA, 16 nt, Homo sapiens
gauguggucaauggaa

SEQ ID NO: 1911832 - RNA, 13 nt, Homo sapiens
ucuuccuacacau

SEQ ID NO: 1911833 - RNA, 20 nt, Homo sapiens
cugccaaccagagcagcuca

SEQ ID NO: 1911834 - RNA, 12 nt, Homo sapiens
uuccucuaguag

SEQ ID NO: 1911835 - RNA, 18 nt, Homo sapiens
auugauucaagugagcca

SEQ ID NO: 1911836 - RNA, 20 nt, Homo sapiens
aauuccugauggaaaaugca

SEQ ID NO: 1911837 - RNA, 20 nt, Homo sapiens
agcagagacgggguuucacc

SEQ ID NO: 1911838 - RNA, 17 nt, Homo sapiens
agaauguguuucaaaac

SEQ ID NO: 1911839 - RNA, 23 nt, Homo sapiens
uugacuauguuuggaguuuaauu

SEQ ID NO: 1911840 - RNA, 15 nt, Homo sapiens
aguccccaccagcuc

SEQ ID NO: 1911841 - RNA, 20 nt, Homo sapiens
uggaauuaccugauaaggga

SEQ ID NO: 1911842 - RNA, 18 nt, Homo sapiens
cuucacauuuacuagcug

SEQ ID NO: 1911843 - RNA, 12 nt, Homo sapiens
uguuucugcaga

SEQ ID NO: 1911844 - RNA, 21 nt, Homo sapiens
cccaggccugggaugcaguga

SEQ ID NO: 1911845 - RNA, 21 nt, Homo sapiens
ccuuccagcacccugcaaaau

SEQ ID NO: 1911846 - RNA, 21 nt, Homo sapiens
uuccaucuccauccaagcaaa

SEQ ID NO: 1911847 - RNA, 17 nt, Homo sapiens
aauuucuaacaguacca

SEQ ID NO: 1911848 - RNA, 19 nt, Homo sapiens
cuccugcgcaggccaugca

SEQ ID NO: 1911849 - RNA, 18 nt, Homo sapiens
auaucagggccugaguga

SEQ ID NO: 1911850 - RNA, 14 nt, Homo sapiens
uaaaacacaguauu

SEQ ID NO: 1911851 - RNA, 16 nt, Homo sapiens
aaguccagauuuacac

SEQ ID NO: 1911852 - RNA, 14 nt, Homo sapiens
ggugauucugaucc

SEQ ID NO: 1911853 - RNA, 17 nt, Homo sapiens
cauuccagucaagcaga

SEQ ID NO: 1911854 - RNA, 16 nt, Homo sapiens
uggucuccucuuccag

SEQ ID NO: 1911855 - RNA, 13 nt, Homo sapiens
ccaaacaaaauag

SEQ ID NO: 1911856 - RNA, 14 nt, Homo sapiens
ugcuaacugguuaa

SEQ ID NO: 1911857 - RNA, 15 nt, Homo sapiens
guuuaucaagccaua

SEQ ID NO: 1911858 - RNA, 14 nt, Homo sapiens
gggccgccuccucc

SEQ ID NO: 1911859 - RNA, 13 nt, Homo sapiens
aggucuaugcaga

SEQ ID NO: 1911860 - RNA, 19 nt, Homo sapiens
cuuuaauucuguaucugua

SEQ ID NO: 1911861 - RNA, 16 nt, Homo sapiens
ucacaagcaauaauua

SEQ ID NO: 1911862 - RNA, 14 nt, Homo sapiens
aucuguacaaugac

SEQ ID NO: 1911863 - RNA, 15 nt, Homo sapiens
ggucuguagggauuu

SEQ ID NO: 1911864 - RNA, 13 nt, Homo sapiens
aaacuccacaaag

SEQ ID NO: 1911865 - RNA, 21 nt, Homo sapiens
cacugcacucaaccuuaagac

SEQ ID NO: 1911866 - RNA, 16 nt, Homo sapiens
gacauaaugggguccu

SEQ ID NO: 1911867 - RNA, 15 nt, Homo sapiens
cacauuuaccaguau

SEQ ID NO: 1911868 - RNA, 21 nt, Homo sapiens
cagcuuccccucacuuaacca

SEQ ID NO: 1911869 - RNA, 23 nt, Homo sapiens
ugaaaggaagcuccacugucacc

SEQ ID NO: 1911870 - RNA, 22 nt, Homo sapiens
guugucaacauuuuuuuccuau

SEQ ID NO: 1911871 - RNA, 15 nt, Homo sapiens
gaauaaaauugcacu

SEQ ID NO: 1911872 - RNA, 16 nt, Homo sapiens
aauggacacuuuucac

SEQ ID NO: 1911873 - RNA, 22 nt, Homo sapiens
uccuucauggcaggcaucgcca

SEQ ID NO: 1911874 - RNA, 20 nt, Homo sapiens
cauccugcuaguuugugaug

SEQ ID NO: 1911875 - RNA, 18 nt, Homo sapiens
uccgaaagucugaaucuc

SEQ ID NO: 1911876 - RNA, 17 nt, Homo sapiens
gugaauacucuucccac

SEQ ID NO: 1911877 - RNA, 17 nt, Homo sapiens
cuccccuucccugggga

SEQ ID NO: 1911878 - RNA, 18 nt, Homo sapiens
cccuguggggccugaugg

SEQ ID NO: 1911879 - RNA, 17 nt, Homo sapiens
uucccugugucugccaa

SEQ ID NO: 1911880 - RNA, 21 nt, Homo sapiens
aaaauacuuguugcugucaca

SEQ ID NO: 1911881 - RNA, 15 nt, Homo sapiens
aucagaagcacaaag

SEQ ID NO: 1911882 - RNA, 16 nt, Homo sapiens
aucucauccuauuacu

SEQ ID NO: 1911883 - RNA, 16 nt, Homo sapiens
ccacuucucucaggau

SEQ ID NO: 1911884 - RNA, 16 nt, Homo sapiens
guccuaaauaucucaa

SEQ ID NO: 1911885 - RNA, 20 nt, Homo sapiens
ccaagagugguuaugccucc

SEQ ID NO: 1911886 - RNA, 18 nt, Homo sapiens
auguggaauugacugccu

SEQ ID NO: 1911887 - RNA, 18 nt, Homo sapiens
cugauccagagcacagau

SEQ ID NO: 1911888 - RNA, 20 nt, Homo sapiens
auuggaccuguucaaaaagg

SEQ ID NO: 1911889 - RNA, 22 nt, Homo sapiens
ggaguguucaaaauacuacuga

SEQ ID NO: 1911890 - RNA, 22 nt, Homo sapiens
auucauuuuuaagauagaacac

SEQ ID NO: 1911891 - RNA, 22 nt, Homo sapiens
gugccgaggacaugcaugacac

SEQ ID NO: 1911892 - RNA, 16 nt, Homo sapiens
uaaaaauccacuauuu

SEQ ID NO: 1911893 - RNA, 15 nt, Homo sapiens
aaaagucuaccaccg

SEQ ID NO: 1911894 - RNA, 19 nt, Homo sapiens
ucgggacuuguaacauaga

SEQ ID NO: 1911895 - RNA, 14 nt, Homo sapiens
gauguuucugugaa

SEQ ID NO: 1911896 - RNA, 19 nt, Homo sapiens
auaaauugccucccuuccu

SEQ ID NO: 1911897 - RNA, 19 nt, Homo sapiens
ugagcucccucgcuguaug

SEQ ID NO: 1911898 - RNA, 23 nt, Homo sapiens
caaccuucugaggagcuguugag

SEQ ID NO: 1911899 - RNA, 14 nt, Homo sapiens
acuccuucaauauu

SEQ ID NO: 1911900 - RNA, 20 nt, Homo sapiens
uguacaaauguuagagccau

SEQ ID NO: 1911901 - RNA, 11 nt, Homo sapiens
aauugucucaa

SEQ ID NO: 1911902 - RNA, 21 nt, Homo sapiens
ugagucuuggccugccuccca

SEQ ID NO: 1911903 - RNA, 20 nt, Homo sapiens
cuguaauuccuaacuaucac

SEQ ID NO: 1911904 - RNA, 22 nt, Homo sapiens
ccucccaaauuugaguugcacc

SEQ ID NO: 1911905 - RNA, 18 nt, Homo sapiens
caagggcaggaccaaugg

SEQ ID NO: 1911906 - RNA, 22 nt, Homo sapiens
gagcauaauaaauuauauuaaa

SEQ ID NO: 1911907 - RNA, 18 nt, Homo sapiens
acaucugagagaugacag

SEQ ID NO: 1911908 - RNA, 14 nt, Homo sapiens
uaaauuauauuccu

SEQ ID NO: 1911909 - RNA, 21 nt, Homo sapiens
ggucagaacccugccauggaa

SEQ ID NO: 1911910 - RNA, 16 nt, Homo sapiens
uuucauauuauuuuag

SEQ ID NO: 1911911 - RNA, 15 nt, Homo sapiens
auaaaucuguuauag

SEQ ID NO: 1911912 - RNA, 21 nt, Homo sapiens
cacuaugaacuuggauauuca

SEQ ID NO: 1911913 - RNA, 13 nt, Homo sapiens
cuucaggugcuuu

SEQ ID NO: 1911914 - RNA, 21 nt, Homo sapiens
ucucccaccuccuucccccca

SEQ ID NO: 1911915 - RNA, 18 nt, Homo sapiens
aaggcuguuaacauuaca

SEQ ID NO: 1911916 - RNA, 14 nt, Homo sapiens
cauuuguugcugcu

SEQ ID NO: 1911917 - RNA, 23 nt, Homo sapiens
acaauggggggaaggauagcauu

SEQ ID NO: 1911918 - RNA, 15 nt, Homo sapiens
uauacagacaggaag

SEQ ID NO: 1911919 - RNA, 17 nt, Homo sapiens
cugauuguuuuaacuga

SEQ ID NO: 1911920 - RNA, 19 nt, Homo sapiens
aagauagucuucaguuuca

SEQ ID NO: 1911921 - RNA, 22 nt, Homo sapiens
cuugugaccuugacuugccaug

SEQ ID NO: 1911922 - RNA, 22 nt, Homo sapiens
cgacaaagccaaacucugccag

SEQ ID NO: 1911923 - RNA, 17 nt, Homo sapiens
uuugggacuugggagcu

SEQ ID NO: 1911924 - RNA, 13 nt, Homo sapiens
gcccagacaagau

SEQ ID NO: 1911925 - RNA, 16 nt, Homo sapiens
gggccugcccagacaa

SEQ ID NO: 1911926 - RNA, 16 nt, Homo sapiens
cgcugguaacuguuaa

SEQ ID NO: 1911927 - RNA, 14 nt, Homo sapiens
uuaaaaucaguauu

SEQ ID NO: 1911928 - RNA, 20 nt, Homo sapiens
uucagaccagugaaagagua

SEQ ID NO: 1911929 - RNA, 13 nt, Homo sapiens
uauaaacuccuua

SEQ ID NO: 1911930 - RNA, 20 nt, Homo sapiens
ucaaaacuucagacauagaa

SEQ ID NO: 1911931 - RNA, 20 nt, Homo sapiens
gcccuuucauggucugcuga

SEQ ID NO: 1911932 - RNA, 16 nt, Homo sapiens
ucagguccaugugcac

SEQ ID NO: 1911933 - RNA, 22 nt, Homo sapiens
auuaugaauagaagguagugaa

SEQ ID NO: 1911934 - RNA, 13 nt, Homo sapiens
uaacuaguacaaa

SEQ ID NO: 1911935 - RNA, 14 nt, Homo sapiens
aauuuagcuuacau

SEQ ID NO: 1911936 - RNA, 15 nt, Homo sapiens
gaauggggaucacag

SEQ ID NO: 1911937 - RNA, 23 nt, Homo sapiens
gacuacauuuagccccucucuua

SEQ ID NO: 1911938 - RNA, 18 nt, Homo sapiens
uaaaaugugaagugaaug

SEQ ID NO: 1911939 - RNA, 23 nt, Homo sapiens
caaguggcugugacaucuacgua

SEQ ID NO: 1911940 - RNA, 22 nt, Homo sapiens
agaggacacuagaugauauuac

SEQ ID NO: 1911941 - RNA, 20 nt, Homo sapiens
cuuccuagugccuacaaugg

SEQ ID NO: 1911942 - RNA, 23 nt, Homo sapiens
aacuagugagcgcccccugcccc

SEQ ID NO: 1911943 - RNA, 14 nt, Homo sapiens
auuauguggaauaa

SEQ ID NO: 1911944 - RNA, 22 nt, Homo sapiens
uaugaauauuuauaacagcauu

SEQ ID NO: 1911945 - RNA, 13 nt, Homo sapiens
guaaaaauccacu

SEQ ID NO: 1911946 - RNA, 20 nt, Homo sapiens
gcuaaaccaaggacugagca

SEQ ID NO: 1911947 - RNA, 17 nt, Homo sapiens
agaccaccaggguccca

SEQ ID NO: 1911948 - RNA, 22 nt, Homo sapiens
aagauccccucuccugcccaag

SEQ ID NO: 1911949 - RNA, 14 nt, Homo sapiens
ugaccuacccaaac

SEQ ID NO: 1911950 - RNA, 19 nt, Homo sapiens
ucagaucguucauugccuu

SEQ ID NO: 1911951 - RNA, 14 nt, Homo sapiens
auuucaugugaauc

SEQ ID NO: 1911952 - RNA, 15 nt, Homo sapiens
ucugggauguauuca

SEQ ID NO: 1911953 - RNA, 13 nt, Homo sapiens
uguuaccuacuuu

SEQ ID NO: 1911954 - RNA, 17 nt, Homo sapiens
ucagugauuacugucaa

SEQ ID NO: 1911955 - RNA, 21 nt, Homo sapiens
ucccuucccagcgcugcuggu

SEQ ID NO: 1911956 - RNA, 23 nt, Homo sapiens
gguaauguuggaugaugaaacau

SEQ ID NO: 1911957 - RNA, 20 nt, Homo sapiens
cugucugucaggccuugaga

SEQ ID NO: 1911958 - RNA, 21 nt, Homo sapiens
agaaaggggcaggagcucaga

SEQ ID NO: 1911959 - RNA, 20 nt, Homo sapiens
gcccuugcacuccuacugag

SEQ ID NO: 1911960 - RNA, 16 nt, Homo sapiens
agaauccgaagggaau

SEQ ID NO: 1911961 - RNA, 13 nt, Homo sapiens
cucacaugcacag

SEQ ID NO: 1911962 - RNA, 13 nt, Homo sapiens
uuaugauguaauc

SEQ ID NO: 1911963 - RNA, 14 nt, Homo sapiens
aaaccucuguucuc

SEQ ID NO: 1911964 - RNA, 22 nt, Homo sapiens
uagccaauauuuuucuuacuga

SEQ ID NO: 1911965 - RNA, 19 nt, Homo sapiens
uuauuacccuucuuuccau

SEQ ID NO: 1911966 - RNA, 16 nt, Homo sapiens
aaaucuuuuguuuuaa

SEQ ID NO: 1911967 - RNA, 13 nt, Homo sapiens
agguguaccuccc

SEQ ID NO: 1911968 - RNA, 18 nt, Homo sapiens
ccagguuggagugcagug

SEQ ID NO: 1911969 - RNA, 17 nt, Homo sapiens
ggugaccugcggcagua

SEQ ID NO: 1911970 - RNA, 23 nt, Homo sapiens
gagucuugcaagacccagggaga

SEQ ID NO: 1911971 - RNA, 15 nt, Homo sapiens
uguaugagcuucuaa

SEQ ID NO: 1911972 - RNA, 19 nt, Homo sapiens
ggcauuacaauugcaguuu

SEQ ID NO: 1911973 - RNA, 22 nt, Homo sapiens
ugcaaacaguaacgugugcgca

SEQ ID NO: 1911974 - RNA, 17 nt, Homo sapiens
uugcuucaagaaugugu

SEQ ID NO: 1911975 - RNA, 18 nt, Homo sapiens
ucccugugcugacggaag

SEQ ID NO: 1911976 - RNA, 18 nt, Homo sapiens
gaaaauucaggucuguau

SEQ ID NO: 1911977 - RNA, 15 nt, Homo sapiens
caagcugucccugca

SEQ ID NO: 1911978 - RNA, 21 nt, Homo sapiens
guagaaaggucauccaaagaa

SEQ ID NO: 1911979 - RNA, 19 nt, Homo sapiens
gagcuagcuucugcaaugu

SEQ ID NO: 1911980 - RNA, 22 nt, Homo sapiens
cugcuuuggggcuuaucagaac

SEQ ID NO: 1911981 - RNA, 18 nt, Homo sapiens
aaauacaauuauuguaua

SEQ ID NO: 1911982 - RNA, 18 nt, Homo sapiens
caguacccucucagcucc

SEQ ID NO: 1911983 - RNA, 17 nt, Homo sapiens
uuaaacacuaaucacaa

SEQ ID NO: 1911984 - RNA, 21 nt, Homo sapiens
aacucagggcuucuaguuucu

SEQ ID NO: 1911985 - RNA, 12 nt, Homo sapiens
ucugcugucuaa

SEQ ID NO: 1911986 - RNA, 18 nt, Homo sapiens
aucugucuuucaucuccc

SEQ ID NO: 1911987 - RNA, 16 nt, Homo sapiens
cuguaauaaauaugag

SEQ ID NO: 1911988 - RNA, 21 nt, Homo sapiens
cauauguauacaugugccaug

SEQ ID NO: 1911989 - RNA, 23 nt, Homo sapiens
uccccauucagugacauguccuc

SEQ ID NO: 1911990 - RNA, 22 nt, Homo sapiens
ccuccugugaaccaacacagac

SEQ ID NO: 1911991 - RNA, 22 nt, Homo sapiens
cgugcugcucaaggaccaagag

SEQ ID NO: 1911992 - RNA, 14 nt, Homo sapiens
aaaaugccaugaaa

SEQ ID NO: 1911993 - RNA, 17 nt, Homo sapiens
gaauuauauuuccuuaa

SEQ ID NO: 1911994 - RNA, 17 nt, Homo sapiens
ccucggccucuacuuug

SEQ ID NO: 1911995 - RNA, 19 nt, Homo sapiens
auacagcuucagcugccug

SEQ ID NO: 1911996 - RNA, 16 nt, Homo sapiens
ucacagcuaccaaagu

SEQ ID NO: 1911997 - RNA, 16 nt, Homo sapiens
uaccugaagcuggacu

SEQ ID NO: 1911998 - RNA, 12 nt, Homo sapiens
agugcuccagua

SEQ ID NO: 1911999 - RNA, 15 nt, Homo sapiens
uuacugacugcuuau

SEQ ID NO: 1912000 - RNA, 16 nt, Homo sapiens
aagauuggcauaucau

SEQ ID NO: 1912001 - RNA, 13 nt, Homo sapiens
uuugcaaacguuc

SEQ ID NO: 1912002 - RNA, 18 nt, Homo sapiens
acgagaagacaaacuccg

SEQ ID NO: 1912003 - RNA, 18 nt, Homo sapiens
acacugaauugaaucuac

SEQ ID NO: 1912004 - RNA, 20 nt, Homo sapiens
cauguacaaaaacacaaaua

SEQ ID NO: 1912005 - RNA, 17 nt, Homo sapiens
gugaaacuugugcuaua

SEQ ID NO: 1912006 - RNA, 22 nt, Homo sapiens
agccaaaggccgugccuggugg

SEQ ID NO: 1912007 - RNA, 14 nt, Homo sapiens
uaaaaaaucuuaau

SEQ ID NO: 1912008 - RNA, 14 nt, Homo sapiens
cuacaaauuaucau

SEQ ID NO: 1912009 - RNA, 18 nt, Homo sapiens
gauucuaaauuaugugaa

SEQ ID NO: 1912010 - RNA, 19 nt, Homo sapiens
uauuuauuuuuugccauuu

SEQ ID NO: 1912011 - RNA, 18 nt, Homo sapiens
ugguucguucuguacugu

SEQ ID NO: 1912012 - RNA, 20 nt, Homo sapiens
auugccacuuaaagaaauaa

SEQ ID NO: 1912013 - RNA, 19 nt, Homo sapiens
gacagguucccagcagcug

SEQ ID NO: 1912014 - RNA, 15 nt, Homo sapiens
uuauuauaacaucca

SEQ ID NO: 1912015 - RNA, 18 nt, Homo sapiens
uguaaauauucuugucca

SEQ ID NO: 1912016 - RNA, 13 nt, Homo sapiens
gugucugggguga

SEQ ID NO: 1912017 - RNA, 12 nt, Homo sapiens
ugccuaccucuu

SEQ ID NO: 1912018 - RNA, 21 nt, Homo sapiens
ucagugcacaaaucauuccau

SEQ ID NO: 1912019 - RNA, 13 nt, Homo sapiens
caauucuuagaau

SEQ ID NO: 1912020 - RNA, 16 nt, Homo sapiens
guauaaauuuacuuuu

SEQ ID NO: 1912021 - RNA, 15 nt, Homo sapiens
cucggcugcaauugu

SEQ ID NO: 1912022 - RNA, 17 nt, Homo sapiens
uccagagggaauugcag

SEQ ID NO: 1912023 - RNA, 17 nt, Homo sapiens
auuacauggcucuaaaa

SEQ ID NO: 1912024 - RNA, 17 nt, Homo sapiens
uuccucaugucaucaaa

SEQ ID NO: 1912025 - RNA, 17 nt, Homo sapiens
aaaaaugagaacauguu

SEQ ID NO: 1912026 - RNA, 14 nt, Homo sapiens
uugcauccauuguu

SEQ ID NO: 1912027 - RNA, 13 nt, Homo sapiens
uuauuaaaauucu

SEQ ID NO: 1912028 - RNA, 16 nt, Homo sapiens
guccaggcacugagau

SEQ ID NO: 1912029 - RNA, 19 nt, Homo sapiens
uagacagguguuacuuaca

SEQ ID NO: 1912030 - RNA, 20 nt, Homo sapiens
aaauuagccacauguacacu

SEQ ID NO: 1912031 - RNA, 16 nt, Homo sapiens
ugacugggggccucug

SEQ ID NO: 1912032 - RNA, 16 nt, Homo sapiens
aaucuuuacacaaugu

SEQ ID NO: 1912033 - RNA, 21 nt, Homo sapiens
acagauauuccagaccaaaau

SEQ ID NO: 1912034 - RNA, 21 nt, Homo sapiens
ugcaguguuucccucuguguu

SEQ ID NO: 1912035 - RNA, 19 nt, Homo sapiens
caaagcuuuggcugagacc

SEQ ID NO: 1912036 - RNA, 16 nt, Homo sapiens
gcacauguauacauau

SEQ ID NO: 1912037 - RNA, 19 nt, Homo sapiens
acuuccuuuaggaucucag

SEQ ID NO: 1912038 - RNA, 13 nt, Homo sapiens
uacuuagcagcua

SEQ ID NO: 1912039 - RNA, 13 nt, Homo sapiens
aacuacuguacau

SEQ ID NO: 1912040 - RNA, 22 nt, Homo sapiens
ucuaaagcagaggcaacacugg

SEQ ID NO: 1912041 - RNA, 13 nt, Homo sapiens
ugauaagcaaauu

SEQ ID NO: 1912042 - RNA, 20 nt, Homo sapiens
accaucaucaucuugucuaa

SEQ ID NO: 1912043 - RNA, 17 nt, Homo sapiens
augaacuuaaaaugaaa

SEQ ID NO: 1912044 - RNA, 16 nt, Homo sapiens
ccaaauauaaucucac

SEQ ID NO: 1912045 - RNA, 23 nt, Homo sapiens
uucgccaaggcucacaugcuccu

SEQ ID NO: 1912046 - RNA, 16 nt, Homo sapiens
aguaugcuuagauuaa

SEQ ID NO: 1912047 - RNA, 23 nt, Homo sapiens
agagccacccaggccacugaccu

SEQ ID NO: 1912048 - RNA, 15 nt, Homo sapiens
cguacacacucagug

SEQ ID NO: 1912049 - RNA, 15 nt, Homo sapiens
aagaggcaaagaauc

SEQ ID NO: 1912050 - RNA, 22 nt, Homo sapiens
ucauccaauaccccuuuacuag

SEQ ID NO: 1912051 - RNA, 21 nt, Homo sapiens
accgggacuucaaagccguga

SEQ ID NO: 1912052 - RNA, 18 nt, Homo sapiens
auuguuccugcgcugcaa

SEQ ID NO: 1912053 - RNA, 20 nt, Homo sapiens
agcuuccauuaugcugcaga

SEQ ID NO: 1912054 - RNA, 22 nt, Homo sapiens
agugcaauuucuucuguagcua

SEQ ID NO: 1912055 - RNA, 15 nt, Homo sapiens
gaaugaacuguggaa

SEQ ID NO: 1912056 - RNA, 11 nt, Homo sapiens
ucuggacacag

SEQ ID NO: 1912057 - RNA, 13 nt, Homo sapiens
aagagaugucaaa

SEQ ID NO: 1912058 - RNA, 15 nt, Homo sapiens
uuucuggccugccuu

SEQ ID NO: 1912059 - RNA, 18 nt, Homo sapiens
aaagaagggaucccuaac

SEQ ID NO: 1912060 - RNA, 19 nt, Homo sapiens
uuguuaugagggcauguga

SEQ ID NO: 1912061 - RNA, 16 nt, Homo sapiens
aaguguucuucagugu

SEQ ID NO: 1912062 - RNA, 18 nt, Homo sapiens
guuuuuuuacaacauuca

SEQ ID NO: 1912063 - RNA, 19 nt, Homo sapiens
cagacuaggguucaugucu

SEQ ID NO: 1912064 - RNA, 20 nt, Homo sapiens
ugcauuccagccugggcaac

SEQ ID NO: 1912065 - RNA, 13 nt, Homo sapiens
uuccuugugguua

SEQ ID NO: 1912066 - RNA, 14 nt, Homo sapiens
aauaucucuaauau

SEQ ID NO: 1912067 - RNA, 18 nt, Homo sapiens
uguuuggaauaaagucaa

SEQ ID NO: 1912068 - RNA, 19 nt, Homo sapiens
acuucuaaguaaaaccaca

SEQ ID NO: 1912069 - RNA, 16 nt, Homo sapiens
acugaguuaucaggug

SEQ ID NO: 1912070 - RNA, 12 nt, Homo sapiens
cucaaaauugau

SEQ ID NO: 1912071 - RNA, 20 nt, Homo sapiens
cuaacauauugccaugugug

SEQ ID NO: 1912072 - RNA, 13 nt, Homo sapiens
uucuuacaaacau

SEQ ID NO: 1912073 - RNA, 19 nt, Homo sapiens
cauuguauguggucaugga

SEQ ID NO: 1912074 - RNA, 18 nt, Homo sapiens
gacacauagaaaacaauc

SEQ ID NO: 1912075 - RNA, 19 nt, Homo sapiens
cgugcacugagagugaagu

SEQ ID NO: 1912076 - RNA, 21 nt, Homo sapiens
caaaaaaaaaaaaaaaagccu

SEQ ID NO: 1912077 - RNA, 22 nt, Homo sapiens
auggacaauggacuguacaaua

SEQ ID NO: 1912078 - RNA, 15 nt, Homo sapiens
cucuuuccuuccuuc

SEQ ID NO: 1912079 - RNA, 16 nt, Homo sapiens
gugacccugcucucac

SEQ ID NO: 1912080 - RNA, 18 nt, Homo sapiens
agccaggguuccagacag

SEQ ID NO: 1912081 - RNA, 14 nt, Homo sapiens
cauaacuucucuga

SEQ ID NO: 1912082 - RNA, 17 nt, Homo sapiens
guuccauucaacuggaa

SEQ ID NO: 1912083 - RNA, 19 nt, Homo sapiens
cugcuccuuggccuaguca

SEQ ID NO: 1912084 - RNA, 11 nt, Homo sapiens
aauaaugcaaa

SEQ ID NO: 1912085 - RNA, 22 nt, Homo sapiens
acguuuauaaacagaaauggaa

SEQ ID NO: 1912086 - RNA, 13 nt, Homo sapiens
uuuaacaauaacu

SEQ ID NO: 1912087 - RNA, 13 nt, Homo sapiens
ggcucacaguggg

SEQ ID NO: 1912088 - RNA, 23 nt, Homo sapiens
ggagagagcaaucuugcugugaa

SEQ ID NO: 1912089 - RNA, 11 nt, Homo sapiens
cuaaaugccuu

SEQ ID NO: 1912090 - RNA, 12 nt, Homo sapiens
caagaggcuccu

SEQ ID NO: 1912091 - RNA, 14 nt, Homo sapiens
ugcuugcuggugcc

SEQ ID NO: 1912092 - RNA, 17 nt, Homo sapiens
cagaauauugugcccca

SEQ ID NO: 1912093 - RNA, 20 nt, Homo sapiens
uccacuaggguccaccagga

SEQ ID NO: 1912094 - RNA, 18 nt, Homo sapiens
uauuaacuauuaguguua

SEQ ID NO: 1912095 - RNA, 15 nt, Homo sapiens
cgcuggcugcacuca

SEQ ID NO: 1912096 - RNA, 15 nt, Homo sapiens
ugaacaaagcaccuc

SEQ ID NO: 1912097 - RNA, 13 nt, Homo sapiens
uugcugagugagu

SEQ ID NO: 1912098 - RNA, 23 nt, Homo sapiens
aauuucaccuugaaaaagcacca

SEQ ID NO: 1912099 - RNA, 14 nt, Homo sapiens
gccuaauggcaaaa

SEQ ID NO: 1912100 - RNA, 21 nt, Homo sapiens
caugugcggcugaacugagaa

SEQ ID NO: 1912101 - RNA, 15 nt, Homo sapiens
cuguaugcucacaac

SEQ ID NO: 1912102 - RNA, 13 nt, Homo sapiens
cgagcacugugac

SEQ ID NO: 1912103 - RNA, 23 nt, Homo sapiens
guucaaaccaaucaaaugguguu

SEQ ID NO: 1912104 - RNA, 17 nt, Homo sapiens
ucaccucccgaagccac

SEQ ID NO: 1912105 - RNA, 16 nt, Homo sapiens
caugaagagcuugugu

SEQ ID NO: 1912106 - RNA, 13 nt, Homo sapiens
aauauuaucuuug

SEQ ID NO: 1912107 - RNA, 15 nt, Homo sapiens
acaugauaagacauu

SEQ ID NO: 1912108 - RNA, 21 nt, Homo sapiens
aaagacaagcucaaguguuca

SEQ ID NO: 1912109 - RNA, 15 nt, Homo sapiens
cuggacgccacggcc

SEQ ID NO: 1912110 - RNA, 17 nt, Homo sapiens
cgaaauuggauuaugca

SEQ ID NO: 1912111 - RNA, 20 nt, Homo sapiens
ucucccgcguggaguucucc

SEQ ID NO: 1912112 - RNA, 13 nt, Homo sapiens
caaguagcuuucu

SEQ ID NO: 1912113 - RNA, 13 nt, Homo sapiens
ccuuuaugugaau

SEQ ID NO: 1912114 - RNA, 13 nt, Homo sapiens
cucuagugccaua

SEQ ID NO: 1912115 - RNA, 23 nt, Homo sapiens
uuaaaugaagugcccacuaagaa

SEQ ID NO: 1912116 - RNA, 16 nt, Homo sapiens
ugggcaccccacugca

SEQ ID NO: 1912117 - RNA, 17 nt, Homo sapiens
aauaaguuaaucaggaa

SEQ ID NO: 1912118 - RNA, 23 nt, Homo sapiens
gaccuuuuuaucuugaguguuau

SEQ ID NO: 1912119 - RNA, 17 nt, Homo sapiens
aucaagaaugaggauau

SEQ ID NO: 1912120 - RNA, 17 nt, Homo sapiens
uaauugcuuugccaaaa

SEQ ID NO: 1912121 - RNA, 22 nt, Homo sapiens
uggaacaccagcagcacuggaa

SEQ ID NO: 1912122 - RNA, 18 nt, Homo sapiens
auuaguaugguucaagau

SEQ ID NO: 1912123 - RNA, 21 nt, Homo sapiens
ccuguuucuaccuauaugcag

SEQ ID NO: 1912124 - RNA, 16 nt, Homo sapiens
aucauuuuaagugcau

SEQ ID NO: 1912125 - RNA, 16 nt, Homo sapiens
gggagauccugcauuu

SEQ ID NO: 1912126 - RNA, 18 nt, Homo sapiens
cauaaaaaggaauccacu

SEQ ID NO: 1912127 - RNA, 19 nt, Homo sapiens
uaugcacucccuugaggau

SEQ ID NO: 1912128 - RNA, 13 nt, Homo sapiens
cgaccagacaccu

SEQ ID NO: 1912129 - RNA, 15 nt, Homo sapiens
ccaaugaucuugcaa

SEQ ID NO: 1912130 - RNA, 19 nt, Homo sapiens
gccaggccuuacaucuggc

SEQ ID NO: 1912131 - RNA, 17 nt, Homo sapiens
gcugguggccaccgugu

SEQ ID NO: 1912132 - RNA, 15 nt, Homo sapiens
uaggaguuugcuaag

SEQ ID NO: 1912133 - RNA, 11 nt, Homo sapiens
aaaguguaaag

SEQ ID NO: 1912134 - RNA, 15 nt, Homo sapiens
auugggaaaacucca

SEQ ID NO: 1912135 - RNA, 14 nt, Homo sapiens
cagggaggguguuu

SEQ ID NO: 1912136 - RNA, 17 nt, Homo sapiens
auuucacaucagcuuua

SEQ ID NO: 1912137 - RNA, 12 nt, Homo sapiens
augcaguuucau

SEQ ID NO: 1912138 - RNA, 15 nt, Homo sapiens
ugaccucacagugac

SEQ ID NO: 1912139 - RNA, 21 nt, Homo sapiens
uagucuggacugcuuccccau

SEQ ID NO: 1912140 - RNA, 16 nt, Homo sapiens
ccuguccagaccuuug

SEQ ID NO: 1912141 - RNA, 10 nt, Homo sapiens
acaucaaaga

SEQ ID NO: 1912142 - RNA, 18 nt, Homo sapiens
aaggaacaaaaaaaccac

SEQ ID NO: 1912143 - RNA, 22 nt, Homo sapiens
cagcucuuccccacccugggau

SEQ ID NO: 1912144 - RNA, 19 nt, Homo sapiens
agaacccagggcucugccc

SEQ ID NO: 1912145 - RNA, 18 nt, Homo sapiens
cucaaguuuuuauaguua

SEQ ID NO: 1912146 - RNA, 12 nt, Homo sapiens
ccagugaugaug

SEQ ID NO: 1912147 - RNA, 13 nt, Homo sapiens
cagcccacuggau

SEQ ID NO: 1912148 - RNA, 22 nt, Homo sapiens
ucucucuuagcauccugccuua

SEQ ID NO: 1912149 - RNA, 19 nt, Homo sapiens
caggcaggcccugccuuca

SEQ ID NO: 1912150 - RNA, 18 nt, Homo sapiens
agggcugcaaaacuggaa

SEQ ID NO: 1912151 - RNA, 17 nt, Homo sapiens
aggacaaauugagacag

SEQ ID NO: 1912152 - RNA, 19 nt, Homo sapiens
ugcauaaacuucaucuuca

SEQ ID NO: 1912153 - RNA, 15 nt, Homo sapiens
agcaaaaaaauuauu

SEQ ID NO: 1912154 - RNA, 17 nt, Homo sapiens
aucucuugucauucuca

SEQ ID NO: 1912155 - RNA, 13 nt, Homo sapiens
cacuuagccucuu

SEQ ID NO: 1912156 - RNA, 17 nt, Homo sapiens
aacagcugcauggcaca

SEQ ID NO: 1912157 - RNA, 17 nt, Homo sapiens
ccuguuuagagaagccg

SEQ ID NO: 1912158 - RNA, 14 nt, Homo sapiens
uuauaaauaugaag

SEQ ID NO: 1912159 - RNA, 21 nt, Homo sapiens
acagaaaguucuuaaacucag

SEQ ID NO: 1912160 - RNA, 14 nt, Homo sapiens
ucacaucuguccag

SEQ ID NO: 1912161 - RNA, 21 nt, Homo sapiens
caaacugcauauguacuucaa

SEQ ID NO: 1912162 - RNA, 15 nt, Homo sapiens
ucaaagaugacuuga

SEQ ID NO: 1912163 - RNA, 23 nt, Homo sapiens
ucugauuuaacacuauccaauga

SEQ ID NO: 1912164 - RNA, 21 nt, Homo sapiens
guauuuuuguuaguuuacaau

SEQ ID NO: 1912165 - RNA, 17 nt, Homo sapiens
cucaccccagccccacu

SEQ ID NO: 1912166 - RNA, 17 nt, Homo sapiens
aaucuagacaauauaca

SEQ ID NO: 1912167 - RNA, 13 nt, Homo sapiens
cuaacuccaguga

SEQ ID NO: 1912168 - RNA, 16 nt, Homo sapiens
aucuuuaaacugcuuu

SEQ ID NO: 1912169 - RNA, 16 nt, Homo sapiens
aauccaaacuaaucca

SEQ ID NO: 1912170 - RNA, 18 nt, Homo sapiens
caguauggcggaggccau

SEQ ID NO: 1912171 - RNA, 16 nt, Homo sapiens
acuuuccucaguugau

SEQ ID NO: 1912172 - RNA, 22 nt, Homo sapiens
auaaaguaccacacauauugca

SEQ ID NO: 1912173 - RNA, 17 nt, Homo sapiens
gcaauaaacuccuacua

SEQ ID NO: 1912174 - RNA, 20 nt, Homo sapiens
aaaaugagggucucacugcu

SEQ ID NO: 1912175 - RNA, 12 nt, Homo sapiens
acacugcacugu

SEQ ID NO: 1912176 - RNA, 19 nt, Homo sapiens
ugacggggaggaaccacug

SEQ ID NO: 1912177 - RNA, 18 nt, Homo sapiens
caggaguuggaagugugu

SEQ ID NO: 1912178 - RNA, 18 nt, Homo sapiens
cauggaggcgcugcugcc

SEQ ID NO: 1912179 - RNA, 20 nt, Homo sapiens
gaauuauuuaaacaaaaacu

SEQ ID NO: 1912180 - RNA, 17 nt, Homo sapiens
acaaugcaaccaacuau

SEQ ID NO: 1912181 - RNA, 21 nt, Homo sapiens
acuuugguaguggaauaguga

SEQ ID NO: 1912182 - RNA, 17 nt, Homo sapiens
uuuucucaaagggcaua

SEQ ID NO: 1912183 - RNA, 19 nt, Homo sapiens
aaugggcagcuauccagug

SEQ ID NO: 1912184 - RNA, 16 nt, Homo sapiens
cuguaggcacagacaa

SEQ ID NO: 1912185 - RNA, 23 nt, Homo sapiens
cuucagugcaccuacugcuuacu

SEQ ID NO: 1912186 - RNA, 16 nt, Homo sapiens
ucagacccacaacgaa

SEQ ID NO: 1912187 - RNA, 19 nt, Homo sapiens
auccugcugaccucacugu

SEQ ID NO: 1912188 - RNA, 18 nt, Homo sapiens
aggcagccggccaaggcc

SEQ ID NO: 1912189 - RNA, 22 nt, Homo sapiens
uggaaaaagaauauauugccaa

SEQ ID NO: 1912190 - RNA, 16 nt, Homo sapiens
ucuuagcugucugcuc

SEQ ID NO: 1912191 - RNA, 21 nt, Homo sapiens
gacagaaagcagaacagugau

SEQ ID NO: 1912192 - RNA, 12 nt, Homo sapiens
gaaaucuacuga

SEQ ID NO: 1912193 - RNA, 23 nt, Homo sapiens
cugaagccuggacgcagccacac

SEQ ID NO: 1912194 - RNA, 13 nt, Homo sapiens
uguuaaaucaaua

SEQ ID NO: 1912195 - RNA, 19 nt, Homo sapiens
uaaaaaaauacaugcaucu

SEQ ID NO: 1912196 - RNA, 23 nt, Homo sapiens
ucaaauguuagauauugcuacua

SEQ ID NO: 1912197 - RNA, 22 nt, Homo sapiens
uguguccgcccccgauggagga

SEQ ID NO: 1912198 - RNA, 14 nt, Homo sapiens
uuuaagacuaugau

SEQ ID NO: 1912199 - RNA, 16 nt, Homo sapiens
accuuauucuacauca

SEQ ID NO: 1912200 - RNA, 18 nt, Homo sapiens
acauauaaagauuaacac

SEQ ID NO: 1912201 - RNA, 18 nt, Homo sapiens
ucagaagucaguugcaaa

SEQ ID NO: 1912202 - RNA, 15 nt, Homo sapiens
gauaugacaacucuu

SEQ ID NO: 1912203 - RNA, 11 nt, Homo sapiens
ucaaguggcag

SEQ ID NO: 1912204 - RNA, 18 nt, Homo sapiens
ggagcccgaggcaccagu

SEQ ID NO: 1912205 - RNA, 16 nt, Homo sapiens
acucaggugauuccag

SEQ ID NO: 1912206 - RNA, 16 nt, Homo sapiens
uuauaguaaugugacu

SEQ ID NO: 1912207 - RNA, 20 nt, Homo sapiens
ucccauaaacaaauguaaug

SEQ ID NO: 1912208 - RNA, 18 nt, Homo sapiens
ugcuagacuccucaggag

SEQ ID NO: 1912209 - RNA, 20 nt, Homo sapiens
gcaguaggaacccagcucuc

SEQ ID NO: 1912210 - RNA, 20 nt, Homo sapiens
auuuuagcuaaauucaggga

SEQ ID NO: 1912211 - RNA, 19 nt, Homo sapiens
ugacagucacugcauuugc

SEQ ID NO: 1912212 - RNA, 12 nt, Homo sapiens
auucuccacagc

SEQ ID NO: 1912213 - RNA, 16 nt, Homo sapiens
cacugcccaaagugcu

SEQ ID NO: 1912214 - RNA, 16 nt, Homo sapiens
aaguuaagauagcuuu

SEQ ID NO: 1912215 - RNA, 23 nt, Homo sapiens
cucggaaauggaaugugccccug

SEQ ID NO: 1912216 - RNA, 17 nt, Homo sapiens
caucugacacugacagc

SEQ ID NO: 1912217 - RNA, 19 nt, Homo sapiens
uccaucccuuuuccuguca

SEQ ID NO: 1912218 - RNA, 20 nt, Homo sapiens
acaacuccacgaggugaaaa

SEQ ID NO: 1912219 - RNA, 14 nt, Homo sapiens
gggcacugcagggg

SEQ ID NO: 1912220 - RNA, 14 nt, Homo sapiens
agcuucaacccuca

SEQ ID NO: 1912221 - RNA, 16 nt, Homo sapiens
ggucucgaugcugcug

SEQ ID NO: 1912222 - RNA, 15 nt, Homo sapiens
uuaugaagugcuaca

SEQ ID NO: 1912223 - RNA, 21 nt, Homo sapiens
agcuguggucaaggcuacaga

SEQ ID NO: 1912224 - RNA, 11 nt, Homo sapiens
ugaaacuaaga

SEQ ID NO: 1912225 - RNA, 12 nt, Homo sapiens
gcuuucuaugua

SEQ ID NO: 1912226 - RNA, 17 nt, Homo sapiens
uggacacucagaccagc

SEQ ID NO: 1912227 - RNA, 21 nt, Homo sapiens
uauaauucagaaggaucuuca

SEQ ID NO: 1912228 - RNA, 18 nt, Homo sapiens
uggcgcauauuaagcacu

SEQ ID NO: 1912229 - RNA, 12 nt, Homo sapiens
auagaaacugau

SEQ ID NO: 1912230 - RNA, 22 nt, Homo sapiens
ccgacacugcagcagaaucucu

SEQ ID NO: 1912231 - RNA, 15 nt, Homo sapiens
uucuguacacagaag

SEQ ID NO: 1912232 - RNA, 20 nt, Homo sapiens
ugugaaauucacaguaauau

SEQ ID NO: 1912233 - RNA, 18 nt, Homo sapiens
gcguggacucugcacaug

SEQ ID NO: 1912234 - RNA, 22 nt, Homo sapiens
gccugaucagcgccgcaccagc

SEQ ID NO: 1912235 - RNA, 21 nt, Homo sapiens
cagagaccccaggaucccaga

SEQ ID NO: 1912236 - RNA, 22 nt, Homo sapiens
cuugagggguuguugcgcaaug

SEQ ID NO: 1912237 - RNA, 24 nt, Homo sapiens
agagggagcucuggagugcuaacu

SEQ ID NO: 1912238 - RNA, 21 nt, Homo sapiens
uuuucucuguguuuguuccua

SEQ ID NO: 1912239 - RNA, 16 nt, Homo sapiens
agguguucaagaccag

SEQ ID NO: 1912240 - RNA, 22 nt, Homo sapiens
cuuuguaaaggucagagucaaa

SEQ ID NO: 1912241 - RNA, 17 nt, Homo sapiens
uucaaaaugcaugugau

SEQ ID NO: 1912242 - RNA, 22 nt, Homo sapiens
gcaaagaaaggagauacagugg

SEQ ID NO: 1912243 - RNA, 20 nt, Homo sapiens
aaauuuuuuguagacagggu

SEQ ID NO: 1912244 - RNA, 18 nt, Homo sapiens
cggacagcguguggcagu

SEQ ID NO: 1912245 - RNA, 21 nt, Homo sapiens
uuggccuauuccauucuggau

SEQ ID NO: 1912246 - RNA, 19 nt, Homo sapiens
ugccucuucuacuuguaaa

SEQ ID NO: 1912247 - RNA, 19 nt, Homo sapiens
caacaauggggugggccca

SEQ ID NO: 1912248 - RNA, 21 nt, Homo sapiens
ucuaggacccccagugcucac

SEQ ID NO: 1912249 - RNA, 16 nt, Homo sapiens
ccuuacagucacuaau

SEQ ID NO: 1912250 - RNA, 15 nt, Homo sapiens
uaaacaaaaagggaa

SEQ ID NO: 1912251 - RNA, 16 nt, Homo sapiens
cuguggaagaggccaa

SEQ ID NO: 1912252 - RNA, 14 nt, Homo sapiens
aucaaaggagauuc

SEQ ID NO: 1912253 - RNA, 10 nt, Homo sapiens
cucauuccac

SEQ ID NO: 1912254 - RNA, 16 nt, Homo sapiens
uaccaugguucugccu

SEQ ID NO: 1912255 - RNA, 19 nt, Homo sapiens
ugccuuuauuuccacugug

SEQ ID NO: 1912256 - RNA, 16 nt, Homo sapiens
uugguauaauguuuaa

SEQ ID NO: 1912257 - RNA, 14 nt, Homo sapiens
uauuaguugccaau

SEQ ID NO: 1912258 - RNA, 20 nt, Homo sapiens
ggucuccucagccuccucau

SEQ ID NO: 1912259 - RNA, 14 nt, Homo sapiens
accuucaacuucca

SEQ ID NO: 1912260 - RNA, 14 nt, Homo sapiens
uggaccaugaauga

SEQ ID NO: 1912261 - RNA, 13 nt, Homo sapiens
aaggauucauaau

SEQ ID NO: 1912262 - RNA, 17 nt, Homo sapiens
gcaacuggccagccaau

SEQ ID NO: 1912263 - RNA, 16 nt, Homo sapiens
gggcucacccucagga

SEQ ID NO: 1912264 - RNA, 14 nt, Homo sapiens
augcugugacaggu

SEQ ID NO: 1912265 - RNA, 16 nt, Homo sapiens
ugcagccaaaggggag

SEQ ID NO: 1912266 - RNA, 21 nt, Homo sapiens
caggccccuuuggaccugcag

SEQ ID NO: 1912267 - RNA, 17 nt, Homo sapiens
cacgcucaucuugcaaa

SEQ ID NO: 1912268 - RNA, 20 nt, Homo sapiens
uguuuuguaagugcugcuau

SEQ ID NO: 1912269 - RNA, 17 nt, Homo sapiens
ugcuaccaaaacaguua

SEQ ID NO: 1912270 - RNA, 19 nt, Homo sapiens
uguaagaacaacuaccuga

SEQ ID NO: 1912271 - RNA, 21 nt, Homo sapiens
gguuuccaagucccgggucuc

SEQ ID NO: 1912272 - RNA, 14 nt, Homo sapiens
uggcugccaaagag

SEQ ID NO: 1912273 - RNA, 17 nt, Homo sapiens
cauguccaaacccaucu

SEQ ID NO: 1912274 - RNA, 13 nt, Homo sapiens
acccaacaugacu

SEQ ID NO: 1912275 - RNA, 22 nt, Homo sapiens
ccugagguggauuuacugagag

SEQ ID NO: 1912276 - RNA, 15 nt, Homo sapiens
cacagcagcaguuac

SEQ ID NO: 1912277 - RNA, 19 nt, Homo sapiens
uugaauaguucuauacaaa

SEQ ID NO: 1912278 - RNA, 13 nt, Homo sapiens
ggagcuaaaacug

SEQ ID NO: 1912279 - RNA, 18 nt, Homo sapiens
uggcccucgcucugccuc

SEQ ID NO: 1912280 - RNA, 22 nt, Homo sapiens
gaacugauuuuacaaauuaaua

SEQ ID NO: 1912281 - RNA, 14 nt, Homo sapiens
cgcaaaugaguauu

SEQ ID NO: 1912282 - RNA, 21 nt, Homo sapiens
uccauaggcgcaggugcacag

SEQ ID NO: 1912283 - RNA, 17 nt, Homo sapiens
cuuuaaagacuugauga

SEQ ID NO: 1912284 - RNA, 15 nt, Homo sapiens
ccccaucauugcacc

SEQ ID NO: 1912285 - RNA, 18 nt, Homo sapiens
gaggcugcguccugagga

SEQ ID NO: 1912286 - RNA, 23 nt, Homo sapiens
ucaccagcccgggcuggcccaag

SEQ ID NO: 1912287 - RNA, 20 nt, Homo sapiens
cuuucauggaccaggucuug

SEQ ID NO: 1912288 - RNA, 12 nt, Homo sapiens
cauucuccugcc

SEQ ID NO: 1912289 - RNA, 17 nt, Homo sapiens
cugaaauuccaguuuag

SEQ ID NO: 1912290 - RNA, 16 nt, Homo sapiens
ggcuguaggugguguu

SEQ ID NO: 1912291 - RNA, 15 nt, Homo sapiens
ggagacaccaagcuc

SEQ ID NO: 1912292 - RNA, 13 nt, Homo sapiens
auuaaccaaagaa

SEQ ID NO: 1912293 - RNA, 13 nt, Homo sapiens
auuugccaaagug

SEQ ID NO: 1912294 - RNA, 18 nt, Homo sapiens
ucagcccccaccagggga

SEQ ID NO: 1912295 - RNA, 21 nt, Homo sapiens
agggggcugucuuggucacug

SEQ ID NO: 1912296 - RNA, 23 nt, Homo sapiens
uacaaaaauuccuuuucccgaag

SEQ ID NO: 1912297 - RNA, 13 nt, Homo sapiens
agaaagugcugau

SEQ ID NO: 1912298 - RNA, 16 nt, Homo sapiens
ccaagccaaguuuucu

SEQ ID NO: 1912299 - RNA, 14 nt, Homo sapiens
ccuuuuaaaaaccu

SEQ ID NO: 1912300 - RNA, 19 nt, Homo sapiens
ccccagguucuagucaugu

SEQ ID NO: 1912301 - RNA, 15 nt, Homo sapiens
accaaucuacuuugu

SEQ ID NO: 1912302 - RNA, 17 nt, Homo sapiens
aguaauacaucaaagag

SEQ ID NO: 1912303 - RNA, 17 nt, Homo sapiens
cugcuguggcaucagga

SEQ ID NO: 1912304 - RNA, 18 nt, Homo sapiens
ccaggguucaguccucaa

SEQ ID NO: 1912305 - RNA, 13 nt, Homo sapiens
uugcuguuuccuu

SEQ ID NO: 1912306 - RNA, 21 nt, Homo sapiens
agauauuuugcuuugugauuu

SEQ ID NO: 1912307 - RNA, 22 nt, Homo sapiens
caggagaaagaugaaacugaaa

SEQ ID NO: 1912308 - RNA, 12 nt, Homo sapiens
aguugugcaacg

SEQ ID NO: 1912309 - RNA, 21 nt, Homo sapiens
accuucagauuuguguuauaa

SEQ ID NO: 1912310 - RNA, 17 nt, Homo sapiens
gccagaauccucucaga

SEQ ID NO: 1912311 - RNA, 15 nt, Homo sapiens
ucgugccguggagcu

SEQ ID NO: 1912312 - RNA, 14 nt, Homo sapiens
aagauuuuaccugg

SEQ ID NO: 1912313 - RNA, 16 nt, Homo sapiens
auugagugaaacauug

SEQ ID NO: 1912314 - RNA, 19 nt, Homo sapiens
uuaaggucauuacucucaa

SEQ ID NO: 1912315 - RNA, 19 nt, Homo sapiens
gccucagcggacaagcagc

SEQ ID NO: 1912316 - RNA, 18 nt, Homo sapiens
uuggauauauuauuguaa

SEQ ID NO: 1912317 - RNA, 23 nt, Homo sapiens
gugcugcaucuuauagcacuuug

SEQ ID NO: 1912318 - RNA, 19 nt, Homo sapiens
cugggcuauaugccuauau

SEQ ID NO: 1912319 - RNA, 22 nt, Homo sapiens
gcaguucuagaagccacagugc

SEQ ID NO: 1912320 - RNA, 15 nt, Homo sapiens
aggcuggcugaaaau

SEQ ID NO: 1912321 - RNA, 14 nt, Homo sapiens
ggaagagggcagua

SEQ ID NO: 1912322 - RNA, 21 nt, Homo sapiens
cagcgcagcuggacucugcau

SEQ ID NO: 1912323 - RNA, 17 nt, Homo sapiens
cuuaaaugagaccaaag

SEQ ID NO: 1912324 - RNA, 17 nt, Homo sapiens
auacucaaaagagagag

SEQ ID NO: 1912325 - RNA, 20 nt, Homo sapiens
aagcuaaaauuagaugaacu

SEQ ID NO: 1912326 - RNA, 13 nt, Homo sapiens
agcgcaacauuuc

SEQ ID NO: 1912327 - RNA, 19 nt, Homo sapiens
gaugucaucacacucucca

SEQ ID NO: 1912328 - RNA, 14 nt, Homo sapiens
ugcaugucuacuca

SEQ ID NO: 1912329 - RNA, 19 nt, Homo sapiens
ccugguuccggcucugcac

SEQ ID NO: 1912330 - RNA, 19 nt, Homo sapiens
aucacucauuuauuuccau

SEQ ID NO: 1912331 - RNA, 15 nt, Homo sapiens
ucugccgguccccca

SEQ ID NO: 1912332 - RNA, 23 nt, Homo sapiens
cacacaugagagagagcccccac

SEQ ID NO: 1912333 - RNA, 12 nt, Homo sapiens
gacuuccagcuu

SEQ ID NO: 1912334 - RNA, 15 nt, Homo sapiens
ccucuggcaccuggg

SEQ ID NO: 1912335 - RNA, 13 nt, Homo sapiens
ccacacgugcaua

SEQ ID NO: 1912336 - RNA, 16 nt, Homo sapiens
gacauuuguccugcag

SEQ ID NO: 1912337 - RNA, 20 nt, Homo sapiens
ucucuacccggcccagagac

SEQ ID NO: 1912338 - RNA, 15 nt, Homo sapiens
aacugccccaucucc

SEQ ID NO: 1912339 - RNA, 16 nt, Homo sapiens
cugcagccugguagaa

SEQ ID NO: 1912340 - RNA, 17 nt, Homo sapiens
cuccccugcccuggucc

SEQ ID NO: 1912341 - RNA, 13 nt, Homo sapiens
gcuguauauuuga

SEQ ID NO: 1912342 - RNA, 22 nt, Homo sapiens
ucagcaaaacuuuccaacugag

SEQ ID NO: 1912343 - RNA, 15 nt, Homo sapiens
agacaggcucagguu

SEQ ID NO: 1912344 - RNA, 18 nt, Homo sapiens
uuacuaaagucacauaua

SEQ ID NO: 1912345 - RNA, 16 nt, Homo sapiens
ccuaggaaaccagcuc

SEQ ID NO: 1912346 - RNA, 17 nt, Homo sapiens
ugcccaugggcacugcu

SEQ ID NO: 1912347 - RNA, 18 nt, Homo sapiens
gucugaacaaaaccaaag

SEQ ID NO: 1912348 - RNA, 18 nt, Homo sapiens
caucaggauacucaaagu

SEQ ID NO: 1912349 - RNA, 12 nt, Homo sapiens
cagacagggugg

SEQ ID NO: 1912350 - RNA, 13 nt, Homo sapiens
acauguccuacaa

SEQ ID NO: 1912351 - RNA, 20 nt, Homo sapiens
uccaauacauugaacacauu

SEQ ID NO: 1912352 - RNA, 12 nt, Homo sapiens
gcccauugcacu

SEQ ID NO: 1912353 - RNA, 16 nt, Homo sapiens
agugcaggcacaguau

SEQ ID NO: 1912354 - RNA, 14 nt, Homo sapiens
ugaauaaauguauc

SEQ ID NO: 1912355 - RNA, 20 nt, Homo sapiens
auguagguacccugccacgg

SEQ ID NO: 1912356 - RNA, 18 nt, Homo sapiens
uguaucaaaugugacauu

SEQ ID NO: 1912357 - RNA, 17 nt, Homo sapiens
uucaaacaguuccauac

SEQ ID NO: 1912358 - RNA, 13 nt, Homo sapiens
ucacucauugaca

SEQ ID NO: 1912359 - RNA, 14 nt, Homo sapiens
ccuggcuauguccu

SEQ ID NO: 1912360 - RNA, 13 nt, Homo sapiens
uaggccucaggcc

SEQ ID NO: 1912361 - RNA, 22 nt, Homo sapiens
gugucagagcccagcucaugca

SEQ ID NO: 1912362 - RNA, 17 nt, Homo sapiens
cuagaugauugauuacc

SEQ ID NO: 1912363 - RNA, 17 nt, Homo sapiens
caccaaagagcauacac

SEQ ID NO: 1912364 - RNA, 23 nt, Homo sapiens
uggacuucauuuuggagaagcuc

SEQ ID NO: 1912365 - RNA, 13 nt, Homo sapiens
cugguauuuaaca

SEQ ID NO: 1912366 - RNA, 17 nt, Homo sapiens
cuuuuagcuacaccccu

SEQ ID NO: 1912367 - RNA, 22 nt, Homo sapiens
ucuaucaaccuucaaguaucca

SEQ ID NO: 1912368 - RNA, 15 nt, Homo sapiens
aggaaggaacagcaa

SEQ ID NO: 1912369 - RNA, 23 nt, Homo sapiens
ucacugcugagacccacaggucu

SEQ ID NO: 1912370 - RNA, 13 nt, Homo sapiens
auaucauaaucug

SEQ ID NO: 1912371 - RNA, 19 nt, Homo sapiens
agagacaguaacacaauua

SEQ ID NO: 1912372 - RNA, 23 nt, Homo sapiens
cugacaguguggggaaguguccc

SEQ ID NO: 1912373 - RNA, 21 nt, Homo sapiens
acaagcagcaggaaacauaga

SEQ ID NO: 1912374 - RNA, 15 nt, Homo sapiens
aauccuuaacauuuc

SEQ ID NO: 1912375 - RNA, 20 nt, Homo sapiens
ccuuggggaaccccgagcug

SEQ ID NO: 1912376 - RNA, 19 nt, Homo sapiens
cuucuggggcuuugccauu

SEQ ID NO: 1912377 - RNA, 16 nt, Homo sapiens
cucccuucugcuccca

SEQ ID NO: 1912378 - RNA, 23 nt, Homo sapiens
gagcaacaguuaugggacacuga

SEQ ID NO: 1912379 - RNA, 20 nt, Homo sapiens
accuucaugucacugcucuu

SEQ ID NO: 1912380 - RNA, 16 nt, Homo sapiens
ccacccaaaagucaaa

SEQ ID NO: 1912381 - RNA, 14 nt, Homo sapiens
uacacauacauaca

SEQ ID NO: 1912382 - RNA, 13 nt, Homo sapiens
aggacaggggcau

SEQ ID NO: 1912383 - RNA, 17 nt, Homo sapiens
cauaccuggacccaaag

SEQ ID NO: 1912384 - RNA, 17 nt, Homo sapiens
uaaugauaacuggaaac

SEQ ID NO: 1912385 - RNA, 19 nt, Homo sapiens
aaauugucuucauguacau

SEQ ID NO: 1912386 - RNA, 13 nt, Homo sapiens
auaaauauuucuc

SEQ ID NO: 1912387 - RNA, 11 nt, Homo sapiens
aaaaugggaga

SEQ ID NO: 1912388 - RNA, 21 nt, Homo sapiens
caggggucuuaccuugaacug

SEQ ID NO: 1912389 - RNA, 12 nt, Homo sapiens
ggcauuuggacc

SEQ ID NO: 1912390 - RNA, 18 nt, Homo sapiens
agguuauugcaauaaagu

SEQ ID NO: 1912391 - RNA, 17 nt, Homo sapiens
cuuccacuucuaugcaa

SEQ ID NO: 1912392 - RNA, 21 nt, Homo sapiens
ugugaaagacaauaaaacacu

SEQ ID NO: 1912393 - RNA, 14 nt, Homo sapiens
ucaucguggcuguu

SEQ ID NO: 1912394 - RNA, 19 nt, Homo sapiens
cuugaguggacagcagcug

SEQ ID NO: 1912395 - RNA, 19 nt, Homo sapiens
uggucuuauagaaagcacu

SEQ ID NO: 1912396 - RNA, 16 nt, Homo sapiens
cuggggagugagcuug

SEQ ID NO: 1912397 - RNA, 22 nt, Homo sapiens
aagagaaaaguccacagugaua

SEQ ID NO: 1912398 - RNA, 18 nt, Homo sapiens
cugggucaagggccaguc

SEQ ID NO: 1912399 - RNA, 15 nt, Homo sapiens
gcaacaguaaucuau

SEQ ID NO: 1912400 - RNA, 22 nt, Homo sapiens
cuguuggaagggggucacuuaa

SEQ ID NO: 1912401 - RNA, 24 nt, Homo sapiens
cuuaaaccagaacccaguguuucc

SEQ ID NO: 1912402 - RNA, 21 nt, Homo sapiens
auaauaaaaauuguagcuuuu

SEQ ID NO: 1912403 - RNA, 13 nt, Homo sapiens
agguacccugcca

SEQ ID NO: 1912404 - RNA, 19 nt, Homo sapiens
accgcuggggaacagagcg

SEQ ID NO: 1912405 - RNA, 14 nt, Homo sapiens
ccaaagacaucagu

SEQ ID NO: 1912406 - RNA, 14 nt, Homo sapiens
ucauuuauauuccu

SEQ ID NO: 1912407 - RNA, 22 nt, Homo sapiens
ugccacaucccagucacagugg

SEQ ID NO: 1912408 - RNA, 15 nt, Homo sapiens
ggagaagggcugaac

SEQ ID NO: 1912409 - RNA, 12 nt, Homo sapiens
ugagcugcccac

SEQ ID NO: 1912410 - RNA, 17 nt, Homo sapiens
agugccgaggacaugca

SEQ ID NO: 1912411 - RNA, 15 nt, Homo sapiens
auuauaacugcauag

SEQ ID NO: 1912412 - RNA, 23 nt, Homo sapiens
gcaacacaggauggucucugcca

SEQ ID NO: 1912413 - RNA, 14 nt, Homo sapiens
agagcucuucagag

SEQ ID NO: 1912414 - RNA, 19 nt, Homo sapiens
agcaaauuagaaacaccau

SEQ ID NO: 1912415 - RNA, 12 nt, Homo sapiens
ccaccugcugag

SEQ ID NO: 1912416 - RNA, 17 nt, Homo sapiens
uuuuccccuugccuuau

SEQ ID NO: 1912417 - RNA, 17 nt, Homo sapiens
ggcacccaccacaucug

SEQ ID NO: 1912418 - RNA, 17 nt, Homo sapiens
cagaaggaaucuucuca

SEQ ID NO: 1912419 - RNA, 22 nt, Homo sapiens
aucccgucuucuccaacaccac

SEQ ID NO: 1912420 - RNA, 14 nt, Homo sapiens
auccuuccacggac

SEQ ID NO: 1912421 - RNA, 21 nt, Homo sapiens
guacaugggugacuaucuccc

SEQ ID NO: 1912422 - RNA, 21 nt, Homo sapiens
ugugaaaauauacuugacucu

SEQ ID NO: 1912423 - RNA, 18 nt, Homo sapiens
uggaugcgacccaagacc

SEQ ID NO: 1912424 - RNA, 17 nt, Homo sapiens
cuggccuugugucacug

SEQ ID NO: 1912425 - RNA, 21 nt, Homo sapiens
aaaggagggguacauugguaa

SEQ ID NO: 1912426 - RNA, 14 nt, Homo sapiens
cggcuugauuuccg

SEQ ID NO: 1912427 - RNA, 22 nt, Homo sapiens
aacauacaaaugcaucuuugau

SEQ ID NO: 1912428 - RNA, 22 nt, Homo sapiens
uggccaguuuucugguaggaag

SEQ ID NO: 1912429 - RNA, 15 nt, Homo sapiens
gcauucuuugcaaua

SEQ ID NO: 1912430 - RNA, 15 nt, Homo sapiens
gcugucuacuggaca

SEQ ID NO: 1912431 - RNA, 16 nt, Homo sapiens
gcuagcaacacccaaa

SEQ ID NO: 1912432 - RNA, 16 nt, Homo sapiens
uggaccgagguuccca

SEQ ID NO: 1912433 - RNA, 15 nt, Homo sapiens
cuccagaugagagua

SEQ ID NO: 1912434 - RNA, 14 nt, Homo sapiens
ggucagaacauguu

SEQ ID NO: 1912435 - RNA, 16 nt, Homo sapiens
gcugcugaccagcacu

SEQ ID NO: 1912436 - RNA, 15 nt, Homo sapiens
uugccuugggcugcu

SEQ ID NO: 1912437 - RNA, 17 nt, Homo sapiens
agacucgccaacauggu

SEQ ID NO: 1912438 - RNA, 16 nt, Homo sapiens
uuucaaagccauuuua

SEQ ID NO: 1912439 - RNA, 21 nt, Homo sapiens
uaugaacgcacaacaugcaca

SEQ ID NO: 1912440 - RNA, 18 nt, Homo sapiens
gaacaccagcagcacugg

SEQ ID NO: 1912441 - RNA, 21 nt, Homo sapiens
agccacagggagccacacaga

SEQ ID NO: 1912442 - RNA, 16 nt, Homo sapiens
ggucugcucuuucucu

SEQ ID NO: 1912443 - RNA, 21 nt, Homo sapiens
ugauuuucucuggcagcauaa

SEQ ID NO: 1912444 - RNA, 18 nt, Homo sapiens
uauauaacuuauuugccc

SEQ ID NO: 1912445 - RNA, 16 nt, Homo sapiens
cuuguauuuuccauac

SEQ ID NO: 1912446 - RNA, 20 nt, Homo sapiens
acaucagagugacauccagg

SEQ ID NO: 1912447 - RNA, 14 nt, Homo sapiens
cccaacgaaaagca

SEQ ID NO: 1912448 - RNA, 21 nt, Homo sapiens
agggcauucgggccacagggc

SEQ ID NO: 1912449 - RNA, 20 nt, Homo sapiens
uaucacagcuuucaaaagca

SEQ ID NO: 1912450 - RNA, 19 nt, Homo sapiens
cacugcugugagugcgccu

SEQ ID NO: 1912451 - RNA, 14 nt, Homo sapiens
ucuuuguucaagau

SEQ ID NO: 1912452 - RNA, 19 nt, Homo sapiens
cuaaggggcaacaaaugca

SEQ ID NO: 1912453 - RNA, 20 nt, Homo sapiens
cagaaaacacagccugugua

SEQ ID NO: 1912454 - RNA, 18 nt, Homo sapiens
ugugcuaucacaggguca

SEQ ID NO: 1912455 - RNA, 17 nt, Homo sapiens
augucuggagaauaauu

SEQ ID NO: 1912456 - RNA, 17 nt, Homo sapiens
aggcacugccugaugga

SEQ ID NO: 1912457 - RNA, 14 nt, Homo sapiens
uguauacaccaagu

SEQ ID NO: 1912458 - RNA, 17 nt, Homo sapiens
uacgugacuguggcaca

SEQ ID NO: 1912459 - RNA, 19 nt, Homo sapiens
gccgaagaauugucuugca

SEQ ID NO: 1912460 - RNA, 23 nt, Homo sapiens
agggcccucccagcccauugcug

SEQ ID NO: 1912461 - RNA, 17 nt, Homo sapiens
cuuccuccuaccugggg

SEQ ID NO: 1912462 - RNA, 14 nt, Homo sapiens
cacacacauggaaa

SEQ ID NO: 1912463 - RNA, 17 nt, Homo sapiens
agccgccccaucugccc

SEQ ID NO: 1912464 - RNA, 23 nt, Homo sapiens
uccagcuggaagggucaacaucu

SEQ ID NO: 1912465 - RNA, 22 nt, Homo sapiens
cccuucaaccauuccccauggg

SEQ ID NO: 1912466 - RNA, 15 nt, Homo sapiens
cuacacauguaaaau

SEQ ID NO: 1912467 - RNA, 18 nt, Homo sapiens
accugcaaguauccagac

SEQ ID NO: 1912468 - RNA, 20 nt, Homo sapiens
caacugaaaagacucagugu

SEQ ID NO: 1912469 - RNA, 16 nt, Homo sapiens
acuaucugauuuccua

SEQ ID NO: 1912470 - RNA, 12 nt, Homo sapiens
aguucaagagaa

SEQ ID NO: 1912471 - RNA, 16 nt, Homo sapiens
ucugagaaaguacaaa

SEQ ID NO: 1912472 - RNA, 16 nt, Homo sapiens
agagacaauacaguaa

SEQ ID NO: 1912473 - RNA, 21 nt, Homo sapiens
cuuccauaauuaugacaguua

SEQ ID NO: 1912474 - RNA, 20 nt, Homo sapiens
caaucccacguacuuauaaa

SEQ ID NO: 1912475 - RNA, 20 nt, Homo sapiens
gcacccaacuacugagcuga

SEQ ID NO: 1912476 - RNA, 19 nt, Homo sapiens
cacaaggucuuuaaaguga

SEQ ID NO: 1912477 - RNA, 13 nt, Homo sapiens
cuccagcccauug

SEQ ID NO: 1912478 - RNA, 15 nt, Homo sapiens
uauuuuuucuugcau

SEQ ID NO: 1912479 - RNA, 15 nt, Homo sapiens
agaagccuucuugcu

SEQ ID NO: 1912480 - RNA, 18 nt, Homo sapiens
gguuuuauaaaagccuug

SEQ ID NO: 1912481 - RNA, 19 nt, Homo sapiens
aacuuaacuguucuuugcc

SEQ ID NO: 1912482 - RNA, 14 nt, Homo sapiens
ugaacauaaaucag

SEQ ID NO: 1912483 - RNA, 21 nt, Homo sapiens
auuuuuuacagcugccugcag

SEQ ID NO: 1912484 - RNA, 19 nt, Homo sapiens
uguccugcuuauucuuuug

SEQ ID NO: 1912485 - RNA, 14 nt, Homo sapiens
aaaaguguuaggga

SEQ ID NO: 1912486 - RNA, 16 nt, Homo sapiens
cccuguucuaaggggg

SEQ ID NO: 1912487 - RNA, 16 nt, Homo sapiens
caggauuuaaguuuca

SEQ ID NO: 1912488 - RNA, 14 nt, Homo sapiens
caugugcauauaaa

SEQ ID NO: 1912489 - RNA, 16 nt, Homo sapiens
cacuuugggacuuggg

SEQ ID NO: 1912490 - RNA, 13 nt, Homo sapiens
uggauugugaaau

SEQ ID NO: 1912491 - RNA, 16 nt, Homo sapiens
cugcccugacaugcac

SEQ ID NO: 1912492 - RNA, 12 nt, Homo sapiens
augauuucacag

SEQ ID NO: 1912493 - RNA, 20 nt, Homo sapiens
agagaugacaaggagcacaa

SEQ ID NO: 1912494 - RNA, 14 nt, Homo sapiens
gauaugcacacaca

SEQ ID NO: 1912495 - RNA, 14 nt, Homo sapiens
gagugcucuugcua

SEQ ID NO: 1912496 - RNA, 16 nt, Homo sapiens
gugcgugagcugguca

SEQ ID NO: 1912497 - RNA, 21 nt, Homo sapiens
aaauguuuucauuuacaggaa

SEQ ID NO: 1912498 - RNA, 15 nt, Homo sapiens
agcagcccuggcucu

SEQ ID NO: 1912499 - RNA, 18 nt, Homo sapiens
gcuauuuugugaagccau

SEQ ID NO: 1912500 - RNA, 22 nt, Homo sapiens
uaaauguuaugacuccuugaua

SEQ ID NO: 1912501 - RNA, 16 nt, Homo sapiens
gaggagccaccaguuc

SEQ ID NO: 1912502 - RNA, 23 nt, Homo sapiens
ggaggucuccccugauccagaca

SEQ ID NO: 1912503 - RNA, 16 nt, Homo sapiens
uuuccgagccuccagu

SEQ ID NO: 1912504 - RNA, 13 nt, Homo sapiens
gcaccugcgcaca

SEQ ID NO: 1912505 - RNA, 20 nt, Homo sapiens
agaagaaccauuuacaugca

SEQ ID NO: 1912506 - RNA, 15 nt, Homo sapiens
cuggaugacauuaaa

SEQ ID NO: 1912507 - RNA, 13 nt, Homo sapiens
cuuucugccuuua

SEQ ID NO: 1912508 - RNA, 23 nt, Homo sapiens
caaaaugucucaauggugcuaua

SEQ ID NO: 1912509 - RNA, 14 nt, Homo sapiens
gagcuagcccaguc

SEQ ID NO: 1912510 - RNA, 21 nt, Homo sapiens
caucauaagcugauuugauac

SEQ ID NO: 1912511 - RNA, 16 nt, Homo sapiens
cuagcuagcuguguua

SEQ ID NO: 1912512 - RNA, 16 nt, Homo sapiens
agccaucaagagacug

SEQ ID NO: 1912513 - RNA, 19 nt, Homo sapiens
agcacugacugaacuguaa

SEQ ID NO: 1912514 - RNA, 21 nt, Homo sapiens
cugcuuggguggagaagccau

SEQ ID NO: 1912515 - RNA, 20 nt, Homo sapiens
cagagaggcacgugccuguc

SEQ ID NO: 1912516 - RNA, 16 nt, Homo sapiens
ugagccaguggugcua

SEQ ID NO: 1912517 - RNA, 22 nt, Homo sapiens
gcauggucgggggagagggcca

SEQ ID NO: 1912518 - RNA, 17 nt, Homo sapiens
cuguagccaggaaaccc

SEQ ID NO: 1912519 - RNA, 22 nt, Homo sapiens
ugacggcugcucgaagaacaau

SEQ ID NO: 1912520 - RNA, 14 nt, Homo sapiens
uauacuuaaucuca

SEQ ID NO: 1912521 - RNA, 13 nt, Homo sapiens
ugcaucuuccagu

SEQ ID NO: 1912522 - RNA, 22 nt, Homo sapiens
ugcagcuacccaggcccaccca

SEQ ID NO: 1912523 - RNA, 20 nt, Homo sapiens
agcacacaauaagcauucaa

SEQ ID NO: 1912524 - RNA, 20 nt, Homo sapiens
uuaguggcucaacauugugu

SEQ ID NO: 1912525 - RNA, 14 nt, Homo sapiens
uuguguugucacua

SEQ ID NO: 1912526 - RNA, 16 nt, Homo sapiens
uuuuguugacauuagu

SEQ ID NO: 1912527 - RNA, 18 nt, Homo sapiens
uguccuucaccuuuccca

SEQ ID NO: 1912528 - RNA, 21 nt, Homo sapiens
aaauacagcuggauuggguua

SEQ ID NO: 1912529 - RNA, 17 nt, Homo sapiens
cuuugcuaguaccaaaa

SEQ ID NO: 1912530 - RNA, 22 nt, Homo sapiens
cucaguguuucauauucaugca

SEQ ID NO: 1912531 - RNA, 16 nt, Homo sapiens
cuuauuuuucuacuug

SEQ ID NO: 1912532 - RNA, 10 nt, Homo sapiens
uaaugcucua

SEQ ID NO: 1912533 - RNA, 13 nt, Homo sapiens
gggccuccagaga

SEQ ID NO: 1912534 - RNA, 15 nt, Homo sapiens
guuuuccaacuuaau

SEQ ID NO: 1912535 - RNA, 21 nt, Homo sapiens
agacauggaugaucugggaga

SEQ ID NO: 1912536 - RNA, 14 nt, Homo sapiens
uaaguaauuuugcc

SEQ ID NO: 1912537 - RNA, 20 nt, Homo sapiens
aggcacuguucaauacugua

SEQ ID NO: 1912538 - RNA, 22 nt, Homo sapiens
cuggauuguguuugugccauau

SEQ ID NO: 1912539 - RNA, 11 nt, Homo sapiens
ugccagugaaa

SEQ ID NO: 1912540 - RNA, 18 nt, Homo sapiens
guuguacuguaugcaguu

SEQ ID NO: 1912541 - RNA, 15 nt, Homo sapiens
auuuuccucucucac

SEQ ID NO: 1912542 - RNA, 22 nt, Homo sapiens
cuaauagacuuagccccaugag

SEQ ID NO: 1912543 - RNA, 16 nt, Homo sapiens
uuccauuuccguucca

SEQ ID NO: 1912544 - RNA, 19 nt, Homo sapiens
uggccaugcuucuugcccc

SEQ ID NO: 1912545 - RNA, 16 nt, Homo sapiens
guggucugagcugucc

SEQ ID NO: 1912546 - RNA, 18 nt, Homo sapiens
uucaaguuaauucucaga

SEQ ID NO: 1912547 - RNA, 19 nt, Homo sapiens
acauaaguaagacuugauu

SEQ ID NO: 1912548 - RNA, 16 nt, Homo sapiens
uagcuuagaccucagc

SEQ ID NO: 1912549 - RNA, 15 nt, Homo sapiens
uuacuccagugccaa

SEQ ID NO: 1912550 - RNA, 13 nt, Homo sapiens
ucaguccuaagaa

SEQ ID NO: 1912551 - RNA, 16 nt, Homo sapiens
aagcaaacaaacucaa

SEQ ID NO: 1912552 - RNA, 15 nt, Homo sapiens
ugaaaacagugauuu

SEQ ID NO: 1912553 - RNA, 23 nt, Homo sapiens
agccaggcugagugagccacaga

SEQ ID NO: 1912554 - RNA, 20 nt, Homo sapiens
ugccaacagacacuacauua

SEQ ID NO: 1912555 - RNA, 12 nt, Homo sapiens
uuccauuuugcc

SEQ ID NO: 1912556 - RNA, 17 nt, Homo sapiens
gcaccaaagacaucagu

SEQ ID NO: 1912557 - RNA, 17 nt, Homo sapiens
uaagaacaaaacuguaa

SEQ ID NO: 1912558 - RNA, 14 nt, Homo sapiens
uuauggugcauuac

SEQ ID NO: 1912559 - RNA, 19 nt, Homo sapiens
caggagcgcagcugcauuu

SEQ ID NO: 1912560 - RNA, 17 nt, Homo sapiens
uuaacuaugaacugaag

SEQ ID NO: 1912561 - RNA, 20 nt, Homo sapiens
aauuccacuuguucauucug

SEQ ID NO: 1912562 - RNA, 21 nt, Homo sapiens
ccucugucggcuuuuugccau

SEQ ID NO: 1912563 - RNA, 14 nt, Homo sapiens
auuaucuccaugau

SEQ ID NO: 1912564 - RNA, 19 nt, Homo sapiens
gauuugauaccauggcacu

SEQ ID NO: 1912565 - RNA, 23 nt, Homo sapiens
agaugguucccaauaucauguga

SEQ ID NO: 1912566 - RNA, 20 nt, Homo sapiens
ggcgaggccucucucaggag

SEQ ID NO: 1912567 - RNA, 18 nt, Homo sapiens
auguuuaaauagccuaaa

SEQ ID NO: 1912568 - RNA, 13 nt, Homo sapiens
uauaacuguuguc

SEQ ID NO: 1912569 - RNA, 22 nt, Homo sapiens
ucauugcaccuaucucagccau

SEQ ID NO: 1912570 - RNA, 20 nt, Homo sapiens
cauuuagcgaacaaccacag

SEQ ID NO: 1912571 - RNA, 18 nt, Homo sapiens
cuguagccuggucugugc

SEQ ID NO: 1912572 - RNA, 17 nt, Homo sapiens
gcagaugccagcgccau

SEQ ID NO: 1912573 - RNA, 11 nt, Homo sapiens
auauacuuugg

SEQ ID NO: 1912574 - RNA, 15 nt, Homo sapiens
aggacuggcuuuguc

SEQ ID NO: 1912575 - RNA, 18 nt, Homo sapiens
agaagacuauuugccaug

SEQ ID NO: 1912576 - RNA, 16 nt, Homo sapiens
caaagaugugcaaaga

SEQ ID NO: 1912577 - RNA, 19 nt, Homo sapiens
uuaccuguuuuucaguauu

SEQ ID NO: 1912578 - RNA, 21 nt, Homo sapiens
uuggcuaaaagacaugcauuu

SEQ ID NO: 1912579 - RNA, 22 nt, Homo sapiens
aaugaguuaccucaugccgcug

SEQ ID NO: 1912580 - RNA, 16 nt, Homo sapiens
caccacaccuggcuaa

SEQ ID NO: 1912581 - RNA, 12 nt, Homo sapiens
uagguagccuug

SEQ ID NO: 1912582 - RNA, 20 nt, Homo sapiens
ugaaagccucacguauuuca

SEQ ID NO: 1912583 - RNA, 16 nt, Homo sapiens
uuaaaacacauaucaa

SEQ ID NO: 1912584 - RNA, 19 nt, Homo sapiens
aggugucccaagcuuugaa

SEQ ID NO: 1912585 - RNA, 14 nt, Homo sapiens
gaaaacuuaguuug

SEQ ID NO: 1912586 - RNA, 18 nt, Homo sapiens
cuaaggaagauuacucag

SEQ ID NO: 1912587 - RNA, 16 nt, Homo sapiens
agauaucaucuaccua

SEQ ID NO: 1912588 - RNA, 15 nt, Homo sapiens
uggcugcaagcccac

SEQ ID NO: 1912589 - RNA, 22 nt, Homo sapiens
gcuguguccacggggugucaca

SEQ ID NO: 1912590 - RNA, 11 nt, Homo sapiens
acaacuuccuc

SEQ ID NO: 1912591 - RNA, 19 nt, Homo sapiens
auucaucaaacucuuugcc

SEQ ID NO: 1912592 - RNA, 18 nt, Homo sapiens
aauggggggcgggccagg

SEQ ID NO: 1912593 - RNA, 15 nt, Homo sapiens
ccuguugaaaagcca

SEQ ID NO: 1912594 - RNA, 17 nt, Homo sapiens
gaggcauacacacagca

SEQ ID NO: 1912595 - RNA, 15 nt, Homo sapiens
aggagccaccugggc

SEQ ID NO: 1912596 - RNA, 23 nt, Homo sapiens
acucuguccuggaggcacuggga

SEQ ID NO: 1912597 - RNA, 17 nt, Homo sapiens
accucccauccuaauca

SEQ ID NO: 1912598 - RNA, 13 nt, Homo sapiens
guauuuagaucuc

SEQ ID NO: 1912599 - RNA, 14 nt, Homo sapiens
ggccucccaaaaga

SEQ ID NO: 1912600 - RNA, 12 nt, Homo sapiens
cagaugaucucu

SEQ ID NO: 1912601 - RNA, 21 nt, Homo sapiens
agcucacaguacaauguuuca

SEQ ID NO: 1912602 - RNA, 23 nt, Homo sapiens
ugccuggccaugcugucccugca

SEQ ID NO: 1912603 - RNA, 17 nt, Homo sapiens
aguaucacugucuuucc

SEQ ID NO: 1912604 - RNA, 20 nt, Homo sapiens
cuggagugcaauggcgcgau

SEQ ID NO: 1912605 - RNA, 22 nt, Homo sapiens
cuguugacaauuugccauagca

SEQ ID NO: 1912606 - RNA, 14 nt, Homo sapiens
aagaggugacccca

SEQ ID NO: 1912607 - RNA, 15 nt, Homo sapiens
uggcuggcucugcac

SEQ ID NO: 1912608 - RNA, 18 nt, Homo sapiens
ugcccaauuucauaacua

SEQ ID NO: 1912609 - RNA, 14 nt, Homo sapiens
uuuuggaaauucag

SEQ ID NO: 1912610 - RNA, 21 nt, Homo sapiens
augcagaaauauuugugacaa

SEQ ID NO: 1912611 - RNA, 18 nt, Homo sapiens
ugggaaauaagcaaaaaa

SEQ ID NO: 1912612 - RNA, 16 nt, Homo sapiens
gcucucccaacucuug

SEQ ID NO: 1912613 - RNA, 19 nt, Homo sapiens
aucaacuuccuaaauauua

SEQ ID NO: 1912614 - RNA, 20 nt, Homo sapiens
uacacacccauagugcacac

SEQ ID NO: 1912615 - RNA, 17 nt, Homo sapiens
augugauuuaugcauuu

SEQ ID NO: 1912616 - RNA, 11 nt, Homo sapiens
ccaauccagcc

SEQ ID NO: 1912617 - RNA, 22 nt, Homo sapiens
ccuuguugguggagaguggaag

SEQ ID NO: 1912618 - RNA, 14 nt, Homo sapiens
acgugcucccucag

SEQ ID NO: 1912619 - RNA, 23 nt, Homo sapiens
cuccuguguucuggacuugcaga

SEQ ID NO: 1912620 - RNA, 16 nt, Homo sapiens
cuuuaaacaugauuau

SEQ ID NO: 1912621 - RNA, 20 nt, Homo sapiens
aucaugguauucuucugaca

SEQ ID NO: 1912622 - RNA, 20 nt, Homo sapiens
gagaauguguuucaaaacca

SEQ ID NO: 1912623 - RNA, 18 nt, Homo sapiens
uugcccugaggcucaguc

SEQ ID NO: 1912624 - RNA, 17 nt, Homo sapiens
uaugcgcaauguggcau

SEQ ID NO: 1912625 - RNA, 17 nt, Homo sapiens
ugaguagcucuccugac

SEQ ID NO: 1912626 - RNA, 17 nt, Homo sapiens
uugaccaaccccagcaa

SEQ ID NO: 1912627 - RNA, 15 nt, Homo sapiens
ucuuggcucacugca

SEQ ID NO: 1912628 - RNA, 16 nt, Homo sapiens
agcgagcugcucugcu

SEQ ID NO: 1912629 - RNA, 14 nt, Homo sapiens
ucugagcucugcau

SEQ ID NO: 1912630 - RNA, 12 nt, Homo sapiens
ugccagcuuccu

SEQ ID NO: 1912631 - RNA, 16 nt, Homo sapiens
guaccaccaugcacug

SEQ ID NO: 1912632 - RNA, 19 nt, Homo sapiens
aucgagaccauccuggcua

SEQ ID NO: 1912633 - RNA, 15 nt, Homo sapiens
auaaauaugucagau

SEQ ID NO: 1912634 - RNA, 17 nt, Homo sapiens
augcucuccaaaccacu

SEQ ID NO: 1912635 - RNA, 9 nt, Homo sapiens
caucucuag

SEQ ID NO: 1912636 - RNA, 22 nt, Homo sapiens
gacaccagagcagaugcagaga

SEQ ID NO: 1912637 - RNA, 13 nt, Homo sapiens
uaaggucauagau

SEQ ID NO: 1912638 - RNA, 13 nt, Homo sapiens
cagagucacaagu

SEQ ID NO: 1912639 - RNA, 20 nt, Homo sapiens
cccucaacugacaugaaaua

SEQ ID NO: 1912640 - RNA, 17 nt, Homo sapiens
aacagucaccacugugc

SEQ ID NO: 1912641 - RNA, 15 nt, Homo sapiens
uuugagcacacauuu

SEQ ID NO: 1912642 - RNA, 16 nt, Homo sapiens
uaagccugagccuuag

SEQ ID NO: 1912643 - RNA, 16 nt, Homo sapiens
uugcagaaauacagua

SEQ ID NO: 1912644 - RNA, 14 nt, Homo sapiens
ugcuggaggggcug

SEQ ID NO: 1912645 - RNA, 18 nt, Homo sapiens
gcacagacccugcccugu

SEQ ID NO: 1912646 - RNA, 18 nt, Homo sapiens
ggccccucacccaccaug

SEQ ID NO: 1912647 - RNA, 16 nt, Homo sapiens
ugcuuuucauguagaa

SEQ ID NO: 1912648 - RNA, 12 nt, Homo sapiens
ucuccacgcacu

SEQ ID NO: 1912649 - RNA, 20 nt, Homo sapiens
uggacgaccuccagcucuca

SEQ ID NO: 1912650 - RNA, 19 nt, Homo sapiens
auacggcuuuuccaaugau

SEQ ID NO: 1912651 - RNA, 23 nt, Homo sapiens
auguuucccuacuaacaucccaa

SEQ ID NO: 1912652 - RNA, 12 nt, Homo sapiens
uucuacaguaca

SEQ ID NO: 1912653 - RNA, 13 nt, Homo sapiens
uuccacuucuucc

SEQ ID NO: 1912654 - RNA, 23 nt, Homo sapiens
uggaaacuaguggcaauauccaa

SEQ ID NO: 1912655 - RNA, 16 nt, Homo sapiens
uacaggugacugccac

SEQ ID NO: 1912656 - RNA, 18 nt, Homo sapiens
acucccaucugauuuacu

SEQ ID NO: 1912657 - RNA, 19 nt, Homo sapiens
gaaaauauacuugacucua

SEQ ID NO: 1912658 - RNA, 16 nt, Homo sapiens
ugcggugacaaauggc

SEQ ID NO: 1912659 - RNA, 15 nt, Homo sapiens
aucaguaaauaccuu

SEQ ID NO: 1912660 - RNA, 15 nt, Homo sapiens
accacuaauagcauu

SEQ ID NO: 1912661 - RNA, 18 nt, Homo sapiens
ugggacuucagcucagag

SEQ ID NO: 1912662 - RNA, 24 nt, Homo sapiens
cucugcugccgccccacccagaug

SEQ ID NO: 1912663 - RNA, 12 nt, Homo sapiens
uucccacacugu

SEQ ID NO: 1912664 - RNA, 11 nt, Homo sapiens
aaaaguuauuu

SEQ ID NO: 1912665 - RNA, 17 nt, Homo sapiens
ugacaaaccauaacuga

SEQ ID NO: 1912666 - RNA, 14 nt, Homo sapiens
ccuagaagaagcua

SEQ ID NO: 1912667 - RNA, 20 nt, Homo sapiens
agcccuccucucccagugac

SEQ ID NO: 1912668 - RNA, 16 nt, Homo sapiens
ucuuucagauuucuau

SEQ ID NO: 1912669 - RNA, 20 nt, Homo sapiens
agacuuuuugguggauguaa

SEQ ID NO: 1912670 - RNA, 13 nt, Homo sapiens
cccaaugcugcuu

SEQ ID NO: 1912671 - RNA, 14 nt, Homo sapiens
uugagaaccugugc

SEQ ID NO: 1912672 - RNA, 15 nt, Homo sapiens
cagcucacgucacac

SEQ ID NO: 1912673 - RNA, 11 nt, Homo sapiens
cuaacuguaaa

SEQ ID NO: 1912674 - RNA, 12 nt, Homo sapiens
uugaccaaauaa

SEQ ID NO: 1912675 - RNA, 19 nt, Homo sapiens
accuucccagcaguuugcu

SEQ ID NO: 1912676 - RNA, 17 nt, Homo sapiens
guaugcuucuuuauaca

SEQ ID NO: 1912677 - RNA, 15 nt, Homo sapiens
uuaaaauaacuaagc

SEQ ID NO: 1912678 - RNA, 16 nt, Homo sapiens
ugugaugcauguagua

SEQ ID NO: 1912679 - RNA, 19 nt, Homo sapiens
aacguugauguaaugaaau

SEQ ID NO: 1912680 - RNA, 13 nt, Homo sapiens
augucaucaugcu

SEQ ID NO: 1912681 - RNA, 21 nt, Homo sapiens
uuucaaaagcggggcuucauc

SEQ ID NO: 1912682 - RNA, 17 nt, Homo sapiens
cugaccagagaaugcac

SEQ ID NO: 1912683 - RNA, 15 nt, Homo sapiens
ccacagaaauacaug

SEQ ID NO: 1912684 - RNA, 18 nt, Homo sapiens
acuucccgacucuacaau

SEQ ID NO: 1912685 - RNA, 17 nt, Homo sapiens
gagaaggagaucagggc

SEQ ID NO: 1912686 - RNA, 16 nt, Homo sapiens
uauuaaguauuuugcu

SEQ ID NO: 1912687 - RNA, 23 nt, Homo sapiens
ucgaguaacuuuaaaaaaaucau

SEQ ID NO: 1912688 - RNA, 21 nt, Homo sapiens
guccuucucucaccuccuaaa

SEQ ID NO: 1912689 - RNA, 16 nt, Homo sapiens
cuuagggacagaauua

SEQ ID NO: 1912690 - RNA, 19 nt, Homo sapiens
ugacuugacagaacacugu

SEQ ID NO: 1912691 - RNA, 22 nt, Homo sapiens
gauuuugaaauauaguaaacac

SEQ ID NO: 1912692 - RNA, 13 nt, Homo sapiens
cggggcugucacc

SEQ ID NO: 1912693 - RNA, 19 nt, Homo sapiens
aaugccaaugaacaucuca

SEQ ID NO: 1912694 - RNA, 22 nt, Homo sapiens
caaucccugaggacugauuuca

SEQ ID NO: 1912695 - RNA, 16 nt, Homo sapiens
aaagcaggacugugcc

SEQ ID NO: 1912696 - RNA, 18 nt, Homo sapiens
uuaauccuguaccaaauc

SEQ ID NO: 1912697 - RNA, 18 nt, Homo sapiens
aacauugcuuuagacaaa

SEQ ID NO: 1912698 - RNA, 14 nt, Homo sapiens
gagcugagcacuuu

SEQ ID NO: 1912699 - RNA, 21 nt, Homo sapiens
cggauaguaagaaaacaaaca

SEQ ID NO: 1912700 - RNA, 15 nt, Homo sapiens
aggacaaucuagcuc

SEQ ID NO: 1912701 - RNA, 18 nt, Homo sapiens
cagccauaagaaagcacu

SEQ ID NO: 1912702 - RNA, 21 nt, Homo sapiens
ucuccauugcauucauguacu

SEQ ID NO: 1912703 - RNA, 16 nt, Homo sapiens
auggcaggacagcucc

SEQ ID NO: 1912704 - RNA, 18 nt, Homo sapiens
auaucucaaugugcaaua

SEQ ID NO: 1912705 - RNA, 19 nt, Homo sapiens
cagaaaugccuuacccuca

SEQ ID NO: 1912706 - RNA, 22 nt, Homo sapiens
acuuucugauuacuguccagcu

SEQ ID NO: 1912707 - RNA, 22 nt, Homo sapiens
acugaggaaugcgguucagggc

SEQ ID NO: 1912708 - RNA, 16 nt, Homo sapiens
auauguucaacuggag

SEQ ID NO: 1912709 - RNA, 12 nt, Homo sapiens
uccccugucagu

SEQ ID NO: 1912710 - RNA, 14 nt, Homo sapiens
uaauuuuucaccuu

SEQ ID NO: 1912711 - RNA, 17 nt, Homo sapiens
uuauuacauggggucua

SEQ ID NO: 1912712 - RNA, 21 nt, Homo sapiens
ugugaaaaagaugguguuugg

SEQ ID NO: 1912713 - RNA, 12 nt, Homo sapiens
guuugcauuucc

SEQ ID NO: 1912714 - RNA, 16 nt, Homo sapiens
gagaauaggggagcca

SEQ ID NO: 1912715 - RNA, 13 nt, Homo sapiens
gauuucauuacau

SEQ ID NO: 1912716 - RNA, 20 nt, Homo sapiens
uuccagaaaacaaaacugca

SEQ ID NO: 1912717 - RNA, 14 nt, Homo sapiens
ucagcccaugcuua

SEQ ID NO: 1912718 - RNA, 13 nt, Homo sapiens
auggcuguugaag

SEQ ID NO: 1912719 - RNA, 22 nt, Homo sapiens
caacucuguaaauauguaugua

SEQ ID NO: 1912720 - RNA, 17 nt, Homo sapiens
agauguggacaugcacc

SEQ ID NO: 1912721 - RNA, 17 nt, Homo sapiens
ucucuaacaguggacaa

SEQ ID NO: 1912722 - RNA, 18 nt, Homo sapiens
cuccccucgcccaucagu

SEQ ID NO: 1912723 - RNA, 13 nt, Homo sapiens
cagccucuucucu

SEQ ID NO: 1912724 - RNA, 21 nt, Homo sapiens
aauaaucccaaggcaaaucuc

SEQ ID NO: 1912725 - RNA, 20 nt, Homo sapiens
uaaugaaauuuacagugaua

SEQ ID NO: 1912726 - RNA, 14 nt, Homo sapiens
aagaagaaucucau

SEQ ID NO: 1912727 - RNA, 13 nt, Homo sapiens
aguuugucaggca

SEQ ID NO: 1912728 - RNA, 22 nt, Homo sapiens
uuauugcaugagaagccauaca

SEQ ID NO: 1912729 - RNA, 14 nt, Homo sapiens
ugccaggacuguga

SEQ ID NO: 1912730 - RNA, 17 nt, Homo sapiens
gccagccagcauggcca

SEQ ID NO: 1912731 - RNA, 22 nt, Homo sapiens
auuuuuccuuccuuccuuccau

SEQ ID NO: 1912732 - RNA, 16 nt, Homo sapiens
acaguuuuauacccuu

SEQ ID NO: 1912733 - RNA, 12 nt, Homo sapiens
acaaaucuucac

SEQ ID NO: 1912734 - RNA, 15 nt, Homo sapiens
uggauuauguugaca

SEQ ID NO: 1912735 - RNA, 17 nt, Homo sapiens
ucucagcgccgucgcca

SEQ ID NO: 1912736 - RNA, 20 nt, Homo sapiens
ugaaauuauagaaauuuacu

SEQ ID NO: 1912737 - RNA, 19 nt, Homo sapiens
ccacacugaaaccaaaaca

SEQ ID NO: 1912738 - RNA, 17 nt, Homo sapiens
ccacaaaucaguauaug

SEQ ID NO: 1912739 - RNA, 14 nt, Homo sapiens
cugccauaaagcca

SEQ ID NO: 1912740 - RNA, 14 nt, Homo sapiens
aagcacuacugcac

SEQ ID NO: 1912741 - RNA, 14 nt, Homo sapiens
aauaauuacuuaau

SEQ ID NO: 1912742 - RNA, 18 nt, Homo sapiens
cucagcugcucgcacaga

SEQ ID NO: 1912743 - RNA, 13 nt, Homo sapiens
acaugcauucaca

SEQ ID NO: 1912744 - RNA, 19 nt, Homo sapiens
gucaguggcuuugcauagc

SEQ ID NO: 1912745 - RNA, 16 nt, Homo sapiens
acuguaugugccaaag

SEQ ID NO: 1912746 - RNA, 22 nt, Homo sapiens
gucccgaggaugcugucaggag

SEQ ID NO: 1912747 - RNA, 15 nt, Homo sapiens
uacuugacccaugcc

SEQ ID NO: 1912748 - RNA, 23 nt, Homo sapiens
ugacaacgucucuucaagcaucc

SEQ ID NO: 1912749 - RNA, 16 nt, Homo sapiens
ugcuaaggcagcugau

SEQ ID NO: 1912750 - RNA, 16 nt, Homo sapiens
uuaguuccccuacuac

SEQ ID NO: 1912751 - RNA, 17 nt, Homo sapiens
aucccgagcaacccucu

SEQ ID NO: 1912752 - RNA, 16 nt, Homo sapiens
auacgagccuucucac

SEQ ID NO: 1912753 - RNA, 16 nt, Homo sapiens
caagaggucuccauca

SEQ ID NO: 1912754 - RNA, 15 nt, Homo sapiens
aauucuuuugccaag

SEQ ID NO: 1912755 - RNA, 14 nt, Homo sapiens
cuguccauucuucc

SEQ ID NO: 1912756 - RNA, 20 nt, Homo sapiens
ugaugugugaaaccugacac

SEQ ID NO: 1912757 - RNA, 15 nt, Homo sapiens
auaaauuuuccauuu

SEQ ID NO: 1912758 - RNA, 20 nt, Homo sapiens
ggcccuggggaucuucccac

SEQ ID NO: 1912759 - RNA, 14 nt, Homo sapiens
aacagugcuguucu

SEQ ID NO: 1912760 - RNA, 19 nt, Homo sapiens
acagacagggccuagcuuu

SEQ ID NO: 1912761 - RNA, 18 nt, Homo sapiens
uauuuauuacuugugcac

SEQ ID NO: 1912762 - RNA, 22 nt, Homo sapiens
cccagcaagaugaaacagggca

SEQ ID NO: 1912763 - RNA, 19 nt, Homo sapiens
aucuauaauuuaccuaaga

SEQ ID NO: 1912764 - RNA, 19 nt, Homo sapiens
uguggccaugguccccaag

SEQ ID NO: 1912765 - RNA, 17 nt, Homo sapiens
cacaggccuguucccuu

SEQ ID NO: 1912766 - RNA, 19 nt, Homo sapiens
caaugucaggaacagaagg

SEQ ID NO: 1912767 - RNA, 19 nt, Homo sapiens
gaagccucuauugccauga

SEQ ID NO: 1912768 - RNA, 16 nt, Homo sapiens
ccccagaaacagugug

SEQ ID NO: 1912769 - RNA, 17 nt, Homo sapiens
ccaacuccaaccucucg

SEQ ID NO: 1912770 - RNA, 13 nt, Homo sapiens
gggcacagcacag

SEQ ID NO: 1912771 - RNA, 19 nt, Homo sapiens
acuaucaccuauuacauuu

SEQ ID NO: 1912772 - RNA, 14 nt, Homo sapiens
aauacucucugaaa

SEQ ID NO: 1912773 - RNA, 22 nt, Homo sapiens
cugcugaucucaguuuccuggc

SEQ ID NO: 1912774 - RNA, 17 nt, Homo sapiens
cuccccaggcuaugcca

SEQ ID NO: 1912775 - RNA, 14 nt, Homo sapiens
cugggguuuccauc

SEQ ID NO: 1912776 - RNA, 21 nt, Homo sapiens
uuaaagacccaacuugccaaa

SEQ ID NO: 1912777 - RNA, 14 nt, Homo sapiens
gcagugaccuuccu

SEQ ID NO: 1912778 - RNA, 22 nt, Homo sapiens
ucuugaccucaggugauccacc

SEQ ID NO: 1912779 - RNA, 13 nt, Homo sapiens
cacccaugacugc

SEQ ID NO: 1912780 - RNA, 21 nt, Homo sapiens
uaauuuuccuggaaagacuga

SEQ ID NO: 1912781 - RNA, 16 nt, Homo sapiens
agcagcccuuuuuaca

SEQ ID NO: 1912782 - RNA, 21 nt, Homo sapiens
gaguuugagcugccuucccua

SEQ ID NO: 1912783 - RNA, 22 nt, Homo sapiens
gcacaagucauaccuacauuca

SEQ ID NO: 1912784 - RNA, 19 nt, Homo sapiens
uucagucuuuucucugaaa

SEQ ID NO: 1912785 - RNA, 18 nt, Homo sapiens
ucuucaucccauuccagg

SEQ ID NO: 1912786 - RNA, 15 nt, Homo sapiens
uauuugaacugguua

SEQ ID NO: 1912787 - RNA, 19 nt, Homo sapiens
aggaagaguuaugcuuuau

SEQ ID NO: 1912788 - RNA, 17 nt, Homo sapiens
uggccauccaugugaug

SEQ ID NO: 1912789 - RNA, 22 nt, Homo sapiens
ugucacccuuguccuugagugc

SEQ ID NO: 1912790 - RNA, 15 nt, Homo sapiens
ggcagaaugcuuuuu

SEQ ID NO: 1912791 - RNA, 20 nt, Homo sapiens
cagcacugaaaauaccauca

SEQ ID NO: 1912792 - RNA, 14 nt, Homo sapiens
gacaaccaccaggu

SEQ ID NO: 1912793 - RNA, 12 nt, Homo sapiens
uuucuaugcugg

SEQ ID NO: 1912794 - RNA, 16 nt, Homo sapiens
ccccugggaacaggcc

SEQ ID NO: 1912795 - RNA, 17 nt, Homo sapiens
augccuaaauauaauua

SEQ ID NO: 1912796 - RNA, 15 nt, Homo sapiens
acaagcgccaccgug

SEQ ID NO: 1912797 - RNA, 22 nt, Homo sapiens
aacucauuucaaguuaugauuc

SEQ ID NO: 1912798 - RNA, 15 nt, Homo sapiens
gacagaaguguagua

SEQ ID NO: 1912799 - RNA, 11 nt, Homo sapiens
cacuguacaag

SEQ ID NO: 1912800 - RNA, 16 nt, Homo sapiens
ugguggccaccgccag

SEQ ID NO: 1912801 - RNA, 21 nt, Homo sapiens
uccauccuuucugccucucaa

SEQ ID NO: 1912802 - RNA, 18 nt, Homo sapiens
agagaggcucauccugua

SEQ ID NO: 1912803 - RNA, 21 nt, Homo sapiens
ucccacugcccccuccacugg

SEQ ID NO: 1912804 - RNA, 14 nt, Homo sapiens
aagacaccuuccca

SEQ ID NO: 1912805 - RNA, 20 nt, Homo sapiens
ucucuuucacauuguuugcu

SEQ ID NO: 1912806 - RNA, 20 nt, Homo sapiens
cagacauacauuucucauac

SEQ ID NO: 1912807 - RNA, 14 nt, Homo sapiens
ucaaugagagccau

SEQ ID NO: 1912808 - RNA, 14 nt, Homo sapiens
auuuuucaagagau

SEQ ID NO: 1912809 - RNA, 15 nt, Homo sapiens
cucacacaugagauc

SEQ ID NO: 1912810 - RNA, 16 nt, Homo sapiens
cacugcuuaacuucac

SEQ ID NO: 1912811 - RNA, 20 nt, Homo sapiens
ucugccuccccuucacuccc

SEQ ID NO: 1912812 - RNA, 19 nt, Homo sapiens
aauugaaaaggaacuugcc

SEQ ID NO: 1912813 - RNA, 13 nt, Homo sapiens
uuauuuuugcaca

SEQ ID NO: 1912814 - RNA, 23 nt, Homo sapiens
cacugugaccugcuccugcccac

SEQ ID NO: 1912815 - RNA, 13 nt, Homo sapiens
aaauggggccaga

SEQ ID NO: 1912816 - RNA, 20 nt, Homo sapiens
acuuagaagcaucagaguug

SEQ ID NO: 1912817 - RNA, 18 nt, Homo sapiens
guaaguaaggugcaauga

SEQ ID NO: 1912818 - RNA, 12 nt, Homo sapiens
caaucucuuaaa

SEQ ID NO: 1912819 - RNA, 18 nt, Homo sapiens
augauaccauuuccugac

SEQ ID NO: 1912820 - RNA, 22 nt, Homo sapiens
aucauucccuagaacaagccac

SEQ ID NO: 1912821 - RNA, 15 nt, Homo sapiens
gcaacuuucuuacac

SEQ ID NO: 1912822 - RNA, 15 nt, Homo sapiens
cccuaauaaguccac

SEQ ID NO: 1912823 - RNA, 20 nt, Homo sapiens
aggaaaaaacuaguauuccc

SEQ ID NO: 1912824 - RNA, 16 nt, Homo sapiens
caagcaaaaugucucu

SEQ ID NO: 1912825 - RNA, 13 nt, Homo sapiens
uagugccuuccac

SEQ ID NO: 1912826 - RNA, 19 nt, Homo sapiens
uuuucaccugaaacacuuu

SEQ ID NO: 1912827 - RNA, 13 nt, Homo sapiens
ucccuuccugcuu

SEQ ID NO: 1912828 - RNA, 19 nt, Homo sapiens
ggagaccaggcuucccaaa

SEQ ID NO: 1912829 - RNA, 13 nt, Homo sapiens
uaggauuacccac

SEQ ID NO: 1912830 - RNA, 19 nt, Homo sapiens
cugggcccuugugcuccuc

SEQ ID NO: 1912831 - RNA, 20 nt, Homo sapiens
uuaagagaauguuucuuaaa

SEQ ID NO: 1912832 - RNA, 15 nt, Homo sapiens
ucauggugcacugag

SEQ ID NO: 1912833 - RNA, 16 nt, Homo sapiens
uccccucacacacaaa

SEQ ID NO: 1912834 - RNA, 20 nt, Homo sapiens
uuuccucgccuaggccugug

SEQ ID NO: 1912835 - RNA, 14 nt, Homo sapiens
cuuccggcucccuu

SEQ ID NO: 1912836 - RNA, 14 nt, Homo sapiens
cauacauacauaca

SEQ ID NO: 1912837 - RNA, 21 nt, Homo sapiens
guagcuauuuuucuuguugca

SEQ ID NO: 1912838 - RNA, 16 nt, Homo sapiens
ucuggccuguggcuaa

SEQ ID NO: 1912839 - RNA, 14 nt, Homo sapiens
augugugugccaau

SEQ ID NO: 1912840 - RNA, 16 nt, Homo sapiens
auauggcagugucuuu

SEQ ID NO: 1912841 - RNA, 22 nt, Homo sapiens
ugaaaauuauuugaaaacauau

SEQ ID NO: 1912842 - RNA, 23 nt, Homo sapiens
cacauuaucgggagcagugucuu

SEQ ID NO: 1912843 - RNA, 14 nt, Homo sapiens
agguccuaaauucu

SEQ ID NO: 1912844 - RNA, 13 nt, Homo sapiens
ccuuuccaauaga

SEQ ID NO: 1912845 - RNA, 20 nt, Homo sapiens
aguacucaguauagcauuga

SEQ ID NO: 1912846 - RNA, 12 nt, Homo sapiens
aagaaauuccug

SEQ ID NO: 1912847 - RNA, 15 nt, Homo sapiens
acugugaacaaucag

SEQ ID NO: 1912848 - RNA, 22 nt, Homo sapiens
guucuccccacgacaaccccac

SEQ ID NO: 1912849 - RNA, 15 nt, Homo sapiens
aagaaauuaucuuua

SEQ ID NO: 1912850 - RNA, 19 nt, Homo sapiens
cagaugugaaaacaucuca

SEQ ID NO: 1912851 - RNA, 16 nt, Homo sapiens
gguccaaacccuucaa

SEQ ID NO: 1912852 - RNA, 20 nt, Homo sapiens
acaaucccuuucuaaggaag

SEQ ID NO: 1912853 - RNA, 18 nt, Homo sapiens
uccauauauuagcauuua

SEQ ID NO: 1912854 - RNA, 15 nt, Homo sapiens
cuggcucuuuuacca

SEQ ID NO: 1912855 - RNA, 17 nt, Homo sapiens
caaggaugucugccaca

SEQ ID NO: 1912856 - RNA, 13 nt, Homo sapiens
cauagcacuugca

SEQ ID NO: 1912857 - RNA, 15 nt, Homo sapiens
gcagugaaguacuca

SEQ ID NO: 1912858 - RNA, 13 nt, Homo sapiens
aaccugugucuua

SEQ ID NO: 1912859 - RNA, 22 nt, Homo sapiens
ucaggccccugcagcugccuca

SEQ ID NO: 1912860 - RNA, 14 nt, Homo sapiens
aaaauagacaugua

SEQ ID NO: 1912861 - RNA, 18 nt, Homo sapiens
uugaugauaaacacugag

SEQ ID NO: 1912862 - RNA, 17 nt, Homo sapiens
gaucaucuaauucucug

SEQ ID NO: 1912863 - RNA, 15 nt, Homo sapiens
cauuugauguacaug

SEQ ID NO: 1912864 - RNA, 13 nt, Homo sapiens
ccaaggaguggaa

SEQ ID NO: 1912865 - RNA, 23 nt, Homo sapiens
uucagcucauuuugucucucuca

SEQ ID NO: 1912866 - RNA, 15 nt, Homo sapiens
ccuuacuaugaucuc

SEQ ID NO: 1912867 - RNA, 23 nt, Homo sapiens
aagauuuuccauuguauccucuu

SEQ ID NO: 1912868 - RNA, 17 nt, Homo sapiens
acaagaaaaucaaauau

SEQ ID NO: 1912869 - RNA, 13 nt, Homo sapiens
uacauaaaaaagu

SEQ ID NO: 1912870 - RNA, 23 nt, Homo sapiens
augcaccaaucuuguuuauagca

SEQ ID NO: 1912871 - RNA, 10 nt, Homo sapiens
agacugugca

SEQ ID NO: 1912872 - RNA, 24 nt, Homo sapiens
gcugcuggaggggacgcuggcuaa

SEQ ID NO: 1912873 - RNA, 20 nt, Homo sapiens
gugcaucuagaaagcuuuga

SEQ ID NO: 1912874 - RNA, 15 nt, Homo sapiens
caugaacgcacuuua

SEQ ID NO: 1912875 - RNA, 16 nt, Homo sapiens
cacagcagcaaagguc

SEQ ID NO: 1912876 - RNA, 13 nt, Homo sapiens
agaaaugcacaau

SEQ ID NO: 1912877 - RNA, 10 nt, Homo sapiens
acacauucac

SEQ ID NO: 1912878 - RNA, 21 nt, Homo sapiens
acaggaaaauguauccagagg

SEQ ID NO: 1912879 - RNA, 24 nt, Homo sapiens
cccaguguuggucuguguccauca

SEQ ID NO: 1912880 - RNA, 16 nt, Homo sapiens
aaagauccagccucau

SEQ ID NO: 1912881 - RNA, 17 nt, Homo sapiens
aagaaaaaaaccaaagu

SEQ ID NO: 1912882 - RNA, 19 nt, Homo sapiens
guuaaaacggaugucucca

SEQ ID NO: 1912883 - RNA, 22 nt, Homo sapiens
guuuauccacccacaacaucua

SEQ ID NO: 1912884 - RNA, 19 nt, Homo sapiens
uaagugccauuacuacugu

SEQ ID NO: 1912885 - RNA, 20 nt, Homo sapiens
uaagguacuuaaagcuucua

SEQ ID NO: 1912886 - RNA, 13 nt, Homo sapiens
ucacggccaggca

SEQ ID NO: 1912887 - RNA, 16 nt, Homo sapiens
uguaugaaaauccuuu

SEQ ID NO: 1912888 - RNA, 16 nt, Homo sapiens
aagcuucaugcacuua

SEQ ID NO: 1912889 - RNA, 13 nt, Homo sapiens
ggauccugcacuc

SEQ ID NO: 1912890 - RNA, 12 nt, Homo sapiens
uaaucaaaccac

SEQ ID NO: 1912891 - RNA, 14 nt, Homo sapiens
ugcaaacaucuuca

SEQ ID NO: 1912892 - RNA, 17 nt, Homo sapiens
uugacuuucuguguacc

SEQ ID NO: 1912893 - RNA, 22 nt, Homo sapiens
uuuucaugaccaauccuauguc

SEQ ID NO: 1912894 - RNA, 14 nt, Homo sapiens
ugagcccaacccuu

SEQ ID NO: 1912895 - RNA, 13 nt, Homo sapiens
uaucucuucucag

SEQ ID NO: 1912896 - RNA, 14 nt, Homo sapiens
acugcaaaucugcc

SEQ ID NO: 1912897 - RNA, 16 nt, Homo sapiens
auuucugucacucaca

SEQ ID NO: 1912898 - RNA, 14 nt, Homo sapiens
agaauaaaugaauc

SEQ ID NO: 1912899 - RNA, 14 nt, Homo sapiens
cuguaauuaguuua

SEQ ID NO: 1912900 - RNA, 19 nt, Homo sapiens
accccacagaucaguuuuc

SEQ ID NO: 1912901 - RNA, 14 nt, Homo sapiens
agacccgugaccug

SEQ ID NO: 1912902 - RNA, 14 nt, Homo sapiens
aaugccugacucag

SEQ ID NO: 1912903 - RNA, 12 nt, Homo sapiens
aucaguuugacu

SEQ ID NO: 1912904 - RNA, 18 nt, Homo sapiens
cgugaccuugcaauguuc

SEQ ID NO: 1912905 - RNA, 16 nt, Homo sapiens
uuaaaaaaagcacaug

SEQ ID NO: 1912906 - RNA, 14 nt, Homo sapiens
uaucaguaucugag

SEQ ID NO: 1912907 - RNA, 23 nt, Homo sapiens
cugcuucaaacucaaacacagag

SEQ ID NO: 1912908 - RNA, 14 nt, Homo sapiens
uuuaaggagcaaaa

SEQ ID NO: 1912909 - RNA, 20 nt, Homo sapiens
aagagcgagacucugucuca

SEQ ID NO: 1912910 - RNA, 20 nt, Homo sapiens
aagagugagacuccgucuca

SEQ ID NO: 1912911 - RNA, 13 nt, Homo sapiens
cugguucagaaau

SEQ ID NO: 1912912 - RNA, 22 nt, Homo sapiens
acacugaggaacucacaauucc

SEQ ID NO: 1912913 - RNA, 22 nt, Homo sapiens
uacauaauuaaauuuuaaugua

SEQ ID NO: 1912914 - RNA, 13 nt, Homo sapiens
agaaguaggcaug

SEQ ID NO: 1912915 - RNA, 22 nt, Homo sapiens
gccucaaagggacugccgccau

SEQ ID NO: 1912916 - RNA, 20 nt, Homo sapiens
ucccaucuugauaagaccac

SEQ ID NO: 1912917 - RNA, 22 nt, Homo sapiens
caggaccuccaagccacugagc

SEQ ID NO: 1912918 - RNA, 19 nt, Homo sapiens
uacaauuuccauauagucu

SEQ ID NO: 1912919 - RNA, 12 nt, Homo sapiens
aagcccaguuca

SEQ ID NO: 1912920 - RNA, 14 nt, Homo sapiens
auaugauucccuuu

SEQ ID NO: 1912921 - RNA, 23 nt, Homo sapiens
cuaggguaggggcaaggaaacuc

SEQ ID NO: 1912922 - RNA, 18 nt, Homo sapiens
auuccaauuugcacuuuc

SEQ ID NO: 1912923 - RNA, 19 nt, Homo sapiens
auaacuggaaaaagugaaa

SEQ ID NO: 1912924 - RNA, 22 nt, Homo sapiens
ccuaucuugauuucacuggaau

SEQ ID NO: 1912925 - RNA, 18 nt, Homo sapiens
cuuugaagugcagcucau

SEQ ID NO: 1912926 - RNA, 23 nt, Homo sapiens
ccaugagagaaggaggggagcag

SEQ ID NO: 1912927 - RNA, 13 nt, Homo sapiens
uagauuugcagcu

SEQ ID NO: 1912928 - RNA, 18 nt, Homo sapiens
uagccaacacccaucugu

SEQ ID NO: 1912929 - RNA, 22 nt, Homo sapiens
auuuuguuuuuaaacuggaaau

SEQ ID NO: 1912930 - RNA, 17 nt, Homo sapiens
acuaauuuuguacguau

SEQ ID NO: 1912931 - RNA, 14 nt, Homo sapiens
aagagaaugucuga

SEQ ID NO: 1912932 - RNA, 22 nt, Homo sapiens
uuugaggauauauuuucacuuu

SEQ ID NO: 1912933 - RNA, 18 nt, Homo sapiens
uuuuaauacauugaucag

SEQ ID NO: 1912934 - RNA, 16 nt, Homo sapiens
ggccuuggccaagcug

SEQ ID NO: 1912935 - RNA, 22 nt, Homo sapiens
gauauauauaugcuuggcuaac

SEQ ID NO: 1912936 - RNA, 16 nt, Homo sapiens
aacuguuucccugcug

SEQ ID NO: 1912937 - RNA, 14 nt, Homo sapiens
ugaaaaggcugccu

SEQ ID NO: 1912938 - RNA, 17 nt, Homo sapiens
ccuggccucuucugggc

SEQ ID NO: 1912939 - RNA, 19 nt, Homo sapiens
gaaaauuggaacucuacuc

SEQ ID NO: 1912940 - RNA, 15 nt, Homo sapiens
agucacaauuugcaa

SEQ ID NO: 1912941 - RNA, 13 nt, Homo sapiens
caaaaaguguaau

SEQ ID NO: 1912942 - RNA, 21 nt, Homo sapiens
cagggaucauagcugacucag

SEQ ID NO: 1912943 - RNA, 18 nt, Homo sapiens
gugucaugaagugcacag

SEQ ID NO: 1912944 - RNA, 18 nt, Homo sapiens
agagagccccugacaauc

SEQ ID NO: 1912945 - RNA, 12 nt, Homo sapiens
agacuuccugua

SEQ ID NO: 1912946 - RNA, 19 nt, Homo sapiens
agauuguccuuuucuccca

SEQ ID NO: 1912947 - RNA, 20 nt, Homo sapiens
aggcacaacuucagcagggg

SEQ ID NO: 1912948 - RNA, 22 nt, Homo sapiens
uggcguuuuagacaaauuugca

SEQ ID NO: 1912949 - RNA, 23 nt, Homo sapiens
gcacaucauggcagugggaccaa

SEQ ID NO: 1912950 - RNA, 20 nt, Homo sapiens
gaaauggauuuaucaucacc

SEQ ID NO: 1912951 - RNA, 15 nt, Homo sapiens
uuccuccauugcaca

SEQ ID NO: 1912952 - RNA, 21 nt, Homo sapiens
auuuacacagugagacuguac

SEQ ID NO: 1912953 - RNA, 17 nt, Homo sapiens
cuuuucuccuaucuuca

SEQ ID NO: 1912954 - RNA, 21 nt, Homo sapiens
gugcucagcccugaggacaga

SEQ ID NO: 1912955 - RNA, 16 nt, Homo sapiens
uggauauggugcaaaa

SEQ ID NO: 1912956 - RNA, 20 nt, Homo sapiens
cuuuaguuaguauccuugga

SEQ ID NO: 1912957 - RNA, 18 nt, Homo sapiens
ccucacuggugcauuuaa

SEQ ID NO: 1912958 - RNA, 15 nt, Homo sapiens
auguacauagugcua

SEQ ID NO: 1912959 - RNA, 18 nt, Homo sapiens
uccacguguaugcaagug

SEQ ID NO: 1912960 - RNA, 23 nt, Homo sapiens
uuugucaacaaaaagacauggaa

SEQ ID NO: 1912961 - RNA, 19 nt, Homo sapiens
auaugcagccaaccaagau

SEQ ID NO: 1912962 - RNA, 13 nt, Homo sapiens
uacaguacaugac

SEQ ID NO: 1912963 - RNA, 19 nt, Homo sapiens
augccacauuuugcuuuau

SEQ ID NO: 1912964 - RNA, 20 nt, Homo sapiens
uaugccuuaaaacauacucu

SEQ ID NO: 1912965 - RNA, 16 nt, Homo sapiens
augauuuaauguugau

SEQ ID NO: 1912966 - RNA, 22 nt, Homo sapiens
accuucauuuuuaagacuguaa

SEQ ID NO: 1912967 - RNA, 14 nt, Homo sapiens
gcaugugcauauag

SEQ ID NO: 1912968 - RNA, 16 nt, Homo sapiens
aacaauuguauuccca

SEQ ID NO: 1912969 - RNA, 19 nt, Homo sapiens
aacuuugauaggaugugga

SEQ ID NO: 1912970 - RNA, 13 nt, Homo sapiens
caagaagaaauca

SEQ ID NO: 1912971 - RNA, 23 nt, Homo sapiens
cagagugagccagugagggcagu

SEQ ID NO: 1912972 - RNA, 12 nt, Homo sapiens
cuuacucuguca

SEQ ID NO: 1912973 - RNA, 12 nt, Homo sapiens
gucucucucuuu

SEQ ID NO: 1912974 - RNA, 15 nt, Homo sapiens
cccacauccaguggg

SEQ ID NO: 1912975 - RNA, 23 nt, Homo sapiens
cccuuccugcauuucucuucuca

SEQ ID NO: 1912976 - RNA, 14 nt, Homo sapiens
agugguuacuuugu

SEQ ID NO: 1912977 - RNA, 23 nt, Homo sapiens
cucagaacaguaucuuugcacuc

SEQ ID NO: 1912978 - RNA, 17 nt, Homo sapiens
ucucugcucucuuggaa

SEQ ID NO: 1912979 - RNA, 12 nt, Homo sapiens
auaucauuuuaa

SEQ ID NO: 1912980 - RNA, 16 nt, Homo sapiens
cccaagcuggagugaa

SEQ ID NO: 1912981 - RNA, 18 nt, Homo sapiens
cugcccugacaugcacac

SEQ ID NO: 1912982 - RNA, 20 nt, Homo sapiens
gaaguacuuuaccugaaaga

SEQ ID NO: 1912983 - RNA, 14 nt, Homo sapiens
uuucuccacacagc

SEQ ID NO: 1912984 - RNA, 18 nt, Homo sapiens
uucccuagaccuuggcau

SEQ ID NO: 1912985 - RNA, 13 nt, Homo sapiens
aguuguucagcau

SEQ ID NO: 1912986 - RNA, 19 nt, Homo sapiens
aauugagcagcaugauuau

SEQ ID NO: 1912987 - RNA, 16 nt, Homo sapiens
cucauuccuucacuca

SEQ ID NO: 1912988 - RNA, 18 nt, Homo sapiens
ugcaaaauuaccuacccc

SEQ ID NO: 1912989 - RNA, 20 nt, Homo sapiens
gcagauugguucaugccugg

SEQ ID NO: 1912990 - RNA, 13 nt, Homo sapiens
cucagaugcacau

SEQ ID NO: 1912991 - RNA, 16 nt, Homo sapiens
gcuuuaauaugagcuu

SEQ ID NO: 1912992 - RNA, 18 nt, Homo sapiens
guaaucccagaacuuugg

SEQ ID NO: 1912993 - RNA, 20 nt, Homo sapiens
guaugcagaaggcuacauau

SEQ ID NO: 1912994 - RNA, 18 nt, Homo sapiens
ccaaucagaucaacucug

SEQ ID NO: 1912995 - RNA, 18 nt, Homo sapiens
caguauaaagggacuuga

SEQ ID NO: 1912996 - RNA, 21 nt, Homo sapiens
uuccuuacagacacccauaau

SEQ ID NO: 1912997 - RNA, 17 nt, Homo sapiens
ucugcaaagacuagauc

SEQ ID NO: 1912998 - RNA, 20 nt, Homo sapiens
uaacauuccuaaaaugcuuc

SEQ ID NO: 1912999 - RNA, 17 nt, Homo sapiens
agagcucucucuucucu

SEQ ID NO: 1913000 - RNA, 13 nt, Homo sapiens
gaaugaaacaauc

SEQ ID NO: 1913001 - RNA, 23 nt, Homo sapiens
gaaaucguugcugcacccuuccc

SEQ ID NO: 1913002 - RNA, 21 nt, Homo sapiens
uucccaggguuauagacaguc

SEQ ID NO: 1913003 - RNA, 15 nt, Homo sapiens
accucacauccaucu

SEQ ID NO: 1913004 - RNA, 13 nt, Homo sapiens
uacuuauuuucca

SEQ ID NO: 1913005 - RNA, 13 nt, Homo sapiens
auccauaaccucu

SEQ ID NO: 1913006 - RNA, 17 nt, Homo sapiens
auaugaaaaugagggua

SEQ ID NO: 1913007 - RNA, 10 nt, Homo sapiens
ccacucuguu

SEQ ID NO: 1913008 - RNA, 19 nt, Homo sapiens
ucuacagugaugauugaau

SEQ ID NO: 1913009 - RNA, 23 nt, Homo sapiens
ccuuuccagggucaaaguacaga

SEQ ID NO: 1913010 - RNA, 20 nt, Homo sapiens
cuugugaaguaggugaucuu

SEQ ID NO: 1913011 - RNA, 21 nt, Homo sapiens
agcaguucucccaccagccuc

SEQ ID NO: 1913012 - RNA, 14 nt, Homo sapiens
acuucccagugaau

SEQ ID NO: 1913013 - RNA, 13 nt, Homo sapiens
cuuguaucuguag

SEQ ID NO: 1913014 - RNA, 23 nt, Homo sapiens
accagagugauguccucucucag

SEQ ID NO: 1913015 - RNA, 12 nt, Homo sapiens
ccuagauaugaa

SEQ ID NO: 1913016 - RNA, 22 nt, Homo sapiens
gacaauggcccaggucucucaa

SEQ ID NO: 1913017 - RNA, 15 nt, Homo sapiens
acagcaguguucuca

SEQ ID NO: 1913018 - RNA, 15 nt, Homo sapiens
ugugagguaacuggg

SEQ ID NO: 1913019 - RNA, 15 nt, Homo sapiens
gcaagaccucaucuc

SEQ ID NO: 1913020 - RNA, 16 nt, Homo sapiens
cccugguugcuuugug

SEQ ID NO: 1913021 - RNA, 19 nt, Homo sapiens
augcucugccccaagcccc

SEQ ID NO: 1913022 - RNA, 19 nt, Homo sapiens
uucuauucaucucaaggaa

SEQ ID NO: 1913023 - RNA, 14 nt, Homo sapiens
uacuuguuccagau

SEQ ID NO: 1913024 - RNA, 18 nt, Homo sapiens
uuuagaaaugagaccaca

SEQ ID NO: 1913025 - RNA, 12 nt, Homo sapiens
agaucuaccccu

SEQ ID NO: 1913026 - RNA, 17 nt, Homo sapiens
agggacagcagauucca

SEQ ID NO: 1913027 - RNA, 19 nt, Homo sapiens
acuuaucaaacguguuaua

SEQ ID NO: 1913028 - RNA, 17 nt, Homo sapiens
cauguaguaagcaagau

SEQ ID NO: 1913029 - RNA, 22 nt, Homo sapiens
guguucucaacacacaguauag

SEQ ID NO: 1913030 - RNA, 16 nt, Homo sapiens
uuucguaccuucccac

SEQ ID NO: 1913031 - RNA, 23 nt, Homo sapiens
aggacucuccacucaaugucuua

SEQ ID NO: 1913032 - RNA, 17 nt, Homo sapiens
uaaauuuggacugucua

SEQ ID NO: 1913033 - RNA, 13 nt, Homo sapiens
aauguuagcaguu

SEQ ID NO: 1913034 - RNA, 12 nt, Homo sapiens
cacaaugccaga

SEQ ID NO: 1913035 - RNA, 17 nt, Homo sapiens
uagugaauacugcuaca

SEQ ID NO: 1913036 - RNA, 13 nt, Homo sapiens
gcacaaaagacaa

SEQ ID NO: 1913037 - RNA, 14 nt, Homo sapiens
guagggcucgccau

SEQ ID NO: 1913038 - RNA, 19 nt, Homo sapiens
aauccagugagcacuagaa

SEQ ID NO: 1913039 - RNA, 13 nt, Homo sapiens
ugaugcugggauu

SEQ ID NO: 1913040 - RNA, 22 nt, Homo sapiens
gcaacaugaugagguaguaccu

SEQ ID NO: 1913041 - RNA, 20 nt, Homo sapiens
agaccuggugcucuaaugcc

SEQ ID NO: 1913042 - RNA, 17 nt, Homo sapiens
ccgcuguuuguauuucu

SEQ ID NO: 1913043 - RNA, 15 nt, Homo sapiens
gaaagagaaccauga

SEQ ID NO: 1913044 - RNA, 12 nt, Homo sapiens
aggucagugcuu

SEQ ID NO: 1913045 - RNA, 19 nt, Homo sapiens
gauuuguccuuggggacau

SEQ ID NO: 1913046 - RNA, 17 nt, Homo sapiens
uuugacauucuucacug

SEQ ID NO: 1913047 - RNA, 16 nt, Homo sapiens
aaugguacucuaauca

SEQ ID NO: 1913048 - RNA, 14 nt, Homo sapiens
aacaaggugcacag

SEQ ID NO: 1913049 - RNA, 22 nt, Homo sapiens
cuugaaagaaaauaugcaucua

SEQ ID NO: 1913050 - RNA, 17 nt, Homo sapiens
uaggcuuuuaaaagcau

SEQ ID NO: 1913051 - RNA, 22 nt, Homo sapiens
ucauucuucuugggcuuugcua

SEQ ID NO: 1913052 - RNA, 13 nt, Homo sapiens
cagaugugugauu

SEQ ID NO: 1913053 - RNA, 14 nt, Homo sapiens
uggcuccuaucugu

SEQ ID NO: 1913054 - RNA, 22 nt, Homo sapiens
agauggaacacuggaacauucc

SEQ ID NO: 1913055 - RNA, 23 nt, Homo sapiens
aaagagaagcaaacaaugguguc

SEQ ID NO: 1913056 - RNA, 20 nt, Homo sapiens
cgugcacacaccugcacacc

SEQ ID NO: 1913057 - RNA, 14 nt, Homo sapiens
gccucuauugccca

SEQ ID NO: 1913058 - RNA, 12 nt, Homo sapiens
uuacucuaugau

SEQ ID NO: 1913059 - RNA, 17 nt, Homo sapiens
uucaccugguauccauu

SEQ ID NO: 1913060 - RNA, 20 nt, Homo sapiens
aauaccugcccugacaugca

SEQ ID NO: 1913061 - RNA, 21 nt, Homo sapiens
acuacucuauuuuuugcaaau

SEQ ID NO: 1913062 - RNA, 21 nt, Homo sapiens
auggucuuaaggaacaucucu

SEQ ID NO: 1913063 - RNA, 12 nt, Homo sapiens
aggcucuaaugu

SEQ ID NO: 1913064 - RNA, 14 nt, Homo sapiens
aacaaugaccuuua

SEQ ID NO: 1913065 - RNA, 18 nt, Homo sapiens
gaaagcuguuaaauucuc

SEQ ID NO: 1913066 - RNA, 18 nt, Homo sapiens
cccaaguuauugggaugu

SEQ ID NO: 1913067 - RNA, 23 nt, Homo sapiens
gggagcagucggcacagugcagc

SEQ ID NO: 1913068 - RNA, 22 nt, Homo sapiens
ggccaaugcuuauacccaguga

SEQ ID NO: 1913069 - RNA, 18 nt, Homo sapiens
accugucuaggucuccuc

SEQ ID NO: 1913070 - RNA, 18 nt, Homo sapiens
cccucuucucuuuugccc

SEQ ID NO: 1913071 - RNA, 19 nt, Homo sapiens
ugcugcccugcucugggga

SEQ ID NO: 1913072 - RNA, 15 nt, Homo sapiens
gugugcagacugugg

SEQ ID NO: 1913073 - RNA, 17 nt, Homo sapiens
uucaugagcuugaacaa

SEQ ID NO: 1913074 - RNA, 14 nt, Homo sapiens
uguaccuugcugug

SEQ ID NO: 1913075 - RNA, 22 nt, Homo sapiens
auaaacugauuuaucuauuuaa

SEQ ID NO: 1913076 - RNA, 16 nt, Homo sapiens
auucugaggaggaaau

SEQ ID NO: 1913077 - RNA, 19 nt, Homo sapiens
ucagaaaccccacuuccau

SEQ ID NO: 1913078 - RNA, 14 nt, Homo sapiens
aucuuguccccaac

SEQ ID NO: 1913079 - RNA, 17 nt, Homo sapiens
uggacugggugccacgg

SEQ ID NO: 1913080 - RNA, 16 nt, Homo sapiens
ugucuagcaugccaac

SEQ ID NO: 1913081 - RNA, 15 nt, Homo sapiens
ugacauugccaaaaa

SEQ ID NO: 1913082 - RNA, 15 nt, Homo sapiens
ccuggcccucacuca

SEQ ID NO: 1913083 - RNA, 14 nt, Homo sapiens
aaaauaaaccaaau

SEQ ID NO: 1913084 - RNA, 18 nt, Homo sapiens
cugauguuuauguacugu

SEQ ID NO: 1913085 - RNA, 20 nt, Homo sapiens
uccaugugcuagucacuggc

SEQ ID NO: 1913086 - RNA, 15 nt, Homo sapiens
uuugcucugucuccu

SEQ ID NO: 1913087 - RNA, 16 nt, Homo sapiens
aaaguugagcgucauu

SEQ ID NO: 1913088 - RNA, 16 nt, Homo sapiens
aucaacgaguacuuca

SEQ ID NO: 1913089 - RNA, 11 nt, Homo sapiens
gccacccaaga

SEQ ID NO: 1913090 - RNA, 20 nt, Homo sapiens
uuugaagaccccacugccac

SEQ ID NO: 1913091 - RNA, 15 nt, Homo sapiens
uuaagcguuguagua

SEQ ID NO: 1913092 - RNA, 18 nt, Homo sapiens
ugccacaaugugauaugu

SEQ ID NO: 1913093 - RNA, 17 nt, Homo sapiens
acacccugagguugugu

SEQ ID NO: 1913094 - RNA, 14 nt, Homo sapiens
gauucaggggcuuu

SEQ ID NO: 1913095 - RNA, 17 nt, Homo sapiens
accucuaccuguuccca

SEQ ID NO: 1913096 - RNA, 15 nt, Homo sapiens
aaauuauugaugaaa

SEQ ID NO: 1913097 - RNA, 15 nt, Homo sapiens
ccuagagcacacugu

SEQ ID NO: 1913098 - RNA, 21 nt, Homo sapiens
uugaggacaaccauuccagac

SEQ ID NO: 1913099 - RNA, 21 nt, Homo sapiens
ccaucuguuugauacaguauu

SEQ ID NO: 1913100 - RNA, 16 nt, Homo sapiens
auaaugucccuucaca

SEQ ID NO: 1913101 - RNA, 16 nt, Homo sapiens
acuccuuaauacuaga

SEQ ID NO: 1913102 - RNA, 20 nt, Homo sapiens
guaacaaggugucuuuucca

SEQ ID NO: 1913103 - RNA, 18 nt, Homo sapiens
ucccauuuguugcugcug

SEQ ID NO: 1913104 - RNA, 20 nt, Homo sapiens
ucaggaacuauggcaaggaa

SEQ ID NO: 1913105 - RNA, 19 nt, Homo sapiens
caggacaccaguccaggua

SEQ ID NO: 1913106 - RNA, 21 nt, Homo sapiens
uaggugcucuuccucaucuca

SEQ ID NO: 1913107 - RNA, 18 nt, Homo sapiens
ucagcuggucaaacaaac

SEQ ID NO: 1913108 - RNA, 15 nt, Homo sapiens
auucuuccugauuca

SEQ ID NO: 1913109 - RNA, 11 nt, Homo sapiens
uagugcuucuu

SEQ ID NO: 1913110 - RNA, 15 nt, Homo sapiens
cgugugacuacuccc

SEQ ID NO: 1913111 - RNA, 18 nt, Homo sapiens
gcaguugaucagacugaa

SEQ ID NO: 1913112 - RNA, 14 nt, Homo sapiens
acugugacacagcu

SEQ ID NO: 1913113 - RNA, 19 nt, Homo sapiens
caggugugccgacagaagg

SEQ ID NO: 1913114 - RNA, 14 nt, Homo sapiens
aggagcuuacugaa

SEQ ID NO: 1913115 - RNA, 21 nt, Homo sapiens
ucaaucuuuacacaaugucac

SEQ ID NO: 1913116 - RNA, 22 nt, Homo sapiens
augcauauuaaagaaagucaua

SEQ ID NO: 1913117 - RNA, 21 nt, Homo sapiens
cauacauucccucuaauuuga

SEQ ID NO: 1913118 - RNA, 23 nt, Homo sapiens
uaggugcugaaugaagcugccau

SEQ ID NO: 1913119 - RNA, 18 nt, Homo sapiens
caguaccgacuaagcaaa

SEQ ID NO: 1913120 - RNA, 13 nt, Homo sapiens
ugcaugagcugca

SEQ ID NO: 1913121 - RNA, 23 nt, Homo sapiens
ugcucugucccuauuauuugccc

SEQ ID NO: 1913122 - RNA, 18 nt, Homo sapiens
caagggauuuuuacaucc

SEQ ID NO: 1913123 - RNA, 12 nt, Homo sapiens
uggaugugcauc

SEQ ID NO: 1913124 - RNA, 19 nt, Homo sapiens
ugcucugaauguccugaca

SEQ ID NO: 1913125 - RNA, 15 nt, Homo sapiens
cugaaucccuuucag

SEQ ID NO: 1913126 - RNA, 14 nt, Homo sapiens
ccucagccaaacac

SEQ ID NO: 1913127 - RNA, 15 nt, Homo sapiens
aauguguccacaguu

SEQ ID NO: 1913128 - RNA, 19 nt, Homo sapiens
ccuucuuggcuucugggac

SEQ ID NO: 1913129 - RNA, 15 nt, Homo sapiens
uguaaggagccuuuc

SEQ ID NO: 1913130 - RNA, 13 nt, Homo sapiens
auugccucugaaa

SEQ ID NO: 1913131 - RNA, 20 nt, Homo sapiens
cccugggguggccaccagua

SEQ ID NO: 1913132 - RNA, 23 nt, Homo sapiens
ucaagccgcaucccagacuugcu

SEQ ID NO: 1913133 - RNA, 18 nt, Homo sapiens
ggucuuugguuggcagaa

SEQ ID NO: 1913134 - RNA, 14 nt, Homo sapiens
gggcccaacaggcc

SEQ ID NO: 1913135 - RNA, 22 nt, Homo sapiens
ccaugauggccaggcugaucuc

SEQ ID NO: 1913136 - RNA, 13 nt, Homo sapiens
ucuuuccauuuac

SEQ ID NO: 1913137 - RNA, 16 nt, Homo sapiens
gagaucuaaugugaaa

SEQ ID NO: 1913138 - RNA, 17 nt, Homo sapiens
ggacccauagacagccc

SEQ ID NO: 1913139 - RNA, 22 nt, Homo sapiens
gacuguugcucaaaucuauuca

SEQ ID NO: 1913140 - RNA, 23 nt, Homo sapiens
guuuaccaugaagauaaacuguu

SEQ ID NO: 1913141 - RNA, 14 nt, Homo sapiens
cucacuuaucccaa

SEQ ID NO: 1913142 - RNA, 17 nt, Homo sapiens
ccaucuguauauacaaa

SEQ ID NO: 1913143 - RNA, 14 nt, Homo sapiens
gaaauuuacuacag

SEQ ID NO: 1913144 - RNA, 22 nt, Homo sapiens
gaucagccuugagagaggccac

SEQ ID NO: 1913145 - RNA, 17 nt, Homo sapiens
uguuaauauuucuaaaa

SEQ ID NO: 1913146 - RNA, 12 nt, Homo sapiens
auuuuugccaaa

SEQ ID NO: 1913147 - RNA, 15 nt, Homo sapiens
caucaaaugcucaag

SEQ ID NO: 1913148 - RNA, 19 nt, Homo sapiens
cauacaaacauaaggcaca

SEQ ID NO: 1913149 - RNA, 23 nt, Homo sapiens
gcuucccuaaacugcagccucuc

SEQ ID NO: 1913150 - RNA, 17 nt, Homo sapiens
cuuuuuguuguucauua

SEQ ID NO: 1913151 - RNA, 14 nt, Homo sapiens
ucagcccugagcua

SEQ ID NO: 1913152 - RNA, 14 nt, Homo sapiens
cccuccucuuggaa

SEQ ID NO: 1913153 - RNA, 13 nt, Homo sapiens
uccccaacaugga

SEQ ID NO: 1913154 - RNA, 22 nt, Homo sapiens
guacccaccugagcuuuggacg

SEQ ID NO: 1913155 - RNA, 18 nt, Homo sapiens
ccagaagacuugccugcu

SEQ ID NO: 1913156 - RNA, 21 nt, Homo sapiens
caccccggggacccugugaca

SEQ ID NO: 1913157 - RNA, 17 nt, Homo sapiens
caggagcugaagcccau

SEQ ID NO: 1913158 - RNA, 14 nt, Homo sapiens
ugaagucaaauguc

SEQ ID NO: 1913159 - RNA, 14 nt, Homo sapiens
acugcaaaacaaga

SEQ ID NO: 1913160 - RNA, 22 nt, Homo sapiens
uucucucucauuuggacuugcu

SEQ ID NO: 1913161 - RNA, 22 nt, Homo sapiens
cucccugagugguccccaccuu

SEQ ID NO: 1913162 - RNA, 20 nt, Homo sapiens
uacuuuauuucugaucuaua

SEQ ID NO: 1913163 - RNA, 21 nt, Homo sapiens
aaguuauaguauaucuggaca

SEQ ID NO: 1913164 - RNA, 15 nt, Homo sapiens
uauaaagauggcuga

SEQ ID NO: 1913165 - RNA, 15 nt, Homo sapiens
uuugaugaaacucau

SEQ ID NO: 1913166 - RNA, 21 nt, Homo sapiens
agcccaugacguguuucuuga

SEQ ID NO: 1913167 - RNA, 20 nt, Homo sapiens
ccagccuggacgacauagcg

SEQ ID NO: 1913168 - RNA, 15 nt, Homo sapiens
gaggagaacaaaaug

SEQ ID NO: 1913169 - RNA, 16 nt, Homo sapiens
cuuugggugaccagcc

SEQ ID NO: 1913170 - RNA, 16 nt, Homo sapiens
cacucuuaucaauccc

SEQ ID NO: 1913171 - RNA, 17 nt, Homo sapiens
cuuggucugcagaccau

SEQ ID NO: 1913172 - RNA, 20 nt, Homo sapiens
uguuucuucuuugacuauaa

SEQ ID NO: 1913173 - RNA, 17 nt, Homo sapiens
caguaguuuaguacaau

SEQ ID NO: 1913174 - RNA, 16 nt, Homo sapiens
acauacauuucucaua

SEQ ID NO: 1913175 - RNA, 16 nt, Homo sapiens
aaggaguacaaugccc

SEQ ID NO: 1913176 - RNA, 17 nt, Homo sapiens
auucauuuaagaacaag

SEQ ID NO: 1913177 - RNA, 13 nt, Homo sapiens
aaaauccauuuua

SEQ ID NO: 1913178 - RNA, 19 nt, Homo sapiens
ggccccugagccugugucc

SEQ ID NO: 1913179 - RNA, 23 nt, Homo sapiens
aauugugaagucgucuuaacuca

SEQ ID NO: 1913180 - RNA, 13 nt, Homo sapiens
aggaucgcucaag

SEQ ID NO: 1913181 - RNA, 20 nt, Homo sapiens
aggcauuaauguuucuaucu

SEQ ID NO: 1913182 - RNA, 21 nt, Homo sapiens
ucauuugaaugugugaauuca

SEQ ID NO: 1913183 - RNA, 18 nt, Homo sapiens
cgacugcucugauggcac

SEQ ID NO: 1913184 - RNA, 15 nt, Homo sapiens
aucauacugccuacu

SEQ ID NO: 1913185 - RNA, 21 nt, Homo sapiens
cagcacgguggugcccaagcc

SEQ ID NO: 1913186 - RNA, 21 nt, Homo sapiens
ccauccuaggcuuaaaugcaa

SEQ ID NO: 1913187 - RNA, 18 nt, Homo sapiens
cugucaucaucauggcca

SEQ ID NO: 1913188 - RNA, 19 nt, Homo sapiens
caugauacuaucugugcca

SEQ ID NO: 1913189 - RNA, 19 nt, Homo sapiens
acuccucuuuccuuccuuc

SEQ ID NO: 1913190 - RNA, 20 nt, Homo sapiens
gagguuacagaggcugacuu

SEQ ID NO: 1913191 - RNA, 13 nt, Homo sapiens
ucauccauuugcg

SEQ ID NO: 1913192 - RNA, 14 nt, Homo sapiens
ccaauuauguuaaa

SEQ ID NO: 1913193 - RNA, 18 nt, Homo sapiens
agcgaguggagucugcca

SEQ ID NO: 1913194 - RNA, 18 nt, Homo sapiens
aauucauaaagaaaugca

SEQ ID NO: 1913195 - RNA, 16 nt, Homo sapiens
caagaggacugagacu

SEQ ID NO: 1913196 - RNA, 24 nt, Homo sapiens
auuuacuguuuuuuucuguagcac

SEQ ID NO: 1913197 - RNA, 15 nt, Homo sapiens
acacaggagaccacc

SEQ ID NO: 1913198 - RNA, 13 nt, Homo sapiens
cacauacauguaa

SEQ ID NO: 1913199 - RNA, 23 nt, Homo sapiens
caaaggcacugaggcccagggag

SEQ ID NO: 1913200 - RNA, 22 nt, Homo sapiens
ugauacaugagccagugauuau

SEQ ID NO: 1913201 - RNA, 15 nt, Homo sapiens
cucaucagucuccau

SEQ ID NO: 1913202 - RNA, 14 nt, Homo sapiens
gucucugcaucuca

SEQ ID NO: 1913203 - RNA, 22 nt, Homo sapiens
uccucagauugcugaaucccau

SEQ ID NO: 1913204 - RNA, 15 nt, Homo sapiens
gacucaggacauccc

SEQ ID NO: 1913205 - RNA, 22 nt, Homo sapiens
uccuacccccugugccuuguca

SEQ ID NO: 1913206 - RNA, 23 nt, Homo sapiens
gacgcagauaacugguuacucag

SEQ ID NO: 1913207 - RNA, 14 nt, Homo sapiens
agucuguaccucaa

SEQ ID NO: 1913208 - RNA, 23 nt, Homo sapiens
auacuuuuucuuugaauuuagca

SEQ ID NO: 1913209 - RNA, 14 nt, Homo sapiens
ucaaagucccuuga

SEQ ID NO: 1913210 - RNA, 19 nt, Homo sapiens
gucaccucaauauuuacua

SEQ ID NO: 1913211 - RNA, 21 nt, Homo sapiens
guaauaaaucuaggaugugau

SEQ ID NO: 1913212 - RNA, 14 nt, Homo sapiens
accuugacgugugu

SEQ ID NO: 1913213 - RNA, 15 nt, Homo sapiens
ucuagccuggggcuu

SEQ ID NO: 1913214 - RNA, 14 nt, Homo sapiens
aaaaacugcucaua

SEQ ID NO: 1913215 - RNA, 22 nt, Homo sapiens
cauaacuaaauuugauacuuau

SEQ ID NO: 1913216 - RNA, 22 nt, Homo sapiens
uagaaagacuacauguuacuaa

SEQ ID NO: 1913217 - RNA, 20 nt, Homo sapiens
ccagaccuagaccugggcca

SEQ ID NO: 1913218 - RNA, 14 nt, Homo sapiens
ugcuagacagccag

SEQ ID NO: 1913219 - RNA, 21 nt, Homo sapiens
ccccaauaguagucucuguga

SEQ ID NO: 1913220 - RNA, 17 nt, Homo sapiens
cgcucagcacacaugca

SEQ ID NO: 1913221 - RNA, 14 nt, Homo sapiens
uauaacauagcugu

SEQ ID NO: 1913222 - RNA, 14 nt, Homo sapiens
uaaagugguuuugu

SEQ ID NO: 1913223 - RNA, 23 nt, Homo sapiens
caaaauucucauuuuucauuucu

SEQ ID NO: 1913224 - RNA, 19 nt, Homo sapiens
ugccgccuccuugugcaca

SEQ ID NO: 1913225 - RNA, 17 nt, Homo sapiens
uguaguuggaaagcaaa

SEQ ID NO: 1913226 - RNA, 20 nt, Homo sapiens
cuugagccagccaggcccug

SEQ ID NO: 1913227 - RNA, 16 nt, Homo sapiens
agacaaaauauuuccc

SEQ ID NO: 1913228 - RNA, 21 nt, Homo sapiens
uugauuaacuccuccugcgau

SEQ ID NO: 1913229 - RNA, 18 nt, Homo sapiens
uuaacugaggaaugcggu

SEQ ID NO: 1913230 - RNA, 18 nt, Homo sapiens
ccauggugcccgugccuc

SEQ ID NO: 1913231 - RNA, 19 nt, Homo sapiens
aguaucacaucacacaaaa

SEQ ID NO: 1913232 - RNA, 18 nt, Homo sapiens
gaacagcaguguucucac

SEQ ID NO: 1913233 - RNA, 14 nt, Homo sapiens
cugaaugaucuauu

SEQ ID NO: 1913234 - RNA, 18 nt, Homo sapiens
aagaaauaaaaucuaauu

SEQ ID NO: 1913235 - RNA, 19 nt, Homo sapiens
uccuagccacccaccacac

SEQ ID NO: 1913236 - RNA, 16 nt, Homo sapiens
ggugcaugaugcugcc

SEQ ID NO: 1913237 - RNA, 22 nt, Homo sapiens
ugucuguaucggagacagugau

SEQ ID NO: 1913238 - RNA, 13 nt, Homo sapiens
uucuguucugcug

SEQ ID NO: 1913239 - RNA, 13 nt, Homo sapiens
uuaguuucugagu

SEQ ID NO: 1913240 - RNA, 15 nt, Homo sapiens
cccaagguugcacag

SEQ ID NO: 1913241 - RNA, 19 nt, Homo sapiens
aauaagggcagagucacac

SEQ ID NO: 1913242 - RNA, 13 nt, Homo sapiens
cacaccagagaca

SEQ ID NO: 1913243 - RNA, 18 nt, Homo sapiens
auaucccaagugcacuuu

SEQ ID NO: 1913244 - RNA, 20 nt, Homo sapiens
aacuugggauaagaguguga

SEQ ID NO: 1913245 - RNA, 16 nt, Homo sapiens
guugauaauucuuauu

SEQ ID NO: 1913246 - RNA, 19 nt, Homo sapiens
auaguaccauuuauacaaa

SEQ ID NO: 1913247 - RNA, 19 nt, Homo sapiens
uguaaugucagacuuugcu

SEQ ID NO: 1913248 - RNA, 23 nt, Homo sapiens
acgagcuguguagccacugacuu

SEQ ID NO: 1913249 - RNA, 20 nt, Homo sapiens
ccugaggcuggacuccagau

SEQ ID NO: 1913250 - RNA, 13 nt, Homo sapiens
ugccaacaugugg

SEQ ID NO: 1913251 - RNA, 19 nt, Homo sapiens
agcuguuuugaauaacaua

SEQ ID NO: 1913252 - RNA, 18 nt, Homo sapiens
gagugguggcagcucaaa

SEQ ID NO: 1913253 - RNA, 16 nt, Homo sapiens
cucuagugcugugaaa

SEQ ID NO: 1913254 - RNA, 17 nt, Homo sapiens
aauguauuuuucacaaa

SEQ ID NO: 1913255 - RNA, 18 nt, Homo sapiens
uucaaaggaaaacaccuu

SEQ ID NO: 1913256 - RNA, 16 nt, Homo sapiens
aguaaaaaucaauacc

SEQ ID NO: 1913257 - RNA, 19 nt, Homo sapiens
accccagaaaucacuguga

SEQ ID NO: 1913258 - RNA, 16 nt, Homo sapiens
ugaggcccccaucucc

SEQ ID NO: 1913259 - RNA, 14 nt, Homo sapiens
caucaggcuuucuu

SEQ ID NO: 1913260 - RNA, 17 nt, Homo sapiens
ucaagcuagaaggccac

SEQ ID NO: 1913261 - RNA, 19 nt, Homo sapiens
caaguuucugauaccacug

SEQ ID NO: 1913262 - RNA, 16 nt, Homo sapiens
aauaaaauguuucucu

SEQ ID NO: 1913263 - RNA, 19 nt, Homo sapiens
uugcugaccccacuuggac

SEQ ID NO: 1913264 - RNA, 21 nt, Homo sapiens
aagaggaauauucugguuuau

SEQ ID NO: 1913265 - RNA, 21 nt, Homo sapiens
uaucacuuaauaaaaaauaua

SEQ ID NO: 1913266 - RNA, 23 nt, Homo sapiens
agagaaagaggccagacauggug

SEQ ID NO: 1913267 - RNA, 18 nt, Homo sapiens
cuggugcuacuugcuuga

SEQ ID NO: 1913268 - RNA, 17 nt, Homo sapiens
gcuaugcaugucugacc

SEQ ID NO: 1913269 - RNA, 17 nt, Homo sapiens
gugucaggaaacauauu

SEQ ID NO: 1913270 - RNA, 20 nt, Homo sapiens
gcuguacccuuccaccuccu

SEQ ID NO: 1913271 - RNA, 21 nt, Homo sapiens
gcugcagcagaggcacugggg

SEQ ID NO: 1913272 - RNA, 14 nt, Homo sapiens
ugcgagaagcacag

SEQ ID NO: 1913273 - RNA, 12 nt, Homo sapiens
uuccauguuaaa

SEQ ID NO: 1913274 - RNA, 17 nt, Homo sapiens
ugccagaggaugcucuu

SEQ ID NO: 1913275 - RNA, 21 nt, Homo sapiens
agaauaaagccacuguaugau

SEQ ID NO: 1913276 - RNA, 13 nt, Homo sapiens
aaguaaaagcaag

SEQ ID NO: 1913277 - RNA, 18 nt, Homo sapiens
ugggagccaacugucagg

SEQ ID NO: 1913278 - RNA, 19 nt, Homo sapiens
auauguuuauauacugggu

SEQ ID NO: 1913279 - RNA, 15 nt, Homo sapiens
aggugaucuaccugc

SEQ ID NO: 1913280 - RNA, 20 nt, Homo sapiens
gacaggaggggaaggcaaca

SEQ ID NO: 1913281 - RNA, 20 nt, Homo sapiens
gagucucacuuuguugccca

SEQ ID NO: 1913282 - RNA, 18 nt, Homo sapiens
gugaguaaucuugcaaau

SEQ ID NO: 1913283 - RNA, 23 nt, Homo sapiens
caacugacagaugaccgcaauaa

SEQ ID NO: 1913284 - RNA, 14 nt, Homo sapiens
guuuucagcauaaa

SEQ ID NO: 1913285 - RNA, 16 nt, Homo sapiens
ucuuagaaaaaccacc

SEQ ID NO: 1913286 - RNA, 18 nt, Homo sapiens
cuuucuuuguauuuuccu

SEQ ID NO: 1913287 - RNA, 19 nt, Homo sapiens
ugagaagaucggaacagcu

SEQ ID NO: 1913288 - RNA, 16 nt, Homo sapiens
ugcagaaauaagaaua

SEQ ID NO: 1913289 - RNA, 19 nt, Homo sapiens
cagagcuguccuccuggca

SEQ ID NO: 1913290 - RNA, 13 nt, Homo sapiens
guuuuuuucccag

SEQ ID NO: 1913291 - RNA, 18 nt, Homo sapiens
auuaguugggcauggugg

SEQ ID NO: 1913292 - RNA, 14 nt, Homo sapiens
uuaauuucuaaaga

SEQ ID NO: 1913293 - RNA, 16 nt, Homo sapiens
aguaaaucagugcagu

SEQ ID NO: 1913294 - RNA, 17 nt, Homo sapiens
uuuuguuggcauagcuc

SEQ ID NO: 1913295 - RNA, 18 nt, Homo sapiens
augccuauuuacuggaaa

SEQ ID NO: 1913296 - RNA, 15 nt, Homo sapiens
ucacaggcagcucug

SEQ ID NO: 1913297 - RNA, 18 nt, Homo sapiens
ucuuggaaaaaaaccaca

SEQ ID NO: 1913298 - RNA, 22 nt, Homo sapiens
aacuuccaagucauucucaccu

SEQ ID NO: 1913299 - RNA, 22 nt, Homo sapiens
ggccugagcgaugggcaucaca

SEQ ID NO: 1913300 - RNA, 23 nt, Homo sapiens
uaauuuugaaaaacugcucauau

SEQ ID NO: 1913301 - RNA, 15 nt, Homo sapiens
auccaucucucucuu

SEQ ID NO: 1913302 - RNA, 19 nt, Homo sapiens
cacgcgacccucggugcag

SEQ ID NO: 1913303 - RNA, 12 nt, Homo sapiens
gcuccuaccugg

SEQ ID NO: 1913304 - RNA, 20 nt, Homo sapiens
acuguauauaaaucuucaaa

SEQ ID NO: 1913305 - RNA, 21 nt, Homo sapiens
uaaaaugguguuuucauguaa

SEQ ID NO: 1913306 - RNA, 18 nt, Homo sapiens
agcgcuucaguucagcuu

SEQ ID NO: 1913307 - RNA, 17 nt, Homo sapiens
ucaagaauagcauugua

SEQ ID NO: 1913308 - RNA, 14 nt, Homo sapiens
guccuggaaauucu

SEQ ID NO: 1913309 - RNA, 23 nt, Homo sapiens
cccuacacaaaauacagcacuuu

SEQ ID NO: 1913310 - RNA, 20 nt, Homo sapiens
cacacaccaaguaccaguau

SEQ ID NO: 1913311 - RNA, 22 nt, Homo sapiens
agcacugaaccacauucaggga

SEQ ID NO: 1913312 - RNA, 15 nt, Homo sapiens
aggugaccaguggga

SEQ ID NO: 1913313 - RNA, 12 nt, Homo sapiens
caucuugccagc

SEQ ID NO: 1913314 - RNA, 22 nt, Homo sapiens
agaucccgugaaauugaugcca

SEQ ID NO: 1913315 - RNA, 18 nt, Homo sapiens
cucuuuguucucagcucc

SEQ ID NO: 1913316 - RNA, 16 nt, Homo sapiens
aggcacaguggcucac

SEQ ID NO: 1913317 - RNA, 19 nt, Homo sapiens
aggcacgcaccaccaugcc

SEQ ID NO: 1913318 - RNA, 18 nt, Homo sapiens
ggugacuuuccuaugaca

SEQ ID NO: 1913319 - RNA, 22 nt, Homo sapiens
cugcagggucgguacugaugga

SEQ ID NO: 1913320 - RNA, 17 nt, Homo sapiens
uagcauuuugcuaucuu

SEQ ID NO: 1913321 - RNA, 22 nt, Homo sapiens
caaauacaauucagucuucucu

SEQ ID NO: 1913322 - RNA, 16 nt, Homo sapiens
acccuguuaaucccaa

SEQ ID NO: 1913323 - RNA, 14 nt, Homo sapiens
auuaauuacauaca

SEQ ID NO: 1913324 - RNA, 18 nt, Homo sapiens
gggagucauggacaugaa

SEQ ID NO: 1913325 - RNA, 18 nt, Homo sapiens
guagcugggauuacaggc

SEQ ID NO: 1913326 - RNA, 15 nt, Homo sapiens
cauucacaccacaca

SEQ ID NO: 1913327 - RNA, 18 nt, Homo sapiens
ggaucuaucaccugucau

SEQ ID NO: 1913328 - RNA, 21 nt, Homo sapiens
uaaagccucagcaacagccag

SEQ ID NO: 1913329 - RNA, 22 nt, Homo sapiens
agauaaggaacagcucgggcca

SEQ ID NO: 1913330 - RNA, 21 nt, Homo sapiens
uggccuauuuuggacguguga

SEQ ID NO: 1913331 - RNA, 16 nt, Homo sapiens
acagacacgugugagu

SEQ ID NO: 1913332 - RNA, 16 nt, Homo sapiens
aucaacaagauuucca

SEQ ID NO: 1913333 - RNA, 19 nt, Homo sapiens
cgccaacauggcacaugua

SEQ ID NO: 1913334 - RNA, 23 nt, Homo sapiens
guguugucucauagaacugccug

SEQ ID NO: 1913335 - RNA, 18 nt, Homo sapiens
gcacguguguguguuuca

SEQ ID NO: 1913336 - RNA, 15 nt, Homo sapiens
gcaugaaucuucccu

SEQ ID NO: 1913337 - RNA, 23 nt, Homo sapiens
gcuuuaauaaaggccacaggaga

SEQ ID NO: 1913338 - RNA, 12 nt, Homo sapiens
cauuggcacaau

SEQ ID NO: 1913339 - RNA, 18 nt, Homo sapiens
uaagagaaggggugcaga

SEQ ID NO: 1913340 - RNA, 17 nt, Homo sapiens
gcucccuuuuaagccag

SEQ ID NO: 1913341 - RNA, 20 nt, Homo sapiens
ugggacuguacacacuuuau

SEQ ID NO: 1913342 - RNA, 19 nt, Homo sapiens
agccgauuccuccagcccu

SEQ ID NO: 1913343 - RNA, 14 nt, Homo sapiens
caggagagacagag

SEQ ID NO: 1913344 - RNA, 11 nt, Homo sapiens
cauuaaauuca

SEQ ID NO: 1913345 - RNA, 22 nt, Homo sapiens
aucagacccaacccaugaaggc

SEQ ID NO: 1913346 - RNA, 15 nt, Homo sapiens
uuggaagucugucuc

SEQ ID NO: 1913347 - RNA, 12 nt, Homo sapiens
gaaacauuggaa

SEQ ID NO: 1913348 - RNA, 15 nt, Homo sapiens
ucauuauauucauau

SEQ ID NO: 1913349 - RNA, 14 nt, Homo sapiens
cugugcaucaacca

SEQ ID NO: 1913350 - RNA, 22 nt, Homo sapiens
ucagagcauuuuguugccucag

SEQ ID NO: 1913351 - RNA, 22 nt, Homo sapiens
accauuuuaguuuuaauuccau

SEQ ID NO: 1913352 - RNA, 13 nt, Homo sapiens
ccagagcacuuua

SEQ ID NO: 1913353 - RNA, 13 nt, Homo sapiens
guugugcagcauu

SEQ ID NO: 1913354 - RNA, 21 nt, Homo sapiens
acuuucuguguugaagcacug

SEQ ID NO: 1913355 - RNA, 13 nt, Homo sapiens
caugcaaugcagc

SEQ ID NO: 1913356 - RNA, 13 nt, Homo sapiens
aaugucagccuuu

SEQ ID NO: 1913357 - RNA, 13 nt, Homo sapiens
cauggcagacuug

SEQ ID NO: 1913358 - RNA, 22 nt, Homo sapiens
uuuuucuggccucgcuguucuc

SEQ ID NO: 1913359 - RNA, 12 nt, Homo sapiens
uuugccaaaaac

SEQ ID NO: 1913360 - RNA, 14 nt, Homo sapiens
gucgagaagccagg

SEQ ID NO: 1913361 - RNA, 22 nt, Homo sapiens
cacccggcucguguauuuauua

SEQ ID NO: 1913362 - RNA, 22 nt, Homo sapiens
uaaaaacuuccuucaaucuuca

SEQ ID NO: 1913363 - RNA, 19 nt, Homo sapiens
ucaucugccaagcuccuca

SEQ ID NO: 1913364 - RNA, 23 nt, Homo sapiens
gauauuuuaccucuuauugcaaa

SEQ ID NO: 1913365 - RNA, 17 nt, Homo sapiens
ccaguuacguuguguau

SEQ ID NO: 1913366 - RNA, 23 nt, Homo sapiens
aaccuuauguagguugccagcua

SEQ ID NO: 1913367 - RNA, 19 nt, Homo sapiens
aagaagaaguaaaacuauu

SEQ ID NO: 1913368 - RNA, 22 nt, Homo sapiens
augcugaggccacccacugacc

SEQ ID NO: 1913369 - RNA, 18 nt, Homo sapiens
ucacauagguguugucaa

SEQ ID NO: 1913370 - RNA, 21 nt, Homo sapiens
aauacaucaaaauauacuggg

SEQ ID NO: 1913371 - RNA, 22 nt, Homo sapiens
guuugucacacgauaaagggau

SEQ ID NO: 1913372 - RNA, 23 nt, Homo sapiens
cuuggaagagaaugucugaucua

SEQ ID NO: 1913373 - RNA, 13 nt, Homo sapiens
gguuuuugcaaau

SEQ ID NO: 1913374 - RNA, 20 nt, Homo sapiens
uuguauuuaaaugaaaguga

SEQ ID NO: 1913375 - RNA, 12 nt, Homo sapiens
auguaaccaaga

SEQ ID NO: 1913376 - RNA, 16 nt, Homo sapiens
auaacaccaucuggag

SEQ ID NO: 1913377 - RNA, 16 nt, Homo sapiens
cagacaccauucauuc

SEQ ID NO: 1913378 - RNA, 22 nt, Homo sapiens
uaaguccuacuuuuaaagaauu

SEQ ID NO: 1913379 - RNA, 23 nt, Homo sapiens
cucaaaggcauaagucauuccaa

SEQ ID NO: 1913380 - RNA, 23 nt, Homo sapiens
cuucaguuuccauccccaggauc

SEQ ID NO: 1913381 - RNA, 18 nt, Homo sapiens
acuuaaaaucuaauucaa

SEQ ID NO: 1913382 - RNA, 14 nt, Homo sapiens
uuuuuaaguguucu

SEQ ID NO: 1913383 - RNA, 18 nt, Homo sapiens
agcucauuugugacaaca

SEQ ID NO: 1913384 - RNA, 22 nt, Homo sapiens
guuaagcacuuuaacacagugu

SEQ ID NO: 1913385 - RNA, 17 nt, Homo sapiens
ccaaacaccagucaccu

SEQ ID NO: 1913386 - RNA, 19 nt, Homo sapiens
auaguuggagguauccugu

SEQ ID NO: 1913387 - RNA, 19 nt, Homo sapiens
cgaaacuccauugagucau

SEQ ID NO: 1913388 - RNA, 21 nt, Homo sapiens
gugagacuucuguuugaucac

SEQ ID NO: 1913389 - RNA, 19 nt, Homo sapiens
uuccauccauuaccuccau

SEQ ID NO: 1913390 - RNA, 18 nt, Homo sapiens
uaggcauaugcuucuuua

SEQ ID NO: 1913391 - RNA, 15 nt, Homo sapiens
caccugggccaagga

SEQ ID NO: 1913392 - RNA, 17 nt, Homo sapiens
gaagacugggugugcaa

SEQ ID NO: 1913393 - RNA, 20 nt, Homo sapiens
cagugcacacggaugcacag

SEQ ID NO: 1913394 - RNA, 14 nt, Homo sapiens
gaauauacauaguc

SEQ ID NO: 1913395 - RNA, 17 nt, Homo sapiens
uccccaagaucugccag

SEQ ID NO: 1913396 - RNA, 19 nt, Homo sapiens
aagggacaccaagccuugg

SEQ ID NO: 1913397 - RNA, 17 nt, Homo sapiens
acuuauuuucuguucag

SEQ ID NO: 1913398 - RNA, 12 nt, Homo sapiens
ucucccaaagug

SEQ ID NO: 1913399 - RNA, 14 nt, Homo sapiens
ugcugaaugaagcu

SEQ ID NO: 1913400 - RNA, 20 nt, Homo sapiens
cagucauuauuagcuuuuau

SEQ ID NO: 1913401 - RNA, 15 nt, Homo sapiens
uuaaucuuuucacaa

SEQ ID NO: 1913402 - RNA, 22 nt, Homo sapiens
uaaggggggcagggagugauga

SEQ ID NO: 1913403 - RNA, 18 nt, Homo sapiens
gaagcucaacuguugcca

SEQ ID NO: 1913404 - RNA, 13 nt, Homo sapiens
aaaaugaagauua

SEQ ID NO: 1913405 - RNA, 15 nt, Homo sapiens
caaguggguaguguc

SEQ ID NO: 1913406 - RNA, 20 nt, Homo sapiens
ugccaugcuggugcgcugca

SEQ ID NO: 1913407 - RNA, 19 nt, Homo sapiens
caacaaggggucaauguca

SEQ ID NO: 1913408 - RNA, 18 nt, Homo sapiens
cuuuuguuuugaguuacu

SEQ ID NO: 1913409 - RNA, 13 nt, Homo sapiens
auaauaacucaua

SEQ ID NO: 1913410 - RNA, 23 nt, Homo sapiens
agaaccaccauagugaaguguga

SEQ ID NO: 1913411 - RNA, 17 nt, Homo sapiens
aacagaacuaucucagc

SEQ ID NO: 1913412 - RNA, 12 nt, Homo sapiens
uucagguauuac

SEQ ID NO: 1913413 - RNA, 17 nt, Homo sapiens
ugcaugaguaugugcac

SEQ ID NO: 1913414 - RNA, 14 nt, Homo sapiens
uaacucuugcucac

SEQ ID NO: 1913415 - RNA, 15 nt, Homo sapiens
gacacaggugccuca

SEQ ID NO: 1913416 - RNA, 20 nt, Homo sapiens
agagaaaaagcccucuucaa

SEQ ID NO: 1913417 - RNA, 16 nt, Homo sapiens
agucuugccuugcuga

SEQ ID NO: 1913418 - RNA, 21 nt, Homo sapiens
acccaggggacagcuggugca

SEQ ID NO: 1913419 - RNA, 22 nt, Homo sapiens
uagaaauguauuuugaaaacac

SEQ ID NO: 1913420 - RNA, 19 nt, Homo sapiens
caucccagacuugcugaau

SEQ ID NO: 1913421 - RNA, 14 nt, Homo sapiens
ugugugcauguaug

SEQ ID NO: 1913422 - RNA, 19 nt, Homo sapiens
aagugcucacgugcagcuc

SEQ ID NO: 1913423 - RNA, 18 nt, Homo sapiens
ccaaccacaagcacacag

SEQ ID NO: 1913424 - RNA, 16 nt, Homo sapiens
ugccagccauucuuuc

SEQ ID NO: 1913425 - RNA, 17 nt, Homo sapiens
gacuucauuuuuccuaa

SEQ ID NO: 1913426 - RNA, 18 nt, Homo sapiens
gaaagcaggcaagcaugu

SEQ ID NO: 1913427 - RNA, 17 nt, Homo sapiens
guauguuuuacacugua

SEQ ID NO: 1913428 - RNA, 22 nt, Homo sapiens
cacagacuggagacaaugcaga

SEQ ID NO: 1913429 - RNA, 13 nt, Homo sapiens
uccuaggcuggaa

SEQ ID NO: 1913430 - RNA, 19 nt, Homo sapiens
gacuuaguacaaaguuuca

SEQ ID NO: 1913431 - RNA, 18 nt, Homo sapiens
cuuguugaauacugagaa

SEQ ID NO: 1913432 - RNA, 17 nt, Homo sapiens
ugaucuccugaccucau

SEQ ID NO: 1913433 - RNA, 15 nt, Homo sapiens
aucucuucuuccuuu

SEQ ID NO: 1913434 - RNA, 13 nt, Homo sapiens
ucuccugugugcu

SEQ ID NO: 1913435 - RNA, 15 nt, Homo sapiens
agauagacggguuga

SEQ ID NO: 1913436 - RNA, 15 nt, Homo sapiens
uccaugaauucuuga

SEQ ID NO: 1913437 - RNA, 21 nt, Homo sapiens
auccuguaggaagguacugua

SEQ ID NO: 1913438 - RNA, 20 nt, Homo sapiens
aagacuuccucaugaaucuc

SEQ ID NO: 1913439 - RNA, 17 nt, Homo sapiens
ucuccugcgugugccca

SEQ ID NO: 1913440 - RNA, 15 nt, Homo sapiens
gccacaagucuucca

SEQ ID NO: 1913441 - RNA, 23 nt, Homo sapiens
uguucuucauuaccucagugaga

SEQ ID NO: 1913442 - RNA, 16 nt, Homo sapiens
uagcuguccucucaga

SEQ ID NO: 1913443 - RNA, 15 nt, Homo sapiens
ugcaaaaguggaauc

SEQ ID NO: 1913444 - RNA, 15 nt, Homo sapiens
uuuuugaaucuauga

SEQ ID NO: 1913445 - RNA, 15 nt, Homo sapiens
cucaggaacccugga

SEQ ID NO: 1913446 - RNA, 14 nt, Homo sapiens
aauaucugcuguau

SEQ ID NO: 1913447 - RNA, 23 nt, Homo sapiens
aagcugguugucuuuacaugaaa

SEQ ID NO: 1913448 - RNA, 22 nt, Homo sapiens
gcauguggugauuggccacaca

SEQ ID NO: 1913449 - RNA, 23 nt, Homo sapiens
aguaauuuuaguuauacuccuca

SEQ ID NO: 1913450 - RNA, 13 nt, Homo sapiens
uccaggagcucag

SEQ ID NO: 1913451 - RNA, 16 nt, Homo sapiens
uguuuuuuuuaagggc

SEQ ID NO: 1913452 - RNA, 18 nt, Homo sapiens
ccuuccugucugaacaaa

SEQ ID NO: 1913453 - RNA, 23 nt, Homo sapiens
gaccccuucccuguccuugcccu

SEQ ID NO: 1913454 - RNA, 19 nt, Homo sapiens
ccuuccccuugaaccucau

SEQ ID NO: 1913455 - RNA, 13 nt, Homo sapiens
agugaaacaugua

SEQ ID NO: 1913456 - RNA, 13 nt, Homo sapiens
ccuagaaauaucu

SEQ ID NO: 1913457 - RNA, 19 nt, Homo sapiens
uccagccacuccaacugug

SEQ ID NO: 1913458 - RNA, 17 nt, Homo sapiens
gggguaugagcugccaa

SEQ ID NO: 1913459 - RNA, 17 nt, Homo sapiens
acuucuguacaguaaga

SEQ ID NO: 1913460 - RNA, 16 nt, Homo sapiens
gcaaaauagcuuggac

SEQ ID NO: 1913461 - RNA, 12 nt, Homo sapiens
uugccaagcccu

SEQ ID NO: 1913462 - RNA, 20 nt, Homo sapiens
cucauuuacacucagcugcu

SEQ ID NO: 1913463 - RNA, 14 nt, Homo sapiens
ccugccaacauacu

SEQ ID NO: 1913464 - RNA, 22 nt, Homo sapiens
uagaaagauggggcauauucau

SEQ ID NO: 1913465 - RNA, 19 nt, Homo sapiens
ggagccccauccuguguua

SEQ ID NO: 1913466 - RNA, 19 nt, Homo sapiens
cguguauuccauaugucua

SEQ ID NO: 1913467 - RNA, 18 nt, Homo sapiens
acacaugcucucaauaua

SEQ ID NO: 1913468 - RNA, 18 nt, Homo sapiens
gauccuaaucccuuccuc

SEQ ID NO: 1913469 - RNA, 14 nt, Homo sapiens
aacuaguauucccu

SEQ ID NO: 1913470 - RNA, 20 nt, Homo sapiens
gaugccacgcuuugcugcua

SEQ ID NO: 1913471 - RNA, 17 nt, Homo sapiens
gacuuaguugcguuaca

SEQ ID NO: 1913472 - RNA, 16 nt, Homo sapiens
cucugacuaacgccau

SEQ ID NO: 1913473 - RNA, 20 nt, Homo sapiens
aauaaaccaucaucuugcca

SEQ ID NO: 1913474 - RNA, 18 nt, Homo sapiens
aggauccagugacaugau

SEQ ID NO: 1913475 - RNA, 14 nt, Homo sapiens
cguuuagaacucau

SEQ ID NO: 1913476 - RNA, 18 nt, Homo sapiens
agagccuaacaucuccau

SEQ ID NO: 1913477 - RNA, 13 nt, Homo sapiens
uuggcaccuguag

SEQ ID NO: 1913478 - RNA, 21 nt, Homo sapiens
aucucccacccuguaccucau

SEQ ID NO: 1913479 - RNA, 21 nt, Homo sapiens
uccaguacucuguaaguuucu

SEQ ID NO: 1913480 - RNA, 18 nt, Homo sapiens
gacgcuucccuugccguu

SEQ ID NO: 1913481 - RNA, 14 nt, Homo sapiens
aggagccucacugg

SEQ ID NO: 1913482 - RNA, 23 nt, Homo sapiens
guuuccgaaggguuuugcuacau

SEQ ID NO: 1913483 - RNA, 15 nt, Homo sapiens
gacaugcacugaccc

SEQ ID NO: 1913484 - RNA, 19 nt, Homo sapiens
ccuggcagcaugacucaga

SEQ ID NO: 1913485 - RNA, 20 nt, Homo sapiens
uuaaaauauucccacucagc

SEQ ID NO: 1913486 - RNA, 13 nt, Homo sapiens
accucacagccag

SEQ ID NO: 1913487 - RNA, 13 nt, Homo sapiens
gccugacaaccac

SEQ ID NO: 1913488 - RNA, 23 nt, Homo sapiens
caggcagaaauauuuaguaucua

SEQ ID NO: 1913489 - RNA, 17 nt, Homo sapiens
uauugaauucauuucac

SEQ ID NO: 1913490 - RNA, 17 nt, Homo sapiens
cuuuuguccacuuguaa

SEQ ID NO: 1913491 - RNA, 21 nt, Homo sapiens
caaguggugagcaagcaccaa

SEQ ID NO: 1913492 - RNA, 19 nt, Homo sapiens
cagauuuuaacagcucucu

SEQ ID NO: 1913493 - RNA, 15 nt, Homo sapiens
uuauugaaugugauu

SEQ ID NO: 1913494 - RNA, 21 nt, Homo sapiens
aggcgcccgggauccagcuca

SEQ ID NO: 1913495 - RNA, 19 nt, Homo sapiens
auaccaccagacugcaaug

SEQ ID NO: 1913496 - RNA, 13 nt, Homo sapiens
auccuccucagcc

SEQ ID NO: 1913497 - RNA, 17 nt, Homo sapiens
aaaucugacagucucaa

SEQ ID NO: 1913498 - RNA, 15 nt, Homo sapiens
gcugcacaggcacug

SEQ ID NO: 1913499 - RNA, 21 nt, Homo sapiens
cacuaugauaaaguuguaaau

SEQ ID NO: 1913500 - RNA, 19 nt, Homo sapiens
aaacagaacggguucuccc

SEQ ID NO: 1913501 - RNA, 20 nt, Homo sapiens
aaggacaggucucugagaca

SEQ ID NO: 1913502 - RNA, 13 nt, Homo sapiens
aggagauacugaa

SEQ ID NO: 1913503 - RNA, 14 nt, Homo sapiens
cuggauuugcagaa

SEQ ID NO: 1913504 - RNA, 14 nt, Homo sapiens
ccgucuuuguauca

SEQ ID NO: 1913505 - RNA, 20 nt, Homo sapiens
cacuuuaccuucagcaguua

SEQ ID NO: 1913506 - RNA, 20 nt, Homo sapiens
cuuacagacacccauaauaa

SEQ ID NO: 1913507 - RNA, 17 nt, Homo sapiens
uugguuuggauuacuau

SEQ ID NO: 1913508 - RNA, 17 nt, Homo sapiens
acauggugccccuagcu

SEQ ID NO: 1913509 - RNA, 14 nt, Homo sapiens
aguauguucuugaa

SEQ ID NO: 1913510 - RNA, 15 nt, Homo sapiens
caauaaaagccagau

SEQ ID NO: 1913511 - RNA, 16 nt, Homo sapiens
uauuugugcucuguga

SEQ ID NO: 1913512 - RNA, 18 nt, Homo sapiens
auuacacgccacaacucc

SEQ ID NO: 1913513 - RNA, 20 nt, Homo sapiens
cuucaagggacaaguauuaa

SEQ ID NO: 1913514 - RNA, 16 nt, Homo sapiens
uaaacaaagcaguaua

SEQ ID NO: 1913515 - RNA, 15 nt, Homo sapiens
aauaucuuaucuucc

SEQ ID NO: 1913516 - RNA, 15 nt, Homo sapiens
aauauuuuaucuuuc

SEQ ID NO: 1913517 - RNA, 16 nt, Homo sapiens
gaaugaacaaagucca

SEQ ID NO: 1913518 - RNA, 20 nt, Homo sapiens
uccaaaaguguugacugugu

SEQ ID NO: 1913519 - RNA, 20 nt, Homo sapiens
gucagccuugcaucaagggc

SEQ ID NO: 1913520 - RNA, 16 nt, Homo sapiens
auuuccaaacuugaaa

SEQ ID NO: 1913521 - RNA, 23 nt, Homo sapiens
ugucccugcccaggccucuggcu

SEQ ID NO: 1913522 - RNA, 18 nt, Homo sapiens
cauagcauuuguguaaag

SEQ ID NO: 1913523 - RNA, 16 nt, Homo sapiens
uuccaguccuaacuuu

SEQ ID NO: 1913524 - RNA, 21 nt, Homo sapiens
auugaaucccuuaaacucagg

SEQ ID NO: 1913525 - RNA, 22 nt, Homo sapiens
caauuagucugucacuccauuu

SEQ ID NO: 1913526 - RNA, 19 nt, Homo sapiens
gugcagacugaugggacau

SEQ ID NO: 1913527 - RNA, 21 nt, Homo sapiens
augcaaaaacauaugucuguc

SEQ ID NO: 1913528 - RNA, 13 nt, Homo sapiens
auucgccuguggg

SEQ ID NO: 1913529 - RNA, 13 nt, Homo sapiens
auucaccugugga

SEQ ID NO: 1913530 - RNA, 21 nt, Homo sapiens
uguauauuuuguaguuaauau

SEQ ID NO: 1913531 - RNA, 21 nt, Homo sapiens
uucaguugcuuugcccaagau

SEQ ID NO: 1913532 - RNA, 23 nt, Homo sapiens
cgugggacaucuaguaggugcuu

SEQ ID NO: 1913533 - RNA, 14 nt, Homo sapiens
uagaagccaaggga

SEQ ID NO: 1913534 - RNA, 23 nt, Homo sapiens
ugggucagaguuccgacugccau

SEQ ID NO: 1913535 - RNA, 19 nt, Homo sapiens
aguguucuaugaacaacuc

SEQ ID NO: 1913536 - RNA, 14 nt, Homo sapiens
agugccuugcccac

SEQ ID NO: 1913537 - RNA, 23 nt, Homo sapiens
auauuuccaucagcccaucucaa

SEQ ID NO: 1913538 - RNA, 17 nt, Homo sapiens
uuggcuugauaaacaua

SEQ ID NO: 1913539 - RNA, 20 nt, Homo sapiens
gaaaggauuuuaccaaagca

SEQ ID NO: 1913540 - RNA, 20 nt, Homo sapiens
auggagguuuccuuuuggaa

SEQ ID NO: 1913541 - RNA, 17 nt, Homo sapiens
ggagaaaucacauaacc

SEQ ID NO: 1913542 - RNA, 17 nt, Homo sapiens
uugacauaaucauucau

SEQ ID NO: 1913543 - RNA, 12 nt, Homo sapiens
ugggcauucaca

SEQ ID NO: 1913544 - RNA, 21 nt, Homo sapiens
accauuuguaaaacauuccaa

SEQ ID NO: 1913545 - RNA, 16 nt, Homo sapiens
auaaaugucuuuccaa

SEQ ID NO: 1913546 - RNA, 22 nt, Homo sapiens
gucaauuaaaaugcccauuugu

SEQ ID NO: 1913547 - RNA, 17 nt, Homo sapiens
gaucaaggaguacaaug

SEQ ID NO: 1913548 - RNA, 23 nt, Homo sapiens
gaccugcggcaguauguacuuca

SEQ ID NO: 1913549 - RNA, 14 nt, Homo sapiens
cuggcugaggggcu

SEQ ID NO: 1913550 - RNA, 13 nt, Homo sapiens
ccagcagucacag

SEQ ID NO: 1913551 - RNA, 23 nt, Homo sapiens
ucacgugucuuuagaacuccagu

SEQ ID NO: 1913552 - RNA, 14 nt, Homo sapiens
gcccccugaccugg

SEQ ID NO: 1913553 - RNA, 14 nt, Homo sapiens
ugaacuaacugcca

SEQ ID NO: 1913554 - RNA, 18 nt, Homo sapiens
ccauggggacgcccucag

SEQ ID NO: 1913555 - RNA, 18 nt, Homo sapiens
caguguccccuccacugu

SEQ ID NO: 1913556 - RNA, 19 nt, Homo sapiens
ggcaggagaagggguguuc

SEQ ID NO: 1913557 - RNA, 21 nt, Homo sapiens
agagaaaaacaacccagcgaa

SEQ ID NO: 1913558 - RNA, 23 nt, Homo sapiens
uguaugaauuuuguaaguauaag

SEQ ID NO: 1913559 - RNA, 10 nt, Homo sapiens
gcccaaccuc

SEQ ID NO: 1913560 - RNA, 16 nt, Homo sapiens
uucacacugaccaaga

SEQ ID NO: 1913561 - RNA, 17 nt, Homo sapiens
augagaguuccuucuca

SEQ ID NO: 1913562 - RNA, 16 nt, Homo sapiens
ccagcuaucugccuga

SEQ ID NO: 1913563 - RNA, 23 nt, Homo sapiens
ucccagauuuaggguacuuuuau

SEQ ID NO: 1913564 - RNA, 22 nt, Homo sapiens
ucccauuuacucuugagacuac

SEQ ID NO: 1913565 - RNA, 14 nt, Homo sapiens
agaugagguucuga

SEQ ID NO: 1913566 - RNA, 14 nt, Homo sapiens
aucucccacacaag

SEQ ID NO: 1913567 - RNA, 22 nt, Homo sapiens
gaacaggacugcaaaaauccuu

SEQ ID NO: 1913568 - RNA, 15 nt, Homo sapiens
aaagauuucaaauaa

SEQ ID NO: 1913569 - RNA, 23 nt, Homo sapiens
uauuguccaccaugcucucucac

SEQ ID NO: 1913570 - RNA, 16 nt, Homo sapiens
ugccuuccacaauuca

SEQ ID NO: 1913571 - RNA, 12 nt, Homo sapiens
cacaacccaucu

SEQ ID NO: 1913572 - RNA, 14 nt, Homo sapiens
uaacugauuacugu

SEQ ID NO: 1913573 - RNA, 22 nt, Homo sapiens
uauaauguacagaagagcaaaa

SEQ ID NO: 1913574 - RNA, 14 nt, Homo sapiens
acuccaagaccacc

SEQ ID NO: 1913575 - RNA, 20 nt, Homo sapiens
cuuuuaaaaugguaugccaa

SEQ ID NO: 1913576 - RNA, 16 nt, Homo sapiens
ccccucaaaauccaag

SEQ ID NO: 1913577 - RNA, 19 nt, Homo sapiens
ccagugggaacugugcaaa

SEQ ID NO: 1913578 - RNA, 11 nt, Homo sapiens
aaaagacauaa

SEQ ID NO: 1913579 - RNA, 13 nt, Homo sapiens
uacugaagccagg

SEQ ID NO: 1913580 - RNA, 23 nt, Homo sapiens
uuaaaucaggaaauacaccugga

SEQ ID NO: 1913581 - RNA, 16 nt, Homo sapiens
aauaauguauacacau

SEQ ID NO: 1913582 - RNA, 22 nt, Homo sapiens
uauuuccaaauuacugauauca

SEQ ID NO: 1913583 - RNA, 14 nt, Homo sapiens
uacuggacuguaaa

SEQ ID NO: 1913584 - RNA, 21 nt, Homo sapiens
caaaagaaaauauagucacag

SEQ ID NO: 1913585 - RNA, 16 nt, Homo sapiens
uaggcuuaaaugcaau

SEQ ID NO: 1913586 - RNA, 23 nt, Homo sapiens
aauaaguuuuuuuaaaguguuau

SEQ ID NO: 1913587 - RNA, 18 nt, Homo sapiens
agucuugcucuguugccc

SEQ ID NO: 1913588 - RNA, 17 nt, Homo sapiens
ggauacagaaugaaucc

SEQ ID NO: 1913589 - RNA, 14 nt, Homo sapiens
aggcucugucucaa

SEQ ID NO: 1913590 - RNA, 18 nt, Homo sapiens
acugcuugugcacuggau

SEQ ID NO: 1913591 - RNA, 23 nt, Homo sapiens
uucacacuaucaacacugcagca

SEQ ID NO: 1913592 - RNA, 20 nt, Homo sapiens
cuucaagauccucuugccac

SEQ ID NO: 1913593 - RNA, 20 nt, Homo sapiens
aggaggcccagcugcucagu

SEQ ID NO: 1913594 - RNA, 21 nt, Homo sapiens
ccaaccuggccccgccccucc

SEQ ID NO: 1913595 - RNA, 18 nt, Homo sapiens
agcccacucccugccuac

SEQ ID NO: 1913596 - RNA, 15 nt, Homo sapiens
gugaaaugcagaguc

SEQ ID NO: 1913597 - RNA, 22 nt, Homo sapiens
aagacugaauguuuuauuuauc

SEQ ID NO: 1913598 - RNA, 10 nt, Homo sapiens
aggacugugu

SEQ ID NO: 1913599 - RNA, 15 nt, Homo sapiens
caugcauaaaucaau

SEQ ID NO: 1913600 - RNA, 20 nt, Homo sapiens
ucauagcaccuaacaacauu

SEQ ID NO: 1913601 - RNA, 16 nt, Homo sapiens
gugaccugacaccugc

SEQ ID NO: 1913602 - RNA, 14 nt, Homo sapiens
uacuaggugccuuu

SEQ ID NO: 1913603 - RNA, 20 nt, Homo sapiens
auaacagcuggggacaacug

SEQ ID NO: 1913604 - RNA, 18 nt, Homo sapiens
uuuaagcuuuccuguuga

SEQ ID NO: 1913605 - RNA, 16 nt, Homo sapiens
acuccuaggcaggaca

SEQ ID NO: 1913606 - RNA, 13 nt, Homo sapiens
cuauucuauccau

SEQ ID NO: 1913607 - RNA, 17 nt, Homo sapiens
gcugcucaacuugcaaa

SEQ ID NO: 1913608 - RNA, 20 nt, Homo sapiens
cugugaagcaggucuuucac

SEQ ID NO: 1913609 - RNA, 15 nt, Homo sapiens
gccccagagugcuuu

SEQ ID NO: 1913610 - RNA, 12 nt, Homo sapiens
ugcauugaacag

SEQ ID NO: 1913611 - RNA, 17 nt, Homo sapiens
acggcuucucacgcuuu

SEQ ID NO: 1913612 - RNA, 22 nt, Homo sapiens
ugccaagcuuccugugcccuca

SEQ ID NO: 1913613 - RNA, 22 nt, Homo sapiens
uugcaguauaucacagagccac

SEQ ID NO: 1913614 - RNA, 17 nt, Homo sapiens
acugggucugacaugaa

SEQ ID NO: 1913615 - RNA, 19 nt, Homo sapiens
caggauuuccucuugaacc

SEQ ID NO: 1913616 - RNA, 19 nt, Homo sapiens
aggcuuugaguuaacucac

SEQ ID NO: 1913617 - RNA, 17 nt, Homo sapiens
uaaauggaaacugaaac

SEQ ID NO: 1913618 - RNA, 15 nt, Homo sapiens
cuuucuccagaucag

SEQ ID NO: 1913619 - RNA, 13 nt, Homo sapiens
uguccauccuccu

SEQ ID NO: 1913620 - RNA, 19 nt, Homo sapiens
agugaagcugguggaacau

SEQ ID NO: 1913621 - RNA, 12 nt, Homo sapiens
cagagucaucuc

SEQ ID NO: 1913622 - RNA, 17 nt, Homo sapiens
ugggaugagagggccca

SEQ ID NO: 1913623 - RNA, 17 nt, Homo sapiens
aaguacuguaacugugu

SEQ ID NO: 1913624 - RNA, 17 nt, Homo sapiens
auguacuguuacugugu

SEQ ID NO: 1913625 - RNA, 14 nt, Homo sapiens
aaucaagauuuaau

SEQ ID NO: 1913626 - RNA, 14 nt, Homo sapiens
auaaaggaugugau

SEQ ID NO: 1913627 - RNA, 14 nt, Homo sapiens
auccaguuauuaga

SEQ ID NO: 1913628 - RNA, 22 nt, Homo sapiens
uaaacaaaugugauacauuuaa

SEQ ID NO: 1913629 - RNA, 13 nt, Homo sapiens
uggggucaggaac

SEQ ID NO: 1913630 - RNA, 15 nt, Homo sapiens
ccccacucagccuuu

SEQ ID NO: 1913631 - RNA, 19 nt, Homo sapiens
cucucucaccaugugacac

SEQ ID NO: 1913632 - RNA, 19 nt, Homo sapiens
uguaguggcauccauuucu

SEQ ID NO: 1913633 - RNA, 20 nt, Homo sapiens
agcacugccucuuccagggc

SEQ ID NO: 1913634 - RNA, 20 nt, Homo sapiens
gcacacacagauaugcacac

SEQ ID NO: 1913635 - RNA, 20 nt, Homo sapiens
gugagugugugugcauggaa

SEQ ID NO: 1913636 - RNA, 11 nt, Homo sapiens
aucucuuguca

SEQ ID NO: 1913637 - RNA, 19 nt, Homo sapiens
aaguguuugaaagcuuuau

SEQ ID NO: 1913638 - RNA, 22 nt, Homo sapiens
gaucugcccccuuuacuccucg

SEQ ID NO: 1913639 - RNA, 19 nt, Homo sapiens
agauguggcuacugacaua

SEQ ID NO: 1913640 - RNA, 20 nt, Homo sapiens
aauaaacuguguuuacucag

SEQ ID NO: 1913641 - RNA, 13 nt, Homo sapiens
aaaucacuugaac

SEQ ID NO: 1913642 - RNA, 20 nt, Homo sapiens
gagaagaauaucaaauaaua

SEQ ID NO: 1913643 - RNA, 21 nt, Homo sapiens
auguuaguguuuagauaauac

SEQ ID NO: 1913644 - RNA, 14 nt, Homo sapiens
cuauuacuaguacu

SEQ ID NO: 1913645 - RNA, 12 nt, Homo sapiens
acauuccuugag

SEQ ID NO: 1913646 - RNA, 12 nt, Homo sapiens
accuuccuugcg

SEQ ID NO: 1913647 - RNA, 20 nt, Homo sapiens
uauuugcugccagacacuga

SEQ ID NO: 1913648 - RNA, 16 nt, Homo sapiens
cuguucccuuccucac

SEQ ID NO: 1913649 - RNA, 21 nt, Homo sapiens
gaaauauauuaugauugcaua

SEQ ID NO: 1913650 - RNA, 15 nt, Homo sapiens
ugaguccuggcaugg

SEQ ID NO: 1913651 - RNA, 16 nt, Homo sapiens
ucagauagaaugacag

SEQ ID NO: 1913652 - RNA, 11 nt, Homo sapiens
uuuuugcagcu

SEQ ID NO: 1913653 - RNA, 18 nt, Homo sapiens
auccaucuugagccacag

SEQ ID NO: 1913654 - RNA, 22 nt, Homo sapiens
ccaggaggagaaagcagccauu

SEQ ID NO: 1913655 - RNA, 18 nt, Homo sapiens
ucugaugucuucuuacua

SEQ ID NO: 1913656 - RNA, 19 nt, Homo sapiens
auaacuuuucuaaagccuu

SEQ ID NO: 1913657 - RNA, 13 nt, Homo sapiens
agggagaugccau

SEQ ID NO: 1913658 - RNA, 13 nt, Homo sapiens
uaaaaaguuugaa

SEQ ID NO: 1913659 - RNA, 13 nt, Homo sapiens
gagugaguguaug

SEQ ID NO: 1913660 - RNA, 13 nt, Homo sapiens
gcaugugaucucc

SEQ ID NO: 1913661 - RNA, 17 nt, Homo sapiens
gugacuguggcacacgc

SEQ ID NO: 1913662 - RNA, 23 nt, Homo sapiens
cuucagaagucacacauuacaaa

SEQ ID NO: 1913663 - RNA, 13 nt, Homo sapiens
ugaacuccugcca

SEQ ID NO: 1913664 - RNA, 22 nt, Homo sapiens
gagauugcacuauugcacucca

SEQ ID NO: 1913665 - RNA, 23 nt, Homo sapiens
gccaaagagaaugccauucucuu

SEQ ID NO: 1913666 - RNA, 17 nt, Homo sapiens
cagccucagggacgacu

SEQ ID NO: 1913667 - RNA, 22 nt, Homo sapiens
uaaauuucucuacugucucagu

SEQ ID NO: 1913668 - RNA, 18 nt, Homo sapiens
acacacugagacuugaau

SEQ ID NO: 1913669 - RNA, 18 nt, Homo sapiens
ccucaugauauguccuca

SEQ ID NO: 1913670 - RNA, 17 nt, Homo sapiens
cugcucuuuugugauga

SEQ ID NO: 1913671 - RNA, 22 nt, Homo sapiens
ugcuucaggauccaagugacaa

SEQ ID NO: 1913672 - RNA, 17 nt, Homo sapiens
augauaauaaaggcauu

SEQ ID NO: 1913673 - RNA, 16 nt, Homo sapiens
uaaccucccacccugc

SEQ ID NO: 1913674 - RNA, 21 nt, Homo sapiens
auggggugcaccuguccaaua

SEQ ID NO: 1913675 - RNA, 16 nt, Homo sapiens
uaaacccuugcugcug

SEQ ID NO: 1913676 - RNA, 22 nt, Homo sapiens
cgugagggcaagagggggaccu

SEQ ID NO: 1913677 - RNA, 16 nt, Homo sapiens
cgaccgccccaguucc

SEQ ID NO: 1913678 - RNA, 20 nt, Homo sapiens
uuggggaccugaacuguccu

SEQ ID NO: 1913679 - RNA, 12 nt, Homo sapiens
aaacacugugua

SEQ ID NO: 1913680 - RNA, 21 nt, Homo sapiens
uagagauguacugaguuugau

SEQ ID NO: 1913681 - RNA, 12 nt, Homo sapiens
gcaaaagguuua

SEQ ID NO: 1913682 - RNA, 12 nt, Homo sapiens
uuuuaagggcau

SEQ ID NO: 1913683 - RNA, 17 nt, Homo sapiens
acuuugagacuauucau

SEQ ID NO: 1913684 - RNA, 13 nt, Homo sapiens
caagagaccagcc

SEQ ID NO: 1913685 - RNA, 16 nt, Homo sapiens
uccaggacuggggcuu

SEQ ID NO: 1913686 - RNA, 20 nt, Homo sapiens
aauacaauggguaucgcuga

SEQ ID NO: 1913687 - RNA, 18 nt, Homo sapiens
uaaguuuuuauuguguaa

SEQ ID NO: 1913688 - RNA, 18 nt, Homo sapiens
gugcugggauuacaggca

SEQ ID NO: 1913689 - RNA, 13 nt, Homo sapiens
acaaacaccaucu

SEQ ID NO: 1913690 - RNA, 17 nt, Homo sapiens
caacaagcaagcuccca

SEQ ID NO: 1913691 - RNA, 16 nt, Homo sapiens
agccaaggccaaagga

SEQ ID NO: 1913692 - RNA, 13 nt, Homo sapiens
uaaaaccagagaa

SEQ ID NO: 1913693 - RNA, 20 nt, Homo sapiens
gguagcuauacucaugguca

SEQ ID NO: 1913694 - RNA, 16 nt, Homo sapiens
cuaugaacuucucuca

SEQ ID NO: 1913695 - RNA, 15 nt, Homo sapiens
agggaugaccuggag

SEQ ID NO: 1913696 - RNA, 20 nt, Homo sapiens
aaaucgagagugugcucucc

SEQ ID NO: 1913697 - RNA, 14 nt, Homo sapiens
uugggcaacagagc

SEQ ID NO: 1913698 - RNA, 19 nt, Homo sapiens
agcccagacucugagcugc

SEQ ID NO: 1913699 - RNA, 16 nt, Homo sapiens
gaugacucaaggccaa

SEQ ID NO: 1913700 - RNA, 22 nt, Homo sapiens
cuuaccccaguuuuuugaacau

SEQ ID NO: 1913701 - RNA, 12 nt, Homo sapiens
agaaaagauuau

SEQ ID NO: 1913702 - RNA, 14 nt, Homo sapiens
agcaaaaacugugg

SEQ ID NO: 1913703 - RNA, 19 nt, Homo sapiens
ugugggugucagucaggga

SEQ ID NO: 1913704 - RNA, 13 nt, Homo sapiens
gucauggaugucc

SEQ ID NO: 1913705 - RNA, 18 nt, Homo sapiens
uuucugccucacaucagc

SEQ ID NO: 1913706 - RNA, 17 nt, Homo sapiens
augacugugaccaccuu

SEQ ID NO: 1913707 - RNA, 22 nt, Homo sapiens
aguauuuuauuaaagcaacauu

SEQ ID NO: 1913708 - RNA, 15 nt, Homo sapiens
uaauauguacaaaua

SEQ ID NO: 1913709 - RNA, 20 nt, Homo sapiens
augguguuaaagcuguacac

SEQ ID NO: 1913710 - RNA, 18 nt, Homo sapiens
uuaacucacacugcccag

SEQ ID NO: 1913711 - RNA, 20 nt, Homo sapiens
acaaguuacaccuccacuca

SEQ ID NO: 1913712 - RNA, 18 nt, Homo sapiens
guuugaaucugacuuuag

SEQ ID NO: 1913713 - RNA, 20 nt, Homo sapiens
uucaaacauugagacugcua

SEQ ID NO: 1913714 - RNA, 13 nt, Homo sapiens
ugccucaagacua

SEQ ID NO: 1913715 - RNA, 16 nt, Homo sapiens
auaacugguagcuaua

SEQ ID NO: 1913716 - RNA, 16 nt, Homo sapiens
cugguuaauuccauaa

SEQ ID NO: 1913717 - RNA, 15 nt, Homo sapiens
caauacaugcugcua

SEQ ID NO: 1913718 - RNA, 14 nt, Homo sapiens
aaagacagcuguuu

SEQ ID NO: 1913719 - RNA, 12 nt, Homo sapiens
cauuuucuacau

SEQ ID NO: 1913720 - RNA, 18 nt, Homo sapiens
uacguguuacuggccaag

SEQ ID NO: 1913721 - RNA, 13 nt, Homo sapiens
ccagacacauggc

SEQ ID NO: 1913722 - RNA, 19 nt, Homo sapiens
aucauuacugguaaagccu

SEQ ID NO: 1913723 - RNA, 18 nt, Homo sapiens
ucugaggaagaagggaua

SEQ ID NO: 1913724 - RNA, 20 nt, Homo sapiens
auaaaaaauguuauuacuga

SEQ ID NO: 1913725 - RNA, 14 nt, Homo sapiens
auguaguuaacaau

SEQ ID NO: 1913726 - RNA, 21 nt, Homo sapiens
acauggcuggagcuagaauuu

SEQ ID NO: 1913727 - RNA, 12 nt, Homo sapiens
gaccgaggacac

SEQ ID NO: 1913728 - RNA, 21 nt, Homo sapiens
accuacaccaacugcucucaa

SEQ ID NO: 1913729 - RNA, 20 nt, Homo sapiens
aaaccuucagaagcuauuuu

SEQ ID NO: 1913730 - RNA, 16 nt, Homo sapiens
uuccuagaaugcagcu

SEQ ID NO: 1913731 - RNA, 21 nt, Homo sapiens
uggcaguuuuuaaaauuggcc

SEQ ID NO: 1913732 - RNA, 13 nt, Homo sapiens
ucuuuuugcuuca

SEQ ID NO: 1913733 - RNA, 20 nt, Homo sapiens
ugucaccaagaaggggcucg

SEQ ID NO: 1913734 - RNA, 13 nt, Homo sapiens
aagaaaaaccacu

SEQ ID NO: 1913735 - RNA, 19 nt, Homo sapiens
caguuuucaggaugagaug

SEQ ID NO: 1913736 - RNA, 12 nt, Homo sapiens
cugcccaaagca

SEQ ID NO: 1913737 - RNA, 18 nt, Homo sapiens
uguaaaccaaguucaaag

SEQ ID NO: 1913738 - RNA, 22 nt, Homo sapiens
uaauaccacuacccgugaauua

SEQ ID NO: 1913739 - RNA, 14 nt, Homo sapiens
gcauucugcaacau

SEQ ID NO: 1913740 - RNA, 12 nt, Homo sapiens
guuaagugcuuu

SEQ ID NO: 1913741 - RNA, 15 nt, Homo sapiens
guaauccaagcaaau

SEQ ID NO: 1913742 - RNA, 22 nt, Homo sapiens
aagagaucccaaguagaaucuc

SEQ ID NO: 1913743 - RNA, 18 nt, Homo sapiens
aggacugugccagcacaa

SEQ ID NO: 1913744 - RNA, 18 nt, Homo sapiens
acuaucuuuguguugcag

SEQ ID NO: 1913745 - RNA, 15 nt, Homo sapiens
auuuuaaaugcacag

SEQ ID NO: 1913746 - RNA, 20 nt, Homo sapiens
caacuuuccucaaaucaaaa

SEQ ID NO: 1913747 - RNA, 22 nt, Homo sapiens
acccacucuguugguagcaauu

SEQ ID NO: 1913748 - RNA, 13 nt, Homo sapiens
aacuagugaugua

SEQ ID NO: 1913749 - RNA, 17 nt, Homo sapiens
aaaaacacuggauucau

SEQ ID NO: 1913750 - RNA, 14 nt, Homo sapiens
acucugaauaccaa

SEQ ID NO: 1913751 - RNA, 17 nt, Homo sapiens
cucacuuaauuuuccca

SEQ ID NO: 1913752 - RNA, 18 nt, Homo sapiens
acaagaucuguaauguua

SEQ ID NO: 1913753 - RNA, 14 nt, Homo sapiens
aagguaaaaugcca

SEQ ID NO: 1913754 - RNA, 11 nt, Homo sapiens
aguugccugac

SEQ ID NO: 1913755 - RNA, 19 nt, Homo sapiens
acauuuuggagugcuuaaa

SEQ ID NO: 1913756 - RNA, 18 nt, Homo sapiens
augaugcuuuacauuuaa

SEQ ID NO: 1913757 - RNA, 18 nt, Homo sapiens
aaugaaauccagugagca

SEQ ID NO: 1913758 - RNA, 17 nt, Homo sapiens
aaugcuucugacuucau

SEQ ID NO: 1913759 - RNA, 19 nt, Homo sapiens
agcuggugcuccaagcaca

SEQ ID NO: 1913760 - RNA, 19 nt, Homo sapiens
ucuaaaauguguuuuauca

SEQ ID NO: 1913761 - RNA, 16 nt, Homo sapiens
gcccccugcacaggga

SEQ ID NO: 1913762 - RNA, 23 nt, Homo sapiens
caguucugcacucuuguacaaaa

SEQ ID NO: 1913763 - RNA, 17 nt, Homo sapiens
aggaugaguuacuugaa

SEQ ID NO: 1913764 - RNA, 13 nt, Homo sapiens
uacugcuucccau

SEQ ID NO: 1913765 - RNA, 23 nt, Homo sapiens
gccagaggcucuaauguacaaua

SEQ ID NO: 1913766 - RNA, 23 nt, Homo sapiens
cucacuauggucaaaaagugaug

SEQ ID NO: 1913767 - RNA, 18 nt, Homo sapiens
acuuuugaaaacaaaaua

SEQ ID NO: 1913768 - RNA, 19 nt, Homo sapiens
acuccaccgccuaucccaa

SEQ ID NO: 1913769 - RNA, 15 nt, Homo sapiens
caaaggagucaggac

SEQ ID NO: 1913770 - RNA, 15 nt, Homo sapiens
gcugccagcacagua

SEQ ID NO: 1913771 - RNA, 21 nt, Homo sapiens
acaaucuuugcuguauacuuu

SEQ ID NO: 1913772 - RNA, 21 nt, Homo sapiens
gaacuagagcuugcagugaag

SEQ ID NO: 1913773 - RNA, 13 nt, Homo sapiens
cuggccgcuggga

SEQ ID NO: 1913774 - RNA, 16 nt, Homo sapiens
auaaacuccuacuaaa

SEQ ID NO: 1913775 - RNA, 19 nt, Homo sapiens
gggagggaagggagccaag

SEQ ID NO: 1913776 - RNA, 18 nt, Homo sapiens
agaucuugaauagucuca

SEQ ID NO: 1913777 - RNA, 15 nt, Homo sapiens
guuagugacauuuaa

SEQ ID NO: 1913778 - RNA, 21 nt, Homo sapiens
uucuuucuaacuguagcuauc

SEQ ID NO: 1913779 - RNA, 19 nt, Homo sapiens
caauuccugugcucaaaaa

SEQ ID NO: 1913780 - RNA, 21 nt, Homo sapiens
uauugucggaagacuugccac

SEQ ID NO: 1913781 - RNA, 14 nt, Homo sapiens
ugguuuaaagucac

SEQ ID NO: 1913782 - RNA, 16 nt, Homo sapiens
cucauuuggggaccac

SEQ ID NO: 1913783 - RNA, 17 nt, Homo sapiens
uuuauaaagggacacuu

SEQ ID NO: 1913784 - RNA, 19 nt, Homo sapiens
gugcugggagaugcucucu

SEQ ID NO: 1913785 - RNA, 19 nt, Homo sapiens
cguaaacacgccugcaaac

SEQ ID NO: 1913786 - RNA, 19 nt, Homo sapiens
cuagacgucucacucaaag

SEQ ID NO: 1913787 - RNA, 21 nt, Homo sapiens
aguggacgucagaagaaucuc

SEQ ID NO: 1913788 - RNA, 14 nt, Homo sapiens
auuaaguggcuuuu

SEQ ID NO: 1913789 - RNA, 18 nt, Homo sapiens
guaaauaaaaucauguau

SEQ ID NO: 1913790 - RNA, 13 nt, Homo sapiens
gauuauccacugc

SEQ ID NO: 1913791 - RNA, 15 nt, Homo sapiens
uugaaaacugugcaa

SEQ ID NO: 1913792 - RNA, 17 nt, Homo sapiens
cagcucagcuucgugcc

SEQ ID NO: 1913793 - RNA, 15 nt, Homo sapiens
gcacaaagugggagc

SEQ ID NO: 1913794 - RNA, 21 nt, Homo sapiens
gugguuauuuagggaacugcu

SEQ ID NO: 1913795 - RNA, 17 nt, Homo sapiens
cggggaagagauccaaa

SEQ ID NO: 1913796 - RNA, 12 nt, Homo sapiens
cugccaagccac

SEQ ID NO: 1913797 - RNA, 20 nt, Homo sapiens
uaacaucagcaggaaugcuc

SEQ ID NO: 1913798 - RNA, 17 nt, Homo sapiens
gaggcagaauaagaaaa

SEQ ID NO: 1913799 - RNA, 19 nt, Homo sapiens
agcacuaccaguaucucca

SEQ ID NO: 1913800 - RNA, 15 nt, Homo sapiens
cuaagucucugugaa

SEQ ID NO: 1913801 - RNA, 17 nt, Homo sapiens
ugaccuccaaccaggag

SEQ ID NO: 1913802 - RNA, 15 nt, Homo sapiens
caugguaacaguucc

SEQ ID NO: 1913803 - RNA, 14 nt, Homo sapiens
agccaaacacuguu

SEQ ID NO: 1913804 - RNA, 19 nt, Homo sapiens
acaccauucaggucuuucu

SEQ ID NO: 1913805 - RNA, 15 nt, Homo sapiens
caugcccccaguuac

SEQ ID NO: 1913806 - RNA, 20 nt, Homo sapiens
cugugucggggcugaccucu

SEQ ID NO: 1913807 - RNA, 20 nt, Homo sapiens
uccagccguguuguagcuaa

SEQ ID NO: 1913808 - RNA, 15 nt, Homo sapiens
caagcacaaaaacuu

SEQ ID NO: 1913809 - RNA, 15 nt, Homo sapiens
gaaacccccaucucu

SEQ ID NO: 1913810 - RNA, 16 nt, Homo sapiens
uuggaauuuugugccc

SEQ ID NO: 1913811 - RNA, 15 nt, Homo sapiens
aauacuguacauugu

SEQ ID NO: 1913812 - RNA, 19 nt, Homo sapiens
cuggcaauguuuauuucau

SEQ ID NO: 1913813 - RNA, 23 nt, Homo sapiens
uuucuucccgaaccccaaggagg

SEQ ID NO: 1913814 - RNA, 20 nt, Homo sapiens
aucuccuauuccuucacaca

SEQ ID NO: 1913815 - RNA, 22 nt, Homo sapiens
uuugccuguucaguuacagaaa

SEQ ID NO: 1913816 - RNA, 16 nt, Homo sapiens
guuuucaacacuuuuu

SEQ ID NO: 1913817 - RNA, 19 nt, Homo sapiens
cucuguucagaaagcaaua

SEQ ID NO: 1913818 - RNA, 17 nt, Homo sapiens
gucuacuugcuccacuc

SEQ ID NO: 1913819 - RNA, 16 nt, Homo sapiens
ugccugucugcuugca

SEQ ID NO: 1913820 - RNA, 23 nt, Homo sapiens
gugaugaaaaggcagcauuugaa

SEQ ID NO: 1913821 - RNA, 23 nt, Homo sapiens
uggauuuggguuggaagugaggg

SEQ ID NO: 1913822 - RNA, 16 nt, Homo sapiens
uugauaguauugugca

SEQ ID NO: 1913823 - RNA, 15 nt, Homo sapiens
gagugucaagcugac

SEQ ID NO: 1913824 - RNA, 19 nt, Homo sapiens
uuuguaauaauaaagaaua

SEQ ID NO: 1913825 - RNA, 12 nt, Homo sapiens
agauaaucagug

SEQ ID NO: 1913826 - RNA, 18 nt, Homo sapiens
cuauauacuauaugauuc

SEQ ID NO: 1913827 - RNA, 19 nt, Homo sapiens
ugccacaucugugucucug

SEQ ID NO: 1913828 - RNA, 13 nt, Homo sapiens
cacuugaagcacu

SEQ ID NO: 1913829 - RNA, 17 nt, Homo sapiens
acacacagagacacauc

SEQ ID NO: 1913830 - RNA, 18 nt, Homo sapiens
gcaugcaaaaaaugcuuu

SEQ ID NO: 1913831 - RNA, 15 nt, Homo sapiens
gcacacacagaugca

SEQ ID NO: 1913832 - RNA, 15 nt, Homo sapiens
uuuuagauccaaaug

SEQ ID NO: 1913833 - RNA, 22 nt, Homo sapiens
uacugucugggauuaagggcaa

SEQ ID NO: 1913834 - RNA, 19 nt, Homo sapiens
gaguauccuuguagcaaag

SEQ ID NO: 1913835 - RNA, 16 nt, Homo sapiens
uuuuacuacuguggaa

SEQ ID NO: 1913836 - RNA, 16 nt, Homo sapiens
uugcauuucaugcuau

SEQ ID NO: 1913837 - RNA, 22 nt, Homo sapiens
ccccaaaccuggcaagucaccu

SEQ ID NO: 1913838 - RNA, 14 nt, Homo sapiens
agguccaugugcac

SEQ ID NO: 1913839 - RNA, 22 nt, Homo sapiens
gaacaauuaaaauauucuuuaa

SEQ ID NO: 1913840 - RNA, 23 nt, Homo sapiens
gauagucagcuguaccaagcccc

SEQ ID NO: 1913841 - RNA, 13 nt, Homo sapiens
aaaaacaugucau

SEQ ID NO: 1913842 - RNA, 17 nt, Homo sapiens
aguuuaauuacaacagc

SEQ ID NO: 1913843 - RNA, 14 nt, Homo sapiens
aggggcaguggccu

SEQ ID NO: 1913844 - RNA, 23 nt, Homo sapiens
uucuccagacccaccacaccgca

SEQ ID NO: 1913845 - RNA, 19 nt, Homo sapiens
acaccucccccugcugcug

SEQ ID NO: 1913846 - RNA, 18 nt, Homo sapiens
gaucgaguguagcuguga

SEQ ID NO: 1913847 - RNA, 23 nt, Homo sapiens
auugaacgcacauagcucaauca

SEQ ID NO: 1913848 - RNA, 21 nt, Homo sapiens
gagcuucccugacucauucug

SEQ ID NO: 1913849 - RNA, 21 nt, Homo sapiens
ucauccugaacgugaccagug

SEQ ID NO: 1913850 - RNA, 20 nt, Homo sapiens
agacucuuuggguccauuca

SEQ ID NO: 1913851 - RNA, 14 nt, Homo sapiens
ucugugaaugcuaa

SEQ ID NO: 1913852 - RNA, 22 nt, Homo sapiens
cauuuaggaaagcagugcagua

SEQ ID NO: 1913853 - RNA, 20 nt, Homo sapiens
agagcuuaggauucuaaucu

SEQ ID NO: 1913854 - RNA, 14 nt, Homo sapiens
guggaagaaggaaa

SEQ ID NO: 1913855 - RNA, 21 nt, Homo sapiens
aagugaguuaaucuuguauga

SEQ ID NO: 1913856 - RNA, 21 nt, Homo sapiens
caagagaacucgcgcucagua

SEQ ID NO: 1913857 - RNA, 18 nt, Homo sapiens
uauauaauuuuauugcug

SEQ ID NO: 1913858 - RNA, 17 nt, Homo sapiens
ucuuucauggggugaug

SEQ ID NO: 1913859 - RNA, 18 nt, Homo sapiens
gauuuauuuucaauuaau

SEQ ID NO: 1913860 - RNA, 13 nt, Homo sapiens
cucccaccugcau

SEQ ID NO: 1913861 - RNA, 13 nt, Homo sapiens
ucaucagcccagg

SEQ ID NO: 1913862 - RNA, 18 nt, Homo sapiens
agaaggauccaagacaaa

SEQ ID NO: 1913863 - RNA, 18 nt, Homo sapiens
agcucccauuucuacucu

SEQ ID NO: 1913864 - RNA, 23 nt, Homo sapiens
cuggccauucuuauguuccagau

SEQ ID NO: 1913865 - RNA, 18 nt, Homo sapiens
uggauaucaaaagcaaau

SEQ ID NO: 1913866 - RNA, 15 nt, Homo sapiens
cauuucacagccuuu

SEQ ID NO: 1913867 - RNA, 21 nt, Homo sapiens
uuccccacagguccuccauca

SEQ ID NO: 1913868 - RNA, 17 nt, Homo sapiens
acugaaucucaccugcu

SEQ ID NO: 1913869 - RNA, 20 nt, Homo sapiens
ggcccaggcuggagugcagu

SEQ ID NO: 1913870 - RNA, 16 nt, Homo sapiens
aauaggugcaaaaaua

SEQ ID NO: 1913871 - RNA, 15 nt, Homo sapiens
gaccaugcugagaca

SEQ ID NO: 1913872 - RNA, 22 nt, Homo sapiens
uggcuccuucacugaacaugcc

SEQ ID NO: 1913873 - RNA, 20 nt, Homo sapiens
caacuuucacuuugcaaaga

SEQ ID NO: 1913874 - RNA, 22 nt, Homo sapiens
aaugcacucugggucuggccag

SEQ ID NO: 1913875 - RNA, 15 nt, Homo sapiens
ccagcuccugggcag

SEQ ID NO: 1913876 - RNA, 21 nt, Homo sapiens
auggaggaucucuaaagagca

SEQ ID NO: 1913877 - RNA, 18 nt, Homo sapiens
caaugcuggccuguggug

SEQ ID NO: 1913878 - RNA, 13 nt, Homo sapiens
uauguaacaugua

SEQ ID NO: 1913879 - RNA, 23 nt, Homo sapiens
gagaaagagcacuuaagagaaua

SEQ ID NO: 1913880 - RNA, 15 nt, Homo sapiens
aaagucccagaucaa

SEQ ID NO: 1913881 - RNA, 14 nt, Homo sapiens
agcacaccuaucuu

SEQ ID NO: 1913882 - RNA, 20 nt, Homo sapiens
gugcacaacauuacagggaa

SEQ ID NO: 1913883 - RNA, 14 nt, Homo sapiens
auauaauggauaau

SEQ ID NO: 1913884 - RNA, 17 nt, Homo sapiens
gcaggaucaaagacaca

SEQ ID NO: 1913885 - RNA, 14 nt, Homo sapiens
uuugagacaggaga

SEQ ID NO: 1913886 - RNA, 14 nt, Homo sapiens
aggaagacuuugga

SEQ ID NO: 1913887 - RNA, 14 nt, Homo sapiens
gccuccauccaucu

SEQ ID NO: 1913888 - RNA, 13 nt, Homo sapiens
ucaaaauccaaaa

SEQ ID NO: 1913889 - RNA, 21 nt, Homo sapiens
uucaugugguucagugccuuc

SEQ ID NO: 1913890 - RNA, 15 nt, Homo sapiens
gguggaacaagcaca

SEQ ID NO: 1913891 - RNA, 22 nt, Homo sapiens
gacagcuuuucccaagauguca

SEQ ID NO: 1913892 - RNA, 18 nt, Homo sapiens
uguguuucuauugacuuc

SEQ ID NO: 1913893 - RNA, 19 nt, Homo sapiens
cuauggaauauacauguaa

SEQ ID NO: 1913894 - RNA, 20 nt, Homo sapiens
caucuccaagaaugcugaaa

SEQ ID NO: 1913895 - RNA, 16 nt, Homo sapiens
aaguuuauaugcuucu

SEQ ID NO: 1913896 - RNA, 20 nt, Homo sapiens
ggucucugccaugaacugga

SEQ ID NO: 1913897 - RNA, 23 nt, Homo sapiens
cauacagaauguucuauugucau

SEQ ID NO: 1913898 - RNA, 14 nt, Homo sapiens
ccagguuagccuuu

SEQ ID NO: 1913899 - RNA, 19 nt, Homo sapiens
cucccaggcuggagugcag

SEQ ID NO: 1913900 - RNA, 19 nt, Homo sapiens
uuacagguaucaggcacag

SEQ ID NO: 1913901 - RNA, 13 nt, Homo sapiens
ccccuggccaaca

SEQ ID NO: 1913902 - RNA, 19 nt, Homo sapiens
uaauugccuaaaucuccag

SEQ ID NO: 1913903 - RNA, 20 nt, Homo sapiens
caucucgcuaaagagugaau

SEQ ID NO: 1913904 - RNA, 16 nt, Homo sapiens
caucaagauuaauuaa

SEQ ID NO: 1913905 - RNA, 14 nt, Homo sapiens
ugcugacagcaaag

SEQ ID NO: 1913906 - RNA, 16 nt, Homo sapiens
ccucucagcugcugaa

SEQ ID NO: 1913907 - RNA, 16 nt, Homo sapiens
agugauauugucuuca

SEQ ID NO: 1913908 - RNA, 16 nt, Homo sapiens
cucauuaauucaauua

SEQ ID NO: 1913909 - RNA, 16 nt, Homo sapiens
cccccaaaucaagcag

SEQ ID NO: 1913910 - RNA, 22 nt, Homo sapiens
cagcacuccuguuccucuguua

SEQ ID NO: 1913911 - RNA, 21 nt, Homo sapiens
cauuguacccugcuguauaau

SEQ ID NO: 1913912 - RNA, 21 nt, Homo sapiens
uuacuagccucaaaauacauc

SEQ ID NO: 1913913 - RNA, 15 nt, Homo sapiens
ugcuuauucuugagc

SEQ ID NO: 1913914 - RNA, 17 nt, Homo sapiens
ggcaaugcagugcagca

SEQ ID NO: 1913915 - RNA, 22 nt, Homo sapiens
cuugcuauuugagcaugcacag

SEQ ID NO: 1913916 - RNA, 14 nt, Homo sapiens
gcaucuuuuccucc

SEQ ID NO: 1913917 - RNA, 21 nt, Homo sapiens
ccagacauacgaaacacaaac

SEQ ID NO: 1913918 - RNA, 21 nt, Homo sapiens
acccccaagccccacugaggc

SEQ ID NO: 1913919 - RNA, 15 nt, Homo sapiens
ugguccgacaugccu

SEQ ID NO: 1913920 - RNA, 15 nt, Homo sapiens
agcagccaagggaug

SEQ ID NO: 1913921 - RNA, 15 nt, Homo sapiens
auuucauuuccagca

SEQ ID NO: 1913922 - RNA, 17 nt, Homo sapiens
aucaaagcauaagcuca

SEQ ID NO: 1913923 - RNA, 16 nt, Homo sapiens
ucuggcccccugaaga

SEQ ID NO: 1913924 - RNA, 20 nt, Homo sapiens
uauaaaauagacuuacugca

SEQ ID NO: 1913925 - RNA, 20 nt, Homo sapiens
acucuaccugcaagauuuca

SEQ ID NO: 1913926 - RNA, 16 nt, Homo sapiens
uuuuauacuaccaagu

SEQ ID NO: 1913927 - RNA, 15 nt, Homo sapiens
gacuuuaggcuuuca

SEQ ID NO: 1913928 - RNA, 14 nt, Homo sapiens
ucccauuugcuccu

SEQ ID NO: 1913929 - RNA, 14 nt, Homo sapiens
uccuuaaccuuaac

SEQ ID NO: 1913930 - RNA, 20 nt, Homo sapiens
guggagacacugagucagaa

SEQ ID NO: 1913931 - RNA, 13 nt, Homo sapiens
gauacuacuuucu

SEQ ID NO: 1913932 - RNA, 21 nt, Homo sapiens
auuuuuaacaagucauuucaa

SEQ ID NO: 1913933 - RNA, 15 nt, Homo sapiens
agucuguugcugcuc

SEQ ID NO: 1913934 - RNA, 23 nt, Homo sapiens
ggucaggggugagaccugaagga

SEQ ID NO: 1913935 - RNA, 23 nt, Homo sapiens
aauuaaaaagaugguugccaagc

SEQ ID NO: 1913936 - RNA, 15 nt, Homo sapiens
guauauucauuucaa

SEQ ID NO: 1913937 - RNA, 23 nt, Homo sapiens
ccgagcugcucccuuuccugcac

SEQ ID NO: 1913938 - RNA, 16 nt, Homo sapiens
cacagccucagaauaa

SEQ ID NO: 1913939 - RNA, 16 nt, Homo sapiens
ucuaccaucuaaucua

SEQ ID NO: 1913940 - RNA, 23 nt, Homo sapiens
uuaucgggcuccagccaucucau

SEQ ID NO: 1913941 - RNA, 16 nt, Homo sapiens
auuaauauauccuaaa

SEQ ID NO: 1913942 - RNA, 16 nt, Homo sapiens
ugugguuauguuccca

SEQ ID NO: 1913943 - RNA, 19 nt, Homo sapiens
cauccccuuuguguagaaa

SEQ ID NO: 1913944 - RNA, 19 nt, Homo sapiens
ccuccugucuaauuugcac

SEQ ID NO: 1913945 - RNA, 18 nt, Homo sapiens
uaaucacaaacugaauga

SEQ ID NO: 1913946 - RNA, 18 nt, Homo sapiens
uuagcaagacugcaagag

SEQ ID NO: 1913947 - RNA, 14 nt, Homo sapiens
gccuuuuguguuuu

SEQ ID NO: 1913948 - RNA, 12 nt, Homo sapiens
uauauacauacg

SEQ ID NO: 1913949 - RNA, 12 nt, Homo sapiens
uauguacauaca

SEQ ID NO: 1913950 - RNA, 12 nt, Homo sapiens
ccagcaccucau

SEQ ID NO: 1913951 - RNA, 15 nt, Homo sapiens
auguauacaccaagu

SEQ ID NO: 1913952 - RNA, 13 nt, Homo sapiens
gacagacagcccu

SEQ ID NO: 1913953 - RNA, 22 nt, Homo sapiens
cugucauuuuggcaucugcaaa

SEQ ID NO: 1913954 - RNA, 19 nt, Homo sapiens
uugaauugaugaugcaguu

SEQ ID NO: 1913955 - RNA, 22 nt, Homo sapiens
cuaguugcauuuucauauugcu

SEQ ID NO: 1913956 - RNA, 17 nt, Homo sapiens
uccugaggaguguccug

SEQ ID NO: 1913957 - RNA, 21 nt, Homo sapiens
caagcuuauuuaagaucacag

SEQ ID NO: 1913958 - RNA, 21 nt, Homo sapiens
caugcacacacacacaucuca

SEQ ID NO: 1913959 - RNA, 15 nt, Homo sapiens
aggggagacuuugau

SEQ ID NO: 1913960 - RNA, 13 nt, Homo sapiens
accguugcacaaa

SEQ ID NO: 1913961 - RNA, 20 nt, Homo sapiens
ugugaacagggaacucagaa

SEQ ID NO: 1913962 - RNA, 15 nt, Homo sapiens
aucugcacacuccag

SEQ ID NO: 1913963 - RNA, 16 nt, Homo sapiens
uucaagacugacauuu

SEQ ID NO: 1913964 - RNA, 22 nt, Homo sapiens
caaucucccgugggcaucucaa

SEQ ID NO: 1913965 - RNA, 21 nt, Homo sapiens
uaguggucagaaaaauacuua

SEQ ID NO: 1913966 - RNA, 18 nt, Homo sapiens
cuuuucuaaaaucuaaaa

SEQ ID NO: 1913967 - RNA, 21 nt, Homo sapiens
cucuucuucauugcaguuauu

SEQ ID NO: 1913968 - RNA, 19 nt, Homo sapiens
uauaaauaaaggaaccuuu

SEQ ID NO: 1913969 - RNA, 19 nt, Homo sapiens
gaaucuacuuuaauuuauu

SEQ ID NO: 1913970 - RNA, 17 nt, Homo sapiens
gcgcaaaggugccucau

SEQ ID NO: 1913971 - RNA, 16 nt, Homo sapiens
gccaccugcugcugcu

SEQ ID NO: 1913972 - RNA, 15 nt, Homo sapiens
cagcucagugccaaa

SEQ ID NO: 1913973 - RNA, 14 nt, Homo sapiens
accucccauuacuu

SEQ ID NO: 1913974 - RNA, 13 nt, Homo sapiens
cucucuccagucu

SEQ ID NO: 1913975 - RNA, 15 nt, Homo sapiens
ugugaccgggguccu

SEQ ID NO: 1913976 - RNA, 16 nt, Homo sapiens
ucacagcuacacagau

SEQ ID NO: 1913977 - RNA, 17 nt, Homo sapiens
cuugaucagugugcuaa

SEQ ID NO: 1913978 - RNA, 15 nt, Homo sapiens
caacucacugugcuc

SEQ ID NO: 1913979 - RNA, 14 nt, Homo sapiens
caaaagcugcucag

SEQ ID NO: 1913980 - RNA, 20 nt, Homo sapiens
cuuguugcuuuguugcacug

SEQ ID NO: 1913981 - RNA, 15 nt, Homo sapiens
ugcuuuagcuuucca

SEQ ID NO: 1913982 - RNA, 15 nt, Homo sapiens
cucacugucuauuua

SEQ ID NO: 1913983 - RNA, 16 nt, Homo sapiens
uaaauguguguaaaaa

SEQ ID NO: 1913984 - RNA, 21 nt, Homo sapiens
uguccuaggaccuuuucccaa

SEQ ID NO: 1913985 - RNA, 21 nt, Homo sapiens
ucauucccaggcacucucuuu

SEQ ID NO: 1913986 - RNA, 14 nt, Homo sapiens
aaauagaugacaaa

SEQ ID NO: 1913987 - RNA, 20 nt, Homo sapiens
agaauugacugaagcacagc

SEQ ID NO: 1913988 - RNA, 16 nt, Homo sapiens
cauuggugacucacuu

SEQ ID NO: 1913989 - RNA, 12 nt, Homo sapiens
cccuacacugcc

SEQ ID NO: 1913990 - RNA, 16 nt, Homo sapiens
acuuuuacucugccua

SEQ ID NO: 1913991 - RNA, 18 nt, Homo sapiens
uaaaaaugagugugaagg

SEQ ID NO: 1913992 - RNA, 14 nt, Homo sapiens
gccgcaccauugaa

SEQ ID NO: 1913993 - RNA, 23 nt, Homo sapiens
ugacucucuggugagcgaggaca

SEQ ID NO: 1913994 - RNA, 13 nt, Homo sapiens
aacccucaaugug

SEQ ID NO: 1913995 - RNA, 18 nt, Homo sapiens
aaaagacaacauaacuca

SEQ ID NO: 1913996 - RNA, 11 nt, Homo sapiens
gaggggccaga

SEQ ID NO: 1913997 - RNA, 11 nt, Homo sapiens
gaagggccagg

SEQ ID NO: 1913998 - RNA, 14 nt, Homo sapiens
ugauaaggcucuga

SEQ ID NO: 1913999 - RNA, 15 nt, Homo sapiens
cugggcaacacagcg

SEQ ID NO: 1914000 - RNA, 23 nt, Homo sapiens
gucaucaggagaaaaagccucca

SEQ ID NO: 1914001 - RNA, 21 nt, Homo sapiens
cuguaauuuaauuuaggacac

SEQ ID NO: 1914002 - RNA, 14 nt, Homo sapiens
agguuggugacuga

SEQ ID NO: 1914003 - RNA, 20 nt, Homo sapiens
gugggaucugucacaccagc

SEQ ID NO: 1914004 - RNA, 21 nt, Homo sapiens
gagccucacuggggcagacaa

SEQ ID NO: 1914005 - RNA, 15 nt, Homo sapiens
acuacgcuugcucau

SEQ ID NO: 1914006 - RNA, 21 nt, Homo sapiens
accucaucucucuaacaauau

SEQ ID NO: 1914007 - RNA, 14 nt, Homo sapiens
ucauacuacauaca

SEQ ID NO: 1914008 - RNA, 17 nt, Homo sapiens
gaaaugugcaagaguau

SEQ ID NO: 1914009 - RNA, 22 nt, Homo sapiens
ccuuuuuauuuauauguacugu

SEQ ID NO: 1914010 - RNA, 17 nt, Homo sapiens
uaauuagaacaauagcu

SEQ ID NO: 1914011 - RNA, 22 nt, Homo sapiens
ccuggggacuguuccaaagcca

SEQ ID NO: 1914012 - RNA, 21 nt, Homo sapiens
guuggaggcaugcuaagaaua

SEQ ID NO: 1914013 - RNA, 13 nt, Homo sapiens
gcgucugcugcuc

SEQ ID NO: 1914014 - RNA, 18 nt, Homo sapiens
aagugacccugcucucac

SEQ ID NO: 1914015 - RNA, 21 nt, Homo sapiens
aguuguugguuuauacuguau

SEQ ID NO: 1914016 - RNA, 15 nt, Homo sapiens
auuuaacaaauacau

SEQ ID NO: 1914017 - RNA, 16 nt, Homo sapiens
aauaauagaauugcuc

SEQ ID NO: 1914018 - RNA, 15 nt, Homo sapiens
cacacgcacacaucu

SEQ ID NO: 1914019 - RNA, 15 nt, Homo sapiens
cugcugcacugcccu

SEQ ID NO: 1914020 - RNA, 18 nt, Homo sapiens
aguacaguggugccauca

SEQ ID NO: 1914021 - RNA, 16 nt, Homo sapiens
aaugaaccgcugaaua

SEQ ID NO: 1914022 - RNA, 21 nt, Homo sapiens
guaaauccuauuauguguuca

SEQ ID NO: 1914023 - RNA, 16 nt, Homo sapiens
auaguuuacacacugu

SEQ ID NO: 1914024 - RNA, 18 nt, Homo sapiens
cucaacauaacauaagcu

SEQ ID NO: 1914025 - RNA, 16 nt, Homo sapiens
accaguuaagagacaa

SEQ ID NO: 1914026 - RNA, 22 nt, Homo sapiens
auugcaaauaaaccacuuucua

SEQ ID NO: 1914027 - RNA, 16 nt, Homo sapiens
auuuuggaaccuaaua

SEQ ID NO: 1914028 - RNA, 22 nt, Homo sapiens
gauaaauuuuaaaauugguaua

SEQ ID NO: 1914029 - RNA, 18 nt, Homo sapiens
gccgcuuugucuguccag

SEQ ID NO: 1914030 - RNA, 16 nt, Homo sapiens
auugucaugacuuuca

SEQ ID NO: 1914031 - RNA, 12 nt, Homo sapiens
ucaaaugcacau

SEQ ID NO: 1914032 - RNA, 17 nt, Homo sapiens
cuucagcuuaauaagua

SEQ ID NO: 1914033 - RNA, 15 nt, Homo sapiens
caacaaggacagccc

SEQ ID NO: 1914034 - RNA, 18 nt, Homo sapiens
auguaguugauguaucca

SEQ ID NO: 1914035 - RNA, 20 nt, Homo sapiens
agguccucuacuuaaugaga

SEQ ID NO: 1914036 - RNA, 20 nt, Homo sapiens
gaauauggaacauaugcaca

SEQ ID NO: 1914037 - RNA, 18 nt, Homo sapiens
ucggagucuguaaaacca

SEQ ID NO: 1914038 - RNA, 19 nt, Homo sapiens
ggccaggugugguggcuca

SEQ ID NO: 1914039 - RNA, 19 nt, Homo sapiens
aucugucuuuuauuuaaca

SEQ ID NO: 1914040 - RNA, 21 nt, Homo sapiens
ugcucaauaaauaaugaucac

SEQ ID NO: 1914041 - RNA, 13 nt, Homo sapiens
caguccauuuccu

SEQ ID NO: 1914042 - RNA, 14 nt, Homo sapiens
uccagaccuuauca

SEQ ID NO: 1914043 - RNA, 18 nt, Homo sapiens
uccauaagauuugcaaag

SEQ ID NO: 1914044 - RNA, 21 nt, Homo sapiens
cacacccacucccuuccccau

SEQ ID NO: 1914045 - RNA, 21 nt, Homo sapiens
uucuaaggcucugagagucua

SEQ ID NO: 1914046 - RNA, 18 nt, Homo sapiens
aauggcagcauacacaga

SEQ ID NO: 1914047 - RNA, 13 nt, Homo sapiens
ugaugucugcaaa

SEQ ID NO: 1914048 - RNA, 13 nt, Homo sapiens
uguuaucugcuag

SEQ ID NO: 1914049 - RNA, 19 nt, Homo sapiens
aauaaguucauuaaacaga

SEQ ID NO: 1914050 - RNA, 22 nt, Homo sapiens
accuugguguuucucucuguaa

SEQ ID NO: 1914051 - RNA, 14 nt, Homo sapiens
cuuccucaugaauc

SEQ ID NO: 1914052 - RNA, 21 nt, Homo sapiens
cccucuauauauacaucauac

SEQ ID NO: 1914053 - RNA, 18 nt, Homo sapiens
cagauauuaauaauucca

SEQ ID NO: 1914054 - RNA, 15 nt, Homo sapiens
cccgggaauguuuca

SEQ ID NO: 1914055 - RNA, 16 nt, Homo sapiens
guuuaaaaauacaugu

SEQ ID NO: 1914056 - RNA, 17 nt, Homo sapiens
caggaccccugcauuua

SEQ ID NO: 1914057 - RNA, 15 nt, Homo sapiens
cacuagaaaugcagc

SEQ ID NO: 1914058 - RNA, 22 nt, Homo sapiens
caaaaggccuuuggaaagacuu

SEQ ID NO: 1914059 - RNA, 19 nt, Homo sapiens
acuauuaacaugauguacu

SEQ ID NO: 1914060 - RNA, 19 nt, Homo sapiens
agguuucaacaaauuucau

SEQ ID NO: 1914061 - RNA, 18 nt, Homo sapiens
uauuuaucuccugucuac

SEQ ID NO: 1914062 - RNA, 16 nt, Homo sapiens
gccagauccacccuau

SEQ ID NO: 1914063 - RNA, 14 nt, Homo sapiens
uugaaaagaacaaa

SEQ ID NO: 1914064 - RNA, 21 nt, Homo sapiens
cugcaccuuccuuucuuccac

SEQ ID NO: 1914065 - RNA, 15 nt, Homo sapiens
agggugagugcaagg

SEQ ID NO: 1914066 - RNA, 17 nt, Homo sapiens
ggcagggugagaagcua

SEQ ID NO: 1914067 - RNA, 21 nt, Homo sapiens
cugcacguugugcacauguac

SEQ ID NO: 1914068 - RNA, 18 nt, Homo sapiens
uuauuugacaacaaucca

SEQ ID NO: 1914069 - RNA, 11 nt, Homo sapiens
aaaaauacuug

SEQ ID NO: 1914070 - RNA, 16 nt, Homo sapiens
uuaaaugccuccuucu

SEQ ID NO: 1914071 - RNA, 18 nt, Homo sapiens
agauuuaaaaaaagaaca

SEQ ID NO: 1914072 - RNA, 13 nt, Homo sapiens
ggaaccacugcac

SEQ ID NO: 1914073 - RNA, 18 nt, Homo sapiens
gaagcuucaugcacuuaa

SEQ ID NO: 1914074 - RNA, 22 nt, Homo sapiens
caugaaucccacccacauguga

SEQ ID NO: 1914075 - RNA, 21 nt, Homo sapiens
gauacuggauuguacuuugug

SEQ ID NO: 1914076 - RNA, 13 nt, Homo sapiens
agaaaucacuccu

SEQ ID NO: 1914077 - RNA, 18 nt, Homo sapiens
ugcacagcucaacggaag

SEQ ID NO: 1914078 - RNA, 13 nt, Homo sapiens
cacaugcugaguc

SEQ ID NO: 1914079 - RNA, 12 nt, Homo sapiens
ccaaggugggag

SEQ ID NO: 1914080 - RNA, 14 nt, Homo sapiens
uaauacucauuccu

SEQ ID NO: 1914081 - RNA, 22 nt, Homo sapiens
cacagagaagaccuucuaguga

SEQ ID NO: 1914082 - RNA, 20 nt, Homo sapiens
uuaaauuugggggacuuaca

SEQ ID NO: 1914083 - RNA, 18 nt, Homo sapiens
aguucucuugcuuucaca

SEQ ID NO: 1914084 - RNA, 13 nt, Homo sapiens
aaauaacacagca

SEQ ID NO: 1914085 - RNA, 21 nt, Homo sapiens
uucuggacucccacucuuuga

SEQ ID NO: 1914086 - RNA, 12 nt, Homo sapiens
uuggagugagau

SEQ ID NO: 1914087 - RNA, 23 nt, Homo sapiens
cagaguuugauaugggcuuucuc

SEQ ID NO: 1914088 - RNA, 15 nt, Homo sapiens
acaggaaaccacuua

SEQ ID NO: 1914089 - RNA, 19 nt, Homo sapiens
aaccaauuccucauccuca

SEQ ID NO: 1914090 - RNA, 16 nt, Homo sapiens
cuaagggguacuccuc

SEQ ID NO: 1914091 - RNA, 17 nt, Homo sapiens
cugagaaggguugaucc

SEQ ID NO: 1914092 - RNA, 20 nt, Homo sapiens
ugaaucugugccugcacuga

SEQ ID NO: 1914093 - RNA, 14 nt, Homo sapiens
caauuuucacugug

SEQ ID NO: 1914094 - RNA, 15 nt, Homo sapiens
ugccaccccuuccuc

SEQ ID NO: 1914095 - RNA, 13 nt, Homo sapiens
ugcgucauuucag

SEQ ID NO: 1914096 - RNA, 20 nt, Homo sapiens
gcagggggugugucugcuca

SEQ ID NO: 1914097 - RNA, 15 nt, Homo sapiens
accaagagcaaggaa

SEQ ID NO: 1914098 - RNA, 17 nt, Homo sapiens
caggacuccuuguucug

SEQ ID NO: 1914099 - RNA, 16 nt, Homo sapiens
caaaauaaacuccccu

SEQ ID NO: 1914100 - RNA, 23 nt, Homo sapiens
uauccauauuuuacugaucucuu

SEQ ID NO: 1914101 - RNA, 15 nt, Homo sapiens
ccugcaggugcugcu

SEQ ID NO: 1914102 - RNA, 19 nt, Homo sapiens
uauaaaucgcauuaaugaa

SEQ ID NO: 1914103 - RNA, 19 nt, Homo sapiens
guaacuauuacaccaaaua

SEQ ID NO: 1914104 - RNA, 21 nt, Homo sapiens
auuuuugaaaauccugaauaa

SEQ ID NO: 1914105 - RNA, 19 nt, Homo sapiens
augcagaggggugcugcuc

SEQ ID NO: 1914106 - RNA, 23 nt, Homo sapiens
uaauacagaaucaacauuuaguc

SEQ ID NO: 1914107 - RNA, 14 nt, Homo sapiens
aaauacgugucaaa

SEQ ID NO: 1914108 - RNA, 18 nt, Homo sapiens
aauuuuaggcacccaucc

SEQ ID NO: 1914109 - RNA, 16 nt, Homo sapiens
gaaacccugucucucc

SEQ ID NO: 1914110 - RNA, 17 nt, Homo sapiens
gcaaaagugcaagaugg

SEQ ID NO: 1914111 - RNA, 11 nt, Homo sapiens
gauacuuugac

SEQ ID NO: 1914112 - RNA, 21 nt, Homo sapiens
aggccugaaaugacauuucac

SEQ ID NO: 1914113 - RNA, 13 nt, Homo sapiens
ucacuucucugau

SEQ ID NO: 1914114 - RNA, 21 nt, Homo sapiens
uggaauaacauaucaaaugaa

SEQ ID NO: 1914115 - RNA, 19 nt, Homo sapiens
uggguccugggucuuucau

SEQ ID NO: 1914116 - RNA, 16 nt, Homo sapiens
uaccaaguccugggaa

SEQ ID NO: 1914117 - RNA, 19 nt, Homo sapiens
uguagccagggacucccca

SEQ ID NO: 1914118 - RNA, 16 nt, Homo sapiens
ugcuaauaaacacugg

SEQ ID NO: 1914119 - RNA, 20 nt, Homo sapiens
aauccaguaggauccaguga

SEQ ID NO: 1914120 - RNA, 15 nt, Homo sapiens
aaaaguauaugugag

SEQ ID NO: 1914121 - RNA, 21 nt, Homo sapiens
uuaaauauuaugugaaaucaa

SEQ ID NO: 1914122 - RNA, 22 nt, Homo sapiens
acagaagcagcuaaaccaagga

SEQ ID NO: 1914123 - RNA, 16 nt, Homo sapiens
gcauagcaagacacau

SEQ ID NO: 1914124 - RNA, 16 nt, Homo sapiens
gcacucaucuacugaa

SEQ ID NO: 1914125 - RNA, 23 nt, Homo sapiens
ucccauuucuugaagauaaaaaa

SEQ ID NO: 1914126 - RNA, 17 nt, Homo sapiens
uacacagaucacagcuu

SEQ ID NO: 1914127 - RNA, 13 nt, Homo sapiens
ugcucgcugagaa

SEQ ID NO: 1914128 - RNA, 17 nt, Homo sapiens
ucacuggggcccaagag

SEQ ID NO: 1914129 - RNA, 19 nt, Homo sapiens
cuuauuucuagaagcacau

SEQ ID NO: 1914130 - RNA, 16 nt, Homo sapiens
augagaacaagcuauu

SEQ ID NO: 1914131 - RNA, 18 nt, Homo sapiens
auagaagagaagagccau

SEQ ID NO: 1914132 - RNA, 17 nt, Homo sapiens
gaacuccuuggcuucuu

SEQ ID NO: 1914133 - RNA, 13 nt, Homo sapiens
cacaggcacuguc

SEQ ID NO: 1914134 - RNA, 23 nt, Homo sapiens
cuuaaugucucuucauaauacuu

SEQ ID NO: 1914135 - RNA, 22 nt, Homo sapiens
gccuuucugccucacaucagcc

SEQ ID NO: 1914136 - RNA, 14 nt, Homo sapiens
ugaauaugacaaag

SEQ ID NO: 1914137 - RNA, 14 nt, Homo sapiens
caggaaauagucac

SEQ ID NO: 1914138 - RNA, 12 nt, Homo sapiens
ggucacugguca

SEQ ID NO: 1914139 - RNA, 21 nt, Homo sapiens
uguacaaguauuacaaccaua

SEQ ID NO: 1914140 - RNA, 18 nt, Homo sapiens
aguuccccucuacuccau

SEQ ID NO: 1914141 - RNA, 21 nt, Homo sapiens
cuguugcaaacucaguuccaa

SEQ ID NO: 1914142 - RNA, 15 nt, Homo sapiens
cuguuacuccaaaaa

SEQ ID NO: 1914143 - RNA, 21 nt, Homo sapiens
cauaagcacauccaacuacuc

SEQ ID NO: 1914144 - RNA, 16 nt, Homo sapiens
auuaugcaucugcuac

SEQ ID NO: 1914145 - RNA, 22 nt, Homo sapiens
aaagaauuuuaugucauauauc

SEQ ID NO: 1914146 - RNA, 24 nt, Homo sapiens
auguauaauuaacuuaacugaaga

SEQ ID NO: 1914147 - RNA, 20 nt, Homo sapiens
ucacuacugaacacaugugu

SEQ ID NO: 1914148 - RNA, 20 nt, Homo sapiens
uugauuuaaaauuguucuac

SEQ ID NO: 1914149 - RNA, 20 nt, Homo sapiens
ccagacuuuuuuaaauguuu

SEQ ID NO: 1914150 - RNA, 14 nt, Homo sapiens
aaggugagugcuug

SEQ ID NO: 1914151 - RNA, 15 nt, Homo sapiens
aauacccuuuuccaa

SEQ ID NO: 1914152 - RNA, 18 nt, Homo sapiens
ucaucaauucucuaucau

SEQ ID NO: 1914153 - RNA, 23 nt, Homo sapiens
cuaaugauggcccauucuacuug

SEQ ID NO: 1914154 - RNA, 17 nt, Homo sapiens
uauuuacaguuuccaga

SEQ ID NO: 1914155 - RNA, 17 nt, Homo sapiens
cuaaccaccuaccuuac

SEQ ID NO: 1914156 - RNA, 14 nt, Homo sapiens
agcauccugugcug

SEQ ID NO: 1914157 - RNA, 15 nt, Homo sapiens
gacugugaccaaagc

SEQ ID NO: 1914158 - RNA, 12 nt, Homo sapiens
cucgcucaggug

SEQ ID NO: 1914159 - RNA, 17 nt, Homo sapiens
ggaaggcuaucagagac

SEQ ID NO: 1914160 - RNA, 14 nt, Homo sapiens
uguacugccuuagu

SEQ ID NO: 1914161 - RNA, 23 nt, Homo sapiens
agugguuugaagaccccacugcc

SEQ ID NO: 1914162 - RNA, 22 nt, Homo sapiens
gagaagcaccagcaauucucuu

SEQ ID NO: 1914163 - RNA, 19 nt, Homo sapiens
ccaugucaugugccacgac

SEQ ID NO: 1914164 - RNA, 20 nt, Homo sapiens
aggagcccccugagaguguc

SEQ ID NO: 1914165 - RNA, 15 nt, Homo sapiens
ugauauaaacagcuu

SEQ ID NO: 1914166 - RNA, 16 nt, Homo sapiens
aggaaaggaugaucaa

SEQ ID NO: 1914167 - RNA, 16 nt, Homo sapiens
aauauauauaauacuu

SEQ ID NO: 1914168 - RNA, 18 nt, Homo sapiens
aggaauggaggcucuaau

SEQ ID NO: 1914169 - RNA, 16 nt, Homo sapiens
cgccuguaaaaugggg

SEQ ID NO: 1914170 - RNA, 15 nt, Homo sapiens
cagugcucugccucu

SEQ ID NO: 1914171 - RNA, 21 nt, Homo sapiens
cauuuccuuccagcccaucca

SEQ ID NO: 1914172 - RNA, 20 nt, Homo sapiens
uccccucacccaugcuuuca

SEQ ID NO: 1914173 - RNA, 15 nt, Homo sapiens
agaauauacuagaau

SEQ ID NO: 1914174 - RNA, 15 nt, Homo sapiens
ccuuaagccaguucc

SEQ ID NO: 1914175 - RNA, 21 nt, Homo sapiens
guguugaugacucacucauaa

SEQ ID NO: 1914176 - RNA, 20 nt, Homo sapiens
ugcuagagggcaggggugca

SEQ ID NO: 1914177 - RNA, 17 nt, Homo sapiens
ucaucaguaacaguauu

SEQ ID NO: 1914178 - RNA, 21 nt, Homo sapiens
uuuccaacaaacuuacuguca

SEQ ID NO: 1914179 - RNA, 22 nt, Homo sapiens
gggguggaacugagugugcucu

SEQ ID NO: 1914180 - RNA, 18 nt, Homo sapiens
ccagcuggcucugcagca

SEQ ID NO: 1914181 - RNA, 13 nt, Homo sapiens
caaaguccuuaac

SEQ ID NO: 1914182 - RNA, 18 nt, Homo sapiens
aacguccacagaguauaa

SEQ ID NO: 1914183 - RNA, 18 nt, Homo sapiens
gacucaagacacugagau

SEQ ID NO: 1914184 - RNA, 16 nt, Homo sapiens
acuaaacauaugauuu

SEQ ID NO: 1914185 - RNA, 17 nt, Homo sapiens
uuccucaaagcauuugc

SEQ ID NO: 1914186 - RNA, 13 nt, Homo sapiens
gagaguuugccac

SEQ ID NO: 1914187 - RNA, 23 nt, Homo sapiens
gccaaggaaacccccaguguaau

SEQ ID NO: 1914188 - RNA, 15 nt, Homo sapiens
ggcaugcaugugcuu

SEQ ID NO: 1914189 - RNA, 16 nt, Homo sapiens
ucucucugucccugua

SEQ ID NO: 1914190 - RNA, 19 nt, Homo sapiens
ugucaauaaaaccacugua

SEQ ID NO: 1914191 - RNA, 20 nt, Homo sapiens
ucagaucugaacacaguuua

SEQ ID NO: 1914192 - RNA, 18 nt, Homo sapiens
gacacuagccugugcacg

SEQ ID NO: 1914193 - RNA, 21 nt, Homo sapiens
agacagagguuucauuuucau

SEQ ID NO: 1914194 - RNA, 17 nt, Homo sapiens
ucauggaggccaagaac

SEQ ID NO: 1914195 - RNA, 22 nt, Homo sapiens
gccuguacccaguagaugccac

SEQ ID NO: 1914196 - RNA, 14 nt, Homo sapiens
ugggagcuuuaaag

SEQ ID NO: 1914197 - RNA, 15 nt, Homo sapiens
auugcaauacauuuc

SEQ ID NO: 1914198 - RNA, 16 nt, Homo sapiens
gcuuucccacucucag

SEQ ID NO: 1914199 - RNA, 19 nt, Homo sapiens
cucccccacugcaccccaa

SEQ ID NO: 1914200 - RNA, 18 nt, Homo sapiens
uuaaacucucuucuucca

SEQ ID NO: 1914201 - RNA, 20 nt, Homo sapiens
cucccaggcaaggcugugga

SEQ ID NO: 1914202 - RNA, 19 nt, Homo sapiens
ccucccaagguccucucag

SEQ ID NO: 1914203 - RNA, 21 nt, Homo sapiens
agaaacggaauaguguggggu

SEQ ID NO: 1914204 - RNA, 14 nt, Homo sapiens
acacugaucuggcu

SEQ ID NO: 1914205 - RNA, 21 nt, Homo sapiens
aaaucaccaccgacugaagug

SEQ ID NO: 1914206 - RNA, 17 nt, Homo sapiens
cuaaaacuggccugacu

SEQ ID NO: 1914207 - RNA, 15 nt, Homo sapiens
aaaaacuuucacuga

SEQ ID NO: 1914208 - RNA, 22 nt, Homo sapiens
gccagcaguggccuuugcaauu

SEQ ID NO: 1914209 - RNA, 14 nt, Homo sapiens
guaucucaacaaca

SEQ ID NO: 1914210 - RNA, 14 nt, Homo sapiens
acaauacaguauuu

SEQ ID NO: 1914211 - RNA, 21 nt, Homo sapiens
gucucaaacucccgaccucag

SEQ ID NO: 1914212 - RNA, 20 nt, Homo sapiens
aguaccgcccucggggcccg

SEQ ID NO: 1914213 - RNA, 18 nt, Homo sapiens
ggccacagugcaauuuua

SEQ ID NO: 1914214 - RNA, 19 nt, Homo sapiens
gauacacuaugaagauguu

SEQ ID NO: 1914215 - RNA, 15 nt, Homo sapiens
uguuucaaaccugca

SEQ ID NO: 1914216 - RNA, 17 nt, Homo sapiens
agcaguccuaugucuca

SEQ ID NO: 1914217 - RNA, 18 nt, Homo sapiens
accuucaugcuuacuauu

SEQ ID NO: 1914218 - RNA, 17 nt, Homo sapiens
cugccuggaguccuuga

SEQ ID NO: 1914219 - RNA, 13 nt, Homo sapiens
ugcaaaugcacuc

SEQ ID NO: 1914220 - RNA, 12 nt, Homo sapiens
cuuguagcauau

SEQ ID NO: 1914221 - RNA, 18 nt, Homo sapiens
cuuaaacuaugaaccuuc

SEQ ID NO: 1914222 - RNA, 20 nt, Homo sapiens
acugauuugauaccauggca

SEQ ID NO: 1914223 - RNA, 16 nt, Homo sapiens
uuacuccccuaagucu

SEQ ID NO: 1914224 - RNA, 20 nt, Homo sapiens
cugaagcgacuauaaagguu

SEQ ID NO: 1914225 - RNA, 18 nt, Homo sapiens
agcacacugcuugugaaa

SEQ ID NO: 1914226 - RNA, 16 nt, Homo sapiens
cuggaaaaauuccaga

SEQ ID NO: 1914227 - RNA, 16 nt, Homo sapiens
auacuuaacauuucau

SEQ ID NO: 1914228 - RNA, 16 nt, Homo sapiens
auuuaagccuugacac

SEQ ID NO: 1914229 - RNA, 15 nt, Homo sapiens
uggacuucagugugu

SEQ ID NO: 1914230 - RNA, 14 nt, Homo sapiens
gccucaggcacucu

SEQ ID NO: 1914231 - RNA, 23 nt, Homo sapiens
aaaugacuccuaagggacuguga

SEQ ID NO: 1914232 - RNA, 12 nt, Homo sapiens
aaagcaugauau

SEQ ID NO: 1914233 - RNA, 21 nt, Homo sapiens
uuaaaucugaauaaauaauuc

SEQ ID NO: 1914234 - RNA, 15 nt, Homo sapiens
guuuugaaaugauau

SEQ ID NO: 1914235 - RNA, 17 nt, Homo sapiens
gcaucuucccacagugg

SEQ ID NO: 1914236 - RNA, 20 nt, Homo sapiens
uaaaauuagaggauugcacu

SEQ ID NO: 1914237 - RNA, 15 nt, Homo sapiens
uugcuuauucacuga

SEQ ID NO: 1914238 - RNA, 18 nt, Homo sapiens
gagaccagcccagccaac

SEQ ID NO: 1914239 - RNA, 15 nt, Homo sapiens
aguccagcuuuccuu

SEQ ID NO: 1914240 - RNA, 14 nt, Homo sapiens
caaccuucgccucc

SEQ ID NO: 1914241 - RNA, 19 nt, Homo sapiens
aaauacagcugcacugagg

SEQ ID NO: 1914242 - RNA, 18 nt, Homo sapiens
auuuuagcuggugucagc

SEQ ID NO: 1914243 - RNA, 17 nt, Homo sapiens
ggcuggcaccaugguga

SEQ ID NO: 1914244 - RNA, 15 nt, Homo sapiens
guucacacaaagccu

SEQ ID NO: 1914245 - RNA, 21 nt, Homo sapiens
uuuggaaguguucccugagaa

SEQ ID NO: 1914246 - RNA, 15 nt, Homo sapiens
uacugaacacuucaa

SEQ ID NO: 1914247 - RNA, 17 nt, Homo sapiens
acaaacaccuuauuugu

SEQ ID NO: 1914248 - RNA, 20 nt, Homo sapiens
cacuuaaugauacauguuuc

SEQ ID NO: 1914249 - RNA, 14 nt, Homo sapiens
acagguaaccacaa

SEQ ID NO: 1914250 - RNA, 17 nt, Homo sapiens
aaacccccaguguaaua

SEQ ID NO: 1914251 - RNA, 23 nt, Homo sapiens
ccacacugaaaauuagacauuua

SEQ ID NO: 1914252 - RNA, 14 nt, Homo sapiens
gacacagugcccaa

SEQ ID NO: 1914253 - RNA, 15 nt, Homo sapiens
caccugcaugugcug

SEQ ID NO: 1914254 - RNA, 15 nt, Homo sapiens
ugggcuugagcugca

SEQ ID NO: 1914255 - RNA, 19 nt, Homo sapiens
uaaugaaggaguucacugu

SEQ ID NO: 1914256 - RNA, 15 nt, Homo sapiens
auuaguugcuuuguu

SEQ ID NO: 1914257 - RNA, 13 nt, Homo sapiens
uccagcagcugcg

SEQ ID NO: 1914258 - RNA, 17 nt, Homo sapiens
gagcagagaacaucugg

SEQ ID NO: 1914259 - RNA, 21 nt, Homo sapiens
auaauuuuguaagaggcuuca

SEQ ID NO: 1914260 - RNA, 14 nt, Homo sapiens
uaacuugugcuuuu

SEQ ID NO: 1914261 - RNA, 16 nt, Homo sapiens
cuucccuuaccucaaa

SEQ ID NO: 1914262 - RNA, 13 nt, Homo sapiens
acccuaacugauc

SEQ ID NO: 1914263 - RNA, 12 nt, Homo sapiens
ugaguuacuuag

SEQ ID NO: 1914264 - RNA, 20 nt, Homo sapiens
acugguugguguucuuccca

SEQ ID NO: 1914265 - RNA, 15 nt, Homo sapiens
gaaggacacuuguau

SEQ ID NO: 1914266 - RNA, 21 nt, Homo sapiens
aagaagaugagccuugcagau

SEQ ID NO: 1914267 - RNA, 21 nt, Homo sapiens
accauccuggcuaacacguga

SEQ ID NO: 1914268 - RNA, 15 nt, Homo sapiens
cugcuugcaucugca

SEQ ID NO: 1914269 - RNA, 16 nt, Homo sapiens
uaagaauuauuuugau

SEQ ID NO: 1914270 - RNA, 19 nt, Homo sapiens
ucucuaccacugcugauau

SEQ ID NO: 1914271 - RNA, 13 nt, Homo sapiens
aagaccaaacuuc

SEQ ID NO: 1914272 - RNA, 17 nt, Homo sapiens
acuauacucuaaaaugg

SEQ ID NO: 1914273 - RNA, 16 nt, Homo sapiens
gaagccuaccagaaga

SEQ ID NO: 1914274 - RNA, 15 nt, Homo sapiens
uagaaacgugauaaa

SEQ ID NO: 1914275 - RNA, 22 nt, Homo sapiens
auauuuauuuauuuucccugag

SEQ ID NO: 1914276 - RNA, 23 nt, Homo sapiens
uaugucaugugcaccuuugcaca

SEQ ID NO: 1914277 - RNA, 22 nt, Homo sapiens
cacuguuucaugagcccaaaca

SEQ ID NO: 1914278 - RNA, 12 nt, Homo sapiens
cugcagcugucu

SEQ ID NO: 1914279 - RNA, 21 nt, Homo sapiens
ugaauuuucaaguaauuguga

SEQ ID NO: 1914280 - RNA, 23 nt, Homo sapiens
uguguauauaguaugaaugcagu

SEQ ID NO: 1914281 - RNA, 13 nt, Homo sapiens
cagagcagaucag

SEQ ID NO: 1914282 - RNA, 21 nt, Homo sapiens
cccaggagcagcggggcagug

SEQ ID NO: 1914283 - RNA, 22 nt, Homo sapiens
cuuuggggagcaggaggccaau

SEQ ID NO: 1914284 - RNA, 13 nt, Homo sapiens
uaguugugcuuuu

SEQ ID NO: 1914285 - RNA, 22 nt, Homo sapiens
uaaugauuauauaaaauacaua

SEQ ID NO: 1914286 - RNA, 16 nt, Homo sapiens
gcacacacacaccaau

SEQ ID NO: 1914287 - RNA, 14 nt, Homo sapiens
ccugaaccccaugg

SEQ ID NO: 1914288 - RNA, 22 nt, Homo sapiens
caggacagcugcaggugcccau

SEQ ID NO: 1914289 - RNA, 19 nt, Homo sapiens
aguuuuuaaaagaauuuca

SEQ ID NO: 1914290 - RNA, 18 nt, Homo sapiens
cugacagaaggacucagg

SEQ ID NO: 1914291 - RNA, 18 nt, Homo sapiens
ggcaacaguuugacauuu

SEQ ID NO: 1914292 - RNA, 14 nt, Homo sapiens
uccuucccugaugg

SEQ ID NO: 1914293 - RNA, 22 nt, Homo sapiens
cagagcugguggacccagggaa

SEQ ID NO: 1914294 - RNA, 20 nt, Homo sapiens
acuguggaucacgacaggaa

SEQ ID NO: 1914295 - RNA, 13 nt, Homo sapiens
uaaguauaucuau

SEQ ID NO: 1914296 - RNA, 22 nt, Homo sapiens
ccacucuggagcauuucucauc

SEQ ID NO: 1914297 - RNA, 15 nt, Homo sapiens
gcuucauacacauga

SEQ ID NO: 1914298 - RNA, 16 nt, Homo sapiens
uaugaauuaagcugua

SEQ ID NO: 1914299 - RNA, 22 nt, Homo sapiens
gaaagcuguggccagcuuguua

SEQ ID NO: 1914300 - RNA, 13 nt, Homo sapiens
auuagacccuuaa

SEQ ID NO: 1914301 - RNA, 13 nt, Homo sapiens
cagggaccaagga

SEQ ID NO: 1914302 - RNA, 13 nt, Homo sapiens
ccaggaccacaga

SEQ ID NO: 1914303 - RNA, 13 nt, Homo sapiens
caaaaaccaaaag

SEQ ID NO: 1914304 - RNA, 12 nt, Homo sapiens
gccugacagaaa

SEQ ID NO: 1914305 - RNA, 17 nt, Homo sapiens
uccauuuucauucuguu

SEQ ID NO: 1914306 - RNA, 20 nt, Homo sapiens
gaaccguuugugauugccau

SEQ ID NO: 1914307 - RNA, 13 nt, Homo sapiens
caagccauuccaa

SEQ ID NO: 1914308 - RNA, 20 nt, Homo sapiens
aagaaccgguuuccaaagac

SEQ ID NO: 1914309 - RNA, 14 nt, Homo sapiens
aaaguguaacaauu

SEQ ID NO: 1914310 - RNA, 18 nt, Homo sapiens
cccagaccuagggauccu

SEQ ID NO: 1914311 - RNA, 14 nt, Homo sapiens
gcuucacugucauc

SEQ ID NO: 1914312 - RNA, 17 nt, Homo sapiens
cucucccagcucugggg

SEQ ID NO: 1914313 - RNA, 24 nt, Homo sapiens
gcagcucuugcuaaucagugucuc

SEQ ID NO: 1914314 - RNA, 20 nt, Homo sapiens
ggaaaguuuucuccacugga

SEQ ID NO: 1914315 - RNA, 20 nt, Homo sapiens
uguugauucuagguugaaaa

SEQ ID NO: 1914316 - RNA, 21 nt, Homo sapiens
guugacguuugcucauuuaag

SEQ ID NO: 1914317 - RNA, 13 nt, Homo sapiens
uuauugacuaaca

SEQ ID NO: 1914318 - RNA, 14 nt, Homo sapiens
ugggacaaauugca

SEQ ID NO: 1914319 - RNA, 18 nt, Homo sapiens
acagggaaauguguaucu

SEQ ID NO: 1914320 - RNA, 20 nt, Homo sapiens
cuguuucucaagaccaacag

SEQ ID NO: 1914321 - RNA, 20 nt, Homo sapiens
acacucgugugcaugagaau

SEQ ID NO: 1914322 - RNA, 17 nt, Homo sapiens
ugucugguucacaguuu

SEQ ID NO: 1914323 - RNA, 19 nt, Homo sapiens
cucaaagcuuccauuccac

SEQ ID NO: 1914324 - RNA, 13 nt, Homo sapiens
aguaaucuguaca

SEQ ID NO: 1914325 - RNA, 19 nt, Homo sapiens
accuuuuugacuuuuccaa

SEQ ID NO: 1914326 - RNA, 22 nt, Homo sapiens
uucaacaaugucuuuuuuccca

SEQ ID NO: 1914327 - RNA, 19 nt, Homo sapiens
aacagagccuucacaacca

SEQ ID NO: 1914328 - RNA, 20 nt, Homo sapiens
agcuagccagucacuaggaa

SEQ ID NO: 1914329 - RNA, 14 nt, Homo sapiens
augcacaguacaau

SEQ ID NO: 1914330 - RNA, 21 nt, Homo sapiens
uguauauuuuuuucauuuggc

SEQ ID NO: 1914331 - RNA, 14 nt, Homo sapiens
aggagcccuucuau

SEQ ID NO: 1914332 - RNA, 23 nt, Homo sapiens
cuuguccgcugggugguacccuc

SEQ ID NO: 1914333 - RNA, 14 nt, Homo sapiens
aauguaacuugaaa

SEQ ID NO: 1914334 - RNA, 15 nt, Homo sapiens
ucucaugagaaguca

SEQ ID NO: 1914335 - RNA, 12 nt, Homo sapiens
cagaaagcauua

SEQ ID NO: 1914336 - RNA, 17 nt, Homo sapiens
guguuuuuuuacauacg

SEQ ID NO: 1914337 - RNA, 14 nt, Homo sapiens
aaggccgggugaca

SEQ ID NO: 1914338 - RNA, 19 nt, Homo sapiens
uagugaaguaugcacuaau

SEQ ID NO: 1914339 - RNA, 18 nt, Homo sapiens
uuggaggaaaugugcuca

SEQ ID NO: 1914340 - RNA, 16 nt, Homo sapiens
uauuugaaaguucuca

SEQ ID NO: 1914341 - RNA, 17 nt, Homo sapiens
acacagaagcugaaaga

SEQ ID NO: 1914342 - RNA, 17 nt, Homo sapiens
acccaaugaaugaugau

SEQ ID NO: 1914343 - RNA, 18 nt, Homo sapiens
caaauaagcaucugugua

SEQ ID NO: 1914344 - RNA, 18 nt, Homo sapiens
uggccugcaaacugggaa

SEQ ID NO: 1914345 - RNA, 13 nt, Homo sapiens
aauaaaaacugac

SEQ ID NO: 1914346 - RNA, 17 nt, Homo sapiens
uugugaaggguuuacug

SEQ ID NO: 1914347 - RNA, 17 nt, Homo sapiens
gcuaucucgcuagccau

SEQ ID NO: 1914348 - RNA, 10 nt, Homo sapiens
agcaggguga

SEQ ID NO: 1914349 - RNA, 16 nt, Homo sapiens
gucaguggcuuugcau

SEQ ID NO: 1914350 - RNA, 15 nt, Homo sapiens
accuccuuggcaccg

SEQ ID NO: 1914351 - RNA, 15 nt, Homo sapiens
cgacuguuucagggg

SEQ ID NO: 1914352 - RNA, 15 nt, Homo sapiens
acauaauacauuaau

SEQ ID NO: 1914353 - RNA, 15 nt, Homo sapiens
cuucagggugaguga

SEQ ID NO: 1914354 - RNA, 21 nt, Homo sapiens
acaguguggaagcagaaggcu

SEQ ID NO: 1914355 - RNA, 15 nt, Homo sapiens
ggauauuauguuucu

SEQ ID NO: 1914356 - RNA, 14 nt, Homo sapiens
aagcaguacaucuu

SEQ ID NO: 1914357 - RNA, 20 nt, Homo sapiens
uggaaccugacguagcugca

SEQ ID NO: 1914358 - RNA, 21 nt, Homo sapiens
cuuucauuccuucagauuugg

SEQ ID NO: 1914359 - RNA, 14 nt, Homo sapiens
uaacagaacagaca

SEQ ID NO: 1914360 - RNA, 23 nt, Homo sapiens
uuuucacucuaagucauguaugu

SEQ ID NO: 1914361 - RNA, 16 nt, Homo sapiens
augucaagauucagcu

SEQ ID NO: 1914362 - RNA, 11 nt, Homo sapiens
ugacaguuccc

SEQ ID NO: 1914363 - RNA, 23 nt, Homo sapiens
uguaaagauguucuggauaccau

SEQ ID NO: 1914364 - RNA, 14 nt, Homo sapiens
ucccuguugguucu

SEQ ID NO: 1914365 - RNA, 17 nt, Homo sapiens
agaaccuguuuccugga

SEQ ID NO: 1914366 - RNA, 18 nt, Homo sapiens
aacaacagagacagugaa

SEQ ID NO: 1914367 - RNA, 14 nt, Homo sapiens
gcagauuuaagaua

SEQ ID NO: 1914368 - RNA, 19 nt, Homo sapiens
cauauacacaauaauguga

SEQ ID NO: 1914369 - RNA, 20 nt, Homo sapiens
uucuaccaccgcauccucac

SEQ ID NO: 1914370 - RNA, 20 nt, Homo sapiens
acaaccaaaagucuucauca

SEQ ID NO: 1914371 - RNA, 18 nt, Homo sapiens
ugcuaggggcuguugcau

SEQ ID NO: 1914372 - RNA, 23 nt, Homo sapiens
acuaguucucuuguccugugauc

SEQ ID NO: 1914373 - RNA, 15 nt, Homo sapiens
aucucaaacuaugac

SEQ ID NO: 1914374 - RNA, 14 nt, Homo sapiens
ucuucgcagccuag

SEQ ID NO: 1914375 - RNA, 18 nt, Homo sapiens
augaagacagauacuccu

SEQ ID NO: 1914376 - RNA, 14 nt, Homo sapiens
aacacacagucaca

SEQ ID NO: 1914377 - RNA, 14 nt, Homo sapiens
accaggcaguuuuu

SEQ ID NO: 1914378 - RNA, 15 nt, Homo sapiens
auguggaucugggga

SEQ ID NO: 1914379 - RNA, 15 nt, Homo sapiens
ccuucaguacugcag

SEQ ID NO: 1914380 - RNA, 20 nt, Homo sapiens
cuuuguaucuucacugccaa

SEQ ID NO: 1914381 - RNA, 16 nt, Homo sapiens
aaauauccagccagua

SEQ ID NO: 1914382 - RNA, 17 nt, Homo sapiens
gagcaugggacuguucu

SEQ ID NO: 1914383 - RNA, 19 nt, Homo sapiens
cagauauggaaacagaaga

SEQ ID NO: 1914384 - RNA, 20 nt, Homo sapiens
auucucuuuuuuucuugucc

SEQ ID NO: 1914385 - RNA, 16 nt, Homo sapiens
aaaucugguuagauaa

SEQ ID NO: 1914386 - RNA, 22 nt, Homo sapiens
cugagugccuacucuuugccaa

SEQ ID NO: 1914387 - RNA, 14 nt, Homo sapiens
ggagaagacugugc

SEQ ID NO: 1914388 - RNA, 17 nt, Homo sapiens
auaccuaaguacuguaa

SEQ ID NO: 1914389 - RNA, 11 nt, Homo sapiens
aauucuacugg

SEQ ID NO: 1914390 - RNA, 23 nt, Homo sapiens
ccgacggauuccuuuaugaguca

SEQ ID NO: 1914391 - RNA, 20 nt, Homo sapiens
cagagguaauguuaguaaau

SEQ ID NO: 1914392 - RNA, 14 nt, Homo sapiens
agcgguaccccagg

SEQ ID NO: 1914393 - RNA, 18 nt, Homo sapiens
aauuuguaaaacuucugc

SEQ ID NO: 1914394 - RNA, 22 nt, Homo sapiens
uuuugaugaaauaaaauaucaa

SEQ ID NO: 1914395 - RNA, 14 nt, Homo sapiens
auguuuuucuucau

SEQ ID NO: 1914396 - RNA, 18 nt, Homo sapiens
agaaaauauauuugcaua

SEQ ID NO: 1914397 - RNA, 13 nt, Homo sapiens
uaaaacaguccuu

SEQ ID NO: 1914398 - RNA, 21 nt, Homo sapiens
uuuauuccaaaugccauccag

SEQ ID NO: 1914399 - RNA, 13 nt, Homo sapiens
gaugaugcaguuu

SEQ ID NO: 1914400 - RNA, 19 nt, Homo sapiens
uuuaauauuacagauaaaa

SEQ ID NO: 1914401 - RNA, 17 nt, Homo sapiens
aucaugcuguguaauau

SEQ ID NO: 1914402 - RNA, 14 nt, Homo sapiens
cauuugcagagucc

SEQ ID NO: 1914403 - RNA, 19 nt, Homo sapiens
gacccaaaacagcuuuguc

SEQ ID NO: 1914404 - RNA, 11 nt, Homo sapiens
cagcagcaucg

SEQ ID NO: 1914405 - RNA, 16 nt, Homo sapiens
cugccugggggcgggg

SEQ ID NO: 1914406 - RNA, 12 nt, Homo sapiens
cuguuguaauau

SEQ ID NO: 1914407 - RNA, 20 nt, Homo sapiens
aucaacagaagcauuuguau

SEQ ID NO: 1914408 - RNA, 23 nt, Homo sapiens
cuccuuuaccccucauccaaagu

SEQ ID NO: 1914409 - RNA, 18 nt, Homo sapiens
cuuugcuaguaccaaaag

SEQ ID NO: 1914410 - RNA, 22 nt, Homo sapiens
gacaaggucaccugggcuguga

SEQ ID NO: 1914411 - RNA, 20 nt, Homo sapiens
gcuuacuaguaucacugcuu

SEQ ID NO: 1914412 - RNA, 19 nt, Homo sapiens
agagcagcaccuccucagc

SEQ ID NO: 1914413 - RNA, 19 nt, Homo sapiens
aauauuuguaaauauucua

SEQ ID NO: 1914414 - RNA, 20 nt, Homo sapiens
ugucuguugaaauaaaacau

SEQ ID NO: 1914415 - RNA, 16 nt, Homo sapiens
caggcugauggagaca

SEQ ID NO: 1914416 - RNA, 17 nt, Homo sapiens
auugggauagaaguauu

SEQ ID NO: 1914417 - RNA, 13 nt, Homo sapiens
agcucacacugau

SEQ ID NO: 1914418 - RNA, 19 nt, Homo sapiens
aaacaauaucagacuuuuu

SEQ ID NO: 1914419 - RNA, 14 nt, Homo sapiens
agucacaguuuuug

SEQ ID NO: 1914420 - RNA, 21 nt, Homo sapiens
uuguugaauaaauguaucuga

SEQ ID NO: 1914421 - RNA, 13 nt, Homo sapiens
uuccuugaccagc

SEQ ID NO: 1914422 - RNA, 22 nt, Homo sapiens
aggggcugcuucuggggcuccc

SEQ ID NO: 1914423 - RNA, 17 nt, Homo sapiens
agaccaaguccuggcua

SEQ ID NO: 1914424 - RNA, 16 nt, Homo sapiens
gguaaguugagauguu

SEQ ID NO: 1914425 - RNA, 21 nt, Homo sapiens
aaccacaagcaaaaucuggau

SEQ ID NO: 1914426 - RNA, 20 nt, Homo sapiens
aaaaauguauuuuuccuaaa

SEQ ID NO: 1914427 - RNA, 22 nt, Homo sapiens
acugcaguugaaagggcaauau

SEQ ID NO: 1914428 - RNA, 11 nt, Homo sapiens
ucacugcugau

SEQ ID NO: 1914429 - RNA, 16 nt, Homo sapiens
cugccuucaaagccac

SEQ ID NO: 1914430 - RNA, 21 nt, Homo sapiens
aguuucagagaaauacuuuca

SEQ ID NO: 1914431 - RNA, 13 nt, Homo sapiens
auacauuuacugu

SEQ ID NO: 1914432 - RNA, 20 nt, Homo sapiens
gggauaauagacacaucaaa

SEQ ID NO: 1914433 - RNA, 21 nt, Homo sapiens
cuaagaaagaggagugcuugu

SEQ ID NO: 1914434 - RNA, 16 nt, Homo sapiens
agcugcugugccugau

SEQ ID NO: 1914435 - RNA, 20 nt, Homo sapiens
ugagaagauaaucauugcuu

SEQ ID NO: 1914436 - RNA, 15 nt, Homo sapiens
caggcucacagagau

SEQ ID NO: 1914437 - RNA, 15 nt, Homo sapiens
ggagagaagugagca

SEQ ID NO: 1914438 - RNA, 16 nt, Homo sapiens
auucuagaacugugaa

SEQ ID NO: 1914439 - RNA, 19 nt, Homo sapiens
acucaggccuccaucuucu

SEQ ID NO: 1914440 - RNA, 13 nt, Homo sapiens
guuuuacacagga

SEQ ID NO: 1914441 - RNA, 14 nt, Homo sapiens
aacuucauauguaa

SEQ ID NO: 1914442 - RNA, 21 nt, Homo sapiens
aaguuuuauaaaagacaugaa

SEQ ID NO: 1914443 - RNA, 18 nt, Homo sapiens
caguggucagcagguguc

SEQ ID NO: 1914444 - RNA, 13 nt, Homo sapiens
ccuccucuuccuc

SEQ ID NO: 1914445 - RNA, 16 nt, Homo sapiens
cuuggcucgaugcugu

SEQ ID NO: 1914446 - RNA, 14 nt, Homo sapiens
ucugaguaacauca

SEQ ID NO: 1914447 - RNA, 22 nt, Homo sapiens
agacaauuguugaaaccugcua

SEQ ID NO: 1914448 - RNA, 16 nt, Homo sapiens
acucacaagugcucau

SEQ ID NO: 1914449 - RNA, 16 nt, Homo sapiens
cagguggacaaaguca

SEQ ID NO: 1914450 - RNA, 17 nt, Homo sapiens
acgacugcaaagccagu

SEQ ID NO: 1914451 - RNA, 17 nt, Homo sapiens
ucuaguuaacauuucaa

SEQ ID NO: 1914452 - RNA, 19 nt, Homo sapiens
uauuaggugguucucuuca

SEQ ID NO: 1914453 - RNA, 21 nt, Homo sapiens
acaggugugagccacagugcc

SEQ ID NO: 1914454 - RNA, 14 nt, Homo sapiens
gagguguuuugcca

SEQ ID NO: 1914455 - RNA, 21 nt, Homo sapiens
aguaaagguuuuuguaauaaa

SEQ ID NO: 1914456 - RNA, 19 nt, Homo sapiens
ccacagccccuugcuucua

SEQ ID NO: 1914457 - RNA, 21 nt, Homo sapiens
acugacacugcgaacucucag

SEQ ID NO: 1914458 - RNA, 17 nt, Homo sapiens
ccacaagcacacaggaa

SEQ ID NO: 1914459 - RNA, 12 nt, Homo sapiens
cuuaaccaaaga

SEQ ID NO: 1914460 - RNA, 17 nt, Homo sapiens
cuuaguaccuuuuuaac

SEQ ID NO: 1914461 - RNA, 12 nt, Homo sapiens
uuccucuguaua

SEQ ID NO: 1914462 - RNA, 18 nt, Homo sapiens
cuagcaauugcuucucua

SEQ ID NO: 1914463 - RNA, 23 nt, Homo sapiens
caggggucucccuggagugcagu

SEQ ID NO: 1914464 - RNA, 21 nt, Homo sapiens
aagcuuggugcuaaaccacaa

SEQ ID NO: 1914465 - RNA, 21 nt, Homo sapiens
gcagggcgugaggaacucucc

SEQ ID NO: 1914466 - RNA, 16 nt, Homo sapiens
guccacaucuucucag

SEQ ID NO: 1914467 - RNA, 13 nt, Homo sapiens
uuccugaagggaa

SEQ ID NO: 1914468 - RNA, 21 nt, Homo sapiens
agugggguuuuauauccauuu

SEQ ID NO: 1914469 - RNA, 18 nt, Homo sapiens
aauuuauuaaucuaaaaa

SEQ ID NO: 1914470 - RNA, 22 nt, Homo sapiens
ccuaguccgguucuucuugucu

SEQ ID NO: 1914471 - RNA, 19 nt, Homo sapiens
aucaggugacuucuagcag

SEQ ID NO: 1914472 - RNA, 21 nt, Homo sapiens
ugcacucuaacccuaggcauc

SEQ ID NO: 1914473 - RNA, 23 nt, Homo sapiens
ugaucaucugcugugacuguggc

SEQ ID NO: 1914474 - RNA, 20 nt, Homo sapiens
aauucuggaaagaaaaccau

SEQ ID NO: 1914475 - RNA, 15 nt, Homo sapiens
ugugucacacuuugc

SEQ ID NO: 1914476 - RNA, 15 nt, Homo sapiens
uucaagacucaaugu

SEQ ID NO: 1914477 - RNA, 13 nt, Homo sapiens
auuuaaaauggaa

SEQ ID NO: 1914478 - RNA, 23 nt, Homo sapiens
cagcuacauuccucagcugccaa

SEQ ID NO: 1914479 - RNA, 13 nt, Homo sapiens
cuccuuccuccua

SEQ ID NO: 1914480 - RNA, 23 nt, Homo sapiens
uaggagaccagaagugaauggga

SEQ ID NO: 1914481 - RNA, 18 nt, Homo sapiens
ucaagcugcucugagcca

SEQ ID NO: 1914482 - RNA, 13 nt, Homo sapiens
aacacuucugcuu

SEQ ID NO: 1914483 - RNA, 18 nt, Homo sapiens
gucucccgggaagccacc

SEQ ID NO: 1914484 - RNA, 20 nt, Homo sapiens
aaaggaaaaucacaucucca

SEQ ID NO: 1914485 - RNA, 19 nt, Homo sapiens
ugucuggagugacagacca

SEQ ID NO: 1914486 - RNA, 20 nt, Homo sapiens
cauuuugugaauacuaugua

SEQ ID NO: 1914487 - RNA, 22 nt, Homo sapiens
ggacaauaugugccaaucaaua

SEQ ID NO: 1914488 - RNA, 20 nt, Homo sapiens
ccuaguacuuagaaauacac

SEQ ID NO: 1914489 - RNA, 13 nt, Homo sapiens
cugucuccaggau

SEQ ID NO: 1914490 - RNA, 16 nt, Homo sapiens
auuaguuuaccucauc

SEQ ID NO: 1914491 - RNA, 16 nt, Homo sapiens
uacucagugacuguug

SEQ ID NO: 1914492 - RNA, 21 nt, Homo sapiens
cacacauuuaaaacauuugaa

SEQ ID NO: 1914493 - RNA, 24 nt, Homo sapiens
gugcuaaccacgucugucuucaca

SEQ ID NO: 1914494 - RNA, 20 nt, Homo sapiens
ucucucuuagcauccugccu

SEQ ID NO: 1914495 - RNA, 22 nt, Homo sapiens
cuugaacccccucccuguccca

SEQ ID NO: 1914496 - RNA, 18 nt, Homo sapiens
ucuuccccauaaucacug

SEQ ID NO: 1914497 - RNA, 18 nt, Homo sapiens
uugugugcacauauccuu

SEQ ID NO: 1914498 - RNA, 18 nt, Homo sapiens
uuaccauuaaccaaggau

SEQ ID NO: 1914499 - RNA, 17 nt, Homo sapiens
uuccacuaacucauagu

SEQ ID NO: 1914500 - RNA, 16 nt, Homo sapiens
cugggguugccagagg

SEQ ID NO: 1914501 - RNA, 15 nt, Homo sapiens
cugccagggagacag

SEQ ID NO: 1914502 - RNA, 20 nt, Homo sapiens
gaccaagccgagaugcccau

SEQ ID NO: 1914503 - RNA, 19 nt, Homo sapiens
cugauguucuuuccaugaa

SEQ ID NO: 1914504 - RNA, 11 nt, Homo sapiens
aaucucagcac

SEQ ID NO: 1914505 - RNA, 17 nt, Homo sapiens
cauucuggguguguucu

SEQ ID NO: 1914506 - RNA, 12 nt, Homo sapiens
guccauuccaaa

SEQ ID NO: 1914507 - RNA, 16 nt, Homo sapiens
gaauuuuuaaacaagu

SEQ ID NO: 1914508 - RNA, 14 nt, Homo sapiens
agagcuagaugugu

SEQ ID NO: 1914509 - RNA, 18 nt, Homo sapiens
gcaguuugaagucaaaug

SEQ ID NO: 1914510 - RNA, 23 nt, Homo sapiens
agaagcugauggggcaaacucaa

SEQ ID NO: 1914511 - RNA, 19 nt, Homo sapiens
cacauuuuuaaagcuuucc

SEQ ID NO: 1914512 - RNA, 14 nt, Homo sapiens
ugagucacaaagaa

SEQ ID NO: 1914513 - RNA, 18 nt, Homo sapiens
cuugaauggagcugguga

SEQ ID NO: 1914514 - RNA, 16 nt, Homo sapiens
gcuuucuacccagcga

SEQ ID NO: 1914515 - RNA, 18 nt, Homo sapiens
cgcuauagaauaaugcau

SEQ ID NO: 1914516 - RNA, 17 nt, Homo sapiens
aacggaggaagcccaca

SEQ ID NO: 1914517 - RNA, 18 nt, Homo sapiens
agcgaauucccugagaua

SEQ ID NO: 1914518 - RNA, 18 nt, Homo sapiens
uggggauuaucugucauu

SEQ ID NO: 1914519 - RNA, 17 nt, Homo sapiens
cugacucuucaagugcc

SEQ ID NO: 1914520 - RNA, 16 nt, Homo sapiens
aguacuuuucuguuca

SEQ ID NO: 1914521 - RNA, 14 nt, Homo sapiens
gggcuuugccauua

SEQ ID NO: 1914522 - RNA, 20 nt, Homo sapiens
cuugugcacuggauguggcc

SEQ ID NO: 1914523 - RNA, 20 nt, Homo sapiens
auugcucugccccaccuugc

SEQ ID NO: 1914524 - RNA, 14 nt, Homo sapiens
ugacacaacucauc

SEQ ID NO: 1914525 - RNA, 19 nt, Homo sapiens
cagagcugauggagaagga

SEQ ID NO: 1914526 - RNA, 13 nt, Homo sapiens
ugcauucuggcca

SEQ ID NO: 1914527 - RNA, 15 nt, Homo sapiens
cuuucuguucaucuc

SEQ ID NO: 1914528 - RNA, 11 nt, Homo sapiens
cguuucuugcc

SEQ ID NO: 1914529 - RNA, 23 nt, Homo sapiens
cacuucagcugggucacauccau

SEQ ID NO: 1914530 - RNA, 14 nt, Homo sapiens
guuuucugcuguaa

SEQ ID NO: 1914531 - RNA, 14 nt, Homo sapiens
cacuugauguuugu

SEQ ID NO: 1914532 - RNA, 22 nt, Homo sapiens
aggugaggguggggugccccag

SEQ ID NO: 1914533 - RNA, 18 nt, Homo sapiens
ccucaagccaggagaccc

SEQ ID NO: 1914534 - RNA, 16 nt, Homo sapiens
ucuuuauacagcugua

SEQ ID NO: 1914535 - RNA, 19 nt, Homo sapiens
gcucacaguacaauguuuc

SEQ ID NO: 1914536 - RNA, 22 nt, Homo sapiens
gcuguuccuuaauuugauuaau

SEQ ID NO: 1914537 - RNA, 22 nt, Homo sapiens
acaaauauggaugagguggaga

SEQ ID NO: 1914538 - RNA, 15 nt, Homo sapiens
uggggagaaaagaca

SEQ ID NO: 1914539 - RNA, 18 nt, Homo sapiens
accaaagggagucugcca

SEQ ID NO: 1914540 - RNA, 16 nt, Homo sapiens
aguaccgccagcagcu

SEQ ID NO: 1914541 - RNA, 11 nt, Homo sapiens
gggcuugccuu

SEQ ID NO: 1914542 - RNA, 12 nt, Homo sapiens
auuuuauaggug

SEQ ID NO: 1914543 - RNA, 14 nt, Homo sapiens
ccuccagcuuuccu

SEQ ID NO: 1914544 - RNA, 13 nt, Homo sapiens
ucuucaccaggug

SEQ ID NO: 1914545 - RNA, 19 nt, Homo sapiens
aauugucuaaaaugucagu

SEQ ID NO: 1914546 - RNA, 17 nt, Homo sapiens
auuucuuuucuggccaa

SEQ ID NO: 1914547 - RNA, 20 nt, Homo sapiens
cacuuacugacuuugcauuu

SEQ ID NO: 1914548 - RNA, 23 nt, Homo sapiens
uucuauuuaaugcuuccagggau

SEQ ID NO: 1914549 - RNA, 15 nt, Homo sapiens
cucaacacuauugua

SEQ ID NO: 1914550 - RNA, 14 nt, Homo sapiens
aguuaucaaccauu

SEQ ID NO: 1914551 - RNA, 19 nt, Homo sapiens
ccaaaugcauggugcaguu

SEQ ID NO: 1914552 - RNA, 16 nt, Homo sapiens
guuuuuaaaacccagu

SEQ ID NO: 1914553 - RNA, 22 nt, Homo sapiens
gacaagcaagggcugugcugag

SEQ ID NO: 1914554 - RNA, 13 nt, Homo sapiens
cacccaugcaccu

SEQ ID NO: 1914555 - RNA, 13 nt, Homo sapiens
ucacuuccccaau

SEQ ID NO: 1914556 - RNA, 13 nt, Homo sapiens
cgaacuccugacc

SEQ ID NO: 1914557 - RNA, 14 nt, Homo sapiens
aauuacugcuauaa

SEQ ID NO: 1914558 - RNA, 10 nt, Homo sapiens
aaagcagugu

SEQ ID NO: 1914559 - RNA, 23 nt, Homo sapiens
uaguaauuuuguuuaugcugcuc

SEQ ID NO: 1914560 - RNA, 15 nt, Homo sapiens
cuguugacaaaugac

SEQ ID NO: 1914561 - RNA, 15 nt, Homo sapiens
augagggaagcaaua

SEQ ID NO: 1914562 - RNA, 13 nt, Homo sapiens
gcuucucaccacg

SEQ ID NO: 1914563 - RNA, 20 nt, Homo sapiens
cuuuguguagaaagccaaau

SEQ ID NO: 1914564 - RNA, 13 nt, Homo sapiens
cacgccuguaauu

SEQ ID NO: 1914565 - RNA, 13 nt, Homo sapiens
cacgucuguaauc

SEQ ID NO: 1914566 - RNA, 19 nt, Homo sapiens
cuuuuauuuagggccuuuu

SEQ ID NO: 1914567 - RNA, 19 nt, Homo sapiens
ccaggccccaggggagaaa

SEQ ID NO: 1914568 - RNA, 17 nt, Homo sapiens
uagggggcgauauacua

SEQ ID NO: 1914569 - RNA, 13 nt, Homo sapiens
agaaccaagaccu

SEQ ID NO: 1914570 - RNA, 14 nt, Homo sapiens
accgccuugcccag

SEQ ID NO: 1914571 - RNA, 14 nt, Homo sapiens
acuuggcacuccug

SEQ ID NO: 1914572 - RNA, 15 nt, Homo sapiens
uacaaaaagauugua

SEQ ID NO: 1914573 - RNA, 16 nt, Homo sapiens
ggucugggaugcugcg

SEQ ID NO: 1914574 - RNA, 14 nt, Homo sapiens
uaagcuacugauga

SEQ ID NO: 1914575 - RNA, 14 nt, Homo sapiens
aauguggccuccau

SEQ ID NO: 1914576 - RNA, 23 nt, Homo sapiens
acgagacccauuuccuugugcuc

SEQ ID NO: 1914577 - RNA, 13 nt, Homo sapiens
uacaagcauuugc

SEQ ID NO: 1914578 - RNA, 20 nt, Homo sapiens
gucuauuuuuuuaacugaaa

SEQ ID NO: 1914579 - RNA, 14 nt, Homo sapiens
gagacccucucagc

SEQ ID NO: 1914580 - RNA, 22 nt, Homo sapiens
ggcauuagugcugauagcugug

SEQ ID NO: 1914581 - RNA, 17 nt, Homo sapiens
gcccugcccuuggcacc

SEQ ID NO: 1914582 - RNA, 12 nt, Homo sapiens
aagcugggagaa

SEQ ID NO: 1914583 - RNA, 18 nt, Homo sapiens
aauguauuauaacuuuaa

SEQ ID NO: 1914584 - RNA, 21 nt, Homo sapiens
gaauuuagcuuauacaauuca

SEQ ID NO: 1914585 - RNA, 15 nt, Homo sapiens
caaaccaucauuuaa

SEQ ID NO: 1914586 - RNA, 20 nt, Homo sapiens
cagaagaccccugacucauc

SEQ ID NO: 1914587 - RNA, 23 nt, Homo sapiens
uguaaccugggaaagccaugacc

SEQ ID NO: 1914588 - RNA, 18 nt, Homo sapiens
cauauuaucaugucuauu

SEQ ID NO: 1914589 - RNA, 13 nt, Homo sapiens
ccucuucauuccg

SEQ ID NO: 1914590 - RNA, 21 nt, Homo sapiens
cacuucccauuuguguuucag

SEQ ID NO: 1914591 - RNA, 14 nt, Homo sapiens
ucauucugccaaag

SEQ ID NO: 1914592 - RNA, 16 nt, Homo sapiens
ccacucucuaccagau

SEQ ID NO: 1914593 - RNA, 13 nt, Homo sapiens
ugccggacacaga

SEQ ID NO: 1914594 - RNA, 11 nt, Homo sapiens
ucgaccacagu

SEQ ID NO: 1914595 - RNA, 19 nt, Homo sapiens
ccagaaguccuaucgacuu

SEQ ID NO: 1914596 - RNA, 14 nt, Homo sapiens
ccugcuauuuccca

SEQ ID NO: 1914597 - RNA, 19 nt, Homo sapiens
uagauguauuuucaauaaa

SEQ ID NO: 1914598 - RNA, 14 nt, Homo sapiens
gugagaccaaagga

SEQ ID NO: 1914599 - RNA, 14 nt, Homo sapiens
gaaaauccauggau

SEQ ID NO: 1914600 - RNA, 15 nt, Homo sapiens
cuacucgaguuacag

SEQ ID NO: 1914601 - RNA, 17 nt, Homo sapiens
gccagcucccccuugcc

SEQ ID NO: 1914602 - RNA, 23 nt, Homo sapiens
cuacucuguuccuucacauccug

SEQ ID NO: 1914603 - RNA, 20 nt, Homo sapiens
ccauuccuuuucguuuagaa

SEQ ID NO: 1914604 - RNA, 13 nt, Homo sapiens
uccgaauuccugc

SEQ ID NO: 1914605 - RNA, 15 nt, Homo sapiens
accugauauauucca

SEQ ID NO: 1914606 - RNA, 18 nt, Homo sapiens
auaggaagauaugccacu

SEQ ID NO: 1914607 - RNA, 17 nt, Homo sapiens
gaaucuuaaugcuugua

SEQ ID NO: 1914608 - RNA, 12 nt, Homo sapiens
aagaacagcuca

SEQ ID NO: 1914609 - RNA, 18 nt, Homo sapiens
uugucuuuuuccaaaaaa

SEQ ID NO: 1914610 - RNA, 18 nt, Homo sapiens
cacagaggacagugcuga

SEQ ID NO: 1914611 - RNA, 16 nt, Homo sapiens
ucagaauauacccauc

SEQ ID NO: 1914612 - RNA, 14 nt, Homo sapiens
cacccucugugcuu

SEQ ID NO: 1914613 - RNA, 22 nt, Homo sapiens
caauucugaaggggaaaaccuc

SEQ ID NO: 1914614 - RNA, 15 nt, Homo sapiens
aggcugacuaagaau

SEQ ID NO: 1914615 - RNA, 21 nt, Homo sapiens
cuucuuguucugagauucaau

SEQ ID NO: 1914616 - RNA, 13 nt, Homo sapiens
caugaugaucugc

SEQ ID NO: 1914617 - RNA, 13 nt, Homo sapiens
ugcagauauucuc

SEQ ID NO: 1914618 - RNA, 18 nt, Homo sapiens
auugcaaauaaaccacuu

SEQ ID NO: 1914619 - RNA, 15 nt, Homo sapiens
uucaauaaauuguaa

SEQ ID NO: 1914620 - RNA, 14 nt, Homo sapiens
accccugagcugaa

SEQ ID NO: 1914621 - RNA, 19 nt, Homo sapiens
cucuaaaaauaaaaugaug

SEQ ID NO: 1914622 - RNA, 14 nt, Homo sapiens
cacuaaaaacugau

SEQ ID NO: 1914623 - RNA, 14 nt, Homo sapiens
cacucuaaacugca

SEQ ID NO: 1914624 - RNA, 22 nt, Homo sapiens
caguagcuccgcgugucucauu

SEQ ID NO: 1914625 - RNA, 22 nt, Homo sapiens
ucuuaaguggucuagucaagga

SEQ ID NO: 1914626 - RNA, 16 nt, Homo sapiens
caacucacacauuccc

SEQ ID NO: 1914627 - RNA, 14 nt, Homo sapiens
guuacuacaugcac

SEQ ID NO: 1914628 - RNA, 22 nt, Homo sapiens
uaugaguuaucagcucuauguc

SEQ ID NO: 1914629 - RNA, 21 nt, Homo sapiens
uguaacccccaguucaagacu

SEQ ID NO: 1914630 - RNA, 20 nt, Homo sapiens
aggcaggagaaucacucgaa

SEQ ID NO: 1914631 - RNA, 16 nt, Homo sapiens
gcgugagccacugcac

SEQ ID NO: 1914632 - RNA, 21 nt, Homo sapiens
caguuguuugcuucuugccau

SEQ ID NO: 1914633 - RNA, 17 nt, Homo sapiens
ugcuaccugcaccucug

SEQ ID NO: 1914634 - RNA, 20 nt, Homo sapiens
cuucauuuuuuaaugugcuc

SEQ ID NO: 1914635 - RNA, 18 nt, Homo sapiens
guauccugggccucagca

SEQ ID NO: 1914636 - RNA, 16 nt, Homo sapiens
acguuuaaagugcagu

SEQ ID NO: 1914637 - RNA, 13 nt, Homo sapiens
uacuuaaacccag

SEQ ID NO: 1914638 - RNA, 23 nt, Homo sapiens
aagauuccugguuaaauuugaau

SEQ ID NO: 1914639 - RNA, 15 nt, Homo sapiens
ggaccaggauuugca

SEQ ID NO: 1914640 - RNA, 22 nt, Homo sapiens
gaggcauucacuagaggugaaa

SEQ ID NO: 1914641 - RNA, 12 nt, Homo sapiens
acuuucucucuu

SEQ ID NO: 1914642 - RNA, 13 nt, Homo sapiens
cuccuugaagcaa

SEQ ID NO: 1914643 - RNA, 23 nt, Homo sapiens
ccucacaauuaggcuucauugca

SEQ ID NO: 1914644 - RNA, 16 nt, Homo sapiens
caagauccucuugcca

SEQ ID NO: 1914645 - RNA, 21 nt, Homo sapiens
cugcuuuuuccagauucuucc

SEQ ID NO: 1914646 - RNA, 19 nt, Homo sapiens
gaaaugugaaaagagcaau

SEQ ID NO: 1914647 - RNA, 18 nt, Homo sapiens
ccuccaccaugcacucac

SEQ ID NO: 1914648 - RNA, 18 nt, Homo sapiens
aacauuuacacauucuca

SEQ ID NO: 1914649 - RNA, 23 nt, Homo sapiens
aacucugagcaguuucauuguga

SEQ ID NO: 1914650 - RNA, 15 nt, Homo sapiens
ugggagaaggugcuu

SEQ ID NO: 1914651 - RNA, 15 nt, Homo sapiens
ugggaguaggugcua

SEQ ID NO: 1914652 - RNA, 15 nt, Homo sapiens
ucucuuuaaucucau

SEQ ID NO: 1914653 - RNA, 11 nt, Homo sapiens
ucuaccugugg

SEQ ID NO: 1914654 - RNA, 19 nt, Homo sapiens
caccucccauuacuuugau

SEQ ID NO: 1914655 - RNA, 15 nt, Homo sapiens
auugcaaagguucca

SEQ ID NO: 1914656 - RNA, 17 nt, Homo sapiens
gaaacaauuucuguguc

SEQ ID NO: 1914657 - RNA, 20 nt, Homo sapiens
uguggggggaagcuuugaua

SEQ ID NO: 1914658 - RNA, 13 nt, Homo sapiens
uauauguaugugu

SEQ ID NO: 1914659 - RNA, 16 nt, Homo sapiens
gaaagccacagacaau

SEQ ID NO: 1914660 - RNA, 19 nt, Homo sapiens
guucuucagggccaguccu

SEQ ID NO: 1914661 - RNA, 14 nt, Homo sapiens
uccaacaguuugau

SEQ ID NO: 1914662 - RNA, 13 nt, Homo sapiens
gauagcaggugaa

SEQ ID NO: 1914663 - RNA, 15 nt, Homo sapiens
acgccacugcacucc

SEQ ID NO: 1914664 - RNA, 23 nt, Homo sapiens
ccccaacaucucccucccacauu

SEQ ID NO: 1914665 - RNA, 15 nt, Homo sapiens
uggcaaaaacaaagg

SEQ ID NO: 1914666 - RNA, 18 nt, Homo sapiens
gugaaauuaguauuuuga

SEQ ID NO: 1914667 - RNA, 13 nt, Homo sapiens
aacauagacucac

SEQ ID NO: 1914668 - RNA, 16 nt, Homo sapiens
augugcagccaccagu

SEQ ID NO: 1914669 - RNA, 21 nt, Homo sapiens
gagaaaaaugcuccccacagc

SEQ ID NO: 1914670 - RNA, 15 nt, Homo sapiens
cacaucccacugcca

SEQ ID NO: 1914671 - RNA, 19 nt, Homo sapiens
cugagagugagcaaccagc

SEQ ID NO: 1914672 - RNA, 16 nt, Homo sapiens
aucacauccuggccug

SEQ ID NO: 1914673 - RNA, 19 nt, Homo sapiens
agaucaucuuggaacugca

SEQ ID NO: 1914674 - RNA, 13 nt, Homo sapiens
aaaguugcucacc

SEQ ID NO: 1914675 - RNA, 19 nt, Homo sapiens
uaauuuuuaccuaaucucc

SEQ ID NO: 1914676 - RNA, 21 nt, Homo sapiens
aacagcgggagaccugugcua

SEQ ID NO: 1914677 - RNA, 13 nt, Homo sapiens
augacugcacaug

SEQ ID NO: 1914678 - RNA, 14 nt, Homo sapiens
uccacugugccaug

SEQ ID NO: 1914679 - RNA, 20 nt, Homo sapiens
ucugauugguccaacaguuu

SEQ ID NO: 1914680 - RNA, 19 nt, Homo sapiens
ccuaaugggaaucauucca

SEQ ID NO: 1914681 - RNA, 14 nt, Homo sapiens
cugcagcacuuuaa

SEQ ID NO: 1914682 - RNA, 16 nt, Homo sapiens
aaaaucucauuauuuc

SEQ ID NO: 1914683 - RNA, 19 nt, Homo sapiens
ucauuuuacacaaagggaa

SEQ ID NO: 1914684 - RNA, 14 nt, Homo sapiens
gccuucauucugca

SEQ ID NO: 1914685 - RNA, 13 nt, Homo sapiens
cauuugcccucau

SEQ ID NO: 1914686 - RNA, 19 nt, Homo sapiens
uuucagguuccaaucagaa

SEQ ID NO: 1914687 - RNA, 22 nt, Homo sapiens
ccugggauucuagaacugugaa

SEQ ID NO: 1914688 - RNA, 13 nt, Homo sapiens
aaggcugguccca

SEQ ID NO: 1914689 - RNA, 22 nt, Homo sapiens
auucagucucuucuaagcaaaa

SEQ ID NO: 1914690 - RNA, 22 nt, Homo sapiens
gugcuccucuuuuuucuuguca

SEQ ID NO: 1914691 - RNA, 14 nt, Homo sapiens
gaaaauuauauucu

SEQ ID NO: 1914692 - RNA, 14 nt, Homo sapiens
aaauucucugcgau

SEQ ID NO: 1914693 - RNA, 17 nt, Homo sapiens
gaaugccucaaugugac

SEQ ID NO: 1914694 - RNA, 22 nt, Homo sapiens
gaucuucuucauccaacuucca

SEQ ID NO: 1914695 - RNA, 18 nt, Homo sapiens
aggaguggccacagcacc

SEQ ID NO: 1914696 - RNA, 19 nt, Homo sapiens
guuaugugcaaguuuauca

SEQ ID NO: 1914697 - RNA, 14 nt, Homo sapiens
ggaagguacuuuaa

SEQ ID NO: 1914698 - RNA, 15 nt, Homo sapiens
cauugauugcuaaau

SEQ ID NO: 1914699 - RNA, 23 nt, Homo sapiens
uaaaaguaccuauugaacaugug

SEQ ID NO: 1914700 - RNA, 21 nt, Homo sapiens
uuaauaugugcugaacauugu

SEQ ID NO: 1914701 - RNA, 22 nt, Homo sapiens
cucugguggccacuucauucca

SEQ ID NO: 1914702 - RNA, 15 nt, Homo sapiens
uaccuuuacauauua

SEQ ID NO: 1914703 - RNA, 23 nt, Homo sapiens
accaaggaggaguuuaaacugaa

SEQ ID NO: 1914704 - RNA, 12 nt, Homo sapiens
uuuuuugguguu

SEQ ID NO: 1914705 - RNA, 19 nt, Homo sapiens
cgaggaaggaaagcacagc

SEQ ID NO: 1914706 - RNA, 18 nt, Homo sapiens
ugcccaucccaguguccu

SEQ ID NO: 1914707 - RNA, 18 nt, Homo sapiens
gacguguacagcacagaa

SEQ ID NO: 1914708 - RNA, 17 nt, Homo sapiens
ugaaacuacaucuccaa

SEQ ID NO: 1914709 - RNA, 19 nt, Homo sapiens
uaccagggacccuggagua

SEQ ID NO: 1914710 - RNA, 17 nt, Homo sapiens
gugaaaauccaucucau

SEQ ID NO: 1914711 - RNA, 17 nt, Homo sapiens
ugacuauaaaaacugcc

SEQ ID NO: 1914712 - RNA, 20 nt, Homo sapiens
gaaucagcaugauucuucca

SEQ ID NO: 1914713 - RNA, 20 nt, Homo sapiens
cucugcauuaucugagguca

SEQ ID NO: 1914714 - RNA, 20 nt, Homo sapiens
accaacuuuuucauucccug

SEQ ID NO: 1914715 - RNA, 16 nt, Homo sapiens
aguguuccccuuccac

SEQ ID NO: 1914716 - RNA, 14 nt, Homo sapiens
ugcaucauagaaca

SEQ ID NO: 1914717 - RNA, 23 nt, Homo sapiens
gcaacugugaauucauucuggag

SEQ ID NO: 1914718 - RNA, 18 nt, Homo sapiens
cuuguuucuguuuagucc

SEQ ID NO: 1914719 - RNA, 12 nt, Homo sapiens
gaauuguguuuu

SEQ ID NO: 1914720 - RNA, 23 nt, Homo sapiens
aacccauauuucauccaggaggc

SEQ ID NO: 1914721 - RNA, 14 nt, Homo sapiens
aggaacaagcaaug

SEQ ID NO: 1914722 - RNA, 18 nt, Homo sapiens
uguggccuguguccagca

SEQ ID NO: 1914723 - RNA, 23 nt, Homo sapiens
caucucuuuaccuccuaauucca

SEQ ID NO: 1914724 - RNA, 19 nt, Homo sapiens
auuuuauacauagucacaa

SEQ ID NO: 1914725 - RNA, 15 nt, Homo sapiens
uaguuauauuugcug

SEQ ID NO: 1914726 - RNA, 13 nt, Homo sapiens
uggguucugcuac

SEQ ID NO: 1914727 - RNA, 17 nt, Homo sapiens
aaucaguucuguccuug

SEQ ID NO: 1914728 - RNA, 20 nt, Homo sapiens
uagucucuacccaguagaug

SEQ ID NO: 1914729 - RNA, 20 nt, Homo sapiens
ugcccagggcucagccuggu

SEQ ID NO: 1914730 - RNA, 15 nt, Homo sapiens
guggacugaugcccc

SEQ ID NO: 1914731 - RNA, 11 nt, Homo sapiens
acuuacccaag

SEQ ID NO: 1914732 - RNA, 15 nt, Homo sapiens
auuggauuuccuaau

SEQ ID NO: 1914733 - RNA, 14 nt, Homo sapiens
augcuuguacaguu

SEQ ID NO: 1914734 - RNA, 14 nt, Homo sapiens
gcccaagaauagau

SEQ ID NO: 1914735 - RNA, 14 nt, Homo sapiens
uucauuaggcaaag

SEQ ID NO: 1914736 - RNA, 14 nt, Homo sapiens
auaaugugcaaauc

SEQ ID NO: 1914737 - RNA, 13 nt, Homo sapiens
agaaauuccccaa

SEQ ID NO: 1914738 - RNA, 15 nt, Homo sapiens
uacauguacagacaa

SEQ ID NO: 1914739 - RNA, 16 nt, Homo sapiens
ugucccgggacaccua

SEQ ID NO: 1914740 - RNA, 14 nt, Homo sapiens
ugaucuguaccuau

SEQ ID NO: 1914741 - RNA, 18 nt, Homo sapiens
cagacuggcaauaaacuc

SEQ ID NO: 1914742 - RNA, 19 nt, Homo sapiens
aguggcacaggagacucca

SEQ ID NO: 1914743 - RNA, 11 nt, Homo sapiens
ugucucugcau

SEQ ID NO: 1914744 - RNA, 11 nt, Homo sapiens
uggcucugcag

SEQ ID NO: 1914745 - RNA, 18 nt, Homo sapiens
ggacacuugcucaugccc

SEQ ID NO: 1914746 - RNA, 16 nt, Homo sapiens
cugcuguugauuccac

SEQ ID NO: 1914747 - RNA, 15 nt, Homo sapiens
auuguaaaguaugug

SEQ ID NO: 1914748 - RNA, 20 nt, Homo sapiens
cauuguauuaacgcaaauau

SEQ ID NO: 1914749 - RNA, 20 nt, Homo sapiens
acagcuaugaaggcuguaca

SEQ ID NO: 1914750 - RNA, 18 nt, Homo sapiens
gaaacggaagcugacaua

SEQ ID NO: 1914751 - RNA, 16 nt, Homo sapiens
cagccacaaccaaaaa

SEQ ID NO: 1914752 - RNA, 16 nt, Homo sapiens
ccacuugccagggugg

SEQ ID NO: 1914753 - RNA, 16 nt, Homo sapiens
uuuauguaaucuaugu

SEQ ID NO: 1914754 - RNA, 19 nt, Homo sapiens
ugguuuuguacacugcugu

SEQ ID NO: 1914755 - RNA, 21 nt, Homo sapiens
gacugguggaaggaaaacaaa

SEQ ID NO: 1914756 - RNA, 19 nt, Homo sapiens
cccuaaagcaaaucugcca

SEQ ID NO: 1914757 - RNA, 19 nt, Homo sapiens
gauagauauccuuggcaca

SEQ ID NO: 1914758 - RNA, 16 nt, Homo sapiens
aaggugaguucucacu

SEQ ID NO: 1914759 - RNA, 17 nt, Homo sapiens
cauguguacauucugcc

SEQ ID NO: 1914760 - RNA, 20 nt, Homo sapiens
gccuaauaggcaccucuuca

SEQ ID NO: 1914761 - RNA, 16 nt, Homo sapiens
uuuggauauagguuuc

SEQ ID NO: 1914762 - RNA, 19 nt, Homo sapiens
uaaaacuugguucugaaua

SEQ ID NO: 1914763 - RNA, 19 nt, Homo sapiens
caguuugacuucuuugaga

SEQ ID NO: 1914764 - RNA, 21 nt, Homo sapiens
accucggugggcccagugggg

SEQ ID NO: 1914765 - RNA, 16 nt, Homo sapiens
aaccuccagugucagg

SEQ ID NO: 1914766 - RNA, 16 nt, Homo sapiens
aaaaguugcauguuau

SEQ ID NO: 1914767 - RNA, 14 nt, Homo sapiens
acagucacauucca

SEQ ID NO: 1914768 - RNA, 17 nt, Homo sapiens
agcugucagaacacucc

SEQ ID NO: 1914769 - RNA, 22 nt, Homo sapiens
ucacaaaggcagagagucagac

SEQ ID NO: 1914770 - RNA, 13 nt, Homo sapiens
cugaguggggaaa

SEQ ID NO: 1914771 - RNA, 20 nt, Homo sapiens
aaauauuucacauccuguaa

SEQ ID NO: 1914772 - RNA, 20 nt, Homo sapiens
cccagcaaagucugcaucug

SEQ ID NO: 1914773 - RNA, 12 nt, Homo sapiens
ugaaaugaccuc

SEQ ID NO: 1914774 - RNA, 18 nt, Homo sapiens
ugguggcagauuuuacaa

SEQ ID NO: 1914775 - RNA, 20 nt, Homo sapiens
gugggccguaucugucacaa

SEQ ID NO: 1914776 - RNA, 15 nt, Homo sapiens
cagucaaggauggau

SEQ ID NO: 1914777 - RNA, 23 nt, Homo sapiens
cuggucaaccccacaagcaccac

SEQ ID NO: 1914778 - RNA, 21 nt, Homo sapiens
uguagaauucgcagugauaua

SEQ ID NO: 1914779 - RNA, 14 nt, Homo sapiens
uccagcaugcaucc

SEQ ID NO: 1914780 - RNA, 20 nt, Homo sapiens
accgagucuugcucuguuac

SEQ ID NO: 1914781 - RNA, 18 nt, Homo sapiens
gccacaccguggcagcuu

SEQ ID NO: 1914782 - RNA, 17 nt, Homo sapiens
gcgccagcgaccucucu

SEQ ID NO: 1914783 - RNA, 16 nt, Homo sapiens
ucgaaaucaaaccacc

SEQ ID NO: 1914784 - RNA, 17 nt, Homo sapiens
cucacuggggcagacaa

SEQ ID NO: 1914785 - RNA, 19 nt, Homo sapiens
ugugaccaacuguguugua

SEQ ID NO: 1914786 - RNA, 20 nt, Homo sapiens
accugcugagggaccagcca

SEQ ID NO: 1914787 - RNA, 22 nt, Homo sapiens
acccuuugccuuucuucugccc

SEQ ID NO: 1914788 - RNA, 15 nt, Homo sapiens
uuuuugguaguuguu

SEQ ID NO: 1914789 - RNA, 16 nt, Homo sapiens
cuggcucuuuuaccag

SEQ ID NO: 1914790 - RNA, 14 nt, Homo sapiens
ugauauacacagug

SEQ ID NO: 1914791 - RNA, 15 nt, Homo sapiens
gaaaucuaaauuucu

SEQ ID NO: 1914792 - RNA, 15 nt, Homo sapiens
gcuauuuaacauuuu

SEQ ID NO: 1914793 - RNA, 18 nt, Homo sapiens
aaauauuauuagauuuau

SEQ ID NO: 1914794 - RNA, 18 nt, Homo sapiens
caguaaggcagugcagua

SEQ ID NO: 1914795 - RNA, 18 nt, Homo sapiens
cuauaaacauaugcaaac

SEQ ID NO: 1914796 - RNA, 18 nt, Homo sapiens
ccuaaauaaaugagcugu

SEQ ID NO: 1914797 - RNA, 16 nt, Homo sapiens
cagggccucugugcag

SEQ ID NO: 1914798 - RNA, 22 nt, Homo sapiens
ucuucucuguuacaaaacgaga

SEQ ID NO: 1914799 - RNA, 13 nt, Homo sapiens
cugagcucacuga

SEQ ID NO: 1914800 - RNA, 17 nt, Homo sapiens
gcuucaccagucugucu

SEQ ID NO: 1914801 - RNA, 20 nt, Homo sapiens
ugaagacagauacuccucca

SEQ ID NO: 1914802 - RNA, 18 nt, Homo sapiens
ucacggcuggauuucucu

SEQ ID NO: 1914803 - RNA, 14 nt, Homo sapiens
agaggguagcugug

SEQ ID NO: 1914804 - RNA, 15 nt, Homo sapiens
aauuacucuaacaaa

SEQ ID NO: 1914805 - RNA, 20 nt, Homo sapiens
gugccacacaccuugacaaa

SEQ ID NO: 1914806 - RNA, 21 nt, Homo sapiens
ucugaggcuucuggggcuuca

SEQ ID NO: 1914807 - RNA, 20 nt, Homo sapiens
agauaugcacacacauggau

SEQ ID NO: 1914808 - RNA, 15 nt, Homo sapiens
auacugcaugcucag

SEQ ID NO: 1914809 - RNA, 14 nt, Homo sapiens
ugacuuucagucuc

SEQ ID NO: 1914810 - RNA, 14 nt, Homo sapiens
agagacucugugau

SEQ ID NO: 1914811 - RNA, 23 nt, Homo sapiens
cucugcaaaggaaauaccaguuc

SEQ ID NO: 1914812 - RNA, 21 nt, Homo sapiens
ugccaccucuaacagcaccaa

SEQ ID NO: 1914813 - RNA, 18 nt, Homo sapiens
acugcccuggccuuugca

SEQ ID NO: 1914814 - RNA, 16 nt, Homo sapiens
cugaagggugccuagu

SEQ ID NO: 1914815 - RNA, 23 nt, Homo sapiens
uagauuuuagacccuauugcugc

SEQ ID NO: 1914816 - RNA, 21 nt, Homo sapiens
cugcucuagugggacagccca

SEQ ID NO: 1914817 - RNA, 15 nt, Homo sapiens
agaaugcauugcauc

SEQ ID NO: 1914818 - RNA, 15 nt, Homo sapiens
cugccaaugauucca

SEQ ID NO: 1914819 - RNA, 21 nt, Homo sapiens
agacauucagcacacugugaa

SEQ ID NO: 1914820 - RNA, 22 nt, Homo sapiens
ugccuuuggauugacucugcau

SEQ ID NO: 1914821 - RNA, 18 nt, Homo sapiens
ucagaacuauaacauuca

SEQ ID NO: 1914822 - RNA, 16 nt, Homo sapiens
uguuuggaaaccacag

SEQ ID NO: 1914823 - RNA, 21 nt, Homo sapiens
uccccagcccagagacauacu

SEQ ID NO: 1914824 - RNA, 21 nt, Homo sapiens
ucccagaaacuccagacuugu

SEQ ID NO: 1914825 - RNA, 23 nt, Homo sapiens
acuaggguaaucugacuucucac

SEQ ID NO: 1914826 - RNA, 16 nt, Homo sapiens
cauuucccaucugcac

SEQ ID NO: 1914827 - RNA, 21 nt, Homo sapiens
aggaagggacugguccaggca

SEQ ID NO: 1914828 - RNA, 21 nt, Homo sapiens
ggacauagccagcauuuuugc

SEQ ID NO: 1914829 - RNA, 16 nt, Homo sapiens
cucuuccugugaucca

SEQ ID NO: 1914830 - RNA, 18 nt, Homo sapiens
aacauuuuucacaucucu

SEQ ID NO: 1914831 - RNA, 14 nt, Homo sapiens
uuacugugcauaca

SEQ ID NO: 1914832 - RNA, 15 nt, Homo sapiens
cauaggcuucuggga

SEQ ID NO: 1914833 - RNA, 16 nt, Homo sapiens
auuucucaagggccau

SEQ ID NO: 1914834 - RNA, 18 nt, Homo sapiens
uuaccuguucaguacucu

SEQ ID NO: 1914835 - RNA, 16 nt, Homo sapiens
gagaacagggaugcua

SEQ ID NO: 1914836 - RNA, 15 nt, Homo sapiens
acaguauuuugacaa

SEQ ID NO: 1914837 - RNA, 19 nt, Homo sapiens
uggugugaggcccccggag

SEQ ID NO: 1914838 - RNA, 18 nt, Homo sapiens
caucaguaagguagcauu

SEQ ID NO: 1914839 - RNA, 22 nt, Homo sapiens
uuuggcaagcucuaucaccaag

SEQ ID NO: 1914840 - RNA, 17 nt, Homo sapiens
auaucuguaaugauacu

SEQ ID NO: 1914841 - RNA, 15 nt, Homo sapiens
cgugcuggugggcau

SEQ ID NO: 1914842 - RNA, 17 nt, Homo sapiens
gucauaugugaagacag

SEQ ID NO: 1914843 - RNA, 22 nt, Homo sapiens
aauaaaauuuuuuuucauguuu

SEQ ID NO: 1914844 - RNA, 21 nt, Homo sapiens
ugaauauggaacauaugcaca

SEQ ID NO: 1914845 - RNA, 21 nt, Homo sapiens
caagaagcccuccuugccacc

SEQ ID NO: 1914846 - RNA, 23 nt, Homo sapiens
gaaccagcaaugagaaggccagg

SEQ ID NO: 1914847 - RNA, 22 nt, Homo sapiens
accacugguuaaaauaaagccu

SEQ ID NO: 1914848 - RNA, 18 nt, Homo sapiens
uacccacgugcuguucca

SEQ ID NO: 1914849 - RNA, 19 nt, Homo sapiens
uaaaaccuugguuaucaaa

SEQ ID NO: 1914850 - RNA, 19 nt, Homo sapiens
cucgcuagguucuuaucaa

SEQ ID NO: 1914851 - RNA, 14 nt, Homo sapiens
agccuggagaccca

SEQ ID NO: 1914852 - RNA, 15 nt, Homo sapiens
aauuaaaaugugcag

SEQ ID NO: 1914853 - RNA, 22 nt, Homo sapiens
ccaggaaguaauuuucuucuca

SEQ ID NO: 1914854 - RNA, 23 nt, Homo sapiens
caaggugggccuugcuaccucaa

SEQ ID NO: 1914855 - RNA, 15 nt, Homo sapiens
aaugucuguuuucca

SEQ ID NO: 1914856 - RNA, 12 nt, Homo sapiens
cccaucaccucu

SEQ ID NO: 1914857 - RNA, 18 nt, Homo sapiens
acuuugcuucuccaaaua

SEQ ID NO: 1914858 - RNA, 16 nt, Homo sapiens
augcaaacaaaaucca

SEQ ID NO: 1914859 - RNA, 20 nt, Homo sapiens
aguuccuacuuuagccacug

SEQ ID NO: 1914860 - RNA, 12 nt, Homo sapiens
aaauuauauccg

SEQ ID NO: 1914861 - RNA, 22 nt, Homo sapiens
uggacaugcuucagugcugcuc

SEQ ID NO: 1914862 - RNA, 14 nt, Homo sapiens
uucuaugccuuuag

SEQ ID NO: 1914863 - RNA, 22 nt, Homo sapiens
caagcaaaucccaaauucuccu

SEQ ID NO: 1914864 - RNA, 23 nt, Homo sapiens
guuuuuuucccucuccuguccuu

SEQ ID NO: 1914865 - RNA, 16 nt, Homo sapiens
aucagaugccucagag

SEQ ID NO: 1914866 - RNA, 21 nt, Homo sapiens
gucuuggauugguaccagagc

SEQ ID NO: 1914867 - RNA, 17 nt, Homo sapiens
gccaugcuuugagucca

SEQ ID NO: 1914868 - RNA, 23 nt, Homo sapiens
uccggguggaaaagaaucccugc

SEQ ID NO: 1914869 - RNA, 17 nt, Homo sapiens
auagcugcuuccagugu

SEQ ID NO: 1914870 - RNA, 19 nt, Homo sapiens
ucaccccgaggcccugcau

SEQ ID NO: 1914871 - RNA, 17 nt, Homo sapiens
cccuccuugggcacuuu

SEQ ID NO: 1914872 - RNA, 19 nt, Homo sapiens
uagaauuccuucaggguga

SEQ ID NO: 1914873 - RNA, 22 nt, Homo sapiens
ucccucagacucagagguccag

SEQ ID NO: 1914874 - RNA, 22 nt, Homo sapiens
aacugagcaucuccagcauucu

SEQ ID NO: 1914875 - RNA, 14 nt, Homo sapiens
accucugcuucuga

SEQ ID NO: 1914876 - RNA, 13 nt, Homo sapiens
caaaugaguucag

SEQ ID NO: 1914877 - RNA, 21 nt, Homo sapiens
ggcucaucuaacucuguccuu

SEQ ID NO: 1914878 - RNA, 14 nt, Homo sapiens
ucuugcccaaaguc

SEQ ID NO: 1914879 - RNA, 20 nt, Homo sapiens
guaugaugcuaaucuugucc

SEQ ID NO: 1914880 - RNA, 20 nt, Homo sapiens
gcauacuccgugaggcugcu

SEQ ID NO: 1914881 - RNA, 15 nt, Homo sapiens
uguacaaagauaugc

SEQ ID NO: 1914882 - RNA, 23 nt, Homo sapiens
ucaucacaaauggcuacaucucc

SEQ ID NO: 1914883 - RNA, 13 nt, Homo sapiens
ucauuacagauuc

SEQ ID NO: 1914884 - RNA, 15 nt, Homo sapiens
cuaguuagcucacaa

SEQ ID NO: 1914885 - RNA, 15 nt, Homo sapiens
cugucuaauuugcac

SEQ ID NO: 1914886 - RNA, 15 nt, Homo sapiens
cuuaacacacuggcc

SEQ ID NO: 1914887 - RNA, 12 nt, Homo sapiens
acuaaugaagug

SEQ ID NO: 1914888 - RNA, 22 nt, Homo sapiens
acuagacucaggaaagcuguua

SEQ ID NO: 1914889 - RNA, 21 nt, Homo sapiens
aggaaguguaguugacugaaa

SEQ ID NO: 1914890 - RNA, 21 nt, Homo sapiens
aucuaccaacccugugcauga

SEQ ID NO: 1914891 - RNA, 21 nt, Homo sapiens
cacgguggucaccaugccaau

SEQ ID NO: 1914892 - RNA, 12 nt, Homo sapiens
ugagcaggguga

SEQ ID NO: 1914893 - RNA, 20 nt, Homo sapiens
ccauccaccaggccuuugag

SEQ ID NO: 1914894 - RNA, 15 nt, Homo sapiens
cauuaaaagacuguu

SEQ ID NO: 1914895 - RNA, 18 nt, Homo sapiens
agauuuucaacauuucaa

SEQ ID NO: 1914896 - RNA, 22 nt, Homo sapiens
gcuccacaaccaccuccagccu

SEQ ID NO: 1914897 - RNA, 20 nt, Homo sapiens
uauaccacuagagucuucag

SEQ ID NO: 1914898 - RNA, 22 nt, Homo sapiens
ugaauucggaacuguccuuucc

SEQ ID NO: 1914899 - RNA, 13 nt, Homo sapiens
ucuuccccagaua

SEQ ID NO: 1914900 - RNA, 19 nt, Homo sapiens
gagaaaugccccaguguua

SEQ ID NO: 1914901 - RNA, 22 nt, Homo sapiens
aauaucaaaaaggagcucuucu

SEQ ID NO: 1914902 - RNA, 15 nt, Homo sapiens
ccaugaggucuuccc

SEQ ID NO: 1914903 - RNA, 16 nt, Homo sapiens
guuuauuuagcucuga

SEQ ID NO: 1914904 - RNA, 16 nt, Homo sapiens
aauugguuguauauaa

SEQ ID NO: 1914905 - RNA, 20 nt, Homo sapiens
cugcagcuuucaagcucauc

SEQ ID NO: 1914906 - RNA, 14 nt, Homo sapiens
gugaacuccaccuc

SEQ ID NO: 1914907 - RNA, 15 nt, Homo sapiens
agaacucacucuggg

SEQ ID NO: 1914908 - RNA, 20 nt, Homo sapiens
aggcuggaguacaguggugu

SEQ ID NO: 1914909 - RNA, 22 nt, Homo sapiens
auaaaggacaggcuggugcuaa

SEQ ID NO: 1914910 - RNA, 14 nt, Homo sapiens
ccaauaaagugacc

SEQ ID NO: 1914911 - RNA, 22 nt, Homo sapiens
gacaggguuucaccauguuggc

SEQ ID NO: 1914912 - RNA, 15 nt, Homo sapiens
aaauccaauaucaug

SEQ ID NO: 1914913 - RNA, 18 nt, Homo sapiens
cuuucaacuccaguacuc

SEQ ID NO: 1914914 - RNA, 17 nt, Homo sapiens
ugcagacaaacaaacau

SEQ ID NO: 1914915 - RNA, 18 nt, Homo sapiens
cauauccgggugcucaau

SEQ ID NO: 1914916 - RNA, 20 nt, Homo sapiens
uaguuuuagcuguagaucaa

SEQ ID NO: 1914917 - RNA, 22 nt, Homo sapiens
gaacccuuggagccaauggaga

SEQ ID NO: 1914918 - RNA, 16 nt, Homo sapiens
gaaacuccgucucaaa

SEQ ID NO: 1914919 - RNA, 16 nt, Homo sapiens
aaaacuccaucucaaa

SEQ ID NO: 1914920 - RNA, 18 nt, Homo sapiens
auuucagucaucaucuca

SEQ ID NO: 1914921 - RNA, 22 nt, Homo sapiens
uccaccccuacucuauucugua

SEQ ID NO: 1914922 - RNA, 14 nt, Homo sapiens
gugacuguggcauu

SEQ ID NO: 1914923 - RNA, 23 nt, Homo sapiens
ugacuuaagcacacuugacauca

SEQ ID NO: 1914924 - RNA, 22 nt, Homo sapiens
ccagucaggcucucugggcuga

SEQ ID NO: 1914925 - RNA, 19 nt, Homo sapiens
gagcuguguaaauacuuca

SEQ ID NO: 1914926 - RNA, 12 nt, Homo sapiens
uacacugugaac

SEQ ID NO: 1914927 - RNA, 23 nt, Homo sapiens
aaauaucuuagguuggagaugac

SEQ ID NO: 1914928 - RNA, 20 nt, Homo sapiens
gagcggaccuucccagcuag

SEQ ID NO: 1914929 - RNA, 22 nt, Homo sapiens
uuucucggcaccagugccucag

SEQ ID NO: 1914930 - RNA, 20 nt, Homo sapiens
cacuacauaaucucuggaaa

SEQ ID NO: 1914931 - RNA, 20 nt, Homo sapiens
aguggugugaucauagcuca

SEQ ID NO: 1914932 - RNA, 18 nt, Homo sapiens
ucuauauguacuugucaa

SEQ ID NO: 1914933 - RNA, 21 nt, Homo sapiens
aacauacaugagauaacucaa

SEQ ID NO: 1914934 - RNA, 14 nt, Homo sapiens
acaaggggucaaug

SEQ ID NO: 1914935 - RNA, 14 nt, Homo sapiens
ugaaguaagcaaag

SEQ ID NO: 1914936 - RNA, 17 nt, Homo sapiens
uacaacuucauugcuac

SEQ ID NO: 1914937 - RNA, 15 nt, Homo sapiens
aucucacaagcacuu

SEQ ID NO: 1914938 - RNA, 15 nt, Homo sapiens
uuaagauaugauguc

SEQ ID NO: 1914939 - RNA, 21 nt, Homo sapiens
ucauuucuucucucugugcug

SEQ ID NO: 1914940 - RNA, 21 nt, Homo sapiens
ggaacguaguguucuuugcau

SEQ ID NO: 1914941 - RNA, 11 nt, Homo sapiens
guaacuguguu

SEQ ID NO: 1914942 - RNA, 11 nt, Homo sapiens
uguacuguuga

SEQ ID NO: 1914943 - RNA, 18 nt, Homo sapiens
gauuccucagcuacuuuu

SEQ ID NO: 1914944 - RNA, 14 nt, Homo sapiens
cagcugaacagcca

SEQ ID NO: 1914945 - RNA, 13 nt, Homo sapiens
gcaaggcugcuaa

SEQ ID NO: 1914946 - RNA, 19 nt, Homo sapiens
ccaccaguguguugaaucc

SEQ ID NO: 1914947 - RNA, 13 nt, Homo sapiens
acuuuuacugucu

SEQ ID NO: 1914948 - RNA, 13 nt, Homo sapiens
agcaagcaaaaug

SEQ ID NO: 1914949 - RNA, 17 nt, Homo sapiens
auaugaguacauacuca

SEQ ID NO: 1914950 - RNA, 16 nt, Homo sapiens
aauaagaaacaugaug

SEQ ID NO: 1914951 - RNA, 13 nt, Homo sapiens
ugucagcaaaaag

SEQ ID NO: 1914952 - RNA, 17 nt, Homo sapiens
uuaugcugacaugccau

SEQ ID NO: 1914953 - RNA, 19 nt, Homo sapiens
aacugcuuccuuucuugau

SEQ ID NO: 1914954 - RNA, 15 nt, Homo sapiens
aggucaggaguucaa

SEQ ID NO: 1914955 - RNA, 23 nt, Homo sapiens
acugcguaggagagaacagggau

SEQ ID NO: 1914956 - RNA, 16 nt, Homo sapiens
aaaucaacuugcuuau

SEQ ID NO: 1914957 - RNA, 15 nt, Homo sapiens
uaauucuaaguuauu

SEQ ID NO: 1914958 - RNA, 15 nt, Homo sapiens
acucaugaaugaaaa

SEQ ID NO: 1914959 - RNA, 14 nt, Homo sapiens
ucagaacccagaaa

SEQ ID NO: 1914960 - RNA, 22 nt, Homo sapiens
ggagagaaugagagagugugga

SEQ ID NO: 1914961 - RNA, 18 nt, Homo sapiens
cuaauaugccuagcacaa

SEQ ID NO: 1914962 - RNA, 23 nt, Homo sapiens
ugggaccucaguuuuaucauuuu

SEQ ID NO: 1914963 - RNA, 15 nt, Homo sapiens
auuaggcaagaauaa

SEQ ID NO: 1914964 - RNA, 20 nt, Homo sapiens
guuggugugaaaauacacuu

SEQ ID NO: 1914965 - RNA, 15 nt, Homo sapiens
ccuugcccucaagca

SEQ ID NO: 1914966 - RNA, 20 nt, Homo sapiens
guaauuaaguacuauguauc

SEQ ID NO: 1914967 - RNA, 17 nt, Homo sapiens
uucuuaggcacuucuua

SEQ ID NO: 1914968 - RNA, 23 nt, Homo sapiens
gccuauaaauuuacucuguugaa

SEQ ID NO: 1914969 - RNA, 17 nt, Homo sapiens
auauccuuuuacugcag

SEQ ID NO: 1914970 - RNA, 16 nt, Homo sapiens
ggaagauggagacacc

SEQ ID NO: 1914971 - RNA, 14 nt, Homo sapiens
cccuucuauuuauu

SEQ ID NO: 1914972 - RNA, 20 nt, Homo sapiens
cuguauuuuauuggacaggu

SEQ ID NO: 1914973 - RNA, 16 nt, Homo sapiens
aaucauuuaaauauua

SEQ ID NO: 1914974 - RNA, 13 nt, Homo sapiens
caucagccugcuu

SEQ ID NO: 1914975 - RNA, 19 nt, Homo sapiens
guuuucaagaugguguuau

SEQ ID NO: 1914976 - RNA, 17 nt, Homo sapiens
uugaggacacaugucca

SEQ ID NO: 1914977 - RNA, 20 nt, Homo sapiens
uguauucuccuuugcacugu

SEQ ID NO: 1914978 - RNA, 17 nt, Homo sapiens
augaagaaagaacacag

SEQ ID NO: 1914979 - RNA, 17 nt, Homo sapiens
ucauuuuugaagugaaa

SEQ ID NO: 1914980 - RNA, 20 nt, Homo sapiens
ccagauucugccucucugga

SEQ ID NO: 1914981 - RNA, 20 nt, Homo sapiens
caauuccaaaggaaucucca

SEQ ID NO: 1914982 - RNA, 15 nt, Homo sapiens
gagcacaucucuuca

SEQ ID NO: 1914983 - RNA, 22 nt, Homo sapiens
agcuucccucugccugacccca

SEQ ID NO: 1914984 - RNA, 15 nt, Homo sapiens
gaaccucccugggcc

SEQ ID NO: 1914985 - RNA, 15 nt, Homo sapiens
gcaaauauacuuuac

SEQ ID NO: 1914986 - RNA, 20 nt, Homo sapiens
cuugaugccaguaggcucaa

SEQ ID NO: 1914987 - RNA, 21 nt, Homo sapiens
ugacaagcaagggcugugcug

SEQ ID NO: 1914988 - RNA, 22 nt, Homo sapiens
uguguuauauuccaaggaaaau

SEQ ID NO: 1914989 - RNA, 18 nt, Homo sapiens
aauaacauuuaaauucca

SEQ ID NO: 1914990 - RNA, 18 nt, Homo sapiens
gaaaugaaaggugacaaa

SEQ ID NO: 1914991 - RNA, 17 nt, Homo sapiens
uuaaagacucaaggugg

SEQ ID NO: 1914992 - RNA, 15 nt, Homo sapiens
uucccugcaccacuc

SEQ ID NO: 1914993 - RNA, 12 nt, Homo sapiens
gaugcuauuaaa

SEQ ID NO: 1914994 - RNA, 15 nt, Homo sapiens
ucuuggccucugcuu

SEQ ID NO: 1914995 - RNA, 20 nt, Homo sapiens
auagauaagguuuccugcuc

SEQ ID NO: 1914996 - RNA, 19 nt, Homo sapiens
gcuugcgcuggaccugguu

SEQ ID NO: 1914997 - RNA, 17 nt, Homo sapiens
aacuugcacuuguuaua

SEQ ID NO: 1914998 - RNA, 21 nt, Homo sapiens
aaggauguguuuucagucuuu

SEQ ID NO: 1914999 - RNA, 23 nt, Homo sapiens
gcccccuauagucaugggguccc

SEQ ID NO: 1915000 - RNA, 13 nt, Homo sapiens
accacucuuggcu

SEQ ID NO: 1915001 - RNA, 16 nt, Homo sapiens
ggcccaagaacugcag

SEQ ID NO: 1915002 - RNA, 14 nt, Homo sapiens
uaauacagcagugu

SEQ ID NO: 1915003 - RNA, 14 nt, Homo sapiens
cuuuguucacugug

SEQ ID NO: 1915004 - RNA, 17 nt, Homo sapiens
acagaauacaagccacu

SEQ ID NO: 1915005 - RNA, 18 nt, Homo sapiens
agcgaagcccccacuacu

SEQ ID NO: 1915006 - RNA, 17 nt, Homo sapiens
cgcaagcaccauccccu

SEQ ID NO: 1915007 - RNA, 19 nt, Homo sapiens
ugcucugguuugagcaauu

SEQ ID NO: 1915008 - RNA, 16 nt, Homo sapiens
cuccauccuccugugu

SEQ ID NO: 1915009 - RNA, 14 nt, Homo sapiens
ucaccucacugaaa

SEQ ID NO: 1915010 - RNA, 15 nt, Homo sapiens
ugaaauccaaaauag

SEQ ID NO: 1915011 - RNA, 17 nt, Homo sapiens
caaugacacccaugcca

SEQ ID NO: 1915012 - RNA, 14 nt, Homo sapiens
aacacccuccuuca

SEQ ID NO: 1915013 - RNA, 18 nt, Homo sapiens
gacccugaggguuuccac

SEQ ID NO: 1915014 - RNA, 18 nt, Homo sapiens
ugcuaacaaagacaaaag

SEQ ID NO: 1915015 - RNA, 18 nt, Homo sapiens
cuuuuguuguuucuuaau

SEQ ID NO: 1915016 - RNA, 20 nt, Homo sapiens
uguccaugccuacagauaau

SEQ ID NO: 1915017 - RNA, 23 nt, Homo sapiens
ugcauuuaccaaaauuugugcac

SEQ ID NO: 1915018 - RNA, 15 nt, Homo sapiens
ggacaaaccuugaaa

SEQ ID NO: 1915019 - RNA, 16 nt, Homo sapiens
aauacuuaaauguuau

SEQ ID NO: 1915020 - RNA, 17 nt, Homo sapiens
aacaagaagcaauguua

SEQ ID NO: 1915021 - RNA, 16 nt, Homo sapiens
uguucauuauaaucuc

SEQ ID NO: 1915022 - RNA, 20 nt, Homo sapiens
aauagaaccacuaugaagcu

SEQ ID NO: 1915023 - RNA, 16 nt, Homo sapiens
cucagacguuccauac

SEQ ID NO: 1915024 - RNA, 16 nt, Homo sapiens
uuuauaaauggacaaa

SEQ ID NO: 1915025 - RNA, 14 nt, Homo sapiens
gugagaucaugcca

SEQ ID NO: 1915026 - RNA, 21 nt, Homo sapiens
ucgaaauaaaggcgauagcug

SEQ ID NO: 1915027 - RNA, 12 nt, Homo sapiens
aaaaaugaguaa

SEQ ID NO: 1915028 - RNA, 23 nt, Homo sapiens
ucaggccacauggcuaaagaagg

SEQ ID NO: 1915029 - RNA, 19 nt, Homo sapiens
uaaaaguaaauucauguaa

SEQ ID NO: 1915030 - RNA, 13 nt, Homo sapiens
ugcccucggcaac

SEQ ID NO: 1915031 - RNA, 18 nt, Homo sapiens
gcagcauucaguugaaau

SEQ ID NO: 1915032 - RNA, 13 nt, Homo sapiens
cauuucaguauca

SEQ ID NO: 1915033 - RNA, 15 nt, Homo sapiens
auaaggacgugugua

SEQ ID NO: 1915034 - RNA, 17 nt, Homo sapiens
ccuagcaauacagggag

SEQ ID NO: 1915035 - RNA, 16 nt, Homo sapiens
ccucugugcaaaggga

SEQ ID NO: 1915036 - RNA, 15 nt, Homo sapiens
caguugguuuugcau

SEQ ID NO: 1915037 - RNA, 23 nt, Homo sapiens
ggugaaguccacagaagugagcu

SEQ ID NO: 1915038 - RNA, 13 nt, Homo sapiens
cacaggugucugc

SEQ ID NO: 1915039 - RNA, 14 nt, Homo sapiens
uaugcuccugcuga

SEQ ID NO: 1915040 - RNA, 13 nt, Homo sapiens
acaaaccaugacu

SEQ ID NO: 1915041 - RNA, 11 nt, Homo sapiens
ucuuaacucac

SEQ ID NO: 1915042 - RNA, 22 nt, Homo sapiens
aagauuacccugagcugcagcu

SEQ ID NO: 1915043 - RNA, 16 nt, Homo sapiens
ggcaggagaauggugu

SEQ ID NO: 1915044 - RNA, 20 nt, Homo sapiens
uaaaauaaggauaauaauca

SEQ ID NO: 1915045 - RNA, 16 nt, Homo sapiens
agcaaacagaucacua

SEQ ID NO: 1915046 - RNA, 15 nt, Homo sapiens
acccaggucuuccag

SEQ ID NO: 1915047 - RNA, 20 nt, Homo sapiens
gcucagaauugcacaucuaa

SEQ ID NO: 1915048 - RNA, 10 nt, Homo sapiens
cccaccacgu

SEQ ID NO: 1915049 - RNA, 19 nt, Homo sapiens
cacagccgcgggccaggag

SEQ ID NO: 1915050 - RNA, 15 nt, Homo sapiens
guauaaguauucaag

SEQ ID NO: 1915051 - RNA, 15 nt, Homo sapiens
gucugcauaaacuuc

SEQ ID NO: 1915052 - RNA, 23 nt, Homo sapiens
ccgcucuugggaaauaugucaaa

SEQ ID NO: 1915053 - RNA, 19 nt, Homo sapiens
uccugccaccagucacugu

SEQ ID NO: 1915054 - RNA, 18 nt, Homo sapiens
uggacuggaggugggcau

SEQ ID NO: 1915055 - RNA, 16 nt, Homo sapiens
uugggauggcuuguag

SEQ ID NO: 1915056 - RNA, 13 nt, Homo sapiens
gcccagcggcccc

SEQ ID NO: 1915057 - RNA, 13 nt, Homo sapiens
gccccgcggccca

SEQ ID NO: 1915058 - RNA, 13 nt, Homo sapiens
cagggucuugcaa

SEQ ID NO: 1915059 - RNA, 16 nt, Homo sapiens
uuaccuaacuguuccu

SEQ ID NO: 1915060 - RNA, 19 nt, Homo sapiens
cuaguuccauccacgcuca

SEQ ID NO: 1915061 - RNA, 23 nt, Homo sapiens
auauauuguaaucacauuccuua

SEQ ID NO: 1915062 - RNA, 13 nt, Homo sapiens
aggacaacacuuc

SEQ ID NO: 1915063 - RNA, 20 nt, Homo sapiens
aguucuaugcagaacaguga

SEQ ID NO: 1915064 - RNA, 19 nt, Homo sapiens
cauggaagaaaaggauuuu

SEQ ID NO: 1915065 - RNA, 19 nt, Homo sapiens
cacuuauucuguauugcca

SEQ ID NO: 1915066 - RNA, 14 nt, Homo sapiens
aauuuauauuuucc

SEQ ID NO: 1915067 - RNA, 20 nt, Homo sapiens
caaagaacuccagagucagu

SEQ ID NO: 1915068 - RNA, 17 nt, Homo sapiens
uggacuuaacucuaauu

SEQ ID NO: 1915069 - RNA, 17 nt, Homo sapiens
ccaccuccccagccuuu

SEQ ID NO: 1915070 - RNA, 19 nt, Homo sapiens
cagggcugaggccucucau

SEQ ID NO: 1915071 - RNA, 22 nt, Homo sapiens
aucaaaacacacuacuaccucu

SEQ ID NO: 1915072 - RNA, 17 nt, Homo sapiens
gaaccaaucccgugaaa

SEQ ID NO: 1915073 - RNA, 14 nt, Homo sapiens
ccuaccccagggcc

SEQ ID NO: 1915074 - RNA, 16 nt, Homo sapiens
gggggccaaaccuggg

SEQ ID NO: 1915075 - RNA, 22 nt, Homo sapiens
uucaagcaggcgccaagugcua

SEQ ID NO: 1915076 - RNA, 20 nt, Homo sapiens
aaucauguuuuuucugcaau

SEQ ID NO: 1915077 - RNA, 16 nt, Homo sapiens
cucacugcuguuuuua

SEQ ID NO: 1915078 - RNA, 13 nt, Homo sapiens
cuagucauaaccu

SEQ ID NO: 1915079 - RNA, 14 nt, Homo sapiens
cucuucuuacuuga

SEQ ID NO: 1915080 - RNA, 19 nt, Homo sapiens
gauauuuauugagugccca

SEQ ID NO: 1915081 - RNA, 19 nt, Homo sapiens
uaauuacucuacuucccag

SEQ ID NO: 1915082 - RNA, 21 nt, Homo sapiens
caugccaaugcacgcacacau

SEQ ID NO: 1915083 - RNA, 15 nt, Homo sapiens
auuacuaucauggca

SEQ ID NO: 1915084 - RNA, 19 nt, Homo sapiens
uuccugggcagcccagaga

SEQ ID NO: 1915085 - RNA, 21 nt, Homo sapiens
gcaguauuggacaaagagcau

SEQ ID NO: 1915086 - RNA, 13 nt, Homo sapiens
gaagguuguucuu

SEQ ID NO: 1915087 - RNA, 15 nt, Homo sapiens
gcuuuuuguucagaa

SEQ ID NO: 1915088 - RNA, 18 nt, Homo sapiens
aaacccguaagauuccuu

SEQ ID NO: 1915089 - RNA, 20 nt, Homo sapiens
accuagaauuggcugaacuc

SEQ ID NO: 1915090 - RNA, 14 nt, Homo sapiens
ucuggccacugucc

SEQ ID NO: 1915091 - RNA, 19 nt, Homo sapiens
cuuagaauuugggggaaaa

SEQ ID NO: 1915092 - RNA, 21 nt, Homo sapiens
guauauuuugacgucacugau

SEQ ID NO: 1915093 - RNA, 15 nt, Homo sapiens
caugaaauacugugc

SEQ ID NO: 1915094 - RNA, 17 nt, Homo sapiens
augcugucugaacaggu

SEQ ID NO: 1915095 - RNA, 15 nt, Homo sapiens
gucuguccauaugaa

SEQ ID NO: 1915096 - RNA, 11 nt, Homo sapiens
aauuccagucu

SEQ ID NO: 1915097 - RNA, 16 nt, Homo sapiens
caugugucuguauuca

SEQ ID NO: 1915098 - RNA, 18 nt, Homo sapiens
auuuuguuuuuacuguau

SEQ ID NO: 1915099 - RNA, 16 nt, Homo sapiens
cuuuuaaaaugcccuu

SEQ ID NO: 1915100 - RNA, 17 nt, Homo sapiens
ugugauugucuuugaau

SEQ ID NO: 1915101 - RNA, 17 nt, Homo sapiens
acuucuaaaagcuaaag

SEQ ID NO: 1915102 - RNA, 18 nt, Homo sapiens
aucccuguaauauuuagc

SEQ ID NO: 1915103 - RNA, 14 nt, Homo sapiens
uuaauaaacucaca

SEQ ID NO: 1915104 - RNA, 14 nt, Homo sapiens
auaagagauccuuu

SEQ ID NO: 1915105 - RNA, 22 nt, Homo sapiens
ugccgaaccaaaagaauuugca

SEQ ID NO: 1915106 - RNA, 13 nt, Homo sapiens
aagacugucucaa

SEQ ID NO: 1915107 - RNA, 13 nt, Homo sapiens
gucuccucuccau

SEQ ID NO: 1915108 - RNA, 12 nt, Homo sapiens
gaaagacaucca

SEQ ID NO: 1915109 - RNA, 20 nt, Homo sapiens
ccacuguuauuaacagauaa

SEQ ID NO: 1915110 - RNA, 17 nt, Homo sapiens
ccaguccucacaugccc

SEQ ID NO: 1915111 - RNA, 18 nt, Homo sapiens
guaaucccaguacuuugg

SEQ ID NO: 1915112 - RNA, 19 nt, Homo sapiens
ugagagcuauugcuuuguu

SEQ ID NO: 1915113 - RNA, 14 nt, Homo sapiens
ggaaaaauguuucc

SEQ ID NO: 1915114 - RNA, 16 nt, Homo sapiens
gagaaggaaagugauu

SEQ ID NO: 1915115 - RNA, 19 nt, Homo sapiens
auuguuucauucauccuga

SEQ ID NO: 1915116 - RNA, 22 nt, Homo sapiens
gcuuaaauuucuuaugugacau

SEQ ID NO: 1915117 - RNA, 10 nt, Homo sapiens
guuguucacg

SEQ ID NO: 1915118 - RNA, 21 nt, Homo sapiens
ccuuuuauucauauuuucaca

SEQ ID NO: 1915119 - RNA, 14 nt, Homo sapiens
agcuaaaaaugaac

SEQ ID NO: 1915120 - RNA, 20 nt, Homo sapiens
caugcccucccaggacccuc

SEQ ID NO: 1915121 - RNA, 15 nt, Homo sapiens
cccagcccauuccuc

SEQ ID NO: 1915122 - RNA, 17 nt, Homo sapiens
aaaguaccacacugagu

SEQ ID NO: 1915123 - RNA, 23 nt, Homo sapiens
gucaguugaggaauaugacuguu

SEQ ID NO: 1915124 - RNA, 21 nt, Homo sapiens
agcagugggcuccuggcagaa

SEQ ID NO: 1915125 - RNA, 14 nt, Homo sapiens
cuucaacaugacau

SEQ ID NO: 1915126 - RNA, 15 nt, Homo sapiens
ccauucacuacaggu

SEQ ID NO: 1915127 - RNA, 18 nt, Homo sapiens
aacagaaguccauggagu

SEQ ID NO: 1915128 - RNA, 15 nt, Homo sapiens
gagguguacagguac

SEQ ID NO: 1915129 - RNA, 20 nt, Homo sapiens
ucgacaagaccacacuuugg

SEQ ID NO: 1915130 - RNA, 13 nt, Homo sapiens
gacaaacuccuga

SEQ ID NO: 1915131 - RNA, 21 nt, Homo sapiens
agaauuuauucaauuccucug

SEQ ID NO: 1915132 - RNA, 22 nt, Homo sapiens
gcaccugccagaggaugcucuu

SEQ ID NO: 1915133 - RNA, 18 nt, Homo sapiens
ccuauccccauucucugc

SEQ ID NO: 1915134 - RNA, 22 nt, Homo sapiens
agcgccuccaacccuagcaaaa

SEQ ID NO: 1915135 - RNA, 20 nt, Homo sapiens
ugccuuaccgagagccaaac

SEQ ID NO: 1915136 - RNA, 22 nt, Homo sapiens
aacccugcguggggacagggcu

SEQ ID NO: 1915137 - RNA, 15 nt, Homo sapiens
acaucuuuaaacagu

SEQ ID NO: 1915138 - RNA, 16 nt, Homo sapiens
ugggcccccauaauaa

SEQ ID NO: 1915139 - RNA, 15 nt, Homo sapiens
aaggggcucuucauc

SEQ ID NO: 1915140 - RNA, 20 nt, Homo sapiens
caaaaugacuguagaacuua

SEQ ID NO: 1915141 - RNA, 16 nt, Homo sapiens
cugccaugucaggggu

SEQ ID NO: 1915142 - RNA, 15 nt, Homo sapiens
cccagccacacccag

SEQ ID NO: 1915143 - RNA, 16 nt, Homo sapiens
uauacauuacaucuga

SEQ ID NO: 1915144 - RNA, 21 nt, Homo sapiens
cugcucugcuccugaagcccu

SEQ ID NO: 1915145 - RNA, 19 nt, Homo sapiens
aaauuguuaagaguaucau

SEQ ID NO: 1915146 - RNA, 20 nt, Homo sapiens
ugaauaguuuauuucuguga

SEQ ID NO: 1915147 - RNA, 11 nt, Homo sapiens
uagcacauggc

SEQ ID NO: 1915148 - RNA, 12 nt, Homo sapiens
aaggugcucaau

SEQ ID NO: 1915149 - RNA, 16 nt, Homo sapiens
uucaccacauucguca

SEQ ID NO: 1915150 - RNA, 11 nt, Homo sapiens
uaguuugcaac

SEQ ID NO: 1915151 - RNA, 14 nt, Homo sapiens
auuuucuacagugu

SEQ ID NO: 1915152 - RNA, 22 nt, Homo sapiens
uuugguuuguugagccuaauau

SEQ ID NO: 1915153 - RNA, 20 nt, Homo sapiens
uuacaauaggaguggugauu

SEQ ID NO: 1915154 - RNA, 13 nt, Homo sapiens
ucaucaucuaccc

SEQ ID NO: 1915155 - RNA, 18 nt, Homo sapiens
guacaguuugcuguacua

SEQ ID NO: 1915156 - RNA, 16 nt, Homo sapiens
uugccaugugugcuga

SEQ ID NO: 1915157 - RNA, 13 nt, Homo sapiens
uucuagacacucc

SEQ ID NO: 1915158 - RNA, 15 nt, Homo sapiens
caguauuguauauga

SEQ ID NO: 1915159 - RNA, 22 nt, Homo sapiens
gucaggaccaucagagaggcaa

SEQ ID NO: 1915160 - RNA, 13 nt, Homo sapiens
uauuucaauguaa

SEQ ID NO: 1915161 - RNA, 13 nt, Homo sapiens
augaacacuggcu

SEQ ID NO: 1915162 - RNA, 10 nt, Homo sapiens
ugauguggac

SEQ ID NO: 1915163 - RNA, 17 nt, Homo sapiens
cacauguguaugauacu

SEQ ID NO: 1915164 - RNA, 15 nt, Homo sapiens
cuuagggaagaaaaa

SEQ ID NO: 1915165 - RNA, 18 nt, Homo sapiens
ccauuccauuuaucuuuc

SEQ ID NO: 1915166 - RNA, 20 nt, Homo sapiens
accacaaaucugaaugugcc

SEQ ID NO: 1915167 - RNA, 23 nt, Homo sapiens
uugaauaaaaauagaaaccugaa

SEQ ID NO: 1915168 - RNA, 17 nt, Homo sapiens
gccucuccuccacagcc

SEQ ID NO: 1915169 - RNA, 18 nt, Homo sapiens
caacguauuauugauauu

SEQ ID NO: 1915170 - RNA, 22 nt, Homo sapiens
uggagguauucaauauccuuug

SEQ ID NO: 1915171 - RNA, 21 nt, Homo sapiens
ugacugcugugggcugcucac

SEQ ID NO: 1915172 - RNA, 15 nt, Homo sapiens
aggacccuccacuca

SEQ ID NO: 1915173 - RNA, 23 nt, Homo sapiens
cacagccuucccucugcauugac

SEQ ID NO: 1915174 - RNA, 21 nt, Homo sapiens
aaauguuagugaucaccacuu

SEQ ID NO: 1915175 - RNA, 16 nt, Homo sapiens
agugcauggacaucua

SEQ ID NO: 1915176 - RNA, 22 nt, Homo sapiens
acaugaaauaaugcacugagua

SEQ ID NO: 1915177 - RNA, 20 nt, Homo sapiens
auggaauuucucccagucau

SEQ ID NO: 1915178 - RNA, 18 nt, Homo sapiens
ggucugcuucugcauuca

SEQ ID NO: 1915179 - RNA, 16 nt, Homo sapiens
cugcuccccucugcac

SEQ ID NO: 1915180 - RNA, 16 nt, Homo sapiens
gaagccacugccagcu

SEQ ID NO: 1915181 - RNA, 17 nt, Homo sapiens
agggaaugcagcaggaa

SEQ ID NO: 1915182 - RNA, 13 nt, Homo sapiens
ugcauuuguguca

SEQ ID NO: 1915183 - RNA, 13 nt, Homo sapiens
cuccuuugcuuaa

SEQ ID NO: 1915184 - RNA, 23 nt, Homo sapiens
uggguugugaaauacucuuccaa

SEQ ID NO: 1915185 - RNA, 16 nt, Homo sapiens
aacuguaccaugugcu

SEQ ID NO: 1915186 - RNA, 14 nt, Homo sapiens
gagcugcgugccac

SEQ ID NO: 1915187 - RNA, 16 nt, Homo sapiens
uccauccaaucuauua

SEQ ID NO: 1915188 - RNA, 13 nt, Homo sapiens
auuaugaaccgca

SEQ ID NO: 1915189 - RNA, 14 nt, Homo sapiens
aaagggacacuuuu

SEQ ID NO: 1915190 - RNA, 22 nt, Homo sapiens
ggaucacucaccauucccagau

SEQ ID NO: 1915191 - RNA, 23 nt, Homo sapiens
aucccuuugucugucaaucacag

SEQ ID NO: 1915192 - RNA, 15 nt, Homo sapiens
ugaggcccaaaacau

SEQ ID NO: 1915193 - RNA, 20 nt, Homo sapiens
uucugauacuuuaguacaau

SEQ ID NO: 1915194 - RNA, 14 nt, Homo sapiens
cauucaacagauca

SEQ ID NO: 1915195 - RNA, 20 nt, Homo sapiens
gaaaaccuaguacauuacua

SEQ ID NO: 1915196 - RNA, 20 nt, Homo sapiens
ccaagaauauugcaaaauac

SEQ ID NO: 1915197 - RNA, 13 nt, Homo sapiens
caagucccuguca

SEQ ID NO: 1915198 - RNA, 20 nt, Homo sapiens
gugguaggccauggccacaa

SEQ ID NO: 1915199 - RNA, 19 nt, Homo sapiens
caucccgucagcuggaaaa

SEQ ID NO: 1915200 - RNA, 14 nt, Homo sapiens
ugacuuugugccau

SEQ ID NO: 1915201 - RNA, 19 nt, Homo sapiens
cuaaguuugguuagccuua

SEQ ID NO: 1915202 - RNA, 17 nt, Homo sapiens
ccaggaagcccacacua

SEQ ID NO: 1915203 - RNA, 18 nt, Homo sapiens
aaucacuucaauccucaa

SEQ ID NO: 1915204 - RNA, 14 nt, Homo sapiens
auuuucuugucaau

SEQ ID NO: 1915205 - RNA, 21 nt, Homo sapiens
gaagcuuuggugagaaccugg

SEQ ID NO: 1915206 - RNA, 15 nt, Homo sapiens
uuccuauuucuggaa

SEQ ID NO: 1915207 - RNA, 23 nt, Homo sapiens
acagcuugggaggaaaccugaga

SEQ ID NO: 1915208 - RNA, 23 nt, Homo sapiens
cucuggccaggauggaggggugg

SEQ ID NO: 1915209 - RNA, 17 nt, Homo sapiens
ugacacauugcugauau

SEQ ID NO: 1915210 - RNA, 23 nt, Homo sapiens
cuuccagguggggugaggcagug

SEQ ID NO: 1915211 - RNA, 17 nt, Homo sapiens
gccacggccacagucau

SEQ ID NO: 1915212 - RNA, 18 nt, Homo sapiens
auaauuggcuugaugucc

SEQ ID NO: 1915213 - RNA, 13 nt, Homo sapiens
gccugucucuagc

SEQ ID NO: 1915214 - RNA, 15 nt, Homo sapiens
auuauaccucaaugu

SEQ ID NO: 1915215 - RNA, 23 nt, Homo sapiens
aauuccuugcauagucucucuug

SEQ ID NO: 1915216 - RNA, 23 nt, Homo sapiens
uuaccagagccucuuugcuggag

SEQ ID NO: 1915217 - RNA, 14 nt, Homo sapiens
gauuaauauuauua

SEQ ID NO: 1915218 - RNA, 22 nt, Homo sapiens
uuaacuucagcauccaaguuua

SEQ ID NO: 1915219 - RNA, 20 nt, Homo sapiens
cagaggaugcaacaaaugug

SEQ ID NO: 1915220 - RNA, 20 nt, Homo sapiens
uaacaaguagcacccuggau

SEQ ID NO: 1915221 - RNA, 14 nt, Homo sapiens
uacugaucucuuua

SEQ ID NO: 1915222 - RNA, 15 nt, Homo sapiens
gccucgguaucuggc

SEQ ID NO: 1915223 - RNA, 16 nt, Homo sapiens
acuggccucugugauu

SEQ ID NO: 1915224 - RNA, 17 nt, Homo sapiens
guccacaagaacaauuc

SEQ ID NO: 1915225 - RNA, 19 nt, Homo sapiens
cuguaagucaaaugugugc

SEQ ID NO: 1915226 - RNA, 21 nt, Homo sapiens
cuugcacaggucccacugccc

SEQ ID NO: 1915227 - RNA, 13 nt, Homo sapiens
cccacccagucuc

SEQ ID NO: 1915228 - RNA, 18 nt, Homo sapiens
uuaaaauuugaaacauug

SEQ ID NO: 1915229 - RNA, 19 nt, Homo sapiens
agaauuacuuguguuacuu

SEQ ID NO: 1915230 - RNA, 21 nt, Homo sapiens
aucggcugggaacugggccag

SEQ ID NO: 1915231 - RNA, 20 nt, Homo sapiens
ugcuuccugucuuauccucc

SEQ ID NO: 1915232 - RNA, 22 nt, Homo sapiens
ucuccccaguguaugucuugua

SEQ ID NO: 1915233 - RNA, 17 nt, Homo sapiens
ccuucacaucacccaug

SEQ ID NO: 1915234 - RNA, 21 nt, Homo sapiens
accuugccuguaguccagucu

SEQ ID NO: 1915235 - RNA, 20 nt, Homo sapiens
cagccuuucugaggacacca

SEQ ID NO: 1915236 - RNA, 19 nt, Homo sapiens
acagauaucuucaguuuaa

SEQ ID NO: 1915237 - RNA, 20 nt, Homo sapiens
aaacugcucccaucauuccu

SEQ ID NO: 1915238 - RNA, 16 nt, Homo sapiens
gagcauggaugcauuu

SEQ ID NO: 1915239 - RNA, 23 nt, Homo sapiens
cuccaugauuauuaguugaccaa

SEQ ID NO: 1915240 - RNA, 18 nt, Homo sapiens
acuucccaagcccuggug

SEQ ID NO: 1915241 - RNA, 20 nt, Homo sapiens
aaaacucauuuccuauguaa

SEQ ID NO: 1915242 - RNA, 20 nt, Homo sapiens
auuacugcaugcacuucuua

SEQ ID NO: 1915243 - RNA, 20 nt, Homo sapiens
ucauuuaacugaacugugaa

SEQ ID NO: 1915244 - RNA, 17 nt, Homo sapiens
gcaccaaccuccagacu

SEQ ID NO: 1915245 - RNA, 13 nt, Homo sapiens
uguacgauucacu

SEQ ID NO: 1915246 - RNA, 17 nt, Homo sapiens
uguuauacacagcuuua

SEQ ID NO: 1915247 - RNA, 11 nt, Homo sapiens
accucaccaag

SEQ ID NO: 1915248 - RNA, 15 nt, Homo sapiens
uaacuuggcugcauu

SEQ ID NO: 1915249 - RNA, 18 nt, Homo sapiens
cacgaauccugacaccac

SEQ ID NO: 1915250 - RNA, 14 nt, Homo sapiens
cuuaucugucacac

SEQ ID NO: 1915251 - RNA, 19 nt, Homo sapiens
aauucugaugagcauuacu

SEQ ID NO: 1915252 - RNA, 16 nt, Homo sapiens
augagggugacuguca

SEQ ID NO: 1915253 - RNA, 23 nt, Homo sapiens
acaauucggcaguuggccaaaac

SEQ ID NO: 1915254 - RNA, 15 nt, Homo sapiens
gaccuaggauuucau

SEQ ID NO: 1915255 - RNA, 14 nt, Homo sapiens
uguuccaugccugg

SEQ ID NO: 1915256 - RNA, 18 nt, Homo sapiens
auuaggcuguaacuacuu

SEQ ID NO: 1915257 - RNA, 15 nt, Homo sapiens
agaugaccagugccu

SEQ ID NO: 1915258 - RNA, 16 nt, Homo sapiens
uuacugcuugaccaaa

SEQ ID NO: 1915259 - RNA, 20 nt, Homo sapiens
ccaaggguuucugacccaag

SEQ ID NO: 1915260 - RNA, 22 nt, Homo sapiens
augacggcucaugccuguaauc

SEQ ID NO: 1915261 - RNA, 17 nt, Homo sapiens
auugccuauaauacuug

SEQ ID NO: 1915262 - RNA, 13 nt, Homo sapiens
uucauuguucuau

SEQ ID NO: 1915263 - RNA, 17 nt, Homo sapiens
agugguauccugugaca

SEQ ID NO: 1915264 - RNA, 21 nt, Homo sapiens
auugcaauauggauguuucuu

SEQ ID NO: 1915265 - RNA, 14 nt, Homo sapiens
ccucccucauuuaa

SEQ ID NO: 1915266 - RNA, 19 nt, Homo sapiens
ccucuuacaacuuucaaac

SEQ ID NO: 1915267 - RNA, 14 nt, Homo sapiens
ugagaagggacaag

SEQ ID NO: 1915268 - RNA, 21 nt, Homo sapiens
ccuccugagcagcugggauua

SEQ ID NO: 1915269 - RNA, 18 nt, Homo sapiens
gcaacagcaaacaggugc

SEQ ID NO: 1915270 - RNA, 18 nt, Homo sapiens
auaccaaugacuuccaua

SEQ ID NO: 1915271 - RNA, 18 nt, Homo sapiens
acauucuuuaucuugaca

SEQ ID NO: 1915272 - RNA, 16 nt, Homo sapiens
uaaaguaaaaagggaa

SEQ ID NO: 1915273 - RNA, 18 nt, Homo sapiens
auuuuagucccauuugac

SEQ ID NO: 1915274 - RNA, 13 nt, Homo sapiens
aucccauacucuc

SEQ ID NO: 1915275 - RNA, 13 nt, Homo sapiens
aauuaauacauca

SEQ ID NO: 1915276 - RNA, 15 nt, Homo sapiens
aaacuaccacauucu

SEQ ID NO: 1915277 - RNA, 22 nt, Homo sapiens
agcacgcacacgagaacgacau

SEQ ID NO: 1915278 - RNA, 15 nt, Homo sapiens
aaaaucuuguguuaa

SEQ ID NO: 1915279 - RNA, 13 nt, Homo sapiens
aaagggggcugca

SEQ ID NO: 1915280 - RNA, 22 nt, Homo sapiens
uaaaucauacuccuaugcuuua

SEQ ID NO: 1915281 - RNA, 23 nt, Homo sapiens
gaauaggcacuuuaaaacacucu

SEQ ID NO: 1915282 - RNA, 16 nt, Homo sapiens
gaugcagaaagacguu

SEQ ID NO: 1915283 - RNA, 18 nt, Homo sapiens
gcaguuagcucauuugag

SEQ ID NO: 1915284 - RNA, 19 nt, Homo sapiens
gccaagggccgacuaagag

SEQ ID NO: 1915285 - RNA, 14 nt, Homo sapiens
guuuggggagacag

SEQ ID NO: 1915286 - RNA, 15 nt, Homo sapiens
gcagagaaagggaca

SEQ ID NO: 1915287 - RNA, 16 nt, Homo sapiens
acaauauguggucaau

SEQ ID NO: 1915288 - RNA, 16 nt, Homo sapiens
cugagauuuugcuuga

SEQ ID NO: 1915289 - RNA, 20 nt, Homo sapiens
cagccacugcccaaagccau

SEQ ID NO: 1915290 - RNA, 19 nt, Homo sapiens
uggcuaaacagauguaaug

SEQ ID NO: 1915291 - RNA, 19 nt, Homo sapiens
uggucauaaaauagaauaa

SEQ ID NO: 1915292 - RNA, 14 nt, Homo sapiens
ccauuuuacuucca

SEQ ID NO: 1915293 - RNA, 14 nt, Homo sapiens
ucguacuguucaca

SEQ ID NO: 1915294 - RNA, 17 nt, Homo sapiens
gauuaagauuuuacaaa

SEQ ID NO: 1915295 - RNA, 14 nt, Homo sapiens
aucauggaaaugua

SEQ ID NO: 1915296 - RNA, 19 nt, Homo sapiens
aggcccugcuccugcagca

SEQ ID NO: 1915297 - RNA, 18 nt, Homo sapiens
ucugccauuugcugcuua

SEQ ID NO: 1915298 - RNA, 19 nt, Homo sapiens
gagagauaggaaggucauu

SEQ ID NO: 1915299 - RNA, 21 nt, Homo sapiens
ugaggguuuguaauggugcuu

SEQ ID NO: 1915300 - RNA, 14 nt, Homo sapiens
gcuacacugacacu

SEQ ID NO: 1915301 - RNA, 19 nt, Homo sapiens
cucagaccagcucccagau

SEQ ID NO: 1915302 - RNA, 16 nt, Homo sapiens
acagucacugauguac

SEQ ID NO: 1915303 - RNA, 17 nt, Homo sapiens
aaagacaucagucucca

SEQ ID NO: 1915304 - RNA, 20 nt, Homo sapiens
ccucuaguagcugaaaugca

SEQ ID NO: 1915305 - RNA, 21 nt, Homo sapiens
uucuggacccuggcuucuccc

SEQ ID NO: 1915306 - RNA, 20 nt, Homo sapiens
cugcagucaucaacaaugau

SEQ ID NO: 1915307 - RNA, 16 nt, Homo sapiens
gaaacauuuauggaau

SEQ ID NO: 1915308 - RNA, 13 nt, Homo sapiens
auucucauucuca

SEQ ID NO: 1915309 - RNA, 17 nt, Homo sapiens
acacuuggaguuugcau

SEQ ID NO: 1915310 - RNA, 19 nt, Homo sapiens
uccccaaggacucuuccac

SEQ ID NO: 1915311 - RNA, 16 nt, Homo sapiens
aucaugguacauuuau

SEQ ID NO: 1915312 - RNA, 12 nt, Homo sapiens
agacucccugau

SEQ ID NO: 1915313 - RNA, 23 nt, Homo sapiens
cagaaacuccuaauucaaauggc

SEQ ID NO: 1915314 - RNA, 14 nt, Homo sapiens
caggaacacuggag

SEQ ID NO: 1915315 - RNA, 15 nt, Homo sapiens
auuaucugugucaaa

SEQ ID NO: 1915316 - RNA, 20 nt, Homo sapiens
uuuagacuaggcucuagugu

SEQ ID NO: 1915317 - RNA, 18 nt, Homo sapiens
aauuuaagacaaguucaa

SEQ ID NO: 1915318 - RNA, 21 nt, Homo sapiens
uugcuguaaacuuguagcauu

SEQ ID NO: 1915319 - RNA, 17 nt, Homo sapiens
aauugucguuuuuauuc

SEQ ID NO: 1915320 - RNA, 13 nt, Homo sapiens
ugaugaugaaggg

SEQ ID NO: 1915321 - RNA, 21 nt, Homo sapiens
uugcauugucuuuaauauaau

SEQ ID NO: 1915322 - RNA, 16 nt, Homo sapiens
aauaucaaacacggac

SEQ ID NO: 1915323 - RNA, 20 nt, Homo sapiens
uccgcggaccggggacccuu

SEQ ID NO: 1915324 - RNA, 20 nt, Homo sapiens
auaauccaugaaagaacuua

SEQ ID NO: 1915325 - RNA, 20 nt, Homo sapiens
acagaauuuuuuaaauugac

SEQ ID NO: 1915326 - RNA, 14 nt, Homo sapiens
uuuacuuuuaacua

SEQ ID NO: 1915327 - RNA, 11 nt, Homo sapiens
agcacugagca

SEQ ID NO: 1915328 - RNA, 15 nt, Homo sapiens
gccuuuguugcucag

SEQ ID NO: 1915329 - RNA, 19 nt, Homo sapiens
auauucaguauuguagaua

SEQ ID NO: 1915330 - RNA, 20 nt, Homo sapiens
uccacaccaaagucagggag

SEQ ID NO: 1915331 - RNA, 14 nt, Homo sapiens
caaugugauuuaua

SEQ ID NO: 1915332 - RNA, 23 nt, Homo sapiens
caaaaagaaaaaguuugugacau

SEQ ID NO: 1915333 - RNA, 20 nt, Homo sapiens
aacuuuagacuucccacugu

SEQ ID NO: 1915334 - RNA, 14 nt, Homo sapiens
auagaaacucucau

SEQ ID NO: 1915335 - RNA, 19 nt, Homo sapiens
uaauguauuuguuugcaau

SEQ ID NO: 1915336 - RNA, 13 nt, Homo sapiens
uacaugaaguauu

SEQ ID NO: 1915337 - RNA, 23 nt, Homo sapiens
aaugccuuguugaugaagcacau

SEQ ID NO: 1915338 - RNA, 17 nt, Homo sapiens
cuacuuccccuucuugc

SEQ ID NO: 1915339 - RNA, 17 nt, Homo sapiens
gggaauccgacacagga

SEQ ID NO: 1915340 - RNA, 16 nt, Homo sapiens
agcugguggcaauaaa

SEQ ID NO: 1915341 - RNA, 19 nt, Homo sapiens
ucauaaaaugcauacuguu

SEQ ID NO: 1915342 - RNA, 17 nt, Homo sapiens
agccugcuuguugggaa

SEQ ID NO: 1915343 - RNA, 13 nt, Homo sapiens
auuauagaaugga

SEQ ID NO: 1915344 - RNA, 14 nt, Homo sapiens
ucaagaacuauaua

SEQ ID NO: 1915345 - RNA, 15 nt, Homo sapiens
cucugcccgcuuuga

SEQ ID NO: 1915346 - RNA, 14 nt, Homo sapiens
ucacagcucacugc

SEQ ID NO: 1915347 - RNA, 20 nt, Homo sapiens
uuuagaauaagaauuugcau

SEQ ID NO: 1915348 - RNA, 18 nt, Homo sapiens
caggaugggggcaauggg

SEQ ID NO: 1915349 - RNA, 20 nt, Homo sapiens
uaccucaagucucaggagaa

SEQ ID NO: 1915350 - RNA, 14 nt, Homo sapiens
auuccaugcacucu

SEQ ID NO: 1915351 - RNA, 19 nt, Homo sapiens
aucagccuugcuaaagcua

SEQ ID NO: 1915352 - RNA, 17 nt, Homo sapiens
agcuaaccuuauccugc

SEQ ID NO: 1915353 - RNA, 21 nt, Homo sapiens
agaagaugcugugaacaccag

SEQ ID NO: 1915354 - RNA, 22 nt, Homo sapiens
augcaccucuuguuacucccug

SEQ ID NO: 1915355 - RNA, 23 nt, Homo sapiens
acuuggcuggugugguacagaga

SEQ ID NO: 1915356 - RNA, 23 nt, Homo sapiens
acccagcugcagaccaugccaga

SEQ ID NO: 1915357 - RNA, 19 nt, Homo sapiens
caauagcauaucacagaga

SEQ ID NO: 1915358 - RNA, 19 nt, Homo sapiens
cugggagcccagaacccac

SEQ ID NO: 1915359 - RNA, 23 nt, Homo sapiens
gaacacucaugcugaaagcccaa

SEQ ID NO: 1915360 - RNA, 22 nt, Homo sapiens
gcucccagccugcccuccagcu

SEQ ID NO: 1915361 - RNA, 22 nt, Homo sapiens
ccucagggcugucggugugcug

SEQ ID NO: 1915362 - RNA, 21 nt, Homo sapiens
cugguucccccaggacccuga

SEQ ID NO: 1915363 - RNA, 14 nt, Homo sapiens
uugaggacacugau

SEQ ID NO: 1915364 - RNA, 22 nt, Homo sapiens
ucaaauuugugucauaccagaa

SEQ ID NO: 1915365 - RNA, 19 nt, Homo sapiens
ugggaaggagggagcugcu

SEQ ID NO: 1915366 - RNA, 13 nt, Homo sapiens
aagagaucagaau

SEQ ID NO: 1915367 - RNA, 17 nt, Homo sapiens
gcuggccccuucugggg

SEQ ID NO: 1915368 - RNA, 21 nt, Homo sapiens
aauuaucaucuuuugaucuuu

SEQ ID NO: 1915369 - RNA, 12 nt, Homo sapiens
aaugugauugca

SEQ ID NO: 1915370 - RNA, 13 nt, Homo sapiens
uagugaaacugca

SEQ ID NO: 1915371 - RNA, 21 nt, Homo sapiens
ucaucaggaaggaaaugacac

SEQ ID NO: 1915372 - RNA, 18 nt, Homo sapiens
ucaaacuacuuugcugcu

SEQ ID NO: 1915373 - RNA, 16 nt, Homo sapiens
uaagucuuuacucuga

SEQ ID NO: 1915374 - RNA, 22 nt, Homo sapiens
gccccaccuuuccuuuccuucc

SEQ ID NO: 1915375 - RNA, 21 nt, Homo sapiens
cagaggagccaccaguucuca

SEQ ID NO: 1915376 - RNA, 17 nt, Homo sapiens
ugacauccaaaucuagc

SEQ ID NO: 1915377 - RNA, 20 nt, Homo sapiens
uaaauuuacguauauuucau

SEQ ID NO: 1915378 - RNA, 21 nt, Homo sapiens
auaaaauuauauucacuacuu

SEQ ID NO: 1915379 - RNA, 16 nt, Homo sapiens
agugaagaugccagug

SEQ ID NO: 1915380 - RNA, 21 nt, Homo sapiens
uguaaugaggugguacuauga

SEQ ID NO: 1915381 - RNA, 13 nt, Homo sapiens
aaaaaugcugaac

SEQ ID NO: 1915382 - RNA, 15 nt, Homo sapiens
uuacugaauuggcaa

SEQ ID NO: 1915383 - RNA, 13 nt, Homo sapiens
gugggcucacacc

SEQ ID NO: 1915384 - RNA, 23 nt, Homo sapiens
gccugcucccuagccagaggcuc

SEQ ID NO: 1915385 - RNA, 20 nt, Homo sapiens
accuguuacuugaaauacca

SEQ ID NO: 1915386 - RNA, 23 nt, Homo sapiens
gagugggcuaggaggacaaggac

SEQ ID NO: 1915387 - RNA, 20 nt, Homo sapiens
cacacacuggcugguggaga

SEQ ID NO: 1915388 - RNA, 23 nt, Homo sapiens
uguucugguggccccagcuguga

SEQ ID NO: 1915389 - RNA, 11 nt, Homo sapiens
agauguuuaca

SEQ ID NO: 1915390 - RNA, 23 nt, Homo sapiens
aagaauaugaaguucuaucuagu

SEQ ID NO: 1915391 - RNA, 14 nt, Homo sapiens
cuaccuugaugaaa

SEQ ID NO: 1915392 - RNA, 14 nt, Homo sapiens
uguacaggggccau

SEQ ID NO: 1915393 - RNA, 19 nt, Homo sapiens
cucccuucucguguuugcu

SEQ ID NO: 1915394 - RNA, 21 nt, Homo sapiens
agugugugauaaaucagucaa

SEQ ID NO: 1915395 - RNA, 15 nt, Homo sapiens
gaccuuccucaucca

SEQ ID NO: 1915396 - RNA, 19 nt, Homo sapiens
gacaggaggucagcacaag

SEQ ID NO: 1915397 - RNA, 16 nt, Homo sapiens
uguaaucauuccuucc

SEQ ID NO: 1915398 - RNA, 19 nt, Homo sapiens
auaaaucaacuccagcucc

SEQ ID NO: 1915399 - RNA, 14 nt, Homo sapiens
aaauaaggcuccuu

SEQ ID NO: 1915400 - RNA, 15 nt, Homo sapiens
cuguaaaauacaugg

SEQ ID NO: 1915401 - RNA, 23 nt, Homo sapiens
ucaauucgacuucuuuccauggg

SEQ ID NO: 1915402 - RNA, 16 nt, Homo sapiens
acacucauauugcccu

SEQ ID NO: 1915403 - RNA, 16 nt, Homo sapiens
ggagccaauccacucc

SEQ ID NO: 1915404 - RNA, 16 nt, Homo sapiens
cucugcagcucaggga

SEQ ID NO: 1915405 - RNA, 16 nt, Homo sapiens
cuucccuuaacuccaa

SEQ ID NO: 1915406 - RNA, 14 nt, Homo sapiens
uuucuucacuugca

SEQ ID NO: 1915407 - RNA, 21 nt, Homo sapiens
agucaaauauguagauugccu

SEQ ID NO: 1915408 - RNA, 21 nt, Homo sapiens
auaauuuauaugcaugcacag

SEQ ID NO: 1915409 - RNA, 15 nt, Homo sapiens
uaaaguugauaaaga

SEQ ID NO: 1915410 - RNA, 18 nt, Homo sapiens
cagugaugacuauucuca

SEQ ID NO: 1915411 - RNA, 14 nt, Homo sapiens
gcacacagggcagu

SEQ ID NO: 1915412 - RNA, 14 nt, Homo sapiens
ggcauauacuuugu

SEQ ID NO: 1915413 - RNA, 20 nt, Homo sapiens
cugagcgggucuaguggaaa

SEQ ID NO: 1915414 - RNA, 13 nt, Homo sapiens
ccagggccaagag

SEQ ID NO: 1915415 - RNA, 11 nt, Homo sapiens
ucuucccuacc

SEQ ID NO: 1915416 - RNA, 21 nt, Homo sapiens
uaacuuuaugaagugcuacag

SEQ ID NO: 1915417 - RNA, 19 nt, Homo sapiens
agcgugggaccccaaguga

SEQ ID NO: 1915418 - RNA, 23 nt, Homo sapiens
ugggaagaggcgagagggcugug

SEQ ID NO: 1915419 - RNA, 19 nt, Homo sapiens
cuuuccccaaaacucuccu

SEQ ID NO: 1915420 - RNA, 16 nt, Homo sapiens
cauuuccaaauucaca

SEQ ID NO: 1915421 - RNA, 22 nt, Homo sapiens
cugcugaggguccagaaggagg

SEQ ID NO: 1915422 - RNA, 20 nt, Homo sapiens
gaucuguuuuggauguugcu

SEQ ID NO: 1915423 - RNA, 18 nt, Homo sapiens
ucacaaccucaccaaacu

SEQ ID NO: 1915424 - RNA, 20 nt, Homo sapiens
auucuaaaugaauguuuaca

SEQ ID NO: 1915425 - RNA, 13 nt, Homo sapiens
aagcagggcacuc

SEQ ID NO: 1915426 - RNA, 17 nt, Homo sapiens
caugggauaaaugccau

SEQ ID NO: 1915427 - RNA, 13 nt, Homo sapiens
gucuaccaucucc

SEQ ID NO: 1915428 - RNA, 15 nt, Homo sapiens
auuaauuaaaccaga

SEQ ID NO: 1915429 - RNA, 14 nt, Homo sapiens
agcauaugaaacca

SEQ ID NO: 1915430 - RNA, 17 nt, Homo sapiens
aguggauguguacuuca

SEQ ID NO: 1915431 - RNA, 20 nt, Homo sapiens
ucuaaauggugcugcagauu

SEQ ID NO: 1915432 - RNA, 15 nt, Homo sapiens
aaccccucuccaggc

SEQ ID NO: 1915433 - RNA, 22 nt, Homo sapiens
gacccucggugcagagugcaga

SEQ ID NO: 1915434 - RNA, 16 nt, Homo sapiens
uuuuaaacaaauggcu

SEQ ID NO: 1915435 - RNA, 17 nt, Homo sapiens
agccaagcacugcucac

SEQ ID NO: 1915436 - RNA, 15 nt, Homo sapiens
cuugguucuggccac

SEQ ID NO: 1915437 - RNA, 18 nt, Homo sapiens
ugaauuagauuauuucug

SEQ ID NO: 1915438 - RNA, 15 nt, Homo sapiens
ccagauggccccucc

SEQ ID NO: 1915439 - RNA, 21 nt, Homo sapiens
uucuagcucuauuuacuucua

SEQ ID NO: 1915440 - RNA, 22 nt, Homo sapiens
aguuuguuuuuaaaaaaaucua

SEQ ID NO: 1915441 - RNA, 14 nt, Homo sapiens
gaauaguacagaca

SEQ ID NO: 1915442 - RNA, 23 nt, Homo sapiens
uaucuaauauguaacaagccacc

SEQ ID NO: 1915443 - RNA, 23 nt, Homo sapiens
agcuaauauacagucaguucuca

SEQ ID NO: 1915444 - RNA, 19 nt, Homo sapiens
agagaucaaguugagacag

SEQ ID NO: 1915445 - RNA, 16 nt, Homo sapiens
uucaaguuaaagugaa

SEQ ID NO: 1915446 - RNA, 18 nt, Homo sapiens
gaaaguucagaguuuucu

SEQ ID NO: 1915447 - RNA, 18 nt, Homo sapiens
cgugcuuguuugcucacc

SEQ ID NO: 1915448 - RNA, 15 nt, Homo sapiens
guaaucaaccuucua

SEQ ID NO: 1915449 - RNA, 15 nt, Homo sapiens
aggucaggacucaga

SEQ ID NO: 1915450 - RNA, 21 nt, Homo sapiens
agcucccauguaccagcagcu

SEQ ID NO: 1915451 - RNA, 16 nt, Homo sapiens
ugaggccugcuucccc

SEQ ID NO: 1915452 - RNA, 15 nt, Homo sapiens
uuaucccccaccaaa

SEQ ID NO: 1915453 - RNA, 22 nt, Homo sapiens
aucucaggaaaaucugugauua

SEQ ID NO: 1915454 - RNA, 17 nt, Homo sapiens
aguuuauauacaauuau

SEQ ID NO: 1915455 - RNA, 12 nt, Homo sapiens
cggacuccaugg

SEQ ID NO: 1915456 - RNA, 17 nt, Homo sapiens
uccagagggaagggaac

SEQ ID NO: 1915457 - RNA, 20 nt, Homo sapiens
acauuuuuuaaacaguuaca

SEQ ID NO: 1915458 - RNA, 17 nt, Homo sapiens
gacagcaagggcuugca

SEQ ID NO: 1915459 - RNA, 18 nt, Homo sapiens
ucugugaagcccuuugcc

SEQ ID NO: 1915460 - RNA, 22 nt, Homo sapiens
uuaggcaaaguacaaaauugcc

SEQ ID NO: 1915461 - RNA, 21 nt, Homo sapiens
acugucucguacuagaauuca

SEQ ID NO: 1915462 - RNA, 21 nt, Homo sapiens
aguuaaaacaaaggaacuaac

SEQ ID NO: 1915463 - RNA, 16 nt, Homo sapiens
cugucuaaagccuuaa

SEQ ID NO: 1915464 - RNA, 17 nt, Homo sapiens
uauuuuaaaacauaaga

SEQ ID NO: 1915465 - RNA, 16 nt, Homo sapiens
gugcagcugauuuuaa

SEQ ID NO: 1915466 - RNA, 21 nt, Homo sapiens
aaaccagagaagauccagcuu

SEQ ID NO: 1915467 - RNA, 17 nt, Homo sapiens
acauucacuuccagaga

SEQ ID NO: 1915468 - RNA, 23 nt, Homo sapiens
aaacugcaggaagcucugaugca

SEQ ID NO: 1915469 - RNA, 21 nt, Homo sapiens
gacauuaugugugcaugugug

SEQ ID NO: 1915470 - RNA, 15 nt, Homo sapiens
agcaaaguaguacuu

SEQ ID NO: 1915471 - RNA, 12 nt, Homo sapiens
cauauacuuuaa

SEQ ID NO: 1915472 - RNA, 14 nt, Homo sapiens
uaaauacacuguga

SEQ ID NO: 1915473 - RNA, 18 nt, Homo sapiens
auguguugccaaaaccaa

SEQ ID NO: 1915474 - RNA, 16 nt, Homo sapiens
guguuuucaccauuca

SEQ ID NO: 1915475 - RNA, 17 nt, Homo sapiens
ugaagaacccugcaggg

SEQ ID NO: 1915476 - RNA, 17 nt, Homo sapiens
acuggggcgucaccucc

SEQ ID NO: 1915477 - RNA, 20 nt, Homo sapiens
auaacccaagguaccauccu

SEQ ID NO: 1915478 - RNA, 19 nt, Homo sapiens
ggaaucaugucaggccauc

SEQ ID NO: 1915479 - RNA, 15 nt, Homo sapiens
uuacuauucacugau

SEQ ID NO: 1915480 - RNA, 17 nt, Homo sapiens
gcgcagaugugcagcag

SEQ ID NO: 1915481 - RNA, 20 nt, Homo sapiens
uggaaaccucuggaggucau

SEQ ID NO: 1915482 - RNA, 12 nt, Homo sapiens
aaagugcauuca

SEQ ID NO: 1915483 - RNA, 14 nt, Homo sapiens
aggaacacugcacu

SEQ ID NO: 1915484 - RNA, 11 nt, Homo sapiens
accaggggugc

SEQ ID NO: 1915485 - RNA, 10 nt, Homo sapiens
guggccacag

SEQ ID NO: 1915486 - RNA, 22 nt, Homo sapiens
ugaaaggguuuuuaaucuccau

SEQ ID NO: 1915487 - RNA, 14 nt, Homo sapiens
gauauaagccauag

SEQ ID NO: 1915488 - RNA, 17 nt, Homo sapiens
gaaaagcauacaagauu

SEQ ID NO: 1915489 - RNA, 18 nt, Homo sapiens
gacaagacccucucaggc

SEQ ID NO: 1915490 - RNA, 20 nt, Homo sapiens
gucucaguggcuucaucugu

SEQ ID NO: 1915491 - RNA, 16 nt, Homo sapiens
agggcaaagaucucag

SEQ ID NO: 1915492 - RNA, 20 nt, Homo sapiens
aagcuuuaggaugacuguau

SEQ ID NO: 1915493 - RNA, 20 nt, Homo sapiens
cgggaaccucacucuugcca

SEQ ID NO: 1915494 - RNA, 15 nt, Homo sapiens
aacacuguacugcaa

SEQ ID NO: 1915495 - RNA, 19 nt, Homo sapiens
ugcccaggucccuccucag

SEQ ID NO: 1915496 - RNA, 15 nt, Homo sapiens
ugaaccgucaaugug

SEQ ID NO: 1915497 - RNA, 13 nt, Homo sapiens
uugggauuuuucu

SEQ ID NO: 1915498 - RNA, 12 nt, Homo sapiens
uuaggcauuaaa

SEQ ID NO: 1915499 - RNA, 22 nt, Homo sapiens
aggagaaaagugggcugcagca

SEQ ID NO: 1915500 - RNA, 16 nt, Homo sapiens
caaaggagcuuucuca

SEQ ID NO: 1915501 - RNA, 20 nt, Homo sapiens
ccauaaccccggaagccaaa

SEQ ID NO: 1915502 - RNA, 22 nt, Homo sapiens
uggauuugucuuuggugaacau

SEQ ID NO: 1915503 - RNA, 17 nt, Homo sapiens
gucaacuuucauuugaa

SEQ ID NO: 1915504 - RNA, 17 nt, Homo sapiens
ucacaauuaugugcaaa

SEQ ID NO: 1915505 - RNA, 17 nt, Homo sapiens
augaauaaacacuuuuu

SEQ ID NO: 1915506 - RNA, 23 nt, Homo sapiens
uggggacagagcagaacuuucac

SEQ ID NO: 1915507 - RNA, 16 nt, Homo sapiens
cuguccucucauuugc

SEQ ID NO: 1915508 - RNA, 21 nt, Homo sapiens
gcagcuggugcuccaagcaca

SEQ ID NO: 1915509 - RNA, 19 nt, Homo sapiens
ugccacuuugcagcuaaaa

SEQ ID NO: 1915510 - RNA, 15 nt, Homo sapiens
auguucuuuccauga

SEQ ID NO: 1915511 - RNA, 15 nt, Homo sapiens
acacuaacucaccag

SEQ ID NO: 1915512 - RNA, 16 nt, Homo sapiens
ugagccacugugccug

SEQ ID NO: 1915513 - RNA, 15 nt, Homo sapiens
ucuugguacuacuag

SEQ ID NO: 1915514 - RNA, 12 nt, Homo sapiens
acaagaaucacu

SEQ ID NO: 1915515 - RNA, 12 nt, Homo sapiens
guccucauucuu

SEQ ID NO: 1915516 - RNA, 14 nt, Homo sapiens
cuagaguccucacu

SEQ ID NO: 1915517 - RNA, 14 nt, Homo sapiens
aucacccucuuccu

SEQ ID NO: 1915518 - RNA, 14 nt, Homo sapiens
ucguaagucacuga

SEQ ID NO: 1915519 - RNA, 15 nt, Homo sapiens
gucccauugauguac

SEQ ID NO: 1915520 - RNA, 17 nt, Homo sapiens
ucuccucuuugauguca

SEQ ID NO: 1915521 - RNA, 20 nt, Homo sapiens
cagaguguuuaauuguacuc

SEQ ID NO: 1915522 - RNA, 17 nt, Homo sapiens
aaaccuuuguuaacucu

SEQ ID NO: 1915523 - RNA, 13 nt, Homo sapiens
gagugaguucuca

SEQ ID NO: 1915524 - RNA, 13 nt, Homo sapiens
aagacuucauccc

SEQ ID NO: 1915525 - RNA, 17 nt, Homo sapiens
ucaccggccuugugaca

SEQ ID NO: 1915526 - RNA, 18 nt, Homo sapiens
auggcguaaguacagaga

SEQ ID NO: 1915527 - RNA, 18 nt, Homo sapiens
uggggagaaaagacauga

SEQ ID NO: 1915528 - RNA, 17 nt, Homo sapiens
ugugaaacuggcacuga

SEQ ID NO: 1915529 - RNA, 14 nt, Homo sapiens
uggaaugcccuuca

SEQ ID NO: 1915530 - RNA, 18 nt, Homo sapiens
uaccaaguuuuauuguca

SEQ ID NO: 1915531 - RNA, 15 nt, Homo sapiens
ugaaauuuacaaauc

SEQ ID NO: 1915532 - RNA, 22 nt, Homo sapiens
gcccuggggccaugggugcaug

SEQ ID NO: 1915533 - RNA, 13 nt, Homo sapiens
ccagacuucauag

SEQ ID NO: 1915534 - RNA, 19 nt, Homo sapiens
gcuggcagggcgugaggaa

SEQ ID NO: 1915535 - RNA, 16 nt, Homo sapiens
cugccuguccccaugc

SEQ ID NO: 1915536 - RNA, 14 nt, Homo sapiens
acuucuagcauaua

SEQ ID NO: 1915537 - RNA, 23 nt, Homo sapiens
caaaguuaaacgugaugugcuca

SEQ ID NO: 1915538 - RNA, 22 nt, Homo sapiens
auaauggucaguccucaucucu

SEQ ID NO: 1915539 - RNA, 14 nt, Homo sapiens
uugcaauguaguca

SEQ ID NO: 1915540 - RNA, 18 nt, Homo sapiens
agacacguguuguuccac

SEQ ID NO: 1915541 - RNA, 12 nt, Homo sapiens
auucucaggaug

SEQ ID NO: 1915542 - RNA, 16 nt, Homo sapiens
gaguugcagcucugua

SEQ ID NO: 1915543 - RNA, 22 nt, Homo sapiens
cacauugaucauuuuuauauga

SEQ ID NO: 1915544 - RNA, 23 nt, Homo sapiens
gggcucuaugccugcacugggaa

SEQ ID NO: 1915545 - RNA, 19 nt, Homo sapiens
aauccacauugccagugac

SEQ ID NO: 1915546 - RNA, 18 nt, Homo sapiens
ccugcacugacucuggaa

SEQ ID NO: 1915547 - RNA, 19 nt, Homo sapiens
aagggccccacucagggau

SEQ ID NO: 1915548 - RNA, 12 nt, Homo sapiens
uaauuauugcuu

SEQ ID NO: 1915549 - RNA, 17 nt, Homo sapiens
aggggaggaucacugga

SEQ ID NO: 1915550 - RNA, 16 nt, Homo sapiens
ugaaguaggugaucuu

SEQ ID NO: 1915551 - RNA, 16 nt, Homo sapiens
ucaaccuuaccaaaaa

SEQ ID NO: 1915552 - RNA, 16 nt, Homo sapiens
guccauccauucagaa

SEQ ID NO: 1915553 - RNA, 23 nt, Homo sapiens
caaauaaaacaaaaccaacucag

SEQ ID NO: 1915554 - RNA, 13 nt, Homo sapiens
aacaaaugcauca

SEQ ID NO: 1915555 - RNA, 18 nt, Homo sapiens
aauaggaagauaugccac

SEQ ID NO: 1915556 - RNA, 16 nt, Homo sapiens
ccguauugguauacuu

SEQ ID NO: 1915557 - RNA, 16 nt, Homo sapiens
ucaaggcggugcuuga

SEQ ID NO: 1915558 - RNA, 17 nt, Homo sapiens
aguacaugggugacuau

SEQ ID NO: 1915559 - RNA, 18 nt, Homo sapiens
auuuagaccccauacaag

SEQ ID NO: 1915560 - RNA, 17 nt, Homo sapiens
ucacccgccucuugccc

SEQ ID NO: 1915561 - RNA, 14 nt, Homo sapiens
gaaagcuggacuga

SEQ ID NO: 1915562 - RNA, 14 nt, Homo sapiens
uaauucuguacaua

SEQ ID NO: 1915563 - RNA, 14 nt, Homo sapiens
auaacuucuuccug

SEQ ID NO: 1915564 - RNA, 15 nt, Homo sapiens
ggugauggagguuuc

SEQ ID NO: 1915565 - RNA, 18 nt, Homo sapiens
cguguagugucuguaaua

SEQ ID NO: 1915566 - RNA, 17 nt, Homo sapiens
gccaccuuccucuccca

SEQ ID NO: 1915567 - RNA, 15 nt, Homo sapiens
aacucaguccuguac

SEQ ID NO: 1915568 - RNA, 16 nt, Homo sapiens
agugcagugcucagua

SEQ ID NO: 1915569 - RNA, 20 nt, Homo sapiens
aaucuuccaucugcaucuua

SEQ ID NO: 1915570 - RNA, 17 nt, Homo sapiens
uagcuuugacaguucuu

SEQ ID NO: 1915571 - RNA, 20 nt, Homo sapiens
aaaagauuuuagcuacaucu

SEQ ID NO: 1915572 - RNA, 18 nt, Homo sapiens
cucuggcacauugacaaa

SEQ ID NO: 1915573 - RNA, 22 nt, Homo sapiens
aacauaaaacaaaaccaagccu

SEQ ID NO: 1915574 - RNA, 22 nt, Homo sapiens
ccugagaaggccagaauacugg

SEQ ID NO: 1915575 - RNA, 18 nt, Homo sapiens
uauggaagaugugugaua

SEQ ID NO: 1915576 - RNA, 15 nt, Homo sapiens
uaaaacuaagcacaa

SEQ ID NO: 1915577 - RNA, 22 nt, Homo sapiens
aaguaauuaaaaguaauauggu

SEQ ID NO: 1915578 - RNA, 21 nt, Homo sapiens
cuuuaccccaccuuccuggga

SEQ ID NO: 1915579 - RNA, 21 nt, Homo sapiens
auauccugccuuuuaccuuca

SEQ ID NO: 1915580 - RNA, 20 nt, Homo sapiens
uaucaaaugaaacucuuuca

SEQ ID NO: 1915581 - RNA, 16 nt, Homo sapiens
ggccgaggugacugca

SEQ ID NO: 1915582 - RNA, 23 nt, Homo sapiens
uuuaagaaauaaauuuauuucaa

SEQ ID NO: 1915583 - RNA, 15 nt, Homo sapiens
uuuagagaaaacuaa

SEQ ID NO: 1915584 - RNA, 21 nt, Homo sapiens
aguuuguagccagguacugca

SEQ ID NO: 1915585 - RNA, 16 nt, Homo sapiens
gcucgauuccucaggg

SEQ ID NO: 1915586 - RNA, 13 nt, Homo sapiens
gugugaacugcaa

SEQ ID NO: 1915587 - RNA, 18 nt, Homo sapiens
gcacucccuccagcacaa

SEQ ID NO: 1915588 - RNA, 16 nt, Homo sapiens
ucaggauccagugaca

SEQ ID NO: 1915589 - RNA, 22 nt, Homo sapiens
ucuucaccccacacccaugugu

SEQ ID NO: 1915590 - RNA, 15 nt, Homo sapiens
uuggaaugaaugaca

SEQ ID NO: 1915591 - RNA, 14 nt, Homo sapiens
cuuccuccuaccac

SEQ ID NO: 1915592 - RNA, 23 nt, Homo sapiens
uguugccuugcauaauggucaga

SEQ ID NO: 1915593 - RNA, 14 nt, Homo sapiens
ccaccagccacuuu

SEQ ID NO: 1915594 - RNA, 11 nt, Homo sapiens
ugagcauauau

SEQ ID NO: 1915595 - RNA, 15 nt, Homo sapiens
ccggcauaagccacu

SEQ ID NO: 1915596 - RNA, 20 nt, Homo sapiens
gauauuuaaaagacaaacac

SEQ ID NO: 1915597 - RNA, 22 nt, Homo sapiens
gucaauauugguguacuguaau

SEQ ID NO: 1915598 - RNA, 19 nt, Homo sapiens
gcaguuguggugugccaug

SEQ ID NO: 1915599 - RNA, 14 nt, Homo sapiens
ccaagccuccacag

SEQ ID NO: 1915600 - RNA, 14 nt, Homo sapiens
gcccaccugccagg

SEQ ID NO: 1915601 - RNA, 22 nt, Homo sapiens
cccugacucucugugaccugcc

SEQ ID NO: 1915602 - RNA, 14 nt, Homo sapiens
ggcaauaaugucaa

SEQ ID NO: 1915603 - RNA, 14 nt, Homo sapiens
aaccauuacuguaa

SEQ ID NO: 1915604 - RNA, 22 nt, Homo sapiens
augguuacuaggcuuaauaccu

SEQ ID NO: 1915605 - RNA, 15 nt, Homo sapiens
caguacuauggagug

SEQ ID NO: 1915606 - RNA, 15 nt, Homo sapiens
cuaacaggcacuuug

SEQ ID NO: 1915607 - RNA, 17 nt, Homo sapiens
uggcaccccagcuaccc

SEQ ID NO: 1915608 - RNA, 15 nt, Homo sapiens
ugagaauugugcuuu

SEQ ID NO: 1915609 - RNA, 14 nt, Homo sapiens
uaaauaaauuguga

SEQ ID NO: 1915610 - RNA, 11 nt, Homo sapiens
cccucauuccc

SEQ ID NO: 1915611 - RNA, 14 nt, Homo sapiens
ugaaguccagugac

SEQ ID NO: 1915612 - RNA, 19 nt, Homo sapiens
acugccucgaaacacagaa

SEQ ID NO: 1915613 - RNA, 18 nt, Homo sapiens
aguucugugguuccagua

SEQ ID NO: 1915614 - RNA, 16 nt, Homo sapiens
ccacccaccuuugcca

SEQ ID NO: 1915615 - RNA, 22 nt, Homo sapiens
uuccauuugaaccagugaucca

SEQ ID NO: 1915616 - RNA, 18 nt, Homo sapiens
agcuuggggccagggaag

SEQ ID NO: 1915617 - RNA, 14 nt, Homo sapiens
uuugcucuacuuua

SEQ ID NO: 1915618 - RNA, 17 nt, Homo sapiens
agaaauggcgaauguca

SEQ ID NO: 1915619 - RNA, 14 nt, Homo sapiens
gaggucagcacaag

SEQ ID NO: 1915620 - RNA, 16 nt, Homo sapiens
ggccacucuaccugaa

SEQ ID NO: 1915621 - RNA, 16 nt, Homo sapiens
caguaaaaacuuguac

SEQ ID NO: 1915622 - RNA, 19 nt, Homo sapiens
cuuugcacgaacaccaagu

SEQ ID NO: 1915623 - RNA, 13 nt, Homo sapiens
gauucauauugaa

SEQ ID NO: 1915624 - RNA, 15 nt, Homo sapiens
uuccaugguuccaca

SEQ ID NO: 1915625 - RNA, 12 nt, Homo sapiens
ccagacuugccu

SEQ ID NO: 1915626 - RNA, 17 nt, Homo sapiens
ugaugcaguuucauagu

SEQ ID NO: 1915627 - RNA, 17 nt, Homo sapiens
aagcacagccucagaau

SEQ ID NO: 1915628 - RNA, 21 nt, Homo sapiens
guagcuguauuagcagcaaaa

SEQ ID NO: 1915629 - RNA, 21 nt, Homo sapiens
cugauggcuugacaugugcaa

SEQ ID NO: 1915630 - RNA, 21 nt, Homo sapiens
acucuaugaguuggacuucag

SEQ ID NO: 1915631 - RNA, 20 nt, Homo sapiens
cuccugcgugugcccacuga

SEQ ID NO: 1915632 - RNA, 20 nt, Homo sapiens
agucaauucugugugguaua

SEQ ID NO: 1915633 - RNA, 17 nt, Homo sapiens
gggccaaggucugagca

SEQ ID NO: 1915634 - RNA, 19 nt, Homo sapiens
accaagaguagcaccuuca

SEQ ID NO: 1915635 - RNA, 21 nt, Homo sapiens
auuuuuaauuuaaaaaagcaa

SEQ ID NO: 1915636 - RNA, 23 nt, Homo sapiens
cagcucccugaggaccaccuccu

SEQ ID NO: 1915637 - RNA, 22 nt, Homo sapiens
aaagagguggauuccugggcaa

SEQ ID NO: 1915638 - RNA, 19 nt, Homo sapiens
caaagguuuauuccagaga

SEQ ID NO: 1915639 - RNA, 16 nt, Homo sapiens
ggcacugagaccucca

SEQ ID NO: 1915640 - RNA, 14 nt, Homo sapiens
agcucccaagggau

SEQ ID NO: 1915641 - RNA, 21 nt, Homo sapiens
uugccaaauugcugcauauuu

SEQ ID NO: 1915642 - RNA, 18 nt, Homo sapiens
agagccccacuugacacu

SEQ ID NO: 1915643 - RNA, 22 nt, Homo sapiens
ugggcaacagagugagacccua

SEQ ID NO: 1915644 - RNA, 12 nt, Homo sapiens
aacauagacaga

SEQ ID NO: 1915645 - RNA, 15 nt, Homo sapiens
ugaugcaggcacuua

SEQ ID NO: 1915646 - RNA, 9 nt, Homo sapiens
cgucuuccc

SEQ ID NO: 1915647 - RNA, 14 nt, Homo sapiens
ugggauuugaacca

SEQ ID NO: 1915648 - RNA, 16 nt, Homo sapiens
ccauuuccauggugca

SEQ ID NO: 1915649 - RNA, 20 nt, Homo sapiens
ccagggaagaagaucaacgc

SEQ ID NO: 1915650 - RNA, 22 nt, Homo sapiens
ugauuaccaaaauauauauuaa

SEQ ID NO: 1915651 - RNA, 23 nt, Homo sapiens
ccugaaggguggaugugcuggag

SEQ ID NO: 1915652 - RNA, 22 nt, Homo sapiens
auuuaguacccugcaggccagg

SEQ ID NO: 1915653 - RNA, 20 nt, Homo sapiens
cucuaaauagccaacaccca

SEQ ID NO: 1915654 - RNA, 16 nt, Homo sapiens
ucccaccccuaccucu

SEQ ID NO: 1915655 - RNA, 22 nt, Homo sapiens
auuuccuacgggcuguguucca

SEQ ID NO: 1915656 - RNA, 22 nt, Homo sapiens
uguuucaaaaauaaaagaacac

SEQ ID NO: 1915657 - RNA, 14 nt, Homo sapiens
gcuuucagagccag

SEQ ID NO: 1915658 - RNA, 13 nt, Homo sapiens
uucauuggggaca

SEQ ID NO: 1915659 - RNA, 21 nt, Homo sapiens
ucugaugaaguuguacaacac

SEQ ID NO: 1915660 - RNA, 15 nt, Homo sapiens
gauuuauucugccaa

SEQ ID NO: 1915661 - RNA, 15 nt, Homo sapiens
gcaccacucugggca

SEQ ID NO: 1915662 - RNA, 15 nt, Homo sapiens
uuuaaagugcucuua

SEQ ID NO: 1915663 - RNA, 16 nt, Homo sapiens
aaucugugagaaguuu

SEQ ID NO: 1915664 - RNA, 19 nt, Homo sapiens
uauaucuagguuuaugaca

SEQ ID NO: 1915665 - RNA, 14 nt, Homo sapiens
uuauauugguauaa

SEQ ID NO: 1915666 - RNA, 14 nt, Homo sapiens
ugacauugggacaa

SEQ ID NO: 1915667 - RNA, 14 nt, Homo sapiens
uauaaauggauaau

SEQ ID NO: 1915668 - RNA, 19 nt, Homo sapiens
aagugcauuauuuuauuga

SEQ ID NO: 1915669 - RNA, 22 nt, Homo sapiens
gugaccuguaaaaaguacucaa

SEQ ID NO: 1915670 - RNA, 21 nt, Homo sapiens
gaaaacugauucucuaugaca

SEQ ID NO: 1915671 - RNA, 12 nt, Homo sapiens
cucccaccucag

SEQ ID NO: 1915672 - RNA, 13 nt, Homo sapiens
aguagaacugucu

SEQ ID NO: 1915673 - RNA, 19 nt, Homo sapiens
cagagaugccaugauauca

SEQ ID NO: 1915674 - RNA, 19 nt, Homo sapiens
cauauauauaguuaugcau

SEQ ID NO: 1915675 - RNA, 23 nt, Homo sapiens
gaucaagaaugcauuaagugugg

SEQ ID NO: 1915676 - RNA, 20 nt, Homo sapiens
ucugauggaagaaagcuaau

SEQ ID NO: 1915677 - RNA, 20 nt, Homo sapiens
ugagguguugcagcccaaag

SEQ ID NO: 1915678 - RNA, 16 nt, Homo sapiens
ugccuugccuccucag

SEQ ID NO: 1915679 - RNA, 21 nt, Homo sapiens
acuugaaucaaagcaguuaac

SEQ ID NO: 1915680 - RNA, 17 nt, Homo sapiens
aagaaacagaguggccu

SEQ ID NO: 1915681 - RNA, 20 nt, Homo sapiens
aacucuccccuuucuuugca

SEQ ID NO: 1915682 - RNA, 16 nt, Homo sapiens
gcauucuagagugcau

SEQ ID NO: 1915683 - RNA, 13 nt, Homo sapiens
uguuccgugccag

SEQ ID NO: 1915684 - RNA, 18 nt, Homo sapiens
uuauucaaacuaccuaua

SEQ ID NO: 1915685 - RNA, 13 nt, Homo sapiens
caucuuccaggug

SEQ ID NO: 1915686 - RNA, 19 nt, Homo sapiens
agugcuccugugcagggau

SEQ ID NO: 1915687 - RNA, 12 nt, Homo sapiens
cagcacagccaa

SEQ ID NO: 1915688 - RNA, 14 nt, Homo sapiens
auugaauacucuga

SEQ ID NO: 1915689 - RNA, 14 nt, Homo sapiens
acaggcaagugaag

SEQ ID NO: 1915690 - RNA, 12 nt, Homo sapiens
cuuauucuuaac

SEQ ID NO: 1915691 - RNA, 18 nt, Homo sapiens
ugagcauauguuccaugc

SEQ ID NO: 1915692 - RNA, 20 nt, Homo sapiens
aaucauucauuuucugggug

SEQ ID NO: 1915693 - RNA, 16 nt, Homo sapiens
aaguaaauccacaggc

SEQ ID NO: 1915694 - RNA, 21 nt, Homo sapiens
cgcugaaauuaaaugccacuu

SEQ ID NO: 1915695 - RNA, 24 nt, Homo sapiens
ucuccagccagcaaugauguccag

SEQ ID NO: 1915696 - RNA, 23 nt, Homo sapiens
caagaaaucugugccugagaaca

SEQ ID NO: 1915697 - RNA, 18 nt, Homo sapiens
aaggauuugaaccaugaa

SEQ ID NO: 1915698 - RNA, 17 nt, Homo sapiens
cugacaugcacaccucc

SEQ ID NO: 1915699 - RNA, 22 nt, Homo sapiens
aacaaggggcuguuacauaaca

SEQ ID NO: 1915700 - RNA, 20 nt, Homo sapiens
cuggacacuuauggggacag

SEQ ID NO: 1915701 - RNA, 16 nt, Homo sapiens
uagcaauaacauacau

SEQ ID NO: 1915702 - RNA, 17 nt, Homo sapiens
uuggccuucagaaccau

SEQ ID NO: 1915703 - RNA, 22 nt, Homo sapiens
ugacaaacuucuuucacucaca

SEQ ID NO: 1915704 - RNA, 20 nt, Homo sapiens
ugaagcugaggcucaggggu

SEQ ID NO: 1915705 - RNA, 13 nt, Homo sapiens
cagagcaagugag

SEQ ID NO: 1915706 - RNA, 20 nt, Homo sapiens
agggucagccugcugugccc

SEQ ID NO: 1915707 - RNA, 22 nt, Homo sapiens
ugccuuccaggcagacacagcu

SEQ ID NO: 1915708 - RNA, 23 nt, Homo sapiens
cuucucacuagcugucucaggag

SEQ ID NO: 1915709 - RNA, 15 nt, Homo sapiens
aacccaguauaugcu

SEQ ID NO: 1915710 - RNA, 17 nt, Homo sapiens
acucugccucuguauau

SEQ ID NO: 1915711 - RNA, 17 nt, Homo sapiens
aagcucaaguguucaca

SEQ ID NO: 1915712 - RNA, 16 nt, Homo sapiens
auuuauuuauggagga

SEQ ID NO: 1915713 - RNA, 19 nt, Homo sapiens
gggcugaaagaacauggac

SEQ ID NO: 1915714 - RNA, 16 nt, Homo sapiens
aggauaugauggucac

SEQ ID NO: 1915715 - RNA, 14 nt, Homo sapiens
cucccuggcacuga

SEQ ID NO: 1915716 - RNA, 20 nt, Homo sapiens
aaaguuuccuaggaugucau

SEQ ID NO: 1915717 - RNA, 15 nt, Homo sapiens
cugggugccuugcau

SEQ ID NO: 1915718 - RNA, 23 nt, Homo sapiens
uuacagcugggagccuuugccau

SEQ ID NO: 1915719 - RNA, 23 nt, Homo sapiens
cuaauacuacugcacagagucag

SEQ ID NO: 1915720 - RNA, 20 nt, Homo sapiens
ucugugcaaaacuaccacau

SEQ ID NO: 1915721 - RNA, 19 nt, Homo sapiens
uuuacaucaucagaugauc

SEQ ID NO: 1915722 - RNA, 21 nt, Homo sapiens
ccaguuuugcugcuauaauuc

SEQ ID NO: 1915723 - RNA, 19 nt, Homo sapiens
agaaguaaauauagcucag

SEQ ID NO: 1915724 - RNA, 16 nt, Homo sapiens
uccucuucucaaagcu

SEQ ID NO: 1915725 - RNA, 16 nt, Homo sapiens
aggcccuuuccacgaa

SEQ ID NO: 1915726 - RNA, 22 nt, Homo sapiens
gguaaucugacuucucacuucc

SEQ ID NO: 1915727 - RNA, 17 nt, Homo sapiens
ugaaaaaaaaaacuauc

SEQ ID NO: 1915728 - RNA, 21 nt, Homo sapiens
guaucucgaagucuuccauca

SEQ ID NO: 1915729 - RNA, 23 nt, Homo sapiens
aaaauauuugagaauaaguucau

SEQ ID NO: 1915730 - RNA, 20 nt, Homo sapiens
aggaaaaguaaggugcaguu

SEQ ID NO: 1915731 - RNA, 17 nt, Homo sapiens
guaauaaaacaauguuu

SEQ ID NO: 1915732 - RNA, 22 nt, Homo sapiens
aggauggggcucccagcuccuu

SEQ ID NO: 1915733 - RNA, 13 nt, Homo sapiens
aacacaguccaga

SEQ ID NO: 1915734 - RNA, 21 nt, Homo sapiens
acaggacccugggaccacaga

SEQ ID NO: 1915735 - RNA, 23 nt, Homo sapiens
acuuguaagaaaaugagacaaaa

SEQ ID NO: 1915736 - RNA, 16 nt, Homo sapiens
cuuauaggguaaaaaa

SEQ ID NO: 1915737 - RNA, 21 nt, Homo sapiens
acaucccaagaaaaucacauc

SEQ ID NO: 1915738 - RNA, 19 nt, Homo sapiens
aggaacguggucaacucac

SEQ ID NO: 1915739 - RNA, 14 nt, Homo sapiens
augaaugaauggcu

SEQ ID NO: 1915740 - RNA, 12 nt, Homo sapiens
uccaacacucca

SEQ ID NO: 1915741 - RNA, 12 nt, Homo sapiens
acauacacacau

SEQ ID NO: 1915742 - RNA, 12 nt, Homo sapiens
ugcuacacugcu

SEQ ID NO: 1915743 - RNA, 23 nt, Homo sapiens
aggagguugaggcagcagaauug

SEQ ID NO: 1915744 - RNA, 20 nt, Homo sapiens
uccucuugguaaucuuccau

SEQ ID NO: 1915745 - RNA, 17 nt, Homo sapiens
cacucuuguugugcucu

SEQ ID NO: 1915746 - RNA, 14 nt, Homo sapiens
uauucuucaugaaa

SEQ ID NO: 1915747 - RNA, 17 nt, Homo sapiens
uagccgaccucagccuu

SEQ ID NO: 1915748 - RNA, 22 nt, Homo sapiens
ucgcaacaggaaggaaccagaa

SEQ ID NO: 1915749 - RNA, 18 nt, Homo sapiens
gcaaugucagaugaaguc

SEQ ID NO: 1915750 - RNA, 17 nt, Homo sapiens
uccccagccuacugccu

SEQ ID NO: 1915751 - RNA, 19 nt, Homo sapiens
ugaaucuguuucuaugucc

SEQ ID NO: 1915752 - RNA, 15 nt, Homo sapiens
uuccaugaagaccac

SEQ ID NO: 1915753 - RNA, 17 nt, Homo sapiens
agcuuccagaugauccu

SEQ ID NO: 1915754 - RNA, 15 nt, Homo sapiens
guagauuucauugaa

SEQ ID NO: 1915755 - RNA, 13 nt, Homo sapiens
ucauccaccccau

SEQ ID NO: 1915756 - RNA, 19 nt, Homo sapiens
auaaagaaacuuuauucaa

SEQ ID NO: 1915757 - RNA, 17 nt, Homo sapiens
acgugcaaagccaaggc

SEQ ID NO: 1915758 - RNA, 18 nt, Homo sapiens
uacuuugguccucugauu

SEQ ID NO: 1915759 - RNA, 18 nt, Homo sapiens
caccuuguuacacauuau

SEQ ID NO: 1915760 - RNA, 14 nt, Homo sapiens
agcaaaaugcugcu

SEQ ID NO: 1915761 - RNA, 14 nt, Homo sapiens
acccaccucugcca

SEQ ID NO: 1915762 - RNA, 12 nt, Homo sapiens
agccaagaccca

SEQ ID NO: 1915763 - RNA, 15 nt, Homo sapiens
uaguuaucaguauuu

SEQ ID NO: 1915764 - RNA, 16 nt, Homo sapiens
gcaugcuuugcugcua

SEQ ID NO: 1915765 - RNA, 15 nt, Homo sapiens
uagaaauucugaauu

SEQ ID NO: 1915766 - RNA, 19 nt, Homo sapiens
ggauugucugcugccucca

SEQ ID NO: 1915767 - RNA, 19 nt, Homo sapiens
uuuuaaguaucccaucuaa

SEQ ID NO: 1915768 - RNA, 13 nt, Homo sapiens
uuggccuucuggg

SEQ ID NO: 1915769 - RNA, 17 nt, Homo sapiens
ugaauccccggccucug

SEQ ID NO: 1915770 - RNA, 16 nt, Homo sapiens
ugauuaaagugccuuc

SEQ ID NO: 1915771 - RNA, 20 nt, Homo sapiens
cagagacauacaccuauguc

SEQ ID NO: 1915772 - RNA, 19 nt, Homo sapiens
uccacgugauuuccaguga

SEQ ID NO: 1915773 - RNA, 13 nt, Homo sapiens
aagaaaaccacaa

SEQ ID NO: 1915774 - RNA, 13 nt, Homo sapiens
cagagaaaaguca

SEQ ID NO: 1915775 - RNA, 14 nt, Homo sapiens
uugaaggucugcaa

SEQ ID NO: 1915776 - RNA, 22 nt, Homo sapiens
uacugaggugcuauguucuuag

SEQ ID NO: 1915777 - RNA, 20 nt, Homo sapiens
uaaugguuuuuguuaguuca

SEQ ID NO: 1915778 - RNA, 12 nt, Homo sapiens
gggaucugccaa

SEQ ID NO: 1915779 - RNA, 17 nt, Homo sapiens
gaaagugaugauacugu

SEQ ID NO: 1915780 - RNA, 18 nt, Homo sapiens
caaaagacaaacaugcaa

SEQ ID NO: 1915781 - RNA, 16 nt, Homo sapiens
guuuuugaaauaccuu

SEQ ID NO: 1915782 - RNA, 14 nt, Homo sapiens
ucauugauugaaua

SEQ ID NO: 1915783 - RNA, 16 nt, Homo sapiens
aagaaugacuaugcaa

SEQ ID NO: 1915784 - RNA, 22 nt, Homo sapiens
ggcaggacaaauugcgcccauu

SEQ ID NO: 1915785 - RNA, 14 nt, Homo sapiens
uuacaguggcaaaa

SEQ ID NO: 1915786 - RNA, 14 nt, Homo sapiens
ucccaguggucaaa

SEQ ID NO: 1915787 - RNA, 23 nt, Homo sapiens
aacagcccauuuuaucuuugaau

SEQ ID NO: 1915788 - RNA, 11 nt, Homo sapiens
gggucuuggcc

SEQ ID NO: 1915789 - RNA, 14 nt, Homo sapiens
acaauaaaauacag

SEQ ID NO: 1915790 - RNA, 11 nt, Homo sapiens
uccccaucagc

SEQ ID NO: 1915791 - RNA, 21 nt, Homo sapiens
aacauugcagagcuaagcagu

SEQ ID NO: 1915792 - RNA, 16 nt, Homo sapiens
cacggcuucacugacc

SEQ ID NO: 1915793 - RNA, 16 nt, Homo sapiens
uaggauagaugugauu

SEQ ID NO: 1915794 - RNA, 21 nt, Homo sapiens
gccuccaucucauguaucauc

SEQ ID NO: 1915795 - RNA, 17 nt, Homo sapiens
ucugaagucaguuucua

SEQ ID NO: 1915796 - RNA, 19 nt, Homo sapiens
gcaccauugaacuguacca

SEQ ID NO: 1915797 - RNA, 16 nt, Homo sapiens
cuauuuaagugcaauu

SEQ ID NO: 1915798 - RNA, 22 nt, Homo sapiens
ccugucauccccuacacuuugg

SEQ ID NO: 1915799 - RNA, 17 nt, Homo sapiens
ggucuuuccacuuucau

SEQ ID NO: 1915800 - RNA, 20 nt, Homo sapiens
caauccauccugcucaggaa

SEQ ID NO: 1915801 - RNA, 15 nt, Homo sapiens
ugucucgaguccuaa

SEQ ID NO: 1915802 - RNA, 17 nt, Homo sapiens
cacuacauuugcuccau

SEQ ID NO: 1915803 - RNA, 15 nt, Homo sapiens
uuaaaugaucaugaa

SEQ ID NO: 1915804 - RNA, 23 nt, Homo sapiens
ccuuuuucuccacacuccacuga

SEQ ID NO: 1915805 - RNA, 13 nt, Homo sapiens
cacuauaucacaa

SEQ ID NO: 1915806 - RNA, 13 nt, Homo sapiens
ugccaaauugcug

SEQ ID NO: 1915807 - RNA, 19 nt, Homo sapiens
ugucucuggggcagauccc

SEQ ID NO: 1915808 - RNA, 14 nt, Homo sapiens
gacuaauuucaaaa

SEQ ID NO: 1915809 - RNA, 23 nt, Homo sapiens
aacuuugacaaccaugagaccac

SEQ ID NO: 1915810 - RNA, 16 nt, Homo sapiens
cugcaccuacugagga

SEQ ID NO: 1915811 - RNA, 20 nt, Homo sapiens
ccuuacagaacuacuucuua

SEQ ID NO: 1915812 - RNA, 15 nt, Homo sapiens
acauggagcucaggu

SEQ ID NO: 1915813 - RNA, 21 nt, Homo sapiens
caggaagcccaggagccucac

SEQ ID NO: 1915814 - RNA, 21 nt, Homo sapiens
acccaagagaacucaccuuau

SEQ ID NO: 1915815 - RNA, 21 nt, Homo sapiens
cauuuuaaauuccacugaaaa

SEQ ID NO: 1915816 - RNA, 17 nt, Homo sapiens
ugucauguuaugcagug

SEQ ID NO: 1915817 - RNA, 21 nt, Homo sapiens
gaggcucagggaaaggccagu

SEQ ID NO: 1915818 - RNA, 15 nt, Homo sapiens
agauacugaaauaaa

SEQ ID NO: 1915819 - RNA, 12 nt, Homo sapiens
aauauuuugcug

SEQ ID NO: 1915820 - RNA, 22 nt, Homo sapiens
augcaaggggaaaaucucagca

SEQ ID NO: 1915821 - RNA, 14 nt, Homo sapiens
aguguugacauagc

SEQ ID NO: 1915822 - RNA, 15 nt, Homo sapiens
gauuugccauucaag

SEQ ID NO: 1915823 - RNA, 23 nt, Homo sapiens
aaauacacagaugauaauaugcu

SEQ ID NO: 1915824 - RNA, 14 nt, Homo sapiens
ucuuucccaauuca

SEQ ID NO: 1915825 - RNA, 10 nt, Homo sapiens
acugcaguga

SEQ ID NO: 1915826 - RNA, 24 nt, Homo sapiens
ugcacaugauuguauaagcaugcu

SEQ ID NO: 1915827 - RNA, 23 nt, Homo sapiens
cacuggaaucgaucuguacugua

SEQ ID NO: 1915828 - RNA, 18 nt, Homo sapiens
acacucaucacacuucau

SEQ ID NO: 1915829 - RNA, 17 nt, Homo sapiens
cuucagcuuugaaaagg

SEQ ID NO: 1915830 - RNA, 18 nt, Homo sapiens
acaugcugccuggcacag

SEQ ID NO: 1915831 - RNA, 19 nt, Homo sapiens
gugcaguucuaguuugcau

SEQ ID NO: 1915832 - RNA, 20 nt, Homo sapiens
ugaaaaguaucacucuaaaa

SEQ ID NO: 1915833 - RNA, 21 nt, Homo sapiens
aacuccggcacuggguuugcu

SEQ ID NO: 1915834 - RNA, 15 nt, Homo sapiens
ccgcaagcaccaucc

SEQ ID NO: 1915835 - RNA, 16 nt, Homo sapiens
ugaaaauuaacacugc

SEQ ID NO: 1915836 - RNA, 16 nt, Homo sapiens
cccuugguacaagcuc

SEQ ID NO: 1915837 - RNA, 20 nt, Homo sapiens
ugcauccagcagcagcacuu

SEQ ID NO: 1915838 - RNA, 18 nt, Homo sapiens
cucaucucucuaacaaua

SEQ ID NO: 1915839 - RNA, 15 nt, Homo sapiens
ucugaccugagcuau

SEQ ID NO: 1915840 - RNA, 18 nt, Homo sapiens
ucuuuuuaaaauggugcu

SEQ ID NO: 1915841 - RNA, 16 nt, Homo sapiens
caggugauccacccac

SEQ ID NO: 1915842 - RNA, 12 nt, Homo sapiens
aagggcucucuu

SEQ ID NO: 1915843 - RNA, 19 nt, Homo sapiens
gcugagauuauaggcauga

SEQ ID NO: 1915844 - RNA, 20 nt, Homo sapiens
uuuacuugaggaucauauga

SEQ ID NO: 1915845 - RNA, 15 nt, Homo sapiens
uccccuucucugccu

SEQ ID NO: 1915846 - RNA, 22 nt, Homo sapiens
ucagggccaggugcagaccuug

SEQ ID NO: 1915847 - RNA, 13 nt, Homo sapiens
auuucaugaagca

SEQ ID NO: 1915848 - RNA, 14 nt, Homo sapiens
cguguaaauuaugu

SEQ ID NO: 1915849 - RNA, 13 nt, Homo sapiens
uuuccuaucauuu

SEQ ID NO: 1915850 - RNA, 19 nt, Homo sapiens
uaucugugggaguccucua

SEQ ID NO: 1915851 - RNA, 18 nt, Homo sapiens
aauucuaaaccaaucaaa

SEQ ID NO: 1915852 - RNA, 19 nt, Homo sapiens
cuagaccuguuuugcuuuu

SEQ ID NO: 1915853 - RNA, 15 nt, Homo sapiens
uggcgugagcugccc

SEQ ID NO: 1915854 - RNA, 17 nt, Homo sapiens
cuuuaaaaaaacacaua

SEQ ID NO: 1915855 - RNA, 22 nt, Homo sapiens
aacuuugaagagaugagcagug

SEQ ID NO: 1915856 - RNA, 17 nt, Homo sapiens
aaagaucgccuggcuca

SEQ ID NO: 1915857 - RNA, 13 nt, Homo sapiens
uacugcacuuaga

SEQ ID NO: 1915858 - RNA, 15 nt, Homo sapiens
agaaagacaguauuu

SEQ ID NO: 1915859 - RNA, 15 nt, Homo sapiens
ugacuuacugucagu

SEQ ID NO: 1915860 - RNA, 14 nt, Homo sapiens
auaauaaaaccaaa

SEQ ID NO: 1915861 - RNA, 23 nt, Homo sapiens
uggugcuaaaugcuacauacucc

SEQ ID NO: 1915862 - RNA, 23 nt, Homo sapiens
gugggggugccgcuuucucugag

SEQ ID NO: 1915863 - RNA, 15 nt, Homo sapiens
agaaaaacaucccaa

SEQ ID NO: 1915864 - RNA, 20 nt, Homo sapiens
ccaagguuuaaagagucuag

SEQ ID NO: 1915865 - RNA, 12 nt, Homo sapiens
auaggcugugua

SEQ ID NO: 1915866 - RNA, 17 nt, Homo sapiens
aaucuuguuccaugccu

SEQ ID NO: 1915867 - RNA, 17 nt, Homo sapiens
ugacauagcacuugccg

SEQ ID NO: 1915868 - RNA, 20 nt, Homo sapiens
acuaaccccaacgcacagga

SEQ ID NO: 1915869 - RNA, 17 nt, Homo sapiens
guguauugaaguccucc

SEQ ID NO: 1915870 - RNA, 22 nt, Homo sapiens
acuuuuauggcucuaucuuuuc

SEQ ID NO: 1915871 - RNA, 14 nt, Homo sapiens
uguacauuaccaua

SEQ ID NO: 1915872 - RNA, 15 nt, Homo sapiens
ccuuuguacugauga

SEQ ID NO: 1915873 - RNA, 13 nt, Homo sapiens
aguaugugucuag

SEQ ID NO: 1915874 - RNA, 22 nt, Homo sapiens
ucguucucugccacagggacuu

SEQ ID NO: 1915875 - RNA, 16 nt, Homo sapiens
ucuaggucacuucuca

SEQ ID NO: 1915876 - RNA, 16 nt, Homo sapiens
aauauaaaacagucau

SEQ ID NO: 1915877 - RNA, 22 nt, Homo sapiens
agguccacggucuguucuugaa

SEQ ID NO: 1915878 - RNA, 16 nt, Homo sapiens
uguuauguuugcacuu

SEQ ID NO: 1915879 - RNA, 13 nt, Homo sapiens
agcuucuaacuca

SEQ ID NO: 1915880 - RNA, 18 nt, Homo sapiens
cucugguaaaugaucacu

SEQ ID NO: 1915881 - RNA, 15 nt, Homo sapiens
cucaauaaauugcaa

SEQ ID NO: 1915882 - RNA, 20 nt, Homo sapiens
aagccucagugacccaugag

SEQ ID NO: 1915883 - RNA, 19 nt, Homo sapiens
cugguucuguacaugugga

SEQ ID NO: 1915884 - RNA, 12 nt, Homo sapiens
gucauggaagag

SEQ ID NO: 1915885 - RNA, 19 nt, Homo sapiens
caguaaugggggaccagcu

SEQ ID NO: 1915886 - RNA, 21 nt, Homo sapiens
uaaguaaucucacagcauuug

SEQ ID NO: 1915887 - RNA, 16 nt, Homo sapiens
agauguuuuccauuug

SEQ ID NO: 1915888 - RNA, 21 nt, Homo sapiens
aagacuacauauugucacuga

SEQ ID NO: 1915889 - RNA, 13 nt, Homo sapiens
guuccccacugac

SEQ ID NO: 1915890 - RNA, 20 nt, Homo sapiens
ccaugugacuaaaaaugcau

SEQ ID NO: 1915891 - RNA, 13 nt, Homo sapiens
cucuagugcugug

SEQ ID NO: 1915892 - RNA, 14 nt, Homo sapiens
ucaguguauuugua

SEQ ID NO: 1915893 - RNA, 21 nt, Homo sapiens
aggauggaacaucaguggaug

SEQ ID NO: 1915894 - RNA, 16 nt, Homo sapiens
aagcauuuuacaagau

SEQ ID NO: 1915895 - RNA, 16 nt, Homo sapiens
gcuucauauaccagca

SEQ ID NO: 1915896 - RNA, 14 nt, Homo sapiens
gccaucaacuacua

SEQ ID NO: 1915897 - RNA, 18 nt, Homo sapiens
uuccucuuuccaucuacc

SEQ ID NO: 1915898 - RNA, 16 nt, Homo sapiens
uccaccaaguucucau

SEQ ID NO: 1915899 - RNA, 23 nt, Homo sapiens
cugagcugcagcucuccaccagc

SEQ ID NO: 1915900 - RNA, 16 nt, Homo sapiens
uccccagcccagagac

SEQ ID NO: 1915901 - RNA, 19 nt, Homo sapiens
gccacucaggggucauuca

SEQ ID NO: 1915902 - RNA, 18 nt, Homo sapiens
cuccccaauaccuaauaa

SEQ ID NO: 1915903 - RNA, 18 nt, Homo sapiens
gcauuuaaauuagauaac

SEQ ID NO: 1915904 - RNA, 21 nt, Homo sapiens
ccaaaaugccauuuagcaaua

SEQ ID NO: 1915905 - RNA, 12 nt, Homo sapiens
uaaaagugucca

SEQ ID NO: 1915906 - RNA, 20 nt, Homo sapiens
uauuucagcccccaucaccc

SEQ ID NO: 1915907 - RNA, 20 nt, Homo sapiens
cugaacuuguuuucugggaa

SEQ ID NO: 1915908 - RNA, 18 nt, Homo sapiens
uugucaguauuuuugccg

SEQ ID NO: 1915909 - RNA, 13 nt, Homo sapiens
agucaccuuccag

SEQ ID NO: 1915910 - RNA, 17 nt, Homo sapiens
ugcaaauccauagcaca

SEQ ID NO: 1915911 - RNA, 23 nt, Homo sapiens
gugagggauaguggggucagggc

SEQ ID NO: 1915912 - RNA, 14 nt, Homo sapiens
uagagacuguaaau

SEQ ID NO: 1915913 - RNA, 19 nt, Homo sapiens
cccaggcugcacugcagug

SEQ ID NO: 1915914 - RNA, 14 nt, Homo sapiens
aggaggccauucca

SEQ ID NO: 1915915 - RNA, 22 nt, Homo sapiens
uugucaaauagcaaggccaggg

SEQ ID NO: 1915916 - RNA, 14 nt, Homo sapiens
gaauaccaccuaau

SEQ ID NO: 1915917 - RNA, 14 nt, Homo sapiens
cuacucuuauaugc

SEQ ID NO: 1915918 - RNA, 23 nt, Homo sapiens
cuguauagacaugcuaccacugg

SEQ ID NO: 1915919 - RNA, 12 nt, Homo sapiens
ccaccuccggga

SEQ ID NO: 1915920 - RNA, 18 nt, Homo sapiens
cuaagcaaauaggcaaaa

SEQ ID NO: 1915921 - RNA, 18 nt, Homo sapiens
auuccucccauucaagau

SEQ ID NO: 1915922 - RNA, 13 nt, Homo sapiens
ccucuuagcucag

SEQ ID NO: 1915923 - RNA, 17 nt, Homo sapiens
cauuuaaaagacagaca

SEQ ID NO: 1915924 - RNA, 15 nt, Homo sapiens
gaggauccuggagaa

SEQ ID NO: 1915925 - RNA, 20 nt, Homo sapiens
cauggauuacuucucuauaa

SEQ ID NO: 1915926 - RNA, 16 nt, Homo sapiens
ugaaugagagguuccu

SEQ ID NO: 1915927 - RNA, 16 nt, Homo sapiens
cuuugguucugccauc

SEQ ID NO: 1915928 - RNA, 18 nt, Homo sapiens
uucaacccagccaugcaa

SEQ ID NO: 1915929 - RNA, 14 nt, Homo sapiens
acuccuuccaucuc

SEQ ID NO: 1915930 - RNA, 19 nt, Homo sapiens
augaccuugggguacaauu

SEQ ID NO: 1915931 - RNA, 13 nt, Homo sapiens
cuagacauuauuu

SEQ ID NO: 1915932 - RNA, 22 nt, Homo sapiens
gcugaggccaggggagacauca

SEQ ID NO: 1915933 - RNA, 12 nt, Homo sapiens
aggaaacuugca

SEQ ID NO: 1915934 - RNA, 14 nt, Homo sapiens
ucaggcacacagcu

SEQ ID NO: 1915935 - RNA, 14 nt, Homo sapiens
auacuccugucacc

SEQ ID NO: 1915936 - RNA, 17 nt, Homo sapiens
cucugcacuacugacau

SEQ ID NO: 1915937 - RNA, 18 nt, Homo sapiens
cacagaaggggacugcca

SEQ ID NO: 1915938 - RNA, 16 nt, Homo sapiens
gguugugcacauuucu

SEQ ID NO: 1915939 - RNA, 18 nt, Homo sapiens
agcacaaaaccuguccua

SEQ ID NO: 1915940 - RNA, 23 nt, Homo sapiens
auccaugugauuaauguuuucau

SEQ ID NO: 1915941 - RNA, 20 nt, Homo sapiens
uagaacucuagagagccuua

SEQ ID NO: 1915942 - RNA, 20 nt, Homo sapiens
cuuucuauaauuuuacaagg

SEQ ID NO: 1915943 - RNA, 22 nt, Homo sapiens
aagacugcugcagucacaucac

SEQ ID NO: 1915944 - RNA, 12 nt, Homo sapiens
cucucguacucu

SEQ ID NO: 1915945 - RNA, 16 nt, Homo sapiens
uuggcauccugugcuu

SEQ ID NO: 1915946 - RNA, 15 nt, Homo sapiens
ugauuaaauucuugc

SEQ ID NO: 1915947 - RNA, 20 nt, Homo sapiens
cuguauuugagagacugcca

SEQ ID NO: 1915948 - RNA, 21 nt, Homo sapiens
aauacaguuuauaaagccaag

SEQ ID NO: 1915949 - RNA, 18 nt, Homo sapiens
gacaaaaaugaaauauau

SEQ ID NO: 1915950 - RNA, 15 nt, Homo sapiens
gccaggaaagcguuu

SEQ ID NO: 1915951 - RNA, 22 nt, Homo sapiens
ucugcagauagugccucugcaa

SEQ ID NO: 1915952 - RNA, 13 nt, Homo sapiens
cugccgaccccua

SEQ ID NO: 1915953 - RNA, 20 nt, Homo sapiens
cagaaaaaugaaagagaauu

SEQ ID NO: 1915954 - RNA, 15 nt, Homo sapiens
agaaggaacauugca

SEQ ID NO: 1915955 - RNA, 16 nt, Homo sapiens
uucaaugcaaaguaca

SEQ ID NO: 1915956 - RNA, 21 nt, Homo sapiens
agaaauaaggacaagccuaac

SEQ ID NO: 1915957 - RNA, 12 nt, Homo sapiens
caguuaagccuu

SEQ ID NO: 1915958 - RNA, 19 nt, Homo sapiens
aggcagcccugccauguca

SEQ ID NO: 1915959 - RNA, 15 nt, Homo sapiens
aucccauuucuugaa

SEQ ID NO: 1915960 - RNA, 16 nt, Homo sapiens
cugcuucugugcauuu

SEQ ID NO: 1915961 - RNA, 16 nt, Homo sapiens
gacaaauacacauaca

SEQ ID NO: 1915962 - RNA, 15 nt, Homo sapiens
cucuucuuuauugca

SEQ ID NO: 1915963 - RNA, 15 nt, Homo sapiens
aauauuaaagcucuu

SEQ ID NO: 1915964 - RNA, 24 nt, Homo sapiens
agcacgugucucagacugcaugua

SEQ ID NO: 1915965 - RNA, 19 nt, Homo sapiens
ccguucccuugaaagggaa

SEQ ID NO: 1915966 - RNA, 19 nt, Homo sapiens
agagagcuagagggacaaa

SEQ ID NO: 1915967 - RNA, 15 nt, Homo sapiens
gucagcucacugagc

SEQ ID NO: 1915968 - RNA, 22 nt, Homo sapiens
agccucggcccuagcauugcac

SEQ ID NO: 1915969 - RNA, 20 nt, Homo sapiens
uacaagcuuaaagcuugauu

SEQ ID NO: 1915970 - RNA, 21 nt, Homo sapiens
gaaauaaaagccucuggugga

SEQ ID NO: 1915971 - RNA, 23 nt, Homo sapiens
uuaucaagcuuagugagcaguga

SEQ ID NO: 1915972 - RNA, 23 nt, Homo sapiens
gaagccugugccucccagcuuaa

SEQ ID NO: 1915973 - RNA, 22 nt, Homo sapiens
uggccaagcaauuccucugaac

SEQ ID NO: 1915974 - RNA, 21 nt, Homo sapiens
cuuacauuuacaaacugaaga

SEQ ID NO: 1915975 - RNA, 17 nt, Homo sapiens
uugaccaucucucuuau

SEQ ID NO: 1915976 - RNA, 20 nt, Homo sapiens
ccagccugggcagcauagca

SEQ ID NO: 1915977 - RNA, 14 nt, Homo sapiens
cacaaggggcucca

SEQ ID NO: 1915978 - RNA, 17 nt, Homo sapiens
cuugggcaacugcagug

SEQ ID NO: 1915979 - RNA, 19 nt, Homo sapiens
agcacuauguggagcucag

SEQ ID NO: 1915980 - RNA, 17 nt, Homo sapiens
guuucccguauugacag

SEQ ID NO: 1915981 - RNA, 11 nt, Homo sapiens
uaaaagugcac

SEQ ID NO: 1915982 - RNA, 20 nt, Homo sapiens
ccuugucccccgugaucucc

SEQ ID NO: 1915983 - RNA, 22 nt, Homo sapiens
aagcuacuauguacugccuuag

SEQ ID NO: 1915984 - RNA, 21 nt, Homo sapiens
aaacaaaucgcagccagcuuu

SEQ ID NO: 1915985 - RNA, 13 nt, Homo sapiens
augugggaucuca

SEQ ID NO: 1915986 - RNA, 18 nt, Homo sapiens
acagcuuugugacuguau

SEQ ID NO: 1915987 - RNA, 23 nt, Homo sapiens
agaacagugaaagguauugcacu

SEQ ID NO: 1915988 - RNA, 13 nt, Homo sapiens
auguguuguucca

SEQ ID NO: 1915989 - RNA, 16 nt, Homo sapiens
gugucagucagggaca

SEQ ID NO: 1915990 - RNA, 14 nt, Homo sapiens
cuccggaggacuga

SEQ ID NO: 1915991 - RNA, 15 nt, Homo sapiens
acuggacacugugaa

SEQ ID NO: 1915992 - RNA, 23 nt, Homo sapiens
ccaaugcugucugguugcgccau

SEQ ID NO: 1915993 - RNA, 21 nt, Homo sapiens
agcauaauuccuccaguugga

SEQ ID NO: 1915994 - RNA, 17 nt, Homo sapiens
ccagagcugugccagca

SEQ ID NO: 1915995 - RNA, 23 nt, Homo sapiens
aaacuuggcucgaaucucugugc

SEQ ID NO: 1915996 - RNA, 16 nt, Homo sapiens
ggacacuaucacucau

SEQ ID NO: 1915997 - RNA, 17 nt, Homo sapiens
caggaagcucucuuaaa

SEQ ID NO: 1915998 - RNA, 18 nt, Homo sapiens
acuuugaagcaacuguga

SEQ ID NO: 1915999 - RNA, 20 nt, Homo sapiens
uacccguuucacaugcuuuu

SEQ ID NO: 1916000 - RNA, 17 nt, Homo sapiens
auaucacuuccaugaca

SEQ ID NO: 1916001 - RNA, 21 nt, Homo sapiens
gaguugcauagagauuuguau

SEQ ID NO: 1916002 - RNA, 23 nt, Homo sapiens
aacuacucagccuagcacaggcu

SEQ ID NO: 1916003 - RNA, 20 nt, Homo sapiens
cagcaaauuaauuggcagca

SEQ ID NO: 1916004 - RNA, 14 nt, Homo sapiens
cuucauccaugucc

SEQ ID NO: 1916005 - RNA, 17 nt, Homo sapiens
uugaauauaauggccuc

SEQ ID NO: 1916006 - RNA, 18 nt, Homo sapiens
cagcauaguacuggcaca

SEQ ID NO: 1916007 - RNA, 18 nt, Homo sapiens
agucacaaagaguucugg

SEQ ID NO: 1916008 - RNA, 18 nt, Homo sapiens
agacagaagucacucaau

SEQ ID NO: 1916009 - RNA, 15 nt, Homo sapiens
auguccaaacuaauu

SEQ ID NO: 1916010 - RNA, 17 nt, Homo sapiens
agauuuuagacuuaccu

SEQ ID NO: 1916011 - RNA, 18 nt, Homo sapiens
uauaauuggugcauagca

SEQ ID NO: 1916012 - RNA, 14 nt, Homo sapiens
agggcccucacuca

SEQ ID NO: 1916013 - RNA, 21 nt, Homo sapiens
ugccaagggggugacuggaag

SEQ ID NO: 1916014 - RNA, 16 nt, Homo sapiens
cuauuugggcucugaa

SEQ ID NO: 1916015 - RNA, 13 nt, Homo sapiens
gaaauaaugccuc

SEQ ID NO: 1916016 - RNA, 13 nt, Homo sapiens
gcaacaaugacuu

SEQ ID NO: 1916017 - RNA, 18 nt, Homo sapiens
aauacaaaaagcaaaaau

SEQ ID NO: 1916018 - RNA, 15 nt, Homo sapiens
auaaacugcagagag

SEQ ID NO: 1916019 - RNA, 18 nt, Homo sapiens
guggaggggcccuccgag

SEQ ID NO: 1916020 - RNA, 13 nt, Homo sapiens
uacagacauacau

SEQ ID NO: 1916021 - RNA, 20 nt, Homo sapiens
gccuuggaagcaaacuuaua

SEQ ID NO: 1916022 - RNA, 10 nt, Homo sapiens
auaccacagc

SEQ ID NO: 1916023 - RNA, 20 nt, Homo sapiens
uuggagggguauuuuugccc

SEQ ID NO: 1916024 - RNA, 21 nt, Homo sapiens
uaucccuacauguauugcaca

SEQ ID NO: 1916025 - RNA, 18 nt, Homo sapiens
aaaguauguuguacauac

SEQ ID NO: 1916026 - RNA, 14 nt, Homo sapiens
uuaauuacauacau

SEQ ID NO: 1916027 - RNA, 20 nt, Homo sapiens
cugugcugggagaaauacuu

SEQ ID NO: 1916028 - RNA, 15 nt, Homo sapiens
ccccucagauuccac

SEQ ID NO: 1916029 - RNA, 14 nt, Homo sapiens
ggagcccgcacugu

SEQ ID NO: 1916030 - RNA, 22 nt, Homo sapiens
aauacuauauuuauacuguaua

SEQ ID NO: 1916031 - RNA, 17 nt, Homo sapiens
ggaguaaaacuguauaa

SEQ ID NO: 1916032 - RNA, 19 nt, Homo sapiens
acuccaccuuggaccucag

SEQ ID NO: 1916033 - RNA, 19 nt, Homo sapiens
auaaacagugagcauaucu

SEQ ID NO: 1916034 - RNA, 16 nt, Homo sapiens
cgccaggcugaccaca

SEQ ID NO: 1916035 - RNA, 17 nt, Homo sapiens
uccuacaucuucuuccc

SEQ ID NO: 1916036 - RNA, 15 nt, Homo sapiens
agcuucuaccuggaa

SEQ ID NO: 1916037 - RNA, 19 nt, Homo sapiens
aggcgggaaaaucauuuga

SEQ ID NO: 1916038 - RNA, 18 nt, Homo sapiens
caaccauaacacuugaug

SEQ ID NO: 1916039 - RNA, 18 nt, Homo sapiens
ugaaaaaucugaauuucu

SEQ ID NO: 1916040 - RNA, 20 nt, Homo sapiens
gcacagccccuggagccuca

SEQ ID NO: 1916041 - RNA, 18 nt, Homo sapiens
agcggaucucacucagcc

SEQ ID NO: 1916042 - RNA, 23 nt, Homo sapiens
aaaauuuaauuuguccuuccuaa

SEQ ID NO: 1916043 - RNA, 23 nt, Homo sapiens
gcugggaacaugacccagccuga

SEQ ID NO: 1916044 - RNA, 14 nt, Homo sapiens
uucuggcacauaaa

SEQ ID NO: 1916045 - RNA, 21 nt, Homo sapiens
ccuuugcuaaugcuaugcaaa

SEQ ID NO: 1916046 - RNA, 15 nt, Homo sapiens
ugguucccauuugcu

SEQ ID NO: 1916047 - RNA, 16 nt, Homo sapiens
aagcugucagaaguuu

SEQ ID NO: 1916048 - RNA, 15 nt, Homo sapiens
gccaagcagugccca

SEQ ID NO: 1916049 - RNA, 21 nt, Homo sapiens
uuaucugagauaggagauaca

SEQ ID NO: 1916050 - RNA, 21 nt, Homo sapiens
gcagccaggggcugcucauca

SEQ ID NO: 1916051 - RNA, 21 nt, Homo sapiens
ggacaaggucgagacauuccu

SEQ ID NO: 1916052 - RNA, 19 nt, Homo sapiens
guuuuuuuuaagauuuauu

SEQ ID NO: 1916053 - RNA, 13 nt, Homo sapiens
uccugcucuucca

SEQ ID NO: 1916054 - RNA, 19 nt, Homo sapiens
gguuuguguuugaguuuua

SEQ ID NO: 1916055 - RNA, 21 nt, Homo sapiens
gcuugggggcuccacuggcuc

SEQ ID NO: 1916056 - RNA, 18 nt, Homo sapiens
gaaagagacuccgucuca

SEQ ID NO: 1916057 - RNA, 18 nt, Homo sapiens
gacaaucacuacaaguca

SEQ ID NO: 1916058 - RNA, 20 nt, Homo sapiens
cucuugagggagcuuagcca

SEQ ID NO: 1916059 - RNA, 19 nt, Homo sapiens
uuugcauaagugcaugaca

SEQ ID NO: 1916060 - RNA, 14 nt, Homo sapiens
guauguguuuagaa

SEQ ID NO: 1916061 - RNA, 15 nt, Homo sapiens
uauuuuuaccugccu

SEQ ID NO: 1916062 - RNA, 13 nt, Homo sapiens
gaagcacugagca

SEQ ID NO: 1916063 - RNA, 22 nt, Homo sapiens
ucaaggccagcaagguggagug

SEQ ID NO: 1916064 - RNA, 12 nt, Homo sapiens
cggccucagugc

SEQ ID NO: 1916065 - RNA, 15 nt, Homo sapiens
augcuuuugcuugca

SEQ ID NO: 1916066 - RNA, 18 nt, Homo sapiens
uaugaaaagcuaucuuaa

SEQ ID NO: 1916067 - RNA, 14 nt, Homo sapiens
cgggacccccaugu

SEQ ID NO: 1916068 - RNA, 23 nt, Homo sapiens
cugccuuguguucagugaaccca

SEQ ID NO: 1916069 - RNA, 15 nt, Homo sapiens
auaccaugacaugaa

SEQ ID NO: 1916070 - RNA, 22 nt, Homo sapiens
cugcuugugcacuggauguggc

SEQ ID NO: 1916071 - RNA, 21 nt, Homo sapiens
agauuauauuggugguucuca

SEQ ID NO: 1916072 - RNA, 19 nt, Homo sapiens
auucaaaagugaacuugau

SEQ ID NO: 1916073 - RNA, 13 nt, Homo sapiens
uuaggcacacaga

SEQ ID NO: 1916074 - RNA, 13 nt, Homo sapiens
accagcacuucaa

SEQ ID NO: 1916075 - RNA, 16 nt, Homo sapiens
ucacuggaaauugagg

SEQ ID NO: 1916076 - RNA, 22 nt, Homo sapiens
agagcucuuugucucaccagcu

SEQ ID NO: 1916077 - RNA, 20 nt, Homo sapiens
ucacuggcuguuaaucuuuc

SEQ ID NO: 1916078 - RNA, 15 nt, Homo sapiens
ggccaggcacggugg

SEQ ID NO: 1916079 - RNA, 14 nt, Homo sapiens
auacaagagacaua

SEQ ID NO: 1916080 - RNA, 13 nt, Homo sapiens
aggucuucuccaa

SEQ ID NO: 1916081 - RNA, 20 nt, Homo sapiens
agccaaaguuaugcaaggga

SEQ ID NO: 1916082 - RNA, 16 nt, Homo sapiens
acugucucucuucuca

SEQ ID NO: 1916083 - RNA, 21 nt, Homo sapiens
acaggguccaggaauggugcu

SEQ ID NO: 1916084 - RNA, 13 nt, Homo sapiens
uagagaucaugaa

SEQ ID NO: 1916085 - RNA, 12 nt, Homo sapiens
uaucucaaguaa

SEQ ID NO: 1916086 - RNA, 17 nt, Homo sapiens
gucuguacuaaaaauac

SEQ ID NO: 1916087 - RNA, 18 nt, Homo sapiens
uaaaagguugcauacuga

SEQ ID NO: 1916088 - RNA, 15 nt, Homo sapiens
ucugaaauuggucac

SEQ ID NO: 1916089 - RNA, 18 nt, Homo sapiens
cagucacagccauuucaa

SEQ ID NO: 1916090 - RNA, 16 nt, Homo sapiens
caggacuaacaacugg

SEQ ID NO: 1916091 - RNA, 21 nt, Homo sapiens
agggcaccgggcaagcacugg

SEQ ID NO: 1916092 - RNA, 21 nt, Homo sapiens
gccccugauuuuaucauucug

SEQ ID NO: 1916093 - RNA, 22 nt, Homo sapiens
guuggacagacacuguugcaaa

SEQ ID NO: 1916094 - RNA, 21 nt, Homo sapiens
aucacagauguaaauuaacuc

SEQ ID NO: 1916095 - RNA, 14 nt, Homo sapiens
aaacauagugguau

SEQ ID NO: 1916096 - RNA, 13 nt, Homo sapiens
augaacugugaca

SEQ ID NO: 1916097 - RNA, 17 nt, Homo sapiens
gacagccccuccuccau

SEQ ID NO: 1916098 - RNA, 12 nt, Homo sapiens
ccucuaaccccu

SEQ ID NO: 1916099 - RNA, 14 nt, Homo sapiens
aaaacacaaagaag

SEQ ID NO: 1916100 - RNA, 13 nt, Homo sapiens
cacucaagcaaca

SEQ ID NO: 1916101 - RNA, 22 nt, Homo sapiens
aucgaggagcuagaacauucca

SEQ ID NO: 1916102 - RNA, 13 nt, Homo sapiens
acgugacuuucaa

SEQ ID NO: 1916103 - RNA, 15 nt, Homo sapiens
caagggacugggggu

SEQ ID NO: 1916104 - RNA, 16 nt, Homo sapiens
aagccugagaacugaa

SEQ ID NO: 1916105 - RNA, 12 nt, Homo sapiens
ccaauuccucau

SEQ ID NO: 1916106 - RNA, 18 nt, Homo sapiens
cagagcccagcucaugca

SEQ ID NO: 1916107 - RNA, 17 nt, Homo sapiens
auuccaguacaguauuc

SEQ ID NO: 1916108 - RNA, 21 nt, Homo sapiens
cacuuugcagaccugggacuu

SEQ ID NO: 1916109 - RNA, 22 nt, Homo sapiens
uacauuuugccugacuuaccuu

SEQ ID NO: 1916110 - RNA, 13 nt, Homo sapiens
ggccaggacuuug

SEQ ID NO: 1916111 - RNA, 17 nt, Homo sapiens
aguauaauguuuauuaa

SEQ ID NO: 1916112 - RNA, 21 nt, Homo sapiens
cuucugccacugcugggcucc

SEQ ID NO: 1916113 - RNA, 22 nt, Homo sapiens
aaauacgaaguggagauuuaca

SEQ ID NO: 1916114 - RNA, 14 nt, Homo sapiens
acucuguacagcug

SEQ ID NO: 1916115 - RNA, 23 nt, Homo sapiens
gccucgaggugccuucuucaggg

SEQ ID NO: 1916116 - RNA, 22 nt, Homo sapiens
gcccucgggcgagucacugccu

SEQ ID NO: 1916117 - RNA, 18 nt, Homo sapiens
gacucacuggcagcccca

SEQ ID NO: 1916118 - RNA, 20 nt, Homo sapiens
uugugaugucuuuucuuggc

SEQ ID NO: 1916119 - RNA, 15 nt, Homo sapiens
auuuuaucuguggag

SEQ ID NO: 1916120 - RNA, 16 nt, Homo sapiens
aagaaugcugaaacca

SEQ ID NO: 1916121 - RNA, 18 nt, Homo sapiens
aggucaguuuagcaagaa

SEQ ID NO: 1916122 - RNA, 14 nt, Homo sapiens
caaacaccagugag

SEQ ID NO: 1916123 - RNA, 22 nt, Homo sapiens
aauuaaaaauaccaacuguaca

SEQ ID NO: 1916124 - RNA, 19 nt, Homo sapiens
aguggccuagagcacucuc

SEQ ID NO: 1916125 - RNA, 23 nt, Homo sapiens
agcauuggauacagcaguagaca

SEQ ID NO: 1916126 - RNA, 18 nt, Homo sapiens
ucauugggaagauucucu

SEQ ID NO: 1916127 - RNA, 16 nt, Homo sapiens
cgccugcccagacuga

SEQ ID NO: 1916128 - RNA, 20 nt, Homo sapiens
aguuuagauugugaggcaau

SEQ ID NO: 1916129 - RNA, 12 nt, Homo sapiens
aauccacagcca

SEQ ID NO: 1916130 - RNA, 20 nt, Homo sapiens
acuucagugggacucgguga

SEQ ID NO: 1916131 - RNA, 15 nt, Homo sapiens
agaggaucugacuga

SEQ ID NO: 1916132 - RNA, 18 nt, Homo sapiens
cauaguggaucacucacc

SEQ ID NO: 1916133 - RNA, 15 nt, Homo sapiens
gcaucugucugcucu

SEQ ID NO: 1916134 - RNA, 22 nt, Homo sapiens
gucuggguuuggcaggcacugc

SEQ ID NO: 1916135 - RNA, 20 nt, Homo sapiens
aaagugagaaaaugccucaa

SEQ ID NO: 1916136 - RNA, 13 nt, Homo sapiens
aauaauguaagac

SEQ ID NO: 1916137 - RNA, 20 nt, Homo sapiens
acuuuuuuucugugacauuu

SEQ ID NO: 1916138 - RNA, 15 nt, Homo sapiens
ggugaauuucacaag

SEQ ID NO: 1916139 - RNA, 17 nt, Homo sapiens
gaaaaugccaccaucca

SEQ ID NO: 1916140 - RNA, 21 nt, Homo sapiens
cucccccaggccugagcugcu

SEQ ID NO: 1916141 - RNA, 13 nt, Homo sapiens
auccaauaccucu

SEQ ID NO: 1916142 - RNA, 15 nt, Homo sapiens
caaucucggcucauu

SEQ ID NO: 1916143 - RNA, 22 nt, Homo sapiens
ucuuucaagucaguucugugau

SEQ ID NO: 1916144 - RNA, 12 nt, Homo sapiens
aagaaaggcaag

SEQ ID NO: 1916145 - RNA, 19 nt, Homo sapiens
uguuuagaacuacugauaa

SEQ ID NO: 1916146 - RNA, 19 nt, Homo sapiens
uagaacuucauggaucaga

SEQ ID NO: 1916147 - RNA, 21 nt, Homo sapiens
caagcuaccuucaugucacug

SEQ ID NO: 1916148 - RNA, 19 nt, Homo sapiens
gccacgcugauaauaugca

SEQ ID NO: 1916149 - RNA, 16 nt, Homo sapiens
ucuacauguaaugaca

SEQ ID NO: 1916150 - RNA, 20 nt, Homo sapiens
gccucuugucugagggacau

SEQ ID NO: 1916151 - RNA, 14 nt, Homo sapiens
ugaaacagcugcca

SEQ ID NO: 1916152 - RNA, 15 nt, Homo sapiens
aggauguuucaccaa

SEQ ID NO: 1916153 - RNA, 15 nt, Homo sapiens
ugccucuaccuggac

SEQ ID NO: 1916154 - RNA, 23 nt, Homo sapiens
uauacauuagacacacauauaca

SEQ ID NO: 1916155 - RNA, 14 nt, Homo sapiens
caauagauauuuac

SEQ ID NO: 1916156 - RNA, 12 nt, Homo sapiens
cucucaagugcc

SEQ ID NO: 1916157 - RNA, 14 nt, Homo sapiens
augaugacuaugga

SEQ ID NO: 1916158 - RNA, 17 nt, Homo sapiens
ugccugagccccucaga

SEQ ID NO: 1916159 - RNA, 15 nt, Homo sapiens
auaaauuuugugcaa

SEQ ID NO: 1916160 - RNA, 18 nt, Homo sapiens
aaccagcagaaaagugcu

SEQ ID NO: 1916161 - RNA, 14 nt, Homo sapiens
cccuuuaaagccuu

SEQ ID NO: 1916162 - RNA, 15 nt, Homo sapiens
uacggaccuuuuugc

SEQ ID NO: 1916163 - RNA, 22 nt, Homo sapiens
aggagucuuuguaaugcuugua

SEQ ID NO: 1916164 - RNA, 20 nt, Homo sapiens
aggaugccacgcacuuccuc

SEQ ID NO: 1916165 - RNA, 14 nt, Homo sapiens
aguccagauuuaca

SEQ ID NO: 1916166 - RNA, 20 nt, Homo sapiens
ugaaagacaccauuuaucua

SEQ ID NO: 1916167 - RNA, 15 nt, Homo sapiens
uaaaugucaguuaca

SEQ ID NO: 1916168 - RNA, 12 nt, Homo sapiens
auaaccaaagag

SEQ ID NO: 1916169 - RNA, 20 nt, Homo sapiens
aauaggcuuuuaaaagcauu

SEQ ID NO: 1916170 - RNA, 15 nt, Homo sapiens
uaccccugcucccau

SEQ ID NO: 1916171 - RNA, 15 nt, Homo sapiens
gaagcuuugcuuauu

SEQ ID NO: 1916172 - RNA, 15 nt, Homo sapiens
accuuaucaauugca

SEQ ID NO: 1916173 - RNA, 14 nt, Homo sapiens
agcagcaucuuuaa

SEQ ID NO: 1916174 - RNA, 20 nt, Homo sapiens
cugaaauagacccacaagag

SEQ ID NO: 1916175 - RNA, 23 nt, Homo sapiens
cagaaccuuacuggcacuguggc

SEQ ID NO: 1916176 - RNA, 14 nt, Homo sapiens
aggcuggcucguag

SEQ ID NO: 1916177 - RNA, 16 nt, Homo sapiens
caguauucugacaugu

SEQ ID NO: 1916178 - RNA, 19 nt, Homo sapiens
auggcccggccccuccuga

SEQ ID NO: 1916179 - RNA, 13 nt, Homo sapiens
aggaauccaguga

SEQ ID NO: 1916180 - RNA, 13 nt, Homo sapiens
uguuucuguacuu

SEQ ID NO: 1916181 - RNA, 15 nt, Homo sapiens
cuccaugaugacuua

SEQ ID NO: 1916182 - RNA, 18 nt, Homo sapiens
guaaaaggauaguaagca

SEQ ID NO: 1916183 - RNA, 16 nt, Homo sapiens
ccuaagacgucccuuu

SEQ ID NO: 1916184 - RNA, 13 nt, Homo sapiens
gaggcuggugcca

SEQ ID NO: 1916185 - RNA, 12 nt, Homo sapiens
caaaacuacuga

SEQ ID NO: 1916186 - RNA, 21 nt, Homo sapiens
gggccagcugucgcaucucag

SEQ ID NO: 1916187 - RNA, 22 nt, Homo sapiens
acuuuuuggugucucauaccca

SEQ ID NO: 1916188 - RNA, 19 nt, Homo sapiens
cuuugaaucaaaaauuuau

SEQ ID NO: 1916189 - RNA, 19 nt, Homo sapiens
accucagcuuugauauuuc

SEQ ID NO: 1916190 - RNA, 15 nt, Homo sapiens
agaaucaagucugug

SEQ ID NO: 1916191 - RNA, 17 nt, Homo sapiens
uaccuagggcacuuuaa

SEQ ID NO: 1916192 - RNA, 21 nt, Homo sapiens
caauucgaaaacaaccguccu

SEQ ID NO: 1916193 - RNA, 14 nt, Homo sapiens
cugcuguaucuuua

SEQ ID NO: 1916194 - RNA, 12 nt, Homo sapiens
ccaggcugccuc

SEQ ID NO: 1916195 - RNA, 23 nt, Homo sapiens
aaccagauacggacagagaccaa

SEQ ID NO: 1916196 - RNA, 23 nt, Homo sapiens
augaaaacucauuacuuuuccau

SEQ ID NO: 1916197 - RNA, 15 nt, Homo sapiens
acccuugagcucaag

SEQ ID NO: 1916198 - RNA, 17 nt, Homo sapiens
acagauaauuuacuuau

SEQ ID NO: 1916199 - RNA, 18 nt, Homo sapiens
ccuccuuccuugaccagc

SEQ ID NO: 1916200 - RNA, 19 nt, Homo sapiens
gauaacauuguuauucuua

SEQ ID NO: 1916201 - RNA, 11 nt, Homo sapiens
uagacugccau

SEQ ID NO: 1916202 - RNA, 13 nt, Homo sapiens
cucagacccaggg

SEQ ID NO: 1916203 - RNA, 22 nt, Homo sapiens
acauugacuguggcucuugccu

SEQ ID NO: 1916204 - RNA, 12 nt, Homo sapiens
cuacucuggaau

SEQ ID NO: 1916205 - RNA, 17 nt, Homo sapiens
cuccaucguccauccuc

SEQ ID NO: 1916206 - RNA, 13 nt, Homo sapiens
gcacugugucauc

SEQ ID NO: 1916207 - RNA, 21 nt, Homo sapiens
uuccuauuugcacacguccau

SEQ ID NO: 1916208 - RNA, 22 nt, Homo sapiens
acauacguuuguguggugacau

SEQ ID NO: 1916209 - RNA, 21 nt, Homo sapiens
caccgcuccaaugccuacuga

SEQ ID NO: 1916210 - RNA, 21 nt, Homo sapiens
guguuccuaaaauggugauau

SEQ ID NO: 1916211 - RNA, 15 nt, Homo sapiens
ccuccuguaaauggu

SEQ ID NO: 1916212 - RNA, 14 nt, Homo sapiens
ucaaaaacagcaga

SEQ ID NO: 1916213 - RNA, 22 nt, Homo sapiens
ugagcuuuggacgcacacagcu

SEQ ID NO: 1916214 - RNA, 11 nt, Homo sapiens
gcuccugguca

SEQ ID NO: 1916215 - RNA, 16 nt, Homo sapiens
gaaccgaacauaucau

SEQ ID NO: 1916216 - RNA, 13 nt, Homo sapiens
acgggaaaaccaa

SEQ ID NO: 1916217 - RNA, 21 nt, Homo sapiens
auuaauuacuucacuauacaa

SEQ ID NO: 1916218 - RNA, 16 nt, Homo sapiens
uggugcuuaugcucuu

SEQ ID NO: 1916219 - RNA, 18 nt, Homo sapiens
ccagugauaagagcagug

SEQ ID NO: 1916220 - RNA, 21 nt, Homo sapiens
uuucccauuuuggaaccuaau

SEQ ID NO: 1916221 - RNA, 14 nt, Homo sapiens
ccucuacauuugaa

SEQ ID NO: 1916222 - RNA, 21 nt, Homo sapiens
ucagugaauccugaaacuggu

SEQ ID NO: 1916223 - RNA, 14 nt, Homo sapiens
ucucaacaguucau

SEQ ID NO: 1916224 - RNA, 22 nt, Homo sapiens
acugaaucuucaagaccaaagc

SEQ ID NO: 1916225 - RNA, 21 nt, Homo sapiens
ugaagaaaggcaaaucugacu

SEQ ID NO: 1916226 - RNA, 22 nt, Homo sapiens
cuuagcugccccuucugaggau

SEQ ID NO: 1916227 - RNA, 15 nt, Homo sapiens
gcucagcuucuucuu

SEQ ID NO: 1916228 - RNA, 17 nt, Homo sapiens
accaucgaucaugaugu

SEQ ID NO: 1916229 - RNA, 21 nt, Homo sapiens
agcaggugucuuuaacuguca

SEQ ID NO: 1916230 - RNA, 19 nt, Homo sapiens
cuuaaagucaggaguccaa

SEQ ID NO: 1916231 - RNA, 19 nt, Homo sapiens
uuguucacaucccauguag

SEQ ID NO: 1916232 - RNA, 19 nt, Homo sapiens
ugcauaugcuucugauggu

SEQ ID NO: 1916233 - RNA, 18 nt, Homo sapiens
uuuuuaacuuuaccaugc

SEQ ID NO: 1916234 - RNA, 18 nt, Homo sapiens
uugugauguuuugagagu

SEQ ID NO: 1916235 - RNA, 19 nt, Homo sapiens
auucugauuuuacauguaa

SEQ ID NO: 1916236 - RNA, 18 nt, Homo sapiens
uuuauagucucaaaucaa

SEQ ID NO: 1916237 - RNA, 18 nt, Homo sapiens
uaaaaguuucaaugugau

SEQ ID NO: 1916238 - RNA, 20 nt, Homo sapiens
cugaagugugcugugacaag

SEQ ID NO: 1916239 - RNA, 12 nt, Homo sapiens
gccuuaauacuu

SEQ ID NO: 1916240 - RNA, 20 nt, Homo sapiens
uccugagcccccagcuucca

SEQ ID NO: 1916241 - RNA, 19 nt, Homo sapiens
ccauuguuucuaauaagca

SEQ ID NO: 1916242 - RNA, 14 nt, Homo sapiens
gagguuaugccaaa

SEQ ID NO: 1916243 - RNA, 23 nt, Homo sapiens
gugauggccaggccaggggaccc

SEQ ID NO: 1916244 - RNA, 14 nt, Homo sapiens
ggcagggucucacu

SEQ ID NO: 1916245 - RNA, 16 nt, Homo sapiens
cucacuuuaauuugaa

SEQ ID NO: 1916246 - RNA, 18 nt, Homo sapiens
caaagagagguccagagu

SEQ ID NO: 1916247 - RNA, 21 nt, Homo sapiens
gaacaacuaguugucaacuaa

SEQ ID NO: 1916248 - RNA, 14 nt, Homo sapiens
accacgcccggcua

SEQ ID NO: 1916249 - RNA, 18 nt, Homo sapiens
cuuuugcuaauaccaaaa

SEQ ID NO: 1916250 - RNA, 19 nt, Homo sapiens
augccaccaacacugcuca

SEQ ID NO: 1916251 - RNA, 23 nt, Homo sapiens
uaagaguaacagucaucauuuau

SEQ ID NO: 1916252 - RNA, 21 nt, Homo sapiens
caccacccucccaccaugcgc

SEQ ID NO: 1916253 - RNA, 21 nt, Homo sapiens
cuuggaugagaaagaugggca

SEQ ID NO: 1916254 - RNA, 14 nt, Homo sapiens
caagccugccucaa

SEQ ID NO: 1916255 - RNA, 17 nt, Homo sapiens
gagucucacuguugccc

SEQ ID NO: 1916256 - RNA, 14 nt, Homo sapiens
gucuaucauaugaa

SEQ ID NO: 1916257 - RNA, 15 nt, Homo sapiens
cuguggucacuugua

SEQ ID NO: 1916258 - RNA, 11 nt, Homo sapiens
cagucaucucc

SEQ ID NO: 1916259 - RNA, 21 nt, Homo sapiens
caucuuucuucuauuuuauuc

SEQ ID NO: 1916260 - RNA, 15 nt, Homo sapiens
aguucaaaaacaaga

SEQ ID NO: 1916261 - RNA, 16 nt, Homo sapiens
gcuccagauggugcua

SEQ ID NO: 1916262 - RNA, 15 nt, Homo sapiens
uuugaggcaaaagaa

SEQ ID NO: 1916263 - RNA, 19 nt, Homo sapiens
agaucugcaggcugccucu

SEQ ID NO: 1916264 - RNA, 22 nt, Homo sapiens
uccccuggggacgccaaggagg

SEQ ID NO: 1916265 - RNA, 18 nt, Homo sapiens
aauauuauuccucaaaaa

SEQ ID NO: 1916266 - RNA, 17 nt, Homo sapiens
cugcagaaacuacugac

SEQ ID NO: 1916267 - RNA, 18 nt, Homo sapiens
accuuuuuuauacauaaa

SEQ ID NO: 1916268 - RNA, 14 nt, Homo sapiens
ccuuugucccagaa

SEQ ID NO: 1916269 - RNA, 15 nt, Homo sapiens
ccaguugguuuaaug

SEQ ID NO: 1916270 - RNA, 16 nt, Homo sapiens
uagacuucgaaaacag

SEQ ID NO: 1916271 - RNA, 16 nt, Homo sapiens
gguggaagaccuggac

SEQ ID NO: 1916272 - RNA, 17 nt, Homo sapiens
caaaggcuccugagaca

SEQ ID NO: 1916273 - RNA, 22 nt, Homo sapiens
guucauuugacccauuugauau

SEQ ID NO: 1916274 - RNA, 14 nt, Homo sapiens
aaguuacuuuccau

SEQ ID NO: 1916275 - RNA, 17 nt, Homo sapiens
aggcccaaggaguaagu

SEQ ID NO: 1916276 - RNA, 18 nt, Homo sapiens
aaggcucauuuacuugaa

SEQ ID NO: 1916277 - RNA, 16 nt, Homo sapiens
acuauguaaaccacau

SEQ ID NO: 1916278 - RNA, 12 nt, Homo sapiens
cuguggagcucu

SEQ ID NO: 1916279 - RNA, 14 nt, Homo sapiens
gcugagacccacag

SEQ ID NO: 1916280 - RNA, 22 nt, Homo sapiens
ucagaccaagcagcaggaauuc

SEQ ID NO: 1916281 - RNA, 13 nt, Homo sapiens
cggcgccagguga

SEQ ID NO: 1916282 - RNA, 22 nt, Homo sapiens
cauuggauucaucagcauuugg

SEQ ID NO: 1916283 - RNA, 15 nt, Homo sapiens
cagcagggcugugau

SEQ ID NO: 1916284 - RNA, 12 nt, Homo sapiens
uuccucugucaa

SEQ ID NO: 1916285 - RNA, 16 nt, Homo sapiens
guaaaagugugagcag

SEQ ID NO: 1916286 - RNA, 20 nt, Homo sapiens
uguaucuaccucacuauuca

SEQ ID NO: 1916287 - RNA, 21 nt, Homo sapiens
ugagcguuuaaaguacugagc

SEQ ID NO: 1916288 - RNA, 19 nt, Homo sapiens
agaugcuuuaagugcacaa

SEQ ID NO: 1916289 - RNA, 22 nt, Homo sapiens
gagcuuggugcgguaggugcug

SEQ ID NO: 1916290 - RNA, 22 nt, Homo sapiens
ccaaguuuugaaaggcuuuccu

SEQ ID NO: 1916291 - RNA, 22 nt, Homo sapiens
agucgaccccaaaggaacacug

SEQ ID NO: 1916292 - RNA, 20 nt, Homo sapiens
cauaagacaaacuccugaaa

SEQ ID NO: 1916293 - RNA, 17 nt, Homo sapiens
ccuugcaaaaaaaaacu

SEQ ID NO: 1916294 - RNA, 14 nt, Homo sapiens
cucagcaaggggcu

SEQ ID NO: 1916295 - RNA, 23 nt, Homo sapiens
aaugggaaaguauucuguacucu

SEQ ID NO: 1916296 - RNA, 15 nt, Homo sapiens
cuguacauugugagc

SEQ ID NO: 1916297 - RNA, 18 nt, Homo sapiens
uaaaauugaacuacuugg

SEQ ID NO: 1916298 - RNA, 17 nt, Homo sapiens
guacuaaacauuuccuu

SEQ ID NO: 1916299 - RNA, 13 nt, Homo sapiens
cagcugacuaaac

SEQ ID NO: 1916300 - RNA, 17 nt, Homo sapiens
gaauacucuucccacau

SEQ ID NO: 1916301 - RNA, 15 nt, Homo sapiens
uagugaacauaugga

SEQ ID NO: 1916302 - RNA, 22 nt, Homo sapiens
guacagcagaagccccaagcaa

SEQ ID NO: 1916303 - RNA, 19 nt, Homo sapiens
cagcucuuccaaucuccau

SEQ ID NO: 1916304 - RNA, 12 nt, Homo sapiens
acuuggcacuua

SEQ ID NO: 1916305 - RNA, 21 nt, Homo sapiens
caaaguccguguccuaccucc

SEQ ID NO: 1916306 - RNA, 20 nt, Homo sapiens
gcuaauaagaagugccaagu

SEQ ID NO: 1916307 - RNA, 22 nt, Homo sapiens
auagguagaaacaaauacuuga

SEQ ID NO: 1916308 - RNA, 19 nt, Homo sapiens
cuuuuguggaguuugacac

SEQ ID NO: 1916309 - RNA, 17 nt, Homo sapiens
gucuggacugacagcau

SEQ ID NO: 1916310 - RNA, 18 nt, Homo sapiens
auaaggaaagcaaugacu

SEQ ID NO: 1916311 - RNA, 13 nt, Homo sapiens
ccagcucuggagu

SEQ ID NO: 1916312 - RNA, 13 nt, Homo sapiens
ccugggagacaga

SEQ ID NO: 1916313 - RNA, 16 nt, Homo sapiens
aauaacaucaccacug

SEQ ID NO: 1916314 - RNA, 19 nt, Homo sapiens
acuccuuuuuugcaugugc

SEQ ID NO: 1916315 - RNA, 14 nt, Homo sapiens
auacaugugccaug

SEQ ID NO: 1916316 - RNA, 17 nt, Homo sapiens
uacuuauucuagauuac

SEQ ID NO: 1916317 - RNA, 23 nt, Homo sapiens
aaucuaaaaauuuugcauuucau

SEQ ID NO: 1916318 - RNA, 21 nt, Homo sapiens
caaaccaagagauugcuaauu

SEQ ID NO: 1916319 - RNA, 11 nt, Homo sapiens
gcauucacaag

SEQ ID NO: 1916320 - RNA, 13 nt, Homo sapiens
auuuucacacaua

SEQ ID NO: 1916321 - RNA, 18 nt, Homo sapiens
cuccuugucuuaaucguc

SEQ ID NO: 1916322 - RNA, 14 nt, Homo sapiens
ccacaccacaggau

SEQ ID NO: 1916323 - RNA, 12 nt, Homo sapiens
uauuuaccucag

SEQ ID NO: 1916324 - RNA, 11 nt, Homo sapiens
cgagaucucag

SEQ ID NO: 1916325 - RNA, 20 nt, Homo sapiens
auagaacugucccacaaaau

SEQ ID NO: 1916326 - RNA, 14 nt, Homo sapiens
cagcaggagcuuau

SEQ ID NO: 1916327 - RNA, 22 nt, Homo sapiens
gugcauuuaauuggaguaucua

SEQ ID NO: 1916328 - RNA, 21 nt, Homo sapiens
uauaaaauuauauucacuacu

SEQ ID NO: 1916329 - RNA, 14 nt, Homo sapiens
aaaagaauguccaa

SEQ ID NO: 1916330 - RNA, 13 nt, Homo sapiens
caucucugccaag

SEQ ID NO: 1916331 - RNA, 22 nt, Homo sapiens
aaggguucaccaggucagggag

SEQ ID NO: 1916332 - RNA, 14 nt, Homo sapiens
gucaggcacaguaa

SEQ ID NO: 1916333 - RNA, 21 nt, Homo sapiens
gaggcugcgugugccccgugg

SEQ ID NO: 1916334 - RNA, 12 nt, Homo sapiens
cucacuuuggac

SEQ ID NO: 1916335 - RNA, 19 nt, Homo sapiens
agaauaucuguaaugguac

SEQ ID NO: 1916336 - RNA, 12 nt, Homo sapiens
guagccagguac

SEQ ID NO: 1916337 - RNA, 14 nt, Homo sapiens
aacucuuuccccag

SEQ ID NO: 1916338 - RNA, 15 nt, Homo sapiens
ucaggaaaacuacag

SEQ ID NO: 1916339 - RNA, 16 nt, Homo sapiens
uuaacacucauuucca

SEQ ID NO: 1916340 - RNA, 13 nt, Homo sapiens
ugcucagugccuc

SEQ ID NO: 1916341 - RNA, 23 nt, Homo sapiens
gagcacugccaggagggacaaag

SEQ ID NO: 1916342 - RNA, 13 nt, Homo sapiens
ccauguuagcucc

SEQ ID NO: 1916343 - RNA, 15 nt, Homo sapiens
uaaauuaugacugcu

SEQ ID NO: 1916344 - RNA, 21 nt, Homo sapiens
uucagugcauuaucuacuugu

SEQ ID NO: 1916345 - RNA, 21 nt, Homo sapiens
aagccauuugcacucuggaac

SEQ ID NO: 1916346 - RNA, 22 nt, Homo sapiens
ugggcuggaggcugagcugcau

SEQ ID NO: 1916347 - RNA, 23 nt, Homo sapiens
gucaccuccuccaagaagcccuc

SEQ ID NO: 1916348 - RNA, 18 nt, Homo sapiens
ccggcauccugaaagcca

SEQ ID NO: 1916349 - RNA, 12 nt, Homo sapiens
cuugccagacau

SEQ ID NO: 1916350 - RNA, 15 nt, Homo sapiens
cuccuuccugugauu

SEQ ID NO: 1916351 - RNA, 18 nt, Homo sapiens
gugcuuuaugugagauac

SEQ ID NO: 1916352 - RNA, 21 nt, Homo sapiens
uuucccucugggauuugccca

SEQ ID NO: 1916353 - RNA, 22 nt, Homo sapiens
ccaaguagucugcucacaguaa

SEQ ID NO: 1916354 - RNA, 12 nt, Homo sapiens
ugagaccauuca

SEQ ID NO: 1916355 - RNA, 13 nt, Homo sapiens
aacacaucaucaa

SEQ ID NO: 1916356 - RNA, 20 nt, Homo sapiens
gcagcugagccugagccaau

SEQ ID NO: 1916357 - RNA, 16 nt, Homo sapiens
gcaaugcccugugcau

SEQ ID NO: 1916358 - RNA, 23 nt, Homo sapiens
guuuugcugcuugguagcacuuu

SEQ ID NO: 1916359 - RNA, 16 nt, Homo sapiens
augcccgcacaguaau

SEQ ID NO: 1916360 - RNA, 16 nt, Homo sapiens
auuauaagaugucauc

SEQ ID NO: 1916361 - RNA, 15 nt, Homo sapiens
agugaggcaggugac

SEQ ID NO: 1916362 - RNA, 14 nt, Homo sapiens
ucauuuucagugac

SEQ ID NO: 1916363 - RNA, 14 nt, Homo sapiens
cauccugucaccau

SEQ ID NO: 1916364 - RNA, 14 nt, Homo sapiens
ccugggcagcuccu

SEQ ID NO: 1916365 - RNA, 15 nt, Homo sapiens
uucggcuaugucuca

SEQ ID NO: 1916366 - RNA, 16 nt, Homo sapiens
ugcacugaucacccaa

SEQ ID NO: 1916367 - RNA, 21 nt, Homo sapiens
uccucucugugucccugcugc

SEQ ID NO: 1916368 - RNA, 18 nt, Homo sapiens
uagcugggacuacagggg

SEQ ID NO: 1916369 - RNA, 23 nt, Homo sapiens
ucugacaagguggucaacaacau

SEQ ID NO: 1916370 - RNA, 16 nt, Homo sapiens
ccaaggaccucucuca

SEQ ID NO: 1916371 - RNA, 18 nt, Homo sapiens
gcugcacugaucacccaa

SEQ ID NO: 1916372 - RNA, 10 nt, Homo sapiens
uaacaucaaa

SEQ ID NO: 1916373 - RNA, 23 nt, Homo sapiens
ucccgaguagggaggaccacagg

SEQ ID NO: 1916374 - RNA, 22 nt, Homo sapiens
ccaaauucccucuggaguuuca

SEQ ID NO: 1916375 - RNA, 20 nt, Homo sapiens
cuggagugcaguggcacgau

SEQ ID NO: 1916376 - RNA, 19 nt, Homo sapiens
guuguauauagaguggaau

SEQ ID NO: 1916377 - RNA, 13 nt, Homo sapiens
acgugggcauuuu

SEQ ID NO: 1916378 - RNA, 20 nt, Homo sapiens
agaaguggagauuucaguuc

SEQ ID NO: 1916379 - RNA, 17 nt, Homo sapiens
cuccagggagaaggcau

SEQ ID NO: 1916380 - RNA, 16 nt, Homo sapiens
ucgcugugccaccacc

SEQ ID NO: 1916381 - RNA, 16 nt, Homo sapiens
cuggggggaccaaaua

SEQ ID NO: 1916382 - RNA, 15 nt, Homo sapiens
aaugagcugagcuua

SEQ ID NO: 1916383 - RNA, 20 nt, Homo sapiens
cuuccacaugggugcauuug

SEQ ID NO: 1916384 - RNA, 20 nt, Homo sapiens
augcugggauuacaggcgua

SEQ ID NO: 1916385 - RNA, 23 nt, Homo sapiens
aagaaauggcuuuccacaucccc

SEQ ID NO: 1916386 - RNA, 15 nt, Homo sapiens
cguauuccagagaug

SEQ ID NO: 1916387 - RNA, 17 nt, Homo sapiens
cugcccagacugaugag

SEQ ID NO: 1916388 - RNA, 21 nt, Homo sapiens
cuguuuuuuggugguucugcu

SEQ ID NO: 1916389 - RNA, 16 nt, Homo sapiens
ucccagcucacugcag

SEQ ID NO: 1916390 - RNA, 17 nt, Homo sapiens
auauccugacaagauua

SEQ ID NO: 1916391 - RNA, 14 nt, Homo sapiens
cuagauacucgugu

SEQ ID NO: 1916392 - RNA, 22 nt, Homo sapiens
acaauugucuuaaaaccagaga

SEQ ID NO: 1916393 - RNA, 21 nt, Homo sapiens
caguaaacuuuggcuuauaaa

SEQ ID NO: 1916394 - RNA, 13 nt, Homo sapiens
agaacacuaaccu

SEQ ID NO: 1916395 - RNA, 16 nt, Homo sapiens
cugcuugagagcuauu

SEQ ID NO: 1916396 - RNA, 15 nt, Homo sapiens
caucaauaccugcug

SEQ ID NO: 1916397 - RNA, 14 nt, Homo sapiens
uuuccaaaacuuua

SEQ ID NO: 1916398 - RNA, 16 nt, Homo sapiens
cuuguguuacuugcca

SEQ ID NO: 1916399 - RNA, 14 nt, Homo sapiens
ggagcucaguuucu

SEQ ID NO: 1916400 - RNA, 15 nt, Homo sapiens
auuuucauucauuca

SEQ ID NO: 1916401 - RNA, 12 nt, Homo sapiens
agcuuacacuga

SEQ ID NO: 1916402 - RNA, 21 nt, Homo sapiens
cacgucccgggcacugucaug

SEQ ID NO: 1916403 - RNA, 23 nt, Homo sapiens
aauugauguugcuggacugucau

SEQ ID NO: 1916404 - RNA, 16 nt, Homo sapiens
caugcuggcugaagag

SEQ ID NO: 1916405 - RNA, 18 nt, Homo sapiens
gcgauucucccgccucag

SEQ ID NO: 1916406 - RNA, 18 nt, Homo sapiens
uggcccugcccugaggaa

SEQ ID NO: 1916407 - RNA, 14 nt, Homo sapiens
cuggacaugccugu

SEQ ID NO: 1916408 - RNA, 22 nt, Homo sapiens
ccacucuguuccuacuggagau

SEQ ID NO: 1916409 - RNA, 20 nt, Homo sapiens
cuguaaacuuuaucacuuaa

SEQ ID NO: 1916410 - RNA, 20 nt, Homo sapiens
uagaaggguaccuugaacac

SEQ ID NO: 1916411 - RNA, 14 nt, Homo sapiens
cauauaucucugug

SEQ ID NO: 1916412 - RNA, 20 nt, Homo sapiens
ggaccugagccugguccugg

SEQ ID NO: 1916413 - RNA, 21 nt, Homo sapiens
cccaggaggcggagguugcag

SEQ ID NO: 1916414 - RNA, 20 nt, Homo sapiens
caaagguauguaguuacaga

SEQ ID NO: 1916415 - RNA, 16 nt, Homo sapiens
cucuugcugcacuuau

SEQ ID NO: 1916416 - RNA, 13 nt, Homo sapiens
ucuaaagcugcca

SEQ ID NO: 1916417 - RNA, 20 nt, Homo sapiens
ccagcuauugauauaaauaa

SEQ ID NO: 1916418 - RNA, 16 nt, Homo sapiens
aaucauugucagagau

SEQ ID NO: 1916419 - RNA, 21 nt, Homo sapiens
accucgagguuucucaaagaa

SEQ ID NO: 1916420 - RNA, 17 nt, Homo sapiens
caauuuuugacauuaau

SEQ ID NO: 1916421 - RNA, 15 nt, Homo sapiens
uggggucaugcccuc

SEQ ID NO: 1916422 - RNA, 21 nt, Homo sapiens
ugacugguuuacaggcccugc

SEQ ID NO: 1916423 - RNA, 11 nt, Homo sapiens
ccaauaucaug

SEQ ID NO: 1916424 - RNA, 13 nt, Homo sapiens
ucuacaugcaaau

SEQ ID NO: 1916425 - RNA, 19 nt, Homo sapiens
uuuucuaacccagucuuau

SEQ ID NO: 1916426 - RNA, 13 nt, Homo sapiens
accuuagauuuag

SEQ ID NO: 1916427 - RNA, 16 nt, Homo sapiens
acagagcucucugagg

SEQ ID NO: 1916428 - RNA, 13 nt, Homo sapiens
cauuuguuuucac

SEQ ID NO: 1916429 - RNA, 13 nt, Homo sapiens
aaaaucaaaugug

SEQ ID NO: 1916430 - RNA, 22 nt, Homo sapiens
ccaggaaugaaauauagauguu

SEQ ID NO: 1916431 - RNA, 23 nt, Homo sapiens
cccucggagcuggcugugccugc

SEQ ID NO: 1916432 - RNA, 22 nt, Homo sapiens
acucuguaauugaauauaaaug

SEQ ID NO: 1916433 - RNA, 18 nt, Homo sapiens
aggcugagaacacuguga

SEQ ID NO: 1916434 - RNA, 19 nt, Homo sapiens
uuauaacguguucaauauu

SEQ ID NO: 1916435 - RNA, 22 nt, Homo sapiens
agguaaugauuauguguccuuu

SEQ ID NO: 1916436 - RNA, 19 nt, Homo sapiens
caguaaaaauccacuauuu

SEQ ID NO: 1916437 - RNA, 13 nt, Homo sapiens
cuucccacuuugg

SEQ ID NO: 1916438 - RNA, 14 nt, Homo sapiens
aaaauauuacugua

SEQ ID NO: 1916439 - RNA, 18 nt, Homo sapiens
ucugcaaagugauucacu

SEQ ID NO: 1916440 - RNA, 18 nt, Homo sapiens
uugcccuuccuacuccuc

SEQ ID NO: 1916441 - RNA, 22 nt, Homo sapiens
guagaugaaaaagcauguacag

SEQ ID NO: 1916442 - RNA, 18 nt, Homo sapiens
ugaggaugccaagauuaa

SEQ ID NO: 1916443 - RNA, 14 nt, Homo sapiens
auccugugcugcug

SEQ ID NO: 1916444 - RNA, 15 nt, Homo sapiens
ccccaaacccugcuu

SEQ ID NO: 1916445 - RNA, 16 nt, Homo sapiens
guaggaugaaucauau

SEQ ID NO: 1916446 - RNA, 23 nt, Homo sapiens
agaaacugaguaggacaaaggga

SEQ ID NO: 1916447 - RNA, 18 nt, Homo sapiens
cagaacuggaaaugucca

SEQ ID NO: 1916448 - RNA, 18 nt, Homo sapiens
uaagcuuuccauuuucua

SEQ ID NO: 1916449 - RNA, 15 nt, Homo sapiens
aaaugaaaugccaaa

SEQ ID NO: 1916450 - RNA, 17 nt, Homo sapiens
uaggcuauuaaaaaagu

SEQ ID NO: 1916451 - RNA, 15 nt, Homo sapiens
gucacuucucacaau

SEQ ID NO: 1916452 - RNA, 19 nt, Homo sapiens
caaaucauuauguuuccua

SEQ ID NO: 1916453 - RNA, 13 nt, Homo sapiens
aaagccacaucuu

SEQ ID NO: 1916454 - RNA, 18 nt, Homo sapiens
aucuagaucaauuaauuc

SEQ ID NO: 1916455 - RNA, 16 nt, Homo sapiens
aaacauuuaucuuugu

SEQ ID NO: 1916456 - RNA, 15 nt, Homo sapiens
gggcugcccccgaca

SEQ ID NO: 1916457 - RNA, 18 nt, Homo sapiens
aguguugggcaugugauc

SEQ ID NO: 1916458 - RNA, 21 nt, Homo sapiens
ggcucuaauucacagugcucu

SEQ ID NO: 1916459 - RNA, 22 nt, Homo sapiens
cugugaucccagcuacuuggga

SEQ ID NO: 1916460 - RNA, 15 nt, Homo sapiens
accccgagacuacca

SEQ ID NO: 1916461 - RNA, 17 nt, Homo sapiens
ucuucaguguaauguga

SEQ ID NO: 1916462 - RNA, 19 nt, Homo sapiens
acuuaauugcuuuccugcc

SEQ ID NO: 1916463 - RNA, 20 nt, Homo sapiens
cuugagucucuuuaccuaau

SEQ ID NO: 1916464 - RNA, 21 nt, Homo sapiens
aaggcugugagccaaggaggg

SEQ ID NO: 1916465 - RNA, 16 nt, Homo sapiens
aggcggggcccagcgc

SEQ ID NO: 1916466 - RNA, 17 nt, Homo sapiens
agugucaggcacugggc

SEQ ID NO: 1916467 - RNA, 13 nt, Homo sapiens
uggugaugucacu

SEQ ID NO: 1916468 - RNA, 16 nt, Homo sapiens
ucugaagaauccugua

SEQ ID NO: 1916469 - RNA, 16 nt, Homo sapiens
acuguguauuccaaga

SEQ ID NO: 1916470 - RNA, 22 nt, Homo sapiens
auaccaaccugaagacaccguu

SEQ ID NO: 1916471 - RNA, 15 nt, Homo sapiens
ucugcguuacaacag

SEQ ID NO: 1916472 - RNA, 17 nt, Homo sapiens
cuccuugauugggacug

SEQ ID NO: 1916473 - RNA, 23 nt, Homo sapiens
caucucccugaccuucuccaggg

SEQ ID NO: 1916474 - RNA, 14 nt, Homo sapiens
ccaaucauuuuaau

SEQ ID NO: 1916475 - RNA, 18 nt, Homo sapiens
uggucuugagccaguaau

SEQ ID NO: 1916476 - RNA, 16 nt, Homo sapiens
cauguaaaaagacaaa

SEQ ID NO: 1916477 - RNA, 15 nt, Homo sapiens
acuagaauagugcau

SEQ ID NO: 1916478 - RNA, 20 nt, Homo sapiens
gaggcaggaggaucacuuga

SEQ ID NO: 1916479 - RNA, 18 nt, Homo sapiens
cuuggagaauacugccaa

SEQ ID NO: 1916480 - RNA, 17 nt, Homo sapiens
cuaaagcaauagaaaca

SEQ ID NO: 1916481 - RNA, 11 nt, Homo sapiens
ccuggucaguc

SEQ ID NO: 1916482 - RNA, 16 nt, Homo sapiens
auucagccagcuuaaa

SEQ ID NO: 1916483 - RNA, 18 nt, Homo sapiens
aggauugucacuccaaac

SEQ ID NO: 1916484 - RNA, 17 nt, Homo sapiens
aaucaggaaccacagau

SEQ ID NO: 1916485 - RNA, 17 nt, Homo sapiens
agcccugcaccaugcug

SEQ ID NO: 1916486 - RNA, 20 nt, Homo sapiens
caguuaccacagcaacugac

SEQ ID NO: 1916487 - RNA, 19 nt, Homo sapiens
gugaaaucccaucugcauu

SEQ ID NO: 1916488 - RNA, 12 nt, Homo sapiens
cugagccacuga

SEQ ID NO: 1916489 - RNA, 17 nt, Homo sapiens
aacugcguggugcucuu

SEQ ID NO: 1916490 - RNA, 12 nt, Homo sapiens
aaaagccaaaaa

SEQ ID NO: 1916491 - RNA, 12 nt, Homo sapiens
aagagccaaaga

SEQ ID NO: 1916492 - RNA, 15 nt, Homo sapiens
ugggcuacagugucu

SEQ ID NO: 1916493 - RNA, 18 nt, Homo sapiens
uucaaccacauuugcuag

SEQ ID NO: 1916494 - RNA, 14 nt, Homo sapiens
guaguuacuguggu

SEQ ID NO: 1916495 - RNA, 18 nt, Homo sapiens
agccaggcugcacagcau

SEQ ID NO: 1916496 - RNA, 17 nt, Homo sapiens
ucagauucagcauuugu

SEQ ID NO: 1916497 - RNA, 20 nt, Homo sapiens
cuauaauuuaaauauaugcu

SEQ ID NO: 1916498 - RNA, 18 nt, Homo sapiens
gccaugauggugcugacc

SEQ ID NO: 1916499 - RNA, 22 nt, Homo sapiens
aagcacauuuuaaaagugccau

SEQ ID NO: 1916500 - RNA, 12 nt, Homo sapiens
ggaaaaugacuc

SEQ ID NO: 1916501 - RNA, 13 nt, Homo sapiens
gcaguggaacuaa

SEQ ID NO: 1916502 - RNA, 14 nt, Homo sapiens
accuggaccccagc

SEQ ID NO: 1916503 - RNA, 19 nt, Homo sapiens
guuggaaccguguccagca

SEQ ID NO: 1916504 - RNA, 20 nt, Homo sapiens
ucuuacuaaccaccauuucc

SEQ ID NO: 1916505 - RNA, 23 nt, Homo sapiens
augcuguucacuggacacuucac

SEQ ID NO: 1916506 - RNA, 15 nt, Homo sapiens
cccuucgcguauuuc

SEQ ID NO: 1916507 - RNA, 20 nt, Homo sapiens
cagaaggcaaaguuuacaga

SEQ ID NO: 1916508 - RNA, 15 nt, Homo sapiens
cuuggacucaugagg

SEQ ID NO: 1916509 - RNA, 22 nt, Homo sapiens
caguucuagaagccacagugcc

SEQ ID NO: 1916510 - RNA, 21 nt, Homo sapiens
cugucuuagaugucaagcuga

SEQ ID NO: 1916511 - RNA, 20 nt, Homo sapiens
cgcugagccccugagcccaa

SEQ ID NO: 1916512 - RNA, 19 nt, Homo sapiens
aaucuggcccuuacacacu

SEQ ID NO: 1916513 - RNA, 13 nt, Homo sapiens
ugcaauguuuuag

SEQ ID NO: 1916514 - RNA, 22 nt, Homo sapiens
aauuuuccaagaacauaguuua

SEQ ID NO: 1916515 - RNA, 21 nt, Homo sapiens
ugggcacugauuugauaccau

SEQ ID NO: 1916516 - RNA, 24 nt, Homo sapiens
gacacaugcugaacaucacagcuu

SEQ ID NO: 1916517 - RNA, 16 nt, Homo sapiens
gugaaaucccugccuc

SEQ ID NO: 1916518 - RNA, 22 nt, Homo sapiens
gaucacugaaauaaaagcuaua

SEQ ID NO: 1916519 - RNA, 10 nt, Homo sapiens
guauaugcac

SEQ ID NO: 1916520 - RNA, 16 nt, Homo sapiens
uauggaaagcaccuca

SEQ ID NO: 1916521 - RNA, 13 nt, Homo sapiens
cauaaauuucucu

SEQ ID NO: 1916522 - RNA, 14 nt, Homo sapiens
gggaaucuaagaga

SEQ ID NO: 1916523 - RNA, 16 nt, Homo sapiens
cucaaaaggaaaccaa

SEQ ID NO: 1916524 - RNA, 21 nt, Homo sapiens
caccucacucuccugccuuga

SEQ ID NO: 1916525 - RNA, 17 nt, Homo sapiens
ugugcccuccuucccaa

SEQ ID NO: 1916526 - RNA, 15 nt, Homo sapiens
agagaauaugucugc

SEQ ID NO: 1916527 - RNA, 15 nt, Homo sapiens
acuugucuuugacuu

SEQ ID NO: 1916528 - RNA, 18 nt, Homo sapiens
uugcuauucccaugcauu

SEQ ID NO: 1916529 - RNA, 23 nt, Homo sapiens
acuuuucuauauugcagugugaa

SEQ ID NO: 1916530 - RNA, 16 nt, Homo sapiens
cacauaccaugugcca

SEQ ID NO: 1916531 - RNA, 20 nt, Homo sapiens
acugguuuuaccuccaggaa

SEQ ID NO: 1916532 - RNA, 18 nt, Homo sapiens
uuaggccagggucucacu

SEQ ID NO: 1916533 - RNA, 22 nt, Homo sapiens
guaauuccuaacuaucacuggu

SEQ ID NO: 1916534 - RNA, 15 nt, Homo sapiens
uuguuugcuucuugc

SEQ ID NO: 1916535 - RNA, 22 nt, Homo sapiens
ccuuaaauuaguacagcacuuu

SEQ ID NO: 1916536 - RNA, 21 nt, Homo sapiens
uccacaaaugguggguacaaa

SEQ ID NO: 1916537 - RNA, 18 nt, Homo sapiens
cuccuaagcaacuaggcc

SEQ ID NO: 1916538 - RNA, 18 nt, Homo sapiens
ggcacccaugccaucuca

SEQ ID NO: 1916539 - RNA, 17 nt, Homo sapiens
auggggaggcagcagag

SEQ ID NO: 1916540 - RNA, 17 nt, Homo sapiens
ccugaguggugccaaac

SEQ ID NO: 1916541 - RNA, 22 nt, Homo sapiens
auaguucccuagucuauucauu

SEQ ID NO: 1916542 - RNA, 22 nt, Homo sapiens
uccagaaaauaggguggacaga

SEQ ID NO: 1916543 - RNA, 15 nt, Homo sapiens
ugacuagccaucuca

SEQ ID NO: 1916544 - RNA, 19 nt, Homo sapiens
aaccgccguccuucaauuu

SEQ ID NO: 1916545 - RNA, 21 nt, Homo sapiens
uccuuuuccucuacccuauuc

SEQ ID NO: 1916546 - RNA, 15 nt, Homo sapiens
gcagcgccagugaca

SEQ ID NO: 1916547 - RNA, 12 nt, Homo sapiens
ugcauuccagcc

SEQ ID NO: 1916548 - RNA, 20 nt, Homo sapiens
gcuuuauuccagaaugcugu

SEQ ID NO: 1916549 - RNA, 21 nt, Homo sapiens
uuugucucuaguugacuucaa

SEQ ID NO: 1916550 - RNA, 15 nt, Homo sapiens
ucccucaucaaggac

SEQ ID NO: 1916551 - RNA, 14 nt, Homo sapiens
gucagcaucugacc

SEQ ID NO: 1916552 - RNA, 22 nt, Homo sapiens
ugcagccucuugggugcuucuc

SEQ ID NO: 1916553 - RNA, 17 nt, Homo sapiens
cucucccucucuuaggg

SEQ ID NO: 1916554 - RNA, 22 nt, Homo sapiens
aggauggagagcagccagcacc

SEQ ID NO: 1916555 - RNA, 19 nt, Homo sapiens
uccacugauggaaacaaag

SEQ ID NO: 1916556 - RNA, 17 nt, Homo sapiens
aggaucuuuugaaccca

SEQ ID NO: 1916557 - RNA, 16 nt, Homo sapiens
cugaccccagugguau

SEQ ID NO: 1916558 - RNA, 16 nt, Homo sapiens
caucacaagaaaguca

SEQ ID NO: 1916559 - RNA, 19 nt, Homo sapiens
auuauuuagucaacauaua

SEQ ID NO: 1916560 - RNA, 18 nt, Homo sapiens
cuacuuuuugcaccuuau

SEQ ID NO: 1916561 - RNA, 18 nt, Homo sapiens
aaagcccagcacuugaau

SEQ ID NO: 1916562 - RNA, 20 nt, Homo sapiens
gaaacccuacgaaagcacag

SEQ ID NO: 1916563 - RNA, 18 nt, Homo sapiens
aggcucacucacagaguc

SEQ ID NO: 1916564 - RNA, 17 nt, Homo sapiens
auuuguuccuggaguuu

SEQ ID NO: 1916565 - RNA, 15 nt, Homo sapiens
ccugacagaugucag

SEQ ID NO: 1916566 - RNA, 18 nt, Homo sapiens
aaugccugugaagcaguc

SEQ ID NO: 1916567 - RNA, 17 nt, Homo sapiens
ccagcggucccugcaga

SEQ ID NO: 1916568 - RNA, 15 nt, Homo sapiens
ucccacggugcccaa

SEQ ID NO: 1916569 - RNA, 16 nt, Homo sapiens
aacccaguugcugauc

SEQ ID NO: 1916570 - RNA, 20 nt, Homo sapiens
ccaccaccaaaacugcuccu

SEQ ID NO: 1916571 - RNA, 21 nt, Homo sapiens
uaauauccuaaacaucauuca

SEQ ID NO: 1916572 - RNA, 16 nt, Homo sapiens
caaaaccccacuacac

SEQ ID NO: 1916573 - RNA, 16 nt, Homo sapiens
uguaguucugaguccu

SEQ ID NO: 1916574 - RNA, 15 nt, Homo sapiens
aaagaauuguuguaa

SEQ ID NO: 1916575 - RNA, 15 nt, Homo sapiens
aagcugugacuucuc

SEQ ID NO: 1916576 - RNA, 15 nt, Homo sapiens
gauguauuguugcuu

SEQ ID NO: 1916577 - RNA, 19 nt, Homo sapiens
gaugggagugggcaccuca

SEQ ID NO: 1916578 - RNA, 16 nt, Homo sapiens
cauuuuucaaagcaau

SEQ ID NO: 1916579 - RNA, 16 nt, Homo sapiens
gguacugaaagccuua

SEQ ID NO: 1916580 - RNA, 13 nt, Homo sapiens
ugcauguucuccu

SEQ ID NO: 1916581 - RNA, 18 nt, Homo sapiens
agcucuuuaacaugguuc

SEQ ID NO: 1916582 - RNA, 14 nt, Homo sapiens
uuacucagcccagc

SEQ ID NO: 1916583 - RNA, 21 nt, Homo sapiens
aaguuguucaaacauuuacca

SEQ ID NO: 1916584 - RNA, 20 nt, Homo sapiens
aaccucaaacuaggaggaaa

SEQ ID NO: 1916585 - RNA, 15 nt, Homo sapiens
guugugaagguugua

SEQ ID NO: 1916586 - RNA, 21 nt, Homo sapiens
gccuuccgacaccacugggaa

SEQ ID NO: 1916587 - RNA, 18 nt, Homo sapiens
ggccaguaaucccaguga

SEQ ID NO: 1916588 - RNA, 19 nt, Homo sapiens
cuccuugcccucaagcaau

SEQ ID NO: 1916589 - RNA, 19 nt, Homo sapiens
gugguauuuuaacauagca

SEQ ID NO: 1916590 - RNA, 17 nt, Homo sapiens
auuuccacuacagugag

SEQ ID NO: 1916591 - RNA, 17 nt, Homo sapiens
ugacauauuaugccuga

SEQ ID NO: 1916592 - RNA, 13 nt, Homo sapiens
gugcagcauuaaa

SEQ ID NO: 1916593 - RNA, 17 nt, Homo sapiens
ccuuuaugcacccaaga

SEQ ID NO: 1916594 - RNA, 23 nt, Homo sapiens
aagauacuaauagaguacuuaau

SEQ ID NO: 1916595 - RNA, 15 nt, Homo sapiens
uguaagugggcccac

SEQ ID NO: 1916596 - RNA, 21 nt, Homo sapiens
ggaaagggagacgcccuuuca

SEQ ID NO: 1916597 - RNA, 17 nt, Homo sapiens
auuucaucaagauuaau

SEQ ID NO: 1916598 - RNA, 20 nt, Homo sapiens
ucaaaugaugaagaccaaag

SEQ ID NO: 1916599 - RNA, 17 nt, Homo sapiens
uuguuucuuaauuugga

SEQ ID NO: 1916600 - RNA, 16 nt, Homo sapiens
uguaaauauugcuaaa

SEQ ID NO: 1916601 - RNA, 20 nt, Homo sapiens
uccacuucuuaaugcuuucc

SEQ ID NO: 1916602 - RNA, 16 nt, Homo sapiens
aaaacuagcauuacau

SEQ ID NO: 1916603 - RNA, 20 nt, Homo sapiens
accucaggugagaagcagag

SEQ ID NO: 1916604 - RNA, 22 nt, Homo sapiens
gaaaaguuaugagggucagggc

SEQ ID NO: 1916605 - RNA, 20 nt, Homo sapiens
acacuguauauaaacauauc

SEQ ID NO: 1916606 - RNA, 23 nt, Homo sapiens
auggcauugaacugguucaugaa

SEQ ID NO: 1916607 - RNA, 15 nt, Homo sapiens
uacuucuucucauac

SEQ ID NO: 1916608 - RNA, 15 nt, Homo sapiens
caagcaauccuccua

SEQ ID NO: 1916609 - RNA, 23 nt, Homo sapiens
gagcucacaauaaaaauggcuca

SEQ ID NO: 1916610 - RNA, 16 nt, Homo sapiens
cuucauacacuguacc

SEQ ID NO: 1916611 - RNA, 15 nt, Homo sapiens
acaguuuauugauau

SEQ ID NO: 1916612 - RNA, 18 nt, Homo sapiens
ucaaaauccuuccaaaga

SEQ ID NO: 1916613 - RNA, 16 nt, Homo sapiens
uaaagugcugcaguau

SEQ ID NO: 1916614 - RNA, 20 nt, Homo sapiens
uaaaucuaggaugugaugau

SEQ ID NO: 1916615 - RNA, 22 nt, Homo sapiens
ugucagaaaaagcuagcacuaa

SEQ ID NO: 1916616 - RNA, 21 nt, Homo sapiens
ggagaaccaccauucacccaa

SEQ ID NO: 1916617 - RNA, 16 nt, Homo sapiens
aauaaugucucuguga

SEQ ID NO: 1916618 - RNA, 15 nt, Homo sapiens
aggucaagcccagga

SEQ ID NO: 1916619 - RNA, 14 nt, Homo sapiens
cgcaaauucgcaaa

SEQ ID NO: 1916620 - RNA, 22 nt, Homo sapiens
uguaugguguugauacgugugu

SEQ ID NO: 1916621 - RNA, 21 nt, Homo sapiens
aauauugugucauagaauuaa

SEQ ID NO: 1916622 - RNA, 14 nt, Homo sapiens
gucuuuggccagaa

SEQ ID NO: 1916623 - RNA, 12 nt, Homo sapiens
ucugccacuucc

SEQ ID NO: 1916624 - RNA, 19 nt, Homo sapiens
accuaaacccucugugaaa

SEQ ID NO: 1916625 - RNA, 13 nt, Homo sapiens
uggucaagcacuc

SEQ ID NO: 1916626 - RNA, 17 nt, Homo sapiens
ucaggccuucuuugguu

SEQ ID NO: 1916627 - RNA, 14 nt, Homo sapiens
aggagcgcaucuca

SEQ ID NO: 1916628 - RNA, 16 nt, Homo sapiens
gaaagcccucaugugc

SEQ ID NO: 1916629 - RNA, 14 nt, Homo sapiens
ggcuaaucuuucau

SEQ ID NO: 1916630 - RNA, 15 nt, Homo sapiens
uguaucaguggauuu

SEQ ID NO: 1916631 - RNA, 19 nt, Homo sapiens
agccugcacacaccugccu

SEQ ID NO: 1916632 - RNA, 23 nt, Homo sapiens
agcucuuauaugcagaacacauu

SEQ ID NO: 1916633 - RNA, 11 nt, Homo sapiens
cuuuuuugcca

SEQ ID NO: 1916634 - RNA, 17 nt, Homo sapiens
uaagagucauccagcuc

SEQ ID NO: 1916635 - RNA, 23 nt, Homo sapiens
ggcugacaccuaccaugcugcuu

SEQ ID NO: 1916636 - RNA, 16 nt, Homo sapiens
uucucaagugccuuaa

SEQ ID NO: 1916637 - RNA, 18 nt, Homo sapiens
uggguccuugaugccaga

SEQ ID NO: 1916638 - RNA, 22 nt, Homo sapiens
cagaguuggacuucuagacuca

SEQ ID NO: 1916639 - RNA, 20 nt, Homo sapiens
accagcuucccuacuccuac

SEQ ID NO: 1916640 - RNA, 20 nt, Homo sapiens
gggagaaacgaaaaccacaa

SEQ ID NO: 1916641 - RNA, 13 nt, Homo sapiens
cucuuuaacacau

SEQ ID NO: 1916642 - RNA, 13 nt, Homo sapiens
aaguauaaaugaa

SEQ ID NO: 1916643 - RNA, 19 nt, Homo sapiens
gcuccaguugucuauucau

SEQ ID NO: 1916644 - RNA, 9 nt, Homo sapiens
uucuuugau

SEQ ID NO: 1916645 - RNA, 17 nt, Homo sapiens
aacuuuugguaucuacu

SEQ ID NO: 1916646 - RNA, 14 nt, Homo sapiens
aaccacaguccuca

SEQ ID NO: 1916647 - RNA, 23 nt, Homo sapiens
gaagaaugaucagcaucugugau

SEQ ID NO: 1916648 - RNA, 20 nt, Homo sapiens
caucuccaaaucuugccauu

SEQ ID NO: 1916649 - RNA, 12 nt, Homo sapiens
ugguaugugaca

SEQ ID NO: 1916650 - RNA, 19 nt, Homo sapiens
aggguugccaguccugcaa

SEQ ID NO: 1916651 - RNA, 18 nt, Homo sapiens
guccugggagaaugcaga

SEQ ID NO: 1916652 - RNA, 14 nt, Homo sapiens
aaaugacauggaca

SEQ ID NO: 1916653 - RNA, 22 nt, Homo sapiens
cacacccagcccacuucugcca

SEQ ID NO: 1916654 - RNA, 14 nt, Homo sapiens
uuggcugcacuuga

SEQ ID NO: 1916655 - RNA, 17 nt, Homo sapiens
caugacagcaguguuaa

SEQ ID NO: 1916656 - RNA, 18 nt, Homo sapiens
guuucagcacuagccaaa

SEQ ID NO: 1916657 - RNA, 20 nt, Homo sapiens
cucaugccuguaaucccaac

SEQ ID NO: 1916658 - RNA, 16 nt, Homo sapiens
uugcuguaagcaccug

SEQ ID NO: 1916659 - RNA, 22 nt, Homo sapiens
agccagcuuacuagcacuuuga

SEQ ID NO: 1916660 - RNA, 19 nt, Homo sapiens
aguuguuuuauauguugcu

SEQ ID NO: 1916661 - RNA, 14 nt, Homo sapiens
cauugaaagugaaa

SEQ ID NO: 1916662 - RNA, 22 nt, Homo sapiens
acuuucuaaugauuauagauaa

SEQ ID NO: 1916663 - RNA, 21 nt, Homo sapiens
gucucugaagugaaacugcuu

SEQ ID NO: 1916664 - RNA, 12 nt, Homo sapiens
uguuugacaaaa

SEQ ID NO: 1916665 - RNA, 20 nt, Homo sapiens
uaugaaagacuuacaggccu

SEQ ID NO: 1916666 - RNA, 15 nt, Homo sapiens
gagaaaaacacacag

SEQ ID NO: 1916667 - RNA, 13 nt, Homo sapiens
cagcgcugcaguu

SEQ ID NO: 1916668 - RNA, 13 nt, Homo sapiens
agacucugagaug

SEQ ID NO: 1916669 - RNA, 17 nt, Homo sapiens
ugcuuugagaaaucuca

SEQ ID NO: 1916670 - RNA, 17 nt, Homo sapiens
ucagggcaugcuuuauu

SEQ ID NO: 1916671 - RNA, 14 nt, Homo sapiens
gcuccaugcaccuc

SEQ ID NO: 1916672 - RNA, 19 nt, Homo sapiens
auaguaaaaccaaccagcu

SEQ ID NO: 1916673 - RNA, 23 nt, Homo sapiens
gaagccacgguguucugugauau

SEQ ID NO: 1916674 - RNA, 18 nt, Homo sapiens
gaagugaaaaggcugccu

SEQ ID NO: 1916675 - RNA, 19 nt, Homo sapiens
agaaaugcugcuggccaaa

SEQ ID NO: 1916676 - RNA, 14 nt, Homo sapiens
aauaugucuuggaa

SEQ ID NO: 1916677 - RNA, 15 nt, Homo sapiens
ugccaccuucaaguu

SEQ ID NO: 1916678 - RNA, 23 nt, Homo sapiens
uagguccuuguuguuucuugccu

SEQ ID NO: 1916679 - RNA, 20 nt, Homo sapiens
augguuauuuagcuggccau

SEQ ID NO: 1916680 - RNA, 15 nt, Homo sapiens
gagcugucuccagga

SEQ ID NO: 1916681 - RNA, 15 nt, Homo sapiens
aaauuguuauuucaa

SEQ ID NO: 1916682 - RNA, 16 nt, Homo sapiens
uauguuuuauuguaau

SEQ ID NO: 1916683 - RNA, 13 nt, Homo sapiens
accuuguuucccu

SEQ ID NO: 1916684 - RNA, 21 nt, Homo sapiens
uuuuuaaagcacaugucucau

SEQ ID NO: 1916685 - RNA, 17 nt, Homo sapiens
ccaucuuaaauuucuaa

SEQ ID NO: 1916686 - RNA, 21 nt, Homo sapiens
auuuuuauaaaaaugagugcu

SEQ ID NO: 1916687 - RNA, 22 nt, Homo sapiens
uccacacacagcugggcugugg

SEQ ID NO: 1916688 - RNA, 22 nt, Homo sapiens
ccaaugcuuucucaugucucaa

SEQ ID NO: 1916689 - RNA, 13 nt, Homo sapiens
cuccaauggggcg

SEQ ID NO: 1916690 - RNA, 17 nt, Homo sapiens
ugcugaauucaccugug

SEQ ID NO: 1916691 - RNA, 23 nt, Homo sapiens
cugcagguuggaacuaugcagug

SEQ ID NO: 1916692 - RNA, 21 nt, Homo sapiens
ucucuacuccaugguucucaa

SEQ ID NO: 1916693 - RNA, 14 nt, Homo sapiens
uagggaucccucau

SEQ ID NO: 1916694 - RNA, 17 nt, Homo sapiens
uuauuagacaauuccau

SEQ ID NO: 1916695 - RNA, 19 nt, Homo sapiens
cuuaaauaauccucuaugu

SEQ ID NO: 1916696 - RNA, 19 nt, Homo sapiens
aaaaaauaaucaagugcau

SEQ ID NO: 1916697 - RNA, 16 nt, Homo sapiens
cucaucacauaaaagg

SEQ ID NO: 1916698 - RNA, 19 nt, Homo sapiens
cacuaagcuaauuccacac

SEQ ID NO: 1916699 - RNA, 23 nt, Homo sapiens
auggcccauuggagcaccugggc

SEQ ID NO: 1916700 - RNA, 13 nt, Homo sapiens
uucuuuugccaag

SEQ ID NO: 1916701 - RNA, 15 nt, Homo sapiens
agcgggcacagggca

SEQ ID NO: 1916702 - RNA, 20 nt, Homo sapiens
cugccuccauuucucuggga

SEQ ID NO: 1916703 - RNA, 14 nt, Homo sapiens
uccaaguguuauac

SEQ ID NO: 1916704 - RNA, 21 nt, Homo sapiens
ugucccugaaacuucaccagg

SEQ ID NO: 1916705 - RNA, 18 nt, Homo sapiens
cagugggacccacaguca

SEQ ID NO: 1916706 - RNA, 16 nt, Homo sapiens
aagaauuacauaugaa

SEQ ID NO: 1916707 - RNA, 19 nt, Homo sapiens
acaccuccgagacagucca

SEQ ID NO: 1916708 - RNA, 15 nt, Homo sapiens
ucccaccccuaccuc

SEQ ID NO: 1916709 - RNA, 17 nt, Homo sapiens
aguuuuauuauugcaau

SEQ ID NO: 1916710 - RNA, 22 nt, Homo sapiens
gauaagaccaccaccucagagu

SEQ ID NO: 1916711 - RNA, 22 nt, Homo sapiens
uggcugcagugacccagauauu

SEQ ID NO: 1916712 - RNA, 10 nt, Homo sapiens
uucacauucu

SEQ ID NO: 1916713 - RNA, 12 nt, Homo sapiens
aaccagacuuug

SEQ ID NO: 1916714 - RNA, 22 nt, Homo sapiens
agccaaagggacuggcagucug

SEQ ID NO: 1916715 - RNA, 16 nt, Homo sapiens
cuuuguagccuaaaga

SEQ ID NO: 1916716 - RNA, 17 nt, Homo sapiens
ccauuucuagccucuau

SEQ ID NO: 1916717 - RNA, 23 nt, Homo sapiens
auuugaggacaagauaccaaggc

SEQ ID NO: 1916718 - RNA, 19 nt, Homo sapiens
gacagaauguaucugugaa

SEQ ID NO: 1916719 - RNA, 14 nt, Homo sapiens
aggugucccugccu

SEQ ID NO: 1916720 - RNA, 18 nt, Homo sapiens
aaauauuccaagcuucau

SEQ ID NO: 1916721 - RNA, 22 nt, Homo sapiens
gaacuugcgaguccaaggccag

SEQ ID NO: 1916722 - RNA, 18 nt, Homo sapiens
ccaacccacgaggaccau

SEQ ID NO: 1916723 - RNA, 13 nt, Homo sapiens
aaucuuaucuuug

SEQ ID NO: 1916724 - RNA, 21 nt, Homo sapiens
acugccuucuccaucaugccc

SEQ ID NO: 1916725 - RNA, 15 nt, Homo sapiens
guuuuaaucuucuca

SEQ ID NO: 1916726 - RNA, 20 nt, Homo sapiens
ugucaccuuaaaauaagauu

SEQ ID NO: 1916727 - RNA, 15 nt, Homo sapiens
uguccauuugcaaau

SEQ ID NO: 1916728 - RNA, 15 nt, Homo sapiens
accaaaauacuccaa

SEQ ID NO: 1916729 - RNA, 16 nt, Homo sapiens
accugguccgugcacu

SEQ ID NO: 1916730 - RNA, 18 nt, Homo sapiens
ugagucaaucagccuuua

SEQ ID NO: 1916731 - RNA, 18 nt, Homo sapiens
auguuuauaaacugagag

SEQ ID NO: 1916732 - RNA, 12 nt, Homo sapiens
aaaaaugccaaa

SEQ ID NO: 1916733 - RNA, 16 nt, Homo sapiens
ucccugaacacucauc

SEQ ID NO: 1916734 - RNA, 16 nt, Homo sapiens
uaauauccacugcaau

SEQ ID NO: 1916735 - RNA, 15 nt, Homo sapiens
acauuuuuccaguaa

SEQ ID NO: 1916736 - RNA, 15 nt, Homo sapiens
auagauuucuauaaa

SEQ ID NO: 1916737 - RNA, 17 nt, Homo sapiens
uuguuacuguucuugcu

SEQ ID NO: 1916738 - RNA, 17 nt, Homo sapiens
cagagccucgcucuguu

SEQ ID NO: 1916739 - RNA, 12 nt, Homo sapiens
uauuaauuuugc

SEQ ID NO: 1916740 - RNA, 18 nt, Homo sapiens
uuguacuuuuuuuuacuu

SEQ ID NO: 1916741 - RNA, 17 nt, Homo sapiens
aucucuuugaucuacuu

SEQ ID NO: 1916742 - RNA, 12 nt, Homo sapiens
uucuucugcaac

SEQ ID NO: 1916743 - RNA, 21 nt, Homo sapiens
cugggguggggaccucaggcc

SEQ ID NO: 1916744 - RNA, 15 nt, Homo sapiens
aacaagcaguacgau

SEQ ID NO: 1916745 - RNA, 14 nt, Homo sapiens
auaccccauuugau

SEQ ID NO: 1916746 - RNA, 20 nt, Homo sapiens
gagucaucucaaccaucccc

SEQ ID NO: 1916747 - RNA, 16 nt, Homo sapiens
cugcaguuccugagua

SEQ ID NO: 1916748 - RNA, 16 nt, Homo sapiens
acacuuuaauguacau

SEQ ID NO: 1916749 - RNA, 20 nt, Homo sapiens
cuaaggcugaaaaugugcau

SEQ ID NO: 1916750 - RNA, 22 nt, Homo sapiens
ccuguguggaguuauucacucu

SEQ ID NO: 1916751 - RNA, 17 nt, Homo sapiens
ggagaccggccugccag

SEQ ID NO: 1916752 - RNA, 15 nt, Homo sapiens
uucuucuacugcuau

SEQ ID NO: 1916753 - RNA, 23 nt, Homo sapiens
cucacaccuguccuucucaggcu

SEQ ID NO: 1916754 - RNA, 17 nt, Homo sapiens
auccugccacccuguag

SEQ ID NO: 1916755 - RNA, 12 nt, Homo sapiens
uagacugugauu

SEQ ID NO: 1916756 - RNA, 14 nt, Homo sapiens
uaaucccagcacuu

SEQ ID NO: 1916757 - RNA, 13 nt, Homo sapiens
caguccuauuuag

SEQ ID NO: 1916758 - RNA, 16 nt, Homo sapiens
ucagaggaagacaucu

SEQ ID NO: 1916759 - RNA, 23 nt, Homo sapiens
ccaacugcugcuuaaaaugcaag

SEQ ID NO: 1916760 - RNA, 19 nt, Homo sapiens
cccugcgcaugaaccugga

SEQ ID NO: 1916761 - RNA, 20 nt, Homo sapiens
cugaucuuugccccugguau

SEQ ID NO: 1916762 - RNA, 21 nt, Homo sapiens
uuccagccguguuguagcuaa

SEQ ID NO: 1916763 - RNA, 22 nt, Homo sapiens
uuucagaggaggaaguacggag

SEQ ID NO: 1916764 - RNA, 21 nt, Homo sapiens
aaaagaccuacagacuaagaa

SEQ ID NO: 1916765 - RNA, 22 nt, Homo sapiens
auuagcucacugaaucuucacg

SEQ ID NO: 1916766 - RNA, 13 nt, Homo sapiens
acuagauguuaag

SEQ ID NO: 1916767 - RNA, 18 nt, Homo sapiens
aaccucuaugcaaucuga

SEQ ID NO: 1916768 - RNA, 16 nt, Homo sapiens
aacagacucgauucau

SEQ ID NO: 1916769 - RNA, 22 nt, Homo sapiens
uuuccaaucaacagcagugagu

SEQ ID NO: 1916770 - RNA, 13 nt, Homo sapiens
uauaccucuugaa

SEQ ID NO: 1916771 - RNA, 14 nt, Homo sapiens
agauacuuaugaaa

SEQ ID NO: 1916772 - RNA, 20 nt, Homo sapiens
gcaggaagcuugucacugga

SEQ ID NO: 1916773 - RNA, 20 nt, Homo sapiens
guggucauaucuagucacuu

SEQ ID NO: 1916774 - RNA, 13 nt, Homo sapiens
uaaaucuaugaag

SEQ ID NO: 1916775 - RNA, 20 nt, Homo sapiens
cacgucuuuucucauaucau

SEQ ID NO: 1916776 - RNA, 18 nt, Homo sapiens
gugggaguccacuuuccu

SEQ ID NO: 1916777 - RNA, 14 nt, Homo sapiens
aguggcgugaucuc

SEQ ID NO: 1916778 - RNA, 13 nt, Homo sapiens
ugcucuccugaca

SEQ ID NO: 1916779 - RNA, 17 nt, Homo sapiens
ccugccacccauuccau

SEQ ID NO: 1916780 - RNA, 13 nt, Homo sapiens
uggggaagaacag

SEQ ID NO: 1916781 - RNA, 16 nt, Homo sapiens
ugccgucuucacuucc

SEQ ID NO: 1916782 - RNA, 22 nt, Homo sapiens
cuaaauuuaagcuuaagccaua

SEQ ID NO: 1916783 - RNA, 12 nt, Homo sapiens
ggaguccacucc

SEQ ID NO: 1916784 - RNA, 23 nt, Homo sapiens
ucauuuucuggguguuuucuuaa

SEQ ID NO: 1916785 - RNA, 15 nt, Homo sapiens
ucaugauaaucuggg

SEQ ID NO: 1916786 - RNA, 17 nt, Homo sapiens
cauuaugcaaauggaga

SEQ ID NO: 1916787 - RNA, 19 nt, Homo sapiens
ucucuccccagaugugacu

SEQ ID NO: 1916788 - RNA, 15 nt, Homo sapiens
uggcggccaagugag

SEQ ID NO: 1916789 - RNA, 16 nt, Homo sapiens
uccuguguccauguga

SEQ ID NO: 1916790 - RNA, 20 nt, Homo sapiens
ggcuuaaacaacaccuccuc

SEQ ID NO: 1916791 - RNA, 22 nt, Homo sapiens
gcucuuuuauaacuugcauuac

SEQ ID NO: 1916792 - RNA, 14 nt, Homo sapiens
cacuguaugugaaa

SEQ ID NO: 1916793 - RNA, 17 nt, Homo sapiens
acgagggauuacuuugg

SEQ ID NO: 1916794 - RNA, 21 nt, Homo sapiens
ccauuguacccugcuguauaa

SEQ ID NO: 1916795 - RNA, 18 nt, Homo sapiens
ugcaccccaccagcaaua

SEQ ID NO: 1916796 - RNA, 18 nt, Homo sapiens
gacccuggaagcagggac

SEQ ID NO: 1916797 - RNA, 13 nt, Homo sapiens
cguccugacuaca

SEQ ID NO: 1916798 - RNA, 20 nt, Homo sapiens
ucugauggcugaagaaugua

SEQ ID NO: 1916799 - RNA, 14 nt, Homo sapiens
ucuggacuggaaag

SEQ ID NO: 1916800 - RNA, 17 nt, Homo sapiens
uccaggccccaucagca

SEQ ID NO: 1916801 - RNA, 15 nt, Homo sapiens
guuagaaaugcaaau

SEQ ID NO: 1916802 - RNA, 18 nt, Homo sapiens
gcacagaaagggcagcuu

SEQ ID NO: 1916803 - RNA, 13 nt, Homo sapiens
auuuuuaccaguc

SEQ ID NO: 1916804 - RNA, 13 nt, Homo sapiens
cugagugccugau

SEQ ID NO: 1916805 - RNA, 23 nt, Homo sapiens
uugaacuccugaccuugugaucc

SEQ ID NO: 1916806 - RNA, 21 nt, Homo sapiens
uuucuacuuuaaauuguggau

SEQ ID NO: 1916807 - RNA, 19 nt, Homo sapiens
gccaucugggccauucaga

SEQ ID NO: 1916808 - RNA, 17 nt, Homo sapiens
auuuaaaacacaguauu

SEQ ID NO: 1916809 - RNA, 16 nt, Homo sapiens
gaaacugcuuugacau

SEQ ID NO: 1916810 - RNA, 13 nt, Homo sapiens
ucaccuauuacau

SEQ ID NO: 1916811 - RNA, 19 nt, Homo sapiens
aaauacacacucaaaucaa

SEQ ID NO: 1916812 - RNA, 23 nt, Homo sapiens
uauacauguguguauauaugugu

SEQ ID NO: 1916813 - RNA, 18 nt, Homo sapiens
aaaagaugaggacucaga

SEQ ID NO: 1916814 - RNA, 15 nt, Homo sapiens
uacuucccucaggcc

SEQ ID NO: 1916815 - RNA, 17 nt, Homo sapiens
ucccagggcugaugcug

SEQ ID NO: 1916816 - RNA, 21 nt, Homo sapiens
caggacugcagagcagauggc

SEQ ID NO: 1916817 - RNA, 11 nt, Homo sapiens
ccauugcaaug

SEQ ID NO: 1916818 - RNA, 20 nt, Homo sapiens
ugcuggggcugaacaugccu

SEQ ID NO: 1916819 - RNA, 15 nt, Homo sapiens
ccaccaucaccagac

SEQ ID NO: 1916820 - RNA, 15 nt, Homo sapiens
uacauguaauccauc

SEQ ID NO: 1916821 - RNA, 17 nt, Homo sapiens
caaaauagcacauccac

SEQ ID NO: 1916822 - RNA, 19 nt, Homo sapiens
ugaggacugaagcuggggc

SEQ ID NO: 1916823 - RNA, 15 nt, Homo sapiens
caucagauaagacau

SEQ ID NO: 1916824 - RNA, 18 nt, Homo sapiens
gaacccgcucucccagac

SEQ ID NO: 1916825 - RNA, 19 nt, Homo sapiens
gacuuuuuuaaauguuugc

SEQ ID NO: 1916826 - RNA, 20 nt, Homo sapiens
aagccucuccagagaaguuu

SEQ ID NO: 1916827 - RNA, 14 nt, Homo sapiens
ccuuauccugcauu

SEQ ID NO: 1916828 - RNA, 14 nt, Homo sapiens
cugggagccagugu

SEQ ID NO: 1916829 - RNA, 14 nt, Homo sapiens
cgugggggcacuga

SEQ ID NO: 1916830 - RNA, 18 nt, Homo sapiens
aaauucaaaccaauucac

SEQ ID NO: 1916831 - RNA, 15 nt, Homo sapiens
cuacauuuacuuuaa

SEQ ID NO: 1916832 - RNA, 21 nt, Homo sapiens
aauccuaucacagucuacuga

SEQ ID NO: 1916833 - RNA, 16 nt, Homo sapiens
ccaggaaccucagggc

SEQ ID NO: 1916834 - RNA, 18 nt, Homo sapiens
guaucaugcccugugcaa

SEQ ID NO: 1916835 - RNA, 17 nt, Homo sapiens
cacaaaauaaugcaguu

SEQ ID NO: 1916836 - RNA, 21 nt, Homo sapiens
ugggaguuauaggucauggga

SEQ ID NO: 1916837 - RNA, 17 nt, Homo sapiens
cugcucugugccuggga

SEQ ID NO: 1916838 - RNA, 15 nt, Homo sapiens
cugcaccccaagaga

SEQ ID NO: 1916839 - RNA, 22 nt, Homo sapiens
aagaugguuuuauucuuugaga

SEQ ID NO: 1916840 - RNA, 15 nt, Homo sapiens
caaauuucaucuccu

SEQ ID NO: 1916841 - RNA, 22 nt, Homo sapiens
ggaaucuauuuucucauugcuc

SEQ ID NO: 1916842 - RNA, 20 nt, Homo sapiens
aagcaacauaaaacaaugaa

SEQ ID NO: 1916843 - RNA, 18 nt, Homo sapiens
cccaagcacuucacagcu

SEQ ID NO: 1916844 - RNA, 14 nt, Homo sapiens
ugguccaugcccac

SEQ ID NO: 1916845 - RNA, 18 nt, Homo sapiens
uagcuaggugacauauac

SEQ ID NO: 1916846 - RNA, 12 nt, Homo sapiens
caauaaauuaca

SEQ ID NO: 1916847 - RNA, 23 nt, Homo sapiens
ucaaaauucucauuuuucauuuc

SEQ ID NO: 1916848 - RNA, 17 nt, Homo sapiens
uguaaaucacauccuua

SEQ ID NO: 1916849 - RNA, 18 nt, Homo sapiens
uccucuuaauguuuccaa

SEQ ID NO: 1916850 - RNA, 18 nt, Homo sapiens
ucuuuaaguuuugauuaa

SEQ ID NO: 1916851 - RNA, 12 nt, Homo sapiens
guucauucaaaa

SEQ ID NO: 1916852 - RNA, 18 nt, Homo sapiens
cugccaggcccuuugcac

SEQ ID NO: 1916853 - RNA, 14 nt, Homo sapiens
uaccugggaauuua

SEQ ID NO: 1916854 - RNA, 21 nt, Homo sapiens
cauucuccuuguaaaagccua

SEQ ID NO: 1916855 - RNA, 14 nt, Homo sapiens
uuccagggauuuaa

SEQ ID NO: 1916856 - RNA, 17 nt, Homo sapiens
cucuaaagccaagcacu

SEQ ID NO: 1916857 - RNA, 23 nt, Homo sapiens
uaccaagaucacauaccagaguc

SEQ ID NO: 1916858 - RNA, 18 nt, Homo sapiens
auaccaggaccaguuuau

SEQ ID NO: 1916859 - RNA, 14 nt, Homo sapiens
uuucacuaccuauc

SEQ ID NO: 1916860 - RNA, 22 nt, Homo sapiens
aaaucaaggagucuucuaaugu

SEQ ID NO: 1916861 - RNA, 14 nt, Homo sapiens
uucuuucuguugaa

SEQ ID NO: 1916862 - RNA, 19 nt, Homo sapiens
acggagucucgcucuguca

SEQ ID NO: 1916863 - RNA, 20 nt, Homo sapiens
cuaugaaauaucaugcucca

SEQ ID NO: 1916864 - RNA, 23 nt, Homo sapiens
acaauacgugaaagaugcaagca

SEQ ID NO: 1916865 - RNA, 13 nt, Homo sapiens
uugaaggcuuuag

SEQ ID NO: 1916866 - RNA, 22 nt, Homo sapiens
gacagagucucgcuauugucac

SEQ ID NO: 1916867 - RNA, 13 nt, Homo sapiens
aaaccuccacugc

SEQ ID NO: 1916868 - RNA, 15 nt, Homo sapiens
agaaaaaacaggccc

SEQ ID NO: 1916869 - RNA, 13 nt, Homo sapiens
guuaccugcacac

SEQ ID NO: 1916870 - RNA, 14 nt, Homo sapiens
gugucuucaggggc

SEQ ID NO: 1916871 - RNA, 18 nt, Homo sapiens
ucaaagagcaauauucca

SEQ ID NO: 1916872 - RNA, 23 nt, Homo sapiens
gaggaaugugggcuauguaguca

SEQ ID NO: 1916873 - RNA, 11 nt, Homo sapiens
uaaaacaaaca

SEQ ID NO: 1916874 - RNA, 22 nt, Homo sapiens
caugaccaccccucucgccuca

SEQ ID NO: 1916875 - RNA, 21 nt, Homo sapiens
gugggccauggccaugguccc

SEQ ID NO: 1916876 - RNA, 20 nt, Homo sapiens
ucacaaaaaaaguaauugua

SEQ ID NO: 1916877 - RNA, 20 nt, Homo sapiens
uaauuguggaaccuagggaa

SEQ ID NO: 1916878 - RNA, 15 nt, Homo sapiens
gagcagcacuggggu

SEQ ID NO: 1916879 - RNA, 19 nt, Homo sapiens
uacagaaucaaaugcaauu

SEQ ID NO: 1916880 - RNA, 17 nt, Homo sapiens
gcucuucccuugcucau

SEQ ID NO: 1916881 - RNA, 16 nt, Homo sapiens
cccuuggagccaaugg

SEQ ID NO: 1916882 - RNA, 19 nt, Homo sapiens
uugaauuuuuugaaauggg

SEQ ID NO: 1916883 - RNA, 17 nt, Homo sapiens
uguugagcaucacagaa

SEQ ID NO: 1916884 - RNA, 15 nt, Homo sapiens
uacaccaacugcucu

SEQ ID NO: 1916885 - RNA, 18 nt, Homo sapiens
agguguucuaaucaaugu

SEQ ID NO: 1916886 - RNA, 21 nt, Homo sapiens
cagcugcugggacccaccucc

SEQ ID NO: 1916887 - RNA, 18 nt, Homo sapiens
aacagacccacauuggaa

SEQ ID NO: 1916888 - RNA, 20 nt, Homo sapiens
gacucaaagggagaggucuc

SEQ ID NO: 1916889 - RNA, 17 nt, Homo sapiens
cguggacucugcacaug

SEQ ID NO: 1916890 - RNA, 13 nt, Homo sapiens
cuguuuugcauau

SEQ ID NO: 1916891 - RNA, 13 nt, Homo sapiens
guccuuccugacc

SEQ ID NO: 1916892 - RNA, 22 nt, Homo sapiens
cagaaacagaggagagucccag

SEQ ID NO: 1916893 - RNA, 12 nt, Homo sapiens
uuuauucuuggu

SEQ ID NO: 1916894 - RNA, 21 nt, Homo sapiens
gccauccccaccuucaccucg

SEQ ID NO: 1916895 - RNA, 17 nt, Homo sapiens
uggccucaagugagcca

SEQ ID NO: 1916896 - RNA, 15 nt, Homo sapiens
aguguucugcugaga

SEQ ID NO: 1916897 - RNA, 14 nt, Homo sapiens
gguggcccugugcc

SEQ ID NO: 1916898 - RNA, 17 nt, Homo sapiens
cccaccagugacuuuuu

SEQ ID NO: 1916899 - RNA, 12 nt, Homo sapiens
aaaaaugacaga

SEQ ID NO: 1916900 - RNA, 16 nt, Homo sapiens
aaagcucauaauggaa

SEQ ID NO: 1916901 - RNA, 16 nt, Homo sapiens
cacauuucacugugau

SEQ ID NO: 1916902 - RNA, 23 nt, Homo sapiens
gccuggcccauagaaacaugaca

SEQ ID NO: 1916903 - RNA, 14 nt, Homo sapiens
uaaaaugauuuaca

SEQ ID NO: 1916904 - RNA, 14 nt, Homo sapiens
aauacuucucucuc

SEQ ID NO: 1916905 - RNA, 23 nt, Homo sapiens
uaugggcuggauauucgguaaua

SEQ ID NO: 1916906 - RNA, 20 nt, Homo sapiens
agcaguucucugccaaagcu

SEQ ID NO: 1916907 - RNA, 14 nt, Homo sapiens
cucuuggucuuccc

SEQ ID NO: 1916908 - RNA, 23 nt, Homo sapiens
aaauagggccucacucuguugcu

SEQ ID NO: 1916909 - RNA, 13 nt, Homo sapiens
auuucugcuuuca

SEQ ID NO: 1916910 - RNA, 13 nt, Homo sapiens
ccacccugcauuu

SEQ ID NO: 1916911 - RNA, 17 nt, Homo sapiens
gcuacuguaaugcugcc

SEQ ID NO: 1916912 - RNA, 21 nt, Homo sapiens
agccuuuccaagucacuagaa

SEQ ID NO: 1916913 - RNA, 15 nt, Homo sapiens
cugaaaagugcuuug

SEQ ID NO: 1916914 - RNA, 15 nt, Homo sapiens
gugaauuucuucacu

SEQ ID NO: 1916915 - RNA, 21 nt, Homo sapiens
cagauuccaggcgaugugcaa

SEQ ID NO: 1916916 - RNA, 18 nt, Homo sapiens
acguggggcagcacagag

SEQ ID NO: 1916917 - RNA, 21 nt, Homo sapiens
ucacuaccuuuauagcucauc

SEQ ID NO: 1916918 - RNA, 11 nt, Homo sapiens
agaggcccaag

SEQ ID NO: 1916919 - RNA, 17 nt, Homo sapiens
uagaagugccaucucaa

SEQ ID NO: 1916920 - RNA, 17 nt, Homo sapiens
uauaguaccacugcaca

SEQ ID NO: 1916921 - RNA, 18 nt, Homo sapiens
acauauguauacaugugc

SEQ ID NO: 1916922 - RNA, 19 nt, Homo sapiens
acucccaccacaggcauaa

SEQ ID NO: 1916923 - RNA, 18 nt, Homo sapiens
ugggaugaugccucauga

SEQ ID NO: 1916924 - RNA, 18 nt, Homo sapiens
cccucccuggcugugagc

SEQ ID NO: 1916925 - RNA, 23 nt, Homo sapiens
gagaugacaaaccauaacugaca

SEQ ID NO: 1916926 - RNA, 13 nt, Homo sapiens
uauaaauggaauc

SEQ ID NO: 1916927 - RNA, 18 nt, Homo sapiens
ugcuaaaagugcauuuaa

SEQ ID NO: 1916928 - RNA, 19 nt, Homo sapiens
guggcccuggcauccaaau

SEQ ID NO: 1916929 - RNA, 15 nt, Homo sapiens
cagaagauugcguag

SEQ ID NO: 1916930 - RNA, 19 nt, Homo sapiens
acaguguauguacuaagca

SEQ ID NO: 1916931 - RNA, 11 nt, Homo sapiens
ccaccagcugg

SEQ ID NO: 1916932 - RNA, 23 nt, Homo sapiens
ugcaagaucuuauuuauuaacua

SEQ ID NO: 1916933 - RNA, 21 nt, Homo sapiens
uaugccaagucccuggaaaag

SEQ ID NO: 1916934 - RNA, 19 nt, Homo sapiens
cagauuuccuaacucuggu

SEQ ID NO: 1916935 - RNA, 12 nt, Homo sapiens
uuucauucacuu

SEQ ID NO: 1916936 - RNA, 14 nt, Homo sapiens
auggcacugacaau

SEQ ID NO: 1916937 - RNA, 13 nt, Homo sapiens
ugcuucagaguuu

SEQ ID NO: 1916938 - RNA, 13 nt, Homo sapiens
uacaacagaauaa

SEQ ID NO: 1916939 - RNA, 13 nt, Homo sapiens
cugugacuccucc

SEQ ID NO: 1916940 - RNA, 14 nt, Homo sapiens
gucaauccugucau

SEQ ID NO: 1916941 - RNA, 16 nt, Homo sapiens
caccgagcgggugcaa

SEQ ID NO: 1916942 - RNA, 14 nt, Homo sapiens
ccuggccuggcacc

SEQ ID NO: 1916943 - RNA, 18 nt, Homo sapiens
ccaucucuuccuuuccaa

SEQ ID NO: 1916944 - RNA, 21 nt, Homo sapiens
gagccagcagggcugugaugg

SEQ ID NO: 1916945 - RNA, 17 nt, Homo sapiens
gcuuugccccacuggga

SEQ ID NO: 1916946 - RNA, 20 nt, Homo sapiens
auugucacagaugaagacau

SEQ ID NO: 1916947 - RNA, 20 nt, Homo sapiens
aauagcagaaaaaccaacau

SEQ ID NO: 1916948 - RNA, 22 nt, Homo sapiens
ucuauuuguauaucucaacaga

SEQ ID NO: 1916949 - RNA, 21 nt, Homo sapiens
aaguuuuguaaaagaaaucau

SEQ ID NO: 1916950 - RNA, 17 nt, Homo sapiens
gcugcauccccuuccag

SEQ ID NO: 1916951 - RNA, 18 nt, Homo sapiens
acagaggauuugcucugg

SEQ ID NO: 1916952 - RNA, 13 nt, Homo sapiens
uccacuacaguga

SEQ ID NO: 1916953 - RNA, 20 nt, Homo sapiens
aggcaagcugaaauuuuaga

SEQ ID NO: 1916954 - RNA, 20 nt, Homo sapiens
augcaauccuuccaaaugag

SEQ ID NO: 1916955 - RNA, 22 nt, Homo sapiens
uccaacccagccacgacugcca

SEQ ID NO: 1916956 - RNA, 23 nt, Homo sapiens
ucuguauuuuaauggaguggaua

SEQ ID NO: 1916957 - RNA, 23 nt, Homo sapiens
gucaucaauuaaaggcaaaggca

SEQ ID NO: 1916958 - RNA, 11 nt, Homo sapiens
uaacgcugaac

SEQ ID NO: 1916959 - RNA, 12 nt, Homo sapiens
agugagcacuag

SEQ ID NO: 1916960 - RNA, 12 nt, Homo sapiens
agaaagcacuua

SEQ ID NO: 1916961 - RNA, 17 nt, Homo sapiens
accacccaaaaucauaa

SEQ ID NO: 1916962 - RNA, 15 nt, Homo sapiens
ugaauaucuuccaca

SEQ ID NO: 1916963 - RNA, 21 nt, Homo sapiens
cgcccagucuggaaugcagug

SEQ ID NO: 1916964 - RNA, 20 nt, Homo sapiens
auuaaaaccuuaagaguucu

SEQ ID NO: 1916965 - RNA, 19 nt, Homo sapiens
ugagcaugcacacugagaa

SEQ ID NO: 1916966 - RNA, 23 nt, Homo sapiens
aggugacuacccuaguucaaaac

SEQ ID NO: 1916967 - RNA, 20 nt, Homo sapiens
gaggacacaggcagcuucca

SEQ ID NO: 1916968 - RNA, 23 nt, Homo sapiens
cggugccaaacccagccccugcg

SEQ ID NO: 1916969 - RNA, 20 nt, Homo sapiens
uuaugcuguuaaaacuacuu

SEQ ID NO: 1916970 - RNA, 21 nt, Homo sapiens
cagcugagaggcauccagaaa

SEQ ID NO: 1916971 - RNA, 23 nt, Homo sapiens
cuuuugcuacaguauauuuuaaa

SEQ ID NO: 1916972 - RNA, 19 nt, Homo sapiens
auagugaauggucucucuu

SEQ ID NO: 1916973 - RNA, 16 nt, Homo sapiens
cugcagucagcacaga

SEQ ID NO: 1916974 - RNA, 17 nt, Homo sapiens
ugcuuucagaugcaguu

SEQ ID NO: 1916975 - RNA, 21 nt, Homo sapiens
uccaccagcaucaccugccug

SEQ ID NO: 1916976 - RNA, 13 nt, Homo sapiens
ccuggucccccac

SEQ ID NO: 1916977 - RNA, 18 nt, Homo sapiens
aaaaggaaggcucuucuc

SEQ ID NO: 1916978 - RNA, 14 nt, Homo sapiens
agcugcacacaccu

SEQ ID NO: 1916979 - RNA, 21 nt, Homo sapiens
ucaggcagacaagagcugcug

SEQ ID NO: 1916980 - RNA, 21 nt, Homo sapiens
cugccacgagggcgacccggc

SEQ ID NO: 1916981 - RNA, 11 nt, Homo sapiens
uuucuauucac

SEQ ID NO: 1916982 - RNA, 19 nt, Homo sapiens
guugaaagcuuugaaauaa

SEQ ID NO: 1916983 - RNA, 21 nt, Homo sapiens
gagccaccaaacccggccuga

SEQ ID NO: 1916984 - RNA, 15 nt, Homo sapiens
accuuggcucugcca

SEQ ID NO: 1916985 - RNA, 20 nt, Homo sapiens
cuucccacuagccuagguca

SEQ ID NO: 1916986 - RNA, 22 nt, Homo sapiens
cccacaauugaacuuccaggaa

SEQ ID NO: 1916987 - RNA, 21 nt, Homo sapiens
ucaccaaggaaauauugagag

SEQ ID NO: 1916988 - RNA, 14 nt, Homo sapiens
uguugguucaucca

SEQ ID NO: 1916989 - RNA, 20 nt, Homo sapiens
gccucuucccacaccuguca

SEQ ID NO: 1916990 - RNA, 21 nt, Homo sapiens
caucauagccugcagccucau

SEQ ID NO: 1916991 - RNA, 16 nt, Homo sapiens
gcaaaaccuuaccuug

SEQ ID NO: 1916992 - RNA, 20 nt, Homo sapiens
uucagcuccagcucaccagc

SEQ ID NO: 1916993 - RNA, 16 nt, Homo sapiens
cuaagagucucuauua

SEQ ID NO: 1916994 - RNA, 14 nt, Homo sapiens
uuguugacugcuga

SEQ ID NO: 1916995 - RNA, 14 nt, Homo sapiens
cuauuuguuuucau

SEQ ID NO: 1916996 - RNA, 14 nt, Homo sapiens
uuauuagucuucaa

SEQ ID NO: 1916997 - RNA, 15 nt, Homo sapiens
cugagacccagagag

SEQ ID NO: 1916998 - RNA, 23 nt, Homo sapiens
acaugaaaaaaggacaauuucaa

SEQ ID NO: 1916999 - RNA, 17 nt, Homo sapiens
uuauaggcaugagccac

SEQ ID NO: 1917000 - RNA, 19 nt, Homo sapiens
gaguggacuuugcauuuua

SEQ ID NO: 1917001 - RNA, 19 nt, Homo sapiens
uaaaauuuucgacuugacu

SEQ ID NO: 1917002 - RNA, 15 nt, Homo sapiens
cuuuccuauuugcac

SEQ ID NO: 1917003 - RNA, 14 nt, Homo sapiens
aaugugugugccaa

SEQ ID NO: 1917004 - RNA, 14 nt, Homo sapiens
cugagagugaagug

SEQ ID NO: 1917005 - RNA, 18 nt, Homo sapiens
agaguauaaauaaccaau

SEQ ID NO: 1917006 - RNA, 20 nt, Homo sapiens
auuucucccagcucuagaca

SEQ ID NO: 1917007 - RNA, 21 nt, Homo sapiens
ccuaacacugggcugcagaga

SEQ ID NO: 1917008 - RNA, 24 nt, Homo sapiens
aguacucaguaacacagugcagua

SEQ ID NO: 1917009 - RNA, 15 nt, Homo sapiens
acuagauaacuuaaa

SEQ ID NO: 1917010 - RNA, 21 nt, Homo sapiens
ggcaggcuuagagucaggcau

SEQ ID NO: 1917011 - RNA, 15 nt, Homo sapiens
aaauauuucagugaa

SEQ ID NO: 1917012 - RNA, 15 nt, Homo sapiens
ccaacuaaaauuuga

SEQ ID NO: 1917013 - RNA, 16 nt, Homo sapiens
gcccuggcugacccca

SEQ ID NO: 1917014 - RNA, 22 nt, Homo sapiens
cucuuuuuguauuuugcaucug

SEQ ID NO: 1917015 - RNA, 18 nt, Homo sapiens
ccacaccuccacaguuca

SEQ ID NO: 1917016 - RNA, 21 nt, Homo sapiens
aaugucuucuguauucacuua

SEQ ID NO: 1917017 - RNA, 16 nt, Homo sapiens
gguaaaacauuacuua

SEQ ID NO: 1917018 - RNA, 23 nt, Homo sapiens
acagcuaaacccuucaacuaugc

SEQ ID NO: 1917019 - RNA, 16 nt, Homo sapiens
ugccuaauuccuggca

SEQ ID NO: 1917020 - RNA, 22 nt, Homo sapiens
cuucaaggucauuuacuuguac

SEQ ID NO: 1917021 - RNA, 16 nt, Homo sapiens
cagauauuuuguucuu

SEQ ID NO: 1917022 - RNA, 13 nt, Homo sapiens
augacacaucucu

SEQ ID NO: 1917023 - RNA, 16 nt, Homo sapiens
cacagcacuaauucaa

SEQ ID NO: 1917024 - RNA, 19 nt, Homo sapiens
aauucgguuggguaccaug

SEQ ID NO: 1917025 - RNA, 17 nt, Homo sapiens
auguuuggacacacugg

SEQ ID NO: 1917026 - RNA, 13 nt, Homo sapiens
agaagucuuccca

SEQ ID NO: 1917027 - RNA, 19 nt, Homo sapiens
cacugaaaugaccaagaca

SEQ ID NO: 1917028 - RNA, 20 nt, Homo sapiens
ccaguuuacauuuaggcauu

SEQ ID NO: 1917029 - RNA, 19 nt, Homo sapiens
uauccaauugcugcuugua

SEQ ID NO: 1917030 - RNA, 23 nt, Homo sapiens
ucuaaauuaaagagaaaauugag

SEQ ID NO: 1917031 - RNA, 12 nt, Homo sapiens
gaaguuacuuuu

SEQ ID NO: 1917032 - RNA, 12 nt, Homo sapiens
gauuuuacuuag

SEQ ID NO: 1917033 - RNA, 23 nt, Homo sapiens
cucagccgugcacucccuaagaa

SEQ ID NO: 1917034 - RNA, 20 nt, Homo sapiens
cagacauucauugucccuga

SEQ ID NO: 1917035 - RNA, 16 nt, Homo sapiens
gcacucugugggucug

SEQ ID NO: 1917036 - RNA, 13 nt, Homo sapiens
cuaauccuuaaaa

SEQ ID NO: 1917037 - RNA, 12 nt, Homo sapiens
ccaggaccaguc

SEQ ID NO: 1917038 - RNA, 17 nt, Homo sapiens
ugucuuuaaaagucauu

SEQ ID NO: 1917039 - RNA, 15 nt, Homo sapiens
gugaacugcaaccuc

SEQ ID NO: 1917040 - RNA, 15 nt, Homo sapiens
uucccuuuuaagcaa

SEQ ID NO: 1917041 - RNA, 17 nt, Homo sapiens
agcacagcacccauggg

SEQ ID NO: 1917042 - RNA, 19 nt, Homo sapiens
aguagagacaggauuucac

SEQ ID NO: 1917043 - RNA, 16 nt, Homo sapiens
caaggacaaccugccc

SEQ ID NO: 1917044 - RNA, 14 nt, Homo sapiens
uggaaauaaaguca

SEQ ID NO: 1917045 - RNA, 17 nt, Homo sapiens
ggcuuucccacuuccca

SEQ ID NO: 1917046 - RNA, 14 nt, Homo sapiens
auuuauaagcuagc

SEQ ID NO: 1917047 - RNA, 22 nt, Homo sapiens
guaacuguuuugguuuugcuca

SEQ ID NO: 1917048 - RNA, 16 nt, Homo sapiens
ccaggcuccagcacau

SEQ ID NO: 1917049 - RNA, 13 nt, Homo sapiens
auaauucaaacac

SEQ ID NO: 1917050 - RNA, 23 nt, Homo sapiens
aagcugcugaaugcauucagggg

SEQ ID NO: 1917051 - RNA, 17 nt, Homo sapiens
auggaugggggaacuca

SEQ ID NO: 1917052 - RNA, 14 nt, Homo sapiens
aaauauaguuugag

SEQ ID NO: 1917053 - RNA, 19 nt, Homo sapiens
uuuuacuggggauucuuga

SEQ ID NO: 1917054 - RNA, 15 nt, Homo sapiens
gacaugagccauuug

SEQ ID NO: 1917055 - RNA, 14 nt, Homo sapiens
ggcagaagcagcag

SEQ ID NO: 1917056 - RNA, 18 nt, Homo sapiens
aucuguugauaaauccau

SEQ ID NO: 1917057 - RNA, 17 nt, Homo sapiens
aaucauguguugcagcu

SEQ ID NO: 1917058 - RNA, 15 nt, Homo sapiens
cucuuccugugaucc

SEQ ID NO: 1917059 - RNA, 13 nt, Homo sapiens
acucaacaaccaa

SEQ ID NO: 1917060 - RNA, 23 nt, Homo sapiens
ugauugccaacaguggcuaauaa

SEQ ID NO: 1917061 - RNA, 20 nt, Homo sapiens
caguggucuccuucacauca

SEQ ID NO: 1917062 - RNA, 13 nt, Homo sapiens
cccaagcaggugg

SEQ ID NO: 1917063 - RNA, 14 nt, Homo sapiens
agcuguauauauua

SEQ ID NO: 1917064 - RNA, 14 nt, Homo sapiens
ggacauguccagga

SEQ ID NO: 1917065 - RNA, 17 nt, Homo sapiens
ugccucuuugcugcuuu

SEQ ID NO: 1917066 - RNA, 19 nt, Homo sapiens
uuugggggaaaauggcacu

SEQ ID NO: 1917067 - RNA, 20 nt, Homo sapiens
caaucugccuguaucucuca

SEQ ID NO: 1917068 - RNA, 22 nt, Homo sapiens
agccccugggcccaguaccuag

SEQ ID NO: 1917069 - RNA, 21 nt, Homo sapiens
uuuucaauaaaacuuuuccaa

SEQ ID NO: 1917070 - RNA, 21 nt, Homo sapiens
uauccugggagcacugcguuu

SEQ ID NO: 1917071 - RNA, 19 nt, Homo sapiens
acgugggcaaacaggcagu

SEQ ID NO: 1917072 - RNA, 17 nt, Homo sapiens
ugaccagagugggacca

SEQ ID NO: 1917073 - RNA, 23 nt, Homo sapiens
uugcagucucccagauguugcau

SEQ ID NO: 1917074 - RNA, 14 nt, Homo sapiens
aggcugugcaccua

SEQ ID NO: 1917075 - RNA, 18 nt, Homo sapiens
auuuuccaaugcacaguu

SEQ ID NO: 1917076 - RNA, 23 nt, Homo sapiens
gugaccccugaccucacugugac

SEQ ID NO: 1917077 - RNA, 13 nt, Homo sapiens
uaugcauacuaau

SEQ ID NO: 1917078 - RNA, 11 nt, Homo sapiens
auucugugacc

SEQ ID NO: 1917079 - RNA, 15 nt, Homo sapiens
ucugucuaccuggga

SEQ ID NO: 1917080 - RNA, 19 nt, Homo sapiens
cuguacuaacaaagccaaa

SEQ ID NO: 1917081 - RNA, 15 nt, Homo sapiens
uugcagucacuuuga

SEQ ID NO: 1917082 - RNA, 15 nt, Homo sapiens
ucugugauuaccucu

SEQ ID NO: 1917083 - RNA, 20 nt, Homo sapiens
aaauggguuucuugccuuaa

SEQ ID NO: 1917084 - RNA, 18 nt, Homo sapiens
aucugaagauacaugucu

SEQ ID NO: 1917085 - RNA, 14 nt, Homo sapiens
aacuacuaucucag

SEQ ID NO: 1917086 - RNA, 18 nt, Homo sapiens
guauguauccccacuuau

SEQ ID NO: 1917087 - RNA, 17 nt, Homo sapiens
ucagcggucuucaggca

SEQ ID NO: 1917088 - RNA, 13 nt, Homo sapiens
caagacagcauuu

SEQ ID NO: 1917089 - RNA, 13 nt, Homo sapiens
cuagacagcuuuu

SEQ ID NO: 1917090 - RNA, 20 nt, Homo sapiens
agcuugccaaaucuuugugu

SEQ ID NO: 1917091 - RNA, 17 nt, Homo sapiens
agcugcuacuagcucuu

SEQ ID NO: 1917092 - RNA, 17 nt, Homo sapiens
ccaaacacauaacaaua

SEQ ID NO: 1917093 - RNA, 22 nt, Homo sapiens
uauugauggccacuaagugugu

SEQ ID NO: 1917094 - RNA, 13 nt, Homo sapiens
gucuaauuuucac

SEQ ID NO: 1917095 - RNA, 14 nt, Homo sapiens
gaaagaaugcaaga

SEQ ID NO: 1917096 - RNA, 22 nt, Homo sapiens
uguauauuuuuaaagaauguua

SEQ ID NO: 1917097 - RNA, 21 nt, Homo sapiens
guucuuuauaaaaagugaaau

SEQ ID NO: 1917098 - RNA, 16 nt, Homo sapiens
gcuucaugccagguua

SEQ ID NO: 1917099 - RNA, 22 nt, Homo sapiens
acugcaagaaggagcucaguua

SEQ ID NO: 1917100 - RNA, 10 nt, Homo sapiens
ucccaaagag

SEQ ID NO: 1917101 - RNA, 15 nt, Homo sapiens
acuggcaauaaacuc

SEQ ID NO: 1917102 - RNA, 20 nt, Homo sapiens
auugugcuucgagugacuga

SEQ ID NO: 1917103 - RNA, 22 nt, Homo sapiens
auuccugaccuccgccauccac

SEQ ID NO: 1917104 - RNA, 15 nt, Homo sapiens
uaaaaagggaauuau

SEQ ID NO: 1917105 - RNA, 15 nt, Homo sapiens
uaggcuccagacagg

SEQ ID NO: 1917106 - RNA, 14 nt, Homo sapiens
uaaugaaacacagc

SEQ ID NO: 1917107 - RNA, 20 nt, Homo sapiens
ccaccaacagccacucagaa

SEQ ID NO: 1917108 - RNA, 20 nt, Homo sapiens
gugcccccacccccacccuc

SEQ ID NO: 1917109 - RNA, 17 nt, Homo sapiens
cagcaaugugccuucua

SEQ ID NO: 1917110 - RNA, 13 nt, Homo sapiens
ugaucauuucaaa

SEQ ID NO: 1917111 - RNA, 22 nt, Homo sapiens
gauauaaaugaaguauuaucug

SEQ ID NO: 1917112 - RNA, 18 nt, Homo sapiens
gcguuggucucugcauuu

SEQ ID NO: 1917113 - RNA, 22 nt, Homo sapiens
uagaagcugucugcguuuacuc

SEQ ID NO: 1917114 - RNA, 16 nt, Homo sapiens
gcuagguucagcuuuc

SEQ ID NO: 1917115 - RNA, 14 nt, Homo sapiens
gggugguacccucu

SEQ ID NO: 1917116 - RNA, 14 nt, Homo sapiens
auaucagcacauau

SEQ ID NO: 1917117 - RNA, 17 nt, Homo sapiens
ucuucacuccaaaaaga

SEQ ID NO: 1917118 - RNA, 21 nt, Homo sapiens
gcaugaaucacugugcucagc

SEQ ID NO: 1917119 - RNA, 19 nt, Homo sapiens
uugcugccuucacccugaa

SEQ ID NO: 1917120 - RNA, 15 nt, Homo sapiens
auacugaaacauuug

SEQ ID NO: 1917121 - RNA, 12 nt, Homo sapiens
cacacacgcacg

SEQ ID NO: 1917122 - RNA, 12 nt, Homo sapiens
cacgcacgcaca

SEQ ID NO: 1917123 - RNA, 23 nt, Homo sapiens
cagacccagcuuagaguucuucu

SEQ ID NO: 1917124 - RNA, 14 nt, Homo sapiens
aggaaagaucccaa

SEQ ID NO: 1917125 - RNA, 14 nt, Homo sapiens
aacagcaggccauc

SEQ ID NO: 1917126 - RNA, 20 nt, Homo sapiens
cuaauacccaguuacuuaug

SEQ ID NO: 1917127 - RNA, 14 nt, Homo sapiens
ccucagcuuugaua

SEQ ID NO: 1917128 - RNA, 13 nt, Homo sapiens
uuccuuacuuugg

SEQ ID NO: 1917129 - RNA, 16 nt, Homo sapiens
ugaaaugacauguucc

SEQ ID NO: 1917130 - RNA, 20 nt, Homo sapiens
aagucuacacugccuuugug

SEQ ID NO: 1917131 - RNA, 15 nt, Homo sapiens
uagcccuuacguccu

SEQ ID NO: 1917132 - RNA, 15 nt, Homo sapiens
ucuuacauaaucaca

SEQ ID NO: 1917133 - RNA, 17 nt, Homo sapiens
ugaaacaaacuacugug

SEQ ID NO: 1917134 - RNA, 22 nt, Homo sapiens
aaucuuaccagaugcuacugga

SEQ ID NO: 1917135 - RNA, 14 nt, Homo sapiens
cugaggccaucagg

SEQ ID NO: 1917136 - RNA, 15 nt, Homo sapiens
gacaucaagcucaag

SEQ ID NO: 1917137 - RNA, 23 nt, Homo sapiens
aacugaauucuggacagauuuaa

SEQ ID NO: 1917138 - RNA, 15 nt, Homo sapiens
aaaagccauguguau

SEQ ID NO: 1917139 - RNA, 23 nt, Homo sapiens
guaccuaaaauugcaacuucuaa

SEQ ID NO: 1917140 - RNA, 19 nt, Homo sapiens
caagugaucuguccaccuc

SEQ ID NO: 1917141 - RNA, 22 nt, Homo sapiens
acugucggccagagucuguuuc

SEQ ID NO: 1917142 - RNA, 16 nt, Homo sapiens
ucuaugacacaugcaa

SEQ ID NO: 1917143 - RNA, 20 nt, Homo sapiens
aagaugagcuuuucuaggcu

SEQ ID NO: 1917144 - RNA, 20 nt, Homo sapiens
cacagcaagacuccgucuca

SEQ ID NO: 1917145 - RNA, 14 nt, Homo sapiens
ucgcaggagucucu

SEQ ID NO: 1917146 - RNA, 22 nt, Homo sapiens
ugaacaaacccuuuaaaugggg

SEQ ID NO: 1917147 - RNA, 22 nt, Homo sapiens
agauggcaaaaucaucuuacau

SEQ ID NO: 1917148 - RNA, 20 nt, Homo sapiens
aucccugccacgcuguggcc

SEQ ID NO: 1917149 - RNA, 18 nt, Homo sapiens
aaguauuauuuauuugaa

SEQ ID NO: 1917150 - RNA, 19 nt, Homo sapiens
caaguugagcuaugacuua

SEQ ID NO: 1917151 - RNA, 14 nt, Homo sapiens
auuaagugacuaua

SEQ ID NO: 1917152 - RNA, 14 nt, Homo sapiens
ccccuaugcuccag

SEQ ID NO: 1917153 - RNA, 15 nt, Homo sapiens
auccaggcagggaua

SEQ ID NO: 1917154 - RNA, 23 nt, Homo sapiens
uagcugucuccaaaaaugcuauu

SEQ ID NO: 1917155 - RNA, 11 nt, Homo sapiens
uguacuacccc

SEQ ID NO: 1917156 - RNA, 11 nt, Homo sapiens
ccugugcagca

SEQ ID NO: 1917157 - RNA, 22 nt, Homo sapiens
uuuugcuaaaccuauuucacaa

SEQ ID NO: 1917158 - RNA, 12 nt, Homo sapiens
uugaugaugcag

SEQ ID NO: 1917159 - RNA, 17 nt, Homo sapiens
ggauaggagcuuccaga

SEQ ID NO: 1917160 - RNA, 21 nt, Homo sapiens
gaaacugccauugugaucauu

SEQ ID NO: 1917161 - RNA, 16 nt, Homo sapiens
aaaauuugagacuauu

SEQ ID NO: 1917162 - RNA, 22 nt, Homo sapiens
aacccuagaaauauauccugug

SEQ ID NO: 1917163 - RNA, 14 nt, Homo sapiens
aauggggcuuccau

SEQ ID NO: 1917164 - RNA, 19 nt, Homo sapiens
agggaaaggauggggacca

SEQ ID NO: 1917165 - RNA, 17 nt, Homo sapiens
uuggacugauaaucucu

SEQ ID NO: 1917166 - RNA, 17 nt, Homo sapiens
aagaucacaaagacaga

SEQ ID NO: 1917167 - RNA, 19 nt, Homo sapiens
cacucuagggcaguggagu

SEQ ID NO: 1917168 - RNA, 17 nt, Homo sapiens
cuguccacugggccauu

SEQ ID NO: 1917169 - RNA, 19 nt, Homo sapiens
uagaacuuacuauucauua

SEQ ID NO: 1917170 - RNA, 14 nt, Homo sapiens
acaaaauuaugcaa

SEQ ID NO: 1917171 - RNA, 17 nt, Homo sapiens
cugagcuagugauuugc

SEQ ID NO: 1917172 - RNA, 17 nt, Homo sapiens
cccuuccucccauuucc

SEQ ID NO: 1917173 - RNA, 20 nt, Homo sapiens
cagagacaggcccaagagau

SEQ ID NO: 1917174 - RNA, 17 nt, Homo sapiens
gucccuguccccaccuc

SEQ ID NO: 1917175 - RNA, 19 nt, Homo sapiens
uuauuuugcaaaaguuccu

SEQ ID NO: 1917176 - RNA, 22 nt, Homo sapiens
acauucguuuuguucauauuca

SEQ ID NO: 1917177 - RNA, 16 nt, Homo sapiens
uuaaaggacauaaaau

SEQ ID NO: 1917178 - RNA, 16 nt, Homo sapiens
ugugaaaaaccugaug

SEQ ID NO: 1917179 - RNA, 19 nt, Homo sapiens
aauaucuuuaaaugaugua

SEQ ID NO: 1917180 - RNA, 14 nt, Homo sapiens
aguucugggcccag

SEQ ID NO: 1917181 - RNA, 18 nt, Homo sapiens
agguugcagugagccaaa

SEQ ID NO: 1917182 - RNA, 22 nt, Homo sapiens
cagguaugggacaggugccagg

SEQ ID NO: 1917183 - RNA, 22 nt, Homo sapiens
uuaaagaaaaugugucugcaac

SEQ ID NO: 1917184 - RNA, 18 nt, Homo sapiens
ucuuuucagaucauggca

SEQ ID NO: 1917185 - RNA, 19 nt, Homo sapiens
uuucguuaacauugaccaa

SEQ ID NO: 1917186 - RNA, 14 nt, Homo sapiens
ucagaucugagguu

SEQ ID NO: 1917187 - RNA, 20 nt, Homo sapiens
uacaaaaaugagcuaggcau

SEQ ID NO: 1917188 - RNA, 17 nt, Homo sapiens
caccugggguauggcau

SEQ ID NO: 1917189 - RNA, 15 nt, Homo sapiens
ucauuggcucuugaa

SEQ ID NO: 1917190 - RNA, 17 nt, Homo sapiens
uccuuugguccuucaaa

SEQ ID NO: 1917191 - RNA, 14 nt, Homo sapiens
gaaaccuacagaca

SEQ ID NO: 1917192 - RNA, 18 nt, Homo sapiens
uggacucuacacugugaa

SEQ ID NO: 1917193 - RNA, 22 nt, Homo sapiens
augugucccagccacaguguua

SEQ ID NO: 1917194 - RNA, 19 nt, Homo sapiens
ucacauucgaguguuucag

SEQ ID NO: 1917195 - RNA, 22 nt, Homo sapiens
auaagcucuccccaaacuugcu

SEQ ID NO: 1917196 - RNA, 23 nt, Homo sapiens
ggaggaugacuaacaagauuugu

SEQ ID NO: 1917197 - RNA, 11 nt, Homo sapiens
aaaucacuugu

SEQ ID NO: 1917198 - RNA, 22 nt, Homo sapiens
acuuccucaucaugaaaacugg

SEQ ID NO: 1917199 - RNA, 18 nt, Homo sapiens
cuguccucuuaagacacu

SEQ ID NO: 1917200 - RNA, 12 nt, Homo sapiens
ccuaaucuucca

SEQ ID NO: 1917201 - RNA, 18 nt, Homo sapiens
augcuuguauuuuacuuu

SEQ ID NO: 1917202 - RNA, 18 nt, Homo sapiens
gagaacuggaaagacaua

SEQ ID NO: 1917203 - RNA, 20 nt, Homo sapiens
aucuucauacaaugacaagu

SEQ ID NO: 1917204 - RNA, 19 nt, Homo sapiens
caaauauauaaugcaacaa

SEQ ID NO: 1917205 - RNA, 18 nt, Homo sapiens
uaacccaaugccugugaa

SEQ ID NO: 1917206 - RNA, 16 nt, Homo sapiens
acagaucaucuuggaa

SEQ ID NO: 1917207 - RNA, 21 nt, Homo sapiens
ucuagcauguaaggccuuuca

SEQ ID NO: 1917208 - RNA, 18 nt, Homo sapiens
aggccuggccucaucuca

SEQ ID NO: 1917209 - RNA, 23 nt, Homo sapiens
ucaacaaggggucaaugucauaa

SEQ ID NO: 1917210 - RNA, 18 nt, Homo sapiens
aaauucagcaaagugguu

SEQ ID NO: 1917211 - RNA, 14 nt, Homo sapiens
cauggcacugacaa

SEQ ID NO: 1917212 - RNA, 15 nt, Homo sapiens
aaauguuaugcaggc

SEQ ID NO: 1917213 - RNA, 17 nt, Homo sapiens
ucgggcgcgaccugcug

SEQ ID NO: 1917214 - RNA, 11 nt, Homo sapiens
cuuugucacaa

SEQ ID NO: 1917215 - RNA, 22 nt, Homo sapiens
agcugauuugauaccauggcac

SEQ ID NO: 1917216 - RNA, 21 nt, Homo sapiens
auucugccuugguucuggcca

SEQ ID NO: 1917217 - RNA, 16 nt, Homo sapiens
uacauuaaacaugacu

SEQ ID NO: 1917218 - RNA, 14 nt, Homo sapiens
cuuggcuaaggaaa

SEQ ID NO: 1917219 - RNA, 18 nt, Homo sapiens
aauuauuuaaaaugcaua

SEQ ID NO: 1917220 - RNA, 20 nt, Homo sapiens
aagaagucuuggaaacagac

SEQ ID NO: 1917221 - RNA, 20 nt, Homo sapiens
ugcaaaucagccaugugcug

SEQ ID NO: 1917222 - RNA, 23 nt, Homo sapiens
uuaagaucugacugccaaauaaa

SEQ ID NO: 1917223 - RNA, 21 nt, Homo sapiens
caaaaucucuccacuuucagc

SEQ ID NO: 1917224 - RNA, 19 nt, Homo sapiens
uaagauuccuuuugugaaa

SEQ ID NO: 1917225 - RNA, 23 nt, Homo sapiens
gacccgcacgccucuucccacac

SEQ ID NO: 1917226 - RNA, 23 nt, Homo sapiens
acucauagcgggggccuaaaaaa

SEQ ID NO: 1917227 - RNA, 14 nt, Homo sapiens
ccagcguaaaugac

SEQ ID NO: 1917228 - RNA, 16 nt, Homo sapiens
ucugcauuucauauua

SEQ ID NO: 1917229 - RNA, 17 nt, Homo sapiens
aucccuuaagaaguuag

SEQ ID NO: 1917230 - RNA, 18 nt, Homo sapiens
ccucucuguugaagucag

SEQ ID NO: 1917231 - RNA, 17 nt, Homo sapiens
guggagguugcagugag

SEQ ID NO: 1917232 - RNA, 20 nt, Homo sapiens
cuguccacuuggagcuaaaa

SEQ ID NO: 1917233 - RNA, 17 nt, Homo sapiens
acagucgagaagccagg

SEQ ID NO: 1917234 - RNA, 17 nt, Homo sapiens
ccauucuggacaccagg

SEQ ID NO: 1917235 - RNA, 16 nt, Homo sapiens
uuucugggcuacguga

SEQ ID NO: 1917236 - RNA, 12 nt, Homo sapiens
gaucgcaccuuu

SEQ ID NO: 1917237 - RNA, 14 nt, Homo sapiens
cugcauggcaucag

SEQ ID NO: 1917238 - RNA, 16 nt, Homo sapiens
ucuccauugcauucau

SEQ ID NO: 1917239 - RNA, 14 nt, Homo sapiens
uauugaaauucuau

SEQ ID NO: 1917240 - RNA, 20 nt, Homo sapiens
gagccgugaacugugcauag

SEQ ID NO: 1917241 - RNA, 14 nt, Homo sapiens
aaggggaaggaaga

SEQ ID NO: 1917242 - RNA, 21 nt, Homo sapiens
aauagcuuucaaaagaaauuu

SEQ ID NO: 1917243 - RNA, 16 nt, Homo sapiens
uauaauuagauuguga

SEQ ID NO: 1917244 - RNA, 13 nt, Homo sapiens
ccuuuuuguacug

SEQ ID NO: 1917245 - RNA, 23 nt, Homo sapiens
ggcgagccauuugucccaagugc

SEQ ID NO: 1917246 - RNA, 19 nt, Homo sapiens
auagcucuguaguggaaua

SEQ ID NO: 1917247 - RNA, 19 nt, Homo sapiens
aaugccugucucuagcugu

SEQ ID NO: 1917248 - RNA, 21 nt, Homo sapiens
cucuugugcccuucugagccc

SEQ ID NO: 1917249 - RNA, 12 nt, Homo sapiens
aggcugugcuag

SEQ ID NO: 1917250 - RNA, 22 nt, Homo sapiens
cacuagcauagagaauguguug

SEQ ID NO: 1917251 - RNA, 15 nt, Homo sapiens
uuccuuuucauuuaa

SEQ ID NO: 1917252 - RNA, 13 nt, Homo sapiens
cccaugaagccac

SEQ ID NO: 1917253 - RNA, 22 nt, Homo sapiens
ucaacacccgccccccccaugu

SEQ ID NO: 1917254 - RNA, 17 nt, Homo sapiens
uugcucuuuucaaugug

SEQ ID NO: 1917255 - RNA, 22 nt, Homo sapiens
cccgccgccugguacucaagcc

SEQ ID NO: 1917256 - RNA, 11 nt, Homo sapiens
aaaacauguaa

SEQ ID NO: 1917257 - RNA, 14 nt, Homo sapiens
ugugcaggcaccug

SEQ ID NO: 1917258 - RNA, 18 nt, Homo sapiens
gaauuuuguuuguugaug

SEQ ID NO: 1917259 - RNA, 18 nt, Homo sapiens
gcaggauguuggccacca

SEQ ID NO: 1917260 - RNA, 19 nt, Homo sapiens
uccccucuggagggcuaug

SEQ ID NO: 1917261 - RNA, 15 nt, Homo sapiens
uucaucuucuuccau

SEQ ID NO: 1917262 - RNA, 15 nt, Homo sapiens
acucaccucucucua

SEQ ID NO: 1917263 - RNA, 18 nt, Homo sapiens
gagacgguguuuugccau

SEQ ID NO: 1917264 - RNA, 15 nt, Homo sapiens
auuucggagcgcaau

SEQ ID NO: 1917265 - RNA, 16 nt, Homo sapiens
gaaaguaucaccaggg

SEQ ID NO: 1917266 - RNA, 17 nt, Homo sapiens
ggauauugucagucuuu

SEQ ID NO: 1917267 - RNA, 18 nt, Homo sapiens
gacaagucuguggcuugg

SEQ ID NO: 1917268 - RNA, 20 nt, Homo sapiens
augaugacucuucuuaucac

SEQ ID NO: 1917269 - RNA, 18 nt, Homo sapiens
gcacaaggccaucugggc

SEQ ID NO: 1917270 - RNA, 14 nt, Homo sapiens
gccucuacuuugau

SEQ ID NO: 1917271 - RNA, 17 nt, Homo sapiens
ugaaauauaaacuguga

SEQ ID NO: 1917272 - RNA, 21 nt, Homo sapiens
gacauuuuauuagggggauaa

SEQ ID NO: 1917273 - RNA, 21 nt, Homo sapiens
gcauaggucucuuugcuuucu

SEQ ID NO: 1917274 - RNA, 23 nt, Homo sapiens
uuuaagggcaugccuugugcugu

SEQ ID NO: 1917275 - RNA, 20 nt, Homo sapiens
gcgccacggcacuccagccu

SEQ ID NO: 1917276 - RNA, 17 nt, Homo sapiens
agaugaccucaaugccu

SEQ ID NO: 1917277 - RNA, 17 nt, Homo sapiens
uugcuuuuagcagauau

SEQ ID NO: 1917278 - RNA, 20 nt, Homo sapiens
ugaaguguuuucauauugcu

SEQ ID NO: 1917279 - RNA, 22 nt, Homo sapiens
guuuuagguggcauaguggcuu

SEQ ID NO: 1917280 - RNA, 19 nt, Homo sapiens
ucuguaauagugaacauau

SEQ ID NO: 1917281 - RNA, 22 nt, Homo sapiens
uuaguauuauuguugcauuaaa

SEQ ID NO: 1917282 - RNA, 19 nt, Homo sapiens
cagagguugcagugagcca

SEQ ID NO: 1917283 - RNA, 14 nt, Homo sapiens
uuaagcaucacaaa

SEQ ID NO: 1917284 - RNA, 16 nt, Homo sapiens
aaagcguaaaaggaga

SEQ ID NO: 1917285 - RNA, 15 nt, Homo sapiens
uagccuggugugauu

SEQ ID NO: 1917286 - RNA, 20 nt, Homo sapiens
cuaauaaauauuuagucugc

SEQ ID NO: 1917287 - RNA, 17 nt, Homo sapiens
ggauuugccugugccac

SEQ ID NO: 1917288 - RNA, 20 nt, Homo sapiens
auugaaggguggucaguagu

SEQ ID NO: 1917289 - RNA, 15 nt, Homo sapiens
ucauguuccucaaaa

SEQ ID NO: 1917290 - RNA, 18 nt, Homo sapiens
ucucaaggacacauuugg

SEQ ID NO: 1917291 - RNA, 14 nt, Homo sapiens
ucacuguacuugua

SEQ ID NO: 1917292 - RNA, 17 nt, Homo sapiens
ccaggacaaaaugcaaa

SEQ ID NO: 1917293 - RNA, 15 nt, Homo sapiens
caaaugcuuuggacu

SEQ ID NO: 1917294 - RNA, 15 nt, Homo sapiens
agcagaacuucugaa

SEQ ID NO: 1917295 - RNA, 15 nt, Homo sapiens
ugcacagcaucucag

SEQ ID NO: 1917296 - RNA, 22 nt, Homo sapiens
uggaggcacaacgcaccagaca

SEQ ID NO: 1917297 - RNA, 15 nt, Homo sapiens
aaauuauuuaucaag

SEQ ID NO: 1917298 - RNA, 17 nt, Homo sapiens
aaccuauguguccucua

SEQ ID NO: 1917299 - RNA, 21 nt, Homo sapiens
ugagcuuaagaauuuugagca

SEQ ID NO: 1917300 - RNA, 20 nt, Homo sapiens
acagugccuggcaaggccuc

SEQ ID NO: 1917301 - RNA, 19 nt, Homo sapiens
cacagauauacacauggau

SEQ ID NO: 1917302 - RNA, 13 nt, Homo sapiens
ugcuucugcuaaa

SEQ ID NO: 1917303 - RNA, 20 nt, Homo sapiens
auggaaacgaagcaccauca

SEQ ID NO: 1917304 - RNA, 18 nt, Homo sapiens
agaagaauaucgauauaa

SEQ ID NO: 1917305 - RNA, 13 nt, Homo sapiens
aaaugauucagcu

SEQ ID NO: 1917306 - RNA, 13 nt, Homo sapiens
auaugauucugcu

SEQ ID NO: 1917307 - RNA, 17 nt, Homo sapiens
ugugaacuccaucauuc

SEQ ID NO: 1917308 - RNA, 20 nt, Homo sapiens
gaccugccaggcacacugag

SEQ ID NO: 1917309 - RNA, 20 nt, Homo sapiens
caucucgcugccgucugucc

SEQ ID NO: 1917310 - RNA, 12 nt, Homo sapiens
agcacacuggcu

SEQ ID NO: 1917311 - RNA, 20 nt, Homo sapiens
gaaacgucccacacuuugaa

SEQ ID NO: 1917312 - RNA, 22 nt, Homo sapiens
cuggugaggagcacagcucagg

SEQ ID NO: 1917313 - RNA, 16 nt, Homo sapiens
gaacauaucauuugug

SEQ ID NO: 1917314 - RNA, 21 nt, Homo sapiens
cuucauauucagcuugcacau

SEQ ID NO: 1917315 - RNA, 22 nt, Homo sapiens
uucuacagugaauuuaaucaaa

SEQ ID NO: 1917316 - RNA, 15 nt, Homo sapiens
gaaauguaacauacu

SEQ ID NO: 1917317 - RNA, 17 nt, Homo sapiens
aaugaagaaaacagaua

SEQ ID NO: 1917318 - RNA, 18 nt, Homo sapiens
ucaagucuaaaccaagau

SEQ ID NO: 1917319 - RNA, 18 nt, Homo sapiens
acccucaggucacaagag

SEQ ID NO: 1917320 - RNA, 14 nt, Homo sapiens
acacagucucaguc

SEQ ID NO: 1917321 - RNA, 22 nt, Homo sapiens
guguggacuguggcacuugccu

SEQ ID NO: 1917322 - RNA, 17 nt, Homo sapiens
cuugggagccacugcca

SEQ ID NO: 1917323 - RNA, 18 nt, Homo sapiens
aucccaucugcauuugau

SEQ ID NO: 1917324 - RNA, 18 nt, Homo sapiens
ucuuuuuugucucaagau

SEQ ID NO: 1917325 - RNA, 20 nt, Homo sapiens
uagcaaggcugugcaucuag

SEQ ID NO: 1917326 - RNA, 22 nt, Homo sapiens
aacuucaagggacaaguauuaa

SEQ ID NO: 1917327 - RNA, 22 nt, Homo sapiens
gaagcugccguagcuucagcca

SEQ ID NO: 1917328 - RNA, 19 nt, Homo sapiens
aauucuuauggcugcugaa

SEQ ID NO: 1917329 - RNA, 16 nt, Homo sapiens
cugugagauaaccaca

SEQ ID NO: 1917330 - RNA, 18 nt, Homo sapiens
ugggcucucuucuguccc

SEQ ID NO: 1917331 - RNA, 23 nt, Homo sapiens
aaacuucugcuuuaauggcuuua

SEQ ID NO: 1917332 - RNA, 17 nt, Homo sapiens
ugagauaggaucacuug

SEQ ID NO: 1917333 - RNA, 22 nt, Homo sapiens
aaaugaauauucaacagcucac

SEQ ID NO: 1917334 - RNA, 12 nt, Homo sapiens
cuuucuccucag

SEQ ID NO: 1917335 - RNA, 19 nt, Homo sapiens
accaaaugcuuuuccucaa

SEQ ID NO: 1917336 - RNA, 14 nt, Homo sapiens
ucaauaagugccau

SEQ ID NO: 1917337 - RNA, 13 nt, Homo sapiens
aacuucaaagagg

SEQ ID NO: 1917338 - RNA, 23 nt, Homo sapiens
cugguccccuccucagugacauc

SEQ ID NO: 1917339 - RNA, 18 nt, Homo sapiens
acuugaaaaauauucaug

SEQ ID NO: 1917340 - RNA, 17 nt, Homo sapiens
caagacugagccagcuu

SEQ ID NO: 1917341 - RNA, 20 nt, Homo sapiens
cucacuaaaaauauacagcu

SEQ ID NO: 1917342 - RNA, 20 nt, Homo sapiens
cuuacagaaaauauagccau

SEQ ID NO: 1917343 - RNA, 21 nt, Homo sapiens
augcagcacgccaacauggca

SEQ ID NO: 1917344 - RNA, 14 nt, Homo sapiens
ucuuuauaaaccau

SEQ ID NO: 1917345 - RNA, 19 nt, Homo sapiens
cuuuaauucagguauguaa

SEQ ID NO: 1917346 - RNA, 20 nt, Homo sapiens
uaaauagggaaaaaacaugu

SEQ ID NO: 1917347 - RNA, 16 nt, Homo sapiens
gcuuaaaaucugugaa

SEQ ID NO: 1917348 - RNA, 22 nt, Homo sapiens
ccuggaguguaugacugcacau

SEQ ID NO: 1917349 - RNA, 16 nt, Homo sapiens
ccuagaccugggccaa

SEQ ID NO: 1917350 - RNA, 17 nt, Homo sapiens
gaaugaagucuuucccu

SEQ ID NO: 1917351 - RNA, 22 nt, Homo sapiens
gcugggaaaugagaugaccacu

SEQ ID NO: 1917352 - RNA, 17 nt, Homo sapiens
caaaagaauguccaaug

SEQ ID NO: 1917353 - RNA, 21 nt, Homo sapiens
aacaaaauuuacacauucauu

SEQ ID NO: 1917354 - RNA, 21 nt, Homo sapiens
cuuuuuuuuuuucugccugag

SEQ ID NO: 1917355 - RNA, 21 nt, Homo sapiens
caucacuuugugaauuaacac

SEQ ID NO: 1917356 - RNA, 19 nt, Homo sapiens
aaucucuauguauauucua

SEQ ID NO: 1917357 - RNA, 22 nt, Homo sapiens
ccugcugcgagacccggcucuc

SEQ ID NO: 1917358 - RNA, 15 nt, Homo sapiens
caauuauuuccccca

SEQ ID NO: 1917359 - RNA, 23 nt, Homo sapiens
aacuuccacauuauacauuugau

SEQ ID NO: 1917360 - RNA, 13 nt, Homo sapiens
cuccagcuccagu

SEQ ID NO: 1917361 - RNA, 21 nt, Homo sapiens
gaagcauccaaggaacuucau

SEQ ID NO: 1917362 - RNA, 19 nt, Homo sapiens
uuucauugaaauaauugau

SEQ ID NO: 1917363 - RNA, 14 nt, Homo sapiens
uugaaauaguugau

SEQ ID NO: 1917364 - RNA, 15 nt, Homo sapiens
gcugaggcaggagga

SEQ ID NO: 1917365 - RNA, 23 nt, Homo sapiens
uuuguacagaagaggauucaaaa

SEQ ID NO: 1917366 - RNA, 18 nt, Homo sapiens
aacagguguuggugacaa

SEQ ID NO: 1917367 - RNA, 16 nt, Homo sapiens
cuuggcgcugccccug

SEQ ID NO: 1917368 - RNA, 13 nt, Homo sapiens
uuccuaaguuuaa

SEQ ID NO: 1917369 - RNA, 17 nt, Homo sapiens
agccccgggaguggcgc

SEQ ID NO: 1917370 - RNA, 23 nt, Homo sapiens
cucuucugacauuuaucaggcac

SEQ ID NO: 1917371 - RNA, 12 nt, Homo sapiens
aguacuaaucau

SEQ ID NO: 1917372 - RNA, 14 nt, Homo sapiens
uagaacagugccug

SEQ ID NO: 1917373 - RNA, 16 nt, Homo sapiens
aaaacuacugauacuu

SEQ ID NO: 1917374 - RNA, 16 nt, Homo sapiens
ccaaucagagagccua

SEQ ID NO: 1917375 - RNA, 21 nt, Homo sapiens
gacaauaugugccaaucaaua

SEQ ID NO: 1917376 - RNA, 21 nt, Homo sapiens
ugaaagaacauggacuuguau

SEQ ID NO: 1917377 - RNA, 16 nt, Homo sapiens
uuugaaggucugcaag

SEQ ID NO: 1917378 - RNA, 18 nt, Homo sapiens
acuccuaaccucaaguga

SEQ ID NO: 1917379 - RNA, 19 nt, Homo sapiens
aauuagauauauauauuca

SEQ ID NO: 1917380 - RNA, 17 nt, Homo sapiens
uguuugagcgcagagua

SEQ ID NO: 1917381 - RNA, 13 nt, Homo sapiens
gggcagauucuga

SEQ ID NO: 1917382 - RNA, 19 nt, Homo sapiens
cucgcugacaucuggggcu

SEQ ID NO: 1917383 - RNA, 14 nt, Homo sapiens
augaucuuguguaa

SEQ ID NO: 1917384 - RNA, 21 nt, Homo sapiens
augacuucuuuacuaacacug

SEQ ID NO: 1917385 - RNA, 20 nt, Homo sapiens
ugaacuucuuugaauuuacu

SEQ ID NO: 1917386 - RNA, 15 nt, Homo sapiens
ugacugcaacuguau

SEQ ID NO: 1917387 - RNA, 13 nt, Homo sapiens
caauacagugaag

SEQ ID NO: 1917388 - RNA, 20 nt, Homo sapiens
augagagaaggaggggagca

SEQ ID NO: 1917389 - RNA, 18 nt, Homo sapiens
auuagauuucugaaucuc

SEQ ID NO: 1917390 - RNA, 13 nt, Homo sapiens
cacgaauccugac

SEQ ID NO: 1917391 - RNA, 16 nt, Homo sapiens
ucccaggcuucccaaa

SEQ ID NO: 1917392 - RNA, 14 nt, Homo sapiens
uacgaaccaugccu

SEQ ID NO: 1917393 - RNA, 19 nt, Homo sapiens
aaauauuuggauguuaaau

SEQ ID NO: 1917394 - RNA, 14 nt, Homo sapiens
cuuuaggcauuaaa

SEQ ID NO: 1917395 - RNA, 21 nt, Homo sapiens
uguagaagaagugaacacuua

SEQ ID NO: 1917396 - RNA, 15 nt, Homo sapiens
ccuagcuauaugcau

SEQ ID NO: 1917397 - RNA, 13 nt, Homo sapiens
caauuugccaguu

SEQ ID NO: 1917398 - RNA, 15 nt, Homo sapiens
aaguuauuacugucu

SEQ ID NO: 1917399 - RNA, 22 nt, Homo sapiens
uggcuuccaucucagcacucug

SEQ ID NO: 1917400 - RNA, 12 nt, Homo sapiens
ggaaaaauagca

SEQ ID NO: 1917401 - RNA, 20 nt, Homo sapiens
aggaauguggcugcaagcaa

SEQ ID NO: 1917402 - RNA, 15 nt, Homo sapiens
cugaugaaucacugu

SEQ ID NO: 1917403 - RNA, 21 nt, Homo sapiens
ucuuuucucccaccuccuucc

SEQ ID NO: 1917404 - RNA, 22 nt, Homo sapiens
uucucuugacguuuacauauau

SEQ ID NO: 1917405 - RNA, 22 nt, Homo sapiens
uaaugagagaaaauguuuugaa

SEQ ID NO: 1917406 - RNA, 18 nt, Homo sapiens
auacugcaugcucaggac

SEQ ID NO: 1917407 - RNA, 14 nt, Homo sapiens
ggcuuuccagcuua

SEQ ID NO: 1917408 - RNA, 14 nt, Homo sapiens
ugcccaagucccag

SEQ ID NO: 1917409 - RNA, 19 nt, Homo sapiens
aaaauggcacuugggggac

SEQ ID NO: 1917410 - RNA, 20 nt, Homo sapiens
auugaccuauuuccagaaau

SEQ ID NO: 1917411 - RNA, 13 nt, Homo sapiens
cuccuaccccuuc

SEQ ID NO: 1917412 - RNA, 14 nt, Homo sapiens
agccccucagagaa

SEQ ID NO: 1917413 - RNA, 13 nt, Homo sapiens
ucagacuugucaa

SEQ ID NO: 1917414 - RNA, 12 nt, Homo sapiens
uuggacucuaaa

SEQ ID NO: 1917415 - RNA, 21 nt, Homo sapiens
ugagauuaugaugaaaaccua

SEQ ID NO: 1917416 - RNA, 14 nt, Homo sapiens
uggaaauacauuua

SEQ ID NO: 1917417 - RNA, 23 nt, Homo sapiens
aauuauaauguugcccaguguga

SEQ ID NO: 1917418 - RNA, 16 nt, Homo sapiens
accauacucaaauggu

SEQ ID NO: 1917419 - RNA, 13 nt, Homo sapiens
uauaccuuacugc

SEQ ID NO: 1917420 - RNA, 23 nt, Homo sapiens
aauaaguuaaucaggaacuguac

SEQ ID NO: 1917421 - RNA, 15 nt, Homo sapiens
agaugugcauuucac

SEQ ID NO: 1917422 - RNA, 21 nt, Homo sapiens
gcucucccacaucccacugga

SEQ ID NO: 1917423 - RNA, 23 nt, Homo sapiens
cuaccaucuaaucuaugcaugua

SEQ ID NO: 1917424 - RNA, 14 nt, Homo sapiens
auuuauauuccuuu

SEQ ID NO: 1917425 - RNA, 18 nt, Homo sapiens
aacagggcaaccaauaaa

SEQ ID NO: 1917426 - RNA, 15 nt, Homo sapiens
cuaggccagagccau

SEQ ID NO: 1917427 - RNA, 13 nt, Homo sapiens
aaaccuucaguga

SEQ ID NO: 1917428 - RNA, 16 nt, Homo sapiens
ucuuggcuuugccaca

SEQ ID NO: 1917429 - RNA, 20 nt, Homo sapiens
cuccaguuuauagaccagaa

SEQ ID NO: 1917430 - RNA, 17 nt, Homo sapiens
uaaauguuugugauguu

SEQ ID NO: 1917431 - RNA, 22 nt, Homo sapiens
cucaguuccaaagucacaggaa

SEQ ID NO: 1917432 - RNA, 16 nt, Homo sapiens
aucaggcucugccuca

SEQ ID NO: 1917433 - RNA, 21 nt, Homo sapiens
gaugaucaaaaccugugccag

SEQ ID NO: 1917434 - RNA, 19 nt, Homo sapiens
cccuccauucauccuucca

SEQ ID NO: 1917435 - RNA, 14 nt, Homo sapiens
cucucccuuguaca

SEQ ID NO: 1917436 - RNA, 19 nt, Homo sapiens
auuaauuccuucagcacuu

SEQ ID NO: 1917437 - RNA, 20 nt, Homo sapiens
acucaaagagguaacugagg

SEQ ID NO: 1917438 - RNA, 22 nt, Homo sapiens
cucccagcuuucugugugcaca

SEQ ID NO: 1917439 - RNA, 15 nt, Homo sapiens
agguccccugcccug

SEQ ID NO: 1917440 - RNA, 21 nt, Homo sapiens
ucacaguguuuuuauugcucg

SEQ ID NO: 1917441 - RNA, 17 nt, Homo sapiens
aagaaucggcaguauuu

SEQ ID NO: 1917442 - RNA, 20 nt, Homo sapiens
cuaauauuuuguucugcaaa

SEQ ID NO: 1917443 - RNA, 22 nt, Homo sapiens
gauacaaauugcagacugugua

SEQ ID NO: 1917444 - RNA, 17 nt, Homo sapiens
ggccaagacuuggcaac

SEQ ID NO: 1917445 - RNA, 18 nt, Homo sapiens
agccucaccucauuccaa

SEQ ID NO: 1917446 - RNA, 14 nt, Homo sapiens
uacaaaacgagaua

SEQ ID NO: 1917447 - RNA, 14 nt, Homo sapiens
ggccagacuggcug

SEQ ID NO: 1917448 - RNA, 17 nt, Homo sapiens
uacuaguacuaugacac

SEQ ID NO: 1917449 - RNA, 14 nt, Homo sapiens
aaaauauauuucag

SEQ ID NO: 1917450 - RNA, 20 nt, Homo sapiens
gcuccaggacuccacuggac

SEQ ID NO: 1917451 - RNA, 18 nt, Homo sapiens
cuuugcuucucucucuaa

SEQ ID NO: 1917452 - RNA, 23 nt, Homo sapiens
aaugaaauuucggugacuggccc

SEQ ID NO: 1917453 - RNA, 11 nt, Homo sapiens
ccugaggaaug

SEQ ID NO: 1917454 - RNA, 14 nt, Homo sapiens
agguuuggacaaaa

SEQ ID NO: 1917455 - RNA, 17 nt, Homo sapiens
gccagguagcagcaaau

SEQ ID NO: 1917456 - RNA, 12 nt, Homo sapiens
agguccacagag

SEQ ID NO: 1917457 - RNA, 20 nt, Homo sapiens
uuuggaagggaaacuuucaa

SEQ ID NO: 1917458 - RNA, 18 nt, Homo sapiens
ccugccucaggcuucuga

SEQ ID NO: 1917459 - RNA, 22 nt, Homo sapiens
augucacagggccaacuugagg

SEQ ID NO: 1917460 - RNA, 22 nt, Homo sapiens
uaguaggagcugagcuuuccag

SEQ ID NO: 1917461 - RNA, 18 nt, Homo sapiens
cugcauggugacagucuc

SEQ ID NO: 1917462 - RNA, 17 nt, Homo sapiens
uuucaggaauugcccau

SEQ ID NO: 1917463 - RNA, 17 nt, Homo sapiens
uucaaggaaaaaugcug

SEQ ID NO: 1917464 - RNA, 10 nt, Homo sapiens
gacaccucac

SEQ ID NO: 1917465 - RNA, 13 nt, Homo sapiens
caguaacagugaa

SEQ ID NO: 1917466 - RNA, 15 nt, Homo sapiens
agcagcgccagugac

SEQ ID NO: 1917467 - RNA, 23 nt, Homo sapiens
ucguuacccauuucuuaccaugc

SEQ ID NO: 1917468 - RNA, 14 nt, Homo sapiens
ugugacugggaccu

SEQ ID NO: 1917469 - RNA, 13 nt, Homo sapiens
acaacaaccuaug

SEQ ID NO: 1917470 - RNA, 16 nt, Homo sapiens
augagggaaaaugagu

SEQ ID NO: 1917471 - RNA, 16 nt, Homo sapiens
gugucuccaugcacau

SEQ ID NO: 1917472 - RNA, 13 nt, Homo sapiens
uccugaucuguga

SEQ ID NO: 1917473 - RNA, 20 nt, Homo sapiens
cucuuccucucuuuugcuca

SEQ ID NO: 1917474 - RNA, 23 nt, Homo sapiens
cuaauuaaaaaacacaucuggcc

SEQ ID NO: 1917475 - RNA, 14 nt, Homo sapiens
aaauguaccugaga

SEQ ID NO: 1917476 - RNA, 18 nt, Homo sapiens
ugcaaggccgcuucgcca

SEQ ID NO: 1917477 - RNA, 23 nt, Homo sapiens
ucugccaggggcuucccacuuug

SEQ ID NO: 1917478 - RNA, 18 nt, Homo sapiens
uaaauucagaaagucaua

SEQ ID NO: 1917479 - RNA, 15 nt, Homo sapiens
guucagccugacccc

SEQ ID NO: 1917480 - RNA, 15 nt, Homo sapiens
uaaagaucuucugua

SEQ ID NO: 1917481 - RNA, 22 nt, Homo sapiens
auuuucaccuauccagagagua

SEQ ID NO: 1917482 - RNA, 14 nt, Homo sapiens
cuggcaugauccaa

SEQ ID NO: 1917483 - RNA, 16 nt, Homo sapiens
acaauaauuaaugugu

SEQ ID NO: 1917484 - RNA, 14 nt, Homo sapiens
agaaccugggcugu

SEQ ID NO: 1917485 - RNA, 22 nt, Homo sapiens
agcucauuugagauaaagucaa

SEQ ID NO: 1917486 - RNA, 15 nt, Homo sapiens
uauuguagucuugca

SEQ ID NO: 1917487 - RNA, 16 nt, Homo sapiens
uacauguauugcacau

SEQ ID NO: 1917488 - RNA, 22 nt, Homo sapiens
aacaggagcucuuaacuacagu

SEQ ID NO: 1917489 - RNA, 17 nt, Homo sapiens
aaucagaacuguuggca

SEQ ID NO: 1917490 - RNA, 15 nt, Homo sapiens
uagucaguugcucau

SEQ ID NO: 1917491 - RNA, 14 nt, Homo sapiens
agguuuuucuugcu

SEQ ID NO: 1917492 - RNA, 12 nt, Homo sapiens
auucucucugcu

SEQ ID NO: 1917493 - RNA, 19 nt, Homo sapiens
aauaucuccgucaacucau

SEQ ID NO: 1917494 - RNA, 12 nt, Homo sapiens
uggcacuugccu

SEQ ID NO: 1917495 - RNA, 14 nt, Homo sapiens
uuaaaccuuuccau

SEQ ID NO: 1917496 - RNA, 17 nt, Homo sapiens
uauacuuugccacugcu

SEQ ID NO: 1917497 - RNA, 18 nt, Homo sapiens
ugccaggggcaguuuuag

SEQ ID NO: 1917498 - RNA, 17 nt, Homo sapiens
agaaauuguuuuuaaca

SEQ ID NO: 1917499 - RNA, 18 nt, Homo sapiens
ucuuaguuaugugacgac

SEQ ID NO: 1917500 - RNA, 19 nt, Homo sapiens
gaaaucaaaccaccaggca

SEQ ID NO: 1917501 - RNA, 23 nt, Homo sapiens
caggccacuugccucaccugcug

SEQ ID NO: 1917502 - RNA, 13 nt, Homo sapiens
ccaacucugggaa

SEQ ID NO: 1917503 - RNA, 22 nt, Homo sapiens
uucaagguugguucaacaucua

SEQ ID NO: 1917504 - RNA, 17 nt, Homo sapiens
uucuacccucaucauca

SEQ ID NO: 1917505 - RNA, 13 nt, Homo sapiens
uuuggccucaaaa

SEQ ID NO: 1917506 - RNA, 19 nt, Homo sapiens
gccagcagggaagaucugg

SEQ ID NO: 1917507 - RNA, 21 nt, Homo sapiens
auuagaguuucaaccaugaag

SEQ ID NO: 1917508 - RNA, 14 nt, Homo sapiens
gguuauaugucuua

SEQ ID NO: 1917509 - RNA, 18 nt, Homo sapiens
acacuuggugcugggaac

SEQ ID NO: 1917510 - RNA, 19 nt, Homo sapiens
auguuuuacuuuucacagu

SEQ ID NO: 1917511 - RNA, 16 nt, Homo sapiens
uggggaaaagggcaau

SEQ ID NO: 1917512 - RNA, 21 nt, Homo sapiens
auuugauaccauggcacugac

SEQ ID NO: 1917513 - RNA, 19 nt, Homo sapiens
auaaauugccauaauauga

SEQ ID NO: 1917514 - RNA, 23 nt, Homo sapiens
cucaaaucugcuuucauccagcc

SEQ ID NO: 1917515 - RNA, 19 nt, Homo sapiens
cugugugguaacucagugu

SEQ ID NO: 1917516 - RNA, 13 nt, Homo sapiens
uccaaacacuggg

SEQ ID NO: 1917517 - RNA, 11 nt, Homo sapiens
cuguacagugu

SEQ ID NO: 1917518 - RNA, 20 nt, Homo sapiens
gccucauuuucacagcacua

SEQ ID NO: 1917519 - RNA, 15 nt, Homo sapiens
uaaauaaacaccaca

SEQ ID NO: 1917520 - RNA, 18 nt, Homo sapiens
ucauguuggggcucuucc

SEQ ID NO: 1917521 - RNA, 14 nt, Homo sapiens
cacaugggaucaag

SEQ ID NO: 1917522 - RNA, 21 nt, Homo sapiens
cuccaaaguuggagcuucuau

SEQ ID NO: 1917523 - RNA, 21 nt, Homo sapiens
cuccuggccucaagugaucug

SEQ ID NO: 1917524 - RNA, 18 nt, Homo sapiens
ugcagucacaucacaaua

SEQ ID NO: 1917525 - RNA, 18 nt, Homo sapiens
cacuucaguuuaaugucu

SEQ ID NO: 1917526 - RNA, 20 nt, Homo sapiens
caugggauugcacagagcug

SEQ ID NO: 1917527 - RNA, 16 nt, Homo sapiens
agcagacauuuaucuu

SEQ ID NO: 1917528 - RNA, 15 nt, Homo sapiens
caccagccacuuuag

SEQ ID NO: 1917529 - RNA, 20 nt, Homo sapiens
auccuagucuagcauucugc

SEQ ID NO: 1917530 - RNA, 17 nt, Homo sapiens
guaacuugggcuguaaa

SEQ ID NO: 1917531 - RNA, 23 nt, Homo sapiens
uuccacacagaaugcaaccaagu

SEQ ID NO: 1917532 - RNA, 16 nt, Homo sapiens
uuucauucaucaugaa

SEQ ID NO: 1917533 - RNA, 20 nt, Homo sapiens
auucaacaguaugcacaaaa

SEQ ID NO: 1917534 - RNA, 14 nt, Homo sapiens
auaggcacaggaaa

SEQ ID NO: 1917535 - RNA, 17 nt, Homo sapiens
cuccugccccacacucc

SEQ ID NO: 1917536 - RNA, 22 nt, Homo sapiens
augucugcuucuuccccagccu

SEQ ID NO: 1917537 - RNA, 18 nt, Homo sapiens
ucuagagucuagacagac

SEQ ID NO: 1917538 - RNA, 17 nt, Homo sapiens
caagugccacaugccua

SEQ ID NO: 1917539 - RNA, 20 nt, Homo sapiens
acauuaaacuaguguuauac

SEQ ID NO: 1917540 - RNA, 18 nt, Homo sapiens
ucaccaucauuucuagua

SEQ ID NO: 1917541 - RNA, 13 nt, Homo sapiens
uguggugugccau

SEQ ID NO: 1917542 - RNA, 15 nt, Homo sapiens
ugguuucacugagag

SEQ ID NO: 1917543 - RNA, 15 nt, Homo sapiens
uaugugaaauggcca

SEQ ID NO: 1917544 - RNA, 11 nt, Homo sapiens
cacgaggucag

SEQ ID NO: 1917545 - RNA, 14 nt, Homo sapiens
ucucaaagauuuga

SEQ ID NO: 1917546 - RNA, 23 nt, Homo sapiens
accaagccuuggcucuacccuga

SEQ ID NO: 1917547 - RNA, 17 nt, Homo sapiens
cccacuucugugccacc

SEQ ID NO: 1917548 - RNA, 14 nt, Homo sapiens
cuucacaguguuuc

SEQ ID NO: 1917549 - RNA, 13 nt, Homo sapiens
gaaagggagcuau

SEQ ID NO: 1917550 - RNA, 21 nt, Homo sapiens
uucaaucucguuuagugccaa

SEQ ID NO: 1917551 - RNA, 16 nt, Homo sapiens
cagaaggaaaugaugg

SEQ ID NO: 1917552 - RNA, 20 nt, Homo sapiens
gaugcugcugagcacaucuc

SEQ ID NO: 1917553 - RNA, 15 nt, Homo sapiens
cucgugagucauuua

SEQ ID NO: 1917554 - RNA, 12 nt, Homo sapiens
uaagggcacuga

SEQ ID NO: 1917555 - RNA, 14 nt, Homo sapiens
agauuuuccucucc

SEQ ID NO: 1917556 - RNA, 15 nt, Homo sapiens
gucuggggcuuuuag

SEQ ID NO: 1917557 - RNA, 21 nt, Homo sapiens
ccgauaucaaaaagacugugg

SEQ ID NO: 1917558 - RNA, 17 nt, Homo sapiens
uccucagaaaccaaagc

SEQ ID NO: 1917559 - RNA, 12 nt, Homo sapiens
aaaaaagauccc

SEQ ID NO: 1917560 - RNA, 20 nt, Homo sapiens
agccuggaagccauccugcc

SEQ ID NO: 1917561 - RNA, 15 nt, Homo sapiens
agcguagcuaaguga

SEQ ID NO: 1917562 - RNA, 12 nt, Homo sapiens
acaaaacuuccu

SEQ ID NO: 1917563 - RNA, 22 nt, Homo sapiens
uggagauggacaacucaaugaa

SEQ ID NO: 1917564 - RNA, 16 nt, Homo sapiens
aauuuucagauuugca

SEQ ID NO: 1917565 - RNA, 12 nt, Homo sapiens
cuccucacugug

SEQ ID NO: 1917566 - RNA, 15 nt, Homo sapiens
uuuuuguuccugccu

SEQ ID NO: 1917567 - RNA, 22 nt, Homo sapiens
uugccuuuuccuguaucuauuu

SEQ ID NO: 1917568 - RNA, 14 nt, Homo sapiens
uaguucuaucugaa

SEQ ID NO: 1917569 - RNA, 14 nt, Homo sapiens
ggggcugcuggccu

SEQ ID NO: 1917570 - RNA, 14 nt, Homo sapiens
gaggcagcuagcca

SEQ ID NO: 1917571 - RNA, 13 nt, Homo sapiens
uugugaugaacau

SEQ ID NO: 1917572 - RNA, 20 nt, Homo sapiens
caucaggauacucaaagugg

SEQ ID NO: 1917573 - RNA, 19 nt, Homo sapiens
acaacaaagcaugcucagu

SEQ ID NO: 1917574 - RNA, 20 nt, Homo sapiens
aggaggggguucuuccucac

SEQ ID NO: 1917575 - RNA, 16 nt, Homo sapiens
gaugugucuuaccaga

SEQ ID NO: 1917576 - RNA, 20 nt, Homo sapiens
uggugaacugagcugggcag

SEQ ID NO: 1917577 - RNA, 19 nt, Homo sapiens
ccuggcagguuguuagaaa

SEQ ID NO: 1917578 - RNA, 23 nt, Homo sapiens
aaaguuauuuuuaaaaacaacuu

SEQ ID NO: 1917579 - RNA, 11 nt, Homo sapiens
cgacuguaaau

SEQ ID NO: 1917580 - RNA, 21 nt, Homo sapiens
cuuaguucuucuccugccuaa

SEQ ID NO: 1917581 - RNA, 20 nt, Homo sapiens
ccugaagcguuuuucucaaa

SEQ ID NO: 1917582 - RNA, 16 nt, Homo sapiens
ugguaucuugcaguau

SEQ ID NO: 1917583 - RNA, 17 nt, Homo sapiens
cauucuucagugucucu

SEQ ID NO: 1917584 - RNA, 21 nt, Homo sapiens
cggugguucaugccuguaauc

SEQ ID NO: 1917585 - RNA, 13 nt, Homo sapiens
ccuuaacuguaua

SEQ ID NO: 1917586 - RNA, 18 nt, Homo sapiens
gcaaguacuuugucuuga

SEQ ID NO: 1917587 - RNA, 15 nt, Homo sapiens
ugagucaaugugcag

SEQ ID NO: 1917588 - RNA, 16 nt, Homo sapiens
augggggaaguauucc

SEQ ID NO: 1917589 - RNA, 19 nt, Homo sapiens
agcguuuaaaguacugagc

SEQ ID NO: 1917590 - RNA, 23 nt, Homo sapiens
uccuggugagaaaauauaugccu

SEQ ID NO: 1917591 - RNA, 16 nt, Homo sapiens
guuucuggugagccaa

SEQ ID NO: 1917592 - RNA, 20 nt, Homo sapiens
aauagaggugaugcugcuaa

SEQ ID NO: 1917593 - RNA, 22 nt, Homo sapiens
gacagauguuggugcaauacaa

SEQ ID NO: 1917594 - RNA, 22 nt, Homo sapiens
gacccagcugcagaccaugcca

SEQ ID NO: 1917595 - RNA, 13 nt, Homo sapiens
uagagguggcaug

SEQ ID NO: 1917596 - RNA, 17 nt, Homo sapiens
agaaaaaggcauuuuag

SEQ ID NO: 1917597 - RNA, 18 nt, Homo sapiens
ugcucuuugcugcacuau

SEQ ID NO: 1917598 - RNA, 18 nt, Homo sapiens
caacauuacaaacaaagg

SEQ ID NO: 1917599 - RNA, 13 nt, Homo sapiens
ugucgccaaaaau

SEQ ID NO: 1917600 - RNA, 16 nt, Homo sapiens
aucuccucuaucacau

SEQ ID NO: 1917601 - RNA, 16 nt, Homo sapiens
uaucaaguguauuuga

SEQ ID NO: 1917602 - RNA, 14 nt, Homo sapiens
aggaaacucuccau

SEQ ID NO: 1917603 - RNA, 16 nt, Homo sapiens
auggagcaaaccuagc

SEQ ID NO: 1917604 - RNA, 23 nt, Homo sapiens
uucaguuuuuguuuuuacuuuug

SEQ ID NO: 1917605 - RNA, 15 nt, Homo sapiens
acaaccacuuucuca

SEQ ID NO: 1917606 - RNA, 20 nt, Homo sapiens
uagaguuuacagcucugacu

SEQ ID NO: 1917607 - RNA, 18 nt, Homo sapiens
accaugugccaucuguac

SEQ ID NO: 1917608 - RNA, 16 nt, Homo sapiens
uccgucccucugucca

SEQ ID NO: 1917609 - RNA, 16 nt, Homo sapiens
cauuuuaccacuuuaa

SEQ ID NO: 1917610 - RNA, 17 nt, Homo sapiens
aaucagggaaacuaauu

SEQ ID NO: 1917611 - RNA, 15 nt, Homo sapiens
cuaaagcaugggauc

SEQ ID NO: 1917612 - RNA, 21 nt, Homo sapiens
ccccugccaguugaagugaga

SEQ ID NO: 1917613 - RNA, 16 nt, Homo sapiens
cucuacccacuaugca

SEQ ID NO: 1917614 - RNA, 16 nt, Homo sapiens
ucccagaaaggucucu

SEQ ID NO: 1917615 - RNA, 18 nt, Homo sapiens
gggagugcucaccgccuc

SEQ ID NO: 1917616 - RNA, 16 nt, Homo sapiens
gacuucuggcagggaa

SEQ ID NO: 1917617 - RNA, 18 nt, Homo sapiens
ugaagaccagccugggca

SEQ ID NO: 1917618 - RNA, 22 nt, Homo sapiens
ccuucuuuccagaggaugucuu

SEQ ID NO: 1917619 - RNA, 20 nt, Homo sapiens
aggaauuaaggguuacccca

SEQ ID NO: 1917620 - RNA, 15 nt, Homo sapiens
agagguaacuaucaa

SEQ ID NO: 1917621 - RNA, 14 nt, Homo sapiens
agacucaagacuua

SEQ ID NO: 1917622 - RNA, 13 nt, Homo sapiens
uuaagauauguga

SEQ ID NO: 1917623 - RNA, 14 nt, Homo sapiens
aaugcagagauaau

SEQ ID NO: 1917624 - RNA, 11 nt, Homo sapiens
aucacaccuca

SEQ ID NO: 1917625 - RNA, 17 nt, Homo sapiens
cugccugcaucuauucu

SEQ ID NO: 1917626 - RNA, 15 nt, Homo sapiens
acacugggacacugu

SEQ ID NO: 1917627 - RNA, 15 nt, Homo sapiens
ggcacuggggcacuu

SEQ ID NO: 1917628 - RNA, 12 nt, Homo sapiens
ccuaacaagccu

SEQ ID NO: 1917629 - RNA, 14 nt, Homo sapiens
aacugcugucaaua

SEQ ID NO: 1917630 - RNA, 23 nt, Homo sapiens
cagaaaugcaugaguaugugcac

SEQ ID NO: 1917631 - RNA, 20 nt, Homo sapiens
caacaagaacgauucaccug

SEQ ID NO: 1917632 - RNA, 19 nt, Homo sapiens
uguaggcagucauggcacc

SEQ ID NO: 1917633 - RNA, 17 nt, Homo sapiens
ugggauuuggagucaga

SEQ ID NO: 1917634 - RNA, 17 nt, Homo sapiens
uguaccaaaagaucucu

SEQ ID NO: 1917635 - RNA, 12 nt, Homo sapiens
uuaaagaaagaa

SEQ ID NO: 1917636 - RNA, 17 nt, Homo sapiens
auuuuauuggggggcaa

SEQ ID NO: 1917637 - RNA, 12 nt, Homo sapiens
aauacaauggga

SEQ ID NO: 1917638 - RNA, 15 nt, Homo sapiens
guauuagccagucau

SEQ ID NO: 1917639 - RNA, 18 nt, Homo sapiens
ugugcucuccaagcccag

SEQ ID NO: 1917640 - RNA, 17 nt, Homo sapiens
acauaaagaaacacuuu

SEQ ID NO: 1917641 - RNA, 22 nt, Homo sapiens
ccucaccuagccugaugagauu

SEQ ID NO: 1917642 - RNA, 17 nt, Homo sapiens
ugucaaagaaggugcug

SEQ ID NO: 1917643 - RNA, 19 nt, Homo sapiens
gaaucugguguuggggaaa

SEQ ID NO: 1917644 - RNA, 15 nt, Homo sapiens
aaguaguucuaugaa

SEQ ID NO: 1917645 - RNA, 16 nt, Homo sapiens
aucuccccucagauuc

SEQ ID NO: 1917646 - RNA, 17 nt, Homo sapiens
acagcaauggugucagu

SEQ ID NO: 1917647 - RNA, 20 nt, Homo sapiens
uaaaccuagaguuuuaucaa

SEQ ID NO: 1917648 - RNA, 15 nt, Homo sapiens
aagcuugucacugga

SEQ ID NO: 1917649 - RNA, 10 nt, Homo sapiens
gcagauucca

SEQ ID NO: 1917650 - RNA, 16 nt, Homo sapiens
caaagaugacuugaaa

SEQ ID NO: 1917651 - RNA, 17 nt, Homo sapiens
ugaaaccgcauuuuggg

SEQ ID NO: 1917652 - RNA, 12 nt, Homo sapiens
cuggacaugucc

SEQ ID NO: 1917653 - RNA, 16 nt, Homo sapiens
ugauuaccucucaauc

SEQ ID NO: 1917654 - RNA, 19 nt, Homo sapiens
guugauucauauugcauca

SEQ ID NO: 1917655 - RNA, 23 nt, Homo sapiens
cuaugaucuugagggcagacagc

SEQ ID NO: 1917656 - RNA, 20 nt, Homo sapiens
ucaagcuuagugagcaguga

SEQ ID NO: 1917657 - RNA, 23 nt, Homo sapiens
aacuuuuagugggugagaaauuu

SEQ ID NO: 1917658 - RNA, 15 nt, Homo sapiens
uuggugcucaauaaa

SEQ ID NO: 1917659 - RNA, 12 nt, Homo sapiens
ugaccuuuccag

SEQ ID NO: 1917660 - RNA, 20 nt, Homo sapiens
gaaucugaauguaauuugug

SEQ ID NO: 1917661 - RNA, 19 nt, Homo sapiens
cgccauaagcagaagauca

SEQ ID NO: 1917662 - RNA, 12 nt, Homo sapiens
acaauaaacccu

SEQ ID NO: 1917663 - RNA, 22 nt, Homo sapiens
cuuaggugugauuauaaaauca

SEQ ID NO: 1917664 - RNA, 17 nt, Homo sapiens
auuuugaugugacaaua

SEQ ID NO: 1917665 - RNA, 17 nt, Homo sapiens
ccuccgugcuuccucag

SEQ ID NO: 1917666 - RNA, 20 nt, Homo sapiens
gccucacaaaugcugugguu

SEQ ID NO: 1917667 - RNA, 20 nt, Homo sapiens
accaacacuuugguauucaa

SEQ ID NO: 1917668 - RNA, 22 nt, Homo sapiens
uuacccuaaagugcaaaaguga

SEQ ID NO: 1917669 - RNA, 13 nt, Homo sapiens
gaacuugcacaaa

SEQ ID NO: 1917670 - RNA, 13 nt, Homo sapiens
cccaggauccacu

SEQ ID NO: 1917671 - RNA, 16 nt, Homo sapiens
aggguaccuugaacac

SEQ ID NO: 1917672 - RNA, 20 nt, Homo sapiens
uccucguucaaaacauucca

SEQ ID NO: 1917673 - RNA, 15 nt, Homo sapiens
ucaugagaggaacua

SEQ ID NO: 1917674 - RNA, 20 nt, Homo sapiens
aaaugcuuucuuggccaggg

SEQ ID NO: 1917675 - RNA, 17 nt, Homo sapiens
aauaacauaacaaauaa

SEQ ID NO: 1917676 - RNA, 22 nt, Homo sapiens
uaccacacuagaauucauguga

SEQ ID NO: 1917677 - RNA, 14 nt, Homo sapiens
caggaauacugaac

SEQ ID NO: 1917678 - RNA, 19 nt, Homo sapiens
ucuuucaacuggguuuuca

SEQ ID NO: 1917679 - RNA, 14 nt, Homo sapiens
aaaaccuuacuuaa

SEQ ID NO: 1917680 - RNA, 18 nt, Homo sapiens
gacagggccagugcaguu

SEQ ID NO: 1917681 - RNA, 20 nt, Homo sapiens
aaugacugccggucauuuga

SEQ ID NO: 1917682 - RNA, 21 nt, Homo sapiens
cagcagcucaggcacacuucu

SEQ ID NO: 1917683 - RNA, 15 nt, Homo sapiens
ucaccuagcucaaug

SEQ ID NO: 1917684 - RNA, 13 nt, Homo sapiens
cugguuccaugcc

SEQ ID NO: 1917685 - RNA, 19 nt, Homo sapiens
acugugccuuugcaaauca

SEQ ID NO: 1917686 - RNA, 19 nt, Homo sapiens
uugauuugcauggauuuug

SEQ ID NO: 1917687 - RNA, 22 nt, Homo sapiens
aaacacuuauuuuacacagcaa

SEQ ID NO: 1917688 - RNA, 17 nt, Homo sapiens
uagauccagauccagac

SEQ ID NO: 1917689 - RNA, 17 nt, Homo sapiens
cucaauuuuauguauuc

SEQ ID NO: 1917690 - RNA, 19 nt, Homo sapiens
gauacagauccgcaugugu

SEQ ID NO: 1917691 - RNA, 22 nt, Homo sapiens
aggcccagggagggaaguguga

SEQ ID NO: 1917692 - RNA, 13 nt, Homo sapiens
cacuaagccaaga

SEQ ID NO: 1917693 - RNA, 20 nt, Homo sapiens
agcuguaauuucgccuuaaa

SEQ ID NO: 1917694 - RNA, 17 nt, Homo sapiens
guauccagaacaauaag

SEQ ID NO: 1917695 - RNA, 21 nt, Homo sapiens
ccuuugcucuugggaagacca

SEQ ID NO: 1917696 - RNA, 16 nt, Homo sapiens
uggguacaaaaaguca

SEQ ID NO: 1917697 - RNA, 14 nt, Homo sapiens
agaaaauugcacaa

SEQ ID NO: 1917698 - RNA, 12 nt, Homo sapiens
ggguuugagggu

SEQ ID NO: 1917699 - RNA, 22 nt, Homo sapiens
aggccucaaaugacaguagcau

SEQ ID NO: 1917700 - RNA, 13 nt, Homo sapiens
cuguacuauccag

SEQ ID NO: 1917701 - RNA, 15 nt, Homo sapiens
ugcacaaaguggcau

SEQ ID NO: 1917702 - RNA, 20 nt, Homo sapiens
cagcaaagccuccagcaucu

SEQ ID NO: 1917703 - RNA, 13 nt, Homo sapiens
caggacauucuca

SEQ ID NO: 1917704 - RNA, 16 nt, Homo sapiens
auuuucaaaaccagcu

SEQ ID NO: 1917705 - RNA, 22 nt, Homo sapiens
uggaguuuaauacagugagcuc

SEQ ID NO: 1917706 - RNA, 14 nt, Homo sapiens
uccuuuucugaaag

SEQ ID NO: 1917707 - RNA, 19 nt, Homo sapiens
cggugguucacgccuguaa

SEQ ID NO: 1917708 - RNA, 15 nt, Homo sapiens
auugccaucauucua

SEQ ID NO: 1917709 - RNA, 18 nt, Homo sapiens
caggugggagauuuggaa

SEQ ID NO: 1917710 - RNA, 15 nt, Homo sapiens
aggcagcagagcauu

SEQ ID NO: 1917711 - RNA, 16 nt, Homo sapiens
uuaucccuugacaaaa

SEQ ID NO: 1917712 - RNA, 15 nt, Homo sapiens
ucaguaacagugaag

SEQ ID NO: 1917713 - RNA, 20 nt, Homo sapiens
gcuuuugccugccugugcua

SEQ ID NO: 1917714 - RNA, 16 nt, Homo sapiens
gugaaguuuaaacucu

SEQ ID NO: 1917715 - RNA, 12 nt, Homo sapiens
gccaaaaggaaa

SEQ ID NO: 1917716 - RNA, 10 nt, Homo sapiens
aaugcucacc

SEQ ID NO: 1917717 - RNA, 15 nt, Homo sapiens
aacgguaugacuuaa

SEQ ID NO: 1917718 - RNA, 19 nt, Homo sapiens
caccuaauaauaguaauuc

SEQ ID NO: 1917719 - RNA, 18 nt, Homo sapiens
ucuggaaucuggagacca

SEQ ID NO: 1917720 - RNA, 17 nt, Homo sapiens
ugguuucuauacaugaa

SEQ ID NO: 1917721 - RNA, 19 nt, Homo sapiens
acaucuugcucugcugaca

SEQ ID NO: 1917722 - RNA, 12 nt, Homo sapiens
uuuucauuccau

SEQ ID NO: 1917723 - RNA, 13 nt, Homo sapiens
guuggcucaggag

SEQ ID NO: 1917724 - RNA, 22 nt, Homo sapiens
aaagaugcaaggaccaggacuc

SEQ ID NO: 1917725 - RNA, 19 nt, Homo sapiens
acaagauauuguacauaaa

SEQ ID NO: 1917726 - RNA, 22 nt, Homo sapiens
uaugcgcuuaaauuaagauuau

SEQ ID NO: 1917727 - RNA, 14 nt, Homo sapiens
guggauuccucccc

SEQ ID NO: 1917728 - RNA, 19 nt, Homo sapiens
gaggacauucucugaccua

SEQ ID NO: 1917729 - RNA, 23 nt, Homo sapiens
gcagcagcccuccccgcagcuag

SEQ ID NO: 1917730 - RNA, 14 nt, Homo sapiens
aacaaaaaccaaaa

SEQ ID NO: 1917731 - RNA, 19 nt, Homo sapiens
agcuggugguuucacggug

SEQ ID NO: 1917732 - RNA, 22 nt, Homo sapiens
gagaauuguagauaauacuguc

SEQ ID NO: 1917733 - RNA, 16 nt, Homo sapiens
cucauggagauggcag

SEQ ID NO: 1917734 - RNA, 22 nt, Homo sapiens
gaaaacacacuccuuugcuuag

SEQ ID NO: 1917735 - RNA, 17 nt, Homo sapiens
uugccaaucauugcaaa

SEQ ID NO: 1917736 - RNA, 15 nt, Homo sapiens
ugauugucaccauga

SEQ ID NO: 1917737 - RNA, 16 nt, Homo sapiens
ccaaaucccacagggc

SEQ ID NO: 1917738 - RNA, 20 nt, Homo sapiens
cuugcucaugcccugccaag

SEQ ID NO: 1917739 - RNA, 16 nt, Homo sapiens
acuagagcggcucuau

SEQ ID NO: 1917740 - RNA, 18 nt, Homo sapiens
uaugacauauagaauuaa

SEQ ID NO: 1917741 - RNA, 17 nt, Homo sapiens
gccuacucuuccaucuu

SEQ ID NO: 1917742 - RNA, 22 nt, Homo sapiens
ccagcaccgcugcucacucgga

SEQ ID NO: 1917743 - RNA, 23 nt, Homo sapiens
guacuauccaaucugugaugaca

SEQ ID NO: 1917744 - RNA, 13 nt, Homo sapiens
gagcagcugggau

SEQ ID NO: 1917745 - RNA, 16 nt, Homo sapiens
uagcccagcacuguga

SEQ ID NO: 1917746 - RNA, 13 nt, Homo sapiens
guguucagugccu

SEQ ID NO: 1917747 - RNA, 21 nt, Homo sapiens
uaaccuauucccaaaugccuu

SEQ ID NO: 1917748 - RNA, 23 nt, Homo sapiens
guuucucuuggguauaaaggcua

SEQ ID NO: 1917749 - RNA, 17 nt, Homo sapiens
auagucccagcuacuca

SEQ ID NO: 1917750 - RNA, 12 nt, Homo sapiens
cagugacauuua

SEQ ID NO: 1917751 - RNA, 21 nt, Homo sapiens
gcaaaaaaauuaaauuauuua

SEQ ID NO: 1917752 - RNA, 18 nt, Homo sapiens
gaagcggagagagccaag

SEQ ID NO: 1917753 - RNA, 23 nt, Homo sapiens
agaccucccucccuccccagugu

SEQ ID NO: 1917754 - RNA, 13 nt, Homo sapiens
cccacucuuugaa

SEQ ID NO: 1917755 - RNA, 13 nt, Homo sapiens
cuuuugugccaug

SEQ ID NO: 1917756 - RNA, 17 nt, Homo sapiens
aggaagggacuggucca

SEQ ID NO: 1917757 - RNA, 22 nt, Homo sapiens
acagagagugaauacacuggaa

SEQ ID NO: 1917758 - RNA, 22 nt, Homo sapiens
agggguggggguggaggcuucc

SEQ ID NO: 1917759 - RNA, 20 nt, Homo sapiens
gcugccccaaccugcugaag

SEQ ID NO: 1917760 - RNA, 18 nt, Homo sapiens
ccuagagcuagauguguc

SEQ ID NO: 1917761 - RNA, 15 nt, Homo sapiens
cuucuguuccagguu

SEQ ID NO: 1917762 - RNA, 16 nt, Homo sapiens
ugggaauacacuugca

SEQ ID NO: 1917763 - RNA, 14 nt, Homo sapiens
uacuuuauugcccu

SEQ ID NO: 1917764 - RNA, 15 nt, Homo sapiens
gauguacuaaaguag

SEQ ID NO: 1917765 - RNA, 16 nt, Homo sapiens
ccacaggcaugcacca

SEQ ID NO: 1917766 - RNA, 21 nt, Homo sapiens
ccugcuguucgugacucagaa

SEQ ID NO: 1917767 - RNA, 21 nt, Homo sapiens
uacauuguacaaggaaugaaa

SEQ ID NO: 1917768 - RNA, 14 nt, Homo sapiens
gacaauaaaccucc

SEQ ID NO: 1917769 - RNA, 18 nt, Homo sapiens
ucacaagaagaccagacu

SEQ ID NO: 1917770 - RNA, 11 nt, Homo sapiens
gaaauuacuua

SEQ ID NO: 1917771 - RNA, 13 nt, Homo sapiens
cuuaacaugcugu

SEQ ID NO: 1917772 - RNA, 20 nt, Homo sapiens
gcacuucuggaauacugaaa

SEQ ID NO: 1917773 - RNA, 23 nt, Homo sapiens
agucugaaagacagaaugucacc

SEQ ID NO: 1917774 - RNA, 18 nt, Homo sapiens
agacaaggucuugcuaug

SEQ ID NO: 1917775 - RNA, 12 nt, Homo sapiens
ucuugacuguua

SEQ ID NO: 1917776 - RNA, 23 nt, Homo sapiens
aaugugcuccuucauaagccauu

SEQ ID NO: 1917777 - RNA, 14 nt, Homo sapiens
agaaugcuucaagu

SEQ ID NO: 1917778 - RNA, 15 nt, Homo sapiens
ugaaacccugucucu

SEQ ID NO: 1917779 - RNA, 17 nt, Homo sapiens
cccuuagccuugcugua

SEQ ID NO: 1917780 - RNA, 18 nt, Homo sapiens
ucaacacuuaagucucag

SEQ ID NO: 1917781 - RNA, 13 nt, Homo sapiens
uaaucaugcucau

SEQ ID NO: 1917782 - RNA, 17 nt, Homo sapiens
aaaguauuagaaauauu

SEQ ID NO: 1917783 - RNA, 11 nt, Homo sapiens
cacuugcacau

SEQ ID NO: 1917784 - RNA, 13 nt, Homo sapiens
auagaagauccua

SEQ ID NO: 1917785 - RNA, 16 nt, Homo sapiens
ccuuguacccuggcua

SEQ ID NO: 1917786 - RNA, 15 nt, Homo sapiens
ggcuauuucuguguc

SEQ ID NO: 1917787 - RNA, 14 nt, Homo sapiens
cccugggcuggcac

SEQ ID NO: 1917788 - RNA, 20 nt, Homo sapiens
uugacuucuuugagaaugca

SEQ ID NO: 1917789 - RNA, 20 nt, Homo sapiens
cucugaguucugggguggga

SEQ ID NO: 1917790 - RNA, 23 nt, Homo sapiens
aacuguuucccuuugauucucca

SEQ ID NO: 1917791 - RNA, 13 nt, Homo sapiens
ucguacaguucuu

SEQ ID NO: 1917792 - RNA, 20 nt, Homo sapiens
acuugcauguauccauaccu

SEQ ID NO: 1917793 - RNA, 21 nt, Homo sapiens
aacagaguuuucuguugcauu

SEQ ID NO: 1917794 - RNA, 17 nt, Homo sapiens
cuucagaguacguccug

SEQ ID NO: 1917795 - RNA, 18 nt, Homo sapiens
auucagagaauagcaguu

SEQ ID NO: 1917796 - RNA, 16 nt, Homo sapiens
augggcccugcaagac

SEQ ID NO: 1917797 - RNA, 13 nt, Homo sapiens
cccacaugcaugu

SEQ ID NO: 1917798 - RNA, 21 nt, Homo sapiens
guccauguuuauccauguacu

SEQ ID NO: 1917799 - RNA, 16 nt, Homo sapiens
uuccaaauuugcuuua

SEQ ID NO: 1917800 - RNA, 15 nt, Homo sapiens
cuaacugcagaccau

SEQ ID NO: 1917801 - RNA, 15 nt, Homo sapiens
gcaugaaagcaguuu

SEQ ID NO: 1917802 - RNA, 16 nt, Homo sapiens
gcagaauuuuauguga

SEQ ID NO: 1917803 - RNA, 19 nt, Homo sapiens
uuucuggaaaguagaucuu

SEQ ID NO: 1917804 - RNA, 16 nt, Homo sapiens
cucagucccuacugag

SEQ ID NO: 1917805 - RNA, 23 nt, Homo sapiens
uacuaguggggcaaugacuuucc

SEQ ID NO: 1917806 - RNA, 17 nt, Homo sapiens
caaacucauuggcuuaa

SEQ ID NO: 1917807 - RNA, 13 nt, Homo sapiens
caagugguuucca

SEQ ID NO: 1917808 - RNA, 14 nt, Homo sapiens
uaaaagacuuugau

SEQ ID NO: 1917809 - RNA, 13 nt, Homo sapiens
uaccuggcagcua

SEQ ID NO: 1917810 - RNA, 19 nt, Homo sapiens
ucagaauaugucagugcug

SEQ ID NO: 1917811 - RNA, 20 nt, Homo sapiens
aaauuuggaaaggaccaaau

SEQ ID NO: 1917812 - RNA, 21 nt, Homo sapiens
cagcuaacauggaaguacuau

SEQ ID NO: 1917813 - RNA, 13 nt, Homo sapiens
uucuuuuauguga

SEQ ID NO: 1917814 - RNA, 22 nt, Homo sapiens
auugauacaugcauugcucuua

SEQ ID NO: 1917815 - RNA, 22 nt, Homo sapiens
gcuguuuuuaauccaguuuaga

SEQ ID NO: 1917816 - RNA, 15 nt, Homo sapiens
gcuuaggacuuucca

SEQ ID NO: 1917817 - RNA, 18 nt, Homo sapiens
uugaagacuuagugcugu

SEQ ID NO: 1917818 - RNA, 17 nt, Homo sapiens
uugaaaaagacauucag

SEQ ID NO: 1917819 - RNA, 21 nt, Homo sapiens
uuccaggggucaccuugagag

SEQ ID NO: 1917820 - RNA, 14 nt, Homo sapiens
gauuucuaccucag

SEQ ID NO: 1917821 - RNA, 22 nt, Homo sapiens
agcuggagcagcggauugcucu

SEQ ID NO: 1917822 - RNA, 12 nt, Homo sapiens
uuaucaccucau

SEQ ID NO: 1917823 - RNA, 16 nt, Homo sapiens
uauuuaccagaccaca

SEQ ID NO: 1917824 - RNA, 16 nt, Homo sapiens
ggaccaugcagggaga

SEQ ID NO: 1917825 - RNA, 19 nt, Homo sapiens
aaaugaccaaauccaugga

SEQ ID NO: 1917826 - RNA, 21 nt, Homo sapiens
caaaaacagcuggacuuauuu

SEQ ID NO: 1917827 - RNA, 22 nt, Homo sapiens
aucuugaaauuaagaaggcaaa

SEQ ID NO: 1917828 - RNA, 21 nt, Homo sapiens
uggugugcuuuucuaagcauu

SEQ ID NO: 1917829 - RNA, 18 nt, Homo sapiens
agagaacacagugcuauu

SEQ ID NO: 1917830 - RNA, 16 nt, Homo sapiens
uauauaaaauacauaa

SEQ ID NO: 1917831 - RNA, 13 nt, Homo sapiens
guacaacacuggu

SEQ ID NO: 1917832 - RNA, 15 nt, Homo sapiens
cuauucucaugccuc

SEQ ID NO: 1917833 - RNA, 17 nt, Homo sapiens
uccuuaguuggcuggaa

SEQ ID NO: 1917834 - RNA, 16 nt, Homo sapiens
ucuuucuacaguauua

SEQ ID NO: 1917835 - RNA, 13 nt, Homo sapiens
aacagugcuguaa

SEQ ID NO: 1917836 - RNA, 16 nt, Homo sapiens
ucaaugugaacacugg

SEQ ID NO: 1917837 - RNA, 17 nt, Homo sapiens
uuaauccaauauuuugc

SEQ ID NO: 1917838 - RNA, 23 nt, Homo sapiens
auuuaugguuucugcgugcuuua

SEQ ID NO: 1917839 - RNA, 12 nt, Homo sapiens
agacucugaccu

SEQ ID NO: 1917840 - RNA, 16 nt, Homo sapiens
uccuaagaaugugaug

SEQ ID NO: 1917841 - RNA, 14 nt, Homo sapiens
cuugcaaagcaacu

SEQ ID NO: 1917842 - RNA, 22 nt, Homo sapiens
agcgcuuuaaaagcgaccucuc

SEQ ID NO: 1917843 - RNA, 10 nt, Homo sapiens
cgaguacuuc

SEQ ID NO: 1917844 - RNA, 15 nt, Homo sapiens
ucagcggccccuuga

SEQ ID NO: 1917845 - RNA, 20 nt, Homo sapiens
aaucacacagccaagccagu

SEQ ID NO: 1917846 - RNA, 19 nt, Homo sapiens
gaauaaauacaaagcaaac

SEQ ID NO: 1917847 - RNA, 13 nt, Homo sapiens
ucucaggcugugc

SEQ ID NO: 1917848 - RNA, 20 nt, Homo sapiens
cuuuggauccugggucaaaa

SEQ ID NO: 1917849 - RNA, 18 nt, Homo sapiens
aaugugguuacuuccuac

SEQ ID NO: 1917850 - RNA, 19 nt, Homo sapiens
cuuggugcauaagcacaga

SEQ ID NO: 1917851 - RNA, 17 nt, Homo sapiens
cacuaaagauguuagua

SEQ ID NO: 1917852 - RNA, 11 nt, Homo sapiens
cuguggagcuc

SEQ ID NO: 1917853 - RNA, 20 nt, Homo sapiens
uaaacucacaacucucuggu

SEQ ID NO: 1917854 - RNA, 17 nt, Homo sapiens
uauagcggggccuuguc

SEQ ID NO: 1917855 - RNA, 18 nt, Homo sapiens
gucuucugggcacagugg

SEQ ID NO: 1917856 - RNA, 13 nt, Homo sapiens
agaggcugagaca

SEQ ID NO: 1917857 - RNA, 21 nt, Homo sapiens
guguggggcugccgaugggaa

SEQ ID NO: 1917858 - RNA, 17 nt, Homo sapiens
caucaagaaacauucag

SEQ ID NO: 1917859 - RNA, 18 nt, Homo sapiens
cagacuccuagacucacu

SEQ ID NO: 1917860 - RNA, 14 nt, Homo sapiens
gccugcagacucac

SEQ ID NO: 1917861 - RNA, 14 nt, Homo sapiens
ugguuucuuugcug

SEQ ID NO: 1917862 - RNA, 16 nt, Homo sapiens
ccauaaacacccauga

SEQ ID NO: 1917863 - RNA, 21 nt, Homo sapiens
cuuucagaacaaacauuaaau

SEQ ID NO: 1917864 - RNA, 13 nt, Homo sapiens
gaaucucuugccu

SEQ ID NO: 1917865 - RNA, 18 nt, Homo sapiens
guguugccaaaaccaaac

SEQ ID NO: 1917866 - RNA, 16 nt, Homo sapiens
uggagccugcaauaag

SEQ ID NO: 1917867 - RNA, 13 nt, Homo sapiens
gcuagagugcagu

SEQ ID NO: 1917868 - RNA, 13 nt, Homo sapiens
gcuggagugcaau

SEQ ID NO: 1917869 - RNA, 16 nt, Homo sapiens
gcaaugcagugcagca

SEQ ID NO: 1917870 - RNA, 16 nt, Homo sapiens
aggcaaauacaauaga

SEQ ID NO: 1917871 - RNA, 21 nt, Homo sapiens
acaaccacggucacaccucac

SEQ ID NO: 1917872 - RNA, 15 nt, Homo sapiens
uaguccagccuucca

SEQ ID NO: 1917873 - RNA, 22 nt, Homo sapiens
uggaggcuucugauacguguau

SEQ ID NO: 1917874 - RNA, 16 nt, Homo sapiens
uuucuaccacuggugu

SEQ ID NO: 1917875 - RNA, 18 nt, Homo sapiens
guuuauuuaaaaugccua

SEQ ID NO: 1917876 - RNA, 18 nt, Homo sapiens
uacuguaguaauuacucu

SEQ ID NO: 1917877 - RNA, 15 nt, Homo sapiens
agaacuugauuugca

SEQ ID NO: 1917878 - RNA, 20 nt, Homo sapiens
auuaccuuaaacuugcagua

SEQ ID NO: 1917879 - RNA, 20 nt, Homo sapiens
aacuacaguuagggcuccua

SEQ ID NO: 1917880 - RNA, 11 nt, Homo sapiens
uaucuuuucaa

SEQ ID NO: 1917881 - RNA, 22 nt, Homo sapiens
acuaugguucuccacuauggca

SEQ ID NO: 1917882 - RNA, 16 nt, Homo sapiens
ccuaaucucuguaaag

SEQ ID NO: 1917883 - RNA, 11 nt, Homo sapiens
gaccucacccu

SEQ ID NO: 1917884 - RNA, 15 nt, Homo sapiens
ugagugugugcaagu

SEQ ID NO: 1917885 - RNA, 15 nt, Homo sapiens
caagagagcacauga

SEQ ID NO: 1917886 - RNA, 18 nt, Homo sapiens
gcccauggcccugugcua

SEQ ID NO: 1917887 - RNA, 17 nt, Homo sapiens
gaagauucuauguuaau

SEQ ID NO: 1917888 - RNA, 21 nt, Homo sapiens
ugucuugaaaguggcaccaga

SEQ ID NO: 1917889 - RNA, 15 nt, Homo sapiens
auaaacucacaacuc

SEQ ID NO: 1917890 - RNA, 21 nt, Homo sapiens
gggaaggaaggcguguccagg

SEQ ID NO: 1917891 - RNA, 15 nt, Homo sapiens
cuuagaauacuguau

SEQ ID NO: 1917892 - RNA, 15 nt, Homo sapiens
aggcaggaguggcag

SEQ ID NO: 1917893 - RNA, 19 nt, Homo sapiens
ucaauuauacuaaaccuca

SEQ ID NO: 1917894 - RNA, 18 nt, Homo sapiens
gauaaauguaucaaucac

SEQ ID NO: 1917895 - RNA, 13 nt, Homo sapiens
ugagggacugccu

SEQ ID NO: 1917896 - RNA, 16 nt, Homo sapiens
guccagcaagugucau

SEQ ID NO: 1917897 - RNA, 13 nt, Homo sapiens
uucuuuugaacug

SEQ ID NO: 1917898 - RNA, 18 nt, Homo sapiens
ucuuugcaagaaagucag

SEQ ID NO: 1917899 - RNA, 21 nt, Homo sapiens
acugugucaggaaacauauuu

SEQ ID NO: 1917900 - RNA, 23 nt, Homo sapiens
agccacugugucuuaugaggaau

SEQ ID NO: 1917901 - RNA, 19 nt, Homo sapiens
uugcuuacagugaugccau

SEQ ID NO: 1917902 - RNA, 18 nt, Homo sapiens
agcuauccagugacuugu

SEQ ID NO: 1917903 - RNA, 16 nt, Homo sapiens
aacacaaauacggaag

SEQ ID NO: 1917904 - RNA, 23 nt, Homo sapiens
cuauaggugcuacaaaaacacag

SEQ ID NO: 1917905 - RNA, 17 nt, Homo sapiens
ucgcauuaagcacacac

SEQ ID NO: 1917906 - RNA, 13 nt, Homo sapiens
cauuugccaaacu

SEQ ID NO: 1917907 - RNA, 20 nt, Homo sapiens
gagacuugaaaccagaagaa

SEQ ID NO: 1917908 - RNA, 19 nt, Homo sapiens
auaaagaaaaaugcaccua

SEQ ID NO: 1917909 - RNA, 23 nt, Homo sapiens
auuggacagcuacuucugggaaa

SEQ ID NO: 1917910 - RNA, 20 nt, Homo sapiens
ccucagcugcucgcacagau

SEQ ID NO: 1917911 - RNA, 15 nt, Homo sapiens
ucugcugcaguuacc

SEQ ID NO: 1917912 - RNA, 17 nt, Homo sapiens
uuagcaauaacauacau

SEQ ID NO: 1917913 - RNA, 17 nt, Homo sapiens
uuuacuuuuaaacugug

SEQ ID NO: 1917914 - RNA, 18 nt, Homo sapiens
caguucuuacacauucca

SEQ ID NO: 1917915 - RNA, 21 nt, Homo sapiens
augcuagaggcuuuuauuaga

SEQ ID NO: 1917916 - RNA, 16 nt, Homo sapiens
acaaucaacaaaaugg

SEQ ID NO: 1917917 - RNA, 19 nt, Homo sapiens
acuuggauguagccaugac

SEQ ID NO: 1917918 - RNA, 15 nt, Homo sapiens
gaacuguaagcucaa

SEQ ID NO: 1917919 - RNA, 17 nt, Homo sapiens
uuaucuagaacauucag

SEQ ID NO: 1917920 - RNA, 15 nt, Homo sapiens
uuguaagcacugacu

SEQ ID NO: 1917921 - RNA, 21 nt, Homo sapiens
agcccuaggauaaaaagccag

SEQ ID NO: 1917922 - RNA, 22 nt, Homo sapiens
ccuggccuaauccuuuagauua

SEQ ID NO: 1917923 - RNA, 21 nt, Homo sapiens
aguuaaggggagcaacagagg

SEQ ID NO: 1917924 - RNA, 13 nt, Homo sapiens
cagaggauguggc

SEQ ID NO: 1917925 - RNA, 23 nt, Homo sapiens
uuucugcucccucgacacuugau

SEQ ID NO: 1917926 - RNA, 18 nt, Homo sapiens
ugcugccucucuuucaca

SEQ ID NO: 1917927 - RNA, 23 nt, Homo sapiens
aggucuauuuaaaaaaaaaguca

SEQ ID NO: 1917928 - RNA, 18 nt, Homo sapiens
aaauuaaaugcauguccu

SEQ ID NO: 1917929 - RNA, 13 nt, Homo sapiens
cuucuccaaccaa

SEQ ID NO: 1917930 - RNA, 16 nt, Homo sapiens
uauagaaaauucuuga

SEQ ID NO: 1917931 - RNA, 15 nt, Homo sapiens
ccuaaaguacuggga

SEQ ID NO: 1917932 - RNA, 14 nt, Homo sapiens
guacuuuugagugu

SEQ ID NO: 1917933 - RNA, 12 nt, Homo sapiens
caaguguucacu

SEQ ID NO: 1917934 - RNA, 15 nt, Homo sapiens
ccucacagcaucucu

SEQ ID NO: 1917935 - RNA, 13 nt, Homo sapiens
aaggaugugggcc

SEQ ID NO: 1917936 - RNA, 20 nt, Homo sapiens
cuccugauggagugugcaga

SEQ ID NO: 1917937 - RNA, 17 nt, Homo sapiens
cccucucaggagccauc

SEQ ID NO: 1917938 - RNA, 22 nt, Homo sapiens
auacaggcguacacaugcacgc

SEQ ID NO: 1917939 - RNA, 20 nt, Homo sapiens
ucuuuaaaggcaucuacaca

SEQ ID NO: 1917940 - RNA, 11 nt, Homo sapiens
uccacucccag

SEQ ID NO: 1917941 - RNA, 11 nt, Homo sapiens
auucuccucau

SEQ ID NO: 1917942 - RNA, 20 nt, Homo sapiens
uggugucccaguaaagccaa

SEQ ID NO: 1917943 - RNA, 20 nt, Homo sapiens
aucuuagaaaauuaaaugaa

SEQ ID NO: 1917944 - RNA, 17 nt, Homo sapiens
gcccuugcacaugggca

SEQ ID NO: 1917945 - RNA, 13 nt, Homo sapiens
gauugucuccuaa

SEQ ID NO: 1917946 - RNA, 22 nt, Homo sapiens
caucguacacacucagugacau

SEQ ID NO: 1917947 - RNA, 17 nt, Homo sapiens
cucuccaggcaccgccu

SEQ ID NO: 1917948 - RNA, 15 nt, Homo sapiens
gcaguaugauggcag

SEQ ID NO: 1917949 - RNA, 17 nt, Homo sapiens
auuauuuuauguugcau

SEQ ID NO: 1917950 - RNA, 18 nt, Homo sapiens
cuuagcccaagaggucug

SEQ ID NO: 1917951 - RNA, 16 nt, Homo sapiens
cuuuuccacuccauug

SEQ ID NO: 1917952 - RNA, 19 nt, Homo sapiens
uggagcagagaacaucugg

SEQ ID NO: 1917953 - RNA, 22 nt, Homo sapiens
aaacaguguggcuuaaacauuu

SEQ ID NO: 1917954 - RNA, 14 nt, Homo sapiens
uagcaacaaaagga

SEQ ID NO: 1917955 - RNA, 16 nt, Homo sapiens
augugucuuuauagca

SEQ ID NO: 1917956 - RNA, 19 nt, Homo sapiens
caauuuguuaagguucaag

SEQ ID NO: 1917957 - RNA, 19 nt, Homo sapiens
ggguggucugagcaccccc

SEQ ID NO: 1917958 - RNA, 23 nt, Homo sapiens
uugucuaaauaaguuugcaauuu

SEQ ID NO: 1917959 - RNA, 18 nt, Homo sapiens
aaaugauuucacagugug

SEQ ID NO: 1917960 - RNA, 18 nt, Homo sapiens
acacauaacaaagggcag

SEQ ID NO: 1917961 - RNA, 19 nt, Homo sapiens
ugcacaacagaguaacuau

SEQ ID NO: 1917962 - RNA, 22 nt, Homo sapiens
cauccaauucuuugaauuuccc

SEQ ID NO: 1917963 - RNA, 14 nt, Homo sapiens
cuuaaagauuuauc

SEQ ID NO: 1917964 - RNA, 16 nt, Homo sapiens
ccagagcaggaaagau

SEQ ID NO: 1917965 - RNA, 12 nt, Homo sapiens
aacccuguguca

SEQ ID NO: 1917966 - RNA, 12 nt, Homo sapiens
augacugugagc

SEQ ID NO: 1917967 - RNA, 13 nt, Homo sapiens
aaaagauggaaug

SEQ ID NO: 1917968 - RNA, 15 nt, Homo sapiens
ccucaagugauccac

SEQ ID NO: 1917969 - RNA, 20 nt, Homo sapiens
gcacauuccccuugccuaaa

SEQ ID NO: 1917970 - RNA, 11 nt, Homo sapiens
uccucccucag

SEQ ID NO: 1917971 - RNA, 21 nt, Homo sapiens
uuuaaaaaaauaacaucugaa

SEQ ID NO: 1917972 - RNA, 12 nt, Homo sapiens
ccuuucacuuac

SEQ ID NO: 1917973 - RNA, 14 nt, Homo sapiens
uacauacaaauucu

SEQ ID NO: 1917974 - RNA, 12 nt, Homo sapiens
aaugucuuuauu

SEQ ID NO: 1917975 - RNA, 17 nt, Homo sapiens
gcaggccucaucuuucc

SEQ ID NO: 1917976 - RNA, 15 nt, Homo sapiens
ucuaagacauucacc

SEQ ID NO: 1917977 - RNA, 13 nt, Homo sapiens
aaaugcuuucuca

SEQ ID NO: 1917978 - RNA, 17 nt, Homo sapiens
ccuauagaaacaccagu

SEQ ID NO: 1917979 - RNA, 22 nt, Homo sapiens
agcauuuccaacaccacagaca

SEQ ID NO: 1917980 - RNA, 22 nt, Homo sapiens
auauuaauuuuccaaugcacag

SEQ ID NO: 1917981 - RNA, 18 nt, Homo sapiens
uggacgaacaggggccaa

SEQ ID NO: 1917982 - RNA, 19 nt, Homo sapiens
cauuugugccgacacuguu

SEQ ID NO: 1917983 - RNA, 14 nt, Homo sapiens
cuuucucccaguga

SEQ ID NO: 1917984 - RNA, 15 nt, Homo sapiens
cacauagacuuuaug

SEQ ID NO: 1917985 - RNA, 15 nt, Homo sapiens
cauacagaaggcaac

SEQ ID NO: 1917986 - RNA, 14 nt, Homo sapiens
ucugucugcucaau

SEQ ID NO: 1917987 - RNA, 15 nt, Homo sapiens
acucaauucugcagu

SEQ ID NO: 1917988 - RNA, 15 nt, Homo sapiens
ugcacacauuaggca

SEQ ID NO: 1917989 - RNA, 14 nt, Homo sapiens
ucuuagaaaauuca

SEQ ID NO: 1917990 - RNA, 22 nt, Homo sapiens
cgcuuucauguuacuguugcag

SEQ ID NO: 1917991 - RNA, 22 nt, Homo sapiens
gagcugaucagccugugccaca

SEQ ID NO: 1917992 - RNA, 15 nt, Homo sapiens
gucucugcaucucau

SEQ ID NO: 1917993 - RNA, 15 nt, Homo sapiens
gcuucugcacuucau

SEQ ID NO: 1917994 - RNA, 19 nt, Homo sapiens
uuacugcaaccuuugccuc

SEQ ID NO: 1917995 - RNA, 20 nt, Homo sapiens
agcagaguggcagucuucag

SEQ ID NO: 1917996 - RNA, 16 nt, Homo sapiens
uuauuucaucauauua

SEQ ID NO: 1917997 - RNA, 17 nt, Homo sapiens
aacugcaccaacgagcu

SEQ ID NO: 1917998 - RNA, 16 nt, Homo sapiens
gcaacagguucaggug

SEQ ID NO: 1917999 - RNA, 19 nt, Homo sapiens
cuccgaggccuaccugcuc

SEQ ID NO: 1918000 - RNA, 21 nt, Homo sapiens
aaucugacucagguguggcug

SEQ ID NO: 1918001 - RNA, 18 nt, Homo sapiens
aaacagccucaguggcca

SEQ ID NO: 1918002 - RNA, 19 nt, Homo sapiens
caggguuucugcacugguc

SEQ ID NO: 1918003 - RNA, 14 nt, Homo sapiens
ggggcacagccaga

SEQ ID NO: 1918004 - RNA, 16 nt, Homo sapiens
acagaaaggccacuca

SEQ ID NO: 1918005 - RNA, 17 nt, Homo sapiens
agacauacuaaccagca

SEQ ID NO: 1918006 - RNA, 19 nt, Homo sapiens
uguaggccuuccagugcag

SEQ ID NO: 1918007 - RNA, 14 nt, Homo sapiens
ggccucccaagcug

SEQ ID NO: 1918008 - RNA, 19 nt, Homo sapiens
cugucuauuuaagugcaau

SEQ ID NO: 1918009 - RNA, 18 nt, Homo sapiens
cuauuuuuguacaaaaga

SEQ ID NO: 1918010 - RNA, 13 nt, Homo sapiens
aucacagggucac

SEQ ID NO: 1918011 - RNA, 15 nt, Homo sapiens
aacugaccaguuguu

SEQ ID NO: 1918012 - RNA, 17 nt, Homo sapiens
accacuguacauauaua

SEQ ID NO: 1918013 - RNA, 21 nt, Homo sapiens
caucaggauacucaaagugga

SEQ ID NO: 1918014 - RNA, 17 nt, Homo sapiens
aaaccagaaaggugauu

SEQ ID NO: 1918015 - RNA, 21 nt, Homo sapiens
agcccugggccccaccaccua

SEQ ID NO: 1918016 - RNA, 13 nt, Homo sapiens
aauuacagcaguu

SEQ ID NO: 1918017 - RNA, 17 nt, Homo sapiens
ccccuauugucuccaag

SEQ ID NO: 1918018 - RNA, 14 nt, Homo sapiens
ccaugcuucuugcc

SEQ ID NO: 1918019 - RNA, 16 nt, Homo sapiens
gguuucaccucccaaa

SEQ ID NO: 1918020 - RNA, 20 nt, Homo sapiens
auaaugacuuaagcacacuu

SEQ ID NO: 1918021 - RNA, 14 nt, Homo sapiens
ggguuauucagaac

SEQ ID NO: 1918022 - RNA, 12 nt, Homo sapiens
agcuugcacaug

SEQ ID NO: 1918023 - RNA, 21 nt, Homo sapiens
uacugaaagguuacccuguaa

SEQ ID NO: 1918024 - RNA, 14 nt, Homo sapiens
aagaucgcaccauu

SEQ ID NO: 1918025 - RNA, 20 nt, Homo sapiens
auuaauucuauaaggccaua

SEQ ID NO: 1918026 - RNA, 14 nt, Homo sapiens
auucauugugauuu

SEQ ID NO: 1918027 - RNA, 19 nt, Homo sapiens
agcaaucugauucagcauc

SEQ ID NO: 1918028 - RNA, 15 nt, Homo sapiens
uuaacugccaagaaa

SEQ ID NO: 1918029 - RNA, 15 nt, Homo sapiens
acuugccacugccau

SEQ ID NO: 1918030 - RNA, 19 nt, Homo sapiens
uguuuacauuuucuuucau

SEQ ID NO: 1918031 - RNA, 21 nt, Homo sapiens
uaugcguaaaucaacuuguca

SEQ ID NO: 1918032 - RNA, 21 nt, Homo sapiens
uuuaguagccucaauucucca

SEQ ID NO: 1918033 - RNA, 19 nt, Homo sapiens
uucuguaauacuaaguccu

SEQ ID NO: 1918034 - RNA, 19 nt, Homo sapiens
auacaaacaggugcuaaca

SEQ ID NO: 1918035 - RNA, 16 nt, Homo sapiens
gguauucugucauuua

SEQ ID NO: 1918036 - RNA, 16 nt, Homo sapiens
ggaccagaagcauuuc

SEQ ID NO: 1918037 - RNA, 19 nt, Homo sapiens
cccugaauucauugucuca

SEQ ID NO: 1918038 - RNA, 23 nt, Homo sapiens
gcaauccaaauccagccuuugga

SEQ ID NO: 1918039 - RNA, 13 nt, Homo sapiens
ugguagcacuuua

SEQ ID NO: 1918040 - RNA, 23 nt, Homo sapiens
aggaacucuggccacccaaacag

SEQ ID NO: 1918041 - RNA, 17 nt, Homo sapiens
ucaauaccaccaagagg

SEQ ID NO: 1918042 - RNA, 18 nt, Homo sapiens
agcuucccacaccugccu

SEQ ID NO: 1918043 - RNA, 16 nt, Homo sapiens
aauauucauugaauaa

SEQ ID NO: 1918044 - RNA, 21 nt, Homo sapiens
cugggacucccagcagagccc

SEQ ID NO: 1918045 - RNA, 14 nt, Homo sapiens
ucucccauccaaga

SEQ ID NO: 1918046 - RNA, 20 nt, Homo sapiens
ugaaucaccuggcugagcag

SEQ ID NO: 1918047 - RNA, 20 nt, Homo sapiens
uggaacacuggaacauucca

SEQ ID NO: 1918048 - RNA, 15 nt, Homo sapiens
ccucucagugggugg

SEQ ID NO: 1918049 - RNA, 19 nt, Homo sapiens
accuacaugagguacugag

SEQ ID NO: 1918050 - RNA, 15 nt, Homo sapiens
aauagagcaaccagu

SEQ ID NO: 1918051 - RNA, 17 nt, Homo sapiens
ucacugcaaacacaccu

SEQ ID NO: 1918052 - RNA, 22 nt, Homo sapiens
ccaucccuuuuuuuacauuuca

SEQ ID NO: 1918053 - RNA, 23 nt, Homo sapiens
acauauuuuuaaaacaaaccaau

SEQ ID NO: 1918054 - RNA, 20 nt, Homo sapiens
ucuguccuggaggcacuggg

SEQ ID NO: 1918055 - RNA, 15 nt, Homo sapiens
guuagugguagaggu

SEQ ID NO: 1918056 - RNA, 11 nt, Homo sapiens
ucagcauuucc

SEQ ID NO: 1918057 - RNA, 14 nt, Homo sapiens
gccacacacacaga

SEQ ID NO: 1918058 - RNA, 18 nt, Homo sapiens
cuacagggaauuuguacg

SEQ ID NO: 1918059 - RNA, 17 nt, Homo sapiens
auacauaaguuuaggau

SEQ ID NO: 1918060 - RNA, 22 nt, Homo sapiens
auauaaaauauauauugcauag

SEQ ID NO: 1918061 - RNA, 18 nt, Homo sapiens
auaaauguguaaaugugg

SEQ ID NO: 1918062 - RNA, 17 nt, Homo sapiens
uugaacacucaugcuga

SEQ ID NO: 1918063 - RNA, 22 nt, Homo sapiens
gauuuucuaaggaaugcacaaa

SEQ ID NO: 1918064 - RNA, 22 nt, Homo sapiens
uucuuccacagugccuaauaau

SEQ ID NO: 1918065 - RNA, 19 nt, Homo sapiens
gaaucugucuaucugugaa

SEQ ID NO: 1918066 - RNA, 17 nt, Homo sapiens
auccaagacagccacac

SEQ ID NO: 1918067 - RNA, 17 nt, Homo sapiens
gugaaugaaacacucag

SEQ ID NO: 1918068 - RNA, 11 nt, Homo sapiens
gauaccauuca

SEQ ID NO: 1918069 - RNA, 14 nt, Homo sapiens
cgaugcacuuugga

SEQ ID NO: 1918070 - RNA, 20 nt, Homo sapiens
cucuaauuagagaacuggag

SEQ ID NO: 1918071 - RNA, 23 nt, Homo sapiens
aaugaccaacgaaauuguuacaa

SEQ ID NO: 1918072 - RNA, 15 nt, Homo sapiens
ugugcagaaaggcag

SEQ ID NO: 1918073 - RNA, 14 nt, Homo sapiens
gcauucgcacuggg

SEQ ID NO: 1918074 - RNA, 15 nt, Homo sapiens
cuguggagggcauuu

SEQ ID NO: 1918075 - RNA, 17 nt, Homo sapiens
ucucucuggaguuuucu

SEQ ID NO: 1918076 - RNA, 9 nt, Homo sapiens
gcacuguuu

SEQ ID NO: 1918077 - RNA, 15 nt, Homo sapiens
gagggcacacacugu

SEQ ID NO: 1918078 - RNA, 12 nt, Homo sapiens
gaacuagccaug

SEQ ID NO: 1918079 - RNA, 15 nt, Homo sapiens
ccacuuuugccagac

SEQ ID NO: 1918080 - RNA, 14 nt, Homo sapiens
caagaggucccaag

SEQ ID NO: 1918081 - RNA, 16 nt, Homo sapiens
ucuggguuacucuucg

SEQ ID NO: 1918082 - RNA, 20 nt, Homo sapiens
ugggauuaugccaaggccgu

SEQ ID NO: 1918083 - RNA, 16 nt, Homo sapiens
auucagaaagucauag

SEQ ID NO: 1918084 - RNA, 15 nt, Homo sapiens
uucauguaacuagaa

SEQ ID NO: 1918085 - RNA, 17 nt, Homo sapiens
ugugacugccaaggugu

SEQ ID NO: 1918086 - RNA, 20 nt, Homo sapiens
uggacccugacuguauacag

SEQ ID NO: 1918087 - RNA, 18 nt, Homo sapiens
aacacagugcagugcuca

SEQ ID NO: 1918088 - RNA, 13 nt, Homo sapiens
ugagguaucuucu

SEQ ID NO: 1918089 - RNA, 17 nt, Homo sapiens
gaguuuuguauucaaua

SEQ ID NO: 1918090 - RNA, 15 nt, Homo sapiens
cuagcccugcuccaa

SEQ ID NO: 1918091 - RNA, 22 nt, Homo sapiens
gguucccguguuguaccugacu

SEQ ID NO: 1918092 - RNA, 22 nt, Homo sapiens
auaauuuucacaugaacccuug

SEQ ID NO: 1918093 - RNA, 15 nt, Homo sapiens
uauauuucuggugaa

SEQ ID NO: 1918094 - RNA, 15 nt, Homo sapiens
ugaauuauggaucag

SEQ ID NO: 1918095 - RNA, 17 nt, Homo sapiens
auugaggaaauauuaau

SEQ ID NO: 1918096 - RNA, 15 nt, Homo sapiens
uaaaagguacuggua

SEQ ID NO: 1918097 - RNA, 16 nt, Homo sapiens
uacauuaaaaugacaa

SEQ ID NO: 1918098 - RNA, 20 nt, Homo sapiens
ggucaccggccgauggagac

SEQ ID NO: 1918099 - RNA, 13 nt, Homo sapiens
uucuccuguucca

SEQ ID NO: 1918100 - RNA, 20 nt, Homo sapiens
accagcccugagaaagaaug

SEQ ID NO: 1918101 - RNA, 14 nt, Homo sapiens
cuccuggguucaag

SEQ ID NO: 1918102 - RNA, 14 nt, Homo sapiens
acuuguggaaaaua

SEQ ID NO: 1918103 - RNA, 16 nt, Homo sapiens
auugacuaaacaguau

SEQ ID NO: 1918104 - RNA, 12 nt, Homo sapiens
caacugauugca

SEQ ID NO: 1918105 - RNA, 14 nt, Homo sapiens
cuagaaguagauuc

SEQ ID NO: 1918106 - RNA, 18 nt, Homo sapiens
cugaucuuuuuauacaca

SEQ ID NO: 1918107 - RNA, 15 nt, Homo sapiens
accaggcagcuccag

SEQ ID NO: 1918108 - RNA, 17 nt, Homo sapiens
uuagaagcaaggcacaa

SEQ ID NO: 1918109 - RNA, 19 nt, Homo sapiens
aaucuccuuuguccauuua

SEQ ID NO: 1918110 - RNA, 20 nt, Homo sapiens
cugggcuucuucagaacaau

SEQ ID NO: 1918111 - RNA, 17 nt, Homo sapiens
acucuggagcaaccuac

SEQ ID NO: 1918112 - RNA, 18 nt, Homo sapiens
aggaagcccacacuaugc

SEQ ID NO: 1918113 - RNA, 23 nt, Homo sapiens
acaaacaaugcauaggauuccaa

SEQ ID NO: 1918114 - RNA, 20 nt, Homo sapiens
acgugacuggccugcuggau

SEQ ID NO: 1918115 - RNA, 14 nt, Homo sapiens
cuuccaacuauguc

SEQ ID NO: 1918116 - RNA, 18 nt, Homo sapiens
cuucccagaaaaccaguc

SEQ ID NO: 1918117 - RNA, 23 nt, Homo sapiens
cccuuccuauucuccugccaugg

SEQ ID NO: 1918118 - RNA, 15 nt, Homo sapiens
cacuauaaccaucag

SEQ ID NO: 1918119 - RNA, 13 nt, Homo sapiens
acauaugaaauau

SEQ ID NO: 1918120 - RNA, 13 nt, Homo sapiens
accauccaauaaa

SEQ ID NO: 1918121 - RNA, 15 nt, Homo sapiens
ugaagcagauguggu

SEQ ID NO: 1918122 - RNA, 18 nt, Homo sapiens
acagauauacacauggau

SEQ ID NO: 1918123 - RNA, 21 nt, Homo sapiens
cagcccagccccuccaaaggu

SEQ ID NO: 1918124 - RNA, 20 nt, Homo sapiens
cuaaggaauaugagcuuuau

SEQ ID NO: 1918125 - RNA, 22 nt, Homo sapiens
uguguccguggaaccaguccua

SEQ ID NO: 1918126 - RNA, 19 nt, Homo sapiens
uccauacguucagaggugc

SEQ ID NO: 1918127 - RNA, 13 nt, Homo sapiens
caauaaagcacua

SEQ ID NO: 1918128 - RNA, 18 nt, Homo sapiens
augaaaccacaugagaag

SEQ ID NO: 1918129 - RNA, 15 nt, Homo sapiens
ucuuacgcuugcuau

SEQ ID NO: 1918130 - RNA, 13 nt, Homo sapiens
cccaggaaucuca

SEQ ID NO: 1918131 - RNA, 16 nt, Homo sapiens
gaaaaccucacuugaa

SEQ ID NO: 1918132 - RNA, 15 nt, Homo sapiens
acuaaacuacauuau

SEQ ID NO: 1918133 - RNA, 16 nt, Homo sapiens
gaaaagcucacuucaa

SEQ ID NO: 1918134 - RNA, 22 nt, Homo sapiens
uaaacacaguccagacucaaac

SEQ ID NO: 1918135 - RNA, 21 nt, Homo sapiens
acgcagacauuuuuuagggga

SEQ ID NO: 1918136 - RNA, 23 nt, Homo sapiens
ccacagcaucauuuugcauucaa

SEQ ID NO: 1918137 - RNA, 17 nt, Homo sapiens
uuccaugucaagauuca

SEQ ID NO: 1918138 - RNA, 21 nt, Homo sapiens
agggugaggugcuugagucuc

SEQ ID NO: 1918139 - RNA, 16 nt, Homo sapiens
ucccaauaucauguga

SEQ ID NO: 1918140 - RNA, 13 nt, Homo sapiens
aaucaaagcagau

SEQ ID NO: 1918141 - RNA, 23 nt, Homo sapiens
aaugguuaaauuuuacaugacag

SEQ ID NO: 1918142 - RNA, 23 nt, Homo sapiens
ucuggcaaugggacucugagaac

SEQ ID NO: 1918143 - RNA, 16 nt, Homo sapiens
ccaaauuaucaagcua

SEQ ID NO: 1918144 - RNA, 15 nt, Homo sapiens
uucaaaaaccacguu

SEQ ID NO: 1918145 - RNA, 19 nt, Homo sapiens
ccaaggccacuacauugag

SEQ ID NO: 1918146 - RNA, 16 nt, Homo sapiens
auauugagaugacacu

SEQ ID NO: 1918147 - RNA, 14 nt, Homo sapiens
gcuggggagcgaaa

SEQ ID NO: 1918148 - RNA, 23 nt, Homo sapiens
gauccaguuuugucaaugcaguu

SEQ ID NO: 1918149 - RNA, 16 nt, Homo sapiens
agacuggauacugccc

SEQ ID NO: 1918150 - RNA, 14 nt, Homo sapiens
aagaaauugugaaa

SEQ ID NO: 1918151 - RNA, 19 nt, Homo sapiens
acuaugaaguaagcaacaa

SEQ ID NO: 1918152 - RNA, 13 nt, Homo sapiens
cugcugcaaaagu

SEQ ID NO: 1918153 - RNA, 22 nt, Homo sapiens
auaaucugucaaaacacugugg

SEQ ID NO: 1918154 - RNA, 15 nt, Homo sapiens
cuguauuaguuuuug

SEQ ID NO: 1918155 - RNA, 16 nt, Homo sapiens
augaaguauuacauga

SEQ ID NO: 1918156 - RNA, 16 nt, Homo sapiens
uuaaagguaugcauuu

SEQ ID NO: 1918157 - RNA, 17 nt, Homo sapiens
agcacaaacacaccucu

SEQ ID NO: 1918158 - RNA, 20 nt, Homo sapiens
acugguaggaagagguacca

SEQ ID NO: 1918159 - RNA, 15 nt, Homo sapiens
ccagaagaagcuuaa

SEQ ID NO: 1918160 - RNA, 13 nt, Homo sapiens
aauguaucuucca

SEQ ID NO: 1918161 - RNA, 20 nt, Homo sapiens
ugcaugccuguagucucagc

SEQ ID NO: 1918162 - RNA, 21 nt, Homo sapiens
cugucuuagugcaaaaaacau

SEQ ID NO: 1918163 - RNA, 23 nt, Homo sapiens
agaaccuggagggcuagaaccua

SEQ ID NO: 1918164 - RNA, 20 nt, Homo sapiens
cuucaguguguugacuucua

SEQ ID NO: 1918165 - RNA, 21 nt, Homo sapiens
ggccaauuuuuccagcauuua

SEQ ID NO: 1918166 - RNA, 16 nt, Homo sapiens
cagacauccacacaca

SEQ ID NO: 1918167 - RNA, 17 nt, Homo sapiens
ucuacagacuccaaaag

SEQ ID NO: 1918168 - RNA, 12 nt, Homo sapiens
guucauguuugg

SEQ ID NO: 1918169 - RNA, 22 nt, Homo sapiens
ugugauuuuuaaucgcuuugau

SEQ ID NO: 1918170 - RNA, 18 nt, Homo sapiens
cauuucaugcuaucagaa

SEQ ID NO: 1918171 - RNA, 23 nt, Homo sapiens
gauaaaauuuaaugacaguuuuu

SEQ ID NO: 1918172 - RNA, 17 nt, Homo sapiens
acuggugcacuuuguaa

SEQ ID NO: 1918173 - RNA, 14 nt, Homo sapiens
uaaccaccccaucu

SEQ ID NO: 1918174 - RNA, 15 nt, Homo sapiens
uuggcuuaauuccaa

SEQ ID NO: 1918175 - RNA, 22 nt, Homo sapiens
cagugccuucucucagcuccca

SEQ ID NO: 1918176 - RNA, 16 nt, Homo sapiens
ccccuggcacuggcaa

SEQ ID NO: 1918177 - RNA, 13 nt, Homo sapiens
gccaaaaauacag

SEQ ID NO: 1918178 - RNA, 13 nt, Homo sapiens
gaacacaaacaca

SEQ ID NO: 1918179 - RNA, 15 nt, Homo sapiens
uuaaggauugugaua

SEQ ID NO: 1918180 - RNA, 21 nt, Homo sapiens
agcacuagccaaaccucacca

SEQ ID NO: 1918181 - RNA, 16 nt, Homo sapiens
uugucagcaaauuaau

SEQ ID NO: 1918182 - RNA, 16 nt, Homo sapiens
aauacuggucucaggc

SEQ ID NO: 1918183 - RNA, 16 nt, Homo sapiens
ugcaucccugcagcuc

SEQ ID NO: 1918184 - RNA, 22 nt, Homo sapiens
ccagaggugcccgcucuucccu

SEQ ID NO: 1918185 - RNA, 13 nt, Homo sapiens
ggaccacaccucc

SEQ ID NO: 1918186 - RNA, 22 nt, Homo sapiens
augcacaguaucuuuucuuuca

SEQ ID NO: 1918187 - RNA, 19 nt, Homo sapiens
acucauucucuucuugcua

SEQ ID NO: 1918188 - RNA, 14 nt, Homo sapiens
uaccaaugcaugca

SEQ ID NO: 1918189 - RNA, 19 nt, Homo sapiens
gagcuccccagaucuccca

SEQ ID NO: 1918190 - RNA, 19 nt, Homo sapiens
uauucaagagacaguauug

SEQ ID NO: 1918191 - RNA, 20 nt, Homo sapiens
cugugucaaggugaagcaca

SEQ ID NO: 1918192 - RNA, 16 nt, Homo sapiens
uuccacugucuuucaa

SEQ ID NO: 1918193 - RNA, 15 nt, Homo sapiens
aaauaguuacugugc

SEQ ID NO: 1918194 - RNA, 20 nt, Homo sapiens
cuaaacugcuguuaauugau

SEQ ID NO: 1918195 - RNA, 22 nt, Homo sapiens
uggccaggccucagggaccaag

SEQ ID NO: 1918196 - RNA, 17 nt, Homo sapiens
gaaaaauauuccuguga

SEQ ID NO: 1918197 - RNA, 14 nt, Homo sapiens
ggugaggcaauaaa

SEQ ID NO: 1918198 - RNA, 15 nt, Homo sapiens
gacguuccaccuggg

SEQ ID NO: 1918199 - RNA, 15 nt, Homo sapiens
ucccugcagagccaa

SEQ ID NO: 1918200 - RNA, 22 nt, Homo sapiens
uuuuuccucccuuucccugaga

SEQ ID NO: 1918201 - RNA, 18 nt, Homo sapiens
auuccccccuacuugaga

SEQ ID NO: 1918202 - RNA, 16 nt, Homo sapiens
gagggccccugcgugg

SEQ ID NO: 1918203 - RNA, 21 nt, Homo sapiens
cucagcaauugucuacauuca

SEQ ID NO: 1918204 - RNA, 18 nt, Homo sapiens
aaagaguuugagaccuga

SEQ ID NO: 1918205 - RNA, 21 nt, Homo sapiens
agcccguuaaauaauucccua

SEQ ID NO: 1918206 - RNA, 20 nt, Homo sapiens
gaaauuccaaauggugugaa

SEQ ID NO: 1918207 - RNA, 12 nt, Homo sapiens
uuuuccaaccaa

SEQ ID NO: 1918208 - RNA, 13 nt, Homo sapiens
ugggccguuacau

SEQ ID NO: 1918209 - RNA, 16 nt, Homo sapiens
gcauuuugcuauugua

SEQ ID NO: 1918210 - RNA, 12 nt, Homo sapiens
gcuggaucugcu

SEQ ID NO: 1918211 - RNA, 16 nt, Homo sapiens
acugccgccuacugga

SEQ ID NO: 1918212 - RNA, 22 nt, Homo sapiens
caauuaaaaguaugcagauuau

SEQ ID NO: 1918213 - RNA, 13 nt, Homo sapiens
aaagugcuuuaaa

SEQ ID NO: 1918214 - RNA, 23 nt, Homo sapiens
agauuugaauagaaaaaguaauc

SEQ ID NO: 1918215 - RNA, 22 nt, Homo sapiens
agacauucauuuaguugauaua

SEQ ID NO: 1918216 - RNA, 13 nt, Homo sapiens
ucuagcacaucau

SEQ ID NO: 1918217 - RNA, 18 nt, Homo sapiens
gauauccucccuccagau

SEQ ID NO: 1918218 - RNA, 18 nt, Homo sapiens
uuuggaauuaugucugcu

SEQ ID NO: 1918219 - RNA, 19 nt, Homo sapiens
gugagaucggugcguucuc

SEQ ID NO: 1918220 - RNA, 19 nt, Homo sapiens
ugcgagagauguguguuga

SEQ ID NO: 1918221 - RNA, 14 nt, Homo sapiens
cacguguccgucca

SEQ ID NO: 1918222 - RNA, 13 nt, Homo sapiens
uacagacaugaac

SEQ ID NO: 1918223 - RNA, 23 nt, Homo sapiens
gccuuucguucugcugaccaaau

SEQ ID NO: 1918224 - RNA, 15 nt, Homo sapiens
caaauuagcaugcaa

SEQ ID NO: 1918225 - RNA, 21 nt, Homo sapiens
agugcguguguacaugugcac

SEQ ID NO: 1918226 - RNA, 12 nt, Homo sapiens
uaaaucaauucu

SEQ ID NO: 1918227 - RNA, 13 nt, Homo sapiens
ccucuagucagca

SEQ ID NO: 1918228 - RNA, 15 nt, Homo sapiens
accuacagagcaccu

SEQ ID NO: 1918229 - RNA, 14 nt, Homo sapiens
uucaauccuacuuu

SEQ ID NO: 1918230 - RNA, 14 nt, Homo sapiens
auauuaccaaaaaa

SEQ ID NO: 1918231 - RNA, 15 nt, Homo sapiens
cagcuucccugaaca

SEQ ID NO: 1918232 - RNA, 19 nt, Homo sapiens
aaauugcuacauaguccaa

SEQ ID NO: 1918233 - RNA, 17 nt, Homo sapiens
uuccaaguauuuugcca

SEQ ID NO: 1918234 - RNA, 13 nt, Homo sapiens
auuuuucacauau

SEQ ID NO: 1918235 - RNA, 20 nt, Homo sapiens
agcaggaaaagguccuugac

SEQ ID NO: 1918236 - RNA, 14 nt, Homo sapiens
ggccccuccaggaa

SEQ ID NO: 1918237 - RNA, 20 nt, Homo sapiens
uccagccagccaaauccauc

SEQ ID NO: 1918238 - RNA, 15 nt, Homo sapiens
cuccccuggggugca

SEQ ID NO: 1918239 - RNA, 12 nt, Homo sapiens
aauugucuugca

SEQ ID NO: 1918240 - RNA, 12 nt, Homo sapiens
uauaaauaucac

SEQ ID NO: 1918241 - RNA, 12 nt, Homo sapiens
gaccuguguucc

SEQ ID NO: 1918242 - RNA, 17 nt, Homo sapiens
gacccucccacuggugc

SEQ ID NO: 1918243 - RNA, 12 nt, Homo sapiens
ugucguccugcc

SEQ ID NO: 1918244 - RNA, 16 nt, Homo sapiens
auuuucuaauuaaaga

SEQ ID NO: 1918245 - RNA, 19 nt, Homo sapiens
agguacauaagcuucucaa

SEQ ID NO: 1918246 - RNA, 23 nt, Homo sapiens
ugucaaccuugugugagugugac

SEQ ID NO: 1918247 - RNA, 23 nt, Homo sapiens
gcucuguugcuguccuccagggc

SEQ ID NO: 1918248 - RNA, 14 nt, Homo sapiens
acaguagcauuaug

SEQ ID NO: 1918249 - RNA, 22 nt, Homo sapiens
auacuuuuuuuuuugaggcaga

SEQ ID NO: 1918250 - RNA, 19 nt, Homo sapiens
aacugagguucuugggaua

SEQ ID NO: 1918251 - RNA, 17 nt, Homo sapiens
ucccccgacacugcugc

SEQ ID NO: 1918252 - RNA, 21 nt, Homo sapiens
cugccaucuguuuuggcaaga

SEQ ID NO: 1918253 - RNA, 20 nt, Homo sapiens
cccagauacccaucuugaaa

SEQ ID NO: 1918254 - RNA, 18 nt, Homo sapiens
aacaacaaagcaugcuca

SEQ ID NO: 1918255 - RNA, 15 nt, Homo sapiens
ccaacaguagccaaa

SEQ ID NO: 1918256 - RNA, 20 nt, Homo sapiens
aaaggaaaaauguacuuaaa

SEQ ID NO: 1918257 - RNA, 16 nt, Homo sapiens
uuccacaagacucaga

SEQ ID NO: 1918258 - RNA, 15 nt, Homo sapiens
agaaucuugaggaac

SEQ ID NO: 1918259 - RNA, 18 nt, Homo sapiens
agaguuaaauaugcaucu

SEQ ID NO: 1918260 - RNA, 14 nt, Homo sapiens
ucacacaacacuga

SEQ ID NO: 1918261 - RNA, 20 nt, Homo sapiens
cagaacacuuauguuauaca

SEQ ID NO: 1918262 - RNA, 23 nt, Homo sapiens
caaaggauguguuuucagucuuu

SEQ ID NO: 1918263 - RNA, 11 nt, Homo sapiens
aaucuucaggu

SEQ ID NO: 1918264 - RNA, 20 nt, Homo sapiens
ugucucugucucuccuagcc

SEQ ID NO: 1918265 - RNA, 20 nt, Homo sapiens
uuccaaauuuagaaagcuua

SEQ ID NO: 1918266 - RNA, 20 nt, Homo sapiens
ugaccccaucaccuacucac

SEQ ID NO: 1918267 - RNA, 23 nt, Homo sapiens
cuucccugcauuaacugcacaaa

SEQ ID NO: 1918268 - RNA, 19 nt, Homo sapiens
uuaauuuuugauauauuca

SEQ ID NO: 1918269 - RNA, 11 nt, Homo sapiens
aguuaccaagu

SEQ ID NO: 1918270 - RNA, 13 nt, Homo sapiens
guuucuacauuca

SEQ ID NO: 1918271 - RNA, 22 nt, Homo sapiens
uucacgccuguaaucccagcac

SEQ ID NO: 1918272 - RNA, 20 nt, Homo sapiens
ugccccaaacaaauaugcaa

SEQ ID NO: 1918273 - RNA, 13 nt, Homo sapiens
auuaaacgggcug

SEQ ID NO: 1918274 - RNA, 18 nt, Homo sapiens
gacucuagaagcucaggu

SEQ ID NO: 1918275 - RNA, 18 nt, Homo sapiens
guccccccacucccucac

SEQ ID NO: 1918276 - RNA, 18 nt, Homo sapiens
caagacccccaggaagga

SEQ ID NO: 1918277 - RNA, 16 nt, Homo sapiens
gaaaucauuuggguua

SEQ ID NO: 1918278 - RNA, 13 nt, Homo sapiens
uagaaaccucauu

SEQ ID NO: 1918279 - RNA, 12 nt, Homo sapiens
auugcuccauac

SEQ ID NO: 1918280 - RNA, 14 nt, Homo sapiens
gggccccaucucca

SEQ ID NO: 1918281 - RNA, 15 nt, Homo sapiens
gugcugagguugaga

SEQ ID NO: 1918282 - RNA, 21 nt, Homo sapiens
agaaauuuuauuagacauucu

SEQ ID NO: 1918283 - RNA, 16 nt, Homo sapiens
acucugaauccucaug

SEQ ID NO: 1918284 - RNA, 22 nt, Homo sapiens
cucagaagguaggggaagggcg

SEQ ID NO: 1918285 - RNA, 16 nt, Homo sapiens
auucauaaaucacaaa

SEQ ID NO: 1918286 - RNA, 15 nt, Homo sapiens
ugccccagcucucuu

SEQ ID NO: 1918287 - RNA, 14 nt, Homo sapiens
uuuauugugaucua

SEQ ID NO: 1918288 - RNA, 15 nt, Homo sapiens
auuuccuccucaucu

SEQ ID NO: 1918289 - RNA, 15 nt, Homo sapiens
cuuaagagugcugug

SEQ ID NO: 1918290 - RNA, 13 nt, Homo sapiens
uccaauuagcuua

SEQ ID NO: 1918291 - RNA, 13 nt, Homo sapiens
gcuuauuauccaa

SEQ ID NO: 1918292 - RNA, 22 nt, Homo sapiens
ccuguguuucauguucuguguc

SEQ ID NO: 1918293 - RNA, 16 nt, Homo sapiens
ccuagacauggacgca

SEQ ID NO: 1918294 - RNA, 14 nt, Homo sapiens
aagauuuccaagaa

SEQ ID NO: 1918295 - RNA, 20 nt, Homo sapiens
auucucucucauuauugaga

SEQ ID NO: 1918296 - RNA, 14 nt, Homo sapiens
uuaacauucacagc

SEQ ID NO: 1918297 - RNA, 16 nt, Homo sapiens
gaacacugcaguguua

SEQ ID NO: 1918298 - RNA, 17 nt, Homo sapiens
gugcagucuuggcucac

SEQ ID NO: 1918299 - RNA, 18 nt, Homo sapiens
gcacacaggugcacagac

SEQ ID NO: 1918300 - RNA, 16 nt, Homo sapiens
caaacuccugaccuca

SEQ ID NO: 1918301 - RNA, 13 nt, Homo sapiens
gcugaugcaguug

SEQ ID NO: 1918302 - RNA, 22 nt, Homo sapiens
agaugggggcuggagggggcag

SEQ ID NO: 1918303 - RNA, 13 nt, Homo sapiens
uaacuguuucccu

SEQ ID NO: 1918304 - RNA, 12 nt, Homo sapiens
gcccaauggaga

SEQ ID NO: 1918305 - RNA, 22 nt, Homo sapiens
aguuggcuagaagaaaguaaaa

SEQ ID NO: 1918306 - RNA, 20 nt, Homo sapiens
augagcaguaaaagucacau

SEQ ID NO: 1918307 - RNA, 14 nt, Homo sapiens
aaagaagcuuuauc

SEQ ID NO: 1918308 - RNA, 17 nt, Homo sapiens
cagauuucuacacuuua

SEQ ID NO: 1918309 - RNA, 16 nt, Homo sapiens
gauguuacuagccucu

SEQ ID NO: 1918310 - RNA, 20 nt, Homo sapiens
acacccagccugucccacug

SEQ ID NO: 1918311 - RNA, 15 nt, Homo sapiens
ggcugaggauuucaa

SEQ ID NO: 1918312 - RNA, 19 nt, Homo sapiens
cacccaccuggauucccug

SEQ ID NO: 1918313 - RNA, 18 nt, Homo sapiens
acccaguugugacaauua

SEQ ID NO: 1918314 - RNA, 15 nt, Homo sapiens
gauauuaaugcccag

SEQ ID NO: 1918315 - RNA, 11 nt, Homo sapiens
auaaagccaug

SEQ ID NO: 1918316 - RNA, 11 nt, Homo sapiens
cugaagcccua

SEQ ID NO: 1918317 - RNA, 15 nt, Homo sapiens
gaucaggcacagugg

SEQ ID NO: 1918318 - RNA, 14 nt, Homo sapiens
uccuacccuuccag

SEQ ID NO: 1918319 - RNA, 12 nt, Homo sapiens
uccacauguuac

SEQ ID NO: 1918320 - RNA, 19 nt, Homo sapiens
ugaggccgggcgcaguggc

SEQ ID NO: 1918321 - RNA, 14 nt, Homo sapiens
agcagaacagugau

SEQ ID NO: 1918322 - RNA, 13 nt, Homo sapiens
gcagucagggaca

SEQ ID NO: 1918323 - RNA, 13 nt, Homo sapiens
gaaagaugcauuu

SEQ ID NO: 1918324 - RNA, 11 nt, Homo sapiens
gccgcacuggg

SEQ ID NO: 1918325 - RNA, 14 nt, Homo sapiens
ucacucauugcuga

SEQ ID NO: 1918326 - RNA, 15 nt, Homo sapiens
aguauaacaacuuug

SEQ ID NO: 1918327 - RNA, 18 nt, Homo sapiens
uaacugugccaguucuuu

SEQ ID NO: 1918328 - RNA, 12 nt, Homo sapiens
cauuuucauuaa

SEQ ID NO: 1918329 - RNA, 18 nt, Homo sapiens
ccuucuagccuuuccuag

SEQ ID NO: 1918330 - RNA, 20 nt, Homo sapiens
agaccagggcuccagccccu

SEQ ID NO: 1918331 - RNA, 20 nt, Homo sapiens
acccaucgucuuuaacccca

SEQ ID NO: 1918332 - RNA, 13 nt, Homo sapiens
accauaauguuac

SEQ ID NO: 1918333 - RNA, 23 nt, Homo sapiens
auucuaaauuaugugaauuuugc

SEQ ID NO: 1918334 - RNA, 19 nt, Homo sapiens
caacuuuaaaacugcucau

SEQ ID NO: 1918335 - RNA, 20 nt, Homo sapiens
gaccaccuccaggacucagu

SEQ ID NO: 1918336 - RNA, 14 nt, Homo sapiens
uuaaugauucugaa

SEQ ID NO: 1918337 - RNA, 14 nt, Homo sapiens
auccuugaccucau

SEQ ID NO: 1918338 - RNA, 16 nt, Homo sapiens
agggcugggucagggg

SEQ ID NO: 1918339 - RNA, 18 nt, Homo sapiens
ugcucugugcacucacgc

SEQ ID NO: 1918340 - RNA, 19 nt, Homo sapiens
acuugcuccuuuugcucuu

SEQ ID NO: 1918341 - RNA, 21 nt, Homo sapiens
uuuuacacucuagugccauau

SEQ ID NO: 1918342 - RNA, 19 nt, Homo sapiens
uaaaucaaaagaaugucca

SEQ ID NO: 1918343 - RNA, 21 nt, Homo sapiens
cugcagagacagacucugaau

SEQ ID NO: 1918344 - RNA, 16 nt, Homo sapiens
ucacuuuaaagcccuu

SEQ ID NO: 1918345 - RNA, 22 nt, Homo sapiens
acuugauagacuuacuaauaaa

SEQ ID NO: 1918346 - RNA, 15 nt, Homo sapiens
aacuucagccagcua

SEQ ID NO: 1918347 - RNA, 18 nt, Homo sapiens
uaguguguguguguauau

SEQ ID NO: 1918348 - RNA, 13 nt, Homo sapiens
caaaucucuauua

SEQ ID NO: 1918349 - RNA, 17 nt, Homo sapiens
guccuaugucucagugc

SEQ ID NO: 1918350 - RNA, 15 nt, Homo sapiens
guccaguugcagcug

SEQ ID NO: 1918351 - RNA, 16 nt, Homo sapiens
ccaggccugaccucaa

SEQ ID NO: 1918352 - RNA, 16 nt, Homo sapiens
gaaaugaggagacaca

SEQ ID NO: 1918353 - RNA, 18 nt, Homo sapiens
acugcguuguccacaaga

SEQ ID NO: 1918354 - RNA, 20 nt, Homo sapiens
ccggcagcagcccccagcuc

SEQ ID NO: 1918355 - RNA, 21 nt, Homo sapiens
cagagagcagcuuuaaacuca

SEQ ID NO: 1918356 - RNA, 17 nt, Homo sapiens
ccacugcuggcugcagc

SEQ ID NO: 1918357 - RNA, 18 nt, Homo sapiens
gucuuccaauuaaugcuu

SEQ ID NO: 1918358 - RNA, 17 nt, Homo sapiens
uuggacagaagcagcuc

SEQ ID NO: 1918359 - RNA, 20 nt, Homo sapiens
guauuagaauaccacaggaa

SEQ ID NO: 1918360 - RNA, 19 nt, Homo sapiens
agaauuaagaggaugcugg

SEQ ID NO: 1918361 - RNA, 14 nt, Homo sapiens
ugagggucugggau

SEQ ID NO: 1918362 - RNA, 18 nt, Homo sapiens
agucuccaaaacauuucu

SEQ ID NO: 1918363 - RNA, 17 nt, Homo sapiens
uuucagcuggcagaguu

SEQ ID NO: 1918364 - RNA, 18 nt, Homo sapiens
gccagaugugguggcacg

SEQ ID NO: 1918365 - RNA, 12 nt, Homo sapiens
ggugccugccau

SEQ ID NO: 1918366 - RNA, 16 nt, Homo sapiens
ugacuuauaauuugca

SEQ ID NO: 1918367 - RNA, 22 nt, Homo sapiens
ugaaacuguggggcuuacagaa

SEQ ID NO: 1918368 - RNA, 18 nt, Homo sapiens
agcucuggugacaccagc

SEQ ID NO: 1918369 - RNA, 15 nt, Homo sapiens
ccugauggcacucug

SEQ ID NO: 1918370 - RNA, 21 nt, Homo sapiens
aacuguaaaaugauacuguag

SEQ ID NO: 1918371 - RNA, 18 nt, Homo sapiens
gauagcucucugacugcu

SEQ ID NO: 1918372 - RNA, 18 nt, Homo sapiens
gguuuuuguuaccuuuau

SEQ ID NO: 1918373 - RNA, 15 nt, Homo sapiens
ccaaaauucauuucu

SEQ ID NO: 1918374 - RNA, 21 nt, Homo sapiens
guuccuauuuggggcuugcau

SEQ ID NO: 1918375 - RNA, 19 nt, Homo sapiens
ggacaaacugccaguuuug

SEQ ID NO: 1918376 - RNA, 14 nt, Homo sapiens
uugugauuugacug

SEQ ID NO: 1918377 - RNA, 17 nt, Homo sapiens
ucaagucugacucucca

SEQ ID NO: 1918378 - RNA, 17 nt, Homo sapiens
guaguuguucugaaaug

SEQ ID NO: 1918379 - RNA, 12 nt, Homo sapiens
cccagauuuccu

SEQ ID NO: 1918380 - RNA, 14 nt, Homo sapiens
ccugaccauugccc

SEQ ID NO: 1918381 - RNA, 22 nt, Homo sapiens
uuagaggagaaaaagcuuaaug

SEQ ID NO: 1918382 - RNA, 20 nt, Homo sapiens
cuacucccuggaccacgagg

SEQ ID NO: 1918383 - RNA, 14 nt, Homo sapiens
ucauccacucugcc

SEQ ID NO: 1918384 - RNA, 19 nt, Homo sapiens
acccagucccagaaccaca

SEQ ID NO: 1918385 - RNA, 14 nt, Homo sapiens
aguucagcuccuuc

SEQ ID NO: 1918386 - RNA, 22 nt, Homo sapiens
uacuauaaaagcuuucugccac

SEQ ID NO: 1918387 - RNA, 17 nt, Homo sapiens
aucucagagcauuucaa

SEQ ID NO: 1918388 - RNA, 15 nt, Homo sapiens
uucugggcucaggga

SEQ ID NO: 1918389 - RNA, 21 nt, Homo sapiens
caugauggcccauacuuguaa

SEQ ID NO: 1918390 - RNA, 15 nt, Homo sapiens
uucuuucaacuugca

SEQ ID NO: 1918391 - RNA, 13 nt, Homo sapiens
aagaaccuugccu

SEQ ID NO: 1918392 - RNA, 20 nt, Homo sapiens
cuucacacugaacucaggau

SEQ ID NO: 1918393 - RNA, 17 nt, Homo sapiens
ggcuaguagaacuggau

SEQ ID NO: 1918394 - RNA, 13 nt, Homo sapiens
gcaccucuuccuu

SEQ ID NO: 1918395 - RNA, 23 nt, Homo sapiens
ugcucuuacccauuuuuuuuacc

SEQ ID NO: 1918396 - RNA, 15 nt, Homo sapiens
cccuuucuugcacug

SEQ ID NO: 1918397 - RNA, 23 nt, Homo sapiens
uccacucggggguggagugagac

SEQ ID NO: 1918398 - RNA, 22 nt, Homo sapiens
caugcuuacaaagaaagcacuu

SEQ ID NO: 1918399 - RNA, 23 nt, Homo sapiens
acagcagagaccaccacauugag

SEQ ID NO: 1918400 - RNA, 14 nt, Homo sapiens
uucaaucccaggau

SEQ ID NO: 1918401 - RNA, 16 nt, Homo sapiens
ggaugagcaugcuguu

SEQ ID NO: 1918402 - RNA, 14 nt, Homo sapiens
ugaacuacacugca

SEQ ID NO: 1918403 - RNA, 21 nt, Homo sapiens
aauccccacaggcacauuaac

SEQ ID NO: 1918404 - RNA, 19 nt, Homo sapiens
cuuccugaguggugccaaa

SEQ ID NO: 1918405 - RNA, 14 nt, Homo sapiens
cuuucgaaagcaau

SEQ ID NO: 1918406 - RNA, 16 nt, Homo sapiens
gaccauguuuccucuc

SEQ ID NO: 1918407 - RNA, 14 nt, Homo sapiens
ucuccugugugcuu

SEQ ID NO: 1918408 - RNA, 16 nt, Homo sapiens
ccauuucucuccucac

SEQ ID NO: 1918409 - RNA, 20 nt, Homo sapiens
aauaaagaugcccacugagg

SEQ ID NO: 1918410 - RNA, 19 nt, Homo sapiens
auuuacaugugauugugau

SEQ ID NO: 1918411 - RNA, 13 nt, Homo sapiens
gugccaucagcuc

SEQ ID NO: 1918412 - RNA, 13 nt, Homo sapiens
ugcauuugcacua

SEQ ID NO: 1918413 - RNA, 18 nt, Homo sapiens
accugaaagaagcccagg

SEQ ID NO: 1918414 - RNA, 20 nt, Homo sapiens
cuucuggggguagaucucaa

SEQ ID NO: 1918415 - RNA, 19 nt, Homo sapiens
uccaugcugcaaaggagaa

SEQ ID NO: 1918416 - RNA, 17 nt, Homo sapiens
ccuuucacauacugaca

SEQ ID NO: 1918417 - RNA, 15 nt, Homo sapiens
agauugcaccacugc

SEQ ID NO: 1918418 - RNA, 13 nt, Homo sapiens
uggaagacacuuc

SEQ ID NO: 1918419 - RNA, 16 nt, Homo sapiens
gggaacuggagucugu

SEQ ID NO: 1918420 - RNA, 22 nt, Homo sapiens
ugccuggagucuuguguucacc

SEQ ID NO: 1918421 - RNA, 15 nt, Homo sapiens
cugcucuacuuugag

SEQ ID NO: 1918422 - RNA, 19 nt, Homo sapiens
ugauuuuuuuaaaguaguu

SEQ ID NO: 1918423 - RNA, 19 nt, Homo sapiens
cuagauuaguagaugcauc

SEQ ID NO: 1918424 - RNA, 22 nt, Homo sapiens
uggauccgugacagcacuuucc

SEQ ID NO: 1918425 - RNA, 19 nt, Homo sapiens
ccacaacugacacaggaaa

SEQ ID NO: 1918426 - RNA, 14 nt, Homo sapiens
ugaccccuccucac

SEQ ID NO: 1918427 - RNA, 16 nt, Homo sapiens
ugcuucuucucaggca

SEQ ID NO: 1918428 - RNA, 21 nt, Homo sapiens
aaucugauuuucaaaaaucau

SEQ ID NO: 1918429 - RNA, 20 nt, Homo sapiens
ggaaaccucccuuuacagca

SEQ ID NO: 1918430 - RNA, 18 nt, Homo sapiens
auuuucauuuucugcaag

SEQ ID NO: 1918431 - RNA, 18 nt, Homo sapiens
cuccugccuaauuuugaa

SEQ ID NO: 1918432 - RNA, 19 nt, Homo sapiens
cugacuucuaggauuuauu

SEQ ID NO: 1918433 - RNA, 17 nt, Homo sapiens
ugcccaggccacagaga

SEQ ID NO: 1918434 - RNA, 20 nt, Homo sapiens
ugcuccucugccuguccucu

SEQ ID NO: 1918435 - RNA, 20 nt, Homo sapiens
ccuaaucccuuccucuccca

SEQ ID NO: 1918436 - RNA, 14 nt, Homo sapiens
cauggcccugugcu

SEQ ID NO: 1918437 - RNA, 22 nt, Homo sapiens
agacaaugugaaaagaaaaaug

SEQ ID NO: 1918438 - RNA, 16 nt, Homo sapiens
augguuagcugucaca

SEQ ID NO: 1918439 - RNA, 14 nt, Homo sapiens
aacauacuguugau

SEQ ID NO: 1918440 - RNA, 17 nt, Homo sapiens
caccuccaucaaacgca

SEQ ID NO: 1918441 - RNA, 14 nt, Homo sapiens
guugaaaagccaug

SEQ ID NO: 1918442 - RNA, 21 nt, Homo sapiens
ugaugaugguauaaaguuugc

SEQ ID NO: 1918443 - RNA, 23 nt, Homo sapiens
ggcagcagagcauucagacucca

SEQ ID NO: 1918444 - RNA, 19 nt, Homo sapiens
gacucuccaaauagcauua

SEQ ID NO: 1918445 - RNA, 21 nt, Homo sapiens
cuuaguacauuugaugcaaaa

SEQ ID NO: 1918446 - RNA, 12 nt, Homo sapiens
aguguuagcuua

SEQ ID NO: 1918447 - RNA, 18 nt, Homo sapiens
ccccugagcuugcagaga

SEQ ID NO: 1918448 - RNA, 21 nt, Homo sapiens
uuaaaaacaaaacaucuuugu

SEQ ID NO: 1918449 - RNA, 15 nt, Homo sapiens
acuguguagacuccu

SEQ ID NO: 1918450 - RNA, 17 nt, Homo sapiens
cuuuauagccuguaacc

SEQ ID NO: 1918451 - RNA, 16 nt, Homo sapiens
cagguuccaaucagaa

SEQ ID NO: 1918452 - RNA, 14 nt, Homo sapiens
ugauucagacagcu

SEQ ID NO: 1918453 - RNA, 15 nt, Homo sapiens
caacugcaccaguga

SEQ ID NO: 1918454 - RNA, 20 nt, Homo sapiens
auccuucacaggcagugcau

SEQ ID NO: 1918455 - RNA, 16 nt, Homo sapiens
ggaagacuccuagcug

SEQ ID NO: 1918456 - RNA, 17 nt, Homo sapiens
gaguccccccacuccca

SEQ ID NO: 1918457 - RNA, 15 nt, Homo sapiens
cuuaaacuugaccca

SEQ ID NO: 1918458 - RNA, 23 nt, Homo sapiens
aguucuuuacuggugauuucuga

SEQ ID NO: 1918459 - RNA, 18 nt, Homo sapiens
auguagacugaaaagcca

SEQ ID NO: 1918460 - RNA, 18 nt, Homo sapiens
uagaccaccuaauaucaa

SEQ ID NO: 1918461 - RNA, 17 nt, Homo sapiens
uaccuucaagaaccagg

SEQ ID NO: 1918462 - RNA, 17 nt, Homo sapiens
guacauugggagucugu

SEQ ID NO: 1918463 - RNA, 11 nt, Homo sapiens
ucccacuggaa

SEQ ID NO: 1918464 - RNA, 15 nt, Homo sapiens
auggauauuugucaa

SEQ ID NO: 1918465 - RNA, 17 nt, Homo sapiens
ugcauguaaacacgccu

SEQ ID NO: 1918466 - RNA, 19 nt, Homo sapiens
cauugcaccagaugccauu

SEQ ID NO: 1918467 - RNA, 16 nt, Homo sapiens
uuugagacagucucac

SEQ ID NO: 1918468 - RNA, 18 nt, Homo sapiens
uccuguuuguaucauagc

SEQ ID NO: 1918469 - RNA, 12 nt, Homo sapiens
ucuaugacugug

SEQ ID NO: 1918470 - RNA, 22 nt, Homo sapiens
uugccaucccucccuccaccuc

SEQ ID NO: 1918471 - RNA, 23 nt, Homo sapiens
cuaggagaacugcuguguucuca

SEQ ID NO: 1918472 - RNA, 20 nt, Homo sapiens
aauaugucaccuggcacauu

SEQ ID NO: 1918473 - RNA, 21 nt, Homo sapiens
uucaaucccggaagggacuua

SEQ ID NO: 1918474 - RNA, 23 nt, Homo sapiens
ggauuccccaucucaggccagag

SEQ ID NO: 1918475 - RNA, 18 nt, Homo sapiens
cugacuuaaguggcauua

SEQ ID NO: 1918476 - RNA, 16 nt, Homo sapiens
acuucagcaggggaug

SEQ ID NO: 1918477 - RNA, 19 nt, Homo sapiens
aacugacgcuggagaugca

SEQ ID NO: 1918478 - RNA, 22 nt, Homo sapiens
ugugccauauucugguucuuga

SEQ ID NO: 1918479 - RNA, 18 nt, Homo sapiens
aacaguauugacuuguau

SEQ ID NO: 1918480 - RNA, 21 nt, Homo sapiens
ccuaggacagccuuguuccuc

SEQ ID NO: 1918481 - RNA, 17 nt, Homo sapiens
cagguuggagugcagug

SEQ ID NO: 1918482 - RNA, 14 nt, Homo sapiens
ugaauaugccuuaa

SEQ ID NO: 1918483 - RNA, 19 nt, Homo sapiens
gcauaaacuucaucuucaa

SEQ ID NO: 1918484 - RNA, 16 nt, Homo sapiens
aaaacugaagcaucaa

SEQ ID NO: 1918485 - RNA, 19 nt, Homo sapiens
ucacagggacucuccauau

SEQ ID NO: 1918486 - RNA, 23 nt, Homo sapiens
uuaaguucaggcagcacaucaau

SEQ ID NO: 1918487 - RNA, 23 nt, Homo sapiens
ggaauuuugaaaaaaaauuucaa

SEQ ID NO: 1918488 - RNA, 20 nt, Homo sapiens
uugcuuuaccuuuucagggc

SEQ ID NO: 1918489 - RNA, 21 nt, Homo sapiens
acgugugaaaucugucuuugc

SEQ ID NO: 1918490 - RNA, 18 nt, Homo sapiens
uacaauuguaaaacugag

SEQ ID NO: 1918491 - RNA, 20 nt, Homo sapiens
ggaagucacagcaugugaau

SEQ ID NO: 1918492 - RNA, 15 nt, Homo sapiens
ugauucaugucucac

SEQ ID NO: 1918493 - RNA, 18 nt, Homo sapiens
uccagggucccucugugu

SEQ ID NO: 1918494 - RNA, 16 nt, Homo sapiens
cuccccugguccugca

SEQ ID NO: 1918495 - RNA, 22 nt, Homo sapiens
aacccaguuuucccucugggag

SEQ ID NO: 1918496 - RNA, 17 nt, Homo sapiens
gacuguccaagugccac

SEQ ID NO: 1918497 - RNA, 14 nt, Homo sapiens
ccaacucuugcaca

SEQ ID NO: 1918498 - RNA, 17 nt, Homo sapiens
ugcagugagcugagauc

SEQ ID NO: 1918499 - RNA, 21 nt, Homo sapiens
gggucuguggccaguugacau

SEQ ID NO: 1918500 - RNA, 13 nt, Homo sapiens
aacagacaacaga

SEQ ID NO: 1918501 - RNA, 20 nt, Homo sapiens
accuggccagagccaagaaa

SEQ ID NO: 1918502 - RNA, 16 nt, Homo sapiens
augcaugugcauauag

SEQ ID NO: 1918503 - RNA, 21 nt, Homo sapiens
caauaaauggccagugcugcu

SEQ ID NO: 1918504 - RNA, 17 nt, Homo sapiens
ucuauguuuuaccaagc

SEQ ID NO: 1918505 - RNA, 21 nt, Homo sapiens
ccuugagucaaaaaaucucaa

SEQ ID NO: 1918506 - RNA, 21 nt, Homo sapiens
gaugcugccugcccagugcac

SEQ ID NO: 1918507 - RNA, 18 nt, Homo sapiens
aggugaccagaaugaggc

SEQ ID NO: 1918508 - RNA, 22 nt, Homo sapiens
cacugaaaugaccaagacaggu

SEQ ID NO: 1918509 - RNA, 15 nt, Homo sapiens
uuaaaugaaagugag

SEQ ID NO: 1918510 - RNA, 15 nt, Homo sapiens
uaaugaaaaugaaua

SEQ ID NO: 1918511 - RNA, 18 nt, Homo sapiens
ugaccuucagauucccca

SEQ ID NO: 1918512 - RNA, 16 nt, Homo sapiens
agacugacugcaagcc

SEQ ID NO: 1918513 - RNA, 22 nt, Homo sapiens
agaucaaugaaaugaugucaua

SEQ ID NO: 1918514 - RNA, 19 nt, Homo sapiens
ucuccaauuggguugugaa

SEQ ID NO: 1918515 - RNA, 21 nt, Homo sapiens
gagguugggaaggcaccugcu

SEQ ID NO: 1918516 - RNA, 14 nt, Homo sapiens
accuacauuaucuc

SEQ ID NO: 1918517 - RNA, 14 nt, Homo sapiens
uauuacuuauuugg

SEQ ID NO: 1918518 - RNA, 13 nt, Homo sapiens
ccgugugccugag

SEQ ID NO: 1918519 - RNA, 19 nt, Homo sapiens
aaaauccaugaacaauuua

SEQ ID NO: 1918520 - RNA, 12 nt, Homo sapiens
aagaccaucucu

SEQ ID NO: 1918521 - RNA, 18 nt, Homo sapiens
uccuaaucaaauucuguc

SEQ ID NO: 1918522 - RNA, 23 nt, Homo sapiens
ucuacuuacacaucuuccacagg

SEQ ID NO: 1918523 - RNA, 13 nt, Homo sapiens
uuuacuggauaaa

SEQ ID NO: 1918524 - RNA, 16 nt, Homo sapiens
uacaccuaugucauuu

SEQ ID NO: 1918525 - RNA, 21 nt, Homo sapiens
uaugagugcugauucaaacca

SEQ ID NO: 1918526 - RNA, 22 nt, Homo sapiens
uuggcugccccacaggccacac

SEQ ID NO: 1918527 - RNA, 13 nt, Homo sapiens
ggagggguggugu

SEQ ID NO: 1918528 - RNA, 23 nt, Homo sapiens
cuuuugaugccaggugcaaucua

SEQ ID NO: 1918529 - RNA, 13 nt, Homo sapiens
gauaacucaggaa

SEQ ID NO: 1918530 - RNA, 15 nt, Homo sapiens
uguagcagucacuga

SEQ ID NO: 1918531 - RNA, 21 nt, Homo sapiens
caaaaccaaacuuguucauuu

SEQ ID NO: 1918532 - RNA, 17 nt, Homo sapiens
acugauaucuggccuaa

SEQ ID NO: 1918533 - RNA, 18 nt, Homo sapiens
augcgcguggaguucaag

SEQ ID NO: 1918534 - RNA, 16 nt, Homo sapiens
ucaaauauuaccaaaa

SEQ ID NO: 1918535 - RNA, 17 nt, Homo sapiens
auaaaugauguacuaca

SEQ ID NO: 1918536 - RNA, 20 nt, Homo sapiens
cugaaccucaguuuccucau

SEQ ID NO: 1918537 - RNA, 17 nt, Homo sapiens
ugucacaauuauuacca

SEQ ID NO: 1918538 - RNA, 21 nt, Homo sapiens
cuuaauacuaggauacagaaa

SEQ ID NO: 1918539 - RNA, 17 nt, Homo sapiens
cgauuugucugucaagg

SEQ ID NO: 1918540 - RNA, 20 nt, Homo sapiens
aauaagauccaauucaucuu

SEQ ID NO: 1918541 - RNA, 19 nt, Homo sapiens
cuggacacccucuucccau

SEQ ID NO: 1918542 - RNA, 14 nt, Homo sapiens
acuaaagugugcuu

SEQ ID NO: 1918543 - RNA, 18 nt, Homo sapiens
ccuucccccugcaaaaag

SEQ ID NO: 1918544 - RNA, 14 nt, Homo sapiens
cuagcugcaaguga

SEQ ID NO: 1918545 - RNA, 19 nt, Homo sapiens
ugaucgugggguugaccaa

SEQ ID NO: 1918546 - RNA, 19 nt, Homo sapiens
guuucucccccugccaguc

SEQ ID NO: 1918547 - RNA, 14 nt, Homo sapiens
caucucucuuuaau

SEQ ID NO: 1918548 - RNA, 22 nt, Homo sapiens
uguaaccuucuauuuucuauaa

SEQ ID NO: 1918549 - RNA, 15 nt, Homo sapiens
acuaaacaaggcauu

SEQ ID NO: 1918550 - RNA, 14 nt, Homo sapiens
uauuuucaugcugu

SEQ ID NO: 1918551 - RNA, 15 nt, Homo sapiens
gacucugcacauguc

SEQ ID NO: 1918552 - RNA, 15 nt, Homo sapiens
auggaugucuucuag

SEQ ID NO: 1918553 - RNA, 20 nt, Homo sapiens
aacaaagugaaggacauaga

SEQ ID NO: 1918554 - RNA, 22 nt, Homo sapiens
ggcccugggucuugccaugugc

SEQ ID NO: 1918555 - RNA, 22 nt, Homo sapiens
aaucauaaauacugcuguauaa

SEQ ID NO: 1918556 - RNA, 21 nt, Homo sapiens
uacacugcaaucauaugugau

SEQ ID NO: 1918557 - RNA, 12 nt, Homo sapiens
cauuagugccau

SEQ ID NO: 1918558 - RNA, 14 nt, Homo sapiens
aucuaauacacuuu

SEQ ID NO: 1918559 - RNA, 14 nt, Homo sapiens
aauuuuuacuuuaa

SEQ ID NO: 1918560 - RNA, 17 nt, Homo sapiens
agacguggugcuucuca

SEQ ID NO: 1918561 - RNA, 21 nt, Homo sapiens
ugucaauaguauuaacuauua

SEQ ID NO: 1918562 - RNA, 20 nt, Homo sapiens
uaaacaauaaaaguguccau

SEQ ID NO: 1918563 - RNA, 13 nt, Homo sapiens
ugacaagaacaaa

SEQ ID NO: 1918564 - RNA, 13 nt, Homo sapiens
gaaugugucucag

SEQ ID NO: 1918565 - RNA, 17 nt, Homo sapiens
acccucaggaauucagu

SEQ ID NO: 1918566 - RNA, 21 nt, Homo sapiens
aaaauuucacuuaauaaugug

SEQ ID NO: 1918567 - RNA, 18 nt, Homo sapiens
cccuuuuaauacagggac

SEQ ID NO: 1918568 - RNA, 13 nt, Homo sapiens
aaguacaaagcau

SEQ ID NO: 1918569 - RNA, 14 nt, Homo sapiens
ucccacccaaccaa

SEQ ID NO: 1918570 - RNA, 21 nt, Homo sapiens
guccuggggccugugcacugu

SEQ ID NO: 1918571 - RNA, 20 nt, Homo sapiens
ugugcccagagaugggacug

SEQ ID NO: 1918572 - RNA, 14 nt, Homo sapiens
gagaguuccuucuc

SEQ ID NO: 1918573 - RNA, 13 nt, Homo sapiens
gccucuuccauuc

SEQ ID NO: 1918574 - RNA, 22 nt, Homo sapiens
aauucucuaaccgaauauucau

SEQ ID NO: 1918575 - RNA, 20 nt, Homo sapiens
cccuuuucauauacuuauuu

SEQ ID NO: 1918576 - RNA, 20 nt, Homo sapiens
uaacuuucauaccacuugaa

SEQ ID NO: 1918577 - RNA, 13 nt, Homo sapiens
cacauacaaauca

SEQ ID NO: 1918578 - RNA, 14 nt, Homo sapiens
uauuguacauaaaa

SEQ ID NO: 1918579 - RNA, 22 nt, Homo sapiens
gaggcacaagaaucacuugaac

SEQ ID NO: 1918580 - RNA, 19 nt, Homo sapiens
accccaccagaagugcccc

SEQ ID NO: 1918581 - RNA, 22 nt, Homo sapiens
caaauaugcacuuucccuagaa

SEQ ID NO: 1918582 - RNA, 17 nt, Homo sapiens
ugccggcucuaguaccu

SEQ ID NO: 1918583 - RNA, 20 nt, Homo sapiens
aagcucucccuuguuuacuc

SEQ ID NO: 1918584 - RNA, 17 nt, Homo sapiens
ggccuccuucaccaaag

SEQ ID NO: 1918585 - RNA, 20 nt, Homo sapiens
gccuggccaucauggugaaa

SEQ ID NO: 1918586 - RNA, 22 nt, Homo sapiens
ucaaaaucugugaccugucaga

SEQ ID NO: 1918587 - RNA, 21 nt, Homo sapiens
gcgaaaguucuugguggugga

SEQ ID NO: 1918588 - RNA, 18 nt, Homo sapiens
uggccuauuucagcugcu

SEQ ID NO: 1918589 - RNA, 16 nt, Homo sapiens
ggacucaggccaguca

SEQ ID NO: 1918590 - RNA, 19 nt, Homo sapiens
agcagaggcccuucaccca

SEQ ID NO: 1918591 - RNA, 12 nt, Homo sapiens
ucugucaugagc

SEQ ID NO: 1918592 - RNA, 22 nt, Homo sapiens
uuauuaaagcauuuccuaccag

SEQ ID NO: 1918593 - RNA, 16 nt, Homo sapiens
cauauaccaucuccag

SEQ ID NO: 1918594 - RNA, 14 nt, Homo sapiens
guucugaguguuuu

SEQ ID NO: 1918595 - RNA, 18 nt, Homo sapiens
ucuagaggcuuugagaag

SEQ ID NO: 1918596 - RNA, 13 nt, Homo sapiens
uccgggaucaaag

SEQ ID NO: 1918597 - RNA, 21 nt, Homo sapiens
aauaacuuuucaccaaugagc

SEQ ID NO: 1918598 - RNA, 20 nt, Homo sapiens
gaaaggaagcuccacuguca

SEQ ID NO: 1918599 - RNA, 21 nt, Homo sapiens
gcaccuaauccaggcagaucc

SEQ ID NO: 1918600 - RNA, 15 nt, Homo sapiens
uuaugaagcagauuu

SEQ ID NO: 1918601 - RNA, 15 nt, Homo sapiens
aauucuggcacauuu

SEQ ID NO: 1918602 - RNA, 14 nt, Homo sapiens
cccaggagacagac

SEQ ID NO: 1918603 - RNA, 17 nt, Homo sapiens
agucaugggaucccaga

SEQ ID NO: 1918604 - RNA, 14 nt, Homo sapiens
aggagccagugggg

SEQ ID NO: 1918605 - RNA, 22 nt, Homo sapiens
acaacuccugucuaacugcugu

SEQ ID NO: 1918606 - RNA, 12 nt, Homo sapiens
ccacgcuuaggg

SEQ ID NO: 1918607 - RNA, 14 nt, Homo sapiens
aaggugaaccaaag

SEQ ID NO: 1918608 - RNA, 19 nt, Homo sapiens
uucccccuuuucugcauuu

SEQ ID NO: 1918609 - RNA, 22 nt, Homo sapiens
acuuguuggcguaggcuacaga

SEQ ID NO: 1918610 - RNA, 14 nt, Homo sapiens
aaauggaguauuuu

SEQ ID NO: 1918611 - RNA, 17 nt, Homo sapiens
cauacccacacacccag

SEQ ID NO: 1918612 - RNA, 19 nt, Homo sapiens
acuguaaacauucaucaag

SEQ ID NO: 1918613 - RNA, 19 nt, Homo sapiens
gcugcauuugccugucaug

SEQ ID NO: 1918614 - RNA, 13 nt, Homo sapiens
ccaaccucaggcu

SEQ ID NO: 1918615 - RNA, 14 nt, Homo sapiens
gcuggggagacaaa

SEQ ID NO: 1918616 - RNA, 19 nt, Homo sapiens
uucucuaucccaagccaac

SEQ ID NO: 1918617 - RNA, 23 nt, Homo sapiens
aaaguuuccguggguucugucau

SEQ ID NO: 1918618 - RNA, 23 nt, Homo sapiens
auuuguagccaaagaaauuucaa

SEQ ID NO: 1918619 - RNA, 21 nt, Homo sapiens
ucaugggacuaaaugaacuaa

SEQ ID NO: 1918620 - RNA, 14 nt, Homo sapiens
uucaugucuuucca

SEQ ID NO: 1918621 - RNA, 20 nt, Homo sapiens
uagcacugacagauuuccau

SEQ ID NO: 1918622 - RNA, 21 nt, Homo sapiens
guauucuuuacuaaagauauc

SEQ ID NO: 1918623 - RNA, 16 nt, Homo sapiens
cccugguccuucacug

SEQ ID NO: 1918624 - RNA, 21 nt, Homo sapiens
uuccaggcgaugugcaagugu

SEQ ID NO: 1918625 - RNA, 17 nt, Homo sapiens
agccuugaacucugggc

SEQ ID NO: 1918626 - RNA, 23 nt, Homo sapiens
aacaaauaugcaaaccaggauuu

SEQ ID NO: 1918627 - RNA, 12 nt, Homo sapiens
auugccaucacu

SEQ ID NO: 1918628 - RNA, 12 nt, Homo sapiens
acccccagugug

SEQ ID NO: 1918629 - RNA, 16 nt, Homo sapiens
uaaaucguaaccuaug

SEQ ID NO: 1918630 - RNA, 19 nt, Homo sapiens
ugggauuacaggugugaac

SEQ ID NO: 1918631 - RNA, 22 nt, Homo sapiens
uaucugcauauguuuuccacau

SEQ ID NO: 1918632 - RNA, 13 nt, Homo sapiens
gcucccuagccag

SEQ ID NO: 1918633 - RNA, 17 nt, Homo sapiens
cauuagaauaggaauug

SEQ ID NO: 1918634 - RNA, 19 nt, Homo sapiens
agaucuugguccuguguuu

SEQ ID NO: 1918635 - RNA, 12 nt, Homo sapiens
uaaaauacucac

SEQ ID NO: 1918636 - RNA, 16 nt, Homo sapiens
gacaugauuuccuuga

SEQ ID NO: 1918637 - RNA, 11 nt, Homo sapiens
ucuugaacucc

SEQ ID NO: 1918638 - RNA, 21 nt, Homo sapiens
cagccuggccaacauaguggg

SEQ ID NO: 1918639 - RNA, 14 nt, Homo sapiens
uacagccauaugca

SEQ ID NO: 1918640 - RNA, 14 nt, Homo sapiens
uguggacaugcacc

SEQ ID NO: 1918641 - RNA, 20 nt, Homo sapiens
ugagagacccucaccuuccu

SEQ ID NO: 1918642 - RNA, 19 nt, Homo sapiens
ucccugaacacucaucccc

SEQ ID NO: 1918643 - RNA, 13 nt, Homo sapiens
uccagacccucau

SEQ ID NO: 1918644 - RNA, 13 nt, Homo sapiens
uggagaaaaucaa

SEQ ID NO: 1918645 - RNA, 23 nt, Homo sapiens
aacucuggugcuccugcaucuca

SEQ ID NO: 1918646 - RNA, 20 nt, Homo sapiens
gggcgcccucucugcuccuu

SEQ ID NO: 1918647 - RNA, 23 nt, Homo sapiens
gucuuacaggaagccucucauag

SEQ ID NO: 1918648 - RNA, 20 nt, Homo sapiens
ccucacuucuggcacuguga

SEQ ID NO: 1918649 - RNA, 19 nt, Homo sapiens
cuuucccuucaguacccuc

SEQ ID NO: 1918650 - RNA, 17 nt, Homo sapiens
agcugcuggcagugggu

SEQ ID NO: 1918651 - RNA, 13 nt, Homo sapiens
cuguggaauauaa

SEQ ID NO: 1918652 - RNA, 15 nt, Homo sapiens
aauuuucuaugcuua

SEQ ID NO: 1918653 - RNA, 15 nt, Homo sapiens
guguucaugaucucc

SEQ ID NO: 1918654 - RNA, 19 nt, Homo sapiens
ggaaggucccuuguuucca

SEQ ID NO: 1918655 - RNA, 15 nt, Homo sapiens
uggaguccuguucuc

SEQ ID NO: 1918656 - RNA, 21 nt, Homo sapiens
ucagccccagucccagccaca

SEQ ID NO: 1918657 - RNA, 20 nt, Homo sapiens
ucuaaagaauguguucuaaa

SEQ ID NO: 1918658 - RNA, 20 nt, Homo sapiens
aggcaccgccagaguguccu

SEQ ID NO: 1918659 - RNA, 14 nt, Homo sapiens
ugacaucauuugua

SEQ ID NO: 1918660 - RNA, 18 nt, Homo sapiens
ugcuccaggccugcauua

SEQ ID NO: 1918661 - RNA, 13 nt, Homo sapiens
ucaacccucucaa

SEQ ID NO: 1918662 - RNA, 21 nt, Homo sapiens
cacguugccaggggcuugaga

SEQ ID NO: 1918663 - RNA, 15 nt, Homo sapiens
cuaaaugccuuugac

SEQ ID NO: 1918664 - RNA, 13 nt, Homo sapiens
ccauggcuuugug

SEQ ID NO: 1918665 - RNA, 12 nt, Homo sapiens
acaggagcacug

SEQ ID NO: 1918666 - RNA, 22 nt, Homo sapiens
cgaagaucgugccauugcacuc

SEQ ID NO: 1918667 - RNA, 13 nt, Homo sapiens
gcuguaugugagc

SEQ ID NO: 1918668 - RNA, 15 nt, Homo sapiens
auguuacugcuucau

SEQ ID NO: 1918669 - RNA, 21 nt, Homo sapiens
gaggugggcagaucaccugag

SEQ ID NO: 1918670 - RNA, 18 nt, Homo sapiens
gauaagauuuaccuuuau

SEQ ID NO: 1918671 - RNA, 19 nt, Homo sapiens
cagacccacagagugccau

SEQ ID NO: 1918672 - RNA, 18 nt, Homo sapiens
ugaaugagacccagcuga

SEQ ID NO: 1918673 - RNA, 15 nt, Homo sapiens
uggccacagugucac

SEQ ID NO: 1918674 - RNA, 15 nt, Homo sapiens
uucuauaaggccaua

SEQ ID NO: 1918675 - RNA, 15 nt, Homo sapiens
caacugggccucuga

SEQ ID NO: 1918676 - RNA, 18 nt, Homo sapiens
aagcuggagcucuuggaa

SEQ ID NO: 1918677 - RNA, 15 nt, Homo sapiens
acuguaaugaggaaa

SEQ ID NO: 1918678 - RNA, 16 nt, Homo sapiens
aaauauaagagcaaga

SEQ ID NO: 1918679 - RNA, 22 nt, Homo sapiens
ucauuaguaaaaaugacuucac

SEQ ID NO: 1918680 - RNA, 21 nt, Homo sapiens
uugaaaggagaugucuuggaa

SEQ ID NO: 1918681 - RNA, 16 nt, Homo sapiens
caacaugcgaccguga

SEQ ID NO: 1918682 - RNA, 20 nt, Homo sapiens
ucucagucaguaauugccaa

SEQ ID NO: 1918683 - RNA, 16 nt, Homo sapiens
cuuuuccaaacccagg

SEQ ID NO: 1918684 - RNA, 18 nt, Homo sapiens
caaaauggaagguuggag

SEQ ID NO: 1918685 - RNA, 17 nt, Homo sapiens
cuccaauugcaguggau

SEQ ID NO: 1918686 - RNA, 14 nt, Homo sapiens
acacagggugcaug

SEQ ID NO: 1918687 - RNA, 21 nt, Homo sapiens
cuccguugcggcugugcuccu

SEQ ID NO: 1918688 - RNA, 14 nt, Homo sapiens
gugucgucugugaa

SEQ ID NO: 1918689 - RNA, 23 nt, Homo sapiens
acuggauagaaccaccauaguga

SEQ ID NO: 1918690 - RNA, 16 nt, Homo sapiens
ucuccucccauggccu

SEQ ID NO: 1918691 - RNA, 18 nt, Homo sapiens
uucuggguccauacacca

SEQ ID NO: 1918692 - RNA, 17 nt, Homo sapiens
gccacgcacagccagac

SEQ ID NO: 1918693 - RNA, 14 nt, Homo sapiens
ucccaggacucuga

SEQ ID NO: 1918694 - RNA, 20 nt, Homo sapiens
caagguguaggucagauauu

SEQ ID NO: 1918695 - RNA, 17 nt, Homo sapiens
auccuggccuuguacuu

SEQ ID NO: 1918696 - RNA, 13 nt, Homo sapiens
uauaacacuguga

SEQ ID NO: 1918697 - RNA, 12 nt, Homo sapiens
ggacaccucuca

SEQ ID NO: 1918698 - RNA, 17 nt, Homo sapiens
ugugauuuuaacucugu

SEQ ID NO: 1918699 - RNA, 15 nt, Homo sapiens
guuugaacucuguaa

SEQ ID NO: 1918700 - RNA, 19 nt, Homo sapiens
ccaaugguccuagaacuuu

SEQ ID NO: 1918701 - RNA, 13 nt, Homo sapiens
aacauuaugaugu

SEQ ID NO: 1918702 - RNA, 22 nt, Homo sapiens
cuccuucccauuucucuacacu

SEQ ID NO: 1918703 - RNA, 20 nt, Homo sapiens
acuuuagacuucccacuguu

SEQ ID NO: 1918704 - RNA, 19 nt, Homo sapiens
uuccaugagaagaagcaga

SEQ ID NO: 1918705 - RNA, 22 nt, Homo sapiens
cauuugucaacaaagucaccca

SEQ ID NO: 1918706 - RNA, 21 nt, Homo sapiens
ugaaguagacauggaauuuau

SEQ ID NO: 1918707 - RNA, 19 nt, Homo sapiens
ggucucucucccucugucu

SEQ ID NO: 1918708 - RNA, 14 nt, Homo sapiens
auucaccuguaaaa

SEQ ID NO: 1918709 - RNA, 23 nt, Homo sapiens
cuggcuugccccaggacucuggc

SEQ ID NO: 1918710 - RNA, 20 nt, Homo sapiens
uucauaaaaaauaauggugu

SEQ ID NO: 1918711 - RNA, 17 nt, Homo sapiens
uucaauccuuuucauac

SEQ ID NO: 1918712 - RNA, 13 nt, Homo sapiens
auuccuaucucau

SEQ ID NO: 1918713 - RNA, 16 nt, Homo sapiens
uaauguguauucauuu

SEQ ID NO: 1918714 - RNA, 19 nt, Homo sapiens
ggcuaugaggauaauggga

SEQ ID NO: 1918715 - RNA, 17 nt, Homo sapiens
ucauuuacaaagcaaaa

SEQ ID NO: 1918716 - RNA, 21 nt, Homo sapiens
auuuuauauaaagaaaaucaa

SEQ ID NO: 1918717 - RNA, 19 nt, Homo sapiens
gcugucccuugcuugccug

SEQ ID NO: 1918718 - RNA, 14 nt, Homo sapiens
cugcccuacuggga

SEQ ID NO: 1918719 - RNA, 14 nt, Homo sapiens
uucaauauugacau

SEQ ID NO: 1918720 - RNA, 14 nt, Homo sapiens
ugcaauauuuacau

SEQ ID NO: 1918721 - RNA, 15 nt, Homo sapiens
acaauuacugugaga

SEQ ID NO: 1918722 - RNA, 16 nt, Homo sapiens
uagccgaaaugaucuu

SEQ ID NO: 1918723 - RNA, 20 nt, Homo sapiens
aacuuuauuggucuugcccu

SEQ ID NO: 1918724 - RNA, 12 nt, Homo sapiens
cucacauucaca

SEQ ID NO: 1918725 - RNA, 12 nt, Homo sapiens
cauccauucuuc

SEQ ID NO: 1918726 - RNA, 23 nt, Homo sapiens
cccugacccagagccuaggggau

SEQ ID NO: 1918727 - RNA, 20 nt, Homo sapiens
acauccaggauggcugcaag

SEQ ID NO: 1918728 - RNA, 18 nt, Homo sapiens
cauucagagguuuuguua

SEQ ID NO: 1918729 - RNA, 20 nt, Homo sapiens
accauacacacacacaaaaa

SEQ ID NO: 1918730 - RNA, 17 nt, Homo sapiens
cuggagguugaagccaa

SEQ ID NO: 1918731 - RNA, 20 nt, Homo sapiens
caguugacucagagugcaag

SEQ ID NO: 1918732 - RNA, 17 nt, Homo sapiens
uucccccugcaaaaaga

SEQ ID NO: 1918733 - RNA, 19 nt, Homo sapiens
ggaggugucuguaucagug

SEQ ID NO: 1918734 - RNA, 16 nt, Homo sapiens
aauuccaauacauuau

SEQ ID NO: 1918735 - RNA, 15 nt, Homo sapiens
gcccaucgugaagaa

SEQ ID NO: 1918736 - RNA, 17 nt, Homo sapiens
gugucagacgagcagug

SEQ ID NO: 1918737 - RNA, 16 nt, Homo sapiens
auacaagaaagcaaug

SEQ ID NO: 1918738 - RNA, 17 nt, Homo sapiens
acccagaguggcccaag

SEQ ID NO: 1918739 - RNA, 16 nt, Homo sapiens
cuuuuucugagcuuuu

SEQ ID NO: 1918740 - RNA, 16 nt, Homo sapiens
gauccccacuguccua

SEQ ID NO: 1918741 - RNA, 14 nt, Homo sapiens
gguccauuuugccu

SEQ ID NO: 1918742 - RNA, 16 nt, Homo sapiens
aguguauuuucuguca

SEQ ID NO: 1918743 - RNA, 16 nt, Homo sapiens
uuuguuuaagcugacu

SEQ ID NO: 1918744 - RNA, 19 nt, Homo sapiens
acuggccccugagaucucu

SEQ ID NO: 1918745 - RNA, 19 nt, Homo sapiens
agccaauaggcagcuuucu

SEQ ID NO: 1918746 - RNA, 22 nt, Homo sapiens
cccuuuucuggggaauuacuuu

SEQ ID NO: 1918747 - RNA, 18 nt, Homo sapiens
acuuucaguaaacauaaa

SEQ ID NO: 1918748 - RNA, 22 nt, Homo sapiens
uauuuuuauaaauauaagccuu

SEQ ID NO: 1918749 - RNA, 21 nt, Homo sapiens
caaggcaaaaaaaucauauaa

SEQ ID NO: 1918750 - RNA, 19 nt, Homo sapiens
cuggcccuaggcacugaua

SEQ ID NO: 1918751 - RNA, 13 nt, Homo sapiens
uaguaauaccucu

SEQ ID NO: 1918752 - RNA, 22 nt, Homo sapiens
ucaagagaaaugauguugucac

SEQ ID NO: 1918753 - RNA, 13 nt, Homo sapiens
gccuucacugaca

SEQ ID NO: 1918754 - RNA, 21 nt, Homo sapiens
agcucaguugagaaacaguuc

SEQ ID NO: 1918755 - RNA, 22 nt, Homo sapiens
ucaccagcaugguaguggcaaa

SEQ ID NO: 1918756 - RNA, 14 nt, Homo sapiens
aagcugaagugcau

SEQ ID NO: 1918757 - RNA, 14 nt, Homo sapiens
gaagugaggacaaa

SEQ ID NO: 1918758 - RNA, 15 nt, Homo sapiens
gaagaagcuauguca

SEQ ID NO: 1918759 - RNA, 21 nt, Homo sapiens
aauacuggggauuaccauuca

SEQ ID NO: 1918760 - RNA, 14 nt, Homo sapiens
acuccugaccucag

SEQ ID NO: 1918761 - RNA, 14 nt, Homo sapiens
aaaucugacaauag

SEQ ID NO: 1918762 - RNA, 20 nt, Homo sapiens
uuacauccuugauuacuucc

SEQ ID NO: 1918763 - RNA, 18 nt, Homo sapiens
cuuaacugcauuuuuaga

SEQ ID NO: 1918764 - RNA, 22 nt, Homo sapiens
agcaacauuuuuacauuuauuc

SEQ ID NO: 1918765 - RNA, 18 nt, Homo sapiens
gccucaguuacacaggaa

SEQ ID NO: 1918766 - RNA, 16 nt, Homo sapiens
auaacuuuaacuuuua

SEQ ID NO: 1918767 - RNA, 15 nt, Homo sapiens
cuguccucagccuug

SEQ ID NO: 1918768 - RNA, 13 nt, Homo sapiens
auucaaaugcaug

SEQ ID NO: 1918769 - RNA, 14 nt, Homo sapiens
ugcauggcauuugu

SEQ ID NO: 1918770 - RNA, 21 nt, Homo sapiens
cccccucuaacccccagugcc

SEQ ID NO: 1918771 - RNA, 23 nt, Homo sapiens
uaacuuuugggcguaagaccaaa

SEQ ID NO: 1918772 - RNA, 12 nt, Homo sapiens
ugauacugcugc

SEQ ID NO: 1918773 - RNA, 14 nt, Homo sapiens
cugacggugcaguc

SEQ ID NO: 1918774 - RNA, 19 nt, Homo sapiens
uuaauaccguaucuucuaa

SEQ ID NO: 1918775 - RNA, 21 nt, Homo sapiens
auucugaguauucauuuugca

SEQ ID NO: 1918776 - RNA, 22 nt, Homo sapiens
caauuauagaguaucacuccca

SEQ ID NO: 1918777 - RNA, 16 nt, Homo sapiens
uugcacugacaguggg

SEQ ID NO: 1918778 - RNA, 12 nt, Homo sapiens
gaugaauaccuu

SEQ ID NO: 1918779 - RNA, 19 nt, Homo sapiens
gauauucucuagucauuug

SEQ ID NO: 1918780 - RNA, 13 nt, Homo sapiens
ugaaugacuugac

SEQ ID NO: 1918781 - RNA, 16 nt, Homo sapiens
acaacuuguauuucca

SEQ ID NO: 1918782 - RNA, 21 nt, Homo sapiens
gccucugugccgcaccauuga

SEQ ID NO: 1918783 - RNA, 17 nt, Homo sapiens
agucuggcaaacaugug

SEQ ID NO: 1918784 - RNA, 15 nt, Homo sapiens
ugcuggaucacagcu

SEQ ID NO: 1918785 - RNA, 17 nt, Homo sapiens
aauguagcagcucauaa

SEQ ID NO: 1918786 - RNA, 17 nt, Homo sapiens
uggaugcuuuggcaaug

SEQ ID NO: 1918787 - RNA, 22 nt, Homo sapiens
cccagugcucacacaaucagac

SEQ ID NO: 1918788 - RNA, 14 nt, Homo sapiens
ucuaaaguguuuag

SEQ ID NO: 1918789 - RNA, 20 nt, Homo sapiens
gucaucugcaugucuacuca

SEQ ID NO: 1918790 - RNA, 14 nt, Homo sapiens
aguaccuucaauac

SEQ ID NO: 1918791 - RNA, 21 nt, Homo sapiens
ucacucaugcaaacugcuuua

SEQ ID NO: 1918792 - RNA, 17 nt, Homo sapiens
ccagucauauguucuca

SEQ ID NO: 1918793 - RNA, 19 nt, Homo sapiens
agaauucuguacuuccaau

SEQ ID NO: 1918794 - RNA, 22 nt, Homo sapiens
gcacccaugacaaucaccuuca

SEQ ID NO: 1918795 - RNA, 18 nt, Homo sapiens
cacugaugggcacuggaa

SEQ ID NO: 1918796 - RNA, 18 nt, Homo sapiens
agauggcugcugcucacc

SEQ ID NO: 1918797 - RNA, 20 nt, Homo sapiens
ucaccuuauucuucauuucg

SEQ ID NO: 1918798 - RNA, 19 nt, Homo sapiens
cugaggaagaagggauaau

SEQ ID NO: 1918799 - RNA, 19 nt, Homo sapiens
ccaaauagcccacacgugc

SEQ ID NO: 1918800 - RNA, 22 nt, Homo sapiens
uuguuacuguucuugcugcuag

SEQ ID NO: 1918801 - RNA, 16 nt, Homo sapiens
acagaagcagacuuuu

SEQ ID NO: 1918802 - RNA, 20 nt, Homo sapiens
caguaaaaucaaaugugcau

SEQ ID NO: 1918803 - RNA, 14 nt, Homo sapiens
agcccccacuccag

SEQ ID NO: 1918804 - RNA, 23 nt, Homo sapiens
uuucuuccaauuauuacaguccu

SEQ ID NO: 1918805 - RNA, 18 nt, Homo sapiens
ucagaacuaccauuguaa

SEQ ID NO: 1918806 - RNA, 14 nt, Homo sapiens
ggccaccaggcugg

SEQ ID NO: 1918807 - RNA, 14 nt, Homo sapiens
gacagagcugggau

SEQ ID NO: 1918808 - RNA, 16 nt, Homo sapiens
cuccaccuagacugua

SEQ ID NO: 1918809 - RNA, 21 nt, Homo sapiens
uaauguaucccgauaacuuug

SEQ ID NO: 1918810 - RNA, 20 nt, Homo sapiens
ucaugcuuuaaaguguaaua

SEQ ID NO: 1918811 - RNA, 18 nt, Homo sapiens
agcaggcagaacucuccu

SEQ ID NO: 1918812 - RNA, 18 nt, Homo sapiens
cuccccacaguccucaca

SEQ ID NO: 1918813 - RNA, 18 nt, Homo sapiens
cauauuguugcauugcuu

SEQ ID NO: 1918814 - RNA, 19 nt, Homo sapiens
uggaaaaauucauugucuc

SEQ ID NO: 1918815 - RNA, 16 nt, Homo sapiens
augcuucuucucaggc

SEQ ID NO: 1918816 - RNA, 19 nt, Homo sapiens
uggauauuacugaaaggga

SEQ ID NO: 1918817 - RNA, 23 nt, Homo sapiens
acauuucaaaauuaauagcuuuu

SEQ ID NO: 1918818 - RNA, 14 nt, Homo sapiens
uguuauaucaggga

SEQ ID NO: 1918819 - RNA, 22 nt, Homo sapiens
cgccauugagaaugugcuuugu

SEQ ID NO: 1918820 - RNA, 18 nt, Homo sapiens
gaaaguuuuguucuguau

SEQ ID NO: 1918821 - RNA, 23 nt, Homo sapiens
aagaacuggaaccccagcuuccc

SEQ ID NO: 1918822 - RNA, 13 nt, Homo sapiens
acaccuaagccca

SEQ ID NO: 1918823 - RNA, 18 nt, Homo sapiens
acucaggaauguuugcug

SEQ ID NO: 1918824 - RNA, 15 nt, Homo sapiens
uuugagggugggggu

SEQ ID NO: 1918825 - RNA, 20 nt, Homo sapiens
cuuacuuucuuuacauacca

SEQ ID NO: 1918826 - RNA, 16 nt, Homo sapiens
augggucccucagucu

SEQ ID NO: 1918827 - RNA, 14 nt, Homo sapiens
uucauucacauuca

SEQ ID NO: 1918828 - RNA, 20 nt, Homo sapiens
ccagcagaauugacaguuga

SEQ ID NO: 1918829 - RNA, 15 nt, Homo sapiens
caccaggagauuaca

SEQ ID NO: 1918830 - RNA, 16 nt, Homo sapiens
aggugcuuauucucaa

SEQ ID NO: 1918831 - RNA, 22 nt, Homo sapiens
augccaucccgucgacucucca

SEQ ID NO: 1918832 - RNA, 21 nt, Homo sapiens
uuaucaacuggggggaccaaa

SEQ ID NO: 1918833 - RNA, 22 nt, Homo sapiens
cauggccuugaaacaguuccau

SEQ ID NO: 1918834 - RNA, 19 nt, Homo sapiens
cuacucgggaggcugaggu

SEQ ID NO: 1918835 - RNA, 21 nt, Homo sapiens
aaaucauccugucacaaggca

SEQ ID NO: 1918836 - RNA, 15 nt, Homo sapiens
ugcuuuuccauuucg

SEQ ID NO: 1918837 - RNA, 19 nt, Homo sapiens
ggacucugggcugugccug

SEQ ID NO: 1918838 - RNA, 14 nt, Homo sapiens
uguauccacaaauc

SEQ ID NO: 1918839 - RNA, 14 nt, Homo sapiens
cggcgauaccauag

SEQ ID NO: 1918840 - RNA, 17 nt, Homo sapiens
agccuucuuuuguacuu

SEQ ID NO: 1918841 - RNA, 23 nt, Homo sapiens
cagaccgacguugccaucaaaac

SEQ ID NO: 1918842 - RNA, 13 nt, Homo sapiens
ggguagaccuuga

SEQ ID NO: 1918843 - RNA, 22 nt, Homo sapiens
gugacuugauugccaaggaaug

SEQ ID NO: 1918844 - RNA, 17 nt, Homo sapiens
gagucucauuugggcua

SEQ ID NO: 1918845 - RNA, 23 nt, Homo sapiens
agaggcugaggugagaggaucag

SEQ ID NO: 1918846 - RNA, 22 nt, Homo sapiens
caugaaaauagccaaccagcag

SEQ ID NO: 1918847 - RNA, 18 nt, Homo sapiens
ugguaugguuguauacac

SEQ ID NO: 1918848 - RNA, 18 nt, Homo sapiens
uucaccuacauuaucuca

SEQ ID NO: 1918849 - RNA, 22 nt, Homo sapiens
guacggcaaccacaugucccag

SEQ ID NO: 1918850 - RNA, 18 nt, Homo sapiens
uacuguucuaaagcucug

SEQ ID NO: 1918851 - RNA, 14 nt, Homo sapiens
aucaaguugcacac

SEQ ID NO: 1918852 - RNA, 13 nt, Homo sapiens
gcacauaacaugc

SEQ ID NO: 1918853 - RNA, 18 nt, Homo sapiens
agccacccuguguugaca

SEQ ID NO: 1918854 - RNA, 23 nt, Homo sapiens
ggaagcacaugccucucucaggc

SEQ ID NO: 1918855 - RNA, 15 nt, Homo sapiens
aguggcagccaagag

SEQ ID NO: 1918856 - RNA, 15 nt, Homo sapiens
cucccccacucccuc

SEQ ID NO: 1918857 - RNA, 14 nt, Homo sapiens
cugugacugugucc

SEQ ID NO: 1918858 - RNA, 18 nt, Homo sapiens
auuuaaauagaacuugau

SEQ ID NO: 1918859 - RNA, 14 nt, Homo sapiens
aagcaaaaccaaag

SEQ ID NO: 1918860 - RNA, 16 nt, Homo sapiens
cuucugauaaacacaa

SEQ ID NO: 1918861 - RNA, 17 nt, Homo sapiens
aguuuccucuguucuca

SEQ ID NO: 1918862 - RNA, 15 nt, Homo sapiens
cuugagcaaauuacc

SEQ ID NO: 1918863 - RNA, 22 nt, Homo sapiens
ucucaaauuauuuaaaaugcau

SEQ ID NO: 1918864 - RNA, 17 nt, Homo sapiens
augcccccuccugcaag

SEQ ID NO: 1918865 - RNA, 20 nt, Homo sapiens
aauguaacucuauaguuauu

SEQ ID NO: 1918866 - RNA, 17 nt, Homo sapiens
agauagugccucugcaa

SEQ ID NO: 1918867 - RNA, 15 nt, Homo sapiens
guugcagugagccgu

SEQ ID NO: 1918868 - RNA, 19 nt, Homo sapiens
cauuuauuuauacagugcc

SEQ ID NO: 1918869 - RNA, 20 nt, Homo sapiens
ggcucucuugugcauuguag

SEQ ID NO: 1918870 - RNA, 13 nt, Homo sapiens
agcauaacacagc

SEQ ID NO: 1918871 - RNA, 13 nt, Homo sapiens
aguaaaguuuaaa

SEQ ID NO: 1918872 - RNA, 19 nt, Homo sapiens
uaaaaaucuuaauguauca

SEQ ID NO: 1918873 - RNA, 21 nt, Homo sapiens
ccggaaggaggccaaccagcc

SEQ ID NO: 1918874 - RNA, 15 nt, Homo sapiens
uggaauauacaugua

SEQ ID NO: 1918875 - RNA, 13 nt, Homo sapiens
uuuaaaaaaugga

SEQ ID NO: 1918876 - RNA, 23 nt, Homo sapiens
auauuuuggggggcagagaauaa

SEQ ID NO: 1918877 - RNA, 12 nt, Homo sapiens
auuuucaguaua

SEQ ID NO: 1918878 - RNA, 22 nt, Homo sapiens
ggcucauaccuggcuugcaggg

SEQ ID NO: 1918879 - RNA, 22 nt, Homo sapiens
uacacgguucaaaccugugaag

SEQ ID NO: 1918880 - RNA, 18 nt, Homo sapiens
agaggcuacaaggacuua

SEQ ID NO: 1918881 - RNA, 18 nt, Homo sapiens
cccucaugaucauucuca

SEQ ID NO: 1918882 - RNA, 17 nt, Homo sapiens
ugcuguugcugauuuua

SEQ ID NO: 1918883 - RNA, 14 nt, Homo sapiens
agaauaaauuccca

SEQ ID NO: 1918884 - RNA, 19 nt, Homo sapiens
auugccacaaguccagcug

SEQ ID NO: 1918885 - RNA, 13 nt, Homo sapiens
auaauucagucug

SEQ ID NO: 1918886 - RNA, 21 nt, Homo sapiens
uucuuuccucaaagaagcaug

SEQ ID NO: 1918887 - RNA, 21 nt, Homo sapiens
gugcuggcauuacagguguga

SEQ ID NO: 1918888 - RNA, 17 nt, Homo sapiens
auuuuuuaaguuuauuu

SEQ ID NO: 1918889 - RNA, 17 nt, Homo sapiens
caaaucugauggccuua

SEQ ID NO: 1918890 - RNA, 12 nt, Homo sapiens
aggauaugcagu

SEQ ID NO: 1918891 - RNA, 20 nt, Homo sapiens
uuuggaggcuccaagccuca

SEQ ID NO: 1918892 - RNA, 14 nt, Homo sapiens
cagacuucaucuuc

SEQ ID NO: 1918893 - RNA, 22 nt, Homo sapiens
auggaauuuuuugaauaugccu

SEQ ID NO: 1918894 - RNA, 16 nt, Homo sapiens
ucgucugucaaugaca

SEQ ID NO: 1918895 - RNA, 18 nt, Homo sapiens
auauacuauuuauauaca

SEQ ID NO: 1918896 - RNA, 23 nt, Homo sapiens
aagccccaugggcugccuugaaa

SEQ ID NO: 1918897 - RNA, 15 nt, Homo sapiens
aagcaugaaacugug

SEQ ID NO: 1918898 - RNA, 16 nt, Homo sapiens
uaaaaauggcucagau

SEQ ID NO: 1918899 - RNA, 12 nt, Homo sapiens
uguuuuuugcca

SEQ ID NO: 1918900 - RNA, 16 nt, Homo sapiens
uauuucacaaauaaua

SEQ ID NO: 1918901 - RNA, 19 nt, Homo sapiens
ugcauaaagaauaguaauu

SEQ ID NO: 1918902 - RNA, 14 nt, Homo sapiens
cuuucuucagcucu

SEQ ID NO: 1918903 - RNA, 13 nt, Homo sapiens
ugaaauucuucaa

SEQ ID NO: 1918904 - RNA, 12 nt, Homo sapiens
aguaaacaauaa

SEQ ID NO: 1918905 - RNA, 14 nt, Homo sapiens
cuuuuguacugaaa

SEQ ID NO: 1918906 - RNA, 17 nt, Homo sapiens
cuuuucugccacuccau

SEQ ID NO: 1918907 - RNA, 15 nt, Homo sapiens
agacuugauacugca

SEQ ID NO: 1918908 - RNA, 22 nt, Homo sapiens
aacugacaggcagccuggacau

SEQ ID NO: 1918909 - RNA, 19 nt, Homo sapiens
aaugucagcacauguugcu

SEQ ID NO: 1918910 - RNA, 23 nt, Homo sapiens
uucauaggaauugguaaggccuc

SEQ ID NO: 1918911 - RNA, 20 nt, Homo sapiens
ucucggcucaggcucugcug

SEQ ID NO: 1918912 - RNA, 20 nt, Homo sapiens
ccuccaaauguccuuucuca

SEQ ID NO: 1918913 - RNA, 17 nt, Homo sapiens
ccuuccuuguagccuuu

SEQ ID NO: 1918914 - RNA, 16 nt, Homo sapiens
acuuuucacaguaugg

SEQ ID NO: 1918915 - RNA, 12 nt, Homo sapiens
ccgagugcaaug

SEQ ID NO: 1918916 - RNA, 22 nt, Homo sapiens
cccugggcuaccaucugcaugg

SEQ ID NO: 1918917 - RNA, 14 nt, Homo sapiens
uccuucaaugcaaa

SEQ ID NO: 1918918 - RNA, 20 nt, Homo sapiens
gcauuccaucccuuccugaa

SEQ ID NO: 1918919 - RNA, 21 nt, Homo sapiens
accccgauagugacacaucuu

SEQ ID NO: 1918920 - RNA, 19 nt, Homo sapiens
aagguccccagcagaauug

SEQ ID NO: 1918921 - RNA, 18 nt, Homo sapiens
agagaacaaucacuauuc

SEQ ID NO: 1918922 - RNA, 21 nt, Homo sapiens
aggcccaacugugagcaagga

SEQ ID NO: 1918923 - RNA, 18 nt, Homo sapiens
uccugcucaggaaaccac

SEQ ID NO: 1918924 - RNA, 14 nt, Homo sapiens
gugccuccucaaac

SEQ ID NO: 1918925 - RNA, 19 nt, Homo sapiens
uuugacugcuucacggacu

SEQ ID NO: 1918926 - RNA, 20 nt, Homo sapiens
cauccuggagaguaucugag

SEQ ID NO: 1918927 - RNA, 21 nt, Homo sapiens
aagaaauguuuuugcuguuaa

SEQ ID NO: 1918928 - RNA, 18 nt, Homo sapiens
gcaguaugugauggacug

SEQ ID NO: 1918929 - RNA, 15 nt, Homo sapiens
aucauaguugcaaaa

SEQ ID NO: 1918930 - RNA, 13 nt, Homo sapiens
acuuaaagugaau

SEQ ID NO: 1918931 - RNA, 24 nt, Homo sapiens
ucugucugggcucagacauccaca

SEQ ID NO: 1918932 - RNA, 13 nt, Homo sapiens
caauucuccugcc

SEQ ID NO: 1918933 - RNA, 21 nt, Homo sapiens
agcggccacacuguacucugc

SEQ ID NO: 1918934 - RNA, 16 nt, Homo sapiens
uggaagacagcucuua

SEQ ID NO: 1918935 - RNA, 23 nt, Homo sapiens
cacacucuuucuccugcuuuaac

SEQ ID NO: 1918936 - RNA, 15 nt, Homo sapiens
aauguauugauucaa

SEQ ID NO: 1918937 - RNA, 12 nt, Homo sapiens
uaaaacaccuca

SEQ ID NO: 1918938 - RNA, 15 nt, Homo sapiens
cccagugaucaccug

SEQ ID NO: 1918939 - RNA, 12 nt, Homo sapiens
acccaugacaau

SEQ ID NO: 1918940 - RNA, 19 nt, Homo sapiens
uucaugucugaaacagaga

SEQ ID NO: 1918941 - RNA, 16 nt, Homo sapiens
gaucucgguuugccaa

SEQ ID NO: 1918942 - RNA, 19 nt, Homo sapiens
uguuuguuguauacuuccu

SEQ ID NO: 1918943 - RNA, 15 nt, Homo sapiens
agcacuagaucuccc

SEQ ID NO: 1918944 - RNA, 19 nt, Homo sapiens
ucacgucuguaaucccagc

SEQ ID NO: 1918945 - RNA, 20 nt, Homo sapiens
acagagacagugaaaguuuu

SEQ ID NO: 1918946 - RNA, 14 nt, Homo sapiens
aggcaacauccaaa

SEQ ID NO: 1918947 - RNA, 20 nt, Homo sapiens
aguauacuagaaaguaauac

SEQ ID NO: 1918948 - RNA, 17 nt, Homo sapiens
cuaggggggucagccag

SEQ ID NO: 1918949 - RNA, 15 nt, Homo sapiens
uuucauugacacucu

SEQ ID NO: 1918950 - RNA, 16 nt, Homo sapiens
aucucuuugaugucau

SEQ ID NO: 1918951 - RNA, 13 nt, Homo sapiens
uguaguuucuuga

SEQ ID NO: 1918952 - RNA, 11 nt, Homo sapiens
caagaaugaga

SEQ ID NO: 1918953 - RNA, 17 nt, Homo sapiens
aaugauggaacaguaau

SEQ ID NO: 1918954 - RNA, 15 nt, Homo sapiens
auaaaugacauuauu

SEQ ID NO: 1918955 - RNA, 12 nt, Homo sapiens
agaggguagcug

SEQ ID NO: 1918956 - RNA, 21 nt, Homo sapiens
uugaaagaaauuuggcuauaa

SEQ ID NO: 1918957 - RNA, 13 nt, Homo sapiens
cuaagugcauuuc

SEQ ID NO: 1918958 - RNA, 22 nt, Homo sapiens
aggacuacauuuugcucuguga

SEQ ID NO: 1918959 - RNA, 17 nt, Homo sapiens
ugcauuaaccacucuac

SEQ ID NO: 1918960 - RNA, 19 nt, Homo sapiens
gcaaucacaagccaagguc

SEQ ID NO: 1918961 - RNA, 21 nt, Homo sapiens
ccguagacucacggcugcacc

SEQ ID NO: 1918962 - RNA, 12 nt, Homo sapiens
cugcucacuguc

SEQ ID NO: 1918963 - RNA, 21 nt, Homo sapiens
aguugauuccucaaguuauga

SEQ ID NO: 1918964 - RNA, 17 nt, Homo sapiens
aaacauuaauauuuacc

SEQ ID NO: 1918965 - RNA, 14 nt, Homo sapiens
uguucuugcugcua

SEQ ID NO: 1918966 - RNA, 21 nt, Homo sapiens
uaguugccguggcaacugugg

SEQ ID NO: 1918967 - RNA, 23 nt, Homo sapiens
aggagcaaucuaagcuguguuac

SEQ ID NO: 1918968 - RNA, 17 nt, Homo sapiens
gccccucgcacacaggg

SEQ ID NO: 1918969 - RNA, 20 nt, Homo sapiens
agaauuucuuugucauucaa

SEQ ID NO: 1918970 - RNA, 21 nt, Homo sapiens
cuugaagacaucgauauacau

SEQ ID NO: 1918971 - RNA, 17 nt, Homo sapiens
ugcugccucucacacau

SEQ ID NO: 1918972 - RNA, 18 nt, Homo sapiens
agagauggauauugaaau

SEQ ID NO: 1918973 - RNA, 17 nt, Homo sapiens
ugaguuucuuggcugca

SEQ ID NO: 1918974 - RNA, 16 nt, Homo sapiens
cagagaaggccuuaca

SEQ ID NO: 1918975 - RNA, 23 nt, Homo sapiens
aacuuggaaauagugauuuccac

SEQ ID NO: 1918976 - RNA, 15 nt, Homo sapiens
uuaauuucauguaua

SEQ ID NO: 1918977 - RNA, 23 nt, Homo sapiens
guuaugauauuguuuaaaauuca

SEQ ID NO: 1918978 - RNA, 15 nt, Homo sapiens
cuauacuuaaucuca

SEQ ID NO: 1918979 - RNA, 20 nt, Homo sapiens
guccugaugcuuuugucuaa

SEQ ID NO: 1918980 - RNA, 21 nt, Homo sapiens
cugccaggcaugguagcucau

SEQ ID NO: 1918981 - RNA, 22 nt, Homo sapiens
ugcucuccucuucuacucacuu

SEQ ID NO: 1918982 - RNA, 21 nt, Homo sapiens
guaagguaauuucuguguauu

SEQ ID NO: 1918983 - RNA, 15 nt, Homo sapiens
uauguucagcagugu

SEQ ID NO: 1918984 - RNA, 12 nt, Homo sapiens
cagggaugcuca

SEQ ID NO: 1918985 - RNA, 17 nt, Homo sapiens
aauaggaacaaucuuug

SEQ ID NO: 1918986 - RNA, 15 nt, Homo sapiens
cauaccucugaccaa

SEQ ID NO: 1918987 - RNA, 13 nt, Homo sapiens
ucccagaaccacu

SEQ ID NO: 1918988 - RNA, 11 nt, Homo sapiens
aaugugaaauu

SEQ ID NO: 1918989 - RNA, 19 nt, Homo sapiens
cucaugcccccucagugag

SEQ ID NO: 1918990 - RNA, 23 nt, Homo sapiens
ggagcugcgcccuggauccucac

SEQ ID NO: 1918991 - RNA, 20 nt, Homo sapiens
aaaguaaguuaauaauguau

SEQ ID NO: 1918992 - RNA, 16 nt, Homo sapiens
agccuugggagccacu

SEQ ID NO: 1918993 - RNA, 11 nt, Homo sapiens
uugagauuacg

SEQ ID NO: 1918994 - RNA, 14 nt, Homo sapiens
acaggccagcccuu

SEQ ID NO: 1918995 - RNA, 17 nt, Homo sapiens
caucuaagcugcagcuu

SEQ ID NO: 1918996 - RNA, 24 nt, Homo sapiens
uccuaaagaaaaauaucuuggccu

SEQ ID NO: 1918997 - RNA, 20 nt, Homo sapiens
gaaauauggaacuuacauug

SEQ ID NO: 1918998 - RNA, 11 nt, Homo sapiens
ccagacuccac

SEQ ID NO: 1918999 - RNA, 23 nt, Homo sapiens
cacauuuugcauuagacagauga

SEQ ID NO: 1919000 - RNA, 22 nt, Homo sapiens
agaaugcacaagaauggaucac

SEQ ID NO: 1919001 - RNA, 14 nt, Homo sapiens
uaacgucaugugca

SEQ ID NO: 1919002 - RNA, 16 nt, Homo sapiens
caccuaugucauuuca

SEQ ID NO: 1919003 - RNA, 10 nt, Homo sapiens
cacugagaua

SEQ ID NO: 1919004 - RNA, 18 nt, Homo sapiens
auauucgguaauaucauu

SEQ ID NO: 1919005 - RNA, 20 nt, Homo sapiens
uagaaagcauuugaaugcau

SEQ ID NO: 1919006 - RNA, 21 nt, Homo sapiens
ccgggcaggcauuucaggaag

SEQ ID NO: 1919007 - RNA, 22 nt, Homo sapiens
ccuugugagaguggcuuucuac

SEQ ID NO: 1919008 - RNA, 17 nt, Homo sapiens
caaugaauuaguugcau

SEQ ID NO: 1919009 - RNA, 14 nt, Homo sapiens
aggucggagugccu

SEQ ID NO: 1919010 - RNA, 16 nt, Homo sapiens
ccaaaaugacuuugaa

SEQ ID NO: 1919011 - RNA, 17 nt, Homo sapiens
aggagagcccagucucc

SEQ ID NO: 1919012 - RNA, 16 nt, Homo sapiens
ugcuuguacaguguca

SEQ ID NO: 1919013 - RNA, 17 nt, Homo sapiens
uaaaagccauauuaagu

SEQ ID NO: 1919014 - RNA, 20 nt, Homo sapiens
aaauccaucuaaauaccugc

SEQ ID NO: 1919015 - RNA, 20 nt, Homo sapiens
acauuauuugucuccaugau

SEQ ID NO: 1919016 - RNA, 13 nt, Homo sapiens
auuuguuugcaau

SEQ ID NO: 1919017 - RNA, 17 nt, Homo sapiens
guccuggaaauucugcu

SEQ ID NO: 1919018 - RNA, 17 nt, Homo sapiens
uuccccuuuguccugcg

SEQ ID NO: 1919019 - RNA, 15 nt, Homo sapiens
aucuuagggaacuuu

SEQ ID NO: 1919020 - RNA, 15 nt, Homo sapiens
ccagaguccggaggc

SEQ ID NO: 1919021 - RNA, 12 nt, Homo sapiens
acucugugcuga

SEQ ID NO: 1919022 - RNA, 11 nt, Homo sapiens
aagguucucuc

SEQ ID NO: 1919023 - RNA, 10 nt, Homo sapiens
aacugugaac

SEQ ID NO: 1919024 - RNA, 16 nt, Homo sapiens
uggugaucagugcaau

SEQ ID NO: 1919025 - RNA, 13 nt, Homo sapiens
agucacacugugg

SEQ ID NO: 1919026 - RNA, 18 nt, Homo sapiens
uugaauaaaagugcacac

SEQ ID NO: 1919027 - RNA, 23 nt, Homo sapiens
gagacucagggccccagcacuaa

SEQ ID NO: 1919028 - RNA, 13 nt, Homo sapiens
ccuagcaaaagug

SEQ ID NO: 1919029 - RNA, 18 nt, Homo sapiens
ugaggugguacuaugauu

SEQ ID NO: 1919030 - RNA, 14 nt, Homo sapiens
uagaaaaugcaguc

SEQ ID NO: 1919031 - RNA, 21 nt, Homo sapiens
aaaaacggcaguaucacagau

SEQ ID NO: 1919032 - RNA, 14 nt, Homo sapiens
guaauaacauuuua

SEQ ID NO: 1919033 - RNA, 22 nt, Homo sapiens
uaccaagggccauucaguacau

SEQ ID NO: 1919034 - RNA, 14 nt, Homo sapiens
ugaauucacuuaag

SEQ ID NO: 1919035 - RNA, 22 nt, Homo sapiens
ucaagcgauucuccugucucag

SEQ ID NO: 1919036 - RNA, 15 nt, Homo sapiens
augaagcagauuuau

SEQ ID NO: 1919037 - RNA, 19 nt, Homo sapiens
accagaacugugugucuca

SEQ ID NO: 1919038 - RNA, 15 nt, Homo sapiens
aucagagggugacug

SEQ ID NO: 1919039 - RNA, 20 nt, Homo sapiens
cauguauaaagugauugacu

SEQ ID NO: 1919040 - RNA, 13 nt, Homo sapiens
uuacuaacacugg

SEQ ID NO: 1919041 - RNA, 16 nt, Homo sapiens
caccaugguagccuua

SEQ ID NO: 1919042 - RNA, 20 nt, Homo sapiens
ccauauuaaaucuuccucau

SEQ ID NO: 1919043 - RNA, 14 nt, Homo sapiens
uaaucuaguuuaca

SEQ ID NO: 1919044 - RNA, 20 nt, Homo sapiens
gaagcugcccucagccagag

SEQ ID NO: 1919045 - RNA, 15 nt, Homo sapiens
ugcucuguauguguu

SEQ ID NO: 1919046 - RNA, 17 nt, Homo sapiens
caugggcugggggccag

SEQ ID NO: 1919047 - RNA, 13 nt, Homo sapiens
uguucaucucuuu

SEQ ID NO: 1919048 - RNA, 18 nt, Homo sapiens
ccagggcaaugccaucag

SEQ ID NO: 1919049 - RNA, 15 nt, Homo sapiens
uaaguguucucauga

SEQ ID NO: 1919050 - RNA, 18 nt, Homo sapiens
caggguuggggugguuuu

SEQ ID NO: 1919051 - RNA, 16 nt, Homo sapiens
acgggaggcugggcac

SEQ ID NO: 1919052 - RNA, 20 nt, Homo sapiens
uaaaccuccgccaaugcacg

SEQ ID NO: 1919053 - RNA, 22 nt, Homo sapiens
gagggcccuccgaccacuucca

SEQ ID NO: 1919054 - RNA, 18 nt, Homo sapiens
aguuucaaaauguuaaca

SEQ ID NO: 1919055 - RNA, 23 nt, Homo sapiens
aaacccuuuuacagucacauuca

SEQ ID NO: 1919056 - RNA, 17 nt, Homo sapiens
cacccgcccacagccag

SEQ ID NO: 1919057 - RNA, 14 nt, Homo sapiens
acuggucucuggcu

SEQ ID NO: 1919058 - RNA, 16 nt, Homo sapiens
ugccuuggccucccac

SEQ ID NO: 1919059 - RNA, 19 nt, Homo sapiens
agagaaugauuuugcugac

SEQ ID NO: 1919060 - RNA, 15 nt, Homo sapiens
aucuuacuguaccug

SEQ ID NO: 1919061 - RNA, 23 nt, Homo sapiens
agagugaaauaauuaaaaaccac

SEQ ID NO: 1919062 - RNA, 21 nt, Homo sapiens
agauguuuguuuucaaaauac

SEQ ID NO: 1919063 - RNA, 17 nt, Homo sapiens
cuguuucaaucacuguc

SEQ ID NO: 1919064 - RNA, 17 nt, Homo sapiens
aaugucuagguccccac

SEQ ID NO: 1919065 - RNA, 18 nt, Homo sapiens
uaaagaaauacacaggga

SEQ ID NO: 1919066 - RNA, 18 nt, Homo sapiens
aucucuuguguaccagcu

SEQ ID NO: 1919067 - RNA, 18 nt, Homo sapiens
auacucucaccauuugga

SEQ ID NO: 1919068 - RNA, 12 nt, Homo sapiens
ugaaaacacugc

SEQ ID NO: 1919069 - RNA, 13 nt, Homo sapiens
uacagugacuguc

SEQ ID NO: 1919070 - RNA, 20 nt, Homo sapiens
ugacacucugcagacugcua

SEQ ID NO: 1919071 - RNA, 13 nt, Homo sapiens
cgccuaacugaau

SEQ ID NO: 1919072 - RNA, 13 nt, Homo sapiens
acgugcaguaucu

SEQ ID NO: 1919073 - RNA, 16 nt, Homo sapiens
cuugcaaagcgacaga

SEQ ID NO: 1919074 - RNA, 21 nt, Homo sapiens
cuuuaauucuuuucccagaag

SEQ ID NO: 1919075 - RNA, 15 nt, Homo sapiens
uuaauucaguacaac

SEQ ID NO: 1919076 - RNA, 14 nt, Homo sapiens
acucuuaacuccua

SEQ ID NO: 1919077 - RNA, 18 nt, Homo sapiens
gaauuuccucuauugaug

SEQ ID NO: 1919078 - RNA, 13 nt, Homo sapiens
guuacccauucaa

SEQ ID NO: 1919079 - RNA, 18 nt, Homo sapiens
ugugcagaugcugcugaa

SEQ ID NO: 1919080 - RNA, 16 nt, Homo sapiens
agcacucuacugcaag

SEQ ID NO: 1919081 - RNA, 22 nt, Homo sapiens
augcuaccccacuaugacagag

SEQ ID NO: 1919082 - RNA, 15 nt, Homo sapiens
guacacuuucaagua

SEQ ID NO: 1919083 - RNA, 20 nt, Homo sapiens
caauuuaccuacucuaugua

SEQ ID NO: 1919084 - RNA, 23 nt, Homo sapiens
aaauacacgcuaguaacuccucu

SEQ ID NO: 1919085 - RNA, 21 nt, Homo sapiens
gauauaaucugaauccuguua

SEQ ID NO: 1919086 - RNA, 15 nt, Homo sapiens
guuuuacaguauauc

SEQ ID NO: 1919087 - RNA, 22 nt, Homo sapiens
auucaaacuucuguguacuggg

SEQ ID NO: 1919088 - RNA, 19 nt, Homo sapiens
ccacuuggucugugagaug

SEQ ID NO: 1919089 - RNA, 14 nt, Homo sapiens
agcuggcaaaggug

SEQ ID NO: 1919090 - RNA, 13 nt, Homo sapiens
uccucuccacugc

SEQ ID NO: 1919091 - RNA, 14 nt, Homo sapiens
acagguuaugcuuu

SEQ ID NO: 1919092 - RNA, 17 nt, Homo sapiens
gaaucaaagacauuuca

SEQ ID NO: 1919093 - RNA, 17 nt, Homo sapiens
auuuucugaaaguuacc

SEQ ID NO: 1919094 - RNA, 15 nt, Homo sapiens
acagauugcugcuuc

SEQ ID NO: 1919095 - RNA, 12 nt, Homo sapiens
cuaaaccaaaaa

SEQ ID NO: 1919096 - RNA, 19 nt, Homo sapiens
uaggugggagagagugcau

SEQ ID NO: 1919097 - RNA, 17 nt, Homo sapiens
ucaauugcagaugccaa

SEQ ID NO: 1919098 - RNA, 17 nt, Homo sapiens
aggcugaaaaugugcau

SEQ ID NO: 1919099 - RNA, 20 nt, Homo sapiens
auggcauccagggcugccag

SEQ ID NO: 1919100 - RNA, 15 nt, Homo sapiens
ccuccuuuugcuuga

SEQ ID NO: 1919101 - RNA, 13 nt, Homo sapiens
acacacuggaccc

SEQ ID NO: 1919102 - RNA, 18 nt, Homo sapiens
aaguuuugguucuucagu

SEQ ID NO: 1919103 - RNA, 19 nt, Homo sapiens
aacuucauugcuacacuua

SEQ ID NO: 1919104 - RNA, 15 nt, Homo sapiens
cuaauggucacagag

SEQ ID NO: 1919105 - RNA, 19 nt, Homo sapiens
uagauugcuuucuucuuaa

SEQ ID NO: 1919106 - RNA, 16 nt, Homo sapiens
augguaacgucuccca

SEQ ID NO: 1919107 - RNA, 15 nt, Homo sapiens
uaucaaaaugguuua

SEQ ID NO: 1919108 - RNA, 18 nt, Homo sapiens
caugauccuugcugauaa

SEQ ID NO: 1919109 - RNA, 23 nt, Homo sapiens
cauaacaaccugggcauuccuug

SEQ ID NO: 1919110 - RNA, 23 nt, Homo sapiens
uugugugcucuccauucugcucc

SEQ ID NO: 1919111 - RNA, 15 nt, Homo sapiens
uccaccuucccucau

SEQ ID NO: 1919112 - RNA, 20 nt, Homo sapiens
ccaaagggaagugaggccca

SEQ ID NO: 1919113 - RNA, 22 nt, Homo sapiens
augucuuugcugcagaacugaa

SEQ ID NO: 1919114 - RNA, 18 nt, Homo sapiens
augaaugggcaaaacuga

SEQ ID NO: 1919115 - RNA, 20 nt, Homo sapiens
aguaugcagauuauuugccc

SEQ ID NO: 1919116 - RNA, 21 nt, Homo sapiens
aaacuuuguuugcuaaugcac

SEQ ID NO: 1919117 - RNA, 17 nt, Homo sapiens
aagaaaaaaacuuacug

SEQ ID NO: 1919118 - RNA, 20 nt, Homo sapiens
uagugacuaaaccauugugc

SEQ ID NO: 1919119 - RNA, 18 nt, Homo sapiens
uuuuaucuugaguguuau

SEQ ID NO: 1919120 - RNA, 22 nt, Homo sapiens
agacaccaaacugccaaaaaca

SEQ ID NO: 1919121 - RNA, 13 nt, Homo sapiens
gggcagcacagag

SEQ ID NO: 1919122 - RNA, 15 nt, Homo sapiens
agaugcuaggaagcu

SEQ ID NO: 1919123 - RNA, 21 nt, Homo sapiens
uaugcauuuucuucacagugc

SEQ ID NO: 1919124 - RNA, 18 nt, Homo sapiens
auauggaaaaaaugaacu

SEQ ID NO: 1919125 - RNA, 14 nt, Homo sapiens
cugaaucuucugaa

SEQ ID NO: 1919126 - RNA, 18 nt, Homo sapiens
cucagagcuccacagaag

SEQ ID NO: 1919127 - RNA, 15 nt, Homo sapiens
uagguuuuucuugcu

SEQ ID NO: 1919128 - RNA, 20 nt, Homo sapiens
cagaacaaauuguuuacaua

SEQ ID NO: 1919129 - RNA, 20 nt, Homo sapiens
ugaaaauauuucucuagugu

SEQ ID NO: 1919130 - RNA, 16 nt, Homo sapiens
ccuacaggcagucucu

SEQ ID NO: 1919131 - RNA, 22 nt, Homo sapiens
cuuuacucucuccgauuugcuu

SEQ ID NO: 1919132 - RNA, 16 nt, Homo sapiens
acuuucuugcaugaau

SEQ ID NO: 1919133 - RNA, 23 nt, Homo sapiens
aagcccuugcccagagcucucua

SEQ ID NO: 1919134 - RNA, 15 nt, Homo sapiens
cccugcccaccaaga

SEQ ID NO: 1919135 - RNA, 22 nt, Homo sapiens
guccuuagcaaggggcucagaa

SEQ ID NO: 1919136 - RNA, 22 nt, Homo sapiens
acuucaucuucucagcucccau

SEQ ID NO: 1919137 - RNA, 19 nt, Homo sapiens
guuauuuggaccacuccag

SEQ ID NO: 1919138 - RNA, 22 nt, Homo sapiens
gauuuaggccuuaacacacugg

SEQ ID NO: 1919139 - RNA, 13 nt, Homo sapiens
acuguaaagcaaa

SEQ ID NO: 1919140 - RNA, 22 nt, Homo sapiens
caggguugugcuuucuagcaaa

SEQ ID NO: 1919141 - RNA, 14 nt, Homo sapiens
cacggccaugaggg

SEQ ID NO: 1919142 - RNA, 12 nt, Homo sapiens
cacuugcacugg

SEQ ID NO: 1919143 - RNA, 19 nt, Homo sapiens
guggggcugguagcucagg

SEQ ID NO: 1919144 - RNA, 16 nt, Homo sapiens
ggggacugcaugcaag

SEQ ID NO: 1919145 - RNA, 15 nt, Homo sapiens
cuuuguuuaugcaua

SEQ ID NO: 1919146 - RNA, 15 nt, Homo sapiens
cuuuguauaugcauu

SEQ ID NO: 1919147 - RNA, 16 nt, Homo sapiens
aaagccaucucagguu

SEQ ID NO: 1919148 - RNA, 20 nt, Homo sapiens
uuacuuguguuacuugccaa

SEQ ID NO: 1919149 - RNA, 22 nt, Homo sapiens
uaaaauguaucaacacacauuu

SEQ ID NO: 1919150 - RNA, 17 nt, Homo sapiens
uaaucccagcacuuugg

SEQ ID NO: 1919151 - RNA, 17 nt, Homo sapiens
uaaucccaacacuuuga

SEQ ID NO: 1919152 - RNA, 17 nt, Homo sapiens
gaucagcaucugugaug

SEQ ID NO: 1919153 - RNA, 18 nt, Homo sapiens
cacagcuaagaugccaug

SEQ ID NO: 1919154 - RNA, 20 nt, Homo sapiens
ggcccuguccuaagcacuuu

SEQ ID NO: 1919155 - RNA, 19 nt, Homo sapiens
acuuggcuuuuuacuauua

SEQ ID NO: 1919156 - RNA, 16 nt, Homo sapiens
agccccugcuccagaa

SEQ ID NO: 1919157 - RNA, 16 nt, Homo sapiens
gaagcccucucuggcu

SEQ ID NO: 1919158 - RNA, 14 nt, Homo sapiens
cugagcgaaaucca

SEQ ID NO: 1919159 - RNA, 13 nt, Homo sapiens
cauauuaagcacu

SEQ ID NO: 1919160 - RNA, 15 nt, Homo sapiens
ucugcuucugcauuc

SEQ ID NO: 1919161 - RNA, 22 nt, Homo sapiens
ucauucugcaacccgguuuacc

SEQ ID NO: 1919162 - RNA, 14 nt, Homo sapiens
aauaaaauguuuau

SEQ ID NO: 1919163 - RNA, 18 nt, Homo sapiens
auuauaaagaacagcuga

SEQ ID NO: 1919164 - RNA, 21 nt, Homo sapiens
acacuguccaugaagcacuga

SEQ ID NO: 1919165 - RNA, 14 nt, Homo sapiens
uccauuaaccagug

SEQ ID NO: 1919166 - RNA, 14 nt, Homo sapiens
auaccucugggaaa

SEQ ID NO: 1919167 - RNA, 18 nt, Homo sapiens
agaguguauuacaacaau

SEQ ID NO: 1919168 - RNA, 15 nt, Homo sapiens
aaccucaagcaguaa

SEQ ID NO: 1919169 - RNA, 23 nt, Homo sapiens
gcaaagugcaaggaccuaaaaca

SEQ ID NO: 1919170 - RNA, 16 nt, Homo sapiens
cacgagagagggaaaa

SEQ ID NO: 1919171 - RNA, 19 nt, Homo sapiens
cucaaaaaauaauuaguua

SEQ ID NO: 1919172 - RNA, 12 nt, Homo sapiens
auuugccaugcu

SEQ ID NO: 1919173 - RNA, 19 nt, Homo sapiens
gaggccccaggucaccucg

SEQ ID NO: 1919174 - RNA, 16 nt, Homo sapiens
uaugaagaaucugcuc

SEQ ID NO: 1919175 - RNA, 18 nt, Homo sapiens
cuacaaggaaaacaaugu

SEQ ID NO: 1919176 - RNA, 18 nt, Homo sapiens
aaauuccuacaacuuaau

SEQ ID NO: 1919177 - RNA, 14 nt, Homo sapiens
aguggcagggaccg

SEQ ID NO: 1919178 - RNA, 16 nt, Homo sapiens
gaaccaggcaacuugg

SEQ ID NO: 1919179 - RNA, 19 nt, Homo sapiens
ucuuccuauuuuaaugaau

SEQ ID NO: 1919180 - RNA, 15 nt, Homo sapiens
aguaccuagugguga

SEQ ID NO: 1919181 - RNA, 15 nt, Homo sapiens
uugaagucuuuaaua

SEQ ID NO: 1919182 - RNA, 19 nt, Homo sapiens
aagcccugguaaaagggau

SEQ ID NO: 1919183 - RNA, 21 nt, Homo sapiens
uuugggggauuaaagauguga

SEQ ID NO: 1919184 - RNA, 19 nt, Homo sapiens
ucugauacagacagcaguc

SEQ ID NO: 1919185 - RNA, 16 nt, Homo sapiens
agaaucucaacauguc

SEQ ID NO: 1919186 - RNA, 21 nt, Homo sapiens
aucacugcauuaucuugcuca

SEQ ID NO: 1919187 - RNA, 20 nt, Homo sapiens
ucuuucacauuguuugcugc

SEQ ID NO: 1919188 - RNA, 18 nt, Homo sapiens
cugugcaauggaauauaa

SEQ ID NO: 1919189 - RNA, 17 nt, Homo sapiens
cagagcagaacuuucac

SEQ ID NO: 1919190 - RNA, 21 nt, Homo sapiens
gaauuuacagucuaguacuua

SEQ ID NO: 1919191 - RNA, 15 nt, Homo sapiens
gccccuccuaguucu

SEQ ID NO: 1919192 - RNA, 18 nt, Homo sapiens
agcaagaucccaucucuu

SEQ ID NO: 1919193 - RNA, 16 nt, Homo sapiens
aacccuuuuacaguca

SEQ ID NO: 1919194 - RNA, 21 nt, Homo sapiens
aacccgaggaagaugcucauc

SEQ ID NO: 1919195 - RNA, 20 nt, Homo sapiens
gggcggggggcaccuacuac

SEQ ID NO: 1919196 - RNA, 21 nt, Homo sapiens
uuagcuucucugccaagcccu

SEQ ID NO: 1919197 - RNA, 21 nt, Homo sapiens
auacaaaggaagaacaucugg

SEQ ID NO: 1919198 - RNA, 17 nt, Homo sapiens
gugacauuuccaugcau

SEQ ID NO: 1919199 - RNA, 16 nt, Homo sapiens
agcuggugguaucuga

SEQ ID NO: 1919200 - RNA, 16 nt, Homo sapiens
caucuucacugcaauu

SEQ ID NO: 1919201 - RNA, 18 nt, Homo sapiens
cuggcccuuacacacuca

SEQ ID NO: 1919202 - RNA, 23 nt, Homo sapiens
agccaucccuuuuuuuacauuuc

SEQ ID NO: 1919203 - RNA, 14 nt, Homo sapiens
acaugagucaaaac

SEQ ID NO: 1919204 - RNA, 20 nt, Homo sapiens
aggccuacaugcuuugugaa

SEQ ID NO: 1919205 - RNA, 17 nt, Homo sapiens
guuauucgaaccacuga

SEQ ID NO: 1919206 - RNA, 19 nt, Homo sapiens
ccaaauuuagucccagaaa

SEQ ID NO: 1919207 - RNA, 19 nt, Homo sapiens
ugugcauugaauacucuga

SEQ ID NO: 1919208 - RNA, 17 nt, Homo sapiens
gugagacagaccgccaa

SEQ ID NO: 1919209 - RNA, 20 nt, Homo sapiens
ucucuaagugggcauugcca

SEQ ID NO: 1919210 - RNA, 18 nt, Homo sapiens
uggaacacucucugagau

SEQ ID NO: 1919211 - RNA, 13 nt, Homo sapiens
auuaggugcaauu

SEQ ID NO: 1919212 - RNA, 13 nt, Homo sapiens
aucuuuucuacuu

SEQ ID NO: 1919213 - RNA, 19 nt, Homo sapiens
agggccaguugguguuccu

SEQ ID NO: 1919214 - RNA, 21 nt, Homo sapiens
uaugcugaucuuuuaaaauca

SEQ ID NO: 1919215 - RNA, 22 nt, Homo sapiens
caucuacuccucuacuccaaau

SEQ ID NO: 1919216 - RNA, 17 nt, Homo sapiens
cacggauccauguagca

SEQ ID NO: 1919217 - RNA, 23 nt, Homo sapiens
gcgcccugcaccugacagcuuua

SEQ ID NO: 1919218 - RNA, 23 nt, Homo sapiens
uugugcaauguguauaaacaaga

SEQ ID NO: 1919219 - RNA, 14 nt, Homo sapiens
cauagcacuguaua

SEQ ID NO: 1919220 - RNA, 20 nt, Homo sapiens
aaacugcaaauauugucaua

SEQ ID NO: 1919221 - RNA, 14 nt, Homo sapiens
ucuucugucaucua

SEQ ID NO: 1919222 - RNA, 19 nt, Homo sapiens
gaucaaaccccauggagca

SEQ ID NO: 1919223 - RNA, 14 nt, Homo sapiens
uuugcaaaagugua

SEQ ID NO: 1919224 - RNA, 20 nt, Homo sapiens
aaaacucuugauaugaccug

SEQ ID NO: 1919225 - RNA, 17 nt, Homo sapiens
gaaaagaagcacccaga

SEQ ID NO: 1919226 - RNA, 14 nt, Homo sapiens
cuugaucaauuccc

SEQ ID NO: 1919227 - RNA, 15 nt, Homo sapiens
ucaaaucaaucugua

SEQ ID NO: 1919228 - RNA, 13 nt, Homo sapiens
gugacacaaugcu

SEQ ID NO: 1919229 - RNA, 17 nt, Homo sapiens
auccggcagcacaagcu

SEQ ID NO: 1919230 - RNA, 16 nt, Homo sapiens
uacugcccacuuguca

SEQ ID NO: 1919231 - RNA, 17 nt, Homo sapiens
ucauccaagcuuguauu

SEQ ID NO: 1919232 - RNA, 16 nt, Homo sapiens
gcuguguccucaugag

SEQ ID NO: 1919233 - RNA, 16 nt, Homo sapiens
cugaagacaaaccacu

SEQ ID NO: 1919234 - RNA, 15 nt, Homo sapiens
acaaaauuaugcaaa

SEQ ID NO: 1919235 - RNA, 22 nt, Homo sapiens
gguuuaagaacgaaggagaaaa

SEQ ID NO: 1919236 - RNA, 19 nt, Homo sapiens
ugcuguccccuuccagggg

SEQ ID NO: 1919237 - RNA, 19 nt, Homo sapiens
gccgagucugucucuguca

SEQ ID NO: 1919238 - RNA, 22 nt, Homo sapiens
cccuuuggggauagucuggaaa

SEQ ID NO: 1919239 - RNA, 20 nt, Homo sapiens
aaaagucuggcccacugugc

SEQ ID NO: 1919240 - RNA, 14 nt, Homo sapiens
ucuugacuccacua

SEQ ID NO: 1919241 - RNA, 21 nt, Homo sapiens
agugcaaccucugcuucccag

SEQ ID NO: 1919242 - RNA, 21 nt, Homo sapiens
cuucacaggcuauucuacuuu

SEQ ID NO: 1919243 - RNA, 17 nt, Homo sapiens
caucugggaaagacauc

SEQ ID NO: 1919244 - RNA, 18 nt, Homo sapiens
ccuuaaucccagcacuuu

SEQ ID NO: 1919245 - RNA, 20 nt, Homo sapiens
cacggaggguccagacuguc

SEQ ID NO: 1919246 - RNA, 16 nt, Homo sapiens
agucauguagccccag

SEQ ID NO: 1919247 - RNA, 12 nt, Homo sapiens
cccaacaccauu

SEQ ID NO: 1919248 - RNA, 21 nt, Homo sapiens
uuacaauuuaaugcacuaaaa

SEQ ID NO: 1919249 - RNA, 16 nt, Homo sapiens
aaaagggaaguaagca

SEQ ID NO: 1919250 - RNA, 16 nt, Homo sapiens
uccugccaccaagaug

SEQ ID NO: 1919251 - RNA, 16 nt, Homo sapiens
ugugguacaagcauuc

SEQ ID NO: 1919252 - RNA, 17 nt, Homo sapiens
ucaacugaaugagguca

SEQ ID NO: 1919253 - RNA, 16 nt, Homo sapiens
ucuccuuaaaaacugg

SEQ ID NO: 1919254 - RNA, 13 nt, Homo sapiens
ucauccaaucuaa

SEQ ID NO: 1919255 - RNA, 15 nt, Homo sapiens
ucucaguucuugagg

SEQ ID NO: 1919256 - RNA, 23 nt, Homo sapiens
uaaauuuaacaagugacaggguu

SEQ ID NO: 1919257 - RNA, 20 nt, Homo sapiens
ugacugguccuaaucuguaa

SEQ ID NO: 1919258 - RNA, 22 nt, Homo sapiens
aauuccagaggacucugcuuaa

SEQ ID NO: 1919259 - RNA, 16 nt, Homo sapiens
guaauaaacucucuag

SEQ ID NO: 1919260 - RNA, 20 nt, Homo sapiens
aaaguaagaggacuacucag

SEQ ID NO: 1919261 - RNA, 13 nt, Homo sapiens
agacccuggaaaa

SEQ ID NO: 1919262 - RNA, 20 nt, Homo sapiens
guaccugcuggcacuaucca

SEQ ID NO: 1919263 - RNA, 21 nt, Homo sapiens
accuccaaggacuaaggccuc

SEQ ID NO: 1919264 - RNA, 17 nt, Homo sapiens
ucaacagugaacagcuu

SEQ ID NO: 1919265 - RNA, 23 nt, Homo sapiens
acaauucugugacauacauauua

SEQ ID NO: 1919266 - RNA, 22 nt, Homo sapiens
gcuccccaauccaacccaugca

SEQ ID NO: 1919267 - RNA, 17 nt, Homo sapiens
gaaucaagcacacugua

SEQ ID NO: 1919268 - RNA, 21 nt, Homo sapiens
uagcaaguguguguuugccaa

SEQ ID NO: 1919269 - RNA, 14 nt, Homo sapiens
ccaaguuuacucaa

SEQ ID NO: 1919270 - RNA, 14 nt, Homo sapiens
uuguuugucuucca

SEQ ID NO: 1919271 - RNA, 22 nt, Homo sapiens
gaagugaauuccugcauuugau

SEQ ID NO: 1919272 - RNA, 20 nt, Homo sapiens
uuacgauggcacccagugag

SEQ ID NO: 1919273 - RNA, 14 nt, Homo sapiens
augauucucugagu

SEQ ID NO: 1919274 - RNA, 14 nt, Homo sapiens
cccuggcuaccuug

SEQ ID NO: 1919275 - RNA, 17 nt, Homo sapiens
agggguucuugagccag

SEQ ID NO: 1919276 - RNA, 22 nt, Homo sapiens
ggcuucccaaaguccugggauu

SEQ ID NO: 1919277 - RNA, 18 nt, Homo sapiens
agcuacggguaggucuau

SEQ ID NO: 1919278 - RNA, 16 nt, Homo sapiens
guaauccuagcacuuu

SEQ ID NO: 1919279 - RNA, 14 nt, Homo sapiens
guguaaaaagcaaa

SEQ ID NO: 1919280 - RNA, 15 nt, Homo sapiens
ugagcagguguucuu

SEQ ID NO: 1919281 - RNA, 15 nt, Homo sapiens
gauauuuagcucugu

SEQ ID NO: 1919282 - RNA, 14 nt, Homo sapiens
ggccugaacaaaau

SEQ ID NO: 1919283 - RNA, 14 nt, Homo sapiens
uccagcucugagac

SEQ ID NO: 1919284 - RNA, 18 nt, Homo sapiens
ccugguucccaccauucc

SEQ ID NO: 1919285 - RNA, 20 nt, Homo sapiens
uuggacaggagucagugucu

SEQ ID NO: 1919286 - RNA, 15 nt, Homo sapiens
ucuuucccacuccua

SEQ ID NO: 1919287 - RNA, 16 nt, Homo sapiens
gcuuugugagccagca

SEQ ID NO: 1919288 - RNA, 19 nt, Homo sapiens
agugguauagaguacugca

SEQ ID NO: 1919289 - RNA, 17 nt, Homo sapiens
guuucccauaauuuucu

SEQ ID NO: 1919290 - RNA, 16 nt, Homo sapiens
aaaauaaacacuacag

SEQ ID NO: 1919291 - RNA, 18 nt, Homo sapiens
cuuguaaccagugcagaa

SEQ ID NO: 1919292 - RNA, 15 nt, Homo sapiens
aacugucuuagucau

SEQ ID NO: 1919293 - RNA, 14 nt, Homo sapiens
cuggggaccagcuu

SEQ ID NO: 1919294 - RNA, 23 nt, Homo sapiens
ugcaggaaaagcaaaauugcaau

SEQ ID NO: 1919295 - RNA, 23 nt, Homo sapiens
gaaccuaaguggggaaaauccua

SEQ ID NO: 1919296 - RNA, 17 nt, Homo sapiens
agcccccaguaucucuu

SEQ ID NO: 1919297 - RNA, 20 nt, Homo sapiens
ccucuggaauaaaacauaca

SEQ ID NO: 1919298 - RNA, 15 nt, Homo sapiens
aauguucacuuuuga

SEQ ID NO: 1919299 - RNA, 16 nt, Homo sapiens
ggcuuuucuagccuau

SEQ ID NO: 1919300 - RNA, 20 nt, Homo sapiens
cauuuucccccacuacugca

SEQ ID NO: 1919301 - RNA, 18 nt, Homo sapiens
cuccuagauggacuuccu

SEQ ID NO: 1919302 - RNA, 15 nt, Homo sapiens
ccaucuuugcugcca

SEQ ID NO: 1919303 - RNA, 18 nt, Homo sapiens
gagcaaguccucacucuu

SEQ ID NO: 1919304 - RNA, 23 nt, Homo sapiens
agcccugugcagcagcuucccuu

SEQ ID NO: 1919305 - RNA, 22 nt, Homo sapiens
cuggugucguauuuugccuguu

SEQ ID NO: 1919306 - RNA, 17 nt, Homo sapiens
aaucuccuucuuuccug

SEQ ID NO: 1919307 - RNA, 17 nt, Homo sapiens
aaaaggucagacugaaa

SEQ ID NO: 1919308 - RNA, 16 nt, Homo sapiens
cugcuguugaacuuuu

SEQ ID NO: 1919309 - RNA, 23 nt, Homo sapiens
uguucccaaagugaacucucaaa

SEQ ID NO: 1919310 - RNA, 20 nt, Homo sapiens
uaauguuaauucagcacuga

SEQ ID NO: 1919311 - RNA, 22 nt, Homo sapiens
agaugacagggaaaacugcaaa

SEQ ID NO: 1919312 - RNA, 22 nt, Homo sapiens
ucuuaacauuuuggugacaguu

SEQ ID NO: 1919313 - RNA, 21 nt, Homo sapiens
guuggcucacaucauguaaua

SEQ ID NO: 1919314 - RNA, 17 nt, Homo sapiens
acccauugucauccugu

SEQ ID NO: 1919315 - RNA, 17 nt, Homo sapiens
uaaccuuauacuacuaa

SEQ ID NO: 1919316 - RNA, 15 nt, Homo sapiens
ccagagugcugccag

SEQ ID NO: 1919317 - RNA, 17 nt, Homo sapiens
aaaagcauaaggccgga

SEQ ID NO: 1919318 - RNA, 22 nt, Homo sapiens
uuuuccuaugcuauugacaaua

SEQ ID NO: 1919319 - RNA, 16 nt, Homo sapiens
uguacuaccuguguau

SEQ ID NO: 1919320 - RNA, 14 nt, Homo sapiens
ccaucugugacuau

SEQ ID NO: 1919321 - RNA, 15 nt, Homo sapiens
aguguuuuuacauau

SEQ ID NO: 1919322 - RNA, 15 nt, Homo sapiens
ugaaaaagacauaaa

SEQ ID NO: 1919323 - RNA, 11 nt, Homo sapiens
ccuaacuguga

SEQ ID NO: 1919324 - RNA, 12 nt, Homo sapiens
gaaugugccucu

SEQ ID NO: 1919325 - RNA, 16 nt, Homo sapiens
agcauuucuagcagug

SEQ ID NO: 1919326 - RNA, 23 nt, Homo sapiens
ugcugggaagacgccugagcuca

SEQ ID NO: 1919327 - RNA, 13 nt, Homo sapiens
gucuggcaccaug

SEQ ID NO: 1919328 - RNA, 17 nt, Homo sapiens
accacugcuaugccauu

SEQ ID NO: 1919329 - RNA, 17 nt, Homo sapiens
cccacugaaccuucuga

SEQ ID NO: 1919330 - RNA, 15 nt, Homo sapiens
auaauuuucauucau

SEQ ID NO: 1919331 - RNA, 15 nt, Homo sapiens
auaucugucauauag

SEQ ID NO: 1919332 - RNA, 19 nt, Homo sapiens
gcccccugaccacucagag

SEQ ID NO: 1919333 - RNA, 22 nt, Homo sapiens
cuguguuuuuucugccaccaaa

SEQ ID NO: 1919334 - RNA, 21 nt, Homo sapiens
cggaguggacaccgcucagua

SEQ ID NO: 1919335 - RNA, 17 nt, Homo sapiens
cugggccauguccaaag

SEQ ID NO: 1919336 - RNA, 14 nt, Homo sapiens
cacggcggcagggu

SEQ ID NO: 1919337 - RNA, 13 nt, Homo sapiens
ccagcccagagac

SEQ ID NO: 1919338 - RNA, 15 nt, Homo sapiens
ggaaaaugccaugaa

SEQ ID NO: 1919339 - RNA, 12 nt, Homo sapiens
auugacuuccuc

SEQ ID NO: 1919340 - RNA, 21 nt, Homo sapiens
ugaaauuugacucaugaacua

SEQ ID NO: 1919341 - RNA, 20 nt, Homo sapiens
cuccccuguucauucugcau

SEQ ID NO: 1919342 - RNA, 18 nt, Homo sapiens
cuugcucucagcugccaa

SEQ ID NO: 1919343 - RNA, 17 nt, Homo sapiens
agguccgaggccaaagu

SEQ ID NO: 1919344 - RNA, 17 nt, Homo sapiens
cagaggaaaagacaccu

SEQ ID NO: 1919345 - RNA, 17 nt, Homo sapiens
ugcuacaggggccagaa

SEQ ID NO: 1919346 - RNA, 13 nt, Homo sapiens
aauaacacuguac

SEQ ID NO: 1919347 - RNA, 14 nt, Homo sapiens
uguuauucauuugg

SEQ ID NO: 1919348 - RNA, 14 nt, Homo sapiens
caguuccuguggcu

SEQ ID NO: 1919349 - RNA, 22 nt, Homo sapiens
aggcccuggugcgaauggacuu

SEQ ID NO: 1919350 - RNA, 16 nt, Homo sapiens
uuuaauuuugcagugu

SEQ ID NO: 1919351 - RNA, 16 nt, Homo sapiens
agccuaucaagccuua

SEQ ID NO: 1919352 - RNA, 22 nt, Homo sapiens
ggcugaggcagcagacuggugu

SEQ ID NO: 1919353 - RNA, 15 nt, Homo sapiens
ggaaugccgcugucu

SEQ ID NO: 1919354 - RNA, 20 nt, Homo sapiens
gcacuugcacgcccaugugu

SEQ ID NO: 1919355 - RNA, 17 nt, Homo sapiens
cucaggagucucuggua

SEQ ID NO: 1919356 - RNA, 15 nt, Homo sapiens
auuuuucagcuauuu

SEQ ID NO: 1919357 - RNA, 23 nt, Homo sapiens
acaauggacuugcaaagcuucac

SEQ ID NO: 1919358 - RNA, 22 nt, Homo sapiens
gagacuugccuuccuaagccug

SEQ ID NO: 1919359 - RNA, 14 nt, Homo sapiens
ccuggcucaucucu

SEQ ID NO: 1919360 - RNA, 21 nt, Homo sapiens
ugacggcgcccccagugugca

SEQ ID NO: 1919361 - RNA, 14 nt, Homo sapiens
gagauggaauauca

SEQ ID NO: 1919362 - RNA, 13 nt, Homo sapiens
uuccauucuggaa

SEQ ID NO: 1919363 - RNA, 15 nt, Homo sapiens
ugaacuugugagaac

SEQ ID NO: 1919364 - RNA, 14 nt, Homo sapiens
ugcugaacauugga

SEQ ID NO: 1919365 - RNA, 14 nt, Homo sapiens
aucugaacugugga

SEQ ID NO: 1919366 - RNA, 21 nt, Homo sapiens
cagaaauguuucugugucauu

SEQ ID NO: 1919367 - RNA, 18 nt, Homo sapiens
cgcauuuucuaccugaaa

SEQ ID NO: 1919368 - RNA, 13 nt, Homo sapiens
uaauuuugucaga

SEQ ID NO: 1919369 - RNA, 14 nt, Homo sapiens
uuccugagauucug

SEQ ID NO: 1919370 - RNA, 19 nt, Homo sapiens
ucugacacauuagccuuga

SEQ ID NO: 1919371 - RNA, 11 nt, Homo sapiens
aaugacugcuu

SEQ ID NO: 1919372 - RNA, 23 nt, Homo sapiens
cucacuaagccccggcacuucua

SEQ ID NO: 1919373 - RNA, 22 nt, Homo sapiens
cccaaaaccuuuccccagacac

SEQ ID NO: 1919374 - RNA, 20 nt, Homo sapiens
gggaaguacuuuuggcauuu

SEQ ID NO: 1919375 - RNA, 17 nt, Homo sapiens
ugagaucaacaacacua

SEQ ID NO: 1919376 - RNA, 17 nt, Homo sapiens
acaucuugaaaaugcca

SEQ ID NO: 1919377 - RNA, 14 nt, Homo sapiens
cuucagagugaaga

SEQ ID NO: 1919378 - RNA, 23 nt, Homo sapiens
ggaauaagcucuaguucuuaaca

SEQ ID NO: 1919379 - RNA, 17 nt, Homo sapiens
cugauuuuguauguaaa

SEQ ID NO: 1919380 - RNA, 23 nt, Homo sapiens
cauuucuuauuugugcucuguga

SEQ ID NO: 1919381 - RNA, 14 nt, Homo sapiens
agcuucucugugaa

SEQ ID NO: 1919382 - RNA, 23 nt, Homo sapiens
acccugagccggccccaggcucg

SEQ ID NO: 1919383 - RNA, 15 nt, Homo sapiens
gaauuuccucuauug

SEQ ID NO: 1919384 - RNA, 14 nt, Homo sapiens
uaaaaugcauugaa

SEQ ID NO: 1919385 - RNA, 14 nt, Homo sapiens
cacacacacagaga

SEQ ID NO: 1919386 - RNA, 18 nt, Homo sapiens
gcuccagaggaagacucc

SEQ ID NO: 1919387 - RNA, 19 nt, Homo sapiens
acuuacucuuuaaccagga

SEQ ID NO: 1919388 - RNA, 16 nt, Homo sapiens
agucuuguauuaaguu

SEQ ID NO: 1919389 - RNA, 22 nt, Homo sapiens
auggacguuauccucucagauu

SEQ ID NO: 1919390 - RNA, 19 nt, Homo sapiens
uucccaagguacagcugua

SEQ ID NO: 1919391 - RNA, 23 nt, Homo sapiens
uguagcccucaugauaaucuggg

SEQ ID NO: 1919392 - RNA, 17 nt, Homo sapiens
cuaacacuguccugucc

SEQ ID NO: 1919393 - RNA, 15 nt, Homo sapiens
aaaaacaaugugcug

SEQ ID NO: 1919394 - RNA, 18 nt, Homo sapiens
cuuuggaaagacuugaau

SEQ ID NO: 1919395 - RNA, 21 nt, Homo sapiens
caugguccuggaggaugacca

SEQ ID NO: 1919396 - RNA, 12 nt, Homo sapiens
aagaaaauccau

SEQ ID NO: 1919397 - RNA, 17 nt, Homo sapiens
uaaccuuauauuuacaa

SEQ ID NO: 1919398 - RNA, 18 nt, Homo sapiens
cccucuguggucacagag

SEQ ID NO: 1919399 - RNA, 23 nt, Homo sapiens
uaaaguauguuuucaauguuuca

SEQ ID NO: 1919400 - RNA, 20 nt, Homo sapiens
uugcuuccccuuuugccaau

SEQ ID NO: 1919401 - RNA, 15 nt, Homo sapiens
uagcacaucauggca

SEQ ID NO: 1919402 - RNA, 14 nt, Homo sapiens
cagaaaaacugugg

SEQ ID NO: 1919403 - RNA, 23 nt, Homo sapiens
ugcggacccuucccagcccucau

SEQ ID NO: 1919404 - RNA, 18 nt, Homo sapiens
agcaggaaaaaaggaaua

SEQ ID NO: 1919405 - RNA, 11 nt, Homo sapiens
aaaaucacuug

SEQ ID NO: 1919406 - RNA, 15 nt, Homo sapiens
cugccccugccccug

SEQ ID NO: 1919407 - RNA, 13 nt, Homo sapiens
ccagacaaucucg

SEQ ID NO: 1919408 - RNA, 19 nt, Homo sapiens
acauuggagcugacuguuc

SEQ ID NO: 1919409 - RNA, 14 nt, Homo sapiens
aggaggagugggac

SEQ ID NO: 1919410 - RNA, 21 nt, Homo sapiens
caaacucauugcagcagauaa

SEQ ID NO: 1919411 - RNA, 22 nt, Homo sapiens
cugagaaaggugaggagggcag

SEQ ID NO: 1919412 - RNA, 22 nt, Homo sapiens
ugucaauugauauuucugugua

SEQ ID NO: 1919413 - RNA, 18 nt, Homo sapiens
ccaggcacuccugaggua

SEQ ID NO: 1919414 - RNA, 21 nt, Homo sapiens
auguuuauuauuuacaucacu

SEQ ID NO: 1919415 - RNA, 20 nt, Homo sapiens
caaccauuuaacugcagugu

SEQ ID NO: 1919416 - RNA, 13 nt, Homo sapiens
uuucuucucccaa

SEQ ID NO: 1919417 - RNA, 22 nt, Homo sapiens
ccaacucugagcccauguucug

SEQ ID NO: 1919418 - RNA, 14 nt, Homo sapiens
ugugaaguacauau

SEQ ID NO: 1919419 - RNA, 19 nt, Homo sapiens
ugggucagggguacacaga

SEQ ID NO: 1919420 - RNA, 20 nt, Homo sapiens
cugcucuucuguuugcacac

SEQ ID NO: 1919421 - RNA, 17 nt, Homo sapiens
auucuggaaaagcaaaa

SEQ ID NO: 1919422 - RNA, 20 nt, Homo sapiens
augaaacuguccaccaagau

SEQ ID NO: 1919423 - RNA, 14 nt, Homo sapiens
cuuucuacccagcg

SEQ ID NO: 1919424 - RNA, 13 nt, Homo sapiens
uccuagucauucu

SEQ ID NO: 1919425 - RNA, 20 nt, Homo sapiens
ggaauggggugggagccaca

SEQ ID NO: 1919426 - RNA, 22 nt, Homo sapiens
uccuuggugauuccgcagugag

SEQ ID NO: 1919427 - RNA, 16 nt, Homo sapiens
cagcaaccugacucag

SEQ ID NO: 1919428 - RNA, 12 nt, Homo sapiens
aagccacccucc

SEQ ID NO: 1919429 - RNA, 12 nt, Homo sapiens
cagacaccauca

SEQ ID NO: 1919430 - RNA, 22 nt, Homo sapiens
gagcucuggugggaaaaugucc

SEQ ID NO: 1919431 - RNA, 15 nt, Homo sapiens
ugacgggaaaaccaa

SEQ ID NO: 1919432 - RNA, 17 nt, Homo sapiens
gugcauaauuuugccaa

SEQ ID NO: 1919433 - RNA, 16 nt, Homo sapiens
aacagcaaaauugugg

SEQ ID NO: 1919434 - RNA, 17 nt, Homo sapiens
auuuucgcugucgugac

SEQ ID NO: 1919435 - RNA, 13 nt, Homo sapiens
gacuaacaaaggc

SEQ ID NO: 1919436 - RNA, 14 nt, Homo sapiens
ggaguacugaugaa

SEQ ID NO: 1919437 - RNA, 15 nt, Homo sapiens
auugaacagcuguga

SEQ ID NO: 1919438 - RNA, 21 nt, Homo sapiens
uaucucaucuugaugaugaua

SEQ ID NO: 1919439 - RNA, 15 nt, Homo sapiens
gucucaaacuccugg

SEQ ID NO: 1919440 - RNA, 20 nt, Homo sapiens
ugggugucaagagggucuga

SEQ ID NO: 1919441 - RNA, 17 nt, Homo sapiens
aaaagccuaaucacagu

SEQ ID NO: 1919442 - RNA, 20 nt, Homo sapiens
gcauaggccuuagcaguaac

SEQ ID NO: 1919443 - RNA, 23 nt, Homo sapiens
cuaagcgaauguguacaaagugu

SEQ ID NO: 1919444 - RNA, 15 nt, Homo sapiens
gacaagccagaacuu

SEQ ID NO: 1919445 - RNA, 17 nt, Homo sapiens
uuccucagugacugugu

SEQ ID NO: 1919446 - RNA, 19 nt, Homo sapiens
gcccacccgaguaccucca

SEQ ID NO: 1919447 - RNA, 22 nt, Homo sapiens
aaguacucuaauauacagugug

SEQ ID NO: 1919448 - RNA, 18 nt, Homo sapiens
cuggacauauguuaggaa

SEQ ID NO: 1919449 - RNA, 15 nt, Homo sapiens
ucucuccagccugac

SEQ ID NO: 1919450 - RNA, 13 nt, Homo sapiens
uucuugaagucca

SEQ ID NO: 1919451 - RNA, 16 nt, Homo sapiens
acacaauuuucacuuu

SEQ ID NO: 1919452 - RNA, 17 nt, Homo sapiens
agacaagugacuguauc

SEQ ID NO: 1919453 - RNA, 17 nt, Homo sapiens
acaaauauucucucugu

SEQ ID NO: 1919454 - RNA, 16 nt, Homo sapiens
auugcaauacauuucu

SEQ ID NO: 1919455 - RNA, 17 nt, Homo sapiens
uaaaggagguagcuguc

SEQ ID NO: 1919456 - RNA, 17 nt, Homo sapiens
uucacagauaauuuacu

SEQ ID NO: 1919457 - RNA, 17 nt, Homo sapiens
gagcauaaugcucccau

SEQ ID NO: 1919458 - RNA, 17 nt, Homo sapiens
ccuguugaauuuacucu

SEQ ID NO: 1919459 - RNA, 21 nt, Homo sapiens
uaucucugaagcauguuucau

SEQ ID NO: 1919460 - RNA, 16 nt, Homo sapiens
cucacgcaccucccau

SEQ ID NO: 1919461 - RNA, 14 nt, Homo sapiens
auuguacagaauca

SEQ ID NO: 1919462 - RNA, 16 nt, Homo sapiens
agauguugucuuggcu

SEQ ID NO: 1919463 - RNA, 20 nt, Homo sapiens
cuuccaaacauuaaugcaau

SEQ ID NO: 1919464 - RNA, 19 nt, Homo sapiens
ccuugauauaaaaaaucuu

SEQ ID NO: 1919465 - RNA, 17 nt, Homo sapiens
uggaaagaggcugcugg

SEQ ID NO: 1919466 - RNA, 16 nt, Homo sapiens
ugugaaugcgaggaaa

SEQ ID NO: 1919467 - RNA, 18 nt, Homo sapiens
gcugggauuacaggcgcc

SEQ ID NO: 1919468 - RNA, 19 nt, Homo sapiens
aacacgugggugagcgugu

SEQ ID NO: 1919469 - RNA, 13 nt, Homo sapiens
uuggaagucauuu

SEQ ID NO: 1919470 - RNA, 22 nt, Homo sapiens
aaauucauucaacaagcaccua

SEQ ID NO: 1919471 - RNA, 21 nt, Homo sapiens
aggaauuuauaacaaauaugg

SEQ ID NO: 1919472 - RNA, 19 nt, Homo sapiens
ugcacaguggccccaucau

SEQ ID NO: 1919473 - RNA, 19 nt, Homo sapiens
ccaaacugauccaguauaa

SEQ ID NO: 1919474 - RNA, 22 nt, Homo sapiens
ucacagauuuuugguaguuucu

SEQ ID NO: 1919475 - RNA, 21 nt, Homo sapiens
gaaccauguugguugcacuuu

SEQ ID NO: 1919476 - RNA, 13 nt, Homo sapiens
ugauguccccaaa

SEQ ID NO: 1919477 - RNA, 23 nt, Homo sapiens
cucccuccauccucgucugucaa

SEQ ID NO: 1919478 - RNA, 20 nt, Homo sapiens
uacagacagaaggugcuaag

SEQ ID NO: 1919479 - RNA, 19 nt, Homo sapiens
ggaucccacucuucuugca

SEQ ID NO: 1919480 - RNA, 22 nt, Homo sapiens
aaagcaugugaauucuggcauu

SEQ ID NO: 1919481 - RNA, 11 nt, Homo sapiens
auguugcccag

SEQ ID NO: 1919482 - RNA, 10 nt, Homo sapiens
gaaagccagg

SEQ ID NO: 1919483 - RNA, 22 nt, Homo sapiens
agucagaauuagcugcuucuau

SEQ ID NO: 1919484 - RNA, 15 nt, Homo sapiens
uuaaaaugacaagca

SEQ ID NO: 1919485 - RNA, 13 nt, Homo sapiens
cagaaugcacauu

SEQ ID NO: 1919486 - RNA, 21 nt, Homo sapiens
gagucucagcccugaccuucu

SEQ ID NO: 1919487 - RNA, 17 nt, Homo sapiens
gaaaauuccagagcuau

SEQ ID NO: 1919488 - RNA, 18 nt, Homo sapiens
ggaucacuugggcccagg

SEQ ID NO: 1919489 - RNA, 15 nt, Homo sapiens
aaaauaagcauuuag

SEQ ID NO: 1919490 - RNA, 18 nt, Homo sapiens
gugccacuggaccucagu

SEQ ID NO: 1919491 - RNA, 12 nt, Homo sapiens
aaacaagccaug

SEQ ID NO: 1919492 - RNA, 19 nt, Homo sapiens
guuuuuccacuacugcuac

SEQ ID NO: 1919493 - RNA, 15 nt, Homo sapiens
cugcuugugaucuca

SEQ ID NO: 1919494 - RNA, 22 nt, Homo sapiens
ccugcugugaugugcaaaggca

SEQ ID NO: 1919495 - RNA, 15 nt, Homo sapiens
uuuauguagcacuac

SEQ ID NO: 1919496 - RNA, 21 nt, Homo sapiens
cacauagguaaaaacuggaau

SEQ ID NO: 1919497 - RNA, 16 nt, Homo sapiens
cccaguuacucaggag

SEQ ID NO: 1919498 - RNA, 13 nt, Homo sapiens
gucugguguucca

SEQ ID NO: 1919499 - RNA, 20 nt, Homo sapiens
ugaccucaggugaucugccc

SEQ ID NO: 1919500 - RNA, 24 nt, Homo sapiens
gaagcuggaggcacaacgcaccag

SEQ ID NO: 1919501 - RNA, 24 nt, Homo sapiens
ucucuguguaaucaucugaagaaa

SEQ ID NO: 1919502 - RNA, 11 nt, Homo sapiens
ugguggcaugg

SEQ ID NO: 1919503 - RNA, 11 nt, Homo sapiens
gccuggcagcc

SEQ ID NO: 1919504 - RNA, 15 nt, Homo sapiens
uucuguguugccaag

SEQ ID NO: 1919505 - RNA, 19 nt, Homo sapiens
accccagagggaccagcug

SEQ ID NO: 1919506 - RNA, 16 nt, Homo sapiens
caaccuccuguggaac

SEQ ID NO: 1919507 - RNA, 12 nt, Homo sapiens
aauaucuuggcc

SEQ ID NO: 1919508 - RNA, 20 nt, Homo sapiens
cuuggcacuguuagugacag

SEQ ID NO: 1919509 - RNA, 16 nt, Homo sapiens
cuugacucuacuauua

SEQ ID NO: 1919510 - RNA, 19 nt, Homo sapiens
uccugaaccaguccugcug

SEQ ID NO: 1919511 - RNA, 22 nt, Homo sapiens
uggcugggggagggacugcuga

SEQ ID NO: 1919512 - RNA, 15 nt, Homo sapiens
gccuuuucacugugu

SEQ ID NO: 1919513 - RNA, 12 nt, Homo sapiens
uauaaucuacuc

SEQ ID NO: 1919514 - RNA, 18 nt, Homo sapiens
gagacccuuuucucagga

SEQ ID NO: 1919515 - RNA, 19 nt, Homo sapiens
cagccugggcgacagagca

SEQ ID NO: 1919516 - RNA, 15 nt, Homo sapiens
uuccuuucauaccuu

SEQ ID NO: 1919517 - RNA, 14 nt, Homo sapiens
uugcuuugcacuuu

SEQ ID NO: 1919518 - RNA, 14 nt, Homo sapiens
augauaaaguaaug

SEQ ID NO: 1919519 - RNA, 14 nt, Homo sapiens
cuucaagccaaguc

SEQ ID NO: 1919520 - RNA, 15 nt, Homo sapiens
ugaauugguugaaua

SEQ ID NO: 1919521 - RNA, 20 nt, Homo sapiens
caauuugauucuaugacuga

SEQ ID NO: 1919522 - RNA, 14 nt, Homo sapiens
uauuguugcugaaa

SEQ ID NO: 1919523 - RNA, 16 nt, Homo sapiens
aaaggaaaaaaagacu

SEQ ID NO: 1919524 - RNA, 18 nt, Homo sapiens
gucaaaaaaggauuccaa

SEQ ID NO: 1919525 - RNA, 16 nt, Homo sapiens
agcagugccuuccaua

SEQ ID NO: 1919526 - RNA, 18 nt, Homo sapiens
cuuauugacaauugugua

SEQ ID NO: 1919527 - RNA, 23 nt, Homo sapiens
gguuguccauuuaugguaccuau

SEQ ID NO: 1919528 - RNA, 14 nt, Homo sapiens
ccugaacucugcaa

SEQ ID NO: 1919529 - RNA, 17 nt, Homo sapiens
aauggggaucacagaga

SEQ ID NO: 1919530 - RNA, 15 nt, Homo sapiens
gcaguuuuucccaag

SEQ ID NO: 1919531 - RNA, 18 nt, Homo sapiens
aggaacuuuccagcagua

SEQ ID NO: 1919532 - RNA, 22 nt, Homo sapiens
aacucagcccccaccacaaaca

SEQ ID NO: 1919533 - RNA, 14 nt, Homo sapiens
cugacuuugcuugc

SEQ ID NO: 1919534 - RNA, 18 nt, Homo sapiens
uucccuguguacccucca

SEQ ID NO: 1919535 - RNA, 15 nt, Homo sapiens
cuauugauaguuuca

SEQ ID NO: 1919536 - RNA, 12 nt, Homo sapiens
aucuugcuccaa

SEQ ID NO: 1919537 - RNA, 13 nt, Homo sapiens
auuuugugcaaca

SEQ ID NO: 1919538 - RNA, 17 nt, Homo sapiens
cuggagcagguggcuug

SEQ ID NO: 1919539 - RNA, 20 nt, Homo sapiens
cuccccaugccacguuccac

SEQ ID NO: 1919540 - RNA, 18 nt, Homo sapiens
aaucucuaaaaugcuguu

SEQ ID NO: 1919541 - RNA, 18 nt, Homo sapiens
aacacuggaacauuccag

SEQ ID NO: 1919542 - RNA, 20 nt, Homo sapiens
ggacuccaaccucagggacu

SEQ ID NO: 1919543 - RNA, 14 nt, Homo sapiens
uggcaugggacaga

SEQ ID NO: 1919544 - RNA, 14 nt, Homo sapiens
uucauguggcugua

SEQ ID NO: 1919545 - RNA, 17 nt, Homo sapiens
auguauuggaacauguc

SEQ ID NO: 1919546 - RNA, 17 nt, Homo sapiens
cagcaucaucugcacug

SEQ ID NO: 1919547 - RNA, 15 nt, Homo sapiens
guucagccuccuuga

SEQ ID NO: 1919548 - RNA, 22 nt, Homo sapiens
uacauaugcagauacuuauuaa

SEQ ID NO: 1919549 - RNA, 14 nt, Homo sapiens
cuggugacaggcca

SEQ ID NO: 1919550 - RNA, 14 nt, Homo sapiens
uaagagacuaucau

SEQ ID NO: 1919551 - RNA, 16 nt, Homo sapiens
cuguaaggaacuggaa

SEQ ID NO: 1919552 - RNA, 15 nt, Homo sapiens
gaucucccacugcgg

SEQ ID NO: 1919553 - RNA, 15 nt, Homo sapiens
gaacccagacucaga

SEQ ID NO: 1919554 - RNA, 18 nt, Homo sapiens
uggcaucaucucagcuca

SEQ ID NO: 1919555 - RNA, 13 nt, Homo sapiens
uaacacaaagaga

SEQ ID NO: 1919556 - RNA, 20 nt, Homo sapiens
guucugguuuuuaaccauug

SEQ ID NO: 1919557 - RNA, 21 nt, Homo sapiens
gagaagcaaaaucuaccaggu

SEQ ID NO: 1919558 - RNA, 22 nt, Homo sapiens
cagcugucagaacacuccaagc

SEQ ID NO: 1919559 - RNA, 17 nt, Homo sapiens
agcagcgaaaacugcca

SEQ ID NO: 1919560 - RNA, 17 nt, Homo sapiens
ggaaagacggugcuaua

SEQ ID NO: 1919561 - RNA, 16 nt, Homo sapiens
uuccuuaaacugugug

SEQ ID NO: 1919562 - RNA, 20 nt, Homo sapiens
aaguuagucaauccugucau

SEQ ID NO: 1919563 - RNA, 22 nt, Homo sapiens
cuccucccagcuguaccggcca

SEQ ID NO: 1919564 - RNA, 21 nt, Homo sapiens
cugaccaugcacuauauuugu

SEQ ID NO: 1919565 - RNA, 16 nt, Homo sapiens
ggaccccaccccucau

SEQ ID NO: 1919566 - RNA, 22 nt, Homo sapiens
ugacuggaaguuguggauauca

SEQ ID NO: 1919567 - RNA, 17 nt, Homo sapiens
auuauagcauguaauau

SEQ ID NO: 1919568 - RNA, 19 nt, Homo sapiens
aaaaaguugaaccauuaua

SEQ ID NO: 1919569 - RNA, 14 nt, Homo sapiens
agccaacuuuugca

SEQ ID NO: 1919570 - RNA, 19 nt, Homo sapiens
agaaacacaaccacucacc

SEQ ID NO: 1919571 - RNA, 18 nt, Homo sapiens
augauacuugguccuuaa

SEQ ID NO: 1919572 - RNA, 20 nt, Homo sapiens
cgcccugugcccgacugacu

SEQ ID NO: 1919573 - RNA, 23 nt, Homo sapiens
aggcugucuaccugaagcuggac

SEQ ID NO: 1919574 - RNA, 18 nt, Homo sapiens
uccagaccucccagagag

SEQ ID NO: 1919575 - RNA, 23 nt, Homo sapiens
uccaauccagaggaacaagcaug

SEQ ID NO: 1919576 - RNA, 20 nt, Homo sapiens
augcuuuaaacauugguucu

SEQ ID NO: 1919577 - RNA, 17 nt, Homo sapiens
ucuuuaaaguuacugau

SEQ ID NO: 1919578 - RNA, 12 nt, Homo sapiens
caugcacaaagu

SEQ ID NO: 1919579 - RNA, 15 nt, Homo sapiens
auuuauggaaucuac

SEQ ID NO: 1919580 - RNA, 19 nt, Homo sapiens
uuaagcccuacgaugggau

SEQ ID NO: 1919581 - RNA, 15 nt, Homo sapiens
uggugacuuuggaua

SEQ ID NO: 1919582 - RNA, 13 nt, Homo sapiens
agaccaguccaug

SEQ ID NO: 1919583 - RNA, 20 nt, Homo sapiens
ccaugugcuagucacuggca

SEQ ID NO: 1919584 - RNA, 17 nt, Homo sapiens
gaacuaagcaucuuuau

SEQ ID NO: 1919585 - RNA, 22 nt, Homo sapiens
gcacucugaguuuaccauuugu

SEQ ID NO: 1919586 - RNA, 12 nt, Homo sapiens
guguugcaaauu

SEQ ID NO: 1919587 - RNA, 22 nt, Homo sapiens
ccaaagcauggacuaaccccaa

SEQ ID NO: 1919588 - RNA, 21 nt, Homo sapiens
uaucacaaggccaguaccaca

SEQ ID NO: 1919589 - RNA, 22 nt, Homo sapiens
uggucugacuccuugggguccu

SEQ ID NO: 1919590 - RNA, 15 nt, Homo sapiens
ccacuaaaauacaua

SEQ ID NO: 1919591 - RNA, 20 nt, Homo sapiens
ugaagaauauaccauuucaa

SEQ ID NO: 1919592 - RNA, 22 nt, Homo sapiens
cuuguuuuuuuaauucauuaac

SEQ ID NO: 1919593 - RNA, 12 nt, Homo sapiens
ggagcugccaca

SEQ ID NO: 1919594 - RNA, 20 nt, Homo sapiens
gcagcuaaaggaagugaauc

SEQ ID NO: 1919595 - RNA, 16 nt, Homo sapiens
ggacaaguagccaccu

SEQ ID NO: 1919596 - RNA, 13 nt, Homo sapiens
caugggacugugc

SEQ ID NO: 1919597 - RNA, 17 nt, Homo sapiens
aucaaauuccagaauga

SEQ ID NO: 1919598 - RNA, 20 nt, Homo sapiens
aaaauggcaccuucccccuu

SEQ ID NO: 1919599 - RNA, 12 nt, Homo sapiens
agugucacuuac

SEQ ID NO: 1919600 - RNA, 22 nt, Homo sapiens
aacaccaagugaggccauagca

SEQ ID NO: 1919601 - RNA, 18 nt, Homo sapiens
acccagcccagcuugcca

SEQ ID NO: 1919602 - RNA, 23 nt, Homo sapiens
aggaaucacuggggaugguggca

SEQ ID NO: 1919603 - RNA, 17 nt, Homo sapiens
uaauaaauuuucuaaaa

SEQ ID NO: 1919604 - RNA, 17 nt, Homo sapiens
uauuauauauacuuaau

SEQ ID NO: 1919605 - RNA, 21 nt, Homo sapiens
cuguagaagaagcccauauca

SEQ ID NO: 1919606 - RNA, 14 nt, Homo sapiens
ccgcaugugucugu

SEQ ID NO: 1919607 - RNA, 17 nt, Homo sapiens
uauguccgaugguaucu

SEQ ID NO: 1919608 - RNA, 17 nt, Homo sapiens
caacugcugcuucacca

SEQ ID NO: 1919609 - RNA, 13 nt, Homo sapiens
cagguccauuuag

SEQ ID NO: 1919610 - RNA, 18 nt, Homo sapiens
cuccaucucuucugcaag

SEQ ID NO: 1919611 - RNA, 16 nt, Homo sapiens
ucagaugaucucucca

SEQ ID NO: 1919612 - RNA, 23 nt, Homo sapiens
ggagacacuauuuaucugugcaa

SEQ ID NO: 1919613 - RNA, 16 nt, Homo sapiens
uguuugcacguuaugg

SEQ ID NO: 1919614 - RNA, 15 nt, Homo sapiens
gaaauaugaugccuu

SEQ ID NO: 1919615 - RNA, 12 nt, Homo sapiens
caacuugauguu

SEQ ID NO: 1919616 - RNA, 23 nt, Homo sapiens
aaaaggccugucccugcagacau

SEQ ID NO: 1919617 - RNA, 17 nt, Homo sapiens
uccuuuaauauuugcua

SEQ ID NO: 1919618 - RNA, 17 nt, Homo sapiens
gcugagauuacaggugu

SEQ ID NO: 1919619 - RNA, 22 nt, Homo sapiens
uaugcaacucaucuucacagau

SEQ ID NO: 1919620 - RNA, 17 nt, Homo sapiens
agccccacuucuggguc

SEQ ID NO: 1919621 - RNA, 21 nt, Homo sapiens
aguugaugggggccaggacac

SEQ ID NO: 1919622 - RNA, 16 nt, Homo sapiens
cacccauugucucauu

SEQ ID NO: 1919623 - RNA, 17 nt, Homo sapiens
aaaguuuaaauaccagu

SEQ ID NO: 1919624 - RNA, 22 nt, Homo sapiens
cugagugcgggcugaggccaga

SEQ ID NO: 1919625 - RNA, 19 nt, Homo sapiens
auuaaaauugccauuuuau

SEQ ID NO: 1919626 - RNA, 21 nt, Homo sapiens
gcccauuggcucccaucugaa

SEQ ID NO: 1919627 - RNA, 21 nt, Homo sapiens
auuucuccauuaaacuucuac

SEQ ID NO: 1919628 - RNA, 15 nt, Homo sapiens
ccuuugaaaugaaua

SEQ ID NO: 1919629 - RNA, 20 nt, Homo sapiens
gucagauaaucggugcagcg

SEQ ID NO: 1919630 - RNA, 16 nt, Homo sapiens
cuuguucuacugagaa

SEQ ID NO: 1919631 - RNA, 16 nt, Homo sapiens
caggacccugggacca

SEQ ID NO: 1919632 - RNA, 12 nt, Homo sapiens
gaaauaccucau

SEQ ID NO: 1919633 - RNA, 19 nt, Homo sapiens
ucuuuuccugaccaaucuu

SEQ ID NO: 1919634 - RNA, 18 nt, Homo sapiens
cucucugguuuacuucaa

SEQ ID NO: 1919635 - RNA, 24 nt, Homo sapiens
cccauuccaggcagccucugucag

SEQ ID NO: 1919636 - RNA, 17 nt, Homo sapiens
agcugaacaaugaaugc

SEQ ID NO: 1919637 - RNA, 14 nt, Homo sapiens
uggcccuaugcuuc

SEQ ID NO: 1919638 - RNA, 20 nt, Homo sapiens
uccugcacuccagaauccac

SEQ ID NO: 1919639 - RNA, 21 nt, Homo sapiens
aguauuuacugacugcuuaua

SEQ ID NO: 1919640 - RNA, 22 nt, Homo sapiens
cuuccgcugaggggucucggau

SEQ ID NO: 1919641 - RNA, 23 nt, Homo sapiens
gaauaagcucuaguucuuaacaa

SEQ ID NO: 1919642 - RNA, 23 nt, Homo sapiens
uucugggagcaucgaagcucugu

SEQ ID NO: 1919643 - RNA, 17 nt, Homo sapiens
cacccccaauuccuuga

SEQ ID NO: 1919644 - RNA, 20 nt, Homo sapiens
ugagcgacaaagaugauuua

SEQ ID NO: 1919645 - RNA, 13 nt, Homo sapiens
ccucugugaagca

SEQ ID NO: 1919646 - RNA, 18 nt, Homo sapiens
auuuaacccuuucuucaa

SEQ ID NO: 1919647 - RNA, 20 nt, Homo sapiens
uccaauccuuaaacugccaa

SEQ ID NO: 1919648 - RNA, 22 nt, Homo sapiens
ugcuucucuucuuuauugcacu

SEQ ID NO: 1919649 - RNA, 14 nt, Homo sapiens
gugucaaaacuggu

SEQ ID NO: 1919650 - RNA, 18 nt, Homo sapiens
uccccacagugacaguca

SEQ ID NO: 1919651 - RNA, 14 nt, Homo sapiens
aaguuaauucucag

SEQ ID NO: 1919652 - RNA, 19 nt, Homo sapiens
caccuuauacaucacuucc

SEQ ID NO: 1919653 - RNA, 13 nt, Homo sapiens
auuauuacuguuu

SEQ ID NO: 1919654 - RNA, 14 nt, Homo sapiens
uacgugucugaauc

SEQ ID NO: 1919655 - RNA, 22 nt, Homo sapiens
gaacccaugucagucucucacc

SEQ ID NO: 1919656 - RNA, 16 nt, Homo sapiens
agaacauacuguucuc

SEQ ID NO: 1919657 - RNA, 15 nt, Homo sapiens
agaaaaaaguuuaca

SEQ ID NO: 1919658 - RNA, 20 nt, Homo sapiens
cuugccuaaggugcguaguc

SEQ ID NO: 1919659 - RNA, 14 nt, Homo sapiens
cacagcuuuuccaa

SEQ ID NO: 1919660 - RNA, 15 nt, Homo sapiens
acuuuccaaacacca

SEQ ID NO: 1919661 - RNA, 23 nt, Homo sapiens
acaggcaaauguacuucucaccc

SEQ ID NO: 1919662 - RNA, 20 nt, Homo sapiens
aguguccccuuauacagugg

SEQ ID NO: 1919663 - RNA, 12 nt, Homo sapiens
uuaauuauacaa

SEQ ID NO: 1919664 - RNA, 15 nt, Homo sapiens
cucacucacucccca

SEQ ID NO: 1919665 - RNA, 16 nt, Homo sapiens
ucugugaccucaggca

SEQ ID NO: 1919666 - RNA, 18 nt, Homo sapiens
uucguugaaacgauuuca

SEQ ID NO: 1919667 - RNA, 17 nt, Homo sapiens
uggcuuggcaucugugu

SEQ ID NO: 1919668 - RNA, 18 nt, Homo sapiens
cagcuaacccuagucaaa

SEQ ID NO: 1919669 - RNA, 21 nt, Homo sapiens
aucauguuggauagucagcug

SEQ ID NO: 1919670 - RNA, 24 nt, Homo sapiens
acugggucuaaagggcuaugccuc

SEQ ID NO: 1919671 - RNA, 22 nt, Homo sapiens
cgucauuucagcucuugcuuca

SEQ ID NO: 1919672 - RNA, 17 nt, Homo sapiens
cccuggguaagaagggu

SEQ ID NO: 1919673 - RNA, 14 nt, Homo sapiens
ccagaaaagcaaua

SEQ ID NO: 1919674 - RNA, 18 nt, Homo sapiens
ucagcugaauucacuuaa

SEQ ID NO: 1919675 - RNA, 19 nt, Homo sapiens
aacagcagugaucucaggg

SEQ ID NO: 1919676 - RNA, 15 nt, Homo sapiens
aaacccagcucccuu

SEQ ID NO: 1919677 - RNA, 23 nt, Homo sapiens
ucugaagacuaguuauauauucc

SEQ ID NO: 1919678 - RNA, 15 nt, Homo sapiens
cauacauuaauuaau

SEQ ID NO: 1919679 - RNA, 23 nt, Homo sapiens
uccucagcuucuuccccgagaaa

SEQ ID NO: 1919680 - RNA, 17 nt, Homo sapiens
cacuuagguuuugucca

SEQ ID NO: 1919681 - RNA, 11 nt, Homo sapiens
aaaauagcuua

SEQ ID NO: 1919682 - RNA, 21 nt, Homo sapiens
auauucaaugaacuuccauuu

SEQ ID NO: 1919683 - RNA, 17 nt, Homo sapiens
uggauuaguuaacagac

SEQ ID NO: 1919684 - RNA, 18 nt, Homo sapiens
agaaagccaugugcagcc

SEQ ID NO: 1919685 - RNA, 17 nt, Homo sapiens
ggucuauuacgugggug

SEQ ID NO: 1919686 - RNA, 13 nt, Homo sapiens
cuuuacaauguga

SEQ ID NO: 1919687 - RNA, 13 nt, Homo sapiens
cuuuucaaugugu

SEQ ID NO: 1919688 - RNA, 20 nt, Homo sapiens
cuuaggaaacccuucuuuac

SEQ ID NO: 1919689 - RNA, 19 nt, Homo sapiens
cauuucuaauguaugcauu

SEQ ID NO: 1919690 - RNA, 18 nt, Homo sapiens
aauaucuaagaaucuuug

SEQ ID NO: 1919691 - RNA, 16 nt, Homo sapiens
ccacaagaacaauuca

SEQ ID NO: 1919692 - RNA, 15 nt, Homo sapiens
uauguuaacauguaa

SEQ ID NO: 1919693 - RNA, 22 nt, Homo sapiens
agccauuuguuggggcaguggu

SEQ ID NO: 1919694 - RNA, 19 nt, Homo sapiens
cgugguagugcaagcugaa

SEQ ID NO: 1919695 - RNA, 19 nt, Homo sapiens
gacagcagauuccacagga

SEQ ID NO: 1919696 - RNA, 15 nt, Homo sapiens
ugcugacuuuaaaag

SEQ ID NO: 1919697 - RNA, 21 nt, Homo sapiens
ugagaucacgccauuguacuc

SEQ ID NO: 1919698 - RNA, 20 nt, Homo sapiens
cuuuguggggcucaaaaccu

SEQ ID NO: 1919699 - RNA, 22 nt, Homo sapiens
aauauuacuggauaaauuguau

SEQ ID NO: 1919700 - RNA, 16 nt, Homo sapiens
cucagccuccaaagua

SEQ ID NO: 1919701 - RNA, 15 nt, Homo sapiens
aauaagcuucaucuc

SEQ ID NO: 1919702 - RNA, 13 nt, Homo sapiens
ccaguaguucuca

SEQ ID NO: 1919703 - RNA, 23 nt, Homo sapiens
ggauugggacgcacagugcaguu

SEQ ID NO: 1919704 - RNA, 22 nt, Homo sapiens
ucugaaucgagauguccauagu

SEQ ID NO: 1919705 - RNA, 18 nt, Homo sapiens
aggagaugaauagaagaa

SEQ ID NO: 1919706 - RNA, 21 nt, Homo sapiens
aacccgacauguguaccucag

SEQ ID NO: 1919707 - RNA, 17 nt, Homo sapiens
cuuuguaauugacacua

SEQ ID NO: 1919708 - RNA, 12 nt, Homo sapiens
ucuaaucucagc

SEQ ID NO: 1919709 - RNA, 12 nt, Homo sapiens
guggcuuuuacc

SEQ ID NO: 1919710 - RNA, 17 nt, Homo sapiens
gacugaccaugcacuau

SEQ ID NO: 1919711 - RNA, 17 nt, Homo sapiens
ugcacaccgugugccau

SEQ ID NO: 1919712 - RNA, 18 nt, Homo sapiens
ugcuggagaaaaauaucu

SEQ ID NO: 1919713 - RNA, 20 nt, Homo sapiens
ucagauuaagaguugccaaa

SEQ ID NO: 1919714 - RNA, 22 nt, Homo sapiens
ucaaaagaaccagacugugucu

SEQ ID NO: 1919715 - RNA, 19 nt, Homo sapiens
cuuucuccuguagcacaaa

SEQ ID NO: 1919716 - RNA, 21 nt, Homo sapiens
caauccuagaaccaagcuuca

SEQ ID NO: 1919717 - RNA, 18 nt, Homo sapiens
uacaacugccucgaaaca

SEQ ID NO: 1919718 - RNA, 21 nt, Homo sapiens
ugcgucagaccaguacuggga

SEQ ID NO: 1919719 - RNA, 14 nt, Homo sapiens
caugaugacucuuc

SEQ ID NO: 1919720 - RNA, 14 nt, Homo sapiens
ccucugccacugac

SEQ ID NO: 1919721 - RNA, 21 nt, Homo sapiens
uuaguuaaaaaaaaauucccu

SEQ ID NO: 1919722 - RNA, 22 nt, Homo sapiens
agcugauguccaguugccacuu

SEQ ID NO: 1919723 - RNA, 23 nt, Homo sapiens
guuccucuuuucuuucaagaacu

SEQ ID NO: 1919724 - RNA, 21 nt, Homo sapiens
auucaggcagcacugacaaua

SEQ ID NO: 1919725 - RNA, 21 nt, Homo sapiens
guacuuuuuguuccagagcug

SEQ ID NO: 1919726 - RNA, 15 nt, Homo sapiens
cucacuugauguuuc

SEQ ID NO: 1919727 - RNA, 14 nt, Homo sapiens
gaucgcugcacaug

SEQ ID NO: 1919728 - RNA, 14 nt, Homo sapiens
uaaacuccauuuaa

SEQ ID NO: 1919729 - RNA, 18 nt, Homo sapiens
uugcagaagagaaacuga

SEQ ID NO: 1919730 - RNA, 13 nt, Homo sapiens
caauacagauaua

SEQ ID NO: 1919731 - RNA, 19 nt, Homo sapiens
aaggcaaugccauccucaa

SEQ ID NO: 1919732 - RNA, 23 nt, Homo sapiens
gaggaaucaugaaaaaugaucuc

SEQ ID NO: 1919733 - RNA, 16 nt, Homo sapiens
gagagugucaaccaga

SEQ ID NO: 1919734 - RNA, 15 nt, Homo sapiens
guauugcuaacaucu

SEQ ID NO: 1919735 - RNA, 13 nt, Homo sapiens
cuucagcugcuga

SEQ ID NO: 1919736 - RNA, 22 nt, Homo sapiens
gugguccaaauaggcaucauca

SEQ ID NO: 1919737 - RNA, 21 nt, Homo sapiens
uaguaaucccccuugccaaau

SEQ ID NO: 1919738 - RNA, 19 nt, Homo sapiens
uaaguuuaauuaucugcau

SEQ ID NO: 1919739 - RNA, 15 nt, Homo sapiens
ccaccuccaaggacu

SEQ ID NO: 1919740 - RNA, 13 nt, Homo sapiens
ccucuacuguugc

SEQ ID NO: 1919741 - RNA, 23 nt, Homo sapiens
cuggaaaagugauguauuuucau

SEQ ID NO: 1919742 - RNA, 17 nt, Homo sapiens
ugcaugugugugcucag

SEQ ID NO: 1919743 - RNA, 18 nt, Homo sapiens
acauguuguaaauggcau

SEQ ID NO: 1919744 - RNA, 21 nt, Homo sapiens
gagaacccugcguggggacag

SEQ ID NO: 1919745 - RNA, 21 nt, Homo sapiens
agauuuccaacuuuuauuuca

SEQ ID NO: 1919746 - RNA, 17 nt, Homo sapiens
aacccagcauguacaaa

SEQ ID NO: 1919747 - RNA, 14 nt, Homo sapiens
gcaacuccccuaca

SEQ ID NO: 1919748 - RNA, 21 nt, Homo sapiens
uuccuaugauguauacugcca

SEQ ID NO: 1919749 - RNA, 20 nt, Homo sapiens
acucugccgcuguguaggga

SEQ ID NO: 1919750 - RNA, 21 nt, Homo sapiens
aagacacguucuugccagcuu

SEQ ID NO: 1919751 - RNA, 20 nt, Homo sapiens
gagaaauaaaaauaccucuu

SEQ ID NO: 1919752 - RNA, 13 nt, Homo sapiens
accuuaccaaaaa

SEQ ID NO: 1919753 - RNA, 13 nt, Homo sapiens
acauaaccaacau

SEQ ID NO: 1919754 - RNA, 19 nt, Homo sapiens
gagggauaaaaacaauacu

SEQ ID NO: 1919755 - RNA, 22 nt, Homo sapiens
ucauaguuacuguguaaacuca

SEQ ID NO: 1919756 - RNA, 18 nt, Homo sapiens
aaccaucgguccacaccu

SEQ ID NO: 1919757 - RNA, 14 nt, Homo sapiens
uaaagaaagaugga

SEQ ID NO: 1919758 - RNA, 14 nt, Homo sapiens
uuugaaaaguaaaa

SEQ ID NO: 1919759 - RNA, 16 nt, Homo sapiens
ugaagugccagaucaa

SEQ ID NO: 1919760 - RNA, 14 nt, Homo sapiens
uugaagcacuuaag

SEQ ID NO: 1919761 - RNA, 19 nt, Homo sapiens
gcucccugaguucacucuc

SEQ ID NO: 1919762 - RNA, 14 nt, Homo sapiens
ccugcuccagugua

SEQ ID NO: 1919763 - RNA, 17 nt, Homo sapiens
gcaucucagccuccuga

SEQ ID NO: 1919764 - RNA, 13 nt, Homo sapiens
aagccccgucucu

SEQ ID NO: 1919765 - RNA, 17 nt, Homo sapiens
ccauuuuauaccaaagg

SEQ ID NO: 1919766 - RNA, 14 nt, Homo sapiens
cauaauuuaauucc

SEQ ID NO: 1919767 - RNA, 16 nt, Homo sapiens
acagcucagaaaauca

SEQ ID NO: 1919768 - RNA, 17 nt, Homo sapiens
accauagugaaguguga

SEQ ID NO: 1919769 - RNA, 15 nt, Homo sapiens
cccugaauggucuca

SEQ ID NO: 1919770 - RNA, 16 nt, Homo sapiens
uccucacuuugcugcc

SEQ ID NO: 1919771 - RNA, 17 nt, Homo sapiens
ggcuuuuuacuauuaac

SEQ ID NO: 1919772 - RNA, 13 nt, Homo sapiens
caccagugacuuu

SEQ ID NO: 1919773 - RNA, 18 nt, Homo sapiens
uguccacagcaaagggca

SEQ ID NO: 1919774 - RNA, 15 nt, Homo sapiens
auaaauguugccaug

SEQ ID NO: 1919775 - RNA, 17 nt, Homo sapiens
uaaaagaugauuucuca

SEQ ID NO: 1919776 - RNA, 20 nt, Homo sapiens
cuuaacguuagaccacaaau

SEQ ID NO: 1919777 - RNA, 23 nt, Homo sapiens
cagaaauagacuuaauaaagguu

SEQ ID NO: 1919778 - RNA, 21 nt, Homo sapiens
uuagcugagccuucugaugag

SEQ ID NO: 1919779 - RNA, 18 nt, Homo sapiens
auguaaauuaguuugaca

SEQ ID NO: 1919780 - RNA, 19 nt, Homo sapiens
cacaugccccucuuagaag

SEQ ID NO: 1919781 - RNA, 15 nt, Homo sapiens
ucggcucacugcaac

SEQ ID NO: 1919782 - RNA, 23 nt, Homo sapiens
aucuugggugucugaacagcuau

SEQ ID NO: 1919783 - RNA, 20 nt, Homo sapiens
cgaguggcccuucauguaca

SEQ ID NO: 1919784 - RNA, 16 nt, Homo sapiens
agguauggccaugccc

SEQ ID NO: 1919785 - RNA, 14 nt, Homo sapiens
ugaacaaaauaagc

SEQ ID NO: 1919786 - RNA, 15 nt, Homo sapiens
caaccauaccuuccu

SEQ ID NO: 1919787 - RNA, 15 nt, Homo sapiens
gagaucggccgccca

SEQ ID NO: 1919788 - RNA, 17 nt, Homo sapiens
uagugucugaugaaugu

SEQ ID NO: 1919789 - RNA, 18 nt, Homo sapiens
agaugugaaaacaucuca

SEQ ID NO: 1919790 - RNA, 14 nt, Homo sapiens
guucuuuuugccag

SEQ ID NO: 1919791 - RNA, 14 nt, Homo sapiens
agaagacagcugcu

SEQ ID NO: 1919792 - RNA, 22 nt, Homo sapiens
guuggagagagauguuccucuu

SEQ ID NO: 1919793 - RNA, 19 nt, Homo sapiens
gaaucaguaugaagacacu

SEQ ID NO: 1919794 - RNA, 21 nt, Homo sapiens
ugccucucccgucgucucuuc

SEQ ID NO: 1919795 - RNA, 20 nt, Homo sapiens
acagccuggccccugugcac

SEQ ID NO: 1919796 - RNA, 15 nt, Homo sapiens
acaaccggucccuuc

SEQ ID NO: 1919797 - RNA, 20 nt, Homo sapiens
guuguugauugacugcauga

SEQ ID NO: 1919798 - RNA, 13 nt, Homo sapiens
uaucuuccuuugg

SEQ ID NO: 1919799 - RNA, 19 nt, Homo sapiens
aacauaaaauaaacacuag

SEQ ID NO: 1919800 - RNA, 13 nt, Homo sapiens
cagcccugcacca

SEQ ID NO: 1919801 - RNA, 15 nt, Homo sapiens
cucacuguuccuucu

SEQ ID NO: 1919802 - RNA, 13 nt, Homo sapiens
cacuacugcaguc

SEQ ID NO: 1919803 - RNA, 21 nt, Homo sapiens
caauuaguuccccuacuacac

SEQ ID NO: 1919804 - RNA, 18 nt, Homo sapiens
ucuguccagaggcuuuaa

SEQ ID NO: 1919805 - RNA, 19 nt, Homo sapiens
uguagaacugcaauuucca

SEQ ID NO: 1919806 - RNA, 23 nt, Homo sapiens
gucugcaggauugauuaugcaga

SEQ ID NO: 1919807 - RNA, 15 nt, Homo sapiens
ccuccagcauuuaaa

SEQ ID NO: 1919808 - RNA, 13 nt, Homo sapiens
auugucaaauaca

SEQ ID NO: 1919809 - RNA, 21 nt, Homo sapiens
uuucuacaacugauugcaaca

SEQ ID NO: 1919810 - RNA, 12 nt, Homo sapiens
gauguucacugu

SEQ ID NO: 1919811 - RNA, 19 nt, Homo sapiens
uggagauuggcaugccauu

SEQ ID NO: 1919812 - RNA, 20 nt, Homo sapiens
uacauaggcuucuauuaccu

SEQ ID NO: 1919813 - RNA, 15 nt, Homo sapiens
aaugcacucaguuua

SEQ ID NO: 1919814 - RNA, 13 nt, Homo sapiens
cuuaaucuugaua

SEQ ID NO: 1919815 - RNA, 16 nt, Homo sapiens
gaauuccaccuggaaa

SEQ ID NO: 1919816 - RNA, 16 nt, Homo sapiens
gccaggugcugugaca

SEQ ID NO: 1919817 - RNA, 15 nt, Homo sapiens
guuuccguaguauau

SEQ ID NO: 1919818 - RNA, 18 nt, Homo sapiens
ugagccgaggucaugcca

SEQ ID NO: 1919819 - RNA, 23 nt, Homo sapiens
uguguauccaugcaccuaccuua

SEQ ID NO: 1919820 - RNA, 19 nt, Homo sapiens
cucauuuggacuugcugaa

SEQ ID NO: 1919821 - RNA, 15 nt, Homo sapiens
augaugcauacaguu

SEQ ID NO: 1919822 - RNA, 23 nt, Homo sapiens
aagugagcagagauguacugcaa

SEQ ID NO: 1919823 - RNA, 13 nt, Homo sapiens
ccuggcccagugc

SEQ ID NO: 1919824 - RNA, 20 nt, Homo sapiens
uucauacuacauuugaacag

SEQ ID NO: 1919825 - RNA, 16 nt, Homo sapiens
agcccuauugcugcua

SEQ ID NO: 1919826 - RNA, 21 nt, Homo sapiens
uccacacaugaguauugugau

SEQ ID NO: 1919827 - RNA, 17 nt, Homo sapiens
acuagcagcugcaguca

SEQ ID NO: 1919828 - RNA, 20 nt, Homo sapiens
ccuccugaguagcugggacu

SEQ ID NO: 1919829 - RNA, 20 nt, Homo sapiens
agugccagaacccaaaucca

SEQ ID NO: 1919830 - RNA, 16 nt, Homo sapiens
uuguuugcugucugau

SEQ ID NO: 1919831 - RNA, 15 nt, Homo sapiens
uaccgagagccaaac

SEQ ID NO: 1919832 - RNA, 20 nt, Homo sapiens
accuuuuccuuauacuguau

SEQ ID NO: 1919833 - RNA, 17 nt, Homo sapiens
gugggcacugugccaag

SEQ ID NO: 1919834 - RNA, 17 nt, Homo sapiens
cuccagaguuguucucu

SEQ ID NO: 1919835 - RNA, 20 nt, Homo sapiens
gauuuggggcagagggacag

SEQ ID NO: 1919836 - RNA, 21 nt, Homo sapiens
uacccaccugagcuuuggacg

SEQ ID NO: 1919837 - RNA, 13 nt, Homo sapiens
aaauggccaaagc

SEQ ID NO: 1919838 - RNA, 21 nt, Homo sapiens
uggaagcacaccaaucuuacu

SEQ ID NO: 1919839 - RNA, 21 nt, Homo sapiens
agcucaagucuucccugauca

SEQ ID NO: 1919840 - RNA, 15 nt, Homo sapiens
aaauaguuaccuuca

SEQ ID NO: 1919841 - RNA, 12 nt, Homo sapiens
agcacugugguc

SEQ ID NO: 1919842 - RNA, 12 nt, Homo sapiens
aacccugugaua

SEQ ID NO: 1919843 - RNA, 14 nt, Homo sapiens
ucccccucuuugca

SEQ ID NO: 1919844 - RNA, 16 nt, Homo sapiens
guaguuauucugccuu

SEQ ID NO: 1919845 - RNA, 15 nt, Homo sapiens
uguaauacacauauc

SEQ ID NO: 1919846 - RNA, 21 nt, Homo sapiens
aggaggggaggaacacugcac

SEQ ID NO: 1919847 - RNA, 15 nt, Homo sapiens
uauguuauuugcucu

SEQ ID NO: 1919848 - RNA, 21 nt, Homo sapiens
uaaaaauuguuuuaaacuaca

SEQ ID NO: 1919849 - RNA, 14 nt, Homo sapiens
ugacgccaggguau

SEQ ID NO: 1919850 - RNA, 22 nt, Homo sapiens
uugucauauucgauguacuuua

SEQ ID NO: 1919851 - RNA, 16 nt, Homo sapiens
uuaacagggccucuca

SEQ ID NO: 1919852 - RNA, 18 nt, Homo sapiens
uguucauucucaucagug

SEQ ID NO: 1919853 - RNA, 12 nt, Homo sapiens
acagugaacaaa

SEQ ID NO: 1919854 - RNA, 19 nt, Homo sapiens
uccugcauucacccagaca

SEQ ID NO: 1919855 - RNA, 23 nt, Homo sapiens
agggaguguuugugucugacuca

SEQ ID NO: 1919856 - RNA, 22 nt, Homo sapiens
gcauguuuugcccaccagauca

SEQ ID NO: 1919857 - RNA, 15 nt, Homo sapiens
auaucugcuguccag

SEQ ID NO: 1919858 - RNA, 20 nt, Homo sapiens
uacagaaauacugcucugaa

SEQ ID NO: 1919859 - RNA, 14 nt, Homo sapiens
ggcugcaguucccu

SEQ ID NO: 1919860 - RNA, 17 nt, Homo sapiens
ugcagcuguaaacauau

SEQ ID NO: 1919861 - RNA, 19 nt, Homo sapiens
gaaaagagaauauuuacaa

SEQ ID NO: 1919862 - RNA, 21 nt, Homo sapiens
gagugccguaacaacuguggu

SEQ ID NO: 1919863 - RNA, 15 nt, Homo sapiens
gaauaauuguguaca

SEQ ID NO: 1919864 - RNA, 14 nt, Homo sapiens
cagcaaaagaccaa

SEQ ID NO: 1919865 - RNA, 20 nt, Homo sapiens
cugucucucaugaaccucaa

SEQ ID NO: 1919866 - RNA, 14 nt, Homo sapiens
guccacucugaaua

SEQ ID NO: 1919867 - RNA, 20 nt, Homo sapiens
cugucuccuuaacacugagc

SEQ ID NO: 1919868 - RNA, 23 nt, Homo sapiens
uauuccugauagagguauggaaa

SEQ ID NO: 1919869 - RNA, 22 nt, Homo sapiens
uguacuggucagcuugcucaga

SEQ ID NO: 1919870 - RNA, 17 nt, Homo sapiens
acuuaccuagauucuac

SEQ ID NO: 1919871 - RNA, 19 nt, Homo sapiens
gaauuuuuuuuaacauucc

SEQ ID NO: 1919872 - RNA, 14 nt, Homo sapiens
ccuuuugauauuaa

SEQ ID NO: 1919873 - RNA, 13 nt, Homo sapiens
augucaguucaua

SEQ ID NO: 1919874 - RNA, 15 nt, Homo sapiens
uaaguacaugugcca

SEQ ID NO: 1919875 - RNA, 22 nt, Homo sapiens
agcuuuaagcaaauucuuuuaa

SEQ ID NO: 1919876 - RNA, 14 nt, Homo sapiens
aaguaaauacagca

SEQ ID NO: 1919877 - RNA, 20 nt, Homo sapiens
ucaucacuugugucaaucau

SEQ ID NO: 1919878 - RNA, 18 nt, Homo sapiens
aauuuaaaaucagacucu

SEQ ID NO: 1919879 - RNA, 17 nt, Homo sapiens
aagccuggacucugccc

SEQ ID NO: 1919880 - RNA, 20 nt, Homo sapiens
agccccuccccagacucuca

SEQ ID NO: 1919881 - RNA, 15 nt, Homo sapiens
gaccaucuaccccuu

SEQ ID NO: 1919882 - RNA, 18 nt, Homo sapiens
uguagcucugaaugcuau

SEQ ID NO: 1919883 - RNA, 13 nt, Homo sapiens
cccacgagggugc

SEQ ID NO: 1919884 - RNA, 19 nt, Homo sapiens
agugucaccuuuucuugcc

SEQ ID NO: 1919885 - RNA, 15 nt, Homo sapiens
ugagcaguucccaag

SEQ ID NO: 1919886 - RNA, 20 nt, Homo sapiens
guacaaacacaggauuugua

SEQ ID NO: 1919887 - RNA, 16 nt, Homo sapiens
cagccuggguggcaga

SEQ ID NO: 1919888 - RNA, 16 nt, Homo sapiens
auaauggggcagacac

SEQ ID NO: 1919889 - RNA, 14 nt, Homo sapiens
guccugcaagcaga

SEQ ID NO: 1919890 - RNA, 19 nt, Homo sapiens
caaaauauuaacauucuuu

SEQ ID NO: 1919891 - RNA, 15 nt, Homo sapiens
caacagcauuuucaa

SEQ ID NO: 1919892 - RNA, 17 nt, Homo sapiens
auggaugagcacacaca

SEQ ID NO: 1919893 - RNA, 19 nt, Homo sapiens
auucuuccagaaugcugaa

SEQ ID NO: 1919894 - RNA, 17 nt, Homo sapiens
augucagaaacaaugac

SEQ ID NO: 1919895 - RNA, 12 nt, Homo sapiens
ucaaacuguaaa

SEQ ID NO: 1919896 - RNA, 12 nt, Homo sapiens
cauuacugccuu

SEQ ID NO: 1919897 - RNA, 17 nt, Homo sapiens
gcagaucugugccccau

SEQ ID NO: 1919898 - RNA, 15 nt, Homo sapiens
uuccuuuuucugggu

SEQ ID NO: 1919899 - RNA, 15 nt, Homo sapiens
gccuugcaguaggca

SEQ ID NO: 1919900 - RNA, 20 nt, Homo sapiens
aaucuguauauguuguaaua

SEQ ID NO: 1919901 - RNA, 17 nt, Homo sapiens
uggaauaaggagaauga

SEQ ID NO: 1919902 - RNA, 12 nt, Homo sapiens
aacugaggccca

SEQ ID NO: 1919903 - RNA, 18 nt, Homo sapiens
cagccaggugcugugaca

SEQ ID NO: 1919904 - RNA, 15 nt, Homo sapiens
guuaucuaaccuguu

SEQ ID NO: 1919905 - RNA, 14 nt, Homo sapiens
uucuguggauucua

SEQ ID NO: 1919906 - RNA, 21 nt, Homo sapiens
aacccacucaugacugcauga

SEQ ID NO: 1919907 - RNA, 16 nt, Homo sapiens
uucuuacaaacaugug

SEQ ID NO: 1919908 - RNA, 18 nt, Homo sapiens
auguugagggaagcuucc

SEQ ID NO: 1919909 - RNA, 13 nt, Homo sapiens
cuuuacagcacug

SEQ ID NO: 1919910 - RNA, 21 nt, Homo sapiens
uguggguguguguuacauaca

SEQ ID NO: 1919911 - RNA, 18 nt, Homo sapiens
ugcagcugcaagacaucu

SEQ ID NO: 1919912 - RNA, 22 nt, Homo sapiens
uauaacaaagacuucugucaua

SEQ ID NO: 1919913 - RNA, 16 nt, Homo sapiens
cugcccaaacuccccu

SEQ ID NO: 1919914 - RNA, 16 nt, Homo sapiens
uuguuggauaaaucag

SEQ ID NO: 1919915 - RNA, 16 nt, Homo sapiens
cuuugauuauuugcau

SEQ ID NO: 1919916 - RNA, 16 nt, Homo sapiens
acuguauuccugucau

SEQ ID NO: 1919917 - RNA, 19 nt, Homo sapiens
uaggcauccugugugcuga

SEQ ID NO: 1919918 - RNA, 16 nt, Homo sapiens
acguauuuugauguuu

SEQ ID NO: 1919919 - RNA, 18 nt, Homo sapiens
cucaccaaaauauaguua

SEQ ID NO: 1919920 - RNA, 14 nt, Homo sapiens
acgcacagugcagu

SEQ ID NO: 1919921 - RNA, 17 nt, Homo sapiens
auguccuuuuaugauuu

SEQ ID NO: 1919922 - RNA, 14 nt, Homo sapiens
cggugcucuggaag

SEQ ID NO: 1919923 - RNA, 20 nt, Homo sapiens
gaaauagcuacagugacaga

SEQ ID NO: 1919924 - RNA, 15 nt, Homo sapiens
gggggcuccacccca

SEQ ID NO: 1919925 - RNA, 12 nt, Homo sapiens
ggucccagacag

SEQ ID NO: 1919926 - RNA, 21 nt, Homo sapiens
uguagguuucucugccuccag

SEQ ID NO: 1919927 - RNA, 21 nt, Homo sapiens
acccucaaguggacagugaau

SEQ ID NO: 1919928 - RNA, 16 nt, Homo sapiens
uuguauuuaccuucua

SEQ ID NO: 1919929 - RNA, 16 nt, Homo sapiens
agggcaaaaagaccaa

SEQ ID NO: 1919930 - RNA, 21 nt, Homo sapiens
gcuaauuuacuggacaaagaa

SEQ ID NO: 1919931 - RNA, 17 nt, Homo sapiens
auguccuacaacagccu

SEQ ID NO: 1919932 - RNA, 16 nt, Homo sapiens
gaaaaucaccauuccg

SEQ ID NO: 1919933 - RNA, 21 nt, Homo sapiens
gacugugaggccauacuugug

SEQ ID NO: 1919934 - RNA, 13 nt, Homo sapiens
ucugaucauguau

SEQ ID NO: 1919935 - RNA, 17 nt, Homo sapiens
aagauuuugcaccugua

SEQ ID NO: 1919936 - RNA, 18 nt, Homo sapiens
cccaggcaucccaucccu

SEQ ID NO: 1919937 - RNA, 17 nt, Homo sapiens
acuaggcauacacugua

SEQ ID NO: 1919938 - RNA, 19 nt, Homo sapiens
agaauuagaaaaguuaaca

SEQ ID NO: 1919939 - RNA, 14 nt, Homo sapiens
ggaagcacagaucu

SEQ ID NO: 1919940 - RNA, 18 nt, Homo sapiens
ucaaagcccccacuucuc

SEQ ID NO: 1919941 - RNA, 17 nt, Homo sapiens
ugacauccccacucacg

SEQ ID NO: 1919942 - RNA, 23 nt, Homo sapiens
uucagucuuguagugugugcuua

SEQ ID NO: 1919943 - RNA, 17 nt, Homo sapiens
uuuaauacucaccuccu

SEQ ID NO: 1919944 - RNA, 19 nt, Homo sapiens
auggaaggaguuccucuaa

SEQ ID NO: 1919945 - RNA, 14 nt, Homo sapiens
cccuggaaccggga

SEQ ID NO: 1919946 - RNA, 13 nt, Homo sapiens
agaggguacuuua

SEQ ID NO: 1919947 - RNA, 19 nt, Homo sapiens
acugagggcaugagucuca

SEQ ID NO: 1919948 - RNA, 16 nt, Homo sapiens
uaccaagcauguuuca

SEQ ID NO: 1919949 - RNA, 22 nt, Homo sapiens
uuuaauugcaccugaaaaaccu

SEQ ID NO: 1919950 - RNA, 14 nt, Homo sapiens
aauucugccuuuau

SEQ ID NO: 1919951 - RNA, 20 nt, Homo sapiens
cccagcccugggaaccacuc

SEQ ID NO: 1919952 - RNA, 19 nt, Homo sapiens
ugguauuuucuagacugug

SEQ ID NO: 1919953 - RNA, 13 nt, Homo sapiens
ugcaaccaggaac

SEQ ID NO: 1919954 - RNA, 18 nt, Homo sapiens
aaaaugcuuuugugucua

SEQ ID NO: 1919955 - RNA, 18 nt, Homo sapiens
cuuguuucaaaauucuca

SEQ ID NO: 1919956 - RNA, 14 nt, Homo sapiens
cagcuccuggacca

SEQ ID NO: 1919957 - RNA, 20 nt, Homo sapiens
acuggcuacaguaccaugcc

SEQ ID NO: 1919958 - RNA, 19 nt, Homo sapiens
ucuugggucccccacguga

SEQ ID NO: 1919959 - RNA, 21 nt, Homo sapiens
guuguuuauauacaguacaca

SEQ ID NO: 1919960 - RNA, 19 nt, Homo sapiens
ggucuguggugcagugugu

SEQ ID NO: 1919961 - RNA, 14 nt, Homo sapiens
ucuuuuccccucau

SEQ ID NO: 1919962 - RNA, 16 nt, Homo sapiens
uggaacgugaacucag

SEQ ID NO: 1919963 - RNA, 18 nt, Homo sapiens
cugcagucucuauaccaa

SEQ ID NO: 1919964 - RNA, 19 nt, Homo sapiens
cuguagucccagcuacuca

SEQ ID NO: 1919965 - RNA, 21 nt, Homo sapiens
cagguuggaugggagugggca

SEQ ID NO: 1919966 - RNA, 14 nt, Homo sapiens
caaauaaaugacaa

SEQ ID NO: 1919967 - RNA, 16 nt, Homo sapiens
uaacaacaaugguuua

SEQ ID NO: 1919968 - RNA, 23 nt, Homo sapiens
acacaccccucaaaaaaagccuu

SEQ ID NO: 1919969 - RNA, 16 nt, Homo sapiens
uauuuggaaugaagga

SEQ ID NO: 1919970 - RNA, 21 nt, Homo sapiens
cagucaguauuguuuugguuu

SEQ ID NO: 1919971 - RNA, 15 nt, Homo sapiens
ccauuuuacauuucu

SEQ ID NO: 1919972 - RNA, 12 nt, Homo sapiens
gaagcagcagcu

SEQ ID NO: 1919973 - RNA, 22 nt, Homo sapiens
augaagacauuucugcucucag

SEQ ID NO: 1919974 - RNA, 21 nt, Homo sapiens
cguaggauuuggggugaauga

SEQ ID NO: 1919975 - RNA, 21 nt, Homo sapiens
gcaagcucuucccuugcucau

SEQ ID NO: 1919976 - RNA, 15 nt, Homo sapiens
uauguaaaauuuugc

SEQ ID NO: 1919977 - RNA, 19 nt, Homo sapiens
cuaaagguuguauugcaua

SEQ ID NO: 1919978 - RNA, 16 nt, Homo sapiens
uaugcaaccugugcaa

SEQ ID NO: 1919979 - RNA, 22 nt, Homo sapiens
cacacucuucucuugagcaguu

SEQ ID NO: 1919980 - RNA, 22 nt, Homo sapiens
auuuugguguccuauuaaagga

SEQ ID NO: 1919981 - RNA, 17 nt, Homo sapiens
guuuuguacauaacuua

SEQ ID NO: 1919982 - RNA, 15 nt, Homo sapiens
auagaugcuguguau

SEQ ID NO: 1919983 - RNA, 19 nt, Homo sapiens
cuaacagcaccaaaucaaa

SEQ ID NO: 1919984 - RNA, 19 nt, Homo sapiens
uaaacugauuacguuuaca

SEQ ID NO: 1919985 - RNA, 15 nt, Homo sapiens
uauaacaaugcugua

SEQ ID NO: 1919986 - RNA, 17 nt, Homo sapiens
uauaaauaugaagcuca

SEQ ID NO: 1919987 - RNA, 23 nt, Homo sapiens
cccugauccaggaaaaugugagg

SEQ ID NO: 1919988 - RNA, 23 nt, Homo sapiens
cuugugccaaaccuacuaggcca

SEQ ID NO: 1919989 - RNA, 19 nt, Homo sapiens
ucucgaacucccgaccuca

SEQ ID NO: 1919990 - RNA, 15 nt, Homo sapiens
aaaauuacugaugca

SEQ ID NO: 1919991 - RNA, 13 nt, Homo sapiens
cuagaagacuguc

SEQ ID NO: 1919992 - RNA, 21 nt, Homo sapiens
agcaaauuccaauacauuauu

SEQ ID NO: 1919993 - RNA, 15 nt, Homo sapiens
ccagaccaguaguga

SEQ ID NO: 1919994 - RNA, 19 nt, Homo sapiens
aagcugcagggaauuuuca

SEQ ID NO: 1919995 - RNA, 15 nt, Homo sapiens
uuauauaugaaguug

SEQ ID NO: 1919996 - RNA, 21 nt, Homo sapiens
gaaugaucagcaucugugaug

SEQ ID NO: 1919997 - RNA, 15 nt, Homo sapiens
ucaccagaaccaguu

SEQ ID NO: 1919998 - RNA, 13 nt, Homo sapiens
cucaaguccauca

SEQ ID NO: 1919999 - RNA, 19 nt, Homo sapiens
cagcuuugaaaaaacacca

SEQ ID NO: 1920000 - RNA, 14 nt, Homo sapiens
guaugaaacauucu

SEQ ID NO: 1920001 - RNA, 14 nt, Homo sapiens
ugaauguaguaagu

SEQ ID NO: 1920002 - RNA, 18 nt, Homo sapiens
auucccacagcacuaauu

SEQ ID NO: 1920003 - RNA, 15 nt, Homo sapiens
ucuugcucccuucag

SEQ ID NO: 1920004 - RNA, 23 nt, Homo sapiens
cacaccauugcaugaauucacaa

SEQ ID NO: 1920005 - RNA, 19 nt, Homo sapiens
acucuaaggcuaagcaucu

SEQ ID NO: 1920006 - RNA, 13 nt, Homo sapiens
caguggacccugg

SEQ ID NO: 1920007 - RNA, 21 nt, Homo sapiens
uuuguaugcaagcaguuucaa

SEQ ID NO: 1920008 - RNA, 18 nt, Homo sapiens
cagcuucuucaucuuuaa

SEQ ID NO: 1920009 - RNA, 16 nt, Homo sapiens
uuccaucugugccaua

SEQ ID NO: 1920010 - RNA, 23 nt, Homo sapiens
uaaaguucaauuucaacauguau

SEQ ID NO: 1920011 - RNA, 15 nt, Homo sapiens
guugagaaguuccca

SEQ ID NO: 1920012 - RNA, 12 nt, Homo sapiens
uugguuguuuaa

SEQ ID NO: 1920013 - RNA, 12 nt, Homo sapiens
uguaugcacuuu

SEQ ID NO: 1920014 - RNA, 12 nt, Homo sapiens
uguuugcacuua

SEQ ID NO: 1920015 - RNA, 19 nt, Homo sapiens
ugacuuauguaaucaaagc

SEQ ID NO: 1920016 - RNA, 15 nt, Homo sapiens
agaaugagacaucca

SEQ ID NO: 1920017 - RNA, 16 nt, Homo sapiens
cuguauauuuguauga

SEQ ID NO: 1920018 - RNA, 23 nt, Homo sapiens
uuggaagagccugcaggugcugc

SEQ ID NO: 1920019 - RNA, 17 nt, Homo sapiens
uaauuuuauuacauaug

SEQ ID NO: 1920020 - RNA, 14 nt, Homo sapiens
ccucaucaucagag

SEQ ID NO: 1920021 - RNA, 12 nt, Homo sapiens
cagaaaauuaca

SEQ ID NO: 1920022 - RNA, 19 nt, Homo sapiens
auauacuuaagaauacaca

SEQ ID NO: 1920023 - RNA, 24 nt, Homo sapiens
gcauauauaaguuuacaccuuuau

SEQ ID NO: 1920024 - RNA, 18 nt, Homo sapiens
aauuuaacaaacuaaaaa

SEQ ID NO: 1920025 - RNA, 19 nt, Homo sapiens
ccucacuggggcagacaau

SEQ ID NO: 1920026 - RNA, 14 nt, Homo sapiens
aucguuaaguuaaa

SEQ ID NO: 1920027 - RNA, 16 nt, Homo sapiens
cuggugaccuacuaaa

SEQ ID NO: 1920028 - RNA, 17 nt, Homo sapiens
ucaguggcuucuccauc

SEQ ID NO: 1920029 - RNA, 16 nt, Homo sapiens
aaugaagacccagugu

SEQ ID NO: 1920030 - RNA, 19 nt, Homo sapiens
cagggugggugagcucuca

SEQ ID NO: 1920031 - RNA, 15 nt, Homo sapiens
gaccaccuaauauca

SEQ ID NO: 1920032 - RNA, 16 nt, Homo sapiens
uaaauaaauguaaaua

SEQ ID NO: 1920033 - RNA, 19 nt, Homo sapiens
gucagacuucagacuuuca

SEQ ID NO: 1920034 - RNA, 14 nt, Homo sapiens
aggcgggccugcaa

SEQ ID NO: 1920035 - RNA, 16 nt, Homo sapiens
gacaccauuaccaaaa

SEQ ID NO: 1920036 - RNA, 23 nt, Homo sapiens
agcaugaggacagaccacagagc

SEQ ID NO: 1920037 - RNA, 22 nt, Homo sapiens
acauuucucugcaaaaugucau

SEQ ID NO: 1920038 - RNA, 14 nt, Homo sapiens
guaaggcucuagau

SEQ ID NO: 1920039 - RNA, 14 nt, Homo sapiens
auguuuaaaacacc

SEQ ID NO: 1920040 - RNA, 10 nt, Homo sapiens
uuaaugacaa

SEQ ID NO: 1920041 - RNA, 13 nt, Homo sapiens
aacuccggcacug

SEQ ID NO: 1920042 - RNA, 16 nt, Homo sapiens
gcuggagguggggcga

SEQ ID NO: 1920043 - RNA, 17 nt, Homo sapiens
cuugcccagacuacagg

SEQ ID NO: 1920044 - RNA, 14 nt, Homo sapiens
guugaagacuuugu

SEQ ID NO: 1920045 - RNA, 20 nt, Homo sapiens
gcuuuugcaaauaacuuaca

SEQ ID NO: 1920046 - RNA, 17 nt, Homo sapiens
cacgacuucugcccauu

SEQ ID NO: 1920047 - RNA, 18 nt, Homo sapiens
caauacaugcugcuaauu

SEQ ID NO: 1920048 - RNA, 20 nt, Homo sapiens
cauuugaauuggcauuuccc

SEQ ID NO: 1920049 - RNA, 18 nt, Homo sapiens
cucagccccuaggaguau

SEQ ID NO: 1920050 - RNA, 15 nt, Homo sapiens
uggccccuucacuuc

SEQ ID NO: 1920051 - RNA, 16 nt, Homo sapiens
caucucaguccucaaa

SEQ ID NO: 1920052 - RNA, 21 nt, Homo sapiens
agcuaaugguucauauaugca

SEQ ID NO: 1920053 - RNA, 12 nt, Homo sapiens
ucuuuguggcag

SEQ ID NO: 1920054 - RNA, 21 nt, Homo sapiens
aaucugcccauucaucuucau

SEQ ID NO: 1920055 - RNA, 15 nt, Homo sapiens
ugaaacacuuugccu

SEQ ID NO: 1920056 - RNA, 14 nt, Homo sapiens
gcucuguagagggu

SEQ ID NO: 1920057 - RNA, 13 nt, Homo sapiens
uccuauuacauag

SEQ ID NO: 1920058 - RNA, 15 nt, Homo sapiens
cuuuacacucaggcu

SEQ ID NO: 1920059 - RNA, 13 nt, Homo sapiens
ccuggagcacuua

SEQ ID NO: 1920060 - RNA, 12 nt, Homo sapiens
gcaggggcugca

SEQ ID NO: 1920061 - RNA, 14 nt, Homo sapiens
cuuauccacuuuga

SEQ ID NO: 1920062 - RNA, 22 nt, Homo sapiens
ucauggaggccaagaacuugca

SEQ ID NO: 1920063 - RNA, 14 nt, Homo sapiens
guaauuguuacaau

SEQ ID NO: 1920064 - RNA, 22 nt, Homo sapiens
ccucuccccaagaggaacugaa

SEQ ID NO: 1920065 - RNA, 17 nt, Homo sapiens
auuuucaaaagcauuaa

SEQ ID NO: 1920066 - RNA, 15 nt, Homo sapiens
aucuuuaucuguucu

SEQ ID NO: 1920067 - RNA, 17 nt, Homo sapiens
gcuuuaaaugucugcau

SEQ ID NO: 1920068 - RNA, 15 nt, Homo sapiens
auaacauuuacuuuu

SEQ ID NO: 1920069 - RNA, 23 nt, Homo sapiens
acaguucuguuggucuacagaaa

SEQ ID NO: 1920070 - RNA, 12 nt, Homo sapiens
gaccccaaagag

SEQ ID NO: 1920071 - RNA, 15 nt, Homo sapiens
uagauaagucaauau

SEQ ID NO: 1920072 - RNA, 15 nt, Homo sapiens
cagugaugccaugaa

SEQ ID NO: 1920073 - RNA, 15 nt, Homo sapiens
ccagccugcucccua

SEQ ID NO: 1920074 - RNA, 16 nt, Homo sapiens
ucacccugugggaccg

SEQ ID NO: 1920075 - RNA, 17 nt, Homo sapiens
agaaccacaaacaauuc

SEQ ID NO: 1920076 - RNA, 20 nt, Homo sapiens
uauuucuuuacagaauggau

SEQ ID NO: 1920077 - RNA, 19 nt, Homo sapiens
uguucugccuggagacaag

SEQ ID NO: 1920078 - RNA, 22 nt, Homo sapiens
gcuuaauggaugggcagucauu

SEQ ID NO: 1920079 - RNA, 18 nt, Homo sapiens
gcagcgccucaucuucaa

SEQ ID NO: 1920080 - RNA, 15 nt, Homo sapiens
gaccuaucacuucca

SEQ ID NO: 1920081 - RNA, 14 nt, Homo sapiens
agcaguguucucac

SEQ ID NO: 1920082 - RNA, 23 nt, Homo sapiens
uaaauacugcaauuaaagugaua

SEQ ID NO: 1920083 - RNA, 17 nt, Homo sapiens
gccucagaugauuuccc

SEQ ID NO: 1920084 - RNA, 18 nt, Homo sapiens
uuggaaguguucccugag

SEQ ID NO: 1920085 - RNA, 14 nt, Homo sapiens
aguggaaggcauca

SEQ ID NO: 1920086 - RNA, 10 nt, Homo sapiens
acccaagggc

SEQ ID NO: 1920087 - RNA, 13 nt, Homo sapiens
ggugaaaugaaug

SEQ ID NO: 1920088 - RNA, 18 nt, Homo sapiens
gcacagucauacaaguca

SEQ ID NO: 1920089 - RNA, 12 nt, Homo sapiens
caguagcuccuu

SEQ ID NO: 1920090 - RNA, 16 nt, Homo sapiens
cagugggccugcugag

SEQ ID NO: 1920091 - RNA, 14 nt, Homo sapiens
ugccgaaugugcag

SEQ ID NO: 1920092 - RNA, 16 nt, Homo sapiens
ucuuacucccuccuuc

SEQ ID NO: 1920093 - RNA, 15 nt, Homo sapiens
aggucccuguauguc

SEQ ID NO: 1920094 - RNA, 19 nt, Homo sapiens
cuucuaucaaagcacauaa

SEQ ID NO: 1920095 - RNA, 19 nt, Homo sapiens
aaauauccacagacucccu

SEQ ID NO: 1920096 - RNA, 16 nt, Homo sapiens
aaagacaaacaugcaa

SEQ ID NO: 1920097 - RNA, 20 nt, Homo sapiens
ugcuauuguaaggucuuugu

SEQ ID NO: 1920098 - RNA, 13 nt, Homo sapiens
ucuagaagcacau

SEQ ID NO: 1920099 - RNA, 18 nt, Homo sapiens
gccuauaucaaacaugca

SEQ ID NO: 1920100 - RNA, 23 nt, Homo sapiens
agcaaugacugugcucaccagua

SEQ ID NO: 1920101 - RNA, 17 nt, Homo sapiens
acuaucuacucuccuca

SEQ ID NO: 1920102 - RNA, 15 nt, Homo sapiens
caaagaaguacuuua

SEQ ID NO: 1920103 - RNA, 16 nt, Homo sapiens
uuuguuugcaucugaa

SEQ ID NO: 1920104 - RNA, 16 nt, Homo sapiens
auuuguuuguauucau

SEQ ID NO: 1920105 - RNA, 18 nt, Homo sapiens
ggauaguccgucucugcu

SEQ ID NO: 1920106 - RNA, 23 nt, Homo sapiens
uggcacccacuguggccuggcau

SEQ ID NO: 1920107 - RNA, 20 nt, Homo sapiens
uggaucacagacacugcaca

SEQ ID NO: 1920108 - RNA, 20 nt, Homo sapiens
ugccuaaguccaguguuucu

SEQ ID NO: 1920109 - RNA, 20 nt, Homo sapiens
cacuguacucugcacuggug

SEQ ID NO: 1920110 - RNA, 20 nt, Homo sapiens
uacaaacuauuucagaauau

SEQ ID NO: 1920111 - RNA, 13 nt, Homo sapiens
gaccucaucagcc

SEQ ID NO: 1920112 - RNA, 14 nt, Homo sapiens
cagucccuggagcu

SEQ ID NO: 1920113 - RNA, 19 nt, Homo sapiens
cagccugggcaacauagua

SEQ ID NO: 1920114 - RNA, 18 nt, Homo sapiens
aaaugcaaacacugugua

SEQ ID NO: 1920115 - RNA, 12 nt, Homo sapiens
uaacacauucuu

SEQ ID NO: 1920116 - RNA, 14 nt, Homo sapiens
ugccacagcucaac

SEQ ID NO: 1920117 - RNA, 12 nt, Homo sapiens
gagccuggacaa

SEQ ID NO: 1920118 - RNA, 13 nt, Homo sapiens
accacauggacca

SEQ ID NO: 1920119 - RNA, 23 nt, Homo sapiens
aaccaaaaaaguuacaacuuccu

SEQ ID NO: 1920120 - RNA, 13 nt, Homo sapiens
augauuucuagca

SEQ ID NO: 1920121 - RNA, 16 nt, Homo sapiens
aaaaugaugagucuau

SEQ ID NO: 1920122 - RNA, 15 nt, Homo sapiens
aagagaaaagcccaa

SEQ ID NO: 1920123 - RNA, 23 nt, Homo sapiens
cccaccaaucuacuuuguugcua

SEQ ID NO: 1920124 - RNA, 16 nt, Homo sapiens
uaucuuucuaaaacug

SEQ ID NO: 1920125 - RNA, 19 nt, Homo sapiens
aguaaagguuaauuaugau

SEQ ID NO: 1920126 - RNA, 14 nt, Homo sapiens
uuucucuuacaauc

SEQ ID NO: 1920127 - RNA, 22 nt, Homo sapiens
ugugugaagcuuaagggucaua

SEQ ID NO: 1920128 - RNA, 16 nt, Homo sapiens
aacuccauauguguuc

SEQ ID NO: 1920129 - RNA, 16 nt, Homo sapiens
cagagaauauaacaug

SEQ ID NO: 1920130 - RNA, 14 nt, Homo sapiens
caggaggaaagguu

SEQ ID NO: 1920131 - RNA, 10 nt, Homo sapiens
acaauuccac

SEQ ID NO: 1920132 - RNA, 13 nt, Homo sapiens
gggaucuucccac

SEQ ID NO: 1920133 - RNA, 18 nt, Homo sapiens
cccagguagucaaaggca

SEQ ID NO: 1920134 - RNA, 23 nt, Homo sapiens
cucugaguaucuccucgcaagcu

SEQ ID NO: 1920135 - RNA, 14 nt, Homo sapiens
ugugguuuauguca

SEQ ID NO: 1920136 - RNA, 16 nt, Homo sapiens
aaauauaguucacaau

SEQ ID NO: 1920137 - RNA, 13 nt, Homo sapiens
agaaagcacugac

SEQ ID NO: 1920138 - RNA, 11 nt, Homo sapiens
aucgguagcuu

SEQ ID NO: 1920139 - RNA, 16 nt, Homo sapiens
uucauuaauacuguag

SEQ ID NO: 1920140 - RNA, 18 nt, Homo sapiens
cauucaggcagcacugac

SEQ ID NO: 1920141 - RNA, 22 nt, Homo sapiens
cagguucccacuuaaaaauuaa

SEQ ID NO: 1920142 - RNA, 20 nt, Homo sapiens
ucuucacuuccccacaggcu

SEQ ID NO: 1920143 - RNA, 18 nt, Homo sapiens
agaccccugcuccugacu

SEQ ID NO: 1920144 - RNA, 19 nt, Homo sapiens
uuuaacaaaucuaaucucu

SEQ ID NO: 1920145 - RNA, 20 nt, Homo sapiens
acugccaggauaaagcuucc

SEQ ID NO: 1920146 - RNA, 12 nt, Homo sapiens
gcgccacccgcc

SEQ ID NO: 1920147 - RNA, 21 nt, Homo sapiens
gacauuucuuccccaguguca

SEQ ID NO: 1920148 - RNA, 17 nt, Homo sapiens
uaggcauuuuaaguaaa

SEQ ID NO: 1920149 - RNA, 14 nt, Homo sapiens
gacugcaacaggcu

SEQ ID NO: 1920150 - RNA, 17 nt, Homo sapiens
ccacaaccaaaaaauuc

SEQ ID NO: 1920151 - RNA, 16 nt, Homo sapiens
aguuccuuucaucccu

SEQ ID NO: 1920152 - RNA, 16 nt, Homo sapiens
ugacagucacucagcc

SEQ ID NO: 1920153 - RNA, 12 nt, Homo sapiens
auaaaccacuuu

SEQ ID NO: 1920154 - RNA, 19 nt, Homo sapiens
auccuuaggaaaaugcuuc

SEQ ID NO: 1920155 - RNA, 15 nt, Homo sapiens
cauaccacagcaucc

SEQ ID NO: 1920156 - RNA, 17 nt, Homo sapiens
gacuggauucgugacaa

SEQ ID NO: 1920157 - RNA, 14 nt, Homo sapiens
guggacacaacagc

SEQ ID NO: 1920158 - RNA, 21 nt, Homo sapiens
uggcuuuuccuggacagcuag

SEQ ID NO: 1920159 - RNA, 14 nt, Homo sapiens
cugcuccagugcag

SEQ ID NO: 1920160 - RNA, 15 nt, Homo sapiens
agaccggacccaggu

SEQ ID NO: 1920161 - RNA, 18 nt, Homo sapiens
cugaauccucaugaggcu

SEQ ID NO: 1920162 - RNA, 16 nt, Homo sapiens
cccuuaggacaggguc

SEQ ID NO: 1920163 - RNA, 23 nt, Homo sapiens
aaccaucgaugaaggaauaucuc

SEQ ID NO: 1920164 - RNA, 18 nt, Homo sapiens
aacuuacuguauauguau

SEQ ID NO: 1920165 - RNA, 20 nt, Homo sapiens
aaugaauuuuauaaucugca

SEQ ID NO: 1920166 - RNA, 19 nt, Homo sapiens
caguugcuggcaugucuuc

SEQ ID NO: 1920167 - RNA, 11 nt, Homo sapiens
uauccaugcug

SEQ ID NO: 1920168 - RNA, 20 nt, Homo sapiens
auauauguguauacauacau

SEQ ID NO: 1920169 - RNA, 12 nt, Homo sapiens
caauggcuccuu

SEQ ID NO: 1920170 - RNA, 13 nt, Homo sapiens
uuuuuguguggau

SEQ ID NO: 1920171 - RNA, 15 nt, Homo sapiens
ccagccauucuuucc

SEQ ID NO: 1920172 - RNA, 20 nt, Homo sapiens
cuuccacagaauacaagcca

SEQ ID NO: 1920173 - RNA, 17 nt, Homo sapiens
cuccuugaucaugucuu

SEQ ID NO: 1920174 - RNA, 20 nt, Homo sapiens
ugggccccucugacucccaa

SEQ ID NO: 1920175 - RNA, 17 nt, Homo sapiens
uggcuuaaauaaucucu

SEQ ID NO: 1920176 - RNA, 14 nt, Homo sapiens
uacacaagacuuuc

SEQ ID NO: 1920177 - RNA, 22 nt, Homo sapiens
ucaacuguuucagaaaacauaa

SEQ ID NO: 1920178 - RNA, 11 nt, Homo sapiens
cucugccuucc

SEQ ID NO: 1920179 - RNA, 16 nt, Homo sapiens
cuuuucugaucugcag

SEQ ID NO: 1920180 - RNA, 19 nt, Homo sapiens
auguuuuaaacacaugccu

SEQ ID NO: 1920181 - RNA, 18 nt, Homo sapiens
accacaucuugcucugcu

SEQ ID NO: 1920182 - RNA, 19 nt, Homo sapiens
uuaauaaacucacaacucu

SEQ ID NO: 1920183 - RNA, 19 nt, Homo sapiens
uugcccuaauucaucuuuu

SEQ ID NO: 1920184 - RNA, 21 nt, Homo sapiens
cacugcugaggacacucagug

SEQ ID NO: 1920185 - RNA, 19 nt, Homo sapiens
uugaagugucuucuguucc

SEQ ID NO: 1920186 - RNA, 16 nt, Homo sapiens
cuuuaaaaaaacacau

SEQ ID NO: 1920187 - RNA, 18 nt, Homo sapiens
ugaaaaaggaacuaccua

SEQ ID NO: 1920188 - RNA, 14 nt, Homo sapiens
uaaagaaugcaauc

SEQ ID NO: 1920189 - RNA, 14 nt, Homo sapiens
ccaggguuccagac

SEQ ID NO: 1920190 - RNA, 14 nt, Homo sapiens
aucugauaagcaag

SEQ ID NO: 1920191 - RNA, 19 nt, Homo sapiens
gcuuuguuuugucuuacaa

SEQ ID NO: 1920192 - RNA, 13 nt, Homo sapiens
uggcuagcaaucu

SEQ ID NO: 1920193 - RNA, 21 nt, Homo sapiens
caagggggcggggacugcugg

SEQ ID NO: 1920194 - RNA, 20 nt, Homo sapiens
cguguccagcacagaaggaa

SEQ ID NO: 1920195 - RNA, 17 nt, Homo sapiens
guugucuccacuuguau

SEQ ID NO: 1920196 - RNA, 12 nt, Homo sapiens
gacacauuggac

SEQ ID NO: 1920197 - RNA, 23 nt, Homo sapiens
uuaaaucaauaaagaccacuuua

SEQ ID NO: 1920198 - RNA, 16 nt, Homo sapiens
auucagauugacaagg

SEQ ID NO: 1920199 - RNA, 17 nt, Homo sapiens
agagaccccaggaacaa

SEQ ID NO: 1920200 - RNA, 22 nt, Homo sapiens
auuccauuuuacuuccaugaua

SEQ ID NO: 1920201 - RNA, 20 nt, Homo sapiens
uaucuauuuguacaauuuua

SEQ ID NO: 1920202 - RNA, 20 nt, Homo sapiens
ugaccucagugagauauuug

SEQ ID NO: 1920203 - RNA, 17 nt, Homo sapiens
acacugaaggaacaguu

SEQ ID NO: 1920204 - RNA, 21 nt, Homo sapiens
cauauagaauuauuacaauuu

SEQ ID NO: 1920205 - RNA, 13 nt, Homo sapiens
ugagaugucuuca

SEQ ID NO: 1920206 - RNA, 19 nt, Homo sapiens
caaagacaguauuuugaca

SEQ ID NO: 1920207 - RNA, 22 nt, Homo sapiens
ugccacuuccuuuuaacugcca

SEQ ID NO: 1920208 - RNA, 13 nt, Homo sapiens
ucagagcagugac

SEQ ID NO: 1920209 - RNA, 22 nt, Homo sapiens
cauguaugucuuggacacugua

SEQ ID NO: 1920210 - RNA, 19 nt, Homo sapiens
cagagucaaugaacuuucc

SEQ ID NO: 1920211 - RNA, 21 nt, Homo sapiens
aaacagcuuugucuccaaaga

SEQ ID NO: 1920212 - RNA, 14 nt, Homo sapiens
uugagaagcacugu

SEQ ID NO: 1920213 - RNA, 19 nt, Homo sapiens
uagcuccauaaaguacaaa

SEQ ID NO: 1920214 - RNA, 22 nt, Homo sapiens
cccucagccuaagaaacacuca

SEQ ID NO: 1920215 - RNA, 15 nt, Homo sapiens
auugaccagcucucu

SEQ ID NO: 1920216 - RNA, 22 nt, Homo sapiens
uacaccucgucaagagcaugca

SEQ ID NO: 1920217 - RNA, 22 nt, Homo sapiens
uaagggcagugcccauguguac

SEQ ID NO: 1920218 - RNA, 18 nt, Homo sapiens
cacgugccauugucuuuc

SEQ ID NO: 1920219 - RNA, 19 nt, Homo sapiens
agacacaaacaaacaagcu

SEQ ID NO: 1920220 - RNA, 19 nt, Homo sapiens
augcuguguccacggggug

SEQ ID NO: 1920221 - RNA, 16 nt, Homo sapiens
acgugucugagagcca

SEQ ID NO: 1920222 - RNA, 14 nt, Homo sapiens
ggcauucucugaag

SEQ ID NO: 1920223 - RNA, 20 nt, Homo sapiens
cauuuaauacagcaguguca

SEQ ID NO: 1920224 - RNA, 19 nt, Homo sapiens
accaucaaacaaaucauuu

SEQ ID NO: 1920225 - RNA, 14 nt, Homo sapiens
ccaauccucaccua

SEQ ID NO: 1920226 - RNA, 14 nt, Homo sapiens
uccaugggacuuuc

SEQ ID NO: 1920227 - RNA, 16 nt, Homo sapiens
cugcaucauccuugca

SEQ ID NO: 1920228 - RNA, 21 nt, Homo sapiens
uccuaauaucaaaugcaguau

SEQ ID NO: 1920229 - RNA, 19 nt, Homo sapiens
aauucugcuucucuuucac

SEQ ID NO: 1920230 - RNA, 15 nt, Homo sapiens
aaagcgugugugaac

SEQ ID NO: 1920231 - RNA, 13 nt, Homo sapiens
auaccugcacugu

SEQ ID NO: 1920232 - RNA, 15 nt, Homo sapiens
uguuguguccugaca

SEQ ID NO: 1920233 - RNA, 17 nt, Homo sapiens
uacaggugacagugaag

SEQ ID NO: 1920234 - RNA, 18 nt, Homo sapiens
accuccccuccuugccuc

SEQ ID NO: 1920235 - RNA, 20 nt, Homo sapiens
gucuacccagacucagagac

SEQ ID NO: 1920236 - RNA, 15 nt, Homo sapiens
uuacaggcuuugaag

SEQ ID NO: 1920237 - RNA, 19 nt, Homo sapiens
uggggacguugcugagcca

SEQ ID NO: 1920238 - RNA, 17 nt, Homo sapiens
agacuccugcucucuau

SEQ ID NO: 1920239 - RNA, 17 nt, Homo sapiens
agugcccaucagccuug

SEQ ID NO: 1920240 - RNA, 20 nt, Homo sapiens
caccuugaucccaauccuua

SEQ ID NO: 1920241 - RNA, 14 nt, Homo sapiens
aggucacucugggc

SEQ ID NO: 1920242 - RNA, 14 nt, Homo sapiens
gagacagaaucuca

SEQ ID NO: 1920243 - RNA, 14 nt, Homo sapiens
aagacagagucuca

SEQ ID NO: 1920244 - RNA, 17 nt, Homo sapiens
ugagcccagaacuucaa

SEQ ID NO: 1920245 - RNA, 20 nt, Homo sapiens
cugccuggggggcaggguua

SEQ ID NO: 1920246 - RNA, 12 nt, Homo sapiens
cacuccaaccag

SEQ ID NO: 1920247 - RNA, 12 nt, Homo sapiens
ccaggcccagau

SEQ ID NO: 1920248 - RNA, 20 nt, Homo sapiens
uuaucucugaggcauggugu

SEQ ID NO: 1920249 - RNA, 22 nt, Homo sapiens
gcaugugccaagauucuacucu

SEQ ID NO: 1920250 - RNA, 15 nt, Homo sapiens
cuugaagacacugaa

SEQ ID NO: 1920251 - RNA, 16 nt, Homo sapiens
agggcuaaacauguga

SEQ ID NO: 1920252 - RNA, 13 nt, Homo sapiens
ugucauauaucaa

SEQ ID NO: 1920253 - RNA, 14 nt, Homo sapiens
auaaaugucacugc

SEQ ID NO: 1920254 - RNA, 15 nt, Homo sapiens
guugcacugaugucc

SEQ ID NO: 1920255 - RNA, 16 nt, Homo sapiens
auuacaacuagaucaa

SEQ ID NO: 1920256 - RNA, 19 nt, Homo sapiens
cuuugccucuucuuugugc

SEQ ID NO: 1920257 - RNA, 18 nt, Homo sapiens
cuuauaagaaagaucaaa

SEQ ID NO: 1920258 - RNA, 15 nt, Homo sapiens
ucugucuguggcaaa

SEQ ID NO: 1920259 - RNA, 16 nt, Homo sapiens
aauaggucaucaugaa

SEQ ID NO: 1920260 - RNA, 12 nt, Homo sapiens
ccuggaguggca

SEQ ID NO: 1920261 - RNA, 18 nt, Homo sapiens
uuaggaagguacugucau

SEQ ID NO: 1920262 - RNA, 20 nt, Homo sapiens
ugacaaggauuagaacacuc

SEQ ID NO: 1920263 - RNA, 17 nt, Homo sapiens
gcuuucuuugaccucuu

SEQ ID NO: 1920264 - RNA, 12 nt, Homo sapiens
gggcaacauagu

SEQ ID NO: 1920265 - RNA, 16 nt, Homo sapiens
gcagauucagugcaau

SEQ ID NO: 1920266 - RNA, 20 nt, Homo sapiens
aaacuauuuaaaauuggcac

SEQ ID NO: 1920267 - RNA, 20 nt, Homo sapiens
ccaacugcagcucuccauca

SEQ ID NO: 1920268 - RNA, 15 nt, Homo sapiens
accauccccuccuag

SEQ ID NO: 1920269 - RNA, 14 nt, Homo sapiens
agaguccucuggau

SEQ ID NO: 1920270 - RNA, 17 nt, Homo sapiens
gauuuuaugaguucuug

SEQ ID NO: 1920271 - RNA, 11 nt, Homo sapiens
ugaccauuuga

SEQ ID NO: 1920272 - RNA, 11 nt, Homo sapiens
ccuccauuccu

SEQ ID NO: 1920273 - RNA, 13 nt, Homo sapiens
ugcacuguagauu

SEQ ID NO: 1920274 - RNA, 20 nt, Homo sapiens
ggaaagggagauuccaggga

SEQ ID NO: 1920275 - RNA, 12 nt, Homo sapiens
caacacaaacug

SEQ ID NO: 1920276 - RNA, 21 nt, Homo sapiens
cuauuugccuccagugcaguc

SEQ ID NO: 1920277 - RNA, 22 nt, Homo sapiens
ugagcagaagcuggaggcacaa

SEQ ID NO: 1920278 - RNA, 17 nt, Homo sapiens
ugauuuuuuaaagcgua

SEQ ID NO: 1920279 - RNA, 22 nt, Homo sapiens
agaccagucacagccauuucaa

SEQ ID NO: 1920280 - RNA, 12 nt, Homo sapiens
uggugcugccac

SEQ ID NO: 1920281 - RNA, 16 nt, Homo sapiens
gcaggugaaacccagu

SEQ ID NO: 1920282 - RNA, 15 nt, Homo sapiens
ucccuugucaccagg

SEQ ID NO: 1920283 - RNA, 16 nt, Homo sapiens
auuucuagaacaauua

SEQ ID NO: 1920284 - RNA, 14 nt, Homo sapiens
gccugugauuuccu

SEQ ID NO: 1920285 - RNA, 19 nt, Homo sapiens
cuuccaugguacuguagca

SEQ ID NO: 1920286 - RNA, 13 nt, Homo sapiens
gggaggcuggaga

SEQ ID NO: 1920287 - RNA, 14 nt, Homo sapiens
ucuauauuucauau

SEQ ID NO: 1920288 - RNA, 16 nt, Homo sapiens
gccuguucaguuacag

SEQ ID NO: 1920289 - RNA, 14 nt, Homo sapiens
gacccagccuucag

SEQ ID NO: 1920290 - RNA, 20 nt, Homo sapiens
aggauguggaaccuguuuaa

SEQ ID NO: 1920291 - RNA, 20 nt, Homo sapiens
cuggcacauuuuuaguuacu

SEQ ID NO: 1920292 - RNA, 18 nt, Homo sapiens
gcugaguggccagccagu

SEQ ID NO: 1920293 - RNA, 18 nt, Homo sapiens
ccucggccccucccacac

SEQ ID NO: 1920294 - RNA, 22 nt, Homo sapiens
acaguggcaggacaggaaaaac

SEQ ID NO: 1920295 - RNA, 15 nt, Homo sapiens
uucuugcugcuagaa

SEQ ID NO: 1920296 - RNA, 13 nt, Homo sapiens
ucuaggcaguuca

SEQ ID NO: 1920297 - RNA, 16 nt, Homo sapiens
cucaauaaagaagccc

SEQ ID NO: 1920298 - RNA, 23 nt, Homo sapiens
uccuagcguuuuggaagaggaaa

SEQ ID NO: 1920299 - RNA, 21 nt, Homo sapiens
uccuuucagaacacucaaagg

SEQ ID NO: 1920300 - RNA, 19 nt, Homo sapiens
cguccugucacugauggaa

SEQ ID NO: 1920301 - RNA, 20 nt, Homo sapiens
ucaucuaaauauuuccauau

SEQ ID NO: 1920302 - RNA, 19 nt, Homo sapiens
uucuaaggagcacuagaau

SEQ ID NO: 1920303 - RNA, 18 nt, Homo sapiens
gaaaggaagccuugcuca

SEQ ID NO: 1920304 - RNA, 18 nt, Homo sapiens
gaaugcuuaccugugaga

SEQ ID NO: 1920305 - RNA, 15 nt, Homo sapiens
ugauaucugaucaaa

SEQ ID NO: 1920306 - RNA, 20 nt, Homo sapiens
aauugucuaaaguuacuacu

SEQ ID NO: 1920307 - RNA, 14 nt, Homo sapiens
uuauuacauguaau

SEQ ID NO: 1920308 - RNA, 16 nt, Homo sapiens
auugcauuucugcucu

SEQ ID NO: 1920309 - RNA, 15 nt, Homo sapiens
auggacuccacugaa

SEQ ID NO: 1920310 - RNA, 19 nt, Homo sapiens
cuauaacauagaauugcaa

SEQ ID NO: 1920311 - RNA, 22 nt, Homo sapiens
uugcccaagauaggaguucucu

SEQ ID NO: 1920312 - RNA, 14 nt, Homo sapiens
cauuugauauguga

SEQ ID NO: 1920313 - RNA, 23 nt, Homo sapiens
cgugugaaguguaguggcaucca

SEQ ID NO: 1920314 - RNA, 14 nt, Homo sapiens
cccccucgccagcu

SEQ ID NO: 1920315 - RNA, 18 nt, Homo sapiens
cauguguguucaugcaca

SEQ ID NO: 1920316 - RNA, 22 nt, Homo sapiens
accuccaggcuccagcacaucc

SEQ ID NO: 1920317 - RNA, 23 nt, Homo sapiens
ugacccagaggguggguguucau

SEQ ID NO: 1920318 - RNA, 19 nt, Homo sapiens
ucccaaauccuagacugcu

SEQ ID NO: 1920319 - RNA, 20 nt, Homo sapiens
gucuguggacacuguggaaa

SEQ ID NO: 1920320 - RNA, 15 nt, Homo sapiens
ucuucaucuuugcca

SEQ ID NO: 1920321 - RNA, 15 nt, Homo sapiens
ugcuggugcagcgua

SEQ ID NO: 1920322 - RNA, 22 nt, Homo sapiens
augccccgagcccaggcagcua

SEQ ID NO: 1920323 - RNA, 17 nt, Homo sapiens
aaagagccagacucugu

SEQ ID NO: 1920324 - RNA, 22 nt, Homo sapiens
aaaguuuuauuuguuuacuuua

SEQ ID NO: 1920325 - RNA, 16 nt, Homo sapiens
gcagggguugcaguga

SEQ ID NO: 1920326 - RNA, 23 nt, Homo sapiens
auggacuuucuugcaagcaacaa

SEQ ID NO: 1920327 - RNA, 15 nt, Homo sapiens
cuuucaaccuugcca

SEQ ID NO: 1920328 - RNA, 15 nt, Homo sapiens
ugaggauaaugggaa

SEQ ID NO: 1920329 - RNA, 21 nt, Homo sapiens
cuacaggcgugagccaccaug

SEQ ID NO: 1920330 - RNA, 21 nt, Homo sapiens
ucgccuguuggggaccucacc

SEQ ID NO: 1920331 - RNA, 15 nt, Homo sapiens
uuccuuccaauauaa

SEQ ID NO: 1920332 - RNA, 15 nt, Homo sapiens
gagacucugucucag

SEQ ID NO: 1920333 - RNA, 17 nt, Homo sapiens
gccuuauuaauauccaa

SEQ ID NO: 1920334 - RNA, 14 nt, Homo sapiens
uugcaacuuagcuc

SEQ ID NO: 1920335 - RNA, 19 nt, Homo sapiens
ucagaaucccuuaacaguu

SEQ ID NO: 1920336 - RNA, 14 nt, Homo sapiens
uacaauacaaugua

SEQ ID NO: 1920337 - RNA, 16 nt, Homo sapiens
auaucauaaauacaag

SEQ ID NO: 1920338 - RNA, 13 nt, Homo sapiens
cgugugagucagg

SEQ ID NO: 1920339 - RNA, 15 nt, Homo sapiens
uaaguggacuggugu

SEQ ID NO: 1920340 - RNA, 15 nt, Homo sapiens
uugaaguacaaaagg

SEQ ID NO: 1920341 - RNA, 13 nt, Homo sapiens
acugagaaggcuc

SEQ ID NO: 1920342 - RNA, 17 nt, Homo sapiens
uggccuccccugccacc

SEQ ID NO: 1920343 - RNA, 15 nt, Homo sapiens
gugggcuccuuacag

SEQ ID NO: 1920344 - RNA, 18 nt, Homo sapiens
ccaauugcucuuucacag

SEQ ID NO: 1920345 - RNA, 24 nt, Homo sapiens
cuuauaaauucuguuagcugcuca

SEQ ID NO: 1920346 - RNA, 18 nt, Homo sapiens
ugucuuuucaaaauauua

SEQ ID NO: 1920347 - RNA, 21 nt, Homo sapiens
cucaccaugugacacacuggc

SEQ ID NO: 1920348 - RNA, 18 nt, Homo sapiens
ugaucacucuuugcacac

SEQ ID NO: 1920349 - RNA, 14 nt, Homo sapiens
cagccacuucugca

SEQ ID NO: 1920350 - RNA, 18 nt, Homo sapiens
aguagagguacacuugug

SEQ ID NO: 1920351 - RNA, 14 nt, Homo sapiens
agaauaucugggau

SEQ ID NO: 1920352 - RNA, 23 nt, Homo sapiens
ccuuucucaacugucccaaggag

SEQ ID NO: 1920353 - RNA, 21 nt, Homo sapiens
auucucucacaguguacucua

SEQ ID NO: 1920354 - RNA, 17 nt, Homo sapiens
ggaaugacucaugccuc

SEQ ID NO: 1920355 - RNA, 15 nt, Homo sapiens
cucccacccuacccc

SEQ ID NO: 1920356 - RNA, 19 nt, Homo sapiens
acaugggugcaaucuuuag

SEQ ID NO: 1920357 - RNA, 21 nt, Homo sapiens
uacaguuuauuuucuguguaa

SEQ ID NO: 1920358 - RNA, 19 nt, Homo sapiens
gguccaggguugcuaggaa

SEQ ID NO: 1920359 - RNA, 16 nt, Homo sapiens
cuuccuucacuuugca

SEQ ID NO: 1920360 - RNA, 20 nt, Homo sapiens
uaauaacaacagaucugcag

SEQ ID NO: 1920361 - RNA, 24 nt, Homo sapiens
ucuuguagguuccaucaaugguga

SEQ ID NO: 1920362 - RNA, 12 nt, Homo sapiens
agccguguucag

SEQ ID NO: 1920363 - RNA, 13 nt, Homo sapiens
gcaucaccagggu

SEQ ID NO: 1920364 - RNA, 17 nt, Homo sapiens
ugcaaagaccaccucca

SEQ ID NO: 1920365 - RNA, 15 nt, Homo sapiens
aggaagcacaugccu

SEQ ID NO: 1920366 - RNA, 19 nt, Homo sapiens
agauguccuugaugcucau

SEQ ID NO: 1920367 - RNA, 14 nt, Homo sapiens
auaagagucagcau

SEQ ID NO: 1920368 - RNA, 23 nt, Homo sapiens
ccauuaaagucgagcuuuucuaa

SEQ ID NO: 1920369 - RNA, 16 nt, Homo sapiens
caagaacgauucaccu

SEQ ID NO: 1920370 - RNA, 13 nt, Homo sapiens
auuucugcuuccu

SEQ ID NO: 1920371 - RNA, 15 nt, Homo sapiens
guggucuugaucucc

SEQ ID NO: 1920372 - RNA, 14 nt, Homo sapiens
aagcacagcccuua

SEQ ID NO: 1920373 - RNA, 19 nt, Homo sapiens
acuagcaccugccagggag

SEQ ID NO: 1920374 - RNA, 15 nt, Homo sapiens
uccucccaccucacc

SEQ ID NO: 1920375 - RNA, 19 nt, Homo sapiens
uuauuaauauauauuaucu

SEQ ID NO: 1920376 - RNA, 16 nt, Homo sapiens
guaacucuaugaacuu

SEQ ID NO: 1920377 - RNA, 16 nt, Homo sapiens
gauagaggaaagggau

SEQ ID NO: 1920378 - RNA, 16 nt, Homo sapiens
uggaaggcuuccacua

SEQ ID NO: 1920379 - RNA, 22 nt, Homo sapiens
ucucaucagaaaugucaucaaa

SEQ ID NO: 1920380 - RNA, 20 nt, Homo sapiens
uuauuaagagcaaacuuuag

SEQ ID NO: 1920381 - RNA, 17 nt, Homo sapiens
aguaacgcgucuuccug

SEQ ID NO: 1920382 - RNA, 13 nt, Homo sapiens
uuccucuuaccug

SEQ ID NO: 1920383 - RNA, 18 nt, Homo sapiens
uucuuccccuuacucuca

SEQ ID NO: 1920384 - RNA, 21 nt, Homo sapiens
cuguauaaacagaacuccacu

SEQ ID NO: 1920385 - RNA, 21 nt, Homo sapiens
cagagcucagcacagccucac

SEQ ID NO: 1920386 - RNA, 18 nt, Homo sapiens
auccuuaacacauucaau

SEQ ID NO: 1920387 - RNA, 16 nt, Homo sapiens
gaaguaaaagcuaauu

SEQ ID NO: 1920388 - RNA, 18 nt, Homo sapiens
gugucuuucacagcuccu

SEQ ID NO: 1920389 - RNA, 14 nt, Homo sapiens
uccuucaccaccuc

SEQ ID NO: 1920390 - RNA, 23 nt, Homo sapiens
cgguagucccuguuuuugcagua

SEQ ID NO: 1920391 - RNA, 18 nt, Homo sapiens
ccacaucccuaacaucau

SEQ ID NO: 1920392 - RNA, 21 nt, Homo sapiens
aggggcgugggauugaauuaa

SEQ ID NO: 1920393 - RNA, 12 nt, Homo sapiens
caagacagaugu

SEQ ID NO: 1920394 - RNA, 13 nt, Homo sapiens
cccaggaagccca

SEQ ID NO: 1920395 - RNA, 23 nt, Homo sapiens
gagcucaguuucuuuuucacuug

SEQ ID NO: 1920396 - RNA, 18 nt, Homo sapiens
cuaaaaucguauucuaau

SEQ ID NO: 1920397 - RNA, 18 nt, Homo sapiens
uggcacccgggaaugacu

SEQ ID NO: 1920398 - RNA, 13 nt, Homo sapiens
uaaaaaucaguuu

SEQ ID NO: 1920399 - RNA, 14 nt, Homo sapiens
uccugaccuacuuc

SEQ ID NO: 1920400 - RNA, 17 nt, Homo sapiens
uguuauauucagugugu

SEQ ID NO: 1920401 - RNA, 21 nt, Homo sapiens
agcccccauuguggucacagg

SEQ ID NO: 1920402 - RNA, 13 nt, Homo sapiens
caaguuuauucag

SEQ ID NO: 1920403 - RNA, 18 nt, Homo sapiens
agaaaaauagugaagacu

SEQ ID NO: 1920404 - RNA, 14 nt, Homo sapiens
aaauaaaacaguau

SEQ ID NO: 1920405 - RNA, 20 nt, Homo sapiens
uagaaaaggccaauauaccu

SEQ ID NO: 1920406 - RNA, 14 nt, Homo sapiens
uuccuggucuuuga

SEQ ID NO: 1920407 - RNA, 20 nt, Homo sapiens
gucuguuuucuaaagccagg

SEQ ID NO: 1920408 - RNA, 17 nt, Homo sapiens
caguuuaauauuccaau

SEQ ID NO: 1920409 - RNA, 20 nt, Homo sapiens
uggagcggggaucugaugaa

SEQ ID NO: 1920410 - RNA, 11 nt, Homo sapiens
aaccucaggga

SEQ ID NO: 1920411 - RNA, 17 nt, Homo sapiens
cugccucagggcccacc

SEQ ID NO: 1920412 - RNA, 15 nt, Homo sapiens
gucauuuucuauuca

SEQ ID NO: 1920413 - RNA, 22 nt, Homo sapiens
ugagcaaaaugcugcuuucugc

SEQ ID NO: 1920414 - RNA, 16 nt, Homo sapiens
caaucagaucaacucu

SEQ ID NO: 1920415 - RNA, 13 nt, Homo sapiens
caaccucccaucc

SEQ ID NO: 1920416 - RNA, 13 nt, Homo sapiens
ugagauccuguga

SEQ ID NO: 1920417 - RNA, 17 nt, Homo sapiens
cuaaaguauaacauguc

SEQ ID NO: 1920418 - RNA, 22 nt, Homo sapiens
cggguaccgugcaugugcaguc

SEQ ID NO: 1920419 - RNA, 17 nt, Homo sapiens
cuggucuucucaguuca

SEQ ID NO: 1920420 - RNA, 19 nt, Homo sapiens
cacugcaccugaccugcug

SEQ ID NO: 1920421 - RNA, 14 nt, Homo sapiens
acuauggagccugg

SEQ ID NO: 1920422 - RNA, 19 nt, Homo sapiens
cauauugauagaugcaaga

SEQ ID NO: 1920423 - RNA, 13 nt, Homo sapiens
aaugagcauguuu

SEQ ID NO: 1920424 - RNA, 19 nt, Homo sapiens
acuuucccacacugugaac

SEQ ID NO: 1920425 - RNA, 18 nt, Homo sapiens
auugcacccuaaauccac

SEQ ID NO: 1920426 - RNA, 19 nt, Homo sapiens
acacuccugggcucugaac

SEQ ID NO: 1920427 - RNA, 16 nt, Homo sapiens
aaucucauuguacaag

SEQ ID NO: 1920428 - RNA, 14 nt, Homo sapiens
uauuccuguagggg

SEQ ID NO: 1920429 - RNA, 19 nt, Homo sapiens
ugucaccucagcugauauu

SEQ ID NO: 1920430 - RNA, 16 nt, Homo sapiens
auaaaauucauuccau

SEQ ID NO: 1920431 - RNA, 18 nt, Homo sapiens
acaucaguuacucugaag

SEQ ID NO: 1920432 - RNA, 19 nt, Homo sapiens
ccuaacaggcuaguucuaa

SEQ ID NO: 1920433 - RNA, 14 nt, Homo sapiens
caugagaggacuga

SEQ ID NO: 1920434 - RNA, 23 nt, Homo sapiens
cuuggauuucauuuguaacuuua

SEQ ID NO: 1920435 - RNA, 20 nt, Homo sapiens
cugcuggaugugaguuucca

SEQ ID NO: 1920436 - RNA, 18 nt, Homo sapiens
aagaacucaucacugugg

SEQ ID NO: 1920437 - RNA, 17 nt, Homo sapiens
uuuaaugagucagucaa

SEQ ID NO: 1920438 - RNA, 15 nt, Homo sapiens
acaauguucauccca

SEQ ID NO: 1920439 - RNA, 13 nt, Homo sapiens
gucuuuggugcuu

SEQ ID NO: 1920440 - RNA, 15 nt, Homo sapiens
ugugagauccuucac

SEQ ID NO: 1920441 - RNA, 14 nt, Homo sapiens
acuuaaagcaaaau

SEQ ID NO: 1920442 - RNA, 22 nt, Homo sapiens
cuugcucucuuucccacuccua

SEQ ID NO: 1920443 - RNA, 11 nt, Homo sapiens
uccaaagggag

SEQ ID NO: 1920444 - RNA, 16 nt, Homo sapiens
gaauauguuaaugcaa

SEQ ID NO: 1920445 - RNA, 24 nt, Homo sapiens
cccugcccgaccccaucucauuca

SEQ ID NO: 1920446 - RNA, 16 nt, Homo sapiens
caauagguaaagcuau

SEQ ID NO: 1920447 - RNA, 18 nt, Homo sapiens
caggcagcgauggucuca

SEQ ID NO: 1920448 - RNA, 20 nt, Homo sapiens
ugaacucucugccuguaaau

SEQ ID NO: 1920449 - RNA, 18 nt, Homo sapiens
agaauuauaagucacaaa

SEQ ID NO: 1920450 - RNA, 13 nt, Homo sapiens
aaaugcuuuuccu

SEQ ID NO: 1920451 - RNA, 15 nt, Homo sapiens
cacugccuauauaug

SEQ ID NO: 1920452 - RNA, 13 nt, Homo sapiens
auggauuuaaucc

SEQ ID NO: 1920453 - RNA, 12 nt, Homo sapiens
gcaggggacugg

SEQ ID NO: 1920454 - RNA, 20 nt, Homo sapiens
gccuuccgacaccacuggga

SEQ ID NO: 1920455 - RNA, 19 nt, Homo sapiens
aacuggaggaguuccuuga

SEQ ID NO: 1920456 - RNA, 22 nt, Homo sapiens
uaguuuaauccuuuguauuaca

SEQ ID NO: 1920457 - RNA, 13 nt, Homo sapiens
ucccuaagugcaa

SEQ ID NO: 1920458 - RNA, 20 nt, Homo sapiens
guccccagacuccaccaagc

SEQ ID NO: 1920459 - RNA, 17 nt, Homo sapiens
caauaaaaccuuugcca

SEQ ID NO: 1920460 - RNA, 15 nt, Homo sapiens
gugcucggcagucau

SEQ ID NO: 1920461 - RNA, 22 nt, Homo sapiens
guuaacugacaagcuccauuua

SEQ ID NO: 1920462 - RNA, 22 nt, Homo sapiens
ugggcagugccuccugggacca

SEQ ID NO: 1920463 - RNA, 18 nt, Homo sapiens
auuugguuauuuaaucac

SEQ ID NO: 1920464 - RNA, 17 nt, Homo sapiens
ugacuguaucuguguag

SEQ ID NO: 1920465 - RNA, 16 nt, Homo sapiens
aaugcagagucaauga

SEQ ID NO: 1920466 - RNA, 17 nt, Homo sapiens
gcuuuauugaagucuua

SEQ ID NO: 1920467 - RNA, 21 nt, Homo sapiens
aacacaaaguccuuaacaugc

SEQ ID NO: 1920468 - RNA, 17 nt, Homo sapiens
auuuucuggguuugaua

SEQ ID NO: 1920469 - RNA, 19 nt, Homo sapiens
aagaagacucgucuuggca

SEQ ID NO: 1920470 - RNA, 14 nt, Homo sapiens
ggagugcaccaaag

SEQ ID NO: 1920471 - RNA, 20 nt, Homo sapiens
ugccugauccuccaacagcu

SEQ ID NO: 1920472 - RNA, 22 nt, Homo sapiens
caccaggaauccccaacaugca

SEQ ID NO: 1920473 - RNA, 13 nt, Homo sapiens
acauguacagaca

SEQ ID NO: 1920474 - RNA, 20 nt, Homo sapiens
ccauuguuccugcgcugcaa

SEQ ID NO: 1920475 - RNA, 19 nt, Homo sapiens
uuauagauguacauaccuc

SEQ ID NO: 1920476 - RNA, 23 nt, Homo sapiens
caaggcggguggaucacuugaga

SEQ ID NO: 1920477 - RNA, 18 nt, Homo sapiens
agcuccgcuuucuaccca

SEQ ID NO: 1920478 - RNA, 17 nt, Homo sapiens
gcccuuccagccuggga

SEQ ID NO: 1920479 - RNA, 15 nt, Homo sapiens
uaaaaccccaucucu

SEQ ID NO: 1920480 - RNA, 15 nt, Homo sapiens
ugaaaccccgucucu

SEQ ID NO: 1920481 - RNA, 16 nt, Homo sapiens
uccccucucaccucau

SEQ ID NO: 1920482 - RNA, 16 nt, Homo sapiens
cagagcauuucaauua

SEQ ID NO: 1920483 - RNA, 23 nt, Homo sapiens
aagcagcacauagcacugggaac

SEQ ID NO: 1920484 - RNA, 17 nt, Homo sapiens
gaaguuugaccaucacc

SEQ ID NO: 1920485 - RNA, 22 nt, Homo sapiens
augucuuucucagaggacaaua

SEQ ID NO: 1920486 - RNA, 18 nt, Homo sapiens
uucugucuggacuuucca

SEQ ID NO: 1920487 - RNA, 17 nt, Homo sapiens
agaaguauuuuaauuca

SEQ ID NO: 1920488 - RNA, 14 nt, Homo sapiens
aauagaacagagaa

SEQ ID NO: 1920489 - RNA, 16 nt, Homo sapiens
uuucugcagauggaaa

SEQ ID NO: 1920490 - RNA, 18 nt, Homo sapiens
ucagccauaggugcaguu

SEQ ID NO: 1920491 - RNA, 20 nt, Homo sapiens
guggcauguggguugugaua

SEQ ID NO: 1920492 - RNA, 23 nt, Homo sapiens
auuauauaaagguggugggcaaa

SEQ ID NO: 1920493 - RNA, 22 nt, Homo sapiens
aaugaauuuucuucauacuuaa

SEQ ID NO: 1920494 - RNA, 14 nt, Homo sapiens
augauuaagugcuu

SEQ ID NO: 1920495 - RNA, 19 nt, Homo sapiens
aggauuccagaaugaucau

SEQ ID NO: 1920496 - RNA, 22 nt, Homo sapiens
auucauucauacuuccguccau

SEQ ID NO: 1920497 - RNA, 17 nt, Homo sapiens
uggucugucagcuguga

SEQ ID NO: 1920498 - RNA, 18 nt, Homo sapiens
gaacaauuaaaauauucu

SEQ ID NO: 1920499 - RNA, 16 nt, Homo sapiens
auauauuuuguaugca

SEQ ID NO: 1920500 - RNA, 16 nt, Homo sapiens
ugaauuuuuaugauau

SEQ ID NO: 1920501 - RNA, 16 nt, Homo sapiens
gauguuuuacgugcaa

SEQ ID NO: 1920502 - RNA, 16 nt, Homo sapiens
ccuccaacacaaggcu

SEQ ID NO: 1920503 - RNA, 12 nt, Homo sapiens
guaaaagacuga

SEQ ID NO: 1920504 - RNA, 13 nt, Homo sapiens
uuggacacugugc

SEQ ID NO: 1920505 - RNA, 14 nt, Homo sapiens
cauaauucagcacu

SEQ ID NO: 1920506 - RNA, 19 nt, Homo sapiens
ccagaggugcuccauggag

SEQ ID NO: 1920507 - RNA, 17 nt, Homo sapiens
augccaauuucucuuaa

SEQ ID NO: 1920508 - RNA, 19 nt, Homo sapiens
auaaagccucugugcugca

SEQ ID NO: 1920509 - RNA, 20 nt, Homo sapiens
uguuuccaacgucauggaag

SEQ ID NO: 1920510 - RNA, 19 nt, Homo sapiens
uuggaauggaacuacugua

SEQ ID NO: 1920511 - RNA, 22 nt, Homo sapiens
guuacccauuucuuaccaugca

SEQ ID NO: 1920512 - RNA, 18 nt, Homo sapiens
agcaaguuacagugaugc

SEQ ID NO: 1920513 - RNA, 19 nt, Homo sapiens
uagucccagcuacuccgga

SEQ ID NO: 1920514 - RNA, 15 nt, Homo sapiens
guggcucagccagca

SEQ ID NO: 1920515 - RNA, 21 nt, Homo sapiens
caacaagauccuuaaugcaga

SEQ ID NO: 1920516 - RNA, 14 nt, Homo sapiens
ucaaaacacucauc

SEQ ID NO: 1920517 - RNA, 20 nt, Homo sapiens
gugcaggggguggguguguu

SEQ ID NO: 1920518 - RNA, 20 nt, Homo sapiens
uuccaaagcagccugugaag

SEQ ID NO: 1920519 - RNA, 13 nt, Homo sapiens
gucucaauccuua

SEQ ID NO: 1920520 - RNA, 19 nt, Homo sapiens
auuucugaucuauacaaau

SEQ ID NO: 1920521 - RNA, 12 nt, Homo sapiens
cucagagcccau

SEQ ID NO: 1920522 - RNA, 16 nt, Homo sapiens
gcaugcaaauuagaca

SEQ ID NO: 1920523 - RNA, 14 nt, Homo sapiens
cuccaccucuucac

SEQ ID NO: 1920524 - RNA, 14 nt, Homo sapiens
gcccagcugcucag

SEQ ID NO: 1920525 - RNA, 17 nt, Homo sapiens
cacaacuuuucugcuac

SEQ ID NO: 1920526 - RNA, 17 nt, Homo sapiens
auuauuguugcauuaaa

SEQ ID NO: 1920527 - RNA, 20 nt, Homo sapiens
auauuuggauggugaaguca

SEQ ID NO: 1920528 - RNA, 16 nt, Homo sapiens
agaacugcagucagca

SEQ ID NO: 1920529 - RNA, 14 nt, Homo sapiens
uggggccucaggcu

SEQ ID NO: 1920530 - RNA, 17 nt, Homo sapiens
uggagagagaguucuca

SEQ ID NO: 1920531 - RNA, 17 nt, Homo sapiens
ucaacuuauuaacaauu

SEQ ID NO: 1920532 - RNA, 15 nt, Homo sapiens
agcagaugccaguga

SEQ ID NO: 1920533 - RNA, 14 nt, Homo sapiens
augaacuaugauuu

SEQ ID NO: 1920534 - RNA, 11 nt, Homo sapiens
auuucagggug

SEQ ID NO: 1920535 - RNA, 13 nt, Homo sapiens
gcaccuaccucac

SEQ ID NO: 1920536 - RNA, 14 nt, Homo sapiens
uaccaaucauuuua

SEQ ID NO: 1920537 - RNA, 15 nt, Homo sapiens
aggauggagugcagu

SEQ ID NO: 1920538 - RNA, 14 nt, Homo sapiens
agucaucaucucau

SEQ ID NO: 1920539 - RNA, 16 nt, Homo sapiens
acugacagauuuccau

SEQ ID NO: 1920540 - RNA, 15 nt, Homo sapiens
uauucuaaaaccauu

SEQ ID NO: 1920541 - RNA, 17 nt, Homo sapiens
aacuucagcaccaugga

SEQ ID NO: 1920542 - RNA, 15 nt, Homo sapiens
acccccagcagcuca

SEQ ID NO: 1920543 - RNA, 15 nt, Homo sapiens
auacuuaacaaauac

SEQ ID NO: 1920544 - RNA, 11 nt, Homo sapiens
caucuacuuag

SEQ ID NO: 1920545 - RNA, 18 nt, Homo sapiens
gaggaguggaguucucug

SEQ ID NO: 1920546 - RNA, 13 nt, Homo sapiens
ggaaaguguaaag

SEQ ID NO: 1920547 - RNA, 19 nt, Homo sapiens
uauuauaaugugcccaaag

SEQ ID NO: 1920548 - RNA, 13 nt, Homo sapiens
ugagaagcacugu

SEQ ID NO: 1920549 - RNA, 13 nt, Homo sapiens
ugauuagcacuua

SEQ ID NO: 1920550 - RNA, 16 nt, Homo sapiens
uuacaaccugauguca

SEQ ID NO: 1920551 - RNA, 14 nt, Homo sapiens
cccuccaccucuca

SEQ ID NO: 1920552 - RNA, 15 nt, Homo sapiens
gaccuggguugugcu

SEQ ID NO: 1920553 - RNA, 23 nt, Homo sapiens
ggaaccacaagacugcacaucaa

SEQ ID NO: 1920554 - RNA, 15 nt, Homo sapiens
uggcagccucuucaa

SEQ ID NO: 1920555 - RNA, 16 nt, Homo sapiens
cagcccugcaccaugc

SEQ ID NO: 1920556 - RNA, 16 nt, Homo sapiens
caccuuaagaagucua

SEQ ID NO: 1920557 - RNA, 22 nt, Homo sapiens
caagaggaauuccagcaucuga

SEQ ID NO: 1920558 - RNA, 17 nt, Homo sapiens
cacaggccuggccucaa

SEQ ID NO: 1920559 - RNA, 18 nt, Homo sapiens
gccagagcgugcuuucaa

SEQ ID NO: 1920560 - RNA, 15 nt, Homo sapiens
acucagacauuccaa

SEQ ID NO: 1920561 - RNA, 17 nt, Homo sapiens
gcagugcaacaacccca

SEQ ID NO: 1920562 - RNA, 14 nt, Homo sapiens
agaaguucauuccu

SEQ ID NO: 1920563 - RNA, 18 nt, Homo sapiens
aucucgaagucuuccauc

SEQ ID NO: 1920564 - RNA, 20 nt, Homo sapiens
aacaucuuuuucuacucgag

SEQ ID NO: 1920565 - RNA, 19 nt, Homo sapiens
agcuggggccgucugugug

SEQ ID NO: 1920566 - RNA, 17 nt, Homo sapiens
ucuuaggaauugaauua

SEQ ID NO: 1920567 - RNA, 23 nt, Homo sapiens
caagcaugaucuuguuacuguga

SEQ ID NO: 1920568 - RNA, 13 nt, Homo sapiens
cggcucccggggc

SEQ ID NO: 1920569 - RNA, 22 nt, Homo sapiens
agguuuucuguguuuagcuauu

SEQ ID NO: 1920570 - RNA, 23 nt, Homo sapiens
agccuggccuccuucaccaaaga

SEQ ID NO: 1920571 - RNA, 15 nt, Homo sapiens
uuaauguucugugau

SEQ ID NO: 1920572 - RNA, 23 nt, Homo sapiens
cagaauuguugacuugcauucag

SEQ ID NO: 1920573 - RNA, 18 nt, Homo sapiens
acugacugccuugcuaaa

SEQ ID NO: 1920574 - RNA, 15 nt, Homo sapiens
ggaaucuucaccuca

SEQ ID NO: 1920575 - RNA, 19 nt, Homo sapiens
uggcacuguggagcucagu

SEQ ID NO: 1920576 - RNA, 12 nt, Homo sapiens
aacaaagccaga

SEQ ID NO: 1920577 - RNA, 19 nt, Homo sapiens
cuacugaaaaaaauggagu

SEQ ID NO: 1920578 - RNA, 14 nt, Homo sapiens
aaagguaacaaagg

SEQ ID NO: 1920579 - RNA, 17 nt, Homo sapiens
cuuuuaaagccuauuca

SEQ ID NO: 1920580 - RNA, 13 nt, Homo sapiens
acgcuugcucugu

SEQ ID NO: 1920581 - RNA, 13 nt, Homo sapiens
gcuagcauuacca

SEQ ID NO: 1920582 - RNA, 13 nt, Homo sapiens
ggacucuugcucu

SEQ ID NO: 1920583 - RNA, 15 nt, Homo sapiens
auuacccugauacua

SEQ ID NO: 1920584 - RNA, 15 nt, Homo sapiens
aacauucugucauca

SEQ ID NO: 1920585 - RNA, 21 nt, Homo sapiens
agccaaaguuucuguugaauu

SEQ ID NO: 1920586 - RNA, 20 nt, Homo sapiens
ugggcauuucacgaacuguu

SEQ ID NO: 1920587 - RNA, 14 nt, Homo sapiens
uucaaucacuguau

SEQ ID NO: 1920588 - RNA, 14 nt, Homo sapiens
uagugacacacaga

SEQ ID NO: 1920589 - RNA, 17 nt, Homo sapiens
cauucugccugcccagg

SEQ ID NO: 1920590 - RNA, 23 nt, Homo sapiens
cuuuaagcgcaacauuucuuggu

SEQ ID NO: 1920591 - RNA, 15 nt, Homo sapiens
cguguguagaguuaa

SEQ ID NO: 1920592 - RNA, 16 nt, Homo sapiens
uggcauucacaucuca

SEQ ID NO: 1920593 - RNA, 23 nt, Homo sapiens
aauuuaaaaauaagaaaauacau

SEQ ID NO: 1920594 - RNA, 21 nt, Homo sapiens
cauucugcaccucuuggcucg

SEQ ID NO: 1920595 - RNA, 18 nt, Homo sapiens
uguugaaggaacuugucu

SEQ ID NO: 1920596 - RNA, 19 nt, Homo sapiens
cugcccgcgggagacagcu

SEQ ID NO: 1920597 - RNA, 13 nt, Homo sapiens
aauaagccuucaa

SEQ ID NO: 1920598 - RNA, 16 nt, Homo sapiens
cuccccucagauucca

SEQ ID NO: 1920599 - RNA, 16 nt, Homo sapiens
cucagccacugucaca

SEQ ID NO: 1920600 - RNA, 17 nt, Homo sapiens
ggcugagaacuggacag

SEQ ID NO: 1920601 - RNA, 15 nt, Homo sapiens
ugaaagccacagaca

SEQ ID NO: 1920602 - RNA, 16 nt, Homo sapiens
agauugacagcauaua

SEQ ID NO: 1920603 - RNA, 23 nt, Homo sapiens
aaaucuuuuaauacaguuuauua

SEQ ID NO: 1920604 - RNA, 14 nt, Homo sapiens
caugccaugaauga

SEQ ID NO: 1920605 - RNA, 18 nt, Homo sapiens
ucugugccccguccuugu

SEQ ID NO: 1920606 - RNA, 13 nt, Homo sapiens
agcuccacucuga

SEQ ID NO: 1920607 - RNA, 19 nt, Homo sapiens
guaucuaccucacuauuca

SEQ ID NO: 1920608 - RNA, 14 nt, Homo sapiens
cuuauaauuugcau

SEQ ID NO: 1920609 - RNA, 21 nt, Homo sapiens
agaaacacugacuccugugga

SEQ ID NO: 1920610 - RNA, 17 nt, Homo sapiens
agaaaauggaagacagc

SEQ ID NO: 1920611 - RNA, 18 nt, Homo sapiens
agacaaguguuuauuaaa

SEQ ID NO: 1920612 - RNA, 22 nt, Homo sapiens
acuucaucuucaaaacugccau

SEQ ID NO: 1920613 - RNA, 19 nt, Homo sapiens
accaucacugguugcacuu

SEQ ID NO: 1920614 - RNA, 13 nt, Homo sapiens
ggauguugcucag

SEQ ID NO: 1920615 - RNA, 19 nt, Homo sapiens
aauauguggaagcaaccaa

SEQ ID NO: 1920616 - RNA, 19 nt, Homo sapiens
gggaacugacgcuggagau

SEQ ID NO: 1920617 - RNA, 17 nt, Homo sapiens
ugacaacagccugagaa

SEQ ID NO: 1920618 - RNA, 22 nt, Homo sapiens
ugacggccaggcucccugacca

SEQ ID NO: 1920619 - RNA, 13 nt, Homo sapiens
gcaccaccagggu

SEQ ID NO: 1920620 - RNA, 12 nt, Homo sapiens
ggagcagggaca

SEQ ID NO: 1920621 - RNA, 17 nt, Homo sapiens
uauuauuaacuuguauu

SEQ ID NO: 1920622 - RNA, 22 nt, Homo sapiens
acuuuuaguagagacaggguuu

SEQ ID NO: 1920623 - RNA, 20 nt, Homo sapiens
cugugauggauggacacaaa

SEQ ID NO: 1920624 - RNA, 19 nt, Homo sapiens
acuuccaagacaagauacc

SEQ ID NO: 1920625 - RNA, 12 nt, Homo sapiens
ccaacucaagga

SEQ ID NO: 1920626 - RNA, 12 nt, Homo sapiens
ccagcucaaggg

SEQ ID NO: 1920627 - RNA, 17 nt, Homo sapiens
ucaacuuuucuaagaaa

SEQ ID NO: 1920628 - RNA, 20 nt, Homo sapiens
guggaggaaauguguauuac

SEQ ID NO: 1920629 - RNA, 19 nt, Homo sapiens
ggcugggagacagagucag

SEQ ID NO: 1920630 - RNA, 19 nt, Homo sapiens
acaacauuuacuuaacaga

SEQ ID NO: 1920631 - RNA, 18 nt, Homo sapiens
aucuccaaaaacagugau

SEQ ID NO: 1920632 - RNA, 12 nt, Homo sapiens
acgaacuguuca

SEQ ID NO: 1920633 - RNA, 19 nt, Homo sapiens
aaacuguccucuacaucaa

SEQ ID NO: 1920634 - RNA, 15 nt, Homo sapiens
aaauucuuuuucaca

SEQ ID NO: 1920635 - RNA, 18 nt, Homo sapiens
uucagugaagaugcugua

SEQ ID NO: 1920636 - RNA, 19 nt, Homo sapiens
aggcacuugucacuaugcu

SEQ ID NO: 1920637 - RNA, 14 nt, Homo sapiens
uuuauaaacagaaa

SEQ ID NO: 1920638 - RNA, 19 nt, Homo sapiens
ggagacuuaauagacauuu

SEQ ID NO: 1920639 - RNA, 19 nt, Homo sapiens
cugaacuccuggcuuucca

SEQ ID NO: 1920640 - RNA, 17 nt, Homo sapiens
agccuagauaugaagaa

SEQ ID NO: 1920641 - RNA, 20 nt, Homo sapiens
uuuuccacuuguggaaaaaa

SEQ ID NO: 1920642 - RNA, 19 nt, Homo sapiens
uccuaugcuuugaaacaga

SEQ ID NO: 1920643 - RNA, 18 nt, Homo sapiens
ccagccuccagggcauug

SEQ ID NO: 1920644 - RNA, 15 nt, Homo sapiens
guggagucauucuca

SEQ ID NO: 1920645 - RNA, 20 nt, Homo sapiens
ucuccauccuuaacugucca

SEQ ID NO: 1920646 - RNA, 14 nt, Homo sapiens
guuucuggggacac

SEQ ID NO: 1920647 - RNA, 17 nt, Homo sapiens
caagugcgugccgugug

SEQ ID NO: 1920648 - RNA, 20 nt, Homo sapiens
uccuggggccugugcacugu

SEQ ID NO: 1920649 - RNA, 20 nt, Homo sapiens
accauuaugcaaguguuccu

SEQ ID NO: 1920650 - RNA, 23 nt, Homo sapiens
ugaaaggaaagaggcucuggcua

SEQ ID NO: 1920651 - RNA, 19 nt, Homo sapiens
acaaauagugcaacuauga

SEQ ID NO: 1920652 - RNA, 12 nt, Homo sapiens
aaacgugcuccc

SEQ ID NO: 1920653 - RNA, 22 nt, Homo sapiens
cccuccacucacugcugugagu

SEQ ID NO: 1920654 - RNA, 12 nt, Homo sapiens
uucuugugauug

SEQ ID NO: 1920655 - RNA, 20 nt, Homo sapiens
gaaaucucgucggaaggaca

SEQ ID NO: 1920656 - RNA, 18 nt, Homo sapiens
caaaaguaaucacuuaaa

SEQ ID NO: 1920657 - RNA, 20 nt, Homo sapiens
guucaccuguguacugagua

SEQ ID NO: 1920658 - RNA, 21 nt, Homo sapiens
auugcugcaccaaugcacuga

SEQ ID NO: 1920659 - RNA, 21 nt, Homo sapiens
caggauauuuacuauuacucc

SEQ ID NO: 1920660 - RNA, 18 nt, Homo sapiens
guugauguuggcugggaa

SEQ ID NO: 1920661 - RNA, 23 nt, Homo sapiens
aagaauugugccucucccaaguc

SEQ ID NO: 1920662 - RNA, 22 nt, Homo sapiens
cuguccccacagcuucucuaca

SEQ ID NO: 1920663 - RNA, 22 nt, Homo sapiens
ugcuucuucuacuucagucuuc

SEQ ID NO: 1920664 - RNA, 21 nt, Homo sapiens
aagugccucggacaguccgca

SEQ ID NO: 1920665 - RNA, 14 nt, Homo sapiens
aaaauggaauacuc

SEQ ID NO: 1920666 - RNA, 13 nt, Homo sapiens
gaaagauuacuuu

SEQ ID NO: 1920667 - RNA, 17 nt, Homo sapiens
acaaaugcacgucacag

SEQ ID NO: 1920668 - RNA, 22 nt, Homo sapiens
guuggacccgcucuggaccaac

SEQ ID NO: 1920669 - RNA, 19 nt, Homo sapiens
acuaguauuguccauauca

SEQ ID NO: 1920670 - RNA, 16 nt, Homo sapiens
uguugagguaccucca

SEQ ID NO: 1920671 - RNA, 21 nt, Homo sapiens
agcaagugaauuuuucucuaa

SEQ ID NO: 1920672 - RNA, 14 nt, Homo sapiens
ugacuaauucuugc

SEQ ID NO: 1920673 - RNA, 14 nt, Homo sapiens
ccuauaaucuguca

SEQ ID NO: 1920674 - RNA, 15 nt, Homo sapiens
agggaaccugugucc

SEQ ID NO: 1920675 - RNA, 21 nt, Homo sapiens
ugcaaaaagauuuaacaaaua

SEQ ID NO: 1920676 - RNA, 14 nt, Homo sapiens
cucuguggguggga

SEQ ID NO: 1920677 - RNA, 17 nt, Homo sapiens
ccugcccucugcucugc

SEQ ID NO: 1920678 - RNA, 13 nt, Homo sapiens
ucaaaagugccuc

SEQ ID NO: 1920679 - RNA, 21 nt, Homo sapiens
agcauuuucuugaaccaauaa

SEQ ID NO: 1920680 - RNA, 14 nt, Homo sapiens
ccagaggacaaagc

SEQ ID NO: 1920681 - RNA, 13 nt, Homo sapiens
gugguauguauau

SEQ ID NO: 1920682 - RNA, 17 nt, Homo sapiens
aaacauucaaagagaca

SEQ ID NO: 1920683 - RNA, 18 nt, Homo sapiens
uaaaguaguccugugaau

SEQ ID NO: 1920684 - RNA, 11 nt, Homo sapiens
cauucuagcac

SEQ ID NO: 1920685 - RNA, 16 nt, Homo sapiens
gcacccagaggaggag

SEQ ID NO: 1920686 - RNA, 15 nt, Homo sapiens
uggaagcacaugugu

SEQ ID NO: 1920687 - RNA, 16 nt, Homo sapiens
caggauugggccaaca

SEQ ID NO: 1920688 - RNA, 21 nt, Homo sapiens
cuuaucuuuauuggcuugaua

SEQ ID NO: 1920689 - RNA, 20 nt, Homo sapiens
aggacucuuuccgacugccc

SEQ ID NO: 1920690 - RNA, 15 nt, Homo sapiens
cucagaaaagcccug

SEQ ID NO: 1920691 - RNA, 22 nt, Homo sapiens
auauuuuuuucugaaauuuccu

SEQ ID NO: 1920692 - RNA, 21 nt, Homo sapiens
ccccugcauucuuucuguauu

SEQ ID NO: 1920693 - RNA, 14 nt, Homo sapiens
aggaucuguacaau

SEQ ID NO: 1920694 - RNA, 16 nt, Homo sapiens
cagacacagguguaga

SEQ ID NO: 1920695 - RNA, 12 nt, Homo sapiens
augaauaagcuu

SEQ ID NO: 1920696 - RNA, 16 nt, Homo sapiens
uguagcugugcuuuga

SEQ ID NO: 1920697 - RNA, 15 nt, Homo sapiens
agaauuuuucuucau

SEQ ID NO: 1920698 - RNA, 16 nt, Homo sapiens
caaauucacuuuauua

SEQ ID NO: 1920699 - RNA, 20 nt, Homo sapiens
uacaggccuacagaaauuga

SEQ ID NO: 1920700 - RNA, 21 nt, Homo sapiens
gauaggguuucuaaugguuau

SEQ ID NO: 1920701 - RNA, 23 nt, Homo sapiens
gaaaagggguguggcaaaggagc

SEQ ID NO: 1920702 - RNA, 21 nt, Homo sapiens
cuucacuucaguugcuuugca

SEQ ID NO: 1920703 - RNA, 23 nt, Homo sapiens
uggaaagauuuuguccagaagaa

SEQ ID NO: 1920704 - RNA, 22 nt, Homo sapiens
uccuccucugugaaacugggau

SEQ ID NO: 1920705 - RNA, 14 nt, Homo sapiens
cccccauuggacac

SEQ ID NO: 1920706 - RNA, 13 nt, Homo sapiens
uggaggggaugau

SEQ ID NO: 1920707 - RNA, 19 nt, Homo sapiens
agagacuggagcaucugac

SEQ ID NO: 1920708 - RNA, 15 nt, Homo sapiens
ccuucaauuccauau

SEQ ID NO: 1920709 - RNA, 18 nt, Homo sapiens
cuuagcucugaggaguac

SEQ ID NO: 1920710 - RNA, 22 nt, Homo sapiens
guuaauugaaaguauaauuugc

SEQ ID NO: 1920711 - RNA, 15 nt, Homo sapiens
gggccccauuugcca

SEQ ID NO: 1920712 - RNA, 20 nt, Homo sapiens
gaucacuaaauaagcuucca

SEQ ID NO: 1920713 - RNA, 15 nt, Homo sapiens
uuuuaaccauuccaa

SEQ ID NO: 1920714 - RNA, 20 nt, Homo sapiens
ggguggcucugauugcuuua

SEQ ID NO: 1920715 - RNA, 14 nt, Homo sapiens
cauuaucuccauga

SEQ ID NO: 1920716 - RNA, 12 nt, Homo sapiens
agacaaaaugga

SEQ ID NO: 1920717 - RNA, 13 nt, Homo sapiens
cgagcucuuggcc

SEQ ID NO: 1920718 - RNA, 17 nt, Homo sapiens
aguauauuaaagugcua

SEQ ID NO: 1920719 - RNA, 15 nt, Homo sapiens
gagauguaugaaggc

SEQ ID NO: 1920720 - RNA, 18 nt, Homo sapiens
auuucauuucaaggcagu

SEQ ID NO: 1920721 - RNA, 21 nt, Homo sapiens
ucaaaaguccuuagaaugagg

SEQ ID NO: 1920722 - RNA, 15 nt, Homo sapiens
ugcacuauagccauu

SEQ ID NO: 1920723 - RNA, 20 nt, Homo sapiens
cuugcauuaauaauuucaau

SEQ ID NO: 1920724 - RNA, 14 nt, Homo sapiens
gcaagagaugaauu

SEQ ID NO: 1920725 - RNA, 16 nt, Homo sapiens
caccauucccugccuu

SEQ ID NO: 1920726 - RNA, 21 nt, Homo sapiens
uggaacaagcagcuaagcaau

SEQ ID NO: 1920727 - RNA, 17 nt, Homo sapiens
caguggcagacaaacag

SEQ ID NO: 1920728 - RNA, 16 nt, Homo sapiens
ucaacagaauucacuu

SEQ ID NO: 1920729 - RNA, 21 nt, Homo sapiens
guuuuucugcuuuagacuuga

SEQ ID NO: 1920730 - RNA, 17 nt, Homo sapiens
auuccauuuacuugauc

SEQ ID NO: 1920731 - RNA, 14 nt, Homo sapiens
aagcaaacuuauuu

SEQ ID NO: 1920732 - RNA, 19 nt, Homo sapiens
uggcucacagggcugaaag

SEQ ID NO: 1920733 - RNA, 15 nt, Homo sapiens
uauauucuuuccuca

SEQ ID NO: 1920734 - RNA, 21 nt, Homo sapiens
aaaucgugacaacacuugugu

SEQ ID NO: 1920735 - RNA, 13 nt, Homo sapiens
aacuauccaaaac

SEQ ID NO: 1920736 - RNA, 13 nt, Homo sapiens
uaaacuccuacua

SEQ ID NO: 1920737 - RNA, 22 nt, Homo sapiens
caggacugugccagcacaaagu

SEQ ID NO: 1920738 - RNA, 22 nt, Homo sapiens
uaugacuguuuuuauaugcaca

SEQ ID NO: 1920739 - RNA, 13 nt, Homo sapiens
augugcuguguaa

SEQ ID NO: 1920740 - RNA, 19 nt, Homo sapiens
augcuggaaccugcaaaaa

SEQ ID NO: 1920741 - RNA, 16 nt, Homo sapiens
uggacugaggaccaca

SEQ ID NO: 1920742 - RNA, 19 nt, Homo sapiens
uugauguggacaugagcca

SEQ ID NO: 1920743 - RNA, 22 nt, Homo sapiens
cccucugccccaucauugcacc

SEQ ID NO: 1920744 - RNA, 16 nt, Homo sapiens
cauggaugcacacaca

SEQ ID NO: 1920745 - RNA, 21 nt, Homo sapiens
uuccuagauaugauaaauaua

SEQ ID NO: 1920746 - RNA, 20 nt, Homo sapiens
cccgugccacgcgcucugca

SEQ ID NO: 1920747 - RNA, 16 nt, Homo sapiens
uugguacuauggugug

SEQ ID NO: 1920748 - RNA, 17 nt, Homo sapiens
augacaaucaccuucag

SEQ ID NO: 1920749 - RNA, 14 nt, Homo sapiens
cauuuuacacaaag

SEQ ID NO: 1920750 - RNA, 13 nt, Homo sapiens
uguuccaaaaaga

SEQ ID NO: 1920751 - RNA, 19 nt, Homo sapiens
cucaggaccacccugccaa

SEQ ID NO: 1920752 - RNA, 13 nt, Homo sapiens
gagcuugacuuca

SEQ ID NO: 1920753 - RNA, 22 nt, Homo sapiens
auauauggaaauauuaacaaug

SEQ ID NO: 1920754 - RNA, 22 nt, Homo sapiens
cagaaguguaguaugcuguaug

SEQ ID NO: 1920755 - RNA, 20 nt, Homo sapiens
caauaaacgaaacacagaac

SEQ ID NO: 1920756 - RNA, 23 nt, Homo sapiens
aucuccuguuuguugagugcacu

SEQ ID NO: 1920757 - RNA, 21 nt, Homo sapiens
gagaauguguuucaaaaccau

SEQ ID NO: 1920758 - RNA, 20 nt, Homo sapiens
uguuagaacacuauuuucag

SEQ ID NO: 1920759 - RNA, 20 nt, Homo sapiens
ugcucacuugguccuaccua

SEQ ID NO: 1920760 - RNA, 19 nt, Homo sapiens
uauuagcuuauuuaaucug

SEQ ID NO: 1920761 - RNA, 18 nt, Homo sapiens
gaauaucaggaugccuua

SEQ ID NO: 1920762 - RNA, 22 nt, Homo sapiens
caggauuaaugguccugugaug

SEQ ID NO: 1920763 - RNA, 21 nt, Homo sapiens
aagggaggggcuguguuucca

SEQ ID NO: 1920764 - RNA, 21 nt, Homo sapiens
uacuucuuguguguaugcaca

SEQ ID NO: 1920765 - RNA, 19 nt, Homo sapiens
uuuggauuauuccucagaa

SEQ ID NO: 1920766 - RNA, 22 nt, Homo sapiens
uaaguacugaaauacauaugau

SEQ ID NO: 1920767 - RNA, 16 nt, Homo sapiens
caaggugaauagcaca

SEQ ID NO: 1920768 - RNA, 12 nt, Homo sapiens
ucccacucucau

SEQ ID NO: 1920769 - RNA, 14 nt, Homo sapiens
acuguacuucccaa

SEQ ID NO: 1920770 - RNA, 18 nt, Homo sapiens
gaaccaugaaaaugggga

SEQ ID NO: 1920771 - RNA, 17 nt, Homo sapiens
uacagcacuguaugugu

SEQ ID NO: 1920772 - RNA, 22 nt, Homo sapiens
guacuuauaaagaagguuggug

SEQ ID NO: 1920773 - RNA, 22 nt, Homo sapiens
guuuacggccuaugagaugaaa

SEQ ID NO: 1920774 - RNA, 15 nt, Homo sapiens
aaaaauaugcauuuu

SEQ ID NO: 1920775 - RNA, 20 nt, Homo sapiens
cagaaguuguggauuucagu

SEQ ID NO: 1920776 - RNA, 22 nt, Homo sapiens
cuaaaccccggcgugugcagug

SEQ ID NO: 1920777 - RNA, 16 nt, Homo sapiens
augggcaaaaaaccaa

SEQ ID NO: 1920778 - RNA, 18 nt, Homo sapiens
agcugcaagaaguccaua

SEQ ID NO: 1920779 - RNA, 21 nt, Homo sapiens
uggaaagacagcuucucaucc

SEQ ID NO: 1920780 - RNA, 16 nt, Homo sapiens
aguccuugaaucaccu

SEQ ID NO: 1920781 - RNA, 22 nt, Homo sapiens
gcagaggagcugaguuggcaga

SEQ ID NO: 1920782 - RNA, 17 nt, Homo sapiens
ggcauuauaaagaacag

SEQ ID NO: 1920783 - RNA, 16 nt, Homo sapiens
uugcagaggagcccag

SEQ ID NO: 1920784 - RNA, 17 nt, Homo sapiens
guuuauuauuugcacag

SEQ ID NO: 1920785 - RNA, 20 nt, Homo sapiens
agcuaaguucuaaguucaug

SEQ ID NO: 1920786 - RNA, 15 nt, Homo sapiens
cagaccauccagagg

SEQ ID NO: 1920787 - RNA, 22 nt, Homo sapiens
gaggcuuauucaguucuuacac

SEQ ID NO: 1920788 - RNA, 16 nt, Homo sapiens
cgugaacugugcauag

SEQ ID NO: 1920789 - RNA, 21 nt, Homo sapiens
cagaacuugaaugugucaggu

SEQ ID NO: 1920790 - RNA, 20 nt, Homo sapiens
gaaucugugcagaugagcag

SEQ ID NO: 1920791 - RNA, 13 nt, Homo sapiens
aacuaggaccuca

SEQ ID NO: 1920792 - RNA, 16 nt, Homo sapiens
ggggcugaagccacac

SEQ ID NO: 1920793 - RNA, 22 nt, Homo sapiens
ccauucccugccuugcugacaa

SEQ ID NO: 1920794 - RNA, 21 nt, Homo sapiens
uauccuugucugaauguauuu

SEQ ID NO: 1920795 - RNA, 20 nt, Homo sapiens
cugaacaguguuggcuuuca

SEQ ID NO: 1920796 - RNA, 22 nt, Homo sapiens
acccaaccugacuuccucugcc

SEQ ID NO: 1920797 - RNA, 12 nt, Homo sapiens
caugugccaguu

SEQ ID NO: 1920798 - RNA, 20 nt, Homo sapiens
ucuguccuggcugugcacau

SEQ ID NO: 1920799 - RNA, 18 nt, Homo sapiens
auugccuaaaucuccagu

SEQ ID NO: 1920800 - RNA, 16 nt, Homo sapiens
uuuuaugcccuucuaa

SEQ ID NO: 1920801 - RNA, 15 nt, Homo sapiens
aaauaaacagcuauu

SEQ ID NO: 1920802 - RNA, 16 nt, Homo sapiens
agcucagccacuguga

SEQ ID NO: 1920803 - RNA, 22 nt, Homo sapiens
aauaacaguaguguuacaugua

SEQ ID NO: 1920804 - RNA, 22 nt, Homo sapiens
aagagucaagugaccaucauuu

SEQ ID NO: 1920805 - RNA, 16 nt, Homo sapiens
agccuguuuauugcca

SEQ ID NO: 1920806 - RNA, 21 nt, Homo sapiens
gguccaaaaaaggcugcccug

SEQ ID NO: 1920807 - RNA, 17 nt, Homo sapiens
uccaucagauguguucc

SEQ ID NO: 1920808 - RNA, 17 nt, Homo sapiens
cacagccacuaagauaa

SEQ ID NO: 1920809 - RNA, 23 nt, Homo sapiens
gcacucagagcugcugaggacaa

SEQ ID NO: 1920810 - RNA, 15 nt, Homo sapiens
cauaggcccagugag

SEQ ID NO: 1920811 - RNA, 16 nt, Homo sapiens
ggcccaccgaggugcu

SEQ ID NO: 1920812 - RNA, 20 nt, Homo sapiens
uacagaaaagacucugacca

SEQ ID NO: 1920813 - RNA, 18 nt, Homo sapiens
uccgcggccugcaccgac

SEQ ID NO: 1920814 - RNA, 14 nt, Homo sapiens
auggauauuucuca

SEQ ID NO: 1920815 - RNA, 17 nt, Homo sapiens
augagaugacauucacc

SEQ ID NO: 1920816 - RNA, 22 nt, Homo sapiens
uuugcaaaguacuguaagaaua

SEQ ID NO: 1920817 - RNA, 11 nt, Homo sapiens
uuauguuccca

SEQ ID NO: 1920818 - RNA, 21 nt, Homo sapiens
ugaaccuuugugcccuaucac

SEQ ID NO: 1920819 - RNA, 22 nt, Homo sapiens
caguuucagauccugaucuuaa

SEQ ID NO: 1920820 - RNA, 16 nt, Homo sapiens
aacuugcuacuuauca

SEQ ID NO: 1920821 - RNA, 13 nt, Homo sapiens
guucugcacagcu

SEQ ID NO: 1920822 - RNA, 18 nt, Homo sapiens
cgcagggaggaugccaca

SEQ ID NO: 1920823 - RNA, 20 nt, Homo sapiens
uuaaugaacaaauggccuuu

SEQ ID NO: 1920824 - RNA, 17 nt, Homo sapiens
gagcuggccuccuaugc

SEQ ID NO: 1920825 - RNA, 13 nt, Homo sapiens
agcuaagucuugu

SEQ ID NO: 1920826 - RNA, 23 nt, Homo sapiens
auggcuuuuuuugccuaccauuu

SEQ ID NO: 1920827 - RNA, 22 nt, Homo sapiens
cuaaguugcuaggaacaugugg

SEQ ID NO: 1920828 - RNA, 19 nt, Homo sapiens
auccaaauucucugagaug

SEQ ID NO: 1920829 - RNA, 17 nt, Homo sapiens
ugugucucccaggugca

SEQ ID NO: 1920830 - RNA, 21 nt, Homo sapiens
uggucagcccaaaccaccaga

SEQ ID NO: 1920831 - RNA, 20 nt, Homo sapiens
augcaucugcuacuguguca

SEQ ID NO: 1920832 - RNA, 15 nt, Homo sapiens
gaaugugucuugcga

SEQ ID NO: 1920833 - RNA, 13 nt, Homo sapiens
cucagcuagcucu

SEQ ID NO: 1920834 - RNA, 15 nt, Homo sapiens
auacaaauacuaucc

SEQ ID NO: 1920835 - RNA, 23 nt, Homo sapiens
agaauuccuuuucuaacucuccc

SEQ ID NO: 1920836 - RNA, 23 nt, Homo sapiens
aaauauuguguugugcagcauua

SEQ ID NO: 1920837 - RNA, 18 nt, Homo sapiens
guccuuuuucacuuugaa

SEQ ID NO: 1920838 - RNA, 21 nt, Homo sapiens
ccagccacggagggaggcacc

SEQ ID NO: 1920839 - RNA, 23 nt, Homo sapiens
cuggauuauaaguucuauuuuac

SEQ ID NO: 1920840 - RNA, 18 nt, Homo sapiens
uacuugcuccauuuacaa

SEQ ID NO: 1920841 - RNA, 21 nt, Homo sapiens
uggguggggcugcuccuccag

SEQ ID NO: 1920842 - RNA, 15 nt, Homo sapiens
ucucgaucuccugac

SEQ ID NO: 1920843 - RNA, 17 nt, Homo sapiens
auaauaguccaccuccc

SEQ ID NO: 1920844 - RNA, 18 nt, Homo sapiens
ugcacgcucaaugcccag

SEQ ID NO: 1920845 - RNA, 23 nt, Homo sapiens
agacuuuuccaacccucaucacc

SEQ ID NO: 1920846 - RNA, 19 nt, Homo sapiens
ucgugaaaccccaucucua

SEQ ID NO: 1920847 - RNA, 23 nt, Homo sapiens
aaucuauauuggaaucuguauca

SEQ ID NO: 1920848 - RNA, 21 nt, Homo sapiens
gauuuuggaaaagaaacaaua

SEQ ID NO: 1920849 - RNA, 21 nt, Homo sapiens
acaaugccagaccgcagagag

SEQ ID NO: 1920850 - RNA, 12 nt, Homo sapiens
ugucucauauga

SEQ ID NO: 1920851 - RNA, 14 nt, Homo sapiens
aaauuauggcccag

SEQ ID NO: 1920852 - RNA, 14 nt, Homo sapiens
aagugacucucaca

SEQ ID NO: 1920853 - RNA, 11 nt, Homo sapiens
aaaugcugcuc

SEQ ID NO: 1920854 - RNA, 23 nt, Homo sapiens
ucaaugaaaaaaaguacauguau

SEQ ID NO: 1920855 - RNA, 18 nt, Homo sapiens
cagcuaaagaaguuugaa

SEQ ID NO: 1920856 - RNA, 20 nt, Homo sapiens
ugugaaggccucgcaggaag

SEQ ID NO: 1920857 - RNA, 16 nt, Homo sapiens
aggccacucccaggga

SEQ ID NO: 1920858 - RNA, 14 nt, Homo sapiens
gaggagacugggca

SEQ ID NO: 1920859 - RNA, 17 nt, Homo sapiens
ccaaggaaauacauaug

SEQ ID NO: 1920860 - RNA, 14 nt, Homo sapiens
cuuccuccacuuca

SEQ ID NO: 1920861 - RNA, 16 nt, Homo sapiens
agugacuguacaguua

SEQ ID NO: 1920862 - RNA, 13 nt, Homo sapiens
cucucucucucuu

SEQ ID NO: 1920863 - RNA, 13 nt, Homo sapiens
gucuuucugucuc

SEQ ID NO: 1920864 - RNA, 17 nt, Homo sapiens
ccuaauuuggacaagau

SEQ ID NO: 1920865 - RNA, 18 nt, Homo sapiens
cccacagcacccaggcuc

SEQ ID NO: 1920866 - RNA, 12 nt, Homo sapiens
aaggagccaggg

SEQ ID NO: 1920867 - RNA, 20 nt, Homo sapiens
aagcauuaaaaauaagccaa

SEQ ID NO: 1920868 - RNA, 12 nt, Homo sapiens
cagggcucccug

SEQ ID NO: 1920869 - RNA, 20 nt, Homo sapiens
ucacucauuaaugaaucaca

SEQ ID NO: 1920870 - RNA, 20 nt, Homo sapiens
agaggaaccaauaccuucaa

SEQ ID NO: 1920871 - RNA, 15 nt, Homo sapiens
gaaaaucaacccaau

SEQ ID NO: 1920872 - RNA, 20 nt, Homo sapiens
aagauuuuagcuacaucuaa

SEQ ID NO: 1920873 - RNA, 14 nt, Homo sapiens
ccucccuaaauaua

SEQ ID NO: 1920874 - RNA, 21 nt, Homo sapiens
uaagucaccuaaguacuuaaa

SEQ ID NO: 1920875 - RNA, 17 nt, Homo sapiens
cagaguguuuaccuggu

SEQ ID NO: 1920876 - RNA, 19 nt, Homo sapiens
aguuucaggagauuguuaa

SEQ ID NO: 1920877 - RNA, 15 nt, Homo sapiens
gacuucucuagacau

SEQ ID NO: 1920878 - RNA, 23 nt, Homo sapiens
caauaagauugcgccugagauac

SEQ ID NO: 1920879 - RNA, 17 nt, Homo sapiens
ucugacuugccaaagaa

SEQ ID NO: 1920880 - RNA, 19 nt, Homo sapiens
gagacagagccuuguucua

SEQ ID NO: 1920881 - RNA, 15 nt, Homo sapiens
aauaucgcugauauu

SEQ ID NO: 1920882 - RNA, 17 nt, Homo sapiens
ccauguaucuaccucac

SEQ ID NO: 1920883 - RNA, 16 nt, Homo sapiens
cccucuaucaugguga

SEQ ID NO: 1920884 - RNA, 18 nt, Homo sapiens
gaauuacaaccacagaaa

SEQ ID NO: 1920885 - RNA, 17 nt, Homo sapiens
gccuccgcugggcuuca

SEQ ID NO: 1920886 - RNA, 19 nt, Homo sapiens
auggcuagccuuucuugua

SEQ ID NO: 1920887 - RNA, 18 nt, Homo sapiens
cagcacagacucuuucag

SEQ ID NO: 1920888 - RNA, 14 nt, Homo sapiens
uuccugugcacagc

SEQ ID NO: 1920889 - RNA, 21 nt, Homo sapiens
gauauccaggcuuaccaaagu

SEQ ID NO: 1920890 - RNA, 16 nt, Homo sapiens
cauaucaccagacaca

SEQ ID NO: 1920891 - RNA, 10 nt, Homo sapiens
accuaccugc

SEQ ID NO: 1920892 - RNA, 14 nt, Homo sapiens
acacuugugccagc

SEQ ID NO: 1920893 - RNA, 22 nt, Homo sapiens
agacuguggcugcuagcacuug

SEQ ID NO: 1920894 - RNA, 22 nt, Homo sapiens
aucaggaugucccugaaacuuc

SEQ ID NO: 1920895 - RNA, 17 nt, Homo sapiens
aagcaagcccuggccag

SEQ ID NO: 1920896 - RNA, 19 nt, Homo sapiens
gcucagcccugacuggugc

SEQ ID NO: 1920897 - RNA, 14 nt, Homo sapiens
gaaaacacagccuc

SEQ ID NO: 1920898 - RNA, 18 nt, Homo sapiens
ugacuaaagcagggacaa

SEQ ID NO: 1920899 - RNA, 18 nt, Homo sapiens
aagggggcugcugcuccu

SEQ ID NO: 1920900 - RNA, 22 nt, Homo sapiens
aaacgggcucgggucugggcag

SEQ ID NO: 1920901 - RNA, 13 nt, Homo sapiens
cuaaguaaucuca

SEQ ID NO: 1920902 - RNA, 14 nt, Homo sapiens
agagcaguguggaa

SEQ ID NO: 1920903 - RNA, 23 nt, Homo sapiens
cucagaucauuaucagccugugc

SEQ ID NO: 1920904 - RNA, 14 nt, Homo sapiens
caagaguuuuaaca

SEQ ID NO: 1920905 - RNA, 18 nt, Homo sapiens
acccugguuauugaugug

SEQ ID NO: 1920906 - RNA, 19 nt, Homo sapiens
uggcuuuuccuugaaucca

SEQ ID NO: 1920907 - RNA, 14 nt, Homo sapiens
acuagaaaauugug

SEQ ID NO: 1920908 - RNA, 22 nt, Homo sapiens
gcaggucuccaccugcacauug

SEQ ID NO: 1920909 - RNA, 15 nt, Homo sapiens
gucagugucguuuau

SEQ ID NO: 1920910 - RNA, 14 nt, Homo sapiens
ugcugccauuugaa

SEQ ID NO: 1920911 - RNA, 17 nt, Homo sapiens
agacuacuaaugacuuu

SEQ ID NO: 1920912 - RNA, 14 nt, Homo sapiens
cagcaauagcaucc

SEQ ID NO: 1920913 - RNA, 14 nt, Homo sapiens
uucuuauguuccag

SEQ ID NO: 1920914 - RNA, 15 nt, Homo sapiens
cuaaauuuccagggg

SEQ ID NO: 1920915 - RNA, 15 nt, Homo sapiens
acauuaaacaugacu

SEQ ID NO: 1920916 - RNA, 15 nt, Homo sapiens
caauaaaaacugucu

SEQ ID NO: 1920917 - RNA, 12 nt, Homo sapiens
agcacuuuugaa

SEQ ID NO: 1920918 - RNA, 16 nt, Homo sapiens
gguugguagcagggag

SEQ ID NO: 1920919 - RNA, 20 nt, Homo sapiens
guuuagaaucaagucuguga

SEQ ID NO: 1920920 - RNA, 17 nt, Homo sapiens
uuauaagacuacuauac

SEQ ID NO: 1920921 - RNA, 16 nt, Homo sapiens
uaaacagcaaagccau

SEQ ID NO: 1920922 - RNA, 22 nt, Homo sapiens
uacuaaugugccccauguccaa

SEQ ID NO: 1920923 - RNA, 16 nt, Homo sapiens
auacaguaaacucugg

SEQ ID NO: 1920924 - RNA, 20 nt, Homo sapiens
uuguauuuuuuaaugcuaau

SEQ ID NO: 1920925 - RNA, 17 nt, Homo sapiens
aggacccauagaugaac

SEQ ID NO: 1920926 - RNA, 14 nt, Homo sapiens
aaucuacuaauucc

SEQ ID NO: 1920927 - RNA, 18 nt, Homo sapiens
cagaucccauccaucagc

SEQ ID NO: 1920928 - RNA, 21 nt, Homo sapiens
gaccuagcuaaggucuauaaa

SEQ ID NO: 1920929 - RNA, 17 nt, Homo sapiens
uaguuggggcaccauac

SEQ ID NO: 1920930 - RNA, 15 nt, Homo sapiens
gaaacaagguuuuca

SEQ ID NO: 1920931 - RNA, 16 nt, Homo sapiens
agcagggacagaucau

SEQ ID NO: 1920932 - RNA, 23 nt, Homo sapiens
cauacauguugggcaugauucua

SEQ ID NO: 1920933 - RNA, 22 nt, Homo sapiens
ucaugcgaugacacuuguacaa

SEQ ID NO: 1920934 - RNA, 12 nt, Homo sapiens
uagcauugcacu

SEQ ID NO: 1920935 - RNA, 22 nt, Homo sapiens
ccucuaaaccauggcacuugau

SEQ ID NO: 1920936 - RNA, 14 nt, Homo sapiens
cuugagaccauuuc

SEQ ID NO: 1920937 - RNA, 14 nt, Homo sapiens
aaugugacauuuac

SEQ ID NO: 1920938 - RNA, 22 nt, Homo sapiens
uagagacauccuucauuugaca

SEQ ID NO: 1920939 - RNA, 19 nt, Homo sapiens
ucuucuuguguccugauga

SEQ ID NO: 1920940 - RNA, 18 nt, Homo sapiens
uccccauacaaauaagca

SEQ ID NO: 1920941 - RNA, 19 nt, Homo sapiens
uucgagacuagccugggaa

SEQ ID NO: 1920942 - RNA, 13 nt, Homo sapiens
caggcuacucugc

SEQ ID NO: 1920943 - RNA, 16 nt, Homo sapiens
ugcauuccagaacaaa

SEQ ID NO: 1920944 - RNA, 13 nt, Homo sapiens
gcaagcagggaaa

SEQ ID NO: 1920945 - RNA, 17 nt, Homo sapiens
ugagaccaaaucuugcu

SEQ ID NO: 1920946 - RNA, 18 nt, Homo sapiens
caaccucauuuuaacuca

SEQ ID NO: 1920947 - RNA, 15 nt, Homo sapiens
guagguaauguuccu

SEQ ID NO: 1920948 - RNA, 18 nt, Homo sapiens
gcaggggugcuguggaca

SEQ ID NO: 1920949 - RNA, 13 nt, Homo sapiens
aaugaacuuuguc

SEQ ID NO: 1920950 - RNA, 14 nt, Homo sapiens
gaaaucauacugua

SEQ ID NO: 1920951 - RNA, 22 nt, Homo sapiens
ugcuaauccucuuuuucuaguc

SEQ ID NO: 1920952 - RNA, 17 nt, Homo sapiens
cugauuugcaggauuuu

SEQ ID NO: 1920953 - RNA, 22 nt, Homo sapiens
auacaagucauggucacaguaa

SEQ ID NO: 1920954 - RNA, 12 nt, Homo sapiens
cucacuuugccc

SEQ ID NO: 1920955 - RNA, 24 nt, Homo sapiens
aauuucuuugauuuaacugacuua

SEQ ID NO: 1920956 - RNA, 15 nt, Homo sapiens
aauuucugucuuucu

SEQ ID NO: 1920957 - RNA, 21 nt, Homo sapiens
aaugguagauucaaagcuccu

SEQ ID NO: 1920958 - RNA, 12 nt, Homo sapiens
ccugaauuuccc

SEQ ID NO: 1920959 - RNA, 19 nt, Homo sapiens
aaaucaaucaagacugcaa

SEQ ID NO: 1920960 - RNA, 21 nt, Homo sapiens
aauuguuucuugacaagcuga

SEQ ID NO: 1920961 - RNA, 16 nt, Homo sapiens
augucucugagcauua

SEQ ID NO: 1920962 - RNA, 20 nt, Homo sapiens
ugugaccacugaauucacuc

SEQ ID NO: 1920963 - RNA, 22 nt, Homo sapiens
uuuuacauacauugauucaugu

SEQ ID NO: 1920964 - RNA, 22 nt, Homo sapiens
ucuauagaaaugaucauugcau

SEQ ID NO: 1920965 - RNA, 13 nt, Homo sapiens
cuguaccauuuau

SEQ ID NO: 1920966 - RNA, 11 nt, Homo sapiens
guugcagugag

SEQ ID NO: 1920967 - RNA, 19 nt, Homo sapiens
gcaaggggcauuacuggga

SEQ ID NO: 1920968 - RNA, 13 nt, Homo sapiens
caucauuuccauu

SEQ ID NO: 1920969 - RNA, 13 nt, Homo sapiens
aaauuuuuacuca

SEQ ID NO: 1920970 - RNA, 15 nt, Homo sapiens
uggauucucauugcc

SEQ ID NO: 1920971 - RNA, 19 nt, Homo sapiens
gucacugccugacauucac

SEQ ID NO: 1920972 - RNA, 21 nt, Homo sapiens
aaggugaagguaacuauuaga

SEQ ID NO: 1920973 - RNA, 12 nt, Homo sapiens
uugcaccaaaga

SEQ ID NO: 1920974 - RNA, 20 nt, Homo sapiens
aaucaaaucugugcucuuuc

SEQ ID NO: 1920975 - RNA, 20 nt, Homo sapiens
caaacucuggggcucaagca

SEQ ID NO: 1920976 - RNA, 14 nt, Homo sapiens
ucucaggaccaaag

SEQ ID NO: 1920977 - RNA, 13 nt, Homo sapiens
ucaauacagugaa

SEQ ID NO: 1920978 - RNA, 21 nt, Homo sapiens
uaugacuguuuuuguaguggu

SEQ ID NO: 1920979 - RNA, 16 nt, Homo sapiens
aaucuuugcugaagaa

SEQ ID NO: 1920980 - RNA, 22 nt, Homo sapiens
caguaacacagugcaguacuca

SEQ ID NO: 1920981 - RNA, 21 nt, Homo sapiens
cauauuucuaccugagugaag

SEQ ID NO: 1920982 - RNA, 14 nt, Homo sapiens
aauaauaauuuucc

SEQ ID NO: 1920983 - RNA, 17 nt, Homo sapiens
guccccagagcuacagg

SEQ ID NO: 1920984 - RNA, 23 nt, Homo sapiens
aaaugugcucaaauuacuaauga

SEQ ID NO: 1920985 - RNA, 16 nt, Homo sapiens
aaaccuccuauuccau

SEQ ID NO: 1920986 - RNA, 17 nt, Homo sapiens
ugcgaggaccacuuugg

SEQ ID NO: 1920987 - RNA, 13 nt, Homo sapiens
aacuucaaaaauc

SEQ ID NO: 1920988 - RNA, 17 nt, Homo sapiens
caauugcuucugugcaa

SEQ ID NO: 1920989 - RNA, 22 nt, Homo sapiens
guauagaauauuauaguuuaaa

SEQ ID NO: 1920990 - RNA, 13 nt, Homo sapiens
caaacaccaguca

SEQ ID NO: 1920991 - RNA, 16 nt, Homo sapiens
auuaccuaguagucau

SEQ ID NO: 1920992 - RNA, 17 nt, Homo sapiens
uucccccaccagcugca

SEQ ID NO: 1920993 - RNA, 16 nt, Homo sapiens
uuaaaaaguuagccag

SEQ ID NO: 1920994 - RNA, 15 nt, Homo sapiens
cucccagacuaccug

SEQ ID NO: 1920995 - RNA, 18 nt, Homo sapiens
agugcaggagagacagug

SEQ ID NO: 1920996 - RNA, 15 nt, Homo sapiens
uugagaagcugccau

SEQ ID NO: 1920997 - RNA, 22 nt, Homo sapiens
gcccaacccacaccaaauaaga

SEQ ID NO: 1920998 - RNA, 17 nt, Homo sapiens
cugaaauauccaggaau

SEQ ID NO: 1920999 - RNA, 20 nt, Homo sapiens
gggccaccccacucuaccuc

SEQ ID NO: 1921000 - RNA, 22 nt, Homo sapiens
cuugaguugaguauuacacauu

SEQ ID NO: 1921001 - RNA, 16 nt, Homo sapiens
cacucauuucaucuca

SEQ ID NO: 1921002 - RNA, 16 nt, Homo sapiens
uguggacgcugugcug

SEQ ID NO: 1921003 - RNA, 15 nt, Homo sapiens
auuuguaccauuccu

SEQ ID NO: 1921004 - RNA, 17 nt, Homo sapiens
ugaaaaaaaaaagacaa

SEQ ID NO: 1921005 - RNA, 17 nt, Homo sapiens
auuagaaugcauguaag

SEQ ID NO: 1921006 - RNA, 19 nt, Homo sapiens
cagggaagcugucccucac

SEQ ID NO: 1921007 - RNA, 18 nt, Homo sapiens
gaucgagccacugcacuc

SEQ ID NO: 1921008 - RNA, 18 nt, Homo sapiens
auaacugaaaaugugcua

SEQ ID NO: 1921009 - RNA, 23 nt, Homo sapiens
uuucugacacagucaauucugau

SEQ ID NO: 1921010 - RNA, 20 nt, Homo sapiens
acccaggcugcagugcaaug

SEQ ID NO: 1921011 - RNA, 12 nt, Homo sapiens
aaauuuggugcu

SEQ ID NO: 1921012 - RNA, 13 nt, Homo sapiens
caacccaaaccau

SEQ ID NO: 1921013 - RNA, 22 nt, Homo sapiens
cuucuccuaggauuccuaagac

SEQ ID NO: 1921014 - RNA, 13 nt, Homo sapiens
uuauuuagauccc

SEQ ID NO: 1921015 - RNA, 13 nt, Homo sapiens
ucaccuagaccuu

SEQ ID NO: 1921016 - RNA, 17 nt, Homo sapiens
ugcugcauauguuacaa

SEQ ID NO: 1921017 - RNA, 14 nt, Homo sapiens
uaugaacucuugau

SEQ ID NO: 1921018 - RNA, 14 nt, Homo sapiens
uucagucucacaga

SEQ ID NO: 1921019 - RNA, 15 nt, Homo sapiens
gcaaaugccaaagca

SEQ ID NO: 1921020 - RNA, 23 nt, Homo sapiens
cuaugcagaacagugagccaaau

SEQ ID NO: 1921021 - RNA, 22 nt, Homo sapiens
uaagccauugcuucucccucac

SEQ ID NO: 1921022 - RNA, 18 nt, Homo sapiens
ggaaaccugcccugccug

SEQ ID NO: 1921023 - RNA, 16 nt, Homo sapiens
aguguagugcucagua

SEQ ID NO: 1921024 - RNA, 18 nt, Homo sapiens
cuucaacaugacauccag

SEQ ID NO: 1921025 - RNA, 20 nt, Homo sapiens
accucaccccaacaaacucc

SEQ ID NO: 1921026 - RNA, 15 nt, Homo sapiens
auagcuuaagaagua

SEQ ID NO: 1921027 - RNA, 23 nt, Homo sapiens
uagaugauaaagagacagugaua

SEQ ID NO: 1921028 - RNA, 22 nt, Homo sapiens
gccccagcucggacuauacugc

SEQ ID NO: 1921029 - RNA, 17 nt, Homo sapiens
ccuuuugcaaccaggaa

SEQ ID NO: 1921030 - RNA, 23 nt, Homo sapiens
agacaccuuuucuauuuaccucc

SEQ ID NO: 1921031 - RNA, 23 nt, Homo sapiens
gcuacaguuauuaaucuggacau

SEQ ID NO: 1921032 - RNA, 19 nt, Homo sapiens
auaugcugacuucacuuau

SEQ ID NO: 1921033 - RNA, 23 nt, Homo sapiens
aauuagaucgguucugugccuuu

SEQ ID NO: 1921034 - RNA, 18 nt, Homo sapiens
uuccuccucgcugccaga

SEQ ID NO: 1921035 - RNA, 17 nt, Homo sapiens
uaaaucgcaucaugcca

SEQ ID NO: 1921036 - RNA, 20 nt, Homo sapiens
aguauuuuccuaagcacaaa

SEQ ID NO: 1921037 - RNA, 16 nt, Homo sapiens
aggaacacugcacucu

SEQ ID NO: 1921038 - RNA, 17 nt, Homo sapiens
cucuuuucccacauuca

SEQ ID NO: 1921039 - RNA, 16 nt, Homo sapiens
gggcuaccaggaagaa

SEQ ID NO: 1921040 - RNA, 19 nt, Homo sapiens
ucaguagccauaucuucca

SEQ ID NO: 1921041 - RNA, 14 nt, Homo sapiens
ggagagaaguuucu

SEQ ID NO: 1921042 - RNA, 19 nt, Homo sapiens
guuaaacccacagccaaac

SEQ ID NO: 1921043 - RNA, 22 nt, Homo sapiens
agauauuguugaaauaauugaa

SEQ ID NO: 1921044 - RNA, 14 nt, Homo sapiens
uaaacauauuuccu

SEQ ID NO: 1921045 - RNA, 21 nt, Homo sapiens
guuuacccaguauuccauuuu

SEQ ID NO: 1921046 - RNA, 18 nt, Homo sapiens
uccugaggccaagaaaga

SEQ ID NO: 1921047 - RNA, 15 nt, Homo sapiens
ugccacugugugaau

SEQ ID NO: 1921048 - RNA, 16 nt, Homo sapiens
uguggaugagaggaac

SEQ ID NO: 1921049 - RNA, 14 nt, Homo sapiens
uaccuugucauaga

SEQ ID NO: 1921050 - RNA, 18 nt, Homo sapiens
aauugcauuuauuuauca

SEQ ID NO: 1921051 - RNA, 23 nt, Homo sapiens
agaauuuaccucuuaugagcucc

SEQ ID NO: 1921052 - RNA, 11 nt, Homo sapiens
uggacuucuua

SEQ ID NO: 1921053 - RNA, 20 nt, Homo sapiens
ccuucacucugacaguauua

SEQ ID NO: 1921054 - RNA, 18 nt, Homo sapiens
aaucccagcaauuuggag

SEQ ID NO: 1921055 - RNA, 20 nt, Homo sapiens
uccagguucuaaugugugga

SEQ ID NO: 1921056 - RNA, 15 nt, Homo sapiens
agguucuagguagug

SEQ ID NO: 1921057 - RNA, 17 nt, Homo sapiens
cuacccaaacccuaggu

SEQ ID NO: 1921058 - RNA, 15 nt, Homo sapiens
ucuacauacauuauu

SEQ ID NO: 1921059 - RNA, 17 nt, Homo sapiens
aucgaaucccuuucuca

SEQ ID NO: 1921060 - RNA, 17 nt, Homo sapiens
gagccaagaucgcacca

SEQ ID NO: 1921061 - RNA, 15 nt, Homo sapiens
agggcaucuccagga

SEQ ID NO: 1921062 - RNA, 17 nt, Homo sapiens
ccuuuaguaaugaaugu

SEQ ID NO: 1921063 - RNA, 20 nt, Homo sapiens
ugaaaagcacacacaauaaa

SEQ ID NO: 1921064 - RNA, 12 nt, Homo sapiens
guuggcacuuau

SEQ ID NO: 1921065 - RNA, 14 nt, Homo sapiens
cuuccucacaccag

SEQ ID NO: 1921066 - RNA, 18 nt, Homo sapiens
uuaaacccacagccaaac

SEQ ID NO: 1921067 - RNA, 23 nt, Homo sapiens
ccaagauuaugugacuugcaaua

SEQ ID NO: 1921068 - RNA, 17 nt, Homo sapiens
uccuucuccaccccagc

SEQ ID NO: 1921069 - RNA, 20 nt, Homo sapiens
ugugcugcucaaggccacag

SEQ ID NO: 1921070 - RNA, 21 nt, Homo sapiens
uaucucaaauuguaauuaaua

SEQ ID NO: 1921071 - RNA, 20 nt, Homo sapiens
ccuuuacauaauugcaauau

SEQ ID NO: 1921072 - RNA, 19 nt, Homo sapiens
aacuagcugggcacagugg

SEQ ID NO: 1921073 - RNA, 20 nt, Homo sapiens
auuguuaggaaaugucauca

SEQ ID NO: 1921074 - RNA, 14 nt, Homo sapiens
aguucauacugaau

SEQ ID NO: 1921075 - RNA, 21 nt, Homo sapiens
ugggacagacggaaaugaaau

SEQ ID NO: 1921076 - RNA, 17 nt, Homo sapiens
ccauuagaauagucaua

SEQ ID NO: 1921077 - RNA, 15 nt, Homo sapiens
augaccauccugcca

SEQ ID NO: 1921078 - RNA, 21 nt, Homo sapiens
cagcguguguauccgacucua

SEQ ID NO: 1921079 - RNA, 16 nt, Homo sapiens
guaccaaaucugacau

SEQ ID NO: 1921080 - RNA, 11 nt, Homo sapiens
caugugcagcc

SEQ ID NO: 1921081 - RNA, 13 nt, Homo sapiens
ugggucuuucaug

SEQ ID NO: 1921082 - RNA, 17 nt, Homo sapiens
agccuuucugcugauua

SEQ ID NO: 1921083 - RNA, 14 nt, Homo sapiens
ugggcuaccaggaa

SEQ ID NO: 1921084 - RNA, 20 nt, Homo sapiens
aauuacaguauauguugcaa

SEQ ID NO: 1921085 - RNA, 18 nt, Homo sapiens
gucugaugagaacucuga

SEQ ID NO: 1921086 - RNA, 11 nt, Homo sapiens
uagaugcaggc

SEQ ID NO: 1921087 - RNA, 20 nt, Homo sapiens
aaaugcaguccagugagaaa

SEQ ID NO: 1921088 - RNA, 20 nt, Homo sapiens
auugaaaaaaauuggcauua

SEQ ID NO: 1921089 - RNA, 14 nt, Homo sapiens
uuuuaagacuauaa

SEQ ID NO: 1921090 - RNA, 15 nt, Homo sapiens
cuuguccucuugcca

SEQ ID NO: 1921091 - RNA, 19 nt, Homo sapiens
gagacugaucccuggccac

SEQ ID NO: 1921092 - RNA, 15 nt, Homo sapiens
ugcccugagacagac

SEQ ID NO: 1921093 - RNA, 17 nt, Homo sapiens
acaaaggagccuugaua

SEQ ID NO: 1921094 - RNA, 20 nt, Homo sapiens
ugaaacagggaaaaugaagc

SEQ ID NO: 1921095 - RNA, 18 nt, Homo sapiens
uaaaguucagauguuuca

SEQ ID NO: 1921096 - RNA, 21 nt, Homo sapiens
uuucaaaccagcuucaugugg

SEQ ID NO: 1921097 - RNA, 20 nt, Homo sapiens
caugggacuaaaugaacuaa

SEQ ID NO: 1921098 - RNA, 18 nt, Homo sapiens
auuuuguuuucuguggag

SEQ ID NO: 1921099 - RNA, 17 nt, Homo sapiens
uccuuucagcaagacuu

SEQ ID NO: 1921100 - RNA, 16 nt, Homo sapiens
ucaguuucccuaucuc

SEQ ID NO: 1921101 - RNA, 15 nt, Homo sapiens
ggcagaauccuuguc

SEQ ID NO: 1921102 - RNA, 21 nt, Homo sapiens
ccagcagcagagaaccaucaa

SEQ ID NO: 1921103 - RNA, 18 nt, Homo sapiens
aucaaauucaauaaucuu

SEQ ID NO: 1921104 - RNA, 20 nt, Homo sapiens
agggccuggcaggccagugu

SEQ ID NO: 1921105 - RNA, 15 nt, Homo sapiens
acuuuucgacauauu

SEQ ID NO: 1921106 - RNA, 12 nt, Homo sapiens
cuucccugauug

SEQ ID NO: 1921107 - RNA, 17 nt, Homo sapiens
agguugaagccaugucu

SEQ ID NO: 1921108 - RNA, 13 nt, Homo sapiens
cuccucuuacccc

SEQ ID NO: 1921109 - RNA, 16 nt, Homo sapiens
aacugaugacauucca

SEQ ID NO: 1921110 - RNA, 19 nt, Homo sapiens
guugcacuacauaaucucu

SEQ ID NO: 1921111 - RNA, 15 nt, Homo sapiens
agaaugugcacucuc

SEQ ID NO: 1921112 - RNA, 23 nt, Homo sapiens
aauguuuaaguauuaacuuacaa

SEQ ID NO: 1921113 - RNA, 17 nt, Homo sapiens
gccccaaucuugcccac

SEQ ID NO: 1921114 - RNA, 13 nt, Homo sapiens
augcaagauuuag

SEQ ID NO: 1921115 - RNA, 12 nt, Homo sapiens
aggaaaugugug

SEQ ID NO: 1921116 - RNA, 20 nt, Homo sapiens
aggcugcgagagaaagggag

SEQ ID NO: 1921117 - RNA, 15 nt, Homo sapiens
acuccuuaucccuug

SEQ ID NO: 1921118 - RNA, 16 nt, Homo sapiens
uuguuucugcauucau

SEQ ID NO: 1921119 - RNA, 13 nt, Homo sapiens
ugacccacacugc

SEQ ID NO: 1921120 - RNA, 16 nt, Homo sapiens
acaacuugaauuacaa

SEQ ID NO: 1921121 - RNA, 19 nt, Homo sapiens
agccaucaagagacugagu

SEQ ID NO: 1921122 - RNA, 17 nt, Homo sapiens
uccugaucaggaaacca

SEQ ID NO: 1921123 - RNA, 12 nt, Homo sapiens
uauagccuuuac

SEQ ID NO: 1921124 - RNA, 13 nt, Homo sapiens
uuuggaaauggag

SEQ ID NO: 1921125 - RNA, 21 nt, Homo sapiens
aggcagucagguccaugugca

SEQ ID NO: 1921126 - RNA, 23 nt, Homo sapiens
cugccuuuuaucugcccagaauu

SEQ ID NO: 1921127 - RNA, 21 nt, Homo sapiens
uggcaggcagagaacugucuc

SEQ ID NO: 1921128 - RNA, 15 nt, Homo sapiens
gcaugacagcuguuc

SEQ ID NO: 1921129 - RNA, 22 nt, Homo sapiens
caaggccgagccacacacccgc

SEQ ID NO: 1921130 - RNA, 14 nt, Homo sapiens
auggcaauuggcau

SEQ ID NO: 1921131 - RNA, 14 nt, Homo sapiens
cauagaacacuuca

SEQ ID NO: 1921132 - RNA, 12 nt, Homo sapiens
ccuaagcccaaa

SEQ ID NO: 1921133 - RNA, 20 nt, Homo sapiens
guuuccauauuuuuugcaca

SEQ ID NO: 1921134 - RNA, 21 nt, Homo sapiens
agggaccacacccuguacugu

SEQ ID NO: 1921135 - RNA, 14 nt, Homo sapiens
caaaguauuugcug

SEQ ID NO: 1921136 - RNA, 21 nt, Homo sapiens
caccugggaaaauaccagaaa

SEQ ID NO: 1921137 - RNA, 16 nt, Homo sapiens
uauuuucaacaauuag

SEQ ID NO: 1921138 - RNA, 20 nt, Homo sapiens
accacuguaccccagguucu

SEQ ID NO: 1921139 - RNA, 21 nt, Homo sapiens
aauccaggcgugguggcacac

SEQ ID NO: 1921140 - RNA, 20 nt, Homo sapiens
uaacauuuacuuuugcuccc

SEQ ID NO: 1921141 - RNA, 18 nt, Homo sapiens
agggaacaagcauucucc

SEQ ID NO: 1921142 - RNA, 15 nt, Homo sapiens
cggucugcuuuggau

SEQ ID NO: 1921143 - RNA, 16 nt, Homo sapiens
gaaaccuuaguuucaa

SEQ ID NO: 1921144 - RNA, 20 nt, Homo sapiens
uuuaagccuugacacacugu

SEQ ID NO: 1921145 - RNA, 23 nt, Homo sapiens
ucagcccugcccuucagcauccu

SEQ ID NO: 1921146 - RNA, 15 nt, Homo sapiens
acucaccuugucuca

SEQ ID NO: 1921147 - RNA, 19 nt, Homo sapiens
ugagaagaacacaucaggc

SEQ ID NO: 1921148 - RNA, 14 nt, Homo sapiens
agcaaaggucacca

SEQ ID NO: 1921149 - RNA, 17 nt, Homo sapiens
aaaaacuuucacugaau

SEQ ID NO: 1921150 - RNA, 19 nt, Homo sapiens
guaauuaaguaaaccaaaa

SEQ ID NO: 1921151 - RNA, 22 nt, Homo sapiens
ugauccccaaguggugaaugac

SEQ ID NO: 1921152 - RNA, 14 nt, Homo sapiens
acagggucucacug

SEQ ID NO: 1921153 - RNA, 20 nt, Homo sapiens
ucaggaagccuguggugugc

SEQ ID NO: 1921154 - RNA, 22 nt, Homo sapiens
uuuccucuccacacagugcuca

SEQ ID NO: 1921155 - RNA, 14 nt, Homo sapiens
cuccauaucugauu

SEQ ID NO: 1921156 - RNA, 23 nt, Homo sapiens
agaagcaauaacuauuuuuccuc

SEQ ID NO: 1921157 - RNA, 16 nt, Homo sapiens
guguaaaauguauauu

SEQ ID NO: 1921158 - RNA, 14 nt, Homo sapiens
agaaccacugaguc

SEQ ID NO: 1921159 - RNA, 17 nt, Homo sapiens
cacuuaaugauacaugu

SEQ ID NO: 1921160 - RNA, 18 nt, Homo sapiens
uuucaacuucaguacuca

SEQ ID NO: 1921161 - RNA, 20 nt, Homo sapiens
uguguauuuaagaaaagugu

SEQ ID NO: 1921162 - RNA, 17 nt, Homo sapiens
cuuuggaaagacuugaa

SEQ ID NO: 1921163 - RNA, 14 nt, Homo sapiens
ccugaggaauaaag

SEQ ID NO: 1921164 - RNA, 18 nt, Homo sapiens
gaaauaacggguggcauu

SEQ ID NO: 1921165 - RNA, 20 nt, Homo sapiens
auaauuagaguugugauaca

SEQ ID NO: 1921166 - RNA, 15 nt, Homo sapiens
caagcuaugugagcu

SEQ ID NO: 1921167 - RNA, 10 nt, Homo sapiens
uaaugaucau

SEQ ID NO: 1921168 - RNA, 15 nt, Homo sapiens
aguuguuaauaaaag

SEQ ID NO: 1921169 - RNA, 14 nt, Homo sapiens
aaaacaacuuccuu

SEQ ID NO: 1921170 - RNA, 13 nt, Homo sapiens
gggugagugcaag

SEQ ID NO: 1921171 - RNA, 12 nt, Homo sapiens
cgaaugucacug

SEQ ID NO: 1921172 - RNA, 22 nt, Homo sapiens
agcuacucuggaggcugagaua

SEQ ID NO: 1921173 - RNA, 15 nt, Homo sapiens
aaguuugaagcacaa

SEQ ID NO: 1921174 - RNA, 19 nt, Homo sapiens
accaaauacuuuaauguau

SEQ ID NO: 1921175 - RNA, 20 nt, Homo sapiens
cuaugaucagaagacuuuaa

SEQ ID NO: 1921176 - RNA, 13 nt, Homo sapiens
ccuugcagccaca

SEQ ID NO: 1921177 - RNA, 14 nt, Homo sapiens
aagagaaugucucc

SEQ ID NO: 1921178 - RNA, 13 nt, Homo sapiens
cuggagugcagug

SEQ ID NO: 1921179 - RNA, 13 nt, Homo sapiens
cuagagugcaaug

SEQ ID NO: 1921180 - RNA, 18 nt, Homo sapiens
uucuuuuuugcccccaga

SEQ ID NO: 1921181 - RNA, 20 nt, Homo sapiens
auguuagagaauuuccuuac

SEQ ID NO: 1921182 - RNA, 16 nt, Homo sapiens
cacccuccauucugca

SEQ ID NO: 1921183 - RNA, 15 nt, Homo sapiens
aggaaacuuugaacu

SEQ ID NO: 1921184 - RNA, 23 nt, Homo sapiens
gacccaaguacuuuccaaucuca

SEQ ID NO: 1921185 - RNA, 18 nt, Homo sapiens
auuuuaaauaaagacaaa

SEQ ID NO: 1921186 - RNA, 23 nt, Homo sapiens
uaugagaucacugaacuuuucaa

SEQ ID NO: 1921187 - RNA, 22 nt, Homo sapiens
ccacuuccugccccaacugcag

SEQ ID NO: 1921188 - RNA, 22 nt, Homo sapiens
cuagcaccagggacuaugaaug

SEQ ID NO: 1921189 - RNA, 14 nt, Homo sapiens
cuccuuugcaggcu

SEQ ID NO: 1921190 - RNA, 22 nt, Homo sapiens
cuguuugaaaccaagcuuucaa

SEQ ID NO: 1921191 - RNA, 17 nt, Homo sapiens
uacccucgcaugacugu

SEQ ID NO: 1921192 - RNA, 12 nt, Homo sapiens
agguaugcagag

SEQ ID NO: 1921193 - RNA, 13 nt, Homo sapiens
acccccagcauua

SEQ ID NO: 1921194 - RNA, 13 nt, Homo sapiens
uccuuacuccauc

SEQ ID NO: 1921195 - RNA, 16 nt, Homo sapiens
guuuccugugucucca

SEQ ID NO: 1921196 - RNA, 16 nt, Homo sapiens
aucccugaaacaucuc

SEQ ID NO: 1921197 - RNA, 19 nt, Homo sapiens
caaacguaauuuguuauau

SEQ ID NO: 1921198 - RNA, 15 nt, Homo sapiens
agcccccccuuccac

SEQ ID NO: 1921199 - RNA, 21 nt, Homo sapiens
cgagcuguguagccacugacu

SEQ ID NO: 1921200 - RNA, 13 nt, Homo sapiens
ggaguccaagacc

SEQ ID NO: 1921201 - RNA, 18 nt, Homo sapiens
gcucauuucacuuuacac

SEQ ID NO: 1921202 - RNA, 23 nt, Homo sapiens
augguacucuuguugaguucugu

SEQ ID NO: 1921203 - RNA, 15 nt, Homo sapiens
accucugcaagacaa

SEQ ID NO: 1921204 - RNA, 17 nt, Homo sapiens
aauaugauacucucaga

SEQ ID NO: 1921205 - RNA, 16 nt, Homo sapiens
ccugccacaaugugau

SEQ ID NO: 1921206 - RNA, 19 nt, Homo sapiens
ccugugugucugcagacaa

SEQ ID NO: 1921207 - RNA, 20 nt, Homo sapiens
auuuuaagccaguuuuacac

SEQ ID NO: 1921208 - RNA, 19 nt, Homo sapiens
uuucaucuaacgugcauua

SEQ ID NO: 1921209 - RNA, 12 nt, Homo sapiens
caagucaccucc

SEQ ID NO: 1921210 - RNA, 14 nt, Homo sapiens
uuauucugugcgcu

SEQ ID NO: 1921211 - RNA, 23 nt, Homo sapiens
uaaaaugcccauuugugaagcuu

SEQ ID NO: 1921212 - RNA, 19 nt, Homo sapiens
auccgaaccuccucuguga

SEQ ID NO: 1921213 - RNA, 14 nt, Homo sapiens
guuacuugcuuuga

SEQ ID NO: 1921214 - RNA, 17 nt, Homo sapiens
cauacauuuaugcacau

SEQ ID NO: 1921215 - RNA, 17 nt, Homo sapiens
cauauguagaugugcug

SEQ ID NO: 1921216 - RNA, 16 nt, Homo sapiens
uccaggacuccacugg

SEQ ID NO: 1921217 - RNA, 15 nt, Homo sapiens
ggcggaucacuugag

SEQ ID NO: 1921218 - RNA, 14 nt, Homo sapiens
cagaagccucugcc

SEQ ID NO: 1921219 - RNA, 17 nt, Homo sapiens
guaugaucacggcucac

SEQ ID NO: 1921220 - RNA, 15 nt, Homo sapiens
acucucaccucguga

SEQ ID NO: 1921221 - RNA, 17 nt, Homo sapiens
uuagaucuuauauuggu

SEQ ID NO: 1921222 - RNA, 21 nt, Homo sapiens
uagggacugccaggcuguuuc

SEQ ID NO: 1921223 - RNA, 15 nt, Homo sapiens
ccaucuccgccucca

SEQ ID NO: 1921224 - RNA, 19 nt, Homo sapiens
gagcuaugauaugugcuug

SEQ ID NO: 1921225 - RNA, 20 nt, Homo sapiens
cucauauuucccaugauuuc

SEQ ID NO: 1921226 - RNA, 14 nt, Homo sapiens
aacuacugaacugu

SEQ ID NO: 1921227 - RNA, 23 nt, Homo sapiens
cccaggcaucugcuuuacucugg

SEQ ID NO: 1921228 - RNA, 14 nt, Homo sapiens
uggcucugccucag

SEQ ID NO: 1921229 - RNA, 13 nt, Homo sapiens
uucaacucuguga

SEQ ID NO: 1921230 - RNA, 19 nt, Homo sapiens
auaaaguuguugcauuccc

SEQ ID NO: 1921231 - RNA, 15 nt, Homo sapiens
agggcaucauccuca

SEQ ID NO: 1921232 - RNA, 14 nt, Homo sapiens
ugucucacacagca

SEQ ID NO: 1921233 - RNA, 18 nt, Homo sapiens
uucuggaaagaaaaccau

SEQ ID NO: 1921234 - RNA, 18 nt, Homo sapiens
ugagaacuacucagggaa

SEQ ID NO: 1921235 - RNA, 17 nt, Homo sapiens
cacauggaggacccaac

SEQ ID NO: 1921236 - RNA, 18 nt, Homo sapiens
uguuaggucucaugccca

SEQ ID NO: 1921237 - RNA, 20 nt, Homo sapiens
gaccggccuuugcaccucca

SEQ ID NO: 1921238 - RNA, 14 nt, Homo sapiens
gaaaauuaauuuca

SEQ ID NO: 1921239 - RNA, 21 nt, Homo sapiens
ccaaggaaaggcauguacaaa

SEQ ID NO: 1921240 - RNA, 19 nt, Homo sapiens
agauguuuggaaaccacag

SEQ ID NO: 1921241 - RNA, 12 nt, Homo sapiens
aaacaaaccauc

SEQ ID NO: 1921242 - RNA, 15 nt, Homo sapiens
guaagcauaacuuau

SEQ ID NO: 1921243 - RNA, 17 nt, Homo sapiens
ggaccaggauacuggac

SEQ ID NO: 1921244 - RNA, 21 nt, Homo sapiens
gccccaggcucguggacugag

SEQ ID NO: 1921245 - RNA, 18 nt, Homo sapiens
gcgcaggggcugccgagu

SEQ ID NO: 1921246 - RNA, 21 nt, Homo sapiens
agucugcccuauggauuugaa

SEQ ID NO: 1921247 - RNA, 16 nt, Homo sapiens
cucucuuuaugcuugc

SEQ ID NO: 1921248 - RNA, 21 nt, Homo sapiens
ugcuccuguacuuguccucag

SEQ ID NO: 1921249 - RNA, 15 nt, Homo sapiens
auaucaaucucucuu

SEQ ID NO: 1921250 - RNA, 21 nt, Homo sapiens
cggccacccgccucccucuca

SEQ ID NO: 1921251 - RNA, 23 nt, Homo sapiens
gacacuuaguuauuuaccaaagc

SEQ ID NO: 1921252 - RNA, 14 nt, Homo sapiens
accgaugguccuca

SEQ ID NO: 1921253 - RNA, 21 nt, Homo sapiens
aggcuagaacacuacagggga

SEQ ID NO: 1921254 - RNA, 23 nt, Homo sapiens
uuccagggacaagcuuaggucau

SEQ ID NO: 1921255 - RNA, 13 nt, Homo sapiens
caccaccaaaauu

SEQ ID NO: 1921256 - RNA, 13 nt, Homo sapiens
acauuccacccca

SEQ ID NO: 1921257 - RNA, 21 nt, Homo sapiens
ggcuuuuccaaugaugaaaua

SEQ ID NO: 1921258 - RNA, 17 nt, Homo sapiens
gaaacuuuacaaccuga

SEQ ID NO: 1921259 - RNA, 22 nt, Homo sapiens
agagaaggcugugagccaagga

SEQ ID NO: 1921260 - RNA, 11 nt, Homo sapiens
gaagacauaaa

SEQ ID NO: 1921261 - RNA, 19 nt, Homo sapiens
uagcaguuuccucagugau

SEQ ID NO: 1921262 - RNA, 13 nt, Homo sapiens
gacugaagaccag

SEQ ID NO: 1921263 - RNA, 20 nt, Homo sapiens
uaagcaaaaucagaaguaua

SEQ ID NO: 1921264 - RNA, 18 nt, Homo sapiens
cauuuuguuuuuacugua

SEQ ID NO: 1921265 - RNA, 13 nt, Homo sapiens
caucuaagccuga

SEQ ID NO: 1921266 - RNA, 23 nt, Homo sapiens
augcuuauugaugagguuuauuc

SEQ ID NO: 1921267 - RNA, 13 nt, Homo sapiens
aucuucuacugua

SEQ ID NO: 1921268 - RNA, 22 nt, Homo sapiens
agagggaagugucaugcaagug

SEQ ID NO: 1921269 - RNA, 13 nt, Homo sapiens
agccaggagcaaa

SEQ ID NO: 1921270 - RNA, 21 nt, Homo sapiens
agaauggaggggacuccaaag

SEQ ID NO: 1921271 - RNA, 13 nt, Homo sapiens
agcaaggagcaca

SEQ ID NO: 1921272 - RNA, 14 nt, Homo sapiens
gcagccacccugcc

SEQ ID NO: 1921273 - RNA, 21 nt, Homo sapiens
ucccccucaauagaucuccag

SEQ ID NO: 1921274 - RNA, 18 nt, Homo sapiens
ccuccccaaauggcugcu

SEQ ID NO: 1921275 - RNA, 17 nt, Homo sapiens
uaaauuuuuauuacuua

SEQ ID NO: 1921276 - RNA, 20 nt, Homo sapiens
aguggguggcaggugggggu

SEQ ID NO: 1921277 - RNA, 17 nt, Homo sapiens
gauguauuucaucucaa

SEQ ID NO: 1921278 - RNA, 21 nt, Homo sapiens
ugaacgcacaugacauagcac

SEQ ID NO: 1921279 - RNA, 15 nt, Homo sapiens
agucuucuccaaugu

SEQ ID NO: 1921280 - RNA, 20 nt, Homo sapiens
acaaggcugggcaccucuag

SEQ ID NO: 1921281 - RNA, 12 nt, Homo sapiens
caaagugcaagg

SEQ ID NO: 1921282 - RNA, 14 nt, Homo sapiens
ccccauucugggac

SEQ ID NO: 1921283 - RNA, 23 nt, Homo sapiens
aaguaauuaucgggaacaguguu

SEQ ID NO: 1921284 - RNA, 16 nt, Homo sapiens
gugugaccauguucau

SEQ ID NO: 1921285 - RNA, 13 nt, Homo sapiens
ccuuugagggcag

SEQ ID NO: 1921286 - RNA, 17 nt, Homo sapiens
cguauguuuguacuugg

SEQ ID NO: 1921287 - RNA, 15 nt, Homo sapiens
ccuggcaaagcagca

SEQ ID NO: 1921288 - RNA, 16 nt, Homo sapiens
auuagcccaacuagaa

SEQ ID NO: 1921289 - RNA, 12 nt, Homo sapiens
cauuuuacugua

SEQ ID NO: 1921290 - RNA, 23 nt, Homo sapiens
gagggccauugaacucugagaga

SEQ ID NO: 1921291 - RNA, 20 nt, Homo sapiens
uaauuguuuaaaaaccgaau

SEQ ID NO: 1921292 - RNA, 18 nt, Homo sapiens
ccaaaggccaacagcauu

SEQ ID NO: 1921293 - RNA, 17 nt, Homo sapiens
uuaaacaaagcaguaua

SEQ ID NO: 1921294 - RNA, 19 nt, Homo sapiens
aaacaguaacuaagcacau

SEQ ID NO: 1921295 - RNA, 17 nt, Homo sapiens
acagacuaugucaccca

SEQ ID NO: 1921296 - RNA, 23 nt, Homo sapiens
cuaaacuccuuccuggccugaga

SEQ ID NO: 1921297 - RNA, 14 nt, Homo sapiens
caaccucugccucc

SEQ ID NO: 1921298 - RNA, 16 nt, Homo sapiens
aauaaaaagaucacuu

SEQ ID NO: 1921299 - RNA, 16 nt, Homo sapiens
gagaaauaaagcacau

SEQ ID NO: 1921300 - RNA, 22 nt, Homo sapiens
gccgauaucuucagaaaaccua

SEQ ID NO: 1921301 - RNA, 13 nt, Homo sapiens
cucuaucuuccuc

SEQ ID NO: 1921302 - RNA, 15 nt, Homo sapiens
ccugcuccugcagca

SEQ ID NO: 1921303 - RNA, 23 nt, Homo sapiens
gaucacagugaacuuaguccugu

SEQ ID NO: 1921304 - RNA, 20 nt, Homo sapiens
cuuguuuuauauaccuggcu

SEQ ID NO: 1921305 - RNA, 13 nt, Homo sapiens
ucaaaaagccaaa

SEQ ID NO: 1921306 - RNA, 18 nt, Homo sapiens
caaguagagaugaaguua

SEQ ID NO: 1921307 - RNA, 17 nt, Homo sapiens
acaucucaucaugucua

SEQ ID NO: 1921308 - RNA, 17 nt, Homo sapiens
auuucugaacuguuaca

SEQ ID NO: 1921309 - RNA, 16 nt, Homo sapiens
ugggacccuguugaug

SEQ ID NO: 1921310 - RNA, 14 nt, Homo sapiens
gugcugguuuauuu

SEQ ID NO: 1921311 - RNA, 12 nt, Homo sapiens
gugaacuuguag

SEQ ID NO: 1921312 - RNA, 22 nt, Homo sapiens
ucagaguuuguguguauuugua

SEQ ID NO: 1921313 - RNA, 22 nt, Homo sapiens
accuggagggaaugaaccugga

SEQ ID NO: 1921314 - RNA, 11 nt, Homo sapiens
aaaugagccac

SEQ ID NO: 1921315 - RNA, 18 nt, Homo sapiens
gcugccccuacugcaaau

SEQ ID NO: 1921316 - RNA, 22 nt, Homo sapiens
cccucuugauguggugaggcag

SEQ ID NO: 1921317 - RNA, 21 nt, Homo sapiens
uggacccaccuguggggccug

SEQ ID NO: 1921318 - RNA, 16 nt, Homo sapiens
ugcccacuauggucau

SEQ ID NO: 1921319 - RNA, 16 nt, Homo sapiens
guaauaauucuaugca

SEQ ID NO: 1921320 - RNA, 15 nt, Homo sapiens
acugauuacacugag

SEQ ID NO: 1921321 - RNA, 18 nt, Homo sapiens
acagugcuugauacagga

SEQ ID NO: 1921322 - RNA, 19 nt, Homo sapiens
guuucuccuuaguuggcug

SEQ ID NO: 1921323 - RNA, 23 nt, Homo sapiens
gcagaggcuccgcggcaggagga

SEQ ID NO: 1921324 - RNA, 17 nt, Homo sapiens
auaaugcaugaugaacu

SEQ ID NO: 1921325 - RNA, 16 nt, Homo sapiens
gucugagacuccucau

SEQ ID NO: 1921326 - RNA, 16 nt, Homo sapiens
gaccucaucacugaga

SEQ ID NO: 1921327 - RNA, 16 nt, Homo sapiens
cuggcggguggcugca

SEQ ID NO: 1921328 - RNA, 13 nt, Homo sapiens
cuggugcaaagau

SEQ ID NO: 1921329 - RNA, 15 nt, Homo sapiens
ccugcuguccguccc

SEQ ID NO: 1921330 - RNA, 20 nt, Homo sapiens
gcccagaaaacugucauuua

SEQ ID NO: 1921331 - RNA, 21 nt, Homo sapiens
cuguggagaucagaaagugac

SEQ ID NO: 1921332 - RNA, 15 nt, Homo sapiens
cuuauccuguucucu

SEQ ID NO: 1921333 - RNA, 23 nt, Homo sapiens
ucaccuccggucgugucucuggu

SEQ ID NO: 1921334 - RNA, 16 nt, Homo sapiens
acugcaaaguguaugc

SEQ ID NO: 1921335 - RNA, 14 nt, Homo sapiens
caaauacaugcaca

SEQ ID NO: 1921336 - RNA, 20 nt, Homo sapiens
caccuguucauuugaagaaa

SEQ ID NO: 1921337 - RNA, 23 nt, Homo sapiens
aaacgcaccaaucagcacucugu

SEQ ID NO: 1921338 - RNA, 13 nt, Homo sapiens
gugagaaggcaac

SEQ ID NO: 1921339 - RNA, 19 nt, Homo sapiens
gaacugcaggugacuuugg

SEQ ID NO: 1921340 - RNA, 22 nt, Homo sapiens
uauuuuagacacuucccugcau

SEQ ID NO: 1921341 - RNA, 20 nt, Homo sapiens
cucauguuccuuuugaaauu

SEQ ID NO: 1921342 - RNA, 15 nt, Homo sapiens
aaugacccugucaag

SEQ ID NO: 1921343 - RNA, 23 nt, Homo sapiens
auguuaaaauagacuaaccucua

SEQ ID NO: 1921344 - RNA, 16 nt, Homo sapiens
guggaaugagugugca

SEQ ID NO: 1921345 - RNA, 18 nt, Homo sapiens
gugaaaucaauguguaca

SEQ ID NO: 1921346 - RNA, 19 nt, Homo sapiens
aagagugaaaaagagaaua

SEQ ID NO: 1921347 - RNA, 12 nt, Homo sapiens
ugguuuuacuac

SEQ ID NO: 1921348 - RNA, 15 nt, Homo sapiens
auacauuagugccau

SEQ ID NO: 1921349 - RNA, 15 nt, Homo sapiens
uccuauaauuuugau

SEQ ID NO: 1921350 - RNA, 18 nt, Homo sapiens
caacucacgggugcauga

SEQ ID NO: 1921351 - RNA, 13 nt, Homo sapiens
ugucauucuagaa

SEQ ID NO: 1921352 - RNA, 15 nt, Homo sapiens
uucugucagaaucac

SEQ ID NO: 1921353 - RNA, 16 nt, Homo sapiens
ccuaugacacagaagc

SEQ ID NO: 1921354 - RNA, 20 nt, Homo sapiens
uuagaacugucaagauguca

SEQ ID NO: 1921355 - RNA, 14 nt, Homo sapiens
ugcacaagugugca

SEQ ID NO: 1921356 - RNA, 19 nt, Homo sapiens
caggcauucagguugcuug

SEQ ID NO: 1921357 - RNA, 15 nt, Homo sapiens
uucaugaguauucau

SEQ ID NO: 1921358 - RNA, 17 nt, Homo sapiens
uggcaguuugaagucaa

SEQ ID NO: 1921359 - RNA, 16 nt, Homo sapiens
ucauccccaccugucu

SEQ ID NO: 1921360 - RNA, 13 nt, Homo sapiens
aauguuuucauac

SEQ ID NO: 1921361 - RNA, 20 nt, Homo sapiens
acaugcgaccgugaccagga

SEQ ID NO: 1921362 - RNA, 12 nt, Homo sapiens
ugucugagacag

SEQ ID NO: 1921363 - RNA, 23 nt, Homo sapiens
aagauuauuuuuuaaaaagguaa

SEQ ID NO: 1921364 - RNA, 18 nt, Homo sapiens
aauguuagauaguuacua

SEQ ID NO: 1921365 - RNA, 17 nt, Homo sapiens
gcccuucaaugcugcag

SEQ ID NO: 1921366 - RNA, 12 nt, Homo sapiens
gccggguacuga

SEQ ID NO: 1921367 - RNA, 22 nt, Homo sapiens
ugcccagcuuggagugccacau

SEQ ID NO: 1921368 - RNA, 20 nt, Homo sapiens
gaucacauguggacuuuuau

SEQ ID NO: 1921369 - RNA, 21 nt, Homo sapiens
ugucuccacccguguccagca

SEQ ID NO: 1921370 - RNA, 21 nt, Homo sapiens
gauucacaaugaaaugcucuc

SEQ ID NO: 1921371 - RNA, 11 nt, Homo sapiens
ugcgucacugu

SEQ ID NO: 1921372 - RNA, 20 nt, Homo sapiens
gauaagaacagagugccugc

SEQ ID NO: 1921373 - RNA, 16 nt, Homo sapiens
acguuguaaugcacac

SEQ ID NO: 1921374 - RNA, 21 nt, Homo sapiens
cuuaaguguaaauaauauaaa

SEQ ID NO: 1921375 - RNA, 21 nt, Homo sapiens
ucauggcucugaacugcacaa

SEQ ID NO: 1921376 - RNA, 13 nt, Homo sapiens
uagucccagcacu

SEQ ID NO: 1921377 - RNA, 18 nt, Homo sapiens
cuagagccgugaugccuc

SEQ ID NO: 1921378 - RNA, 12 nt, Homo sapiens
uucccaguguuc

SEQ ID NO: 1921379 - RNA, 17 nt, Homo sapiens
aagacaucuguggccaa

SEQ ID NO: 1921380 - RNA, 23 nt, Homo sapiens
uacuguagaacugcaauuuccau

SEQ ID NO: 1921381 - RNA, 15 nt, Homo sapiens
ccuuuuuuauauaca

SEQ ID NO: 1921382 - RNA, 14 nt, Homo sapiens
agguuaagggguga

SEQ ID NO: 1921383 - RNA, 21 nt, Homo sapiens
cggcagcgggcggaggggauc

SEQ ID NO: 1921384 - RNA, 9 nt, Homo sapiens
uccaucucu

SEQ ID NO: 1921385 - RNA, 20 nt, Homo sapiens
cagaugacccccaucccuca

SEQ ID NO: 1921386 - RNA, 18 nt, Homo sapiens
uuuuccuguucagugaga

SEQ ID NO: 1921387 - RNA, 14 nt, Homo sapiens
agaaucaagucugu

SEQ ID NO: 1921388 - RNA, 17 nt, Homo sapiens
uaggaaagaugagaaau

SEQ ID NO: 1921389 - RNA, 23 nt, Homo sapiens
agauccuuuuuuacgcuuugcag

SEQ ID NO: 1921390 - RNA, 19 nt, Homo sapiens
ucccccaccgguccagcug

SEQ ID NO: 1921391 - RNA, 20 nt, Homo sapiens
agcucugaaaccaguguuag

SEQ ID NO: 1921392 - RNA, 18 nt, Homo sapiens
cuggugccucugugcaca

SEQ ID NO: 1921393 - RNA, 14 nt, Homo sapiens
uaauucugaugcua

SEQ ID NO: 1921394 - RNA, 21 nt, Homo sapiens
cucacugccugcagcugagau

SEQ ID NO: 1921395 - RNA, 10 nt, Homo sapiens
gucacuggaa

SEQ ID NO: 1921396 - RNA, 15 nt, Homo sapiens
cccaccugguacuga

SEQ ID NO: 1921397 - RNA, 17 nt, Homo sapiens
agugccuauaaccaugu

SEQ ID NO: 1921398 - RNA, 10 nt, Homo sapiens
uuuguugcac

SEQ ID NO: 1921399 - RNA, 13 nt, Homo sapiens
ugaagaaaagggg

SEQ ID NO: 1921400 - RNA, 18 nt, Homo sapiens
aucugcauuuucacccca

SEQ ID NO: 1921401 - RNA, 21 nt, Homo sapiens
acugaaacuguaugugcugua

SEQ ID NO: 1921402 - RNA, 20 nt, Homo sapiens
cagaaagaauaaaauaggaa

SEQ ID NO: 1921403 - RNA, 19 nt, Homo sapiens
ugugguuacuaguacaggu

SEQ ID NO: 1921404 - RNA, 13 nt, Homo sapiens
gucacagggccaa

SEQ ID NO: 1921405 - RNA, 13 nt, Homo sapiens
gcagcaggguaga

SEQ ID NO: 1921406 - RNA, 20 nt, Homo sapiens
guccuggugccuaucugccu

SEQ ID NO: 1921407 - RNA, 14 nt, Homo sapiens
ucugaugucuccac

SEQ ID NO: 1921408 - RNA, 16 nt, Homo sapiens
uccagcgguugccuuu

SEQ ID NO: 1921409 - RNA, 17 nt, Homo sapiens
uuucaauaaaccuaaua

SEQ ID NO: 1921410 - RNA, 14 nt, Homo sapiens
gucuccacugggga

SEQ ID NO: 1921411 - RNA, 19 nt, Homo sapiens
uauuuaugagaucacugaa

SEQ ID NO: 1921412 - RNA, 23 nt, Homo sapiens
uucauuaauuaguuccaguuucu

SEQ ID NO: 1921413 - RNA, 19 nt, Homo sapiens
agaguaacagucaucauuu

SEQ ID NO: 1921414 - RNA, 14 nt, Homo sapiens
uaauugcuugacaa

SEQ ID NO: 1921415 - RNA, 17 nt, Homo sapiens
acuaaucaauacuuuga

SEQ ID NO: 1921416 - RNA, 17 nt, Homo sapiens
cagaagggaaauuucaa

SEQ ID NO: 1921417 - RNA, 18 nt, Homo sapiens
cauguacccuaaaacuua

SEQ ID NO: 1921418 - RNA, 14 nt, Homo sapiens
auagaugcacuuau

SEQ ID NO: 1921419 - RNA, 19 nt, Homo sapiens
gcacuaucuuucaggaaau

SEQ ID NO: 1921420 - RNA, 14 nt, Homo sapiens
gcuaaaacuggccc

SEQ ID NO: 1921421 - RNA, 9 nt, Homo sapiens
gaaggggag

SEQ ID NO: 1921422 - RNA, 16 nt, Homo sapiens
aaaaauucacacugcc

SEQ ID NO: 1921423 - RNA, 18 nt, Homo sapiens
gucuccuuugcacugagg

SEQ ID NO: 1921424 - RNA, 19 nt, Homo sapiens
cccugcuccucccuggcug

SEQ ID NO: 1921425 - RNA, 16 nt, Homo sapiens
cuuaaguccagcucau

SEQ ID NO: 1921426 - RNA, 18 nt, Homo sapiens
guuggaugggagugggca

SEQ ID NO: 1921427 - RNA, 22 nt, Homo sapiens
gaucaagcugugagacaguggg

SEQ ID NO: 1921428 - RNA, 22 nt, Homo sapiens
uaugcaauaaauaacagugcaa

SEQ ID NO: 1921429 - RNA, 15 nt, Homo sapiens
uggaggaacagggcu

SEQ ID NO: 1921430 - RNA, 14 nt, Homo sapiens
acagaucaguuuuc

SEQ ID NO: 1921431 - RNA, 15 nt, Homo sapiens
ccugaaacauugcau

SEQ ID NO: 1921432 - RNA, 11 nt, Homo sapiens
caaaauaugaa

SEQ ID NO: 1921433 - RNA, 21 nt, Homo sapiens
cagaccagaccccaaaccagc

SEQ ID NO: 1921434 - RNA, 24 nt, Homo sapiens
gcccagaauucugggcaagucacc

SEQ ID NO: 1921435 - RNA, 20 nt, Homo sapiens
uaauaccaggaacccagcgg

SEQ ID NO: 1921436 - RNA, 16 nt, Homo sapiens
uggccaaggagcugcu

SEQ ID NO: 1921437 - RNA, 13 nt, Homo sapiens
aacaagccuaaaa

SEQ ID NO: 1921438 - RNA, 22 nt, Homo sapiens
cucggcauucacacacagccug

SEQ ID NO: 1921439 - RNA, 19 nt, Homo sapiens
auuuacuuuucaagcuaua

SEQ ID NO: 1921440 - RNA, 18 nt, Homo sapiens
cuuuggguuuuuaacuca

SEQ ID NO: 1921441 - RNA, 16 nt, Homo sapiens
uuuucacgcaggucau

SEQ ID NO: 1921442 - RNA, 18 nt, Homo sapiens
gcauaauaaaaaggcaau

SEQ ID NO: 1921443 - RNA, 23 nt, Homo sapiens
caaguuccccaucccugucauuu

SEQ ID NO: 1921444 - RNA, 17 nt, Homo sapiens
cccuucuuuacuuccca

SEQ ID NO: 1921445 - RNA, 23 nt, Homo sapiens
gucauuauucucugaacaauaca

SEQ ID NO: 1921446 - RNA, 14 nt, Homo sapiens
ugaaugcaugaccu

SEQ ID NO: 1921447 - RNA, 22 nt, Homo sapiens
caucugucagcuucccaacaau

SEQ ID NO: 1921448 - RNA, 14 nt, Homo sapiens
acccagcucacagg

SEQ ID NO: 1921449 - RNA, 22 nt, Homo sapiens
gaaugaaugucagugugacuga

SEQ ID NO: 1921450 - RNA, 13 nt, Homo sapiens
cuaaucuguaauc

SEQ ID NO: 1921451 - RNA, 16 nt, Homo sapiens
aauauugcaguucaua

SEQ ID NO: 1921452 - RNA, 9 nt, Homo sapiens
ccuaaccac

SEQ ID NO: 1921453 - RNA, 19 nt, Homo sapiens
gaaauaaagagcuguuaua

SEQ ID NO: 1921454 - RNA, 14 nt, Homo sapiens
cccaggccaucacc

SEQ ID NO: 1921455 - RNA, 16 nt, Homo sapiens
cucaagaugaaggcaa

SEQ ID NO: 1921456 - RNA, 21 nt, Homo sapiens
ccucucuaggccuguugccuc

SEQ ID NO: 1921457 - RNA, 17 nt, Homo sapiens
gucaggcuggucucaaa

SEQ ID NO: 1921458 - RNA, 22 nt, Homo sapiens
cugaacugugaacccuugugcc

SEQ ID NO: 1921459 - RNA, 11 nt, Homo sapiens
ccagguccuuu

SEQ ID NO: 1921460 - RNA, 12 nt, Homo sapiens
cuccucuauucc

SEQ ID NO: 1921461 - RNA, 17 nt, Homo sapiens
ucacauuggagucacug

SEQ ID NO: 1921462 - RNA, 22 nt, Homo sapiens
gcacugaaggcuuucagggccu

SEQ ID NO: 1921463 - RNA, 19 nt, Homo sapiens
gagaguucuuuuuugcuua

SEQ ID NO: 1921464 - RNA, 22 nt, Homo sapiens
cccagggacugcaaguggccau

SEQ ID NO: 1921465 - RNA, 18 nt, Homo sapiens
caggggucgucaccaccu

SEQ ID NO: 1921466 - RNA, 13 nt, Homo sapiens
cuaagucauucau

SEQ ID NO: 1921467 - RNA, 12 nt, Homo sapiens
aauaacuaauac

SEQ ID NO: 1921468 - RNA, 17 nt, Homo sapiens
uguccucccuuguggcu

SEQ ID NO: 1921469 - RNA, 9 nt, Homo sapiens
auacuuguc

SEQ ID NO: 1921470 - RNA, 21 nt, Homo sapiens
uuauaucagcagacacuccag

SEQ ID NO: 1921471 - RNA, 19 nt, Homo sapiens
ucuucuccaacaccaccuc

SEQ ID NO: 1921472 - RNA, 15 nt, Homo sapiens
gaagaggagaacaaa

SEQ ID NO: 1921473 - RNA, 14 nt, Homo sapiens
gugucauaccagaa

SEQ ID NO: 1921474 - RNA, 20 nt, Homo sapiens
ggccucaagggaugucucac

SEQ ID NO: 1921475 - RNA, 18 nt, Homo sapiens
gccuggcacaggacugau

SEQ ID NO: 1921476 - RNA, 18 nt, Homo sapiens
gagaaaauccaggucaug

SEQ ID NO: 1921477 - RNA, 14 nt, Homo sapiens
cgcaucauaugcag

SEQ ID NO: 1921478 - RNA, 17 nt, Homo sapiens
ccuugaccucauuuaca

SEQ ID NO: 1921479 - RNA, 16 nt, Homo sapiens
agaaaaaacacacucc

SEQ ID NO: 1921480 - RNA, 21 nt, Homo sapiens
cgggguggugcaggcucccaa

SEQ ID NO: 1921481 - RNA, 17 nt, Homo sapiens
cuaauucuaugauuaaa

SEQ ID NO: 1921482 - RNA, 17 nt, Homo sapiens
ggaaggcuucuguguca

SEQ ID NO: 1921483 - RNA, 17 nt, Homo sapiens
ccaauaaaggucccuua

SEQ ID NO: 1921484 - RNA, 20 nt, Homo sapiens
aucccagcaagcgagcuuua

SEQ ID NO: 1921485 - RNA, 23 nt, Homo sapiens
ucugaaggcucguuuggcuuuau

SEQ ID NO: 1921486 - RNA, 17 nt, Homo sapiens
auaaugcaauggaagaa

SEQ ID NO: 1921487 - RNA, 21 nt, Homo sapiens
ucacccagggcccccaaagag

SEQ ID NO: 1921488 - RNA, 22 nt, Homo sapiens
auuacuuuugcuguaauguuaa

SEQ ID NO: 1921489 - RNA, 23 nt, Homo sapiens
ccagggacccaggugugccugug

SEQ ID NO: 1921490 - RNA, 17 nt, Homo sapiens
ggacgacgaugacaaug

SEQ ID NO: 1921491 - RNA, 19 nt, Homo sapiens
acaauuccuccucuggcca

SEQ ID NO: 1921492 - RNA, 17 nt, Homo sapiens
uggccagccagugccau

SEQ ID NO: 1921493 - RNA, 19 nt, Homo sapiens
auaauguuaguagcacuga

SEQ ID NO: 1921494 - RNA, 17 nt, Homo sapiens
cuuuuucuuuaccucca

SEQ ID NO: 1921495 - RNA, 16 nt, Homo sapiens
acgucucaagacugaa

SEQ ID NO: 1921496 - RNA, 15 nt, Homo sapiens
cagauguuuaaugaa

SEQ ID NO: 1921497 - RNA, 23 nt, Homo sapiens
auccaaaaauguguaagaacaac

SEQ ID NO: 1921498 - RNA, 16 nt, Homo sapiens
ugaaggacaugagacu

SEQ ID NO: 1921499 - RNA, 19 nt, Homo sapiens
aucuuccccaagagggacu

SEQ ID NO: 1921500 - RNA, 15 nt, Homo sapiens
agcacccguugaguc

SEQ ID NO: 1921501 - RNA, 14 nt, Homo sapiens
auagaaaggaauuu

SEQ ID NO: 1921502 - RNA, 15 nt, Homo sapiens
cuuuuaaucagugaa

SEQ ID NO: 1921503 - RNA, 22 nt, Homo sapiens
auuccccucgugugacucucuu

SEQ ID NO: 1921504 - RNA, 23 nt, Homo sapiens
augaaauacuuuauagcacaugg

SEQ ID NO: 1921505 - RNA, 19 nt, Homo sapiens
auuuguaaugagcaccugg

SEQ ID NO: 1921506 - RNA, 13 nt, Homo sapiens
ucaauaggcaaag

SEQ ID NO: 1921507 - RNA, 14 nt, Homo sapiens
aagcccggauccca

SEQ ID NO: 1921508 - RNA, 19 nt, Homo sapiens
agucucccuggccuaggca

SEQ ID NO: 1921509 - RNA, 19 nt, Homo sapiens
aguggcaggugggcugccu

SEQ ID NO: 1921510 - RNA, 17 nt, Homo sapiens
cccggagagguaacuga

SEQ ID NO: 1921511 - RNA, 21 nt, Homo sapiens
gaauccaggaggcaguggaca

SEQ ID NO: 1921512 - RNA, 21 nt, Homo sapiens
gaucaucuccaaaucuugcca

SEQ ID NO: 1921513 - RNA, 23 nt, Homo sapiens
agaaaucuuuauuaauguuuaga

SEQ ID NO: 1921514 - RNA, 15 nt, Homo sapiens
caugucucaauagua

SEQ ID NO: 1921515 - RNA, 19 nt, Homo sapiens
uucuuuaaaauucacuaau

SEQ ID NO: 1921516 - RNA, 12 nt, Homo sapiens
uuuagucacuaa

SEQ ID NO: 1921517 - RNA, 15 nt, Homo sapiens
cuuuuauacauuuua

SEQ ID NO: 1921518 - RNA, 16 nt, Homo sapiens
uuuagaaaugauuuca

SEQ ID NO: 1921519 - RNA, 19 nt, Homo sapiens
aggagauaaauauuuugca

SEQ ID NO: 1921520 - RNA, 18 nt, Homo sapiens
cacacacgaugcauuuaa

SEQ ID NO: 1921521 - RNA, 15 nt, Homo sapiens
auucauuuaacagag

SEQ ID NO: 1921522 - RNA, 15 nt, Homo sapiens
agggaaugccaggga

SEQ ID NO: 1921523 - RNA, 14 nt, Homo sapiens
uaucaauuaccaca

SEQ ID NO: 1921524 - RNA, 19 nt, Homo sapiens
gaccugcagcgggcaaaga

SEQ ID NO: 1921525 - RNA, 15 nt, Homo sapiens
cuaauuccacacccc

SEQ ID NO: 1921526 - RNA, 20 nt, Homo sapiens
auuaauaccacuacccguga

SEQ ID NO: 1921527 - RNA, 16 nt, Homo sapiens
agccaccuccuuggca

SEQ ID NO: 1921528 - RNA, 14 nt, Homo sapiens
uucuauacauucua

SEQ ID NO: 1921529 - RNA, 14 nt, Homo sapiens
ugcuauacagucua

SEQ ID NO: 1921530 - RNA, 16 nt, Homo sapiens
gaguuuuuaaagccuu

SEQ ID NO: 1921531 - RNA, 10 nt, Homo sapiens
guaaacugua

SEQ ID NO: 1921532 - RNA, 23 nt, Homo sapiens
uguaacagcggcaggguguccca

SEQ ID NO: 1921533 - RNA, 12 nt, Homo sapiens
agcauugcacuu

SEQ ID NO: 1921534 - RNA, 12 nt, Homo sapiens
ugcauugcucuu

SEQ ID NO: 1921535 - RNA, 13 nt, Homo sapiens
cuagccaauucac

SEQ ID NO: 1921536 - RNA, 16 nt, Homo sapiens
acagcuuggcacuuua

SEQ ID NO: 1921537 - RNA, 20 nt, Homo sapiens
gaacaaaucauuauguuucc

SEQ ID NO: 1921538 - RNA, 20 nt, Homo sapiens
uccaggguugaaucuugucc

SEQ ID NO: 1921539 - RNA, 19 nt, Homo sapiens
gggaguccuugcgucccau

SEQ ID NO: 1921540 - RNA, 20 nt, Homo sapiens
uggaaggcugcuuucuccuu

SEQ ID NO: 1921541 - RNA, 14 nt, Homo sapiens
agggagaccaugcc

SEQ ID NO: 1921542 - RNA, 19 nt, Homo sapiens
aauuguuuaagaaucaugg

SEQ ID NO: 1921543 - RNA, 13 nt, Homo sapiens
uucuucuauaaau

SEQ ID NO: 1921544 - RNA, 23 nt, Homo sapiens
uguuuauuccaaaugccauccag

SEQ ID NO: 1921545 - RNA, 15 nt, Homo sapiens
auaacauuuuauaca

SEQ ID NO: 1921546 - RNA, 23 nt, Homo sapiens
caagagcucuucaucugcuacaa

SEQ ID NO: 1921547 - RNA, 22 nt, Homo sapiens
uccugggccucagcaagccaug

SEQ ID NO: 1921548 - RNA, 12 nt, Homo sapiens
ucuuuucaaaag

SEQ ID NO: 1921549 - RNA, 21 nt, Homo sapiens
cuugccuaaauuuaaugcugc

SEQ ID NO: 1921550 - RNA, 20 nt, Homo sapiens
cuuccuuaaagcauuugcaa

SEQ ID NO: 1921551 - RNA, 16 nt, Homo sapiens
aagaaauuucucauga

SEQ ID NO: 1921552 - RNA, 20 nt, Homo sapiens
aaacccucagcacuguuaca

SEQ ID NO: 1921553 - RNA, 16 nt, Homo sapiens
uagguguguccacaga

SEQ ID NO: 1921554 - RNA, 23 nt, Homo sapiens
gcugagggaggcagaaagggaaa

SEQ ID NO: 1921555 - RNA, 20 nt, Homo sapiens
acuuaucaccacaccacugc

SEQ ID NO: 1921556 - RNA, 20 nt, Homo sapiens
ccagaaccaacugcauuggu

SEQ ID NO: 1921557 - RNA, 16 nt, Homo sapiens
auuaggaaauucugau

SEQ ID NO: 1921558 - RNA, 11 nt, Homo sapiens
gaaaggccagu

SEQ ID NO: 1921559 - RNA, 23 nt, Homo sapiens
agcauccccagccacaacugcca

SEQ ID NO: 1921560 - RNA, 13 nt, Homo sapiens
gaaggaucaucug

SEQ ID NO: 1921561 - RNA, 20 nt, Homo sapiens
aacaugaaaaacaggugaca

SEQ ID NO: 1921562 - RNA, 14 nt, Homo sapiens
uccaagggacccuu

SEQ ID NO: 1921563 - RNA, 16 nt, Homo sapiens
caggauauugacaaga

SEQ ID NO: 1921564 - RNA, 16 nt, Homo sapiens
cuauuucgcacuguau

SEQ ID NO: 1921565 - RNA, 17 nt, Homo sapiens
cagucuucugacuguca

SEQ ID NO: 1921566 - RNA, 21 nt, Homo sapiens
gaggcaggaggaucacaguga

SEQ ID NO: 1921567 - RNA, 12 nt, Homo sapiens
guauacauuuag

SEQ ID NO: 1921568 - RNA, 12 nt, Homo sapiens
auguaaauacca

SEQ ID NO: 1921569 - RNA, 14 nt, Homo sapiens
gcgacagagccaga

SEQ ID NO: 1921570 - RNA, 18 nt, Homo sapiens
cucaagcagcaaaauccu

SEQ ID NO: 1921571 - RNA, 14 nt, Homo sapiens
cauuaaucuaagaa

SEQ ID NO: 1921572 - RNA, 21 nt, Homo sapiens
cuauugcagaaugaagccauu

SEQ ID NO: 1921573 - RNA, 18 nt, Homo sapiens
gaacaagcccaacaguaa

SEQ ID NO: 1921574 - RNA, 12 nt, Homo sapiens
cccugugccugg

SEQ ID NO: 1921575 - RNA, 17 nt, Homo sapiens
augucaagauucagcua

SEQ ID NO: 1921576 - RNA, 13 nt, Homo sapiens
caacacagaggaa

SEQ ID NO: 1921577 - RNA, 14 nt, Homo sapiens
auaacaucacuguc

SEQ ID NO: 1921578 - RNA, 12 nt, Homo sapiens
auaaauaaccaa

SEQ ID NO: 1921579 - RNA, 20 nt, Homo sapiens
uuugucuuuuuucuauguaa

SEQ ID NO: 1921580 - RNA, 19 nt, Homo sapiens
cucagccuuuagggcuuau

SEQ ID NO: 1921581 - RNA, 23 nt, Homo sapiens
cacagacuggcaauaaacuccua

SEQ ID NO: 1921582 - RNA, 20 nt, Homo sapiens
guggguauagcucaggguaa

SEQ ID NO: 1921583 - RNA, 15 nt, Homo sapiens
accgagagccaaaca

SEQ ID NO: 1921584 - RNA, 20 nt, Homo sapiens
ucuggauuucauccuugacc

SEQ ID NO: 1921585 - RNA, 19 nt, Homo sapiens
cccagagaacaagcacugu

SEQ ID NO: 1921586 - RNA, 13 nt, Homo sapiens
aaauaaugcacug

SEQ ID NO: 1921587 - RNA, 15 nt, Homo sapiens
agggaugcugcaaug

SEQ ID NO: 1921588 - RNA, 13 nt, Homo sapiens
gcuggucuugggg

SEQ ID NO: 1921589 - RNA, 17 nt, Homo sapiens
aacauuuaacuagccuu

SEQ ID NO: 1921590 - RNA, 16 nt, Homo sapiens
agcugggaccacaagu

SEQ ID NO: 1921591 - RNA, 23 nt, Homo sapiens
caugaccugaagccccucccuga

SEQ ID NO: 1921592 - RNA, 13 nt, Homo sapiens
ugucugccaaaca

SEQ ID NO: 1921593 - RNA, 20 nt, Homo sapiens
cuggcagagagcacagugau

SEQ ID NO: 1921594 - RNA, 19 nt, Homo sapiens
gaggcgugggauccagaga

SEQ ID NO: 1921595 - RNA, 20 nt, Homo sapiens
guuuaaagaaacaauacaaa

SEQ ID NO: 1921596 - RNA, 20 nt, Homo sapiens
acagaugccauggccugugc

SEQ ID NO: 1921597 - RNA, 13 nt, Homo sapiens
cagaguucuggga

SEQ ID NO: 1921598 - RNA, 16 nt, Homo sapiens
aguacagccuggacca

SEQ ID NO: 1921599 - RNA, 22 nt, Homo sapiens
gaaaggagaacuauccaaaacu

SEQ ID NO: 1921600 - RNA, 22 nt, Homo sapiens
ugcccaggagcggcgaugcacu

SEQ ID NO: 1921601 - RNA, 15 nt, Homo sapiens
cuuuagaauauauca

SEQ ID NO: 1921602 - RNA, 16 nt, Homo sapiens
ccuggagaaggguuca

SEQ ID NO: 1921603 - RNA, 23 nt, Homo sapiens
uggccaagaagauaggcucucag

SEQ ID NO: 1921604 - RNA, 21 nt, Homo sapiens
ccguugaggcgguuuccugaa

SEQ ID NO: 1921605 - RNA, 22 nt, Homo sapiens
aaccuguaagcccagcauuuga

SEQ ID NO: 1921606 - RNA, 23 nt, Homo sapiens
gggaucuuccuugggaugaucuu

SEQ ID NO: 1921607 - RNA, 22 nt, Homo sapiens
uccuuucuuuugaaaugccacg

SEQ ID NO: 1921608 - RNA, 15 nt, Homo sapiens
aucuucuaauuccaa

SEQ ID NO: 1921609 - RNA, 17 nt, Homo sapiens
gccagauggacuccagc

SEQ ID NO: 1921610 - RNA, 18 nt, Homo sapiens
gaggaguggauuccuccc

SEQ ID NO: 1921611 - RNA, 21 nt, Homo sapiens
agauuuacaucccagacacau

SEQ ID NO: 1921612 - RNA, 17 nt, Homo sapiens
acugagggacucugaag

SEQ ID NO: 1921613 - RNA, 15 nt, Homo sapiens
ugccucagcuucccc

SEQ ID NO: 1921614 - RNA, 14 nt, Homo sapiens
guuaacacauggcu

SEQ ID NO: 1921615 - RNA, 15 nt, Homo sapiens
cugcaguuccaucag

SEQ ID NO: 1921616 - RNA, 20 nt, Homo sapiens
acuaaguacuugcucucuga

SEQ ID NO: 1921617 - RNA, 21 nt, Homo sapiens
gcucaccuuuaucaccucauu

SEQ ID NO: 1921618 - RNA, 11 nt, Homo sapiens
acuggagucag

SEQ ID NO: 1921619 - RNA, 19 nt, Homo sapiens
gacugcauugccgcuguau

SEQ ID NO: 1921620 - RNA, 18 nt, Homo sapiens
auaaaucugacccagugc

SEQ ID NO: 1921621 - RNA, 21 nt, Homo sapiens
aauuauacuguagcugaugaa

SEQ ID NO: 1921622 - RNA, 18 nt, Homo sapiens
ccuggaauugcagcugua

SEQ ID NO: 1921623 - RNA, 22 nt, Homo sapiens
agucauccccuugggcucucac

SEQ ID NO: 1921624 - RNA, 13 nt, Homo sapiens
guucgcuuaucaa

SEQ ID NO: 1921625 - RNA, 16 nt, Homo sapiens
uagcacagguuagggu

SEQ ID NO: 1921626 - RNA, 12 nt, Homo sapiens
ccacucaccaac

SEQ ID NO: 1921627 - RNA, 14 nt, Homo sapiens
aagggacucugggc

SEQ ID NO: 1921628 - RNA, 19 nt, Homo sapiens
uuccuucagacagauucca

SEQ ID NO: 1921629 - RNA, 20 nt, Homo sapiens
ccugguggcaagagggaaug

SEQ ID NO: 1921630 - RNA, 16 nt, Homo sapiens
ucauaccaucugcugc

SEQ ID NO: 1921631 - RNA, 21 nt, Homo sapiens
ggcauugugagaauguaacuu

SEQ ID NO: 1921632 - RNA, 17 nt, Homo sapiens
uccauugguguugacau

SEQ ID NO: 1921633 - RNA, 19 nt, Homo sapiens
cuucccaaaugugugccca

SEQ ID NO: 1921634 - RNA, 11 nt, Homo sapiens
gaguagcucag

SEQ ID NO: 1921635 - RNA, 16 nt, Homo sapiens
agauaaaaacaauaua

SEQ ID NO: 1921636 - RNA, 12 nt, Homo sapiens
uuggcacacuug

SEQ ID NO: 1921637 - RNA, 17 nt, Homo sapiens
cucagagcagaguauua

SEQ ID NO: 1921638 - RNA, 19 nt, Homo sapiens
caugguuacaaacuacaga

SEQ ID NO: 1921639 - RNA, 20 nt, Homo sapiens
ccaggucguccaagcaaaaa

SEQ ID NO: 1921640 - RNA, 11 nt, Homo sapiens
guuaacuuaau

SEQ ID NO: 1921641 - RNA, 19 nt, Homo sapiens
cacccugccacucuugaca

SEQ ID NO: 1921642 - RNA, 21 nt, Homo sapiens
augcuacugaaacuuaccuga

SEQ ID NO: 1921643 - RNA, 15 nt, Homo sapiens
ugggaaauucuugca

SEQ ID NO: 1921644 - RNA, 19 nt, Homo sapiens
ggggucggguccaccauga

SEQ ID NO: 1921645 - RNA, 21 nt, Homo sapiens
ggcugauuuguuugugauguu

SEQ ID NO: 1921646 - RNA, 12 nt, Homo sapiens
uauguugucaua

SEQ ID NO: 1921647 - RNA, 21 nt, Homo sapiens
guuguauucuccuuugcacug

SEQ ID NO: 1921648 - RNA, 12 nt, Homo sapiens
cauuugugauau

SEQ ID NO: 1921649 - RNA, 18 nt, Homo sapiens
caauaaaggcagcugccu

SEQ ID NO: 1921650 - RNA, 17 nt, Homo sapiens
cagccugucagauccag

SEQ ID NO: 1921651 - RNA, 22 nt, Homo sapiens
caagugaaaagcaggcaaaaga

SEQ ID NO: 1921652 - RNA, 22 nt, Homo sapiens
cuucagcccucaccccugguuc

SEQ ID NO: 1921653 - RNA, 22 nt, Homo sapiens
caaaaauuauaacauuuacuuu

SEQ ID NO: 1921654 - RNA, 20 nt, Homo sapiens
agcccuggccucugcucaac

SEQ ID NO: 1921655 - RNA, 15 nt, Homo sapiens
gaggacagaaccaac

SEQ ID NO: 1921656 - RNA, 20 nt, Homo sapiens
gcuguaugacugaaguaaua

SEQ ID NO: 1921657 - RNA, 21 nt, Homo sapiens
uccuuuucaucuguuguucug

SEQ ID NO: 1921658 - RNA, 16 nt, Homo sapiens
acacugcacaauaacu

SEQ ID NO: 1921659 - RNA, 15 nt, Homo sapiens
cacugccauuaccca

SEQ ID NO: 1921660 - RNA, 22 nt, Homo sapiens
caaaugcucucucuucuuauua

SEQ ID NO: 1921661 - RNA, 22 nt, Homo sapiens
aucacaucuuaaagcuaaaaau

SEQ ID NO: 1921662 - RNA, 17 nt, Homo sapiens
acuccauauguguuccu

SEQ ID NO: 1921663 - RNA, 17 nt, Homo sapiens
uguaccuaauccaaaua

SEQ ID NO: 1921664 - RNA, 13 nt, Homo sapiens
ccucacauacccu

SEQ ID NO: 1921665 - RNA, 23 nt, Homo sapiens
cugcccaaugccuugacaacaga

SEQ ID NO: 1921666 - RNA, 22 nt, Homo sapiens
uguuucaacaauuuuugaucaa

SEQ ID NO: 1921667 - RNA, 19 nt, Homo sapiens
ucacuccccacaucccauc

SEQ ID NO: 1921668 - RNA, 17 nt, Homo sapiens
aacaacaaaaaccaaaa

SEQ ID NO: 1921669 - RNA, 19 nt, Homo sapiens
aguaauagucccaguucca

SEQ ID NO: 1921670 - RNA, 23 nt, Homo sapiens
caucacccacagccgcagcugua

SEQ ID NO: 1921671 - RNA, 14 nt, Homo sapiens
gcgcgcgcacacac

SEQ ID NO: 1921672 - RNA, 13 nt, Homo sapiens
gcccccucuacca

SEQ ID NO: 1921673 - RNA, 17 nt, Homo sapiens
ccagcuaacucugaccu

SEQ ID NO: 1921674 - RNA, 18 nt, Homo sapiens
ccuuugccucaaggacuu

SEQ ID NO: 1921675 - RNA, 16 nt, Homo sapiens
caugcucaggagccac

SEQ ID NO: 1921676 - RNA, 12 nt, Homo sapiens
agaaaaauuauu

SEQ ID NO: 1921677 - RNA, 15 nt, Homo sapiens
uacaauuuagcuuaa

SEQ ID NO: 1921678 - RNA, 14 nt, Homo sapiens
agagguugauuaua

SEQ ID NO: 1921679 - RNA, 23 nt, Homo sapiens
cuuccggucggcuggccagcuga

SEQ ID NO: 1921680 - RNA, 18 nt, Homo sapiens
cuggacagauuuaagccu

SEQ ID NO: 1921681 - RNA, 15 nt, Homo sapiens
agaacucacaguacc

SEQ ID NO: 1921682 - RNA, 16 nt, Homo sapiens
agagcagacuacagcu

SEQ ID NO: 1921683 - RNA, 22 nt, Homo sapiens
acacuugcugucaauguuuuga

SEQ ID NO: 1921684 - RNA, 20 nt, Homo sapiens
uucaaauuugugcagugucu

SEQ ID NO: 1921685 - RNA, 15 nt, Homo sapiens
ucauuuuaguugccu

SEQ ID NO: 1921686 - RNA, 19 nt, Homo sapiens
cauuuaaagaaagaaugca

SEQ ID NO: 1921687 - RNA, 14 nt, Homo sapiens
agggcaaagccagg

SEQ ID NO: 1921688 - RNA, 15 nt, Homo sapiens
caucucggagcaucc

SEQ ID NO: 1921689 - RNA, 16 nt, Homo sapiens
augaaggcaucagaaa

SEQ ID NO: 1921690 - RNA, 16 nt, Homo sapiens
aagaaacuguuacugu

SEQ ID NO: 1921691 - RNA, 20 nt, Homo sapiens
ucaacuuuggugaacaguuu

SEQ ID NO: 1921692 - RNA, 18 nt, Homo sapiens
ucugccaaaguacucuua

SEQ ID NO: 1921693 - RNA, 14 nt, Homo sapiens
aaauguuuacugua

SEQ ID NO: 1921694 - RNA, 15 nt, Homo sapiens
cuuaucuagccaaag

SEQ ID NO: 1921695 - RNA, 13 nt, Homo sapiens
uauggcagccauc

SEQ ID NO: 1921696 - RNA, 16 nt, Homo sapiens
aguaagacagugcagu

SEQ ID NO: 1921697 - RNA, 16 nt, Homo sapiens
ugggguauggcaucua

SEQ ID NO: 1921698 - RNA, 18 nt, Homo sapiens
uucauuauuuuauuauga

SEQ ID NO: 1921699 - RNA, 16 nt, Homo sapiens
auuucacaugccuugc

SEQ ID NO: 1921700 - RNA, 14 nt, Homo sapiens
ugcccauuccugcc

SEQ ID NO: 1921701 - RNA, 17 nt, Homo sapiens
cugugcuccuguggaua

SEQ ID NO: 1921702 - RNA, 15 nt, Homo sapiens
caugauuguuuacag

SEQ ID NO: 1921703 - RNA, 21 nt, Homo sapiens
ucgccaacacuuguguugcuu

SEQ ID NO: 1921704 - RNA, 15 nt, Homo sapiens
gacaaccagacucug

SEQ ID NO: 1921705 - RNA, 21 nt, Homo sapiens
gucauuguaaccucgugucua

SEQ ID NO: 1921706 - RNA, 21 nt, Homo sapiens
aacuucuccccauuuccccca

SEQ ID NO: 1921707 - RNA, 17 nt, Homo sapiens
ggaagguucuacgccag

SEQ ID NO: 1921708 - RNA, 22 nt, Homo sapiens
ccacgucacguguaguguccau

SEQ ID NO: 1921709 - RNA, 19 nt, Homo sapiens
auuaagcccaauuaauucc

SEQ ID NO: 1921710 - RNA, 15 nt, Homo sapiens
uugaagcaacuguga

SEQ ID NO: 1921711 - RNA, 21 nt, Homo sapiens
ugaccaccgauuccagcugcg

SEQ ID NO: 1921712 - RNA, 18 nt, Homo sapiens
gaauauugucugccuuaa

SEQ ID NO: 1921713 - RNA, 21 nt, Homo sapiens
cccagggagcccccagaggac

SEQ ID NO: 1921714 - RNA, 22 nt, Homo sapiens
cucagacaccugugugcuguag

SEQ ID NO: 1921715 - RNA, 18 nt, Homo sapiens
agggaaauucacacugug

SEQ ID NO: 1921716 - RNA, 16 nt, Homo sapiens
auaacaguuacuccag

SEQ ID NO: 1921717 - RNA, 19 nt, Homo sapiens
uaaauaagaucagacucug

SEQ ID NO: 1921718 - RNA, 15 nt, Homo sapiens
cugcucauccagggu

SEQ ID NO: 1921719 - RNA, 21 nt, Homo sapiens
gcucagcauaaguaaacaaca

SEQ ID NO: 1921720 - RNA, 22 nt, Homo sapiens
accauggugaauuaaucacuuu

SEQ ID NO: 1921721 - RNA, 13 nt, Homo sapiens
uuuaaacuaugau

SEQ ID NO: 1921722 - RNA, 17 nt, Homo sapiens
accagcaaauggaugcg

SEQ ID NO: 1921723 - RNA, 15 nt, Homo sapiens
uacuccucggggaac

SEQ ID NO: 1921724 - RNA, 18 nt, Homo sapiens
aacaauaacgauacaaau

SEQ ID NO: 1921725 - RNA, 21 nt, Homo sapiens
aaguucucaauguucuuuucc

SEQ ID NO: 1921726 - RNA, 22 nt, Homo sapiens
cuuaaaucugccuaguuuugau

SEQ ID NO: 1921727 - RNA, 22 nt, Homo sapiens
uaaauguuuaacaucauugcau

SEQ ID NO: 1921728 - RNA, 20 nt, Homo sapiens
cauuaaauauaauaugcaca

SEQ ID NO: 1921729 - RNA, 19 nt, Homo sapiens
ugucaauguaaagccaaaa

SEQ ID NO: 1921730 - RNA, 20 nt, Homo sapiens
gaggcagguggaucgcuuga

SEQ ID NO: 1921731 - RNA, 16 nt, Homo sapiens
ggcacuggugggccau

SEQ ID NO: 1921732 - RNA, 19 nt, Homo sapiens
gccucuucgcugaccucga

SEQ ID NO: 1921733 - RNA, 20 nt, Homo sapiens
ucaaugggcucuuccaacaa

SEQ ID NO: 1921734 - RNA, 17 nt, Homo sapiens
uacguguagauaauuaa

SEQ ID NO: 1921735 - RNA, 22 nt, Homo sapiens
agcucugcccuggaaccuacca

SEQ ID NO: 1921736 - RNA, 18 nt, Homo sapiens
caucuguggaaugauuca

SEQ ID NO: 1921737 - RNA, 15 nt, Homo sapiens
aaguagauugccagc

SEQ ID NO: 1921738 - RNA, 20 nt, Homo sapiens
uaaacagcugcuuuaugaaa

SEQ ID NO: 1921739 - RNA, 17 nt, Homo sapiens
ugaaauauacacacagc

SEQ ID NO: 1921740 - RNA, 15 nt, Homo sapiens
caccaucauguuuca

SEQ ID NO: 1921741 - RNA, 23 nt, Homo sapiens
ccaucacuagaagaaaagcccau

SEQ ID NO: 1921742 - RNA, 21 nt, Homo sapiens
auucacacaugccacuaugag

SEQ ID NO: 1921743 - RNA, 17 nt, Homo sapiens
cugacaaauauuuuaga

SEQ ID NO: 1921744 - RNA, 14 nt, Homo sapiens
auuuuuauuacaac

SEQ ID NO: 1921745 - RNA, 14 nt, Homo sapiens
cauuaauauaugga

SEQ ID NO: 1921746 - RNA, 18 nt, Homo sapiens
cugaucugcuagugcugu

SEQ ID NO: 1921747 - RNA, 21 nt, Homo sapiens
aaggccuccccaauccaggcc

SEQ ID NO: 1921748 - RNA, 14 nt, Homo sapiens
ucggcacacacugu

SEQ ID NO: 1921749 - RNA, 21 nt, Homo sapiens
ucagcaguucagcuccuucca

SEQ ID NO: 1921750 - RNA, 17 nt, Homo sapiens
acggccagguacaacac

SEQ ID NO: 1921751 - RNA, 12 nt, Homo sapiens
ugaccacagcac

SEQ ID NO: 1921752 - RNA, 19 nt, Homo sapiens
cuccccucccccacucuau

SEQ ID NO: 1921753 - RNA, 18 nt, Homo sapiens
aucucaaaagaucuccug

SEQ ID NO: 1921754 - RNA, 17 nt, Homo sapiens
gcugggccauguccaaa

SEQ ID NO: 1921755 - RNA, 20 nt, Homo sapiens
uagucccacuuacuugggag

SEQ ID NO: 1921756 - RNA, 16 nt, Homo sapiens
cagccgaaaagcuuuu

SEQ ID NO: 1921757 - RNA, 13 nt, Homo sapiens
uuuacagcacugu

SEQ ID NO: 1921758 - RNA, 17 nt, Homo sapiens
ugaauccuuccauucca

SEQ ID NO: 1921759 - RNA, 19 nt, Homo sapiens
cuugauuacauaauguuag

SEQ ID NO: 1921760 - RNA, 18 nt, Homo sapiens
cucccaaagugcuggaau

SEQ ID NO: 1921761 - RNA, 19 nt, Homo sapiens
caggaagaagagaugcacu

SEQ ID NO: 1921762 - RNA, 17 nt, Homo sapiens
caucacugguugcacuu

SEQ ID NO: 1921763 - RNA, 13 nt, Homo sapiens
agcaucaagccac

SEQ ID NO: 1921764 - RNA, 12 nt, Homo sapiens
ugaaaacugaca

SEQ ID NO: 1921765 - RNA, 17 nt, Homo sapiens
gggucgggggagcaaaa

SEQ ID NO: 1921766 - RNA, 17 nt, Homo sapiens
gaaggaggaaguggaag

SEQ ID NO: 1921767 - RNA, 21 nt, Homo sapiens
uggaguuuuaaaaggcuccca

SEQ ID NO: 1921768 - RNA, 22 nt, Homo sapiens
caccagacuuuuuuaaacauca

SEQ ID NO: 1921769 - RNA, 18 nt, Homo sapiens
cagggccuggggccugag

SEQ ID NO: 1921770 - RNA, 23 nt, Homo sapiens
cugacuucagaguggacuugugu

SEQ ID NO: 1921771 - RNA, 15 nt, Homo sapiens
aaaacagccucuuug

SEQ ID NO: 1921772 - RNA, 15 nt, Homo sapiens
uuuagaguaugcaag

SEQ ID NO: 1921773 - RNA, 13 nt, Homo sapiens
cugucucuuuaag

SEQ ID NO: 1921774 - RNA, 14 nt, Homo sapiens
caagaaugcugaaa

SEQ ID NO: 1921775 - RNA, 16 nt, Homo sapiens
cuucuuuuaaaccauu

SEQ ID NO: 1921776 - RNA, 21 nt, Homo sapiens
uccccaggguucaguccucaa

SEQ ID NO: 1921777 - RNA, 16 nt, Homo sapiens
aacuuauucuacugaa

SEQ ID NO: 1921778 - RNA, 24 nt, Homo sapiens
auuaaggccuuuuccacacgcauu

SEQ ID NO: 1921779 - RNA, 20 nt, Homo sapiens
cuggaugucaaacaguaaua

SEQ ID NO: 1921780 - RNA, 21 nt, Homo sapiens
aaagcaucugagcuaacuuau

SEQ ID NO: 1921781 - RNA, 22 nt, Homo sapiens
cucuacagaugucccauuuuca

SEQ ID NO: 1921782 - RNA, 21 nt, Homo sapiens
caaugacauuuauaucacaug

SEQ ID NO: 1921783 - RNA, 19 nt, Homo sapiens
cuugugugugggcugugag

SEQ ID NO: 1921784 - RNA, 17 nt, Homo sapiens
uuaaacuugcaguaucu

SEQ ID NO: 1921785 - RNA, 20 nt, Homo sapiens
aggcuacuauagguccagaa

SEQ ID NO: 1921786 - RNA, 13 nt, Homo sapiens
gcauggcauuaau

SEQ ID NO: 1921787 - RNA, 21 nt, Homo sapiens
cccauuucaauuccugugauu

SEQ ID NO: 1921788 - RNA, 13 nt, Homo sapiens
acuuuuaauguca

SEQ ID NO: 1921789 - RNA, 16 nt, Homo sapiens
gccaagagaauauccg

SEQ ID NO: 1921790 - RNA, 19 nt, Homo sapiens
cucugcaccggaccauuga

SEQ ID NO: 1921791 - RNA, 18 nt, Homo sapiens
cugaaaauaacacaacaa

SEQ ID NO: 1921792 - RNA, 14 nt, Homo sapiens
agcuccuaccucug

SEQ ID NO: 1921793 - RNA, 15 nt, Homo sapiens
caaaaugacuuugaa

SEQ ID NO: 1921794 - RNA, 16 nt, Homo sapiens
uuguuuuuaaacugga

SEQ ID NO: 1921795 - RNA, 20 nt, Homo sapiens
caugaauuaagaacugacac

SEQ ID NO: 1921796 - RNA, 17 nt, Homo sapiens
gaccaagcuuguccaac

SEQ ID NO: 1921797 - RNA, 18 nt, Homo sapiens
ugcuuuccaucuccagga

SEQ ID NO: 1921798 - RNA, 20 nt, Homo sapiens
uccugugcggugucaccaug

SEQ ID NO: 1921799 - RNA, 16 nt, Homo sapiens
aaugcacacguagcca

SEQ ID NO: 1921800 - RNA, 20 nt, Homo sapiens
gauguugacgccuaacugaa

SEQ ID NO: 1921801 - RNA, 14 nt, Homo sapiens
auaaccccuaguca

SEQ ID NO: 1921802 - RNA, 12 nt, Homo sapiens
cuuaagucauaa

SEQ ID NO: 1921803 - RNA, 17 nt, Homo sapiens
cucugcuggacguccag

SEQ ID NO: 1921804 - RNA, 19 nt, Homo sapiens
ugcccauuugugaagcuua

SEQ ID NO: 1921805 - RNA, 15 nt, Homo sapiens
uauguguaucucaca

SEQ ID NO: 1921806 - RNA, 23 nt, Homo sapiens
uuaccuuuuuguaugugaacaaa

SEQ ID NO: 1921807 - RNA, 15 nt, Homo sapiens
aguauaccagagaag

SEQ ID NO: 1921808 - RNA, 13 nt, Homo sapiens
acacucacugcgg

SEQ ID NO: 1921809 - RNA, 22 nt, Homo sapiens
caacuaagaugaaauauugaaa

SEQ ID NO: 1921810 - RNA, 21 nt, Homo sapiens
cagagggagacuccaucucaa

SEQ ID NO: 1921811 - RNA, 20 nt, Homo sapiens
gacuuggucugauuucagga

SEQ ID NO: 1921812 - RNA, 21 nt, Homo sapiens
gccaaggcagcgaccccagga

SEQ ID NO: 1921813 - RNA, 18 nt, Homo sapiens
aguguagggcaacaauac

SEQ ID NO: 1921814 - RNA, 15 nt, Homo sapiens
auguuacauagugua

SEQ ID NO: 1921815 - RNA, 12 nt, Homo sapiens
accaucuuaauc

SEQ ID NO: 1921816 - RNA, 22 nt, Homo sapiens
gaaaugcaaauucucaagccgc

SEQ ID NO: 1921817 - RNA, 14 nt, Homo sapiens
caguaguaaugugc

SEQ ID NO: 1921818 - RNA, 18 nt, Homo sapiens
cuccgcgggagaccccuu

SEQ ID NO: 1921819 - RNA, 20 nt, Homo sapiens
aguuuguugaaaacaaaaac

SEQ ID NO: 1921820 - RNA, 16 nt, Homo sapiens
uugugauuacccauaa

SEQ ID NO: 1921821 - RNA, 16 nt, Homo sapiens
gccugcaucugugaaa

SEQ ID NO: 1921822 - RNA, 17 nt, Homo sapiens
gucuuuugagcuauuca

SEQ ID NO: 1921823 - RNA, 23 nt, Homo sapiens
gccuuccuuucuccaggaccaau

SEQ ID NO: 1921824 - RNA, 19 nt, Homo sapiens
agccacuuauuuccaugga

SEQ ID NO: 1921825 - RNA, 23 nt, Homo sapiens
cacaugauuuuacucauaugugg

SEQ ID NO: 1921826 - RNA, 14 nt, Homo sapiens
gucacuggaucaag

SEQ ID NO: 1921827 - RNA, 15 nt, Homo sapiens
auuccaugcaaugga

SEQ ID NO: 1921828 - RNA, 15 nt, Homo sapiens
ugguucauauaugca

SEQ ID NO: 1921829 - RNA, 15 nt, Homo sapiens
ucgagacugcaaugu

SEQ ID NO: 1921830 - RNA, 15 nt, Homo sapiens
auaucaauggugcug

SEQ ID NO: 1921831 - RNA, 21 nt, Homo sapiens
gccuuuacauggacagaauuu

SEQ ID NO: 1921832 - RNA, 18 nt, Homo sapiens
cuagaaagagaaacaguu

SEQ ID NO: 1921833 - RNA, 15 nt, Homo sapiens
auguauugucugccc

SEQ ID NO: 1921834 - RNA, 15 nt, Homo sapiens
auaaaugaagauuac

SEQ ID NO: 1921835 - RNA, 15 nt, Homo sapiens
aaguuuaaauaccag

SEQ ID NO: 1921836 - RNA, 17 nt, Homo sapiens
ccugcgauggugcugca

SEQ ID NO: 1921837 - RNA, 20 nt, Homo sapiens
cauauuuuuagauacaguga

SEQ ID NO: 1921838 - RNA, 15 nt, Homo sapiens
cuuuccugaaccaug

SEQ ID NO: 1921839 - RNA, 22 nt, Homo sapiens
cgcuugcaccacuuccguccca

SEQ ID NO: 1921840 - RNA, 19 nt, Homo sapiens
gaugcaggcaugcuucuca

SEQ ID NO: 1921841 - RNA, 17 nt, Homo sapiens
cucacugccagugcaga

SEQ ID NO: 1921842 - RNA, 17 nt, Homo sapiens
augacccaccccugugc

SEQ ID NO: 1921843 - RNA, 21 nt, Homo sapiens
cggcugcgucuccuccgcaca

SEQ ID NO: 1921844 - RNA, 21 nt, Homo sapiens
ugauuuaucuaucaccauuac

SEQ ID NO: 1921845 - RNA, 20 nt, Homo sapiens
auggcaugagauagcuggug

SEQ ID NO: 1921846 - RNA, 18 nt, Homo sapiens
auacauauauguauauau

SEQ ID NO: 1921847 - RNA, 20 nt, Homo sapiens
gcuuccucaguaacauuucu

SEQ ID NO: 1921848 - RNA, 19 nt, Homo sapiens
gguaacucauuuacaguca

SEQ ID NO: 1921849 - RNA, 21 nt, Homo sapiens
guacacuguuucaaacuuuac

SEQ ID NO: 1921850 - RNA, 12 nt, Homo sapiens
ccauaacagcca

SEQ ID NO: 1921851 - RNA, 12 nt, Homo sapiens
ccaaaacagccu

SEQ ID NO: 1921852 - RNA, 20 nt, Homo sapiens
agaaagucuaucuaaugaca

SEQ ID NO: 1921853 - RNA, 23 nt, Homo sapiens
guuuagccaaaggauaagugucc

SEQ ID NO: 1921854 - RNA, 22 nt, Homo sapiens
cauuuccuuuuccuucaagccu

SEQ ID NO: 1921855 - RNA, 19 nt, Homo sapiens
uaauguaggaugacaggcu

SEQ ID NO: 1921856 - RNA, 21 nt, Homo sapiens
gaagugaauauuugagacaaa

SEQ ID NO: 1921857 - RNA, 17 nt, Homo sapiens
ugcucaagauauggaag

SEQ ID NO: 1921858 - RNA, 13 nt, Homo sapiens
cgcguguguacac

SEQ ID NO: 1921859 - RNA, 12 nt, Homo sapiens
ccacccuugugu

SEQ ID NO: 1921860 - RNA, 22 nt, Homo sapiens
ugcaaacccugguugcuguauu

SEQ ID NO: 1921861 - RNA, 16 nt, Homo sapiens
gcaaaugacaaaaagc

SEQ ID NO: 1921862 - RNA, 18 nt, Homo sapiens
aauguauugagcauguga

SEQ ID NO: 1921863 - RNA, 15 nt, Homo sapiens
aggaaggcugucuca

SEQ ID NO: 1921864 - RNA, 10 nt, Homo sapiens
ucacugccaa

SEQ ID NO: 1921865 - RNA, 21 nt, Homo sapiens
uccuuccuaaacccaaugacu

SEQ ID NO: 1921866 - RNA, 22 nt, Homo sapiens
uaauaaugcccuuaaugugagg

SEQ ID NO: 1921867 - RNA, 14 nt, Homo sapiens
aacuaucaccaaaa

SEQ ID NO: 1921868 - RNA, 16 nt, Homo sapiens
ucugggaagauuucua

SEQ ID NO: 1921869 - RNA, 17 nt, Homo sapiens
agauauuggacaaagaa

SEQ ID NO: 1921870 - RNA, 12 nt, Homo sapiens
uucgccaugugc

SEQ ID NO: 1921871 - RNA, 21 nt, Homo sapiens
gcugagaaggguugauccugc

SEQ ID NO: 1921872 - RNA, 21 nt, Homo sapiens
ugaagccaaaugaaacucaaa

SEQ ID NO: 1921873 - RNA, 16 nt, Homo sapiens
cucugcugacuucuga

SEQ ID NO: 1921874 - RNA, 15 nt, Homo sapiens
ggaggggggagccag

SEQ ID NO: 1921875 - RNA, 18 nt, Homo sapiens
acagugccaccaagcuca

SEQ ID NO: 1921876 - RNA, 21 nt, Homo sapiens
agacggcacaggccuaggaga

SEQ ID NO: 1921877 - RNA, 22 nt, Homo sapiens
cccuguccaaacugccuaagcc

SEQ ID NO: 1921878 - RNA, 17 nt, Homo sapiens
uggcauggauuaauaga

SEQ ID NO: 1921879 - RNA, 16 nt, Homo sapiens
uuuuuaaaaaucuaua

SEQ ID NO: 1921880 - RNA, 23 nt, Homo sapiens
auuuaugggaucaaacauaugau

SEQ ID NO: 1921881 - RNA, 21 nt, Homo sapiens
aaaguugcuuuuauugcacca

SEQ ID NO: 1921882 - RNA, 19 nt, Homo sapiens
agucaugugccuugaacau

SEQ ID NO: 1921883 - RNA, 16 nt, Homo sapiens
agccgcugcacaucac

SEQ ID NO: 1921884 - RNA, 11 nt, Homo sapiens
gaaaacauuuu

SEQ ID NO: 1921885 - RNA, 20 nt, Homo sapiens
aauagaagaacauccaagga

SEQ ID NO: 1921886 - RNA, 16 nt, Homo sapiens
acugagucacucacau

SEQ ID NO: 1921887 - RNA, 12 nt, Homo sapiens
auacuuuuggcu

SEQ ID NO: 1921888 - RNA, 23 nt, Homo sapiens
ugcauacaggcauacacaugcac

SEQ ID NO: 1921889 - RNA, 18 nt, Homo sapiens
gauauauuaaaccuucag

SEQ ID NO: 1921890 - RNA, 16 nt, Homo sapiens
gggacucaaugcacug

SEQ ID NO: 1921891 - RNA, 17 nt, Homo sapiens
aauacgaagauaaagcu

SEQ ID NO: 1921892 - RNA, 14 nt, Homo sapiens
gugcugcugcugcu

SEQ ID NO: 1921893 - RNA, 14 nt, Homo sapiens
ccaaacucugccag

SEQ ID NO: 1921894 - RNA, 20 nt, Homo sapiens
aaaagcuuauucaucuguuu

SEQ ID NO: 1921895 - RNA, 21 nt, Homo sapiens
gagcaaauaaagaccugagaa

SEQ ID NO: 1921896 - RNA, 12 nt, Homo sapiens
gugauguuauag

SEQ ID NO: 1921897 - RNA, 15 nt, Homo sapiens
cuagugaacugcaac

SEQ ID NO: 1921898 - RNA, 22 nt, Homo sapiens
cucaccuccggccuccacauga

SEQ ID NO: 1921899 - RNA, 13 nt, Homo sapiens
guccugaugcugu

SEQ ID NO: 1921900 - RNA, 14 nt, Homo sapiens
guucccaaaacaau

SEQ ID NO: 1921901 - RNA, 16 nt, Homo sapiens
gaaggcucuucugacu

SEQ ID NO: 1921902 - RNA, 21 nt, Homo sapiens
agggcagaaggggaagauacu

SEQ ID NO: 1921903 - RNA, 12 nt, Homo sapiens
ggucaugugcau

SEQ ID NO: 1921904 - RNA, 22 nt, Homo sapiens
gugucauaugacugauuacuca

SEQ ID NO: 1921905 - RNA, 19 nt, Homo sapiens
accaggggcccacccucug

SEQ ID NO: 1921906 - RNA, 15 nt, Homo sapiens
caugcucaaccacug

SEQ ID NO: 1921907 - RNA, 14 nt, Homo sapiens
gaggagaaggguua

SEQ ID NO: 1921908 - RNA, 18 nt, Homo sapiens
gcagaucacgaacucauu

SEQ ID NO: 1921909 - RNA, 20 nt, Homo sapiens
cuucccaaucagcacugaaa

SEQ ID NO: 1921910 - RNA, 17 nt, Homo sapiens
auuuuccuuuguagcua

SEQ ID NO: 1921911 - RNA, 15 nt, Homo sapiens
gcccuccacugcccu

SEQ ID NO: 1921912 - RNA, 20 nt, Homo sapiens
ugccacaccgguacccuccu

SEQ ID NO: 1921913 - RNA, 20 nt, Homo sapiens
auuuaauaucuggcacuguu

SEQ ID NO: 1921914 - RNA, 15 nt, Homo sapiens
gacuuucuguuacua

SEQ ID NO: 1921915 - RNA, 13 nt, Homo sapiens
auuaguggcacuu

SEQ ID NO: 1921916 - RNA, 13 nt, Homo sapiens
ccuaaaacaguag

SEQ ID NO: 1921917 - RNA, 18 nt, Homo sapiens
aggaauauaagaaaagua

SEQ ID NO: 1921918 - RNA, 16 nt, Homo sapiens
gugcauuuuucugacg

SEQ ID NO: 1921919 - RNA, 15 nt, Homo sapiens
guccaagaagccagc

SEQ ID NO: 1921920 - RNA, 16 nt, Homo sapiens
cuuaaacccacauaaa

SEQ ID NO: 1921921 - RNA, 22 nt, Homo sapiens
gacuuccccucaacaugcugcc

SEQ ID NO: 1921922 - RNA, 15 nt, Homo sapiens
cauuccugaagggaa

SEQ ID NO: 1921923 - RNA, 12 nt, Homo sapiens
guuucaacagag

SEQ ID NO: 1921924 - RNA, 17 nt, Homo sapiens
agcaaaaaauaaugaca

SEQ ID NO: 1921925 - RNA, 14 nt, Homo sapiens
uucugcacugaaaa

SEQ ID NO: 1921926 - RNA, 18 nt, Homo sapiens
uaaaugagggcugcacau

SEQ ID NO: 1921927 - RNA, 20 nt, Homo sapiens
caccuuugucuggaugcaca

SEQ ID NO: 1921928 - RNA, 16 nt, Homo sapiens
acaguaaacacuccac

SEQ ID NO: 1921929 - RNA, 18 nt, Homo sapiens
uucugacaucagcagaga

SEQ ID NO: 1921930 - RNA, 21 nt, Homo sapiens
uggacaacccaagucucuggg

SEQ ID NO: 1921931 - RNA, 11 nt, Homo sapiens
agaacagggaa

SEQ ID NO: 1921932 - RNA, 19 nt, Homo sapiens
gucuaugcccacauaccca

SEQ ID NO: 1921933 - RNA, 17 nt, Homo sapiens
acccauuccuguguaau

SEQ ID NO: 1921934 - RNA, 20 nt, Homo sapiens
aagcauuuuuucauauucug

SEQ ID NO: 1921935 - RNA, 19 nt, Homo sapiens
uuuaaugaacuaccaucug

SEQ ID NO: 1921936 - RNA, 19 nt, Homo sapiens
agagacuacucugccugaa

SEQ ID NO: 1921937 - RNA, 13 nt, Homo sapiens
cugcaguagugca

SEQ ID NO: 1921938 - RNA, 19 nt, Homo sapiens
gcacauguugcuaaugaca

SEQ ID NO: 1921939 - RNA, 19 nt, Homo sapiens
gaaguuuuacuugauuaag

SEQ ID NO: 1921940 - RNA, 13 nt, Homo sapiens
gaaauaccuauuc

SEQ ID NO: 1921941 - RNA, 23 nt, Homo sapiens
agugaacauauggaaaguauuag

SEQ ID NO: 1921942 - RNA, 20 nt, Homo sapiens
augugaacaaccugcucaca

SEQ ID NO: 1921943 - RNA, 21 nt, Homo sapiens
auacuguacugagacauuaca

SEQ ID NO: 1921944 - RNA, 20 nt, Homo sapiens
cagccucccgaguagcuggg

SEQ ID NO: 1921945 - RNA, 18 nt, Homo sapiens
uagaaaaugcaccaaaua

SEQ ID NO: 1921946 - RNA, 16 nt, Homo sapiens
caugcugcuguugcug

SEQ ID NO: 1921947 - RNA, 21 nt, Homo sapiens
cucuaacagcucaggaucucu

SEQ ID NO: 1921948 - RNA, 22 nt, Homo sapiens
caggugccaucacgcuugugau

SEQ ID NO: 1921949 - RNA, 15 nt, Homo sapiens
uaaaagaucuugaau

SEQ ID NO: 1921950 - RNA, 18 nt, Homo sapiens
acacuggaacauuccagu

SEQ ID NO: 1921951 - RNA, 19 nt, Homo sapiens
acuuaagcccagugcacug

SEQ ID NO: 1921952 - RNA, 14 nt, Homo sapiens
cccuguucuuggau

SEQ ID NO: 1921953 - RNA, 23 nt, Homo sapiens
acugaaucuucagcauguucuca

SEQ ID NO: 1921954 - RNA, 20 nt, Homo sapiens
gccagcacucgcuagcagug

SEQ ID NO: 1921955 - RNA, 19 nt, Homo sapiens
gaauggggugcaugaaggu

SEQ ID NO: 1921956 - RNA, 23 nt, Homo sapiens
gacgguuucuccccggacacucg

SEQ ID NO: 1921957 - RNA, 15 nt, Homo sapiens
acagguuacaacaga

SEQ ID NO: 1921958 - RNA, 23 nt, Homo sapiens
cccucacacuuugccauuugcuu

SEQ ID NO: 1921959 - RNA, 23 nt, Homo sapiens
ugacccagaacaggacuccacac

SEQ ID NO: 1921960 - RNA, 14 nt, Homo sapiens
aaguccaucugaca

SEQ ID NO: 1921961 - RNA, 17 nt, Homo sapiens
gagauuggccagcaaaa

SEQ ID NO: 1921962 - RNA, 18 nt, Homo sapiens
auucuauaaaacacauca

SEQ ID NO: 1921963 - RNA, 15 nt, Homo sapiens
guggugcgugugaau

SEQ ID NO: 1921964 - RNA, 23 nt, Homo sapiens
gcuaaacagaugucuucuugcaa

SEQ ID NO: 1921965 - RNA, 17 nt, Homo sapiens
ggccacacuggucacag

SEQ ID NO: 1921966 - RNA, 14 nt, Homo sapiens
guauguugccuuua

SEQ ID NO: 1921967 - RNA, 11 nt, Homo sapiens
uaagcaaaaag

SEQ ID NO: 1921968 - RNA, 20 nt, Homo sapiens
aauccuucccugcucuugca

SEQ ID NO: 1921969 - RNA, 19 nt, Homo sapiens
gcacacuccccugcacugg

SEQ ID NO: 1921970 - RNA, 22 nt, Homo sapiens
gccaucaaacauaauucucuca

SEQ ID NO: 1921971 - RNA, 20 nt, Homo sapiens
agaaugucucggucacauca

SEQ ID NO: 1921972 - RNA, 17 nt, Homo sapiens
ccucugaccugccugua

SEQ ID NO: 1921973 - RNA, 17 nt, Homo sapiens
aggaugauggcacugag

SEQ ID NO: 1921974 - RNA, 16 nt, Homo sapiens
acuagggaauccugcg

SEQ ID NO: 1921975 - RNA, 15 nt, Homo sapiens
gaaccaauucacuuu

SEQ ID NO: 1921976 - RNA, 16 nt, Homo sapiens
uaauggaacuuagcca

SEQ ID NO: 1921977 - RNA, 13 nt, Homo sapiens
cuaucugaccaaa

SEQ ID NO: 1921978 - RNA, 12 nt, Homo sapiens
uuuaugcuccua

SEQ ID NO: 1921979 - RNA, 22 nt, Homo sapiens
ccagcuggugucacucugccuc

SEQ ID NO: 1921980 - RNA, 21 nt, Homo sapiens
cuuuuagacaacuagauuugu

SEQ ID NO: 1921981 - RNA, 20 nt, Homo sapiens
caacgauggaguacacagcu

SEQ ID NO: 1921982 - RNA, 12 nt, Homo sapiens
uaucaaagucau

SEQ ID NO: 1921983 - RNA, 12 nt, Homo sapiens
aaucaaagacau

SEQ ID NO: 1921984 - RNA, 17 nt, Homo sapiens
ugcagaaggaaagaagg

SEQ ID NO: 1921985 - RNA, 18 nt, Homo sapiens
ucgggcuccugugcccuu

SEQ ID NO: 1921986 - RNA, 16 nt, Homo sapiens
aagguaaaaugccaug

SEQ ID NO: 1921987 - RNA, 17 nt, Homo sapiens
ccuaggggaagagcaga

SEQ ID NO: 1921988 - RNA, 23 nt, Homo sapiens
gccaugguaacuaaaacuuuuca

SEQ ID NO: 1921989 - RNA, 14 nt, Homo sapiens
gggucuccuuggcu

SEQ ID NO: 1921990 - RNA, 14 nt, Homo sapiens
cccuagugcuggua

SEQ ID NO: 1921991 - RNA, 20 nt, Homo sapiens
cuuuaaguaaaaauccaaaa

SEQ ID NO: 1921992 - RNA, 18 nt, Homo sapiens
caugacccguacacacca

SEQ ID NO: 1921993 - RNA, 20 nt, Homo sapiens
cgucacccuccugagccuca

SEQ ID NO: 1921994 - RNA, 18 nt, Homo sapiens
gcagcuccugaccaaaga

SEQ ID NO: 1921995 - RNA, 21 nt, Homo sapiens
agcagaggaaggcuacuugag

SEQ ID NO: 1921996 - RNA, 18 nt, Homo sapiens
agaacucugggcugcuac

SEQ ID NO: 1921997 - RNA, 17 nt, Homo sapiens
cacucuagucaaugaca

SEQ ID NO: 1921998 - RNA, 17 nt, Homo sapiens
uuaauaauauguacaaa

SEQ ID NO: 1921999 - RNA, 19 nt, Homo sapiens
ugcugagaaccacggugaa

SEQ ID NO: 1922000 - RNA, 21 nt, Homo sapiens
agagaguuaaucaacugaaag

SEQ ID NO: 1922001 - RNA, 21 nt, Homo sapiens
aggucacugcuagagacgcug

SEQ ID NO: 1922002 - RNA, 14 nt, Homo sapiens
uuaguuuuucuuac

SEQ ID NO: 1922003 - RNA, 12 nt, Homo sapiens
auuucacugaca

SEQ ID NO: 1922004 - RNA, 19 nt, Homo sapiens
caggacuauauuugggccu

SEQ ID NO: 1922005 - RNA, 16 nt, Homo sapiens
aaacacaaauugugaa

SEQ ID NO: 1922006 - RNA, 20 nt, Homo sapiens
ggacuuguuuagagagccug

SEQ ID NO: 1922007 - RNA, 14 nt, Homo sapiens
ccgccauucugcag

SEQ ID NO: 1922008 - RNA, 22 nt, Homo sapiens
aagaugaaucacuuaauaccgu

SEQ ID NO: 1922009 - RNA, 23 nt, Homo sapiens
gcagcgcccccaucugucuucag

SEQ ID NO: 1922010 - RNA, 15 nt, Homo sapiens
ucuaauuaaauguag

SEQ ID NO: 1922011 - RNA, 12 nt, Homo sapiens
gcauaucucagu

SEQ ID NO: 1922012 - RNA, 13 nt, Homo sapiens
ucucgauggacaa

SEQ ID NO: 1922013 - RNA, 18 nt, Homo sapiens
aaucuucuaauuccaaga

SEQ ID NO: 1922014 - RNA, 17 nt, Homo sapiens
ugagcaccgucauggcu

SEQ ID NO: 1922015 - RNA, 18 nt, Homo sapiens
uagaauaguaugaugcuu

SEQ ID NO: 1922016 - RNA, 19 nt, Homo sapiens
gguuugagucccuccaaag

SEQ ID NO: 1922017 - RNA, 21 nt, Homo sapiens
agcagcacaggggacgcaaug

SEQ ID NO: 1922018 - RNA, 17 nt, Homo sapiens
cacugcccgagcuggug

SEQ ID NO: 1922019 - RNA, 16 nt, Homo sapiens
uggagacacugaguca

SEQ ID NO: 1922020 - RNA, 22 nt, Homo sapiens
ccugcuuuucacugcugcaagg

SEQ ID NO: 1922021 - RNA, 11 nt, Homo sapiens
acugucuuuca

SEQ ID NO: 1922022 - RNA, 15 nt, Homo sapiens
uuaaccuuaaauaca

SEQ ID NO: 1922023 - RNA, 21 nt, Homo sapiens
aaauuuaugaagcagauuuau

SEQ ID NO: 1922024 - RNA, 15 nt, Homo sapiens
auagaugucuuuuau

SEQ ID NO: 1922025 - RNA, 20 nt, Homo sapiens
ccaugacgacauacaugcua

SEQ ID NO: 1922026 - RNA, 21 nt, Homo sapiens
ugagggcagcuccagugccag

SEQ ID NO: 1922027 - RNA, 21 nt, Homo sapiens
ccguggacagcccgccgucag

SEQ ID NO: 1922028 - RNA, 23 nt, Homo sapiens
ggcuuucucuuccccuuccuguu

SEQ ID NO: 1922029 - RNA, 11 nt, Homo sapiens
acaauguaucu

SEQ ID NO: 1922030 - RNA, 14 nt, Homo sapiens
uaaggucugacuga

SEQ ID NO: 1922031 - RNA, 23 nt, Homo sapiens
ugcugagugcaccacuucaagug

SEQ ID NO: 1922032 - RNA, 12 nt, Homo sapiens
ccuaggcccaag

SEQ ID NO: 1922033 - RNA, 13 nt, Homo sapiens
agaaucugagggc

SEQ ID NO: 1922034 - RNA, 18 nt, Homo sapiens
auuucuuaaugucuguca

SEQ ID NO: 1922035 - RNA, 22 nt, Homo sapiens
ucauuuggaggaaucaccccau

SEQ ID NO: 1922036 - RNA, 15 nt, Homo sapiens
auuaauuuucuauga

SEQ ID NO: 1922037 - RNA, 18 nt, Homo sapiens
gaaaaucgaguuggcaaa

SEQ ID NO: 1922038 - RNA, 16 nt, Homo sapiens
uaaagggaaaacccuc

SEQ ID NO: 1922039 - RNA, 23 nt, Homo sapiens
cuguagaaaggaaauagacuuug

SEQ ID NO: 1922040 - RNA, 11 nt, Homo sapiens
aauacacaauu

SEQ ID NO: 1922041 - RNA, 21 nt, Homo sapiens
ccuugcuguuuucaucucugc

SEQ ID NO: 1922042 - RNA, 13 nt, Homo sapiens
guggcauguggcc

SEQ ID NO: 1922043 - RNA, 22 nt, Homo sapiens
ugaacucuuuccccagcugauu

SEQ ID NO: 1922044 - RNA, 21 nt, Homo sapiens
cuauuauuuagaaaugaacaa

SEQ ID NO: 1922045 - RNA, 19 nt, Homo sapiens
uaggcuacagagaagccuu

SEQ ID NO: 1922046 - RNA, 18 nt, Homo sapiens
agauagccaaggccaaag

SEQ ID NO: 1922047 - RNA, 14 nt, Homo sapiens
cuuaaaacacguuu

SEQ ID NO: 1922048 - RNA, 23 nt, Homo sapiens
aaucuuggcuucuuaaaaacugu

SEQ ID NO: 1922049 - RNA, 20 nt, Homo sapiens
cugaggcaggagaauggugu

SEQ ID NO: 1922050 - RNA, 18 nt, Homo sapiens
ucugucacaaagggacuu

SEQ ID NO: 1922051 - RNA, 17 nt, Homo sapiens
uuggggacaaccuuggc

SEQ ID NO: 1922052 - RNA, 22 nt, Homo sapiens
gcucuauauaugaagugaaaaa

SEQ ID NO: 1922053 - RNA, 12 nt, Homo sapiens
cugccugagcac

SEQ ID NO: 1922054 - RNA, 15 nt, Homo sapiens
gacaguaacacuggc

SEQ ID NO: 1922055 - RNA, 15 nt, Homo sapiens
cuccaccugcuggug

SEQ ID NO: 1922056 - RNA, 18 nt, Homo sapiens
uaucccagagaacaauca

SEQ ID NO: 1922057 - RNA, 16 nt, Homo sapiens
uggacggaaugggaug

SEQ ID NO: 1922058 - RNA, 12 nt, Homo sapiens
ggaaaagcaaaa

SEQ ID NO: 1922059 - RNA, 21 nt, Homo sapiens
uaauuguagcacauuaccaau

SEQ ID NO: 1922060 - RNA, 20 nt, Homo sapiens
gagguggagauugcagugag

SEQ ID NO: 1922061 - RNA, 16 nt, Homo sapiens
ggagcugccccucucu

SEQ ID NO: 1922062 - RNA, 12 nt, Homo sapiens
guuacuuuacag

SEQ ID NO: 1922063 - RNA, 13 nt, Homo sapiens
aaagcacaggugg

SEQ ID NO: 1922064 - RNA, 14 nt, Homo sapiens
gcaaaggcucucac

SEQ ID NO: 1922065 - RNA, 16 nt, Homo sapiens
caggcucaagcugucc

SEQ ID NO: 1922066 - RNA, 22 nt, Homo sapiens
ggauauguuaaauguauagcug

SEQ ID NO: 1922067 - RNA, 17 nt, Homo sapiens
ugccggggguucagggu

SEQ ID NO: 1922068 - RNA, 16 nt, Homo sapiens
auguucguauuacaag

SEQ ID NO: 1922069 - RNA, 15 nt, Homo sapiens
gcuccucacucaccu

SEQ ID NO: 1922070 - RNA, 21 nt, Homo sapiens
ccacaggagugggaaaacacu

SEQ ID NO: 1922071 - RNA, 18 nt, Homo sapiens
cacuaauugguacuuuua

SEQ ID NO: 1922072 - RNA, 19 nt, Homo sapiens
ccugcucugggcacuggga

SEQ ID NO: 1922073 - RNA, 15 nt, Homo sapiens
cagcucagaggccca

SEQ ID NO: 1922074 - RNA, 15 nt, Homo sapiens
uugacaaaacccacu

SEQ ID NO: 1922075 - RNA, 19 nt, Homo sapiens
gaacuggaagaaagcaaca

SEQ ID NO: 1922076 - RNA, 17 nt, Homo sapiens
caggaggugcuaucgca

SEQ ID NO: 1922077 - RNA, 13 nt, Homo sapiens
uccccaacgaaaa

SEQ ID NO: 1922078 - RNA, 18 nt, Homo sapiens
aguauaguuuugacagag

SEQ ID NO: 1922079 - RNA, 16 nt, Homo sapiens
gaagugccacaugaca

SEQ ID NO: 1922080 - RNA, 21 nt, Homo sapiens
caaucugagaagacaauaugu

SEQ ID NO: 1922081 - RNA, 21 nt, Homo sapiens
uccucugaaacagcugccuua

SEQ ID NO: 1922082 - RNA, 16 nt, Homo sapiens
aaagcagaacagugau

SEQ ID NO: 1922083 - RNA, 18 nt, Homo sapiens
gguccagggagggguccc

SEQ ID NO: 1922084 - RNA, 21 nt, Homo sapiens
acaaugaacccccaugaugua

SEQ ID NO: 1922085 - RNA, 21 nt, Homo sapiens
gugcccagggcucuaaugugu

SEQ ID NO: 1922086 - RNA, 16 nt, Homo sapiens
acucuccacaaaaacu

SEQ ID NO: 1922087 - RNA, 16 nt, Homo sapiens
auuaacaguauaacau

SEQ ID NO: 1922088 - RNA, 23 nt, Homo sapiens
caauaaugugacgaaaguggaaa

SEQ ID NO: 1922089 - RNA, 17 nt, Homo sapiens
acuccacagucaauauu

SEQ ID NO: 1922090 - RNA, 21 nt, Homo sapiens
gcuggccaugaaucucugccu

SEQ ID NO: 1922091 - RNA, 19 nt, Homo sapiens
aaaaucuggugcucaauaa

SEQ ID NO: 1922092 - RNA, 15 nt, Homo sapiens
cuaagucauguauau

SEQ ID NO: 1922093 - RNA, 16 nt, Homo sapiens
aaagagccauguccaa

SEQ ID NO: 1922094 - RNA, 13 nt, Homo sapiens
ccuaaaugaccuc

SEQ ID NO: 1922095 - RNA, 17 nt, Homo sapiens
ugaucaacaauuugggc

SEQ ID NO: 1922096 - RNA, 14 nt, Homo sapiens
caaagagauuauuu

SEQ ID NO: 1922097 - RNA, 19 nt, Homo sapiens
auaugaauauuacauguaa

SEQ ID NO: 1922098 - RNA, 23 nt, Homo sapiens
cuuugcuacuacuaugugcagga

SEQ ID NO: 1922099 - RNA, 21 nt, Homo sapiens
cucaauucuuuguauaugcau

SEQ ID NO: 1922100 - RNA, 15 nt, Homo sapiens
caaaugcccaaggga

SEQ ID NO: 1922101 - RNA, 16 nt, Homo sapiens
auaauaucaugugcac

SEQ ID NO: 1922102 - RNA, 20 nt, Homo sapiens
cagcacucacacccuaacuc

SEQ ID NO: 1922103 - RNA, 18 nt, Homo sapiens
ggaguguaugagugugag

SEQ ID NO: 1922104 - RNA, 17 nt, Homo sapiens
uuuugcucaguuccaug

SEQ ID NO: 1922105 - RNA, 22 nt, Homo sapiens
uccuucacaggcagugcaugug

SEQ ID NO: 1922106 - RNA, 19 nt, Homo sapiens
ucagccgcuucugacugcu

SEQ ID NO: 1922107 - RNA, 15 nt, Homo sapiens
uugauacugaaugca

SEQ ID NO: 1922108 - RNA, 20 nt, Homo sapiens
cugguaugaaacaaacuacu

SEQ ID NO: 1922109 - RNA, 23 nt, Homo sapiens
agaauucagaagaccccugacuc

SEQ ID NO: 1922110 - RNA, 18 nt, Homo sapiens
ucauuagaaguuaccaaa

SEQ ID NO: 1922111 - RNA, 14 nt, Homo sapiens
gccucuugggugcu

SEQ ID NO: 1922112 - RNA, 21 nt, Homo sapiens
ucaguggaauagaugucucaa

SEQ ID NO: 1922113 - RNA, 17 nt, Homo sapiens
ucuuaccugggaccuca

SEQ ID NO: 1922114 - RNA, 15 nt, Homo sapiens
ccaacucaagguucu

SEQ ID NO: 1922115 - RNA, 19 nt, Homo sapiens
accucuaccagcacauuaa

SEQ ID NO: 1922116 - RNA, 14 nt, Homo sapiens
ggaggaacugcuug

SEQ ID NO: 1922117 - RNA, 19 nt, Homo sapiens
gaagaccagauccaagaug

SEQ ID NO: 1922118 - RNA, 22 nt, Homo sapiens
ucaggcgcaguggcucaugccu

SEQ ID NO: 1922119 - RNA, 16 nt, Homo sapiens
agaaauggauucuauu

SEQ ID NO: 1922120 - RNA, 13 nt, Homo sapiens
agauauaccuaau

SEQ ID NO: 1922121 - RNA, 21 nt, Homo sapiens
cuuaagauuccauuuuggaaa

SEQ ID NO: 1922122 - RNA, 21 nt, Homo sapiens
guauggggaggcaaguguggg

SEQ ID NO: 1922123 - RNA, 11 nt, Homo sapiens
gcuugggcauu

SEQ ID NO: 1922124 - RNA, 17 nt, Homo sapiens
uacacugaggacugugg

SEQ ID NO: 1922125 - RNA, 19 nt, Homo sapiens
uucuaguucugccaggaga

SEQ ID NO: 1922126 - RNA, 19 nt, Homo sapiens
uuccauaaacacccaugaa

SEQ ID NO: 1922127 - RNA, 13 nt, Homo sapiens
aauaagagaagcu

SEQ ID NO: 1922128 - RNA, 19 nt, Homo sapiens
ccuuaaaauuuauauguau

SEQ ID NO: 1922129 - RNA, 12 nt, Homo sapiens
ccaccugugcuu

SEQ ID NO: 1922130 - RNA, 20 nt, Homo sapiens
aagguucgacuagugauagu

SEQ ID NO: 1922131 - RNA, 14 nt, Homo sapiens
aaacuaauuucaua

SEQ ID NO: 1922132 - RNA, 23 nt, Homo sapiens
aagaauaggucauuuucuauuca

SEQ ID NO: 1922133 - RNA, 15 nt, Homo sapiens
cuccuguuuuuugau

SEQ ID NO: 1922134 - RNA, 17 nt, Homo sapiens
uacggcaaccacauguc

SEQ ID NO: 1922135 - RNA, 21 nt, Homo sapiens
ugcaauccucccuaccguccu

SEQ ID NO: 1922136 - RNA, 18 nt, Homo sapiens
caucauaggcugacacca

SEQ ID NO: 1922137 - RNA, 18 nt, Homo sapiens
auuguuaaucucuguuau

SEQ ID NO: 1922138 - RNA, 15 nt, Homo sapiens
gaaauaguucauguu

SEQ ID NO: 1922139 - RNA, 15 nt, Homo sapiens
agccugucccaugga

SEQ ID NO: 1922140 - RNA, 22 nt, Homo sapiens
augcaugguuucagcacuagcc

SEQ ID NO: 1922141 - RNA, 17 nt, Homo sapiens
cuauauuggucauugcc

SEQ ID NO: 1922142 - RNA, 19 nt, Homo sapiens
uccgucucaaaaaaagggc

SEQ ID NO: 1922143 - RNA, 17 nt, Homo sapiens
ugcuccaguguaucuca

SEQ ID NO: 1922144 - RNA, 18 nt, Homo sapiens
cuguggacuccaugccuc

SEQ ID NO: 1922145 - RNA, 15 nt, Homo sapiens
caucccuaaugcugc

SEQ ID NO: 1922146 - RNA, 20 nt, Homo sapiens
gguggccagaaauaaaggga

SEQ ID NO: 1922147 - RNA, 17 nt, Homo sapiens
ggaggggcugggccaag

SEQ ID NO: 1922148 - RNA, 21 nt, Homo sapiens
ugcaaaggcgcagugcuucuc

SEQ ID NO: 1922149 - RNA, 17 nt, Homo sapiens
cagugacuggugccagu

SEQ ID NO: 1922150 - RNA, 23 nt, Homo sapiens
gauaauuuauuaaaggugguccu

SEQ ID NO: 1922151 - RNA, 23 nt, Homo sapiens
aagccaugguguguguucagcuc

SEQ ID NO: 1922152 - RNA, 12 nt, Homo sapiens
uaagaaaaucau

SEQ ID NO: 1922153 - RNA, 16 nt, Homo sapiens
ccaaaauacuugcauc

SEQ ID NO: 1922154 - RNA, 16 nt, Homo sapiens
accauccucuguuacc

SEQ ID NO: 1922155 - RNA, 21 nt, Homo sapiens
aucaugucccccuuauguuga

SEQ ID NO: 1922156 - RNA, 16 nt, Homo sapiens
aagaccagcuuucuca

SEQ ID NO: 1922157 - RNA, 12 nt, Homo sapiens
cgcaauacugua

SEQ ID NO: 1922158 - RNA, 18 nt, Homo sapiens
ccuugcugugaaauuucu

SEQ ID NO: 1922159 - RNA, 18 nt, Homo sapiens
gaagucuaaaagcagaaa

SEQ ID NO: 1922160 - RNA, 18 nt, Homo sapiens
gaaguaguccagccuucc

SEQ ID NO: 1922161 - RNA, 16 nt, Homo sapiens
gcaggacaguauuccu

SEQ ID NO: 1922162 - RNA, 12 nt, Homo sapiens
ggacucucugac

SEQ ID NO: 1922163 - RNA, 23 nt, Homo sapiens
aaaauugcagcaguugcuagcaa

SEQ ID NO: 1922164 - RNA, 20 nt, Homo sapiens
aggggcucuguggcaaaaag

SEQ ID NO: 1922165 - RNA, 23 nt, Homo sapiens
uugcacagcucuccggucucucu

SEQ ID NO: 1922166 - RNA, 18 nt, Homo sapiens
acugaaaacuuagccaga

SEQ ID NO: 1922167 - RNA, 15 nt, Homo sapiens
auauauauauaguaa

SEQ ID NO: 1922168 - RNA, 16 nt, Homo sapiens
ggaaaguucuugacag

SEQ ID NO: 1922169 - RNA, 23 nt, Homo sapiens
ccacugauuuagccaugugaaac

SEQ ID NO: 1922170 - RNA, 22 nt, Homo sapiens
aagccugagggaggaggcagga

SEQ ID NO: 1922171 - RNA, 17 nt, Homo sapiens
cugagugacugcagcuu

SEQ ID NO: 1922172 - RNA, 13 nt, Homo sapiens
uacaaacauuuaa

SEQ ID NO: 1922173 - RNA, 21 nt, Homo sapiens
aaacauguuuaaauagccuaa

SEQ ID NO: 1922174 - RNA, 20 nt, Homo sapiens
gcuagaaaaaaaaaacacuu

SEQ ID NO: 1922175 - RNA, 18 nt, Homo sapiens
cuuuauucuuuacuauua

SEQ ID NO: 1922176 - RNA, 17 nt, Homo sapiens
agauuauucauaaugug

SEQ ID NO: 1922177 - RNA, 14 nt, Homo sapiens
uaaagacagggucu

SEQ ID NO: 1922178 - RNA, 23 nt, Homo sapiens
gcagguuggugggggccucggug

SEQ ID NO: 1922179 - RNA, 22 nt, Homo sapiens
gaauaauccaguauugcugauu

SEQ ID NO: 1922180 - RNA, 15 nt, Homo sapiens
cagucacugacucaa

SEQ ID NO: 1922181 - RNA, 17 nt, Homo sapiens
gcuagaugcugugacag

SEQ ID NO: 1922182 - RNA, 12 nt, Homo sapiens
gacagaccuuca

SEQ ID NO: 1922183 - RNA, 18 nt, Homo sapiens
gcccuuuccucaggcaag

SEQ ID NO: 1922184 - RNA, 17 nt, Homo sapiens
gcuuugcacuucaaaaa

SEQ ID NO: 1922185 - RNA, 18 nt, Homo sapiens
uuguacaaagauaugcua

SEQ ID NO: 1922186 - RNA, 14 nt, Homo sapiens
auaauugaugaugu

SEQ ID NO: 1922187 - RNA, 22 nt, Homo sapiens
aaaggcccccuacgccaaucaa

SEQ ID NO: 1922188 - RNA, 14 nt, Homo sapiens
aauaaauacauuuc

SEQ ID NO: 1922189 - RNA, 16 nt, Homo sapiens
uucaauucgacuucuu

SEQ ID NO: 1922190 - RNA, 15 nt, Homo sapiens
gauucaaauugcugc

SEQ ID NO: 1922191 - RNA, 12 nt, Homo sapiens
uccaaaaccucc

SEQ ID NO: 1922192 - RNA, 17 nt, Homo sapiens
uguauucuucaaccuca

SEQ ID NO: 1922193 - RNA, 20 nt, Homo sapiens
uucuuauuuccccuuuccaa

SEQ ID NO: 1922194 - RNA, 15 nt, Homo sapiens
auguuugccuagaca

SEQ ID NO: 1922195 - RNA, 22 nt, Homo sapiens
cagagaugugcacccaugggcu

SEQ ID NO: 1922196 - RNA, 14 nt, Homo sapiens
ucauguaccaucaa

SEQ ID NO: 1922197 - RNA, 18 nt, Homo sapiens
aaaaccauuuuuuccuac

SEQ ID NO: 1922198 - RNA, 16 nt, Homo sapiens
uguguauguuugcaca

SEQ ID NO: 1922199 - RNA, 14 nt, Homo sapiens
gggaauccugagaa

SEQ ID NO: 1922200 - RNA, 14 nt, Homo sapiens
ccaggugggugugg

SEQ ID NO: 1922201 - RNA, 22 nt, Homo sapiens
ccugaugagggggaauuccugg

SEQ ID NO: 1922202 - RNA, 20 nt, Homo sapiens
uucagaacugcuaccaugaa

SEQ ID NO: 1922203 - RNA, 23 nt, Homo sapiens
ccuucugcucagcucugggccau

SEQ ID NO: 1922204 - RNA, 11 nt, Homo sapiens
cacacacagcc

SEQ ID NO: 1922205 - RNA, 18 nt, Homo sapiens
uaaacuaucaauaauaca

SEQ ID NO: 1922206 - RNA, 18 nt, Homo sapiens
caaagugucucauucuca

SEQ ID NO: 1922207 - RNA, 22 nt, Homo sapiens
caugugaaacucuacccugaag

SEQ ID NO: 1922208 - RNA, 13 nt, Homo sapiens
acuugcauccaag

SEQ ID NO: 1922209 - RNA, 14 nt, Homo sapiens
uggggaaaggggac

SEQ ID NO: 1922210 - RNA, 13 nt, Homo sapiens
auaaacauaugca

SEQ ID NO: 1922211 - RNA, 20 nt, Homo sapiens
gacauuucccuccugggaga

SEQ ID NO: 1922212 - RNA, 14 nt, Homo sapiens
augaaucugcacau

SEQ ID NO: 1922213 - RNA, 18 nt, Homo sapiens
acaggauuuguaauuccu

SEQ ID NO: 1922214 - RNA, 18 nt, Homo sapiens
ugugccacacaccuugac

SEQ ID NO: 1922215 - RNA, 13 nt, Homo sapiens
aacaaacaaaagc

SEQ ID NO: 1922216 - RNA, 14 nt, Homo sapiens
cauggccauggcag

SEQ ID NO: 1922217 - RNA, 14 nt, Homo sapiens
cuuugcaccuccau

SEQ ID NO: 1922218 - RNA, 22 nt, Homo sapiens
ggccauuggcuagaaucagggu

SEQ ID NO: 1922219 - RNA, 13 nt, Homo sapiens
uguuucuggucuu

SEQ ID NO: 1922220 - RNA, 17 nt, Homo sapiens
caaaaugaauugccuuu

SEQ ID NO: 1922221 - RNA, 13 nt, Homo sapiens
ggccuccagaacc

SEQ ID NO: 1922222 - RNA, 16 nt, Homo sapiens
cacucagggagcauuu

SEQ ID NO: 1922223 - RNA, 16 nt, Homo sapiens
accagcccugcugcuu

SEQ ID NO: 1922224 - RNA, 14 nt, Homo sapiens
agagaggaugugca

SEQ ID NO: 1922225 - RNA, 16 nt, Homo sapiens
ccuucuacccuggguc

SEQ ID NO: 1922226 - RNA, 15 nt, Homo sapiens
uuucugugugugaug

SEQ ID NO: 1922227 - RNA, 12 nt, Homo sapiens
ucuaaagaccau

SEQ ID NO: 1922228 - RNA, 14 nt, Homo sapiens
auauggugcaaaaa

SEQ ID NO: 1922229 - RNA, 16 nt, Homo sapiens
cugcaccaccgaccaa

SEQ ID NO: 1922230 - RNA, 13 nt, Homo sapiens
agauuuaauugua

SEQ ID NO: 1922231 - RNA, 14 nt, Homo sapiens
agagaauucacuuu

SEQ ID NO: 1922232 - RNA, 17 nt, Homo sapiens
uguaaauacacauagca

SEQ ID NO: 1922233 - RNA, 23 nt, Homo sapiens
cuuccugagggaucuauacuugc

SEQ ID NO: 1922234 - RNA, 22 nt, Homo sapiens
caugacagcuacuaaccuggag

SEQ ID NO: 1922235 - RNA, 22 nt, Homo sapiens
ccagcacuaacguaaauacaca

SEQ ID NO: 1922236 - RNA, 17 nt, Homo sapiens
uguuuccaaaaaccaug

SEQ ID NO: 1922237 - RNA, 21 nt, Homo sapiens
gcaucaccuuaggcagggaag

SEQ ID NO: 1922238 - RNA, 23 nt, Homo sapiens
acauucccuaucaaaacauauca

SEQ ID NO: 1922239 - RNA, 18 nt, Homo sapiens
ucaguggggccccaaagc

SEQ ID NO: 1922240 - RNA, 15 nt, Homo sapiens
ccagccgauguggua

SEQ ID NO: 1922241 - RNA, 18 nt, Homo sapiens
ccacuggaaaaguguaau

SEQ ID NO: 1922242 - RNA, 13 nt, Homo sapiens
caauaugugccaa

SEQ ID NO: 1922243 - RNA, 11 nt, Homo sapiens
gaaaauuacag

SEQ ID NO: 1922244 - RNA, 15 nt, Homo sapiens
aaaacagucaaccaa

SEQ ID NO: 1922245 - RNA, 22 nt, Homo sapiens
cucuggggucuuuuuaugcauu

SEQ ID NO: 1922246 - RNA, 11 nt, Homo sapiens
ugauuccaugg

SEQ ID NO: 1922247 - RNA, 13 nt, Homo sapiens
aucaguuacuggu

SEQ ID NO: 1922248 - RNA, 20 nt, Homo sapiens
cuuguguccccaccucaggc

SEQ ID NO: 1922249 - RNA, 17 nt, Homo sapiens
guggaauugacugccua

SEQ ID NO: 1922250 - RNA, 17 nt, Homo sapiens
gagaauuucaaggcagg

SEQ ID NO: 1922251 - RNA, 18 nt, Homo sapiens
aaugcaaauacccaccag

SEQ ID NO: 1922252 - RNA, 18 nt, Homo sapiens
augaguuuuucaguuuug

SEQ ID NO: 1922253 - RNA, 16 nt, Homo sapiens
cucuucacaccauuca

SEQ ID NO: 1922254 - RNA, 21 nt, Homo sapiens
uguuuccuguggaaauaugca

SEQ ID NO: 1922255 - RNA, 14 nt, Homo sapiens
uuguauccuugaug

SEQ ID NO: 1922256 - RNA, 19 nt, Homo sapiens
cugcuaugucugugauguc

SEQ ID NO: 1922257 - RNA, 14 nt, Homo sapiens
uugacacaguuguu

SEQ ID NO: 1922258 - RNA, 18 nt, Homo sapiens
cuugagacagauucucuc

SEQ ID NO: 1922259 - RNA, 21 nt, Homo sapiens
gucuguucucaaagcagaagu

SEQ ID NO: 1922260 - RNA, 22 nt, Homo sapiens
accucaccugcuggggaccuca

SEQ ID NO: 1922261 - RNA, 19 nt, Homo sapiens
cuauguaaacaaaccacag

SEQ ID NO: 1922262 - RNA, 19 nt, Homo sapiens
gcgaacauaaaugucugua

SEQ ID NO: 1922263 - RNA, 17 nt, Homo sapiens
uagccaccuccuuggca

SEQ ID NO: 1922264 - RNA, 21 nt, Homo sapiens
uuaugcagucggaagcuccag

SEQ ID NO: 1922265 - RNA, 18 nt, Homo sapiens
aguuacaaauucaaggag

SEQ ID NO: 1922266 - RNA, 17 nt, Homo sapiens
cauauuguagcucaaua

SEQ ID NO: 1922267 - RNA, 23 nt, Homo sapiens
uuggccaugggucccauucuugg

SEQ ID NO: 1922268 - RNA, 17 nt, Homo sapiens
ucauaaguuucugagau

SEQ ID NO: 1922269 - RNA, 18 nt, Homo sapiens
aaguugcugcuugugauc

SEQ ID NO: 1922270 - RNA, 16 nt, Homo sapiens
guccugcagcuucggg

SEQ ID NO: 1922271 - RNA, 16 nt, Homo sapiens
caaggcaaggcuguca

SEQ ID NO: 1922272 - RNA, 13 nt, Homo sapiens
aagcccuggcaac

SEQ ID NO: 1922273 - RNA, 17 nt, Homo sapiens
aguguuagacuauagcc

SEQ ID NO: 1922274 - RNA, 20 nt, Homo sapiens
uucaucguguuaaccaggau

SEQ ID NO: 1922275 - RNA, 19 nt, Homo sapiens
ugagcuaaggcagccuuca

SEQ ID NO: 1922276 - RNA, 21 nt, Homo sapiens
ggggacacagcaucagcucaa

SEQ ID NO: 1922277 - RNA, 16 nt, Homo sapiens
cauaacaggagugcca

SEQ ID NO: 1922278 - RNA, 21 nt, Homo sapiens
gucucuguugguccacugugu

SEQ ID NO: 1922279 - RNA, 18 nt, Homo sapiens
cuucugaauaaagcaauu

SEQ ID NO: 1922280 - RNA, 12 nt, Homo sapiens
gaaacucccacc

SEQ ID NO: 1922281 - RNA, 11 nt, Homo sapiens
aggggccagaa

SEQ ID NO: 1922282 - RNA, 16 nt, Homo sapiens
gucauugacaaagcug

SEQ ID NO: 1922283 - RNA, 18 nt, Homo sapiens
cucuuccccauaaucacu

SEQ ID NO: 1922284 - RNA, 14 nt, Homo sapiens
gccuggccucucag

SEQ ID NO: 1922285 - RNA, 20 nt, Homo sapiens
aaugcaaacucaccgcucca

SEQ ID NO: 1922286 - RNA, 17 nt, Homo sapiens
ccccucacacuuugcca

SEQ ID NO: 1922287 - RNA, 21 nt, Homo sapiens
ccagaaaaccucuccugaccc

SEQ ID NO: 1922288 - RNA, 22 nt, Homo sapiens
cuaauagagugguacagcacug

SEQ ID NO: 1922289 - RNA, 21 nt, Homo sapiens
aggcagaguuugccuuccuuu

SEQ ID NO: 1922290 - RNA, 16 nt, Homo sapiens
auugugaauuacaguu

SEQ ID NO: 1922291 - RNA, 19 nt, Homo sapiens
ccuggcuaagaucaugucu

SEQ ID NO: 1922292 - RNA, 20 nt, Homo sapiens
ccauggucuuuccacuuuca

SEQ ID NO: 1922293 - RNA, 16 nt, Homo sapiens
uugugauaauucucag

SEQ ID NO: 1922294 - RNA, 23 nt, Homo sapiens
guuaaaaucuuagaaaauuaaau

SEQ ID NO: 1922295 - RNA, 23 nt, Homo sapiens
gagcugcccccuccaggccaguu

SEQ ID NO: 1922296 - RNA, 14 nt, Homo sapiens
cacacuguauauaa

SEQ ID NO: 1922297 - RNA, 16 nt, Homo sapiens
auuucagcuacauaua

SEQ ID NO: 1922298 - RNA, 19 nt, Homo sapiens
uccuuagcauucauaaacu

SEQ ID NO: 1922299 - RNA, 18 nt, Homo sapiens
uuccaaaagcaaaugaua

SEQ ID NO: 1922300 - RNA, 14 nt, Homo sapiens
gucuccaugcucac

SEQ ID NO: 1922301 - RNA, 23 nt, Homo sapiens
cucaagaaauaaaaggaagccaa

SEQ ID NO: 1922302 - RNA, 15 nt, Homo sapiens
guuuggccuauucca

SEQ ID NO: 1922303 - RNA, 19 nt, Homo sapiens
ggccucagcugaaugccuc

SEQ ID NO: 1922304 - RNA, 24 nt, Homo sapiens
cacauguauguccauucacuuuca

SEQ ID NO: 1922305 - RNA, 19 nt, Homo sapiens
ccuccuccgcgcuguguaa

SEQ ID NO: 1922306 - RNA, 19 nt, Homo sapiens
cccugauuguguauauuca

SEQ ID NO: 1922307 - RNA, 16 nt, Homo sapiens
acaucacaccugcccu

SEQ ID NO: 1922308 - RNA, 15 nt, Homo sapiens
uguauaaguaauuca

SEQ ID NO: 1922309 - RNA, 23 nt, Homo sapiens
auugaauaggcauuaaaugcaaa

SEQ ID NO: 1922310 - RNA, 17 nt, Homo sapiens
aucuaauagggcaauua

SEQ ID NO: 1922311 - RNA, 22 nt, Homo sapiens
uauuuccccaccccacuauccu

SEQ ID NO: 1922312 - RNA, 22 nt, Homo sapiens
ccccuaaugccuaucugaccaa

SEQ ID NO: 1922313 - RNA, 16 nt, Homo sapiens
aucuaguuaaccaauc

SEQ ID NO: 1922314 - RNA, 16 nt, Homo sapiens
cuuuuaaccaucugau

SEQ ID NO: 1922315 - RNA, 16 nt, Homo sapiens
aaaucuugucuuacca

SEQ ID NO: 1922316 - RNA, 18 nt, Homo sapiens
ccagacuucucuuucuua

SEQ ID NO: 1922317 - RNA, 19 nt, Homo sapiens
cagcccuucccugcuuuga

SEQ ID NO: 1922318 - RNA, 15 nt, Homo sapiens
uuuauuggccuuaca

SEQ ID NO: 1922319 - RNA, 14 nt, Homo sapiens
acuaaagauaucag

SEQ ID NO: 1922320 - RNA, 22 nt, Homo sapiens
caaugcuaccgccccaaaguaa

SEQ ID NO: 1922321 - RNA, 21 nt, Homo sapiens
accaaaaugacaaugaugaug

SEQ ID NO: 1922322 - RNA, 19 nt, Homo sapiens
aagggcaacagaucaguaa

SEQ ID NO: 1922323 - RNA, 12 nt, Homo sapiens
uaccagaaccac

SEQ ID NO: 1922324 - RNA, 19 nt, Homo sapiens
cauaguuauuuacuugaaa

SEQ ID NO: 1922325 - RNA, 14 nt, Homo sapiens
ucaaggagauauga

SEQ ID NO: 1922326 - RNA, 23 nt, Homo sapiens
agacuuucagccgacucagcaac

SEQ ID NO: 1922327 - RNA, 17 nt, Homo sapiens
caacaaugguugaauga

SEQ ID NO: 1922328 - RNA, 17 nt, Homo sapiens
aaaccaaauuacaagua

SEQ ID NO: 1922329 - RNA, 17 nt, Homo sapiens
uagcugggaccacaagu

SEQ ID NO: 1922330 - RNA, 19 nt, Homo sapiens
auuggucauaacucagccc

SEQ ID NO: 1922331 - RNA, 15 nt, Homo sapiens
ggaggcccuccugug

SEQ ID NO: 1922332 - RNA, 15 nt, Homo sapiens
aaugcucuuuugcac

SEQ ID NO: 1922333 - RNA, 13 nt, Homo sapiens
gcuguagauccca

SEQ ID NO: 1922334 - RNA, 24 nt, Homo sapiens
agugaaugaaagucuugugacuag

SEQ ID NO: 1922335 - RNA, 16 nt, Homo sapiens
auguaaggagccuuuc

SEQ ID NO: 1922336 - RNA, 21 nt, Homo sapiens
gccagccugucccauggacac

SEQ ID NO: 1922337 - RNA, 11 nt, Homo sapiens
gaagauguuua

SEQ ID NO: 1922338 - RNA, 12 nt, Homo sapiens
cuggcacccacu

SEQ ID NO: 1922339 - RNA, 22 nt, Homo sapiens
uaccccuuggaaaugucugcug

SEQ ID NO: 1922340 - RNA, 18 nt, Homo sapiens
aaaagggaaguugugccu

SEQ ID NO: 1922341 - RNA, 18 nt, Homo sapiens
aaaugcugccuagugcua

SEQ ID NO: 1922342 - RNA, 19 nt, Homo sapiens
gagaaaacagauaaugaua

SEQ ID NO: 1922343 - RNA, 18 nt, Homo sapiens
cacagacacaauauguau

SEQ ID NO: 1922344 - RNA, 13 nt, Homo sapiens
auguuuacuguaa

SEQ ID NO: 1922345 - RNA, 17 nt, Homo sapiens
aauuccacagauuauca

SEQ ID NO: 1922346 - RNA, 20 nt, Homo sapiens
cuuggcacccaagaccucag

SEQ ID NO: 1922347 - RNA, 12 nt, Homo sapiens
aacugauucucu

SEQ ID NO: 1922348 - RNA, 23 nt, Homo sapiens
caucugagugcagccguuugaga

SEQ ID NO: 1922349 - RNA, 18 nt, Homo sapiens
gccccagcgagucuggag

SEQ ID NO: 1922350 - RNA, 16 nt, Homo sapiens
ucaaagauucugcauu

SEQ ID NO: 1922351 - RNA, 18 nt, Homo sapiens
ugugcuucucuuuguccc

SEQ ID NO: 1922352 - RNA, 19 nt, Homo sapiens
caggagaccuggcacugga

SEQ ID NO: 1922353 - RNA, 20 nt, Homo sapiens
gcauaccauuaaauaaugca

SEQ ID NO: 1922354 - RNA, 17 nt, Homo sapiens
agccaagggacacagga

SEQ ID NO: 1922355 - RNA, 15 nt, Homo sapiens
acuguuuccugagua

SEQ ID NO: 1922356 - RNA, 15 nt, Homo sapiens
auuacugcaugcacu

SEQ ID NO: 1922357 - RNA, 16 nt, Homo sapiens
gacagacacugcugaa

SEQ ID NO: 1922358 - RNA, 22 nt, Homo sapiens
ucccauuucaauuccugugauu

SEQ ID NO: 1922359 - RNA, 22 nt, Homo sapiens
auucccguugaacgucacaucu

SEQ ID NO: 1922360 - RNA, 13 nt, Homo sapiens
acaugggugcaau

SEQ ID NO: 1922361 - RNA, 15 nt, Homo sapiens
ccacgcccccagaaa

SEQ ID NO: 1922362 - RNA, 15 nt, Homo sapiens
gagccaugcugggaa

SEQ ID NO: 1922363 - RNA, 18 nt, Homo sapiens
gcaggacagcaguacuca

SEQ ID NO: 1922364 - RNA, 17 nt, Homo sapiens
uuaauaugacaaaacaa

SEQ ID NO: 1922365 - RNA, 22 nt, Homo sapiens
gcugaccacgcccccagcugug

SEQ ID NO: 1922366 - RNA, 17 nt, Homo sapiens
cucagcuaacauuccau

SEQ ID NO: 1922367 - RNA, 15 nt, Homo sapiens
uucccacauacauua

SEQ ID NO: 1922368 - RNA, 15 nt, Homo sapiens
auaauuaaaaaccac

SEQ ID NO: 1922369 - RNA, 20 nt, Homo sapiens
ccucccaugcgggugcacac

SEQ ID NO: 1922370 - RNA, 15 nt, Homo sapiens
uaaagaauaauacuu

SEQ ID NO: 1922371 - RNA, 15 nt, Homo sapiens
caucuugcucugcau

SEQ ID NO: 1922372 - RNA, 19 nt, Homo sapiens
uccuuccuauaacuugaug

SEQ ID NO: 1922373 - RNA, 16 nt, Homo sapiens
uugggugcauuugccc

SEQ ID NO: 1922374 - RNA, 20 nt, Homo sapiens
gugggggugcucucucugag

SEQ ID NO: 1922375 - RNA, 17 nt, Homo sapiens
agagauuguuacagaag

SEQ ID NO: 1922376 - RNA, 17 nt, Homo sapiens
accuuacaacucgggga

SEQ ID NO: 1922377 - RNA, 14 nt, Homo sapiens
agaccuugcugaua

SEQ ID NO: 1922378 - RNA, 14 nt, Homo sapiens
uaaaaugucuucuc

SEQ ID NO: 1922379 - RNA, 22 nt, Homo sapiens
acacugggugcccaagcucaga

SEQ ID NO: 1922380 - RNA, 21 nt, Homo sapiens
uugccauuauagcgccuguau

SEQ ID NO: 1922381 - RNA, 22 nt, Homo sapiens
cagcacaguggcggcaacauug

SEQ ID NO: 1922382 - RNA, 19 nt, Homo sapiens
aauguccaaacccacucau

SEQ ID NO: 1922383 - RNA, 16 nt, Homo sapiens
aaaacauaauguauca

SEQ ID NO: 1922384 - RNA, 14 nt, Homo sapiens
uucacacaauacaa

SEQ ID NO: 1922385 - RNA, 16 nt, Homo sapiens
ggaacugguucaagag

SEQ ID NO: 1922386 - RNA, 18 nt, Homo sapiens
caauaaaccuccgccaau

SEQ ID NO: 1922387 - RNA, 18 nt, Homo sapiens
cauauaaauucugauuua

SEQ ID NO: 1922388 - RNA, 19 nt, Homo sapiens
acucacccugggagccagu

SEQ ID NO: 1922389 - RNA, 18 nt, Homo sapiens
uaaacuaaaauacaagua

SEQ ID NO: 1922390 - RNA, 13 nt, Homo sapiens
augggaugaaugg

SEQ ID NO: 1922391 - RNA, 15 nt, Homo sapiens
auuugaaaugguugu

SEQ ID NO: 1922392 - RNA, 21 nt, Homo sapiens
aaagaugggguuucaccaugu

SEQ ID NO: 1922393 - RNA, 17 nt, Homo sapiens
agguagcccagcacugu

SEQ ID NO: 1922394 - RNA, 12 nt, Homo sapiens
ugugacuacuau

SEQ ID NO: 1922395 - RNA, 13 nt, Homo sapiens
agaagcaagccag

SEQ ID NO: 1922396 - RNA, 13 nt, Homo sapiens
accaacaaggaaa

SEQ ID NO: 1922397 - RNA, 23 nt, Homo sapiens
agaaaguuauugauaaguucaua

SEQ ID NO: 1922398 - RNA, 23 nt, Homo sapiens
cauacugcguccacccugagcuc

SEQ ID NO: 1922399 - RNA, 21 nt, Homo sapiens
acaagaagguggaaggcagug

SEQ ID NO: 1922400 - RNA, 16 nt, Homo sapiens
cacacagccaauccaa

SEQ ID NO: 1922401 - RNA, 23 nt, Homo sapiens
agaagaccuugggccaagaugcu

SEQ ID NO: 1922402 - RNA, 16 nt, Homo sapiens
uuaugcccaugaacaa

SEQ ID NO: 1922403 - RNA, 20 nt, Homo sapiens
ccaaaggcauccauagugca

SEQ ID NO: 1922404 - RNA, 14 nt, Homo sapiens
uggccaaucccugu

SEQ ID NO: 1922405 - RNA, 13 nt, Homo sapiens
caagccugagucc

SEQ ID NO: 1922406 - RNA, 14 nt, Homo sapiens
gagaauuggccaga

SEQ ID NO: 1922407 - RNA, 14 nt, Homo sapiens
gcagugaguacuca

SEQ ID NO: 1922408 - RNA, 22 nt, Homo sapiens
uacuauuaccaccaccugcuca

SEQ ID NO: 1922409 - RNA, 19 nt, Homo sapiens
aaguuccacuugguucagg

SEQ ID NO: 1922410 - RNA, 19 nt, Homo sapiens
aaaaguacaaagggcacau

SEQ ID NO: 1922411 - RNA, 22 nt, Homo sapiens
augccuaauguuaguuagugua

SEQ ID NO: 1922412 - RNA, 14 nt, Homo sapiens
gcccagcauggaau

SEQ ID NO: 1922413 - RNA, 14 nt, Homo sapiens
gggaaagccaguga

SEQ ID NO: 1922414 - RNA, 16 nt, Homo sapiens
ugcacacgcuccuucc

SEQ ID NO: 1922415 - RNA, 18 nt, Homo sapiens
ucugugucucugcaucca

SEQ ID NO: 1922416 - RNA, 16 nt, Homo sapiens
ugucuguggggugguu

SEQ ID NO: 1922417 - RNA, 15 nt, Homo sapiens
gauaucuuuccuccc

SEQ ID NO: 1922418 - RNA, 24 nt, Homo sapiens
uacagacaaauacuuagacaguau

SEQ ID NO: 1922419 - RNA, 14 nt, Homo sapiens
uaaacagucaucuu

SEQ ID NO: 1922420 - RNA, 17 nt, Homo sapiens
caaacgcccuuuccucc

SEQ ID NO: 1922421 - RNA, 21 nt, Homo sapiens
ccuugucucucacugcauuug

SEQ ID NO: 1922422 - RNA, 16 nt, Homo sapiens
aacuugcaacuuugag

SEQ ID NO: 1922423 - RNA, 18 nt, Homo sapiens
aauucagaaggaucuuca

SEQ ID NO: 1922424 - RNA, 23 nt, Homo sapiens
cugcuucccacaacuacuagugu

SEQ ID NO: 1922425 - RNA, 21 nt, Homo sapiens
ucccucuggaaagaaacaugu

SEQ ID NO: 1922426 - RNA, 10 nt, Homo sapiens
ucaccuucac

SEQ ID NO: 1922427 - RNA, 17 nt, Homo sapiens
agcacaaaagccucuca

SEQ ID NO: 1922428 - RNA, 15 nt, Homo sapiens
agguaauaaaacucu

SEQ ID NO: 1922429 - RNA, 15 nt, Homo sapiens
aaguugggauuucau

SEQ ID NO: 1922430 - RNA, 16 nt, Homo sapiens
cuaguguguccuguga

SEQ ID NO: 1922431 - RNA, 18 nt, Homo sapiens
cccacacagcuacagcuu

SEQ ID NO: 1922432 - RNA, 19 nt, Homo sapiens
uauccuuggcaccaaagau

SEQ ID NO: 1922433 - RNA, 14 nt, Homo sapiens
uggagacaguaaca

SEQ ID NO: 1922434 - RNA, 22 nt, Homo sapiens
acauagguuagauucucauuca

SEQ ID NO: 1922435 - RNA, 16 nt, Homo sapiens
uagccugcucugccac

SEQ ID NO: 1922436 - RNA, 16 nt, Homo sapiens
uuccucaugaauguaa

SEQ ID NO: 1922437 - RNA, 17 nt, Homo sapiens
guauuuggauaucuguu

SEQ ID NO: 1922438 - RNA, 16 nt, Homo sapiens
ucuuuuauguuugaau

SEQ ID NO: 1922439 - RNA, 15 nt, Homo sapiens
cugcuugcacuuugu

SEQ ID NO: 1922440 - RNA, 18 nt, Homo sapiens
caaagccacugacugaga

SEQ ID NO: 1922441 - RNA, 15 nt, Homo sapiens
gaggagcccugccuc

SEQ ID NO: 1922442 - RNA, 19 nt, Homo sapiens
ucaaauccuuauuguucag

SEQ ID NO: 1922443 - RNA, 21 nt, Homo sapiens
agggaggaacaccugaucuua

SEQ ID NO: 1922444 - RNA, 14 nt, Homo sapiens
acacaaagugaaau

SEQ ID NO: 1922445 - RNA, 17 nt, Homo sapiens
agaaugaagauaaguaa

SEQ ID NO: 1922446 - RNA, 16 nt, Homo sapiens
cuggauuugccugcag

SEQ ID NO: 1922447 - RNA, 15 nt, Homo sapiens
uccccacucccgaaa

SEQ ID NO: 1922448 - RNA, 21 nt, Homo sapiens
uuaugccuucacuuuacaaau

SEQ ID NO: 1922449 - RNA, 18 nt, Homo sapiens
cauuccuuacuugcacug

SEQ ID NO: 1922450 - RNA, 20 nt, Homo sapiens
ccagagcggcuucaccugcg

SEQ ID NO: 1922451 - RNA, 23 nt, Homo sapiens
uuuugugacagagagagauucca

SEQ ID NO: 1922452 - RNA, 14 nt, Homo sapiens
guccauugauguau

SEQ ID NO: 1922453 - RNA, 16 nt, Homo sapiens
cuccagggacagcaac

SEQ ID NO: 1922454 - RNA, 15 nt, Homo sapiens
ccauguucaccaaga

SEQ ID NO: 1922455 - RNA, 20 nt, Homo sapiens
aaucagaauuguagccaguu

SEQ ID NO: 1922456 - RNA, 12 nt, Homo sapiens
cagucagguggg

SEQ ID NO: 1922457 - RNA, 21 nt, Homo sapiens
cauaggccgagcuguggacaa

SEQ ID NO: 1922458 - RNA, 20 nt, Homo sapiens
ugacaucaaagccuggccua

SEQ ID NO: 1922459 - RNA, 20 nt, Homo sapiens
gacauuuuggaagcugagau

SEQ ID NO: 1922460 - RNA, 17 nt, Homo sapiens
uucugaaauaacauggc

SEQ ID NO: 1922461 - RNA, 16 nt, Homo sapiens
aagacaaaaccaaaac

SEQ ID NO: 1922462 - RNA, 13 nt, Homo sapiens
uuaguauuugccc

SEQ ID NO: 1922463 - RNA, 14 nt, Homo sapiens
cccagccacaccca

SEQ ID NO: 1922464 - RNA, 13 nt, Homo sapiens
ugacaagugagac

SEQ ID NO: 1922465 - RNA, 14 nt, Homo sapiens
aaccccugcuccag

SEQ ID NO: 1922466 - RNA, 23 nt, Homo sapiens
uaaccguuuccuuucauuuacug

SEQ ID NO: 1922467 - RNA, 14 nt, Homo sapiens
cagagacccaacag

SEQ ID NO: 1922468 - RNA, 10 nt, Homo sapiens
uccauuagua

SEQ ID NO: 1922469 - RNA, 17 nt, Homo sapiens
gcucacugcaaccucca

SEQ ID NO: 1922470 - RNA, 21 nt, Homo sapiens
ucgcccugcgguagaugggag

SEQ ID NO: 1922471 - RNA, 14 nt, Homo sapiens
gguaaggcugguga

SEQ ID NO: 1922472 - RNA, 22 nt, Homo sapiens
uaccuuugacuuuuuggcuuua

SEQ ID NO: 1922473 - RNA, 19 nt, Homo sapiens
agaguagagggcacugggu

SEQ ID NO: 1922474 - RNA, 21 nt, Homo sapiens
acucuccuugcaguucuugag

SEQ ID NO: 1922475 - RNA, 20 nt, Homo sapiens
gcagcuccuuccuagccuug

SEQ ID NO: 1922476 - RNA, 15 nt, Homo sapiens
gcuuacuacagugaa

SEQ ID NO: 1922477 - RNA, 15 nt, Homo sapiens
ucagagaucauggaa

SEQ ID NO: 1922478 - RNA, 14 nt, Homo sapiens
ugauaugggacuga

SEQ ID NO: 1922479 - RNA, 21 nt, Homo sapiens
aguuuaauuuuugaaaacugg

SEQ ID NO: 1922480 - RNA, 18 nt, Homo sapiens
agggcugcuaugccugug

SEQ ID NO: 1922481 - RNA, 16 nt, Homo sapiens
caaaacaaaauguuau

SEQ ID NO: 1922482 - RNA, 22 nt, Homo sapiens
ucaguuuuaucuuuaaucuccu

SEQ ID NO: 1922483 - RNA, 18 nt, Homo sapiens
ucugcccggcuacaucag

SEQ ID NO: 1922484 - RNA, 17 nt, Homo sapiens
ccuuuaaaaaugcacca

SEQ ID NO: 1922485 - RNA, 16 nt, Homo sapiens
gccaaauaaacagcua

SEQ ID NO: 1922486 - RNA, 16 nt, Homo sapiens
accacgccuagccuca

SEQ ID NO: 1922487 - RNA, 18 nt, Homo sapiens
uaggagauaccaccgaca

SEQ ID NO: 1922488 - RNA, 14 nt, Homo sapiens
augaaauuaacaca

SEQ ID NO: 1922489 - RNA, 20 nt, Homo sapiens
aacugaccagccuccaugcu

SEQ ID NO: 1922490 - RNA, 20 nt, Homo sapiens
cuuucacacuuccaccagcc

SEQ ID NO: 1922491 - RNA, 15 nt, Homo sapiens
aggauaacuugcuuu

SEQ ID NO: 1922492 - RNA, 14 nt, Homo sapiens
ccaaugaacgaagc

SEQ ID NO: 1922493 - RNA, 19 nt, Homo sapiens
cacacaugaguauugugau

SEQ ID NO: 1922494 - RNA, 21 nt, Homo sapiens
uccugggugcugucaugccca

SEQ ID NO: 1922495 - RNA, 17 nt, Homo sapiens
ugcaaaacauaucuuga

SEQ ID NO: 1922496 - RNA, 16 nt, Homo sapiens
aauaaauuaaacaugc

SEQ ID NO: 1922497 - RNA, 12 nt, Homo sapiens
aguuaaagcuac

SEQ ID NO: 1922498 - RNA, 15 nt, Homo sapiens
cgugguagucacuug

SEQ ID NO: 1922499 - RNA, 15 nt, Homo sapiens
aagacaaccaucaca

SEQ ID NO: 1922500 - RNA, 23 nt, Homo sapiens
uaaguaccuuauucuacaucauu

SEQ ID NO: 1922501 - RNA, 12 nt, Homo sapiens
uuaugugaagaa

SEQ ID NO: 1922502 - RNA, 20 nt, Homo sapiens
ucaaacgccgcugacugcca

SEQ ID NO: 1922503 - RNA, 19 nt, Homo sapiens
ugugguuuuuagugcacuu

SEQ ID NO: 1922504 - RNA, 13 nt, Homo sapiens
ucccccugccucc

SEQ ID NO: 1922505 - RNA, 17 nt, Homo sapiens
ugucagauuaccaguua

SEQ ID NO: 1922506 - RNA, 17 nt, Homo sapiens
gauaccuacccccaaaa

SEQ ID NO: 1922507 - RNA, 19 nt, Homo sapiens
ccacacugauccuggagaa

SEQ ID NO: 1922508 - RNA, 17 nt, Homo sapiens
aggcugcugaaaaccau

SEQ ID NO: 1922509 - RNA, 18 nt, Homo sapiens
caaucucugccauaucag

SEQ ID NO: 1922510 - RNA, 14 nt, Homo sapiens
guuauaaaguccuu

SEQ ID NO: 1922511 - RNA, 14 nt, Homo sapiens
aauaauaaaaccaa

SEQ ID NO: 1922512 - RNA, 24 nt, Homo sapiens
uuucuggugccuauuuauucauuc

SEQ ID NO: 1922513 - RNA, 13 nt, Homo sapiens
ucgaacacauuca

SEQ ID NO: 1922514 - RNA, 22 nt, Homo sapiens
gacucacuuguucucacugucu

SEQ ID NO: 1922515 - RNA, 13 nt, Homo sapiens
guuauauauuccu

SEQ ID NO: 1922516 - RNA, 13 nt, Homo sapiens
uccagaccaccug

SEQ ID NO: 1922517 - RNA, 21 nt, Homo sapiens
aauagauuguaauacacauau

SEQ ID NO: 1922518 - RNA, 14 nt, Homo sapiens
aaagugaccuccag

SEQ ID NO: 1922519 - RNA, 17 nt, Homo sapiens
uguuuccuaacugugau

SEQ ID NO: 1922520 - RNA, 14 nt, Homo sapiens
ugacaaaacacagc

SEQ ID NO: 1922521 - RNA, 20 nt, Homo sapiens
uuccaguuauuuauuuccaa

SEQ ID NO: 1922522 - RNA, 19 nt, Homo sapiens
gcgggacugucaauggagg

SEQ ID NO: 1922523 - RNA, 15 nt, Homo sapiens
aaggucuucagccau

SEQ ID NO: 1922524 - RNA, 20 nt, Homo sapiens
gaugcacggcggcagggugg

SEQ ID NO: 1922525 - RNA, 20 nt, Homo sapiens
cccaggccacccccauggaa

SEQ ID NO: 1922526 - RNA, 17 nt, Homo sapiens
cugucucuccagugaaa

SEQ ID NO: 1922527 - RNA, 22 nt, Homo sapiens
gaucacugaagaaacuucugcu

SEQ ID NO: 1922528 - RNA, 20 nt, Homo sapiens
gcaagaugaccuacuaguuu

SEQ ID NO: 1922529 - RNA, 13 nt, Homo sapiens
acaaucagaccaa

SEQ ID NO: 1922530 - RNA, 15 nt, Homo sapiens
cugacaguaaaucuc

SEQ ID NO: 1922531 - RNA, 22 nt, Homo sapiens
cucuuccccauaaucacugacc

SEQ ID NO: 1922532 - RNA, 14 nt, Homo sapiens
cacagaagggugug

SEQ ID NO: 1922533 - RNA, 21 nt, Homo sapiens
acaggcaugaaucacugugcu

SEQ ID NO: 1922534 - RNA, 20 nt, Homo sapiens
auaagcagucauccucagau

SEQ ID NO: 1922535 - RNA, 12 nt, Homo sapiens
guguacaaugug

SEQ ID NO: 1922536 - RNA, 15 nt, Homo sapiens
gaucuuugacucuuu

SEQ ID NO: 1922537 - RNA, 19 nt, Homo sapiens
caaacccagauugaagcua

SEQ ID NO: 1922538 - RNA, 15 nt, Homo sapiens
ccagccuggccaaca

SEQ ID NO: 1922539 - RNA, 21 nt, Homo sapiens
auauaucuaugucuauaucau

SEQ ID NO: 1922540 - RNA, 19 nt, Homo sapiens
cccaauggcaacaucuugc

SEQ ID NO: 1922541 - RNA, 18 nt, Homo sapiens
aaacaagugggacauauu

SEQ ID NO: 1922542 - RNA, 18 nt, Homo sapiens
auuugaccacggacucca

SEQ ID NO: 1922543 - RNA, 20 nt, Homo sapiens
aucucagccauucuaacuca

SEQ ID NO: 1922544 - RNA, 23 nt, Homo sapiens
caaguucuggagcucuuguguca

SEQ ID NO: 1922545 - RNA, 17 nt, Homo sapiens
ugagcaaacaaaaccac

SEQ ID NO: 1922546 - RNA, 11 nt, Homo sapiens
ugcuugcuccc

SEQ ID NO: 1922547 - RNA, 19 nt, Homo sapiens
ccagccagacccuggagag

SEQ ID NO: 1922548 - RNA, 12 nt, Homo sapiens
uaacacagugca

SEQ ID NO: 1922549 - RNA, 12 nt, Homo sapiens
aaccacagagaa

SEQ ID NO: 1922550 - RNA, 22 nt, Homo sapiens
accccauagaccuaacugugaa

SEQ ID NO: 1922551 - RNA, 15 nt, Homo sapiens
ccuaucccauucugc

SEQ ID NO: 1922552 - RNA, 17 nt, Homo sapiens
aaugucuuucuauucau

SEQ ID NO: 1922553 - RNA, 20 nt, Homo sapiens
acaacuugccaaaacagaua

SEQ ID NO: 1922554 - RNA, 19 nt, Homo sapiens
gccuaccaaugccaaaagg

SEQ ID NO: 1922555 - RNA, 14 nt, Homo sapiens
cagcugggugcaga

SEQ ID NO: 1922556 - RNA, 17 nt, Homo sapiens
caauauuuuaagcauua

SEQ ID NO: 1922557 - RNA, 21 nt, Homo sapiens
aagaauggcacucuugggcuu

SEQ ID NO: 1922558 - RNA, 22 nt, Homo sapiens
ugguuuauguggacaagccauu

SEQ ID NO: 1922559 - RNA, 21 nt, Homo sapiens
acacauauauuauuugcagug

SEQ ID NO: 1922560 - RNA, 23 nt, Homo sapiens
cccugagggacuuggcaguagaa

SEQ ID NO: 1922561 - RNA, 13 nt, Homo sapiens
aucaaugucacuu

SEQ ID NO: 1922562 - RNA, 16 nt, Homo sapiens
uuaagauguguagacc

SEQ ID NO: 1922563 - RNA, 14 nt, Homo sapiens
caggaaaauggaca

SEQ ID NO: 1922564 - RNA, 11 nt, Homo sapiens
uugcuguagaa

SEQ ID NO: 1922565 - RNA, 18 nt, Homo sapiens
gucuguggcuuggugagu

SEQ ID NO: 1922566 - RNA, 13 nt, Homo sapiens
auaacagccucau

SEQ ID NO: 1922567 - RNA, 13 nt, Homo sapiens
ucagcuggcugua

SEQ ID NO: 1922568 - RNA, 20 nt, Homo sapiens
aagaauugucuuucugucuc

SEQ ID NO: 1922569 - RNA, 18 nt, Homo sapiens
gccaaacuggugcaugac

SEQ ID NO: 1922570 - RNA, 13 nt, Homo sapiens
ucaggcccaggag

SEQ ID NO: 1922571 - RNA, 23 nt, Homo sapiens
aaggaggguugugcccacuucau

SEQ ID NO: 1922572 - RNA, 20 nt, Homo sapiens
cugcacauuuuguacaaaga

SEQ ID NO: 1922573 - RNA, 20 nt, Homo sapiens
uaaaaccacagaacaguuug

SEQ ID NO: 1922574 - RNA, 12 nt, Homo sapiens
uuaaacuugaaa

SEQ ID NO: 1922575 - RNA, 18 nt, Homo sapiens
cagugagaacaucuggcc

SEQ ID NO: 1922576 - RNA, 21 nt, Homo sapiens
uuuccuccuguguacagggaa

SEQ ID NO: 1922577 - RNA, 15 nt, Homo sapiens
cugucugcccugaac

SEQ ID NO: 1922578 - RNA, 13 nt, Homo sapiens
uacagaaaugacu

SEQ ID NO: 1922579 - RNA, 18 nt, Homo sapiens
aacggugccaucccugaa

SEQ ID NO: 1922580 - RNA, 13 nt, Homo sapiens
auucagccuuuag

SEQ ID NO: 1922581 - RNA, 20 nt, Homo sapiens
uuuaagccugaagagcuuau

SEQ ID NO: 1922582 - RNA, 19 nt, Homo sapiens
cauagauuaauggcacuga

SEQ ID NO: 1922583 - RNA, 23 nt, Homo sapiens
gaaaucuugucuuaccacagugu

SEQ ID NO: 1922584 - RNA, 17 nt, Homo sapiens
guucuucuggggugcua

SEQ ID NO: 1922585 - RNA, 19 nt, Homo sapiens
auucuguacuuccaauuua

SEQ ID NO: 1922586 - RNA, 22 nt, Homo sapiens
auggcagggcugaggaugggcu

SEQ ID NO: 1922587 - RNA, 21 nt, Homo sapiens
aaguaugugguacuacuguaa

SEQ ID NO: 1922588 - RNA, 14 nt, Homo sapiens
aaaauaaaagacua

SEQ ID NO: 1922589 - RNA, 15 nt, Homo sapiens
ugccggaggccuucc

SEQ ID NO: 1922590 - RNA, 13 nt, Homo sapiens
gacauuguuacaa

SEQ ID NO: 1922591 - RNA, 16 nt, Homo sapiens
uaaggcaggagaauca

SEQ ID NO: 1922592 - RNA, 17 nt, Homo sapiens
gugaauuaaaguacuuu

SEQ ID NO: 1922593 - RNA, 15 nt, Homo sapiens
cugacuggugcugca

SEQ ID NO: 1922594 - RNA, 14 nt, Homo sapiens
cucgagauguaucc

SEQ ID NO: 1922595 - RNA, 22 nt, Homo sapiens
uugggacgcacagugcaguuga

SEQ ID NO: 1922596 - RNA, 14 nt, Homo sapiens
ugugguuagaaaag

SEQ ID NO: 1922597 - RNA, 23 nt, Homo sapiens
ccuuugagugucaggcucugaau

SEQ ID NO: 1922598 - RNA, 12 nt, Homo sapiens
uaucaacugcca

SEQ ID NO: 1922599 - RNA, 12 nt, Homo sapiens
ugacuuuaguga

SEQ ID NO: 1922600 - RNA, 20 nt, Homo sapiens
cagauccaccugcacaaaca

SEQ ID NO: 1922601 - RNA, 16 nt, Homo sapiens
ugaugaaucaacaaga

SEQ ID NO: 1922602 - RNA, 17 nt, Homo sapiens
cuugcguauuggcuuuu

SEQ ID NO: 1922603 - RNA, 17 nt, Homo sapiens
acugccagaacauggau

SEQ ID NO: 1922604 - RNA, 12 nt, Homo sapiens
auucuucacucu

SEQ ID NO: 1922605 - RNA, 17 nt, Homo sapiens
aguguucccugaucccu

SEQ ID NO: 1922606 - RNA, 15 nt, Homo sapiens
guuugauuuucauau

SEQ ID NO: 1922607 - RNA, 17 nt, Homo sapiens
aguagcugagugcacuc

SEQ ID NO: 1922608 - RNA, 13 nt, Homo sapiens
cuucccagguagc

SEQ ID NO: 1922609 - RNA, 14 nt, Homo sapiens
ugauuugccugccu

SEQ ID NO: 1922610 - RNA, 23 nt, Homo sapiens
ucuucuauauuccgggugccauu

SEQ ID NO: 1922611 - RNA, 20 nt, Homo sapiens
gacggaaaggaaaaacugau

SEQ ID NO: 1922612 - RNA, 17 nt, Homo sapiens
gacagaugggcauaugu

SEQ ID NO: 1922613 - RNA, 16 nt, Homo sapiens
cauaaugaacagaauu

SEQ ID NO: 1922614 - RNA, 19 nt, Homo sapiens
aucucagcauuuuuauucc

SEQ ID NO: 1922615 - RNA, 20 nt, Homo sapiens
cauaguaaugagugaguucu

SEQ ID NO: 1922616 - RNA, 20 nt, Homo sapiens
acauuuguaaaaauacuguu

SEQ ID NO: 1922617 - RNA, 23 nt, Homo sapiens
cuggcaaaaucuuguuaauguca

SEQ ID NO: 1922618 - RNA, 23 nt, Homo sapiens
cacugcugggaaguggcuuaaua

SEQ ID NO: 1922619 - RNA, 19 nt, Homo sapiens
gaacacccucuaaauggga

SEQ ID NO: 1922620 - RNA, 14 nt, Homo sapiens
cugcacaggucucu

SEQ ID NO: 1922621 - RNA, 19 nt, Homo sapiens
ggaaaauggagccaugaca

SEQ ID NO: 1922622 - RNA, 22 nt, Homo sapiens
gcgccagccugucccauggaca

SEQ ID NO: 1922623 - RNA, 20 nt, Homo sapiens
aguuuucuagagacuugaag

SEQ ID NO: 1922624 - RNA, 19 nt, Homo sapiens
uuauuuagggaacugcuug

SEQ ID NO: 1922625 - RNA, 18 nt, Homo sapiens
acuucccagagcaucuug

SEQ ID NO: 1922626 - RNA, 21 nt, Homo sapiens
cagaaaaaguuucuuaaggaa

SEQ ID NO: 1922627 - RNA, 13 nt, Homo sapiens
ccaaguagcugcu

SEQ ID NO: 1922628 - RNA, 21 nt, Homo sapiens
uguccgggcucagaaugggag

SEQ ID NO: 1922629 - RNA, 21 nt, Homo sapiens
aucccaugauguagugccucu

SEQ ID NO: 1922630 - RNA, 23 nt, Homo sapiens
gccaccuggaggaacugcuugug

SEQ ID NO: 1922631 - RNA, 18 nt, Homo sapiens
cugcacaugguucaccau

SEQ ID NO: 1922632 - RNA, 15 nt, Homo sapiens
ugcuggacugaggac

SEQ ID NO: 1922633 - RNA, 21 nt, Homo sapiens
uaaaauguuuauagcauuccu

SEQ ID NO: 1922634 - RNA, 13 nt, Homo sapiens
cccugcucccaca

SEQ ID NO: 1922635 - RNA, 17 nt, Homo sapiens
agacacuacaacauaug

SEQ ID NO: 1922636 - RNA, 19 nt, Homo sapiens
cuacuuuuaguugacucac

SEQ ID NO: 1922637 - RNA, 12 nt, Homo sapiens
ccuguaccucau

SEQ ID NO: 1922638 - RNA, 14 nt, Homo sapiens
uuaaaaugacaaaa

SEQ ID NO: 1922639 - RNA, 16 nt, Homo sapiens
gcccuuucugcuccuu

SEQ ID NO: 1922640 - RNA, 16 nt, Homo sapiens
cacacuguccuauuau

SEQ ID NO: 1922641 - RNA, 18 nt, Homo sapiens
aaugaaugcuccaugaaa

SEQ ID NO: 1922642 - RNA, 13 nt, Homo sapiens
aaagcaacaguua

SEQ ID NO: 1922643 - RNA, 17 nt, Homo sapiens
ccagucccucagccacu

SEQ ID NO: 1922644 - RNA, 13 nt, Homo sapiens
auuuuauuucaau

SEQ ID NO: 1922645 - RNA, 22 nt, Homo sapiens
aauuaaauuuuuaaacuaugug

SEQ ID NO: 1922646 - RNA, 15 nt, Homo sapiens
acugucuuccucaaa

SEQ ID NO: 1922647 - RNA, 21 nt, Homo sapiens
gcacgaucucggcucacugca

SEQ ID NO: 1922648 - RNA, 22 nt, Homo sapiens
caacugugaguagccuaugaau

SEQ ID NO: 1922649 - RNA, 18 nt, Homo sapiens
ccaccucccauuacuuug

SEQ ID NO: 1922650 - RNA, 22 nt, Homo sapiens
caaaccgccggccacacugguc

SEQ ID NO: 1922651 - RNA, 16 nt, Homo sapiens
gaauauaaacacauaa

SEQ ID NO: 1922652 - RNA, 15 nt, Homo sapiens
uuaaguuuaccaaau

SEQ ID NO: 1922653 - RNA, 18 nt, Homo sapiens
ucaccguggggcuggaag

SEQ ID NO: 1922654 - RNA, 21 nt, Homo sapiens
gugccagcaaugacaucucag

SEQ ID NO: 1922655 - RNA, 21 nt, Homo sapiens
gggucucacucuguugcccag

SEQ ID NO: 1922656 - RNA, 20 nt, Homo sapiens
agaggaauuuuuucuuuuga

SEQ ID NO: 1922657 - RNA, 18 nt, Homo sapiens
guucgauuucuaccucag

SEQ ID NO: 1922658 - RNA, 14 nt, Homo sapiens
cacgauuaacugug

SEQ ID NO: 1922659 - RNA, 13 nt, Homo sapiens
cacccaucaggac

SEQ ID NO: 1922660 - RNA, 17 nt, Homo sapiens
auaguaacguguuacug

SEQ ID NO: 1922661 - RNA, 21 nt, Homo sapiens
gguaaaaaggagaauuuuucc

SEQ ID NO: 1922662 - RNA, 15 nt, Homo sapiens
aaucuauaugauuaa

SEQ ID NO: 1922663 - RNA, 14 nt, Homo sapiens
cccugggacaccca

SEQ ID NO: 1922664 - RNA, 22 nt, Homo sapiens
ggcuaguuaauccaaacaugca

SEQ ID NO: 1922665 - RNA, 12 nt, Homo sapiens
gagcuaagucac

SEQ ID NO: 1922666 - RNA, 16 nt, Homo sapiens
uuaacucauaugaucu

SEQ ID NO: 1922667 - RNA, 15 nt, Homo sapiens
gcucgaagacuguga

SEQ ID NO: 1922668 - RNA, 22 nt, Homo sapiens
cuggaugcagccucacaguccu

SEQ ID NO: 1922669 - RNA, 20 nt, Homo sapiens
ugcauauuuuuaaacaaaga

SEQ ID NO: 1922670 - RNA, 17 nt, Homo sapiens
gaucauuuuuauaugaa

SEQ ID NO: 1922671 - RNA, 23 nt, Homo sapiens
guugaggggaccaagguggcacg

SEQ ID NO: 1922672 - RNA, 13 nt, Homo sapiens
uaacaccugccua

SEQ ID NO: 1922673 - RNA, 15 nt, Homo sapiens
uaacuauauuugcuu

SEQ ID NO: 1922674 - RNA, 23 nt, Homo sapiens
uuugccauauuuucaccauuuga

SEQ ID NO: 1922675 - RNA, 15 nt, Homo sapiens
ccugugugugcugcc

SEQ ID NO: 1922676 - RNA, 15 nt, Homo sapiens
uagugaaacauguac

SEQ ID NO: 1922677 - RNA, 13 nt, Homo sapiens
ccuguucuuuuaa

SEQ ID NO: 1922678 - RNA, 16 nt, Homo sapiens
ccuuccaugugccuuu

SEQ ID NO: 1922679 - RNA, 17 nt, Homo sapiens
auuaaaaccauuaccuu

SEQ ID NO: 1922680 - RNA, 19 nt, Homo sapiens
cugucaauacagguuuuau

SEQ ID NO: 1922681 - RNA, 16 nt, Homo sapiens
uaaaaaugaauuggga

SEQ ID NO: 1922682 - RNA, 13 nt, Homo sapiens
agaaugaaaguag

SEQ ID NO: 1922683 - RNA, 20 nt, Homo sapiens
agagaaaccugccaaggagc

SEQ ID NO: 1922684 - RNA, 20 nt, Homo sapiens
uacacagagaaauacaaaau

SEQ ID NO: 1922685 - RNA, 23 nt, Homo sapiens
gaguuugaaggaggugagggaug

SEQ ID NO: 1922686 - RNA, 22 nt, Homo sapiens
uuuucccaacuccucaugucuu

SEQ ID NO: 1922687 - RNA, 18 nt, Homo sapiens
ccucuuugucuaaaacaa

SEQ ID NO: 1922688 - RNA, 13 nt, Homo sapiens
agagaaauucugu

SEQ ID NO: 1922689 - RNA, 22 nt, Homo sapiens
cugcagggggugugucugcuca

SEQ ID NO: 1922690 - RNA, 14 nt, Homo sapiens
guaauccuauuaaa

SEQ ID NO: 1922691 - RNA, 16 nt, Homo sapiens
aacaccagcagcacug

SEQ ID NO: 1922692 - RNA, 12 nt, Homo sapiens
cugaacagugga

SEQ ID NO: 1922693 - RNA, 18 nt, Homo sapiens
uuuccguaaaaaugauuu

SEQ ID NO: 1922694 - RNA, 13 nt, Homo sapiens
ugcauggccuuag

SEQ ID NO: 1922695 - RNA, 23 nt, Homo sapiens
gauaccauucuauucuccagaca

SEQ ID NO: 1922696 - RNA, 20 nt, Homo sapiens
caggcugguauuuaucugca

SEQ ID NO: 1922697 - RNA, 17 nt, Homo sapiens
uagcaacccugugauac

SEQ ID NO: 1922698 - RNA, 13 nt, Homo sapiens
cuuucauauggua

SEQ ID NO: 1922699 - RNA, 21 nt, Homo sapiens
cagggcucgggagccauguca

SEQ ID NO: 1922700 - RNA, 17 nt, Homo sapiens
cacgcuggacagcacuc

SEQ ID NO: 1922701 - RNA, 23 nt, Homo sapiens
acaauguugcauuuaugaugcag

SEQ ID NO: 1922702 - RNA, 21 nt, Homo sapiens
ccucuucccccuuccaaauaa

SEQ ID NO: 1922703 - RNA, 14 nt, Homo sapiens
ucaccaagagccaa

SEQ ID NO: 1922704 - RNA, 16 nt, Homo sapiens
uaaauacaaguucuuu

SEQ ID NO: 1922705 - RNA, 21 nt, Homo sapiens
uaauaaaaugcuaaaugucaa

SEQ ID NO: 1922706 - RNA, 16 nt, Homo sapiens
ccaccaaaugugcuuu

SEQ ID NO: 1922707 - RNA, 14 nt, Homo sapiens
caguuuuaccucuu

SEQ ID NO: 1922708 - RNA, 16 nt, Homo sapiens
uguauucugcaacagc

SEQ ID NO: 1922709 - RNA, 21 nt, Homo sapiens
gcucccacuauggugggagac

SEQ ID NO: 1922710 - RNA, 14 nt, Homo sapiens
gaaaugcauugcuc

SEQ ID NO: 1922711 - RNA, 13 nt, Homo sapiens
guguauuugccag

SEQ ID NO: 1922712 - RNA, 17 nt, Homo sapiens
ucauaaucuuugcuuua

SEQ ID NO: 1922713 - RNA, 23 nt, Homo sapiens
caggucugacaccuuucagucuc

SEQ ID NO: 1922714 - RNA, 18 nt, Homo sapiens
agcaaucauuuuauauaa

SEQ ID NO: 1922715 - RNA, 18 nt, Homo sapiens
uuuugacaucaaugauga

SEQ ID NO: 1922716 - RNA, 12 nt, Homo sapiens
uuucucauuaga

SEQ ID NO: 1922717 - RNA, 15 nt, Homo sapiens
ggcagcaggggccaa

SEQ ID NO: 1922718 - RNA, 15 nt, Homo sapiens
ggccggccgggugcu

SEQ ID NO: 1922719 - RNA, 22 nt, Homo sapiens
acauucuagcugagaagcaaug

SEQ ID NO: 1922720 - RNA, 19 nt, Homo sapiens
gcagucgucgcacagucuc

SEQ ID NO: 1922721 - RNA, 16 nt, Homo sapiens
cgauucccaagcuccc

SEQ ID NO: 1922722 - RNA, 13 nt, Homo sapiens
auaaagagcaaua

SEQ ID NO: 1922723 - RNA, 16 nt, Homo sapiens
ccuuugugagucaaua

SEQ ID NO: 1922724 - RNA, 19 nt, Homo sapiens
caacuuggcauuucuauac

SEQ ID NO: 1922725 - RNA, 17 nt, Homo sapiens
auacugagccugccaaa

SEQ ID NO: 1922726 - RNA, 13 nt, Homo sapiens
aaauaucuugcaa

SEQ ID NO: 1922727 - RNA, 19 nt, Homo sapiens
cuaauguacaauaaagcaa

SEQ ID NO: 1922728 - RNA, 15 nt, Homo sapiens
ugcacacauuucuga

SEQ ID NO: 1922729 - RNA, 18 nt, Homo sapiens
ccaggauaucugaaaaua

SEQ ID NO: 1922730 - RNA, 21 nt, Homo sapiens
guccugagcaccacacccagu

SEQ ID NO: 1922731 - RNA, 19 nt, Homo sapiens
gaucaacucugucuugggc

SEQ ID NO: 1922732 - RNA, 19 nt, Homo sapiens
agccagcuggcuuugcacu

SEQ ID NO: 1922733 - RNA, 17 nt, Homo sapiens
ccuucugaggaugcuga

SEQ ID NO: 1922734 - RNA, 14 nt, Homo sapiens
gcacgaagcaguua

SEQ ID NO: 1922735 - RNA, 17 nt, Homo sapiens
augggaaccccuucauc

SEQ ID NO: 1922736 - RNA, 14 nt, Homo sapiens
acgaggcucaaaaa

SEQ ID NO: 1922737 - RNA, 22 nt, Homo sapiens
uuuuaaucaaaugcuuuggacu

SEQ ID NO: 1922738 - RNA, 12 nt, Homo sapiens
uaguaaagcaaa

SEQ ID NO: 1922739 - RNA, 19 nt, Homo sapiens
ccaaggacacgacacacag

SEQ ID NO: 1922740 - RNA, 19 nt, Homo sapiens
caagcaggcgcugugcuau

SEQ ID NO: 1922741 - RNA, 15 nt, Homo sapiens
aaucuugcugcuuau

SEQ ID NO: 1922742 - RNA, 16 nt, Homo sapiens
agaggcccaagcugcc

SEQ ID NO: 1922743 - RNA, 19 nt, Homo sapiens
uuuuuaaaacaucaauuga

SEQ ID NO: 1922744 - RNA, 22 nt, Homo sapiens
augcaauauuuccucaugugau

SEQ ID NO: 1922745 - RNA, 17 nt, Homo sapiens
ggcccacccccaggaag

SEQ ID NO: 1922746 - RNA, 19 nt, Homo sapiens
uauugugccaauauguauu

SEQ ID NO: 1922747 - RNA, 14 nt, Homo sapiens
auugagcugagauc

SEQ ID NO: 1922748 - RNA, 21 nt, Homo sapiens
cagaggucaggaagcaggggu

SEQ ID NO: 1922749 - RNA, 22 nt, Homo sapiens
aaggacauuucucaagggccau

SEQ ID NO: 1922750 - RNA, 20 nt, Homo sapiens
ucgaucuccugaccucguga

SEQ ID NO: 1922751 - RNA, 19 nt, Homo sapiens
cuuauaauuacaaugcaca

SEQ ID NO: 1922752 - RNA, 22 nt, Homo sapiens
acaaacagccucacuccucagc

SEQ ID NO: 1922753 - RNA, 18 nt, Homo sapiens
cuuuaagguguuggugua

SEQ ID NO: 1922754 - RNA, 15 nt, Homo sapiens
uaauuuagacuugga

SEQ ID NO: 1922755 - RNA, 20 nt, Homo sapiens
uaaccuaaugcagaauugcu

SEQ ID NO: 1922756 - RNA, 21 nt, Homo sapiens
accagccuugcucucuucaau

SEQ ID NO: 1922757 - RNA, 14 nt, Homo sapiens
cauguaaauugcaa

SEQ ID NO: 1922758 - RNA, 19 nt, Homo sapiens
caauggaguggcugccaug

SEQ ID NO: 1922759 - RNA, 17 nt, Homo sapiens
aggcaaauuaacuguau

SEQ ID NO: 1922760 - RNA, 21 nt, Homo sapiens
aauggaaaguuaccuuacuga

SEQ ID NO: 1922761 - RNA, 12 nt, Homo sapiens
aggagacauaua

SEQ ID NO: 1922762 - RNA, 16 nt, Homo sapiens
aaauacuguuucacua

SEQ ID NO: 1922763 - RNA, 17 nt, Homo sapiens
uugucugaacaaagugc

SEQ ID NO: 1922764 - RNA, 11 nt, Homo sapiens
aauuaacuggg

SEQ ID NO: 1922765 - RNA, 13 nt, Homo sapiens
aaaagaccaucug

SEQ ID NO: 1922766 - RNA, 23 nt, Homo sapiens
ggcuggguccccuucgcaguguu

SEQ ID NO: 1922767 - RNA, 22 nt, Homo sapiens
uaauauugaaaaugucacuguu

SEQ ID NO: 1922768 - RNA, 21 nt, Homo sapiens
cuugagaggaugaauguaugu

SEQ ID NO: 1922769 - RNA, 18 nt, Homo sapiens
gcacaauuugcacuaaau

SEQ ID NO: 1922770 - RNA, 19 nt, Homo sapiens
aaaguaaagaaaggggaga

SEQ ID NO: 1922771 - RNA, 17 nt, Homo sapiens
cuguacuauccagugag

SEQ ID NO: 1922772 - RNA, 18 nt, Homo sapiens
aaagggagccaugcucuu

SEQ ID NO: 1922773 - RNA, 20 nt, Homo sapiens
uuuagcauucauauuuucca

SEQ ID NO: 1922774 - RNA, 15 nt, Homo sapiens
uaacagugugcucau

SEQ ID NO: 1922775 - RNA, 20 nt, Homo sapiens
caaggcaguugcuuguguuu

SEQ ID NO: 1922776 - RNA, 19 nt, Homo sapiens
ugcacaaaagucucaaugu

SEQ ID NO: 1922777 - RNA, 21 nt, Homo sapiens
aggaauagucgcgcaagcauc

SEQ ID NO: 1922778 - RNA, 15 nt, Homo sapiens
uuuaaaauauccugu

SEQ ID NO: 1922779 - RNA, 17 nt, Homo sapiens
ucaauaaaguacugcaa

SEQ ID NO: 1922780 - RNA, 20 nt, Homo sapiens
gcuucagugacaaacauauc

SEQ ID NO: 1922781 - RNA, 21 nt, Homo sapiens
ccugggaggaaauuugaaugg

SEQ ID NO: 1922782 - RNA, 20 nt, Homo sapiens
acggagauaucccaggaaaa

SEQ ID NO: 1922783 - RNA, 21 nt, Homo sapiens
cacugcaccucuuugucacag

SEQ ID NO: 1922784 - RNA, 15 nt, Homo sapiens
ucauguauacuucaa

SEQ ID NO: 1922785 - RNA, 18 nt, Homo sapiens
cucggcaccagugccuca

SEQ ID NO: 1922786 - RNA, 18 nt, Homo sapiens
uguuaguauuaacuauua

SEQ ID NO: 1922787 - RNA, 21 nt, Homo sapiens
acugugucccucucucuggaa

SEQ ID NO: 1922788 - RNA, 12 nt, Homo sapiens
gaaaccuugcag

SEQ ID NO: 1922789 - RNA, 20 nt, Homo sapiens
gaauucuugaaaaacuuaca

SEQ ID NO: 1922790 - RNA, 22 nt, Homo sapiens
uaaauuaaagagaaaauugaga

SEQ ID NO: 1922791 - RNA, 18 nt, Homo sapiens
aaagauucuauaguucua

SEQ ID NO: 1922792 - RNA, 12 nt, Homo sapiens
gcagacaccugu

SEQ ID NO: 1922793 - RNA, 15 nt, Homo sapiens
ugggaggccauuugu

SEQ ID NO: 1922794 - RNA, 22 nt, Homo sapiens
aagugauuuuuuuccacaagau

SEQ ID NO: 1922795 - RNA, 15 nt, Homo sapiens
guacucucucucuuu

SEQ ID NO: 1922796 - RNA, 22 nt, Homo sapiens
ugaugaccaaguuuucuggaag

SEQ ID NO: 1922797 - RNA, 16 nt, Homo sapiens
ccaaauuuggcuaaaa

SEQ ID NO: 1922798 - RNA, 19 nt, Homo sapiens
agcuuucuucuacaaccag

SEQ ID NO: 1922799 - RNA, 19 nt, Homo sapiens
cuucccuucuuugcacuuu

SEQ ID NO: 1922800 - RNA, 23 nt, Homo sapiens
uaaucaugagccuguuuauugcc

SEQ ID NO: 1922801 - RNA, 19 nt, Homo sapiens
uacagacaacaaaccuguu

SEQ ID NO: 1922802 - RNA, 13 nt, Homo sapiens
uggcccagccuuu

SEQ ID NO: 1922803 - RNA, 22 nt, Homo sapiens
caauugugagaauuacuguuug

SEQ ID NO: 1922804 - RNA, 20 nt, Homo sapiens
gauuguaagucccaugaaua

SEQ ID NO: 1922805 - RNA, 17 nt, Homo sapiens
gcuuaaauauugaauaa

SEQ ID NO: 1922806 - RNA, 15 nt, Homo sapiens
caagaggcugagaca

SEQ ID NO: 1922807 - RNA, 16 nt, Homo sapiens
guaugucagugucacu

SEQ ID NO: 1922808 - RNA, 14 nt, Homo sapiens
cuuugagacguccu

SEQ ID NO: 1922809 - RNA, 14 nt, Homo sapiens
gucugcuguagaaa

SEQ ID NO: 1922810 - RNA, 19 nt, Homo sapiens
aaagaacaaauaaaugagc

SEQ ID NO: 1922811 - RNA, 14 nt, Homo sapiens
auugaacacaggca

SEQ ID NO: 1922812 - RNA, 23 nt, Homo sapiens
aguuuaaucuucacaauauccaa

SEQ ID NO: 1922813 - RNA, 19 nt, Homo sapiens
aguugcauugacugucaca

SEQ ID NO: 1922814 - RNA, 14 nt, Homo sapiens
ccuuguauucugag

SEQ ID NO: 1922815 - RNA, 13 nt, Homo sapiens
acaaaauacacau

SEQ ID NO: 1922816 - RNA, 20 nt, Homo sapiens
aacuccccagcuaaagcagu

SEQ ID NO: 1922817 - RNA, 21 nt, Homo sapiens
aucuuuaaaauacacacucaa

SEQ ID NO: 1922818 - RNA, 19 nt, Homo sapiens
uucacuguccauuccaaau

SEQ ID NO: 1922819 - RNA, 21 nt, Homo sapiens
ccagcuacucgggaggcugag

SEQ ID NO: 1922820 - RNA, 12 nt, Homo sapiens
cuuuaguacuua

SEQ ID NO: 1922821 - RNA, 15 nt, Homo sapiens
auaaugagucugcau

SEQ ID NO: 1922822 - RNA, 14 nt, Homo sapiens
aauuuuuacauuca

SEQ ID NO: 1922823 - RNA, 21 nt, Homo sapiens
aacaaggugcacagaccucag

SEQ ID NO: 1922824 - RNA, 21 nt, Homo sapiens
acauuacagggaaugccugag

SEQ ID NO: 1922825 - RNA, 14 nt, Homo sapiens
guuauuacuuguaa

SEQ ID NO: 1922826 - RNA, 17 nt, Homo sapiens
gaucuaagcaguugcaa

SEQ ID NO: 1922827 - RNA, 21 nt, Homo sapiens
gaaccacaccacaucuaagcc

SEQ ID NO: 1922828 - RNA, 19 nt, Homo sapiens
ccaacuccaaccucucggc

SEQ ID NO: 1922829 - RNA, 15 nt, Homo sapiens
auaaauuugagcuau

SEQ ID NO: 1922830 - RNA, 17 nt, Homo sapiens
aaaauacuauugccuca

SEQ ID NO: 1922831 - RNA, 22 nt, Homo sapiens
ggaggugaaagaaagggaccca

SEQ ID NO: 1922832 - RNA, 14 nt, Homo sapiens
uccaugcugugcgc

SEQ ID NO: 1922833 - RNA, 14 nt, Homo sapiens
uugcaugcuugcau

SEQ ID NO: 1922834 - RNA, 14 nt, Homo sapiens
aucucugcaucucu

SEQ ID NO: 1922835 - RNA, 14 nt, Homo sapiens
ugcuuugcugcuuu

SEQ ID NO: 1922836 - RNA, 17 nt, Homo sapiens
guuacuguugcacugau

SEQ ID NO: 1922837 - RNA, 22 nt, Homo sapiens
ugaccacauagaacaugugucu

SEQ ID NO: 1922838 - RNA, 21 nt, Homo sapiens
ucauguaaaccuaagcacgua

SEQ ID NO: 1922839 - RNA, 20 nt, Homo sapiens
uagucuacucuuaagccauc

SEQ ID NO: 1922840 - RNA, 19 nt, Homo sapiens
accuuauacaucacuuccu

SEQ ID NO: 1922841 - RNA, 16 nt, Homo sapiens
guaacuuacaccugga

SEQ ID NO: 1922842 - RNA, 18 nt, Homo sapiens
agaugcugaaaauguccu

SEQ ID NO: 1922843 - RNA, 18 nt, Homo sapiens
accaagaacauaagaauu

SEQ ID NO: 1922844 - RNA, 12 nt, Homo sapiens
uuccacccugcc

SEQ ID NO: 1922845 - RNA, 16 nt, Homo sapiens
acaugaaucaagcaau

SEQ ID NO: 1922846 - RNA, 15 nt, Homo sapiens
agaguuacaguucug

SEQ ID NO: 1922847 - RNA, 17 nt, Homo sapiens
gccacagggugagcacu

SEQ ID NO: 1922848 - RNA, 17 nt, Homo sapiens
ugaaauuaguguuuuca

SEQ ID NO: 1922849 - RNA, 21 nt, Homo sapiens
agcccaggcucggccugcccc

SEQ ID NO: 1922850 - RNA, 18 nt, Homo sapiens
gccugauacugccugaca

SEQ ID NO: 1922851 - RNA, 17 nt, Homo sapiens
cuucccugccacuucaa

SEQ ID NO: 1922852 - RNA, 18 nt, Homo sapiens
ugugauauuucguguacu

SEQ ID NO: 1922853 - RNA, 21 nt, Homo sapiens
ccugugccauaaaaugugcuu

SEQ ID NO: 1922854 - RNA, 18 nt, Homo sapiens
cauucauuccauucugga

SEQ ID NO: 1922855 - RNA, 19 nt, Homo sapiens
gacuaaguguaccagagaa

SEQ ID NO: 1922856 - RNA, 18 nt, Homo sapiens
ggcaacagagcaagaucc

SEQ ID NO: 1922857 - RNA, 15 nt, Homo sapiens
cguccucaugguacu

SEQ ID NO: 1922858 - RNA, 16 nt, Homo sapiens
agcccuggaccugccu

SEQ ID NO: 1922859 - RNA, 20 nt, Homo sapiens
gcauuggcucaugucuguaa

SEQ ID NO: 1922860 - RNA, 12 nt, Homo sapiens
uaagacuguaau

SEQ ID NO: 1922861 - RNA, 20 nt, Homo sapiens
uuaucaauguucuaguucug

SEQ ID NO: 1922862 - RNA, 24 nt, Homo sapiens
agcacaaacacaaggucauggcca

SEQ ID NO: 1922863 - RNA, 18 nt, Homo sapiens
caaaccuuaaaacagcug

SEQ ID NO: 1922864 - RNA, 15 nt, Homo sapiens
uaaaacauguacaaa

SEQ ID NO: 1922865 - RNA, 17 nt, Homo sapiens
auaauaccccaacagau

SEQ ID NO: 1922866 - RNA, 11 nt, Homo sapiens
cuucugccuaa

SEQ ID NO: 1922867 - RNA, 18 nt, Homo sapiens
gaagggauuucauuugaa

SEQ ID NO: 1922868 - RNA, 19 nt, Homo sapiens
uugagguggacucucacca

SEQ ID NO: 1922869 - RNA, 17 nt, Homo sapiens
ugggcaauucacagccu

SEQ ID NO: 1922870 - RNA, 20 nt, Homo sapiens
uccaguaaucugagcagucu

SEQ ID NO: 1922871 - RNA, 21 nt, Homo sapiens
uccccggcgggacugucaaug

SEQ ID NO: 1922872 - RNA, 18 nt, Homo sapiens
acuaauuuuugcuuaaca

SEQ ID NO: 1922873 - RNA, 20 nt, Homo sapiens
cuccccaaggccacagggag

SEQ ID NO: 1922874 - RNA, 22 nt, Homo sapiens
uacuuuugaaaaucaacuguau

SEQ ID NO: 1922875 - RNA, 21 nt, Homo sapiens
aguuaaaacacauaucaaaug

SEQ ID NO: 1922876 - RNA, 16 nt, Homo sapiens
ccugggcagcugccuc

SEQ ID NO: 1922877 - RNA, 13 nt, Homo sapiens
gagauaaagaaua

SEQ ID NO: 1922878 - RNA, 13 nt, Homo sapiens
ugaucagugugcu

SEQ ID NO: 1922879 - RNA, 13 nt, Homo sapiens
cugcucacuuuaa

SEQ ID NO: 1922880 - RNA, 23 nt, Homo sapiens
aaaguucucagaguuguacauau

SEQ ID NO: 1922881 - RNA, 14 nt, Homo sapiens
cagccuacacugcc

SEQ ID NO: 1922882 - RNA, 18 nt, Homo sapiens
guuuauaaaagaugcauu

SEQ ID NO: 1922883 - RNA, 13 nt, Homo sapiens
cccaguguucucc

SEQ ID NO: 1922884 - RNA, 17 nt, Homo sapiens
cagcucugccuugcacu

SEQ ID NO: 1922885 - RNA, 23 nt, Homo sapiens
aaaaguaugcagauuauuugccc

SEQ ID NO: 1922886 - RNA, 18 nt, Homo sapiens
gcaucacacaguggcacu

SEQ ID NO: 1922887 - RNA, 15 nt, Homo sapiens
gguccaccaugcaga

SEQ ID NO: 1922888 - RNA, 20 nt, Homo sapiens
caauaacuuuauaugaagua

SEQ ID NO: 1922889 - RNA, 20 nt, Homo sapiens
ucugucugccucuccacagc

SEQ ID NO: 1922890 - RNA, 13 nt, Homo sapiens
guauacuaaugcc

SEQ ID NO: 1922891 - RNA, 21 nt, Homo sapiens
acaucccugauucucucucca

SEQ ID NO: 1922892 - RNA, 22 nt, Homo sapiens
auaaaaacugcccauuguaacu

SEQ ID NO: 1922893 - RNA, 13 nt, Homo sapiens
uagaaucaauuua

SEQ ID NO: 1922894 - RNA, 22 nt, Homo sapiens
guaccacucacgagagcugaug

SEQ ID NO: 1922895 - RNA, 20 nt, Homo sapiens
uaucuauagcuaaguacaca

SEQ ID NO: 1922896 - RNA, 23 nt, Homo sapiens
auuuucucccaggaagcuuugau

SEQ ID NO: 1922897 - RNA, 15 nt, Homo sapiens
acugaacugcacguu

SEQ ID NO: 1922898 - RNA, 17 nt, Homo sapiens
ggucuuuucuccuacuc

SEQ ID NO: 1922899 - RNA, 18 nt, Homo sapiens
guugcaaaacagccagac

SEQ ID NO: 1922900 - RNA, 14 nt, Homo sapiens
aagaauaagugucu

SEQ ID NO: 1922901 - RNA, 22 nt, Homo sapiens
aaugaauuuuaaaagcauauau

SEQ ID NO: 1922902 - RNA, 20 nt, Homo sapiens
uguauuuuuaauauaugcau

SEQ ID NO: 1922903 - RNA, 17 nt, Homo sapiens
gguccccaucaucccag

SEQ ID NO: 1922904 - RNA, 18 nt, Homo sapiens
guuugaccucauuuguaa

SEQ ID NO: 1922905 - RNA, 16 nt, Homo sapiens
aaagucaaaaggugcc

SEQ ID NO: 1922906 - RNA, 22 nt, Homo sapiens
gggcacugagcccuucccaggc

SEQ ID NO: 1922907 - RNA, 16 nt, Homo sapiens
uagacuggccaugcaa

SEQ ID NO: 1922908 - RNA, 19 nt, Homo sapiens
uccucguugguucaugugu

SEQ ID NO: 1922909 - RNA, 22 nt, Homo sapiens
ugagguggagucucauucuguu

SEQ ID NO: 1922910 - RNA, 17 nt, Homo sapiens
cuuucucgauugguguc

SEQ ID NO: 1922911 - RNA, 13 nt, Homo sapiens
aaacuaagccagg

SEQ ID NO: 1922912 - RNA, 16 nt, Homo sapiens
ucuaaaucaccagaga

SEQ ID NO: 1922913 - RNA, 20 nt, Homo sapiens
auauuaggagacacagggaa

SEQ ID NO: 1922914 - RNA, 13 nt, Homo sapiens
cugaaaugccugc

SEQ ID NO: 1922915 - RNA, 16 nt, Homo sapiens
aagaaaguggucuuaa

SEQ ID NO: 1922916 - RNA, 15 nt, Homo sapiens
acaaguaaucacuaa

SEQ ID NO: 1922917 - RNA, 21 nt, Homo sapiens
gagcauauguuccaugccugg

SEQ ID NO: 1922918 - RNA, 14 nt, Homo sapiens
caaagcacauuggg

SEQ ID NO: 1922919 - RNA, 18 nt, Homo sapiens
uccugugauuuaugccaa

SEQ ID NO: 1922920 - RNA, 18 nt, Homo sapiens
cacggaggagggaugcug

SEQ ID NO: 1922921 - RNA, 14 nt, Homo sapiens
auaauagauugagu

SEQ ID NO: 1922922 - RNA, 21 nt, Homo sapiens
gaaacucaacuucuuuccucu

SEQ ID NO: 1922923 - RNA, 12 nt, Homo sapiens
uuguacuuugaa

SEQ ID NO: 1922924 - RNA, 17 nt, Homo sapiens
agcacagguuagggcau

SEQ ID NO: 1922925 - RNA, 17 nt, Homo sapiens
ccuauagaugaugaugu

SEQ ID NO: 1922926 - RNA, 18 nt, Homo sapiens
aauacaugcacagucaua

SEQ ID NO: 1922927 - RNA, 18 nt, Homo sapiens
agauccccccacugagcu

SEQ ID NO: 1922928 - RNA, 14 nt, Homo sapiens
ugggaaaugagcag

SEQ ID NO: 1922929 - RNA, 17 nt, Homo sapiens
uccaagugccacaugcc

SEQ ID NO: 1922930 - RNA, 18 nt, Homo sapiens
uaccuagaauagucucac

SEQ ID NO: 1922931 - RNA, 14 nt, Homo sapiens
cugucuagacuggc

SEQ ID NO: 1922932 - RNA, 11 nt, Homo sapiens
aacugccucag

SEQ ID NO: 1922933 - RNA, 15 nt, Homo sapiens
cucucucacacauca

SEQ ID NO: 1922934 - RNA, 20 nt, Homo sapiens
cauucugaaggccuuguuaa

SEQ ID NO: 1922935 - RNA, 12 nt, Homo sapiens
agaggccaugaa

SEQ ID NO: 1922936 - RNA, 22 nt, Homo sapiens
uaaaauuguauagaccuaaaau

SEQ ID NO: 1922937 - RNA, 16 nt, Homo sapiens
cuauucuuuccaugac

SEQ ID NO: 1922938 - RNA, 17 nt, Homo sapiens
ucccgaguagcugggau

SEQ ID NO: 1922939 - RNA, 16 nt, Homo sapiens
uguaauauaugauauu

SEQ ID NO: 1922940 - RNA, 22 nt, Homo sapiens
cauuuguuuucggcagccuuaa

SEQ ID NO: 1922941 - RNA, 19 nt, Homo sapiens
accccagagccacacaugg

SEQ ID NO: 1922942 - RNA, 17 nt, Homo sapiens
gaauauuccacuauuug

SEQ ID NO: 1922943 - RNA, 17 nt, Homo sapiens
uccaaaaaaauacugcc

SEQ ID NO: 1922944 - RNA, 19 nt, Homo sapiens
uagaaucaagucugugaaa

SEQ ID NO: 1922945 - RNA, 15 nt, Homo sapiens
cucaccagccccacu

SEQ ID NO: 1922946 - RNA, 19 nt, Homo sapiens
ugugggugcagcugucaca

SEQ ID NO: 1922947 - RNA, 17 nt, Homo sapiens
aauuccagacuuucuau

SEQ ID NO: 1922948 - RNA, 21 nt, Homo sapiens
ugcccaggcagucuuugcuca

SEQ ID NO: 1922949 - RNA, 17 nt, Homo sapiens
caaagccacuggaagga

SEQ ID NO: 1922950 - RNA, 20 nt, Homo sapiens
gaaguuucuggugccauuuc

SEQ ID NO: 1922951 - RNA, 12 nt, Homo sapiens
ugaucugucagc

SEQ ID NO: 1922952 - RNA, 15 nt, Homo sapiens
ccaaaugcagggagg

SEQ ID NO: 1922953 - RNA, 18 nt, Homo sapiens
ccaaagucucuaauucua

SEQ ID NO: 1922954 - RNA, 15 nt, Homo sapiens
auucauaaaaauaac

SEQ ID NO: 1922955 - RNA, 20 nt, Homo sapiens
aaccuccacuucccagguuc

SEQ ID NO: 1922956 - RNA, 16 nt, Homo sapiens
auccccguuucuugca

SEQ ID NO: 1922957 - RNA, 18 nt, Homo sapiens
accaugcauggugcauca

SEQ ID NO: 1922958 - RNA, 14 nt, Homo sapiens
ggccuuaugagcuc

SEQ ID NO: 1922959 - RNA, 20 nt, Homo sapiens
ucuuuaggauggggaguauu

SEQ ID NO: 1922960 - RNA, 23 nt, Homo sapiens
cagcuaccucaaccaaugccaaa

SEQ ID NO: 1922961 - RNA, 17 nt, Homo sapiens
acuugacauguagcuuc

SEQ ID NO: 1922962 - RNA, 21 nt, Homo sapiens
ccgucuuccagagaaccugug

SEQ ID NO: 1922963 - RNA, 14 nt, Homo sapiens
uuacagaaacugca

SEQ ID NO: 1922964 - RNA, 15 nt, Homo sapiens
aauacuguacagggg

SEQ ID NO: 1922965 - RNA, 23 nt, Homo sapiens
uuuuucacuucuaccuacauauu

SEQ ID NO: 1922966 - RNA, 13 nt, Homo sapiens
ugugacugaucuc

SEQ ID NO: 1922967 - RNA, 16 nt, Homo sapiens
cguugccucucugcca

SEQ ID NO: 1922968 - RNA, 17 nt, Homo sapiens
ggcaguuuaaagcacaa

SEQ ID NO: 1922969 - RNA, 15 nt, Homo sapiens
aagcagcucaaaggc

SEQ ID NO: 1922970 - RNA, 21 nt, Homo sapiens
ugaauuucuuugauuuaacug

SEQ ID NO: 1922971 - RNA, 14 nt, Homo sapiens
uuauagaauuaugc

SEQ ID NO: 1922972 - RNA, 20 nt, Homo sapiens
cuuauuuugugaucuguaac

SEQ ID NO: 1922973 - RNA, 20 nt, Homo sapiens
cagugucacugaguccuuga

SEQ ID NO: 1922974 - RNA, 16 nt, Homo sapiens
uuaaaccaaacggaac

SEQ ID NO: 1922975 - RNA, 19 nt, Homo sapiens
aggucuccaaacugauuaa

SEQ ID NO: 1922976 - RNA, 22 nt, Homo sapiens
ccuccccaacaccccacugagc

SEQ ID NO: 1922977 - RNA, 14 nt, Homo sapiens
ugauuaaucaaagg

SEQ ID NO: 1922978 - RNA, 12 nt, Homo sapiens
ucagauuccacc

SEQ ID NO: 1922979 - RNA, 15 nt, Homo sapiens
uacagaaaagaaauu

SEQ ID NO: 1922980 - RNA, 23 nt, Homo sapiens
uacacuacagaggggccagggga

SEQ ID NO: 1922981 - RNA, 23 nt, Homo sapiens
aagugcugggauuacaguuguga

SEQ ID NO: 1922982 - RNA, 22 nt, Homo sapiens
cucuaucuuccuccuugugauc

SEQ ID NO: 1922983 - RNA, 22 nt, Homo sapiens
cuuaugauacuugagguaccag

SEQ ID NO: 1922984 - RNA, 19 nt, Homo sapiens
acagcucagagaugaaacu

SEQ ID NO: 1922985 - RNA, 16 nt, Homo sapiens
gugcuuuugcaaaaga

SEQ ID NO: 1922986 - RNA, 14 nt, Homo sapiens
auccaaaucugucc

SEQ ID NO: 1922987 - RNA, 22 nt, Homo sapiens
gcccaacuacuaucucagagau

SEQ ID NO: 1922988 - RNA, 20 nt, Homo sapiens
ggcaugagacucagugcaga

SEQ ID NO: 1922989 - RNA, 15 nt, Homo sapiens
acucugaguccucau

SEQ ID NO: 1922990 - RNA, 18 nt, Homo sapiens
cuauaugcagucucuuua

SEQ ID NO: 1922991 - RNA, 22 nt, Homo sapiens
cuacucaaugccuggagacaga

SEQ ID NO: 1922992 - RNA, 11 nt, Homo sapiens
cacauucccuc

SEQ ID NO: 1922993 - RNA, 15 nt, Homo sapiens
ucuuagaagugacau

SEQ ID NO: 1922994 - RNA, 23 nt, Homo sapiens
cagaugagaguacaccccaacag

SEQ ID NO: 1922995 - RNA, 14 nt, Homo sapiens
gcuguuaacacugc

SEQ ID NO: 1922996 - RNA, 11 nt, Homo sapiens
aaaauuuugcc

SEQ ID NO: 1922997 - RNA, 19 nt, Homo sapiens
uccugcugaacguuucccc

SEQ ID NO: 1922998 - RNA, 19 nt, Homo sapiens
guucuguaaaauauacuua

SEQ ID NO: 1922999 - RNA, 21 nt, Homo sapiens
aucccuggccaccugccaggc

SEQ ID NO: 1923000 - RNA, 21 nt, Homo sapiens
aauuuuauguuuaguugcaca

SEQ ID NO: 1923001 - RNA, 22 nt, Homo sapiens
aaugagcuuguaaauacuccau

SEQ ID NO: 1923002 - RNA, 22 nt, Homo sapiens
uagcaaaaacauguaugugcau

SEQ ID NO: 1923003 - RNA, 16 nt, Homo sapiens
aaaucuguccucugua

SEQ ID NO: 1923004 - RNA, 16 nt, Homo sapiens
uugcuagugacaugua

SEQ ID NO: 1923005 - RNA, 17 nt, Homo sapiens
aggggagggguugccac

SEQ ID NO: 1923006 - RNA, 18 nt, Homo sapiens
ccugaggaucagaaagua

SEQ ID NO: 1923007 - RNA, 17 nt, Homo sapiens
gaaacaaaacuggauag

SEQ ID NO: 1923008 - RNA, 14 nt, Homo sapiens
ugaccuuccaaacc

SEQ ID NO: 1923009 - RNA, 17 nt, Homo sapiens
cauuuucuucacagugc

SEQ ID NO: 1923010 - RNA, 22 nt, Homo sapiens
agaugcuguaggugguauguga

SEQ ID NO: 1923011 - RNA, 18 nt, Homo sapiens
uaaagucuagcacaguuc

SEQ ID NO: 1923012 - RNA, 23 nt, Homo sapiens
caaaugaaagugaugauacugua

SEQ ID NO: 1923013 - RNA, 12 nt, Homo sapiens
gauccucacccg

SEQ ID NO: 1923014 - RNA, 17 nt, Homo sapiens
cagaggaagagacauga

SEQ ID NO: 1923015 - RNA, 14 nt, Homo sapiens
uagcaaaauugagg

SEQ ID NO: 1923016 - RNA, 20 nt, Homo sapiens
uccugauccugacacauucu

SEQ ID NO: 1923017 - RNA, 22 nt, Homo sapiens
aaucgaugaauguaaacucggg

SEQ ID NO: 1923018 - RNA, 15 nt, Homo sapiens
augagaugacagaua

SEQ ID NO: 1923019 - RNA, 20 nt, Homo sapiens
gugcaccaauaccuacugaa

SEQ ID NO: 1923020 - RNA, 17 nt, Homo sapiens
uggcccucucugaagga

SEQ ID NO: 1923021 - RNA, 11 nt, Homo sapiens
uagucuugucu

SEQ ID NO: 1923022 - RNA, 13 nt, Homo sapiens
aaaggaacuggaa

SEQ ID NO: 1923023 - RNA, 17 nt, Homo sapiens
uguucaaguuugcugca

SEQ ID NO: 1923024 - RNA, 17 nt, Homo sapiens
gaacugcauauguuucg

SEQ ID NO: 1923025 - RNA, 21 nt, Homo sapiens
aagaguccauguggacugugc

SEQ ID NO: 1923026 - RNA, 20 nt, Homo sapiens
uucagaaagaggucuuucag

SEQ ID NO: 1923027 - RNA, 22 nt, Homo sapiens
guuuguggggcacagaugccug

SEQ ID NO: 1923028 - RNA, 19 nt, Homo sapiens
cccaggcuagagugcaaug

SEQ ID NO: 1923029 - RNA, 19 nt, Homo sapiens
cccaggcuggagugcagug

SEQ ID NO: 1923030 - RNA, 13 nt, Homo sapiens
ccucccacugagg

SEQ ID NO: 1923031 - RNA, 18 nt, Homo sapiens
auggacauaagacagaca

SEQ ID NO: 1923032 - RNA, 22 nt, Homo sapiens
ugcagcagugagucucuucaga

SEQ ID NO: 1923033 - RNA, 15 nt, Homo sapiens
agaaugccaggaaua

SEQ ID NO: 1923034 - RNA, 17 nt, Homo sapiens
caggugcgugccacauc

SEQ ID NO: 1923035 - RNA, 15 nt, Homo sapiens
uuucaucuccagugu

SEQ ID NO: 1923036 - RNA, 12 nt, Homo sapiens
aucuucaccaga

SEQ ID NO: 1923037 - RNA, 13 nt, Homo sapiens
ccucaaacaacac

SEQ ID NO: 1923038 - RNA, 12 nt, Homo sapiens
agaagugaaaag

SEQ ID NO: 1923039 - RNA, 17 nt, Homo sapiens
cuccuggguucaagcaa

SEQ ID NO: 1923040 - RNA, 17 nt, Homo sapiens
uggcucaucgguggaag

SEQ ID NO: 1923041 - RNA, 13 nt, Homo sapiens
gauuccucagggu

SEQ ID NO: 1923042 - RNA, 17 nt, Homo sapiens
ccugccuccagcuguca

SEQ ID NO: 1923043 - RNA, 13 nt, Homo sapiens
ugugaugcugaca

SEQ ID NO: 1923044 - RNA, 19 nt, Homo sapiens
ucagcacauucgggaccaa

SEQ ID NO: 1923045 - RNA, 21 nt, Homo sapiens
acucuaaaagauagacaucag

SEQ ID NO: 1923046 - RNA, 20 nt, Homo sapiens
agccaccagggaguggccau

SEQ ID NO: 1923047 - RNA, 15 nt, Homo sapiens
aggaaaagauuccug

SEQ ID NO: 1923048 - RNA, 15 nt, Homo sapiens
aguaguaucugcuua

SEQ ID NO: 1923049 - RNA, 21 nt, Homo sapiens
cucuugcccagccggcugcaa

SEQ ID NO: 1923050 - RNA, 19 nt, Homo sapiens
acugcucucaaaaugugaa

SEQ ID NO: 1923051 - RNA, 16 nt, Homo sapiens
aucuucacagcacauu

SEQ ID NO: 1923052 - RNA, 20 nt, Homo sapiens
cugccuuaaugagaacauuu

SEQ ID NO: 1923053 - RNA, 14 nt, Homo sapiens
gccaucucaagcaa

SEQ ID NO: 1923054 - RNA, 17 nt, Homo sapiens
uggaucacucaccauuc

SEQ ID NO: 1923055 - RNA, 18 nt, Homo sapiens
cagugauugaaguaucug

SEQ ID NO: 1923056 - RNA, 16 nt, Homo sapiens
acuucguacccuuugc

SEQ ID NO: 1923057 - RNA, 13 nt, Homo sapiens
auacacuguucau

SEQ ID NO: 1923058 - RNA, 15 nt, Homo sapiens
cccagccucacucca

SEQ ID NO: 1923059 - RNA, 16 nt, Homo sapiens
agugaggccauagcaa

SEQ ID NO: 1923060 - RNA, 18 nt, Homo sapiens
aagacuuuaaaccaccua

SEQ ID NO: 1923061 - RNA, 15 nt, Homo sapiens
guugucaagugauau

SEQ ID NO: 1923062 - RNA, 15 nt, Homo sapiens
agugaaugugucugg

SEQ ID NO: 1923063 - RNA, 17 nt, Homo sapiens
aggucccuggaccagcc

SEQ ID NO: 1923064 - RNA, 18 nt, Homo sapiens
accuguagcaaaacagcu

SEQ ID NO: 1923065 - RNA, 23 nt, Homo sapiens
caggcugggccauguccaaagag

SEQ ID NO: 1923066 - RNA, 20 nt, Homo sapiens
cagcaugccuucaaaucaau

SEQ ID NO: 1923067 - RNA, 19 nt, Homo sapiens
agaaauugagcgccauaag

SEQ ID NO: 1923068 - RNA, 20 nt, Homo sapiens
uucaguucuuacacauucca

SEQ ID NO: 1923069 - RNA, 21 nt, Homo sapiens
uacaaaauauagcuuucauaa

SEQ ID NO: 1923070 - RNA, 12 nt, Homo sapiens
uguuuuccauga

SEQ ID NO: 1923071 - RNA, 22 nt, Homo sapiens
ccgguggaaaacuggacugugg

SEQ ID NO: 1923072 - RNA, 14 nt, Homo sapiens
caaaagaugccauu

SEQ ID NO: 1923073 - RNA, 15 nt, Homo sapiens
aaggcacugccugau

SEQ ID NO: 1923074 - RNA, 19 nt, Homo sapiens
uuaaggacaaagugccaaa

SEQ ID NO: 1923075 - RNA, 20 nt, Homo sapiens
auuuuaaauauuguauuuga

SEQ ID NO: 1923076 - RNA, 13 nt, Homo sapiens
cacacacauccac

SEQ ID NO: 1923077 - RNA, 16 nt, Homo sapiens
cuuuccucagaucauc

SEQ ID NO: 1923078 - RNA, 20 nt, Homo sapiens
uaauaucugaggaugaccag

SEQ ID NO: 1923079 - RNA, 13 nt, Homo sapiens
agcauaacagcca

SEQ ID NO: 1923080 - RNA, 21 nt, Homo sapiens
cagggcgccccugggagacaa

SEQ ID NO: 1923081 - RNA, 20 nt, Homo sapiens
ucagcaaaaagcaaaaucau

SEQ ID NO: 1923082 - RNA, 17 nt, Homo sapiens
cucuggaaaaugugacc

SEQ ID NO: 1923083 - RNA, 19 nt, Homo sapiens
auuaaaugcauguccucaa

SEQ ID NO: 1923084 - RNA, 23 nt, Homo sapiens
caguuacugguuucaguugacaa

SEQ ID NO: 1923085 - RNA, 13 nt, Homo sapiens
uacacuacuccug

SEQ ID NO: 1923086 - RNA, 14 nt, Homo sapiens
uuuccccagaucaa

SEQ ID NO: 1923087 - RNA, 21 nt, Homo sapiens
gauauuguggguaacgugaga

SEQ ID NO: 1923088 - RNA, 16 nt, Homo sapiens
auaaaccccucagaca

SEQ ID NO: 1923089 - RNA, 20 nt, Homo sapiens
agcauauguuguugcuugua

SEQ ID NO: 1923090 - RNA, 20 nt, Homo sapiens
aguaaaucuuuuacaacugc

SEQ ID NO: 1923091 - RNA, 19 nt, Homo sapiens
gaaaaguaaguuuuguuaa

SEQ ID NO: 1923092 - RNA, 15 nt, Homo sapiens
accuuaaugacaaca

SEQ ID NO: 1923093 - RNA, 21 nt, Homo sapiens
uccaacaacugucagaauaaa

SEQ ID NO: 1923094 - RNA, 19 nt, Homo sapiens
aggaaccaaagcgaauuuu

SEQ ID NO: 1923095 - RNA, 19 nt, Homo sapiens
ucccuuuaugcacccaaga

SEQ ID NO: 1923096 - RNA, 19 nt, Homo sapiens
uccaaaauaaauggacuga

SEQ ID NO: 1923097 - RNA, 15 nt, Homo sapiens
gaaucaagacaagac

SEQ ID NO: 1923098 - RNA, 16 nt, Homo sapiens
agaaaacgaacuggga

SEQ ID NO: 1923099 - RNA, 13 nt, Homo sapiens
gucgaacuggggg

SEQ ID NO: 1923100 - RNA, 14 nt, Homo sapiens
aaaugaaggaugaa

SEQ ID NO: 1923101 - RNA, 14 nt, Homo sapiens
aucgcugccugcca

SEQ ID NO: 1923102 - RNA, 21 nt, Homo sapiens
uaaaaagacacgguugcucua

SEQ ID NO: 1923103 - RNA, 16 nt, Homo sapiens
ucuuauggaaagcaaa

SEQ ID NO: 1923104 - RNA, 19 nt, Homo sapiens
aagaccucugagaccaaaa

SEQ ID NO: 1923105 - RNA, 22 nt, Homo sapiens
cagauuccaggcgaugugcaag

SEQ ID NO: 1923106 - RNA, 21 nt, Homo sapiens
cuccacgugauuuccagugag

SEQ ID NO: 1923107 - RNA, 19 nt, Homo sapiens
ugugaauaauggcacugac

SEQ ID NO: 1923108 - RNA, 20 nt, Homo sapiens
cacgucuguaaucccagcgc

SEQ ID NO: 1923109 - RNA, 16 nt, Homo sapiens
cuucagauuuguguua

SEQ ID NO: 1923110 - RNA, 18 nt, Homo sapiens
cccggagagggagucagu

SEQ ID NO: 1923111 - RNA, 20 nt, Homo sapiens
aucuacccuugagucauauu

SEQ ID NO: 1923112 - RNA, 20 nt, Homo sapiens
gcgaaaccccaucucuacua

SEQ ID NO: 1923113 - RNA, 11 nt, Homo sapiens
aggucucagcc

SEQ ID NO: 1923114 - RNA, 13 nt, Homo sapiens
agguggcucucca

SEQ ID NO: 1923115 - RNA, 18 nt, Homo sapiens
acuguaccccagcucucu

SEQ ID NO: 1923116 - RNA, 18 nt, Homo sapiens
gaagcucucgauggacaa

SEQ ID NO: 1923117 - RNA, 22 nt, Homo sapiens
ucaaagugagcuccuaagccau

SEQ ID NO: 1923118 - RNA, 12 nt, Homo sapiens
gcuuagcauucc

SEQ ID NO: 1923119 - RNA, 17 nt, Homo sapiens
aggcuggucuugaacuc

SEQ ID NO: 1923120 - RNA, 20 nt, Homo sapiens
ucuuugaagcugaaaauaua

SEQ ID NO: 1923121 - RNA, 18 nt, Homo sapiens
ccauuucaaacuggagag

SEQ ID NO: 1923122 - RNA, 20 nt, Homo sapiens
agcaucuggauucugccuaa

SEQ ID NO: 1923123 - RNA, 22 nt, Homo sapiens
ggcucaugggugggacauggaa

SEQ ID NO: 1923124 - RNA, 17 nt, Homo sapiens
cagcgccuuuccugcca

SEQ ID NO: 1923125 - RNA, 22 nt, Homo sapiens
acuugcugugugaccucaggcc

SEQ ID NO: 1923126 - RNA, 23 nt, Homo sapiens
guccucagaugggaauugcacag

SEQ ID NO: 1923127 - RNA, 15 nt, Homo sapiens
ccagguaccacccuu

SEQ ID NO: 1923128 - RNA, 17 nt, Homo sapiens
ggccucagggccaggaa

SEQ ID NO: 1923129 - RNA, 22 nt, Homo sapiens
caauguugcuuaggaugugugc

SEQ ID NO: 1923130 - RNA, 13 nt, Homo sapiens
agauccuacccca

SEQ ID NO: 1923131 - RNA, 17 nt, Homo sapiens
cccaccccuuccaauga

SEQ ID NO: 1923132 - RNA, 23 nt, Homo sapiens
cacagugcaguacucaguaauac

SEQ ID NO: 1923133 - RNA, 14 nt, Homo sapiens
guguuuaacauuca

SEQ ID NO: 1923134 - RNA, 18 nt, Homo sapiens
guaacagcauuaacuguc

SEQ ID NO: 1923135 - RNA, 22 nt, Homo sapiens
ccaaccccucccccacgucucu

SEQ ID NO: 1923136 - RNA, 20 nt, Homo sapiens
cugguucccaccauucccug

SEQ ID NO: 1923137 - RNA, 19 nt, Homo sapiens
ugaaugugugaauucaaua

SEQ ID NO: 1923138 - RNA, 20 nt, Homo sapiens
caggcagcacagugugugaa

SEQ ID NO: 1923139 - RNA, 11 nt, Homo sapiens
guaaaugccuc

SEQ ID NO: 1923140 - RNA, 15 nt, Homo sapiens
uucagcugcaauaaa

SEQ ID NO: 1923141 - RNA, 15 nt, Homo sapiens
acuucucgaauugaa

SEQ ID NO: 1923142 - RNA, 23 nt, Homo sapiens
agcugguuguacccucuccaggc

SEQ ID NO: 1923143 - RNA, 13 nt, Homo sapiens
aaacgagacuuuc

SEQ ID NO: 1923144 - RNA, 21 nt, Homo sapiens
gaaaagcaauacuguuuccau

SEQ ID NO: 1923145 - RNA, 19 nt, Homo sapiens
gucacagccuccucugucu

SEQ ID NO: 1923146 - RNA, 14 nt, Homo sapiens
gaaugcaagcugga

SEQ ID NO: 1923147 - RNA, 15 nt, Homo sapiens
cacuauaugaucagu

SEQ ID NO: 1923148 - RNA, 13 nt, Homo sapiens
uauaacaguguuu

SEQ ID NO: 1923149 - RNA, 15 nt, Homo sapiens
ugaacuaacugacag

SEQ ID NO: 1923150 - RNA, 15 nt, Homo sapiens
agaggaagagugcaa

SEQ ID NO: 1923151 - RNA, 14 nt, Homo sapiens
ugcuuggugcuggu

SEQ ID NO: 1923152 - RNA, 11 nt, Homo sapiens
aacagagccuu

SEQ ID NO: 1923153 - RNA, 23 nt, Homo sapiens
cuagguuugcaagaaaaauauga

SEQ ID NO: 1923154 - RNA, 14 nt, Homo sapiens
acagacaagcccuu

SEQ ID NO: 1923155 - RNA, 22 nt, Homo sapiens
aucuggguaagaagaaagcaaa

SEQ ID NO: 1923156 - RNA, 18 nt, Homo sapiens
aucccagcauucuguucc

SEQ ID NO: 1923157 - RNA, 15 nt, Homo sapiens
gcucuagauucauaa

SEQ ID NO: 1923158 - RNA, 15 nt, Homo sapiens
uguagccauccuguu

SEQ ID NO: 1923159 - RNA, 16 nt, Homo sapiens
gagacuguuaucagga

SEQ ID NO: 1923160 - RNA, 23 nt, Homo sapiens
uaaucaguucuuagauucagggg

SEQ ID NO: 1923161 - RNA, 22 nt, Homo sapiens
cccuggcgcugugcuagcuuuc

SEQ ID NO: 1923162 - RNA, 15 nt, Homo sapiens
cauuggaaagcacac

SEQ ID NO: 1923163 - RNA, 21 nt, Homo sapiens
cugugcugguguccugaccac

SEQ ID NO: 1923164 - RNA, 23 nt, Homo sapiens
acagccuccccacccaggaugac

SEQ ID NO: 1923165 - RNA, 16 nt, Homo sapiens
cagguucucaccucag

SEQ ID NO: 1923166 - RNA, 21 nt, Homo sapiens
cugaaugucccaacccagaca

SEQ ID NO: 1923167 - RNA, 13 nt, Homo sapiens
guuuacaacauca

SEQ ID NO: 1923168 - RNA, 19 nt, Homo sapiens
uaaaggggagaccucagaa

SEQ ID NO: 1923169 - RNA, 19 nt, Homo sapiens
cagccgccggcugugcagu

SEQ ID NO: 1923170 - RNA, 14 nt, Homo sapiens
uagaaaacauucca

SEQ ID NO: 1923171 - RNA, 21 nt, Homo sapiens
cauacugaagaugcagcaaaa

SEQ ID NO: 1923172 - RNA, 22 nt, Homo sapiens
guacauggaauaacauguaauu

SEQ ID NO: 1923173 - RNA, 18 nt, Homo sapiens
guccagauuuacacuggg

SEQ ID NO: 1923174 - RNA, 21 nt, Homo sapiens
uaguaauguuuuauacuguuu

SEQ ID NO: 1923175 - RNA, 21 nt, Homo sapiens
acauagaggccuucccaucca

SEQ ID NO: 1923176 - RNA, 19 nt, Homo sapiens
guauuuuucaaaacauaca

SEQ ID NO: 1923177 - RNA, 14 nt, Homo sapiens
guguuuugcaaggg

SEQ ID NO: 1923178 - RNA, 13 nt, Homo sapiens
uuauuuaacccuu

SEQ ID NO: 1923179 - RNA, 14 nt, Homo sapiens
ggcucaaccacaca

SEQ ID NO: 1923180 - RNA, 13 nt, Homo sapiens
guggaaaaggaaa

SEQ ID NO: 1923181 - RNA, 18 nt, Homo sapiens
uaccaaauagcaauacaa

SEQ ID NO: 1923182 - RNA, 19 nt, Homo sapiens
cucuugaaaauagaacaac

SEQ ID NO: 1923183 - RNA, 19 nt, Homo sapiens
ccagcuugggcccagcugg

SEQ ID NO: 1923184 - RNA, 14 nt, Homo sapiens
gagcugagaucaca

SEQ ID NO: 1923185 - RNA, 15 nt, Homo sapiens
cucuuaccaaaacag

SEQ ID NO: 1923186 - RNA, 21 nt, Homo sapiens
gcucaguuucccuccuuccca

SEQ ID NO: 1923187 - RNA, 21 nt, Homo sapiens
aggcuccaucguccauccucu

SEQ ID NO: 1923188 - RNA, 13 nt, Homo sapiens
acaauagucaaaa

SEQ ID NO: 1923189 - RNA, 15 nt, Homo sapiens
aacuaggcucauacu

SEQ ID NO: 1923190 - RNA, 14 nt, Homo sapiens
ucacacccuaacuc

SEQ ID NO: 1923191 - RNA, 20 nt, Homo sapiens
agcacggacugucaguucuc

SEQ ID NO: 1923192 - RNA, 14 nt, Homo sapiens
auugacuucucuug

SEQ ID NO: 1923193 - RNA, 17 nt, Homo sapiens
uucauuucauguauagu

SEQ ID NO: 1923194 - RNA, 15 nt, Homo sapiens
gucugcaguccagua

SEQ ID NO: 1923195 - RNA, 12 nt, Homo sapiens
uagauuugaccu

SEQ ID NO: 1923196 - RNA, 23 nt, Homo sapiens
gauguagguuauuaugauuagcu

SEQ ID NO: 1923197 - RNA, 21 nt, Homo sapiens
ucugaguugagaccuuugauu

SEQ ID NO: 1923198 - RNA, 15 nt, Homo sapiens
aauauuauuccucaa

SEQ ID NO: 1923199 - RNA, 22 nt, Homo sapiens
auggauauguuuucacuguauu

SEQ ID NO: 1923200 - RNA, 18 nt, Homo sapiens
augguggguacaaaaagu

SEQ ID NO: 1923201 - RNA, 12 nt, Homo sapiens
gcuagugccuuu

SEQ ID NO: 1923202 - RNA, 13 nt, Homo sapiens
uucuuuauacugu

SEQ ID NO: 1923203 - RNA, 18 nt, Homo sapiens
uaaacaguuuuuggcaaa

SEQ ID NO: 1923204 - RNA, 19 nt, Homo sapiens
gcucacuaaaaugcuaauu

SEQ ID NO: 1923205 - RNA, 18 nt, Homo sapiens
agugauuaacuuaagauu

SEQ ID NO: 1923206 - RNA, 18 nt, Homo sapiens
aaaucuuagaaagaaaca

SEQ ID NO: 1923207 - RNA, 23 nt, Homo sapiens
ccugcugcagucacguguaaaca

SEQ ID NO: 1923208 - RNA, 22 nt, Homo sapiens
auuuguggugauauagaauuag

SEQ ID NO: 1923209 - RNA, 20 nt, Homo sapiens
uuuaaaugugcaguacacau

SEQ ID NO: 1923210 - RNA, 23 nt, Homo sapiens
cagccugucccauggacacucca

SEQ ID NO: 1923211 - RNA, 18 nt, Homo sapiens
auuaaauguacuuuuuga

SEQ ID NO: 1923212 - RNA, 15 nt, Homo sapiens
aguuaugugauuuuc

SEQ ID NO: 1923213 - RNA, 15 nt, Homo sapiens
aaaauccauccaauc

SEQ ID NO: 1923214 - RNA, 14 nt, Homo sapiens
cuuagccccaugag

SEQ ID NO: 1923215 - RNA, 21 nt, Homo sapiens
ucccuccgcaucccgucagcu

SEQ ID NO: 1923216 - RNA, 22 nt, Homo sapiens
auucuuacuguucugaaauuag

SEQ ID NO: 1923217 - RNA, 21 nt, Homo sapiens
aggggaaaagagaugaugaaa

SEQ ID NO: 1923218 - RNA, 16 nt, Homo sapiens
cuauggccacauucaa

SEQ ID NO: 1923219 - RNA, 17 nt, Homo sapiens
ugucccuuucacacugu

SEQ ID NO: 1923220 - RNA, 14 nt, Homo sapiens
auuucaccacucaa

SEQ ID NO: 1923221 - RNA, 16 nt, Homo sapiens
gaguugggcagccagg

SEQ ID NO: 1923222 - RNA, 16 nt, Homo sapiens
aaaagcaauacuguuu

SEQ ID NO: 1923223 - RNA, 20 nt, Homo sapiens
acguggugcauuuugcuugu

SEQ ID NO: 1923224 - RNA, 15 nt, Homo sapiens
cccacccugcacuuu

SEQ ID NO: 1923225 - RNA, 18 nt, Homo sapiens
uggagucacaucagugag

SEQ ID NO: 1923226 - RNA, 14 nt, Homo sapiens
aucacugugaaaau

SEQ ID NO: 1923227 - RNA, 18 nt, Homo sapiens
ucauguuuuuucugcaau

SEQ ID NO: 1923228 - RNA, 18 nt, Homo sapiens
auggcgaggccucucuca

SEQ ID NO: 1923229 - RNA, 16 nt, Homo sapiens
cugaagccucacuuau

SEQ ID NO: 1923230 - RNA, 17 nt, Homo sapiens
cagcaacagcaaaucac

SEQ ID NO: 1923231 - RNA, 19 nt, Homo sapiens
gaaauuauaaugcaauaaa

SEQ ID NO: 1923232 - RNA, 16 nt, Homo sapiens
acaguguuuacuuuaa

SEQ ID NO: 1923233 - RNA, 18 nt, Homo sapiens
aaaagucuccaccccuac

SEQ ID NO: 1923234 - RNA, 20 nt, Homo sapiens
aagggauuguuguguaguca

SEQ ID NO: 1923235 - RNA, 18 nt, Homo sapiens
cucaucaguaguucacau

SEQ ID NO: 1923236 - RNA, 23 nt, Homo sapiens
cuugacuguaaagagaaguaauu

SEQ ID NO: 1923237 - RNA, 17 nt, Homo sapiens
cuccuggggacuuggaa

SEQ ID NO: 1923238 - RNA, 13 nt, Homo sapiens
ccauuucuucucu

SEQ ID NO: 1923239 - RNA, 19 nt, Homo sapiens
gcccuccaccuuguuccug

SEQ ID NO: 1923240 - RNA, 21 nt, Homo sapiens
gaugccccagggaccuuugua

SEQ ID NO: 1923241 - RNA, 22 nt, Homo sapiens
ucagcaccuacaguguacaguc

SEQ ID NO: 1923242 - RNA, 23 nt, Homo sapiens
aauuuuuuuuuuuuaacuuuaag

SEQ ID NO: 1923243 - RNA, 16 nt, Homo sapiens
uuacaaugcagaauuu

SEQ ID NO: 1923244 - RNA, 17 nt, Homo sapiens
cuucaggaauaugcauc

SEQ ID NO: 1923245 - RNA, 19 nt, Homo sapiens
aguuccuugcauguuguag

SEQ ID NO: 1923246 - RNA, 19 nt, Homo sapiens
augcaugcuucuucucaaa

SEQ ID NO: 1923247 - RNA, 19 nt, Homo sapiens
gaguuuguuuacacuuguc

SEQ ID NO: 1923248 - RNA, 11 nt, Homo sapiens
aucaguguuua

SEQ ID NO: 1923249 - RNA, 11 nt, Homo sapiens
aguuaggugug

SEQ ID NO: 1923250 - RNA, 17 nt, Homo sapiens
cuuaugaggucaagaaa

SEQ ID NO: 1923251 - RNA, 14 nt, Homo sapiens
aaaagggagaacau

SEQ ID NO: 1923252 - RNA, 18 nt, Homo sapiens
cucuccccugauuacacc

SEQ ID NO: 1923253 - RNA, 21 nt, Homo sapiens
gaccuucucccucacuccugc

SEQ ID NO: 1923254 - RNA, 13 nt, Homo sapiens
cagaaagguguga

SEQ ID NO: 1923255 - RNA, 17 nt, Homo sapiens
ucuauauggaauugcuu

SEQ ID NO: 1923256 - RNA, 20 nt, Homo sapiens
ugaggcccauucuucacucu

SEQ ID NO: 1923257 - RNA, 11 nt, Homo sapiens
cucuuccucau

SEQ ID NO: 1923258 - RNA, 19 nt, Homo sapiens
gacuccuguggacuccacu

SEQ ID NO: 1923259 - RNA, 18 nt, Homo sapiens
cgggacccucccagugag

SEQ ID NO: 1923260 - RNA, 22 nt, Homo sapiens
auggagaagcaccuuugcucuc

SEQ ID NO: 1923261 - RNA, 22 nt, Homo sapiens
acuugcaugcagcagcuuuuga

SEQ ID NO: 1923262 - RNA, 22 nt, Homo sapiens
aucuccuugauuacauaauguu

SEQ ID NO: 1923263 - RNA, 17 nt, Homo sapiens
cccagacuuucuacacc

SEQ ID NO: 1923264 - RNA, 23 nt, Homo sapiens
ccucccugcugccagaagcagca

SEQ ID NO: 1923265 - RNA, 19 nt, Homo sapiens
uuacagaucauauaagcaa

SEQ ID NO: 1923266 - RNA, 13 nt, Homo sapiens
cauccagcagucc

SEQ ID NO: 1923267 - RNA, 17 nt, Homo sapiens
auuauaaacagcagggu

SEQ ID NO: 1923268 - RNA, 18 nt, Homo sapiens
uaagagguuaugccaaaa

SEQ ID NO: 1923269 - RNA, 17 nt, Homo sapiens
gaagcucagcuaugaaa

SEQ ID NO: 1923270 - RNA, 17 nt, Homo sapiens
ugcagucccacacugug

SEQ ID NO: 1923271 - RNA, 12 nt, Homo sapiens
aauuaaugauuc

SEQ ID NO: 1923272 - RNA, 12 nt, Homo sapiens
cagaaccaaacc

SEQ ID NO: 1923273 - RNA, 22 nt, Homo sapiens
uuacuaaugugccccaugucca

SEQ ID NO: 1923274 - RNA, 14 nt, Homo sapiens
aacucagugugacu

SEQ ID NO: 1923275 - RNA, 20 nt, Homo sapiens
cuggaaugaguugaggccac

SEQ ID NO: 1923276 - RNA, 21 nt, Homo sapiens
uaacagcggcaggguguccca

SEQ ID NO: 1923277 - RNA, 21 nt, Homo sapiens
ucuguaaaugaagggucauuu

SEQ ID NO: 1923278 - RNA, 13 nt, Homo sapiens
caaauacuaucca

SEQ ID NO: 1923279 - RNA, 18 nt, Homo sapiens
uuguacuacaguauacuu

SEQ ID NO: 1923280 - RNA, 18 nt, Homo sapiens
ccccucaacaccucugca

SEQ ID NO: 1923281 - RNA, 16 nt, Homo sapiens
cugcuuugacgggcca

SEQ ID NO: 1923282 - RNA, 18 nt, Homo sapiens
ccuuacuagauucauaau

SEQ ID NO: 1923283 - RNA, 17 nt, Homo sapiens
cucuccgcaggcccacu

SEQ ID NO: 1923284 - RNA, 21 nt, Homo sapiens
cugaugaccgucugagcccag

SEQ ID NO: 1923285 - RNA, 22 nt, Homo sapiens
ugcaaggugaacaccacuuugu

SEQ ID NO: 1923286 - RNA, 15 nt, Homo sapiens
auuaauugagcagca

SEQ ID NO: 1923287 - RNA, 20 nt, Homo sapiens
ccuccugaaccagcacuaau

SEQ ID NO: 1923288 - RNA, 16 nt, Homo sapiens
cuaugggaagcucugu

SEQ ID NO: 1923289 - RNA, 16 nt, Homo sapiens
agaauugguugccaua

SEQ ID NO: 1923290 - RNA, 22 nt, Homo sapiens
gacaccuggauugcagacucau

SEQ ID NO: 1923291 - RNA, 15 nt, Homo sapiens
uagaaagggugcugc

SEQ ID NO: 1923292 - RNA, 16 nt, Homo sapiens
acaagugucugugcau

SEQ ID NO: 1923293 - RNA, 14 nt, Homo sapiens
ggaggcuggccaag

SEQ ID NO: 1923294 - RNA, 17 nt, Homo sapiens
auugguaugaugcugcc

SEQ ID NO: 1923295 - RNA, 13 nt, Homo sapiens
ccccuuucccacc

SEQ ID NO: 1923296 - RNA, 14 nt, Homo sapiens
cugauacauuaaaa

SEQ ID NO: 1923297 - RNA, 14 nt, Homo sapiens
aggcugcacugcag

SEQ ID NO: 1923298 - RNA, 15 nt, Homo sapiens
uauccugccucagcc

SEQ ID NO: 1923299 - RNA, 23 nt, Homo sapiens
uuggacauguccaugaccagaag

SEQ ID NO: 1923300 - RNA, 11 nt, Homo sapiens
aaccaaugcaa

SEQ ID NO: 1923301 - RNA, 14 nt, Homo sapiens
uccuuccuucaggg

SEQ ID NO: 1923302 - RNA, 21 nt, Homo sapiens
cauaagcugauuugauaccau

SEQ ID NO: 1923303 - RNA, 17 nt, Homo sapiens
aauaaaauauucacucu

SEQ ID NO: 1923304 - RNA, 18 nt, Homo sapiens
guagaccaggugcucagc

SEQ ID NO: 1923305 - RNA, 22 nt, Homo sapiens
ucacaguaucaguauuuucaca

SEQ ID NO: 1923306 - RNA, 15 nt, Homo sapiens
cuagaagccaaggga

SEQ ID NO: 1923307 - RNA, 23 nt, Homo sapiens
gcagcuugacauuauguuuuauu

SEQ ID NO: 1923308 - RNA, 20 nt, Homo sapiens
ugacacccuuuaauguucua

SEQ ID NO: 1923309 - RNA, 21 nt, Homo sapiens
agauugggguguuagaagugc

SEQ ID NO: 1923310 - RNA, 17 nt, Homo sapiens
ccuaucauagauuuaca

SEQ ID NO: 1923311 - RNA, 13 nt, Homo sapiens
uaccaaguuauau

SEQ ID NO: 1923312 - RNA, 22 nt, Homo sapiens
uggugggggugggcgccuguag

SEQ ID NO: 1923313 - RNA, 20 nt, Homo sapiens
acucagaacucuccagggag

SEQ ID NO: 1923314 - RNA, 16 nt, Homo sapiens
gucuugccagccagaa

SEQ ID NO: 1923315 - RNA, 22 nt, Homo sapiens
uuucccacgaggaaucuguggg

SEQ ID NO: 1923316 - RNA, 16 nt, Homo sapiens
aacuuaaaucacugag

SEQ ID NO: 1923317 - RNA, 18 nt, Homo sapiens
uuuucaauuuugugcuau

SEQ ID NO: 1923318 - RNA, 22 nt, Homo sapiens
acagaugugugauucacagugu

SEQ ID NO: 1923319 - RNA, 19 nt, Homo sapiens
gugcguuaaauaagcaaau

SEQ ID NO: 1923320 - RNA, 13 nt, Homo sapiens
uggauaauuccaa

SEQ ID NO: 1923321 - RNA, 19 nt, Homo sapiens
uguugguggccucugcuug

SEQ ID NO: 1923322 - RNA, 18 nt, Homo sapiens
auucccucuggaguuuca

SEQ ID NO: 1923323 - RNA, 15 nt, Homo sapiens
acacgcgcgcgcaca

SEQ ID NO: 1923324 - RNA, 13 nt, Homo sapiens
ccacguaucuuuc

SEQ ID NO: 1923325 - RNA, 21 nt, Homo sapiens
acaccacugggaaccaagggc

SEQ ID NO: 1923326 - RNA, 19 nt, Homo sapiens
guauagcuuuauacucucu

SEQ ID NO: 1923327 - RNA, 14 nt, Homo sapiens
ugcucugaugcagu

SEQ ID NO: 1923328 - RNA, 16 nt, Homo sapiens
augaaaaguuuagugu

SEQ ID NO: 1923329 - RNA, 11 nt, Homo sapiens
cuccagcacuc

SEQ ID NO: 1923330 - RNA, 21 nt, Homo sapiens
ccugggggcagugacuggcag

SEQ ID NO: 1923331 - RNA, 22 nt, Homo sapiens
uacuugaaauaccagugaacca

SEQ ID NO: 1923332 - RNA, 15 nt, Homo sapiens
ucuaagaucuugccu

SEQ ID NO: 1923333 - RNA, 22 nt, Homo sapiens
guauuucaccucuacauuugaa

SEQ ID NO: 1923334 - RNA, 17 nt, Homo sapiens
uuacagucacauucaga

SEQ ID NO: 1923335 - RNA, 19 nt, Homo sapiens
agaaguuacuaaguauuaa

SEQ ID NO: 1923336 - RNA, 13 nt, Homo sapiens
gacccgaggccca

SEQ ID NO: 1923337 - RNA, 14 nt, Homo sapiens
auaagauuccaaaa

SEQ ID NO: 1923338 - RNA, 16 nt, Homo sapiens
cuuggaacaguguuua

SEQ ID NO: 1923339 - RNA, 17 nt, Homo sapiens
agacuuugugacuguca

SEQ ID NO: 1923340 - RNA, 15 nt, Homo sapiens
ccuauaaucugucaa

SEQ ID NO: 1923341 - RNA, 14 nt, Homo sapiens
uuaaugacaguuuu

SEQ ID NO: 1923342 - RNA, 14 nt, Homo sapiens
aauacaguaagcau

SEQ ID NO: 1923343 - RNA, 14 nt, Homo sapiens
ggaaguuugcugug

SEQ ID NO: 1923344 - RNA, 21 nt, Homo sapiens
cuguggaaaguugguuuugua

SEQ ID NO: 1923345 - RNA, 21 nt, Homo sapiens
caccuggcccuagugacaggu

SEQ ID NO: 1923346 - RNA, 16 nt, Homo sapiens
gaggagacccuggaau

SEQ ID NO: 1923347 - RNA, 21 nt, Homo sapiens
gaugaggugguggaguggagu

SEQ ID NO: 1923348 - RNA, 15 nt, Homo sapiens
acagaguuucacucu

SEQ ID NO: 1923349 - RNA, 22 nt, Homo sapiens
agggaggcaacacugcugucca

SEQ ID NO: 1923350 - RNA, 20 nt, Homo sapiens
gcucuagagaaaagucuacc

SEQ ID NO: 1923351 - RNA, 16 nt, Homo sapiens
uucauccgcacuguaa

SEQ ID NO: 1923352 - RNA, 16 nt, Homo sapiens
uccucuuaauucccaa

SEQ ID NO: 1923353 - RNA, 23 nt, Homo sapiens
ccaugagcuccuuaaggcucuuu

SEQ ID NO: 1923354 - RNA, 23 nt, Homo sapiens
agucaggccuuaauuuucaguau

SEQ ID NO: 1923355 - RNA, 15 nt, Homo sapiens
aacaccacgucacuu

SEQ ID NO: 1923356 - RNA, 15 nt, Homo sapiens
uaucucuucagucuc

SEQ ID NO: 1923357 - RNA, 20 nt, Homo sapiens
caaugucauaaaugucacaa

SEQ ID NO: 1923358 - RNA, 19 nt, Homo sapiens
uuuacaucuaucccagagu

SEQ ID NO: 1923359 - RNA, 19 nt, Homo sapiens
aaaucuaacuacaaggaca

SEQ ID NO: 1923360 - RNA, 18 nt, Homo sapiens
caucugauaaaguugaga

SEQ ID NO: 1923361 - RNA, 18 nt, Homo sapiens
augucccuccaacacaga

SEQ ID NO: 1923362 - RNA, 14 nt, Homo sapiens
gcucugaaucugua

SEQ ID NO: 1923363 - RNA, 19 nt, Homo sapiens
ggggcaaagaaaagccaga

SEQ ID NO: 1923364 - RNA, 18 nt, Homo sapiens
ucagucccugacuaacag

SEQ ID NO: 1923365 - RNA, 15 nt, Homo sapiens
cugccagacaugcca

SEQ ID NO: 1923366 - RNA, 15 nt, Homo sapiens
uguguuugugccaua

SEQ ID NO: 1923367 - RNA, 17 nt, Homo sapiens
acuuucauucaauuugc

SEQ ID NO: 1923368 - RNA, 22 nt, Homo sapiens
gugaucugccugccuuggucuc

SEQ ID NO: 1923369 - RNA, 13 nt, Homo sapiens
ggcuccugugcuu

SEQ ID NO: 1923370 - RNA, 17 nt, Homo sapiens
uaauagccauaugcaau

SEQ ID NO: 1923371 - RNA, 19 nt, Homo sapiens
caaagacuaccugagauca

SEQ ID NO: 1923372 - RNA, 21 nt, Homo sapiens
uugguccuaccuauuauccuu

SEQ ID NO: 1923373 - RNA, 13 nt, Homo sapiens
gaguguggugugu

SEQ ID NO: 1923374 - RNA, 12 nt, Homo sapiens
uucccaccucag

SEQ ID NO: 1923375 - RNA, 18 nt, Homo sapiens
uugucaagagagagucaa

SEQ ID NO: 1923376 - RNA, 16 nt, Homo sapiens
gcuucaucugucaagu

SEQ ID NO: 1923377 - RNA, 19 nt, Homo sapiens
aucugacuucauacauccc

SEQ ID NO: 1923378 - RNA, 16 nt, Homo sapiens
auccuuccuacuuugc

SEQ ID NO: 1923379 - RNA, 17 nt, Homo sapiens
ccuacguucucuuuaaa

SEQ ID NO: 1923380 - RNA, 22 nt, Homo sapiens
uuccaguacuauggagugcuca

SEQ ID NO: 1923381 - RNA, 19 nt, Homo sapiens
gaaguaaaacagucaucua

SEQ ID NO: 1923382 - RNA, 23 nt, Homo sapiens
gaagauuuuuaggagugauuacu

SEQ ID NO: 1923383 - RNA, 15 nt, Homo sapiens
ucaaaugacccaaag

SEQ ID NO: 1923384 - RNA, 15 nt, Homo sapiens
uccugucaccaugac

SEQ ID NO: 1923385 - RNA, 16 nt, Homo sapiens
ccauuuuuagugaaau

SEQ ID NO: 1923386 - RNA, 17 nt, Homo sapiens
aguaguacuucuucugu

SEQ ID NO: 1923387 - RNA, 23 nt, Homo sapiens
cagccugucucuccuuguugccc

SEQ ID NO: 1923388 - RNA, 17 nt, Homo sapiens
cauuccucaugaaugua

SEQ ID NO: 1923389 - RNA, 22 nt, Homo sapiens
aaggcuucuccgcccauucuga

SEQ ID NO: 1923390 - RNA, 17 nt, Homo sapiens
uagaugggacuacaggc

SEQ ID NO: 1923391 - RNA, 16 nt, Homo sapiens
ucaugcggacccucac

SEQ ID NO: 1923392 - RNA, 21 nt, Homo sapiens
cucauucugcaaugagccaug

SEQ ID NO: 1923393 - RNA, 18 nt, Homo sapiens
aaaacccucugcuucucc

SEQ ID NO: 1923394 - RNA, 14 nt, Homo sapiens
cguaaagaacuuuu

SEQ ID NO: 1923395 - RNA, 14 nt, Homo sapiens
ucuucucucggggc

SEQ ID NO: 1923396 - RNA, 22 nt, Homo sapiens
auuuucagcugcaaggauucag

SEQ ID NO: 1923397 - RNA, 17 nt, Homo sapiens
gugucugagagccauaa

SEQ ID NO: 1923398 - RNA, 21 nt, Homo sapiens
aguauauuuuccucccaguuc

SEQ ID NO: 1923399 - RNA, 21 nt, Homo sapiens
cuaaguugcuaggaacaugug

SEQ ID NO: 1923400 - RNA, 17 nt, Homo sapiens
gacccucccuaccugag

SEQ ID NO: 1923401 - RNA, 18 nt, Homo sapiens
auucaggacuccaaccaa

SEQ ID NO: 1923402 - RNA, 21 nt, Homo sapiens
acccaauuugauuugaauauu

SEQ ID NO: 1923403 - RNA, 20 nt, Homo sapiens
uaaagacugguuuucugcca

SEQ ID NO: 1923404 - RNA, 16 nt, Homo sapiens
caggccagcucaggaa

SEQ ID NO: 1923405 - RNA, 16 nt, Homo sapiens
ucaugaauugugagca

SEQ ID NO: 1923406 - RNA, 21 nt, Homo sapiens
caagucaggacaucagucuga

SEQ ID NO: 1923407 - RNA, 13 nt, Homo sapiens
aagcuuacacaag

SEQ ID NO: 1923408 - RNA, 20 nt, Homo sapiens
ugcuauuuuuauacagugaa

SEQ ID NO: 1923409 - RNA, 22 nt, Homo sapiens
guccagaagggcuacuuuccac

SEQ ID NO: 1923410 - RNA, 21 nt, Homo sapiens
agucaccaguggccuuacccc

SEQ ID NO: 1923411 - RNA, 16 nt, Homo sapiens
acauguauccuuucac

SEQ ID NO: 1923412 - RNA, 21 nt, Homo sapiens
uuaaucagugaagaugcaauc

SEQ ID NO: 1923413 - RNA, 20 nt, Homo sapiens
ugaccucucauaaauuuacu

SEQ ID NO: 1923414 - RNA, 23 nt, Homo sapiens
ccauuccaaaauacaauguuauc

SEQ ID NO: 1923415 - RNA, 20 nt, Homo sapiens
guguauucuagugaaugaau

SEQ ID NO: 1923416 - RNA, 21 nt, Homo sapiens
uccucacguccaucacuggcu

SEQ ID NO: 1923417 - RNA, 22 nt, Homo sapiens
aauauaaauuuguguucucaaa

SEQ ID NO: 1923418 - RNA, 17 nt, Homo sapiens
aguucuuuuacuguaau

SEQ ID NO: 1923419 - RNA, 13 nt, Homo sapiens
ucuucagccauag

SEQ ID NO: 1923420 - RNA, 16 nt, Homo sapiens
aucugcugguaccuau

SEQ ID NO: 1923421 - RNA, 16 nt, Homo sapiens
agauguugugugcaau

SEQ ID NO: 1923422 - RNA, 13 nt, Homo sapiens
gucaagcugcuga

SEQ ID NO: 1923423 - RNA, 24 nt, Homo sapiens
cagcccaaccuagaccuguagauu

SEQ ID NO: 1923424 - RNA, 19 nt, Homo sapiens
agaaaauaagagcucagga

SEQ ID NO: 1923425 - RNA, 23 nt, Homo sapiens
aagccucugugucacuggcugcc

SEQ ID NO: 1923426 - RNA, 18 nt, Homo sapiens
gguagcugccacuugaac

SEQ ID NO: 1923427 - RNA, 15 nt, Homo sapiens
guuccgagaagaaca

SEQ ID NO: 1923428 - RNA, 14 nt, Homo sapiens
agauucucaccugc

SEQ ID NO: 1923429 - RNA, 14 nt, Homo sapiens
agauguucaccuuu

SEQ ID NO: 1923430 - RNA, 17 nt, Homo sapiens
acaacauagcaaauuaa

SEQ ID NO: 1923431 - RNA, 17 nt, Homo sapiens
auacuuacauaucugac

SEQ ID NO: 1923432 - RNA, 22 nt, Homo sapiens
cugacacugcgaacucucagga

SEQ ID NO: 1923433 - RNA, 14 nt, Homo sapiens
augugaacaaccug

SEQ ID NO: 1923434 - RNA, 19 nt, Homo sapiens
uccugugaugucaugaaag

SEQ ID NO: 1923435 - RNA, 18 nt, Homo sapiens
caagcaccucuccuguga

SEQ ID NO: 1923436 - RNA, 16 nt, Homo sapiens
agguggggacagggau

SEQ ID NO: 1923437 - RNA, 17 nt, Homo sapiens
auuaucacaucaagcau

SEQ ID NO: 1923438 - RNA, 14 nt, Homo sapiens
auuuaacugcauau

SEQ ID NO: 1923439 - RNA, 15 nt, Homo sapiens
cagggugcaguauca

SEQ ID NO: 1923440 - RNA, 15 nt, Homo sapiens
aauauccauccugaa

SEQ ID NO: 1923441 - RNA, 20 nt, Homo sapiens
caguugagagagaaucucaa

SEQ ID NO: 1923442 - RNA, 20 nt, Homo sapiens
caucaucuguucgauugaaa

SEQ ID NO: 1923443 - RNA, 16 nt, Homo sapiens
ccgugggcuguuacuu

SEQ ID NO: 1923444 - RNA, 20 nt, Homo sapiens
guacuuauguugcacaauga

SEQ ID NO: 1923445 - RNA, 15 nt, Homo sapiens
gccauucugccucag

SEQ ID NO: 1923446 - RNA, 14 nt, Homo sapiens
aggcaggugucuug

SEQ ID NO: 1923447 - RNA, 20 nt, Homo sapiens
gugagugccuccuguggucu

SEQ ID NO: 1923448 - RNA, 13 nt, Homo sapiens
gaaccaacaucuu

SEQ ID NO: 1923449 - RNA, 15 nt, Homo sapiens
gucugugacauuucc

SEQ ID NO: 1923450 - RNA, 16 nt, Homo sapiens
aagaaguuacuuugua

SEQ ID NO: 1923451 - RNA, 13 nt, Homo sapiens
cauuuuaacaaga

SEQ ID NO: 1923452 - RNA, 14 nt, Homo sapiens
ggaguuggagacca

SEQ ID NO: 1923453 - RNA, 14 nt, Homo sapiens
caguagauacuaaa

SEQ ID NO: 1923454 - RNA, 22 nt, Homo sapiens
agagguuugagaccgaccagcc

SEQ ID NO: 1923455 - RNA, 12 nt, Homo sapiens
cuucugcuacug

SEQ ID NO: 1923456 - RNA, 21 nt, Homo sapiens
uucucaaaagagguuacuuua

SEQ ID NO: 1923457 - RNA, 17 nt, Homo sapiens
aauuauguuuucaucca

SEQ ID NO: 1923458 - RNA, 18 nt, Homo sapiens
acagcccuccgacccuca

SEQ ID NO: 1923459 - RNA, 11 nt, Homo sapiens
uccucaaagaa

SEQ ID NO: 1923460 - RNA, 12 nt, Homo sapiens
ggcaugugccau

SEQ ID NO: 1923461 - RNA, 21 nt, Homo sapiens
uaauccaaaaggucuuuuuac

SEQ ID NO: 1923462 - RNA, 14 nt, Homo sapiens
acauuguaaaugau

SEQ ID NO: 1923463 - RNA, 13 nt, Homo sapiens
uuaaacaauuuga

SEQ ID NO: 1923464 - RNA, 14 nt, Homo sapiens
gauggccacugggu

SEQ ID NO: 1923465 - RNA, 23 nt, Homo sapiens
uccccaguugcaaaacagccaga

SEQ ID NO: 1923466 - RNA, 13 nt, Homo sapiens
uugccaaaggagg

SEQ ID NO: 1923467 - RNA, 14 nt, Homo sapiens
uuuacauucugcaa

SEQ ID NO: 1923468 - RNA, 12 nt, Homo sapiens
caauucuaguca

SEQ ID NO: 1923469 - RNA, 17 nt, Homo sapiens
uaccucugauaccucaa

SEQ ID NO: 1923470 - RNA, 21 nt, Homo sapiens
acacuucauuguaaaucacuu

SEQ ID NO: 1923471 - RNA, 23 nt, Homo sapiens
ccuccacauucauguacaaugau

SEQ ID NO: 1923472 - RNA, 14 nt, Homo sapiens
auaaagucucucug

SEQ ID NO: 1923473 - RNA, 17 nt, Homo sapiens
caaagaaaggagauaca

SEQ ID NO: 1923474 - RNA, 16 nt, Homo sapiens
acccaauuggcccaac

SEQ ID NO: 1923475 - RNA, 16 nt, Homo sapiens
uaaaagaaaccuucca

SEQ ID NO: 1923476 - RNA, 13 nt, Homo sapiens
uccacuucuuccu

SEQ ID NO: 1923477 - RNA, 13 nt, Homo sapiens
uucccuucuccau

SEQ ID NO: 1923478 - RNA, 19 nt, Homo sapiens
agaccucuaggaggagcua

SEQ ID NO: 1923479 - RNA, 20 nt, Homo sapiens
gggaaguuucguaugcacuc

SEQ ID NO: 1923480 - RNA, 22 nt, Homo sapiens
augcgaaccacccaaaacacgc

SEQ ID NO: 1923481 - RNA, 12 nt, Homo sapiens
gaauaguccuug

SEQ ID NO: 1923482 - RNA, 18 nt, Homo sapiens
uuuuuaaauaaaagucau

SEQ ID NO: 1923483 - RNA, 22 nt, Homo sapiens
ugugugauuuuuauuuucuucu

SEQ ID NO: 1923484 - RNA, 13 nt, Homo sapiens
ccuuccaacugcc

SEQ ID NO: 1923485 - RNA, 18 nt, Homo sapiens
cauccaaggcuguuacca

SEQ ID NO: 1923486 - RNA, 16 nt, Homo sapiens
cugcuguggggaccac

SEQ ID NO: 1923487 - RNA, 16 nt, Homo sapiens
agcuagcuguguuaga

SEQ ID NO: 1923488 - RNA, 14 nt, Homo sapiens
aguccuauuugcac

SEQ ID NO: 1923489 - RNA, 19 nt, Homo sapiens
ccagggaaggugagccaga

SEQ ID NO: 1923490 - RNA, 21 nt, Homo sapiens
uugcucgggucccuucaccuc

SEQ ID NO: 1923491 - RNA, 21 nt, Homo sapiens
uuauuaaaguacaaccauaga

SEQ ID NO: 1923492 - RNA, 16 nt, Homo sapiens
aaauaugaaagacuua

SEQ ID NO: 1923493 - RNA, 19 nt, Homo sapiens
accuuuuguauuuacuuug

SEQ ID NO: 1923494 - RNA, 20 nt, Homo sapiens
gccugccucaugcucucuau

SEQ ID NO: 1923495 - RNA, 18 nt, Homo sapiens
ugagucaaaaaaucucaa

SEQ ID NO: 1923496 - RNA, 17 nt, Homo sapiens
gaauuucucacaaagga

SEQ ID NO: 1923497 - RNA, 14 nt, Homo sapiens
auuauaagccaaac

SEQ ID NO: 1923498 - RNA, 14 nt, Homo sapiens
acacacagcuucua

SEQ ID NO: 1923499 - RNA, 17 nt, Homo sapiens
cagucugcuucagugca

SEQ ID NO: 1923500 - RNA, 20 nt, Homo sapiens
gaggcacucagugagccucc

SEQ ID NO: 1923501 - RNA, 21 nt, Homo sapiens
acaagcauuugcccuguggau

SEQ ID NO: 1923502 - RNA, 16 nt, Homo sapiens
uccagaaacagcugcu

SEQ ID NO: 1923503 - RNA, 19 nt, Homo sapiens
ucacuagcugucucaggag

SEQ ID NO: 1923504 - RNA, 22 nt, Homo sapiens
guacucuuaucugggugccuua

SEQ ID NO: 1923505 - RNA, 15 nt, Homo sapiens
agagccuuugaucuu

SEQ ID NO: 1923506 - RNA, 21 nt, Homo sapiens
uaguccguuaacacuacuuaa

SEQ ID NO: 1923507 - RNA, 17 nt, Homo sapiens
cuuuccuaaggcugcaa

SEQ ID NO: 1923508 - RNA, 12 nt, Homo sapiens
auguggucucag

SEQ ID NO: 1923509 - RNA, 18 nt, Homo sapiens
cuugaugcuagaaaggaa

SEQ ID NO: 1923510 - RNA, 13 nt, Homo sapiens
uuuaagaaucuau

SEQ ID NO: 1923511 - RNA, 21 nt, Homo sapiens
acuccucggggaacccaaggc

SEQ ID NO: 1923512 - RNA, 15 nt, Homo sapiens
ccacuuuaucuugaa

SEQ ID NO: 1923513 - RNA, 18 nt, Homo sapiens
aaacaaaagcaaagaugc

SEQ ID NO: 1923514 - RNA, 20 nt, Homo sapiens
uuccuaacuucaucauugau

SEQ ID NO: 1923515 - RNA, 22 nt, Homo sapiens
caucauuuuugaugacuaccuc

SEQ ID NO: 1923516 - RNA, 20 nt, Homo sapiens
ugccaugccaggaaccuguc

SEQ ID NO: 1923517 - RNA, 16 nt, Homo sapiens
aggccaccaggcugaa

SEQ ID NO: 1923518 - RNA, 18 nt, Homo sapiens
uauccauucucuccuucc

SEQ ID NO: 1923519 - RNA, 22 nt, Homo sapiens
ugguccccucccccauccccac

SEQ ID NO: 1923520 - RNA, 19 nt, Homo sapiens
ucccuuuaugcagagccac

SEQ ID NO: 1923521 - RNA, 19 nt, Homo sapiens
acgaacaggggccaaacug

SEQ ID NO: 1923522 - RNA, 13 nt, Homo sapiens
cuugagcuugacc

SEQ ID NO: 1923523 - RNA, 20 nt, Homo sapiens
aucuuagacccgguccugcc

SEQ ID NO: 1923524 - RNA, 22 nt, Homo sapiens
aagacucaggagucugccacuu

SEQ ID NO: 1923525 - RNA, 22 nt, Homo sapiens
ucaaaucucuccaccucuaguc

SEQ ID NO: 1923526 - RNA, 14 nt, Homo sapiens
ugaaaugaugguaa

SEQ ID NO: 1923527 - RNA, 11 nt, Homo sapiens
ccaaacacuuc

SEQ ID NO: 1923528 - RNA, 22 nt, Homo sapiens
uauuugcauaauaugcauauau

SEQ ID NO: 1923529 - RNA, 20 nt, Homo sapiens
uaaaagcaugauugggaaaa

SEQ ID NO: 1923530 - RNA, 13 nt, Homo sapiens
uaaugaaauucca

SEQ ID NO: 1923531 - RNA, 22 nt, Homo sapiens
guuucccauaacaaccugggca

SEQ ID NO: 1923532 - RNA, 17 nt, Homo sapiens
cuugggagcaccgccug

SEQ ID NO: 1923533 - RNA, 19 nt, Homo sapiens
uuaauuaaagaaaauuaau

SEQ ID NO: 1923534 - RNA, 17 nt, Homo sapiens
ucaaauauuaccaaaaa

SEQ ID NO: 1923535 - RNA, 17 nt, Homo sapiens
uguaauuucugccaaua

SEQ ID NO: 1923536 - RNA, 16 nt, Homo sapiens
uuagauauugcuacua

SEQ ID NO: 1923537 - RNA, 13 nt, Homo sapiens
ggaacuggcaaaa

SEQ ID NO: 1923538 - RNA, 13 nt, Homo sapiens
ccuauacauuaua

SEQ ID NO: 1923539 - RNA, 12 nt, Homo sapiens
cagagcucccuc

SEQ ID NO: 1923540 - RNA, 12 nt, Homo sapiens
ugauuguuuaca

SEQ ID NO: 1923541 - RNA, 14 nt, Homo sapiens
aucaauuaccacac

SEQ ID NO: 1923542 - RNA, 14 nt, Homo sapiens
uggaacucuacuca

SEQ ID NO: 1923543 - RNA, 21 nt, Homo sapiens
cugcaacaacgccuggugccc

SEQ ID NO: 1923544 - RNA, 21 nt, Homo sapiens
caccauuguuccuuaccuuua

SEQ ID NO: 1923545 - RNA, 20 nt, Homo sapiens
uuaaaagaaauauacaguuu

SEQ ID NO: 1923546 - RNA, 18 nt, Homo sapiens
guugagguacaguuugca

SEQ ID NO: 1923547 - RNA, 22 nt, Homo sapiens
cagcugaaaaguaaauugccuu

SEQ ID NO: 1923548 - RNA, 16 nt, Homo sapiens
ggcuucccugucuauu

SEQ ID NO: 1923549 - RNA, 19 nt, Homo sapiens
uuguaugcauggaaacaug

SEQ ID NO: 1923550 - RNA, 20 nt, Homo sapiens
caagugguaugaccagugau

SEQ ID NO: 1923551 - RNA, 18 nt, Homo sapiens
ggcuuuuccaaugaugaa

SEQ ID NO: 1923552 - RNA, 16 nt, Homo sapiens
ucuguggugcagugug

SEQ ID NO: 1923553 - RNA, 18 nt, Homo sapiens
acuguaugccucugagca

SEQ ID NO: 1923554 - RNA, 23 nt, Homo sapiens
gugaaaaugaauaucaugcaaau

SEQ ID NO: 1923555 - RNA, 19 nt, Homo sapiens
aguuaaaaucacauuuuaa

SEQ ID NO: 1923556 - RNA, 17 nt, Homo sapiens
auagucaaugaugguuu

SEQ ID NO: 1923557 - RNA, 17 nt, Homo sapiens
augcuguacaugacauc

SEQ ID NO: 1923558 - RNA, 15 nt, Homo sapiens
uuguuucuuaugcca

SEQ ID NO: 1923559 - RNA, 12 nt, Homo sapiens
uguucgacucag

SEQ ID NO: 1923560 - RNA, 13 nt, Homo sapiens
uguaauucauuga

SEQ ID NO: 1923561 - RNA, 12 nt, Homo sapiens
gccgacugccug

SEQ ID NO: 1923562 - RNA, 22 nt, Homo sapiens
aauguagaguuuuuaaacauca

SEQ ID NO: 1923563 - RNA, 19 nt, Homo sapiens
agacucagguuccagaaca

SEQ ID NO: 1923564 - RNA, 21 nt, Homo sapiens
acucaaugguaucauuacaau

SEQ ID NO: 1923565 - RNA, 18 nt, Homo sapiens
aauuaaugcagauuucuc

SEQ ID NO: 1923566 - RNA, 18 nt, Homo sapiens
ucccaaauaaacuccaga

SEQ ID NO: 1923567 - RNA, 14 nt, Homo sapiens
cuaaauccaaugac

SEQ ID NO: 1923568 - RNA, 14 nt, Homo sapiens
uauguucaaagacu

SEQ ID NO: 1923569 - RNA, 19 nt, Homo sapiens
guugaaaaccacagucagu

SEQ ID NO: 1923570 - RNA, 19 nt, Homo sapiens
uuccccacgggaacauuau

SEQ ID NO: 1923571 - RNA, 16 nt, Homo sapiens
augaccacauccugaa

SEQ ID NO: 1923572 - RNA, 21 nt, Homo sapiens
aggcucuggcccuugccuuug

SEQ ID NO: 1923573 - RNA, 14 nt, Homo sapiens
aggguuccaaaggg

SEQ ID NO: 1923574 - RNA, 15 nt, Homo sapiens
gccagagguuugaga

SEQ ID NO: 1923575 - RNA, 21 nt, Homo sapiens
uccccuuuggcuaccugaugg

SEQ ID NO: 1923576 - RNA, 13 nt, Homo sapiens
agcgagacccugu

SEQ ID NO: 1923577 - RNA, 22 nt, Homo sapiens
ucaaauaggcuauuaaaaaagu

SEQ ID NO: 1923578 - RNA, 13 nt, Homo sapiens
aauuuagccaaua

SEQ ID NO: 1923579 - RNA, 13 nt, Homo sapiens
cuuacauggcgcu

SEQ ID NO: 1923580 - RNA, 21 nt, Homo sapiens
aggaccugaagguauuggccu

SEQ ID NO: 1923581 - RNA, 12 nt, Homo sapiens
gugccauauucu

SEQ ID NO: 1923582 - RNA, 21 nt, Homo sapiens
cugcgcuccucugcagccuga

SEQ ID NO: 1923583 - RNA, 14 nt, Homo sapiens
ggcagaucacuuga

SEQ ID NO: 1923584 - RNA, 17 nt, Homo sapiens
ugggucuccauccucca

SEQ ID NO: 1923585 - RNA, 20 nt, Homo sapiens
cagaaaauaaaugguuucau

SEQ ID NO: 1923586 - RNA, 22 nt, Homo sapiens
auuucauaaugaaaaacuaugu

SEQ ID NO: 1923587 - RNA, 20 nt, Homo sapiens
auuucuccguugagucaucu

SEQ ID NO: 1923588 - RNA, 16 nt, Homo sapiens
ugccucugcucccucu

SEQ ID NO: 1923589 - RNA, 15 nt, Homo sapiens
uugaaaguacuccuu

SEQ ID NO: 1923590 - RNA, 23 nt, Homo sapiens
ggugaaacccuacgaaagcacag

SEQ ID NO: 1923591 - RNA, 17 nt, Homo sapiens
uguagggggcaggggaa

SEQ ID NO: 1923592 - RNA, 21 nt, Homo sapiens
cauuuggcagagucugaagaa

SEQ ID NO: 1923593 - RNA, 22 nt, Homo sapiens
aaaauucucauuuuucauuucu

SEQ ID NO: 1923594 - RNA, 20 nt, Homo sapiens
caucagagcagcuagcucuu

SEQ ID NO: 1923595 - RNA, 22 nt, Homo sapiens
gauggaccuccuucgcuggaag

SEQ ID NO: 1923596 - RNA, 15 nt, Homo sapiens
uggagaaaaggcagu

SEQ ID NO: 1923597 - RNA, 18 nt, Homo sapiens
uguaaaacuaaacauaca

SEQ ID NO: 1923598 - RNA, 20 nt, Homo sapiens
aggguccuacggagggacca

SEQ ID NO: 1923599 - RNA, 18 nt, Homo sapiens
acuccuguaacugucuca

SEQ ID NO: 1923600 - RNA, 10 nt, Homo sapiens
cuugccuuau

SEQ ID NO: 1923601 - RNA, 12 nt, Homo sapiens
uauuugucacaa

SEQ ID NO: 1923602 - RNA, 18 nt, Homo sapiens
uaaauguguuagcacuga

SEQ ID NO: 1923603 - RNA, 23 nt, Homo sapiens
aggaaauaguaccuucaauacuu

SEQ ID NO: 1923604 - RNA, 13 nt, Homo sapiens
caaucagccuuua

SEQ ID NO: 1923605 - RNA, 11 nt, Homo sapiens
gcugacaauaa

SEQ ID NO: 1923606 - RNA, 14 nt, Homo sapiens
cugccuuaaacaca

SEQ ID NO: 1923607 - RNA, 21 nt, Homo sapiens
uuccccgcccguuuuacaaag

SEQ ID NO: 1923608 - RNA, 13 nt, Homo sapiens
gaccacccggcau

SEQ ID NO: 1923609 - RNA, 22 nt, Homo sapiens
ucugguuaggugugucagguug

SEQ ID NO: 1923610 - RNA, 20 nt, Homo sapiens
cuuuaauugacaguuucaau

SEQ ID NO: 1923611 - RNA, 18 nt, Homo sapiens
uacgugagaaauagcuga

SEQ ID NO: 1923612 - RNA, 18 nt, Homo sapiens
acugugaaugcuucugau

SEQ ID NO: 1923613 - RNA, 14 nt, Homo sapiens
ccgcgugccaugca

SEQ ID NO: 1923614 - RNA, 15 nt, Homo sapiens
ccacacuguacucug

SEQ ID NO: 1923615 - RNA, 14 nt, Homo sapiens
ucaaaaagaacuaa

SEQ ID NO: 1923616 - RNA, 19 nt, Homo sapiens
ggcccagcuuucccugcca

SEQ ID NO: 1923617 - RNA, 17 nt, Homo sapiens
aagcauagacgucucag

SEQ ID NO: 1923618 - RNA, 21 nt, Homo sapiens
gguuuuauaaggcugauguca

SEQ ID NO: 1923619 - RNA, 15 nt, Homo sapiens
augucuagcucaucu

SEQ ID NO: 1923620 - RNA, 15 nt, Homo sapiens
agcucucaguugcag

SEQ ID NO: 1923621 - RNA, 15 nt, Homo sapiens
cugacuccacucaaa

SEQ ID NO: 1923622 - RNA, 17 nt, Homo sapiens
auugagcaguuagcuca

SEQ ID NO: 1923623 - RNA, 17 nt, Homo sapiens
uuuagacuguagauuau

SEQ ID NO: 1923624 - RNA, 15 nt, Homo sapiens
uaagcuaugugaaau

SEQ ID NO: 1923625 - RNA, 13 nt, Homo sapiens
ggucaccaaacag

SEQ ID NO: 1923626 - RNA, 21 nt, Homo sapiens
accucauuuacaaagcaaaaa

SEQ ID NO: 1923627 - RNA, 20 nt, Homo sapiens
auuauuuuagagcaucucau

SEQ ID NO: 1923628 - RNA, 16 nt, Homo sapiens
ggccaagggccagaca

SEQ ID NO: 1923629 - RNA, 18 nt, Homo sapiens
auuaugagucucuaugau

SEQ ID NO: 1923630 - RNA, 18 nt, Homo sapiens
ugugucuugcgagcuguu

SEQ ID NO: 1923631 - RNA, 13 nt, Homo sapiens
uggcuucuaggug

SEQ ID NO: 1923632 - RNA, 17 nt, Homo sapiens
uaacccugucugagaug

SEQ ID NO: 1923633 - RNA, 21 nt, Homo sapiens
ccucuucucuacucuagggaa

SEQ ID NO: 1923634 - RNA, 21 nt, Homo sapiens
cugaauguuuaaagaucauga

SEQ ID NO: 1923635 - RNA, 20 nt, Homo sapiens
aagcaacacuuugugaucuc

SEQ ID NO: 1923636 - RNA, 15 nt, Homo sapiens
guaaacaaaggaauu

SEQ ID NO: 1923637 - RNA, 17 nt, Homo sapiens
acacauuuggcaguuua

SEQ ID NO: 1923638 - RNA, 22 nt, Homo sapiens
uaaggaaaaaauaauauccaua

SEQ ID NO: 1923639 - RNA, 15 nt, Homo sapiens
cagcuguagccaugg

SEQ ID NO: 1923640 - RNA, 14 nt, Homo sapiens
gcaguuggcagaaa

SEQ ID NO: 1923641 - RNA, 22 nt, Homo sapiens
ucauuguaaacaaacucuugaa

SEQ ID NO: 1923642 - RNA, 16 nt, Homo sapiens
cauguugagccaugag

SEQ ID NO: 1923643 - RNA, 17 nt, Homo sapiens
aaugcuuuccaucucca

SEQ ID NO: 1923644 - RNA, 23 nt, Homo sapiens
cagucccuuacacguaccucuca

SEQ ID NO: 1923645 - RNA, 14 nt, Homo sapiens
ucuaugugcaacug

SEQ ID NO: 1923646 - RNA, 17 nt, Homo sapiens
gauucuauuuaauugaa

SEQ ID NO: 1923647 - RNA, 14 nt, Homo sapiens
caaggaaacaugca

SEQ ID NO: 1923648 - RNA, 14 nt, Homo sapiens
uaagucccuuucaa

SEQ ID NO: 1923649 - RNA, 21 nt, Homo sapiens
aucuauugcucaucagcuuua

SEQ ID NO: 1923650 - RNA, 20 nt, Homo sapiens
aauacauggacaauaccccc

SEQ ID NO: 1923651 - RNA, 16 nt, Homo sapiens
ugggcuugaaacauua

SEQ ID NO: 1923652 - RNA, 17 nt, Homo sapiens
auauacuaauauguaau

SEQ ID NO: 1923653 - RNA, 14 nt, Homo sapiens
uucuugcaauuuga

SEQ ID NO: 1923654 - RNA, 20 nt, Homo sapiens
cugucuuccuguguaccucu

SEQ ID NO: 1923655 - RNA, 17 nt, Homo sapiens
guucuccucugaccugc

SEQ ID NO: 1923656 - RNA, 17 nt, Homo sapiens
ugauucaccucuuccuc

SEQ ID NO: 1923657 - RNA, 16 nt, Homo sapiens
uauaaaacguguuugu

SEQ ID NO: 1923658 - RNA, 19 nt, Homo sapiens
uucugugguuucauguuag

SEQ ID NO: 1923659 - RNA, 20 nt, Homo sapiens
ggcuguguugguguggccca

SEQ ID NO: 1923660 - RNA, 22 nt, Homo sapiens
caugcacugcaaauacuuccaa

SEQ ID NO: 1923661 - RNA, 15 nt, Homo sapiens
uggcaggacuccaga

SEQ ID NO: 1923662 - RNA, 14 nt, Homo sapiens
cagccgauguggua

SEQ ID NO: 1923663 - RNA, 15 nt, Homo sapiens
ggggagaauggcucu

SEQ ID NO: 1923664 - RNA, 19 nt, Homo sapiens
auauggacuuccaaucuac

SEQ ID NO: 1923665 - RNA, 12 nt, Homo sapiens
aggaaauuugca

SEQ ID NO: 1923666 - RNA, 23 nt, Homo sapiens
acugacauuuuuuccuaaggaag

SEQ ID NO: 1923667 - RNA, 15 nt, Homo sapiens
uuuugugccauguuc

SEQ ID NO: 1923668 - RNA, 14 nt, Homo sapiens
gauauugaauguga

SEQ ID NO: 1923669 - RNA, 19 nt, Homo sapiens
guuauaacucugcacuacu

SEQ ID NO: 1923670 - RNA, 15 nt, Homo sapiens
gcuggcccgugacag

SEQ ID NO: 1923671 - RNA, 17 nt, Homo sapiens
aacuagaauuuauucaa

SEQ ID NO: 1923672 - RNA, 15 nt, Homo sapiens
uaccuuccuccucaa

SEQ ID NO: 1923673 - RNA, 13 nt, Homo sapiens
agaacuguucuca

SEQ ID NO: 1923674 - RNA, 17 nt, Homo sapiens
aggaaauaagacuuuua

SEQ ID NO: 1923675 - RNA, 14 nt, Homo sapiens
gucgaggcugguaa

SEQ ID NO: 1923676 - RNA, 18 nt, Homo sapiens
gaauggucaagugaugaa

SEQ ID NO: 1923677 - RNA, 17 nt, Homo sapiens
cacccgccucccucuca

SEQ ID NO: 1923678 - RNA, 19 nt, Homo sapiens
aacccuguuuuauugaguu

SEQ ID NO: 1923679 - RNA, 22 nt, Homo sapiens
gaugaucagaaaaauaauucca

SEQ ID NO: 1923680 - RNA, 20 nt, Homo sapiens
ugcuaucggggaagccagac

SEQ ID NO: 1923681 - RNA, 15 nt, Homo sapiens
uuuaaccuuccaaga

SEQ ID NO: 1923682 - RNA, 13 nt, Homo sapiens
ugagugugugagc

SEQ ID NO: 1923683 - RNA, 13 nt, Homo sapiens
cacaugugcacac

SEQ ID NO: 1923684 - RNA, 13 nt, Homo sapiens
ucacugugucacc

SEQ ID NO: 1923685 - RNA, 15 nt, Homo sapiens
aacacacagcuccca

SEQ ID NO: 1923686 - RNA, 22 nt, Homo sapiens
cauuugauaaugauaaaacacc

SEQ ID NO: 1923687 - RNA, 18 nt, Homo sapiens
augggcuaccaggaagaa

SEQ ID NO: 1923688 - RNA, 17 nt, Homo sapiens
ucugccaagauacuuga

SEQ ID NO: 1923689 - RNA, 14 nt, Homo sapiens
gcccaggaucucuu

SEQ ID NO: 1923690 - RNA, 18 nt, Homo sapiens
ucagagccgggguggggu

SEQ ID NO: 1923691 - RNA, 12 nt, Homo sapiens
uggcccuguuaa

SEQ ID NO: 1923692 - RNA, 11 nt, Homo sapiens
gacguugccua

SEQ ID NO: 1923693 - RNA, 14 nt, Homo sapiens
cucagaguccaguc

SEQ ID NO: 1923694 - RNA, 21 nt, Homo sapiens
agaaucagagaaggaacauac

SEQ ID NO: 1923695 - RNA, 19 nt, Homo sapiens
auguaaaggaaacauauuu

SEQ ID NO: 1923696 - RNA, 19 nt, Homo sapiens
caauauuaacacgcugccu

SEQ ID NO: 1923697 - RNA, 20 nt, Homo sapiens
ggacucaaaguuucagagac

SEQ ID NO: 1923698 - RNA, 14 nt, Homo sapiens
auguauguagcgua

SEQ ID NO: 1923699 - RNA, 17 nt, Homo sapiens
ugcgagggccacagccc

SEQ ID NO: 1923700 - RNA, 17 nt, Homo sapiens
caucgaccacaccagcc

SEQ ID NO: 1923701 - RNA, 20 nt, Homo sapiens
uaguaugcuaugcuauggaa

SEQ ID NO: 1923702 - RNA, 16 nt, Homo sapiens
cugaaaacuaugcaag

SEQ ID NO: 1923703 - RNA, 15 nt, Homo sapiens
auaucuaaguucaca

SEQ ID NO: 1923704 - RNA, 14 nt, Homo sapiens
uuacaaauggugaa

SEQ ID NO: 1923705 - RNA, 18 nt, Homo sapiens
guuugaucauagaauugu

SEQ ID NO: 1923706 - RNA, 20 nt, Homo sapiens
ucagacacuaccccauauac

SEQ ID NO: 1923707 - RNA, 20 nt, Homo sapiens
aguagaauacgcagaacuac

SEQ ID NO: 1923708 - RNA, 21 nt, Homo sapiens
cuaaaauugcuucuuuaccaa

SEQ ID NO: 1923709 - RNA, 15 nt, Homo sapiens
ucuuucucucuuucc

SEQ ID NO: 1923710 - RNA, 22 nt, Homo sapiens
ugagacagcucugcauacucau

SEQ ID NO: 1923711 - RNA, 15 nt, Homo sapiens
uugaaccugugcuca

SEQ ID NO: 1923712 - RNA, 20 nt, Homo sapiens
uccagcaaaaugucuccuga

SEQ ID NO: 1923713 - RNA, 21 nt, Homo sapiens
ucccaugagugugauccacau

SEQ ID NO: 1923714 - RNA, 23 nt, Homo sapiens
aauuuucagaauuaaugcauuca

SEQ ID NO: 1923715 - RNA, 14 nt, Homo sapiens
gcagagaacaucug

SEQ ID NO: 1923716 - RNA, 15 nt, Homo sapiens
cuaauccaaauauca

SEQ ID NO: 1923717 - RNA, 21 nt, Homo sapiens
uucucaacuaccucgcaucau

SEQ ID NO: 1923718 - RNA, 15 nt, Homo sapiens
aauugagaccacagg

SEQ ID NO: 1923719 - RNA, 20 nt, Homo sapiens
ucagacacccucuccuuaaa

SEQ ID NO: 1923720 - RNA, 20 nt, Homo sapiens
ugcaaaaguaaauguugaca

SEQ ID NO: 1923721 - RNA, 11 nt, Homo sapiens
cgucuccuagc

SEQ ID NO: 1923722 - RNA, 16 nt, Homo sapiens
ccugaccucacuguga

SEQ ID NO: 1923723 - RNA, 16 nt, Homo sapiens
uucugucucauaugau

SEQ ID NO: 1923724 - RNA, 21 nt, Homo sapiens
aacaugguggaaaacgaagcu

SEQ ID NO: 1923725 - RNA, 21 nt, Homo sapiens
cuuuucuuacuagcuucagaa

SEQ ID NO: 1923726 - RNA, 22 nt, Homo sapiens
uggagagugggcugacaucaag

SEQ ID NO: 1923727 - RNA, 23 nt, Homo sapiens
guucuggggggacccagugcaga

SEQ ID NO: 1923728 - RNA, 13 nt, Homo sapiens
gauaauagauucu

SEQ ID NO: 1923729 - RNA, 20 nt, Homo sapiens
aguaaaggcaguaaugccuu

SEQ ID NO: 1923730 - RNA, 18 nt, Homo sapiens
aaaucuacacuccaguga

SEQ ID NO: 1923731 - RNA, 18 nt, Homo sapiens
uuaauagcuuuugauuag

SEQ ID NO: 1923732 - RNA, 16 nt, Homo sapiens
ucauaucucuugcccu

SEQ ID NO: 1923733 - RNA, 15 nt, Homo sapiens
guacuuagcagcuau

SEQ ID NO: 1923734 - RNA, 22 nt, Homo sapiens
acacuccagugccagcaaugac

SEQ ID NO: 1923735 - RNA, 15 nt, Homo sapiens
uguccuaugcgcuca

SEQ ID NO: 1923736 - RNA, 22 nt, Homo sapiens
uaaaaauauauauagugcuaua

SEQ ID NO: 1923737 - RNA, 18 nt, Homo sapiens
ucaccucagggguuaaga

SEQ ID NO: 1923738 - RNA, 16 nt, Homo sapiens
acacgcauguaugcau

SEQ ID NO: 1923739 - RNA, 14 nt, Homo sapiens
gaggcuaacccuga

SEQ ID NO: 1923740 - RNA, 13 nt, Homo sapiens
ucaagacauuaaa

SEQ ID NO: 1923741 - RNA, 15 nt, Homo sapiens
ccaucauuuacuuuu

SEQ ID NO: 1923742 - RNA, 19 nt, Homo sapiens
ggaagaaaagcugccauuu

SEQ ID NO: 1923743 - RNA, 17 nt, Homo sapiens
ucucugcaucuacuccc

SEQ ID NO: 1923744 - RNA, 17 nt, Homo sapiens
cugccuccaugaugcaa

SEQ ID NO: 1923745 - RNA, 16 nt, Homo sapiens
cuucagaauaucuuaa

SEQ ID NO: 1923746 - RNA, 19 nt, Homo sapiens
uacagcuuugugacuguau

SEQ ID NO: 1923747 - RNA, 19 nt, Homo sapiens
aaaaucugaauuuugcaau

SEQ ID NO: 1923748 - RNA, 20 nt, Homo sapiens
uaaaaaggaacaagacugac

SEQ ID NO: 1923749 - RNA, 20 nt, Homo sapiens
uccuuuaccgaggacagccu

SEQ ID NO: 1923750 - RNA, 20 nt, Homo sapiens
acucacuuuucccacuccaa

SEQ ID NO: 1923751 - RNA, 22 nt, Homo sapiens
gaauacuggggauuaccauuca

SEQ ID NO: 1923752 - RNA, 15 nt, Homo sapiens
ucccacucaguccau

SEQ ID NO: 1923753 - RNA, 14 nt, Homo sapiens
gauccacccaccuc

SEQ ID NO: 1923754 - RNA, 24 nt, Homo sapiens
guuaaguugaaguaaaagcaagua

SEQ ID NO: 1923755 - RNA, 12 nt, Homo sapiens
aaucagcacuga

SEQ ID NO: 1923756 - RNA, 20 nt, Homo sapiens
cagaugugagccaccgugcc

SEQ ID NO: 1923757 - RNA, 17 nt, Homo sapiens
gauuuccucugaauuau

SEQ ID NO: 1923758 - RNA, 17 nt, Homo sapiens
uguuuguaugucugugu

SEQ ID NO: 1923759 - RNA, 20 nt, Homo sapiens
uaaguaaaagcuacuaugua

SEQ ID NO: 1923760 - RNA, 18 nt, Homo sapiens
ccagccugcccaacgugg

SEQ ID NO: 1923761 - RNA, 17 nt, Homo sapiens
gcagcuggagaucuuaa

SEQ ID NO: 1923762 - RNA, 21 nt, Homo sapiens
aauauuuucuguguguuccug

SEQ ID NO: 1923763 - RNA, 22 nt, Homo sapiens
ucuuuaaacacucuucagagaa

SEQ ID NO: 1923764 - RNA, 15 nt, Homo sapiens
caauguccuaaaaag

SEQ ID NO: 1923765 - RNA, 16 nt, Homo sapiens
cucuccccaaauugcc

SEQ ID NO: 1923766 - RNA, 21 nt, Homo sapiens
ugacuguaggcgccccugggg

SEQ ID NO: 1923767 - RNA, 19 nt, Homo sapiens
ugucucauaguuguguuaa

SEQ ID NO: 1923768 - RNA, 22 nt, Homo sapiens
agaugucauuuaguucagcauc

SEQ ID NO: 1923769 - RNA, 21 nt, Homo sapiens
auaauaugugaucagcuuuca

SEQ ID NO: 1923770 - RNA, 18 nt, Homo sapiens
gucacuagaaguccugcu

SEQ ID NO: 1923771 - RNA, 20 nt, Homo sapiens
aggcugccugcuauguauuu

SEQ ID NO: 1923772 - RNA, 20 nt, Homo sapiens
agaaacagauaccauacuca

SEQ ID NO: 1923773 - RNA, 16 nt, Homo sapiens
gcccucucugcuccuu

SEQ ID NO: 1923774 - RNA, 18 nt, Homo sapiens
aagggacggggaagccga

SEQ ID NO: 1923775 - RNA, 22 nt, Homo sapiens
agagcuuugcuucucucucuaa

SEQ ID NO: 1923776 - RNA, 21 nt, Homo sapiens
agcacuuuaacacagugucug

SEQ ID NO: 1923777 - RNA, 12 nt, Homo sapiens
gagugacucugg

SEQ ID NO: 1923778 - RNA, 19 nt, Homo sapiens
guucccauauauuguuaua

SEQ ID NO: 1923779 - RNA, 17 nt, Homo sapiens
gagcagaggucucccaa

SEQ ID NO: 1923780 - RNA, 17 nt, Homo sapiens
gugcccccugaaacagc

SEQ ID NO: 1923781 - RNA, 19 nt, Homo sapiens
cuauggaaaugugagaaau

SEQ ID NO: 1923782 - RNA, 15 nt, Homo sapiens
ccgagguaggggugg

SEQ ID NO: 1923783 - RNA, 13 nt, Homo sapiens
ugaugccaagaaa

SEQ ID NO: 1923784 - RNA, 13 nt, Homo sapiens
ucuucagauccug

SEQ ID NO: 1923785 - RNA, 22 nt, Homo sapiens
gaaaugaugaaaagguugccug

SEQ ID NO: 1923786 - RNA, 11 nt, Homo sapiens
uugcucaaggc

SEQ ID NO: 1923787 - RNA, 13 nt, Homo sapiens
aucagaaacugaa

SEQ ID NO: 1923788 - RNA, 21 nt, Homo sapiens
guuacaaaguaauuucuuuga

SEQ ID NO: 1923789 - RNA, 18 nt, Homo sapiens
gucuuugcagggcacaga

SEQ ID NO: 1923790 - RNA, 21 nt, Homo sapiens
ccuaguuugaccucacaguga

SEQ ID NO: 1923791 - RNA, 17 nt, Homo sapiens
aucacuugcacuccgga

SEQ ID NO: 1923792 - RNA, 19 nt, Homo sapiens
auuuugaaaacugugcaau

SEQ ID NO: 1923793 - RNA, 23 nt, Homo sapiens
augcaugauaaugaguuuuacau

SEQ ID NO: 1923794 - RNA, 17 nt, Homo sapiens
ugcagcuguacugagga

SEQ ID NO: 1923795 - RNA, 16 nt, Homo sapiens
cugugcucacuaccug

SEQ ID NO: 1923796 - RNA, 20 nt, Homo sapiens
uacaauaaaaccuuugccac

SEQ ID NO: 1923797 - RNA, 12 nt, Homo sapiens
cacgaggaaaag

SEQ ID NO: 1923798 - RNA, 16 nt, Homo sapiens
aaugagugaguucuca

SEQ ID NO: 1923799 - RNA, 15 nt, Homo sapiens
auauauauauucuca

SEQ ID NO: 1923800 - RNA, 22 nt, Homo sapiens
caaaccuucugccuuugauguu

SEQ ID NO: 1923801 - RNA, 20 nt, Homo sapiens
ccaaagucuaaacugagcuc

SEQ ID NO: 1923802 - RNA, 20 nt, Homo sapiens
ggagguggaggcugcaguga

SEQ ID NO: 1923803 - RNA, 17 nt, Homo sapiens
ccucaaaaaaagccuuu

SEQ ID NO: 1923804 - RNA, 20 nt, Homo sapiens
guauuuuauaaguaucuuca

SEQ ID NO: 1923805 - RNA, 10 nt, Homo sapiens
guaugugcac

SEQ ID NO: 1923806 - RNA, 17 nt, Homo sapiens
auuugaacuccucucag

SEQ ID NO: 1923807 - RNA, 14 nt, Homo sapiens
caggaaaccaaaua

SEQ ID NO: 1923808 - RNA, 19 nt, Homo sapiens
aaauagcuauauccaugua

SEQ ID NO: 1923809 - RNA, 13 nt, Homo sapiens
aaacuucacucca

SEQ ID NO: 1923810 - RNA, 22 nt, Homo sapiens
uccuuguaauaccugauugauc

SEQ ID NO: 1923811 - RNA, 11 nt, Homo sapiens
cucaaccaaau

SEQ ID NO: 1923812 - RNA, 23 nt, Homo sapiens
aaugguaucauauuaacauauuc

SEQ ID NO: 1923813 - RNA, 14 nt, Homo sapiens
gcagagaaccaaag

SEQ ID NO: 1923814 - RNA, 19 nt, Homo sapiens
uuaguaacaucauaagaua

SEQ ID NO: 1923815 - RNA, 19 nt, Homo sapiens
gaaguuaggucauuacuaa

SEQ ID NO: 1923816 - RNA, 23 nt, Homo sapiens
cuggcucccucuuggucuuccca

SEQ ID NO: 1923817 - RNA, 19 nt, Homo sapiens
uagagauggugcuauugaa

SEQ ID NO: 1923818 - RNA, 15 nt, Homo sapiens
ugguggaugaacaaa

SEQ ID NO: 1923819 - RNA, 17 nt, Homo sapiens
uacaagagacauauaau

SEQ ID NO: 1923820 - RNA, 22 nt, Homo sapiens
aucuuucaagggaccucuccau

SEQ ID NO: 1923821 - RNA, 15 nt, Homo sapiens
aggaagugauaacac

SEQ ID NO: 1923822 - RNA, 21 nt, Homo sapiens
ccaaagaacagccugagccaa

SEQ ID NO: 1923823 - RNA, 14 nt, Homo sapiens
uaauguuggaugau

SEQ ID NO: 1923824 - RNA, 21 nt, Homo sapiens
ucccaacucuugcacagucac

SEQ ID NO: 1923825 - RNA, 17 nt, Homo sapiens
aagcccaccacuggcca

SEQ ID NO: 1923826 - RNA, 20 nt, Homo sapiens
cauugaugacccucugaccc

SEQ ID NO: 1923827 - RNA, 16 nt, Homo sapiens
uccaugugugugcaag

SEQ ID NO: 1923828 - RNA, 16 nt, Homo sapiens
aacuuccuucuuacuu

SEQ ID NO: 1923829 - RNA, 21 nt, Homo sapiens
agggauaguacuaagcauuuc

SEQ ID NO: 1923830 - RNA, 18 nt, Homo sapiens
auuuagagucaauuugcu

SEQ ID NO: 1923831 - RNA, 15 nt, Homo sapiens
aaucuuuuacauuga

SEQ ID NO: 1923832 - RNA, 16 nt, Homo sapiens
aucucaacaaccugaa

SEQ ID NO: 1923833 - RNA, 16 nt, Homo sapiens
cucccaccuccuggug

SEQ ID NO: 1923834 - RNA, 20 nt, Homo sapiens
ccagaaggcaaaaaccagaa

SEQ ID NO: 1923835 - RNA, 21 nt, Homo sapiens
caaauucauggugcacugagc

SEQ ID NO: 1923836 - RNA, 22 nt, Homo sapiens
aauacucagggaaagcauuuaa

SEQ ID NO: 1923837 - RNA, 14 nt, Homo sapiens
auccucccaccuca

SEQ ID NO: 1923838 - RNA, 20 nt, Homo sapiens
ggaauggggcaaaguaaauu

SEQ ID NO: 1923839 - RNA, 12 nt, Homo sapiens
gguccugucuaa

SEQ ID NO: 1923840 - RNA, 16 nt, Homo sapiens
uggagaaagcacugac

SEQ ID NO: 1923841 - RNA, 21 nt, Homo sapiens
guaacccuuuucaugauuuca

SEQ ID NO: 1923842 - RNA, 17 nt, Homo sapiens
aggacagaauguguucu

SEQ ID NO: 1923843 - RNA, 20 nt, Homo sapiens
ucaacaaauauuuaccaagu

SEQ ID NO: 1923844 - RNA, 18 nt, Homo sapiens
uugcccaaaaugucaauu

SEQ ID NO: 1923845 - RNA, 14 nt, Homo sapiens
ccucuguggucaca

SEQ ID NO: 1923846 - RNA, 18 nt, Homo sapiens
uguuuaccuucagccaua

SEQ ID NO: 1923847 - RNA, 13 nt, Homo sapiens
caugcuggggcaa

SEQ ID NO: 1923848 - RNA, 22 nt, Homo sapiens
auuuaaagaaaauaaacaccau

SEQ ID NO: 1923849 - RNA, 11 nt, Homo sapiens
uccaacagggg

SEQ ID NO: 1923850 - RNA, 23 nt, Homo sapiens
gacagcugccgcccggugccacc

SEQ ID NO: 1923851 - RNA, 23 nt, Homo sapiens
ugaucuguguacaauuuuaguca

SEQ ID NO: 1923852 - RNA, 16 nt, Homo sapiens
uccucuggaucacaga

SEQ ID NO: 1923853 - RNA, 15 nt, Homo sapiens
ccauggccugugcug

SEQ ID NO: 1923854 - RNA, 21 nt, Homo sapiens
uuaagcucucauagcucauaa

SEQ ID NO: 1923855 - RNA, 12 nt, Homo sapiens
cauuuccagagc

SEQ ID NO: 1923856 - RNA, 21 nt, Homo sapiens
agagugucuuaaaauguuuca

SEQ ID NO: 1923857 - RNA, 14 nt, Homo sapiens
uccagcuucaggca

SEQ ID NO: 1923858 - RNA, 18 nt, Homo sapiens
caagguggguuccaggga

SEQ ID NO: 1923859 - RNA, 14 nt, Homo sapiens
aauacaugguuuaa

SEQ ID NO: 1923860 - RNA, 17 nt, Homo sapiens
ucgccugcuggggaccu

SEQ ID NO: 1923861 - RNA, 16 nt, Homo sapiens
acucuugucacccagg

SEQ ID NO: 1923862 - RNA, 14 nt, Homo sapiens
uucccgccuaauaa

SEQ ID NO: 1923863 - RNA, 16 nt, Homo sapiens
cauguacaaaaacaca

SEQ ID NO: 1923864 - RNA, 14 nt, Homo sapiens
gcgagccugacucu

SEQ ID NO: 1923865 - RNA, 14 nt, Homo sapiens
gguuaaaaaggcca

SEQ ID NO: 1923866 - RNA, 18 nt, Homo sapiens
ugcagcuagaggcaucuu

SEQ ID NO: 1923867 - RNA, 12 nt, Homo sapiens
cuaaauguauuu

SEQ ID NO: 1923868 - RNA, 13 nt, Homo sapiens
aaggauccaucuu

SEQ ID NO: 1923869 - RNA, 20 nt, Homo sapiens
uaaucccagcauguugagag

SEQ ID NO: 1923870 - RNA, 23 nt, Homo sapiens
gcagccugccuggaguacuuuga

SEQ ID NO: 1923871 - RNA, 15 nt, Homo sapiens
ugaauggguucucag

SEQ ID NO: 1923872 - RNA, 17 nt, Homo sapiens
auugugugacuauucau

SEQ ID NO: 1923873 - RNA, 14 nt, Homo sapiens
ugugguccaaauag

SEQ ID NO: 1923874 - RNA, 15 nt, Homo sapiens
aaggcuuugccaugg

SEQ ID NO: 1923875 - RNA, 19 nt, Homo sapiens
gaaauaauuuucaagcaaa

SEQ ID NO: 1923876 - RNA, 13 nt, Homo sapiens
cacuccagccuga

SEQ ID NO: 1923877 - RNA, 12 nt, Homo sapiens
gaggcugagaaa

SEQ ID NO: 1923878 - RNA, 23 nt, Homo sapiens
aauuucuacuacaggcauugaga

SEQ ID NO: 1923879 - RNA, 14 nt, Homo sapiens
aaacauuaguucua

SEQ ID NO: 1923880 - RNA, 22 nt, Homo sapiens
gagacuucucccauagcaaaga

SEQ ID NO: 1923881 - RNA, 14 nt, Homo sapiens
cuucaccucacuga

SEQ ID NO: 1923882 - RNA, 13 nt, Homo sapiens
uugauuuuugccc

SEQ ID NO: 1923883 - RNA, 11 nt, Homo sapiens
ccaagcauuua

SEQ ID NO: 1923884 - RNA, 20 nt, Homo sapiens
caagcaagggucuccuucaa

SEQ ID NO: 1923885 - RNA, 12 nt, Homo sapiens
gcugaccuggua

SEQ ID NO: 1923886 - RNA, 12 nt, Homo sapiens
uacaggcaccca

SEQ ID NO: 1923887 - RNA, 20 nt, Homo sapiens
uacaauauuaaguccaaauc

SEQ ID NO: 1923888 - RNA, 23 nt, Homo sapiens
guacauugagguugugggccuuc

SEQ ID NO: 1923889 - RNA, 14 nt, Homo sapiens
auauaaauggaauc

SEQ ID NO: 1923890 - RNA, 18 nt, Homo sapiens
cacuuuuuguuguucauu

SEQ ID NO: 1923891 - RNA, 16 nt, Homo sapiens
ugggugcauaucuucc

SEQ ID NO: 1923892 - RNA, 15 nt, Homo sapiens
ggauauuccaaaaua

SEQ ID NO: 1923893 - RNA, 18 nt, Homo sapiens
agcacaguguaaucucua

SEQ ID NO: 1923894 - RNA, 19 nt, Homo sapiens
cugaaagacucgagaacca

SEQ ID NO: 1923895 - RNA, 23 nt, Homo sapiens
cagaacagccucccgaaugaagc

SEQ ID NO: 1923896 - RNA, 21 nt, Homo sapiens
ugagggugggggugcucucuc

SEQ ID NO: 1923897 - RNA, 15 nt, Homo sapiens
ccgauggccauguaa

SEQ ID NO: 1923898 - RNA, 17 nt, Homo sapiens
gacacugacaaagucau

SEQ ID NO: 1923899 - RNA, 20 nt, Homo sapiens
gaaacaucucaacaaccuga

SEQ ID NO: 1923900 - RNA, 19 nt, Homo sapiens
aaauugaaaggcauucucu

SEQ ID NO: 1923901 - RNA, 13 nt, Homo sapiens
ugaaauagaccca

SEQ ID NO: 1923902 - RNA, 17 nt, Homo sapiens
agcccuagacuggugcu

SEQ ID NO: 1923903 - RNA, 15 nt, Homo sapiens
acaguauuacuucug

SEQ ID NO: 1923904 - RNA, 15 nt, Homo sapiens
uaaaagucugagaua

SEQ ID NO: 1923905 - RNA, 18 nt, Homo sapiens
uaauuaccaaccuguuac

SEQ ID NO: 1923906 - RNA, 19 nt, Homo sapiens
aaugcauuucuaaagccau

SEQ ID NO: 1923907 - RNA, 18 nt, Homo sapiens
cuuucugcuaucaaagag

SEQ ID NO: 1923908 - RNA, 19 nt, Homo sapiens
ccacgaagcugugaacuca

SEQ ID NO: 1923909 - RNA, 15 nt, Homo sapiens
uggcuggaugugcau

SEQ ID NO: 1923910 - RNA, 15 nt, Homo sapiens
agaguuucaaccaug

SEQ ID NO: 1923911 - RNA, 19 nt, Homo sapiens
aaaaguugguguugacaua

SEQ ID NO: 1923912 - RNA, 21 nt, Homo sapiens
auuaccacucaggcauuugac

SEQ ID NO: 1923913 - RNA, 14 nt, Homo sapiens
gcaggugagcagac

SEQ ID NO: 1923914 - RNA, 15 nt, Homo sapiens
ccaaugguccugacu

SEQ ID NO: 1923915 - RNA, 19 nt, Homo sapiens
gaauuauuuuuguguuucu

SEQ ID NO: 1923916 - RNA, 23 nt, Homo sapiens
ucugagagugaaaccaugacugu

SEQ ID NO: 1923917 - RNA, 18 nt, Homo sapiens
uccagcaagcagugcccu

SEQ ID NO: 1923918 - RNA, 13 nt, Homo sapiens
cgggcuaacggga

SEQ ID NO: 1923919 - RNA, 13 nt, Homo sapiens
auaaauaaauaac

SEQ ID NO: 1923920 - RNA, 16 nt, Homo sapiens
caagauuccuuuccac

SEQ ID NO: 1923921 - RNA, 19 nt, Homo sapiens
acuucuugcuucuuucuag

SEQ ID NO: 1923922 - RNA, 21 nt, Homo sapiens
uguaaauaaauuuugugcaaa

SEQ ID NO: 1923923 - RNA, 21 nt, Homo sapiens
gucuucagugucuuaaugugg

SEQ ID NO: 1923924 - RNA, 14 nt, Homo sapiens
uguccuacaauauc

SEQ ID NO: 1923925 - RNA, 16 nt, Homo sapiens
uguuuuuuucuagccu

SEQ ID NO: 1923926 - RNA, 15 nt, Homo sapiens
accaugcucucucac

SEQ ID NO: 1923927 - RNA, 17 nt, Homo sapiens
gacaaggccccagagac

SEQ ID NO: 1923928 - RNA, 12 nt, Homo sapiens
uuaaacuaaaga

SEQ ID NO: 1923929 - RNA, 19 nt, Homo sapiens
gcgccagggcccaggccau

SEQ ID NO: 1923930 - RNA, 20 nt, Homo sapiens
cauuucuguucucauuugau

SEQ ID NO: 1923931 - RNA, 15 nt, Homo sapiens
agaggggcaaauaga

SEQ ID NO: 1923932 - RNA, 16 nt, Homo sapiens
ccaacuccucaugucu

SEQ ID NO: 1923933 - RNA, 16 nt, Homo sapiens
gguuacccuaaauguu

SEQ ID NO: 1923934 - RNA, 14 nt, Homo sapiens
gcuccuaagcaaaa

SEQ ID NO: 1923935 - RNA, 13 nt, Homo sapiens
accugcccugaca

SEQ ID NO: 1923936 - RNA, 12 nt, Homo sapiens
ucugagaucucc

SEQ ID NO: 1923937 - RNA, 17 nt, Homo sapiens
gcccaacuacuaucuca

SEQ ID NO: 1923938 - RNA, 15 nt, Homo sapiens
ugaaauagagugaau

SEQ ID NO: 1923939 - RNA, 17 nt, Homo sapiens
acuuggucuggcuuuaa

SEQ ID NO: 1923940 - RNA, 13 nt, Homo sapiens
uugccauuugcug

SEQ ID NO: 1923941 - RNA, 13 nt, Homo sapiens
uugugauuugccc

SEQ ID NO: 1923942 - RNA, 18 nt, Homo sapiens
uguacagugucugugcca

SEQ ID NO: 1923943 - RNA, 22 nt, Homo sapiens
gaacugguucaagagacacugc

SEQ ID NO: 1923944 - RNA, 16 nt, Homo sapiens
aagagccccccacugc

SEQ ID NO: 1923945 - RNA, 21 nt, Homo sapiens
agcacuccccagagcugugcc

SEQ ID NO: 1923946 - RNA, 14 nt, Homo sapiens
ugaucuuugcaaag

SEQ ID NO: 1923947 - RNA, 23 nt, Homo sapiens
auuaaccgaugcuuuaccaaaca

SEQ ID NO: 1923948 - RNA, 13 nt, Homo sapiens
ugacggacuucau

SEQ ID NO: 1923949 - RNA, 14 nt, Homo sapiens
aaucuuugugacag

SEQ ID NO: 1923950 - RNA, 13 nt, Homo sapiens
ugccagcccuuca

SEQ ID NO: 1923951 - RNA, 19 nt, Homo sapiens
gacucugagaacuccucau

SEQ ID NO: 1923952 - RNA, 20 nt, Homo sapiens
auauguuuguggaauggauu

SEQ ID NO: 1923953 - RNA, 20 nt, Homo sapiens
aaauugggagauaauuauca

SEQ ID NO: 1923954 - RNA, 14 nt, Homo sapiens
ugaaaguugcaguu

SEQ ID NO: 1923955 - RNA, 16 nt, Homo sapiens
agcacagaguggcuug

SEQ ID NO: 1923956 - RNA, 11 nt, Homo sapiens
agaggugaccu

SEQ ID NO: 1923957 - RNA, 18 nt, Homo sapiens
gucauaccuuuggauuua

SEQ ID NO: 1923958 - RNA, 12 nt, Homo sapiens
uguauuacaaau

SEQ ID NO: 1923959 - RNA, 13 nt, Homo sapiens
uaguacugggaau

SEQ ID NO: 1923960 - RNA, 13 nt, Homo sapiens
augacaugcacug

SEQ ID NO: 1923961 - RNA, 20 nt, Homo sapiens
uaaaugcauguccucaaaac

SEQ ID NO: 1923962 - RNA, 18 nt, Homo sapiens
uagccuggucugugcauu

SEQ ID NO: 1923963 - RNA, 20 nt, Homo sapiens
guccucaguccacugcugag

SEQ ID NO: 1923964 - RNA, 17 nt, Homo sapiens
aaacguuaguuaauccc

SEQ ID NO: 1923965 - RNA, 19 nt, Homo sapiens
ccaggacccaggucugcug

SEQ ID NO: 1923966 - RNA, 12 nt, Homo sapiens
uaaaacauuccu

SEQ ID NO: 1923967 - RNA, 15 nt, Homo sapiens
aucccacuaaugcaa

SEQ ID NO: 1923968 - RNA, 21 nt, Homo sapiens
uuuauggucagaauuucccuc

SEQ ID NO: 1923969 - RNA, 23 nt, Homo sapiens
agcaauaggguggcacagaagcu

SEQ ID NO: 1923970 - RNA, 17 nt, Homo sapiens
auauccaaagacuguac

SEQ ID NO: 1923971 - RNA, 22 nt, Homo sapiens
ugccuuaaauaaaacugcauug

SEQ ID NO: 1923972 - RNA, 18 nt, Homo sapiens
cuucagccuuaauggaag

SEQ ID NO: 1923973 - RNA, 17 nt, Homo sapiens
agcucaggggcagcuca

SEQ ID NO: 1923974 - RNA, 18 nt, Homo sapiens
uacagggcaggagcugcu

SEQ ID NO: 1923975 - RNA, 16 nt, Homo sapiens
aaugaguaacaucuac

SEQ ID NO: 1923976 - RNA, 17 nt, Homo sapiens
uauuucaagcucugcaa

SEQ ID NO: 1923977 - RNA, 21 nt, Homo sapiens
uacgugauuuggcugcacuug

SEQ ID NO: 1923978 - RNA, 14 nt, Homo sapiens
auggugaagugcuu

SEQ ID NO: 1923979 - RNA, 19 nt, Homo sapiens
guuauugccucugaaaugc

SEQ ID NO: 1923980 - RNA, 20 nt, Homo sapiens
ggauauuuugaaaugaacuu

SEQ ID NO: 1923981 - RNA, 14 nt, Homo sapiens
uccuuuuugcagca

SEQ ID NO: 1923982 - RNA, 15 nt, Homo sapiens
aauucccagcugucu

SEQ ID NO: 1923983 - RNA, 13 nt, Homo sapiens
uccuccacucuga

SEQ ID NO: 1923984 - RNA, 22 nt, Homo sapiens
aaugccugguaccagaggaugg

SEQ ID NO: 1923985 - RNA, 12 nt, Homo sapiens
aaugaaauccag

SEQ ID NO: 1923986 - RNA, 22 nt, Homo sapiens
uuuacauuagcugaaaagagaa

SEQ ID NO: 1923987 - RNA, 19 nt, Homo sapiens
uuuaauugacagucacuca

SEQ ID NO: 1923988 - RNA, 15 nt, Homo sapiens
uaauuagaauucucu

SEQ ID NO: 1923989 - RNA, 14 nt, Homo sapiens
agaucugugccugg

SEQ ID NO: 1923990 - RNA, 17 nt, Homo sapiens
uauccagaaggggagcu

SEQ ID NO: 1923991 - RNA, 14 nt, Homo sapiens
acacccagagggua

SEQ ID NO: 1923992 - RNA, 14 nt, Homo sapiens
aguaaccccuccug

SEQ ID NO: 1923993 - RNA, 17 nt, Homo sapiens
cuacaauuucuaugugg

SEQ ID NO: 1923994 - RNA, 21 nt, Homo sapiens
aguauauuuauagucacaaga

SEQ ID NO: 1923995 - RNA, 21 nt, Homo sapiens
caccuugccacccauucuucc

SEQ ID NO: 1923996 - RNA, 23 nt, Homo sapiens
ggggcucuugaucagugugcuaa

SEQ ID NO: 1923997 - RNA, 14 nt, Homo sapiens
agaauaaaguccaa

SEQ ID NO: 1923998 - RNA, 18 nt, Homo sapiens
caauaaggcagugcagug

SEQ ID NO: 1923999 - RNA, 22 nt, Homo sapiens
auugucuucauguacauuugga

SEQ ID NO: 1924000 - RNA, 23 nt, Homo sapiens
ugggaugggccugcuuccugucu

SEQ ID NO: 1924001 - RNA, 16 nt, Homo sapiens
acuugugucccaugau

SEQ ID NO: 1924002 - RNA, 15 nt, Homo sapiens
aaauuguacauuuga

SEQ ID NO: 1924003 - RNA, 16 nt, Homo sapiens
auagcuauuaagauac

SEQ ID NO: 1924004 - RNA, 14 nt, Homo sapiens
aauuaauguucuga

SEQ ID NO: 1924005 - RNA, 19 nt, Homo sapiens
augaaaugccaagacucua

SEQ ID NO: 1924006 - RNA, 14 nt, Homo sapiens
auuuugauucucau

SEQ ID NO: 1924007 - RNA, 11 nt, Homo sapiens
gauuauaccug

SEQ ID NO: 1924008 - RNA, 12 nt, Homo sapiens
uuuaucacugaa

SEQ ID NO: 1924009 - RNA, 12 nt, Homo sapiens
aguuucacauau

SEQ ID NO: 1924010 - RNA, 22 nt, Homo sapiens
ccacuaguuuuuggacuaugua

SEQ ID NO: 1924011 - RNA, 20 nt, Homo sapiens
aaaauuggaacucuacucaa

SEQ ID NO: 1924012 - RNA, 21 nt, Homo sapiens
uauaggaaaacaauaauuuua

SEQ ID NO: 1924013 - RNA, 20 nt, Homo sapiens
uacucaguguuaacacaugg

SEQ ID NO: 1924014 - RNA, 18 nt, Homo sapiens
ccuucaggccagcugggu

SEQ ID NO: 1924015 - RNA, 21 nt, Homo sapiens
acagucuccggccucuccagc

SEQ ID NO: 1924016 - RNA, 18 nt, Homo sapiens
gccuuccagaaaacaaaa

SEQ ID NO: 1924017 - RNA, 23 nt, Homo sapiens
aggagagauauuuugauucucau

SEQ ID NO: 1924018 - RNA, 20 nt, Homo sapiens
cuagccaggaaguacuucca

SEQ ID NO: 1924019 - RNA, 17 nt, Homo sapiens
ucuggcuuuacauuuua

SEQ ID NO: 1924020 - RNA, 21 nt, Homo sapiens
augcucaagcccccagcugga

SEQ ID NO: 1924021 - RNA, 20 nt, Homo sapiens
augagaccguucgcauggca

SEQ ID NO: 1924022 - RNA, 19 nt, Homo sapiens
uaguuugagaaaugcauag

SEQ ID NO: 1924023 - RNA, 21 nt, Homo sapiens
agcuaaaaccuuccaugucaa

SEQ ID NO: 1924024 - RNA, 14 nt, Homo sapiens
gggaaaaugcacac

SEQ ID NO: 1924025 - RNA, 22 nt, Homo sapiens
gauuuaagccuuacaaagggaa

SEQ ID NO: 1924026 - RNA, 18 nt, Homo sapiens
auacgucuugaucagaca

SEQ ID NO: 1924027 - RNA, 18 nt, Homo sapiens
aguagcaggucaaaaacc

SEQ ID NO: 1924028 - RNA, 12 nt, Homo sapiens
ccccagcuuucu

SEQ ID NO: 1924029 - RNA, 15 nt, Homo sapiens
caggcauuugacuga

SEQ ID NO: 1924030 - RNA, 21 nt, Homo sapiens
uugaaaugaugguaaguuaau

SEQ ID NO: 1924031 - RNA, 15 nt, Homo sapiens
ucauuccuucacuca

SEQ ID NO: 1924032 - RNA, 18 nt, Homo sapiens
guauaacugaaaaaggac

SEQ ID NO: 1924033 - RNA, 18 nt, Homo sapiens
gcauuacuauucacugau

SEQ ID NO: 1924034 - RNA, 17 nt, Homo sapiens
aagauccuccugcugca

SEQ ID NO: 1924035 - RNA, 16 nt, Homo sapiens
uuuguugagcaagagu

SEQ ID NO: 1924036 - RNA, 15 nt, Homo sapiens
acuuuggaggacaau

SEQ ID NO: 1924037 - RNA, 18 nt, Homo sapiens
auauccucuauaauugac

SEQ ID NO: 1924038 - RNA, 22 nt, Homo sapiens
acacaguagggcuuggugaaug

SEQ ID NO: 1924039 - RNA, 21 nt, Homo sapiens
uauuaaaauuuggugcuuaua

SEQ ID NO: 1924040 - RNA, 23 nt, Homo sapiens
aucuuacagagacucucccugac

SEQ ID NO: 1924041 - RNA, 14 nt, Homo sapiens
auguggaacaggau

SEQ ID NO: 1924042 - RNA, 19 nt, Homo sapiens
uucugauuuuuauucucaa

SEQ ID NO: 1924043 - RNA, 15 nt, Homo sapiens
uugucuuacuggcaa

SEQ ID NO: 1924044 - RNA, 18 nt, Homo sapiens
cugaggagauacugaaca

SEQ ID NO: 1924045 - RNA, 16 nt, Homo sapiens
cgccaggcgcugcagg

SEQ ID NO: 1924046 - RNA, 18 nt, Homo sapiens
aaaaucuucuagcauguu

SEQ ID NO: 1924047 - RNA, 22 nt, Homo sapiens
cuggaacucagugugacuccuc

SEQ ID NO: 1924048 - RNA, 22 nt, Homo sapiens
ucuuauuuucaaagcaguauag

SEQ ID NO: 1924049 - RNA, 15 nt, Homo sapiens
aauggaaaguuguau

SEQ ID NO: 1924050 - RNA, 16 nt, Homo sapiens
uggggaacaaccagag

SEQ ID NO: 1924051 - RNA, 13 nt, Homo sapiens
ucugggaggccau

SEQ ID NO: 1924052 - RNA, 14 nt, Homo sapiens
uacagcaaauuuau

SEQ ID NO: 1924053 - RNA, 20 nt, Homo sapiens
caugucacacaaacugauga

SEQ ID NO: 1924054 - RNA, 23 nt, Homo sapiens
aaacaaggcuuaaaagaguagaa

SEQ ID NO: 1924055 - RNA, 19 nt, Homo sapiens
auagccacuaaccuugccu

SEQ ID NO: 1924056 - RNA, 19 nt, Homo sapiens
uaauuuuauuuugugaagu

SEQ ID NO: 1924057 - RNA, 11 nt, Homo sapiens
guccaggaaac

SEQ ID NO: 1924058 - RNA, 12 nt, Homo sapiens
auaggacauacu

SEQ ID NO: 1924059 - RNA, 17 nt, Homo sapiens
cccaccgcucaguguca

SEQ ID NO: 1924060 - RNA, 19 nt, Homo sapiens
gaucccagcucacugcagc

SEQ ID NO: 1924061 - RNA, 21 nt, Homo sapiens
acugagggggagcugucuugu

SEQ ID NO: 1924062 - RNA, 23 nt, Homo sapiens
uguaacugugccaguucuuucca

SEQ ID NO: 1924063 - RNA, 13 nt, Homo sapiens
agagcugguuggg

SEQ ID NO: 1924064 - RNA, 15 nt, Homo sapiens
acagcauuugccaag

SEQ ID NO: 1924065 - RNA, 15 nt, Homo sapiens
gaaaaggagcuucag

SEQ ID NO: 1924066 - RNA, 20 nt, Homo sapiens
ugaaugggacccuguugaug

SEQ ID NO: 1924067 - RNA, 16 nt, Homo sapiens
acaaaaggaaaccucu

SEQ ID NO: 1924068 - RNA, 17 nt, Homo sapiens
aggcaaucccuguagcc

SEQ ID NO: 1924069 - RNA, 20 nt, Homo sapiens
uucccucagccuaagaaaca

SEQ ID NO: 1924070 - RNA, 13 nt, Homo sapiens
aaaaagcaggaaa

SEQ ID NO: 1924071 - RNA, 12 nt, Homo sapiens
cugccacuuccc

SEQ ID NO: 1924072 - RNA, 12 nt, Homo sapiens
cccacacuuuga

SEQ ID NO: 1924073 - RNA, 18 nt, Homo sapiens
accuuggugccugaucca

SEQ ID NO: 1924074 - RNA, 17 nt, Homo sapiens
guucacacacacucuga

SEQ ID NO: 1924075 - RNA, 18 nt, Homo sapiens
auuuaaaagauccauuua

SEQ ID NO: 1924076 - RNA, 18 nt, Homo sapiens
ugguccuggcugcacucu

SEQ ID NO: 1924077 - RNA, 17 nt, Homo sapiens
aggcaugaaauacugug

SEQ ID NO: 1924078 - RNA, 12 nt, Homo sapiens
cauguguggaag

SEQ ID NO: 1924079 - RNA, 21 nt, Homo sapiens
ugcuucuagaaacucuggcuc

SEQ ID NO: 1924080 - RNA, 12 nt, Homo sapiens
aggacagcugcc

SEQ ID NO: 1924081 - RNA, 12 nt, Homo sapiens
uggccagcagca

SEQ ID NO: 1924082 - RNA, 16 nt, Homo sapiens
uaaggaaguaucagca

SEQ ID NO: 1924083 - RNA, 19 nt, Homo sapiens
accauguggcagaagggau

SEQ ID NO: 1924084 - RNA, 14 nt, Homo sapiens
ccccagggcuguca

SEQ ID NO: 1924085 - RNA, 21 nt, Homo sapiens
uucugacuuaagugugcaaaa

SEQ ID NO: 1924086 - RNA, 17 nt, Homo sapiens
augaaauaaaauaucaa

SEQ ID NO: 1924087 - RNA, 22 nt, Homo sapiens
ugugcaaacauggagaaaucua

SEQ ID NO: 1924088 - RNA, 19 nt, Homo sapiens
aaaugauuucacagugugu

SEQ ID NO: 1924089 - RNA, 20 nt, Homo sapiens
agaagaauugaggauguccc

SEQ ID NO: 1924090 - RNA, 17 nt, Homo sapiens
augucauauaucaaauc

SEQ ID NO: 1924091 - RNA, 20 nt, Homo sapiens
uacuggaccccgccucccag

SEQ ID NO: 1924092 - RNA, 15 nt, Homo sapiens
aaguucccuccugca

SEQ ID NO: 1924093 - RNA, 19 nt, Homo sapiens
agaaagccucucucucccu

SEQ ID NO: 1924094 - RNA, 12 nt, Homo sapiens
ugcacaacagcc

SEQ ID NO: 1924095 - RNA, 13 nt, Homo sapiens
ccccacacucacu

SEQ ID NO: 1924096 - RNA, 14 nt, Homo sapiens
gccucuugucuaca

SEQ ID NO: 1924097 - RNA, 23 nt, Homo sapiens
gaucccaaucugagaaaaggcaa

SEQ ID NO: 1924098 - RNA, 22 nt, Homo sapiens
aucuagucuugaccucuccagc

SEQ ID NO: 1924099 - RNA, 13 nt, Homo sapiens
auuucagcucuug

SEQ ID NO: 1924100 - RNA, 19 nt, Homo sapiens
uaggccucucaccucugug

SEQ ID NO: 1924101 - RNA, 19 nt, Homo sapiens
uauucauccuaaaaaguuc

SEQ ID NO: 1924102 - RNA, 15 nt, Homo sapiens
cgugaaauugaugcc

SEQ ID NO: 1924103 - RNA, 19 nt, Homo sapiens
gauucuaggaccugugucc

SEQ ID NO: 1924104 - RNA, 14 nt, Homo sapiens
uucagcacauucca

SEQ ID NO: 1924105 - RNA, 16 nt, Homo sapiens
agcugaagaauugaaa

SEQ ID NO: 1924106 - RNA, 21 nt, Homo sapiens
cuccaaaaacagcaggccauc

SEQ ID NO: 1924107 - RNA, 15 nt, Homo sapiens
uugaacgcuuaaguc

SEQ ID NO: 1924108 - RNA, 20 nt, Homo sapiens
gcagccccccccucaagggg

SEQ ID NO: 1924109 - RNA, 19 nt, Homo sapiens
cuguguguuuuaguuucau

SEQ ID NO: 1924110 - RNA, 16 nt, Homo sapiens
uauuaugacacuccca

SEQ ID NO: 1924111 - RNA, 14 nt, Homo sapiens
caauuuuggaugag

SEQ ID NO: 1924112 - RNA, 16 nt, Homo sapiens
aauaccuucugaacua

SEQ ID NO: 1924113 - RNA, 20 nt, Homo sapiens
guugccaggagauggaauau

SEQ ID NO: 1924114 - RNA, 15 nt, Homo sapiens
acuggagaguggcaa

SEQ ID NO: 1924115 - RNA, 21 nt, Homo sapiens
caucuaucccagaguacaaag

SEQ ID NO: 1924116 - RNA, 15 nt, Homo sapiens
gagggagccauggaa

SEQ ID NO: 1924117 - RNA, 23 nt, Homo sapiens
ugcaaaccuuccugggaggacag

SEQ ID NO: 1924118 - RNA, 19 nt, Homo sapiens
cuugucuucuugacugucu

SEQ ID NO: 1924119 - RNA, 19 nt, Homo sapiens
ccaccaccucaccaguuuc

SEQ ID NO: 1924120 - RNA, 19 nt, Homo sapiens
acaaugaacccccaugaug

SEQ ID NO: 1924121 - RNA, 18 nt, Homo sapiens
caguaaauccacagccaa

SEQ ID NO: 1924122 - RNA, 15 nt, Homo sapiens
caaaccuaacaggag

SEQ ID NO: 1924123 - RNA, 23 nt, Homo sapiens
ugggaaugucucuuuggcgaccu

SEQ ID NO: 1924124 - RNA, 19 nt, Homo sapiens
acaauaaaaaauccucaac

SEQ ID NO: 1924125 - RNA, 18 nt, Homo sapiens
agcccaguccacugagca

SEQ ID NO: 1924126 - RNA, 16 nt, Homo sapiens
cucaugccuuaauccc

SEQ ID NO: 1924127 - RNA, 20 nt, Homo sapiens
ccucuucucaagugccuuaa

SEQ ID NO: 1924128 - RNA, 13 nt, Homo sapiens
uauuucauuuuaa

SEQ ID NO: 1924129 - RNA, 13 nt, Homo sapiens
aaauucauauaaa

SEQ ID NO: 1924130 - RNA, 15 nt, Homo sapiens
augaggcaaugucag

SEQ ID NO: 1924131 - RNA, 17 nt, Homo sapiens
cauagaagcagugugca

SEQ ID NO: 1924132 - RNA, 20 nt, Homo sapiens
cagaggagggcgugacucac

SEQ ID NO: 1924133 - RNA, 17 nt, Homo sapiens
uuaggauguaaaucugc

SEQ ID NO: 1924134 - RNA, 20 nt, Homo sapiens
gaagucaggugucaucauca

SEQ ID NO: 1924135 - RNA, 12 nt, Homo sapiens
aguuacuugaaa

SEQ ID NO: 1924136 - RNA, 14 nt, Homo sapiens
auauuucuagacau

SEQ ID NO: 1924137 - RNA, 14 nt, Homo sapiens
agucuucuauuuau

SEQ ID NO: 1924138 - RNA, 13 nt, Homo sapiens
aacagacucucac

SEQ ID NO: 1924139 - RNA, 12 nt, Homo sapiens
cuuucuguauaa

SEQ ID NO: 1924140 - RNA, 22 nt, Homo sapiens
guacuuugaagaugucauccca

SEQ ID NO: 1924141 - RNA, 17 nt, Homo sapiens
auauuccaccauucaca

SEQ ID NO: 1924142 - RNA, 22 nt, Homo sapiens
gugaccagaaagcuucauccac

SEQ ID NO: 1924143 - RNA, 16 nt, Homo sapiens
ugauuguucauaucaa

SEQ ID NO: 1924144 - RNA, 14 nt, Homo sapiens
acagauaccuccaa

SEQ ID NO: 1924145 - RNA, 21 nt, Homo sapiens
agccugcucauguaccucuga

SEQ ID NO: 1924146 - RNA, 13 nt, Homo sapiens
aucuuccaagggu

SEQ ID NO: 1924147 - RNA, 14 nt, Homo sapiens
ggagagacagugac

SEQ ID NO: 1924148 - RNA, 15 nt, Homo sapiens
gucugggugcuacug

SEQ ID NO: 1924149 - RNA, 15 nt, Homo sapiens
uagagcuggugccag

SEQ ID NO: 1924150 - RNA, 19 nt, Homo sapiens
uuuggcuuaaaccagaacc

SEQ ID NO: 1924151 - RNA, 20 nt, Homo sapiens
uaggaaguauggcaugaaca

SEQ ID NO: 1924152 - RNA, 15 nt, Homo sapiens
ugccuucuguugaga

SEQ ID NO: 1924153 - RNA, 11 nt, Homo sapiens
gcaguggugcu

SEQ ID NO: 1924154 - RNA, 22 nt, Homo sapiens
aacauuggagacaucacuugcc

SEQ ID NO: 1924155 - RNA, 13 nt, Homo sapiens
gaaugaguaggaa

SEQ ID NO: 1924156 - RNA, 22 nt, Homo sapiens
aaggcuggugguaacuuuugaa

SEQ ID NO: 1924157 - RNA, 14 nt, Homo sapiens
ucaagaggaaugaa

SEQ ID NO: 1924158 - RNA, 17 nt, Homo sapiens
cagaccugaaugcuucu

SEQ ID NO: 1924159 - RNA, 20 nt, Homo sapiens
cagagaugugcaugugggua

SEQ ID NO: 1924160 - RNA, 14 nt, Homo sapiens
cucuucuccacugg

SEQ ID NO: 1924161 - RNA, 14 nt, Homo sapiens
gagggaagcagugu

SEQ ID NO: 1924162 - RNA, 13 nt, Homo sapiens
cugugucugugua

SEQ ID NO: 1924163 - RNA, 18 nt, Homo sapiens
aacuugcaauaccaaugu

SEQ ID NO: 1924164 - RNA, 12 nt, Homo sapiens
ggguaacagagu

SEQ ID NO: 1924165 - RNA, 12 nt, Homo sapiens
gggcaacagagc

SEQ ID NO: 1924166 - RNA, 24 nt, Homo sapiens
cuuuauugcaucuggguagcugua

SEQ ID NO: 1924167 - RNA, 19 nt, Homo sapiens
ggcuacagauugggcgggg

SEQ ID NO: 1924168 - RNA, 21 nt, Homo sapiens
auguuucucacauugcuguau

SEQ ID NO: 1924169 - RNA, 12 nt, Homo sapiens
ccccagccaugg

SEQ ID NO: 1924170 - RNA, 14 nt, Homo sapiens
cauggaaacccaua

SEQ ID NO: 1924171 - RNA, 21 nt, Homo sapiens
accagcuucugauaaacacaa

SEQ ID NO: 1924172 - RNA, 20 nt, Homo sapiens
caaaggaucuuuguuccucu

SEQ ID NO: 1924173 - RNA, 21 nt, Homo sapiens
ugaaaugcagagucaaugaac

SEQ ID NO: 1924174 - RNA, 16 nt, Homo sapiens
auuucuagaagcacau

SEQ ID NO: 1924175 - RNA, 11 nt, Homo sapiens
auaacugccuu

SEQ ID NO: 1924176 - RNA, 14 nt, Homo sapiens
gccaaauuuuggcc

SEQ ID NO: 1924177 - RNA, 16 nt, Homo sapiens
ccugggguugcccugg

SEQ ID NO: 1924178 - RNA, 14 nt, Homo sapiens
aaaagcuguuccca

SEQ ID NO: 1924179 - RNA, 14 nt, Homo sapiens
cuuucauaaagcac

SEQ ID NO: 1924180 - RNA, 17 nt, Homo sapiens
agaaucaacagugaaca

SEQ ID NO: 1924181 - RNA, 17 nt, Homo sapiens
ugaauucuggaaucaca

SEQ ID NO: 1924182 - RNA, 19 nt, Homo sapiens
uuucuauuucucuccuuaa

SEQ ID NO: 1924183 - RNA, 20 nt, Homo sapiens
acguggagggguuuagccag

SEQ ID NO: 1924184 - RNA, 19 nt, Homo sapiens
agcagaagcacauuuucag

SEQ ID NO: 1924185 - RNA, 23 nt, Homo sapiens
ggacagcccuucuuuccacagaa

SEQ ID NO: 1924186 - RNA, 23 nt, Homo sapiens
aaauaaacacuagacuguaucac

SEQ ID NO: 1924187 - RNA, 19 nt, Homo sapiens
ugucaaugagguuaugaga

SEQ ID NO: 1924188 - RNA, 17 nt, Homo sapiens
gaccagugccuuggcca

SEQ ID NO: 1924189 - RNA, 22 nt, Homo sapiens
ugaacaauccccuaacacaagu

SEQ ID NO: 1924190 - RNA, 12 nt, Homo sapiens
aaauaacuguga

SEQ ID NO: 1924191 - RNA, 21 nt, Homo sapiens
cuauagggugugaugaaguca

SEQ ID NO: 1924192 - RNA, 16 nt, Homo sapiens
ugcugcaaguuaugaa

SEQ ID NO: 1924193 - RNA, 18 nt, Homo sapiens
acuaaggggcaacaaaug

SEQ ID NO: 1924194 - RNA, 16 nt, Homo sapiens
accugcuuagcugccu

SEQ ID NO: 1924195 - RNA, 14 nt, Homo sapiens
ccugggacuuccau

SEQ ID NO: 1924196 - RNA, 18 nt, Homo sapiens
accccauauuguucuuca

SEQ ID NO: 1924197 - RNA, 21 nt, Homo sapiens
auucacacugggccaagagca

SEQ ID NO: 1924198 - RNA, 14 nt, Homo sapiens
aagccagcugccua

SEQ ID NO: 1924199 - RNA, 17 nt, Homo sapiens
uuuggccccacuuugaa

SEQ ID NO: 1924200 - RNA, 19 nt, Homo sapiens
gugaaaugcuggcauuugc

SEQ ID NO: 1924201 - RNA, 14 nt, Homo sapiens
augugauaucugaa

SEQ ID NO: 1924202 - RNA, 20 nt, Homo sapiens
uucuggugggguguguucca

SEQ ID NO: 1924203 - RNA, 20 nt, Homo sapiens
augcuuuugcuugcaaugua

SEQ ID NO: 1924204 - RNA, 16 nt, Homo sapiens
gucaacucacaccugc

SEQ ID NO: 1924205 - RNA, 19 nt, Homo sapiens
gccagguugcagcugcucu

SEQ ID NO: 1924206 - RNA, 23 nt, Homo sapiens
ugguaggcagagggcaaagucau

SEQ ID NO: 1924207 - RNA, 22 nt, Homo sapiens
uguaccugaaguacaguauauu

SEQ ID NO: 1924208 - RNA, 21 nt, Homo sapiens
caagucaggcccuuauuuuca

SEQ ID NO: 1924209 - RNA, 19 nt, Homo sapiens
acuuuagcaacaguuauca

SEQ ID NO: 1924210 - RNA, 12 nt, Homo sapiens
caaacauuugaa

SEQ ID NO: 1924211 - RNA, 15 nt, Homo sapiens
uuaaaacucuuuauc

SEQ ID NO: 1924212 - RNA, 16 nt, Homo sapiens
uguguccccaccucag

SEQ ID NO: 1924213 - RNA, 19 nt, Homo sapiens
uucucccaacucagccugu

SEQ ID NO: 1924214 - RNA, 12 nt, Homo sapiens
acugaacacugc

SEQ ID NO: 1924215 - RNA, 13 nt, Homo sapiens
gaaaacucaugaa

SEQ ID NO: 1924216 - RNA, 16 nt, Homo sapiens
guuuggugaacuauau

SEQ ID NO: 1924217 - RNA, 19 nt, Homo sapiens
ggcagcucagccaccacuc

SEQ ID NO: 1924218 - RNA, 16 nt, Homo sapiens
ggcaguugaacagagg

SEQ ID NO: 1924219 - RNA, 13 nt, Homo sapiens
cacgcgugcacac

SEQ ID NO: 1924220 - RNA, 13 nt, Homo sapiens
uauguguguauau

SEQ ID NO: 1924221 - RNA, 20 nt, Homo sapiens
acucuaacaucuagcuggcu

SEQ ID NO: 1924222 - RNA, 23 nt, Homo sapiens
aauguuaucaaccaacugcacaa

SEQ ID NO: 1924223 - RNA, 14 nt, Homo sapiens
gcugccacaaccag

SEQ ID NO: 1924224 - RNA, 18 nt, Homo sapiens
auugaauaucaguugaca

SEQ ID NO: 1924225 - RNA, 13 nt, Homo sapiens
caugauuguuuga

SEQ ID NO: 1924226 - RNA, 13 nt, Homo sapiens
cuauuuuguaauu

SEQ ID NO: 1924227 - RNA, 21 nt, Homo sapiens
acggcgugccuggacacugua

SEQ ID NO: 1924228 - RNA, 19 nt, Homo sapiens
ugugcguggaaguguuccu

SEQ ID NO: 1924229 - RNA, 15 nt, Homo sapiens
ugcuguuuacuugaa

SEQ ID NO: 1924230 - RNA, 18 nt, Homo sapiens
uacugguugcauggaaau

SEQ ID NO: 1924231 - RNA, 12 nt, Homo sapiens
cggaacugccuu

SEQ ID NO: 1924232 - RNA, 17 nt, Homo sapiens
aaaauauguccauaucu

SEQ ID NO: 1924233 - RNA, 22 nt, Homo sapiens
agggaugccacccagcaacaca

SEQ ID NO: 1924234 - RNA, 22 nt, Homo sapiens
uaucuguagugagauagcauug

SEQ ID NO: 1924235 - RNA, 18 nt, Homo sapiens
ggcccgcaagagggacag

SEQ ID NO: 1924236 - RNA, 16 nt, Homo sapiens
cccauccccuuuccuc

SEQ ID NO: 1924237 - RNA, 18 nt, Homo sapiens
cuagccugcucugccacu

SEQ ID NO: 1924238 - RNA, 18 nt, Homo sapiens
uuggagguaaauuauguc

SEQ ID NO: 1924239 - RNA, 17 nt, Homo sapiens
ugaugccguuucuuuca

SEQ ID NO: 1924240 - RNA, 22 nt, Homo sapiens
cugauuaccugaaggacagcug

SEQ ID NO: 1924241 - RNA, 12 nt, Homo sapiens
auaaagacuuuu

SEQ ID NO: 1924242 - RNA, 14 nt, Homo sapiens
acuucaccuacauu

SEQ ID NO: 1924243 - RNA, 21 nt, Homo sapiens
cauggugccccaggaccagcu

SEQ ID NO: 1924244 - RNA, 17 nt, Homo sapiens
cagcccagaagugcaga

SEQ ID NO: 1924245 - RNA, 14 nt, Homo sapiens
cagacuccugcucu

SEQ ID NO: 1924246 - RNA, 18 nt, Homo sapiens
ucaggcaggcaccuagca

SEQ ID NO: 1924247 - RNA, 20 nt, Homo sapiens
cccuucuauacccacccaga

SEQ ID NO: 1924248 - RNA, 14 nt, Homo sapiens
aggaggagcaccuc

SEQ ID NO: 1924249 - RNA, 21 nt, Homo sapiens
gcugcccaggcuagagugcag

SEQ ID NO: 1924250 - RNA, 14 nt, Homo sapiens
ucaauuucucaaua

SEQ ID NO: 1924251 - RNA, 19 nt, Homo sapiens
auucccuuggauguagucu

SEQ ID NO: 1924252 - RNA, 15 nt, Homo sapiens
caguuacaaaguaau

SEQ ID NO: 1924253 - RNA, 20 nt, Homo sapiens
ggaugugcccacagggacca

SEQ ID NO: 1924254 - RNA, 23 nt, Homo sapiens
ucuacccugaucaccucagggca

SEQ ID NO: 1924255 - RNA, 13 nt, Homo sapiens
cauuugauuguca

SEQ ID NO: 1924256 - RNA, 16 nt, Homo sapiens
ccucugcacgugcaca

SEQ ID NO: 1924257 - RNA, 21 nt, Homo sapiens
acccccugcuccaccagcagc

SEQ ID NO: 1924258 - RNA, 16 nt, Homo sapiens
gcugugagacaguggg

SEQ ID NO: 1924259 - RNA, 20 nt, Homo sapiens
aaucugggcaucucgugcca

SEQ ID NO: 1924260 - RNA, 13 nt, Homo sapiens
gauaucuucagaa

SEQ ID NO: 1924261 - RNA, 14 nt, Homo sapiens
cugcugaauucacc

SEQ ID NO: 1924262 - RNA, 21 nt, Homo sapiens
cugcagggcugggucaggggu

SEQ ID NO: 1924263 - RNA, 14 nt, Homo sapiens
cacgccaaugcaca

SEQ ID NO: 1924264 - RNA, 21 nt, Homo sapiens
aagaaaugggugaaugagcuu

SEQ ID NO: 1924265 - RNA, 21 nt, Homo sapiens
uuguaaaguucaauuucaaca

SEQ ID NO: 1924266 - RNA, 16 nt, Homo sapiens
cugggauuacaggugu

SEQ ID NO: 1924267 - RNA, 19 nt, Homo sapiens
augaugauuuuaacaguuu

SEQ ID NO: 1924268 - RNA, 18 nt, Homo sapiens
gauuuauaguaugugacu

SEQ ID NO: 1924269 - RNA, 19 nt, Homo sapiens
cauucauuuauucauucau

SEQ ID NO: 1924270 - RNA, 20 nt, Homo sapiens
cuggcugcuaggccagagcc

SEQ ID NO: 1924271 - RNA, 17 nt, Homo sapiens
agugcuguccaugaugu

SEQ ID NO: 1924272 - RNA, 14 nt, Homo sapiens
caacaugugacuaa

SEQ ID NO: 1924273 - RNA, 21 nt, Homo sapiens
uguuggaaaggaccuuaccug

SEQ ID NO: 1924274 - RNA, 18 nt, Homo sapiens
cuugauggagauauuuac

SEQ ID NO: 1924275 - RNA, 12 nt, Homo sapiens
guuaucaagcaa

SEQ ID NO: 1924276 - RNA, 23 nt, Homo sapiens
uggagccuaccucugucugagac

SEQ ID NO: 1924277 - RNA, 15 nt, Homo sapiens
uuaaaaauacuucuc

SEQ ID NO: 1924278 - RNA, 23 nt, Homo sapiens
auguuuuuggaaacuaguggcaa

SEQ ID NO: 1924279 - RNA, 19 nt, Homo sapiens
cccaccaugcgcugcucaa

SEQ ID NO: 1924280 - RNA, 23 nt, Homo sapiens
cuguuaucuaaugauguucucug

SEQ ID NO: 1924281 - RNA, 17 nt, Homo sapiens
cacaugaacuuagauuu

SEQ ID NO: 1924282 - RNA, 17 nt, Homo sapiens
auguugucugaacuaau

SEQ ID NO: 1924283 - RNA, 16 nt, Homo sapiens
caucacagaaugugau

SEQ ID NO: 1924284 - RNA, 20 nt, Homo sapiens
caaagaagcuuccacaaaau

SEQ ID NO: 1924285 - RNA, 20 nt, Homo sapiens
aacagccacuacauuacuuc

SEQ ID NO: 1924286 - RNA, 16 nt, Homo sapiens
ggaaauuccaacagau

SEQ ID NO: 1924287 - RNA, 21 nt, Homo sapiens
ccucuucuacccucaucauca

SEQ ID NO: 1924288 - RNA, 19 nt, Homo sapiens
ccagaggcuggaccacaca

SEQ ID NO: 1924289 - RNA, 12 nt, Homo sapiens
accuacauuuga

SEQ ID NO: 1924290 - RNA, 12 nt, Homo sapiens
aaggcacaugcc

SEQ ID NO: 1924291 - RNA, 14 nt, Homo sapiens
uagaugccugugaa

SEQ ID NO: 1924292 - RNA, 21 nt, Homo sapiens
aacuagauuuucacuuaugaa

SEQ ID NO: 1924293 - RNA, 16 nt, Homo sapiens
cuuccuuaugcuucuu

SEQ ID NO: 1924294 - RNA, 18 nt, Homo sapiens
aucaccuuguauucucuu

SEQ ID NO: 1924295 - RNA, 23 nt, Homo sapiens
gcauacugguguuaacagucaca

SEQ ID NO: 1924296 - RNA, 15 nt, Homo sapiens
uacuuacauuuccau

SEQ ID NO: 1924297 - RNA, 18 nt, Homo sapiens
ucccuuacccuccuccag

SEQ ID NO: 1924298 - RNA, 21 nt, Homo sapiens
cugaaacucauagacacugau

SEQ ID NO: 1924299 - RNA, 20 nt, Homo sapiens
ccucagugcacgagcuggcc

SEQ ID NO: 1924300 - RNA, 17 nt, Homo sapiens
uccuguuuuucugggug

SEQ ID NO: 1924301 - RNA, 17 nt, Homo sapiens
cuggaccccagccucaa

SEQ ID NO: 1924302 - RNA, 13 nt, Homo sapiens
ccgugccaaaaau

SEQ ID NO: 1924303 - RNA, 15 nt, Homo sapiens
gaauuauaacccaga

SEQ ID NO: 1924304 - RNA, 12 nt, Homo sapiens
ucuagacuaaaa

SEQ ID NO: 1924305 - RNA, 16 nt, Homo sapiens
uguggcuguauccacu

SEQ ID NO: 1924306 - RNA, 19 nt, Homo sapiens
ucugagaaaagcuuugaac

SEQ ID NO: 1924307 - RNA, 16 nt, Homo sapiens
uggguaugcucuguga

SEQ ID NO: 1924308 - RNA, 16 nt, Homo sapiens
ucugaaaaagacauaa

SEQ ID NO: 1924309 - RNA, 15 nt, Homo sapiens
gccugaugauggaag

SEQ ID NO: 1924310 - RNA, 21 nt, Homo sapiens
gaugaaguuuuacauuguuga

SEQ ID NO: 1924311 - RNA, 15 nt, Homo sapiens
uuaugacugugaaau

SEQ ID NO: 1924312 - RNA, 13 nt, Homo sapiens
guuuuaaugcaau

SEQ ID NO: 1924313 - RNA, 13 nt, Homo sapiens
guauuaaugcuau

SEQ ID NO: 1924314 - RNA, 16 nt, Homo sapiens
aagagugucacugagc

SEQ ID NO: 1924315 - RNA, 12 nt, Homo sapiens
agaauaccccac

SEQ ID NO: 1924316 - RNA, 14 nt, Homo sapiens
ucuaggacuccaca

SEQ ID NO: 1924317 - RNA, 15 nt, Homo sapiens
acaaauuucaucucc

SEQ ID NO: 1924318 - RNA, 17 nt, Homo sapiens
ugggaaggggggccaua

SEQ ID NO: 1924319 - RNA, 22 nt, Homo sapiens
uggccugggaucuggcacacuc

SEQ ID NO: 1924320 - RNA, 19 nt, Homo sapiens
uaaaggcauuguccaaagu

SEQ ID NO: 1924321 - RNA, 17 nt, Homo sapiens
ucccagcuacucaggag

SEQ ID NO: 1924322 - RNA, 15 nt, Homo sapiens
ugccugcgucuuccg

SEQ ID NO: 1924323 - RNA, 15 nt, Homo sapiens
uggauggaaagggag

SEQ ID NO: 1924324 - RNA, 20 nt, Homo sapiens
ggccucucccuccuccagga

SEQ ID NO: 1924325 - RNA, 18 nt, Homo sapiens
auauguuucacaguacag

SEQ ID NO: 1924326 - RNA, 17 nt, Homo sapiens
auuuuuuuccuaagaca

SEQ ID NO: 1924327 - RNA, 15 nt, Homo sapiens
ccauucaacucggaa

SEQ ID NO: 1924328 - RNA, 17 nt, Homo sapiens
acuuaacauagccaaaa

SEQ ID NO: 1924329 - RNA, 16 nt, Homo sapiens
ucucaauauauucagu

SEQ ID NO: 1924330 - RNA, 14 nt, Homo sapiens
acgcugguggugcu

SEQ ID NO: 1924331 - RNA, 23 nt, Homo sapiens
gcucuggucuauauaaccacauu

SEQ ID NO: 1924332 - RNA, 20 nt, Homo sapiens
uuaguuuacaaucagccaca

SEQ ID NO: 1924333 - RNA, 22 nt, Homo sapiens
ccaaauuucuuuugcugaacag

SEQ ID NO: 1924334 - RNA, 17 nt, Homo sapiens
uaacuuuuaaaagggaa

SEQ ID NO: 1924335 - RNA, 23 nt, Homo sapiens
cacaggccauggauggaaaacgc

SEQ ID NO: 1924336 - RNA, 12 nt, Homo sapiens
uaauuucuacuu

SEQ ID NO: 1924337 - RNA, 14 nt, Homo sapiens
uuggcgggccaagg

SEQ ID NO: 1924338 - RNA, 11 nt, Homo sapiens
ucuucuuuaug

SEQ ID NO: 1924339 - RNA, 17 nt, Homo sapiens
agugaauuugcacuguu

SEQ ID NO: 1924340 - RNA, 13 nt, Homo sapiens
ucuuaaucuugau

SEQ ID NO: 1924341 - RNA, 15 nt, Homo sapiens
aaugucaaugccagg

SEQ ID NO: 1924342 - RNA, 21 nt, Homo sapiens
uuacagaaaagacucugacca

SEQ ID NO: 1924343 - RNA, 14 nt, Homo sapiens
aggucccagugcca

SEQ ID NO: 1924344 - RNA, 19 nt, Homo sapiens
augcccagacagcaaguau

SEQ ID NO: 1924345 - RNA, 23 nt, Homo sapiens
agaauaaaugguuucucauuaaa

SEQ ID NO: 1924346 - RNA, 17 nt, Homo sapiens
ugguguacucuaggacu

SEQ ID NO: 1924347 - RNA, 22 nt, Homo sapiens
uccgggaagugagggcucacuc

SEQ ID NO: 1924348 - RNA, 16 nt, Homo sapiens
gagaaguacuaucuuu

SEQ ID NO: 1924349 - RNA, 18 nt, Homo sapiens
gcagguccccagacucca

SEQ ID NO: 1924350 - RNA, 16 nt, Homo sapiens
auaauuuuaugcugga

SEQ ID NO: 1924351 - RNA, 15 nt, Homo sapiens
ccacaagcaccacuc

SEQ ID NO: 1924352 - RNA, 15 nt, Homo sapiens
cuggcagcucuccag

SEQ ID NO: 1924353 - RNA, 13 nt, Homo sapiens
uaauaauuugcuc

SEQ ID NO: 1924354 - RNA, 18 nt, Homo sapiens
cuuauauuguucacuucu

SEQ ID NO: 1924355 - RNA, 21 nt, Homo sapiens
ugcaggucuccaccugcacau

SEQ ID NO: 1924356 - RNA, 18 nt, Homo sapiens
aucuucagcauguucuca

SEQ ID NO: 1924357 - RNA, 12 nt, Homo sapiens
gcuagaaggaau

SEQ ID NO: 1924358 - RNA, 21 nt, Homo sapiens
cagggucucuagugcugugaa

SEQ ID NO: 1924359 - RNA, 21 nt, Homo sapiens
uguauauuugaacuccucuca

SEQ ID NO: 1924360 - RNA, 15 nt, Homo sapiens
cuucaagacucugaa

SEQ ID NO: 1924361 - RNA, 18 nt, Homo sapiens
augaauaaguuuuauuga

SEQ ID NO: 1924362 - RNA, 13 nt, Homo sapiens
aaguccuaauaaa

SEQ ID NO: 1924363 - RNA, 19 nt, Homo sapiens
caaggcccauaucugugaa

SEQ ID NO: 1924364 - RNA, 12 nt, Homo sapiens
aagccuccgccu

SEQ ID NO: 1924365 - RNA, 20 nt, Homo sapiens
aagucugucugucugaugau

SEQ ID NO: 1924366 - RNA, 23 nt, Homo sapiens
aaagguuuugagcauggguucau

SEQ ID NO: 1924367 - RNA, 17 nt, Homo sapiens
agggucucuagugcugu

SEQ ID NO: 1924368 - RNA, 17 nt, Homo sapiens
acaugguugugagucuu

SEQ ID NO: 1924369 - RNA, 15 nt, Homo sapiens
auuccaaacuaugac

SEQ ID NO: 1924370 - RNA, 19 nt, Homo sapiens
cuguuuugugccagugcua

SEQ ID NO: 1924371 - RNA, 19 nt, Homo sapiens
uguaaaaucccaucugcua

SEQ ID NO: 1924372 - RNA, 18 nt, Homo sapiens
agaaaggugugcugguca

SEQ ID NO: 1924373 - RNA, 19 nt, Homo sapiens
uagcuuuauauauggacau

SEQ ID NO: 1924374 - RNA, 23 nt, Homo sapiens
auuuaugaauauuagucgcacau

SEQ ID NO: 1924375 - RNA, 22 nt, Homo sapiens
ccauaggguccugaauguuuca

SEQ ID NO: 1924376 - RNA, 17 nt, Homo sapiens
agugacauuucaaucac

SEQ ID NO: 1924377 - RNA, 22 nt, Homo sapiens
uuuuaccaccgucugucucaga

SEQ ID NO: 1924378 - RNA, 14 nt, Homo sapiens
cuuaacaaaaguga

SEQ ID NO: 1924379 - RNA, 12 nt, Homo sapiens
acaccuguugca

SEQ ID NO: 1924380 - RNA, 22 nt, Homo sapiens
ccugacggcuggggacccaccc

SEQ ID NO: 1924381 - RNA, 15 nt, Homo sapiens
uccauuaaauugccu

SEQ ID NO: 1924382 - RNA, 19 nt, Homo sapiens
agucuauuugagacuccuc

SEQ ID NO: 1924383 - RNA, 19 nt, Homo sapiens
aucaucaaugugacauuua

SEQ ID NO: 1924384 - RNA, 14 nt, Homo sapiens
caacaucagcucac

SEQ ID NO: 1924385 - RNA, 17 nt, Homo sapiens
caccuuuuuucacccca

SEQ ID NO: 1924386 - RNA, 11 nt, Homo sapiens
aaacaaaaaua

SEQ ID NO: 1924387 - RNA, 19 nt, Homo sapiens
aagucacaggaugagacag

SEQ ID NO: 1924388 - RNA, 18 nt, Homo sapiens
ggaaggcugucuaccuga

SEQ ID NO: 1924389 - RNA, 16 nt, Homo sapiens
ucagcauuuggaccaa

SEQ ID NO: 1924390 - RNA, 23 nt, Homo sapiens
gcccgugcccuggugaaucaccu

SEQ ID NO: 1924391 - RNA, 14 nt, Homo sapiens
uggacuguugccac

SEQ ID NO: 1924392 - RNA, 23 nt, Homo sapiens
agggcuggaaucuggagagcuag

SEQ ID NO: 1924393 - RNA, 23 nt, Homo sapiens
ugaacauuuugcaaaacuuauca

SEQ ID NO: 1924394 - RNA, 18 nt, Homo sapiens
ugcccacggagccuaccc

SEQ ID NO: 1924395 - RNA, 18 nt, Homo sapiens
agagaaccaagcuugucu

SEQ ID NO: 1924396 - RNA, 18 nt, Homo sapiens
acccuugguggcuuaugg

SEQ ID NO: 1924397 - RNA, 15 nt, Homo sapiens
cuccccaacaaaaga

SEQ ID NO: 1924398 - RNA, 20 nt, Homo sapiens
auuucauacaaaacuguuca

SEQ ID NO: 1924399 - RNA, 21 nt, Homo sapiens
gcaggaaaguuuacccaugaa

SEQ ID NO: 1924400 - RNA, 23 nt, Homo sapiens
ugaaucccucuaucucuaaagaa

SEQ ID NO: 1924401 - RNA, 16 nt, Homo sapiens
gcugaccucccaguga

SEQ ID NO: 1924402 - RNA, 20 nt, Homo sapiens
accccagcuagggcuggacu

SEQ ID NO: 1924403 - RNA, 15 nt, Homo sapiens
caauccccgugcuaa

SEQ ID NO: 1924404 - RNA, 22 nt, Homo sapiens
ccuucgcuuaagccagcacuca

SEQ ID NO: 1924405 - RNA, 15 nt, Homo sapiens
caggagcgcaucuca

SEQ ID NO: 1924406 - RNA, 12 nt, Homo sapiens
uuagcuguaaac

SEQ ID NO: 1924407 - RNA, 22 nt, Homo sapiens
agugcuuguuccucucaucucc

SEQ ID NO: 1924408 - RNA, 13 nt, Homo sapiens
uaagauucaucca

SEQ ID NO: 1924409 - RNA, 16 nt, Homo sapiens
caaauauauuuuggaa

SEQ ID NO: 1924410 - RNA, 12 nt, Homo sapiens
gcagccaagagc

SEQ ID NO: 1924411 - RNA, 13 nt, Homo sapiens
uaccauguggcaa

SEQ ID NO: 1924412 - RNA, 20 nt, Homo sapiens
cuggaguggaguggcgugau

SEQ ID NO: 1924413 - RNA, 18 nt, Homo sapiens
uagucuccuuugcacuga

SEQ ID NO: 1924414 - RNA, 17 nt, Homo sapiens
auccugucaccaugacu

SEQ ID NO: 1924415 - RNA, 18 nt, Homo sapiens
cauggaugcuuuggcaau

SEQ ID NO: 1924416 - RNA, 15 nt, Homo sapiens
cggcuguggguggug

SEQ ID NO: 1924417 - RNA, 23 nt, Homo sapiens
agggguuugagaugcuguaggug

SEQ ID NO: 1924418 - RNA, 22 nt, Homo sapiens
uuccuacacguuagauuugccg

SEQ ID NO: 1924419 - RNA, 18 nt, Homo sapiens
uuucagugccauacaugu

SEQ ID NO: 1924420 - RNA, 18 nt, Homo sapiens
aauauucaaguaacacuu

SEQ ID NO: 1924421 - RNA, 21 nt, Homo sapiens
caaggaaacccccaguguaau

SEQ ID NO: 1924422 - RNA, 13 nt, Homo sapiens
gcauuggauacag

SEQ ID NO: 1924423 - RNA, 20 nt, Homo sapiens
acagagcaagaccucgucuc

SEQ ID NO: 1924424 - RNA, 15 nt, Homo sapiens
ugugaauauggacag

SEQ ID NO: 1924425 - RNA, 22 nt, Homo sapiens
ugauaggacuuaaaauagucuc

SEQ ID NO: 1924426 - RNA, 14 nt, Homo sapiens
cagaaggcaaagca

SEQ ID NO: 1924427 - RNA, 19 nt, Homo sapiens
auauaaguuuacaccuuua

SEQ ID NO: 1924428 - RNA, 17 nt, Homo sapiens
cacugccugcucuucag

SEQ ID NO: 1924429 - RNA, 15 nt, Homo sapiens
cauuaagugaaagga

SEQ ID NO: 1924430 - RNA, 19 nt, Homo sapiens
ucccuugccucaaugccag

SEQ ID NO: 1924431 - RNA, 15 nt, Homo sapiens
uacuuaaugccaagu

SEQ ID NO: 1924432 - RNA, 16 nt, Homo sapiens
gacuuauuaugcauaa

SEQ ID NO: 1924433 - RNA, 21 nt, Homo sapiens
cuccaguaguaguauggcacu

SEQ ID NO: 1924434 - RNA, 16 nt, Homo sapiens
agaaacaacacuguag

SEQ ID NO: 1924435 - RNA, 22 nt, Homo sapiens
caaccacugcgaccacaagaag

SEQ ID NO: 1924436 - RNA, 22 nt, Homo sapiens
gacggcaguaaauccacaguga

SEQ ID NO: 1924437 - RNA, 24 nt, Homo sapiens
caagugagccaggaaagcagcaaa

SEQ ID NO: 1924438 - RNA, 19 nt, Homo sapiens
acaagcuggcuuacacugg

SEQ ID NO: 1924439 - RNA, 22 nt, Homo sapiens
auaagcugccuaggcagccagc

SEQ ID NO: 1924440 - RNA, 12 nt, Homo sapiens
acugaugacuuu

SEQ ID NO: 1924441 - RNA, 12 nt, Homo sapiens
auauaugaccag

SEQ ID NO: 1924442 - RNA, 12 nt, Homo sapiens
ccuuaugaauug

SEQ ID NO: 1924443 - RNA, 20 nt, Homo sapiens
gaauugacugccuaugccaa

SEQ ID NO: 1924444 - RNA, 15 nt, Homo sapiens
agaauuggaaucaca

SEQ ID NO: 1924445 - RNA, 17 nt, Homo sapiens
ccauggcuuaaugcuuc

SEQ ID NO: 1924446 - RNA, 18 nt, Homo sapiens
guuuccaaagaugugggu

SEQ ID NO: 1924447 - RNA, 20 nt, Homo sapiens
ccaguguguguaacaggguc

SEQ ID NO: 1924448 - RNA, 23 nt, Homo sapiens
auuccccuguagcagucacugac

SEQ ID NO: 1924449 - RNA, 17 nt, Homo sapiens
ccagguugggggcagug

SEQ ID NO: 1924450 - RNA, 17 nt, Homo sapiens
uguggaucuugagcucu

SEQ ID NO: 1924451 - RNA, 22 nt, Homo sapiens
cccuggcugaacagugcucugc

SEQ ID NO: 1924452 - RNA, 23 nt, Homo sapiens
cuuaaagcuuguuuguucuaguu

SEQ ID NO: 1924453 - RNA, 15 nt, Homo sapiens
acaucccauguagaa

SEQ ID NO: 1924454 - RNA, 20 nt, Homo sapiens
augcuggcucccagggccau

SEQ ID NO: 1924455 - RNA, 21 nt, Homo sapiens
acuguaauuaaguaaaccaaa

SEQ ID NO: 1924456 - RNA, 20 nt, Homo sapiens
aaguggucgcuuacuuugag

SEQ ID NO: 1924457 - RNA, 17 nt, Homo sapiens
uaugccggcuccuucaa

SEQ ID NO: 1924458 - RNA, 22 nt, Homo sapiens
uuaguugguuugugugaucaua

SEQ ID NO: 1924459 - RNA, 23 nt, Homo sapiens
uggcagagagcacagugaucacc

SEQ ID NO: 1924460 - RNA, 16 nt, Homo sapiens
aaaugguaauuucuac

SEQ ID NO: 1924461 - RNA, 18 nt, Homo sapiens
cuccuuucuccugugaau

SEQ ID NO: 1924462 - RNA, 20 nt, Homo sapiens
gagcaguuugccaccccugu

SEQ ID NO: 1924463 - RNA, 16 nt, Homo sapiens
cuauucauggcuaccu

SEQ ID NO: 1924464 - RNA, 20 nt, Homo sapiens
ccaaggggaaucagaacuca

SEQ ID NO: 1924465 - RNA, 21 nt, Homo sapiens
ugugaaacgucuggacugcua

SEQ ID NO: 1924466 - RNA, 22 nt, Homo sapiens
aaaacugcagucaucaacaaug

SEQ ID NO: 1924467 - RNA, 19 nt, Homo sapiens
aaccaaauguaacuauguu

SEQ ID NO: 1924468 - RNA, 14 nt, Homo sapiens
agccucaaccaaca

SEQ ID NO: 1924469 - RNA, 22 nt, Homo sapiens
ggaaauuucaauaaccuuucac

SEQ ID NO: 1924470 - RNA, 15 nt, Homo sapiens
accccgcauugcugu

SEQ ID NO: 1924471 - RNA, 11 nt, Homo sapiens
ccuuuugcaca

SEQ ID NO: 1924472 - RNA, 18 nt, Homo sapiens
agcacuuccuugccaguc

SEQ ID NO: 1924473 - RNA, 17 nt, Homo sapiens
aucaacaagauuuccac

SEQ ID NO: 1924474 - RNA, 23 nt, Homo sapiens
agggucugcucuuucucugccag

SEQ ID NO: 1924475 - RNA, 14 nt, Homo sapiens
cuccccgccugucc

SEQ ID NO: 1924476 - RNA, 14 nt, Homo sapiens
gaaguauggugugu

SEQ ID NO: 1924477 - RNA, 11 nt, Homo sapiens
aggcgccagca

SEQ ID NO: 1924478 - RNA, 19 nt, Homo sapiens
aaauaauguuugauaguaa

SEQ ID NO: 1924479 - RNA, 12 nt, Homo sapiens
cuuaacccuguc

SEQ ID NO: 1924480 - RNA, 17 nt, Homo sapiens
agcacucccuaauuuau

SEQ ID NO: 1924481 - RNA, 15 nt, Homo sapiens
guaauuuggcuccuu

SEQ ID NO: 1924482 - RNA, 19 nt, Homo sapiens
guaggggguuauugccucu

SEQ ID NO: 1924483 - RNA, 20 nt, Homo sapiens
ugcacagaccacacacagca

SEQ ID NO: 1924484 - RNA, 16 nt, Homo sapiens
aucaagagacauggua

SEQ ID NO: 1924485 - RNA, 21 nt, Homo sapiens
agccaacugccccgggugccu

SEQ ID NO: 1924486 - RNA, 12 nt, Homo sapiens
gauguccuacua

SEQ ID NO: 1924487 - RNA, 22 nt, Homo sapiens
uucagauuauccuuccuccuca

SEQ ID NO: 1924488 - RNA, 15 nt, Homo sapiens
ugcaaaugaaugccu

SEQ ID NO: 1924489 - RNA, 16 nt, Homo sapiens
gaaaaacagcucuguu

SEQ ID NO: 1924490 - RNA, 22 nt, Homo sapiens
ccaacuugagggcccagagcag

SEQ ID NO: 1924491 - RNA, 13 nt, Homo sapiens
uaacuuauaucau

SEQ ID NO: 1924492 - RNA, 23 nt, Homo sapiens
agggcaaccaauaaaagugucac

SEQ ID NO: 1924493 - RNA, 18 nt, Homo sapiens
aucucccuuuuccaugac

SEQ ID NO: 1924494 - RNA, 12 nt, Homo sapiens
caaucuuuacac

SEQ ID NO: 1924495 - RNA, 12 nt, Homo sapiens
aaaccuuuccau

SEQ ID NO: 1924496 - RNA, 21 nt, Homo sapiens
cagaaggauauuuacuacuuu

SEQ ID NO: 1924497 - RNA, 19 nt, Homo sapiens
acgguccuuugagugucag

SEQ ID NO: 1924498 - RNA, 21 nt, Homo sapiens
gcccccagcagauggaaagaa

SEQ ID NO: 1924499 - RNA, 13 nt, Homo sapiens
gacuucagugugu

SEQ ID NO: 1924500 - RNA, 22 nt, Homo sapiens
aggcggaaaccuugcagcauuu

SEQ ID NO: 1924501 - RNA, 22 nt, Homo sapiens
agugaauacauuaacggugcua

SEQ ID NO: 1924502 - RNA, 23 nt, Homo sapiens
auaagacguauguaaacaaaaac

SEQ ID NO: 1924503 - RNA, 13 nt, Homo sapiens
acagagugcauug

SEQ ID NO: 1924504 - RNA, 13 nt, Homo sapiens
caauggugacuga

SEQ ID NO: 1924505 - RNA, 22 nt, Homo sapiens
ucacugcacugcaugcaaacaa

SEQ ID NO: 1924506 - RNA, 22 nt, Homo sapiens
acccuccagagacaacagguaa

SEQ ID NO: 1924507 - RNA, 19 nt, Homo sapiens
gucuccuuugcaggcucau

SEQ ID NO: 1924508 - RNA, 18 nt, Homo sapiens
agugggagcugucaggca

SEQ ID NO: 1924509 - RNA, 19 nt, Homo sapiens
gaagccuauuagcugggau

SEQ ID NO: 1924510 - RNA, 16 nt, Homo sapiens
caacuguggucaaucc

SEQ ID NO: 1924511 - RNA, 13 nt, Homo sapiens
uaauguuugcauu

SEQ ID NO: 1924512 - RNA, 14 nt, Homo sapiens
aagaaaauccauua

SEQ ID NO: 1924513 - RNA, 17 nt, Homo sapiens
agaucuugagagcugcu

SEQ ID NO: 1924514 - RNA, 19 nt, Homo sapiens
aggcugaccacagcacagc

SEQ ID NO: 1924515 - RNA, 15 nt, Homo sapiens
ggagaggguggcauc

SEQ ID NO: 1924516 - RNA, 21 nt, Homo sapiens
acuggagcguguacuacccca

SEQ ID NO: 1924517 - RNA, 18 nt, Homo sapiens
ugcaccuacccacaugca

SEQ ID NO: 1924518 - RNA, 12 nt, Homo sapiens
ucaaaaagccaa

SEQ ID NO: 1924519 - RNA, 22 nt, Homo sapiens
aucuauuuggaaagcacuggaa

SEQ ID NO: 1924520 - RNA, 21 nt, Homo sapiens
ucaccaaaaaccuauuccacu

SEQ ID NO: 1924521 - RNA, 17 nt, Homo sapiens
acucuucaugagcacuu

SEQ ID NO: 1924522 - RNA, 15 nt, Homo sapiens
uaacaagacuucaaa

SEQ ID NO: 1924523 - RNA, 13 nt, Homo sapiens
auaaaaaacacug

SEQ ID NO: 1924524 - RNA, 21 nt, Homo sapiens
aaacaucacaccugcccuaaa

SEQ ID NO: 1924525 - RNA, 21 nt, Homo sapiens
caggacaccgcuguccuggca

SEQ ID NO: 1924526 - RNA, 21 nt, Homo sapiens
agguaauucucccuaaggaau

SEQ ID NO: 1924527 - RNA, 16 nt, Homo sapiens
uauucccaaaugccuu

SEQ ID NO: 1924528 - RNA, 16 nt, Homo sapiens
gacugggaaaaacauc

SEQ ID NO: 1924529 - RNA, 15 nt, Homo sapiens
gagacacugugcuau

SEQ ID NO: 1924530 - RNA, 20 nt, Homo sapiens
cccaggguugaggggaccaa

SEQ ID NO: 1924531 - RNA, 19 nt, Homo sapiens
gaauuggcauaauuugucu

SEQ ID NO: 1924532 - RNA, 20 nt, Homo sapiens
agcuacacucccacuucuuc

SEQ ID NO: 1924533 - RNA, 23 nt, Homo sapiens
gagaaccucguugacaugcacag

SEQ ID NO: 1924534 - RNA, 12 nt, Homo sapiens
gcaucucaaaaa

SEQ ID NO: 1924535 - RNA, 12 nt, Homo sapiens
acaucucagaaa

SEQ ID NO: 1924536 - RNA, 19 nt, Homo sapiens
agggaggggagcuaugcua

SEQ ID NO: 1924537 - RNA, 21 nt, Homo sapiens
guuucccaaaaaccccagugu

SEQ ID NO: 1924538 - RNA, 17 nt, Homo sapiens
caaaacaguaauuuccu

SEQ ID NO: 1924539 - RNA, 22 nt, Homo sapiens
cuuccaauccuuaaacugccaa

SEQ ID NO: 1924540 - RNA, 13 nt, Homo sapiens
uaauagugaacau

SEQ ID NO: 1924541 - RNA, 17 nt, Homo sapiens
ugaacuauuagacauga

SEQ ID NO: 1924542 - RNA, 14 nt, Homo sapiens
agcuccaucaauga

SEQ ID NO: 1924543 - RNA, 19 nt, Homo sapiens
uuaaagcauuuacuuugaa

SEQ ID NO: 1924544 - RNA, 14 nt, Homo sapiens
ccaaauaaagcaaa

SEQ ID NO: 1924545 - RNA, 14 nt, Homo sapiens
aaaucguauucuaa

SEQ ID NO: 1924546 - RNA, 16 nt, Homo sapiens
gacuugaaaccagaag

SEQ ID NO: 1924547 - RNA, 16 nt, Homo sapiens
aaaauguagcaugaug

SEQ ID NO: 1924548 - RNA, 19 nt, Homo sapiens
cuguugcuugucuugauua

SEQ ID NO: 1924549 - RNA, 20 nt, Homo sapiens
caaguucuacaucaauauca

SEQ ID NO: 1924550 - RNA, 23 nt, Homo sapiens
gccuuugaccccagcagcuugga

SEQ ID NO: 1924551 - RNA, 19 nt, Homo sapiens
auacuacauacaagcauaa

SEQ ID NO: 1924552 - RNA, 15 nt, Homo sapiens
cugugacaccuggug

SEQ ID NO: 1924553 - RNA, 18 nt, Homo sapiens
ugcugcucuauauuacaa

SEQ ID NO: 1924554 - RNA, 22 nt, Homo sapiens
gcacacacacagagauaugcac

SEQ ID NO: 1924555 - RNA, 22 nt, Homo sapiens
cucccccagagguggauacugg

SEQ ID NO: 1924556 - RNA, 13 nt, Homo sapiens
auugaugccagug

SEQ ID NO: 1924557 - RNA, 14 nt, Homo sapiens
uaauauacuauaug

SEQ ID NO: 1924558 - RNA, 16 nt, Homo sapiens
ugccuagaaauaucuu

SEQ ID NO: 1924559 - RNA, 12 nt, Homo sapiens
cugccaaggugg

SEQ ID NO: 1924560 - RNA, 19 nt, Homo sapiens
uaaaacugcacagugcugu

SEQ ID NO: 1924561 - RNA, 22 nt, Homo sapiens
agaaucgcuugaaccugggaag

SEQ ID NO: 1924562 - RNA, 16 nt, Homo sapiens
ugaauugagcuagaaa

SEQ ID NO: 1924563 - RNA, 15 nt, Homo sapiens
caagccuauugugcc

SEQ ID NO: 1924564 - RNA, 18 nt, Homo sapiens
cauguaugacaagacaau

SEQ ID NO: 1924565 - RNA, 18 nt, Homo sapiens
agugaagcagcacuguga

SEQ ID NO: 1924566 - RNA, 14 nt, Homo sapiens
cugccaacuguccu

SEQ ID NO: 1924567 - RNA, 23 nt, Homo sapiens
acacaggaaaccaacacccaaag

SEQ ID NO: 1924568 - RNA, 17 nt, Homo sapiens
acagggaacacauuccu

SEQ ID NO: 1924569 - RNA, 12 nt, Homo sapiens
gaccccaaguga

SEQ ID NO: 1924570 - RNA, 15 nt, Homo sapiens
cuucccgccuuccaa

SEQ ID NO: 1924571 - RNA, 20 nt, Homo sapiens
aggauugggaaaaaguaauu

SEQ ID NO: 1924572 - RNA, 12 nt, Homo sapiens
auugaacuguac

SEQ ID NO: 1924573 - RNA, 14 nt, Homo sapiens
acugagugugcucu

SEQ ID NO: 1924574 - RNA, 16 nt, Homo sapiens
ugucucaauggugcua

SEQ ID NO: 1924575 - RNA, 16 nt, Homo sapiens
caguccucccuagcuc

SEQ ID NO: 1924576 - RNA, 16 nt, Homo sapiens
cauucagaccgagaga

SEQ ID NO: 1924577 - RNA, 22 nt, Homo sapiens
aaugaagaccuaaaugaccuca

SEQ ID NO: 1924578 - RNA, 13 nt, Homo sapiens
aaauggcaaagaa

SEQ ID NO: 1924579 - RNA, 13 nt, Homo sapiens
cccaaugccugcu

SEQ ID NO: 1924580 - RNA, 21 nt, Homo sapiens
caaauaauuuuucacuucaaa

SEQ ID NO: 1924581 - RNA, 15 nt, Homo sapiens
gcacgaauggaagag

SEQ ID NO: 1924582 - RNA, 17 nt, Homo sapiens
ggggagcccaggccugg

SEQ ID NO: 1924583 - RNA, 13 nt, Homo sapiens
gaucuuagauucu

SEQ ID NO: 1924584 - RNA, 23 nt, Homo sapiens
auuccuccagacguccaccucag

SEQ ID NO: 1924585 - RNA, 14 nt, Homo sapiens
gaaaguucauaucu

SEQ ID NO: 1924586 - RNA, 15 nt, Homo sapiens
cuaacgugaugagac

SEQ ID NO: 1924587 - RNA, 14 nt, Homo sapiens
ucaugccauugcac

SEQ ID NO: 1924588 - RNA, 19 nt, Homo sapiens
cugucaauacuauggagua

SEQ ID NO: 1924589 - RNA, 17 nt, Homo sapiens
gaagcaauuuguugcug

SEQ ID NO: 1924590 - RNA, 20 nt, Homo sapiens
aagagcaaaacucagucuca

SEQ ID NO: 1924591 - RNA, 22 nt, Homo sapiens
gguaggggcuuaaaagaaacua

SEQ ID NO: 1924592 - RNA, 20 nt, Homo sapiens
cucuuauaugccagaaugua

SEQ ID NO: 1924593 - RNA, 19 nt, Homo sapiens
auaauauuucaagugccua

SEQ ID NO: 1924594 - RNA, 18 nt, Homo sapiens
cugugcacaaaguggcau

SEQ ID NO: 1924595 - RNA, 19 nt, Homo sapiens
aaauaguaagccucccucc

SEQ ID NO: 1924596 - RNA, 11 nt, Homo sapiens
aaugagugugc

SEQ ID NO: 1924597 - RNA, 20 nt, Homo sapiens
caggcgcccgccaccaugcc

SEQ ID NO: 1924598 - RNA, 14 nt, Homo sapiens
cucuguggugauga

SEQ ID NO: 1924599 - RNA, 13 nt, Homo sapiens
aauggugcugcag

SEQ ID NO: 1924600 - RNA, 19 nt, Homo sapiens
uagguggguugaaagccaa

SEQ ID NO: 1924601 - RNA, 21 nt, Homo sapiens
caauuucccacccaucuccag

SEQ ID NO: 1924602 - RNA, 19 nt, Homo sapiens
cuauaccucauucacagcu

SEQ ID NO: 1924603 - RNA, 23 nt, Homo sapiens
cugacaguuaauaaaccuuugca

SEQ ID NO: 1924604 - RNA, 23 nt, Homo sapiens
gauuuuauuuuugcaaaauaagu

SEQ ID NO: 1924605 - RNA, 15 nt, Homo sapiens
ccacuccacccuguu

SEQ ID NO: 1924606 - RNA, 20 nt, Homo sapiens
uuugacuuucuucugaauau

SEQ ID NO: 1924607 - RNA, 15 nt, Homo sapiens
acaugauaguuaaac

SEQ ID NO: 1924608 - RNA, 17 nt, Homo sapiens
uuaaaaaguuugaauag

SEQ ID NO: 1924609 - RNA, 20 nt, Homo sapiens
gagugcaguggcgugaucuc

SEQ ID NO: 1924610 - RNA, 12 nt, Homo sapiens
acaccccagugg

SEQ ID NO: 1924611 - RNA, 12 nt, Homo sapiens
cuagguguuguc

SEQ ID NO: 1924612 - RNA, 14 nt, Homo sapiens
agauucugagcaaa

SEQ ID NO: 1924613 - RNA, 17 nt, Homo sapiens
gaccugacaccuuucau

SEQ ID NO: 1924614 - RNA, 22 nt, Homo sapiens
gagccuaccuucaccaccuaua

SEQ ID NO: 1924615 - RNA, 15 nt, Homo sapiens
uccuuugcugcugag

SEQ ID NO: 1924616 - RNA, 16 nt, Homo sapiens
auauuuuagccuuaaa

SEQ ID NO: 1924617 - RNA, 16 nt, Homo sapiens
guauccagaagccagu

SEQ ID NO: 1924618 - RNA, 16 nt, Homo sapiens
augauggcaacagauc

SEQ ID NO: 1924619 - RNA, 22 nt, Homo sapiens
caccuauuuaagagggaacuua

SEQ ID NO: 1924620 - RNA, 19 nt, Homo sapiens
aaauuucuauucucuccac

SEQ ID NO: 1924621 - RNA, 21 nt, Homo sapiens
ugagguuaaaauauaaauuaa

SEQ ID NO: 1924622 - RNA, 20 nt, Homo sapiens
aaaccucugggucaucucuc

SEQ ID NO: 1924623 - RNA, 20 nt, Homo sapiens
caucugaguuagguuccagc

SEQ ID NO: 1924624 - RNA, 19 nt, Homo sapiens
agcccagcugggucaggca

SEQ ID NO: 1924625 - RNA, 19 nt, Homo sapiens
guuuacacugcacauugaa

SEQ ID NO: 1924626 - RNA, 18 nt, Homo sapiens
uuuauggguuuugcuuaa

SEQ ID NO: 1924627 - RNA, 19 nt, Homo sapiens
uugcucuucagaugccacu

SEQ ID NO: 1924628 - RNA, 22 nt, Homo sapiens
caggaucguugucccuacagga

SEQ ID NO: 1924629 - RNA, 13 nt, Homo sapiens
uagaaugcaggag

SEQ ID NO: 1924630 - RNA, 16 nt, Homo sapiens
caagauuguagaaacu

SEQ ID NO: 1924631 - RNA, 17 nt, Homo sapiens
uugggggaaaaaaaaga

SEQ ID NO: 1924632 - RNA, 23 nt, Homo sapiens
uuuuccccaauuaauugcuauug

SEQ ID NO: 1924633 - RNA, 13 nt, Homo sapiens
agcucuucauuuc

SEQ ID NO: 1924634 - RNA, 13 nt, Homo sapiens
auccauucaguca

SEQ ID NO: 1924635 - RNA, 15 nt, Homo sapiens
uacucuugaucuuca

SEQ ID NO: 1924636 - RNA, 23 nt, Homo sapiens
cagaguauauuuaagaagccaag

SEQ ID NO: 1924637 - RNA, 13 nt, Homo sapiens
uuggaaacuaaua

SEQ ID NO: 1924638 - RNA, 15 nt, Homo sapiens
ggucuguuggggucu

SEQ ID NO: 1924639 - RNA, 15 nt, Homo sapiens
cagcugaucauguca

SEQ ID NO: 1924640 - RNA, 13 nt, Homo sapiens
ugauggcaaaaaa

SEQ ID NO: 1924641 - RNA, 14 nt, Homo sapiens
uaaauucucaguca

SEQ ID NO: 1924642 - RNA, 23 nt, Homo sapiens
uuaucuuuuuaaaaacucuucag

SEQ ID NO: 1924643 - RNA, 17 nt, Homo sapiens
caggaaacuaauuuccu

SEQ ID NO: 1924644 - RNA, 21 nt, Homo sapiens
agccacgccugcgauggugcu

SEQ ID NO: 1924645 - RNA, 18 nt, Homo sapiens
aaugaccaaauccaugga

SEQ ID NO: 1924646 - RNA, 17 nt, Homo sapiens
acauaacccacucuguc

SEQ ID NO: 1924647 - RNA, 15 nt, Homo sapiens
uguaaaauuauuuca

SEQ ID NO: 1924648 - RNA, 19 nt, Homo sapiens
caaagaucucagcagccag

SEQ ID NO: 1924649 - RNA, 21 nt, Homo sapiens
uagcuauuuucuuacagugga

SEQ ID NO: 1924650 - RNA, 12 nt, Homo sapiens
cucugcuuccug

SEQ ID NO: 1924651 - RNA, 18 nt, Homo sapiens
uuccuggguuuccugcag

SEQ ID NO: 1924652 - RNA, 18 nt, Homo sapiens
ucccucacuguuccccaa

SEQ ID NO: 1924653 - RNA, 17 nt, Homo sapiens
cacuuccccuugcaccc

SEQ ID NO: 1924654 - RNA, 17 nt, Homo sapiens
cucacuggccugccaug

SEQ ID NO: 1924655 - RNA, 16 nt, Homo sapiens
aaggauuacucuccau

SEQ ID NO: 1924656 - RNA, 19 nt, Homo sapiens
uuuccugcuccuccaguac

SEQ ID NO: 1924657 - RNA, 14 nt, Homo sapiens
cauuauuauuugcu

SEQ ID NO: 1924658 - RNA, 17 nt, Homo sapiens
gauuuaaguguuuugua

SEQ ID NO: 1924659 - RNA, 16 nt, Homo sapiens
cagccuccaggcaccc

SEQ ID NO: 1924660 - RNA, 16 nt, Homo sapiens
augacuuugcaccugc

SEQ ID NO: 1924661 - RNA, 14 nt, Homo sapiens
ggcacaagugucag

SEQ ID NO: 1924662 - RNA, 15 nt, Homo sapiens
aaaccguggucucau

SEQ ID NO: 1924663 - RNA, 21 nt, Homo sapiens
gacaauuuugcuucacuuugc

SEQ ID NO: 1924664 - RNA, 12 nt, Homo sapiens
guggaaagucag

SEQ ID NO: 1924665 - RNA, 17 nt, Homo sapiens
acagccauagugugugu

SEQ ID NO: 1924666 - RNA, 21 nt, Homo sapiens
ucuucaugugucuugcaauga

SEQ ID NO: 1924667 - RNA, 18 nt, Homo sapiens
aauuaccacaccaucucc

SEQ ID NO: 1924668 - RNA, 14 nt, Homo sapiens
uagggaugcucaaa

SEQ ID NO: 1924669 - RNA, 20 nt, Homo sapiens
agugaccccagcuccaggca

SEQ ID NO: 1924670 - RNA, 19 nt, Homo sapiens
gccaagggcagcaccaucu

SEQ ID NO: 1924671 - RNA, 21 nt, Homo sapiens
cagccacauguccuccaucag

SEQ ID NO: 1924672 - RNA, 20 nt, Homo sapiens
uaacacucauuuccaaucau

SEQ ID NO: 1924673 - RNA, 12 nt, Homo sapiens
caaaacugccuc

SEQ ID NO: 1924674 - RNA, 15 nt, Homo sapiens
auguaaaugcucaaa

SEQ ID NO: 1924675 - RNA, 19 nt, Homo sapiens
uauguaagaagaaacugcu

SEQ ID NO: 1924676 - RNA, 15 nt, Homo sapiens
ugccuccugccuccc

SEQ ID NO: 1924677 - RNA, 15 nt, Homo sapiens
cacuaggauugugau

SEQ ID NO: 1924678 - RNA, 15 nt, Homo sapiens
aucuccuguccauca

SEQ ID NO: 1924679 - RNA, 20 nt, Homo sapiens
agauggaguucuugugccau

SEQ ID NO: 1924680 - RNA, 23 nt, Homo sapiens
guccacaacaauaugaaguacag

SEQ ID NO: 1924681 - RNA, 17 nt, Homo sapiens
gagcguuaacacaguaa

SEQ ID NO: 1924682 - RNA, 18 nt, Homo sapiens
uugaacugguucaugaaa

SEQ ID NO: 1924683 - RNA, 11 nt, Homo sapiens
ggaaguuauuu

SEQ ID NO: 1924684 - RNA, 18 nt, Homo sapiens
aagcaaaaccacugagcu

SEQ ID NO: 1924685 - RNA, 13 nt, Homo sapiens
caucuucuuccau

SEQ ID NO: 1924686 - RNA, 14 nt, Homo sapiens
cagcaggguggccu

SEQ ID NO: 1924687 - RNA, 16 nt, Homo sapiens
gucaaccagugaggcu

SEQ ID NO: 1924688 - RNA, 19 nt, Homo sapiens
agaaauguuggcauuuagu

SEQ ID NO: 1924689 - RNA, 14 nt, Homo sapiens
uccaccagggccag

SEQ ID NO: 1924690 - RNA, 17 nt, Homo sapiens
cucaucugccugcagug

SEQ ID NO: 1924691 - RNA, 17 nt, Homo sapiens
aucaguuuccagucuca

SEQ ID NO: 1924692 - RNA, 14 nt, Homo sapiens
gggaggggguccug

SEQ ID NO: 1924693 - RNA, 20 nt, Homo sapiens
gacauuuuagaaugucaaua

SEQ ID NO: 1924694 - RNA, 17 nt, Homo sapiens
ggcuggccgcaugacca

SEQ ID NO: 1924695 - RNA, 22 nt, Homo sapiens
uccccacugcucucugugguga

SEQ ID NO: 1924696 - RNA, 11 nt, Homo sapiens
auaucagcucu

SEQ ID NO: 1924697 - RNA, 12 nt, Homo sapiens
gaagcugaccuu

SEQ ID NO: 1924698 - RNA, 15 nt, Homo sapiens
auuugauguacaugu

SEQ ID NO: 1924699 - RNA, 22 nt, Homo sapiens
gcaacauucguucucuaaccau

SEQ ID NO: 1924700 - RNA, 13 nt, Homo sapiens
acacaaauauuua

SEQ ID NO: 1924701 - RNA, 13 nt, Homo sapiens
ucaggcaccucau

SEQ ID NO: 1924702 - RNA, 17 nt, Homo sapiens
aaaucagcugcuacuac

SEQ ID NO: 1924703 - RNA, 16 nt, Homo sapiens
auaaccuugugccuug

SEQ ID NO: 1924704 - RNA, 18 nt, Homo sapiens
acucagucuuuaaucuga

SEQ ID NO: 1924705 - RNA, 21 nt, Homo sapiens
uugcauaucuuaaaacuaaau

SEQ ID NO: 1924706 - RNA, 23 nt, Homo sapiens
cauauucacaauggaaacuuuag

SEQ ID NO: 1924707 - RNA, 19 nt, Homo sapiens
agaaagaggaguagcauga

SEQ ID NO: 1924708 - RNA, 13 nt, Homo sapiens
ucaugguacugua

SEQ ID NO: 1924709 - RNA, 18 nt, Homo sapiens
guacauauguaaacauaa

SEQ ID NO: 1924710 - RNA, 16 nt, Homo sapiens
aggccuuccagugcag

SEQ ID NO: 1924711 - RNA, 12 nt, Homo sapiens
aagaaagggaaa

SEQ ID NO: 1924712 - RNA, 20 nt, Homo sapiens
ugugguuucucuggcccuga

SEQ ID NO: 1924713 - RNA, 21 nt, Homo sapiens
agcggacagaaugaugccaaa

SEQ ID NO: 1924714 - RNA, 14 nt, Homo sapiens
guacauugugaaca

SEQ ID NO: 1924715 - RNA, 15 nt, Homo sapiens
agagccucugagaug

SEQ ID NO: 1924716 - RNA, 21 nt, Homo sapiens
aauacauaaaaaaguguuuac

SEQ ID NO: 1924717 - RNA, 13 nt, Homo sapiens
ucaaggugggccu

SEQ ID NO: 1924718 - RNA, 18 nt, Homo sapiens
aagaucaaaacagucaua

SEQ ID NO: 1924719 - RNA, 23 nt, Homo sapiens
uccucuaccucucagcugcugaa

SEQ ID NO: 1924720 - RNA, 14 nt, Homo sapiens
ucaaagcuaaaggg

SEQ ID NO: 1924721 - RNA, 22 nt, Homo sapiens
cagaaaugcugccugccugucu

SEQ ID NO: 1924722 - RNA, 21 nt, Homo sapiens
uuaucucccugcuucauaucu

SEQ ID NO: 1924723 - RNA, 19 nt, Homo sapiens
ucuucaccucugcuacuca

SEQ ID NO: 1924724 - RNA, 20 nt, Homo sapiens
uaaaugagcugccagaauca

SEQ ID NO: 1924725 - RNA, 18 nt, Homo sapiens
agucacuaguuguaauuu

SEQ ID NO: 1924726 - RNA, 15 nt, Homo sapiens
uuaaguuucucagcu

SEQ ID NO: 1924727 - RNA, 19 nt, Homo sapiens
guauguaaguaauugcauu

SEQ ID NO: 1924728 - RNA, 21 nt, Homo sapiens
ugcugaccccugugugacauc

SEQ ID NO: 1924729 - RNA, 22 nt, Homo sapiens
ucaccacaguuuauugauuuca

SEQ ID NO: 1924730 - RNA, 22 nt, Homo sapiens
acauaauguuuucacaguuccu

SEQ ID NO: 1924731 - RNA, 22 nt, Homo sapiens
uaugccaggcccauuuccugcu

SEQ ID NO: 1924732 - RNA, 16 nt, Homo sapiens
gugcaugugcacuugc

SEQ ID NO: 1924733 - RNA, 12 nt, Homo sapiens
gauacauuuaau

SEQ ID NO: 1924734 - RNA, 18 nt, Homo sapiens
gcaguugcugucagucuu

SEQ ID NO: 1924735 - RNA, 19 nt, Homo sapiens
uucaggaaguugcugagaa

SEQ ID NO: 1924736 - RNA, 15 nt, Homo sapiens
gacuuuaagugaaag

SEQ ID NO: 1924737 - RNA, 20 nt, Homo sapiens
auagacaauuugcccuauca

SEQ ID NO: 1924738 - RNA, 13 nt, Homo sapiens
uuaacacauucaa

SEQ ID NO: 1924739 - RNA, 11 nt, Homo sapiens
aaacucuguca

SEQ ID NO: 1924740 - RNA, 20 nt, Homo sapiens
aaauauguguacacauauga

SEQ ID NO: 1924741 - RNA, 15 nt, Homo sapiens
cagagggccuggcuc

SEQ ID NO: 1924742 - RNA, 11 nt, Homo sapiens
ggcaccagcaa

SEQ ID NO: 1924743 - RNA, 16 nt, Homo sapiens
gugugcauaugcaugu

SEQ ID NO: 1924744 - RNA, 16 nt, Homo sapiens
gguuuacaacaaacac

SEQ ID NO: 1924745 - RNA, 22 nt, Homo sapiens
uuagauguuucaacugugcucu

SEQ ID NO: 1924746 - RNA, 21 nt, Homo sapiens
ucaaccugcacuucauaucua

SEQ ID NO: 1924747 - RNA, 18 nt, Homo sapiens
aggaugcugucaggagau

SEQ ID NO: 1924748 - RNA, 11 nt, Homo sapiens
acacaggguga

SEQ ID NO: 1924749 - RNA, 21 nt, Homo sapiens
acuggaagaaagcaacaaaga

SEQ ID NO: 1924750 - RNA, 20 nt, Homo sapiens
ugugccaccaccccuugacc

SEQ ID NO: 1924751 - RNA, 16 nt, Homo sapiens
ccuccugccuccagca

SEQ ID NO: 1924752 - RNA, 19 nt, Homo sapiens
uguguauagcuuaccugaa

SEQ ID NO: 1924753 - RNA, 13 nt, Homo sapiens
auuuccugugagg

SEQ ID NO: 1924754 - RNA, 21 nt, Homo sapiens
gaaaagaggcccaagugcaaa

SEQ ID NO: 1924755 - RNA, 17 nt, Homo sapiens
uuuaagaguuacuuaau

SEQ ID NO: 1924756 - RNA, 15 nt, Homo sapiens
acgaauuugcacagu

SEQ ID NO: 1924757 - RNA, 19 nt, Homo sapiens
aaugauuauuuucauuaca

SEQ ID NO: 1924758 - RNA, 12 nt, Homo sapiens
uguaaagccagc

SEQ ID NO: 1924759 - RNA, 13 nt, Homo sapiens
uuuugugcuacag

SEQ ID NO: 1924760 - RNA, 16 nt, Homo sapiens
agcaugccuucaaauc

SEQ ID NO: 1924761 - RNA, 16 nt, Homo sapiens
uccuccaccacaagag

SEQ ID NO: 1924762 - RNA, 17 nt, Homo sapiens
cugccaugacagaggcu

SEQ ID NO: 1924763 - RNA, 20 nt, Homo sapiens
aagauaaucuuagcugccaa

SEQ ID NO: 1924764 - RNA, 13 nt, Homo sapiens
agaauaugaaguu

SEQ ID NO: 1924765 - RNA, 12 nt, Homo sapiens
gucuccaaaaca

SEQ ID NO: 1924766 - RNA, 15 nt, Homo sapiens
aggugcuucuucacu

SEQ ID NO: 1924767 - RNA, 20 nt, Homo sapiens
uagccuaauacaacauguag

SEQ ID NO: 1924768 - RNA, 20 nt, Homo sapiens
uggcaaaugccugacucagu

SEQ ID NO: 1924769 - RNA, 13 nt, Homo sapiens
cacaaagcucaau

SEQ ID NO: 1924770 - RNA, 13 nt, Homo sapiens
cucugcuccuuau

SEQ ID NO: 1924771 - RNA, 18 nt, Homo sapiens
agauaucaugaugugcaa

SEQ ID NO: 1924772 - RNA, 19 nt, Homo sapiens
uuaaauaauccucuaugug

SEQ ID NO: 1924773 - RNA, 19 nt, Homo sapiens
aacuacccccagcugugcu

SEQ ID NO: 1924774 - RNA, 14 nt, Homo sapiens
uaacuccugccuau

SEQ ID NO: 1924775 - RNA, 16 nt, Homo sapiens
auagauuuaaagaaua

SEQ ID NO: 1924776 - RNA, 16 nt, Homo sapiens
uucugacuuacuguca

SEQ ID NO: 1924777 - RNA, 15 nt, Homo sapiens
cacacaggucucauu

SEQ ID NO: 1924778 - RNA, 23 nt, Homo sapiens
ccaggagcugggcagaaggccaa

SEQ ID NO: 1924779 - RNA, 16 nt, Homo sapiens
aagaccagccuggcca

SEQ ID NO: 1924780 - RNA, 15 nt, Homo sapiens
gcgccccgcaccugu

SEQ ID NO: 1924781 - RNA, 14 nt, Homo sapiens
uuugauuauaguau

SEQ ID NO: 1924782 - RNA, 23 nt, Homo sapiens
aaugagcaaaaccaaauauucca

SEQ ID NO: 1924783 - RNA, 15 nt, Homo sapiens
augcaaugccaaaua

SEQ ID NO: 1924784 - RNA, 23 nt, Homo sapiens
gcagugcaguauagaauaggcac

SEQ ID NO: 1924785 - RNA, 21 nt, Homo sapiens
ccacucugaauaccaagugug

SEQ ID NO: 1924786 - RNA, 14 nt, Homo sapiens
aaacguccacaaag

SEQ ID NO: 1924787 - RNA, 17 nt, Homo sapiens
gacaaccagaaggcccu

SEQ ID NO: 1924788 - RNA, 19 nt, Homo sapiens
gauagggagcagaugcaau

SEQ ID NO: 1924789 - RNA, 15 nt, Homo sapiens
aucagauaaugccac

SEQ ID NO: 1924790 - RNA, 16 nt, Homo sapiens
ucaggcagcagugucu

SEQ ID NO: 1924791 - RNA, 20 nt, Homo sapiens
acucuuaaacuaacaauuca

SEQ ID NO: 1924792 - RNA, 14 nt, Homo sapiens
agggagguggugau

SEQ ID NO: 1924793 - RNA, 14 nt, Homo sapiens
aaucuuauuuauac

SEQ ID NO: 1924794 - RNA, 17 nt, Homo sapiens
ccgguguuuaagacauu

SEQ ID NO: 1924795 - RNA, 21 nt, Homo sapiens
uccccuucccccaucccuacc

SEQ ID NO: 1924796 - RNA, 18 nt, Homo sapiens
auguuauccaacuauuaa

SEQ ID NO: 1924797 - RNA, 23 nt, Homo sapiens
cugguuauuguucagacauucca

SEQ ID NO: 1924798 - RNA, 15 nt, Homo sapiens
gccccagggucugaa

SEQ ID NO: 1924799 - RNA, 17 nt, Homo sapiens
agcugcuggcugugaca

SEQ ID NO: 1924800 - RNA, 12 nt, Homo sapiens
uguuagcuuucc

SEQ ID NO: 1924801 - RNA, 14 nt, Homo sapiens
aagacuugugcauc

SEQ ID NO: 1924802 - RNA, 17 nt, Homo sapiens
uauuuuauuauucagaa

SEQ ID NO: 1924803 - RNA, 13 nt, Homo sapiens
auauauauuacaa

SEQ ID NO: 1924804 - RNA, 14 nt, Homo sapiens
uggcugaaaaucac

SEQ ID NO: 1924805 - RNA, 19 nt, Homo sapiens
gauccuguauugugcccgg

SEQ ID NO: 1924806 - RNA, 16 nt, Homo sapiens
uaaaugcaauauguau

SEQ ID NO: 1924807 - RNA, 12 nt, Homo sapiens
uauacagagccu

SEQ ID NO: 1924808 - RNA, 15 nt, Homo sapiens
cuuaauaaacucaca

SEQ ID NO: 1924809 - RNA, 19 nt, Homo sapiens
guaccuauuugucauguau

SEQ ID NO: 1924810 - RNA, 22 nt, Homo sapiens
acuuugcugucaaaacuacuga

SEQ ID NO: 1924811 - RNA, 18 nt, Homo sapiens
guaaaauuaucuguucua

SEQ ID NO: 1924812 - RNA, 17 nt, Homo sapiens
cugcccuuggcacccaa

SEQ ID NO: 1924813 - RNA, 18 nt, Homo sapiens
gaagcaaaaguaaucacu

SEQ ID NO: 1924814 - RNA, 17 nt, Homo sapiens
ccuuguuguucuuuaac

SEQ ID NO: 1924815 - RNA, 21 nt, Homo sapiens
ugucacuugaccaauacugac

SEQ ID NO: 1924816 - RNA, 13 nt, Homo sapiens
gccagcagcacgu

SEQ ID NO: 1924817 - RNA, 15 nt, Homo sapiens
uacagaaugcauuaa

SEQ ID NO: 1924818 - RNA, 22 nt, Homo sapiens
caaaccuggauuuuuuauguac

SEQ ID NO: 1924819 - RNA, 23 nt, Homo sapiens
ggccaugauggcaacagaucugg

SEQ ID NO: 1924820 - RNA, 12 nt, Homo sapiens
cuaauccuaucu

SEQ ID NO: 1924821 - RNA, 20 nt, Homo sapiens
acuuagaauccgaagggaau

SEQ ID NO: 1924822 - RNA, 16 nt, Homo sapiens
uugaauuauaugguug

SEQ ID NO: 1924823 - RNA, 18 nt, Homo sapiens
ugugucccccucugucca

SEQ ID NO: 1924824 - RNA, 18 nt, Homo sapiens
aaccucgagguuucucaa

SEQ ID NO: 1924825 - RNA, 24 nt, Homo sapiens
uaaauacgaagauaaagcuuuauu

SEQ ID NO: 1924826 - RNA, 20 nt, Homo sapiens
ccacccccuguuggcccuca

SEQ ID NO: 1924827 - RNA, 12 nt, Homo sapiens
uccccuguguca

SEQ ID NO: 1924828 - RNA, 15 nt, Homo sapiens
gagcaaaaugcucuu

SEQ ID NO: 1924829 - RNA, 14 nt, Homo sapiens
cuguauuuaagaaa

SEQ ID NO: 1924830 - RNA, 12 nt, Homo sapiens
uggcuucuccag

SEQ ID NO: 1924831 - RNA, 13 nt, Homo sapiens
caggcuucgucuc

SEQ ID NO: 1924832 - RNA, 14 nt, Homo sapiens
agugacacagcagc

SEQ ID NO: 1924833 - RNA, 14 nt, Homo sapiens
augcccagcagggg

SEQ ID NO: 1924834 - RNA, 14 nt, Homo sapiens
agagaaaugagcug

SEQ ID NO: 1924835 - RNA, 14 nt, Homo sapiens
cacuagacccacug

SEQ ID NO: 1924836 - RNA, 22 nt, Homo sapiens
ugugagauccucuuuacucugg

SEQ ID NO: 1924837 - RNA, 19 nt, Homo sapiens
aucugacugccaagccaga

SEQ ID NO: 1924838 - RNA, 17 nt, Homo sapiens
cagaggauucuguguuc

SEQ ID NO: 1924839 - RNA, 22 nt, Homo sapiens
auaacuuccuggcuccuucacu

SEQ ID NO: 1924840 - RNA, 14 nt, Homo sapiens
caaagcauuuccca

SEQ ID NO: 1924841 - RNA, 22 nt, Homo sapiens
ccaauucuaacagcaaauaaca

SEQ ID NO: 1924842 - RNA, 15 nt, Homo sapiens
gaggccgaggccaug

SEQ ID NO: 1924843 - RNA, 17 nt, Homo sapiens
ugcagugagcuaagauc

SEQ ID NO: 1924844 - RNA, 16 nt, Homo sapiens
guguguuuaacauuca

SEQ ID NO: 1924845 - RNA, 20 nt, Homo sapiens
ccccauuuccccgauguccc

SEQ ID NO: 1924846 - RNA, 19 nt, Homo sapiens
uggccgggucccugagcuc

SEQ ID NO: 1924847 - RNA, 20 nt, Homo sapiens
gacaaugugaaaccaucaca

SEQ ID NO: 1924848 - RNA, 12 nt, Homo sapiens
cucuacaugcau

SEQ ID NO: 1924849 - RNA, 14 nt, Homo sapiens
aagaaaaccaaaca

SEQ ID NO: 1924850 - RNA, 14 nt, Homo sapiens
aaauucagaacaag

SEQ ID NO: 1924851 - RNA, 21 nt, Homo sapiens
aaaugggaucuuucugacaca

SEQ ID NO: 1924852 - RNA, 23 nt, Homo sapiens
aguaauugaggaaaaacugacag

SEQ ID NO: 1924853 - RNA, 17 nt, Homo sapiens
gaaugaagcuaauguga

SEQ ID NO: 1924854 - RNA, 13 nt, Homo sapiens
aaacuucaauauc

SEQ ID NO: 1924855 - RNA, 13 nt, Homo sapiens
cauccucacuuuu

SEQ ID NO: 1924856 - RNA, 14 nt, Homo sapiens
guccuugugugcau

SEQ ID NO: 1924857 - RNA, 17 nt, Homo sapiens
guuaaugucugacuguu

SEQ ID NO: 1924858 - RNA, 20 nt, Homo sapiens
agacuccuagacucacuugu

SEQ ID NO: 1924859 - RNA, 12 nt, Homo sapiens
aaauaauuugaa

SEQ ID NO: 1924860 - RNA, 21 nt, Homo sapiens
uucuucuuugauaguguaaac

SEQ ID NO: 1924861 - RNA, 15 nt, Homo sapiens
uuugaaacuuuucaa

SEQ ID NO: 1924862 - RNA, 18 nt, Homo sapiens
ugacacacagcagcacug

SEQ ID NO: 1924863 - RNA, 20 nt, Homo sapiens
ccccuuaagcaugcuucuau

SEQ ID NO: 1924864 - RNA, 14 nt, Homo sapiens
cagcagcuugacgc

SEQ ID NO: 1924865 - RNA, 13 nt, Homo sapiens
uagugcuuuucag

SEQ ID NO: 1924866 - RNA, 13 nt, Homo sapiens
uaguucuuuucau

SEQ ID NO: 1924867 - RNA, 20 nt, Homo sapiens
cagggggcugaaacuugaac

SEQ ID NO: 1924868 - RNA, 21 nt, Homo sapiens
ccuuggguuagaccuacaggg

SEQ ID NO: 1924869 - RNA, 13 nt, Homo sapiens
ccugacugccaag

SEQ ID NO: 1924870 - RNA, 13 nt, Homo sapiens
acuaugaaucuau

SEQ ID NO: 1924871 - RNA, 13 nt, Homo sapiens
ugcaugaaagcau

SEQ ID NO: 1924872 - RNA, 18 nt, Homo sapiens
ccugcagagauauuucuu

SEQ ID NO: 1924873 - RNA, 18 nt, Homo sapiens
caacugaaggcuaaaaag

SEQ ID NO: 1924874 - RNA, 14 nt, Homo sapiens
acugaauaauauca

SEQ ID NO: 1924875 - RNA, 11 nt, Homo sapiens
uaaugcucuga

SEQ ID NO: 1924876 - RNA, 17 nt, Homo sapiens
ggugggcugaguacagu

SEQ ID NO: 1924877 - RNA, 15 nt, Homo sapiens
uuucaaaaugcaugu

SEQ ID NO: 1924878 - RNA, 23 nt, Homo sapiens
gaauagaaauuugccccuggcaa

SEQ ID NO: 1924879 - RNA, 17 nt, Homo sapiens
uuaaauucaagcugcuu

SEQ ID NO: 1924880 - RNA, 15 nt, Homo sapiens
cucccucagcucucu

SEQ ID NO: 1924881 - RNA, 14 nt, Homo sapiens
acugagaugcaaau

SEQ ID NO: 1924882 - RNA, 13 nt, Homo sapiens
ucaugugccaucu

SEQ ID NO: 1924883 - RNA, 13 nt, Homo sapiens
aacugcaguaugg

SEQ ID NO: 1924884 - RNA, 14 nt, Homo sapiens
uucuaauugcuuau

SEQ ID NO: 1924885 - RNA, 22 nt, Homo sapiens
ccugagguuagcccaauggaga

SEQ ID NO: 1924886 - RNA, 22 nt, Homo sapiens
uaaguguuggccaucauuucau

SEQ ID NO: 1924887 - RNA, 23 nt, Homo sapiens
gggcccucccagcccauugcugc

SEQ ID NO: 1924888 - RNA, 15 nt, Homo sapiens
acucugucucaaaaa

SEQ ID NO: 1924889 - RNA, 19 nt, Homo sapiens
acugcacagugcaucucag

SEQ ID NO: 1924890 - RNA, 18 nt, Homo sapiens
uaucaugaagauguuggu

SEQ ID NO: 1924891 - RNA, 19 nt, Homo sapiens
aaaaggaggcucuucucau

SEQ ID NO: 1924892 - RNA, 20 nt, Homo sapiens
agcuuguguccuguccuuuc

SEQ ID NO: 1924893 - RNA, 12 nt, Homo sapiens
gggaugggccac

SEQ ID NO: 1924894 - RNA, 23 nt, Homo sapiens
ugagcccucucacuccagccaaa

SEQ ID NO: 1924895 - RNA, 20 nt, Homo sapiens
uaauuaaaagugugggcugg

SEQ ID NO: 1924896 - RNA, 22 nt, Homo sapiens
acuauugugcacaagucuuucc

SEQ ID NO: 1924897 - RNA, 20 nt, Homo sapiens
ugcacguggcuucugaugaa

SEQ ID NO: 1924898 - RNA, 22 nt, Homo sapiens
gggcucucgcggccucuucucu

SEQ ID NO: 1924899 - RNA, 17 nt, Homo sapiens
uccucuucuuguugacc

SEQ ID NO: 1924900 - RNA, 17 nt, Homo sapiens
aguacuuucaaugaaca

SEQ ID NO: 1924901 - RNA, 22 nt, Homo sapiens
cacuuaucaguguauugauguu

SEQ ID NO: 1924902 - RNA, 21 nt, Homo sapiens
ggauguuuuuucccuguuuaa

SEQ ID NO: 1924903 - RNA, 15 nt, Homo sapiens
augggagagcuagaa

SEQ ID NO: 1924904 - RNA, 18 nt, Homo sapiens
aaagggugcccacaaaau

SEQ ID NO: 1924905 - RNA, 18 nt, Homo sapiens
aucuggccuaauguucca

SEQ ID NO: 1924906 - RNA, 19 nt, Homo sapiens
aggcaugaacacacaugga

SEQ ID NO: 1924907 - RNA, 15 nt, Homo sapiens
ccaaauccuugagau

SEQ ID NO: 1924908 - RNA, 23 nt, Homo sapiens
agccuaaugagagugcacugcuc

SEQ ID NO: 1924909 - RNA, 16 nt, Homo sapiens
ucauuuacacagugcu

SEQ ID NO: 1924910 - RNA, 19 nt, Homo sapiens
caaaaaaaggcggugagca

SEQ ID NO: 1924911 - RNA, 16 nt, Homo sapiens
agcccaccuucuugcu

SEQ ID NO: 1924912 - RNA, 15 nt, Homo sapiens
uggaacuguugaaag

SEQ ID NO: 1924913 - RNA, 15 nt, Homo sapiens
cuuuuucuagacuug

SEQ ID NO: 1924914 - RNA, 17 nt, Homo sapiens
aacaaguagcacacuga

SEQ ID NO: 1924915 - RNA, 16 nt, Homo sapiens
ccuggaaaugugcuaa

SEQ ID NO: 1924916 - RNA, 17 nt, Homo sapiens
uauaagaauuacuaaau

SEQ ID NO: 1924917 - RNA, 12 nt, Homo sapiens
acuggauguuuc

SEQ ID NO: 1924918 - RNA, 21 nt, Homo sapiens
aggaucaacaacauccacugu

SEQ ID NO: 1924919 - RNA, 18 nt, Homo sapiens
ccccagaagcagccauaa

SEQ ID NO: 1924920 - RNA, 16 nt, Homo sapiens
agcagccagucucaga

SEQ ID NO: 1924921 - RNA, 20 nt, Homo sapiens
ugcacuccagcuugggcaac

SEQ ID NO: 1924922 - RNA, 21 nt, Homo sapiens
auuaucauaugaacuugucag

SEQ ID NO: 1924923 - RNA, 21 nt, Homo sapiens
gcuggugggggcauccuugag

SEQ ID NO: 1924924 - RNA, 18 nt, Homo sapiens
gccggcuucaaguggcag

SEQ ID NO: 1924925 - RNA, 16 nt, Homo sapiens
aauucaauuuggcaaa

SEQ ID NO: 1924926 - RNA, 16 nt, Homo sapiens
augcgucaggggccua

SEQ ID NO: 1924927 - RNA, 21 nt, Homo sapiens
gauuggucuggguggauguga

SEQ ID NO: 1924928 - RNA, 16 nt, Homo sapiens
aaaugccaccauccaa

SEQ ID NO: 1924929 - RNA, 16 nt, Homo sapiens
auggcuaguacuguau

SEQ ID NO: 1924930 - RNA, 16 nt, Homo sapiens
ugagaaagaugggcaa

SEQ ID NO: 1924931 - RNA, 15 nt, Homo sapiens
aucuaggaugugaug

SEQ ID NO: 1924932 - RNA, 13 nt, Homo sapiens
cauucuacacuga

SEQ ID NO: 1924933 - RNA, 13 nt, Homo sapiens
gaaaugagcgaaa

SEQ ID NO: 1924934 - RNA, 15 nt, Homo sapiens
acugagucuguggac

SEQ ID NO: 1924935 - RNA, 18 nt, Homo sapiens
cucugacgcaaaaccacu

SEQ ID NO: 1924936 - RNA, 23 nt, Homo sapiens
ccauaguggacauuguuggcagc

SEQ ID NO: 1924937 - RNA, 15 nt, Homo sapiens
ggauugacauucuac

SEQ ID NO: 1924938 - RNA, 16 nt, Homo sapiens
ugccauuacacuccag

SEQ ID NO: 1924939 - RNA, 16 nt, Homo sapiens
uagcgauugauugaug

SEQ ID NO: 1924940 - RNA, 15 nt, Homo sapiens
acauucuaauuugca

SEQ ID NO: 1924941 - RNA, 20 nt, Homo sapiens
ugaauagcgaaucaucucaa

SEQ ID NO: 1924942 - RNA, 22 nt, Homo sapiens
ucuagacugucucuguggaaua

SEQ ID NO: 1924943 - RNA, 22 nt, Homo sapiens
aaauucucuuaaucacuacugu

SEQ ID NO: 1924944 - RNA, 15 nt, Homo sapiens
aaguaaaaccacagc

SEQ ID NO: 1924945 - RNA, 14 nt, Homo sapiens
ugaaugcagggaca

SEQ ID NO: 1924946 - RNA, 18 nt, Homo sapiens
gaaccacuacaucuggcu

SEQ ID NO: 1924947 - RNA, 18 nt, Homo sapiens
uuuacauaaagacugugc

SEQ ID NO: 1924948 - RNA, 17 nt, Homo sapiens
cucggccucccaaagug

SEQ ID NO: 1924949 - RNA, 17 nt, Homo sapiens
caucaaaagacuuaaaa

SEQ ID NO: 1924950 - RNA, 21 nt, Homo sapiens
acucagagaaaagagauugag

SEQ ID NO: 1924951 - RNA, 21 nt, Homo sapiens
uacauauguuaauaaacugca

SEQ ID NO: 1924952 - RNA, 16 nt, Homo sapiens
ugaggcugcuuuccaa

SEQ ID NO: 1924953 - RNA, 15 nt, Homo sapiens
gcccaacugcgcaga

SEQ ID NO: 1924954 - RNA, 13 nt, Homo sapiens
cacauuucacugu

SEQ ID NO: 1924955 - RNA, 19 nt, Homo sapiens
aagagccugacuguguuca

SEQ ID NO: 1924956 - RNA, 16 nt, Homo sapiens
gaggaaaaacagggaa

SEQ ID NO: 1924957 - RNA, 20 nt, Homo sapiens
ggccgaaccccccacucccu

SEQ ID NO: 1924958 - RNA, 21 nt, Homo sapiens
uguaacauccggcaaaacuga

SEQ ID NO: 1924959 - RNA, 23 nt, Homo sapiens
ucgcguggaucuacccucuaguu

SEQ ID NO: 1924960 - RNA, 23 nt, Homo sapiens
gaacguggggugagggaucacug

SEQ ID NO: 1924961 - RNA, 13 nt, Homo sapiens
uggauacuaagca

SEQ ID NO: 1924962 - RNA, 20 nt, Homo sapiens
aauguagcuucagucauuaa

SEQ ID NO: 1924963 - RNA, 17 nt, Homo sapiens
aacacggccuacugagc

SEQ ID NO: 1924964 - RNA, 22 nt, Homo sapiens
guacauguuuauuauguucaau

SEQ ID NO: 1924965 - RNA, 12 nt, Homo sapiens
ccccguuuucca

SEQ ID NO: 1924966 - RNA, 16 nt, Homo sapiens
cccauuugggauuuuc

SEQ ID NO: 1924967 - RNA, 13 nt, Homo sapiens
ucuguguuuacag

SEQ ID NO: 1924968 - RNA, 18 nt, Homo sapiens
uguacugaguauugauaa

SEQ ID NO: 1924969 - RNA, 23 nt, Homo sapiens
uggauucaauucgacuucuuucc

SEQ ID NO: 1924970 - RNA, 23 nt, Homo sapiens
ugaauuugagauacaaacauguu

SEQ ID NO: 1924971 - RNA, 21 nt, Homo sapiens
ggcucugccaguccuguccuu

SEQ ID NO: 1924972 - RNA, 21 nt, Homo sapiens
uuauuaaagcaaucuaauuau

SEQ ID NO: 1924973 - RNA, 18 nt, Homo sapiens
uuauuucagagagcaaau

SEQ ID NO: 1924974 - RNA, 23 nt, Homo sapiens
uuaauggguuucccuugcccuuu

SEQ ID NO: 1924975 - RNA, 19 nt, Homo sapiens
aacagguuuuccugaagaa

SEQ ID NO: 1924976 - RNA, 17 nt, Homo sapiens
auccaaauuuauugugc

SEQ ID NO: 1924977 - RNA, 15 nt, Homo sapiens
caaugaucaucucac

SEQ ID NO: 1924978 - RNA, 23 nt, Homo sapiens
cuaucauuuauuuacaucuaugu

SEQ ID NO: 1924979 - RNA, 17 nt, Homo sapiens
auaagaggugcuacuga

SEQ ID NO: 1924980 - RNA, 16 nt, Homo sapiens
uuaaguuuucaugaau

SEQ ID NO: 1924981 - RNA, 15 nt, Homo sapiens
gcagguaaccccaga

SEQ ID NO: 1924982 - RNA, 23 nt, Homo sapiens
ccaaaccuucugacuuugccaaa

SEQ ID NO: 1924983 - RNA, 21 nt, Homo sapiens
caauucccccuuaaacuucca

SEQ ID NO: 1924984 - RNA, 17 nt, Homo sapiens
gagagcccagucucccu

SEQ ID NO: 1924985 - RNA, 19 nt, Homo sapiens
augaaagggaaacugggaa

SEQ ID NO: 1924986 - RNA, 20 nt, Homo sapiens
auguaacaacaauuauuuga

SEQ ID NO: 1924987 - RNA, 22 nt, Homo sapiens
aaagacauuucaaauaacugca

SEQ ID NO: 1924988 - RNA, 18 nt, Homo sapiens
uauaacugugcaaauaca

SEQ ID NO: 1924989 - RNA, 14 nt, Homo sapiens
acaguuuccaguca

SEQ ID NO: 1924990 - RNA, 14 nt, Homo sapiens
aagugcaugauggu

SEQ ID NO: 1924991 - RNA, 17 nt, Homo sapiens
ggagaaguagcuaguag

SEQ ID NO: 1924992 - RNA, 20 nt, Homo sapiens
cagccacaucgccugagauu

SEQ ID NO: 1924993 - RNA, 17 nt, Homo sapiens
guggagaaacuguaguc

SEQ ID NO: 1924994 - RNA, 15 nt, Homo sapiens
uauacaauguuacaa

SEQ ID NO: 1924995 - RNA, 14 nt, Homo sapiens
aacgugugucacca

SEQ ID NO: 1924996 - RNA, 20 nt, Homo sapiens
uccagaaacuuuccauccca

SEQ ID NO: 1924997 - RNA, 21 nt, Homo sapiens
agauugagaaguuacuuucca

SEQ ID NO: 1924998 - RNA, 16 nt, Homo sapiens
cugucuccucugucag

SEQ ID NO: 1924999 - RNA, 14 nt, Homo sapiens
cuaaggaaugaucc

SEQ ID NO: 1925000 - RNA, 17 nt, Homo sapiens
gguaucaggacugugac

SEQ ID NO: 1925001 - RNA, 22 nt, Homo sapiens
aagcugcuaccccuacaucauc

SEQ ID NO: 1925002 - RNA, 18 nt, Homo sapiens
guuccauguucaccaaga

SEQ ID NO: 1925003 - RNA, 15 nt, Homo sapiens
cgccgugcuguaaau

SEQ ID NO: 1925004 - RNA, 17 nt, Homo sapiens
acugauuuuuagcuuua

SEQ ID NO: 1925005 - RNA, 17 nt, Homo sapiens
ccucaaaauuaccaaac

SEQ ID NO: 1925006 - RNA, 23 nt, Homo sapiens
ucucuuccuguuuuguacauaga

SEQ ID NO: 1925007 - RNA, 16 nt, Homo sapiens
aagcuauccaggauuu

SEQ ID NO: 1925008 - RNA, 13 nt, Homo sapiens
cugcuugugaccu

SEQ ID NO: 1925009 - RNA, 18 nt, Homo sapiens
acuuccuauaugcacuua

SEQ ID NO: 1925010 - RNA, 17 nt, Homo sapiens
acgaggaggagugcaug

SEQ ID NO: 1925011 - RNA, 13 nt, Homo sapiens
guaaaaacuaguu

SEQ ID NO: 1925012 - RNA, 16 nt, Homo sapiens
uguaaauccauaguca

SEQ ID NO: 1925013 - RNA, 16 nt, Homo sapiens
gaucuaccugccucag

SEQ ID NO: 1925014 - RNA, 20 nt, Homo sapiens
uguuaucuguguagcaagcu

SEQ ID NO: 1925015 - RNA, 16 nt, Homo sapiens
ugaucccgugugccac

SEQ ID NO: 1925016 - RNA, 21 nt, Homo sapiens
acgccuguauucccacaccag

SEQ ID NO: 1925017 - RNA, 19 nt, Homo sapiens
acacaguguuccagcugcc

SEQ ID NO: 1925018 - RNA, 23 nt, Homo sapiens
gucuuagacuugaaauacuacuu

SEQ ID NO: 1925019 - RNA, 13 nt, Homo sapiens
aaauacacucucu

SEQ ID NO: 1925020 - RNA, 20 nt, Homo sapiens
acuguugcccuucuguccaa

SEQ ID NO: 1925021 - RNA, 15 nt, Homo sapiens
uauaggaacaauucu

SEQ ID NO: 1925022 - RNA, 14 nt, Homo sapiens
ugagucugugccac

SEQ ID NO: 1925023 - RNA, 20 nt, Homo sapiens
auauacaggccucaagggga

SEQ ID NO: 1925024 - RNA, 13 nt, Homo sapiens
cugguccuuccag

SEQ ID NO: 1925025 - RNA, 20 nt, Homo sapiens
uuccuggaggucagcauuug

SEQ ID NO: 1925026 - RNA, 21 nt, Homo sapiens
aacaucuuuuuaaccugcaaa

SEQ ID NO: 1925027 - RNA, 17 nt, Homo sapiens
acuccuaugaucucagg

SEQ ID NO: 1925028 - RNA, 17 nt, Homo sapiens
auguucacauacagacu

SEQ ID NO: 1925029 - RNA, 12 nt, Homo sapiens
auauuaucucau

SEQ ID NO: 1925030 - RNA, 15 nt, Homo sapiens
aacucacucccucac

SEQ ID NO: 1925031 - RNA, 21 nt, Homo sapiens
uccuguaagugcuuaaucaua

SEQ ID NO: 1925032 - RNA, 18 nt, Homo sapiens
ggaguaucauucuuuaca

SEQ ID NO: 1925033 - RNA, 22 nt, Homo sapiens
gcagccccgucugcccaccauu

SEQ ID NO: 1925034 - RNA, 20 nt, Homo sapiens
cauguauugugccaaucugu

SEQ ID NO: 1925035 - RNA, 14 nt, Homo sapiens
uuguagacuguucc

SEQ ID NO: 1925036 - RNA, 17 nt, Homo sapiens
cuuucuagccagaggag

SEQ ID NO: 1925037 - RNA, 12 nt, Homo sapiens
cuccaguguccu

SEQ ID NO: 1925038 - RNA, 20 nt, Homo sapiens
cugaauacauucugcuuuca

SEQ ID NO: 1925039 - RNA, 14 nt, Homo sapiens
caguuuuguugaga

SEQ ID NO: 1925040 - RNA, 19 nt, Homo sapiens
ugacuaaagguuaccuguu

SEQ ID NO: 1925041 - RNA, 14 nt, Homo sapiens
aacagauauuguca

SEQ ID NO: 1925042 - RNA, 13 nt, Homo sapiens
caaucuugcccua

SEQ ID NO: 1925043 - RNA, 19 nt, Homo sapiens
agccccaggccccagcugg

SEQ ID NO: 1925044 - RNA, 14 nt, Homo sapiens
acaguugaacagaa

SEQ ID NO: 1925045 - RNA, 22 nt, Homo sapiens
cccuacugggagaggggccuca

SEQ ID NO: 1925046 - RNA, 16 nt, Homo sapiens
acucagccugcaguua

SEQ ID NO: 1925047 - RNA, 23 nt, Homo sapiens
cugccgccucagcuucucaaagu

SEQ ID NO: 1925048 - RNA, 14 nt, Homo sapiens
uauuuaaguucaua

SEQ ID NO: 1925049 - RNA, 14 nt, Homo sapiens
cauuugagcucaug

SEQ ID NO: 1925050 - RNA, 14 nt, Homo sapiens
cuuugcagcacagc

SEQ ID NO: 1925051 - RNA, 17 nt, Homo sapiens
aguuauggcuucacauu

SEQ ID NO: 1925052 - RNA, 15 nt, Homo sapiens
uuuacagcaagaaca

SEQ ID NO: 1925053 - RNA, 15 nt, Homo sapiens
gcucucugaguccug

SEQ ID NO: 1925054 - RNA, 20 nt, Homo sapiens
acacuuugccuugcuguuua

SEQ ID NO: 1925055 - RNA, 16 nt, Homo sapiens
aaugucaggguucugc

SEQ ID NO: 1925056 - RNA, 19 nt, Homo sapiens
aucucucaagagugcugag

SEQ ID NO: 1925057 - RNA, 22 nt, Homo sapiens
gccacuguguuucugugcucca

SEQ ID NO: 1925058 - RNA, 23 nt, Homo sapiens
ccucacugcuguagacauuugcu

SEQ ID NO: 1925059 - RNA, 18 nt, Homo sapiens
gaucacuacaaguauuau

SEQ ID NO: 1925060 - RNA, 22 nt, Homo sapiens
agguggccccaguucaaucucc

SEQ ID NO: 1925061 - RNA, 22 nt, Homo sapiens
cagacacgcacuucuggggcca

SEQ ID NO: 1925062 - RNA, 20 nt, Homo sapiens
uagaaauucuaacuuaaugu

SEQ ID NO: 1925063 - RNA, 20 nt, Homo sapiens
ugaaguggucugaauucugg

SEQ ID NO: 1925064 - RNA, 19 nt, Homo sapiens
auguccucuuguugcugag

SEQ ID NO: 1925065 - RNA, 13 nt, Homo sapiens
ugagagacugcca

SEQ ID NO: 1925066 - RNA, 14 nt, Homo sapiens
ccagcagugccuug

SEQ ID NO: 1925067 - RNA, 17 nt, Homo sapiens
acaggucacccaucagg

SEQ ID NO: 1925068 - RNA, 16 nt, Homo sapiens
aauuccugcauuugau

SEQ ID NO: 1925069 - RNA, 18 nt, Homo sapiens
cucuacagccucccuggc

SEQ ID NO: 1925070 - RNA, 14 nt, Homo sapiens
uuggacagauuuca

SEQ ID NO: 1925071 - RNA, 21 nt, Homo sapiens
uagauugcaccauugcacucu

SEQ ID NO: 1925072 - RNA, 14 nt, Homo sapiens
uauauaaauaaagc

SEQ ID NO: 1925073 - RNA, 13 nt, Homo sapiens
ugagggucagaga

SEQ ID NO: 1925074 - RNA, 19 nt, Homo sapiens
aaggauagcaccgcuuuug

SEQ ID NO: 1925075 - RNA, 22 nt, Homo sapiens
uggacugguuuucacauuagaa

SEQ ID NO: 1925076 - RNA, 22 nt, Homo sapiens
caacuuccaaauuggauacugc

SEQ ID NO: 1925077 - RNA, 16 nt, Homo sapiens
ugccucugagccacug

SEQ ID NO: 1925078 - RNA, 23 nt, Homo sapiens
cucccacccucuuccuacugguc

SEQ ID NO: 1925079 - RNA, 19 nt, Homo sapiens
ccugguuugcaaagaccac

SEQ ID NO: 1925080 - RNA, 15 nt, Homo sapiens
uucaucaggaccaaa

SEQ ID NO: 1925081 - RNA, 21 nt, Homo sapiens
agcaccguucugugcacaaaa

SEQ ID NO: 1925082 - RNA, 22 nt, Homo sapiens
gccagcagacauugucagcaaa

SEQ ID NO: 1925083 - RNA, 21 nt, Homo sapiens
aauacgaacccaaucugcaca

SEQ ID NO: 1925084 - RNA, 15 nt, Homo sapiens
gaaauaaacauaaga

SEQ ID NO: 1925085 - RNA, 21 nt, Homo sapiens
ucaccuggacuuaagcaucug

SEQ ID NO: 1925086 - RNA, 13 nt, Homo sapiens
ucagcaaccugua

SEQ ID NO: 1925087 - RNA, 21 nt, Homo sapiens
gcuauguuggaaaugugcaac

SEQ ID NO: 1925088 - RNA, 19 nt, Homo sapiens
cugcugcucaaaaugccac

SEQ ID NO: 1925089 - RNA, 22 nt, Homo sapiens
uuuacaucccagacacauucac

SEQ ID NO: 1925090 - RNA, 14 nt, Homo sapiens
accaaaacaugccg

SEQ ID NO: 1925091 - RNA, 17 nt, Homo sapiens
ugaaaaaauaacacugu

SEQ ID NO: 1925092 - RNA, 17 nt, Homo sapiens
augugccgaaugugcag

SEQ ID NO: 1925093 - RNA, 12 nt, Homo sapiens
ccacacuggccg

SEQ ID NO: 1925094 - RNA, 17 nt, Homo sapiens
acuuaugagauaauuaa

SEQ ID NO: 1925095 - RNA, 18 nt, Homo sapiens
auuccaacauuucucacu

SEQ ID NO: 1925096 - RNA, 13 nt, Homo sapiens
cuuaaagcacuga

SEQ ID NO: 1925097 - RNA, 16 nt, Homo sapiens
uuuucuccaccuuaaa

SEQ ID NO: 1925098 - RNA, 19 nt, Homo sapiens
augcaugucugccuaugca

SEQ ID NO: 1925099 - RNA, 19 nt, Homo sapiens
ccaacauuuuuucccagug

SEQ ID NO: 1925100 - RNA, 16 nt, Homo sapiens
cuccuaccucugcucu

SEQ ID NO: 1925101 - RNA, 22 nt, Homo sapiens
cacugccucucggugaccuccg

SEQ ID NO: 1925102 - RNA, 20 nt, Homo sapiens
ccaugugggccccagccauc

SEQ ID NO: 1925103 - RNA, 14 nt, Homo sapiens
ccaaagaaguuuaa

SEQ ID NO: 1925104 - RNA, 13 nt, Homo sapiens
agauaaaucaugg

SEQ ID NO: 1925105 - RNA, 15 nt, Homo sapiens
gcagacaccuggacu

SEQ ID NO: 1925106 - RNA, 15 nt, Homo sapiens
aaaaucauuucugca

SEQ ID NO: 1925107 - RNA, 19 nt, Homo sapiens
cccccaguucgcagugccu

SEQ ID NO: 1925108 - RNA, 22 nt, Homo sapiens
caguaagacagugcagugcuca

SEQ ID NO: 1925109 - RNA, 21 nt, Homo sapiens
auuggcaaacuuuguauuaau

SEQ ID NO: 1925110 - RNA, 13 nt, Homo sapiens
auucauucaguga

SEQ ID NO: 1925111 - RNA, 13 nt, Homo sapiens
auacguucagagg

SEQ ID NO: 1925112 - RNA, 21 nt, Homo sapiens
ccugggcaucuggcccugcug

SEQ ID NO: 1925113 - RNA, 19 nt, Homo sapiens
ugcauguaccauuugcaug

SEQ ID NO: 1925114 - RNA, 13 nt, Homo sapiens
gcaguacuuugug

SEQ ID NO: 1925115 - RNA, 23 nt, Homo sapiens
caguuuuuaaaauuggccuuuua

SEQ ID NO: 1925116 - RNA, 18 nt, Homo sapiens
ggcuguggaccguggaca

SEQ ID NO: 1925117 - RNA, 18 nt, Homo sapiens
agccuagccgaccucagc

SEQ ID NO: 1925118 - RNA, 12 nt, Homo sapiens
acuccucaagac

SEQ ID NO: 1925119 - RNA, 19 nt, Homo sapiens
auuauauacuauguaugga

SEQ ID NO: 1925120 - RNA, 14 nt, Homo sapiens
caucaauucuuaga

SEQ ID NO: 1925121 - RNA, 23 nt, Homo sapiens
cgccuuaugccucagucuauucu

SEQ ID NO: 1925122 - RNA, 12 nt, Homo sapiens
uuucacauugaa

SEQ ID NO: 1925123 - RNA, 18 nt, Homo sapiens
ccaagaguuaaagaccag

SEQ ID NO: 1925124 - RNA, 15 nt, Homo sapiens
agccuccgccugcug

SEQ ID NO: 1925125 - RNA, 19 nt, Homo sapiens
aaucacucauuuauuucca

SEQ ID NO: 1925126 - RNA, 19 nt, Homo sapiens
uaccucacagagugcauug

SEQ ID NO: 1925127 - RNA, 16 nt, Homo sapiens
aggagucaaaacuaca

SEQ ID NO: 1925128 - RNA, 21 nt, Homo sapiens
aaauccacacacccagagcau

SEQ ID NO: 1925129 - RNA, 12 nt, Homo sapiens
ucugauuacaca

SEQ ID NO: 1925130 - RNA, 21 nt, Homo sapiens
uaaaugccuuuauauuucaca

SEQ ID NO: 1925131 - RNA, 20 nt, Homo sapiens
uggggaauuuauccuugacc

SEQ ID NO: 1925132 - RNA, 12 nt, Homo sapiens
ccagaagugccc

SEQ ID NO: 1925133 - RNA, 13 nt, Homo sapiens
aaaaagaccaaga

SEQ ID NO: 1925134 - RNA, 22 nt, Homo sapiens
uggcucgcaaccuccgccuccc

SEQ ID NO: 1925135 - RNA, 16 nt, Homo sapiens
uucaggaacacucuga

SEQ ID NO: 1925136 - RNA, 15 nt, Homo sapiens
gaccuccucccucau

SEQ ID NO: 1925137 - RNA, 17 nt, Homo sapiens
uucauuuucagauucag

SEQ ID NO: 1925138 - RNA, 12 nt, Homo sapiens
cguccaccaggc

SEQ ID NO: 1925139 - RNA, 20 nt, Homo sapiens
ccuguaauauuuagcuguaa

SEQ ID NO: 1925140 - RNA, 15 nt, Homo sapiens
acucaguacuguaca

SEQ ID NO: 1925141 - RNA, 21 nt, Homo sapiens
aauacuaaggaaccaacaauc

SEQ ID NO: 1925142 - RNA, 23 nt, Homo sapiens
cuaugaggaaacugagucacuca

SEQ ID NO: 1925143 - RNA, 17 nt, Homo sapiens
cagaacccagauuuccu

SEQ ID NO: 1925144 - RNA, 19 nt, Homo sapiens
ugcccucgggcgagucacu

SEQ ID NO: 1925145 - RNA, 23 nt, Homo sapiens
uuugccaugacauuucaucuggg

SEQ ID NO: 1925146 - RNA, 17 nt, Homo sapiens
cucuuccuuacucccag

SEQ ID NO: 1925147 - RNA, 17 nt, Homo sapiens
ucaauucagugcuguac

SEQ ID NO: 1925148 - RNA, 20 nt, Homo sapiens
acauaacucuguaaaaacac

SEQ ID NO: 1925149 - RNA, 16 nt, Homo sapiens
agucuccuagacacuc

SEQ ID NO: 1925150 - RNA, 18 nt, Homo sapiens
uagaauagcauuugccac

SEQ ID NO: 1925151 - RNA, 15 nt, Homo sapiens
accuugccacacuga

SEQ ID NO: 1925152 - RNA, 17 nt, Homo sapiens
ccacuguucuguucuca

SEQ ID NO: 1925153 - RNA, 17 nt, Homo sapiens
auagcaucuguacaaag

SEQ ID NO: 1925154 - RNA, 16 nt, Homo sapiens
gaucauagcugacuca

SEQ ID NO: 1925155 - RNA, 16 nt, Homo sapiens
aaaucccaaauucucc

SEQ ID NO: 1925156 - RNA, 16 nt, Homo sapiens
acuuuuccacauucca

SEQ ID NO: 1925157 - RNA, 19 nt, Homo sapiens
ccgucucuggccccucuca

SEQ ID NO: 1925158 - RNA, 18 nt, Homo sapiens
cucaggcgggacagugcu

SEQ ID NO: 1925159 - RNA, 22 nt, Homo sapiens
caggguggggggugacagugcc

SEQ ID NO: 1925160 - RNA, 14 nt, Homo sapiens
acaaagauugagaa

SEQ ID NO: 1925161 - RNA, 17 nt, Homo sapiens
accugggcuggcacugc

SEQ ID NO: 1925162 - RNA, 19 nt, Homo sapiens
acaaaaaauauucaucugu

SEQ ID NO: 1925163 - RNA, 16 nt, Homo sapiens
ucccaugcuggcugaa

SEQ ID NO: 1925164 - RNA, 19 nt, Homo sapiens
cugaaaggugauugcagcu

SEQ ID NO: 1925165 - RNA, 18 nt, Homo sapiens
agcuuaccugacacaaga

SEQ ID NO: 1925166 - RNA, 18 nt, Homo sapiens
cccaggucagcuguuacu

SEQ ID NO: 1925167 - RNA, 16 nt, Homo sapiens
uuuuggacuacauauu

SEQ ID NO: 1925168 - RNA, 21 nt, Homo sapiens
ugcacagaauuuguauguauu

SEQ ID NO: 1925169 - RNA, 18 nt, Homo sapiens
auccaugcgucaguuuuu

SEQ ID NO: 1925170 - RNA, 21 nt, Homo sapiens
uccuggaaacuuagcuuuuga

SEQ ID NO: 1925171 - RNA, 13 nt, Homo sapiens
cuccaguguccug

SEQ ID NO: 1925172 - RNA, 14 nt, Homo sapiens
uucacugcucugcc

SEQ ID NO: 1925173 - RNA, 20 nt, Homo sapiens
guucaaagugugacauucag

SEQ ID NO: 1925174 - RNA, 16 nt, Homo sapiens
auugugacuucacugu

SEQ ID NO: 1925175 - RNA, 13 nt, Homo sapiens
agaaugaauuuau

SEQ ID NO: 1925176 - RNA, 17 nt, Homo sapiens
aaacuaaggcauuugau

SEQ ID NO: 1925177 - RNA, 13 nt, Homo sapiens
uuaggaugugauc

SEQ ID NO: 1925178 - RNA, 18 nt, Homo sapiens
auauacuaaccauuucuu

SEQ ID NO: 1925179 - RNA, 17 nt, Homo sapiens
ccaugggggugcugcag

SEQ ID NO: 1925180 - RNA, 14 nt, Homo sapiens
ccagcuugguucca

SEQ ID NO: 1925181 - RNA, 13 nt, Homo sapiens
ggggcagugugag

SEQ ID NO: 1925182 - RNA, 23 nt, Homo sapiens
gacccccuccaccccccggccac

SEQ ID NO: 1925183 - RNA, 21 nt, Homo sapiens
ugucagagcugggaguagcau

SEQ ID NO: 1925184 - RNA, 20 nt, Homo sapiens
gucccucuucucuccucagu

SEQ ID NO: 1925185 - RNA, 20 nt, Homo sapiens
gcuugccaggcuugucaaau

SEQ ID NO: 1925186 - RNA, 17 nt, Homo sapiens
gccagaacaagugcugg

SEQ ID NO: 1925187 - RNA, 22 nt, Homo sapiens
acaugguacgaauggcagcaua

SEQ ID NO: 1925188 - RNA, 14 nt, Homo sapiens
gccaggacugagcc

SEQ ID NO: 1925189 - RNA, 13 nt, Homo sapiens
ugagacaucuggc

SEQ ID NO: 1925190 - RNA, 19 nt, Homo sapiens
acuugcacgcccaugugug

SEQ ID NO: 1925191 - RNA, 18 nt, Homo sapiens
gagccacaacacccagcc

SEQ ID NO: 1925192 - RNA, 13 nt, Homo sapiens
gaauucaaugggu

SEQ ID NO: 1925193 - RNA, 16 nt, Homo sapiens
ugccucaacauacugu

SEQ ID NO: 1925194 - RNA, 15 nt, Homo sapiens
ugaaggugcaguuga

SEQ ID NO: 1925195 - RNA, 22 nt, Homo sapiens
aggugagaccucaaaucacugc

SEQ ID NO: 1925196 - RNA, 19 nt, Homo sapiens
cauuuucagcaucaaacau

SEQ ID NO: 1925197 - RNA, 14 nt, Homo sapiens
caauuaauguagcu

SEQ ID NO: 1925198 - RNA, 16 nt, Homo sapiens
caaugggcacugggau

SEQ ID NO: 1925199 - RNA, 17 nt, Homo sapiens
cuggaggcugagcugca

SEQ ID NO: 1925200 - RNA, 21 nt, Homo sapiens
uuaaauuucuccaguggauuc

SEQ ID NO: 1925201 - RNA, 14 nt, Homo sapiens
agcugggcaugcca

SEQ ID NO: 1925202 - RNA, 17 nt, Homo sapiens
cagcaaaacgacacugc

SEQ ID NO: 1925203 - RNA, 22 nt, Homo sapiens
aguaguucacauacaaaucauc

SEQ ID NO: 1925204 - RNA, 14 nt, Homo sapiens
agcauuuucauuca

SEQ ID NO: 1925205 - RNA, 22 nt, Homo sapiens
uugcacaugaacauauguccau

SEQ ID NO: 1925206 - RNA, 20 nt, Homo sapiens
ugagaaagccuucauaagcc

SEQ ID NO: 1925207 - RNA, 21 nt, Homo sapiens
ucccaugauuucauguacugc

SEQ ID NO: 1925208 - RNA, 16 nt, Homo sapiens
auauggagcucauguc

SEQ ID NO: 1925209 - RNA, 22 nt, Homo sapiens
uggcaaaucucuauuaggaaau

SEQ ID NO: 1925210 - RNA, 20 nt, Homo sapiens
ucuguccccaaaauguggaa

SEQ ID NO: 1925211 - RNA, 16 nt, Homo sapiens
gacuuguagucuccau

SEQ ID NO: 1925212 - RNA, 19 nt, Homo sapiens
aucaaaccacuguuauuaa

SEQ ID NO: 1925213 - RNA, 22 nt, Homo sapiens
uuucaauggugagaaacauuau

SEQ ID NO: 1925214 - RNA, 16 nt, Homo sapiens
cuucccugccuuuaag

SEQ ID NO: 1925215 - RNA, 15 nt, Homo sapiens
cgggaugucaugucc

SEQ ID NO: 1925216 - RNA, 13 nt, Homo sapiens
auaaucacugacc

SEQ ID NO: 1925217 - RNA, 15 nt, Homo sapiens
cuuccuguccacucu

SEQ ID NO: 1925218 - RNA, 24 nt, Homo sapiens
uccuguuucugaaccauuacugua

SEQ ID NO: 1925219 - RNA, 21 nt, Homo sapiens
gcccagucuggauguggacuu

SEQ ID NO: 1925220 - RNA, 21 nt, Homo sapiens
cugucccgccuuccuccucca

SEQ ID NO: 1925221 - RNA, 15 nt, Homo sapiens
cuccaggaagucuuu

SEQ ID NO: 1925222 - RNA, 22 nt, Homo sapiens
guuggucaugugggucuuccag

SEQ ID NO: 1925223 - RNA, 17 nt, Homo sapiens
gaaguugccaugggaaa

SEQ ID NO: 1925224 - RNA, 23 nt, Homo sapiens
uacuuaagcaaaagucagucuua

SEQ ID NO: 1925225 - RNA, 19 nt, Homo sapiens
auguauaaugggaaauguu

SEQ ID NO: 1925226 - RNA, 21 nt, Homo sapiens
agauugagauguaagucucaa

SEQ ID NO: 1925227 - RNA, 23 nt, Homo sapiens
caaaugcuucuaaauaugaagga

SEQ ID NO: 1925228 - RNA, 22 nt, Homo sapiens
uuuccccuagcuuacugauaaa

SEQ ID NO: 1925229 - RNA, 14 nt, Homo sapiens
caacaggaaggaac

SEQ ID NO: 1925230 - RNA, 16 nt, Homo sapiens
uagaaaauaaggaaca

SEQ ID NO: 1925231 - RNA, 23 nt, Homo sapiens
guaauugcauuucugcucuucca

SEQ ID NO: 1925232 - RNA, 22 nt, Homo sapiens
ugagaguggguaaaucagggac

SEQ ID NO: 1925233 - RNA, 14 nt, Homo sapiens
cacaugggugcaau

SEQ ID NO: 1925234 - RNA, 17 nt, Homo sapiens
ugcccccaccccgggga

SEQ ID NO: 1925235 - RNA, 17 nt, Homo sapiens
cgagggggucagcccaa

SEQ ID NO: 1925236 - RNA, 20 nt, Homo sapiens
agccugcucauguaccucug

SEQ ID NO: 1925237 - RNA, 23 nt, Homo sapiens
ucagucccuauguauuugcaguu

SEQ ID NO: 1925238 - RNA, 16 nt, Homo sapiens
uucagguggccaggaa

SEQ ID NO: 1925239 - RNA, 18 nt, Homo sapiens
cucuaacaaugacauuua

SEQ ID NO: 1925240 - RNA, 14 nt, Homo sapiens
ugacaucacucuag

SEQ ID NO: 1925241 - RNA, 19 nt, Homo sapiens
ugucuaccuuccuccucaa

SEQ ID NO: 1925242 - RNA, 18 nt, Homo sapiens
uucuuuuuuuugagacaa

SEQ ID NO: 1925243 - RNA, 20 nt, Homo sapiens
caccucuugggcaugcucag

SEQ ID NO: 1925244 - RNA, 13 nt, Homo sapiens
aaugcugagguua

SEQ ID NO: 1925245 - RNA, 11 nt, Homo sapiens
gggcuguagac

SEQ ID NO: 1925246 - RNA, 23 nt, Homo sapiens
augucuuuuuacuacaaacuaca

SEQ ID NO: 1925247 - RNA, 14 nt, Homo sapiens
ccugaagcaguuca

SEQ ID NO: 1925248 - RNA, 20 nt, Homo sapiens
ccacucccuggccaucucaa

SEQ ID NO: 1925249 - RNA, 22 nt, Homo sapiens
uaauguagagauaaaagcagua

SEQ ID NO: 1925250 - RNA, 13 nt, Homo sapiens
uuuccaacauaca

SEQ ID NO: 1925251 - RNA, 19 nt, Homo sapiens
acuaagggcgcuuguccca

SEQ ID NO: 1925252 - RNA, 18 nt, Homo sapiens
cccaggccagaagaccuc

SEQ ID NO: 1925253 - RNA, 21 nt, Homo sapiens
uacuuguuucaccauacuuca

SEQ ID NO: 1925254 - RNA, 15 nt, Homo sapiens
guaacauuugccuua

SEQ ID NO: 1925255 - RNA, 15 nt, Homo sapiens
agacaaccacuggga

SEQ ID NO: 1925256 - RNA, 13 nt, Homo sapiens
uuuucaucuucuu

SEQ ID NO: 1925257 - RNA, 18 nt, Homo sapiens
accucuuaugagcuccau

SEQ ID NO: 1925258 - RNA, 17 nt, Homo sapiens
aucauggccagcuggag

SEQ ID NO: 1925259 - RNA, 20 nt, Homo sapiens
guagaauagugguugccaau

SEQ ID NO: 1925260 - RNA, 11 nt, Homo sapiens
ccucuuuggag

SEQ ID NO: 1925261 - RNA, 19 nt, Homo sapiens
caggaguucgagaccagcc

SEQ ID NO: 1925262 - RNA, 16 nt, Homo sapiens
uguaucuuuuuuauaa

SEQ ID NO: 1925263 - RNA, 14 nt, Homo sapiens
aacguaugcaugug

SEQ ID NO: 1925264 - RNA, 19 nt, Homo sapiens
gaaaacuuuguuaggccaa

SEQ ID NO: 1925265 - RNA, 21 nt, Homo sapiens
uucuuugcaguucuucaucau

SEQ ID NO: 1925266 - RNA, 17 nt, Homo sapiens
uuuaauguuugcacuga

SEQ ID NO: 1925267 - RNA, 21 nt, Homo sapiens
gcuccagagagaggaugcaga

SEQ ID NO: 1925268 - RNA, 15 nt, Homo sapiens
aaccugggugucaga

SEQ ID NO: 1925269 - RNA, 22 nt, Homo sapiens
cuuugaggugucucaaucugau

SEQ ID NO: 1925270 - RNA, 17 nt, Homo sapiens
agaaaauaaaagcacuu

SEQ ID NO: 1925271 - RNA, 16 nt, Homo sapiens
acagggacacagucug

SEQ ID NO: 1925272 - RNA, 16 nt, Homo sapiens
cuuuggugcuuuucac

SEQ ID NO: 1925273 - RNA, 15 nt, Homo sapiens
aaacaaauauacuca

SEQ ID NO: 1925274 - RNA, 22 nt, Homo sapiens
gggcaaggugagggaugccaua

SEQ ID NO: 1925275 - RNA, 22 nt, Homo sapiens
uuuugugggggugaagucuugc

SEQ ID NO: 1925276 - RNA, 15 nt, Homo sapiens
ucugugcuggccuga

SEQ ID NO: 1925277 - RNA, 19 nt, Homo sapiens
agaaagauuaaauauaucu

SEQ ID NO: 1925278 - RNA, 14 nt, Homo sapiens
gccucuacuuuauc

SEQ ID NO: 1925279 - RNA, 19 nt, Homo sapiens
gugucccccuaugcuccag

SEQ ID NO: 1925280 - RNA, 19 nt, Homo sapiens
cccaguuucccacucugaa

SEQ ID NO: 1925281 - RNA, 18 nt, Homo sapiens
uagcacuuuauaagccaa

SEQ ID NO: 1925282 - RNA, 13 nt, Homo sapiens
gcagcuggugcuc

SEQ ID NO: 1925283 - RNA, 21 nt, Homo sapiens
ugugauucuauaaaacacauc

SEQ ID NO: 1925284 - RNA, 16 nt, Homo sapiens
cuucuuucccaaaauu

SEQ ID NO: 1925285 - RNA, 19 nt, Homo sapiens
ccacacaaauaggcucugc

SEQ ID NO: 1925286 - RNA, 19 nt, Homo sapiens
cgggugccaugaagugugu

SEQ ID NO: 1925287 - RNA, 14 nt, Homo sapiens
cuauguagucauaa

SEQ ID NO: 1925288 - RNA, 18 nt, Homo sapiens
ucacuugaguuguugcuu

SEQ ID NO: 1925289 - RNA, 19 nt, Homo sapiens
gaguaacauuugcuguuuu

SEQ ID NO: 1925290 - RNA, 17 nt, Homo sapiens
ccucucuccaccugccu

SEQ ID NO: 1925291 - RNA, 13 nt, Homo sapiens
acacccaagcaca

SEQ ID NO: 1925292 - RNA, 12 nt, Homo sapiens
uuuucucaggac

SEQ ID NO: 1925293 - RNA, 18 nt, Homo sapiens
gcagcccccagcucccac

SEQ ID NO: 1925294 - RNA, 14 nt, Homo sapiens
ucagccaagugcag

SEQ ID NO: 1925295 - RNA, 22 nt, Homo sapiens
acuuacaauaccauggguuauu

SEQ ID NO: 1925296 - RNA, 23 nt, Homo sapiens
accagccucaaaaacgcccucaa

SEQ ID NO: 1925297 - RNA, 21 nt, Homo sapiens
ggccuuaucuccaagaccaga

SEQ ID NO: 1925298 - RNA, 19 nt, Homo sapiens
ugggcucagauccugggca

SEQ ID NO: 1925299 - RNA, 14 nt, Homo sapiens
cuguuuacaucucc

SEQ ID NO: 1925300 - RNA, 21 nt, Homo sapiens
ugaggcucugcaguggcaaau

SEQ ID NO: 1925301 - RNA, 19 nt, Homo sapiens
uuccuaaauguauaccugu

SEQ ID NO: 1925302 - RNA, 22 nt, Homo sapiens
cugacacgugauggaccaaagc

SEQ ID NO: 1925303 - RNA, 21 nt, Homo sapiens
gcaaucucauuacuggguaua

SEQ ID NO: 1925304 - RNA, 18 nt, Homo sapiens
agaaaaaguccugucagu

SEQ ID NO: 1925305 - RNA, 13 nt, Homo sapiens
aacuucugaagau

SEQ ID NO: 1925306 - RNA, 13 nt, Homo sapiens
uacuacuguagaa

SEQ ID NO: 1925307 - RNA, 18 nt, Homo sapiens
gaaauguuuguccuugca

SEQ ID NO: 1925308 - RNA, 15 nt, Homo sapiens
cccggaggacaggcu

SEQ ID NO: 1925309 - RNA, 22 nt, Homo sapiens
uaggaaucaacuuaacaaaaca

SEQ ID NO: 1925310 - RNA, 23 nt, Homo sapiens
uguggagccuuuuaacugugcaa

SEQ ID NO: 1925311 - RNA, 19 nt, Homo sapiens
agaaugcauugcaucauca

SEQ ID NO: 1925312 - RNA, 13 nt, Homo sapiens
cucacgauuccag

SEQ ID NO: 1925313 - RNA, 14 nt, Homo sapiens
acaggcccaagaga

SEQ ID NO: 1925314 - RNA, 21 nt, Homo sapiens
aucuacccacuuacuaaccug

SEQ ID NO: 1925315 - RNA, 16 nt, Homo sapiens
aagcaugaagucuuaa

SEQ ID NO: 1925316 - RNA, 23 nt, Homo sapiens
ucacugcacccuggauuugcaua

SEQ ID NO: 1925317 - RNA, 22 nt, Homo sapiens
agacagaguuuucacucuuauu

SEQ ID NO: 1925318 - RNA, 19 nt, Homo sapiens
aauacauuucuacuuuauu

SEQ ID NO: 1925319 - RNA, 17 nt, Homo sapiens
uuuauaugaaaacacuc

SEQ ID NO: 1925320 - RNA, 18 nt, Homo sapiens
caauagguuuguaaaaug

SEQ ID NO: 1925321 - RNA, 16 nt, Homo sapiens
caugcucccagcauuu

SEQ ID NO: 1925322 - RNA, 18 nt, Homo sapiens
uuugcuccaccccacuca

SEQ ID NO: 1925323 - RNA, 16 nt, Homo sapiens
uucccacucugaagau

SEQ ID NO: 1925324 - RNA, 14 nt, Homo sapiens
ucugcucauucuaa

SEQ ID NO: 1925325 - RNA, 17 nt, Homo sapiens
gacagauacuccuccaa

SEQ ID NO: 1925326 - RNA, 19 nt, Homo sapiens
cccucuccucucuuccucc

SEQ ID NO: 1925327 - RNA, 16 nt, Homo sapiens
gaaaugaaugguuuca

SEQ ID NO: 1925328 - RNA, 17 nt, Homo sapiens
cuuauuaaucauacaaa

SEQ ID NO: 1925329 - RNA, 21 nt, Homo sapiens
augcauggugccccaggacca

SEQ ID NO: 1925330 - RNA, 16 nt, Homo sapiens
cagaaauacagauaaa

SEQ ID NO: 1925331 - RNA, 16 nt, Homo sapiens
aauacuuuaacuucca

SEQ ID NO: 1925332 - RNA, 16 nt, Homo sapiens
caauauuaaauacaga

SEQ ID NO: 1925333 - RNA, 21 nt, Homo sapiens
ggaagcuccgcuuucuaccca

SEQ ID NO: 1925334 - RNA, 17 nt, Homo sapiens
ccaaaacuuagacccau

SEQ ID NO: 1925335 - RNA, 16 nt, Homo sapiens
cuggaccuugggccua

SEQ ID NO: 1925336 - RNA, 21 nt, Homo sapiens
aaacagauuacuagaaauauu

SEQ ID NO: 1925337 - RNA, 21 nt, Homo sapiens
ugggcaugguggcucaugccu

SEQ ID NO: 1925338 - RNA, 17 nt, Homo sapiens
auauuggggccaugagu

SEQ ID NO: 1925339 - RNA, 20 nt, Homo sapiens
cugaaugccucaaugugacc

SEQ ID NO: 1925340 - RNA, 19 nt, Homo sapiens
agcaacauucauagucuuu

SEQ ID NO: 1925341 - RNA, 18 nt, Homo sapiens
caaaagcaaagaugcauu

SEQ ID NO: 1925342 - RNA, 13 nt, Homo sapiens
uggaaacagcucg

SEQ ID NO: 1925343 - RNA, 18 nt, Homo sapiens
aacagacguuaccaauua

SEQ ID NO: 1925344 - RNA, 17 nt, Homo sapiens
ucucuuagggacaguca

SEQ ID NO: 1925345 - RNA, 14 nt, Homo sapiens
acuaccugugagca

SEQ ID NO: 1925346 - RNA, 18 nt, Homo sapiens
aacaugcuuauaacauua

SEQ ID NO: 1925347 - RNA, 18 nt, Homo sapiens
aucucuagaugcaaauac

SEQ ID NO: 1925348 - RNA, 14 nt, Homo sapiens
agugaaggugcugg

SEQ ID NO: 1925349 - RNA, 18 nt, Homo sapiens
cauagccauucauuuaca

SEQ ID NO: 1925350 - RNA, 21 nt, Homo sapiens
auggcaugcgccaccaugccc

SEQ ID NO: 1925351 - RNA, 13 nt, Homo sapiens
ucaaaaucuuucc

SEQ ID NO: 1925352 - RNA, 15 nt, Homo sapiens
ccagcccaaccggga

SEQ ID NO: 1925353 - RNA, 14 nt, Homo sapiens
ccacgguaggcuag

SEQ ID NO: 1925354 - RNA, 16 nt, Homo sapiens
aggcagccucuggaau

SEQ ID NO: 1925355 - RNA, 16 nt, Homo sapiens
ugaauuuagucauuau

SEQ ID NO: 1925356 - RNA, 16 nt, Homo sapiens
cacggcuuauaccagg

SEQ ID NO: 1925357 - RNA, 21 nt, Homo sapiens
gcgcaccaaaacuauccugau

SEQ ID NO: 1925358 - RNA, 14 nt, Homo sapiens
ugccccuuugcccg

SEQ ID NO: 1925359 - RNA, 15 nt, Homo sapiens
gcuagggaggaccaa

SEQ ID NO: 1925360 - RNA, 14 nt, Homo sapiens
cuugaaaacugcug

SEQ ID NO: 1925361 - RNA, 17 nt, Homo sapiens
uuguauuugcauaugua

SEQ ID NO: 1925362 - RNA, 18 nt, Homo sapiens
agcagagagggauggguu

SEQ ID NO: 1925363 - RNA, 21 nt, Homo sapiens
ucucaaaacugcacugucaag

SEQ ID NO: 1925364 - RNA, 15 nt, Homo sapiens
ugauuuuuaauaguu

SEQ ID NO: 1925365 - RNA, 17 nt, Homo sapiens
uccuccugacucuucag

SEQ ID NO: 1925366 - RNA, 19 nt, Homo sapiens
aagaggaaaaaaaguaaau

SEQ ID NO: 1925367 - RNA, 13 nt, Homo sapiens
gauccugcacuga

SEQ ID NO: 1925368 - RNA, 19 nt, Homo sapiens
ugacccuccuguccagcag

SEQ ID NO: 1925369 - RNA, 16 nt, Homo sapiens
uacauaaacugucacu

SEQ ID NO: 1925370 - RNA, 22 nt, Homo sapiens
cuaauuucuauuugaucugaua

SEQ ID NO: 1925371 - RNA, 23 nt, Homo sapiens
ggccauuccaacagcucaagucu

SEQ ID NO: 1925372 - RNA, 20 nt, Homo sapiens
aaugucuguauuucauucuu

SEQ ID NO: 1925373 - RNA, 15 nt, Homo sapiens
guuucugccugggca

SEQ ID NO: 1925374 - RNA, 14 nt, Homo sapiens
auaaaugugaacuu

SEQ ID NO: 1925375 - RNA, 16 nt, Homo sapiens
gucucacccacuagga

SEQ ID NO: 1925376 - RNA, 22 nt, Homo sapiens
ggugguuuuauuucaaagggaa

SEQ ID NO: 1925377 - RNA, 16 nt, Homo sapiens
caaauaaacuuacaga

SEQ ID NO: 1925378 - RNA, 18 nt, Homo sapiens
gccacagcagguccucca

SEQ ID NO: 1925379 - RNA, 19 nt, Homo sapiens
gcacugagcaaagcauuga

SEQ ID NO: 1925380 - RNA, 15 nt, Homo sapiens
cagcccgcuuggcca

SEQ ID NO: 1925381 - RNA, 15 nt, Homo sapiens
aaaguaauugacaaa

SEQ ID NO: 1925382 - RNA, 16 nt, Homo sapiens
ugcagaagaaaucaua

SEQ ID NO: 1925383 - RNA, 23 nt, Homo sapiens
cugauuuuaaaagguugacucaa

SEQ ID NO: 1925384 - RNA, 17 nt, Homo sapiens
ccucacgugucucagau

SEQ ID NO: 1925385 - RNA, 12 nt, Homo sapiens
caacugacacag

SEQ ID NO: 1925386 - RNA, 20 nt, Homo sapiens
cuaaagugggaaaguugcau

SEQ ID NO: 1925387 - RNA, 12 nt, Homo sapiens
ggauuaaucucu

SEQ ID NO: 1925388 - RNA, 23 nt, Homo sapiens
caugcacuacugaaauuuacaca

SEQ ID NO: 1925389 - RNA, 16 nt, Homo sapiens
auuccugaugaccaau

SEQ ID NO: 1925390 - RNA, 12 nt, Homo sapiens
uucaaugcauuu

SEQ ID NO: 1925391 - RNA, 19 nt, Homo sapiens
cauucgucuuguuguuauu

SEQ ID NO: 1925392 - RNA, 14 nt, Homo sapiens
gugauauaaacagc

SEQ ID NO: 1925393 - RNA, 15 nt, Homo sapiens
cgcauauagacugua

SEQ ID NO: 1925394 - RNA, 17 nt, Homo sapiens
aguugcucacaugucuu

SEQ ID NO: 1925395 - RNA, 12 nt, Homo sapiens
uuagaaacacca

SEQ ID NO: 1925396 - RNA, 17 nt, Homo sapiens
cuaauguuauuucuuaa

SEQ ID NO: 1925397 - RNA, 16 nt, Homo sapiens
cagccaaaggggagcc

SEQ ID NO: 1925398 - RNA, 20 nt, Homo sapiens
gcccacgcuaguuccaucca

SEQ ID NO: 1925399 - RNA, 22 nt, Homo sapiens
caccaaaaacaaaaaccaaaug

SEQ ID NO: 1925400 - RNA, 14 nt, Homo sapiens
cugagucaccuccu

SEQ ID NO: 1925401 - RNA, 15 nt, Homo sapiens
gugcagucugaucca

SEQ ID NO: 1925402 - RNA, 16 nt, Homo sapiens
gaaacacacacagaca

SEQ ID NO: 1925403 - RNA, 21 nt, Homo sapiens
aagcagaagcauuaacuucuc

SEQ ID NO: 1925404 - RNA, 21 nt, Homo sapiens
gcguagcugggacuacaggug

SEQ ID NO: 1925405 - RNA, 15 nt, Homo sapiens
uggauuccucucugu

SEQ ID NO: 1925406 - RNA, 19 nt, Homo sapiens
guaucaugcuucuacucca

SEQ ID NO: 1925407 - RNA, 16 nt, Homo sapiens
cucauuccaagcacuu

SEQ ID NO: 1925408 - RNA, 21 nt, Homo sapiens
ugccucggggacacuagugac

SEQ ID NO: 1925409 - RNA, 20 nt, Homo sapiens
uauugaggcugcagcaggug

SEQ ID NO: 1925410 - RNA, 21 nt, Homo sapiens
aggagaagcgggaguggcuga

SEQ ID NO: 1925411 - RNA, 14 nt, Homo sapiens
uaauaaauacugca

SEQ ID NO: 1925412 - RNA, 16 nt, Homo sapiens
cuguucuuaacacuuc

SEQ ID NO: 1925413 - RNA, 16 nt, Homo sapiens
aggagggcacuggagc

SEQ ID NO: 1925414 - RNA, 19 nt, Homo sapiens
agaugucaucccauugucu

SEQ ID NO: 1925415 - RNA, 19 nt, Homo sapiens
ucaggaauaugcaucccac

SEQ ID NO: 1925416 - RNA, 20 nt, Homo sapiens
caccaagggaucugccauug

SEQ ID NO: 1925417 - RNA, 18 nt, Homo sapiens
ucacagccacuugggaua

SEQ ID NO: 1925418 - RNA, 18 nt, Homo sapiens
auugccuacaauaaaaag

SEQ ID NO: 1925419 - RNA, 18 nt, Homo sapiens
uggaugcuugaggaauau

SEQ ID NO: 1925420 - RNA, 15 nt, Homo sapiens
uaaaugaacaagaga

SEQ ID NO: 1925421 - RNA, 16 nt, Homo sapiens
cugagagaaggugaaa

SEQ ID NO: 1925422 - RNA, 20 nt, Homo sapiens
caaucuaaagauacaguguc

SEQ ID NO: 1925423 - RNA, 23 nt, Homo sapiens
aaaauguuaugauaaucuuucuc

SEQ ID NO: 1925424 - RNA, 21 nt, Homo sapiens
ucaaggacuccugucuguccu

SEQ ID NO: 1925425 - RNA, 19 nt, Homo sapiens
aauaucaacucugaagcua

SEQ ID NO: 1925426 - RNA, 16 nt, Homo sapiens
cuucaugcauuugcac

SEQ ID NO: 1925427 - RNA, 16 nt, Homo sapiens
aaucaugccauugcac

SEQ ID NO: 1925428 - RNA, 19 nt, Homo sapiens
gaaacaggggcagaguaau

SEQ ID NO: 1925429 - RNA, 17 nt, Homo sapiens
ucagcacccaacugaga

SEQ ID NO: 1925430 - RNA, 14 nt, Homo sapiens
cagccauauggaaa

SEQ ID NO: 1925431 - RNA, 17 nt, Homo sapiens
agaugagucagugccau

SEQ ID NO: 1925432 - RNA, 16 nt, Homo sapiens
cgccacggccuggcug

SEQ ID NO: 1925433 - RNA, 14 nt, Homo sapiens
ccagagcccagcuc

SEQ ID NO: 1925434 - RNA, 15 nt, Homo sapiens
acaauaaaaugucuu

SEQ ID NO: 1925435 - RNA, 19 nt, Homo sapiens
agcccuggcccccugaguu

SEQ ID NO: 1925436 - RNA, 18 nt, Homo sapiens
gaagagguauuacugaca

SEQ ID NO: 1925437 - RNA, 16 nt, Homo sapiens
acuuauuucagauuca

SEQ ID NO: 1925438 - RNA, 16 nt, Homo sapiens
uuuuuauuuugcugca

SEQ ID NO: 1925439 - RNA, 15 nt, Homo sapiens
ugaacuuuaugcugu

SEQ ID NO: 1925440 - RNA, 15 nt, Homo sapiens
cagcacuguaugugu

SEQ ID NO: 1925441 - RNA, 22 nt, Homo sapiens
ggugcgaucuuggcucacugca

SEQ ID NO: 1925442 - RNA, 22 nt, Homo sapiens
ggcgcgaucucggcucacugca

SEQ ID NO: 1925443 - RNA, 16 nt, Homo sapiens
auagaagaacugcaaa

SEQ ID NO: 1925444 - RNA, 21 nt, Homo sapiens
cuacagagagaaaaauugccu

SEQ ID NO: 1925445 - RNA, 16 nt, Homo sapiens
cuaugggacugcagug

SEQ ID NO: 1925446 - RNA, 18 nt, Homo sapiens
cuuaagaaaaugaugcug

SEQ ID NO: 1925447 - RNA, 20 nt, Homo sapiens
gcccuccacccccaccucaa

SEQ ID NO: 1925448 - RNA, 18 nt, Homo sapiens
agaggcucuaauguacaa

SEQ ID NO: 1925449 - RNA, 17 nt, Homo sapiens
uaaggaaaaguaaggga

SEQ ID NO: 1925450 - RNA, 12 nt, Homo sapiens
aauaaaugccac

SEQ ID NO: 1925451 - RNA, 17 nt, Homo sapiens
ucaaacaaacucucuga

SEQ ID NO: 1925452 - RNA, 22 nt, Homo sapiens
acagacucaaugugcucuguaa

SEQ ID NO: 1925453 - RNA, 23 nt, Homo sapiens
acacuugggauugucuuacuguu

SEQ ID NO: 1925454 - RNA, 13 nt, Homo sapiens
acauggauuccac

SEQ ID NO: 1925455 - RNA, 21 nt, Homo sapiens
uggguagcauauccucaauua

SEQ ID NO: 1925456 - RNA, 15 nt, Homo sapiens
ccaccuggacgaaga

SEQ ID NO: 1925457 - RNA, 22 nt, Homo sapiens
ucaccggagcuuucaaagaagg

SEQ ID NO: 1925458 - RNA, 15 nt, Homo sapiens
uaacuugcaaaaagu

SEQ ID NO: 1925459 - RNA, 15 nt, Homo sapiens
uaaauugauuuguua

SEQ ID NO: 1925460 - RNA, 16 nt, Homo sapiens
ugccagggcagggucu

SEQ ID NO: 1925461 - RNA, 22 nt, Homo sapiens
uccgaggcaaagagaaaagcca

SEQ ID NO: 1925462 - RNA, 20 nt, Homo sapiens
cuccuagaagcccucugagc

SEQ ID NO: 1925463 - RNA, 17 nt, Homo sapiens
cacugucaugcugucag

SEQ ID NO: 1925464 - RNA, 23 nt, Homo sapiens
agugcucuuuccaccccaaaggg

SEQ ID NO: 1925465 - RNA, 21 nt, Homo sapiens
auuucaccccacagacacuua

SEQ ID NO: 1925466 - RNA, 16 nt, Homo sapiens
agugccguaacaacug

SEQ ID NO: 1925467 - RNA, 14 nt, Homo sapiens
aauguauguacaau

SEQ ID NO: 1925468 - RNA, 15 nt, Homo sapiens
cuuuguaauaccaga

SEQ ID NO: 1925469 - RNA, 21 nt, Homo sapiens
ugacuauucuugauguaaaau

SEQ ID NO: 1925470 - RNA, 16 nt, Homo sapiens
gacugagaaccgugac

SEQ ID NO: 1925471 - RNA, 23 nt, Homo sapiens
uucaguucccaccaucugauuaa

SEQ ID NO: 1925472 - RNA, 13 nt, Homo sapiens
aacuggaaugccu

SEQ ID NO: 1925473 - RNA, 17 nt, Homo sapiens
guggacuuauucauucc

SEQ ID NO: 1925474 - RNA, 19 nt, Homo sapiens
agccucugggaucugccaa

SEQ ID NO: 1925475 - RNA, 14 nt, Homo sapiens
gacauugucucccg

SEQ ID NO: 1925476 - RNA, 19 nt, Homo sapiens
uacaaguagauccugagaa

SEQ ID NO: 1925477 - RNA, 11 nt, Homo sapiens
ucuauuuagau

SEQ ID NO: 1925478 - RNA, 21 nt, Homo sapiens
ccuaaaccauuuugcagaaau

SEQ ID NO: 1925479 - RNA, 13 nt, Homo sapiens
uacaggugauaac

SEQ ID NO: 1925480 - RNA, 16 nt, Homo sapiens
ucuaacauccuugucu

SEQ ID NO: 1925481 - RNA, 20 nt, Homo sapiens
aauggaggcagagaccucca

SEQ ID NO: 1925482 - RNA, 14 nt, Homo sapiens
cuuuaacagucaaa

SEQ ID NO: 1925483 - RNA, 17 nt, Homo sapiens
ugagggccagggaccca

SEQ ID NO: 1925484 - RNA, 16 nt, Homo sapiens
ucugcgcuguguacaa

SEQ ID NO: 1925485 - RNA, 22 nt, Homo sapiens
gagucaggcaggguuaaacugc

SEQ ID NO: 1925486 - RNA, 21 nt, Homo sapiens
acuaccuuuggcuuaauucca

SEQ ID NO: 1925487 - RNA, 14 nt, Homo sapiens
augugaagcccagc

SEQ ID NO: 1925488 - RNA, 15 nt, Homo sapiens
uuguaugagguuuga

SEQ ID NO: 1925489 - RNA, 14 nt, Homo sapiens
uuauuuuucacucu

SEQ ID NO: 1925490 - RNA, 15 nt, Homo sapiens
aucccaguucuuccu

SEQ ID NO: 1925491 - RNA, 15 nt, Homo sapiens
ggaggcagcucagga

SEQ ID NO: 1925492 - RNA, 18 nt, Homo sapiens
cugagguaacugucauua

SEQ ID NO: 1925493 - RNA, 23 nt, Homo sapiens
gggaagcaguguguacuucuuca

SEQ ID NO: 1925494 - RNA, 22 nt, Homo sapiens
uagcuagaauauccuauacugg

SEQ ID NO: 1925495 - RNA, 13 nt, Homo sapiens
cugcccacuucac

SEQ ID NO: 1925496 - RNA, 18 nt, Homo sapiens
ccacuucacuuucuucaa

SEQ ID NO: 1925497 - RNA, 17 nt, Homo sapiens
acagcucaggaucucuu

SEQ ID NO: 1925498 - RNA, 14 nt, Homo sapiens
gagggagagcaccu

SEQ ID NO: 1925499 - RNA, 21 nt, Homo sapiens
caaugggaagcagacaauaac

SEQ ID NO: 1925500 - RNA, 20 nt, Homo sapiens
aaaacuaugacccauuuaau

SEQ ID NO: 1925501 - RNA, 15 nt, Homo sapiens
cguggccgcugccca

SEQ ID NO: 1925502 - RNA, 22 nt, Homo sapiens
aaauaaggacacaaacuuucaa

SEQ ID NO: 1925503 - RNA, 17 nt, Homo sapiens
cauugucaccucuguga

SEQ ID NO: 1925504 - RNA, 17 nt, Homo sapiens
uccggccccgucucucu

SEQ ID NO: 1925505 - RNA, 18 nt, Homo sapiens
uagauuguuuugccacuu

SEQ ID NO: 1925506 - RNA, 20 nt, Homo sapiens
acaguagggcuuggugaaug

SEQ ID NO: 1925507 - RNA, 11 nt, Homo sapiens
ugcaugggcuc

SEQ ID NO: 1925508 - RNA, 16 nt, Homo sapiens
uuuauauguacauaca

SEQ ID NO: 1925509 - RNA, 20 nt, Homo sapiens
cuaaaauuauguuacuguau

SEQ ID NO: 1925510 - RNA, 21 nt, Homo sapiens
guugcuuuucuaaucuuguua

SEQ ID NO: 1925511 - RNA, 17 nt, Homo sapiens
ugcaaacucagugcaaa

SEQ ID NO: 1925512 - RNA, 13 nt, Homo sapiens
uucccaccaacaa

SEQ ID NO: 1925513 - RNA, 13 nt, Homo sapiens
uaauucagcacuu

SEQ ID NO: 1925514 - RNA, 13 nt, Homo sapiens
uacuacagcaaua

SEQ ID NO: 1925515 - RNA, 17 nt, Homo sapiens
aaugauuuacauaaaag

SEQ ID NO: 1925516 - RNA, 21 nt, Homo sapiens
gcauccauuugaacacauuau

SEQ ID NO: 1925517 - RNA, 23 nt, Homo sapiens
uaacagguguguauguaaaguua

SEQ ID NO: 1925518 - RNA, 13 nt, Homo sapiens
aagaauuuaauga

SEQ ID NO: 1925519 - RNA, 19 nt, Homo sapiens
uacagagcacauuugucag

SEQ ID NO: 1925520 - RNA, 13 nt, Homo sapiens
cauccuucuccag

SEQ ID NO: 1925521 - RNA, 21 nt, Homo sapiens
uucaauggcaccuucauucuc

SEQ ID NO: 1925522 - RNA, 23 nt, Homo sapiens
ugccaggcucucccucucugcac

SEQ ID NO: 1925523 - RNA, 13 nt, Homo sapiens
aggguugccugua

SEQ ID NO: 1925524 - RNA, 21 nt, Homo sapiens
gaauguuaaauaaauuguaua

SEQ ID NO: 1925525 - RNA, 21 nt, Homo sapiens
acuguuuugguuuugcucaca

SEQ ID NO: 1925526 - RNA, 16 nt, Homo sapiens
caauccuaguugucua

SEQ ID NO: 1925527 - RNA, 20 nt, Homo sapiens
ucugucacacuaaacuucuu

SEQ ID NO: 1925528 - RNA, 17 nt, Homo sapiens
cagggaccaagauguca

SEQ ID NO: 1925529 - RNA, 19 nt, Homo sapiens
uggaccucugacagcagca

SEQ ID NO: 1925530 - RNA, 22 nt, Homo sapiens
aacccuggauaagucacuuaaa

SEQ ID NO: 1925531 - RNA, 17 nt, Homo sapiens
cuagaaauagguuaaac

SEQ ID NO: 1925532 - RNA, 21 nt, Homo sapiens
uccccagcagggucuuuucau

SEQ ID NO: 1925533 - RNA, 19 nt, Homo sapiens
ugggccaagucaaagacau

SEQ ID NO: 1925534 - RNA, 21 nt, Homo sapiens
uccucgaauuuuaucugugga

SEQ ID NO: 1925535 - RNA, 21 nt, Homo sapiens
gcuucacaguagagccagcuu

SEQ ID NO: 1925536 - RNA, 17 nt, Homo sapiens
aagugggaaagcauuuu

SEQ ID NO: 1925537 - RNA, 13 nt, Homo sapiens
accauuauaauga

SEQ ID NO: 1925538 - RNA, 22 nt, Homo sapiens
acaguggagagagaaaggcuuc

SEQ ID NO: 1925539 - RNA, 13 nt, Homo sapiens
uaacuagaucucc

SEQ ID NO: 1925540 - RNA, 16 nt, Homo sapiens
accuaaacguauuuca

SEQ ID NO: 1925541 - RNA, 16 nt, Homo sapiens
cauguggauauguuua

SEQ ID NO: 1925542 - RNA, 18 nt, Homo sapiens
aggaguucuccuggagca

SEQ ID NO: 1925543 - RNA, 19 nt, Homo sapiens
caccccucuggcaccuggg

SEQ ID NO: 1925544 - RNA, 20 nt, Homo sapiens
aacccagguggcggagguug

SEQ ID NO: 1925545 - RNA, 19 nt, Homo sapiens
caagaaaggggacccaaga

SEQ ID NO: 1925546 - RNA, 18 nt, Homo sapiens
ccagggcuggacugaggc

SEQ ID NO: 1925547 - RNA, 17 nt, Homo sapiens
cuccugagccacucaga

SEQ ID NO: 1925548 - RNA, 20 nt, Homo sapiens
cacaaaccacaacugacaca

SEQ ID NO: 1925549 - RNA, 18 nt, Homo sapiens
guguccaccuuucaggag

SEQ ID NO: 1925550 - RNA, 19 nt, Homo sapiens
ccacaccgucuuccuucag

SEQ ID NO: 1925551 - RNA, 21 nt, Homo sapiens
acauacaauuugcacuguuac

SEQ ID NO: 1925552 - RNA, 16 nt, Homo sapiens
aaccaaauugcacuga

SEQ ID NO: 1925553 - RNA, 23 nt, Homo sapiens
uccugggaaggccaccucccacu

SEQ ID NO: 1925554 - RNA, 22 nt, Homo sapiens
cuucagcugggucacauccauc

SEQ ID NO: 1925555 - RNA, 17 nt, Homo sapiens
agaaagggaaauugcag

SEQ ID NO: 1925556 - RNA, 23 nt, Homo sapiens
accaugauuaaccacuucagcug

SEQ ID NO: 1925557 - RNA, 18 nt, Homo sapiens
uccaacucuugguauuac

SEQ ID NO: 1925558 - RNA, 19 nt, Homo sapiens
gaagggaauuuauugccuc

SEQ ID NO: 1925559 - RNA, 11 nt, Homo sapiens
aaccacuguac

SEQ ID NO: 1925560 - RNA, 11 nt, Homo sapiens
agacacuguga

SEQ ID NO: 1925561 - RNA, 15 nt, Homo sapiens
gucacuuuacugucc

SEQ ID NO: 1925562 - RNA, 15 nt, Homo sapiens
ugauacauaacuaaa

SEQ ID NO: 1925563 - RNA, 17 nt, Homo sapiens
uauguuuggaauaaagu

SEQ ID NO: 1925564 - RNA, 16 nt, Homo sapiens
gagcauacacacaggu

SEQ ID NO: 1925565 - RNA, 22 nt, Homo sapiens
aaaccagcuuguucugggcuca

SEQ ID NO: 1925566 - RNA, 16 nt, Homo sapiens
uucaacaaauugcccu

SEQ ID NO: 1925567 - RNA, 15 nt, Homo sapiens
aaacaauaugcuccu

SEQ ID NO: 1925568 - RNA, 17 nt, Homo sapiens
ugccaagcagugcacau

SEQ ID NO: 1925569 - RNA, 15 nt, Homo sapiens
agaggagaaggaggg

SEQ ID NO: 1925570 - RNA, 13 nt, Homo sapiens
uuguucuugugaa

SEQ ID NO: 1925571 - RNA, 22 nt, Homo sapiens
aaaauuggucacccuaaggaaa

SEQ ID NO: 1925572 - RNA, 13 nt, Homo sapiens
acuuuagaauuaa

SEQ ID NO: 1925573 - RNA, 16 nt, Homo sapiens
uacaaucuuagugaau

SEQ ID NO: 1925574 - RNA, 23 nt, Homo sapiens
agaacauaaagguaaaacaaaac

SEQ ID NO: 1925575 - RNA, 20 nt, Homo sapiens
agaauguagucagacugaca

SEQ ID NO: 1925576 - RNA, 13 nt, Homo sapiens
ucaucaccaagau

SEQ ID NO: 1925577 - RNA, 12 nt, Homo sapiens
agguccacagac

SEQ ID NO: 1925578 - RNA, 13 nt, Homo sapiens
guugggaauugca

SEQ ID NO: 1925579 - RNA, 21 nt, Homo sapiens
ucgcaaaaugaugugaaagga

SEQ ID NO: 1925580 - RNA, 18 nt, Homo sapiens
gaguuacaacagaagcug

SEQ ID NO: 1925581 - RNA, 21 nt, Homo sapiens
cccugacagggccagugcagu

SEQ ID NO: 1925582 - RNA, 22 nt, Homo sapiens
aacaugugcucgcucugcauga

SEQ ID NO: 1925583 - RNA, 13 nt, Homo sapiens
aagacuacuauac

SEQ ID NO: 1925584 - RNA, 13 nt, Homo sapiens
cccacaguaggca

SEQ ID NO: 1925585 - RNA, 19 nt, Homo sapiens
ucagguccuagggccucug

SEQ ID NO: 1925586 - RNA, 22 nt, Homo sapiens
gugagcagacugcaaaucugcc

SEQ ID NO: 1925587 - RNA, 23 nt, Homo sapiens
gugggggugccgcugucucugag

SEQ ID NO: 1925588 - RNA, 18 nt, Homo sapiens
gucacugcccaccaaagg

SEQ ID NO: 1925589 - RNA, 22 nt, Homo sapiens
aauccuuccauuucuucugcac

SEQ ID NO: 1925590 - RNA, 14 nt, Homo sapiens
cugcuuaauucaaa

SEQ ID NO: 1925591 - RNA, 17 nt, Homo sapiens
agcugucccaccugcac

SEQ ID NO: 1925592 - RNA, 19 nt, Homo sapiens
cgccuggugcugagugcac

SEQ ID NO: 1925593 - RNA, 17 nt, Homo sapiens
uauggguagcacuacua

SEQ ID NO: 1925594 - RNA, 14 nt, Homo sapiens
agauguucaaauau

SEQ ID NO: 1925595 - RNA, 22 nt, Homo sapiens
ugaaggugccacuccagugccc

SEQ ID NO: 1925596 - RNA, 21 nt, Homo sapiens
auugucuuuggugcuuuucac

SEQ ID NO: 1925597 - RNA, 14 nt, Homo sapiens
ccuaaaaugaauuu

SEQ ID NO: 1925598 - RNA, 17 nt, Homo sapiens
agagcagagaauauaac

SEQ ID NO: 1925599 - RNA, 16 nt, Homo sapiens
ggcugucccgugcaug

SEQ ID NO: 1925600 - RNA, 20 nt, Homo sapiens
cuggcccagaugaucacuga

SEQ ID NO: 1925601 - RNA, 13 nt, Homo sapiens
auuaccuaaugaa

SEQ ID NO: 1925602 - RNA, 21 nt, Homo sapiens
agcaugaucuuguuacuguga

SEQ ID NO: 1925603 - RNA, 17 nt, Homo sapiens
auugaugauaacacuua

SEQ ID NO: 1925604 - RNA, 11 nt, Homo sapiens
uugaaugauga

SEQ ID NO: 1925605 - RNA, 21 nt, Homo sapiens
ucucucuggcccucuaccccu

SEQ ID NO: 1925606 - RNA, 23 nt, Homo sapiens
aagcagaggcuaauucaguguca

SEQ ID NO: 1925607 - RNA, 23 nt, Homo sapiens
ugacaaauucuuuuucacacuga

SEQ ID NO: 1925608 - RNA, 18 nt, Homo sapiens
guuucacuaugauuuucu

SEQ ID NO: 1925609 - RNA, 15 nt, Homo sapiens
guccugaagcugcug

SEQ ID NO: 1925610 - RNA, 23 nt, Homo sapiens
uaggccauguuaauuaaacugaa

SEQ ID NO: 1925611 - RNA, 14 nt, Homo sapiens
gagacuccgucuca

SEQ ID NO: 1925612 - RNA, 14 nt, Homo sapiens
aagacuccaucuca

SEQ ID NO: 1925613 - RNA, 17 nt, Homo sapiens
ugauccacccgccucag

SEQ ID NO: 1925614 - RNA, 14 nt, Homo sapiens
aauagcagcacagc

SEQ ID NO: 1925615 - RNA, 23 nt, Homo sapiens
uacagaugguguccugcauguau

SEQ ID NO: 1925616 - RNA, 15 nt, Homo sapiens
uaagauuguaauuca

SEQ ID NO: 1925617 - RNA, 15 nt, Homo sapiens
acugucugacuuaua

SEQ ID NO: 1925618 - RNA, 23 nt, Homo sapiens
gggccaagccaggguuccagaca

SEQ ID NO: 1925619 - RNA, 15 nt, Homo sapiens
ugaacacucuuggua

SEQ ID NO: 1925620 - RNA, 12 nt, Homo sapiens
aaaaaaacuucu

SEQ ID NO: 1925621 - RNA, 17 nt, Homo sapiens
gcagaccaucuccagca

SEQ ID NO: 1925622 - RNA, 23 nt, Homo sapiens
cacuggcugggaguccuuaccuc

SEQ ID NO: 1925623 - RNA, 18 nt, Homo sapiens
uuugaacgugccagcagc

SEQ ID NO: 1925624 - RNA, 24 nt, Homo sapiens
ugguacaucgaggcucuugcucaa

SEQ ID NO: 1925625 - RNA, 19 nt, Homo sapiens
cccugcccccacuugccau

SEQ ID NO: 1925626 - RNA, 15 nt, Homo sapiens
guccccuuuccucua

SEQ ID NO: 1925627 - RNA, 14 nt, Homo sapiens
cagacucucaggug

SEQ ID NO: 1925628 - RNA, 16 nt, Homo sapiens
acagcuucauagagca

SEQ ID NO: 1925629 - RNA, 15 nt, Homo sapiens
gcuacaguacuaugu

SEQ ID NO: 1925630 - RNA, 22 nt, Homo sapiens
cugccccuggcccuccaugaca

SEQ ID NO: 1925631 - RNA, 14 nt, Homo sapiens
ccagugagggcagu

SEQ ID NO: 1925632 - RNA, 16 nt, Homo sapiens
ccccuaaaugggcaag

SEQ ID NO: 1925633 - RNA, 22 nt, Homo sapiens
agguccgcccgaccaggaucag

SEQ ID NO: 1925634 - RNA, 23 nt, Homo sapiens
ucagagcugcugaggacaauguc

SEQ ID NO: 1925635 - RNA, 22 nt, Homo sapiens
gaaaauuaccuuuaaugcaaug

SEQ ID NO: 1925636 - RNA, 17 nt, Homo sapiens
cagccacgaggugcaac

SEQ ID NO: 1925637 - RNA, 12 nt, Homo sapiens
cagauaguguaa

SEQ ID NO: 1925638 - RNA, 15 nt, Homo sapiens
ugcaguucuacucag

SEQ ID NO: 1925639 - RNA, 22 nt, Homo sapiens
uaaccuguuuauauaauuuugc

SEQ ID NO: 1925640 - RNA, 18 nt, Homo sapiens
auccucacgccuuggccu

SEQ ID NO: 1925641 - RNA, 23 nt, Homo sapiens
acgcagucauggaggccaagaac

SEQ ID NO: 1925642 - RNA, 17 nt, Homo sapiens
aucuauauuuguuccca

SEQ ID NO: 1925643 - RNA, 19 nt, Homo sapiens
auacucuugaaauguagaa

SEQ ID NO: 1925644 - RNA, 12 nt, Homo sapiens
cuaaacuuucaa

SEQ ID NO: 1925645 - RNA, 23 nt, Homo sapiens
aaacaaguauauaauuuacuuug

SEQ ID NO: 1925646 - RNA, 14 nt, Homo sapiens
caguuauucuugca

SEQ ID NO: 1925647 - RNA, 20 nt, Homo sapiens
acaggccagguggugggcau

SEQ ID NO: 1925648 - RNA, 16 nt, Homo sapiens
cucuugggaagaccag

SEQ ID NO: 1925649 - RNA, 14 nt, Homo sapiens
acagucugcuccuc

SEQ ID NO: 1925650 - RNA, 13 nt, Homo sapiens
cacuccucggcag

SEQ ID NO: 1925651 - RNA, 19 nt, Homo sapiens
ccucaaaaaucagggccac

SEQ ID NO: 1925652 - RNA, 16 nt, Homo sapiens
uaagcugucugccaca

SEQ ID NO: 1925653 - RNA, 19 nt, Homo sapiens
agaauaugaagacauagcu

SEQ ID NO: 1925654 - RNA, 21 nt, Homo sapiens
acuugaugccaaaaugacuuu

SEQ ID NO: 1925655 - RNA, 21 nt, Homo sapiens
guuuuaagagaagaugugauu

SEQ ID NO: 1925656 - RNA, 18 nt, Homo sapiens
guggucugcugccucagg

SEQ ID NO: 1925657 - RNA, 20 nt, Homo sapiens
ggacccuggaagcagggacu

SEQ ID NO: 1925658 - RNA, 18 nt, Homo sapiens
cauagcagcugcuacuag

SEQ ID NO: 1925659 - RNA, 13 nt, Homo sapiens
cuggagucgggac

SEQ ID NO: 1925660 - RNA, 12 nt, Homo sapiens
cacacaauggau

SEQ ID NO: 1925661 - RNA, 14 nt, Homo sapiens
gcccacugccugcc

SEQ ID NO: 1925662 - RNA, 14 nt, Homo sapiens
cucuccugcaaaag

SEQ ID NO: 1925663 - RNA, 19 nt, Homo sapiens
uugagauguagucuuacuc

SEQ ID NO: 1925664 - RNA, 22 nt, Homo sapiens
agaaggacacuagccugugcac

SEQ ID NO: 1925665 - RNA, 21 nt, Homo sapiens
ccccacaagccaggaccugcu

SEQ ID NO: 1925666 - RNA, 19 nt, Homo sapiens
acuccucuguccaggcacu

SEQ ID NO: 1925667 - RNA, 23 nt, Homo sapiens
uuaauaauaaucuaggcaugaag

SEQ ID NO: 1925668 - RNA, 16 nt, Homo sapiens
ugcagcaaacacucca

SEQ ID NO: 1925669 - RNA, 19 nt, Homo sapiens
uuauugucucugugacuga

SEQ ID NO: 1925670 - RNA, 17 nt, Homo sapiens
caacugauccugcucca

SEQ ID NO: 1925671 - RNA, 13 nt, Homo sapiens
gcucaggugcaag

SEQ ID NO: 1925672 - RNA, 14 nt, Homo sapiens
gugcaccaaggaga

SEQ ID NO: 1925673 - RNA, 17 nt, Homo sapiens
cuccuuccucugaggcu

SEQ ID NO: 1925674 - RNA, 17 nt, Homo sapiens
gaggaagaaaaccagcg

SEQ ID NO: 1925675 - RNA, 23 nt, Homo sapiens
agaaguggguggggacagaccag

SEQ ID NO: 1925676 - RNA, 15 nt, Homo sapiens
guaaacaguucugca

SEQ ID NO: 1925677 - RNA, 13 nt, Homo sapiens
aagugugucuucc

SEQ ID NO: 1925678 - RNA, 20 nt, Homo sapiens
ccuaauuaagggacauguau

SEQ ID NO: 1925679 - RNA, 14 nt, Homo sapiens
cuggaccugaaguu

SEQ ID NO: 1925680 - RNA, 12 nt, Homo sapiens
cugauaccaaag

SEQ ID NO: 1925681 - RNA, 20 nt, Homo sapiens
accuucaugcccuucugauu

SEQ ID NO: 1925682 - RNA, 13 nt, Homo sapiens
ucagcuuaucucu

SEQ ID NO: 1925683 - RNA, 17 nt, Homo sapiens
augagcccuggcuccca

SEQ ID NO: 1925684 - RNA, 17 nt, Homo sapiens
uuccugauggcaggaug

SEQ ID NO: 1925685 - RNA, 16 nt, Homo sapiens
cuggagauggggagaa

SEQ ID NO: 1925686 - RNA, 16 nt, Homo sapiens
cugaaccugggaacca

SEQ ID NO: 1925687 - RNA, 23 nt, Homo sapiens
cuucugauacguguaugagacua

SEQ ID NO: 1925688 - RNA, 16 nt, Homo sapiens
aggaccuuccuuccuc

SEQ ID NO: 1925689 - RNA, 22 nt, Homo sapiens
uuuccccaaguacaaccacacc

SEQ ID NO: 1925690 - RNA, 14 nt, Homo sapiens
gagaaaaagggagg

SEQ ID NO: 1925691 - RNA, 13 nt, Homo sapiens
gaugacauucccu

SEQ ID NO: 1925692 - RNA, 20 nt, Homo sapiens
cauuccuuuuucuucacuua

SEQ ID NO: 1925693 - RNA, 12 nt, Homo sapiens
gaaagauuugau

SEQ ID NO: 1925694 - RNA, 16 nt, Homo sapiens
aaguccagccuagucu

SEQ ID NO: 1925695 - RNA, 13 nt, Homo sapiens
aagucaccaaaau

SEQ ID NO: 1925696 - RNA, 14 nt, Homo sapiens
auugcuugagccca

SEQ ID NO: 1925697 - RNA, 17 nt, Homo sapiens
ccugguuguuguaguaa

SEQ ID NO: 1925698 - RNA, 13 nt, Homo sapiens
aguaaaaacauuu

SEQ ID NO: 1925699 - RNA, 19 nt, Homo sapiens
ugaacguuuucucuucacc

SEQ ID NO: 1925700 - RNA, 20 nt, Homo sapiens
ucaagaucucauccaagcaa

SEQ ID NO: 1925701 - RNA, 14 nt, Homo sapiens
uauaucuucuacau

SEQ ID NO: 1925702 - RNA, 20 nt, Homo sapiens
ggggucuguauauacauuuc

SEQ ID NO: 1925703 - RNA, 17 nt, Homo sapiens
uaaaguaaauacaugca

SEQ ID NO: 1925704 - RNA, 16 nt, Homo sapiens
gcuuucgguacuguaa

SEQ ID NO: 1925705 - RNA, 13 nt, Homo sapiens
ccuuuugcauugc

SEQ ID NO: 1925706 - RNA, 13 nt, Homo sapiens
gaggaacacugca

SEQ ID NO: 1925707 - RNA, 18 nt, Homo sapiens
ucuuucauaaaaacacuc

SEQ ID NO: 1925708 - RNA, 18 nt, Homo sapiens
auuaacuuuaauucucuu

SEQ ID NO: 1925709 - RNA, 22 nt, Homo sapiens
ucugcugucuuuauaaugggau

SEQ ID NO: 1925710 - RNA, 13 nt, Homo sapiens
acucugcaggcag

SEQ ID NO: 1925711 - RNA, 19 nt, Homo sapiens
ccagggacaaaacacugug

SEQ ID NO: 1925712 - RNA, 13 nt, Homo sapiens
aaaaccucacuug

SEQ ID NO: 1925713 - RNA, 14 nt, Homo sapiens
augaucaaggugaa

SEQ ID NO: 1925714 - RNA, 20 nt, Homo sapiens
cccggaauccgagauagggu

SEQ ID NO: 1925715 - RNA, 14 nt, Homo sapiens
ugaggagacuauga

SEQ ID NO: 1925716 - RNA, 14 nt, Homo sapiens
aaccacuuucucag

SEQ ID NO: 1925717 - RNA, 19 nt, Homo sapiens
acaaucacacaacaaauaa

SEQ ID NO: 1925718 - RNA, 19 nt, Homo sapiens
cccuuccugaagaagaucc

SEQ ID NO: 1925719 - RNA, 22 nt, Homo sapiens
ccuuaaaaauauccuugaugua

SEQ ID NO: 1925720 - RNA, 13 nt, Homo sapiens
uugaagggcuuua

SEQ ID NO: 1925721 - RNA, 12 nt, Homo sapiens
acuauuacuggg

SEQ ID NO: 1925722 - RNA, 18 nt, Homo sapiens
ugcagauuauuugcccaa

SEQ ID NO: 1925723 - RNA, 18 nt, Homo sapiens
aggcauuuggcauuuauu

SEQ ID NO: 1925724 - RNA, 18 nt, Homo sapiens
aggcuccaucuccagugg

SEQ ID NO: 1925725 - RNA, 18 nt, Homo sapiens
uuguaccaggaugugcua

SEQ ID NO: 1925726 - RNA, 13 nt, Homo sapiens
gucaugccaaaag

SEQ ID NO: 1925727 - RNA, 18 nt, Homo sapiens
gccgcuggcaacaacagc

SEQ ID NO: 1925728 - RNA, 14 nt, Homo sapiens
uucacacuaagaaa

SEQ ID NO: 1925729 - RNA, 13 nt, Homo sapiens
gauccugcugcuu

SEQ ID NO: 1925730 - RNA, 18 nt, Homo sapiens
auucucaguucucuucac

SEQ ID NO: 1925731 - RNA, 15 nt, Homo sapiens
auugaacacaaacug

SEQ ID NO: 1925732 - RNA, 20 nt, Homo sapiens
uugugcuucuuucuuuggga

SEQ ID NO: 1925733 - RNA, 21 nt, Homo sapiens
agcugagauugcgccacugca

SEQ ID NO: 1925734 - RNA, 22 nt, Homo sapiens
acagcuguaaucccagcacuuu

SEQ ID NO: 1925735 - RNA, 17 nt, Homo sapiens
ucuuuauaaucuacucc

SEQ ID NO: 1925736 - RNA, 20 nt, Homo sapiens
acagguagacaguauauaac

SEQ ID NO: 1925737 - RNA, 17 nt, Homo sapiens
uucauaacagaacaaga

SEQ ID NO: 1925738 - RNA, 19 nt, Homo sapiens
caucacauucccauggugg

SEQ ID NO: 1925739 - RNA, 14 nt, Homo sapiens
ucccugcaaccuga

SEQ ID NO: 1925740 - RNA, 16 nt, Homo sapiens
uacauuaacuugaaaa

SEQ ID NO: 1925741 - RNA, 22 nt, Homo sapiens
ugucaccaagcuaggugcuauu

SEQ ID NO: 1925742 - RNA, 20 nt, Homo sapiens
acaauaaauggccagugcug

SEQ ID NO: 1925743 - RNA, 17 nt, Homo sapiens
ucacaaacaaauggcug

SEQ ID NO: 1925744 - RNA, 22 nt, Homo sapiens
uucuuaaaaguugugauuccag

SEQ ID NO: 1925745 - RNA, 20 nt, Homo sapiens
uggaauuccuuggagccacu

SEQ ID NO: 1925746 - RNA, 21 nt, Homo sapiens
uuaaucccaguacgauuugca

SEQ ID NO: 1925747 - RNA, 13 nt, Homo sapiens
cagcaguuuccag

SEQ ID NO: 1925748 - RNA, 10 nt, Homo sapiens
gcagccucac

SEQ ID NO: 1925749 - RNA, 15 nt, Homo sapiens
gaaaauauauaucua

SEQ ID NO: 1925750 - RNA, 19 nt, Homo sapiens
gaacuuggcacacucucca

SEQ ID NO: 1925751 - RNA, 16 nt, Homo sapiens
cuaauguuuacuauau

SEQ ID NO: 1925752 - RNA, 16 nt, Homo sapiens
aaaauguuuguuaaag

SEQ ID NO: 1925753 - RNA, 16 nt, Homo sapiens
acauaccuaccaguau

SEQ ID NO: 1925754 - RNA, 13 nt, Homo sapiens
uagucucuuuaaa

SEQ ID NO: 1925755 - RNA, 21 nt, Homo sapiens
accccaacacccccaagacag

SEQ ID NO: 1925756 - RNA, 17 nt, Homo sapiens
uauuuuuuauacuguau

SEQ ID NO: 1925757 - RNA, 17 nt, Homo sapiens
ugccuuggggaggacaa

SEQ ID NO: 1925758 - RNA, 15 nt, Homo sapiens
cuuuugagacagagu

SEQ ID NO: 1925759 - RNA, 19 nt, Homo sapiens
uccgaggccccugucucag

SEQ ID NO: 1925760 - RNA, 16 nt, Homo sapiens
ugauaaaacuuauaaa

SEQ ID NO: 1925761 - RNA, 22 nt, Homo sapiens
aauuauucagauguacacccac

SEQ ID NO: 1925762 - RNA, 20 nt, Homo sapiens
cucuacacccacccaaaagu

SEQ ID NO: 1925763 - RNA, 21 nt, Homo sapiens
aggcgcaguggcucaugccug

SEQ ID NO: 1925764 - RNA, 19 nt, Homo sapiens
aagacuguugccacuuaac

SEQ ID NO: 1925765 - RNA, 22 nt, Homo sapiens
cacacacagacuguugucccug

SEQ ID NO: 1925766 - RNA, 14 nt, Homo sapiens
uaaugacauguagc

SEQ ID NO: 1925767 - RNA, 16 nt, Homo sapiens
auccugcaaugggaga

SEQ ID NO: 1925768 - RNA, 16 nt, Homo sapiens
uccacacagugcucaa

SEQ ID NO: 1925769 - RNA, 16 nt, Homo sapiens
ucuggcucugccucag

SEQ ID NO: 1925770 - RNA, 14 nt, Homo sapiens
caccuguggugacc

SEQ ID NO: 1925771 - RNA, 22 nt, Homo sapiens
guugaacauucauucaacagcu

SEQ ID NO: 1925772 - RNA, 16 nt, Homo sapiens
ccaacaguugcuaaac

SEQ ID NO: 1925773 - RNA, 16 nt, Homo sapiens
ugguccccucuauaua

SEQ ID NO: 1925774 - RNA, 16 nt, Homo sapiens
ccucacccgaaucucc

SEQ ID NO: 1925775 - RNA, 13 nt, Homo sapiens
gagaaauggccaa

SEQ ID NO: 1925776 - RNA, 15 nt, Homo sapiens
gugccagcaccugcc

SEQ ID NO: 1925777 - RNA, 12 nt, Homo sapiens
agcugcauauga

SEQ ID NO: 1925778 - RNA, 22 nt, Homo sapiens
gagaagaaaaccucaaguaaua

SEQ ID NO: 1925779 - RNA, 22 nt, Homo sapiens
ucugaaccauauccauguugcu

SEQ ID NO: 1925780 - RNA, 18 nt, Homo sapiens
uccuggagugauaugauc

SEQ ID NO: 1925781 - RNA, 15 nt, Homo sapiens
gcaagaaagcuuccu

SEQ ID NO: 1925782 - RNA, 17 nt, Homo sapiens
gaccacugaauucacuc

SEQ ID NO: 1925783 - RNA, 20 nt, Homo sapiens
augugggaaaaaaagaaauu

SEQ ID NO: 1925784 - RNA, 17 nt, Homo sapiens
aaacggaggccagagag

SEQ ID NO: 1925785 - RNA, 17 nt, Homo sapiens
gcaaaggaaaccaaagg

SEQ ID NO: 1925786 - RNA, 16 nt, Homo sapiens
aauguuaaagggauau

SEQ ID NO: 1925787 - RNA, 19 nt, Homo sapiens
uaaacugauugcuggcaac

SEQ ID NO: 1925788 - RNA, 11 nt, Homo sapiens
accaugaauga

SEQ ID NO: 1925789 - RNA, 20 nt, Homo sapiens
caaagcaccucaagugcaag

SEQ ID NO: 1925790 - RNA, 17 nt, Homo sapiens
guggugaacagaacaaa

SEQ ID NO: 1925791 - RNA, 20 nt, Homo sapiens
gaggaucguggccaacgugg

SEQ ID NO: 1925792 - RNA, 16 nt, Homo sapiens
gcugaagaguuuacug

SEQ ID NO: 1925793 - RNA, 17 nt, Homo sapiens
augaguauaauacauua

SEQ ID NO: 1925794 - RNA, 15 nt, Homo sapiens
aggcuuuacagugua

SEQ ID NO: 1925795 - RNA, 23 nt, Homo sapiens
auuaugccagggcgcacuuucca

SEQ ID NO: 1925796 - RNA, 16 nt, Homo sapiens
uaaauacugcuugacc

SEQ ID NO: 1925797 - RNA, 19 nt, Homo sapiens
ugcuucuuuccucuuaaug

SEQ ID NO: 1925798 - RNA, 19 nt, Homo sapiens
acugggugaggauaacaca

SEQ ID NO: 1925799 - RNA, 20 nt, Homo sapiens
ucaccuugguuuaugagaac

SEQ ID NO: 1925800 - RNA, 16 nt, Homo sapiens
acgcucauuguagaaa

SEQ ID NO: 1925801 - RNA, 19 nt, Homo sapiens
aggggcgaguuccucgcuc

SEQ ID NO: 1925802 - RNA, 14 nt, Homo sapiens
ugcaaaucaacucu

SEQ ID NO: 1925803 - RNA, 20 nt, Homo sapiens
acugaauaaacucaaaacuc

SEQ ID NO: 1925804 - RNA, 23 nt, Homo sapiens
ccuugcaggggccggaguaggag

SEQ ID NO: 1925805 - RNA, 16 nt, Homo sapiens
auauuugguuuggcca

SEQ ID NO: 1925806 - RNA, 14 nt, Homo sapiens
agucaucucaacca

SEQ ID NO: 1925807 - RNA, 18 nt, Homo sapiens
acauggcccgcaguggcu

SEQ ID NO: 1925808 - RNA, 18 nt, Homo sapiens
cuacuuguggaccucacc

SEQ ID NO: 1925809 - RNA, 15 nt, Homo sapiens
gagaaaaaaaggaaa

SEQ ID NO: 1925810 - RNA, 20 nt, Homo sapiens
auuacaccuuuaucucaaga

SEQ ID NO: 1925811 - RNA, 16 nt, Homo sapiens
agaugccagagcaaag

SEQ ID NO: 1925812 - RNA, 13 nt, Homo sapiens
aaguugcucugua

SEQ ID NO: 1925813 - RNA, 21 nt, Homo sapiens
uuuaagguacugaagcuuuau

SEQ ID NO: 1925814 - RNA, 21 nt, Homo sapiens
ccagugauccucaaacacaca

SEQ ID NO: 1925815 - RNA, 16 nt, Homo sapiens
uuuaauuacaauggaa

SEQ ID NO: 1925816 - RNA, 20 nt, Homo sapiens
acuaacaggagaaugcacag

SEQ ID NO: 1925817 - RNA, 23 nt, Homo sapiens
uccagagauguaugagagcauuu

SEQ ID NO: 1925818 - RNA, 15 nt, Homo sapiens
aaaugcucacacucc

SEQ ID NO: 1925819 - RNA, 22 nt, Homo sapiens
uuaaaucucagagguagcagua

SEQ ID NO: 1925820 - RNA, 12 nt, Homo sapiens
aaaaaacuaauu

SEQ ID NO: 1925821 - RNA, 21 nt, Homo sapiens
ugcucagcgcuuaaaaaaaca

SEQ ID NO: 1925822 - RNA, 23 nt, Homo sapiens
accugugugagagaauuuaucac

SEQ ID NO: 1925823 - RNA, 12 nt, Homo sapiens
uucaauuuacag

SEQ ID NO: 1925824 - RNA, 16 nt, Homo sapiens
gggucugugaauuucu

SEQ ID NO: 1925825 - RNA, 21 nt, Homo sapiens
ugcauaaaguaaguaaggugc

SEQ ID NO: 1925826 - RNA, 17 nt, Homo sapiens
caggaaaacugggacau

SEQ ID NO: 1925827 - RNA, 20 nt, Homo sapiens
ugccagugcuaaacuacuga

SEQ ID NO: 1925828 - RNA, 22 nt, Homo sapiens
acacacauaccuucaugugguu

SEQ ID NO: 1925829 - RNA, 23 nt, Homo sapiens
agagcuucucacagcaaaccucu

SEQ ID NO: 1925830 - RNA, 14 nt, Homo sapiens
acacacacaccucu

SEQ ID NO: 1925831 - RNA, 15 nt, Homo sapiens
acuucuuguucaaaa

SEQ ID NO: 1925832 - RNA, 18 nt, Homo sapiens
ucgugggaaaggggagua

SEQ ID NO: 1925833 - RNA, 14 nt, Homo sapiens
aguuauguguuaaa

SEQ ID NO: 1925834 - RNA, 14 nt, Homo sapiens
agauaaguguaaau

SEQ ID NO: 1925835 - RNA, 20 nt, Homo sapiens
cuuuaguucugcugucuccc

SEQ ID NO: 1925836 - RNA, 23 nt, Homo sapiens
cauauuuaacaaaauuugaauag

SEQ ID NO: 1925837 - RNA, 17 nt, Homo sapiens
uugugagagccugugau

SEQ ID NO: 1925838 - RNA, 23 nt, Homo sapiens
aguuguuggcaagguagcaauac

SEQ ID NO: 1925839 - RNA, 20 nt, Homo sapiens
gccacccaggaacuccugac

SEQ ID NO: 1925840 - RNA, 20 nt, Homo sapiens
gcuccaucgcugucaucuca

SEQ ID NO: 1925841 - RNA, 13 nt, Homo sapiens
ugcacagugauau

SEQ ID NO: 1925842 - RNA, 20 nt, Homo sapiens
aguauuuacauacagcuuau

SEQ ID NO: 1925843 - RNA, 19 nt, Homo sapiens
caagucugaguaguuauga

SEQ ID NO: 1925844 - RNA, 14 nt, Homo sapiens
aggagaucaucuga

SEQ ID NO: 1925845 - RNA, 13 nt, Homo sapiens
caccuucaaaagc

SEQ ID NO: 1925846 - RNA, 13 nt, Homo sapiens
cugcccucugcau

SEQ ID NO: 1925847 - RNA, 14 nt, Homo sapiens
ccugaagaaccagu

SEQ ID NO: 1925848 - RNA, 23 nt, Homo sapiens
aaccuuaaaggccgucauuucau

SEQ ID NO: 1925849 - RNA, 14 nt, Homo sapiens
aauuugaaauuuag

SEQ ID NO: 1925850 - RNA, 14 nt, Homo sapiens
cucaagaacacaug

SEQ ID NO: 1925851 - RNA, 17 nt, Homo sapiens
auacuugcaguugugau

SEQ ID NO: 1925852 - RNA, 20 nt, Homo sapiens
ccuguaauaaagcucuuuaa

SEQ ID NO: 1925853 - RNA, 19 nt, Homo sapiens
gccacuaccccugaugaga

SEQ ID NO: 1925854 - RNA, 15 nt, Homo sapiens
gucacucacacuggc

SEQ ID NO: 1925855 - RNA, 16 nt, Homo sapiens
cauuuaacuggagcuc

SEQ ID NO: 1925856 - RNA, 21 nt, Homo sapiens
uaaguaaagucaacauaugca

SEQ ID NO: 1925857 - RNA, 16 nt, Homo sapiens
ccacacucugacgcaa

SEQ ID NO: 1925858 - RNA, 21 nt, Homo sapiens
acugugcuggagccacuaacu

SEQ ID NO: 1925859 - RNA, 12 nt, Homo sapiens
agagacuggcca

SEQ ID NO: 1925860 - RNA, 15 nt, Homo sapiens
ugcuccuacauccag

SEQ ID NO: 1925861 - RNA, 19 nt, Homo sapiens
cacaaaccacaacugacac

SEQ ID NO: 1925862 - RNA, 17 nt, Homo sapiens
agaaaaaggaugcacag

SEQ ID NO: 1925863 - RNA, 18 nt, Homo sapiens
aguggggagacaccucag

SEQ ID NO: 1925864 - RNA, 12 nt, Homo sapiens
aucuuccuuccu

SEQ ID NO: 1925865 - RNA, 16 nt, Homo sapiens
agcccagaagugcaga

SEQ ID NO: 1925866 - RNA, 16 nt, Homo sapiens
acuccagaaccgcaga

SEQ ID NO: 1925867 - RNA, 16 nt, Homo sapiens
gcccugaggcugugag

SEQ ID NO: 1925868 - RNA, 18 nt, Homo sapiens
cucuaauaaauuugacug

SEQ ID NO: 1925869 - RNA, 19 nt, Homo sapiens
cuaggcucugggugcagua

SEQ ID NO: 1925870 - RNA, 18 nt, Homo sapiens
ggacauuuggcugugaug

SEQ ID NO: 1925871 - RNA, 19 nt, Homo sapiens
gccuucauuugcaauucau

SEQ ID NO: 1925872 - RNA, 21 nt, Homo sapiens
auaaggacagcagcuggugcc

SEQ ID NO: 1925873 - RNA, 20 nt, Homo sapiens
aaauaauccaaauccaucaa

SEQ ID NO: 1925874 - RNA, 21 nt, Homo sapiens
ugcucugcaggcagccuugcc

SEQ ID NO: 1925875 - RNA, 16 nt, Homo sapiens
aaauagccaacaccca

SEQ ID NO: 1925876 - RNA, 15 nt, Homo sapiens
gccuggugugguggc

SEQ ID NO: 1925877 - RNA, 17 nt, Homo sapiens
acuuuucaccaaugagc

SEQ ID NO: 1925878 - RNA, 19 nt, Homo sapiens
acaaaguuggugccaagcu

SEQ ID NO: 1925879 - RNA, 20 nt, Homo sapiens
ugagccaaacacacuguaaa

SEQ ID NO: 1925880 - RNA, 22 nt, Homo sapiens
ggggcugucaccacgugcagua

SEQ ID NO: 1925881 - RNA, 19 nt, Homo sapiens
gaacaugacccagccugaa

SEQ ID NO: 1925882 - RNA, 16 nt, Homo sapiens
auucuucacucaggac

SEQ ID NO: 1925883 - RNA, 22 nt, Homo sapiens
aaugcuaucacugucuuugacu

SEQ ID NO: 1925884 - RNA, 22 nt, Homo sapiens
cagccacaguguuaugcucugu

SEQ ID NO: 1925885 - RNA, 19 nt, Homo sapiens
aagaaaauuaggccucaaa

SEQ ID NO: 1925886 - RNA, 21 nt, Homo sapiens
gauucuaugaggcaaccacag

SEQ ID NO: 1925887 - RNA, 21 nt, Homo sapiens
ccuaguuguucagcauggcau

SEQ ID NO: 1925888 - RNA, 23 nt, Homo sapiens
aaaacagcucuguugaaucacag

SEQ ID NO: 1925889 - RNA, 14 nt, Homo sapiens
auggugaagucaca

SEQ ID NO: 1925890 - RNA, 22 nt, Homo sapiens
aucagggauccaauaugacuca

SEQ ID NO: 1925891 - RNA, 15 nt, Homo sapiens
aauugaaagaacuua

SEQ ID NO: 1925892 - RNA, 18 nt, Homo sapiens
gcauuaccacacucagcu

SEQ ID NO: 1925893 - RNA, 11 nt, Homo sapiens
ccccucaaaaa

SEQ ID NO: 1925894 - RNA, 19 nt, Homo sapiens
aaauaaaaaacauauacaa

SEQ ID NO: 1925895 - RNA, 19 nt, Homo sapiens
cacaggcagugcaugugaa

SEQ ID NO: 1925896 - RNA, 13 nt, Homo sapiens
gcaccaucucuga

SEQ ID NO: 1925897 - RNA, 18 nt, Homo sapiens
agugcuugcaagauucca

SEQ ID NO: 1925898 - RNA, 13 nt, Homo sapiens
augugacaccuaa

SEQ ID NO: 1925899 - RNA, 16 nt, Homo sapiens
uaaauuacguaugcaa

SEQ ID NO: 1925900 - RNA, 17 nt, Homo sapiens
ugcagccucgaccuccc

SEQ ID NO: 1925901 - RNA, 21 nt, Homo sapiens
acuacaagacaauuguugaaa

SEQ ID NO: 1925902 - RNA, 21 nt, Homo sapiens
accccagccuccugccuaccc

SEQ ID NO: 1925903 - RNA, 17 nt, Homo sapiens
aagaaucuaaacuuuau

SEQ ID NO: 1925904 - RNA, 17 nt, Homo sapiens
caaguacuguaacugug

SEQ ID NO: 1925905 - RNA, 16 nt, Homo sapiens
cagggcagaaccaaga

SEQ ID NO: 1925906 - RNA, 21 nt, Homo sapiens
augguuucaauaaaccuaaua

SEQ ID NO: 1925907 - RNA, 18 nt, Homo sapiens
ggaacccagacucagaca

SEQ ID NO: 1925908 - RNA, 21 nt, Homo sapiens
cucuguuuuacaaguuggagu

SEQ ID NO: 1925909 - RNA, 16 nt, Homo sapiens
gugccagccacgagac

SEQ ID NO: 1925910 - RNA, 14 nt, Homo sapiens
auauauuguucaaa

SEQ ID NO: 1925911 - RNA, 18 nt, Homo sapiens
auggagggagccaucccu

SEQ ID NO: 1925912 - RNA, 15 nt, Homo sapiens
aaacauccucuucca

SEQ ID NO: 1925913 - RNA, 14 nt, Homo sapiens
cagugugacaucua

SEQ ID NO: 1925914 - RNA, 13 nt, Homo sapiens
aacauuguacaag

SEQ ID NO: 1925915 - RNA, 13 nt, Homo sapiens
gaaugugugccuu

SEQ ID NO: 1925916 - RNA, 15 nt, Homo sapiens
caacaacaauaauaa

SEQ ID NO: 1925917 - RNA, 14 nt, Homo sapiens
gaguauagcucugu

SEQ ID NO: 1925918 - RNA, 18 nt, Homo sapiens
cugauacuagacuagaca

SEQ ID NO: 1925919 - RNA, 21 nt, Homo sapiens
uugaauauuagcauugccaau

SEQ ID NO: 1925920 - RNA, 22 nt, Homo sapiens
augaaaacauagcaucucagga

SEQ ID NO: 1925921 - RNA, 20 nt, Homo sapiens
ucuuuuggggucaucuuuga

SEQ ID NO: 1925922 - RNA, 13 nt, Homo sapiens
cgccuugcugaga

SEQ ID NO: 1925923 - RNA, 21 nt, Homo sapiens
acacacgugagccacagggcu

SEQ ID NO: 1925924 - RNA, 14 nt, Homo sapiens
ugcuaugacaugca

SEQ ID NO: 1925925 - RNA, 20 nt, Homo sapiens
uaaacuuggaaccuuggaaa

SEQ ID NO: 1925926 - RNA, 14 nt, Homo sapiens
ccaagaacugcaga

SEQ ID NO: 1925927 - RNA, 23 nt, Homo sapiens
gauucaauaaaaugcacugacca

SEQ ID NO: 1925928 - RNA, 18 nt, Homo sapiens
ugucccugaagugccagc

SEQ ID NO: 1925929 - RNA, 16 nt, Homo sapiens
cugcgauggugcugca

SEQ ID NO: 1925930 - RNA, 16 nt, Homo sapiens
caaguauuaagcaguu

SEQ ID NO: 1925931 - RNA, 16 nt, Homo sapiens
cagagggucccuaggu

SEQ ID NO: 1925932 - RNA, 20 nt, Homo sapiens
ugcagucagaagaucuuucu

SEQ ID NO: 1925933 - RNA, 15 nt, Homo sapiens
uccuaaggccacugu

SEQ ID NO: 1925934 - RNA, 12 nt, Homo sapiens
ucaacuuugaca

SEQ ID NO: 1925935 - RNA, 18 nt, Homo sapiens
ugucuagggcagaguaug

SEQ ID NO: 1925936 - RNA, 15 nt, Homo sapiens
acagcauuaacuguc

SEQ ID NO: 1925937 - RNA, 23 nt, Homo sapiens
guauuccauuucuggacaugacg

SEQ ID NO: 1925938 - RNA, 15 nt, Homo sapiens
cccugcucauccacu

SEQ ID NO: 1925939 - RNA, 15 nt, Homo sapiens
cccucagacaguuug

SEQ ID NO: 1925940 - RNA, 17 nt, Homo sapiens
accuacugacugaugac

SEQ ID NO: 1925941 - RNA, 23 nt, Homo sapiens
uuggcucccgggggccccaccuc

SEQ ID NO: 1925942 - RNA, 22 nt, Homo sapiens
ccacaaggggauuuugcugaug

SEQ ID NO: 1925943 - RNA, 17 nt, Homo sapiens
gcagaacuucccuccau

SEQ ID NO: 1925944 - RNA, 12 nt, Homo sapiens
cugcccccggcc

SEQ ID NO: 1925945 - RNA, 20 nt, Homo sapiens
guaugucagugucacuggau

SEQ ID NO: 1925946 - RNA, 20 nt, Homo sapiens
aacccucagggcaaagccag

SEQ ID NO: 1925947 - RNA, 11 nt, Homo sapiens
ggaaagcaaau

SEQ ID NO: 1925948 - RNA, 22 nt, Homo sapiens
aaucaaauacauacaaccuaug

SEQ ID NO: 1925949 - RNA, 21 nt, Homo sapiens
aaauuaccaaaugcuucuaaa

SEQ ID NO: 1925950 - RNA, 16 nt, Homo sapiens
ccacacuugugccagc

SEQ ID NO: 1925951 - RNA, 14 nt, Homo sapiens
agaaaucuauucca

SEQ ID NO: 1925952 - RNA, 22 nt, Homo sapiens
caaagccccuggaaaugugcua

SEQ ID NO: 1925953 - RNA, 13 nt, Homo sapiens
gccaccucaccaa

SEQ ID NO: 1925954 - RNA, 20 nt, Homo sapiens
caugguuuuugcucuacuuu

SEQ ID NO: 1925955 - RNA, 19 nt, Homo sapiens
ccgacucuuugauaugcca

SEQ ID NO: 1925956 - RNA, 19 nt, Homo sapiens
ugccaagacucuaugcucu

SEQ ID NO: 1925957 - RNA, 17 nt, Homo sapiens
uggagagugcacaugcc

SEQ ID NO: 1925958 - RNA, 17 nt, Homo sapiens
acauuauuaaucauucc

SEQ ID NO: 1925959 - RNA, 13 nt, Homo sapiens
aggucuccgggga

SEQ ID NO: 1925960 - RNA, 16 nt, Homo sapiens
ugugauuagaucacau

SEQ ID NO: 1925961 - RNA, 19 nt, Homo sapiens
ccaccugcuggagugaagg

SEQ ID NO: 1925962 - RNA, 21 nt, Homo sapiens
ccuguuaagucugagaaggcu

SEQ ID NO: 1925963 - RNA, 16 nt, Homo sapiens
gcccucggucacugag

SEQ ID NO: 1925964 - RNA, 23 nt, Homo sapiens
uuuaauuuagugaucuuagcaua

SEQ ID NO: 1925965 - RNA, 22 nt, Homo sapiens
ucugccuuugugcucuguuccu

SEQ ID NO: 1925966 - RNA, 21 nt, Homo sapiens
ugcugccauauuguagcucaa

SEQ ID NO: 1925967 - RNA, 11 nt, Homo sapiens
agauucacuuc

SEQ ID NO: 1925968 - RNA, 14 nt, Homo sapiens
agagagagagccuu

SEQ ID NO: 1925969 - RNA, 17 nt, Homo sapiens
ggugcuucucagauuuc

SEQ ID NO: 1925970 - RNA, 20 nt, Homo sapiens
ugugaagcccuguugugcca

SEQ ID NO: 1925971 - RNA, 12 nt, Homo sapiens
ugcaaaccucag

SEQ ID NO: 1925972 - RNA, 14 nt, Homo sapiens
auaaccacuccuaa

SEQ ID NO: 1925973 - RNA, 23 nt, Homo sapiens
ccuucaaauaaagaaauuuggua

SEQ ID NO: 1925974 - RNA, 22 nt, Homo sapiens
uucaacgucccccgcucaggug

SEQ ID NO: 1925975 - RNA, 17 nt, Homo sapiens
uaaugaacuaacugaca

SEQ ID NO: 1925976 - RNA, 13 nt, Homo sapiens
gaagcaugaguua

SEQ ID NO: 1925977 - RNA, 16 nt, Homo sapiens
auaccuugauugggga

SEQ ID NO: 1925978 - RNA, 20 nt, Homo sapiens
uuuugucuguguugcuguuu

SEQ ID NO: 1925979 - RNA, 17 nt, Homo sapiens
cauuaaccagggcacca

SEQ ID NO: 1925980 - RNA, 15 nt, Homo sapiens
uggagcaucaagcca

SEQ ID NO: 1925981 - RNA, 18 nt, Homo sapiens
cugccacuguguacugug

SEQ ID NO: 1925982 - RNA, 14 nt, Homo sapiens
caauaucaauaugg

SEQ ID NO: 1925983 - RNA, 18 nt, Homo sapiens
uagguuaacauuuguaau

SEQ ID NO: 1925984 - RNA, 15 nt, Homo sapiens
uauuugaugguggua

SEQ ID NO: 1925985 - RNA, 18 nt, Homo sapiens
agccccuccucccucaga

SEQ ID NO: 1925986 - RNA, 22 nt, Homo sapiens
cgucaguaguuugagaccagcc

SEQ ID NO: 1925987 - RNA, 16 nt, Homo sapiens
auuuuugcucuauggg

SEQ ID NO: 1925988 - RNA, 19 nt, Homo sapiens
caaaggguacuuccacuga

SEQ ID NO: 1925989 - RNA, 17 nt, Homo sapiens
ggagauaaucuagaaca

SEQ ID NO: 1925990 - RNA, 15 nt, Homo sapiens
uugucagaauccacu

SEQ ID NO: 1925991 - RNA, 20 nt, Homo sapiens
ccuuccaaccccuuuccacg

SEQ ID NO: 1925992 - RNA, 16 nt, Homo sapiens
uucaccaucccaaagc

SEQ ID NO: 1925993 - RNA, 22 nt, Homo sapiens
uauaacuuuugguaucuacuuc

SEQ ID NO: 1925994 - RNA, 21 nt, Homo sapiens
cgguccaagccugcaacucau

SEQ ID NO: 1925995 - RNA, 12 nt, Homo sapiens
gcacucucaggu

SEQ ID NO: 1925996 - RNA, 19 nt, Homo sapiens
acacauuaauaaacaaucu

SEQ ID NO: 1925997 - RNA, 19 nt, Homo sapiens
uuccaacguggcccagaga

SEQ ID NO: 1925998 - RNA, 14 nt, Homo sapiens
ugcugucagcucag

SEQ ID NO: 1925999 - RNA, 14 nt, Homo sapiens
auauuucccauuug

SEQ ID NO: 1926000 - RNA, 21 nt, Homo sapiens
gaaauggaugcaaaguacaau

SEQ ID NO: 1926001 - RNA, 20 nt, Homo sapiens
ugcuguccgugcuugcuggu

SEQ ID NO: 1926002 - RNA, 17 nt, Homo sapiens
uggcagcgcggggagcc

SEQ ID NO: 1926003 - RNA, 16 nt, Homo sapiens
ggacagcgccaccucu

SEQ ID NO: 1926004 - RNA, 18 nt, Homo sapiens
uguucuuggcucaccuga

SEQ ID NO: 1926005 - RNA, 21 nt, Homo sapiens
agagaaagugacaugcauuca

SEQ ID NO: 1926006 - RNA, 19 nt, Homo sapiens
agagcuguugaugggauga

SEQ ID NO: 1926007 - RNA, 21 nt, Homo sapiens
cccaaguaagaggcuggaguu

SEQ ID NO: 1926008 - RNA, 17 nt, Homo sapiens
agucacuggcaucucac

SEQ ID NO: 1926009 - RNA, 16 nt, Homo sapiens
acuauuuaaagaaaua

SEQ ID NO: 1926010 - RNA, 21 nt, Homo sapiens
uuuaacuucugccuguggaac

SEQ ID NO: 1926011 - RNA, 13 nt, Homo sapiens
uccuccaucccaa

SEQ ID NO: 1926012 - RNA, 12 nt, Homo sapiens
uugcugccacau

SEQ ID NO: 1926013 - RNA, 15 nt, Homo sapiens
ucaaacccagucuca

SEQ ID NO: 1926014 - RNA, 21 nt, Homo sapiens
gaaguagugugaguguuagaa

SEQ ID NO: 1926015 - RNA, 21 nt, Homo sapiens
aacagcaugggccucaccucc

SEQ ID NO: 1926016 - RNA, 20 nt, Homo sapiens
uuuagaugguuacacuguua

SEQ ID NO: 1926017 - RNA, 18 nt, Homo sapiens
caacugucucucuucuca

SEQ ID NO: 1926018 - RNA, 14 nt, Homo sapiens
cucacuaauucauu

SEQ ID NO: 1926019 - RNA, 14 nt, Homo sapiens
uauuuguuucauua

SEQ ID NO: 1926020 - RNA, 14 nt, Homo sapiens
caaaaguuccuaaa

SEQ ID NO: 1926021 - RNA, 22 nt, Homo sapiens
auuuuuauucaaacuaccuaua

SEQ ID NO: 1926022 - RNA, 20 nt, Homo sapiens
ucagguuguaguaaagaaau

SEQ ID NO: 1926023 - RNA, 12 nt, Homo sapiens
guacaaaaccac

SEQ ID NO: 1926024 - RNA, 12 nt, Homo sapiens
aguccccugaaa

SEQ ID NO: 1926025 - RNA, 17 nt, Homo sapiens
cagcuccccaagaaagc

SEQ ID NO: 1926026 - RNA, 21 nt, Homo sapiens
caugcuuguggccaaugcauc

SEQ ID NO: 1926027 - RNA, 12 nt, Homo sapiens
uucacugugcaa

SEQ ID NO: 1926028 - RNA, 21 nt, Homo sapiens
ggaagccuugcucauucuuga

SEQ ID NO: 1926029 - RNA, 17 nt, Homo sapiens
caucaauucccauugca

SEQ ID NO: 1926030 - RNA, 22 nt, Homo sapiens
gagaguagaugguuugagccug

SEQ ID NO: 1926031 - RNA, 13 nt, Homo sapiens
gcccacagugccu

SEQ ID NO: 1926032 - RNA, 23 nt, Homo sapiens
ucagcaggaguaauaaauuuacu

SEQ ID NO: 1926033 - RNA, 21 nt, Homo sapiens
agugcaguggcaucaucucag

SEQ ID NO: 1926034 - RNA, 22 nt, Homo sapiens
aguguaagcccugcuuagcuca

SEQ ID NO: 1926035 - RNA, 18 nt, Homo sapiens
aaacaucuccccucucac

SEQ ID NO: 1926036 - RNA, 16 nt, Homo sapiens
ccucucuuagggugag

SEQ ID NO: 1926037 - RNA, 23 nt, Homo sapiens
ggaacuagaaagaaggacccaga

SEQ ID NO: 1926038 - RNA, 15 nt, Homo sapiens
acaccagggccagua

SEQ ID NO: 1926039 - RNA, 15 nt, Homo sapiens
aaacauucuuuaaca

SEQ ID NO: 1926040 - RNA, 23 nt, Homo sapiens
cucagccuugcaaauagccagug

SEQ ID NO: 1926041 - RNA, 12 nt, Homo sapiens
auauucuuucaa

SEQ ID NO: 1926042 - RNA, 20 nt, Homo sapiens
caaaauugcuucuucuucaa

SEQ ID NO: 1926043 - RNA, 15 nt, Homo sapiens
acaauggacuugcaa

SEQ ID NO: 1926044 - RNA, 19 nt, Homo sapiens
agagacccccgugccaaau

SEQ ID NO: 1926045 - RNA, 15 nt, Homo sapiens
ugguggcuucuccag

SEQ ID NO: 1926046 - RNA, 13 nt, Homo sapiens
ggcucagggccag

SEQ ID NO: 1926047 - RNA, 15 nt, Homo sapiens
cuuuugucuuccuca

SEQ ID NO: 1926048 - RNA, 20 nt, Homo sapiens
uuccuucccagaauguuacu

SEQ ID NO: 1926049 - RNA, 14 nt, Homo sapiens
ucccugaguucacu

SEQ ID NO: 1926050 - RNA, 17 nt, Homo sapiens
cagucucaucuccugac

SEQ ID NO: 1926051 - RNA, 16 nt, Homo sapiens
uauaaauggaaucaca

SEQ ID NO: 1926052 - RNA, 23 nt, Homo sapiens
cuguaggugguaugugacaccaa

SEQ ID NO: 1926053 - RNA, 13 nt, Homo sapiens
uaaauaaugauuc

SEQ ID NO: 1926054 - RNA, 15 nt, Homo sapiens
aaucuccaucucaaa

SEQ ID NO: 1926055 - RNA, 15 nt, Homo sapiens
aaucaaaaucucucc

SEQ ID NO: 1926056 - RNA, 14 nt, Homo sapiens
ucacucaggaaccc

SEQ ID NO: 1926057 - RNA, 14 nt, Homo sapiens
uaccuuaggccccu

SEQ ID NO: 1926058 - RNA, 14 nt, Homo sapiens
gcuucuaguauuuu

SEQ ID NO: 1926059 - RNA, 12 nt, Homo sapiens
cuccugaccuca

SEQ ID NO: 1926060 - RNA, 12 nt, Homo sapiens
aaucugacaaua

SEQ ID NO: 1926061 - RNA, 21 nt, Homo sapiens
gccuugccccaccuccaucaa

SEQ ID NO: 1926062 - RNA, 19 nt, Homo sapiens
guuguaucaaagugugaua

SEQ ID NO: 1926063 - RNA, 18 nt, Homo sapiens
ucguuuuuuucauuccau

SEQ ID NO: 1926064 - RNA, 14 nt, Homo sapiens
gcuucccaauguua

SEQ ID NO: 1926065 - RNA, 18 nt, Homo sapiens
aggggccuugcucugagc

SEQ ID NO: 1926066 - RNA, 13 nt, Homo sapiens
auuuaagauauau

SEQ ID NO: 1926067 - RNA, 15 nt, Homo sapiens
ccucccccaguuccu

SEQ ID NO: 1926068 - RNA, 13 nt, Homo sapiens
cacccccauggaa

SEQ ID NO: 1926069 - RNA, 23 nt, Homo sapiens
agccauuuuuagcucugaucagc

SEQ ID NO: 1926070 - RNA, 19 nt, Homo sapiens
gucgaauguuagauuccuc

SEQ ID NO: 1926071 - RNA, 21 nt, Homo sapiens
ggugauggccagucaugugcu

SEQ ID NO: 1926072 - RNA, 19 nt, Homo sapiens
aaauauuucucaacugagg

SEQ ID NO: 1926073 - RNA, 14 nt, Homo sapiens
gcagaucauuuccc

SEQ ID NO: 1926074 - RNA, 15 nt, Homo sapiens
gccuuugaccccagc

SEQ ID NO: 1926075 - RNA, 21 nt, Homo sapiens
uagucccaccuuggagcauuu

SEQ ID NO: 1926076 - RNA, 21 nt, Homo sapiens
cugaaagaacauggacuugua

SEQ ID NO: 1926077 - RNA, 15 nt, Homo sapiens
ugaaauaaaagcaca

SEQ ID NO: 1926078 - RNA, 13 nt, Homo sapiens
cucgcucuugucu

SEQ ID NO: 1926079 - RNA, 20 nt, Homo sapiens
uguacaguagauuuuccaaa

SEQ ID NO: 1926080 - RNA, 20 nt, Homo sapiens
ggagaucuuggggugcagca

SEQ ID NO: 1926081 - RNA, 11 nt, Homo sapiens
aggugcacaga

SEQ ID NO: 1926082 - RNA, 20 nt, Homo sapiens
cagcucuucuggcuguguug

SEQ ID NO: 1926083 - RNA, 17 nt, Homo sapiens
ucaucuuagcuuuccac

SEQ ID NO: 1926084 - RNA, 21 nt, Homo sapiens
ugccacucuguaauugcaaaa

SEQ ID NO: 1926085 - RNA, 11 nt, Homo sapiens
ccuaccucagc

SEQ ID NO: 1926086 - RNA, 15 nt, Homo sapiens
ucccauucuugcaug

SEQ ID NO: 1926087 - RNA, 20 nt, Homo sapiens
guauaugugcauggacugug

SEQ ID NO: 1926088 - RNA, 19 nt, Homo sapiens
aaagaaaaaaaaacugggg

SEQ ID NO: 1926089 - RNA, 19 nt, Homo sapiens
cucuuaaauauacaacuuu

SEQ ID NO: 1926090 - RNA, 18 nt, Homo sapiens
cuacuucugugucuguca

SEQ ID NO: 1926091 - RNA, 21 nt, Homo sapiens
acaguauuuacugugcuaaug

SEQ ID NO: 1926092 - RNA, 15 nt, Homo sapiens
acuuuauagcucuaa

SEQ ID NO: 1926093 - RNA, 14 nt, Homo sapiens
agaaguuaauccac

SEQ ID NO: 1926094 - RNA, 20 nt, Homo sapiens
agaagcugagcaccagggga

SEQ ID NO: 1926095 - RNA, 18 nt, Homo sapiens
ccucuguugccaggcuag

SEQ ID NO: 1926096 - RNA, 17 nt, Homo sapiens
gagaaaauuugaaaaug

SEQ ID NO: 1926097 - RNA, 17 nt, Homo sapiens
cauccaucuuuccaucc

SEQ ID NO: 1926098 - RNA, 17 nt, Homo sapiens
cuagugugcaagugugu

SEQ ID NO: 1926099 - RNA, 12 nt, Homo sapiens
aaaauugccaaa

SEQ ID NO: 1926100 - RNA, 15 nt, Homo sapiens
aaauccaacuuucac

SEQ ID NO: 1926101 - RNA, 19 nt, Homo sapiens
cucaccucccgaagccacc

SEQ ID NO: 1926102 - RNA, 20 nt, Homo sapiens
caggccucucggugcuccau

SEQ ID NO: 1926103 - RNA, 19 nt, Homo sapiens
uucucaagaucaaagggga

SEQ ID NO: 1926104 - RNA, 14 nt, Homo sapiens
uauguugcuccagu

SEQ ID NO: 1926105 - RNA, 17 nt, Homo sapiens
ugcugugccccaccacg

SEQ ID NO: 1926106 - RNA, 23 nt, Homo sapiens
uggcguuacugcuugaccaaaga

SEQ ID NO: 1926107 - RNA, 22 nt, Homo sapiens
ugcccuuuguggaaagucacag

SEQ ID NO: 1926108 - RNA, 13 nt, Homo sapiens
aucagcugcugac

SEQ ID NO: 1926109 - RNA, 17 nt, Homo sapiens
auaacucauugucugug

SEQ ID NO: 1926110 - RNA, 11 nt, Homo sapiens
gagugcugcuc

SEQ ID NO: 1926111 - RNA, 23 nt, Homo sapiens
uuccauuuuuuucuaauggaaug

SEQ ID NO: 1926112 - RNA, 13 nt, Homo sapiens
gacacaguaaaau

SEQ ID NO: 1926113 - RNA, 14 nt, Homo sapiens
uugcaguaaugaua

SEQ ID NO: 1926114 - RNA, 15 nt, Homo sapiens
uuccaaacacauaca

SEQ ID NO: 1926115 - RNA, 16 nt, Homo sapiens
ucucagacgacaccug

SEQ ID NO: 1926116 - RNA, 14 nt, Homo sapiens
acuuccugcuacag

SEQ ID NO: 1926117 - RNA, 22 nt, Homo sapiens
gcacaaaccaauuaaacccagu

SEQ ID NO: 1926118 - RNA, 22 nt, Homo sapiens
gagggcaucucugagugucucu

SEQ ID NO: 1926119 - RNA, 15 nt, Homo sapiens
cccaacccuaucucc

SEQ ID NO: 1926120 - RNA, 10 nt, Homo sapiens
aauuccuguu

SEQ ID NO: 1926121 - RNA, 22 nt, Homo sapiens
cagcuuucaaaagcaagaacac

SEQ ID NO: 1926122 - RNA, 23 nt, Homo sapiens
auuuggcuagcaaucugccugua

SEQ ID NO: 1926123 - RNA, 23 nt, Homo sapiens
cagcuagaaagagaaaaagcccu

SEQ ID NO: 1926124 - RNA, 13 nt, Homo sapiens
acuugggaacuag

SEQ ID NO: 1926125 - RNA, 14 nt, Homo sapiens
ucuauagagccaag

SEQ ID NO: 1926126 - RNA, 21 nt, Homo sapiens
uuggagggcacuuggccaguu

SEQ ID NO: 1926127 - RNA, 20 nt, Homo sapiens
gcuaaaucccaagugucucu

SEQ ID NO: 1926128 - RNA, 22 nt, Homo sapiens
auuaaaagaugucucugcaaac

SEQ ID NO: 1926129 - RNA, 22 nt, Homo sapiens
cagccaccagggaguggccauu

SEQ ID NO: 1926130 - RNA, 21 nt, Homo sapiens
ugauuuacagacugaugccag

SEQ ID NO: 1926131 - RNA, 22 nt, Homo sapiens
cauuuggguuugaaucugaaug

SEQ ID NO: 1926132 - RNA, 19 nt, Homo sapiens
ggguacagcccuugcacuc

SEQ ID NO: 1926133 - RNA, 19 nt, Homo sapiens
auguguauauaugucaaau

SEQ ID NO: 1926134 - RNA, 12 nt, Homo sapiens
aucuaccuucca

SEQ ID NO: 1926135 - RNA, 12 nt, Homo sapiens
uaugccauagca

SEQ ID NO: 1926136 - RNA, 16 nt, Homo sapiens
acacugacaaagucau

SEQ ID NO: 1926137 - RNA, 15 nt, Homo sapiens
gcuucuccaugagac

SEQ ID NO: 1926138 - RNA, 16 nt, Homo sapiens
aaaagaaaaucuauua

SEQ ID NO: 1926139 - RNA, 16 nt, Homo sapiens
uuaaaaauuacuguuu

SEQ ID NO: 1926140 - RNA, 19 nt, Homo sapiens
aaaauauguguaucucaaa

SEQ ID NO: 1926141 - RNA, 19 nt, Homo sapiens
gaguacaccccaacagcac

SEQ ID NO: 1926142 - RNA, 21 nt, Homo sapiens
gaggcugcuuuccaaagccaa

SEQ ID NO: 1926143 - RNA, 16 nt, Homo sapiens
ugcaaagugcccucau

SEQ ID NO: 1926144 - RNA, 15 nt, Homo sapiens
gaauuucugauuuca

SEQ ID NO: 1926145 - RNA, 17 nt, Homo sapiens
gacuggggagggcugca

SEQ ID NO: 1926146 - RNA, 16 nt, Homo sapiens
uaaagucaggauuuau

SEQ ID NO: 1926147 - RNA, 23 nt, Homo sapiens
cuuuugaaaaaacaaaaaaccuc

SEQ ID NO: 1926148 - RNA, 14 nt, Homo sapiens
uaccuuuaccccau

SEQ ID NO: 1926149 - RNA, 16 nt, Homo sapiens
cccugagugcccagac

SEQ ID NO: 1926150 - RNA, 18 nt, Homo sapiens
gaaauacagucuuccaca

SEQ ID NO: 1926151 - RNA, 14 nt, Homo sapiens
cuaaaauucaggua

SEQ ID NO: 1926152 - RNA, 23 nt, Homo sapiens
uuucucuccaacucccucuggga

SEQ ID NO: 1926153 - RNA, 14 nt, Homo sapiens
accuagauuccaua

SEQ ID NO: 1926154 - RNA, 15 nt, Homo sapiens
cuuucagcuccugac

SEQ ID NO: 1926155 - RNA, 14 nt, Homo sapiens
guuuuacugcagcu

SEQ ID NO: 1926156 - RNA, 14 nt, Homo sapiens
guucucccaugauu

SEQ ID NO: 1926157 - RNA, 16 nt, Homo sapiens
acagaaaaguccacau

SEQ ID NO: 1926158 - RNA, 16 nt, Homo sapiens
gauacuuugacagugu

SEQ ID NO: 1926159 - RNA, 19 nt, Homo sapiens
guuuccugucugauagcac

SEQ ID NO: 1926160 - RNA, 16 nt, Homo sapiens
gaauaccugugguggu

SEQ ID NO: 1926161 - RNA, 13 nt, Homo sapiens
gcaauuugcacau

SEQ ID NO: 1926162 - RNA, 15 nt, Homo sapiens
uggccucaagugauu

SEQ ID NO: 1926163 - RNA, 15 nt, Homo sapiens
acaaauaguucugaa

SEQ ID NO: 1926164 - RNA, 14 nt, Homo sapiens
gaaugacccuguca

SEQ ID NO: 1926165 - RNA, 14 nt, Homo sapiens
aggauagaugcugg

SEQ ID NO: 1926166 - RNA, 17 nt, Homo sapiens
cuccauacauaacuuga

SEQ ID NO: 1926167 - RNA, 18 nt, Homo sapiens
caggcaugaaauucuucc

SEQ ID NO: 1926168 - RNA, 18 nt, Homo sapiens
agaaccggccuggagcuc

SEQ ID NO: 1926169 - RNA, 19 nt, Homo sapiens
ucugauuugcaggauuuuu

SEQ ID NO: 1926170 - RNA, 17 nt, Homo sapiens
ugcuuucuauuguacag

SEQ ID NO: 1926171 - RNA, 20 nt, Homo sapiens
cagccagaaggaaugcacag

SEQ ID NO: 1926172 - RNA, 19 nt, Homo sapiens
gacucccaccccagggauu

SEQ ID NO: 1926173 - RNA, 15 nt, Homo sapiens
ugaggagacagaaua

SEQ ID NO: 1926174 - RNA, 21 nt, Homo sapiens
aggacuguugaugaaagggac

SEQ ID NO: 1926175 - RNA, 17 nt, Homo sapiens
cagagcucacagcugga

SEQ ID NO: 1926176 - RNA, 13 nt, Homo sapiens
auauuguccugcu

SEQ ID NO: 1926177 - RNA, 18 nt, Homo sapiens
ucacagcaagccccuuag

SEQ ID NO: 1926178 - RNA, 23 nt, Homo sapiens
aaagggggugggauggggguacu

SEQ ID NO: 1926179 - RNA, 19 nt, Homo sapiens
ggagcugugcucagcacag

SEQ ID NO: 1926180 - RNA, 17 nt, Homo sapiens
gggggcaggcucugcca

SEQ ID NO: 1926181 - RNA, 23 nt, Homo sapiens
cuccugggaaggagggagcugcu

SEQ ID NO: 1926182 - RNA, 16 nt, Homo sapiens
cuugagaagcugccau

SEQ ID NO: 1926183 - RNA, 19 nt, Homo sapiens
acaugagaacaaacagauc

SEQ ID NO: 1926184 - RNA, 16 nt, Homo sapiens
acggcugcgcacugug

SEQ ID NO: 1926185 - RNA, 17 nt, Homo sapiens
gaaauggcuaugaacag

SEQ ID NO: 1926186 - RNA, 13 nt, Homo sapiens
aauuuucuucuca

SEQ ID NO: 1926187 - RNA, 19 nt, Homo sapiens
agacuauuuucuauuuucc

SEQ ID NO: 1926188 - RNA, 22 nt, Homo sapiens
accaaccuggccaacaugguga

SEQ ID NO: 1926189 - RNA, 23 nt, Homo sapiens
agauuuggaagcucuucuuccca

SEQ ID NO: 1926190 - RNA, 15 nt, Homo sapiens
aagcaccccaugcca

SEQ ID NO: 1926191 - RNA, 19 nt, Homo sapiens
gagauggaauaaagcccuu

SEQ ID NO: 1926192 - RNA, 14 nt, Homo sapiens
guucagucacaugu

SEQ ID NO: 1926193 - RNA, 15 nt, Homo sapiens
cacucuacaggucca

SEQ ID NO: 1926194 - RNA, 19 nt, Homo sapiens
acuccucaggcagcgugug

SEQ ID NO: 1926195 - RNA, 15 nt, Homo sapiens
ggcugaagugucaca

SEQ ID NO: 1926196 - RNA, 15 nt, Homo sapiens
cugcuugcuuggccc

SEQ ID NO: 1926197 - RNA, 16 nt, Homo sapiens
accgaaaccuugccuu

SEQ ID NO: 1926198 - RNA, 13 nt, Homo sapiens
acugacuccuuag

SEQ ID NO: 1926199 - RNA, 19 nt, Homo sapiens
auuuggaucuauuuauuag

SEQ ID NO: 1926200 - RNA, 19 nt, Homo sapiens
acaguuggauacaggagaa

SEQ ID NO: 1926201 - RNA, 18 nt, Homo sapiens
aauuaccaugcuucacaa

SEQ ID NO: 1926202 - RNA, 14 nt, Homo sapiens
agguuccuccuagg

SEQ ID NO: 1926203 - RNA, 15 nt, Homo sapiens
auugagaagccaugu

SEQ ID NO: 1926204 - RNA, 19 nt, Homo sapiens
caacacuguggguguguga

SEQ ID NO: 1926205 - RNA, 20 nt, Homo sapiens
acauacaagcauaagcaaaa

SEQ ID NO: 1926206 - RNA, 23 nt, Homo sapiens
augggauggcuuggggggcucca

SEQ ID NO: 1926207 - RNA, 20 nt, Homo sapiens
gucgauuaguaaaagugcuu

SEQ ID NO: 1926208 - RNA, 22 nt, Homo sapiens
aaggagaucgguaucuuuguaa

SEQ ID NO: 1926209 - RNA, 18 nt, Homo sapiens
gcaguuauuucaaccagc

SEQ ID NO: 1926210 - RNA, 21 nt, Homo sapiens
agauuccuguaaaugugacaa

SEQ ID NO: 1926211 - RNA, 17 nt, Homo sapiens
aaugguuucacaugguu

SEQ ID NO: 1926212 - RNA, 22 nt, Homo sapiens
cucaguuagaauuuuccuaaaa

SEQ ID NO: 1926213 - RNA, 20 nt, Homo sapiens
aaacuuuuauuguaaaugag

SEQ ID NO: 1926214 - RNA, 13 nt, Homo sapiens
acauguguguaua

SEQ ID NO: 1926215 - RNA, 15 nt, Homo sapiens
cuugagcuacaguag

SEQ ID NO: 1926216 - RNA, 17 nt, Homo sapiens
acccaacucaaggacag

SEQ ID NO: 1926217 - RNA, 14 nt, Homo sapiens
aaugguucuggaua

SEQ ID NO: 1926218 - RNA, 23 nt, Homo sapiens
uugcaaccaggcagcugagacca

SEQ ID NO: 1926219 - RNA, 18 nt, Homo sapiens
guucaccauguugcccag

SEQ ID NO: 1926220 - RNA, 17 nt, Homo sapiens
uuuacaaaguauuugcu

SEQ ID NO: 1926221 - RNA, 22 nt, Homo sapiens
gcccauugucuuauuggcacau

SEQ ID NO: 1926222 - RNA, 21 nt, Homo sapiens
aaacuuuuuuuuccuacuauc

SEQ ID NO: 1926223 - RNA, 18 nt, Homo sapiens
aacuuagguuagugacaa

SEQ ID NO: 1926224 - RNA, 12 nt, Homo sapiens
ccagguaggggc

SEQ ID NO: 1926225 - RNA, 21 nt, Homo sapiens
uggggcauggcaaaucagggg

SEQ ID NO: 1926226 - RNA, 21 nt, Homo sapiens
ugccucugaguuuugaugcug

SEQ ID NO: 1926227 - RNA, 15 nt, Homo sapiens
cugcucuaagcacac

SEQ ID NO: 1926228 - RNA, 22 nt, Homo sapiens
cucugaauauuuuguaauaaag

SEQ ID NO: 1926229 - RNA, 14 nt, Homo sapiens
ucaaaaagagucuu

SEQ ID NO: 1926230 - RNA, 15 nt, Homo sapiens
ugcuuugugagccag

SEQ ID NO: 1926231 - RNA, 18 nt, Homo sapiens
caucccgucgacucucca

SEQ ID NO: 1926232 - RNA, 22 nt, Homo sapiens
ucuggaaggggcagcccugagu

SEQ ID NO: 1926233 - RNA, 22 nt, Homo sapiens
caaucugcaaaaaaaugugcau

SEQ ID NO: 1926234 - RNA, 14 nt, Homo sapiens
cuacagagaagccu

SEQ ID NO: 1926235 - RNA, 15 nt, Homo sapiens
auauguaacuucaga

SEQ ID NO: 1926236 - RNA, 17 nt, Homo sapiens
cugaggacuguccuccc

SEQ ID NO: 1926237 - RNA, 18 nt, Homo sapiens
cugccucuaaggccaagg

SEQ ID NO: 1926238 - RNA, 22 nt, Homo sapiens
aagauuugaugggccacaacug

SEQ ID NO: 1926239 - RNA, 16 nt, Homo sapiens
acauuaaacacacuua

SEQ ID NO: 1926240 - RNA, 20 nt, Homo sapiens
cucccucaaagcacacguca

SEQ ID NO: 1926241 - RNA, 20 nt, Homo sapiens
auuucuuggugcuuugucua

SEQ ID NO: 1926242 - RNA, 17 nt, Homo sapiens
gaguagaagucucuucc

SEQ ID NO: 1926243 - RNA, 19 nt, Homo sapiens
aguauucaggcacugagaa

SEQ ID NO: 1926244 - RNA, 20 nt, Homo sapiens
accgcgcccggccucagugc

SEQ ID NO: 1926245 - RNA, 17 nt, Homo sapiens
aaccugguggcaccaga

SEQ ID NO: 1926246 - RNA, 23 nt, Homo sapiens
gaagugguguuuagaaugucagu

SEQ ID NO: 1926247 - RNA, 17 nt, Homo sapiens
ugaagcugcacaguguu

SEQ ID NO: 1926248 - RNA, 14 nt, Homo sapiens
agcucuugugaaua

SEQ ID NO: 1926249 - RNA, 18 nt, Homo sapiens
uagaaagguuuugagcau

SEQ ID NO: 1926250 - RNA, 15 nt, Homo sapiens
gggaguuuagggugg

SEQ ID NO: 1926251 - RNA, 21 nt, Homo sapiens
aaaauguaaugcaacuaccca

SEQ ID NO: 1926252 - RNA, 12 nt, Homo sapiens
auuucuauucaa

SEQ ID NO: 1926253 - RNA, 17 nt, Homo sapiens
ccugaccaacaggccca

SEQ ID NO: 1926254 - RNA, 16 nt, Homo sapiens
guacaauaaagcaaug

SEQ ID NO: 1926255 - RNA, 19 nt, Homo sapiens
uacauaaacugucacucua

SEQ ID NO: 1926256 - RNA, 22 nt, Homo sapiens
ccucaugucuucucacaagcca

SEQ ID NO: 1926257 - RNA, 14 nt, Homo sapiens
gaaaacacuuucau

SEQ ID NO: 1926258 - RNA, 16 nt, Homo sapiens
aauguaauauacugag

SEQ ID NO: 1926259 - RNA, 20 nt, Homo sapiens
uagcauuuucucuaccuuca

SEQ ID NO: 1926260 - RNA, 16 nt, Homo sapiens
uggggguuggggugcu

SEQ ID NO: 1926261 - RNA, 13 nt, Homo sapiens
caguccaagguau

SEQ ID NO: 1926262 - RNA, 17 nt, Homo sapiens
gcccagacccccagugu

SEQ ID NO: 1926263 - RNA, 21 nt, Homo sapiens
uguaaucgcccuacuauucag

SEQ ID NO: 1926264 - RNA, 13 nt, Homo sapiens
aagcaacccaguc

SEQ ID NO: 1926265 - RNA, 20 nt, Homo sapiens
acgcgugcacacaccagagc

SEQ ID NO: 1926266 - RNA, 14 nt, Homo sapiens
uagaauaugccuug

SEQ ID NO: 1926267 - RNA, 18 nt, Homo sapiens
ugcuuuuggggcucuuga

SEQ ID NO: 1926268 - RNA, 18 nt, Homo sapiens
cuuuucuugauaggccua

SEQ ID NO: 1926269 - RNA, 14 nt, Homo sapiens
cuaaagccauugua

SEQ ID NO: 1926270 - RNA, 14 nt, Homo sapiens
acuugcugccugaa

SEQ ID NO: 1926271 - RNA, 21 nt, Homo sapiens
ucaacgucccccgcucaggug

SEQ ID NO: 1926272 - RNA, 14 nt, Homo sapiens
cagcugggcagggu

SEQ ID NO: 1926273 - RNA, 21 nt, Homo sapiens
agcucuaagucucaacugcuc

SEQ ID NO: 1926274 - RNA, 16 nt, Homo sapiens
accucacacccaaagc

SEQ ID NO: 1926275 - RNA, 15 nt, Homo sapiens
ugaggaauaaagcuu

SEQ ID NO: 1926276 - RNA, 16 nt, Homo sapiens
uaccuucuuguugaua

SEQ ID NO: 1926277 - RNA, 23 nt, Homo sapiens
ucucuacagugccaacuccucac

SEQ ID NO: 1926278 - RNA, 16 nt, Homo sapiens
cauuuuuucccaguga

SEQ ID NO: 1926279 - RNA, 21 nt, Homo sapiens
gaaauguuccuuuuaauggau

SEQ ID NO: 1926280 - RNA, 19 nt, Homo sapiens
cacaccaacagugugaagu

SEQ ID NO: 1926281 - RNA, 21 nt, Homo sapiens
uuuucuggccaaaagcaguaa

SEQ ID NO: 1926282 - RNA, 18 nt, Homo sapiens
uuuuaaaugagcuuucag

SEQ ID NO: 1926283 - RNA, 13 nt, Homo sapiens
caauacauguauc

SEQ ID NO: 1926284 - RNA, 23 nt, Homo sapiens
ccagagaaguuugguuucuuugc

SEQ ID NO: 1926285 - RNA, 15 nt, Homo sapiens
acugaaccaggguau

SEQ ID NO: 1926286 - RNA, 23 nt, Homo sapiens
gugacagcuuucugggaugucac

SEQ ID NO: 1926287 - RNA, 15 nt, Homo sapiens
uugugaaagaguuga

SEQ ID NO: 1926288 - RNA, 17 nt, Homo sapiens
acagaaaaaaucgucuc

SEQ ID NO: 1926289 - RNA, 21 nt, Homo sapiens
uggaaaauucucuuaaucacu

SEQ ID NO: 1926290 - RNA, 17 nt, Homo sapiens
gauguuguagacugaga

SEQ ID NO: 1926291 - RNA, 19 nt, Homo sapiens
uguugaagaacucauguga

SEQ ID NO: 1926292 - RNA, 19 nt, Homo sapiens
ggucuuuucuccuacucuu

SEQ ID NO: 1926293 - RNA, 21 nt, Homo sapiens
ccagucugcagaagcauuuga

SEQ ID NO: 1926294 - RNA, 19 nt, Homo sapiens
ucuaaacuuuagaauuaau

SEQ ID NO: 1926295 - RNA, 16 nt, Homo sapiens
cugaagacaggcacaa

SEQ ID NO: 1926296 - RNA, 19 nt, Homo sapiens
accuguuuuuaacauguga

SEQ ID NO: 1926297 - RNA, 18 nt, Homo sapiens
ggcugggagguugggagg

SEQ ID NO: 1926298 - RNA, 14 nt, Homo sapiens
uggagugcagugac

SEQ ID NO: 1926299 - RNA, 16 nt, Homo sapiens
ucacaaguagccucug

SEQ ID NO: 1926300 - RNA, 14 nt, Homo sapiens
augcuuuugcugcu

SEQ ID NO: 1926301 - RNA, 16 nt, Homo sapiens
cuauguuuccauuugu

SEQ ID NO: 1926302 - RNA, 16 nt, Homo sapiens
uuccuuuuagggaaua

SEQ ID NO: 1926303 - RNA, 23 nt, Homo sapiens
guaaugccacucauacucagagc

SEQ ID NO: 1926304 - RNA, 21 nt, Homo sapiens
gauaccgaaguugaaagcaag

SEQ ID NO: 1926305 - RNA, 21 nt, Homo sapiens
uucucagaaucucaaauaacu

SEQ ID NO: 1926306 - RNA, 14 nt, Homo sapiens
gcccccaccgccgg

SEQ ID NO: 1926307 - RNA, 14 nt, Homo sapiens
cccugacuuucuaa

SEQ ID NO: 1926308 - RNA, 14 nt, Homo sapiens
ccauaacuuuauga

SEQ ID NO: 1926309 - RNA, 18 nt, Homo sapiens
gcacuuugggaggccaag

SEQ ID NO: 1926310 - RNA, 22 nt, Homo sapiens
uagguuacagauuaucacauua

SEQ ID NO: 1926311 - RNA, 22 nt, Homo sapiens
ugaauaaauguuauagcugcau

SEQ ID NO: 1926312 - RNA, 14 nt, Homo sapiens
auguauagcugcuu

SEQ ID NO: 1926313 - RNA, 21 nt, Homo sapiens
aggcaagaaagcuuccuucaa

SEQ ID NO: 1926314 - RNA, 16 nt, Homo sapiens
caccuacuuauuucag

SEQ ID NO: 1926315 - RNA, 18 nt, Homo sapiens
agaccaccucucaauauu

SEQ ID NO: 1926316 - RNA, 20 nt, Homo sapiens
gacacaagcggcccugacac

SEQ ID NO: 1926317 - RNA, 22 nt, Homo sapiens
uuaacaacucauucugauccuc

SEQ ID NO: 1926318 - RNA, 12 nt, Homo sapiens
uucacuacaggu

SEQ ID NO: 1926319 - RNA, 14 nt, Homo sapiens
acucugacuuugag

SEQ ID NO: 1926320 - RNA, 12 nt, Homo sapiens
uuaugaaaacug

SEQ ID NO: 1926321 - RNA, 16 nt, Homo sapiens
cacugaucacccaaug

SEQ ID NO: 1926322 - RNA, 14 nt, Homo sapiens
agccacaaagcccc

SEQ ID NO: 1926323 - RNA, 14 nt, Homo sapiens
aauaaaaaaauaca

SEQ ID NO: 1926324 - RNA, 16 nt, Homo sapiens
gccacaggcacugugu

SEQ ID NO: 1926325 - RNA, 15 nt, Homo sapiens
aacaaacccaaaggu

SEQ ID NO: 1926326 - RNA, 23 nt, Homo sapiens
uauguuuaaaaacuucgugcauu

SEQ ID NO: 1926327 - RNA, 22 nt, Homo sapiens
cacuccuuuacaaccauacuuu

SEQ ID NO: 1926328 - RNA, 18 nt, Homo sapiens
agcucuacauucugcucu

SEQ ID NO: 1926329 - RNA, 19 nt, Homo sapiens
aacuuuguggaugucuucc

SEQ ID NO: 1926330 - RNA, 19 nt, Homo sapiens
uguggauguguaaauggcu

SEQ ID NO: 1926331 - RNA, 20 nt, Homo sapiens
auggacaaaauuaauacauu

SEQ ID NO: 1926332 - RNA, 14 nt, Homo sapiens
cagugacaacaucg

SEQ ID NO: 1926333 - RNA, 22 nt, Homo sapiens
ggaaaagguagcuuaccugaca

SEQ ID NO: 1926334 - RNA, 22 nt, Homo sapiens
cucuuggaugcagcuucaagaa

SEQ ID NO: 1926335 - RNA, 23 nt, Homo sapiens
ccugaagucuucuccuccaugaa

SEQ ID NO: 1926336 - RNA, 14 nt, Homo sapiens
uccccaagggccaa

SEQ ID NO: 1926337 - RNA, 15 nt, Homo sapiens
gugcccaaaagccau

SEQ ID NO: 1926338 - RNA, 19 nt, Homo sapiens
uuuacaagaaguauguaag

SEQ ID NO: 1926339 - RNA, 17 nt, Homo sapiens
caccguucugugcacaa

SEQ ID NO: 1926340 - RNA, 17 nt, Homo sapiens
gagccuccacugccucu

SEQ ID NO: 1926341 - RNA, 20 nt, Homo sapiens
aaguguaguggcauccauuu

SEQ ID NO: 1926342 - RNA, 16 nt, Homo sapiens
acacccgugugcacac

SEQ ID NO: 1926343 - RNA, 18 nt, Homo sapiens
cugucaccggccuuguga

SEQ ID NO: 1926344 - RNA, 20 nt, Homo sapiens
uaaccuguauacucuugaau

SEQ ID NO: 1926345 - RNA, 21 nt, Homo sapiens
auauacaccuggaacauugag

SEQ ID NO: 1926346 - RNA, 14 nt, Homo sapiens
aaauuagugcugua

SEQ ID NO: 1926347 - RNA, 19 nt, Homo sapiens
ucacacuaucaacacugca

SEQ ID NO: 1926348 - RNA, 14 nt, Homo sapiens
gucugcacagauuc

SEQ ID NO: 1926349 - RNA, 20 nt, Homo sapiens
gaauaauaaaaucaaaaacu

SEQ ID NO: 1926350 - RNA, 21 nt, Homo sapiens
gaauuaacaauaaaaguguga

SEQ ID NO: 1926351 - RNA, 23 nt, Homo sapiens
gcagggcuggcaggaugccgugg

SEQ ID NO: 1926352 - RNA, 16 nt, Homo sapiens
aacugcugaugcucau

SEQ ID NO: 1926353 - RNA, 20 nt, Homo sapiens
caugcauagguuuagcagua

SEQ ID NO: 1926354 - RNA, 18 nt, Homo sapiens
gcuuauauauauuugauu

SEQ ID NO: 1926355 - RNA, 15 nt, Homo sapiens
ccucccuuccaugcc

SEQ ID NO: 1926356 - RNA, 16 nt, Homo sapiens
aagaccaugcauucag

SEQ ID NO: 1926357 - RNA, 15 nt, Homo sapiens
uguguuguuuccaua

SEQ ID NO: 1926358 - RNA, 14 nt, Homo sapiens
uuaacauuugccuu

SEQ ID NO: 1926359 - RNA, 17 nt, Homo sapiens
gauugcuuuauccaaaa

SEQ ID NO: 1926360 - RNA, 22 nt, Homo sapiens
ugcgccaguccugcuaccuccc

SEQ ID NO: 1926361 - RNA, 22 nt, Homo sapiens
agcucaugcauuucaagcagcu

SEQ ID NO: 1926362 - RNA, 15 nt, Homo sapiens
aaguuuaaagcaucu

SEQ ID NO: 1926363 - RNA, 21 nt, Homo sapiens
cugcaucauaagcugauuuga

SEQ ID NO: 1926364 - RNA, 11 nt, Homo sapiens
acugugucagg

SEQ ID NO: 1926365 - RNA, 17 nt, Homo sapiens
auugcaguuucauguau

SEQ ID NO: 1926366 - RNA, 21 nt, Homo sapiens
aucuacuugcuuaaauugugg

SEQ ID NO: 1926367 - RNA, 16 nt, Homo sapiens
uucuaugcaagccuug

SEQ ID NO: 1926368 - RNA, 21 nt, Homo sapiens
agaugcgcaaagagugugcuc

SEQ ID NO: 1926369 - RNA, 16 nt, Homo sapiens
gcuuggggcaccauga

SEQ ID NO: 1926370 - RNA, 18 nt, Homo sapiens
uaaaucauauuaguauua

SEQ ID NO: 1926371 - RNA, 14 nt, Homo sapiens
cugguaauauugac

SEQ ID NO: 1926372 - RNA, 18 nt, Homo sapiens
ccaugaccugcgcucuca

SEQ ID NO: 1926373 - RNA, 15 nt, Homo sapiens
ggcacauccuaugca

SEQ ID NO: 1926374 - RNA, 16 nt, Homo sapiens
uaggauauacuguaug

SEQ ID NO: 1926375 - RNA, 17 nt, Homo sapiens
gcuuuguaugacaguga

SEQ ID NO: 1926376 - RNA, 17 nt, Homo sapiens
uaagaggaucuccuguc

SEQ ID NO: 1926377 - RNA, 20 nt, Homo sapiens
caguuuauaccuugccugua

SEQ ID NO: 1926378 - RNA, 15 nt, Homo sapiens
ucaguaguuugcauu

SEQ ID NO: 1926379 - RNA, 20 nt, Homo sapiens
acaagcaagggcugugcuga

SEQ ID NO: 1926380 - RNA, 13 nt, Homo sapiens
ucaguuaucuuga

SEQ ID NO: 1926381 - RNA, 11 nt, Homo sapiens
acacagcugcc

SEQ ID NO: 1926382 - RNA, 22 nt, Homo sapiens
caugcuuaauaaacaugucaca

SEQ ID NO: 1926383 - RNA, 18 nt, Homo sapiens
aucacaugcucaaugacu

SEQ ID NO: 1926384 - RNA, 20 nt, Homo sapiens
agagaguaucugaggcacau

SEQ ID NO: 1926385 - RNA, 17 nt, Homo sapiens
acuguuguucugugguu

SEQ ID NO: 1926386 - RNA, 17 nt, Homo sapiens
acaaguaaccaaggaac

SEQ ID NO: 1926387 - RNA, 12 nt, Homo sapiens
cuguguacccac

SEQ ID NO: 1926388 - RNA, 20 nt, Homo sapiens
uuggggcacagucauucaca

SEQ ID NO: 1926389 - RNA, 16 nt, Homo sapiens
aauaaagugaacuuug

SEQ ID NO: 1926390 - RNA, 21 nt, Homo sapiens
acaucgacaaccacguaccaa

SEQ ID NO: 1926391 - RNA, 20 nt, Homo sapiens
gaacuauuucuacacagugg

SEQ ID NO: 1926392 - RNA, 16 nt, Homo sapiens
agugugcucggacaca

SEQ ID NO: 1926393 - RNA, 16 nt, Homo sapiens
caaguuggagugcaau

SEQ ID NO: 1926394 - RNA, 21 nt, Homo sapiens
ugcucuccccuccucggagga

SEQ ID NO: 1926395 - RNA, 15 nt, Homo sapiens
uaauaauuuuuaccu

SEQ ID NO: 1926396 - RNA, 17 nt, Homo sapiens
uccuuucgaaagcaaug

SEQ ID NO: 1926397 - RNA, 15 nt, Homo sapiens
uugccaaucuuccag

SEQ ID NO: 1926398 - RNA, 18 nt, Homo sapiens
uccauaucccuuugcagu

SEQ ID NO: 1926399 - RNA, 14 nt, Homo sapiens
ugauuuccuuccaa

SEQ ID NO: 1926400 - RNA, 16 nt, Homo sapiens
acaugaguucaaauac

SEQ ID NO: 1926401 - RNA, 16 nt, Homo sapiens
gaucuaaaccaguccu

SEQ ID NO: 1926402 - RNA, 19 nt, Homo sapiens
ugauuuuacuuaacucauu

SEQ ID NO: 1926403 - RNA, 16 nt, Homo sapiens
ccccagggaggucaau

SEQ ID NO: 1926404 - RNA, 18 nt, Homo sapiens
ugaagauucgcagcauuc

SEQ ID NO: 1926405 - RNA, 15 nt, Homo sapiens
cgguggucacuggaa

SEQ ID NO: 1926406 - RNA, 22 nt, Homo sapiens
aauauuuuagauuacaggauua

SEQ ID NO: 1926407 - RNA, 16 nt, Homo sapiens
agcaacucacacggga

SEQ ID NO: 1926408 - RNA, 21 nt, Homo sapiens
uaaaccaaugaagaagacaaa

SEQ ID NO: 1926409 - RNA, 22 nt, Homo sapiens
cagagguuugcuuccucaguaa

SEQ ID NO: 1926410 - RNA, 17 nt, Homo sapiens
ccccacccccagugcag

SEQ ID NO: 1926411 - RNA, 14 nt, Homo sapiens
uuaagaggggaaaa

SEQ ID NO: 1926412 - RNA, 20 nt, Homo sapiens
aucugagugaaaaaagucac

SEQ ID NO: 1926413 - RNA, 23 nt, Homo sapiens
cuuuuccauuuauuuauucaugu

SEQ ID NO: 1926414 - RNA, 20 nt, Homo sapiens
uacaaaaugacauuuugcca

SEQ ID NO: 1926415 - RNA, 20 nt, Homo sapiens
ugggcuuuucaggaagugaa

SEQ ID NO: 1926416 - RNA, 21 nt, Homo sapiens
uauuugguauauacuuugcca

SEQ ID NO: 1926417 - RNA, 18 nt, Homo sapiens
cagaaucugcuguugcca

SEQ ID NO: 1926418 - RNA, 13 nt, Homo sapiens
gcaauucuaccca

SEQ ID NO: 1926419 - RNA, 15 nt, Homo sapiens
uggacuguugccacc

SEQ ID NO: 1926420 - RNA, 15 nt, Homo sapiens
uaccagcauacgcuc

SEQ ID NO: 1926421 - RNA, 21 nt, Homo sapiens
cauguugugauguacacauuu

SEQ ID NO: 1926422 - RNA, 13 nt, Homo sapiens
gucuaacugcugu

SEQ ID NO: 1926423 - RNA, 20 nt, Homo sapiens
uuauauuugaguugugauug

SEQ ID NO: 1926424 - RNA, 13 nt, Homo sapiens
gccuuacuguuga

SEQ ID NO: 1926425 - RNA, 15 nt, Homo sapiens
ggcaagccuggccau

SEQ ID NO: 1926426 - RNA, 9 nt, Homo sapiens
ugcacacaa

SEQ ID NO: 1926427 - RNA, 15 nt, Homo sapiens
ucucuaaaauagcca

SEQ ID NO: 1926428 - RNA, 15 nt, Homo sapiens
ugguuccuucccaau

SEQ ID NO: 1926429 - RNA, 10 nt, Homo sapiens
gagaccucaa

SEQ ID NO: 1926430 - RNA, 17 nt, Homo sapiens
gcaucgaccacaccagc

SEQ ID NO: 1926431 - RNA, 17 nt, Homo sapiens
uauuguuuucuuuucuc

SEQ ID NO: 1926432 - RNA, 15 nt, Homo sapiens
cacacaccuguaguc

SEQ ID NO: 1926433 - RNA, 21 nt, Homo sapiens
cagagacgggguuugccaugc

SEQ ID NO: 1926434 - RNA, 15 nt, Homo sapiens
aauaauucaucuuug

SEQ ID NO: 1926435 - RNA, 17 nt, Homo sapiens
cccaaacaugcacuucc

SEQ ID NO: 1926436 - RNA, 15 nt, Homo sapiens
uggucauccaaacuc

SEQ ID NO: 1926437 - RNA, 13 nt, Homo sapiens
agggcaacuugag

SEQ ID NO: 1926438 - RNA, 12 nt, Homo sapiens
uugaaguacaaa

SEQ ID NO: 1926439 - RNA, 14 nt, Homo sapiens
aaagagcuaggaaa

SEQ ID NO: 1926440 - RNA, 21 nt, Homo sapiens
auguuuuuuaaacuaguuuau

SEQ ID NO: 1926441 - RNA, 14 nt, Homo sapiens
uuccuuucuugauu

SEQ ID NO: 1926442 - RNA, 16 nt, Homo sapiens
uccuuaaaaaucacac

SEQ ID NO: 1926443 - RNA, 21 nt, Homo sapiens
guauucaaauuugugucauac

SEQ ID NO: 1926444 - RNA, 16 nt, Homo sapiens
uguaaaauggagacac

SEQ ID NO: 1926445 - RNA, 18 nt, Homo sapiens
uggauugauaauugcauu

SEQ ID NO: 1926446 - RNA, 13 nt, Homo sapiens
ucccaacccauuc

SEQ ID NO: 1926447 - RNA, 15 nt, Homo sapiens
gcagcaguggguuca

SEQ ID NO: 1926448 - RNA, 19 nt, Homo sapiens
uggagacugagaucacuga

SEQ ID NO: 1926449 - RNA, 23 nt, Homo sapiens
ccccaaguucucuuuuguccuca

SEQ ID NO: 1926450 - RNA, 14 nt, Homo sapiens
guauauacaaagaa

SEQ ID NO: 1926451 - RNA, 21 nt, Homo sapiens
cuucccaaggccuuaagcuuu

SEQ ID NO: 1926452 - RNA, 15 nt, Homo sapiens
auucucucucuaagu

SEQ ID NO: 1926453 - RNA, 21 nt, Homo sapiens
cugauuucuauggcuuucaaa

SEQ ID NO: 1926454 - RNA, 16 nt, Homo sapiens
ggucaguuuucacaga

SEQ ID NO: 1926455 - RNA, 18 nt, Homo sapiens
ucugaguuccugcaugcc

SEQ ID NO: 1926456 - RNA, 14 nt, Homo sapiens
uccuucagaucucu

SEQ ID NO: 1926457 - RNA, 14 nt, Homo sapiens
gaaauacuugacaa

SEQ ID NO: 1926458 - RNA, 15 nt, Homo sapiens
ccuaaaacuggcaaa

SEQ ID NO: 1926459 - RNA, 14 nt, Homo sapiens
cauaugaauaacau

SEQ ID NO: 1926460 - RNA, 13 nt, Homo sapiens
uuaagugcuuaca

SEQ ID NO: 1926461 - RNA, 15 nt, Homo sapiens
ugacuuaaguggcau

SEQ ID NO: 1926462 - RNA, 13 nt, Homo sapiens
acucuacccuaua

SEQ ID NO: 1926463 - RNA, 21 nt, Homo sapiens
acccuauaucuauaaacacug

SEQ ID NO: 1926464 - RNA, 14 nt, Homo sapiens
ugcagauugcuacu

SEQ ID NO: 1926465 - RNA, 20 nt, Homo sapiens
aauaaguuuucaguggacua

SEQ ID NO: 1926466 - RNA, 21 nt, Homo sapiens
ugaaaucccaucugcauuuga

SEQ ID NO: 1926467 - RNA, 18 nt, Homo sapiens
aauaugcaaccugugcaa

SEQ ID NO: 1926468 - RNA, 20 nt, Homo sapiens
gaagagauaaacgaccaaac

SEQ ID NO: 1926469 - RNA, 19 nt, Homo sapiens
aacuugaggacacaugucc

SEQ ID NO: 1926470 - RNA, 15 nt, Homo sapiens
cucacauguggcucc

SEQ ID NO: 1926471 - RNA, 17 nt, Homo sapiens
cgcucagucagugcacu

SEQ ID NO: 1926472 - RNA, 19 nt, Homo sapiens
cuggagcuggcgucugcau

SEQ ID NO: 1926473 - RNA, 17 nt, Homo sapiens
auaucaagauguuaaau

SEQ ID NO: 1926474 - RNA, 14 nt, Homo sapiens
uucauuuugcagaa

SEQ ID NO: 1926475 - RNA, 14 nt, Homo sapiens
cuggcccagccaau

SEQ ID NO: 1926476 - RNA, 21 nt, Homo sapiens
uugaaaaauguuauaacuuau

SEQ ID NO: 1926477 - RNA, 23 nt, Homo sapiens
uggggaaggagaaggagugccau

SEQ ID NO: 1926478 - RNA, 17 nt, Homo sapiens
aagcaguuugaagccca

SEQ ID NO: 1926479 - RNA, 17 nt, Homo sapiens
gcucccacaaaugacag

SEQ ID NO: 1926480 - RNA, 23 nt, Homo sapiens
guaacuuguuuacauagcauuug

SEQ ID NO: 1926481 - RNA, 23 nt, Homo sapiens
guucagacacuaccccauauaca

SEQ ID NO: 1926482 - RNA, 23 nt, Homo sapiens
ggcugaauagcuucuccaaaggc

SEQ ID NO: 1926483 - RNA, 19 nt, Homo sapiens
acuugcuuauuacauuuaa

SEQ ID NO: 1926484 - RNA, 19 nt, Homo sapiens
uaaucaauucuagcauuuu

SEQ ID NO: 1926485 - RNA, 23 nt, Homo sapiens
uuuucugauuuauauuucaugau

SEQ ID NO: 1926486 - RNA, 23 nt, Homo sapiens
ucacaauguucuggcacuauuau

SEQ ID NO: 1926487 - RNA, 18 nt, Homo sapiens
uucucauaacucugugau

SEQ ID NO: 1926488 - RNA, 18 nt, Homo sapiens
augguuaagaacugugaa

SEQ ID NO: 1926489 - RNA, 21 nt, Homo sapiens
gaagguaauguuuaauguuga

SEQ ID NO: 1926490 - RNA, 20 nt, Homo sapiens
acagcuuccccucucuccuc

SEQ ID NO: 1926491 - RNA, 20 nt, Homo sapiens
cccugcagcuaugcuggaaa

SEQ ID NO: 1926492 - RNA, 12 nt, Homo sapiens
uaaaaagcccaa

SEQ ID NO: 1926493 - RNA, 23 nt, Homo sapiens
ucuacauuauaccgcagaguauu

SEQ ID NO: 1926494 - RNA, 13 nt, Homo sapiens
aauccuagcacuu

SEQ ID NO: 1926495 - RNA, 14 nt, Homo sapiens
agguaauuucuucc

SEQ ID NO: 1926496 - RNA, 19 nt, Homo sapiens
acuacacacccccaagcca

SEQ ID NO: 1926497 - RNA, 13 nt, Homo sapiens
acugccagcagca

SEQ ID NO: 1926498 - RNA, 14 nt, Homo sapiens
uuuuuccuaaaaga

SEQ ID NO: 1926499 - RNA, 16 nt, Homo sapiens
acucagcaguugacau

SEQ ID NO: 1926500 - RNA, 21 nt, Homo sapiens
gcagaggucagacuaagaaau

SEQ ID NO: 1926501 - RNA, 21 nt, Homo sapiens
uguuuuggaugaaugcaguau

SEQ ID NO: 1926502 - RNA, 12 nt, Homo sapiens
auccaucuacuu

SEQ ID NO: 1926503 - RNA, 22 nt, Homo sapiens
gauaauuuagacauugaguuca

SEQ ID NO: 1926504 - RNA, 16 nt, Homo sapiens
augcuuaccugugaga

SEQ ID NO: 1926505 - RNA, 17 nt, Homo sapiens
uaacauuuaaauuccac

SEQ ID NO: 1926506 - RNA, 14 nt, Homo sapiens
agauccucuuuacu

SEQ ID NO: 1926507 - RNA, 21 nt, Homo sapiens
ccagugcaaaugcaugcuucu

SEQ ID NO: 1926508 - RNA, 15 nt, Homo sapiens
agccaccaaacccgg

SEQ ID NO: 1926509 - RNA, 14 nt, Homo sapiens
caggccaucaagga

SEQ ID NO: 1926510 - RNA, 14 nt, Homo sapiens
uaggcuacuguaau

SEQ ID NO: 1926511 - RNA, 12 nt, Homo sapiens
ggacaagggauu

SEQ ID NO: 1926512 - RNA, 15 nt, Homo sapiens
ugggggcggaucccu

SEQ ID NO: 1926513 - RNA, 16 nt, Homo sapiens
caucaugaaaacuggg

SEQ ID NO: 1926514 - RNA, 19 nt, Homo sapiens
gguggccccgacaggucuu

SEQ ID NO: 1926515 - RNA, 19 nt, Homo sapiens
cuucaggaaggacauggac

SEQ ID NO: 1926516 - RNA, 20 nt, Homo sapiens
caugcugagacaucccucau

SEQ ID NO: 1926517 - RNA, 15 nt, Homo sapiens
gagagccuugguuca

SEQ ID NO: 1926518 - RNA, 13 nt, Homo sapiens
ugcgacugaugaa

SEQ ID NO: 1926519 - RNA, 19 nt, Homo sapiens
uaaaauguuggugcaauua

SEQ ID NO: 1926520 - RNA, 17 nt, Homo sapiens
uugaaaaaaauauauga

SEQ ID NO: 1926521 - RNA, 22 nt, Homo sapiens
caaauugaaagagauccaggga

SEQ ID NO: 1926522 - RNA, 21 nt, Homo sapiens
gucucuauaauagaauucugu

SEQ ID NO: 1926523 - RNA, 20 nt, Homo sapiens
agauaaaaugauguuauaca

SEQ ID NO: 1926524 - RNA, 17 nt, Homo sapiens
gggcaggaagcuuguca

SEQ ID NO: 1926525 - RNA, 22 nt, Homo sapiens
gacaguuuguggcaucuugcca

SEQ ID NO: 1926526 - RNA, 13 nt, Homo sapiens
uuuccaaagacaa

SEQ ID NO: 1926527 - RNA, 16 nt, Homo sapiens
ucagcuagacauugca

SEQ ID NO: 1926528 - RNA, 16 nt, Homo sapiens
aaaagugucacuaaga

SEQ ID NO: 1926529 - RNA, 23 nt, Homo sapiens
ccagcucuacgucccacauuuua

SEQ ID NO: 1926530 - RNA, 13 nt, Homo sapiens
caaaaagauguau

SEQ ID NO: 1926531 - RNA, 16 nt, Homo sapiens
aauaaaaacauugccu

SEQ ID NO: 1926532 - RNA, 11 nt, Homo sapiens
ggggcauuauc

SEQ ID NO: 1926533 - RNA, 18 nt, Homo sapiens
gcuauuacuaguacuauu

SEQ ID NO: 1926534 - RNA, 21 nt, Homo sapiens
agaccagaccccaaaccagcc

SEQ ID NO: 1926535 - RNA, 22 nt, Homo sapiens
uugaaccacuucccucaucucu

SEQ ID NO: 1926536 - RNA, 13 nt, Homo sapiens
cauauauauguca

SEQ ID NO: 1926537 - RNA, 19 nt, Homo sapiens
cuccguggcaucaccuuag

SEQ ID NO: 1926538 - RNA, 12 nt, Homo sapiens
gaugaucuucag

SEQ ID NO: 1926539 - RNA, 16 nt, Homo sapiens
cagcuggucuuuauuc

SEQ ID NO: 1926540 - RNA, 16 nt, Homo sapiens
guuccuuccaguguca

SEQ ID NO: 1926541 - RNA, 22 nt, Homo sapiens
cgugugcccacugaacaugcuc

SEQ ID NO: 1926542 - RNA, 22 nt, Homo sapiens
aaaagucaaacuuucaccucag

SEQ ID NO: 1926543 - RNA, 13 nt, Homo sapiens
uuaaauucugaau

SEQ ID NO: 1926544 - RNA, 13 nt, Homo sapiens
ugccuuucuucca

SEQ ID NO: 1926545 - RNA, 16 nt, Homo sapiens
cagaaaacaaaagaga

SEQ ID NO: 1926546 - RNA, 19 nt, Homo sapiens
cgccuuggccuugcagcug

SEQ ID NO: 1926547 - RNA, 22 nt, Homo sapiens
uagaggucuugaucuuuggaau

SEQ ID NO: 1926548 - RNA, 16 nt, Homo sapiens
gccuuggcucguucuc

SEQ ID NO: 1926549 - RNA, 13 nt, Homo sapiens
cacccauaucaug

SEQ ID NO: 1926550 - RNA, 16 nt, Homo sapiens
guugccucucuugccc

SEQ ID NO: 1926551 - RNA, 13 nt, Homo sapiens
uagucaucaucaa

SEQ ID NO: 1926552 - RNA, 21 nt, Homo sapiens
aacugauuuguagugauucau

SEQ ID NO: 1926553 - RNA, 20 nt, Homo sapiens
uacaaucgagacugcaaugu

SEQ ID NO: 1926554 - RNA, 16 nt, Homo sapiens
agcugagaucgugcua

SEQ ID NO: 1926555 - RNA, 22 nt, Homo sapiens
aguuuuggcaagaagucuauua

SEQ ID NO: 1926556 - RNA, 21 nt, Homo sapiens
aagcgaauuugucuucagauu

SEQ ID NO: 1926557 - RNA, 16 nt, Homo sapiens
aacaaaaaaacuauaa

SEQ ID NO: 1926558 - RNA, 14 nt, Homo sapiens
cauuucaguguuuu

SEQ ID NO: 1926559 - RNA, 14 nt, Homo sapiens
caucccaguguccu

SEQ ID NO: 1926560 - RNA, 14 nt, Homo sapiens
aaccccugaccuca

SEQ ID NO: 1926561 - RNA, 14 nt, Homo sapiens
cuguuuguuuacaa

SEQ ID NO: 1926562 - RNA, 14 nt, Homo sapiens
agcucuucuaagga

SEQ ID NO: 1926563 - RNA, 22 nt, Homo sapiens
gcacacgggccucugcuugcca

SEQ ID NO: 1926564 - RNA, 16 nt, Homo sapiens
gcaaacccaugaagcu

SEQ ID NO: 1926565 - RNA, 14 nt, Homo sapiens
gacucagcagaaca

SEQ ID NO: 1926566 - RNA, 15 nt, Homo sapiens
uggaacauaugcaca

SEQ ID NO: 1926567 - RNA, 16 nt, Homo sapiens
cagagccacuaccuuu

SEQ ID NO: 1926568 - RNA, 14 nt, Homo sapiens
cacuggaaaguuua

SEQ ID NO: 1926569 - RNA, 16 nt, Homo sapiens
ugaaaugaccaagaca

SEQ ID NO: 1926570 - RNA, 15 nt, Homo sapiens
augcaaagaugaacc

SEQ ID NO: 1926571 - RNA, 22 nt, Homo sapiens
ucaauaaauagaugaguccugu

SEQ ID NO: 1926572 - RNA, 19 nt, Homo sapiens
uguaagggcagugcccaug

SEQ ID NO: 1926573 - RNA, 14 nt, Homo sapiens
ugccaggcacuuug

SEQ ID NO: 1926574 - RNA, 18 nt, Homo sapiens
uucacacaacuguggaua

SEQ ID NO: 1926575 - RNA, 19 nt, Homo sapiens
cugucauuuugcacuguaa

SEQ ID NO: 1926576 - RNA, 18 nt, Homo sapiens
agggaguuacugaagucu

SEQ ID NO: 1926577 - RNA, 16 nt, Homo sapiens
caaaguuggugccaag

SEQ ID NO: 1926578 - RNA, 20 nt, Homo sapiens
uaggguuuuccaaugugacu

SEQ ID NO: 1926579 - RNA, 23 nt, Homo sapiens
cgguccgcagaagcagaccucau

SEQ ID NO: 1926580 - RNA, 18 nt, Homo sapiens
ucuggcucuaauucacag

SEQ ID NO: 1926581 - RNA, 13 nt, Homo sapiens
ugugccaccaagc

SEQ ID NO: 1926582 - RNA, 23 nt, Homo sapiens
acaucucuuccuccgaggccagu

SEQ ID NO: 1926583 - RNA, 18 nt, Homo sapiens
acuugauaaauggaacua

SEQ ID NO: 1926584 - RNA, 13 nt, Homo sapiens
ggaaggaacucaa

SEQ ID NO: 1926585 - RNA, 21 nt, Homo sapiens
cagcccugcaccaugcugcug

SEQ ID NO: 1926586 - RNA, 14 nt, Homo sapiens
auacauacauacaa

SEQ ID NO: 1926587 - RNA, 14 nt, Homo sapiens
uucucaacuucucu

SEQ ID NO: 1926588 - RNA, 17 nt, Homo sapiens
uuaagacugaaaauaua

SEQ ID NO: 1926589 - RNA, 13 nt, Homo sapiens
uacuacggagaaa

SEQ ID NO: 1926590 - RNA, 13 nt, Homo sapiens
gccacugcacaga

SEQ ID NO: 1926591 - RNA, 19 nt, Homo sapiens
gcccucugccagggcaccu

SEQ ID NO: 1926592 - RNA, 20 nt, Homo sapiens
auucugcaagcaaucaaaua

SEQ ID NO: 1926593 - RNA, 18 nt, Homo sapiens
ugagaaggugccugccau

SEQ ID NO: 1926594 - RNA, 17 nt, Homo sapiens
ggcuggcaucuccccca

SEQ ID NO: 1926595 - RNA, 15 nt, Homo sapiens
uucucuauugcugcu

SEQ ID NO: 1926596 - RNA, 18 nt, Homo sapiens
ugggggaggcggcacauu

SEQ ID NO: 1926597 - RNA, 14 nt, Homo sapiens
cgcuugaagccuga

SEQ ID NO: 1926598 - RNA, 16 nt, Homo sapiens
agcagcuggguuggua

SEQ ID NO: 1926599 - RNA, 20 nt, Homo sapiens
ugggcuccuggggcaauggg

SEQ ID NO: 1926600 - RNA, 11 nt, Homo sapiens
ucccauacucu

SEQ ID NO: 1926601 - RNA, 17 nt, Homo sapiens
cucuaacgccugagccc

SEQ ID NO: 1926602 - RNA, 23 nt, Homo sapiens
cuugucuuuuuguuaugcaaaug

SEQ ID NO: 1926603 - RNA, 19 nt, Homo sapiens
caucagucuuaauauucag

SEQ ID NO: 1926604 - RNA, 16 nt, Homo sapiens
auauuaaaauagcaua

SEQ ID NO: 1926605 - RNA, 16 nt, Homo sapiens
ugagccauugauucuu

SEQ ID NO: 1926606 - RNA, 16 nt, Homo sapiens
uguucaauuguguauu

SEQ ID NO: 1926607 - RNA, 12 nt, Homo sapiens
ccaaugaccccc

SEQ ID NO: 1926608 - RNA, 20 nt, Homo sapiens
acugccaugcuagacaagcu

SEQ ID NO: 1926609 - RNA, 17 nt, Homo sapiens
uuuaaauagaacuugau

SEQ ID NO: 1926610 - RNA, 15 nt, Homo sapiens
auucuguaguugcag

SEQ ID NO: 1926611 - RNA, 18 nt, Homo sapiens
ggagcccacacaugggau

SEQ ID NO: 1926612 - RNA, 14 nt, Homo sapiens
uagacauaccucuc

SEQ ID NO: 1926613 - RNA, 18 nt, Homo sapiens
gccccacaguuguguuca

SEQ ID NO: 1926614 - RNA, 19 nt, Homo sapiens
aacacacacuguucugaaa

SEQ ID NO: 1926615 - RNA, 21 nt, Homo sapiens
aacaggccgcacaucucacuu

SEQ ID NO: 1926616 - RNA, 12 nt, Homo sapiens
cggggugggggu

SEQ ID NO: 1926617 - RNA, 14 nt, Homo sapiens
augggacuacaggc

SEQ ID NO: 1926618 - RNA, 22 nt, Homo sapiens
augccuggagccacagcagcca

SEQ ID NO: 1926619 - RNA, 14 nt, Homo sapiens
aguggccuuugcaa

SEQ ID NO: 1926620 - RNA, 14 nt, Homo sapiens
gggcauuguaguua

SEQ ID NO: 1926621 - RNA, 21 nt, Homo sapiens
aauagcuccgaccuccaugau

SEQ ID NO: 1926622 - RNA, 22 nt, Homo sapiens
gaggcuccaagccucaaagugc

SEQ ID NO: 1926623 - RNA, 18 nt, Homo sapiens
caaaugcuuucaguaaua

SEQ ID NO: 1926624 - RNA, 12 nt, Homo sapiens
uuccguaucucc

SEQ ID NO: 1926625 - RNA, 18 nt, Homo sapiens
ugugagaccaggggacca

SEQ ID NO: 1926626 - RNA, 22 nt, Homo sapiens
cucuucuaacucauggguaccc

SEQ ID NO: 1926627 - RNA, 18 nt, Homo sapiens
gccguuccgucccaaaca

SEQ ID NO: 1926628 - RNA, 15 nt, Homo sapiens
aucccacauauuuca

SEQ ID NO: 1926629 - RNA, 20 nt, Homo sapiens
ucacaaaaucacaauucucu

SEQ ID NO: 1926630 - RNA, 14 nt, Homo sapiens
ugacuguauacaga

SEQ ID NO: 1926631 - RNA, 16 nt, Homo sapiens
cuauauauuucuuaau

SEQ ID NO: 1926632 - RNA, 22 nt, Homo sapiens
ucuucuuuucuuuuuuuaaaca

SEQ ID NO: 1926633 - RNA, 15 nt, Homo sapiens
ucccccuaaacugug

SEQ ID NO: 1926634 - RNA, 23 nt, Homo sapiens
aaucuguuuauuuacaagggaag

SEQ ID NO: 1926635 - RNA, 12 nt, Homo sapiens
auaaugaauacu

SEQ ID NO: 1926636 - RNA, 19 nt, Homo sapiens
cuguuugccacacccaggu

SEQ ID NO: 1926637 - RNA, 13 nt, Homo sapiens
acauuuucuaccc

SEQ ID NO: 1926638 - RNA, 23 nt, Homo sapiens
uauguauggaugaaagcaaucug

SEQ ID NO: 1926639 - RNA, 21 nt, Homo sapiens
aggaguguccucuucccucuc

SEQ ID NO: 1926640 - RNA, 22 nt, Homo sapiens
auguucccagcucagugccaaa

SEQ ID NO: 1926641 - RNA, 14 nt, Homo sapiens
ggucauccuugcca

SEQ ID NO: 1926642 - RNA, 16 nt, Homo sapiens
acauuaccauauaaug

SEQ ID NO: 1926643 - RNA, 14 nt, Homo sapiens
ucuuucuccaggga

SEQ ID NO: 1926644 - RNA, 17 nt, Homo sapiens
caauccugucauauaau

SEQ ID NO: 1926645 - RNA, 20 nt, Homo sapiens
cauuguaaaagcauuuugua

SEQ ID NO: 1926646 - RNA, 14 nt, Homo sapiens
aacuguuacugucc

SEQ ID NO: 1926647 - RNA, 22 nt, Homo sapiens
cccaagagauuguuguuugcca

SEQ ID NO: 1926648 - RNA, 21 nt, Homo sapiens
acucaccacuaccagccagcc

SEQ ID NO: 1926649 - RNA, 17 nt, Homo sapiens
ccacuaagcuaauucca

SEQ ID NO: 1926650 - RNA, 15 nt, Homo sapiens
acuggaaaacauaga

SEQ ID NO: 1926651 - RNA, 23 nt, Homo sapiens
aagaguaguuauuaguucugcuu

SEQ ID NO: 1926652 - RNA, 23 nt, Homo sapiens
aggugucugagaugggcccguac

SEQ ID NO: 1926653 - RNA, 17 nt, Homo sapiens
aaccaaagaccaucuga

SEQ ID NO: 1926654 - RNA, 15 nt, Homo sapiens
auaaacuagaucucc

SEQ ID NO: 1926655 - RNA, 17 nt, Homo sapiens
acacucaaaucaagaaa

SEQ ID NO: 1926656 - RNA, 23 nt, Homo sapiens
auggccggcuggaaaugcugggc

SEQ ID NO: 1926657 - RNA, 20 nt, Homo sapiens
gguguugugagagcugggau

SEQ ID NO: 1926658 - RNA, 17 nt, Homo sapiens
ucauggaauuggagcuc

SEQ ID NO: 1926659 - RNA, 17 nt, Homo sapiens
ucaaccacagauuuaua

SEQ ID NO: 1926660 - RNA, 19 nt, Homo sapiens
cccaaaagucaccacucca

SEQ ID NO: 1926661 - RNA, 19 nt, Homo sapiens
cauggucuucagcagacaa

SEQ ID NO: 1926662 - RNA, 18 nt, Homo sapiens
uuucauuuuuccaugaca

SEQ ID NO: 1926663 - RNA, 22 nt, Homo sapiens
uucucugggccuucucaccaca

SEQ ID NO: 1926664 - RNA, 15 nt, Homo sapiens
ggaggcugaggcaca

SEQ ID NO: 1926665 - RNA, 14 nt, Homo sapiens
agaugcauacaaag

SEQ ID NO: 1926666 - RNA, 12 nt, Homo sapiens
uucaaacagaac

SEQ ID NO: 1926667 - RNA, 12 nt, Homo sapiens
ggcugagcucuu

SEQ ID NO: 1926668 - RNA, 20 nt, Homo sapiens
gaacucuuuucuuguuuauc

SEQ ID NO: 1926669 - RNA, 17 nt, Homo sapiens
aaaugaugccacuuccc

SEQ ID NO: 1926670 - RNA, 23 nt, Homo sapiens
ccuggaaagaggcagucuucuua

SEQ ID NO: 1926671 - RNA, 14 nt, Homo sapiens
ucacagcugaagaa

SEQ ID NO: 1926672 - RNA, 20 nt, Homo sapiens
aguaccauuaaaaccagaaa

SEQ ID NO: 1926673 - RNA, 14 nt, Homo sapiens
gagagucaagggaa

SEQ ID NO: 1926674 - RNA, 18 nt, Homo sapiens
caggacagggguuccuuc

SEQ ID NO: 1926675 - RNA, 17 nt, Homo sapiens
gaugugaagacaccugc

SEQ ID NO: 1926676 - RNA, 23 nt, Homo sapiens
guuucugugcagauaaacagaaa

SEQ ID NO: 1926677 - RNA, 15 nt, Homo sapiens
augugcagcuauuua

SEQ ID NO: 1926678 - RNA, 16 nt, Homo sapiens
uaccaauauuuacuca

SEQ ID NO: 1926679 - RNA, 14 nt, Homo sapiens
aauaacuaugcuuu

SEQ ID NO: 1926680 - RNA, 22 nt, Homo sapiens
gugucagagcugggaguagcau

SEQ ID NO: 1926681 - RNA, 22 nt, Homo sapiens
ugucugucagacacacacaggu

SEQ ID NO: 1926682 - RNA, 15 nt, Homo sapiens
ucacaacauuccuca

SEQ ID NO: 1926683 - RNA, 15 nt, Homo sapiens
gaaccuagugcauuu

SEQ ID NO: 1926684 - RNA, 20 nt, Homo sapiens
aaauguaauacuccuaagac

SEQ ID NO: 1926685 - RNA, 13 nt, Homo sapiens
acuguagauuuaa

SEQ ID NO: 1926686 - RNA, 15 nt, Homo sapiens
ccggcagcacaagcu

SEQ ID NO: 1926687 - RNA, 15 nt, Homo sapiens
augugucuggaagaa

SEQ ID NO: 1926688 - RNA, 14 nt, Homo sapiens
ccgucucuuuaaaa

SEQ ID NO: 1926689 - RNA, 18 nt, Homo sapiens
uccaucagccuccauccu

SEQ ID NO: 1926690 - RNA, 17 nt, Homo sapiens
auguccaaacuuaacag

SEQ ID NO: 1926691 - RNA, 21 nt, Homo sapiens
cugauguccuaccacuuugaa

SEQ ID NO: 1926692 - RNA, 20 nt, Homo sapiens
uggaaguuuagcucugagaa

SEQ ID NO: 1926693 - RNA, 15 nt, Homo sapiens
uggaccaguacuccc

SEQ ID NO: 1926694 - RNA, 21 nt, Homo sapiens
cacagauaccucaucauccac

SEQ ID NO: 1926695 - RNA, 18 nt, Homo sapiens
ucuaauauggcaaccauu

SEQ ID NO: 1926696 - RNA, 21 nt, Homo sapiens
aaucccucuccacucuucucu

SEQ ID NO: 1926697 - RNA, 19 nt, Homo sapiens
acauacuaaugaaguauua

SEQ ID NO: 1926698 - RNA, 20 nt, Homo sapiens
uacguuaugauaguguccca

SEQ ID NO: 1926699 - RNA, 15 nt, Homo sapiens
ggaucaagucacuca

SEQ ID NO: 1926700 - RNA, 22 nt, Homo sapiens
cuucaugcgcaguccccaggua

SEQ ID NO: 1926701 - RNA, 12 nt, Homo sapiens
uucacuggccac

SEQ ID NO: 1926702 - RNA, 20 nt, Homo sapiens
gaaguauuuuccuccaaagu

SEQ ID NO: 1926703 - RNA, 15 nt, Homo sapiens
caugcauacauacac

SEQ ID NO: 1926704 - RNA, 15 nt, Homo sapiens
ggggugcagggaugu

SEQ ID NO: 1926705 - RNA, 15 nt, Homo sapiens
cccaggcugaagagu

SEQ ID NO: 1926706 - RNA, 17 nt, Homo sapiens
uauuuguauaauggugu

SEQ ID NO: 1926707 - RNA, 20 nt, Homo sapiens
uuaauauuuuccuaguagau

SEQ ID NO: 1926708 - RNA, 14 nt, Homo sapiens
uuugauugauuuga

SEQ ID NO: 1926709 - RNA, 13 nt, Homo sapiens
auaaguacauuau

SEQ ID NO: 1926710 - RNA, 16 nt, Homo sapiens
uuuucugucacuguag

SEQ ID NO: 1926711 - RNA, 14 nt, Homo sapiens
ccaucucacugcag

SEQ ID NO: 1926712 - RNA, 19 nt, Homo sapiens
caaagcaguagucaaggag

SEQ ID NO: 1926713 - RNA, 20 nt, Homo sapiens
gacaaugggcacacagggaa

SEQ ID NO: 1926714 - RNA, 12 nt, Homo sapiens
acuuuagugaaa

SEQ ID NO: 1926715 - RNA, 12 nt, Homo sapiens
ccugaggugccc

SEQ ID NO: 1926716 - RNA, 23 nt, Homo sapiens
gaaauuuauuuccuaguucugua

SEQ ID NO: 1926717 - RNA, 17 nt, Homo sapiens
cuuggccgacucaggga

SEQ ID NO: 1926718 - RNA, 23 nt, Homo sapiens
gccucuuugugugcgucacugug

SEQ ID NO: 1926719 - RNA, 13 nt, Homo sapiens
ccugacugguugu

SEQ ID NO: 1926720 - RNA, 13 nt, Homo sapiens
guucucugccuca

SEQ ID NO: 1926721 - RNA, 17 nt, Homo sapiens
caguugcuuugcccaag

SEQ ID NO: 1926722 - RNA, 16 nt, Homo sapiens
ggacucuacacuguga

SEQ ID NO: 1926723 - RNA, 14 nt, Homo sapiens
agacaugugugugu

SEQ ID NO: 1926724 - RNA, 17 nt, Homo sapiens
aagcaucaguagcugag

SEQ ID NO: 1926725 - RNA, 20 nt, Homo sapiens
uagucuuacuaaaugcagaa

SEQ ID NO: 1926726 - RNA, 16 nt, Homo sapiens
uaggugauccacucgc

SEQ ID NO: 1926727 - RNA, 15 nt, Homo sapiens
ggccauuuacuguaa

SEQ ID NO: 1926728 - RNA, 15 nt, Homo sapiens
ucacuugcucuuuga

SEQ ID NO: 1926729 - RNA, 16 nt, Homo sapiens
cucacacccuaccuuc

SEQ ID NO: 1926730 - RNA, 22 nt, Homo sapiens
guuacugacaagccucagcaaa

SEQ ID NO: 1926731 - RNA, 11 nt, Homo sapiens
guagcugcuac

SEQ ID NO: 1926732 - RNA, 19 nt, Homo sapiens
ccacagguucucacuagau

SEQ ID NO: 1926733 - RNA, 15 nt, Homo sapiens
acuuuucaccaauga

SEQ ID NO: 1926734 - RNA, 19 nt, Homo sapiens
aaaaauaaaugucacugcc

SEQ ID NO: 1926735 - RNA, 18 nt, Homo sapiens
caguuuaagguacacugu

SEQ ID NO: 1926736 - RNA, 13 nt, Homo sapiens
agauguaguuuuc

SEQ ID NO: 1926737 - RNA, 15 nt, Homo sapiens
cccuccaucuacccc

SEQ ID NO: 1926738 - RNA, 17 nt, Homo sapiens
caaaauacagcuaugaa

SEQ ID NO: 1926739 - RNA, 24 nt, Homo sapiens
caugaacaaauucuuuaguacuca

SEQ ID NO: 1926740 - RNA, 15 nt, Homo sapiens
uucuuacccauauau

SEQ ID NO: 1926741 - RNA, 22 nt, Homo sapiens
uucacuuucccaaaacugccac

SEQ ID NO: 1926742 - RNA, 13 nt, Homo sapiens
gcaguagugucac

SEQ ID NO: 1926743 - RNA, 13 nt, Homo sapiens
ggccucugugcag

SEQ ID NO: 1926744 - RNA, 23 nt, Homo sapiens
ccuaaccucuuuucugcaucauc

SEQ ID NO: 1926745 - RNA, 23 nt, Homo sapiens
ccagaggggugcgcagagcugac

SEQ ID NO: 1926746 - RNA, 14 nt, Homo sapiens
gcugaagauggcau

SEQ ID NO: 1926747 - RNA, 17 nt, Homo sapiens
augcccuccauguguaa

SEQ ID NO: 1926748 - RNA, 22 nt, Homo sapiens
agagauacuguuguuacuucug

SEQ ID NO: 1926749 - RNA, 23 nt, Homo sapiens
uacucugcacauacgcaccacau

SEQ ID NO: 1926750 - RNA, 19 nt, Homo sapiens
caagaucgcaccauugcac

SEQ ID NO: 1926751 - RNA, 15 nt, Homo sapiens
cacccauaccagcua

SEQ ID NO: 1926752 - RNA, 13 nt, Homo sapiens
auauaaucauauc

SEQ ID NO: 1926753 - RNA, 13 nt, Homo sapiens
aaagcaucaaaga

SEQ ID NO: 1926754 - RNA, 16 nt, Homo sapiens
acucauuaaugaauca

SEQ ID NO: 1926755 - RNA, 15 nt, Homo sapiens
ggggcagcaccuccu

SEQ ID NO: 1926756 - RNA, 24 nt, Homo sapiens
cuuucaggccacauggcuaaagaa

SEQ ID NO: 1926757 - RNA, 19 nt, Homo sapiens
uguaaucccagcauuuuga

SEQ ID NO: 1926758 - RNA, 14 nt, Homo sapiens
auuucacuugauga

SEQ ID NO: 1926759 - RNA, 15 nt, Homo sapiens
cgagacuccaucuca

SEQ ID NO: 1926760 - RNA, 17 nt, Homo sapiens
ccagaccucaggugcua

SEQ ID NO: 1926761 - RNA, 14 nt, Homo sapiens
acaggcagcauuua

SEQ ID NO: 1926762 - RNA, 21 nt, Homo sapiens
auacauaaacaagaccacguu

SEQ ID NO: 1926763 - RNA, 17 nt, Homo sapiens
uucaaaguaauauauca

SEQ ID NO: 1926764 - RNA, 15 nt, Homo sapiens
cagcuuccaugcuga

SEQ ID NO: 1926765 - RNA, 22 nt, Homo sapiens
uggcagguccucuguugcaaac

SEQ ID NO: 1926766 - RNA, 14 nt, Homo sapiens
cccugaucaaguca

SEQ ID NO: 1926767 - RNA, 20 nt, Homo sapiens
uaaagaucugcaacuacuau

SEQ ID NO: 1926768 - RNA, 15 nt, Homo sapiens
agcuucuagaggcuc

SEQ ID NO: 1926769 - RNA, 17 nt, Homo sapiens
gauggccuuacacugaa

SEQ ID NO: 1926770 - RNA, 20 nt, Homo sapiens
acaaccaaaaaauucuacaa

SEQ ID NO: 1926771 - RNA, 21 nt, Homo sapiens
cugcucugaggcuuccagaga

SEQ ID NO: 1926772 - RNA, 18 nt, Homo sapiens
ugggaugaaacuaaagca

SEQ ID NO: 1926773 - RNA, 22 nt, Homo sapiens
caguuuuccagaacacucuuag

SEQ ID NO: 1926774 - RNA, 20 nt, Homo sapiens
uucuggauuucauacuguaa

SEQ ID NO: 1926775 - RNA, 22 nt, Homo sapiens
uuccagggggcagcccagugga

SEQ ID NO: 1926776 - RNA, 20 nt, Homo sapiens
aauacagaucaucuuggaac

SEQ ID NO: 1926777 - RNA, 20 nt, Homo sapiens
ugcacaaaauagcacaucca

SEQ ID NO: 1926778 - RNA, 20 nt, Homo sapiens
aaauugaacuaaauccaaac

SEQ ID NO: 1926779 - RNA, 20 nt, Homo sapiens
cuacauuuuauuacacuaaa

SEQ ID NO: 1926780 - RNA, 14 nt, Homo sapiens
uccugagggagcuc

SEQ ID NO: 1926781 - RNA, 14 nt, Homo sapiens
ggggcugcugugau

SEQ ID NO: 1926782 - RNA, 12 nt, Homo sapiens
aaagauacuuga

SEQ ID NO: 1926783 - RNA, 17 nt, Homo sapiens
ugaaaguauguuuuacu

SEQ ID NO: 1926784 - RNA, 16 nt, Homo sapiens
uagcaugacguguggu

SEQ ID NO: 1926785 - RNA, 19 nt, Homo sapiens
ggcauaucaagguuccuga

SEQ ID NO: 1926786 - RNA, 21 nt, Homo sapiens
gcagauccccacuguccuacc

SEQ ID NO: 1926787 - RNA, 14 nt, Homo sapiens
ugccaaccagacac

SEQ ID NO: 1926788 - RNA, 17 nt, Homo sapiens
cuuucaaagccauuuua

SEQ ID NO: 1926789 - RNA, 17 nt, Homo sapiens
gucuuuuuacuacaaac

SEQ ID NO: 1926790 - RNA, 14 nt, Homo sapiens
gggcagugcccaug

SEQ ID NO: 1926791 - RNA, 22 nt, Homo sapiens
agacauucucgcuucccugaaa

SEQ ID NO: 1926792 - RNA, 14 nt, Homo sapiens
guucagaguggcuc

SEQ ID NO: 1926793 - RNA, 18 nt, Homo sapiens
auuucuaaguguuucaca

SEQ ID NO: 1926794 - RNA, 17 nt, Homo sapiens
gacauaaucuaguuuua

SEQ ID NO: 1926795 - RNA, 21 nt, Homo sapiens
aucacagcaaugcucuauucc

SEQ ID NO: 1926796 - RNA, 21 nt, Homo sapiens
auaaggcagugcagugcucag

SEQ ID NO: 1926797 - RNA, 19 nt, Homo sapiens
ucagcccccaccucagguu

SEQ ID NO: 1926798 - RNA, 20 nt, Homo sapiens
cuugucugguaaguggcuuc

SEQ ID NO: 1926799 - RNA, 18 nt, Homo sapiens
aacaauguuugauacucu

SEQ ID NO: 1926800 - RNA, 15 nt, Homo sapiens
aggucagggugagga

SEQ ID NO: 1926801 - RNA, 14 nt, Homo sapiens
gcuuuuuugcaaua

SEQ ID NO: 1926802 - RNA, 18 nt, Homo sapiens
ggaccauggggagguggc

SEQ ID NO: 1926803 - RNA, 23 nt, Homo sapiens
cacagagcuccuggcccuggcca

SEQ ID NO: 1926804 - RNA, 22 nt, Homo sapiens
uaaaugacugcugaaugacaua

SEQ ID NO: 1926805 - RNA, 18 nt, Homo sapiens
uauccauuacgugcauuu

SEQ ID NO: 1926806 - RNA, 17 nt, Homo sapiens
agucgagcuuuucuaaa

SEQ ID NO: 1926807 - RNA, 15 nt, Homo sapiens
aucucuucacuaccc

SEQ ID NO: 1926808 - RNA, 17 nt, Homo sapiens
ccucucaguuguugaaa

SEQ ID NO: 1926809 - RNA, 23 nt, Homo sapiens
agggcaauggcaccgucuuggcu

SEQ ID NO: 1926810 - RNA, 17 nt, Homo sapiens
ggaagcuccacugucac

SEQ ID NO: 1926811 - RNA, 15 nt, Homo sapiens
accccaaaccuggca

SEQ ID NO: 1926812 - RNA, 16 nt, Homo sapiens
auguuuaguuuuacau

SEQ ID NO: 1926813 - RNA, 16 nt, Homo sapiens
uaaaaugacuauuucu

SEQ ID NO: 1926814 - RNA, 11 nt, Homo sapiens
gauuugccuca

SEQ ID NO: 1926815 - RNA, 19 nt, Homo sapiens
cacaugauuccagccauca

SEQ ID NO: 1926816 - RNA, 22 nt, Homo sapiens
uuuagaacuuuaccuauggaag

SEQ ID NO: 1926817 - RNA, 11 nt, Homo sapiens
uguaugcauca

SEQ ID NO: 1926818 - RNA, 19 nt, Homo sapiens
uagaugaagaagcuagaaa

SEQ ID NO: 1926819 - RNA, 19 nt, Homo sapiens
ggugagcagggucagugga

SEQ ID NO: 1926820 - RNA, 23 nt, Homo sapiens
gucauuggccacugucuccacuc

SEQ ID NO: 1926821 - RNA, 19 nt, Homo sapiens
gaggucuguuagguguaca

SEQ ID NO: 1926822 - RNA, 14 nt, Homo sapiens
ggcucccacugccc

SEQ ID NO: 1926823 - RNA, 20 nt, Homo sapiens
cauaaugaaugcuauugaaa

SEQ ID NO: 1926824 - RNA, 14 nt, Homo sapiens
cucauccuccuucu

SEQ ID NO: 1926825 - RNA, 15 nt, Homo sapiens
gcuaguguaccuccu

SEQ ID NO: 1926826 - RNA, 15 nt, Homo sapiens
acacaggugcacaga

SEQ ID NO: 1926827 - RNA, 12 nt, Homo sapiens
acaaaaugcaag

SEQ ID NO: 1926828 - RNA, 12 nt, Homo sapiens
aaugaaugccua

SEQ ID NO: 1926829 - RNA, 13 nt, Homo sapiens
uuaguuauacucc

SEQ ID NO: 1926830 - RNA, 19 nt, Homo sapiens
gcagcaccuccgggacuga

SEQ ID NO: 1926831 - RNA, 23 nt, Homo sapiens
acuucuggcauaacuaaaauuaa

SEQ ID NO: 1926832 - RNA, 19 nt, Homo sapiens
aauacacucaagugccauu

SEQ ID NO: 1926833 - RNA, 17 nt, Homo sapiens
aguggcccauggcauuu

SEQ ID NO: 1926834 - RNA, 20 nt, Homo sapiens
gaaggcaucagaaacaucug

SEQ ID NO: 1926835 - RNA, 16 nt, Homo sapiens
uuggcuucuaaucaaa

SEQ ID NO: 1926836 - RNA, 22 nt, Homo sapiens
cuuauuagggagaaaauucaau

SEQ ID NO: 1926837 - RNA, 20 nt, Homo sapiens
cccuggugccucugugcaca

SEQ ID NO: 1926838 - RNA, 18 nt, Homo sapiens
cuuucuugcacuguccag

SEQ ID NO: 1926839 - RNA, 23 nt, Homo sapiens
ccugcuuagcugccuugagcuaa

SEQ ID NO: 1926840 - RNA, 22 nt, Homo sapiens
accacaagggcucucuuaggca

SEQ ID NO: 1926841 - RNA, 22 nt, Homo sapiens
auagcagcugcuacuagcucuu

SEQ ID NO: 1926842 - RNA, 12 nt, Homo sapiens
auccaacgugaa

SEQ ID NO: 1926843 - RNA, 21 nt, Homo sapiens
aagcagaaaauuguacaaccu

SEQ ID NO: 1926844 - RNA, 12 nt, Homo sapiens
gugaaugcuucu

SEQ ID NO: 1926845 - RNA, 19 nt, Homo sapiens
ugaauauaugauuugcaug

SEQ ID NO: 1926846 - RNA, 17 nt, Homo sapiens
uaacaaucacaaaggaa

SEQ ID NO: 1926847 - RNA, 18 nt, Homo sapiens
agugaaagagaguaccau

SEQ ID NO: 1926848 - RNA, 14 nt, Homo sapiens
accacugaguccac

SEQ ID NO: 1926849 - RNA, 16 nt, Homo sapiens
uaaauguuuucauugg

SEQ ID NO: 1926850 - RNA, 21 nt, Homo sapiens
acuccagccugggcgacaaaa

SEQ ID NO: 1926851 - RNA, 17 nt, Homo sapiens
ccacuuuggagcacugu

SEQ ID NO: 1926852 - RNA, 13 nt, Homo sapiens
uauauacauucuu

SEQ ID NO: 1926853 - RNA, 13 nt, Homo sapiens
aauuaacaaucaa

SEQ ID NO: 1926854 - RNA, 18 nt, Homo sapiens
agaagacaccagagcaga

SEQ ID NO: 1926855 - RNA, 18 nt, Homo sapiens
gaugaccaaucucuguga

SEQ ID NO: 1926856 - RNA, 22 nt, Homo sapiens
augccgccccggacaguggcac

SEQ ID NO: 1926857 - RNA, 20 nt, Homo sapiens
gaaacauuuuuguucuuaug

SEQ ID NO: 1926858 - RNA, 20 nt, Homo sapiens
agccugggcaacaagagcaa

SEQ ID NO: 1926859 - RNA, 20 nt, Homo sapiens
cacgcggccccacauugcac

SEQ ID NO: 1926860 - RNA, 14 nt, Homo sapiens
ucaggauguucucc

SEQ ID NO: 1926861 - RNA, 14 nt, Homo sapiens
ccaggcugcucuca

SEQ ID NO: 1926862 - RNA, 20 nt, Homo sapiens
cugcucuagaggcccaagcu

SEQ ID NO: 1926863 - RNA, 16 nt, Homo sapiens
acugaaggugcaguug

SEQ ID NO: 1926864 - RNA, 21 nt, Homo sapiens
ccaacuagcucuauguuuaca

SEQ ID NO: 1926865 - RNA, 14 nt, Homo sapiens
aagcuuccauucca

SEQ ID NO: 1926866 - RNA, 21 nt, Homo sapiens
ggcaggugccccucucuccau

SEQ ID NO: 1926867 - RNA, 21 nt, Homo sapiens
uaagcaaaaugcuucugcaca

SEQ ID NO: 1926868 - RNA, 23 nt, Homo sapiens
gggagcuggaaauaaaccuggag

SEQ ID NO: 1926869 - RNA, 23 nt, Homo sapiens
ccugcuuuugugucccauucaca

SEQ ID NO: 1926870 - RNA, 23 nt, Homo sapiens
gauuucuccaaccacucaucccu

SEQ ID NO: 1926871 - RNA, 21 nt, Homo sapiens
ugaauagugugguucagugag

SEQ ID NO: 1926872 - RNA, 19 nt, Homo sapiens
aacugguuugccuauaauu

SEQ ID NO: 1926873 - RNA, 16 nt, Homo sapiens
aagguauucgaaugaa

SEQ ID NO: 1926874 - RNA, 21 nt, Homo sapiens
aagugcagcuugacauuaugu

SEQ ID NO: 1926875 - RNA, 16 nt, Homo sapiens
cauagagugugaugua

SEQ ID NO: 1926876 - RNA, 22 nt, Homo sapiens
ccccugagcccaaggcacugag

SEQ ID NO: 1926877 - RNA, 15 nt, Homo sapiens
ggcugagcugagcuu

SEQ ID NO: 1926878 - RNA, 12 nt, Homo sapiens
cugccucagguu

SEQ ID NO: 1926879 - RNA, 18 nt, Homo sapiens
gacgugcacugacagccu

SEQ ID NO: 1926880 - RNA, 14 nt, Homo sapiens
cauuugcugccauu

SEQ ID NO: 1926881 - RNA, 21 nt, Homo sapiens
caauccuaugcaugguuucag

SEQ ID NO: 1926882 - RNA, 15 nt, Homo sapiens
acaaggaaauacccu

SEQ ID NO: 1926883 - RNA, 14 nt, Homo sapiens
gguucaacuuauua

SEQ ID NO: 1926884 - RNA, 17 nt, Homo sapiens
uauccuucacaauuuca

SEQ ID NO: 1926885 - RNA, 22 nt, Homo sapiens
ggcugcuuccugugacagugaa

SEQ ID NO: 1926886 - RNA, 14 nt, Homo sapiens
cgggagcugcacua

SEQ ID NO: 1926887 - RNA, 17 nt, Homo sapiens
acgauggcaauuggcau

SEQ ID NO: 1926888 - RNA, 18 nt, Homo sapiens
gccggagggcaccaggga

SEQ ID NO: 1926889 - RNA, 19 nt, Homo sapiens
uuccaaugcuucuguugau

SEQ ID NO: 1926890 - RNA, 13 nt, Homo sapiens
ccuugaggggcua

SEQ ID NO: 1926891 - RNA, 21 nt, Homo sapiens
uaugacaugaucgcuuucuac

SEQ ID NO: 1926892 - RNA, 19 nt, Homo sapiens
aaacagcagcagcaaacaa

SEQ ID NO: 1926893 - RNA, 17 nt, Homo sapiens
caaagagaaacuuguaa

SEQ ID NO: 1926894 - RNA, 20 nt, Homo sapiens
cccuccccauucagacacuu

SEQ ID NO: 1926895 - RNA, 19 nt, Homo sapiens
ccccagaaaaaggccgggu

SEQ ID NO: 1926896 - RNA, 15 nt, Homo sapiens
agcauaauacuugcu

SEQ ID NO: 1926897 - RNA, 14 nt, Homo sapiens
gccagcugcggcca

SEQ ID NO: 1926898 - RNA, 17 nt, Homo sapiens
cugcuaggcgcugggga

SEQ ID NO: 1926899 - RNA, 13 nt, Homo sapiens
acugacucuguua

SEQ ID NO: 1926900 - RNA, 21 nt, Homo sapiens
uaaaagucacgugaaacagag

SEQ ID NO: 1926901 - RNA, 22 nt, Homo sapiens
ucuugccugcaugaaacauguu

SEQ ID NO: 1926902 - RNA, 20 nt, Homo sapiens
auggcagcuguuucucauga

SEQ ID NO: 1926903 - RNA, 19 nt, Homo sapiens
agaauguucauacugaugu

SEQ ID NO: 1926904 - RNA, 18 nt, Homo sapiens
uccuugauaaaugccuca

SEQ ID NO: 1926905 - RNA, 23 nt, Homo sapiens
uuacaguaggagcccagcucuga

SEQ ID NO: 1926906 - RNA, 17 nt, Homo sapiens
cauaggaaaaugccaug

SEQ ID NO: 1926907 - RNA, 17 nt, Homo sapiens
agcaacuugaacuucac

SEQ ID NO: 1926908 - RNA, 21 nt, Homo sapiens
acccaggggaaacgagcugug

SEQ ID NO: 1926909 - RNA, 19 nt, Homo sapiens
ucacauugcacucaucaua

SEQ ID NO: 1926910 - RNA, 23 nt, Homo sapiens
ugcccacgucccgggcacuguca

SEQ ID NO: 1926911 - RNA, 22 nt, Homo sapiens
cuucccgcaaaucaacacuuuc

SEQ ID NO: 1926912 - RNA, 16 nt, Homo sapiens
uaagugccauuacuac

SEQ ID NO: 1926913 - RNA, 15 nt, Homo sapiens
ucaucaaucuuuaug

SEQ ID NO: 1926914 - RNA, 22 nt, Homo sapiens
cuuucccccugugaaagcaaaa

SEQ ID NO: 1926915 - RNA, 19 nt, Homo sapiens
ccuggaagccggccggcug

SEQ ID NO: 1926916 - RNA, 22 nt, Homo sapiens
cuaucgucaggaaaccaaauaa

SEQ ID NO: 1926917 - RNA, 17 nt, Homo sapiens
cugcugaaggaggguca

SEQ ID NO: 1926918 - RNA, 15 nt, Homo sapiens
ucacgauuccagugc

SEQ ID NO: 1926919 - RNA, 11 nt, Homo sapiens
ucuucauucag

SEQ ID NO: 1926920 - RNA, 22 nt, Homo sapiens
cuauuuauuaaaaacaugacca

SEQ ID NO: 1926921 - RNA, 18 nt, Homo sapiens
aggcagaucccacuugca

SEQ ID NO: 1926922 - RNA, 13 nt, Homo sapiens
uucuaggcaaaag

SEQ ID NO: 1926923 - RNA, 19 nt, Homo sapiens
acagguggugagaaauuuc

SEQ ID NO: 1926924 - RNA, 15 nt, Homo sapiens
cacuagaaugcaagu

SEQ ID NO: 1926925 - RNA, 21 nt, Homo sapiens
uuauaggcaccuaccaccacg

SEQ ID NO: 1926926 - RNA, 17 nt, Homo sapiens
uaaauauuuguccuuaa

SEQ ID NO: 1926927 - RNA, 22 nt, Homo sapiens
cuuuaguguucaaauacuucaa

SEQ ID NO: 1926928 - RNA, 14 nt, Homo sapiens
gcuuuagcacagga

SEQ ID NO: 1926929 - RNA, 21 nt, Homo sapiens
uucacaaaauaucaccaaaaa

SEQ ID NO: 1926930 - RNA, 17 nt, Homo sapiens
uaccugcgauguuuacg

SEQ ID NO: 1926931 - RNA, 14 nt, Homo sapiens
ccgaggaagcacag

SEQ ID NO: 1926932 - RNA, 12 nt, Homo sapiens
aagcaccaggac

SEQ ID NO: 1926933 - RNA, 21 nt, Homo sapiens
gcuucuccaauacagcaaacc

SEQ ID NO: 1926934 - RNA, 18 nt, Homo sapiens
aaucaaaggcgcuuugaa

SEQ ID NO: 1926935 - RNA, 14 nt, Homo sapiens
agaguugagcucuc

SEQ ID NO: 1926936 - RNA, 16 nt, Homo sapiens
cucaaaacacccaaaa

SEQ ID NO: 1926937 - RNA, 14 nt, Homo sapiens
aucaugcugagaga

SEQ ID NO: 1926938 - RNA, 19 nt, Homo sapiens
guuauuaauuaauauucau

SEQ ID NO: 1926939 - RNA, 18 nt, Homo sapiens
ccaucagugaauccugaa

SEQ ID NO: 1926940 - RNA, 14 nt, Homo sapiens
ugcgcaaaacugaa

SEQ ID NO: 1926941 - RNA, 20 nt, Homo sapiens
auucuugagggacaaugcca

SEQ ID NO: 1926942 - RNA, 12 nt, Homo sapiens
aaaaaaaauccc

SEQ ID NO: 1926943 - RNA, 12 nt, Homo sapiens
uccucacccacc

SEQ ID NO: 1926944 - RNA, 17 nt, Homo sapiens
caagagucuggggacca

SEQ ID NO: 1926945 - RNA, 17 nt, Homo sapiens
cauaaaauagagugcau

SEQ ID NO: 1926946 - RNA, 15 nt, Homo sapiens
cagcgcuucuaugca

SEQ ID NO: 1926947 - RNA, 17 nt, Homo sapiens
acugauucccucuccca

SEQ ID NO: 1926948 - RNA, 22 nt, Homo sapiens
aaagaaaaguuuaccaucugaa

SEQ ID NO: 1926949 - RNA, 22 nt, Homo sapiens
cacagcaucauuuugcauucaa

SEQ ID NO: 1926950 - RNA, 17 nt, Homo sapiens
gccuggucugugcauug

SEQ ID NO: 1926951 - RNA, 14 nt, Homo sapiens
guggugauguugcc

SEQ ID NO: 1926952 - RNA, 22 nt, Homo sapiens
gugugaaccacuguguacugga

SEQ ID NO: 1926953 - RNA, 17 nt, Homo sapiens
auugucaccuagcagau

SEQ ID NO: 1926954 - RNA, 19 nt, Homo sapiens
uagaugguaauaaucugga

SEQ ID NO: 1926955 - RNA, 18 nt, Homo sapiens
uuaagacaacaggcauuu

SEQ ID NO: 1926956 - RNA, 18 nt, Homo sapiens
ucuaccugagucccaaag

SEQ ID NO: 1926957 - RNA, 15 nt, Homo sapiens
caagucaccaugcug

SEQ ID NO: 1926958 - RNA, 14 nt, Homo sapiens
uuucaccuucauau

SEQ ID NO: 1926959 - RNA, 16 nt, Homo sapiens
gcuccuuuacaaaaga

SEQ ID NO: 1926960 - RNA, 14 nt, Homo sapiens
acugcaaaccgcca

SEQ ID NO: 1926961 - RNA, 14 nt, Homo sapiens
auugacaacugcac

SEQ ID NO: 1926962 - RNA, 22 nt, Homo sapiens
gaaaccucuuccuaggccacgu

SEQ ID NO: 1926963 - RNA, 13 nt, Homo sapiens
auacgcaucagac

SEQ ID NO: 1926964 - RNA, 22 nt, Homo sapiens
ucaggcucuguuccucaauggc

SEQ ID NO: 1926965 - RNA, 14 nt, Homo sapiens
gugcacaguggcuu

SEQ ID NO: 1926966 - RNA, 17 nt, Homo sapiens
cauuauuuaauuacaga

SEQ ID NO: 1926967 - RNA, 14 nt, Homo sapiens
agaucaaacuucca

SEQ ID NO: 1926968 - RNA, 21 nt, Homo sapiens
aaaauucagaguccuugcaaa

SEQ ID NO: 1926969 - RNA, 16 nt, Homo sapiens
aaaauaaaggcucugu

SEQ ID NO: 1926970 - RNA, 14 nt, Homo sapiens
uguuuuaguucuug

SEQ ID NO: 1926971 - RNA, 14 nt, Homo sapiens
uuucugagugccuu

SEQ ID NO: 1926972 - RNA, 17 nt, Homo sapiens
gagauguggucaaugga

SEQ ID NO: 1926973 - RNA, 17 nt, Homo sapiens
aucucagaguccaguca

SEQ ID NO: 1926974 - RNA, 14 nt, Homo sapiens
ugauauauauaugc

SEQ ID NO: 1926975 - RNA, 15 nt, Homo sapiens
aacugaugauuucac

SEQ ID NO: 1926976 - RNA, 15 nt, Homo sapiens
auccauugaacuaaa

SEQ ID NO: 1926977 - RNA, 21 nt, Homo sapiens
agugaaauaauuaaaaaccac

SEQ ID NO: 1926978 - RNA, 15 nt, Homo sapiens
cuucgucuucacucu

SEQ ID NO: 1926979 - RNA, 19 nt, Homo sapiens
ucagacauuccauggugau

SEQ ID NO: 1926980 - RNA, 14 nt, Homo sapiens
uaaaugaccaaaga

SEQ ID NO: 1926981 - RNA, 13 nt, Homo sapiens
agugugugcaagu

SEQ ID NO: 1926982 - RNA, 12 nt, Homo sapiens
ugucugccuguu

SEQ ID NO: 1926983 - RNA, 21 nt, Homo sapiens
ccagugguggguaauuguaca

SEQ ID NO: 1926984 - RNA, 19 nt, Homo sapiens
gcagaaauuuaucuuucaa

SEQ ID NO: 1926985 - RNA, 19 nt, Homo sapiens
cccuucucuccugcuuccu

SEQ ID NO: 1926986 - RNA, 18 nt, Homo sapiens
cgagaagguacugaaaua

SEQ ID NO: 1926987 - RNA, 20 nt, Homo sapiens
aucugugcaccacuugacag

SEQ ID NO: 1926988 - RNA, 19 nt, Homo sapiens
uuguauaaauaagcacuau

SEQ ID NO: 1926989 - RNA, 14 nt, Homo sapiens
cauuucuacuuuau

SEQ ID NO: 1926990 - RNA, 12 nt, Homo sapiens
auucgugcagca

SEQ ID NO: 1926991 - RNA, 19 nt, Homo sapiens
aauuccaccuggaaagcca

SEQ ID NO: 1926992 - RNA, 14 nt, Homo sapiens
gagugcagugccac

SEQ ID NO: 1926993 - RNA, 17 nt, Homo sapiens
ugucaagguccuaaagu

SEQ ID NO: 1926994 - RNA, 19 nt, Homo sapiens
auuuuugccacguuuaaca

SEQ ID NO: 1926995 - RNA, 19 nt, Homo sapiens
gcuguagacauuugcuaug

SEQ ID NO: 1926996 - RNA, 12 nt, Homo sapiens
aacuuucagugg

SEQ ID NO: 1926997 - RNA, 20 nt, Homo sapiens
uucucuuuuccuuugguccu

SEQ ID NO: 1926998 - RNA, 13 nt, Homo sapiens
cugcuuaagugcc

SEQ ID NO: 1926999 - RNA, 21 nt, Homo sapiens
aaaacucuucagugcaaauug

SEQ ID NO: 1927000 - RNA, 15 nt, Homo sapiens
agugguacauuccau

SEQ ID NO: 1927001 - RNA, 13 nt, Homo sapiens
uuaguuggcugga

SEQ ID NO: 1927002 - RNA, 21 nt, Homo sapiens
aauauauaguggguacaucaa

SEQ ID NO: 1927003 - RNA, 18 nt, Homo sapiens
cgguuaagaaagcacuua

SEQ ID NO: 1927004 - RNA, 11 nt, Homo sapiens
uuuuaaucucc

SEQ ID NO: 1927005 - RNA, 17 nt, Homo sapiens
aaagcucaaaguaugca

SEQ ID NO: 1927006 - RNA, 23 nt, Homo sapiens
cugaggacaagagaaaaaagcca

SEQ ID NO: 1927007 - RNA, 21 nt, Homo sapiens
caguacagccuccggaagcag

SEQ ID NO: 1927008 - RNA, 13 nt, Homo sapiens
auauaaucaauca

SEQ ID NO: 1927009 - RNA, 12 nt, Homo sapiens
ucacacacagcc

SEQ ID NO: 1927010 - RNA, 21 nt, Homo sapiens
agcaaggguugggcccagugu

SEQ ID NO: 1927011 - RNA, 20 nt, Homo sapiens
ucucaaaccccugaccucaa

SEQ ID NO: 1927012 - RNA, 20 nt, Homo sapiens
uauucuuugaaaacagauga

SEQ ID NO: 1927013 - RNA, 13 nt, Homo sapiens
agcugcaccugcc

SEQ ID NO: 1927014 - RNA, 21 nt, Homo sapiens
acuucccuuaggauaacagcc

SEQ ID NO: 1927015 - RNA, 22 nt, Homo sapiens
cuccaaaaaagaaacauuguua

SEQ ID NO: 1927016 - RNA, 19 nt, Homo sapiens
ucagccuccccuucuuccc

SEQ ID NO: 1927017 - RNA, 17 nt, Homo sapiens
gguagcaucauugaucu

SEQ ID NO: 1927018 - RNA, 12 nt, Homo sapiens
acugcauccuca

SEQ ID NO: 1927019 - RNA, 23 nt, Homo sapiens
cgugccugcuacgaacgcuccaa

SEQ ID NO: 1927020 - RNA, 21 nt, Homo sapiens
gagggccuaaccgagaucagu

SEQ ID NO: 1927021 - RNA, 19 nt, Homo sapiens
gccgugugagugugacagg

SEQ ID NO: 1927022 - RNA, 21 nt, Homo sapiens
ucugcucugguuagaaaaagg

SEQ ID NO: 1927023 - RNA, 13 nt, Homo sapiens
caucauuccuuga

SEQ ID NO: 1927024 - RNA, 15 nt, Homo sapiens
auucuagcuuucaaa

SEQ ID NO: 1927025 - RNA, 19 nt, Homo sapiens
auuuaacagaaauguacag

SEQ ID NO: 1927026 - RNA, 17 nt, Homo sapiens
uagugcuuucuugucag

SEQ ID NO: 1927027 - RNA, 15 nt, Homo sapiens
caguacuacugcucu

SEQ ID NO: 1927028 - RNA, 15 nt, Homo sapiens
auguuuaaaagcaua

SEQ ID NO: 1927029 - RNA, 18 nt, Homo sapiens
ucagguuauucguuacuc

SEQ ID NO: 1927030 - RNA, 19 nt, Homo sapiens
uucacuuauccuguucucu

SEQ ID NO: 1927031 - RNA, 15 nt, Homo sapiens
aaaagaugcagagua

SEQ ID NO: 1927032 - RNA, 19 nt, Homo sapiens
ucucaaagguaauucugaa

SEQ ID NO: 1927033 - RNA, 22 nt, Homo sapiens
uauuacugguauuaguuaaaac

SEQ ID NO: 1927034 - RNA, 19 nt, Homo sapiens
cugcucaauaaaguacaag

SEQ ID NO: 1927035 - RNA, 17 nt, Homo sapiens
cauuccgagauuuuaaa

SEQ ID NO: 1927036 - RNA, 22 nt, Homo sapiens
uggagaaguucccugaaccuuc

SEQ ID NO: 1927037 - RNA, 15 nt, Homo sapiens
acaucaaaccugagu

SEQ ID NO: 1927038 - RNA, 16 nt, Homo sapiens
aaaauucuggacacau

SEQ ID NO: 1927039 - RNA, 19 nt, Homo sapiens
aaaauggcucagaugccac

SEQ ID NO: 1927040 - RNA, 18 nt, Homo sapiens
uuuccuuugguccuucaa

SEQ ID NO: 1927041 - RNA, 19 nt, Homo sapiens
cuccucccaagcacuucaa

SEQ ID NO: 1927042 - RNA, 17 nt, Homo sapiens
ugcagccacugauucuc

SEQ ID NO: 1927043 - RNA, 17 nt, Homo sapiens
uugagcuuugcauuuau

SEQ ID NO: 1927044 - RNA, 16 nt, Homo sapiens
aauaauacaccagaga

SEQ ID NO: 1927045 - RNA, 18 nt, Homo sapiens
caugacgacaaagcugcu

SEQ ID NO: 1927046 - RNA, 16 nt, Homo sapiens
ccaaaaccugcuuccu

SEQ ID NO: 1927047 - RNA, 21 nt, Homo sapiens
aacaagaguaaauauugucac

SEQ ID NO: 1927048 - RNA, 18 nt, Homo sapiens
ugaccuucccacacaauc

SEQ ID NO: 1927049 - RNA, 13 nt, Homo sapiens
aaacccaggguga

SEQ ID NO: 1927050 - RNA, 14 nt, Homo sapiens
aauugauguugcug

SEQ ID NO: 1927051 - RNA, 21 nt, Homo sapiens
aaauguauuagaagauuuuag

SEQ ID NO: 1927052 - RNA, 13 nt, Homo sapiens
aggcaucccaaga

SEQ ID NO: 1927053 - RNA, 21 nt, Homo sapiens
uccaugugaccgaacacugca

SEQ ID NO: 1927054 - RNA, 16 nt, Homo sapiens
gauugauuaugcagaa

SEQ ID NO: 1927055 - RNA, 18 nt, Homo sapiens
uuugcaagcauugaauaa

SEQ ID NO: 1927056 - RNA, 22 nt, Homo sapiens
aaaaaguuucuaguaucacaua

SEQ ID NO: 1927057 - RNA, 20 nt, Homo sapiens
uucacucuggguaccaaauu

SEQ ID NO: 1927058 - RNA, 23 nt, Homo sapiens
accucaggguauugcuugccacu

SEQ ID NO: 1927059 - RNA, 11 nt, Homo sapiens
auuauuugccc

SEQ ID NO: 1927060 - RNA, 20 nt, Homo sapiens
cacauuuauuuuuauaucua

SEQ ID NO: 1927061 - RNA, 13 nt, Homo sapiens
gcacugugcucag

SEQ ID NO: 1927062 - RNA, 13 nt, Homo sapiens
cccagcugaccag

SEQ ID NO: 1927063 - RNA, 18 nt, Homo sapiens
cacccuuccaucugauuc

SEQ ID NO: 1927064 - RNA, 18 nt, Homo sapiens
gauaaugccccaaggaca

SEQ ID NO: 1927065 - RNA, 17 nt, Homo sapiens
agcuuaagugacuuccu

SEQ ID NO: 1927066 - RNA, 17 nt, Homo sapiens
ccuauuuucaugauuuc

SEQ ID NO: 1927067 - RNA, 22 nt, Homo sapiens
aaagguuugagauuccuguaaa

SEQ ID NO: 1927068 - RNA, 13 nt, Homo sapiens
ugauucaagccau

SEQ ID NO: 1927069 - RNA, 15 nt, Homo sapiens
aaaucccccaccucc

SEQ ID NO: 1927070 - RNA, 23 nt, Homo sapiens
gaauuggccucaguguaguuaaa

SEQ ID NO: 1927071 - RNA, 13 nt, Homo sapiens
acauguaugugca

SEQ ID NO: 1927072 - RNA, 16 nt, Homo sapiens
cccagggagaggccau

SEQ ID NO: 1927073 - RNA, 18 nt, Homo sapiens
ccccaccagccaccucuu

SEQ ID NO: 1927074 - RNA, 17 nt, Homo sapiens
acuuuauuuauacacug

SEQ ID NO: 1927075 - RNA, 12 nt, Homo sapiens
agagcagcacug

SEQ ID NO: 1927076 - RNA, 23 nt, Homo sapiens
uaaaaaggccuuugggauuugcc

SEQ ID NO: 1927077 - RNA, 18 nt, Homo sapiens
gaugaguuaacugugaaa

SEQ ID NO: 1927078 - RNA, 16 nt, Homo sapiens
ugaggaagucacuuua

SEQ ID NO: 1927079 - RNA, 23 nt, Homo sapiens
agaccucugugaggaaagcacac

SEQ ID NO: 1927080 - RNA, 21 nt, Homo sapiens
caaacaccuucagugcuggug

SEQ ID NO: 1927081 - RNA, 12 nt, Homo sapiens
ugguacugcugu

SEQ ID NO: 1927082 - RNA, 15 nt, Homo sapiens
uauuauuugcacaga

SEQ ID NO: 1927083 - RNA, 16 nt, Homo sapiens
cuagguggaaaagccu

SEQ ID NO: 1927084 - RNA, 16 nt, Homo sapiens
ugagaagaacacauca

SEQ ID NO: 1927085 - RNA, 20 nt, Homo sapiens
gguggaugggcccugcaaga

SEQ ID NO: 1927086 - RNA, 12 nt, Homo sapiens
augucaaaugga

SEQ ID NO: 1927087 - RNA, 20 nt, Homo sapiens
cauuuuuauuaaagcauuuc

SEQ ID NO: 1927088 - RNA, 18 nt, Homo sapiens
acacauaaggacgugugu

SEQ ID NO: 1927089 - RNA, 18 nt, Homo sapiens
agacggauuugcuuuggu

SEQ ID NO: 1927090 - RNA, 16 nt, Homo sapiens
aucggaagcagugccu

SEQ ID NO: 1927091 - RNA, 15 nt, Homo sapiens
ugacaaauauucucu

SEQ ID NO: 1927092 - RNA, 14 nt, Homo sapiens
agggucaucugccc

SEQ ID NO: 1927093 - RNA, 16 nt, Homo sapiens
auauaccaaagcacau

SEQ ID NO: 1927094 - RNA, 18 nt, Homo sapiens
cccauaacaaccugggca

SEQ ID NO: 1927095 - RNA, 18 nt, Homo sapiens
ccuucauuuauagaugag

SEQ ID NO: 1927096 - RNA, 19 nt, Homo sapiens
cagucuguuaaguaaaaug

SEQ ID NO: 1927097 - RNA, 18 nt, Homo sapiens
uacauccagaaagaagga

SEQ ID NO: 1927098 - RNA, 18 nt, Homo sapiens
uuucuuaaaacauuauga

SEQ ID NO: 1927099 - RNA, 23 nt, Homo sapiens
cuaccccaccugaccucugcaag

SEQ ID NO: 1927100 - RNA, 14 nt, Homo sapiens
gaagccugcugauu

SEQ ID NO: 1927101 - RNA, 13 nt, Homo sapiens
ccguugcuacaag

SEQ ID NO: 1927102 - RNA, 17 nt, Homo sapiens
auggauuucauggugau

SEQ ID NO: 1927103 - RNA, 17 nt, Homo sapiens
cagccaucacaugaucu

SEQ ID NO: 1927104 - RNA, 20 nt, Homo sapiens
uuccacguaagucacugaaa

SEQ ID NO: 1927105 - RNA, 18 nt, Homo sapiens
aaagcucccuguccugaa

SEQ ID NO: 1927106 - RNA, 17 nt, Homo sapiens
ugaaauagacuaagaua

SEQ ID NO: 1927107 - RNA, 22 nt, Homo sapiens
auacaucaauuuaaaaagcaaa

SEQ ID NO: 1927108 - RNA, 12 nt, Homo sapiens
ugcaucacauga

SEQ ID NO: 1927109 - RNA, 18 nt, Homo sapiens
acagaggaagagcaggca

SEQ ID NO: 1927110 - RNA, 12 nt, Homo sapiens
cuagauguaaca

SEQ ID NO: 1927111 - RNA, 18 nt, Homo sapiens
acagauaccucucagugu

SEQ ID NO: 1927112 - RNA, 18 nt, Homo sapiens
ucaugaagugcacaggag

SEQ ID NO: 1927113 - RNA, 14 nt, Homo sapiens
aacuguuuccccag

SEQ ID NO: 1927114 - RNA, 14 nt, Homo sapiens
aaucauuuccuugg

SEQ ID NO: 1927115 - RNA, 20 nt, Homo sapiens
uacucccugaucccaguuuc

SEQ ID NO: 1927116 - RNA, 13 nt, Homo sapiens
cccugaacaucug

SEQ ID NO: 1927117 - RNA, 13 nt, Homo sapiens
uucugccuaauaa

SEQ ID NO: 1927118 - RNA, 19 nt, Homo sapiens
uagaaacguaaacuaugac

SEQ ID NO: 1927119 - RNA, 17 nt, Homo sapiens
ccucaaagcacacguca

SEQ ID NO: 1927120 - RNA, 19 nt, Homo sapiens
uuuuaaaaauucacuucua

SEQ ID NO: 1927121 - RNA, 14 nt, Homo sapiens
ucuaagauucuaaa

SEQ ID NO: 1927122 - RNA, 14 nt, Homo sapiens
aauguacuauaugu

SEQ ID NO: 1927123 - RNA, 14 nt, Homo sapiens
cccucucaagugcc

SEQ ID NO: 1927124 - RNA, 13 nt, Homo sapiens
ccaacuaugucca

SEQ ID NO: 1927125 - RNA, 22 nt, Homo sapiens
ccacugguguaaaaaacaaaca

SEQ ID NO: 1927126 - RNA, 14 nt, Homo sapiens
gaauaagcacuuuu

SEQ ID NO: 1927127 - RNA, 20 nt, Homo sapiens
auaaaguucagauguuucau

SEQ ID NO: 1927128 - RNA, 9 nt, Homo sapiens
caucaucuc

SEQ ID NO: 1927129 - RNA, 18 nt, Homo sapiens
acucaguccacuguugag

SEQ ID NO: 1927130 - RNA, 19 nt, Homo sapiens
agugaucaaacuacauauu

SEQ ID NO: 1927131 - RNA, 15 nt, Homo sapiens
gaagacagagggaaa

SEQ ID NO: 1927132 - RNA, 16 nt, Homo sapiens
uguccagcagcugcca

SEQ ID NO: 1927133 - RNA, 14 nt, Homo sapiens
gagaaccaaccaag

SEQ ID NO: 1927134 - RNA, 12 nt, Homo sapiens
uaaacucuucca

SEQ ID NO: 1927135 - RNA, 17 nt, Homo sapiens
ucaccuagaccuugccu

SEQ ID NO: 1927136 - RNA, 13 nt, Homo sapiens
acauauaacaugc

SEQ ID NO: 1927137 - RNA, 13 nt, Homo sapiens
aaagcaugucuca

SEQ ID NO: 1927138 - RNA, 15 nt, Homo sapiens
acauaguuguauaua

SEQ ID NO: 1927139 - RNA, 16 nt, Homo sapiens
aauuguauuucaaaaa

SEQ ID NO: 1927140 - RNA, 14 nt, Homo sapiens
aagcagaauccuua

SEQ ID NO: 1927141 - RNA, 21 nt, Homo sapiens
uauggugcuaauguacuuuca

SEQ ID NO: 1927142 - RNA, 23 nt, Homo sapiens
ucuagauacaauaaauugcuaau

SEQ ID NO: 1927143 - RNA, 20 nt, Homo sapiens
gagggaauuugaagaaagga

SEQ ID NO: 1927144 - RNA, 18 nt, Homo sapiens
caggcuggucucgaacuc

SEQ ID NO: 1927145 - RNA, 19 nt, Homo sapiens
aaucacuugccaaaaucca

SEQ ID NO: 1927146 - RNA, 14 nt, Homo sapiens
cuugucacauggaa

SEQ ID NO: 1927147 - RNA, 23 nt, Homo sapiens
uuaggaggcugcaugcucuggaa

SEQ ID NO: 1927148 - RNA, 16 nt, Homo sapiens
acucuucuaacacaaa

SEQ ID NO: 1927149 - RNA, 14 nt, Homo sapiens
agggaucacuggcu

SEQ ID NO: 1927150 - RNA, 20 nt, Homo sapiens
cauguauucauccagaguuc

SEQ ID NO: 1927151 - RNA, 19 nt, Homo sapiens
agcaaugcagagagggcau

SEQ ID NO: 1927152 - RNA, 20 nt, Homo sapiens
accuuaucuuaaagcacuua

SEQ ID NO: 1927153 - RNA, 20 nt, Homo sapiens
ugcuccggaaagaugagcuu

SEQ ID NO: 1927154 - RNA, 16 nt, Homo sapiens
caaggucgagacauuc

SEQ ID NO: 1927155 - RNA, 17 nt, Homo sapiens
accuuuugcaccugcuc

SEQ ID NO: 1927156 - RNA, 22 nt, Homo sapiens
cuucagaaauucucugcgauua

SEQ ID NO: 1927157 - RNA, 15 nt, Homo sapiens
caaaaaacuacuucu

SEQ ID NO: 1927158 - RNA, 19 nt, Homo sapiens
cagaguaacaugccagcuu

SEQ ID NO: 1927159 - RNA, 17 nt, Homo sapiens
cauuaacaaaagcaauu

SEQ ID NO: 1927160 - RNA, 11 nt, Homo sapiens
agaaagcucua

SEQ ID NO: 1927161 - RNA, 19 nt, Homo sapiens
aggugaugguaacugcaca

SEQ ID NO: 1927162 - RNA, 18 nt, Homo sapiens
uccucuacugugcaucuc

SEQ ID NO: 1927163 - RNA, 18 nt, Homo sapiens
caaaacugugaauacuuu

SEQ ID NO: 1927164 - RNA, 18 nt, Homo sapiens
gaguuuuuaauggccauu

SEQ ID NO: 1927165 - RNA, 19 nt, Homo sapiens
aacuuuuuuugucuguuga

SEQ ID NO: 1927166 - RNA, 16 nt, Homo sapiens
agaagagaaucaaggc

SEQ ID NO: 1927167 - RNA, 20 nt, Homo sapiens
auacugaaaaagaaugaaaa

SEQ ID NO: 1927168 - RNA, 21 nt, Homo sapiens
cagcguccggggugguggaca

SEQ ID NO: 1927169 - RNA, 15 nt, Homo sapiens
caugguuaccgagga

SEQ ID NO: 1927170 - RNA, 14 nt, Homo sapiens
ucuacuugucauau

SEQ ID NO: 1927171 - RNA, 14 nt, Homo sapiens
aaauaaugaauaca

SEQ ID NO: 1927172 - RNA, 14 nt, Homo sapiens
uguggccacagccc

SEQ ID NO: 1927173 - RNA, 17 nt, Homo sapiens
guuaauuuaauuugcag

SEQ ID NO: 1927174 - RNA, 22 nt, Homo sapiens
ugccugcggaguugugcacgua

SEQ ID NO: 1927175 - RNA, 15 nt, Homo sapiens
aacacucaugcugaa

SEQ ID NO: 1927176 - RNA, 20 nt, Homo sapiens
cugcagcucuccaccagcug

SEQ ID NO: 1927177 - RNA, 19 nt, Homo sapiens
cuuauuaauuugacuagaa

SEQ ID NO: 1927178 - RNA, 14 nt, Homo sapiens
uuagaaaucauaga

SEQ ID NO: 1927179 - RNA, 23 nt, Homo sapiens
agggcuuccucaaauacaugcac

SEQ ID NO: 1927180 - RNA, 22 nt, Homo sapiens
acaauuugcaguaaacuuuuaa

SEQ ID NO: 1927181 - RNA, 21 nt, Homo sapiens
cuuucccuuuagcacguuuaa

SEQ ID NO: 1927182 - RNA, 16 nt, Homo sapiens
ucuaauaauccugcuu

SEQ ID NO: 1927183 - RNA, 15 nt, Homo sapiens
agccccugggaccag

SEQ ID NO: 1927184 - RNA, 14 nt, Homo sapiens
ugcauuucuuacca

SEQ ID NO: 1927185 - RNA, 23 nt, Homo sapiens
uggcaaagauagagaaugcccuc

SEQ ID NO: 1927186 - RNA, 14 nt, Homo sapiens
ccuuuccuuuccca

SEQ ID NO: 1927187 - RNA, 20 nt, Homo sapiens
aagaaauccagcuucauaau

SEQ ID NO: 1927188 - RNA, 13 nt, Homo sapiens
aggaacauuccuu

SEQ ID NO: 1927189 - RNA, 18 nt, Homo sapiens
uacuucuuauacauuuga

SEQ ID NO: 1927190 - RNA, 16 nt, Homo sapiens
uuuuuccucuuuacuu

SEQ ID NO: 1927191 - RNA, 20 nt, Homo sapiens
uaguuuuuccuaucauguua

SEQ ID NO: 1927192 - RNA, 19 nt, Homo sapiens
agcacaagcagagugcaca

SEQ ID NO: 1927193 - RNA, 15 nt, Homo sapiens
guccucucugaguca

SEQ ID NO: 1927194 - RNA, 13 nt, Homo sapiens
gaacggggagaaa

SEQ ID NO: 1927195 - RNA, 15 nt, Homo sapiens
cucugaaaccagugu

SEQ ID NO: 1927196 - RNA, 20 nt, Homo sapiens
uaauuaaacaagugcacuug

SEQ ID NO: 1927197 - RNA, 20 nt, Homo sapiens
caauaaaauaaaagcacuua

SEQ ID NO: 1927198 - RNA, 23 nt, Homo sapiens
aaggagacugaggggcuuuguaa

SEQ ID NO: 1927199 - RNA, 21 nt, Homo sapiens
gaaaauaggggaugguccagg

SEQ ID NO: 1927200 - RNA, 18 nt, Homo sapiens
uaucuuugccacccucau

SEQ ID NO: 1927201 - RNA, 17 nt, Homo sapiens
guauaaauaagcacuau

SEQ ID NO: 1927202 - RNA, 17 nt, Homo sapiens
aagggcaucacuggguc

SEQ ID NO: 1927203 - RNA, 23 nt, Homo sapiens
cuaaucaagaaaagaauuacaga

SEQ ID NO: 1927204 - RNA, 16 nt, Homo sapiens
ggaaagcagugcagua

SEQ ID NO: 1927205 - RNA, 19 nt, Homo sapiens
guugaacacaauugauacu

SEQ ID NO: 1927206 - RNA, 13 nt, Homo sapiens
cgggggaagggag

SEQ ID NO: 1927207 - RNA, 14 nt, Homo sapiens
gugccguaguccuu

SEQ ID NO: 1927208 - RNA, 16 nt, Homo sapiens
uaauggcuaguacugu

SEQ ID NO: 1927209 - RNA, 19 nt, Homo sapiens
acgaacuuuagcugcaucc

SEQ ID NO: 1927210 - RNA, 20 nt, Homo sapiens
uuuuaaugccaagauugaca

SEQ ID NO: 1927211 - RNA, 14 nt, Homo sapiens
agcgcagacuggcg

SEQ ID NO: 1927212 - RNA, 16 nt, Homo sapiens
uugagcaguuagcuca

SEQ ID NO: 1927213 - RNA, 23 nt, Homo sapiens
uccagcuccuccgugcuuccuca

SEQ ID NO: 1927214 - RNA, 20 nt, Homo sapiens
agcauggccacccucaagag

SEQ ID NO: 1927215 - RNA, 13 nt, Homo sapiens
uggagugugucag

SEQ ID NO: 1927216 - RNA, 21 nt, Homo sapiens
ucccagggagcaugagaggag

SEQ ID NO: 1927217 - RNA, 18 nt, Homo sapiens
gauuguuguguagucaag

SEQ ID NO: 1927218 - RNA, 19 nt, Homo sapiens
uaaacauuuugacacaaaa

SEQ ID NO: 1927219 - RNA, 19 nt, Homo sapiens
ugaugcuaauuuucagggu

SEQ ID NO: 1927220 - RNA, 12 nt, Homo sapiens
cucaaugcauga

SEQ ID NO: 1927221 - RNA, 17 nt, Homo sapiens
gaccaaaauguguuuca

SEQ ID NO: 1927222 - RNA, 13 nt, Homo sapiens
aagaauacagaaa

SEQ ID NO: 1927223 - RNA, 22 nt, Homo sapiens
uuccucacuaguguaaacaaaa

SEQ ID NO: 1927224 - RNA, 16 nt, Homo sapiens
augggccugccugccu

SEQ ID NO: 1927225 - RNA, 17 nt, Homo sapiens
aaguggcaccuaauaaa

SEQ ID NO: 1927226 - RNA, 15 nt, Homo sapiens
aaccaugaaaauggg

SEQ ID NO: 1927227 - RNA, 13 nt, Homo sapiens
agccccgacuucc

SEQ ID NO: 1927228 - RNA, 15 nt, Homo sapiens
ugcauucucuauaga

SEQ ID NO: 1927229 - RNA, 16 nt, Homo sapiens
cuaaagccagccugac

SEQ ID NO: 1927230 - RNA, 13 nt, Homo sapiens
gacaaucuaaaaa

SEQ ID NO: 1927231 - RNA, 17 nt, Homo sapiens
agagaaucaacauuucu

SEQ ID NO: 1927232 - RNA, 22 nt, Homo sapiens
agauuauauuuuauaagaggga

SEQ ID NO: 1927233 - RNA, 19 nt, Homo sapiens
gcaucucugccuccaaccc

SEQ ID NO: 1927234 - RNA, 21 nt, Homo sapiens
auaaaccuugcggauguggcu

SEQ ID NO: 1927235 - RNA, 15 nt, Homo sapiens
cuucuggaaaugggg

SEQ ID NO: 1927236 - RNA, 13 nt, Homo sapiens
gcauaguggcacu

SEQ ID NO: 1927237 - RNA, 18 nt, Homo sapiens
gagaugcagccuucacca

SEQ ID NO: 1927238 - RNA, 13 nt, Homo sapiens
uucccacuccagc

SEQ ID NO: 1927239 - RNA, 18 nt, Homo sapiens
acuuagagaugcuacugu

SEQ ID NO: 1927240 - RNA, 18 nt, Homo sapiens
cagaauuuuuugaguaau

SEQ ID NO: 1927241 - RNA, 13 nt, Homo sapiens
cucaguaccccau

SEQ ID NO: 1927242 - RNA, 18 nt, Homo sapiens
aaguaugugaauaugaau

SEQ ID NO: 1927243 - RNA, 16 nt, Homo sapiens
cucggccucccaaagu

SEQ ID NO: 1927244 - RNA, 14 nt, Homo sapiens
ucagucaucucaug

SEQ ID NO: 1927245 - RNA, 14 nt, Homo sapiens
gcugccugcugaag

SEQ ID NO: 1927246 - RNA, 12 nt, Homo sapiens
auguguacuuaa

SEQ ID NO: 1927247 - RNA, 13 nt, Homo sapiens
uaaagucugaauc

SEQ ID NO: 1927248 - RNA, 16 nt, Homo sapiens
aggacucaacauuaca

SEQ ID NO: 1927249 - RNA, 16 nt, Homo sapiens
ggcagagguuacaggu

SEQ ID NO: 1927250 - RNA, 16 nt, Homo sapiens
aucuuuguacauuuaa

SEQ ID NO: 1927251 - RNA, 13 nt, Homo sapiens
acauaacugccuu

SEQ ID NO: 1927252 - RNA, 12 nt, Homo sapiens
cgacaguuuucc

SEQ ID NO: 1927253 - RNA, 13 nt, Homo sapiens
ugucuucucaggc

SEQ ID NO: 1927254 - RNA, 18 nt, Homo sapiens
ucuaaaaaaaaaaacugu

SEQ ID NO: 1927255 - RNA, 16 nt, Homo sapiens
aagcguacaaagugau

SEQ ID NO: 1927256 - RNA, 15 nt, Homo sapiens
acccaggcccagcug

SEQ ID NO: 1927257 - RNA, 21 nt, Homo sapiens
uauucaaacuaccuauauucc

SEQ ID NO: 1927258 - RNA, 23 nt, Homo sapiens
uggagccauugaacagcugugag

SEQ ID NO: 1927259 - RNA, 15 nt, Homo sapiens
ggcucacgccuguaa

SEQ ID NO: 1927260 - RNA, 16 nt, Homo sapiens
cuccuucccacucuuc

SEQ ID NO: 1927261 - RNA, 21 nt, Homo sapiens
acugggaugccugucuugagu

SEQ ID NO: 1927262 - RNA, 12 nt, Homo sapiens
uauacaauaaug

SEQ ID NO: 1927263 - RNA, 15 nt, Homo sapiens
cuagaauucacucca

SEQ ID NO: 1927264 - RNA, 14 nt, Homo sapiens
gugaccgggguccu

SEQ ID NO: 1927265 - RNA, 15 nt, Homo sapiens
ugaagaaaacuccuu

SEQ ID NO: 1927266 - RNA, 18 nt, Homo sapiens
ucgcaacccugccuguca

SEQ ID NO: 1927267 - RNA, 18 nt, Homo sapiens
gcuaggaacacuccuuca

SEQ ID NO: 1927268 - RNA, 13 nt, Homo sapiens
ggcacuacaggca

SEQ ID NO: 1927269 - RNA, 21 nt, Homo sapiens
cgucuucuccaacaccaccuc

SEQ ID NO: 1927270 - RNA, 19 nt, Homo sapiens
ccugcacagugacuucuga

SEQ ID NO: 1927271 - RNA, 12 nt, Homo sapiens
ccuggucaccaa

SEQ ID NO: 1927272 - RNA, 12 nt, Homo sapiens
agucuugaucua

SEQ ID NO: 1927273 - RNA, 21 nt, Homo sapiens
ccugucaccagagcuucucug

SEQ ID NO: 1927274 - RNA, 16 nt, Homo sapiens
cucccucaaagcacac

SEQ ID NO: 1927275 - RNA, 15 nt, Homo sapiens
uauagacaaauaaua

SEQ ID NO: 1927276 - RNA, 20 nt, Homo sapiens
acacucucuucuuacuguau

SEQ ID NO: 1927277 - RNA, 14 nt, Homo sapiens
aaagaaucacagua

SEQ ID NO: 1927278 - RNA, 15 nt, Homo sapiens
ugaccuuacccgcua

SEQ ID NO: 1927279 - RNA, 14 nt, Homo sapiens
ugaaaacuaaagau

SEQ ID NO: 1927280 - RNA, 17 nt, Homo sapiens
gacaaugacuaagccaa

SEQ ID NO: 1927281 - RNA, 20 nt, Homo sapiens
aaguuauuaccuuuacauau

SEQ ID NO: 1927282 - RNA, 15 nt, Homo sapiens
aauagugacaaguga

SEQ ID NO: 1927283 - RNA, 14 nt, Homo sapiens
cugacuacagggcc

SEQ ID NO: 1927284 - RNA, 15 nt, Homo sapiens
aaucccauacucuca

SEQ ID NO: 1927285 - RNA, 21 nt, Homo sapiens
aaaugucauguggcuaccugu

SEQ ID NO: 1927286 - RNA, 17 nt, Homo sapiens
gugucacaguuucaggc

SEQ ID NO: 1927287 - RNA, 16 nt, Homo sapiens
ucuuccugcacccaca

SEQ ID NO: 1927288 - RNA, 16 nt, Homo sapiens
gccuuuaagccaaaga

SEQ ID NO: 1927289 - RNA, 16 nt, Homo sapiens
gaaacaugaugugaga

SEQ ID NO: 1927290 - RNA, 20 nt, Homo sapiens
ucaguucccaccaucugauu

SEQ ID NO: 1927291 - RNA, 12 nt, Homo sapiens
ugcuagauuucu

SEQ ID NO: 1927292 - RNA, 21 nt, Homo sapiens
uacaaucuuggagcugcuugg

SEQ ID NO: 1927293 - RNA, 14 nt, Homo sapiens
cucacucuguugac

SEQ ID NO: 1927294 - RNA, 21 nt, Homo sapiens
acacacuaacaaaagcaugaa

SEQ ID NO: 1927295 - RNA, 15 nt, Homo sapiens
acuccccccccagag

SEQ ID NO: 1927296 - RNA, 18 nt, Homo sapiens
acggugggagaccugcug

SEQ ID NO: 1927297 - RNA, 14 nt, Homo sapiens
aauccuugacugga

SEQ ID NO: 1927298 - RNA, 20 nt, Homo sapiens
agaucuaagccuuuccauaa

SEQ ID NO: 1927299 - RNA, 23 nt, Homo sapiens
uuuccaaugaugaaauauaauca

SEQ ID NO: 1927300 - RNA, 13 nt, Homo sapiens
acuuccacaagag

SEQ ID NO: 1927301 - RNA, 17 nt, Homo sapiens
agguuggcgacugucau

SEQ ID NO: 1927302 - RNA, 14 nt, Homo sapiens
gggccugcccucau

SEQ ID NO: 1927303 - RNA, 22 nt, Homo sapiens
uaacugaggacuguuugcaauu

SEQ ID NO: 1927304 - RNA, 16 nt, Homo sapiens
uaauuuggaaacuaau

SEQ ID NO: 1927305 - RNA, 17 nt, Homo sapiens
acaccuggcccuaguga

SEQ ID NO: 1927306 - RNA, 21 nt, Homo sapiens
cuguggaagggccaauggaga

SEQ ID NO: 1927307 - RNA, 19 nt, Homo sapiens
ucccuauggagaggcuucc

SEQ ID NO: 1927308 - RNA, 16 nt, Homo sapiens
gcuuauauuaagcaaa

SEQ ID NO: 1927309 - RNA, 12 nt, Homo sapiens
uuucuugccuca

SEQ ID NO: 1927310 - RNA, 21 nt, Homo sapiens
auauauacacauacauacaca

SEQ ID NO: 1927311 - RNA, 18 nt, Homo sapiens
auggcauauauguucaaa

SEQ ID NO: 1927312 - RNA, 22 nt, Homo sapiens
gaugucaucuugagcucuucau

SEQ ID NO: 1927313 - RNA, 17 nt, Homo sapiens
aauacuuacucuugucg

SEQ ID NO: 1927314 - RNA, 23 nt, Homo sapiens
ugcccucggagugccacacaugc

SEQ ID NO: 1927315 - RNA, 17 nt, Homo sapiens
caguagugcuaucucau

SEQ ID NO: 1927316 - RNA, 19 nt, Homo sapiens
cauacacacacaaaccauu

SEQ ID NO: 1927317 - RNA, 24 nt, Homo sapiens
auggcuucuucccuaaaacgugga

SEQ ID NO: 1927318 - RNA, 17 nt, Homo sapiens
gccaggagcgcaucuca

SEQ ID NO: 1927319 - RNA, 21 nt, Homo sapiens
uguuauugccucuacuuugau

SEQ ID NO: 1927320 - RNA, 20 nt, Homo sapiens
ucuuccugucuccuuugaag

SEQ ID NO: 1927321 - RNA, 13 nt, Homo sapiens
acauguuccccau

SEQ ID NO: 1927322 - RNA, 21 nt, Homo sapiens
ugugaccuguuagaugugaca

SEQ ID NO: 1927323 - RNA, 18 nt, Homo sapiens
aucugcacagucacuggc

SEQ ID NO: 1927324 - RNA, 19 nt, Homo sapiens
auauugaaagguagcaaug

SEQ ID NO: 1927325 - RNA, 19 nt, Homo sapiens
auuaaacaaguauaaaaua

SEQ ID NO: 1927326 - RNA, 20 nt, Homo sapiens
gaacugcgcagccuuaccca

SEQ ID NO: 1927327 - RNA, 19 nt, Homo sapiens
uggacuggugugcucucuu

SEQ ID NO: 1927328 - RNA, 20 nt, Homo sapiens
cgcaucucaacaaaucucag

SEQ ID NO: 1927329 - RNA, 13 nt, Homo sapiens
cugggccaaguca

SEQ ID NO: 1927330 - RNA, 22 nt, Homo sapiens
ucuccaccaacuggagcacuga

SEQ ID NO: 1927331 - RNA, 18 nt, Homo sapiens
uugacagcaaaauguuga

SEQ ID NO: 1927332 - RNA, 17 nt, Homo sapiens
aaccaggauauugacau

SEQ ID NO: 1927333 - RNA, 19 nt, Homo sapiens
agcgaauguguacaaagug

SEQ ID NO: 1927334 - RNA, 15 nt, Homo sapiens
caguuuuuccuaguc

SEQ ID NO: 1927335 - RNA, 21 nt, Homo sapiens
cuagccauuggugcacaggau

SEQ ID NO: 1927336 - RNA, 16 nt, Homo sapiens
ugagccauuugagggg

SEQ ID NO: 1927337 - RNA, 14 nt, Homo sapiens
aucugcaaacauua

SEQ ID NO: 1927338 - RNA, 17 nt, Homo sapiens
cugauggugacauugca

SEQ ID NO: 1927339 - RNA, 22 nt, Homo sapiens
cagggaaggugagccagacaca

SEQ ID NO: 1927340 - RNA, 14 nt, Homo sapiens
gaagagcaggugac

SEQ ID NO: 1927341 - RNA, 22 nt, Homo sapiens
cuaaccugcacguugugcacau

SEQ ID NO: 1927342 - RNA, 14 nt, Homo sapiens
ugagaacugcauau

SEQ ID NO: 1927343 - RNA, 13 nt, Homo sapiens
guuggugcugcuu

SEQ ID NO: 1927344 - RNA, 19 nt, Homo sapiens
gcacacggaugcacagaga

SEQ ID NO: 1927345 - RNA, 14 nt, Homo sapiens
uugcucauggaauu

SEQ ID NO: 1927346 - RNA, 14 nt, Homo sapiens
cacugggcuucuag

SEQ ID NO: 1927347 - RNA, 22 nt, Homo sapiens
ugugcauggaggcccuccugug

SEQ ID NO: 1927348 - RNA, 20 nt, Homo sapiens
aggaaauauucuguaaucuu

SEQ ID NO: 1927349 - RNA, 20 nt, Homo sapiens
gacauuugggacugucuuga

SEQ ID NO: 1927350 - RNA, 20 nt, Homo sapiens
aaguuguugguuuauacugu

SEQ ID NO: 1927351 - RNA, 23 nt, Homo sapiens
uaacagcuggggacaacugcggu

SEQ ID NO: 1927352 - RNA, 22 nt, Homo sapiens
gcccacuccgccagccacagga

SEQ ID NO: 1927353 - RNA, 18 nt, Homo sapiens
agccucugccgcugccau

SEQ ID NO: 1927354 - RNA, 17 nt, Homo sapiens
caaagauacuugaugca

SEQ ID NO: 1927355 - RNA, 23 nt, Homo sapiens
caguccuggguuguuuccaggag

SEQ ID NO: 1927356 - RNA, 15 nt, Homo sapiens
ugcccuuucugcucc

SEQ ID NO: 1927357 - RNA, 24 nt, Homo sapiens
acaaagcgugguggacaugcacag

SEQ ID NO: 1927358 - RNA, 15 nt, Homo sapiens
guggguuuugaacau

SEQ ID NO: 1927359 - RNA, 15 nt, Homo sapiens
uaauaaauuucacca

SEQ ID NO: 1927360 - RNA, 14 nt, Homo sapiens
uggaauaguggcau

SEQ ID NO: 1927361 - RNA, 16 nt, Homo sapiens
gaaaagagcugggauc

SEQ ID NO: 1927362 - RNA, 20 nt, Homo sapiens
gaacaccauccuacauaaua

SEQ ID NO: 1927363 - RNA, 18 nt, Homo sapiens
aaaaccaaaacugugcag

SEQ ID NO: 1927364 - RNA, 17 nt, Homo sapiens
uuaaccauggcacugag

SEQ ID NO: 1927365 - RNA, 14 nt, Homo sapiens
ucuggggugcagcu

SEQ ID NO: 1927366 - RNA, 20 nt, Homo sapiens
aaaagggagauucagacugu

SEQ ID NO: 1927367 - RNA, 20 nt, Homo sapiens
gugcucccuuccagcuggug

SEQ ID NO: 1927368 - RNA, 21 nt, Homo sapiens
uucuaaaagccauuauuauga

SEQ ID NO: 1927369 - RNA, 16 nt, Homo sapiens
uaaaaugauggaacca

SEQ ID NO: 1927370 - RNA, 16 nt, Homo sapiens
gucccaggagcaggac

SEQ ID NO: 1927371 - RNA, 23 nt, Homo sapiens
cucagcccugggccccaccaccu

SEQ ID NO: 1927372 - RNA, 18 nt, Homo sapiens
uaucugccuuauacauua

SEQ ID NO: 1927373 - RNA, 19 nt, Homo sapiens
uaacuuccaugugaggguu

SEQ ID NO: 1927374 - RNA, 21 nt, Homo sapiens
acaugacauucuuagcuguaa

SEQ ID NO: 1927375 - RNA, 18 nt, Homo sapiens
uaaaacuuaaaucucacu

SEQ ID NO: 1927376 - RNA, 14 nt, Homo sapiens
gucugcugcuccca

SEQ ID NO: 1927377 - RNA, 20 nt, Homo sapiens
cagucacugcugcaaggugg

SEQ ID NO: 1927378 - RNA, 15 nt, Homo sapiens
cuaaaauuagaugaa

SEQ ID NO: 1927379 - RNA, 17 nt, Homo sapiens
gcuucuauuagucaccu

SEQ ID NO: 1927380 - RNA, 21 nt, Homo sapiens
cuucaacugaccagccuccau

SEQ ID NO: 1927381 - RNA, 15 nt, Homo sapiens
cugccaugcuuugag

SEQ ID NO: 1927382 - RNA, 15 nt, Homo sapiens
aaugcaccacuuuuu

SEQ ID NO: 1927383 - RNA, 19 nt, Homo sapiens
ucuaaauagccaacaccca

SEQ ID NO: 1927384 - RNA, 13 nt, Homo sapiens
ccugucccaugca

SEQ ID NO: 1927385 - RNA, 14 nt, Homo sapiens
gcacagucacccau

SEQ ID NO: 1927386 - RNA, 23 nt, Homo sapiens
gucugcccugcccauacugagcc

SEQ ID NO: 1927387 - RNA, 13 nt, Homo sapiens
gaauugcagagua

SEQ ID NO: 1927388 - RNA, 16 nt, Homo sapiens
gaugugaaaugaaugu

SEQ ID NO: 1927389 - RNA, 19 nt, Homo sapiens
gggcuccgggucacugcug

SEQ ID NO: 1927390 - RNA, 23 nt, Homo sapiens
uaaugauaguguuuuguacuugu

SEQ ID NO: 1927391 - RNA, 17 nt, Homo sapiens
ggguggcagagacagug

SEQ ID NO: 1927392 - RNA, 21 nt, Homo sapiens
cagcuucaccagagcauuucc

SEQ ID NO: 1927393 - RNA, 12 nt, Homo sapiens
acauaaacugac

SEQ ID NO: 1927394 - RNA, 15 nt, Homo sapiens
ugugccuugccacau

SEQ ID NO: 1927395 - RNA, 18 nt, Homo sapiens
uguacauaauucuugcua

SEQ ID NO: 1927396 - RNA, 14 nt, Homo sapiens
caguuaagguggag

SEQ ID NO: 1927397 - RNA, 22 nt, Homo sapiens
ggccagguaugcauggaaaaug

SEQ ID NO: 1927398 - RNA, 15 nt, Homo sapiens
acucugacaguauua

SEQ ID NO: 1927399 - RNA, 21 nt, Homo sapiens
agugccguaacaacugugguc

SEQ ID NO: 1927400 - RNA, 16 nt, Homo sapiens
cugggaacuuccucag

SEQ ID NO: 1927401 - RNA, 23 nt, Homo sapiens
auccugaaaaggguguugcuaag

SEQ ID NO: 1927402 - RNA, 21 nt, Homo sapiens
agaaauggaacccccagccca

SEQ ID NO: 1927403 - RNA, 22 nt, Homo sapiens
augacuguuuuucggacaguuu

SEQ ID NO: 1927404 - RNA, 17 nt, Homo sapiens
aggugacaaaaggcaga

SEQ ID NO: 1927405 - RNA, 21 nt, Homo sapiens
ccuguaguacaagauuaucuu

SEQ ID NO: 1927406 - RNA, 21 nt, Homo sapiens
ggcuuugcuguuguugggaca

SEQ ID NO: 1927407 - RNA, 16 nt, Homo sapiens
cucaacugacaugaaa

SEQ ID NO: 1927408 - RNA, 18 nt, Homo sapiens
uauuuauagaacaguuga

SEQ ID NO: 1927409 - RNA, 13 nt, Homo sapiens
auaucaugcucca

SEQ ID NO: 1927410 - RNA, 17 nt, Homo sapiens
acuuuggcauucagugc

SEQ ID NO: 1927411 - RNA, 11 nt, Homo sapiens
agcagacuuuu

SEQ ID NO: 1927412 - RNA, 13 nt, Homo sapiens
ggccauauuaccc

SEQ ID NO: 1927413 - RNA, 18 nt, Homo sapiens
gcagagcaugaccugagg

SEQ ID NO: 1927414 - RNA, 22 nt, Homo sapiens
ugcauguccggcugaaggcuga

SEQ ID NO: 1927415 - RNA, 12 nt, Homo sapiens
uagucauugcag

SEQ ID NO: 1927416 - RNA, 12 nt, Homo sapiens
ccacaacuccag

SEQ ID NO: 1927417 - RNA, 14 nt, Homo sapiens
agagagucuuccag

SEQ ID NO: 1927418 - RNA, 17 nt, Homo sapiens
cucaugaugcuacccga

SEQ ID NO: 1927419 - RNA, 14 nt, Homo sapiens
agaauugauuuccc

SEQ ID NO: 1927420 - RNA, 13 nt, Homo sapiens
ugcuucagccucc

SEQ ID NO: 1927421 - RNA, 18 nt, Homo sapiens
aaucugguaaaagcacca

SEQ ID NO: 1927422 - RNA, 22 nt, Homo sapiens
auaguuacuguguaaacucauc

SEQ ID NO: 1927423 - RNA, 20 nt, Homo sapiens
gaggcucccacuucuuggga

SEQ ID NO: 1927424 - RNA, 23 nt, Homo sapiens
ugauagaacuuugccagucuuua

SEQ ID NO: 1927425 - RNA, 12 nt, Homo sapiens
gaacuccaggau

SEQ ID NO: 1927426 - RNA, 20 nt, Homo sapiens
ggauaaccccaggcacuguu

SEQ ID NO: 1927427 - RNA, 16 nt, Homo sapiens
aaucccaacauuucuc

SEQ ID NO: 1927428 - RNA, 17 nt, Homo sapiens
ucuaccugcccccauca

SEQ ID NO: 1927429 - RNA, 13 nt, Homo sapiens
aaguguguuuccu

SEQ ID NO: 1927430 - RNA, 16 nt, Homo sapiens
ucaucuacuacagggu

SEQ ID NO: 1927431 - RNA, 18 nt, Homo sapiens
auugaaucuaaaaccaaa

SEQ ID NO: 1927432 - RNA, 16 nt, Homo sapiens
cugcagaccauccaga

SEQ ID NO: 1927433 - RNA, 18 nt, Homo sapiens
ucaaacgaugugcaauac

SEQ ID NO: 1927434 - RNA, 17 nt, Homo sapiens
auuauccuguaguacaa

SEQ ID NO: 1927435 - RNA, 22 nt, Homo sapiens
ucacaccuguccuucucaggcu

SEQ ID NO: 1927436 - RNA, 23 nt, Homo sapiens
caggcuggagugcagugagcuau

SEQ ID NO: 1927437 - RNA, 18 nt, Homo sapiens
ucugcuaccucacugggg

SEQ ID NO: 1927438 - RNA, 20 nt, Homo sapiens
aaagguaauuguagcacauu

SEQ ID NO: 1927439 - RNA, 14 nt, Homo sapiens
uguauuaaugcuau

SEQ ID NO: 1927440 - RNA, 14 nt, Homo sapiens
uuucacugcugcaa

SEQ ID NO: 1927441 - RNA, 20 nt, Homo sapiens
ugcugccuggccacugcucc

SEQ ID NO: 1927442 - RNA, 21 nt, Homo sapiens
caaagcuguuggccucugcaa

SEQ ID NO: 1927443 - RNA, 21 nt, Homo sapiens
uuuuacauuucauacaacaga

SEQ ID NO: 1927444 - RNA, 19 nt, Homo sapiens
uagcuguaaauacaugugu

SEQ ID NO: 1927445 - RNA, 16 nt, Homo sapiens
agauaaucuugugcaa

SEQ ID NO: 1927446 - RNA, 16 nt, Homo sapiens
gaacaagcaaacccag

SEQ ID NO: 1927447 - RNA, 14 nt, Homo sapiens
uaaaggcagcugcc

SEQ ID NO: 1927448 - RNA, 20 nt, Homo sapiens
ggaaugccgcugucucugag

SEQ ID NO: 1927449 - RNA, 15 nt, Homo sapiens
guauacaccaagugg

SEQ ID NO: 1927450 - RNA, 21 nt, Homo sapiens
guuaaacuuauuucaagugau

SEQ ID NO: 1927451 - RNA, 15 nt, Homo sapiens
ugcuccaaaugcuga

SEQ ID NO: 1927452 - RNA, 21 nt, Homo sapiens
ucgauguccuccucugugaaa

SEQ ID NO: 1927453 - RNA, 20 nt, Homo sapiens
acugacauuauaucauggca

SEQ ID NO: 1927454 - RNA, 22 nt, Homo sapiens
agcagcacaggggacgcaaugg

SEQ ID NO: 1927455 - RNA, 14 nt, Homo sapiens
gcaacuuuaguuug

SEQ ID NO: 1927456 - RNA, 16 nt, Homo sapiens
agugguauauacauau

SEQ ID NO: 1927457 - RNA, 19 nt, Homo sapiens
uuuggaagaggacuccuua

SEQ ID NO: 1927458 - RNA, 15 nt, Homo sapiens
ccucugcagucucua

SEQ ID NO: 1927459 - RNA, 18 nt, Homo sapiens
cuuuucaaucuucuacuu

SEQ ID NO: 1927460 - RNA, 14 nt, Homo sapiens
ccaagucuuuccua

SEQ ID NO: 1927461 - RNA, 18 nt, Homo sapiens
cagccugggggcugggag

SEQ ID NO: 1927462 - RNA, 15 nt, Homo sapiens
uggaauugacucaaa

SEQ ID NO: 1927463 - RNA, 12 nt, Homo sapiens
aggaugcacauu

SEQ ID NO: 1927464 - RNA, 16 nt, Homo sapiens
acaaugaauucuucaa

SEQ ID NO: 1927465 - RNA, 22 nt, Homo sapiens
cccagaaagucucucauucuag

SEQ ID NO: 1927466 - RNA, 14 nt, Homo sapiens
ccaguagaugccac

SEQ ID NO: 1927467 - RNA, 13 nt, Homo sapiens
ucuugcugugcuu

SEQ ID NO: 1927468 - RNA, 17 nt, Homo sapiens
acugcuacaaucaaggc

SEQ ID NO: 1927469 - RNA, 15 nt, Homo sapiens
ucugagaaaaggcaa

SEQ ID NO: 1927470 - RNA, 19 nt, Homo sapiens
gaccauuuuuacauccaug

SEQ ID NO: 1927471 - RNA, 18 nt, Homo sapiens
agugaaagcccugacuau

SEQ ID NO: 1927472 - RNA, 15 nt, Homo sapiens
ucauaaaacaaaucc

SEQ ID NO: 1927473 - RNA, 13 nt, Homo sapiens
gcaagaauggaga

SEQ ID NO: 1927474 - RNA, 15 nt, Homo sapiens
uacuaaggagcauga

SEQ ID NO: 1927475 - RNA, 20 nt, Homo sapiens
cuuaaaacuauaacauuaua

SEQ ID NO: 1927476 - RNA, 17 nt, Homo sapiens
auugaggacuauggaaa

SEQ ID NO: 1927477 - RNA, 18 nt, Homo sapiens
uccagacuguccacucgg

SEQ ID NO: 1927478 - RNA, 16 nt, Homo sapiens
agugaauaaacuucag

SEQ ID NO: 1927479 - RNA, 12 nt, Homo sapiens
gcccacaccucc

SEQ ID NO: 1927480 - RNA, 20 nt, Homo sapiens
aaagcaagcauucagaagaa

SEQ ID NO: 1927481 - RNA, 15 nt, Homo sapiens
caugugcucagggaa

SEQ ID NO: 1927482 - RNA, 14 nt, Homo sapiens
uugagcuacuucaa

SEQ ID NO: 1927483 - RNA, 17 nt, Homo sapiens
acauaucacaugucagc

SEQ ID NO: 1927484 - RNA, 12 nt, Homo sapiens
cucugauuucag

SEQ ID NO: 1927485 - RNA, 17 nt, Homo sapiens
aacuuaccuuguuaaga

SEQ ID NO: 1927486 - RNA, 22 nt, Homo sapiens
accucaguugaaaaugcaacuc

SEQ ID NO: 1927487 - RNA, 14 nt, Homo sapiens
gaaaauaaacugac

SEQ ID NO: 1927488 - RNA, 17 nt, Homo sapiens
uagugauuaccaaaaua

SEQ ID NO: 1927489 - RNA, 16 nt, Homo sapiens
uuccauugguccaaga

SEQ ID NO: 1927490 - RNA, 17 nt, Homo sapiens
agaugaccucguacuca

SEQ ID NO: 1927491 - RNA, 14 nt, Homo sapiens
aagcagauaccuug

SEQ ID NO: 1927492 - RNA, 18 nt, Homo sapiens
gccuaugcagacaucucu

SEQ ID NO: 1927493 - RNA, 17 nt, Homo sapiens
auaggccaggcacugug

SEQ ID NO: 1927494 - RNA, 13 nt, Homo sapiens
gguuaauccagcu

SEQ ID NO: 1927495 - RNA, 16 nt, Homo sapiens
gccagccguaaugggg

SEQ ID NO: 1927496 - RNA, 14 nt, Homo sapiens
acuguaucuaaaaa

SEQ ID NO: 1927497 - RNA, 15 nt, Homo sapiens
uucgcugccaggaca

SEQ ID NO: 1927498 - RNA, 19 nt, Homo sapiens
accucugggucaucucuca

SEQ ID NO: 1927499 - RNA, 13 nt, Homo sapiens
uuagcaugcugcu

SEQ ID NO: 1927500 - RNA, 13 nt, Homo sapiens
uucuucaugucau

SEQ ID NO: 1927501 - RNA, 17 nt, Homo sapiens
gccaggaguggguuucc

SEQ ID NO: 1927502 - RNA, 23 nt, Homo sapiens
cucaagcgauccucccaccucag

SEQ ID NO: 1927503 - RNA, 17 nt, Homo sapiens
auugcuugagcccagaa

SEQ ID NO: 1927504 - RNA, 23 nt, Homo sapiens
ccaucaggucaccgcgaggccua

SEQ ID NO: 1927505 - RNA, 20 nt, Homo sapiens
uuccacccacaaacuccagg

SEQ ID NO: 1927506 - RNA, 19 nt, Homo sapiens
cugccugcagcugagauuc

SEQ ID NO: 1927507 - RNA, 19 nt, Homo sapiens
uccuuagucucaagggcua

SEQ ID NO: 1927508 - RNA, 17 nt, Homo sapiens
ucaagcacuuacagcuc

SEQ ID NO: 1927509 - RNA, 23 nt, Homo sapiens
caccaggaaggaagcuguugcuu

SEQ ID NO: 1927510 - RNA, 22 nt, Homo sapiens
auguuuuaugguagcuuuuacu

SEQ ID NO: 1927511 - RNA, 22 nt, Homo sapiens
auguaaauuaucaggcaaauuu

SEQ ID NO: 1927512 - RNA, 19 nt, Homo sapiens
gagguguuggcugcacgug

SEQ ID NO: 1927513 - RNA, 16 nt, Homo sapiens
augacagccauuugua

SEQ ID NO: 1927514 - RNA, 19 nt, Homo sapiens
acagugcucgaccuugaua

SEQ ID NO: 1927515 - RNA, 23 nt, Homo sapiens
uucaccuccagcccccagugucc

SEQ ID NO: 1927516 - RNA, 16 nt, Homo sapiens
gaacauacacugugaa

SEQ ID NO: 1927517 - RNA, 16 nt, Homo sapiens
guaggcaggugucuug

SEQ ID NO: 1927518 - RNA, 12 nt, Homo sapiens
ugagaaggccag

SEQ ID NO: 1927519 - RNA, 12 nt, Homo sapiens
uccaccuucuac

SEQ ID NO: 1927520 - RNA, 16 nt, Homo sapiens
aaauguauuaucacca

SEQ ID NO: 1927521 - RNA, 20 nt, Homo sapiens
caacuuaggcuacagaauga

SEQ ID NO: 1927522 - RNA, 19 nt, Homo sapiens
aacacguuuuuucacuauu

SEQ ID NO: 1927523 - RNA, 17 nt, Homo sapiens
uuagcuuagaccucagc

SEQ ID NO: 1927524 - RNA, 19 nt, Homo sapiens
guugcaggaccucagguga

SEQ ID NO: 1927525 - RNA, 14 nt, Homo sapiens
ucuauauaccaaag

SEQ ID NO: 1927526 - RNA, 19 nt, Homo sapiens
cccaccacauagcaugcuu

SEQ ID NO: 1927527 - RNA, 13 nt, Homo sapiens
uucaguguugaca

SEQ ID NO: 1927528 - RNA, 22 nt, Homo sapiens
ucacaagaaaaaggaagccacu

SEQ ID NO: 1927529 - RNA, 17 nt, Homo sapiens
auugcuaugaaugauac

SEQ ID NO: 1927530 - RNA, 18 nt, Homo sapiens
gcaggagcagcugugcug

SEQ ID NO: 1927531 - RNA, 19 nt, Homo sapiens
ugcaugucugccuaugcac

SEQ ID NO: 1927532 - RNA, 20 nt, Homo sapiens
ugugaacaugccuccuccug

SEQ ID NO: 1927533 - RNA, 21 nt, Homo sapiens
cagggucucacuauguugccc

SEQ ID NO: 1927534 - RNA, 20 nt, Homo sapiens
aaauauguuucacacaaaca

SEQ ID NO: 1927535 - RNA, 13 nt, Homo sapiens
uuuaagcaucaaa

SEQ ID NO: 1927536 - RNA, 23 nt, Homo sapiens
ugauuguuauuggguaucaccac

SEQ ID NO: 1927537 - RNA, 15 nt, Homo sapiens
caaaucaggcugggu

SEQ ID NO: 1927538 - RNA, 12 nt, Homo sapiens
cagcuccagugc

SEQ ID NO: 1927539 - RNA, 17 nt, Homo sapiens
uaugcgcaaaacugccu

SEQ ID NO: 1927540 - RNA, 17 nt, Homo sapiens
caaccgcacaugugcca

SEQ ID NO: 1927541 - RNA, 15 nt, Homo sapiens
caguaaacacuccac

SEQ ID NO: 1927542 - RNA, 23 nt, Homo sapiens
uaaucccgauucacccuguccaa

SEQ ID NO: 1927543 - RNA, 21 nt, Homo sapiens
acagauguccaucagaugaca

SEQ ID NO: 1927544 - RNA, 22 nt, Homo sapiens
aucauaaacuauauucugugac

SEQ ID NO: 1927545 - RNA, 19 nt, Homo sapiens
gaucacucaccauucccag

SEQ ID NO: 1927546 - RNA, 20 nt, Homo sapiens
cuuauaucauguaccucaga

SEQ ID NO: 1927547 - RNA, 17 nt, Homo sapiens
augucuuaaccuaccug

SEQ ID NO: 1927548 - RNA, 19 nt, Homo sapiens
aaagaagaagaaguuccgu

SEQ ID NO: 1927549 - RNA, 14 nt, Homo sapiens
cuccuggaaccuug

SEQ ID NO: 1927550 - RNA, 13 nt, Homo sapiens
auuagccaggugu

SEQ ID NO: 1927551 - RNA, 21 nt, Homo sapiens
cauauauuggguuccauucuc

SEQ ID NO: 1927552 - RNA, 17 nt, Homo sapiens
ugucucgaugccauaau

SEQ ID NO: 1927553 - RNA, 23 nt, Homo sapiens
acauaaaaaauaaaguaccacac

SEQ ID NO: 1927554 - RNA, 14 nt, Homo sapiens
ugaacugacaauga

SEQ ID NO: 1927555 - RNA, 15 nt, Homo sapiens
gcucccggugugcag

SEQ ID NO: 1927556 - RNA, 15 nt, Homo sapiens
gccaguaaaaguaua

SEQ ID NO: 1927557 - RNA, 22 nt, Homo sapiens
ugugcccacugaacaugcucau

SEQ ID NO: 1927558 - RNA, 20 nt, Homo sapiens
gagaaauugaacuucaggga

SEQ ID NO: 1927559 - RNA, 23 nt, Homo sapiens
gagagucuauuuacggaacucaa

SEQ ID NO: 1927560 - RNA, 17 nt, Homo sapiens
cuaugaagacaucuucc

SEQ ID NO: 1927561 - RNA, 17 nt, Homo sapiens
uucaccagagcauuucc

SEQ ID NO: 1927562 - RNA, 14 nt, Homo sapiens
uaacuguugucaua

SEQ ID NO: 1927563 - RNA, 15 nt, Homo sapiens
uguuccgugccaggc

SEQ ID NO: 1927564 - RNA, 21 nt, Homo sapiens
acugaaguauacauuuaguua

SEQ ID NO: 1927565 - RNA, 10 nt, Homo sapiens
ggacugcugg

SEQ ID NO: 1927566 - RNA, 14 nt, Homo sapiens
guuuaaagucccuu

SEQ ID NO: 1927567 - RNA, 14 nt, Homo sapiens
gcuccuaagccaug

SEQ ID NO: 1927568 - RNA, 16 nt, Homo sapiens
cguauuuuacaugaag

SEQ ID NO: 1927569 - RNA, 19 nt, Homo sapiens
cuagauacagaauaaugga

SEQ ID NO: 1927570 - RNA, 19 nt, Homo sapiens
cugugcugggugagcucuu

SEQ ID NO: 1927571 - RNA, 18 nt, Homo sapiens
ccucguuaacacauggcu

SEQ ID NO: 1927572 - RNA, 15 nt, Homo sapiens
accaauuuauccuug

SEQ ID NO: 1927573 - RNA, 20 nt, Homo sapiens
cuguuguuccauuuuaugca

SEQ ID NO: 1927574 - RNA, 15 nt, Homo sapiens
cauucagcaugagau

SEQ ID NO: 1927575 - RNA, 22 nt, Homo sapiens
acucugggcagggacccggggu

SEQ ID NO: 1927576 - RNA, 18 nt, Homo sapiens
ugguguaauuuuguccuc

SEQ ID NO: 1927577 - RNA, 13 nt, Homo sapiens
ggaacucucucca

SEQ ID NO: 1927578 - RNA, 20 nt, Homo sapiens
aauuucauaccuaucaucuu

SEQ ID NO: 1927579 - RNA, 19 nt, Homo sapiens
gauugcaugugacucugaa

SEQ ID NO: 1927580 - RNA, 12 nt, Homo sapiens
auacaaagugau

SEQ ID NO: 1927581 - RNA, 22 nt, Homo sapiens
gaaauguauuuugaaaacacuu

SEQ ID NO: 1927582 - RNA, 16 nt, Homo sapiens
uaguuguggacauuua

SEQ ID NO: 1927583 - RNA, 23 nt, Homo sapiens
uggacugugggacccuccuggug

SEQ ID NO: 1927584 - RNA, 19 nt, Homo sapiens
aagcagucgaccgcacuua

SEQ ID NO: 1927585 - RNA, 16 nt, Homo sapiens
guucccuuggccucag

SEQ ID NO: 1927586 - RNA, 16 nt, Homo sapiens
agaugucccauuuuca

SEQ ID NO: 1927587 - RNA, 18 nt, Homo sapiens
agugcaguggcacgaucu

SEQ ID NO: 1927588 - RNA, 18 nt, Homo sapiens
caauccagcuauguuaua

SEQ ID NO: 1927589 - RNA, 23 nt, Homo sapiens
uggagaaaagggauggagcugaa

SEQ ID NO: 1927590 - RNA, 14 nt, Homo sapiens
ccgcugcagggugg

SEQ ID NO: 1927591 - RNA, 20 nt, Homo sapiens
agaucaagaaaaaaagggag

SEQ ID NO: 1927592 - RNA, 20 nt, Homo sapiens
ccuuggccaagcugcugcuu

SEQ ID NO: 1927593 - RNA, 14 nt, Homo sapiens
ugccauagcaagau

SEQ ID NO: 1927594 - RNA, 18 nt, Homo sapiens
aaggucucauucuuccaa

SEQ ID NO: 1927595 - RNA, 16 nt, Homo sapiens
agaaggaacauugcag

SEQ ID NO: 1927596 - RNA, 21 nt, Homo sapiens
ugcaaugccaguccugcagga

SEQ ID NO: 1927597 - RNA, 14 nt, Homo sapiens
uaauggacuuucag

SEQ ID NO: 1927598 - RNA, 18 nt, Homo sapiens
cuccagacucucugugaa

SEQ ID NO: 1927599 - RNA, 14 nt, Homo sapiens
acugaucaauuuca

SEQ ID NO: 1927600 - RNA, 14 nt, Homo sapiens
ucagaucauuauca

SEQ ID NO: 1927601 - RNA, 23 nt, Homo sapiens
agcaguuacaaaaaccuucccca

SEQ ID NO: 1927602 - RNA, 22 nt, Homo sapiens
uauguuaauauuuuauguguaa

SEQ ID NO: 1927603 - RNA, 22 nt, Homo sapiens
agaaugcugcaggacuugagaa

SEQ ID NO: 1927604 - RNA, 22 nt, Homo sapiens
aauugguagaaaaauaucuuua

SEQ ID NO: 1927605 - RNA, 18 nt, Homo sapiens
ugcuguggacaccaccua

SEQ ID NO: 1927606 - RNA, 12 nt, Homo sapiens
cuguucaucuca

SEQ ID NO: 1927607 - RNA, 22 nt, Homo sapiens
aagguggccacagugucacugg

SEQ ID NO: 1927608 - RNA, 23 nt, Homo sapiens
aguuggguuaauaccagcuuaaa

SEQ ID NO: 1927609 - RNA, 13 nt, Homo sapiens
cagccuuggcacg

SEQ ID NO: 1927610 - RNA, 19 nt, Homo sapiens
ccgggcaauccagacagca

SEQ ID NO: 1927611 - RNA, 13 nt, Homo sapiens
auguaaagucauc

SEQ ID NO: 1927612 - RNA, 14 nt, Homo sapiens
acaagaaagcuauu

SEQ ID NO: 1927613 - RNA, 14 nt, Homo sapiens
ucugaaaggggugu

SEQ ID NO: 1927614 - RNA, 19 nt, Homo sapiens
cagagagcaaacauaggaa

SEQ ID NO: 1927615 - RNA, 15 nt, Homo sapiens
accccccuugcccau

SEQ ID NO: 1927616 - RNA, 17 nt, Homo sapiens
cuaauccagcaaaguga

SEQ ID NO: 1927617 - RNA, 23 nt, Homo sapiens
ugaggcucuauugagccaagacc

SEQ ID NO: 1927618 - RNA, 15 nt, Homo sapiens
acuacaguacaguga

SEQ ID NO: 1927619 - RNA, 19 nt, Homo sapiens
ccuguagucccauugaugu

SEQ ID NO: 1927620 - RNA, 14 nt, Homo sapiens
uuuaaucucuaaca

SEQ ID NO: 1927621 - RNA, 15 nt, Homo sapiens
caaacuucccagaga

SEQ ID NO: 1927622 - RNA, 18 nt, Homo sapiens
guggaaagucaccuacag

SEQ ID NO: 1927623 - RNA, 14 nt, Homo sapiens
auuucucaagaaua

SEQ ID NO: 1927624 - RNA, 11 nt, Homo sapiens
caaaaguggau

SEQ ID NO: 1927625 - RNA, 15 nt, Homo sapiens
auuccaugaauuaaa

SEQ ID NO: 1927626 - RNA, 15 nt, Homo sapiens
auaucuugaaacaua

SEQ ID NO: 1927627 - RNA, 21 nt, Homo sapiens
aacguggggcagcacagagag

SEQ ID NO: 1927628 - RNA, 19 nt, Homo sapiens
uucuaucauuuuuguacag

SEQ ID NO: 1927629 - RNA, 22 nt, Homo sapiens
caguucccuuugcuugucuucu

SEQ ID NO: 1927630 - RNA, 22 nt, Homo sapiens
acugcucucaaaaugugaacug

SEQ ID NO: 1927631 - RNA, 12 nt, Homo sapiens
agcucuucucaa

SEQ ID NO: 1927632 - RNA, 14 nt, Homo sapiens
ggaacugagccaga

SEQ ID NO: 1927633 - RNA, 14 nt, Homo sapiens
caauaaaugaacug

SEQ ID NO: 1927634 - RNA, 16 nt, Homo sapiens
caauucguucucugcc

SEQ ID NO: 1927635 - RNA, 23 nt, Homo sapiens
ggaaaggccccaaucuugcccac

SEQ ID NO: 1927636 - RNA, 17 nt, Homo sapiens
cugcaaguucauuuuaa

SEQ ID NO: 1927637 - RNA, 16 nt, Homo sapiens
gucauccaaauggacu

SEQ ID NO: 1927638 - RNA, 23 nt, Homo sapiens
cuuggcucccauucacucuucca

SEQ ID NO: 1927639 - RNA, 16 nt, Homo sapiens
augguaauuguugcua

SEQ ID NO: 1927640 - RNA, 18 nt, Homo sapiens
uuggagcucuauccauau

SEQ ID NO: 1927641 - RNA, 17 nt, Homo sapiens
uguaagcaccccuucau

SEQ ID NO: 1927642 - RNA, 20 nt, Homo sapiens
gcucaaagcaaucccaguga

SEQ ID NO: 1927643 - RNA, 15 nt, Homo sapiens
aaagacguugccuau

SEQ ID NO: 1927644 - RNA, 15 nt, Homo sapiens
aaauguacaacugca

SEQ ID NO: 1927645 - RNA, 20 nt, Homo sapiens
aguugguuuguaucuugccu

SEQ ID NO: 1927646 - RNA, 19 nt, Homo sapiens
ccuucaggagaaucuacac

SEQ ID NO: 1927647 - RNA, 20 nt, Homo sapiens
uuuuauccuagucauucuuc

SEQ ID NO: 1927648 - RNA, 17 nt, Homo sapiens
ugccagugggaacuccu

SEQ ID NO: 1927649 - RNA, 16 nt, Homo sapiens
uucuaaguuucuaaga

SEQ ID NO: 1927650 - RNA, 16 nt, Homo sapiens
uccuguguuccuguga

SEQ ID NO: 1927651 - RNA, 16 nt, Homo sapiens
acauacauacauacaa

SEQ ID NO: 1927652 - RNA, 22 nt, Homo sapiens
uguccccucuccccucauggag

SEQ ID NO: 1927653 - RNA, 13 nt, Homo sapiens
acccaagccacaa

SEQ ID NO: 1927654 - RNA, 16 nt, Homo sapiens
agaaaaugcaccucau

SEQ ID NO: 1927655 - RNA, 17 nt, Homo sapiens
acuauuggguaugaacu

SEQ ID NO: 1927656 - RNA, 22 nt, Homo sapiens
gucacguggaggagcagugcag

SEQ ID NO: 1927657 - RNA, 21 nt, Homo sapiens
cuucucaagcacugacacuca

SEQ ID NO: 1927658 - RNA, 22 nt, Homo sapiens
gaacacuaacucaccagcccca

SEQ ID NO: 1927659 - RNA, 17 nt, Homo sapiens
uugcuaaaaaagcauau

SEQ ID NO: 1927660 - RNA, 21 nt, Homo sapiens
gaaugauuucccacucagggc

SEQ ID NO: 1927661 - RNA, 17 nt, Homo sapiens
acaaugccuugggagag

SEQ ID NO: 1927662 - RNA, 20 nt, Homo sapiens
uaacaagaguuuuaacacuu

SEQ ID NO: 1927663 - RNA, 13 nt, Homo sapiens
ucccccacuucac

SEQ ID NO: 1927664 - RNA, 19 nt, Homo sapiens
gcaacuuguucguggguca

SEQ ID NO: 1927665 - RNA, 18 nt, Homo sapiens
ucaagauucuacuuggug

SEQ ID NO: 1927666 - RNA, 14 nt, Homo sapiens
cccugccucucugc

SEQ ID NO: 1927667 - RNA, 22 nt, Homo sapiens
gcaccuugucauguaccaucaa

SEQ ID NO: 1927668 - RNA, 13 nt, Homo sapiens
uauuauaguauuc

SEQ ID NO: 1927669 - RNA, 15 nt, Homo sapiens
uuguauaaugaacau

SEQ ID NO: 1927670 - RNA, 22 nt, Homo sapiens
auuaugaugaaaaccuacauau

SEQ ID NO: 1927671 - RNA, 21 nt, Homo sapiens
uacauaugcaaaaauauaccu

SEQ ID NO: 1927672 - RNA, 14 nt, Homo sapiens
auccauaucagcuc

SEQ ID NO: 1927673 - RNA, 21 nt, Homo sapiens
uaccugucuucuggcucucuc

SEQ ID NO: 1927674 - RNA, 22 nt, Homo sapiens
uaugcugcuuuuauaucuguau

SEQ ID NO: 1927675 - RNA, 14 nt, Homo sapiens
agacagugagacag

SEQ ID NO: 1927676 - RNA, 14 nt, Homo sapiens
acccacugacccac

SEQ ID NO: 1927677 - RNA, 14 nt, Homo sapiens
uauauauguauaua

SEQ ID NO: 1927678 - RNA, 14 nt, Homo sapiens
cacacaugcacaca

SEQ ID NO: 1927679 - RNA, 14 nt, Homo sapiens
uaaaauuguaaaau

SEQ ID NO: 1927680 - RNA, 14 nt, Homo sapiens
cacaugugcacaug

SEQ ID NO: 1927681 - RNA, 14 nt, Homo sapiens
cauacaugcauaca

SEQ ID NO: 1927682 - RNA, 14 nt, Homo sapiens
cagcuugcugaggg

SEQ ID NO: 1927683 - RNA, 22 nt, Homo sapiens
gagaaccuugugccuggcucag

SEQ ID NO: 1927684 - RNA, 22 nt, Homo sapiens
gguaaggcuggugagguccugg

SEQ ID NO: 1927685 - RNA, 21 nt, Homo sapiens
ugacuccuccaaggaaaggga

SEQ ID NO: 1927686 - RNA, 14 nt, Homo sapiens
gcacauguacauau

SEQ ID NO: 1927687 - RNA, 19 nt, Homo sapiens
agcaaguccucacucuuca

SEQ ID NO: 1927688 - RNA, 20 nt, Homo sapiens
gcugccugggccuguucacg

SEQ ID NO: 1927689 - RNA, 19 nt, Homo sapiens
gaagguggaccuggcagug

SEQ ID NO: 1927690 - RNA, 19 nt, Homo sapiens
cuggggaguuuacuaccug

SEQ ID NO: 1927691 - RNA, 18 nt, Homo sapiens
uuacaggugcccaccacc

SEQ ID NO: 1927692 - RNA, 21 nt, Homo sapiens
uuugaaugcagucuguccagg

SEQ ID NO: 1927693 - RNA, 12 nt, Homo sapiens
uuuguagugcca

SEQ ID NO: 1927694 - RNA, 23 nt, Homo sapiens
gacuggcaagaggccucaugccu

SEQ ID NO: 1927695 - RNA, 20 nt, Homo sapiens
aauuauauuuugaacaacuc

SEQ ID NO: 1927696 - RNA, 14 nt, Homo sapiens
ccuuuuaacugcca

SEQ ID NO: 1927697 - RNA, 22 nt, Homo sapiens
ucugcucugaggcuuccagaga

SEQ ID NO: 1927698 - RNA, 21 nt, Homo sapiens
gcucagcaugcagaagugcau

SEQ ID NO: 1927699 - RNA, 18 nt, Homo sapiens
agauacuugaacacugug

SEQ ID NO: 1927700 - RNA, 14 nt, Homo sapiens
uggaauuggacaua

SEQ ID NO: 1927701 - RNA, 11 nt, Homo sapiens
gguucacugag

SEQ ID NO: 1927702 - RNA, 12 nt, Homo sapiens
uaccagauuuga

SEQ ID NO: 1927703 - RNA, 23 nt, Homo sapiens
aaagucagugcccaacuguuaua

SEQ ID NO: 1927704 - RNA, 23 nt, Homo sapiens
cucagcaccugggacccaacaga

SEQ ID NO: 1927705 - RNA, 22 nt, Homo sapiens
gcauucagaacuucaaguucuc

SEQ ID NO: 1927706 - RNA, 22 nt, Homo sapiens
accaugagaccacuguuaucaa

SEQ ID NO: 1927707 - RNA, 18 nt, Homo sapiens
agguggaacaagcacaga

SEQ ID NO: 1927708 - RNA, 13 nt, Homo sapiens
acuaagcacaaag

SEQ ID NO: 1927709 - RNA, 13 nt, Homo sapiens
ccuaagcaaaaag

SEQ ID NO: 1927710 - RNA, 17 nt, Homo sapiens
guaucagcacuccucau

SEQ ID NO: 1927711 - RNA, 23 nt, Homo sapiens
uccgaacgcugcuccaugcacag

SEQ ID NO: 1927712 - RNA, 16 nt, Homo sapiens
acuauaccaacugggc

SEQ ID NO: 1927713 - RNA, 21 nt, Homo sapiens
uaaguaauuuccccacucuga

SEQ ID NO: 1927714 - RNA, 15 nt, Homo sapiens
caugaaaagcaaaua

SEQ ID NO: 1927715 - RNA, 18 nt, Homo sapiens
uuauggcuuuugugcauu

SEQ ID NO: 1927716 - RNA, 13 nt, Homo sapiens
ccuuguugcacug

SEQ ID NO: 1927717 - RNA, 16 nt, Homo sapiens
cccagaggaaguggau

SEQ ID NO: 1927718 - RNA, 15 nt, Homo sapiens
gaccucugacaaagc

SEQ ID NO: 1927719 - RNA, 17 nt, Homo sapiens
caaacacaguuacacuu

SEQ ID NO: 1927720 - RNA, 12 nt, Homo sapiens
ucaugacaaagu

SEQ ID NO: 1927721 - RNA, 15 nt, Homo sapiens
agacagagacagaga

SEQ ID NO: 1927722 - RNA, 12 nt, Homo sapiens
gguuacacuguu

SEQ ID NO: 1927723 - RNA, 13 nt, Homo sapiens
cacugcauuucau

SEQ ID NO: 1927724 - RNA, 17 nt, Homo sapiens
ucugcguugugugugau

SEQ ID NO: 1927725 - RNA, 16 nt, Homo sapiens
caaagacucugagcca

SEQ ID NO: 1927726 - RNA, 14 nt, Homo sapiens
uguaacacuuguca

SEQ ID NO: 1927727 - RNA, 15 nt, Homo sapiens
uaaauacuguacaua

SEQ ID NO: 1927728 - RNA, 14 nt, Homo sapiens
cauuugugaagcuu

SEQ ID NO: 1927729 - RNA, 20 nt, Homo sapiens
ccuggacaguuuucugcuuu

SEQ ID NO: 1927730 - RNA, 14 nt, Homo sapiens
uacauguguguaua

SEQ ID NO: 1927731 - RNA, 12 nt, Homo sapiens
aaaacaccacca

SEQ ID NO: 1927732 - RNA, 17 nt, Homo sapiens
acuuauccaugcaucac

SEQ ID NO: 1927733 - RNA, 20 nt, Homo sapiens
ccuguuguacacuuggguga

SEQ ID NO: 1927734 - RNA, 19 nt, Homo sapiens
ccacacauuaguacuuaug

SEQ ID NO: 1927735 - RNA, 16 nt, Homo sapiens
cacuccucuaagacaa

SEQ ID NO: 1927736 - RNA, 20 nt, Homo sapiens
caaaagcugcucagggaaaa

SEQ ID NO: 1927737 - RNA, 22 nt, Homo sapiens
uaaauuuccccaacagugugaa

SEQ ID NO: 1927738 - RNA, 20 nt, Homo sapiens
ugagaaagcuuuuauuccuu

SEQ ID NO: 1927739 - RNA, 11 nt, Homo sapiens
aaaucuuucaa

SEQ ID NO: 1927740 - RNA, 11 nt, Homo sapiens
ccaucuuuaca

SEQ ID NO: 1927741 - RNA, 15 nt, Homo sapiens
uagaaggagacagag

SEQ ID NO: 1927742 - RNA, 20 nt, Homo sapiens
agcugaggcagaacucacug

SEQ ID NO: 1927743 - RNA, 22 nt, Homo sapiens
uucccuuguaaagacagaguga

SEQ ID NO: 1927744 - RNA, 17 nt, Homo sapiens
aaaccaaaucauacuuu

SEQ ID NO: 1927745 - RNA, 22 nt, Homo sapiens
uaagaggaucuccuguccauca

SEQ ID NO: 1927746 - RNA, 18 nt, Homo sapiens
gaaacaugacacugaccu

SEQ ID NO: 1927747 - RNA, 16 nt, Homo sapiens
auguguuuucagucuu

SEQ ID NO: 1927748 - RNA, 21 nt, Homo sapiens
gauaaucucuuuaaauggcuu

SEQ ID NO: 1927749 - RNA, 17 nt, Homo sapiens
caaauauguucucugaa

SEQ ID NO: 1927750 - RNA, 15 nt, Homo sapiens
cagggauagcacuga

SEQ ID NO: 1927751 - RNA, 16 nt, Homo sapiens
caauaaaaugucuucu

SEQ ID NO: 1927752 - RNA, 22 nt, Homo sapiens
uugggggggaggugagguacca

SEQ ID NO: 1927753 - RNA, 18 nt, Homo sapiens
cccgaaauagauccagug

SEQ ID NO: 1927754 - RNA, 16 nt, Homo sapiens
gcacauguacccuaaa

SEQ ID NO: 1927755 - RNA, 17 nt, Homo sapiens
aaaggauuuuacagaaa

SEQ ID NO: 1927756 - RNA, 18 nt, Homo sapiens
aaacugacuaaacuuaca

SEQ ID NO: 1927757 - RNA, 23 nt, Homo sapiens
uaaaccagguuuagacaguauga

SEQ ID NO: 1927758 - RNA, 16 nt, Homo sapiens
uaaugguagucagauu

SEQ ID NO: 1927759 - RNA, 22 nt, Homo sapiens
uguauaugccucauacacauaa

SEQ ID NO: 1927760 - RNA, 17 nt, Homo sapiens
caucacucaucugccaa

SEQ ID NO: 1927761 - RNA, 16 nt, Homo sapiens
aacucaucacauaaag

SEQ ID NO: 1927762 - RNA, 19 nt, Homo sapiens
cugaugcagaaagaccgug

SEQ ID NO: 1927763 - RNA, 19 nt, Homo sapiens
agaaggaaagaauaaccaa

SEQ ID NO: 1927764 - RNA, 19 nt, Homo sapiens
ggcuggagugcaauggcgu

SEQ ID NO: 1927765 - RNA, 20 nt, Homo sapiens
ugcuuaauugugaacagcca

SEQ ID NO: 1927766 - RNA, 12 nt, Homo sapiens
gaugggcaaagc

SEQ ID NO: 1927767 - RNA, 15 nt, Homo sapiens
gagugaaccuaccuu

SEQ ID NO: 1927768 - RNA, 15 nt, Homo sapiens
aaaucuccagugugc

SEQ ID NO: 1927769 - RNA, 15 nt, Homo sapiens
acagacacuguugca

SEQ ID NO: 1927770 - RNA, 17 nt, Homo sapiens
gagcaucgaagcucugu

SEQ ID NO: 1927771 - RNA, 18 nt, Homo sapiens
ugggucuuuguacauuuu

SEQ ID NO: 1927772 - RNA, 18 nt, Homo sapiens
cauuucuagcagugauga

SEQ ID NO: 1927773 - RNA, 19 nt, Homo sapiens
ggcugcgucccugcucagc

SEQ ID NO: 1927774 - RNA, 17 nt, Homo sapiens
acaaaccuuuagcugug

SEQ ID NO: 1927775 - RNA, 14 nt, Homo sapiens
ccuuccagccacau

SEQ ID NO: 1927776 - RNA, 21 nt, Homo sapiens
accugcgucauuucagcucuu

SEQ ID NO: 1927777 - RNA, 15 nt, Homo sapiens
gauacaaaguacaga

SEQ ID NO: 1927778 - RNA, 15 nt, Homo sapiens
gacugcaucucaaaa

SEQ ID NO: 1927779 - RNA, 22 nt, Homo sapiens
cauaacaggcauugcacuaaaa

SEQ ID NO: 1927780 - RNA, 19 nt, Homo sapiens
acaagcagcuggugcucca

SEQ ID NO: 1927781 - RNA, 19 nt, Homo sapiens
ucauuuucuuuccuuuccc

SEQ ID NO: 1927782 - RNA, 16 nt, Homo sapiens
gucuaauaaacacaga

SEQ ID NO: 1927783 - RNA, 16 nt, Homo sapiens
gagaauucaugucugc

SEQ ID NO: 1927784 - RNA, 18 nt, Homo sapiens
gauggaggggcugacuca

SEQ ID NO: 1927785 - RNA, 22 nt, Homo sapiens
cgggcaugagucuguuucccaa

SEQ ID NO: 1927786 - RNA, 19 nt, Homo sapiens
ccagcucccuaggagacca

SEQ ID NO: 1927787 - RNA, 19 nt, Homo sapiens
auuucuuaaaacacaugau

SEQ ID NO: 1927788 - RNA, 22 nt, Homo sapiens
cuucauucgagaugaguuucug

SEQ ID NO: 1927789 - RNA, 19 nt, Homo sapiens
ugucaccucuguuaagguu

SEQ ID NO: 1927790 - RNA, 21 nt, Homo sapiens
cucacugaggguaucugacaa

SEQ ID NO: 1927791 - RNA, 18 nt, Homo sapiens
gggugugcuguugccuuc

SEQ ID NO: 1927792 - RNA, 17 nt, Homo sapiens
ccuugggccuugcugcu

SEQ ID NO: 1927793 - RNA, 17 nt, Homo sapiens
cagaaaaaaaaauggaa

SEQ ID NO: 1927794 - RNA, 22 nt, Homo sapiens
augaggucaauuuccugaugca

SEQ ID NO: 1927795 - RNA, 19 nt, Homo sapiens
uggcaggaagggacugcca

SEQ ID NO: 1927796 - RNA, 16 nt, Homo sapiens
aaugaaaaacuauguc

SEQ ID NO: 1927797 - RNA, 16 nt, Homo sapiens
ugcuauuugcuguuau

SEQ ID NO: 1927798 - RNA, 16 nt, Homo sapiens
aaauaaauacguguca

SEQ ID NO: 1927799 - RNA, 20 nt, Homo sapiens
uguugucaauaacagguuug

SEQ ID NO: 1927800 - RNA, 18 nt, Homo sapiens
ugccuuagcaugugacuc

SEQ ID NO: 1927801 - RNA, 13 nt, Homo sapiens
caaaugcaauuuu

SEQ ID NO: 1927802 - RNA, 13 nt, Homo sapiens
auuuagcacaaaa

SEQ ID NO: 1927803 - RNA, 20 nt, Homo sapiens
ucaagguguaggucagauau

SEQ ID NO: 1927804 - RNA, 23 nt, Homo sapiens
uucauggaguagagucaggagaa

SEQ ID NO: 1927805 - RNA, 16 nt, Homo sapiens
caguaccaguguaaau

SEQ ID NO: 1927806 - RNA, 15 nt, Homo sapiens
uguguucguugcaca

SEQ ID NO: 1927807 - RNA, 11 nt, Homo sapiens
cagucugugaa

SEQ ID NO: 1927808 - RNA, 21 nt, Homo sapiens
uggaucuauuuacauagucau

SEQ ID NO: 1927809 - RNA, 16 nt, Homo sapiens
cgcugagcucccagac

SEQ ID NO: 1927810 - RNA, 13 nt, Homo sapiens
acuucacuccaaa

SEQ ID NO: 1927811 - RNA, 15 nt, Homo sapiens
uugcuuguguuuauu

SEQ ID NO: 1927812 - RNA, 13 nt, Homo sapiens
cggcucuagcccc

SEQ ID NO: 1927813 - RNA, 21 nt, Homo sapiens
aaagcaggauuauuaagugau

SEQ ID NO: 1927814 - RNA, 17 nt, Homo sapiens
ugauucucaugcacugc

SEQ ID NO: 1927815 - RNA, 17 nt, Homo sapiens
auguauuuugacacugg

SEQ ID NO: 1927816 - RNA, 17 nt, Homo sapiens
ccuuguuccaauuugac

SEQ ID NO: 1927817 - RNA, 12 nt, Homo sapiens
ucuuucuguccc

SEQ ID NO: 1927818 - RNA, 15 nt, Homo sapiens
ucccagcugaccaga

SEQ ID NO: 1927819 - RNA, 12 nt, Homo sapiens
ccaagucuuccu

SEQ ID NO: 1927820 - RNA, 15 nt, Homo sapiens
ccgaggggccagggu

SEQ ID NO: 1927821 - RNA, 17 nt, Homo sapiens
aacaggccgcacaucuc

SEQ ID NO: 1927822 - RNA, 15 nt, Homo sapiens
caaaucugacauauu

SEQ ID NO: 1927823 - RNA, 19 nt, Homo sapiens
caguuccauucaacuggaa

SEQ ID NO: 1927824 - RNA, 15 nt, Homo sapiens
accacuagguucuag

SEQ ID NO: 1927825 - RNA, 21 nt, Homo sapiens
uccaacuaacaagaaacucac

SEQ ID NO: 1927826 - RNA, 15 nt, Homo sapiens
cacacagcugcccua

SEQ ID NO: 1927827 - RNA, 12 nt, Homo sapiens
ccaggugccuug

SEQ ID NO: 1927828 - RNA, 12 nt, Homo sapiens
ccaugugccuuu

SEQ ID NO: 1927829 - RNA, 21 nt, Homo sapiens
aaccauuuuuaggaagcuaga

SEQ ID NO: 1927830 - RNA, 20 nt, Homo sapiens
aauccauaucagcucugcau

SEQ ID NO: 1927831 - RNA, 17 nt, Homo sapiens
aaugcuaaucuugugaa

SEQ ID NO: 1927832 - RNA, 14 nt, Homo sapiens
ugucuguuggucaa

SEQ ID NO: 1927833 - RNA, 18 nt, Homo sapiens
uggagccccaucagcucc

SEQ ID NO: 1927834 - RNA, 22 nt, Homo sapiens
uagaagccaaguaaagugcuua

SEQ ID NO: 1927835 - RNA, 17 nt, Homo sapiens
ccugacacuccuuucag

SEQ ID NO: 1927836 - RNA, 16 nt, Homo sapiens
auucaggauuacaugc

SEQ ID NO: 1927837 - RNA, 22 nt, Homo sapiens
aagaucaaaauaaaaagugaca

SEQ ID NO: 1927838 - RNA, 22 nt, Homo sapiens
uaaguggccggaaaacaagccu

SEQ ID NO: 1927839 - RNA, 14 nt, Homo sapiens
ggaagagauccaaa

SEQ ID NO: 1927840 - RNA, 14 nt, Homo sapiens
uauuaacuacugaa

SEQ ID NO: 1927841 - RNA, 23 nt, Homo sapiens
ggagauccgcaucuggggacccc

SEQ ID NO: 1927842 - RNA, 22 nt, Homo sapiens
ggacuggugucauaaacuuucu

SEQ ID NO: 1927843 - RNA, 15 nt, Homo sapiens
aauaguggauaacau

SEQ ID NO: 1927844 - RNA, 14 nt, Homo sapiens
uuuagcaaaacugg

SEQ ID NO: 1927845 - RNA, 23 nt, Homo sapiens
ugaaacuagaagagauuucuaaa

SEQ ID NO: 1927846 - RNA, 13 nt, Homo sapiens
cccagacucugag

SEQ ID NO: 1927847 - RNA, 15 nt, Homo sapiens
gaaaucaaaauccaa

SEQ ID NO: 1927848 - RNA, 19 nt, Homo sapiens
aauauagugacuaugaacu

SEQ ID NO: 1927849 - RNA, 16 nt, Homo sapiens
cgcugccaggggcugc

SEQ ID NO: 1927850 - RNA, 18 nt, Homo sapiens
cccagcuaagaaccugga

SEQ ID NO: 1927851 - RNA, 19 nt, Homo sapiens
ugagccccacagcccugcu

SEQ ID NO: 1927852 - RNA, 18 nt, Homo sapiens
gguucucagaaccauuuc

SEQ ID NO: 1927853 - RNA, 18 nt, Homo sapiens
acccuguuuucagcuaaa

SEQ ID NO: 1927854 - RNA, 16 nt, Homo sapiens
gaauauaggauaagaa

SEQ ID NO: 1927855 - RNA, 18 nt, Homo sapiens
aucucccagugacaacau

SEQ ID NO: 1927856 - RNA, 14 nt, Homo sapiens
ccaggccacccacu

SEQ ID NO: 1927857 - RNA, 23 nt, Homo sapiens
ucagaucccagcuucggcauuug

SEQ ID NO: 1927858 - RNA, 16 nt, Homo sapiens
cccauguguggcagca

SEQ ID NO: 1927859 - RNA, 14 nt, Homo sapiens
cuaaaauucuguca

SEQ ID NO: 1927860 - RNA, 15 nt, Homo sapiens
aaaaguuacauguuu

SEQ ID NO: 1927861 - RNA, 17 nt, Homo sapiens
ucgcacugggggacaug

SEQ ID NO: 1927862 - RNA, 15 nt, Homo sapiens
uaaaacucaccuccc

SEQ ID NO: 1927863 - RNA, 20 nt, Homo sapiens
ucacagaggcaguaggaacc

SEQ ID NO: 1927864 - RNA, 14 nt, Homo sapiens
auacauuucaauua

SEQ ID NO: 1927865 - RNA, 19 nt, Homo sapiens
aguuuccaaguuuauugcc

SEQ ID NO: 1927866 - RNA, 19 nt, Homo sapiens
ccucucagcugcugggacg

SEQ ID NO: 1927867 - RNA, 13 nt, Homo sapiens
auaaaacaaugaa

SEQ ID NO: 1927868 - RNA, 13 nt, Homo sapiens
cugaaacacuaaa

SEQ ID NO: 1927869 - RNA, 19 nt, Homo sapiens
ccccagccugccuuugcca

SEQ ID NO: 1927870 - RNA, 19 nt, Homo sapiens
ugaaauuaacucagacaca

SEQ ID NO: 1927871 - RNA, 13 nt, Homo sapiens
agcuacuugccuu

SEQ ID NO: 1927872 - RNA, 14 nt, Homo sapiens
augcaauuugauaa

SEQ ID NO: 1927873 - RNA, 15 nt, Homo sapiens
uauggccacauucaa

SEQ ID NO: 1927874 - RNA, 14 nt, Homo sapiens
agacucagugcaca

SEQ ID NO: 1927875 - RNA, 13 nt, Homo sapiens
uucgccucuggau

SEQ ID NO: 1927876 - RNA, 20 nt, Homo sapiens
caacucaagggcacauagaa

SEQ ID NO: 1927877 - RNA, 22 nt, Homo sapiens
uccuugucguaggaaaaccaug

SEQ ID NO: 1927878 - RNA, 18 nt, Homo sapiens
cauggauguuaaauuaua

SEQ ID NO: 1927879 - RNA, 21 nt, Homo sapiens
acugucuuuuuccucaaugaa

SEQ ID NO: 1927880 - RNA, 20 nt, Homo sapiens
caggaggcagacaaugaccc

SEQ ID NO: 1927881 - RNA, 21 nt, Homo sapiens
aaagcaaaggcagucccggga

SEQ ID NO: 1927882 - RNA, 12 nt, Homo sapiens
cugcacaaugca

SEQ ID NO: 1927883 - RNA, 16 nt, Homo sapiens
ugugguuugcagauga

SEQ ID NO: 1927884 - RNA, 19 nt, Homo sapiens
gcacagcucuucacaccau

SEQ ID NO: 1927885 - RNA, 19 nt, Homo sapiens
ccagugacaaggcccugag

SEQ ID NO: 1927886 - RNA, 13 nt, Homo sapiens
ucuuguugcaaaa

SEQ ID NO: 1927887 - RNA, 16 nt, Homo sapiens
agccaacauggugaaa

SEQ ID NO: 1927888 - RNA, 20 nt, Homo sapiens
ucuugcugccagcuaauaag

SEQ ID NO: 1927889 - RNA, 22 nt, Homo sapiens
gcaucagugggaucccagacau

SEQ ID NO: 1927890 - RNA, 16 nt, Homo sapiens
aguccugacugggcug

SEQ ID NO: 1927891 - RNA, 17 nt, Homo sapiens
acauucuauagccauaa

SEQ ID NO: 1927892 - RNA, 22 nt, Homo sapiens
cuccucugacuuggggcagcuu

SEQ ID NO: 1927893 - RNA, 22 nt, Homo sapiens
accucauggaugcuuuggcaau

SEQ ID NO: 1927894 - RNA, 17 nt, Homo sapiens
uguucaguguugacaua

SEQ ID NO: 1927895 - RNA, 16 nt, Homo sapiens
aauuauaagcauacaa

SEQ ID NO: 1927896 - RNA, 13 nt, Homo sapiens
aaucagacuauga

SEQ ID NO: 1927897 - RNA, 11 nt, Homo sapiens
aggauguugcc

SEQ ID NO: 1927898 - RNA, 15 nt, Homo sapiens
auguucaugugauua

SEQ ID NO: 1927899 - RNA, 17 nt, Homo sapiens
auuuaacacuauccaau

SEQ ID NO: 1927900 - RNA, 20 nt, Homo sapiens
cagaaagggaacaguccaua

SEQ ID NO: 1927901 - RNA, 20 nt, Homo sapiens
aaacaucuccccucucaccu

SEQ ID NO: 1927902 - RNA, 23 nt, Homo sapiens
uccuguugccuuuauauccaaaa

SEQ ID NO: 1927903 - RNA, 17 nt, Homo sapiens
cuggagcucaucugcaa

SEQ ID NO: 1927904 - RNA, 19 nt, Homo sapiens
ggccaaugggagagcucuu

SEQ ID NO: 1927905 - RNA, 13 nt, Homo sapiens
uguaaaugugaca

SEQ ID NO: 1927906 - RNA, 14 nt, Homo sapiens
gauuuuaauuagcc

SEQ ID NO: 1927907 - RNA, 17 nt, Homo sapiens
aagcagccaucacauga

SEQ ID NO: 1927908 - RNA, 21 nt, Homo sapiens
caauagaacaguuuacuugga

SEQ ID NO: 1927909 - RNA, 22 nt, Homo sapiens
cuaguaaguaauuaugcacuaa

SEQ ID NO: 1927910 - RNA, 16 nt, Homo sapiens
ccccaauuacagggug

SEQ ID NO: 1927911 - RNA, 22 nt, Homo sapiens
gcuacuugggaggcugagccag

SEQ ID NO: 1927912 - RNA, 14 nt, Homo sapiens
auagccgauaucag

SEQ ID NO: 1927913 - RNA, 20 nt, Homo sapiens
cuuaaaauaaugaauacauu

SEQ ID NO: 1927914 - RNA, 11 nt, Homo sapiens
cugugaccaaa

SEQ ID NO: 1927915 - RNA, 19 nt, Homo sapiens
ucacacacuuucucuucaa

SEQ ID NO: 1927916 - RNA, 13 nt, Homo sapiens
agcagagcaggca

SEQ ID NO: 1927917 - RNA, 13 nt, Homo sapiens
uggcaagcugcag

SEQ ID NO: 1927918 - RNA, 15 nt, Homo sapiens
uccacuuacauauau

SEQ ID NO: 1927919 - RNA, 13 nt, Homo sapiens
aagagcaaaacuc

SEQ ID NO: 1927920 - RNA, 13 nt, Homo sapiens
cacaccaacagug

SEQ ID NO: 1927921 - RNA, 19 nt, Homo sapiens
aggaaccgagguguugcca

SEQ ID NO: 1927922 - RNA, 23 nt, Homo sapiens
acagaauuuuuuaaauugacagu

SEQ ID NO: 1927923 - RNA, 19 nt, Homo sapiens
ucccacagagugcuggacu

SEQ ID NO: 1927924 - RNA, 21 nt, Homo sapiens
augguaccuauuuggugcuag

SEQ ID NO: 1927925 - RNA, 18 nt, Homo sapiens
ucauauacaauugucaug

SEQ ID NO: 1927926 - RNA, 17 nt, Homo sapiens
acuuagagaugcuacug

SEQ ID NO: 1927927 - RNA, 18 nt, Homo sapiens
acauaaaaaagaagcacu

SEQ ID NO: 1927928 - RNA, 12 nt, Homo sapiens
cuccugcuccuc

SEQ ID NO: 1927929 - RNA, 22 nt, Homo sapiens
uguuuggaauauuccacuauuu

SEQ ID NO: 1927930 - RNA, 18 nt, Homo sapiens
gaauuauuuaaauuacag

SEQ ID NO: 1927931 - RNA, 15 nt, Homo sapiens
uccuguguaugcuga

SEQ ID NO: 1927932 - RNA, 16 nt, Homo sapiens
caucauaaccauuccc

SEQ ID NO: 1927933 - RNA, 17 nt, Homo sapiens
caggagaugauucuguu

SEQ ID NO: 1927934 - RNA, 23 nt, Homo sapiens
aagcauuuuauaaaucgcuuuug

SEQ ID NO: 1927935 - RNA, 20 nt, Homo sapiens
caggguaccucaagccccau

SEQ ID NO: 1927936 - RNA, 18 nt, Homo sapiens
agagggggccuucacagu

SEQ ID NO: 1927937 - RNA, 15 nt, Homo sapiens
aagcugccugugcca

SEQ ID NO: 1927938 - RNA, 11 nt, Homo sapiens
augguacugua

SEQ ID NO: 1927939 - RNA, 15 nt, Homo sapiens
gcaagucgccaggca

SEQ ID NO: 1927940 - RNA, 12 nt, Homo sapiens
gucccuugccuu

SEQ ID NO: 1927941 - RNA, 15 nt, Homo sapiens
uugcauguacuugaa

SEQ ID NO: 1927942 - RNA, 18 nt, Homo sapiens
aaccguguaacacgugaa

SEQ ID NO: 1927943 - RNA, 19 nt, Homo sapiens
aguagagacgggguuucac

SEQ ID NO: 1927944 - RNA, 13 nt, Homo sapiens
ggaguugccugac

SEQ ID NO: 1927945 - RNA, 20 nt, Homo sapiens
cuaaguaaccugauuacaag

SEQ ID NO: 1927946 - RNA, 17 nt, Homo sapiens
gucaugucugugauugc

SEQ ID NO: 1927947 - RNA, 15 nt, Homo sapiens
uccauugucaugaaa

SEQ ID NO: 1927948 - RNA, 13 nt, Homo sapiens
cugagccagcugc

SEQ ID NO: 1927949 - RNA, 22 nt, Homo sapiens
aaggaacucuggcuuccaggua

SEQ ID NO: 1927950 - RNA, 16 nt, Homo sapiens
agaccaguagugacca

SEQ ID NO: 1927951 - RNA, 20 nt, Homo sapiens
cuauccagccgcaaauccau

SEQ ID NO: 1927952 - RNA, 18 nt, Homo sapiens
cuagaaaggaacugcaau

SEQ ID NO: 1927953 - RNA, 13 nt, Homo sapiens
uuuauaaauucau

SEQ ID NO: 1927954 - RNA, 13 nt, Homo sapiens
uuucuaaauuccu

SEQ ID NO: 1927955 - RNA, 13 nt, Homo sapiens
guuaaaaagucaa

SEQ ID NO: 1927956 - RNA, 16 nt, Homo sapiens
agaugcuccaagauuc

SEQ ID NO: 1927957 - RNA, 17 nt, Homo sapiens
agcguguuuacaugugu

SEQ ID NO: 1927958 - RNA, 12 nt, Homo sapiens
ugaaagugcacu

SEQ ID NO: 1927959 - RNA, 23 nt, Homo sapiens
agaagucugucuuucuauagaaa

SEQ ID NO: 1927960 - RNA, 17 nt, Homo sapiens
auaaacccaguugccau

SEQ ID NO: 1927961 - RNA, 13 nt, Homo sapiens
aaugaagcugcca

SEQ ID NO: 1927962 - RNA, 20 nt, Homo sapiens
guguuugcacuauacuuucu

SEQ ID NO: 1927963 - RNA, 20 nt, Homo sapiens
ucagauggaagcuuacucuc

SEQ ID NO: 1927964 - RNA, 15 nt, Homo sapiens
cuggcccacccaguc

SEQ ID NO: 1927965 - RNA, 20 nt, Homo sapiens
acuauugguaaacaccuaaa

SEQ ID NO: 1927966 - RNA, 17 nt, Homo sapiens
gagccagccuugcagua

SEQ ID NO: 1927967 - RNA, 18 nt, Homo sapiens
cuacugcaaauggcaguu

SEQ ID NO: 1927968 - RNA, 23 nt, Homo sapiens
ucaaaacuggacagucacugcca

SEQ ID NO: 1927969 - RNA, 19 nt, Homo sapiens
acuccugggucccugggaa

SEQ ID NO: 1927970 - RNA, 16 nt, Homo sapiens
aauccauaucagcucu

SEQ ID NO: 1927971 - RNA, 16 nt, Homo sapiens
gauagggaacugggga

SEQ ID NO: 1927972 - RNA, 20 nt, Homo sapiens
ccagaucacccauuccgggu

SEQ ID NO: 1927973 - RNA, 20 nt, Homo sapiens
uggaauagggaacuguaaug

SEQ ID NO: 1927974 - RNA, 17 nt, Homo sapiens
aacaggagaaugcacag

SEQ ID NO: 1927975 - RNA, 20 nt, Homo sapiens
auuuuaaauauugucauuac

SEQ ID NO: 1927976 - RNA, 18 nt, Homo sapiens
aaugaaggccaucaucuc

SEQ ID NO: 1927977 - RNA, 13 nt, Homo sapiens
uggucccacuuca

SEQ ID NO: 1927978 - RNA, 22 nt, Homo sapiens
auugcccccucucacuuuagca

SEQ ID NO: 1927979 - RNA, 21 nt, Homo sapiens
ccaugccacugccaggcaccu

SEQ ID NO: 1927980 - RNA, 15 nt, Homo sapiens
gaguaccauaauucu

SEQ ID NO: 1927981 - RNA, 20 nt, Homo sapiens
uugggauuuugguuucuucc

SEQ ID NO: 1927982 - RNA, 14 nt, Homo sapiens
caacaaacacuuga

SEQ ID NO: 1927983 - RNA, 11 nt, Homo sapiens
acgucauuugu

SEQ ID NO: 1927984 - RNA, 13 nt, Homo sapiens
gggagaaaugacu

SEQ ID NO: 1927985 - RNA, 13 nt, Homo sapiens
ggaaauaauauca

SEQ ID NO: 1927986 - RNA, 18 nt, Homo sapiens
agguccugagcacugcca

SEQ ID NO: 1927987 - RNA, 14 nt, Homo sapiens
caccauucugaauu

SEQ ID NO: 1927988 - RNA, 19 nt, Homo sapiens
cacuguuuguuacuaugua

SEQ ID NO: 1927989 - RNA, 20 nt, Homo sapiens
cccuccaaaucucauguuca

SEQ ID NO: 1927990 - RNA, 22 nt, Homo sapiens
caagauuguaaguaaauugccu

SEQ ID NO: 1927991 - RNA, 17 nt, Homo sapiens
cauuugacuuucugucu

SEQ ID NO: 1927992 - RNA, 17 nt, Homo sapiens
agcacaagaaacuuugg

SEQ ID NO: 1927993 - RNA, 18 nt, Homo sapiens
aauuaaaguggaccaaua

SEQ ID NO: 1927994 - RNA, 12 nt, Homo sapiens
uauuucucuucc

SEQ ID NO: 1927995 - RNA, 22 nt, Homo sapiens
uagggacaugaaauuuacaaag

SEQ ID NO: 1927996 - RNA, 12 nt, Homo sapiens
acaucucuguga

SEQ ID NO: 1927997 - RNA, 17 nt, Homo sapiens
gaaaguauaaagucacu

SEQ ID NO: 1927998 - RNA, 12 nt, Homo sapiens
augucucugcaa

SEQ ID NO: 1927999 - RNA, 14 nt, Homo sapiens
cacagugcugggau

SEQ ID NO: 1928000 - RNA, 14 nt, Homo sapiens
guggaacauugggg

SEQ ID NO: 1928001 - RNA, 14 nt, Homo sapiens
gcggagcaucggga

SEQ ID NO: 1928002 - RNA, 18 nt, Homo sapiens
uaccucacacccaaagca

SEQ ID NO: 1928003 - RNA, 19 nt, Homo sapiens
ccaacauggcacauguaua

SEQ ID NO: 1928004 - RNA, 20 nt, Homo sapiens
uaacaugaggcccauucuuc

SEQ ID NO: 1928005 - RNA, 13 nt, Homo sapiens
aaugggcagagcc

SEQ ID NO: 1928006 - RNA, 18 nt, Homo sapiens
ucaguaaauaacuggaaa

SEQ ID NO: 1928007 - RNA, 14 nt, Homo sapiens
ugcuuagaaauuca

SEQ ID NO: 1928008 - RNA, 23 nt, Homo sapiens
ugucacccagacuggagugcagu

SEQ ID NO: 1928009 - RNA, 15 nt, Homo sapiens
gacccaggaggccca

SEQ ID NO: 1928010 - RNA, 13 nt, Homo sapiens
gaauugaagccaa

SEQ ID NO: 1928011 - RNA, 16 nt, Homo sapiens
cugacugaauguguuc

SEQ ID NO: 1928012 - RNA, 14 nt, Homo sapiens
ucaacauuaccaaa

SEQ ID NO: 1928013 - RNA, 15 nt, Homo sapiens
cuagaauaaucucau

SEQ ID NO: 1928014 - RNA, 23 nt, Homo sapiens
cccugauugcgcaaaacugaaag

SEQ ID NO: 1928015 - RNA, 22 nt, Homo sapiens
uccacaaccuccuccuccaguu

SEQ ID NO: 1928016 - RNA, 20 nt, Homo sapiens
uaacagaggcaggaguggca

SEQ ID NO: 1928017 - RNA, 12 nt, Homo sapiens
gaauccuagggc

SEQ ID NO: 1928018 - RNA, 14 nt, Homo sapiens
uuguuuauauugca

SEQ ID NO: 1928019 - RNA, 21 nt, Homo sapiens
cuaagaauguuuugcacugac

SEQ ID NO: 1928020 - RNA, 16 nt, Homo sapiens
aauucucagugccaac

SEQ ID NO: 1928021 - RNA, 14 nt, Homo sapiens
cagcaucucagagu

SEQ ID NO: 1928022 - RNA, 16 nt, Homo sapiens
cggauguaugaucucu

SEQ ID NO: 1928023 - RNA, 14 nt, Homo sapiens
cuccauaccugccc

SEQ ID NO: 1928024 - RNA, 16 nt, Homo sapiens
caaccuuccauucaca

SEQ ID NO: 1928025 - RNA, 15 nt, Homo sapiens
accccuagugucuuu

SEQ ID NO: 1928026 - RNA, 13 nt, Homo sapiens
gcacucagaggga

SEQ ID NO: 1928027 - RNA, 17 nt, Homo sapiens
ugcuguccacaugaccu

SEQ ID NO: 1928028 - RNA, 15 nt, Homo sapiens
caauaugccagcuug

SEQ ID NO: 1928029 - RNA, 11 nt, Homo sapiens
uccaccugcag

SEQ ID NO: 1928030 - RNA, 13 nt, Homo sapiens
aucuuuagggaau

SEQ ID NO: 1928031 - RNA, 12 nt, Homo sapiens
gggaccugagag

SEQ ID NO: 1928032 - RNA, 16 nt, Homo sapiens
ucaaaugcauuuucua

SEQ ID NO: 1928033 - RNA, 17 nt, Homo sapiens
uucaugcaauccuucca

SEQ ID NO: 1928034 - RNA, 15 nt, Homo sapiens
ugagauguacaucuu

SEQ ID NO: 1928035 - RNA, 15 nt, Homo sapiens
ugcuucugcacacaa

SEQ ID NO: 1928036 - RNA, 19 nt, Homo sapiens
ucagcuuucaaagcauuua

SEQ ID NO: 1928037 - RNA, 14 nt, Homo sapiens
guuuaacugugcau

SEQ ID NO: 1928038 - RNA, 16 nt, Homo sapiens
uauugcucucauuuca

SEQ ID NO: 1928039 - RNA, 17 nt, Homo sapiens
uaaugacauugauuucu

SEQ ID NO: 1928040 - RNA, 20 nt, Homo sapiens
uaauccuucuggcagauuca

SEQ ID NO: 1928041 - RNA, 18 nt, Homo sapiens
gcugauaauaugcaaaug

SEQ ID NO: 1928042 - RNA, 23 nt, Homo sapiens
cugcaucuccccucagauuccac

SEQ ID NO: 1928043 - RNA, 14 nt, Homo sapiens
agucauucugggaa

SEQ ID NO: 1928044 - RNA, 21 nt, Homo sapiens
aguggaaggacacucuuggcu

SEQ ID NO: 1928045 - RNA, 15 nt, Homo sapiens
agauacuuaauuccc

SEQ ID NO: 1928046 - RNA, 23 nt, Homo sapiens
ugccucgguugauugugcaugga

SEQ ID NO: 1928047 - RNA, 18 nt, Homo sapiens
gcacuuuacagaugagau

SEQ ID NO: 1928048 - RNA, 14 nt, Homo sapiens
acuacaaauguuaa

SEQ ID NO: 1928049 - RNA, 16 nt, Homo sapiens
acggcggcaguauuga

SEQ ID NO: 1928050 - RNA, 20 nt, Homo sapiens
uugaacuucuuuaguauuau

SEQ ID NO: 1928051 - RNA, 23 nt, Homo sapiens
cugguccuaccaauggauucaug

SEQ ID NO: 1928052 - RNA, 16 nt, Homo sapiens
uuugauucaccaaaca

SEQ ID NO: 1928053 - RNA, 19 nt, Homo sapiens
auucaguuaucacuacaga

SEQ ID NO: 1928054 - RNA, 22 nt, Homo sapiens
agguaaauucuuaauguucaca

SEQ ID NO: 1928055 - RNA, 14 nt, Homo sapiens
auaaugaucacagg

SEQ ID NO: 1928056 - RNA, 20 nt, Homo sapiens
ucaugaauauauuaaucagc

SEQ ID NO: 1928057 - RNA, 15 nt, Homo sapiens
gaauaaaccaagaca

SEQ ID NO: 1928058 - RNA, 19 nt, Homo sapiens
uuauaagaaaaccaaacaa

SEQ ID NO: 1928059 - RNA, 14 nt, Homo sapiens
aguuacugaucaca

SEQ ID NO: 1928060 - RNA, 22 nt, Homo sapiens
gcugacccaaguguugagggga

SEQ ID NO: 1928061 - RNA, 15 nt, Homo sapiens
guaucuauuguauau

SEQ ID NO: 1928062 - RNA, 21 nt, Homo sapiens
cacacaaaaagugucucugcc

SEQ ID NO: 1928063 - RNA, 19 nt, Homo sapiens
agaauugcuugaacccagg

SEQ ID NO: 1928064 - RNA, 21 nt, Homo sapiens
uccuaaucugcugccagaauu

SEQ ID NO: 1928065 - RNA, 15 nt, Homo sapiens
uuaagacaugcacua

SEQ ID NO: 1928066 - RNA, 15 nt, Homo sapiens
ucuagaaaaccagcu

SEQ ID NO: 1928067 - RNA, 14 nt, Homo sapiens
ugagcaguucauga

SEQ ID NO: 1928068 - RNA, 15 nt, Homo sapiens
aagucccagaucaag

SEQ ID NO: 1928069 - RNA, 12 nt, Homo sapiens
gagaacagggau

SEQ ID NO: 1928070 - RNA, 20 nt, Homo sapiens
cucccaggcucaagcacuuu

SEQ ID NO: 1928071 - RNA, 20 nt, Homo sapiens
gcucccuccgcccccaggua

SEQ ID NO: 1928072 - RNA, 20 nt, Homo sapiens
gucaccuccuuccccagcuc

SEQ ID NO: 1928073 - RNA, 14 nt, Homo sapiens
aaccagcucugaac

SEQ ID NO: 1928074 - RNA, 21 nt, Homo sapiens
gaaagauuuuaugugcuugaa

SEQ ID NO: 1928075 - RNA, 14 nt, Homo sapiens
auugcagcauuuau

SEQ ID NO: 1928076 - RNA, 23 nt, Homo sapiens
agacauuacaauguguaauggaa

SEQ ID NO: 1928077 - RNA, 13 nt, Homo sapiens
uauaaacauuggu

SEQ ID NO: 1928078 - RNA, 12 nt, Homo sapiens
gacgcacugcuc

SEQ ID NO: 1928079 - RNA, 17 nt, Homo sapiens
caacaguguucugagcc

SEQ ID NO: 1928080 - RNA, 11 nt, Homo sapiens
ugcuacaacau

SEQ ID NO: 1928081 - RNA, 14 nt, Homo sapiens
ugggaaagcauugu

SEQ ID NO: 1928082 - RNA, 20 nt, Homo sapiens
ucagcuuuaguagauauuac

SEQ ID NO: 1928083 - RNA, 22 nt, Homo sapiens
gaacaaaugcuggggucauaua

SEQ ID NO: 1928084 - RNA, 15 nt, Homo sapiens
auuuucuucacuugc

SEQ ID NO: 1928085 - RNA, 13 nt, Homo sapiens
acuucuugaauau

SEQ ID NO: 1928086 - RNA, 22 nt, Homo sapiens
cacaccuggcauggugcaggga

SEQ ID NO: 1928087 - RNA, 16 nt, Homo sapiens
gguggcucuccaguua

SEQ ID NO: 1928088 - RNA, 19 nt, Homo sapiens
aguguucaaauaccaguga

SEQ ID NO: 1928089 - RNA, 23 nt, Homo sapiens
guuaucauguuaguaauaccucu

SEQ ID NO: 1928090 - RNA, 22 nt, Homo sapiens
uggcccaagucucuuccuccua

SEQ ID NO: 1928091 - RNA, 20 nt, Homo sapiens
uuaaugauugauuauaucau

SEQ ID NO: 1928092 - RNA, 15 nt, Homo sapiens
gcccagcacugucug

SEQ ID NO: 1928093 - RNA, 19 nt, Homo sapiens
guuuuuaugauagugcaag

SEQ ID NO: 1928094 - RNA, 12 nt, Homo sapiens
uagcccuguuga

SEQ ID NO: 1928095 - RNA, 20 nt, Homo sapiens
caaaugaaaccuacaggaau

SEQ ID NO: 1928096 - RNA, 21 nt, Homo sapiens
aaauuagccaguaauccugua

SEQ ID NO: 1928097 - RNA, 22 nt, Homo sapiens
ugucucgaguacuaauaugcaa

SEQ ID NO: 1928098 - RNA, 15 nt, Homo sapiens
gaugacuugcucaag

SEQ ID NO: 1928099 - RNA, 15 nt, Homo sapiens
ccccuucggcagcua

SEQ ID NO: 1928100 - RNA, 16 nt, Homo sapiens
aucuucuucaccauuu

SEQ ID NO: 1928101 - RNA, 23 nt, Homo sapiens
aaaagcaaucuggaagaaagccc

SEQ ID NO: 1928102 - RNA, 17 nt, Homo sapiens
guucuauaaacaggcuu

SEQ ID NO: 1928103 - RNA, 13 nt, Homo sapiens
uaauucugggaag

SEQ ID NO: 1928104 - RNA, 21 nt, Homo sapiens
gcugccugcaaugcagggcau

SEQ ID NO: 1928105 - RNA, 18 nt, Homo sapiens
agaagaaaauaguggugu

SEQ ID NO: 1928106 - RNA, 22 nt, Homo sapiens
aaauuaaagccuuuaguaucag

SEQ ID NO: 1928107 - RNA, 17 nt, Homo sapiens
cugugagccuugcauga

SEQ ID NO: 1928108 - RNA, 15 nt, Homo sapiens
uuacaaagcauguga

SEQ ID NO: 1928109 - RNA, 20 nt, Homo sapiens
cauggacucuggguuucaua

SEQ ID NO: 1928110 - RNA, 15 nt, Homo sapiens
uauacauacauguau

SEQ ID NO: 1928111 - RNA, 14 nt, Homo sapiens
uaacuaugacagau

SEQ ID NO: 1928112 - RNA, 14 nt, Homo sapiens
uaaguuugacacaa

SEQ ID NO: 1928113 - RNA, 20 nt, Homo sapiens
cacacaguuauuuaaucaaa

SEQ ID NO: 1928114 - RNA, 23 nt, Homo sapiens
uuauuuuugcugaaacccaauga

SEQ ID NO: 1928115 - RNA, 13 nt, Homo sapiens
uguucugugucac

SEQ ID NO: 1928116 - RNA, 14 nt, Homo sapiens
cagacacucugacu

SEQ ID NO: 1928117 - RNA, 14 nt, Homo sapiens
uucugacuuacugu

SEQ ID NO: 1928118 - RNA, 14 nt, Homo sapiens
gaagagccaaagaa

SEQ ID NO: 1928119 - RNA, 11 nt, Homo sapiens
gcccuaugugu

SEQ ID NO: 1928120 - RNA, 21 nt, Homo sapiens
gacagagaagggaaguaggcc

SEQ ID NO: 1928121 - RNA, 22 nt, Homo sapiens
caaauagggcaaagaaucaaca

SEQ ID NO: 1928122 - RNA, 12 nt, Homo sapiens
ugccccugccuu

SEQ ID NO: 1928123 - RNA, 23 nt, Homo sapiens
ccacggccacuggccaucuccac

SEQ ID NO: 1928124 - RNA, 22 nt, Homo sapiens
agaacaaaaagaaaucuugucu

SEQ ID NO: 1928125 - RNA, 21 nt, Homo sapiens
ucccuccuuggauuucugacc

SEQ ID NO: 1928126 - RNA, 17 nt, Homo sapiens
ugaauuggaccauccua

SEQ ID NO: 1928127 - RNA, 15 nt, Homo sapiens
accugggcaugacau

SEQ ID NO: 1928128 - RNA, 19 nt, Homo sapiens
auccaggcccaacugugag

SEQ ID NO: 1928129 - RNA, 22 nt, Homo sapiens
cuuuauauacaauaauggaaaa

SEQ ID NO: 1928130 - RNA, 23 nt, Homo sapiens
acucacaugccgcccccagcagc

SEQ ID NO: 1928131 - RNA, 16 nt, Homo sapiens
agugcaguggugcgau

SEQ ID NO: 1928132 - RNA, 17 nt, Homo sapiens
augaggaaaaaacccag

SEQ ID NO: 1928133 - RNA, 15 nt, Homo sapiens
ucuuucauacauuau

SEQ ID NO: 1928134 - RNA, 22 nt, Homo sapiens
acucagguaccucuuucagggu

SEQ ID NO: 1928135 - RNA, 19 nt, Homo sapiens
acauucuggaaaagcaaaa

SEQ ID NO: 1928136 - RNA, 21 nt, Homo sapiens
uggcccaggcuggagugcagu

SEQ ID NO: 1928137 - RNA, 18 nt, Homo sapiens
uaugaaaccaacuguuga

SEQ ID NO: 1928138 - RNA, 22 nt, Homo sapiens
aaauuuggccuuaagaacugug

SEQ ID NO: 1928139 - RNA, 20 nt, Homo sapiens
ccugaaaaggacuucuggcu

SEQ ID NO: 1928140 - RNA, 15 nt, Homo sapiens
ucugcuucagugcag

SEQ ID NO: 1928141 - RNA, 13 nt, Homo sapiens
aaguugcaguuuu

SEQ ID NO: 1928142 - RNA, 13 nt, Homo sapiens
aauaugcagugau

SEQ ID NO: 1928143 - RNA, 20 nt, Homo sapiens
aacgugucugagagccauaa

SEQ ID NO: 1928144 - RNA, 15 nt, Homo sapiens
gcaaagguugcagug

SEQ ID NO: 1928145 - RNA, 15 nt, Homo sapiens
caugccaagcacugu

SEQ ID NO: 1928146 - RNA, 19 nt, Homo sapiens
acauugacagcaauucaug

SEQ ID NO: 1928147 - RNA, 22 nt, Homo sapiens
uuaaugccaagauugacagguu

SEQ ID NO: 1928148 - RNA, 20 nt, Homo sapiens
uuauguauuuucuuccaccc

SEQ ID NO: 1928149 - RNA, 13 nt, Homo sapiens
ugucuccugagca

SEQ ID NO: 1928150 - RNA, 17 nt, Homo sapiens
aggucccagagggugga

SEQ ID NO: 1928151 - RNA, 16 nt, Homo sapiens
uaaagacgacuacaga

SEQ ID NO: 1928152 - RNA, 17 nt, Homo sapiens
cuguucuugcugcuaga

SEQ ID NO: 1928153 - RNA, 16 nt, Homo sapiens
ugugugguuuagugua

SEQ ID NO: 1928154 - RNA, 18 nt, Homo sapiens
ugacagugcccagcauga

SEQ ID NO: 1928155 - RNA, 14 nt, Homo sapiens
cauaguaauuaccc

SEQ ID NO: 1928156 - RNA, 15 nt, Homo sapiens
acaauaaaacauuaa

SEQ ID NO: 1928157 - RNA, 15 nt, Homo sapiens
gccucccagccaccc

SEQ ID NO: 1928158 - RNA, 20 nt, Homo sapiens
aagggagaaguugagauuca

SEQ ID NO: 1928159 - RNA, 11 nt, Homo sapiens
cuccugaagga

SEQ ID NO: 1928160 - RNA, 24 nt, Homo sapiens
uucccgacauaacauuguacugua

SEQ ID NO: 1928161 - RNA, 21 nt, Homo sapiens
agccaucaauauucagcaaaa

SEQ ID NO: 1928162 - RNA, 10 nt, Homo sapiens
ucaccaaaau

SEQ ID NO: 1928163 - RNA, 22 nt, Homo sapiens
ugcuucccagguucaagcgauu

SEQ ID NO: 1928164 - RNA, 16 nt, Homo sapiens
caccagcuaucuguca

SEQ ID NO: 1928165 - RNA, 18 nt, Homo sapiens
uaaacuugacccaggugg

SEQ ID NO: 1928166 - RNA, 15 nt, Homo sapiens
acaaagcccuuccau

SEQ ID NO: 1928167 - RNA, 21 nt, Homo sapiens
uuaacuuuucuaacagaaagc

SEQ ID NO: 1928168 - RNA, 21 nt, Homo sapiens
auugaauguuuccaaccugga

SEQ ID NO: 1928169 - RNA, 15 nt, Homo sapiens
cuggaaugcugggua

SEQ ID NO: 1928170 - RNA, 13 nt, Homo sapiens
ugagggcccuucc

SEQ ID NO: 1928171 - RNA, 16 nt, Homo sapiens
aauaguuccauucuau

SEQ ID NO: 1928172 - RNA, 16 nt, Homo sapiens
cuuaccucauuugcau

SEQ ID NO: 1928173 - RNA, 15 nt, Homo sapiens
ccgugccugagcugc

SEQ ID NO: 1928174 - RNA, 15 nt, Homo sapiens
cugaggguccagaag

SEQ ID NO: 1928175 - RNA, 16 nt, Homo sapiens
acuauuaacucugcau

SEQ ID NO: 1928176 - RNA, 14 nt, Homo sapiens
aauaagcugauguc

SEQ ID NO: 1928177 - RNA, 15 nt, Homo sapiens
gccccagcuggagaa

SEQ ID NO: 1928178 - RNA, 14 nt, Homo sapiens
gccucaaguuccau

SEQ ID NO: 1928179 - RNA, 17 nt, Homo sapiens
agaaaaacaccgcuucu

SEQ ID NO: 1928180 - RNA, 15 nt, Homo sapiens
gaaaagcugccauuu

SEQ ID NO: 1928181 - RNA, 15 nt, Homo sapiens
ucugcaaacaugcca

SEQ ID NO: 1928182 - RNA, 19 nt, Homo sapiens
uuuaaaaaaagaacauaaa

SEQ ID NO: 1928183 - RNA, 13 nt, Homo sapiens
acauuugggagac

SEQ ID NO: 1928184 - RNA, 15 nt, Homo sapiens
uaccuggugccuugg

SEQ ID NO: 1928185 - RNA, 16 nt, Homo sapiens
ucuaaagaauguguuc

SEQ ID NO: 1928186 - RNA, 16 nt, Homo sapiens
gccacuauuacuggga

SEQ ID NO: 1928187 - RNA, 14 nt, Homo sapiens
aaugacuaagccaa

SEQ ID NO: 1928188 - RNA, 18 nt, Homo sapiens
ccugugugggacugagau

SEQ ID NO: 1928189 - RNA, 19 nt, Homo sapiens
cucccauagcgcuggcuca

SEQ ID NO: 1928190 - RNA, 19 nt, Homo sapiens
agggcagcuccagugccag

SEQ ID NO: 1928191 - RNA, 15 nt, Homo sapiens
aaaaugucaggccuu

SEQ ID NO: 1928192 - RNA, 16 nt, Homo sapiens
aucauuuuugaugacu

SEQ ID NO: 1928193 - RNA, 18 nt, Homo sapiens
ugaccuuggagagacaca

SEQ ID NO: 1928194 - RNA, 19 nt, Homo sapiens
ucccacgugcacagcuucc

SEQ ID NO: 1928195 - RNA, 23 nt, Homo sapiens
uauggacugacuggguuauugaa

SEQ ID NO: 1928196 - RNA, 17 nt, Homo sapiens
uguuguuuaacuugucu

SEQ ID NO: 1928197 - RNA, 13 nt, Homo sapiens
ugugaguauuucu

SEQ ID NO: 1928198 - RNA, 21 nt, Homo sapiens
uggaugggagugggcaccuca

SEQ ID NO: 1928199 - RNA, 20 nt, Homo sapiens
cuucacuagaguucuuugaa

SEQ ID NO: 1928200 - RNA, 14 nt, Homo sapiens
ugaagagcaaaggg

SEQ ID NO: 1928201 - RNA, 21 nt, Homo sapiens
cacaguaucaguauuuucaca

SEQ ID NO: 1928202 - RNA, 22 nt, Homo sapiens
agugugacauucaguguuagag

SEQ ID NO: 1928203 - RNA, 19 nt, Homo sapiens
uuuaugaucuuggcuguau

SEQ ID NO: 1928204 - RNA, 17 nt, Homo sapiens
ugaaugggcaaaacuga

SEQ ID NO: 1928205 - RNA, 19 nt, Homo sapiens
uagaacagugccuggcaca

SEQ ID NO: 1928206 - RNA, 12 nt, Homo sapiens
ccacagucagug

SEQ ID NO: 1928207 - RNA, 18 nt, Homo sapiens
aagaauaaaauacugcaa

SEQ ID NO: 1928208 - RNA, 23 nt, Homo sapiens
aguuuuacuaaaacacugaaaaa

SEQ ID NO: 1928209 - RNA, 14 nt, Homo sapiens
uggugauccucuau

SEQ ID NO: 1928210 - RNA, 18 nt, Homo sapiens
gcaguuucuaagcaugua

SEQ ID NO: 1928211 - RNA, 14 nt, Homo sapiens
acccccuucagugc

SEQ ID NO: 1928212 - RNA, 16 nt, Homo sapiens
agguguauugaagucc

SEQ ID NO: 1928213 - RNA, 21 nt, Homo sapiens
cuuucuucaccaagugcaaua

SEQ ID NO: 1928214 - RNA, 19 nt, Homo sapiens
uuccuuuccccagcccagg

SEQ ID NO: 1928215 - RNA, 15 nt, Homo sapiens
auuuugcauuccaga

SEQ ID NO: 1928216 - RNA, 19 nt, Homo sapiens
ucugcauguuugucugugu

SEQ ID NO: 1928217 - RNA, 19 nt, Homo sapiens
gcacacacuguguacagua

SEQ ID NO: 1928218 - RNA, 15 nt, Homo sapiens
ucacuuuaaauauga

SEQ ID NO: 1928219 - RNA, 10 nt, Homo sapiens
ccuguuauau

SEQ ID NO: 1928220 - RNA, 19 nt, Homo sapiens
uucaauuagggaugcucaa

SEQ ID NO: 1928221 - RNA, 14 nt, Homo sapiens
cuucuuauuaauca

SEQ ID NO: 1928222 - RNA, 15 nt, Homo sapiens
gauaguccaaagacu

SEQ ID NO: 1928223 - RNA, 22 nt, Homo sapiens
gaauuauuugccuucugaaaug

SEQ ID NO: 1928224 - RNA, 19 nt, Homo sapiens
cuugagaccuggaaccaga

SEQ ID NO: 1928225 - RNA, 21 nt, Homo sapiens
cagcugauuuugucacugucu

SEQ ID NO: 1928226 - RNA, 22 nt, Homo sapiens
uaaaauagcacccuuuguuaau

SEQ ID NO: 1928227 - RNA, 24 nt, Homo sapiens
ggagcaagcucuucccuugcucau

SEQ ID NO: 1928228 - RNA, 14 nt, Homo sapiens
ccugcacuaggcag

SEQ ID NO: 1928229 - RNA, 17 nt, Homo sapiens
ugacccuccccuaguca

SEQ ID NO: 1928230 - RNA, 22 nt, Homo sapiens
aagaauuggggauucucuauug

SEQ ID NO: 1928231 - RNA, 23 nt, Homo sapiens
gcuguauuccaaggccugugaau

SEQ ID NO: 1928232 - RNA, 16 nt, Homo sapiens
gcugaaaauaacacaa

SEQ ID NO: 1928233 - RNA, 22 nt, Homo sapiens
aauuuaguuucccuuagacuuu

SEQ ID NO: 1928234 - RNA, 16 nt, Homo sapiens
cuauucuagagcuuuu

SEQ ID NO: 1928235 - RNA, 17 nt, Homo sapiens
gagaaagggagugcaug

SEQ ID NO: 1928236 - RNA, 18 nt, Homo sapiens
ugcugaaagacuaccucg

SEQ ID NO: 1928237 - RNA, 21 nt, Homo sapiens
aggaguuggaauguuguaguu

SEQ ID NO: 1928238 - RNA, 22 nt, Homo sapiens
cccuccauucauccuuccaucc

SEQ ID NO: 1928239 - RNA, 16 nt, Homo sapiens
uucacuccagacagac

SEQ ID NO: 1928240 - RNA, 15 nt, Homo sapiens
caucuguaaaaugga

SEQ ID NO: 1928241 - RNA, 17 nt, Homo sapiens
auucugaucaguugcca

SEQ ID NO: 1928242 - RNA, 17 nt, Homo sapiens
cacaggaggcuccguga

SEQ ID NO: 1928243 - RNA, 17 nt, Homo sapiens
agggcgagacuccgucu

SEQ ID NO: 1928244 - RNA, 18 nt, Homo sapiens
accauccugccauccuug

SEQ ID NO: 1928245 - RNA, 22 nt, Homo sapiens
aagcaaagauuauuuucauuua

SEQ ID NO: 1928246 - RNA, 15 nt, Homo sapiens
uucugagccugccuu

SEQ ID NO: 1928247 - RNA, 11 nt, Homo sapiens
cuauuagccag

SEQ ID NO: 1928248 - RNA, 21 nt, Homo sapiens
aggcaggaaacuaacuggugu

SEQ ID NO: 1928249 - RNA, 15 nt, Homo sapiens
aggaacuccuuggcc

SEQ ID NO: 1928250 - RNA, 13 nt, Homo sapiens
gagcuugauuaaa

SEQ ID NO: 1928251 - RNA, 23 nt, Homo sapiens
cuacacuuugcuccucuggccca

SEQ ID NO: 1928252 - RNA, 15 nt, Homo sapiens
gaagccagagcccca

SEQ ID NO: 1928253 - RNA, 15 nt, Homo sapiens
guaaucaaagccacu

SEQ ID NO: 1928254 - RNA, 21 nt, Homo sapiens
ucccaccgguugcuucuggga

SEQ ID NO: 1928255 - RNA, 18 nt, Homo sapiens
uaagcccccucuugagag

SEQ ID NO: 1928256 - RNA, 16 nt, Homo sapiens
aauucuuucuguugaa

SEQ ID NO: 1928257 - RNA, 22 nt, Homo sapiens
cagggaggaagaagcuuaggca

SEQ ID NO: 1928258 - RNA, 22 nt, Homo sapiens
acgcgggacgucccugcccaug

SEQ ID NO: 1928259 - RNA, 18 nt, Homo sapiens
ugacauuguggcacauuc

SEQ ID NO: 1928260 - RNA, 15 nt, Homo sapiens
uuaauuuucuaugug

SEQ ID NO: 1928261 - RNA, 23 nt, Homo sapiens
ugcuugcuaccaaucugugagaa

SEQ ID NO: 1928262 - RNA, 19 nt, Homo sapiens
cuacaguuuuuaacucuac

SEQ ID NO: 1928263 - RNA, 21 nt, Homo sapiens
cccagcaggcccagcaugcag

SEQ ID NO: 1928264 - RNA, 19 nt, Homo sapiens
gucauggaggccaagaacu

SEQ ID NO: 1928265 - RNA, 14 nt, Homo sapiens
cuuccucaucucau

SEQ ID NO: 1928266 - RNA, 20 nt, Homo sapiens
auuccuacucccucuuccaa

SEQ ID NO: 1928267 - RNA, 17 nt, Homo sapiens
cuguuucugcuugcucu

SEQ ID NO: 1928268 - RNA, 20 nt, Homo sapiens
uguucccauuggaugcauuu

SEQ ID NO: 1928269 - RNA, 17 nt, Homo sapiens
acauaccuugcuucuuc

SEQ ID NO: 1928270 - RNA, 16 nt, Homo sapiens
cgaaucacacagacag

SEQ ID NO: 1928271 - RNA, 19 nt, Homo sapiens
ugacuaaaccauugugcau

SEQ ID NO: 1928272 - RNA, 21 nt, Homo sapiens
uugagaagcaaauauguuugc

SEQ ID NO: 1928273 - RNA, 14 nt, Homo sapiens
gcuuaggauguuuu

SEQ ID NO: 1928274 - RNA, 22 nt, Homo sapiens
gaaacuacauuucuacuaugau

SEQ ID NO: 1928275 - RNA, 13 nt, Homo sapiens
acuguucacacac

SEQ ID NO: 1928276 - RNA, 15 nt, Homo sapiens
agcauuuagacucuc

SEQ ID NO: 1928277 - RNA, 22 nt, Homo sapiens
aaaacaacccacggcucaacuc

SEQ ID NO: 1928278 - RNA, 21 nt, Homo sapiens
agauucccacccaauucaaaa

SEQ ID NO: 1928279 - RNA, 16 nt, Homo sapiens
cuccaauggggcgggg

SEQ ID NO: 1928280 - RNA, 16 nt, Homo sapiens
agcuuaaauacaccuu

SEQ ID NO: 1928281 - RNA, 14 nt, Homo sapiens
uucuuugcuugccu

SEQ ID NO: 1928282 - RNA, 15 nt, Homo sapiens
ugagucugcaugugc

SEQ ID NO: 1928283 - RNA, 22 nt, Homo sapiens
aaauguuggaaugggagucuga

SEQ ID NO: 1928284 - RNA, 15 nt, Homo sapiens
ugauaagcaacucca

SEQ ID NO: 1928285 - RNA, 15 nt, Homo sapiens
aggaaggcucuguca

SEQ ID NO: 1928286 - RNA, 15 nt, Homo sapiens
cgauuucuaccucag

SEQ ID NO: 1928287 - RNA, 18 nt, Homo sapiens
gccacucugggcagucuu

SEQ ID NO: 1928288 - RNA, 18 nt, Homo sapiens
ucauucauucaaguaaua

SEQ ID NO: 1928289 - RNA, 13 nt, Homo sapiens
cgagaaggugcuu

SEQ ID NO: 1928290 - RNA, 14 nt, Homo sapiens
cucugaugauguca

SEQ ID NO: 1928291 - RNA, 21 nt, Homo sapiens
gaagagucgaugaucaccaag

SEQ ID NO: 1928292 - RNA, 14 nt, Homo sapiens
ggccugcuccagac

SEQ ID NO: 1928293 - RNA, 14 nt, Homo sapiens
caaagacuuaauca

SEQ ID NO: 1928294 - RNA, 21 nt, Homo sapiens
ugccugugugggacugagaug

SEQ ID NO: 1928295 - RNA, 15 nt, Homo sapiens
guacguguggcuugg

SEQ ID NO: 1928296 - RNA, 22 nt, Homo sapiens
aauguuuguuuauaucacuguc

SEQ ID NO: 1928297 - RNA, 11 nt, Homo sapiens
aacagcuguug

SEQ ID NO: 1928298 - RNA, 11 nt, Homo sapiens
aagagcuguuc

SEQ ID NO: 1928299 - RNA, 18 nt, Homo sapiens
gacaacauuucuauagcc

SEQ ID NO: 1928300 - RNA, 16 nt, Homo sapiens
caaaccaucauuuaau

SEQ ID NO: 1928301 - RNA, 16 nt, Homo sapiens
aauauuccugugacuu

SEQ ID NO: 1928302 - RNA, 21 nt, Homo sapiens
gcccagcucaugcacaucagc

SEQ ID NO: 1928303 - RNA, 17 nt, Homo sapiens
auaguaccucugcuauu

SEQ ID NO: 1928304 - RNA, 21 nt, Homo sapiens
ugguuccaucuaguaccagag

SEQ ID NO: 1928305 - RNA, 15 nt, Homo sapiens
acauucuuuuccacu

SEQ ID NO: 1928306 - RNA, 19 nt, Homo sapiens
acaguaaugugucauauca

SEQ ID NO: 1928307 - RNA, 14 nt, Homo sapiens
auaccaacuguaca

SEQ ID NO: 1928308 - RNA, 12 nt, Homo sapiens
ggaugggggcag

SEQ ID NO: 1928309 - RNA, 12 nt, Homo sapiens
agauggggacag

SEQ ID NO: 1928310 - RNA, 22 nt, Homo sapiens
cuccuuccuuguuacccaugaa

SEQ ID NO: 1928311 - RNA, 15 nt, Homo sapiens
cucuuguccugugau

SEQ ID NO: 1928312 - RNA, 14 nt, Homo sapiens
auaaugaugcuguc

SEQ ID NO: 1928313 - RNA, 14 nt, Homo sapiens
guuaggccauucuu

SEQ ID NO: 1928314 - RNA, 16 nt, Homo sapiens
aagucauaccaaugaa

SEQ ID NO: 1928315 - RNA, 13 nt, Homo sapiens
gcuuguagcagaa

SEQ ID NO: 1928316 - RNA, 14 nt, Homo sapiens
caccacuggccacc

SEQ ID NO: 1928317 - RNA, 15 nt, Homo sapiens
agagcuagcugccac

SEQ ID NO: 1928318 - RNA, 19 nt, Homo sapiens
caaggagcaagaaaugaac

SEQ ID NO: 1928319 - RNA, 23 nt, Homo sapiens
uuacuguacccucgcaugacugu

SEQ ID NO: 1928320 - RNA, 18 nt, Homo sapiens
uuagcaacaguuaucaca

SEQ ID NO: 1928321 - RNA, 18 nt, Homo sapiens
gugugcaagugugugcau

SEQ ID NO: 1928322 - RNA, 16 nt, Homo sapiens
gaacuguucucaugga

SEQ ID NO: 1928323 - RNA, 19 nt, Homo sapiens
uaaggaguaaucuguguac

SEQ ID NO: 1928324 - RNA, 19 nt, Homo sapiens
aagugagaaaaugccucaa

SEQ ID NO: 1928325 - RNA, 14 nt, Homo sapiens
aaugcaaaguacau

SEQ ID NO: 1928326 - RNA, 16 nt, Homo sapiens
agcuacuuuauguaaa

SEQ ID NO: 1928327 - RNA, 16 nt, Homo sapiens
gcacauagagauaugc

SEQ ID NO: 1928328 - RNA, 14 nt, Homo sapiens
agcgggacucuguc

SEQ ID NO: 1928329 - RNA, 17 nt, Homo sapiens
uaggagggagacacugg

SEQ ID NO: 1928330 - RNA, 17 nt, Homo sapiens
cugucuugugucuccua

SEQ ID NO: 1928331 - RNA, 16 nt, Homo sapiens
cuagcaacaaacaaua

SEQ ID NO: 1928332 - RNA, 23 nt, Homo sapiens
uauaauguguuaggaaauuacag

SEQ ID NO: 1928333 - RNA, 21 nt, Homo sapiens
agggcugaccugccucucaca

SEQ ID NO: 1928334 - RNA, 19 nt, Homo sapiens
gaaucaacaagauuuccac

SEQ ID NO: 1928335 - RNA, 17 nt, Homo sapiens
gcuucugcaguucucau

SEQ ID NO: 1928336 - RNA, 21 nt, Homo sapiens
ggcgaagcucaggcaaaaaca

SEQ ID NO: 1928337 - RNA, 17 nt, Homo sapiens
aauuuaguucaugcauu

SEQ ID NO: 1928338 - RNA, 19 nt, Homo sapiens
ugauuuggaagagaggcac

SEQ ID NO: 1928339 - RNA, 23 nt, Homo sapiens
ucugggcagacauuauguaaaag

SEQ ID NO: 1928340 - RNA, 11 nt, Homo sapiens
gauaugcugcu

SEQ ID NO: 1928341 - RNA, 17 nt, Homo sapiens
aaaucuuuuaaaucuuu

SEQ ID NO: 1928342 - RNA, 15 nt, Homo sapiens
acccaggcaugggca

SEQ ID NO: 1928343 - RNA, 21 nt, Homo sapiens
uacacacgugugauguauguu

SEQ ID NO: 1928344 - RNA, 21 nt, Homo sapiens
aaugcuuccccacgggaacau

SEQ ID NO: 1928345 - RNA, 20 nt, Homo sapiens
agcauacucuaugugauuua

SEQ ID NO: 1928346 - RNA, 15 nt, Homo sapiens
ugugugaguguacca

SEQ ID NO: 1928347 - RNA, 15 nt, Homo sapiens
ugccacugcacucua

SEQ ID NO: 1928348 - RNA, 15 nt, Homo sapiens
ugccauugcacucca

SEQ ID NO: 1928349 - RNA, 19 nt, Homo sapiens
gauggccaagcaauuccuc

SEQ ID NO: 1928350 - RNA, 17 nt, Homo sapiens
caagacaagccuggccu

SEQ ID NO: 1928351 - RNA, 17 nt, Homo sapiens
aguucuuguugacucag

SEQ ID NO: 1928352 - RNA, 20 nt, Homo sapiens
uuuucaagcuauaaugcuau

SEQ ID NO: 1928353 - RNA, 18 nt, Homo sapiens
cuggaaauucuuauuucc

SEQ ID NO: 1928354 - RNA, 20 nt, Homo sapiens
uggcguuuggacccaguuca

SEQ ID NO: 1928355 - RNA, 18 nt, Homo sapiens
gucagguggacucuggga

SEQ ID NO: 1928356 - RNA, 14 nt, Homo sapiens
agugcuuguuuacu

SEQ ID NO: 1928357 - RNA, 13 nt, Homo sapiens
aagaaaaguuuac

SEQ ID NO: 1928358 - RNA, 15 nt, Homo sapiens
cuuccucuuagccuc

SEQ ID NO: 1928359 - RNA, 22 nt, Homo sapiens
cauccuauagagucaaccacca

SEQ ID NO: 1928360 - RNA, 13 nt, Homo sapiens
uccaucaugcaaa

SEQ ID NO: 1928361 - RNA, 14 nt, Homo sapiens
aauugauugaauua

SEQ ID NO: 1928362 - RNA, 15 nt, Homo sapiens
guucuuuacugguga

SEQ ID NO: 1928363 - RNA, 13 nt, Homo sapiens
uguccagcaccuu

SEQ ID NO: 1928364 - RNA, 19 nt, Homo sapiens
ucugaauccucaugaggcu

SEQ ID NO: 1928365 - RNA, 13 nt, Homo sapiens
aucuugggaccaa

SEQ ID NO: 1928366 - RNA, 16 nt, Homo sapiens
agggaagggacuggga

SEQ ID NO: 1928367 - RNA, 15 nt, Homo sapiens
aggcaucugcuuuac

SEQ ID NO: 1928368 - RNA, 14 nt, Homo sapiens
augacucacuccau

SEQ ID NO: 1928369 - RNA, 14 nt, Homo sapiens
augacaggacauuu

SEQ ID NO: 1928370 - RNA, 16 nt, Homo sapiens
auuaaaugugagcaaa

SEQ ID NO: 1928371 - RNA, 14 nt, Homo sapiens
gcuuagccuccuga

SEQ ID NO: 1928372 - RNA, 21 nt, Homo sapiens
uucgggagggcacucacaugc

SEQ ID NO: 1928373 - RNA, 14 nt, Homo sapiens
uagaaugagacuua

SEQ ID NO: 1928374 - RNA, 18 nt, Homo sapiens
gagagcuuuucacuguga

SEQ ID NO: 1928375 - RNA, 18 nt, Homo sapiens
uaaggcaaaauaaucuaa

SEQ ID NO: 1928376 - RNA, 12 nt, Homo sapiens
aauuuugccaaa

SEQ ID NO: 1928377 - RNA, 12 nt, Homo sapiens
aauauugccaau

SEQ ID NO: 1928378 - RNA, 16 nt, Homo sapiens
ccaaauaaaguaccau

SEQ ID NO: 1928379 - RNA, 19 nt, Homo sapiens
acaucuuuuacauucugca

SEQ ID NO: 1928380 - RNA, 20 nt, Homo sapiens
ucuaccaugguucugccucc

SEQ ID NO: 1928381 - RNA, 15 nt, Homo sapiens
uccauucagugcagc

SEQ ID NO: 1928382 - RNA, 17 nt, Homo sapiens
cugacuugaguguuccu

SEQ ID NO: 1928383 - RNA, 21 nt, Homo sapiens
agccugcuuuuguccuguuau

SEQ ID NO: 1928384 - RNA, 22 nt, Homo sapiens
cugugugugaaaggaagcucca

SEQ ID NO: 1928385 - RNA, 22 nt, Homo sapiens
aguuccuauaccuuacugacac

SEQ ID NO: 1928386 - RNA, 18 nt, Homo sapiens
agagcuguggcacagacc

SEQ ID NO: 1928387 - RNA, 22 nt, Homo sapiens
uuuuaaaaaggccuuugggauu

SEQ ID NO: 1928388 - RNA, 22 nt, Homo sapiens
ccgcuugcucuccuggagcaag

SEQ ID NO: 1928389 - RNA, 16 nt, Homo sapiens
uuugagcauggguuca

SEQ ID NO: 1928390 - RNA, 17 nt, Homo sapiens
gcccuuccaaacucuuc

SEQ ID NO: 1928391 - RNA, 23 nt, Homo sapiens
acagggucucuagugcugugaaa

SEQ ID NO: 1928392 - RNA, 19 nt, Homo sapiens
gucacaggaaacuacuuca

SEQ ID NO: 1928393 - RNA, 15 nt, Homo sapiens
aauauuauaaaucca

SEQ ID NO: 1928394 - RNA, 23 nt, Homo sapiens
aguuguaccgcaaugugacuuaa

SEQ ID NO: 1928395 - RNA, 19 nt, Homo sapiens
auuaccaaaacacugccug

SEQ ID NO: 1928396 - RNA, 12 nt, Homo sapiens
ucuggccucaga

SEQ ID NO: 1928397 - RNA, 21 nt, Homo sapiens
caaaauuguuacccauuugaa

SEQ ID NO: 1928398 - RNA, 18 nt, Homo sapiens
ccagguggaggugccagg

SEQ ID NO: 1928399 - RNA, 19 nt, Homo sapiens
caccuuggacccuggugac

SEQ ID NO: 1928400 - RNA, 19 nt, Homo sapiens
aaacuguggcacuuuucac

SEQ ID NO: 1928401 - RNA, 23 nt, Homo sapiens
acaauuugagcaauucauuucac

SEQ ID NO: 1928402 - RNA, 17 nt, Homo sapiens
ugagcuccccagaucuc

SEQ ID NO: 1928403 - RNA, 18 nt, Homo sapiens
cuuaguaugugcauuuaa

SEQ ID NO: 1928404 - RNA, 13 nt, Homo sapiens
uaaaccaaaaagg

SEQ ID NO: 1928405 - RNA, 22 nt, Homo sapiens
ucccaaaucuauagcauuuaaa

SEQ ID NO: 1928406 - RNA, 15 nt, Homo sapiens
cauucaaaaagccaa

SEQ ID NO: 1928407 - RNA, 15 nt, Homo sapiens
uuaaauaagauucua

SEQ ID NO: 1928408 - RNA, 16 nt, Homo sapiens
uauuuuguuacaaaaa

SEQ ID NO: 1928409 - RNA, 15 nt, Homo sapiens
gaaaguggugcuaua

SEQ ID NO: 1928410 - RNA, 23 nt, Homo sapiens
uauucaauggugagcagacugca

SEQ ID NO: 1928411 - RNA, 18 nt, Homo sapiens
gccagggcagugcuagug

SEQ ID NO: 1928412 - RNA, 23 nt, Homo sapiens
augucuaagguccccacugccug

SEQ ID NO: 1928413 - RNA, 17 nt, Homo sapiens
ggugagacacugcacag

SEQ ID NO: 1928414 - RNA, 15 nt, Homo sapiens
cccccugcugcucau

SEQ ID NO: 1928415 - RNA, 12 nt, Homo sapiens
uugcauauccuu

SEQ ID NO: 1928416 - RNA, 20 nt, Homo sapiens
uauccugagccaucggugaa

SEQ ID NO: 1928417 - RNA, 21 nt, Homo sapiens
uaguaagaaaacaucacugaa

SEQ ID NO: 1928418 - RNA, 16 nt, Homo sapiens
ccaggugucaaaugag

SEQ ID NO: 1928419 - RNA, 21 nt, Homo sapiens
cccugcaggcuguuuauaugu

SEQ ID NO: 1928420 - RNA, 22 nt, Homo sapiens
uucuuuugaaaauuaguauggu

SEQ ID NO: 1928421 - RNA, 13 nt, Homo sapiens
ucaagacacugag

SEQ ID NO: 1928422 - RNA, 22 nt, Homo sapiens
caacuugauuuuuucaaaaaag

SEQ ID NO: 1928423 - RNA, 17 nt, Homo sapiens
aaggaaagaugaugcuc

SEQ ID NO: 1928424 - RNA, 18 nt, Homo sapiens
augauccuaaugaaugca

SEQ ID NO: 1928425 - RNA, 17 nt, Homo sapiens
uagcaauuccccuacau

SEQ ID NO: 1928426 - RNA, 23 nt, Homo sapiens
ugggcuccuccugcccuccaucu

SEQ ID NO: 1928427 - RNA, 23 nt, Homo sapiens
uuuugucgauuaguaaaagugcu

SEQ ID NO: 1928428 - RNA, 17 nt, Homo sapiens
auuuuccuccaaaguaa

SEQ ID NO: 1928429 - RNA, 15 nt, Homo sapiens
ucuuugugaacauuc

SEQ ID NO: 1928430 - RNA, 16 nt, Homo sapiens
auuccugaucccaugg

SEQ ID NO: 1928431 - RNA, 17 nt, Homo sapiens
caguaauaaaaagccac

SEQ ID NO: 1928432 - RNA, 17 nt, Homo sapiens
aagaaccaaauaccuca

SEQ ID NO: 1928433 - RNA, 14 nt, Homo sapiens
cagaauacuagcca

SEQ ID NO: 1928434 - RNA, 15 nt, Homo sapiens
aauuuugaaugcccu

SEQ ID NO: 1928435 - RNA, 17 nt, Homo sapiens
cccugcccauacugagc

SEQ ID NO: 1928436 - RNA, 19 nt, Homo sapiens
aaaacuuuaucgcucuaaa

SEQ ID NO: 1928437 - RNA, 15 nt, Homo sapiens
auacaaaacugugaa

SEQ ID NO: 1928438 - RNA, 17 nt, Homo sapiens
ggucccagacaugcugc

SEQ ID NO: 1928439 - RNA, 21 nt, Homo sapiens
gagggcucaccucuugccuuc

SEQ ID NO: 1928440 - RNA, 23 nt, Homo sapiens
auggaugugucucaggcaccuca

SEQ ID NO: 1928441 - RNA, 17 nt, Homo sapiens
aaucacuuaagccugga

SEQ ID NO: 1928442 - RNA, 16 nt, Homo sapiens
gccagagauaaacuaa

SEQ ID NO: 1928443 - RNA, 18 nt, Homo sapiens
caugaugucuaccucaga

SEQ ID NO: 1928444 - RNA, 13 nt, Homo sapiens
cuuaccuuuacau

SEQ ID NO: 1928445 - RNA, 15 nt, Homo sapiens
caguggcacugaagu

SEQ ID NO: 1928446 - RNA, 15 nt, Homo sapiens
gugaaacagagugau

SEQ ID NO: 1928447 - RNA, 20 nt, Homo sapiens
gcaggaguggugcagacaga

SEQ ID NO: 1928448 - RNA, 14 nt, Homo sapiens
ggcuuuaccuuuau

SEQ ID NO: 1928449 - RNA, 16 nt, Homo sapiens
caguggacucuuccac

SEQ ID NO: 1928450 - RNA, 17 nt, Homo sapiens
acgcuaaagagcccuug

SEQ ID NO: 1928451 - RNA, 18 nt, Homo sapiens
cacucucuagcuuuaggg

SEQ ID NO: 1928452 - RNA, 21 nt, Homo sapiens
uaauuacuaauguacgcugcu

SEQ ID NO: 1928453 - RNA, 15 nt, Homo sapiens
auuuccacugugcag

SEQ ID NO: 1928454 - RNA, 21 nt, Homo sapiens
gagaugaccuugacauaccaa

SEQ ID NO: 1928455 - RNA, 17 nt, Homo sapiens
uugaagauuagcuuuua

SEQ ID NO: 1928456 - RNA, 18 nt, Homo sapiens
ccaacaaccacacuuaaa

SEQ ID NO: 1928457 - RNA, 14 nt, Homo sapiens
gggauaagccagcu

SEQ ID NO: 1928458 - RNA, 17 nt, Homo sapiens
cuagguaggggcccacu

SEQ ID NO: 1928459 - RNA, 20 nt, Homo sapiens
gauacuugaacacuguguuu

SEQ ID NO: 1928460 - RNA, 14 nt, Homo sapiens
aaucagcaugacaa

SEQ ID NO: 1928461 - RNA, 23 nt, Homo sapiens
acuauguggcugaaaaugcaaag

SEQ ID NO: 1928462 - RNA, 18 nt, Homo sapiens
acucuucuuguaaaucac

SEQ ID NO: 1928463 - RNA, 17 nt, Homo sapiens
ugcauaugcauucacuc

SEQ ID NO: 1928464 - RNA, 14 nt, Homo sapiens
ugcauuaagugugg

SEQ ID NO: 1928465 - RNA, 16 nt, Homo sapiens
agaaaauuugcuuuaa

SEQ ID NO: 1928466 - RNA, 17 nt, Homo sapiens
aguucaucaccauuucc

SEQ ID NO: 1928467 - RNA, 11 nt, Homo sapiens
aaacauuccaa

SEQ ID NO: 1928468 - RNA, 21 nt, Homo sapiens
gccaggagcccacagugccug

SEQ ID NO: 1928469 - RNA, 20 nt, Homo sapiens
aacauguaagcauaacuuau

SEQ ID NO: 1928470 - RNA, 20 nt, Homo sapiens
cuggaaaaccugaggccaaa

SEQ ID NO: 1928471 - RNA, 14 nt, Homo sapiens
aaugcauuaagugu

SEQ ID NO: 1928472 - RNA, 18 nt, Homo sapiens
cacaacucuuuguucaaa

SEQ ID NO: 1928473 - RNA, 17 nt, Homo sapiens
aaucaauguucacgcaa

SEQ ID NO: 1928474 - RNA, 11 nt, Homo sapiens
gagaugccaug

SEQ ID NO: 1928475 - RNA, 23 nt, Homo sapiens
gcucuccccaggcauuugccaag

SEQ ID NO: 1928476 - RNA, 22 nt, Homo sapiens
ucuagcaccaggacucagagga

SEQ ID NO: 1928477 - RNA, 17 nt, Homo sapiens
aacacccuuucaucuca

SEQ ID NO: 1928478 - RNA, 13 nt, Homo sapiens
agucacguccuuu

SEQ ID NO: 1928479 - RNA, 21 nt, Homo sapiens
ccaagcacagugccugcaugu

SEQ ID NO: 1928480 - RNA, 19 nt, Homo sapiens
uaggcagcaagcuuugguu

SEQ ID NO: 1928481 - RNA, 21 nt, Homo sapiens
gguaaagcuuauggaacugag

SEQ ID NO: 1928482 - RNA, 20 nt, Homo sapiens
ugguuacuaaaaaguaccag

SEQ ID NO: 1928483 - RNA, 12 nt, Homo sapiens
auugcuuaccuu

SEQ ID NO: 1928484 - RNA, 20 nt, Homo sapiens
uuaugcacacagagauuuga

SEQ ID NO: 1928485 - RNA, 18 nt, Homo sapiens
gauauggacuauugcaau

SEQ ID NO: 1928486 - RNA, 18 nt, Homo sapiens
agaacuuuggcugccuuu

SEQ ID NO: 1928487 - RNA, 16 nt, Homo sapiens
gcaauguauagugucu

SEQ ID NO: 1928488 - RNA, 23 nt, Homo sapiens
aaauggguauuuguucaaaauaa

SEQ ID NO: 1928489 - RNA, 23 nt, Homo sapiens
auuuuccauaaagguaacaaagg

SEQ ID NO: 1928490 - RNA, 22 nt, Homo sapiens
guugaacaauaaguaaauccac

SEQ ID NO: 1928491 - RNA, 13 nt, Homo sapiens
uugauuugcucuu

SEQ ID NO: 1928492 - RNA, 16 nt, Homo sapiens
ugcagcccucuugccc

SEQ ID NO: 1928493 - RNA, 18 nt, Homo sapiens
ggccccuuuaacucuuau

SEQ ID NO: 1928494 - RNA, 14 nt, Homo sapiens
agcucuaucugcaa

SEQ ID NO: 1928495 - RNA, 14 nt, Homo sapiens
acggggagaaauaa

SEQ ID NO: 1928496 - RNA, 15 nt, Homo sapiens
ugaugacccucugac

SEQ ID NO: 1928497 - RNA, 18 nt, Homo sapiens
gaucacuagccugucauc

SEQ ID NO: 1928498 - RNA, 13 nt, Homo sapiens
ucgugccguccuc

SEQ ID NO: 1928499 - RNA, 19 nt, Homo sapiens
caggcuggaaguacuuggc

SEQ ID NO: 1928500 - RNA, 20 nt, Homo sapiens
uugaaaagagguggauucau

SEQ ID NO: 1928501 - RNA, 16 nt, Homo sapiens
guauucuucaaccagu

SEQ ID NO: 1928502 - RNA, 20 nt, Homo sapiens
aaugaguucccuugauucaa

SEQ ID NO: 1928503 - RNA, 19 nt, Homo sapiens
uuguuaugaucuacucauu

SEQ ID NO: 1928504 - RNA, 19 nt, Homo sapiens
aacuacuucuuacuucuuu

SEQ ID NO: 1928505 - RNA, 15 nt, Homo sapiens
ccucagccccacuga

SEQ ID NO: 1928506 - RNA, 22 nt, Homo sapiens
uguaaaauuguuaguaaacaua

SEQ ID NO: 1928507 - RNA, 16 nt, Homo sapiens
auuuugcuaccaaaga

SEQ ID NO: 1928508 - RNA, 23 nt, Homo sapiens
ccugugaucuauaccaccuucaa

SEQ ID NO: 1928509 - RNA, 15 nt, Homo sapiens
ccagguaagcccuuu

SEQ ID NO: 1928510 - RNA, 19 nt, Homo sapiens
aucgaggcucuugcucaag

SEQ ID NO: 1928511 - RNA, 22 nt, Homo sapiens
aaugugaguguguaugucagug

SEQ ID NO: 1928512 - RNA, 14 nt, Homo sapiens
ccuagcacuuuaua

SEQ ID NO: 1928513 - RNA, 18 nt, Homo sapiens
agacuuuucccaagccua

SEQ ID NO: 1928514 - RNA, 14 nt, Homo sapiens
gaugaugaugacuc

SEQ ID NO: 1928515 - RNA, 12 nt, Homo sapiens
aagcccauggcu

SEQ ID NO: 1928516 - RNA, 11 nt, Homo sapiens
aucaucucagc

SEQ ID NO: 1928517 - RNA, 15 nt, Homo sapiens
ccaccuccugcaaua

SEQ ID NO: 1928518 - RNA, 17 nt, Homo sapiens
uguugcuaucaauccaa

SEQ ID NO: 1928519 - RNA, 17 nt, Homo sapiens
uaauuaaagaugguuua

SEQ ID NO: 1928520 - RNA, 22 nt, Homo sapiens
gccccccacaccuuuuccccaa

SEQ ID NO: 1928521 - RNA, 19 nt, Homo sapiens
cauuuuucauagauaccau

SEQ ID NO: 1928522 - RNA, 21 nt, Homo sapiens
gaaugugucugcguuccuguu

SEQ ID NO: 1928523 - RNA, 13 nt, Homo sapiens
cgcuaucacagcu

SEQ ID NO: 1928524 - RNA, 15 nt, Homo sapiens
cugucagucguguug

SEQ ID NO: 1928525 - RNA, 15 nt, Homo sapiens
uuucaccucuacauu

SEQ ID NO: 1928526 - RNA, 15 nt, Homo sapiens
gauauauacaaggug

SEQ ID NO: 1928527 - RNA, 15 nt, Homo sapiens
ccuuucauuaggcaa

SEQ ID NO: 1928528 - RNA, 15 nt, Homo sapiens
uagucaauccuguca

SEQ ID NO: 1928529 - RNA, 19 nt, Homo sapiens
gauauuuucccuaccuaag

SEQ ID NO: 1928530 - RNA, 21 nt, Homo sapiens
cuuaaaaugugagugaccuca

SEQ ID NO: 1928531 - RNA, 23 nt, Homo sapiens
ugccucuugaaugcagggacaaa

SEQ ID NO: 1928532 - RNA, 22 nt, Homo sapiens
uaugcaggguagcacugggaac

SEQ ID NO: 1928533 - RNA, 15 nt, Homo sapiens
ugaggaguaaaaaga

SEQ ID NO: 1928534 - RNA, 15 nt, Homo sapiens
auuacaguagugcau

SEQ ID NO: 1928535 - RNA, 20 nt, Homo sapiens
cugacuuaagugugcaaaau

SEQ ID NO: 1928536 - RNA, 19 nt, Homo sapiens
aggugacuucuagcagaga

SEQ ID NO: 1928537 - RNA, 24 nt, Homo sapiens
acauuucauuguacaaguauuaca

SEQ ID NO: 1928538 - RNA, 22 nt, Homo sapiens
gcauucucagccacaaccaaaa

SEQ ID NO: 1928539 - RNA, 23 nt, Homo sapiens
ucucggaguccaaaggguuuuaa

SEQ ID NO: 1928540 - RNA, 15 nt, Homo sapiens
acugauggccaggca

SEQ ID NO: 1928541 - RNA, 21 nt, Homo sapiens
acuuuuguugaaauagcuuua

SEQ ID NO: 1928542 - RNA, 23 nt, Homo sapiens
aaccagaaaauaaagauaguuaa

SEQ ID NO: 1928543 - RNA, 16 nt, Homo sapiens
cugcggaggggggcaa

SEQ ID NO: 1928544 - RNA, 13 nt, Homo sapiens
uauuuaaacaauu

SEQ ID NO: 1928545 - RNA, 19 nt, Homo sapiens
gaagaauuuaucugugaau

SEQ ID NO: 1928546 - RNA, 22 nt, Homo sapiens
aggcacugcugcccagccucca

SEQ ID NO: 1928547 - RNA, 16 nt, Homo sapiens
aauuccuguacugugu

SEQ ID NO: 1928548 - RNA, 16 nt, Homo sapiens
aucucugguuuugcuu

SEQ ID NO: 1928549 - RNA, 17 nt, Homo sapiens
uaagaauuucccaguga

SEQ ID NO: 1928550 - RNA, 19 nt, Homo sapiens
uggggaccccaaccucaga

SEQ ID NO: 1928551 - RNA, 13 nt, Homo sapiens
auaacaacuuuca

SEQ ID NO: 1928552 - RNA, 22 nt, Homo sapiens
cuaccugcagaguuacuaacuu

SEQ ID NO: 1928553 - RNA, 22 nt, Homo sapiens
uugucacccaaagccuguccca

SEQ ID NO: 1928554 - RNA, 18 nt, Homo sapiens
uuucuuccuuuucacugc

SEQ ID NO: 1928555 - RNA, 16 nt, Homo sapiens
aaccccaagcugccuc

SEQ ID NO: 1928556 - RNA, 22 nt, Homo sapiens
uauauuuaaaaaauuauggaau

SEQ ID NO: 1928557 - RNA, 17 nt, Homo sapiens
agggaagccuuuugcaa

SEQ ID NO: 1928558 - RNA, 14 nt, Homo sapiens
auauccagguucua

SEQ ID NO: 1928559 - RNA, 21 nt, Homo sapiens
gcaucaauuuuucuuauuuca

SEQ ID NO: 1928560 - RNA, 20 nt, Homo sapiens
uaucuuuauuaaucacuauu

SEQ ID NO: 1928561 - RNA, 20 nt, Homo sapiens
ccucaaaugacccaaagacc

SEQ ID NO: 1928562 - RNA, 14 nt, Homo sapiens
aaguuaucaucuca

SEQ ID NO: 1928563 - RNA, 15 nt, Homo sapiens
cacuuuagaaagcug

SEQ ID NO: 1928564 - RNA, 15 nt, Homo sapiens
ccuaagaaaccccag

SEQ ID NO: 1928565 - RNA, 22 nt, Homo sapiens
acaggaaaaaugaaaauguuac

SEQ ID NO: 1928566 - RNA, 21 nt, Homo sapiens
acggugcagucugggugcucg

SEQ ID NO: 1928567 - RNA, 18 nt, Homo sapiens
uacguggaugauuucuac

SEQ ID NO: 1928568 - RNA, 12 nt, Homo sapiens
aaggcucuacac

SEQ ID NO: 1928569 - RNA, 20 nt, Homo sapiens
agcugcuggaugacuugaga

SEQ ID NO: 1928570 - RNA, 14 nt, Homo sapiens
gcuuguguuuuuaa

SEQ ID NO: 1928571 - RNA, 19 nt, Homo sapiens
gaaaaggagcuucaguauu

SEQ ID NO: 1928572 - RNA, 16 nt, Homo sapiens
ucuaauucuucauuau

SEQ ID NO: 1928573 - RNA, 23 nt, Homo sapiens
acaagaggauuguaaaaugcacc

SEQ ID NO: 1928574 - RNA, 18 nt, Homo sapiens
auauaaucucaccugcuu

SEQ ID NO: 1928575 - RNA, 13 nt, Homo sapiens
cuugucugaggga

SEQ ID NO: 1928576 - RNA, 11 nt, Homo sapiens
uucuaugcaaa

SEQ ID NO: 1928577 - RNA, 17 nt, Homo sapiens
gaaagggaaaagggaga

SEQ ID NO: 1928578 - RNA, 20 nt, Homo sapiens
gcucacccugcggcacgugg

SEQ ID NO: 1928579 - RNA, 22 nt, Homo sapiens
ccugguacugagguugggcuga

SEQ ID NO: 1928580 - RNA, 18 nt, Homo sapiens
gucugauuguagcuauga

SEQ ID NO: 1928581 - RNA, 15 nt, Homo sapiens
aagguuucccaguga

SEQ ID NO: 1928582 - RNA, 15 nt, Homo sapiens
uaguagagacagggu

SEQ ID NO: 1928583 - RNA, 14 nt, Homo sapiens
ugacaugcacugac

SEQ ID NO: 1928584 - RNA, 20 nt, Homo sapiens
ugggaagagaagagggccca

SEQ ID NO: 1928585 - RNA, 16 nt, Homo sapiens
gaaggcuucucuccac

SEQ ID NO: 1928586 - RNA, 12 nt, Homo sapiens
cuggcugcuaac

SEQ ID NO: 1928587 - RNA, 14 nt, Homo sapiens
uuucauaagcacau

SEQ ID NO: 1928588 - RNA, 23 nt, Homo sapiens
auaaauuuucuucuugguucuga

SEQ ID NO: 1928589 - RNA, 22 nt, Homo sapiens
gcuccuccuucccagggaccag

SEQ ID NO: 1928590 - RNA, 20 nt, Homo sapiens
gaaauuauuuuucaggaaaa

SEQ ID NO: 1928591 - RNA, 13 nt, Homo sapiens
cagccauaugcag

SEQ ID NO: 1928592 - RNA, 15 nt, Homo sapiens
uguuaauaaauggau

SEQ ID NO: 1928593 - RNA, 20 nt, Homo sapiens
cugguacuauugugaccaca

SEQ ID NO: 1928594 - RNA, 20 nt, Homo sapiens
cucuuucuuauuuuguaaua

SEQ ID NO: 1928595 - RNA, 18 nt, Homo sapiens
aguugcuguugugugauc

SEQ ID NO: 1928596 - RNA, 22 nt, Homo sapiens
gacuuaccuguucaguacucua

SEQ ID NO: 1928597 - RNA, 18 nt, Homo sapiens
acgcaccuguagucccag

SEQ ID NO: 1928598 - RNA, 20 nt, Homo sapiens
gaagaagccauugagcucuc

SEQ ID NO: 1928599 - RNA, 18 nt, Homo sapiens
gugguaugguuguauaca

SEQ ID NO: 1928600 - RNA, 13 nt, Homo sapiens
augcacaauucca

SEQ ID NO: 1928601 - RNA, 16 nt, Homo sapiens
accaccaccaccauca

SEQ ID NO: 1928602 - RNA, 16 nt, Homo sapiens
gaccaguaggacucaa

SEQ ID NO: 1928603 - RNA, 18 nt, Homo sapiens
cugcugaccauuugguca

SEQ ID NO: 1928604 - RNA, 16 nt, Homo sapiens
uaagcucacacagcua

SEQ ID NO: 1928605 - RNA, 17 nt, Homo sapiens
uagcggucaauuugccu

SEQ ID NO: 1928606 - RNA, 16 nt, Homo sapiens
uaggccguuccuucaa

SEQ ID NO: 1928607 - RNA, 23 nt, Homo sapiens
ugguauguguguguaugcuacua

SEQ ID NO: 1928608 - RNA, 13 nt, Homo sapiens
caaacagguuguu

SEQ ID NO: 1928609 - RNA, 17 nt, Homo sapiens
cagugagcugaugugcc

SEQ ID NO: 1928610 - RNA, 23 nt, Homo sapiens
agaugguggagauuggcaugcca

SEQ ID NO: 1928611 - RNA, 11 nt, Homo sapiens
cagcacugagg

SEQ ID NO: 1928612 - RNA, 21 nt, Homo sapiens
uacaaguaauauuauuacuuu

SEQ ID NO: 1928613 - RNA, 14 nt, Homo sapiens
agcagugucuguca

SEQ ID NO: 1928614 - RNA, 15 nt, Homo sapiens
gccucuccaucugua

SEQ ID NO: 1928615 - RNA, 14 nt, Homo sapiens
aaccacaguuauua

SEQ ID NO: 1928616 - RNA, 13 nt, Homo sapiens
uucagaaucucuc

SEQ ID NO: 1928617 - RNA, 20 nt, Homo sapiens
cuggcagaguugaagacaga

SEQ ID NO: 1928618 - RNA, 14 nt, Homo sapiens
uaauaacagcagug

SEQ ID NO: 1928619 - RNA, 20 nt, Homo sapiens
uuucuucaagaacauucuac

SEQ ID NO: 1928620 - RNA, 20 nt, Homo sapiens
ccuaaagaggaaaagugcaa

SEQ ID NO: 1928621 - RNA, 14 nt, Homo sapiens
uaguguccauaaau

SEQ ID NO: 1928622 - RNA, 14 nt, Homo sapiens
uaaugaccaugaaa

SEQ ID NO: 1928623 - RNA, 17 nt, Homo sapiens
gggggcgugccugccaa

SEQ ID NO: 1928624 - RNA, 16 nt, Homo sapiens
augaauaaaguguaag

SEQ ID NO: 1928625 - RNA, 22 nt, Homo sapiens
gcucaucccuggacuucuggga

SEQ ID NO: 1928626 - RNA, 19 nt, Homo sapiens
aacagccucuuugcccaaa

SEQ ID NO: 1928627 - RNA, 23 nt, Homo sapiens
uuagcuguaaauacaugugugga

SEQ ID NO: 1928628 - RNA, 15 nt, Homo sapiens
uggaguccagucucu

SEQ ID NO: 1928629 - RNA, 22 nt, Homo sapiens
cuuuguccccacacagccucua

SEQ ID NO: 1928630 - RNA, 19 nt, Homo sapiens
ugcuaauccaggacagcau

SEQ ID NO: 1928631 - RNA, 22 nt, Homo sapiens
agaagcuaccccucaaacugca

SEQ ID NO: 1928632 - RNA, 18 nt, Homo sapiens
ugcaacauguguacuuaa

SEQ ID NO: 1928633 - RNA, 14 nt, Homo sapiens
cauugcacuuuccu

SEQ ID NO: 1928634 - RNA, 16 nt, Homo sapiens
gaccucacgugcaaag

SEQ ID NO: 1928635 - RNA, 13 nt, Homo sapiens
gugcuguggcaua

SEQ ID NO: 1928636 - RNA, 22 nt, Homo sapiens
aggucacucuuggucccuggaa

SEQ ID NO: 1928637 - RNA, 12 nt, Homo sapiens
acaccucuccaa

SEQ ID NO: 1928638 - RNA, 19 nt, Homo sapiens
cccacggcaccucggggac

SEQ ID NO: 1928639 - RNA, 21 nt, Homo sapiens
accacaagggcucucuuaggc

SEQ ID NO: 1928640 - RNA, 13 nt, Homo sapiens
ugauaaacugaau

SEQ ID NO: 1928641 - RNA, 19 nt, Homo sapiens
uguacuuuaaaaagaugua

SEQ ID NO: 1928642 - RNA, 13 nt, Homo sapiens
aucacaaaaccac

SEQ ID NO: 1928643 - RNA, 23 nt, Homo sapiens
acucaacauguuacugaccagca

SEQ ID NO: 1928644 - RNA, 23 nt, Homo sapiens
ugcaaaucagagcauacaaaaua

SEQ ID NO: 1928645 - RNA, 17 nt, Homo sapiens
gcuauugaccgagcaca

SEQ ID NO: 1928646 - RNA, 23 nt, Homo sapiens
aaauggaguuaucaguuaucugu

SEQ ID NO: 1928647 - RNA, 18 nt, Homo sapiens
gaauuuggguaugaacag

SEQ ID NO: 1928648 - RNA, 20 nt, Homo sapiens
uaaaagaucauaguugcaaa

SEQ ID NO: 1928649 - RNA, 18 nt, Homo sapiens
cauauuaauucaugcaaa

SEQ ID NO: 1928650 - RNA, 18 nt, Homo sapiens
agaggggauucacaaggu

SEQ ID NO: 1928651 - RNA, 14 nt, Homo sapiens
caauggcuggguuu

SEQ ID NO: 1928652 - RNA, 18 nt, Homo sapiens
ucaacuguugccaggaga

SEQ ID NO: 1928653 - RNA, 17 nt, Homo sapiens
gcauuguaucgauguua

SEQ ID NO: 1928654 - RNA, 13 nt, Homo sapiens
augauaccaccuu

SEQ ID NO: 1928655 - RNA, 16 nt, Homo sapiens
ucacagggacucucca

SEQ ID NO: 1928656 - RNA, 16 nt, Homo sapiens
ucccuguguucugggc

SEQ ID NO: 1928657 - RNA, 14 nt, Homo sapiens
ggugacaccucccc

SEQ ID NO: 1928658 - RNA, 21 nt, Homo sapiens
aaauucuacugaacacuucaa

SEQ ID NO: 1928659 - RNA, 17 nt, Homo sapiens
auuacaggugugagcca

SEQ ID NO: 1928660 - RNA, 17 nt, Homo sapiens
aaugaugcacauuucau

SEQ ID NO: 1928661 - RNA, 16 nt, Homo sapiens
gcuuggcacacugcca

SEQ ID NO: 1928662 - RNA, 22 nt, Homo sapiens
gagcccugucuccucucucugu

SEQ ID NO: 1928663 - RNA, 16 nt, Homo sapiens
ucuucauggugacauu

SEQ ID NO: 1928664 - RNA, 20 nt, Homo sapiens
cuugggaaaaaaacuuggca

SEQ ID NO: 1928665 - RNA, 20 nt, Homo sapiens
ugcccacaggugcgggacca

SEQ ID NO: 1928666 - RNA, 21 nt, Homo sapiens
gacaggaagacuggagacugu

SEQ ID NO: 1928667 - RNA, 19 nt, Homo sapiens
ggcacuggcgagcagccac

SEQ ID NO: 1928668 - RNA, 19 nt, Homo sapiens
uuuguagccacuucacuuu

SEQ ID NO: 1928669 - RNA, 18 nt, Homo sapiens
uuccaaguucucaccucu

SEQ ID NO: 1928670 - RNA, 11 nt, Homo sapiens
guccuauucau

SEQ ID NO: 1928671 - RNA, 16 nt, Homo sapiens
acacuaccuuaucagg

SEQ ID NO: 1928672 - RNA, 14 nt, Homo sapiens
auaaaaagcagaau

SEQ ID NO: 1928673 - RNA, 21 nt, Homo sapiens
aacacuaguagcuguuuugaa

SEQ ID NO: 1928674 - RNA, 14 nt, Homo sapiens
caaugaacaucuca

SEQ ID NO: 1928675 - RNA, 16 nt, Homo sapiens
cacuggaagccagaga

SEQ ID NO: 1928676 - RNA, 16 nt, Homo sapiens
caauaggugcaaaaau

SEQ ID NO: 1928677 - RNA, 14 nt, Homo sapiens
gaaaaccugucacu

SEQ ID NO: 1928678 - RNA, 13 nt, Homo sapiens
cuuaauuucugcc

SEQ ID NO: 1928679 - RNA, 13 nt, Homo sapiens
ucaggcacagguc

SEQ ID NO: 1928680 - RNA, 21 nt, Homo sapiens
augcuguuuuaaaaacaaaga

SEQ ID NO: 1928681 - RNA, 17 nt, Homo sapiens
agccuuguugguggaga

SEQ ID NO: 1928682 - RNA, 19 nt, Homo sapiens
caggguuuauaugcacuuu

SEQ ID NO: 1928683 - RNA, 20 nt, Homo sapiens
cccacugggagcacuuugua

SEQ ID NO: 1928684 - RNA, 13 nt, Homo sapiens
gauauuguuauau

SEQ ID NO: 1928685 - RNA, 13 nt, Homo sapiens
uccagugugccag

SEQ ID NO: 1928686 - RNA, 13 nt, Homo sapiens
ucaugugugcaug

SEQ ID NO: 1928687 - RNA, 16 nt, Homo sapiens
ugaauccaacguguaa

SEQ ID NO: 1928688 - RNA, 13 nt, Homo sapiens
uguggacugugau

SEQ ID NO: 1928689 - RNA, 23 nt, Homo sapiens
uggagugagggguaaaagcugau

SEQ ID NO: 1928690 - RNA, 20 nt, Homo sapiens
ugaggcacaagaaucacuug

SEQ ID NO: 1928691 - RNA, 17 nt, Homo sapiens
agcuccgcgugucucau

SEQ ID NO: 1928692 - RNA, 14 nt, Homo sapiens
agaaagaauguuca

SEQ ID NO: 1928693 - RNA, 13 nt, Homo sapiens
aaucaaccaaagu

SEQ ID NO: 1928694 - RNA, 17 nt, Homo sapiens
uggaaaauaguuugcaa

SEQ ID NO: 1928695 - RNA, 15 nt, Homo sapiens
ucccccaaccaagga

SEQ ID NO: 1928696 - RNA, 12 nt, Homo sapiens
gccacacuguca

SEQ ID NO: 1928697 - RNA, 17 nt, Homo sapiens
cagccccuccuccauag

SEQ ID NO: 1928698 - RNA, 13 nt, Homo sapiens
caagagcacacag

SEQ ID NO: 1928699 - RNA, 20 nt, Homo sapiens
augcacuuggcugcauaaau

SEQ ID NO: 1928700 - RNA, 15 nt, Homo sapiens
gcuacgagaccuuca

SEQ ID NO: 1928701 - RNA, 11 nt, Homo sapiens
aauaacuaaua

SEQ ID NO: 1928702 - RNA, 23 nt, Homo sapiens
acuguaggaaaagaggccagcuc

SEQ ID NO: 1928703 - RNA, 20 nt, Homo sapiens
ggauguuuugucccauuucc

SEQ ID NO: 1928704 - RNA, 19 nt, Homo sapiens
caaaacauucauaggcagu

SEQ ID NO: 1928705 - RNA, 14 nt, Homo sapiens
uuaucaauucugau

SEQ ID NO: 1928706 - RNA, 14 nt, Homo sapiens
cuuuugcauucucc

SEQ ID NO: 1928707 - RNA, 15 nt, Homo sapiens
agaggaguagcauga

SEQ ID NO: 1928708 - RNA, 18 nt, Homo sapiens
gaaccagcagaagccaga

SEQ ID NO: 1928709 - RNA, 23 nt, Homo sapiens
uaaauucagauccuuucuccaca

SEQ ID NO: 1928710 - RNA, 20 nt, Homo sapiens
gcccucaccacccacuugau

SEQ ID NO: 1928711 - RNA, 19 nt, Homo sapiens
ucacagucucaguucucuu

SEQ ID NO: 1928712 - RNA, 13 nt, Homo sapiens
guacuaaagccaa

SEQ ID NO: 1928713 - RNA, 15 nt, Homo sapiens
auucucaucacucaa

SEQ ID NO: 1928714 - RNA, 16 nt, Homo sapiens
ugcuacuuaacaaagu

SEQ ID NO: 1928715 - RNA, 22 nt, Homo sapiens
ccguuuccuaagccaagaguca

SEQ ID NO: 1928716 - RNA, 14 nt, Homo sapiens
gacuucugaguaau

SEQ ID NO: 1928717 - RNA, 18 nt, Homo sapiens
acccagucuguugcugcu

SEQ ID NO: 1928718 - RNA, 18 nt, Homo sapiens
cuucccuucuccaucucu

SEQ ID NO: 1928719 - RNA, 17 nt, Homo sapiens
agaaacugaguccuguu

SEQ ID NO: 1928720 - RNA, 12 nt, Homo sapiens
gccuuuaauauu

SEQ ID NO: 1928721 - RNA, 13 nt, Homo sapiens
cuucccuaccuca

SEQ ID NO: 1928722 - RNA, 11 nt, Homo sapiens
uggacacugag

SEQ ID NO: 1928723 - RNA, 15 nt, Homo sapiens
agaugagaacaaagc

SEQ ID NO: 1928724 - RNA, 20 nt, Homo sapiens
uuaauaugguuguacuacag

SEQ ID NO: 1928725 - RNA, 19 nt, Homo sapiens
ucuucagccucauucacug

SEQ ID NO: 1928726 - RNA, 17 nt, Homo sapiens
ugaaaagcuacccugaa

SEQ ID NO: 1928727 - RNA, 14 nt, Homo sapiens
uuuugaguaucucg

SEQ ID NO: 1928728 - RNA, 23 nt, Homo sapiens
gcuggccaauuaaggcaucauca

SEQ ID NO: 1928729 - RNA, 20 nt, Homo sapiens
uuuguaaugcugcacagaaa

SEQ ID NO: 1928730 - RNA, 16 nt, Homo sapiens
ugcaauguaagcauac

SEQ ID NO: 1928731 - RNA, 15 nt, Homo sapiens
agagugagacuccac

SEQ ID NO: 1928732 - RNA, 15 nt, Homo sapiens
cuaaacccucuguga

SEQ ID NO: 1928733 - RNA, 20 nt, Homo sapiens
uuagcugguggcaauaaaua

SEQ ID NO: 1928734 - RNA, 18 nt, Homo sapiens
acaccaagugaggccaua

SEQ ID NO: 1928735 - RNA, 17 nt, Homo sapiens
uggauugggagauuuca

SEQ ID NO: 1928736 - RNA, 17 nt, Homo sapiens
guauaguugcuugccug

SEQ ID NO: 1928737 - RNA, 13 nt, Homo sapiens
cccagguccugca

SEQ ID NO: 1928738 - RNA, 14 nt, Homo sapiens
cuuauauuuacaau

SEQ ID NO: 1928739 - RNA, 15 nt, Homo sapiens
cuguucccuugccau

SEQ ID NO: 1928740 - RNA, 21 nt, Homo sapiens
acagagcaagacuccaucuca

SEQ ID NO: 1928741 - RNA, 21 nt, Homo sapiens
acagagcgagacuccgucuca

SEQ ID NO: 1928742 - RNA, 22 nt, Homo sapiens
gcuccagcccuugucagauuca

SEQ ID NO: 1928743 - RNA, 12 nt, Homo sapiens
uuuauccacuua

SEQ ID NO: 1928744 - RNA, 19 nt, Homo sapiens
gagacagaaucucagucug

SEQ ID NO: 1928745 - RNA, 16 nt, Homo sapiens
ggggaugcucugugca

SEQ ID NO: 1928746 - RNA, 17 nt, Homo sapiens
ggauuugcucagugucu

SEQ ID NO: 1928747 - RNA, 20 nt, Homo sapiens
cugagcuguuaucuugugua

SEQ ID NO: 1928748 - RNA, 12 nt, Homo sapiens
aguugccuuuau

SEQ ID NO: 1928749 - RNA, 19 nt, Homo sapiens
augugaccgaacacugcag

SEQ ID NO: 1928750 - RNA, 22 nt, Homo sapiens
acuugaaaugcucuuuugcaca

SEQ ID NO: 1928751 - RNA, 17 nt, Homo sapiens
auccugggggccugggu

SEQ ID NO: 1928752 - RNA, 19 nt, Homo sapiens
acauaacuccugucccuuu

SEQ ID NO: 1928753 - RNA, 22 nt, Homo sapiens
gaguuaaugugcugagcauuuu

SEQ ID NO: 1928754 - RNA, 21 nt, Homo sapiens
uacauuccaacucguauagca

SEQ ID NO: 1928755 - RNA, 15 nt, Homo sapiens
uuucuaagacucacu

SEQ ID NO: 1928756 - RNA, 20 nt, Homo sapiens
ugaccauaaaauuagacaua

SEQ ID NO: 1928757 - RNA, 17 nt, Homo sapiens
acaggcagcaaggucau

SEQ ID NO: 1928758 - RNA, 22 nt, Homo sapiens
caucuuccgcgcaggugccaac

SEQ ID NO: 1928759 - RNA, 23 nt, Homo sapiens
agaaacccuugcugcuuuagucc

SEQ ID NO: 1928760 - RNA, 16 nt, Homo sapiens
uaagcaagccaggaga

SEQ ID NO: 1928761 - RNA, 15 nt, Homo sapiens
aaaccuugauuuaaa

SEQ ID NO: 1928762 - RNA, 12 nt, Homo sapiens
caaguguuauac

SEQ ID NO: 1928763 - RNA, 23 nt, Homo sapiens
caguugagcuucauauaccagca

SEQ ID NO: 1928764 - RNA, 15 nt, Homo sapiens
uuguacaauaccaga

SEQ ID NO: 1928765 - RNA, 19 nt, Homo sapiens
cuaugucauuucauuuccu

SEQ ID NO: 1928766 - RNA, 15 nt, Homo sapiens
cagcagcugaagcca

SEQ ID NO: 1928767 - RNA, 16 nt, Homo sapiens
ucugacucccaaagag

SEQ ID NO: 1928768 - RNA, 16 nt, Homo sapiens
uaaaacagcaugaguc

SEQ ID NO: 1928769 - RNA, 17 nt, Homo sapiens
acaacaucuguuacauu

SEQ ID NO: 1928770 - RNA, 16 nt, Homo sapiens
aggaagggacaagaca

SEQ ID NO: 1928771 - RNA, 23 nt, Homo sapiens
gcacagagcaguggccaggccac

SEQ ID NO: 1928772 - RNA, 14 nt, Homo sapiens
ucaggacagaugcc

SEQ ID NO: 1928773 - RNA, 22 nt, Homo sapiens
acauguaugcuuccagggacaa

SEQ ID NO: 1928774 - RNA, 18 nt, Homo sapiens
uauuuuaguuaacuauga

SEQ ID NO: 1928775 - RNA, 21 nt, Homo sapiens
aaagaugagcuuuucuaggcu

SEQ ID NO: 1928776 - RNA, 17 nt, Homo sapiens
aaguuccuauaccuuac

SEQ ID NO: 1928777 - RNA, 22 nt, Homo sapiens
aaagacaaaugggccugccaaa

SEQ ID NO: 1928778 - RNA, 17 nt, Homo sapiens
accuauucccaaaugcc

SEQ ID NO: 1928779 - RNA, 14 nt, Homo sapiens
aaauacuuaaugau

SEQ ID NO: 1928780 - RNA, 12 nt, Homo sapiens
uuacaguguaug

SEQ ID NO: 1928781 - RNA, 14 nt, Homo sapiens
cggccaccugagug

SEQ ID NO: 1928782 - RNA, 13 nt, Homo sapiens
gcacaaauuccac

SEQ ID NO: 1928783 - RNA, 20 nt, Homo sapiens
ucuacccggcccagagaccc

SEQ ID NO: 1928784 - RNA, 17 nt, Homo sapiens
ugcaaauaaucacagau

SEQ ID NO: 1928785 - RNA, 18 nt, Homo sapiens
acuuagcaucuaauuuca

SEQ ID NO: 1928786 - RNA, 22 nt, Homo sapiens
auagccgugugagcagucucag

SEQ ID NO: 1928787 - RNA, 18 nt, Homo sapiens
aauuuaggacacauuuag

SEQ ID NO: 1928788 - RNA, 18 nt, Homo sapiens
ugauauuuucucuaggaa

SEQ ID NO: 1928789 - RNA, 22 nt, Homo sapiens
ucugcccucaccucugugccca

SEQ ID NO: 1928790 - RNA, 13 nt, Homo sapiens
ucccuucauacuu

SEQ ID NO: 1928791 - RNA, 16 nt, Homo sapiens
aggcaggcacugccaa

SEQ ID NO: 1928792 - RNA, 17 nt, Homo sapiens
ggauauugggucucagc

SEQ ID NO: 1928793 - RNA, 18 nt, Homo sapiens
caauuuuuauacauauca

SEQ ID NO: 1928794 - RNA, 13 nt, Homo sapiens
uuuagccauacca

SEQ ID NO: 1928795 - RNA, 16 nt, Homo sapiens
ccucuuggccucagca

SEQ ID NO: 1928796 - RNA, 15 nt, Homo sapiens
uaugaacagacuuuu

SEQ ID NO: 1928797 - RNA, 21 nt, Homo sapiens
uuuagaaaauaaaaacuuuag

SEQ ID NO: 1928798 - RNA, 10 nt, Homo sapiens
gaagcacuuu

SEQ ID NO: 1928799 - RNA, 22 nt, Homo sapiens
acaaggccugcuugacuuucca

SEQ ID NO: 1928800 - RNA, 15 nt, Homo sapiens
uguggggaaugggaa

SEQ ID NO: 1928801 - RNA, 17 nt, Homo sapiens
uuccugcuacacaaaag

SEQ ID NO: 1928802 - RNA, 18 nt, Homo sapiens
ucgacugugaccuguggg

SEQ ID NO: 1928803 - RNA, 17 nt, Homo sapiens
ccggucaugguggugca

SEQ ID NO: 1928804 - RNA, 23 nt, Homo sapiens
ccaccuccuuccccccaccagac

SEQ ID NO: 1928805 - RNA, 22 nt, Homo sapiens
agcacugggaacaggagaccca

SEQ ID NO: 1928806 - RNA, 19 nt, Homo sapiens
ugugaccaauacauuugua

SEQ ID NO: 1928807 - RNA, 16 nt, Homo sapiens
cugaaaaauggccaug

SEQ ID NO: 1928808 - RNA, 23 nt, Homo sapiens
caaagugcugagauuacaggugu

SEQ ID NO: 1928809 - RNA, 14 nt, Homo sapiens
gaugucccuaugga

SEQ ID NO: 1928810 - RNA, 21 nt, Homo sapiens
cauagaaacaauaaaugaguu

SEQ ID NO: 1928811 - RNA, 15 nt, Homo sapiens
agaguucuugcaccc

SEQ ID NO: 1928812 - RNA, 23 nt, Homo sapiens
gcacugaaaucacuuuaccugca

SEQ ID NO: 1928813 - RNA, 20 nt, Homo sapiens
ucagaacuccuuucuaagga

SEQ ID NO: 1928814 - RNA, 15 nt, Homo sapiens
gucuuaacucaccau

SEQ ID NO: 1928815 - RNA, 14 nt, Homo sapiens
ugagcuugugccuu

SEQ ID NO: 1928816 - RNA, 21 nt, Homo sapiens
cucaggcaaucugcccgccug

SEQ ID NO: 1928817 - RNA, 16 nt, Homo sapiens
gcaauaaaauguauuu

SEQ ID NO: 1928818 - RNA, 16 nt, Homo sapiens
aacuuuaaacauugac

SEQ ID NO: 1928819 - RNA, 14 nt, Homo sapiens
acuacugcaaaaag

SEQ ID NO: 1928820 - RNA, 17 nt, Homo sapiens
auuggggacaugggaug

SEQ ID NO: 1928821 - RNA, 15 nt, Homo sapiens
aauaguauugcugaa

SEQ ID NO: 1928822 - RNA, 21 nt, Homo sapiens
guaaucuaccaguggugcuca

SEQ ID NO: 1928823 - RNA, 17 nt, Homo sapiens
aggugaacugggagcag

SEQ ID NO: 1928824 - RNA, 14 nt, Homo sapiens
cuccaccucuccuu

SEQ ID NO: 1928825 - RNA, 22 nt, Homo sapiens
uugccuucaucuucacugcaau

SEQ ID NO: 1928826 - RNA, 21 nt, Homo sapiens
ccuuaaagacaagacagcauu

SEQ ID NO: 1928827 - RNA, 20 nt, Homo sapiens
aacuauuucuacacaguggg

SEQ ID NO: 1928828 - RNA, 20 nt, Homo sapiens
gaauccaagacaaacuaaac

SEQ ID NO: 1928829 - RNA, 14 nt, Homo sapiens
gucccacacuggug

SEQ ID NO: 1928830 - RNA, 22 nt, Homo sapiens
gagagguccacuucccuuagaa

SEQ ID NO: 1928831 - RNA, 24 nt, Homo sapiens
agcacuaguauuucauguugcaca

SEQ ID NO: 1928832 - RNA, 20 nt, Homo sapiens
agaaaacgucuugcuuggga

SEQ ID NO: 1928833 - RNA, 16 nt, Homo sapiens
uauugaucuuugccca

SEQ ID NO: 1928834 - RNA, 19 nt, Homo sapiens
aauuguacaaaauuaagca

SEQ ID NO: 1928835 - RNA, 12 nt, Homo sapiens
ccuaaacccaau

SEQ ID NO: 1928836 - RNA, 17 nt, Homo sapiens
ccugcucuacccaugag

SEQ ID NO: 1928837 - RNA, 17 nt, Homo sapiens
gcccuuuggaaagccau

SEQ ID NO: 1928838 - RNA, 16 nt, Homo sapiens
uagacuccucuuccca

SEQ ID NO: 1928839 - RNA, 21 nt, Homo sapiens
ucauuguucagaaaagcaccu

SEQ ID NO: 1928840 - RNA, 14 nt, Homo sapiens
gaaugauauaaggu

SEQ ID NO: 1928841 - RNA, 18 nt, Homo sapiens
ggaggcuggggacccaga

SEQ ID NO: 1928842 - RNA, 12 nt, Homo sapiens
uaaaaaagcauu

SEQ ID NO: 1928843 - RNA, 12 nt, Homo sapiens
ucuaaaagccau

SEQ ID NO: 1928844 - RNA, 22 nt, Homo sapiens
uacuccgcggagugaucaugga

SEQ ID NO: 1928845 - RNA, 15 nt, Homo sapiens
uuaccaaaacauaag

SEQ ID NO: 1928846 - RNA, 19 nt, Homo sapiens
ucagcugcaagguacucug

SEQ ID NO: 1928847 - RNA, 15 nt, Homo sapiens
aucucugcaggaugg

SEQ ID NO: 1928848 - RNA, 14 nt, Homo sapiens
gcuuguugcaauug

SEQ ID NO: 1928849 - RNA, 13 nt, Homo sapiens
gaaauaauuacuu

SEQ ID NO: 1928850 - RNA, 13 nt, Homo sapiens
aaacacagugcug

SEQ ID NO: 1928851 - RNA, 10 nt, Homo sapiens
agaaugcaac

SEQ ID NO: 1928852 - RNA, 16 nt, Homo sapiens
acacagaggaccucuu

SEQ ID NO: 1928853 - RNA, 17 nt, Homo sapiens
ucaaggcaaugggcuac

SEQ ID NO: 1928854 - RNA, 20 nt, Homo sapiens
agcugggccgaguaccuuaa

SEQ ID NO: 1928855 - RNA, 14 nt, Homo sapiens
auguaaaaugcaaa

SEQ ID NO: 1928856 - RNA, 12 nt, Homo sapiens
gacugguugguu

SEQ ID NO: 1928857 - RNA, 21 nt, Homo sapiens
cguguccaggagaccuuccac

SEQ ID NO: 1928858 - RNA, 18 nt, Homo sapiens
gggcagccugugggagaa

SEQ ID NO: 1928859 - RNA, 14 nt, Homo sapiens
agcuugaaucuacu

SEQ ID NO: 1928860 - RNA, 11 nt, Homo sapiens
aagcuacaggu

SEQ ID NO: 1928861 - RNA, 12 nt, Homo sapiens
cuaccuguaacu

SEQ ID NO: 1928862 - RNA, 13 nt, Homo sapiens
ccuucccuuccac

SEQ ID NO: 1928863 - RNA, 23 nt, Homo sapiens
caguaagaucaagcuccaucuua

SEQ ID NO: 1928864 - RNA, 23 nt, Homo sapiens
gugcaauaaaaccaagugcuuau

SEQ ID NO: 1928865 - RNA, 22 nt, Homo sapiens
uaaacauuuaacuuguuuccaa

SEQ ID NO: 1928866 - RNA, 12 nt, Homo sapiens
cuggacucagga

SEQ ID NO: 1928867 - RNA, 18 nt, Homo sapiens
uagcacugggcucugaug

SEQ ID NO: 1928868 - RNA, 11 nt, Homo sapiens
gaacuugcaau

SEQ ID NO: 1928869 - RNA, 15 nt, Homo sapiens
uacacagucacacaa

SEQ ID NO: 1928870 - RNA, 14 nt, Homo sapiens
gaacuauaugugaa

SEQ ID NO: 1928871 - RNA, 23 nt, Homo sapiens
ccgcacagagcuggggcugaggg

SEQ ID NO: 1928872 - RNA, 13 nt, Homo sapiens
auagcaaacucca

SEQ ID NO: 1928873 - RNA, 18 nt, Homo sapiens
cuaaaguuacaaacagac

SEQ ID NO: 1928874 - RNA, 17 nt, Homo sapiens
ccaaauauuccagagac

SEQ ID NO: 1928875 - RNA, 12 nt, Homo sapiens
uccuugcaucaa

SEQ ID NO: 1928876 - RNA, 12 nt, Homo sapiens
ucgccagcugcc

SEQ ID NO: 1928877 - RNA, 17 nt, Homo sapiens
aggcuuugggaccaccc

SEQ ID NO: 1928878 - RNA, 13 nt, Homo sapiens
accuuaguacuuu

SEQ ID NO: 1928879 - RNA, 17 nt, Homo sapiens
gacauauaccuucucaa

SEQ ID NO: 1928880 - RNA, 22 nt, Homo sapiens
gaaaugauccccaaguggugaa

SEQ ID NO: 1928881 - RNA, 12 nt, Homo sapiens
guuugcacuuug

SEQ ID NO: 1928882 - RNA, 21 nt, Homo sapiens
cuuccacgcugucuccagacc

SEQ ID NO: 1928883 - RNA, 20 nt, Homo sapiens
caguaaauauuuacuauuua

SEQ ID NO: 1928884 - RNA, 14 nt, Homo sapiens
acuuguucauuugg

SEQ ID NO: 1928885 - RNA, 19 nt, Homo sapiens
ucagcccucucuugccaaa

SEQ ID NO: 1928886 - RNA, 12 nt, Homo sapiens
caaagcuguuaa

SEQ ID NO: 1928887 - RNA, 15 nt, Homo sapiens
ugaaaauggagaaag

SEQ ID NO: 1928888 - RNA, 17 nt, Homo sapiens
uauggugcuaauguacu

SEQ ID NO: 1928889 - RNA, 20 nt, Homo sapiens
ccagaaacaaaucucaaagu

SEQ ID NO: 1928890 - RNA, 12 nt, Homo sapiens
aauccugaagaa

SEQ ID NO: 1928891 - RNA, 13 nt, Homo sapiens
gauuaauuugaaa

SEQ ID NO: 1928892 - RNA, 13 nt, Homo sapiens
ccucugagacaga

SEQ ID NO: 1928893 - RNA, 16 nt, Homo sapiens
uuguaggugaaagugu

SEQ ID NO: 1928894 - RNA, 19 nt, Homo sapiens
ccagaaggaaagggcagug

SEQ ID NO: 1928895 - RNA, 11 nt, Homo sapiens
gcaugguggcu

SEQ ID NO: 1928896 - RNA, 14 nt, Homo sapiens
ccacuugauuuugc

SEQ ID NO: 1928897 - RNA, 11 nt, Homo sapiens
gccuguggcau

SEQ ID NO: 1928898 - RNA, 15 nt, Homo sapiens
cgggagcagugucuu

SEQ ID NO: 1928899 - RNA, 13 nt, Homo sapiens
cacagaugucucu

SEQ ID NO: 1928900 - RNA, 21 nt, Homo sapiens
accccaauggaugaagacccc

SEQ ID NO: 1928901 - RNA, 12 nt, Homo sapiens
gcaguaccauuc

SEQ ID NO: 1928902 - RNA, 20 nt, Homo sapiens
aggguaucaggugcugccau

SEQ ID NO: 1928903 - RNA, 20 nt, Homo sapiens
agacugacauuuuuuccuaa

SEQ ID NO: 1928904 - RNA, 15 nt, Homo sapiens
agugcaauaaaacuc

SEQ ID NO: 1928905 - RNA, 20 nt, Homo sapiens
aauccaugaaccaagaccau

SEQ ID NO: 1928906 - RNA, 19 nt, Homo sapiens
uaaaugacucuucccucaa

SEQ ID NO: 1928907 - RNA, 15 nt, Homo sapiens
uauuuugcauuccag

SEQ ID NO: 1928908 - RNA, 23 nt, Homo sapiens
cuuuccccaugucucgacucauc

SEQ ID NO: 1928909 - RNA, 18 nt, Homo sapiens
cucccucaguccuuuauu

SEQ ID NO: 1928910 - RNA, 13 nt, Homo sapiens
aguuguauguggc

SEQ ID NO: 1928911 - RNA, 21 nt, Homo sapiens
cacuguguuucugugcuccaa

SEQ ID NO: 1928912 - RNA, 18 nt, Homo sapiens
ccaagcaggcaaggcaag

SEQ ID NO: 1928913 - RNA, 17 nt, Homo sapiens
ucccauggcaccuucag

SEQ ID NO: 1928914 - RNA, 11 nt, Homo sapiens
gcaucagagau

SEQ ID NO: 1928915 - RNA, 20 nt, Homo sapiens
cccuaaugccaguuccagcu

SEQ ID NO: 1928916 - RNA, 16 nt, Homo sapiens
aaguaacuugucuuaa

SEQ ID NO: 1928917 - RNA, 13 nt, Homo sapiens
uucuuugcugcug

SEQ ID NO: 1928918 - RNA, 22 nt, Homo sapiens
aaccaagccuuggcucguucuc

SEQ ID NO: 1928919 - RNA, 16 nt, Homo sapiens
cuaguaugggguggga

SEQ ID NO: 1928920 - RNA, 15 nt, Homo sapiens
aucugggucaaucca

SEQ ID NO: 1928921 - RNA, 12 nt, Homo sapiens
ccuucccagugg

SEQ ID NO: 1928922 - RNA, 17 nt, Homo sapiens
aagcgugagccacugca

SEQ ID NO: 1928923 - RNA, 17 nt, Homo sapiens
gaucaaaagugauuuua

SEQ ID NO: 1928924 - RNA, 19 nt, Homo sapiens
guugaccaggcuggucuca

SEQ ID NO: 1928925 - RNA, 22 nt, Homo sapiens
ugggaacacaaugccuacuuca

SEQ ID NO: 1928926 - RNA, 23 nt, Homo sapiens
auagucaccugcuguuggaugca

SEQ ID NO: 1928927 - RNA, 22 nt, Homo sapiens
aaauuaaugguuuauucuuugc

SEQ ID NO: 1928928 - RNA, 14 nt, Homo sapiens
cuuugauguuccuu

SEQ ID NO: 1928929 - RNA, 14 nt, Homo sapiens
ucauccccugugaa

SEQ ID NO: 1928930 - RNA, 14 nt, Homo sapiens
agccuagauaugaa

SEQ ID NO: 1928931 - RNA, 16 nt, Homo sapiens
uguuggggcaguggua

SEQ ID NO: 1928932 - RNA, 22 nt, Homo sapiens
ugggcauuccuugggacucagg

SEQ ID NO: 1928933 - RNA, 19 nt, Homo sapiens
auguaauauauuguacaaa

SEQ ID NO: 1928934 - RNA, 13 nt, Homo sapiens
guauauacauaug

SEQ ID NO: 1928935 - RNA, 15 nt, Homo sapiens
gaggugcagcuggag

SEQ ID NO: 1928936 - RNA, 18 nt, Homo sapiens
uccaucagagaugacucu

SEQ ID NO: 1928937 - RNA, 13 nt, Homo sapiens
gauuucacugaca

SEQ ID NO: 1928938 - RNA, 17 nt, Homo sapiens
uucuaguccuggaugac

SEQ ID NO: 1928939 - RNA, 21 nt, Homo sapiens
gcacggagggcagucccgggu

SEQ ID NO: 1928940 - RNA, 14 nt, Homo sapiens
uuuuuaagcucaaa

SEQ ID NO: 1928941 - RNA, 15 nt, Homo sapiens
cucuuugcuaguacc

SEQ ID NO: 1928942 - RNA, 11 nt, Homo sapiens
aaguugcucac

SEQ ID NO: 1928943 - RNA, 16 nt, Homo sapiens
agacaacaguugcaca

SEQ ID NO: 1928944 - RNA, 19 nt, Homo sapiens
aaacuuccaagaccugacu

SEQ ID NO: 1928945 - RNA, 23 nt, Homo sapiens
gauaccuguuccuuuuucugggu

SEQ ID NO: 1928946 - RNA, 15 nt, Homo sapiens
aauaaugacuaaaga

SEQ ID NO: 1928947 - RNA, 18 nt, Homo sapiens
acauugcagcaagcaaua

SEQ ID NO: 1928948 - RNA, 22 nt, Homo sapiens
uucacggaaagugccugcaaaa

SEQ ID NO: 1928949 - RNA, 19 nt, Homo sapiens
guucugcauggauucagca

SEQ ID NO: 1928950 - RNA, 16 nt, Homo sapiens
aagugauccucaggca

SEQ ID NO: 1928951 - RNA, 19 nt, Homo sapiens
aguggucucuacuguggca

SEQ ID NO: 1928952 - RNA, 16 nt, Homo sapiens
ugugaauaaagugcug

SEQ ID NO: 1928953 - RNA, 23 nt, Homo sapiens
aaccgaagggacuggaucugcag

SEQ ID NO: 1928954 - RNA, 16 nt, Homo sapiens
aacacuuugagcauuu

SEQ ID NO: 1928955 - RNA, 16 nt, Homo sapiens
aacaaaaggagccaag

SEQ ID NO: 1928956 - RNA, 15 nt, Homo sapiens
guguguucucaguga

SEQ ID NO: 1928957 - RNA, 20 nt, Homo sapiens
uuucugaucauugguuucuu

SEQ ID NO: 1928958 - RNA, 13 nt, Homo sapiens
gaguguguggucu

SEQ ID NO: 1928959 - RNA, 15 nt, Homo sapiens
aagcccuacucggau

SEQ ID NO: 1928960 - RNA, 22 nt, Homo sapiens
aagaccuucguauccccucuca

SEQ ID NO: 1928961 - RNA, 22 nt, Homo sapiens
agggagaucuuggggugcagca

SEQ ID NO: 1928962 - RNA, 22 nt, Homo sapiens
agagcugggggcugagggagac

SEQ ID NO: 1928963 - RNA, 22 nt, Homo sapiens
uaaauaguauuugagaguucua

SEQ ID NO: 1928964 - RNA, 11 nt, Homo sapiens
caauuguguag

SEQ ID NO: 1928965 - RNA, 22 nt, Homo sapiens
uauuguauuuauuccauauuca

SEQ ID NO: 1928966 - RNA, 23 nt, Homo sapiens
cuuauuccccugcccagguguga

SEQ ID NO: 1928967 - RNA, 15 nt, Homo sapiens
gugggccuggcagga

SEQ ID NO: 1928968 - RNA, 22 nt, Homo sapiens
acuacaucugggacugacuuuc

SEQ ID NO: 1928969 - RNA, 23 nt, Homo sapiens
gccauguugugccucccugguga

SEQ ID NO: 1928970 - RNA, 22 nt, Homo sapiens
ugcaauaaaaaaauuacccuga

SEQ ID NO: 1928971 - RNA, 15 nt, Homo sapiens
uuuuaaggauguugc

SEQ ID NO: 1928972 - RNA, 23 nt, Homo sapiens
uggagaugucucuguguguuugu

SEQ ID NO: 1928973 - RNA, 18 nt, Homo sapiens
caccugggccccacugga

SEQ ID NO: 1928974 - RNA, 11 nt, Homo sapiens
guaacuugaaa

SEQ ID NO: 1928975 - RNA, 16 nt, Homo sapiens
auaauuuuccugugac

SEQ ID NO: 1928976 - RNA, 14 nt, Homo sapiens
uucagacacuuugg

SEQ ID NO: 1928977 - RNA, 19 nt, Homo sapiens
ugaagaaguuauaccuucc

SEQ ID NO: 1928978 - RNA, 13 nt, Homo sapiens
uugucacugcugu

SEQ ID NO: 1928979 - RNA, 15 nt, Homo sapiens
cugcgagcauuuccc

SEQ ID NO: 1928980 - RNA, 22 nt, Homo sapiens
auuucagggucuuggcugccug

SEQ ID NO: 1928981 - RNA, 15 nt, Homo sapiens
aagaugacauugcua

SEQ ID NO: 1928982 - RNA, 12 nt, Homo sapiens
cuacacugccuu

SEQ ID NO: 1928983 - RNA, 20 nt, Homo sapiens
ugaggcaaccacaggcagca

SEQ ID NO: 1928984 - RNA, 23 nt, Homo sapiens
ucauuccccugaugggcccugac

SEQ ID NO: 1928985 - RNA, 16 nt, Homo sapiens
aauugaacuaaaucca

SEQ ID NO: 1928986 - RNA, 19 nt, Homo sapiens
acugucagaauaaagaaca

SEQ ID NO: 1928987 - RNA, 12 nt, Homo sapiens
uguuaccuuaaa

SEQ ID NO: 1928988 - RNA, 18 nt, Homo sapiens
guagagcucuacugccuc

SEQ ID NO: 1928989 - RNA, 17 nt, Homo sapiens
agauguuuuaguuuaaa

SEQ ID NO: 1928990 - RNA, 22 nt, Homo sapiens
uucagagucagccaggaccaua

SEQ ID NO: 1928991 - RNA, 18 nt, Homo sapiens
auaaugguuuuuaauguc

SEQ ID NO: 1928992 - RNA, 15 nt, Homo sapiens
cuagacagauccccg

SEQ ID NO: 1928993 - RNA, 19 nt, Homo sapiens
agucauuugcugagcaugu

SEQ ID NO: 1928994 - RNA, 13 nt, Homo sapiens
ugugcaacaaaca

SEQ ID NO: 1928995 - RNA, 14 nt, Homo sapiens
acuaaaauaguuua

SEQ ID NO: 1928996 - RNA, 14 nt, Homo sapiens
acauagauagaaug

SEQ ID NO: 1928997 - RNA, 14 nt, Homo sapiens
aguaucauacuuac

SEQ ID NO: 1928998 - RNA, 15 nt, Homo sapiens
cugucccacugggac

SEQ ID NO: 1928999 - RNA, 15 nt, Homo sapiens
cauugaaacaugcca

SEQ ID NO: 1929000 - RNA, 18 nt, Homo sapiens
cucuaaaacccuguguuc

SEQ ID NO: 1929001 - RNA, 22 nt, Homo sapiens
ucagaggaaggacuuuggcaag

SEQ ID NO: 1929002 - RNA, 13 nt, Homo sapiens
cuguauuaacuga

SEQ ID NO: 1929003 - RNA, 17 nt, Homo sapiens
aaggcuggggccagugu

SEQ ID NO: 1929004 - RNA, 20 nt, Homo sapiens
uccuguccaaccuaaccccu

SEQ ID NO: 1929005 - RNA, 19 nt, Homo sapiens
ugguggguaauuguacaau

SEQ ID NO: 1929006 - RNA, 17 nt, Homo sapiens
caucucagacuguggaa

SEQ ID NO: 1929007 - RNA, 16 nt, Homo sapiens
gcaaaggcgucugaau

SEQ ID NO: 1929008 - RNA, 19 nt, Homo sapiens
auuuguaaaugucugacuu

SEQ ID NO: 1929009 - RNA, 15 nt, Homo sapiens
gcaaagagugugcuc

SEQ ID NO: 1929010 - RNA, 15 nt, Homo sapiens
auaaaaauggcauuu

SEQ ID NO: 1929011 - RNA, 18 nt, Homo sapiens
cagugcucuuuguagcua

SEQ ID NO: 1929012 - RNA, 18 nt, Homo sapiens
cugaaaagcugcauuuaa

SEQ ID NO: 1929013 - RNA, 22 nt, Homo sapiens
gcccagcagagguuugcugaca

SEQ ID NO: 1929014 - RNA, 14 nt, Homo sapiens
caucuacccaucua

SEQ ID NO: 1929015 - RNA, 14 nt, Homo sapiens
aaccaaccaaccaa

SEQ ID NO: 1929016 - RNA, 15 nt, Homo sapiens
guauccucgcuggug

SEQ ID NO: 1929017 - RNA, 20 nt, Homo sapiens
ugucagaaaauaacagaugc

SEQ ID NO: 1929018 - RNA, 17 nt, Homo sapiens
gaauucugucauuucaa

SEQ ID NO: 1929019 - RNA, 18 nt, Homo sapiens
guggcccagagaagccaa

SEQ ID NO: 1929020 - RNA, 18 nt, Homo sapiens
ucuaaaugauuaucuuga

SEQ ID NO: 1929021 - RNA, 19 nt, Homo sapiens
auauuugaaucuuucuuac

SEQ ID NO: 1929022 - RNA, 17 nt, Homo sapiens
agcacuuugcacuuaau

SEQ ID NO: 1929023 - RNA, 17 nt, Homo sapiens
gacccuggaacuggaga

SEQ ID NO: 1929024 - RNA, 18 nt, Homo sapiens
gaucacuugaguucagga

SEQ ID NO: 1929025 - RNA, 14 nt, Homo sapiens
gccugccuaugaaa

SEQ ID NO: 1929026 - RNA, 17 nt, Homo sapiens
gcuuauuauagaauugc

SEQ ID NO: 1929027 - RNA, 16 nt, Homo sapiens
ugucauuccaguuuga

SEQ ID NO: 1929028 - RNA, 21 nt, Homo sapiens
uauuuuuagacagagucucac

SEQ ID NO: 1929029 - RNA, 14 nt, Homo sapiens
ucaaaugugcaucc

SEQ ID NO: 1929030 - RNA, 18 nt, Homo sapiens
cucucugcaccugucuca

SEQ ID NO: 1929031 - RNA, 14 nt, Homo sapiens
acaauaguucugug

SEQ ID NO: 1929032 - RNA, 17 nt, Homo sapiens
ugcagacacaucagcug

SEQ ID NO: 1929033 - RNA, 18 nt, Homo sapiens
gcauuuuuauaaacaaaa

SEQ ID NO: 1929034 - RNA, 22 nt, Homo sapiens
caagaaacaugaaaucugcuuc

SEQ ID NO: 1929035 - RNA, 17 nt, Homo sapiens
aucaccugaaacacugg

SEQ ID NO: 1929036 - RNA, 15 nt, Homo sapiens
guaucccuuauccaa

SEQ ID NO: 1929037 - RNA, 21 nt, Homo sapiens
uaagggcuuguuuuucuucag

SEQ ID NO: 1929038 - RNA, 21 nt, Homo sapiens
ggcugacaccuaccaugcugc

SEQ ID NO: 1929039 - RNA, 14 nt, Homo sapiens
gcagauguggugau

SEQ ID NO: 1929040 - RNA, 21 nt, Homo sapiens
uucuagagaguugcugaccaa

SEQ ID NO: 1929041 - RNA, 20 nt, Homo sapiens
caaaugaugaagaccaaaga

SEQ ID NO: 1929042 - RNA, 13 nt, Homo sapiens
ccuuuguaguuaa

SEQ ID NO: 1929043 - RNA, 11 nt, Homo sapiens
cccuuccccac

SEQ ID NO: 1929044 - RNA, 11 nt, Homo sapiens
ccuuuccccau

SEQ ID NO: 1929045 - RNA, 13 nt, Homo sapiens
guuucacugugca

SEQ ID NO: 1929046 - RNA, 21 nt, Homo sapiens
guauuuuuuccuuaagagcua

SEQ ID NO: 1929047 - RNA, 13 nt, Homo sapiens
ggguaacacugau

SEQ ID NO: 1929048 - RNA, 16 nt, Homo sapiens
cuacugaaauuaucau

SEQ ID NO: 1929049 - RNA, 16 nt, Homo sapiens
uucuugcuaauucuca

SEQ ID NO: 1929050 - RNA, 17 nt, Homo sapiens
gcccgagggucccaagg

SEQ ID NO: 1929051 - RNA, 20 nt, Homo sapiens
ccauucaucccacccucuca

SEQ ID NO: 1929052 - RNA, 16 nt, Homo sapiens
cuuugccuuagcuuug

SEQ ID NO: 1929053 - RNA, 21 nt, Homo sapiens
cuugaggcacagaaacuccug

SEQ ID NO: 1929054 - RNA, 16 nt, Homo sapiens
cuccugacccugugau

SEQ ID NO: 1929055 - RNA, 22 nt, Homo sapiens
cauaacggaaaaauaauugcca

SEQ ID NO: 1929056 - RNA, 19 nt, Homo sapiens
uauugguuugagaacuucu

SEQ ID NO: 1929057 - RNA, 22 nt, Homo sapiens
auaaaugcaugauuuuauacau

SEQ ID NO: 1929058 - RNA, 19 nt, Homo sapiens
gcaaaauuaaauacauaaa

SEQ ID NO: 1929059 - RNA, 12 nt, Homo sapiens
gguuucagcacu

SEQ ID NO: 1929060 - RNA, 18 nt, Homo sapiens
gaauaaaucaaauauucc

SEQ ID NO: 1929061 - RNA, 18 nt, Homo sapiens
ugagaaaucaugccuagu

SEQ ID NO: 1929062 - RNA, 11 nt, Homo sapiens
uuugggagaca

SEQ ID NO: 1929063 - RNA, 23 nt, Homo sapiens
ggccuccuucaccaaagaucugc

SEQ ID NO: 1929064 - RNA, 19 nt, Homo sapiens
aucauacaaauacuaucca

SEQ ID NO: 1929065 - RNA, 18 nt, Homo sapiens
uaaagauggggaaacuaa

SEQ ID NO: 1929066 - RNA, 21 nt, Homo sapiens
agacagcauuuguguguuaca

SEQ ID NO: 1929067 - RNA, 14 nt, Homo sapiens
cccuggcacuggca

SEQ ID NO: 1929068 - RNA, 22 nt, Homo sapiens
cucacacggacacucaaaagcu

SEQ ID NO: 1929069 - RNA, 15 nt, Homo sapiens
gcaggagaucaucug

SEQ ID NO: 1929070 - RNA, 15 nt, Homo sapiens
ucuugagagcugcug

SEQ ID NO: 1929071 - RNA, 17 nt, Homo sapiens
aagagcgucauguccuu

SEQ ID NO: 1929072 - RNA, 19 nt, Homo sapiens
gacuggacagaucugagga

SEQ ID NO: 1929073 - RNA, 23 nt, Homo sapiens
ggcccuacccuccugcugagcug

SEQ ID NO: 1929074 - RNA, 19 nt, Homo sapiens
cauggcuuuggcuuugcaa

SEQ ID NO: 1929075 - RNA, 16 nt, Homo sapiens
agcaugaauccagucc

SEQ ID NO: 1929076 - RNA, 13 nt, Homo sapiens
cacaaacugugaa

SEQ ID NO: 1929077 - RNA, 15 nt, Homo sapiens
uccauguguaucugg

SEQ ID NO: 1929078 - RNA, 19 nt, Homo sapiens
gugcccaggaagagccauu

SEQ ID NO: 1929079 - RNA, 20 nt, Homo sapiens
uaauaauguauguacagcug

SEQ ID NO: 1929080 - RNA, 16 nt, Homo sapiens
gccuuugaccccagca

SEQ ID NO: 1929081 - RNA, 17 nt, Homo sapiens
uagauuauuucauauac

SEQ ID NO: 1929082 - RNA, 13 nt, Homo sapiens
gagcaugaccuga

SEQ ID NO: 1929083 - RNA, 22 nt, Homo sapiens
uggccuggauucacgcccucuu

SEQ ID NO: 1929084 - RNA, 21 nt, Homo sapiens
agcuguccuugagcuguccua

SEQ ID NO: 1929085 - RNA, 23 nt, Homo sapiens
gcucuuucucugagaaccaaaag

SEQ ID NO: 1929086 - RNA, 19 nt, Homo sapiens
agccuggccccggccuuua

SEQ ID NO: 1929087 - RNA, 21 nt, Homo sapiens
cgcaaggugguagcaggaaaa

SEQ ID NO: 1929088 - RNA, 19 nt, Homo sapiens
ucugaggguccacuacuca

SEQ ID NO: 1929089 - RNA, 21 nt, Homo sapiens
caaugucuggagaccaccagg

SEQ ID NO: 1929090 - RNA, 23 nt, Homo sapiens
auucacgcuguuuguuucauaua

SEQ ID NO: 1929091 - RNA, 16 nt, Homo sapiens
agguggaaaaacugag

SEQ ID NO: 1929092 - RNA, 22 nt, Homo sapiens
uggccagccuggaucuccucaa

SEQ ID NO: 1929093 - RNA, 19 nt, Homo sapiens
agggauauuuaacuggagc

SEQ ID NO: 1929094 - RNA, 20 nt, Homo sapiens
uacaauuuaaugcacuaaaa

SEQ ID NO: 1929095 - RNA, 23 nt, Homo sapiens
acaaucuuugcuguauacuuuua

SEQ ID NO: 1929096 - RNA, 13 nt, Homo sapiens
aagcccuuugcca

SEQ ID NO: 1929097 - RNA, 16 nt, Homo sapiens
auaguggauccacuuu

SEQ ID NO: 1929098 - RNA, 15 nt, Homo sapiens
auaguugcuugccug

SEQ ID NO: 1929099 - RNA, 15 nt, Homo sapiens
auagccacuugcuca

SEQ ID NO: 1929100 - RNA, 24 nt, Homo sapiens
cucaugggaagcauguggaugaca

SEQ ID NO: 1929101 - RNA, 23 nt, Homo sapiens
aaaguuuuauaacuuguguuauu

SEQ ID NO: 1929102 - RNA, 20 nt, Homo sapiens
ggcagugugcggagcugaua

SEQ ID NO: 1929103 - RNA, 15 nt, Homo sapiens
cugaaaaagacauaa

SEQ ID NO: 1929104 - RNA, 12 nt, Homo sapiens
gauuacuuguaa

SEQ ID NO: 1929105 - RNA, 16 nt, Homo sapiens
auuucugaauucaaag

SEQ ID NO: 1929106 - RNA, 15 nt, Homo sapiens
gacuucuagcugucu

SEQ ID NO: 1929107 - RNA, 16 nt, Homo sapiens
auaugaucggccauca

SEQ ID NO: 1929108 - RNA, 13 nt, Homo sapiens
agucaugaagcuc

SEQ ID NO: 1929109 - RNA, 13 nt, Homo sapiens
agcucugaaguca

SEQ ID NO: 1929110 - RNA, 14 nt, Homo sapiens
acagaguacgugaa

SEQ ID NO: 1929111 - RNA, 20 nt, Homo sapiens
ucaccacgugcaguaucuca

SEQ ID NO: 1929112 - RNA, 13 nt, Homo sapiens
auacccaucuagg

SEQ ID NO: 1929113 - RNA, 12 nt, Homo sapiens
gaagaucuggcc

SEQ ID NO: 1929114 - RNA, 20 nt, Homo sapiens
aauucuuuguauaugcauuc

SEQ ID NO: 1929115 - RNA, 16 nt, Homo sapiens
cacccccuuguuguaa

SEQ ID NO: 1929116 - RNA, 21 nt, Homo sapiens
ccuuaaaggggagaccucaga

SEQ ID NO: 1929117 - RNA, 21 nt, Homo sapiens
acacccugcuucucccgggga

SEQ ID NO: 1929118 - RNA, 18 nt, Homo sapiens
guaggggaagugugcuga

SEQ ID NO: 1929119 - RNA, 18 nt, Homo sapiens
cuuaaaauuagugagauu

SEQ ID NO: 1929120 - RNA, 16 nt, Homo sapiens
ugccgcuacaaaaagg

SEQ ID NO: 1929121 - RNA, 22 nt, Homo sapiens
caaguguuaaggcaacauuccu

SEQ ID NO: 1929122 - RNA, 21 nt, Homo sapiens
guaaaucauauuuuagcugca

SEQ ID NO: 1929123 - RNA, 15 nt, Homo sapiens
gugagcacuaaggug

SEQ ID NO: 1929124 - RNA, 20 nt, Homo sapiens
cagaggcuuccguguccucu

SEQ ID NO: 1929125 - RNA, 23 nt, Homo sapiens
ccuggauuccucgaaacugccau

SEQ ID NO: 1929126 - RNA, 17 nt, Homo sapiens
cuccccaccaaccaaga

SEQ ID NO: 1929127 - RNA, 18 nt, Homo sapiens
uccaugcugagaacaaaa

SEQ ID NO: 1929128 - RNA, 23 nt, Homo sapiens
cagugauggcgcgggaggcacca

SEQ ID NO: 1929129 - RNA, 21 nt, Homo sapiens
cacauagcgccgugcuguaaa

SEQ ID NO: 1929130 - RNA, 21 nt, Homo sapiens
cuuuuuuuuccccaaguauua

SEQ ID NO: 1929131 - RNA, 19 nt, Homo sapiens
ggccccugcgugggggcca

SEQ ID NO: 1929132 - RNA, 14 nt, Homo sapiens
uggauuacaguaug

SEQ ID NO: 1929133 - RNA, 20 nt, Homo sapiens
uugggaauucuugcuguuaa

SEQ ID NO: 1929134 - RNA, 18 nt, Homo sapiens
caugaugagaaauggaug

SEQ ID NO: 1929135 - RNA, 13 nt, Homo sapiens
ccagagaacacag

SEQ ID NO: 1929136 - RNA, 20 nt, Homo sapiens
gcgagaacccucaacugaca

SEQ ID NO: 1929137 - RNA, 13 nt, Homo sapiens
gucuucuaaacuu

SEQ ID NO: 1929138 - RNA, 14 nt, Homo sapiens
cucugcucuugccu

SEQ ID NO: 1929139 - RNA, 19 nt, Homo sapiens
gugucacggccaggcagau

SEQ ID NO: 1929140 - RNA, 22 nt, Homo sapiens
cauaacuucauagaugcaggag

SEQ ID NO: 1929141 - RNA, 23 nt, Homo sapiens
acccaggcuauucggcaaggaag

SEQ ID NO: 1929142 - RNA, 14 nt, Homo sapiens
uccagcagauuucc

SEQ ID NO: 1929143 - RNA, 14 nt, Homo sapiens
cugggacuacagau

SEQ ID NO: 1929144 - RNA, 11 nt, Homo sapiens
cuuugcuuacc

SEQ ID NO: 1929145 - RNA, 11 nt, Homo sapiens
cucugcuuacu

SEQ ID NO: 1929146 - RNA, 14 nt, Homo sapiens
agccuggcccuccu

SEQ ID NO: 1929147 - RNA, 21 nt, Homo sapiens
cuucaguaaaugugauucacc

SEQ ID NO: 1929148 - RNA, 19 nt, Homo sapiens
aaugucuccuuugcucuug

SEQ ID NO: 1929149 - RNA, 13 nt, Homo sapiens
uaucacgcagauc

SEQ ID NO: 1929150 - RNA, 15 nt, Homo sapiens
agggagaagcaugaa

SEQ ID NO: 1929151 - RNA, 18 nt, Homo sapiens
gucacaucaagcaucauu

SEQ ID NO: 1929152 - RNA, 17 nt, Homo sapiens
auacguuaggaggacaa

SEQ ID NO: 1929153 - RNA, 15 nt, Homo sapiens
aggacuuuaucugaa

SEQ ID NO: 1929154 - RNA, 19 nt, Homo sapiens
agccucgcaacccgugcca

SEQ ID NO: 1929155 - RNA, 16 nt, Homo sapiens
uggaaggacacaguga

SEQ ID NO: 1929156 - RNA, 16 nt, Homo sapiens
acauguacaugcauuu

SEQ ID NO: 1929157 - RNA, 22 nt, Homo sapiens
uaccacacugaguucuaucagu

SEQ ID NO: 1929158 - RNA, 16 nt, Homo sapiens
cauaaagcacuaccua

SEQ ID NO: 1929159 - RNA, 22 nt, Homo sapiens
agcuuauaagagggcauauaca

SEQ ID NO: 1929160 - RNA, 17 nt, Homo sapiens
cauuuuacauauggaaa

SEQ ID NO: 1929161 - RNA, 21 nt, Homo sapiens
cccuguaaguuacagucacaa

SEQ ID NO: 1929162 - RNA, 17 nt, Homo sapiens
uaccaaaugaaaugcca

SEQ ID NO: 1929163 - RNA, 22 nt, Homo sapiens
caagcccaguuguugcagugau

SEQ ID NO: 1929164 - RNA, 18 nt, Homo sapiens
cauuuuaagugcuucaca

SEQ ID NO: 1929165 - RNA, 18 nt, Homo sapiens
ggucagggggcacugucu

SEQ ID NO: 1929166 - RNA, 18 nt, Homo sapiens
ccgaccucaggugaucca

SEQ ID NO: 1929167 - RNA, 19 nt, Homo sapiens
auaucagugcucgagacac

SEQ ID NO: 1929168 - RNA, 18 nt, Homo sapiens
cuugccuaucugacuuca

SEQ ID NO: 1929169 - RNA, 16 nt, Homo sapiens
aauauuaacauaagaa

SEQ ID NO: 1929170 - RNA, 19 nt, Homo sapiens
agguuucagcaacaagacu

SEQ ID NO: 1929171 - RNA, 17 nt, Homo sapiens
cccagccaccaccacug

SEQ ID NO: 1929172 - RNA, 16 nt, Homo sapiens
acagucauacaaguca

SEQ ID NO: 1929173 - RNA, 18 nt, Homo sapiens
aauuugcaacaguaauca

SEQ ID NO: 1929174 - RNA, 19 nt, Homo sapiens
auaauaccuuucuaaggga

SEQ ID NO: 1929175 - RNA, 15 nt, Homo sapiens
guggacaccauugga

SEQ ID NO: 1929176 - RNA, 15 nt, Homo sapiens
gcauuuggcauuuau

SEQ ID NO: 1929177 - RNA, 13 nt, Homo sapiens
auucccaccaagg

SEQ ID NO: 1929178 - RNA, 20 nt, Homo sapiens
ugaaaaacuaaugugucuca

SEQ ID NO: 1929179 - RNA, 16 nt, Homo sapiens
guacauuugagccaug

SEQ ID NO: 1929180 - RNA, 19 nt, Homo sapiens
ccaggaaagaagaguugga

SEQ ID NO: 1929181 - RNA, 16 nt, Homo sapiens
agagagcaccacguga

SEQ ID NO: 1929182 - RNA, 12 nt, Homo sapiens
gcacagccaccc

SEQ ID NO: 1929183 - RNA, 21 nt, Homo sapiens
cagggucugggcugggcaccu

SEQ ID NO: 1929184 - RNA, 15 nt, Homo sapiens
auccuuccuacuuug

SEQ ID NO: 1929185 - RNA, 20 nt, Homo sapiens
ucaagaccagccugggcaac

SEQ ID NO: 1929186 - RNA, 22 nt, Homo sapiens
cuaaguagaccaaaucuuguua

SEQ ID NO: 1929187 - RNA, 12 nt, Homo sapiens
cugucaaacaaa

SEQ ID NO: 1929188 - RNA, 15 nt, Homo sapiens
cucuggggugcugcc

SEQ ID NO: 1929189 - RNA, 19 nt, Homo sapiens
auuuuuuuguuuucaaaaa

SEQ ID NO: 1929190 - RNA, 14 nt, Homo sapiens
ucuguuucaaugua

SEQ ID NO: 1929191 - RNA, 18 nt, Homo sapiens
gaauacuuacauucucua

SEQ ID NO: 1929192 - RNA, 23 nt, Homo sapiens
uaaauuugggggacuuacaugau

SEQ ID NO: 1929193 - RNA, 20 nt, Homo sapiens
acauuuauauaauacauuaa

SEQ ID NO: 1929194 - RNA, 15 nt, Homo sapiens
auguacauguacuga

SEQ ID NO: 1929195 - RNA, 22 nt, Homo sapiens
augcuuuaaugucuaaccaaga

SEQ ID NO: 1929196 - RNA, 14 nt, Homo sapiens
gccagugcacuccg

SEQ ID NO: 1929197 - RNA, 11 nt, Homo sapiens
aauaaagugac

SEQ ID NO: 1929198 - RNA, 22 nt, Homo sapiens
aggaauuugaagcucagaaagg

SEQ ID NO: 1929199 - RNA, 16 nt, Homo sapiens
auugcauccacuagcu

SEQ ID NO: 1929200 - RNA, 20 nt, Homo sapiens
agccgagaucgcgccacugu

SEQ ID NO: 1929201 - RNA, 21 nt, Homo sapiens
auguccucacucucgccaucu

SEQ ID NO: 1929202 - RNA, 14 nt, Homo sapiens
aauaagagugauua

SEQ ID NO: 1929203 - RNA, 18 nt, Homo sapiens
gcuuaaauaggaaaguuu

SEQ ID NO: 1929204 - RNA, 23 nt, Homo sapiens
acauugcuuaaaauauauaguga

SEQ ID NO: 1929205 - RNA, 20 nt, Homo sapiens
caauucaguggacuauaaua

SEQ ID NO: 1929206 - RNA, 18 nt, Homo sapiens
gaucaguuuuccuagucu

SEQ ID NO: 1929207 - RNA, 15 nt, Homo sapiens
gcauguugccaugag

SEQ ID NO: 1929208 - RNA, 17 nt, Homo sapiens
ggccgcccugcggguga

SEQ ID NO: 1929209 - RNA, 14 nt, Homo sapiens
ggaccugguacaaa

SEQ ID NO: 1929210 - RNA, 19 nt, Homo sapiens
gaaggcaagagggggugga

SEQ ID NO: 1929211 - RNA, 22 nt, Homo sapiens
cucaaccuccuguggaacccag

SEQ ID NO: 1929212 - RNA, 20 nt, Homo sapiens
acuacccagauccauucccu

SEQ ID NO: 1929213 - RNA, 20 nt, Homo sapiens
cccauuuuugcuuagcucaa

SEQ ID NO: 1929214 - RNA, 20 nt, Homo sapiens
aggugaaaugaagcaacaga

SEQ ID NO: 1929215 - RNA, 21 nt, Homo sapiens
cacugucccuaccacugagcc

SEQ ID NO: 1929216 - RNA, 13 nt, Homo sapiens
guggccugggauc

SEQ ID NO: 1929217 - RNA, 12 nt, Homo sapiens
uaagugcugcua

SEQ ID NO: 1929218 - RNA, 22 nt, Homo sapiens
uggugaggaagccccaagccau

SEQ ID NO: 1929219 - RNA, 23 nt, Homo sapiens
auuuuuguaaauaaauuucccaa

SEQ ID NO: 1929220 - RNA, 16 nt, Homo sapiens
ccuuaaucuauuuuca

SEQ ID NO: 1929221 - RNA, 23 nt, Homo sapiens
aaaaccuuauuuuuucuuucuug

SEQ ID NO: 1929222 - RNA, 15 nt, Homo sapiens
gaaaggggcccaguc

SEQ ID NO: 1929223 - RNA, 18 nt, Homo sapiens
cuucaccauggauccugg

SEQ ID NO: 1929224 - RNA, 17 nt, Homo sapiens
ucucuugucucacaugc

SEQ ID NO: 1929225 - RNA, 17 nt, Homo sapiens
guccaaacucagugcug

SEQ ID NO: 1929226 - RNA, 15 nt, Homo sapiens
uaagcuagcaaauag

SEQ ID NO: 1929227 - RNA, 17 nt, Homo sapiens
guucuuugugucaacau

SEQ ID NO: 1929228 - RNA, 13 nt, Homo sapiens
uguguaagacacu

SEQ ID NO: 1929229 - RNA, 16 nt, Homo sapiens
cccuucuaggcaucuc

SEQ ID NO: 1929230 - RNA, 19 nt, Homo sapiens
uagagcacuuuucacuuau

SEQ ID NO: 1929231 - RNA, 13 nt, Homo sapiens
acacauuugccca

SEQ ID NO: 1929232 - RNA, 22 nt, Homo sapiens
auaagcacuagaucucccuuaa

SEQ ID NO: 1929233 - RNA, 22 nt, Homo sapiens
ucuccagcauucucagccacaa

SEQ ID NO: 1929234 - RNA, 14 nt, Homo sapiens
ucuucucucuugau

SEQ ID NO: 1929235 - RNA, 14 nt, Homo sapiens
cacccaaaagucaa

SEQ ID NO: 1929236 - RNA, 18 nt, Homo sapiens
auggcaacagaaaccaag

SEQ ID NO: 1929237 - RNA, 12 nt, Homo sapiens
ugugcugcucaa

SEQ ID NO: 1929238 - RNA, 20 nt, Homo sapiens
gauuagcucuggaccagccu

SEQ ID NO: 1929239 - RNA, 23 nt, Homo sapiens
ugagaucacuaaauaagcuucca

SEQ ID NO: 1929240 - RNA, 21 nt, Homo sapiens
cucagagaguacucgcagggg

SEQ ID NO: 1929241 - RNA, 18 nt, Homo sapiens
cucacacucgacaugaaa

SEQ ID NO: 1929242 - RNA, 19 nt, Homo sapiens
cauuaaaguuaaacuguau

SEQ ID NO: 1929243 - RNA, 20 nt, Homo sapiens
ggaccagagggaugggagag

SEQ ID NO: 1929244 - RNA, 12 nt, Homo sapiens
caggugaugcuc

SEQ ID NO: 1929245 - RNA, 16 nt, Homo sapiens
acccugggaucucagg

SEQ ID NO: 1929246 - RNA, 23 nt, Homo sapiens
ucuuuaaaagauauaagacuuaa

SEQ ID NO: 1929247 - RNA, 22 nt, Homo sapiens
aaauggaacuaucuccaaauuu

SEQ ID NO: 1929248 - RNA, 23 nt, Homo sapiens
aauguuuauuuagcucugaagca

SEQ ID NO: 1929249 - RNA, 19 nt, Homo sapiens
auuaaauggaauaauauga

SEQ ID NO: 1929250 - RNA, 22 nt, Homo sapiens
acacauuauaaagaauacaaaa

SEQ ID NO: 1929251 - RNA, 16 nt, Homo sapiens
aauuugucgcaaagac

SEQ ID NO: 1929252 - RNA, 18 nt, Homo sapiens
ucuuaagcagcauggaaa

SEQ ID NO: 1929253 - RNA, 13 nt, Homo sapiens
gagaccaagaaca

SEQ ID NO: 1929254 - RNA, 12 nt, Homo sapiens
gaccuaccuccc

SEQ ID NO: 1929255 - RNA, 12 nt, Homo sapiens
gauuuaccucuu

SEQ ID NO: 1929256 - RNA, 20 nt, Homo sapiens
agucauuccaagaacuauaa

SEQ ID NO: 1929257 - RNA, 18 nt, Homo sapiens
uggaguguaagugcuuca

SEQ ID NO: 1929258 - RNA, 20 nt, Homo sapiens
cucuacucacagcugaagaa

SEQ ID NO: 1929259 - RNA, 19 nt, Homo sapiens
uguccuuuguguccauuga

SEQ ID NO: 1929260 - RNA, 12 nt, Homo sapiens
aguaaacuugaa

SEQ ID NO: 1929261 - RNA, 13 nt, Homo sapiens
agaugcagucucu

SEQ ID NO: 1929262 - RNA, 22 nt, Homo sapiens
aggaaauaccaguucugggcaa

SEQ ID NO: 1929263 - RNA, 13 nt, Homo sapiens
aguugcagucacu

SEQ ID NO: 1929264 - RNA, 15 nt, Homo sapiens
gugaagcagccuuac

SEQ ID NO: 1929265 - RNA, 22 nt, Homo sapiens
cuguugggacuugggauucuga

SEQ ID NO: 1929266 - RNA, 22 nt, Homo sapiens
auccuccacugacuuccuccca

SEQ ID NO: 1929267 - RNA, 15 nt, Homo sapiens
uuuagucugcauugc

SEQ ID NO: 1929268 - RNA, 13 nt, Homo sapiens
cacagcacuuugg

SEQ ID NO: 1929269 - RNA, 18 nt, Homo sapiens
uuccucccuauuaaccua

SEQ ID NO: 1929270 - RNA, 22 nt, Homo sapiens
cuccaacaccaagcacagcagc

SEQ ID NO: 1929271 - RNA, 23 nt, Homo sapiens
gcaauccuucccugcucuugcag

SEQ ID NO: 1929272 - RNA, 16 nt, Homo sapiens
ggaguggaugcgauaa

SEQ ID NO: 1929273 - RNA, 21 nt, Homo sapiens
cuuaaaauaugugaaguuuuc

SEQ ID NO: 1929274 - RNA, 13 nt, Homo sapiens
uguacugccuuag

SEQ ID NO: 1929275 - RNA, 23 nt, Homo sapiens
caggaggaggugccaacaguguu

SEQ ID NO: 1929276 - RNA, 17 nt, Homo sapiens
ucguccccagaccagua

SEQ ID NO: 1929277 - RNA, 22 nt, Homo sapiens
uagagcagccugcugcucucag

SEQ ID NO: 1929278 - RNA, 22 nt, Homo sapiens
gcauagaaggaaguguguuugc

SEQ ID NO: 1929279 - RNA, 21 nt, Homo sapiens
uagauuuuuucagacuuguca

SEQ ID NO: 1929280 - RNA, 14 nt, Homo sapiens
agugacagcuugag

SEQ ID NO: 1929281 - RNA, 22 nt, Homo sapiens
cuaaauaguucuaucaggaaaa

SEQ ID NO: 1929282 - RNA, 13 nt, Homo sapiens
ggaaagguccugc

SEQ ID NO: 1929283 - RNA, 22 nt, Homo sapiens
aacaucuuuacguacuguaacu

SEQ ID NO: 1929284 - RNA, 19 nt, Homo sapiens
cuuccugaggaugggcaac

SEQ ID NO: 1929285 - RNA, 10 nt, Homo sapiens
aaagcauucu

SEQ ID NO: 1929286 - RNA, 13 nt, Homo sapiens
cugccucaggacc

SEQ ID NO: 1929287 - RNA, 11 nt, Homo sapiens
uucaugaacac

SEQ ID NO: 1929288 - RNA, 11 nt, Homo sapiens
uaaaugaacua

SEQ ID NO: 1929289 - RNA, 20 nt, Homo sapiens
cauauuuggagagaauauga

SEQ ID NO: 1929290 - RNA, 16 nt, Homo sapiens
cugugagaagugcaac

SEQ ID NO: 1929291 - RNA, 17 nt, Homo sapiens
aauuuaacuuauugcua

SEQ ID NO: 1929292 - RNA, 21 nt, Homo sapiens
agcuucagaaguuuggcaaua

SEQ ID NO: 1929293 - RNA, 18 nt, Homo sapiens
gagcugguccccucuaua

SEQ ID NO: 1929294 - RNA, 19 nt, Homo sapiens
gagcaaaucaucugcauuc

SEQ ID NO: 1929295 - RNA, 13 nt, Homo sapiens
gaaaauuauuuug

SEQ ID NO: 1929296 - RNA, 14 nt, Homo sapiens
ccugcugagaucug

SEQ ID NO: 1929297 - RNA, 23 nt, Homo sapiens
cucagcccaggccucgggaccaa

SEQ ID NO: 1929298 - RNA, 20 nt, Homo sapiens
caucggguaagaugcuccug

SEQ ID NO: 1929299 - RNA, 13 nt, Homo sapiens
cucugucucaaaa

SEQ ID NO: 1929300 - RNA, 13 nt, Homo sapiens
aaaugucuaucaa

SEQ ID NO: 1929301 - RNA, 23 nt, Homo sapiens
caccaguauggccccaccugcuc

SEQ ID NO: 1929302 - RNA, 23 nt, Homo sapiens
cauguagguaggaagcacugaaa

SEQ ID NO: 1929303 - RNA, 14 nt, Homo sapiens
acaguguugcccag

SEQ ID NO: 1929304 - RNA, 23 nt, Homo sapiens
uguuaauucuuucucauguuggg

SEQ ID NO: 1929305 - RNA, 22 nt, Homo sapiens
auuucagcaacaaccaucucau

SEQ ID NO: 1929306 - RNA, 23 nt, Homo sapiens
aaacuguacaguuucuuccccaa

SEQ ID NO: 1929307 - RNA, 17 nt, Homo sapiens
uauuauucuucauaaca

SEQ ID NO: 1929308 - RNA, 13 nt, Homo sapiens
gaauaaugaaggu

SEQ ID NO: 1929309 - RNA, 14 nt, Homo sapiens
cccaugcuuaacau

SEQ ID NO: 1929310 - RNA, 22 nt, Homo sapiens
guccuaaggcaucuaucugugc

SEQ ID NO: 1929311 - RNA, 23 nt, Homo sapiens
aagguggcuuuuagcauucugug

SEQ ID NO: 1929312 - RNA, 22 nt, Homo sapiens
uuacuuggcuuuuuacuauuaa

SEQ ID NO: 1929313 - RNA, 23 nt, Homo sapiens
acauccuccaauuccacagucuc

SEQ ID NO: 1929314 - RNA, 21 nt, Homo sapiens
aaucuguuaccagaggacaaa

SEQ ID NO: 1929315 - RNA, 17 nt, Homo sapiens
ucaggagaucgagacca

SEQ ID NO: 1929316 - RNA, 20 nt, Homo sapiens
gcugaauaaccaggggcaca

SEQ ID NO: 1929317 - RNA, 20 nt, Homo sapiens
agaagguuaccaagaagccu

SEQ ID NO: 1929318 - RNA, 16 nt, Homo sapiens
uuuccuccaaacuccu

SEQ ID NO: 1929319 - RNA, 21 nt, Homo sapiens
gcugcccuaggauaugcccuc

SEQ ID NO: 1929320 - RNA, 17 nt, Homo sapiens
aaacgguggaggccagg

SEQ ID NO: 1929321 - RNA, 21 nt, Homo sapiens
ucuccaaacagucaccauaca

SEQ ID NO: 1929322 - RNA, 14 nt, Homo sapiens
gaauguaugugcac

SEQ ID NO: 1929323 - RNA, 12 nt, Homo sapiens
ugcaauuacugc

SEQ ID NO: 1929324 - RNA, 20 nt, Homo sapiens
ugggucccggggugcauuug

SEQ ID NO: 1929325 - RNA, 14 nt, Homo sapiens
auacagcauaccac

SEQ ID NO: 1929326 - RNA, 12 nt, Homo sapiens
uccccaucucag

SEQ ID NO: 1929327 - RNA, 15 nt, Homo sapiens
agaccuuggcgcuac

SEQ ID NO: 1929328 - RNA, 21 nt, Homo sapiens
cuaggugggagagagugcaua

SEQ ID NO: 1929329 - RNA, 13 nt, Homo sapiens
ucagagugcaagc

SEQ ID NO: 1929330 - RNA, 23 nt, Homo sapiens
gcagcaccgugggcccucaagcu

SEQ ID NO: 1929331 - RNA, 19 nt, Homo sapiens
agccugcguggccuggggc

SEQ ID NO: 1929332 - RNA, 20 nt, Homo sapiens
agccccaggguuuacaugaa

SEQ ID NO: 1929333 - RNA, 11 nt, Homo sapiens
uccccuguggu

SEQ ID NO: 1929334 - RNA, 16 nt, Homo sapiens
auucuugaaguucaug

SEQ ID NO: 1929335 - RNA, 15 nt, Homo sapiens
caguuguguugacac

SEQ ID NO: 1929336 - RNA, 12 nt, Homo sapiens
uuauugaaucua

SEQ ID NO: 1929337 - RNA, 18 nt, Homo sapiens
aacaugccugcaccugca

SEQ ID NO: 1929338 - RNA, 21 nt, Homo sapiens
acauuguccuguagcuuuaaa

SEQ ID NO: 1929339 - RNA, 17 nt, Homo sapiens
ucauaaugaacacucau

SEQ ID NO: 1929340 - RNA, 14 nt, Homo sapiens
ccuuguccuggguc

SEQ ID NO: 1929341 - RNA, 16 nt, Homo sapiens
caccuaccgaguucaa

SEQ ID NO: 1929342 - RNA, 16 nt, Homo sapiens
guguucuguaaucaaa

SEQ ID NO: 1929343 - RNA, 15 nt, Homo sapiens
aagaauuacuuugug

SEQ ID NO: 1929344 - RNA, 23 nt, Homo sapiens
auuugucaagcaaauguuuaaaa

SEQ ID NO: 1929345 - RNA, 15 nt, Homo sapiens
aaucaaaacucacaa

SEQ ID NO: 1929346 - RNA, 17 nt, Homo sapiens
acaagccaacuuguaaa

SEQ ID NO: 1929347 - RNA, 14 nt, Homo sapiens
auaaaauuagcuug

SEQ ID NO: 1929348 - RNA, 19 nt, Homo sapiens
ucauugcccgaaaccagag

SEQ ID NO: 1929349 - RNA, 16 nt, Homo sapiens
agggaagggggaacau

SEQ ID NO: 1929350 - RNA, 22 nt, Homo sapiens
uaggugccaggcuguaagcauu

SEQ ID NO: 1929351 - RNA, 16 nt, Homo sapiens
uucuaaaaaugguuau

SEQ ID NO: 1929352 - RNA, 15 nt, Homo sapiens
gaaaacaaacaaaca

SEQ ID NO: 1929353 - RNA, 15 nt, Homo sapiens
acccuccagaccucc

SEQ ID NO: 1929354 - RNA, 15 nt, Homo sapiens
gaauauaaacauaua

SEQ ID NO: 1929355 - RNA, 18 nt, Homo sapiens
uauacauaugacauauau

SEQ ID NO: 1929356 - RNA, 21 nt, Homo sapiens
cauuccugaaagaaacaguua

SEQ ID NO: 1929357 - RNA, 21 nt, Homo sapiens
caaacagggcuuuacuaucuu

SEQ ID NO: 1929358 - RNA, 18 nt, Homo sapiens
cacauucuggcucaggga

SEQ ID NO: 1929359 - RNA, 18 nt, Homo sapiens
caaucuuguccacagucu

SEQ ID NO: 1929360 - RNA, 21 nt, Homo sapiens
gacucuggaaguuuucuagca

SEQ ID NO: 1929361 - RNA, 19 nt, Homo sapiens
ugaagucuguacagauuca

SEQ ID NO: 1929362 - RNA, 17 nt, Homo sapiens
uugacucuaaaugcagu

SEQ ID NO: 1929363 - RNA, 15 nt, Homo sapiens
aagccuccugcugag

SEQ ID NO: 1929364 - RNA, 18 nt, Homo sapiens
cagauagauauaugcucu

SEQ ID NO: 1929365 - RNA, 23 nt, Homo sapiens
uccgggugaagacauguacugau

SEQ ID NO: 1929366 - RNA, 20 nt, Homo sapiens
aacucuauaaccucagcuuu

SEQ ID NO: 1929367 - RNA, 19 nt, Homo sapiens
acaagauuccugguugaua

SEQ ID NO: 1929368 - RNA, 21 nt, Homo sapiens
cugcacacuguccuauuauau

SEQ ID NO: 1929369 - RNA, 16 nt, Homo sapiens
ugcucacuggcuuuag

SEQ ID NO: 1929370 - RNA, 14 nt, Homo sapiens
uuccuucauauaau

SEQ ID NO: 1929371 - RNA, 23 nt, Homo sapiens
ccaacgcgccucgccggaucuga

SEQ ID NO: 1929372 - RNA, 14 nt, Homo sapiens
cauaaccugucuca

SEQ ID NO: 1929373 - RNA, 23 nt, Homo sapiens
agagguggagguugcagugagcc

SEQ ID NO: 1929374 - RNA, 12 nt, Homo sapiens
acuguccagggc

SEQ ID NO: 1929375 - RNA, 13 nt, Homo sapiens
aguucuguagaaa

SEQ ID NO: 1929376 - RNA, 21 nt, Homo sapiens
aacugaaaugccugcuuugaa

SEQ ID NO: 1929377 - RNA, 17 nt, Homo sapiens
ucaucacucaucugcca

SEQ ID NO: 1929378 - RNA, 16 nt, Homo sapiens
ucaggaguuccagugc

SEQ ID NO: 1929379 - RNA, 23 nt, Homo sapiens
aacugugcuuguugaaugucaau

SEQ ID NO: 1929380 - RNA, 12 nt, Homo sapiens
uuuggccuccau

SEQ ID NO: 1929381 - RNA, 23 nt, Homo sapiens
aguaguugggauuaccaguagau

SEQ ID NO: 1929382 - RNA, 15 nt, Homo sapiens
gaagaggcugcugag

SEQ ID NO: 1929383 - RNA, 14 nt, Homo sapiens
uccccuaucccauu

SEQ ID NO: 1929384 - RNA, 20 nt, Homo sapiens
caggcauuuuuacagcacac

SEQ ID NO: 1929385 - RNA, 15 nt, Homo sapiens
gcaggaccagcccac

SEQ ID NO: 1929386 - RNA, 17 nt, Homo sapiens
gcaguccauuuccuaau

SEQ ID NO: 1929387 - RNA, 24 nt, Homo sapiens
augcuaauauuuuuaacaagucau

SEQ ID NO: 1929388 - RNA, 21 nt, Homo sapiens
cugggucagggguacacagag

SEQ ID NO: 1929389 - RNA, 18 nt, Homo sapiens
cuggagaaagaguuucug

SEQ ID NO: 1929390 - RNA, 18 nt, Homo sapiens
aauguguuucaaaaccau

SEQ ID NO: 1929391 - RNA, 14 nt, Homo sapiens
ugugugugugcuga

SEQ ID NO: 1929392 - RNA, 20 nt, Homo sapiens
uucagcauuauuccuccagg

SEQ ID NO: 1929393 - RNA, 14 nt, Homo sapiens
aaagaugauugaau

SEQ ID NO: 1929394 - RNA, 19 nt, Homo sapiens
ccucuuaaagcugccugua

SEQ ID NO: 1929395 - RNA, 17 nt, Homo sapiens
gggaugugacaugccca

SEQ ID NO: 1929396 - RNA, 15 nt, Homo sapiens
caucuuuuuccacuu

SEQ ID NO: 1929397 - RNA, 13 nt, Homo sapiens
auaacagcacaau

SEQ ID NO: 1929398 - RNA, 13 nt, Homo sapiens
gaaucauucugua

SEQ ID NO: 1929399 - RNA, 14 nt, Homo sapiens
uacaucugccuuaa

SEQ ID NO: 1929400 - RNA, 20 nt, Homo sapiens
cuguaguuuaugaugcaaau

SEQ ID NO: 1929401 - RNA, 18 nt, Homo sapiens
gggugcaaagacucugag

SEQ ID NO: 1929402 - RNA, 21 nt, Homo sapiens
augaagguggaacaagcacag

SEQ ID NO: 1929403 - RNA, 23 nt, Homo sapiens
gaccaugguuuuggcucucccac

SEQ ID NO: 1929404 - RNA, 18 nt, Homo sapiens
uggagaacaugcauacua

SEQ ID NO: 1929405 - RNA, 17 nt, Homo sapiens
aguuacaaaauacaaaa

SEQ ID NO: 1929406 - RNA, 22 nt, Homo sapiens
cucuggaugaagcucuggccaa

SEQ ID NO: 1929407 - RNA, 21 nt, Homo sapiens
cuacacagagcaggacugcac

SEQ ID NO: 1929408 - RNA, 15 nt, Homo sapiens
caagaagugccaguu

SEQ ID NO: 1929409 - RNA, 12 nt, Homo sapiens
cuauagucccag

SEQ ID NO: 1929410 - RNA, 16 nt, Homo sapiens
ucauugugugucuuca

SEQ ID NO: 1929411 - RNA, 12 nt, Homo sapiens
auauagucacag

SEQ ID NO: 1929412 - RNA, 14 nt, Homo sapiens
ugauaagacuguuu

SEQ ID NO: 1929413 - RNA, 17 nt, Homo sapiens
agaggauaagccacugg

SEQ ID NO: 1929414 - RNA, 12 nt, Homo sapiens
ccacuaagccaa

SEQ ID NO: 1929415 - RNA, 15 nt, Homo sapiens
ccaaguuacuugaaa

SEQ ID NO: 1929416 - RNA, 19 nt, Homo sapiens
gauaauuguuucauucauc

SEQ ID NO: 1929417 - RNA, 18 nt, Homo sapiens
acugugucucuaugugaa

SEQ ID NO: 1929418 - RNA, 16 nt, Homo sapiens
uacuuuuauaaugaaa

SEQ ID NO: 1929419 - RNA, 16 nt, Homo sapiens
gcugagugcaccacuu

SEQ ID NO: 1929420 - RNA, 21 nt, Homo sapiens
gaaugucuuuggcucaguuca

SEQ ID NO: 1929421 - RNA, 20 nt, Homo sapiens
uaagauccuaaacucucuag

SEQ ID NO: 1929422 - RNA, 23 nt, Homo sapiens
ccaccuucuacgcaauugacaaa

SEQ ID NO: 1929423 - RNA, 14 nt, Homo sapiens
agggagacucagcc

SEQ ID NO: 1929424 - RNA, 15 nt, Homo sapiens
gcacaagccagaccc

SEQ ID NO: 1929425 - RNA, 20 nt, Homo sapiens
accaggaaagccacacggag

SEQ ID NO: 1929426 - RNA, 21 nt, Homo sapiens
aguuucccagagaaacaagca

SEQ ID NO: 1929427 - RNA, 14 nt, Homo sapiens
accuccacucugcc

SEQ ID NO: 1929428 - RNA, 13 nt, Homo sapiens
uaacaaauaaaua

SEQ ID NO: 1929429 - RNA, 15 nt, Homo sapiens
uuggaacacccugga

SEQ ID NO: 1929430 - RNA, 15 nt, Homo sapiens
cuucuugugaaacca

SEQ ID NO: 1929431 - RNA, 14 nt, Homo sapiens
uacuacacauccaa

SEQ ID NO: 1929432 - RNA, 13 nt, Homo sapiens
gcaacgacuacuu

SEQ ID NO: 1929433 - RNA, 14 nt, Homo sapiens
aucaagcagccaag

SEQ ID NO: 1929434 - RNA, 14 nt, Homo sapiens
acuccucaguuccu

SEQ ID NO: 1929435 - RNA, 22 nt, Homo sapiens
aguaaagcccagaucucugcau

SEQ ID NO: 1929436 - RNA, 13 nt, Homo sapiens
ugaaccauuacug

SEQ ID NO: 1929437 - RNA, 19 nt, Homo sapiens
cuacucaauacuaccucug

SEQ ID NO: 1929438 - RNA, 14 nt, Homo sapiens
cccgacacugccaa

SEQ ID NO: 1929439 - RNA, 18 nt, Homo sapiens
acagagaugugcaugugg

SEQ ID NO: 1929440 - RNA, 18 nt, Homo sapiens
acuucacgcccuuggcca

SEQ ID NO: 1929441 - RNA, 13 nt, Homo sapiens
acuacacuccagc

SEQ ID NO: 1929442 - RNA, 13 nt, Homo sapiens
cuaguacuauuau

SEQ ID NO: 1929443 - RNA, 16 nt, Homo sapiens
gcaauuuacuuggaau

SEQ ID NO: 1929444 - RNA, 19 nt, Homo sapiens
agcuuuggacgcacacagc

SEQ ID NO: 1929445 - RNA, 22 nt, Homo sapiens
aacauguuccuuauauuuacuc

SEQ ID NO: 1929446 - RNA, 14 nt, Homo sapiens
gugcaccugcccca

SEQ ID NO: 1929447 - RNA, 15 nt, Homo sapiens
aaugccacuucacca

SEQ ID NO: 1929448 - RNA, 16 nt, Homo sapiens
acuguaaacaguucug

SEQ ID NO: 1929449 - RNA, 17 nt, Homo sapiens
auagguagauccagauc

SEQ ID NO: 1929450 - RNA, 12 nt, Homo sapiens
cagacaaaugga

SEQ ID NO: 1929451 - RNA, 17 nt, Homo sapiens
uuacuguuguacaauca

SEQ ID NO: 1929452 - RNA, 14 nt, Homo sapiens
gugcagcucuggag

SEQ ID NO: 1929453 - RNA, 14 nt, Homo sapiens
gcacugcuccagug

SEQ ID NO: 1929454 - RNA, 14 nt, Homo sapiens
cugcuccugugguc

SEQ ID NO: 1929455 - RNA, 16 nt, Homo sapiens
ugacuccugcucucug

SEQ ID NO: 1929456 - RNA, 20 nt, Homo sapiens
uccacacauuuguugccaga

SEQ ID NO: 1929457 - RNA, 12 nt, Homo sapiens
gaccugauguaa

SEQ ID NO: 1929458 - RNA, 21 nt, Homo sapiens
cagucgcacacacauuuggaa

SEQ ID NO: 1929459 - RNA, 15 nt, Homo sapiens
uucuuuccaugcagu

SEQ ID NO: 1929460 - RNA, 14 nt, Homo sapiens
augcagagcuuuca

SEQ ID NO: 1929461 - RNA, 14 nt, Homo sapiens
cacuggaggucaca

SEQ ID NO: 1929462 - RNA, 14 nt, Homo sapiens
ugaaugauuuccca

SEQ ID NO: 1929463 - RNA, 13 nt, Homo sapiens
uaagacucugcca

SEQ ID NO: 1929464 - RNA, 22 nt, Homo sapiens
uucggauguaugaucucucuag

SEQ ID NO: 1929465 - RNA, 20 nt, Homo sapiens
uuuccucugugcaaagggaa

SEQ ID NO: 1929466 - RNA, 16 nt, Homo sapiens
aguauauuuaaacuca

SEQ ID NO: 1929467 - RNA, 21 nt, Homo sapiens
guuugagaccacccugggcaa

SEQ ID NO: 1929468 - RNA, 20 nt, Homo sapiens
uuccuuuuaaaacacuucca

SEQ ID NO: 1929469 - RNA, 18 nt, Homo sapiens
auguaguuuuccauccuu

SEQ ID NO: 1929470 - RNA, 15 nt, Homo sapiens
guucaugcuuuguac

SEQ ID NO: 1929471 - RNA, 22 nt, Homo sapiens
ugcuguaacucagacauuccaa

SEQ ID NO: 1929472 - RNA, 14 nt, Homo sapiens
ggcaacuccagaag

SEQ ID NO: 1929473 - RNA, 17 nt, Homo sapiens
ccaaacauuucugugaa

SEQ ID NO: 1929474 - RNA, 22 nt, Homo sapiens
ucugcauuuucugaaacuaaug

SEQ ID NO: 1929475 - RNA, 19 nt, Homo sapiens
uuugcuaaaccuauuucac

SEQ ID NO: 1929476 - RNA, 15 nt, Homo sapiens
uaguuuaauuggucu

SEQ ID NO: 1929477 - RNA, 13 nt, Homo sapiens
caaaauuaaauac

SEQ ID NO: 1929478 - RNA, 14 nt, Homo sapiens
auaaaaguuccuag

SEQ ID NO: 1929479 - RNA, 17 nt, Homo sapiens
auucagcggcagugugu

SEQ ID NO: 1929480 - RNA, 20 nt, Homo sapiens
cuucuaaaugaagugcaaau

SEQ ID NO: 1929481 - RNA, 22 nt, Homo sapiens
accaacaucgcagacacaugug

SEQ ID NO: 1929482 - RNA, 12 nt, Homo sapiens
cccuuucuucaa

SEQ ID NO: 1929483 - RNA, 13 nt, Homo sapiens
auggacacuacac

SEQ ID NO: 1929484 - RNA, 18 nt, Homo sapiens
ccuguucugggugcagcu

SEQ ID NO: 1929485 - RNA, 22 nt, Homo sapiens
caggaaguaauuuucuucucau

SEQ ID NO: 1929486 - RNA, 16 nt, Homo sapiens
accaagcucuguccaa

SEQ ID NO: 1929487 - RNA, 21 nt, Homo sapiens
accucaccccguuacagcucc

SEQ ID NO: 1929488 - RNA, 15 nt, Homo sapiens
ucucugagcuccagu

SEQ ID NO: 1929489 - RNA, 15 nt, Homo sapiens
uccuaaagcuuuuau

SEQ ID NO: 1929490 - RNA, 20 nt, Homo sapiens
cagagcgaggaaaggauuuu

SEQ ID NO: 1929491 - RNA, 21 nt, Homo sapiens
uagcccucuuucucucugugu

SEQ ID NO: 1929492 - RNA, 12 nt, Homo sapiens
cgugaaacacac

SEQ ID NO: 1929493 - RNA, 20 nt, Homo sapiens
aauacaauuacucaccaaaa

SEQ ID NO: 1929494 - RNA, 18 nt, Homo sapiens
cuuccagaucacugccac

SEQ ID NO: 1929495 - RNA, 16 nt, Homo sapiens
uuucguagguugacua

SEQ ID NO: 1929496 - RNA, 23 nt, Homo sapiens
ucuuuucucuacuccaugguucu

SEQ ID NO: 1929497 - RNA, 22 nt, Homo sapiens
aacauuuucagaccaugaauga

SEQ ID NO: 1929498 - RNA, 17 nt, Homo sapiens
cagaauauaauucccaa

SEQ ID NO: 1929499 - RNA, 16 nt, Homo sapiens
caacuggggggcaauu

SEQ ID NO: 1929500 - RNA, 16 nt, Homo sapiens
gagagaugggccaggc

SEQ ID NO: 1929501 - RNA, 11 nt, Homo sapiens
aggacugagau

SEQ ID NO: 1929502 - RNA, 20 nt, Homo sapiens
cuccugacaucaggugaucc

SEQ ID NO: 1929503 - RNA, 22 nt, Homo sapiens
agguagcuuguccaaggucuca

SEQ ID NO: 1929504 - RNA, 15 nt, Homo sapiens
guacaguauucaauu

SEQ ID NO: 1929505 - RNA, 17 nt, Homo sapiens
aucaugaaaagugcugu

SEQ ID NO: 1929506 - RNA, 21 nt, Homo sapiens
agaggguaaguaaacagauuu

SEQ ID NO: 1929507 - RNA, 15 nt, Homo sapiens
ucccccaaagccgga

SEQ ID NO: 1929508 - RNA, 14 nt, Homo sapiens
cacacacacaagua

SEQ ID NO: 1929509 - RNA, 14 nt, Homo sapiens
ugaguacaugcaca

SEQ ID NO: 1929510 - RNA, 17 nt, Homo sapiens
uugacaaccaugagacc

SEQ ID NO: 1929511 - RNA, 12 nt, Homo sapiens
gggcagagguaa

SEQ ID NO: 1929512 - RNA, 19 nt, Homo sapiens
aaccauucuaaaacacaac

SEQ ID NO: 1929513 - RNA, 23 nt, Homo sapiens
acauccuugucugggucuaccag

SEQ ID NO: 1929514 - RNA, 14 nt, Homo sapiens
aacauaacuucuca

SEQ ID NO: 1929515 - RNA, 22 nt, Homo sapiens
cuauguuccgaauugagcacaa

SEQ ID NO: 1929516 - RNA, 18 nt, Homo sapiens
guuucacacuagucacau

SEQ ID NO: 1929517 - RNA, 18 nt, Homo sapiens
agagcccagcucaugcac

SEQ ID NO: 1929518 - RNA, 21 nt, Homo sapiens
gaauuagauguuuauaucaaa

SEQ ID NO: 1929519 - RNA, 16 nt, Homo sapiens
auauauuaaauuugaa

SEQ ID NO: 1929520 - RNA, 10 nt, Homo sapiens
guacaucucu

SEQ ID NO: 1929521 - RNA, 11 nt, Homo sapiens
gguugaacuau

SEQ ID NO: 1929522 - RNA, 16 nt, Homo sapiens
cggagguccugcuacc

SEQ ID NO: 1929523 - RNA, 21 nt, Homo sapiens
aauucacaaguuacacugcca

SEQ ID NO: 1929524 - RNA, 20 nt, Homo sapiens
cauaagaggaguaggcccug

SEQ ID NO: 1929525 - RNA, 16 nt, Homo sapiens
ccagauccagacugua

SEQ ID NO: 1929526 - RNA, 16 nt, Homo sapiens
acagguaaaacagggc

SEQ ID NO: 1929527 - RNA, 19 nt, Homo sapiens
gaagcuucuaaauggugcu

SEQ ID NO: 1929528 - RNA, 16 nt, Homo sapiens
aggccuugcucacuca

SEQ ID NO: 1929529 - RNA, 19 nt, Homo sapiens
aauuagggcauccugcccc

SEQ ID NO: 1929530 - RNA, 15 nt, Homo sapiens
cauccaaguggcaua

SEQ ID NO: 1929531 - RNA, 22 nt, Homo sapiens
aguguggcccagggaagccaaa

SEQ ID NO: 1929532 - RNA, 16 nt, Homo sapiens
ugcagaguuuggauaa

SEQ ID NO: 1929533 - RNA, 13 nt, Homo sapiens
aaaauauaaucua

SEQ ID NO: 1929534 - RNA, 19 nt, Homo sapiens
aauauguacaucacugaga

SEQ ID NO: 1929535 - RNA, 14 nt, Homo sapiens
gugcccuguucucu

SEQ ID NO: 1929536 - RNA, 15 nt, Homo sapiens
ggagagacaggcagc

SEQ ID NO: 1929537 - RNA, 16 nt, Homo sapiens
ccaaaacuaguucaaa

SEQ ID NO: 1929538 - RNA, 13 nt, Homo sapiens
agcgaacaugccu

SEQ ID NO: 1929539 - RNA, 13 nt, Homo sapiens
aaaguacauaaca

SEQ ID NO: 1929540 - RNA, 16 nt, Homo sapiens
caacucauuuucauau

SEQ ID NO: 1929541 - RNA, 22 nt, Homo sapiens
gacuuucuguguaccacuggga

SEQ ID NO: 1929542 - RNA, 11 nt, Homo sapiens
aauauuuccau

SEQ ID NO: 1929543 - RNA, 14 nt, Homo sapiens
gaaaccacucugaa

SEQ ID NO: 1929544 - RNA, 16 nt, Homo sapiens
accucugugaccucag

SEQ ID NO: 1929545 - RNA, 19 nt, Homo sapiens
guguguccaaaacugccuc

SEQ ID NO: 1929546 - RNA, 15 nt, Homo sapiens
uggcucgcaaccucc

SEQ ID NO: 1929547 - RNA, 22 nt, Homo sapiens
uacuuuacaaaccauuaccugu

SEQ ID NO: 1929548 - RNA, 14 nt, Homo sapiens
aaauaaagcucaag

SEQ ID NO: 1929549 - RNA, 11 nt, Homo sapiens
ugucuggucuu

SEQ ID NO: 1929550 - RNA, 16 nt, Homo sapiens
acuguuccccaaaaca

SEQ ID NO: 1929551 - RNA, 15 nt, Homo sapiens
aguuuccauauguua

SEQ ID NO: 1929552 - RNA, 13 nt, Homo sapiens
aauauuuauucau

SEQ ID NO: 1929553 - RNA, 17 nt, Homo sapiens
agaaagggaaacuggcu

SEQ ID NO: 1929554 - RNA, 21 nt, Homo sapiens
augaauuuaucuuuaccaaaa

SEQ ID NO: 1929555 - RNA, 24 nt, Homo sapiens
cauagcugagcuggaaaggaugcu

SEQ ID NO: 1929556 - RNA, 23 nt, Homo sapiens
agcugcugacacgcagccugcuc

SEQ ID NO: 1929557 - RNA, 17 nt, Homo sapiens
agcuggagaugaggcca

SEQ ID NO: 1929558 - RNA, 23 nt, Homo sapiens
uucugacuugacuuuagucugca

SEQ ID NO: 1929559 - RNA, 21 nt, Homo sapiens
gccuuugccccggcuugccug

SEQ ID NO: 1929560 - RNA, 13 nt, Homo sapiens
ucagccuccacuc

SEQ ID NO: 1929561 - RNA, 18 nt, Homo sapiens
ugaauuggauacaaggau

SEQ ID NO: 1929562 - RNA, 15 nt, Homo sapiens
uugaugcauguuacu

SEQ ID NO: 1929563 - RNA, 13 nt, Homo sapiens
acauuaaggacca

SEQ ID NO: 1929564 - RNA, 16 nt, Homo sapiens
uggaaggguaaauacu

SEQ ID NO: 1929565 - RNA, 14 nt, Homo sapiens
uaaugaagugcaau

SEQ ID NO: 1929566 - RNA, 21 nt, Homo sapiens
gacagguuggccguuugcuua

SEQ ID NO: 1929567 - RNA, 18 nt, Homo sapiens
accugucaaaaauuuuga

SEQ ID NO: 1929568 - RNA, 22 nt, Homo sapiens
ccuaggaggcuagaagagccaa

SEQ ID NO: 1929569 - RNA, 16 nt, Homo sapiens
uuuaguuacguauaau

SEQ ID NO: 1929570 - RNA, 19 nt, Homo sapiens
guauucaagagacaguauu

SEQ ID NO: 1929571 - RNA, 23 nt, Homo sapiens
acaggcgugagccacugcgccca

SEQ ID NO: 1929572 - RNA, 15 nt, Homo sapiens
gcuuuagaauauauc

SEQ ID NO: 1929573 - RNA, 14 nt, Homo sapiens
ugggggaggcuuca

SEQ ID NO: 1929574 - RNA, 14 nt, Homo sapiens
cccaagcuggagug

SEQ ID NO: 1929575 - RNA, 17 nt, Homo sapiens
uauuaaaaaaacacaaa

SEQ ID NO: 1929576 - RNA, 13 nt, Homo sapiens
aaccucagggaca

SEQ ID NO: 1929577 - RNA, 16 nt, Homo sapiens
agacaaguauggcucc

SEQ ID NO: 1929578 - RNA, 22 nt, Homo sapiens
caaccaguuuauccaccaagaa

SEQ ID NO: 1929579 - RNA, 17 nt, Homo sapiens
agcuacuagcaaaauaa

SEQ ID NO: 1929580 - RNA, 16 nt, Homo sapiens
acaaauguuacuucua

SEQ ID NO: 1929581 - RNA, 19 nt, Homo sapiens
gaacccuguuacacuauua

SEQ ID NO: 1929582 - RNA, 15 nt, Homo sapiens
gccagagccaagaaa

SEQ ID NO: 1929583 - RNA, 17 nt, Homo sapiens
aucauauucauaugcag

SEQ ID NO: 1929584 - RNA, 23 nt, Homo sapiens
ucauacuuaacauuucauuguac

SEQ ID NO: 1929585 - RNA, 14 nt, Homo sapiens
aagauucuaucaaa

SEQ ID NO: 1929586 - RNA, 21 nt, Homo sapiens
caaguauguuuguacaguaug

SEQ ID NO: 1929587 - RNA, 18 nt, Homo sapiens
cuguuggaagaaaagaga

SEQ ID NO: 1929588 - RNA, 16 nt, Homo sapiens
uaaacuuuaucucaca

SEQ ID NO: 1929589 - RNA, 21 nt, Homo sapiens
ucucccccuccugauuaaaaa

SEQ ID NO: 1929590 - RNA, 13 nt, Homo sapiens
cuuccuccagcug

SEQ ID NO: 1929591 - RNA, 16 nt, Homo sapiens
aggacgauuucacuga

SEQ ID NO: 1929592 - RNA, 13 nt, Homo sapiens
aguuagcacugaa

SEQ ID NO: 1929593 - RNA, 19 nt, Homo sapiens
aggauuccaaaguuuugaa

SEQ ID NO: 1929594 - RNA, 21 nt, Homo sapiens
uuuccuugggagaacuaagua

SEQ ID NO: 1929595 - RNA, 20 nt, Homo sapiens
cagcuguccacugggccauu

SEQ ID NO: 1929596 - RNA, 22 nt, Homo sapiens
ucacaagcccaggcuggagauc

SEQ ID NO: 1929597 - RNA, 13 nt, Homo sapiens
auuccaacuugaa

SEQ ID NO: 1929598 - RNA, 16 nt, Homo sapiens
auguggaacaacagca

SEQ ID NO: 1929599 - RNA, 17 nt, Homo sapiens
gaccuccaaccaggagu

SEQ ID NO: 1929600 - RNA, 12 nt, Homo sapiens
ccuauagcucuu

SEQ ID NO: 1929601 - RNA, 14 nt, Homo sapiens
ucuaaagcugccag

SEQ ID NO: 1929602 - RNA, 21 nt, Homo sapiens
acugcucagcuucuucuuuca

SEQ ID NO: 1929603 - RNA, 20 nt, Homo sapiens
ugaaauuuuaaccuaugaua

SEQ ID NO: 1929604 - RNA, 17 nt, Homo sapiens
cucauuaauucaaugaa

SEQ ID NO: 1929605 - RNA, 17 nt, Homo sapiens
uaacuggaaaacagaac

SEQ ID NO: 1929606 - RNA, 21 nt, Homo sapiens
aagcuaggguggcccuugcag

SEQ ID NO: 1929607 - RNA, 12 nt, Homo sapiens
ccuccauucuga

SEQ ID NO: 1929608 - RNA, 20 nt, Homo sapiens
agccucuuuaacagcuuucu

SEQ ID NO: 1929609 - RNA, 21 nt, Homo sapiens
cuuaacagucaccacugugcu

SEQ ID NO: 1929610 - RNA, 16 nt, Homo sapiens
ccagcgagcucucaaa

SEQ ID NO: 1929611 - RNA, 16 nt, Homo sapiens
ugagcuucuuuagcua

SEQ ID NO: 1929612 - RNA, 15 nt, Homo sapiens
ccagccccuuugcca

SEQ ID NO: 1929613 - RNA, 16 nt, Homo sapiens
gacagcgccaccucuu

SEQ ID NO: 1929614 - RNA, 17 nt, Homo sapiens
acccuucacaccccagg

SEQ ID NO: 1929615 - RNA, 14 nt, Homo sapiens
uaauugcuuugaag

SEQ ID NO: 1929616 - RNA, 15 nt, Homo sapiens
ggggacaaguccccu

SEQ ID NO: 1929617 - RNA, 19 nt, Homo sapiens
gguagaaaagaaaugguau

SEQ ID NO: 1929618 - RNA, 14 nt, Homo sapiens
guguggagcacgug

SEQ ID NO: 1929619 - RNA, 22 nt, Homo sapiens
ugucccaaaccagacaccugga

SEQ ID NO: 1929620 - RNA, 18 nt, Homo sapiens
auuugacguuguugucau

SEQ ID NO: 1929621 - RNA, 15 nt, Homo sapiens
acuucugacucuucc

SEQ ID NO: 1929622 - RNA, 21 nt, Homo sapiens
ccccagguugccugggccacg

SEQ ID NO: 1929623 - RNA, 20 nt, Homo sapiens
uaaaggcugaagcuuuuugu

SEQ ID NO: 1929624 - RNA, 17 nt, Homo sapiens
ggaauauaaccucccac

SEQ ID NO: 1929625 - RNA, 14 nt, Homo sapiens
gaguuaaagaccag

SEQ ID NO: 1929626 - RNA, 15 nt, Homo sapiens
uuugccacugcugua

SEQ ID NO: 1929627 - RNA, 15 nt, Homo sapiens
auugccacagcugua

SEQ ID NO: 1929628 - RNA, 13 nt, Homo sapiens
ucaaaaaugccac

SEQ ID NO: 1929629 - RNA, 15 nt, Homo sapiens
gcuuugaaugcaugu

SEQ ID NO: 1929630 - RNA, 23 nt, Homo sapiens
acaguucuaggugcuaaaauuca

SEQ ID NO: 1929631 - RNA, 17 nt, Homo sapiens
aguuacuggaugcagca

SEQ ID NO: 1929632 - RNA, 15 nt, Homo sapiens
cuggcugcugcaguc

SEQ ID NO: 1929633 - RNA, 20 nt, Homo sapiens
uuaguuuugggaauaggcau

SEQ ID NO: 1929634 - RNA, 12 nt, Homo sapiens
uggcccaggaau

SEQ ID NO: 1929635 - RNA, 13 nt, Homo sapiens
acaaacucucacc

SEQ ID NO: 1929636 - RNA, 14 nt, Homo sapiens
cauaugauacugau

SEQ ID NO: 1929637 - RNA, 13 nt, Homo sapiens
cugcucguggcca

SEQ ID NO: 1929638 - RNA, 13 nt, Homo sapiens
auuaaaugcaugu

SEQ ID NO: 1929639 - RNA, 15 nt, Homo sapiens
gacccugccauucca

SEQ ID NO: 1929640 - RNA, 18 nt, Homo sapiens
acaggacuucugugcauu

SEQ ID NO: 1929641 - RNA, 16 nt, Homo sapiens
cagguguggaccggcc

SEQ ID NO: 1929642 - RNA, 18 nt, Homo sapiens
uguccggcccagugccac

SEQ ID NO: 1929643 - RNA, 20 nt, Homo sapiens
ccugggcaacauagugauac

SEQ ID NO: 1929644 - RNA, 21 nt, Homo sapiens
aggacagggaggugaccccag

SEQ ID NO: 1929645 - RNA, 18 nt, Homo sapiens
uucccuaggaaacucaca

SEQ ID NO: 1929646 - RNA, 14 nt, Homo sapiens
auggcuugugaacu

SEQ ID NO: 1929647 - RNA, 19 nt, Homo sapiens
agaaugaaauguaugugcu

SEQ ID NO: 1929648 - RNA, 13 nt, Homo sapiens
gaaacagugugca

SEQ ID NO: 1929649 - RNA, 21 nt, Homo sapiens
uacagaaauacugcucugaau

SEQ ID NO: 1929650 - RNA, 15 nt, Homo sapiens
guacuuuuuccagac

SEQ ID NO: 1929651 - RNA, 20 nt, Homo sapiens
gagcuggcaccauucagacu

SEQ ID NO: 1929652 - RNA, 20 nt, Homo sapiens
gggagugcccccaacagcac

SEQ ID NO: 1929653 - RNA, 19 nt, Homo sapiens
cuagaaaacaggcaaauuc

SEQ ID NO: 1929654 - RNA, 16 nt, Homo sapiens
caaggggucuguauau

SEQ ID NO: 1929655 - RNA, 23 nt, Homo sapiens
acaugaauauuuaguguucauaa

SEQ ID NO: 1929656 - RNA, 14 nt, Homo sapiens
ccccacgcugacca

SEQ ID NO: 1929657 - RNA, 14 nt, Homo sapiens
agcucaggcagcuc

SEQ ID NO: 1929658 - RNA, 15 nt, Homo sapiens
augcaggugguggga

SEQ ID NO: 1929659 - RNA, 13 nt, Homo sapiens
agaaucacuugaa

SEQ ID NO: 1929660 - RNA, 19 nt, Homo sapiens
gcagccugagcaacucuug

SEQ ID NO: 1929661 - RNA, 17 nt, Homo sapiens
aauuuuuauacauauca

SEQ ID NO: 1929662 - RNA, 17 nt, Homo sapiens
uuucuauuuucucugau

SEQ ID NO: 1929663 - RNA, 14 nt, Homo sapiens
ucccuagcagugaa

SEQ ID NO: 1929664 - RNA, 16 nt, Homo sapiens
ggcagucugcucugcu

SEQ ID NO: 1929665 - RNA, 14 nt, Homo sapiens
gaggaguuccuuga

SEQ ID NO: 1929666 - RNA, 14 nt, Homo sapiens
aacauucaguuccc

SEQ ID NO: 1929667 - RNA, 14 nt, Homo sapiens
ugccagugccuuau

SEQ ID NO: 1929668 - RNA, 15 nt, Homo sapiens
guggcacaagcaaaa

SEQ ID NO: 1929669 - RNA, 21 nt, Homo sapiens
gagaaauuuaaacuauaagca

SEQ ID NO: 1929670 - RNA, 14 nt, Homo sapiens
uaaaugucccaaau

SEQ ID NO: 1929671 - RNA, 23 nt, Homo sapiens
acauguacaauaagaacuucuau

SEQ ID NO: 1929672 - RNA, 22 nt, Homo sapiens
ggccuucagaaaagacacuuca

SEQ ID NO: 1929673 - RNA, 20 nt, Homo sapiens
agccuaccaaugccaaaagg

SEQ ID NO: 1929674 - RNA, 14 nt, Homo sapiens
aaaaaauacucugc

SEQ ID NO: 1929675 - RNA, 16 nt, Homo sapiens
uagcuuucuccagauc

SEQ ID NO: 1929676 - RNA, 18 nt, Homo sapiens
uagaaugagacuuacuuc

SEQ ID NO: 1929677 - RNA, 21 nt, Homo sapiens
uguuguggagaaaagagccag

SEQ ID NO: 1929678 - RNA, 18 nt, Homo sapiens
uuaaaacaauucugugac

SEQ ID NO: 1929679 - RNA, 14 nt, Homo sapiens
uacuuccaugauac

SEQ ID NO: 1929680 - RNA, 22 nt, Homo sapiens
caauauucccggucagcaguau

SEQ ID NO: 1929681 - RNA, 19 nt, Homo sapiens
aaauagcacacuuuuccac

SEQ ID NO: 1929682 - RNA, 21 nt, Homo sapiens
aaaggacucugcuucagucca

SEQ ID NO: 1929683 - RNA, 16 nt, Homo sapiens
uucuaagaaauaucug

SEQ ID NO: 1929684 - RNA, 18 nt, Homo sapiens
caucuggaaggacaucua

SEQ ID NO: 1929685 - RNA, 22 nt, Homo sapiens
gaucagcuaccaggcaggauau

SEQ ID NO: 1929686 - RNA, 21 nt, Homo sapiens
acucggggcaggccagcaaua

SEQ ID NO: 1929687 - RNA, 13 nt, Homo sapiens
gauagaacuacuu

SEQ ID NO: 1929688 - RNA, 14 nt, Homo sapiens
gaaaaaaaaaccca

SEQ ID NO: 1929689 - RNA, 23 nt, Homo sapiens
uuucucuuugauuauuugcaugu

SEQ ID NO: 1929690 - RNA, 15 nt, Homo sapiens
cugucuuucacugaa

SEQ ID NO: 1929691 - RNA, 20 nt, Homo sapiens
uuuuaugccuuuauauacuu

SEQ ID NO: 1929692 - RNA, 20 nt, Homo sapiens
gauaaauauuugacuugcau

SEQ ID NO: 1929693 - RNA, 22 nt, Homo sapiens
aaguuagucaauccugucauau

SEQ ID NO: 1929694 - RNA, 16 nt, Homo sapiens
uuauuagacauucucu

SEQ ID NO: 1929695 - RNA, 15 nt, Homo sapiens
acagugacacuggac

SEQ ID NO: 1929696 - RNA, 16 nt, Homo sapiens
uggccucuggcucuca

SEQ ID NO: 1929697 - RNA, 17 nt, Homo sapiens
guccccugccucaagaa

SEQ ID NO: 1929698 - RNA, 13 nt, Homo sapiens
aucugacuucaua

SEQ ID NO: 1929699 - RNA, 13 nt, Homo sapiens
auaugacuuccua

SEQ ID NO: 1929700 - RNA, 16 nt, Homo sapiens
agcccagcagaucuca

SEQ ID NO: 1929701 - RNA, 18 nt, Homo sapiens
aucaggaccuccaagcca

SEQ ID NO: 1929702 - RNA, 14 nt, Homo sapiens
caugacaccugcca

SEQ ID NO: 1929703 - RNA, 14 nt, Homo sapiens
ccaucaccuacuca

SEQ ID NO: 1929704 - RNA, 13 nt, Homo sapiens
gcagcacugcugc

SEQ ID NO: 1929705 - RNA, 13 nt, Homo sapiens
ugaaaacuuguaa

SEQ ID NO: 1929706 - RNA, 22 nt, Homo sapiens
uggaucagcucuuccuguguuu

SEQ ID NO: 1929707 - RNA, 16 nt, Homo sapiens
ucccucaggcccagga

SEQ ID NO: 1929708 - RNA, 14 nt, Homo sapiens
caguuccagcuuuu

SEQ ID NO: 1929709 - RNA, 21 nt, Homo sapiens
gguuacaagaaacagccacug

SEQ ID NO: 1929710 - RNA, 19 nt, Homo sapiens
cacggacgcgcgugacaca

SEQ ID NO: 1929711 - RNA, 13 nt, Homo sapiens
agaaccucuccaa

SEQ ID NO: 1929712 - RNA, 19 nt, Homo sapiens
auauugcagcuuauauuca

SEQ ID NO: 1929713 - RNA, 18 nt, Homo sapiens
ggacauuccaauuugcac

SEQ ID NO: 1929714 - RNA, 14 nt, Homo sapiens
cuuucagcauuagg

SEQ ID NO: 1929715 - RNA, 21 nt, Homo sapiens
guugaaacugcuugagcauca

SEQ ID NO: 1929716 - RNA, 16 nt, Homo sapiens
ugcaaccaacugcugc

SEQ ID NO: 1929717 - RNA, 18 nt, Homo sapiens
gauuuccuuuggcaauau

SEQ ID NO: 1929718 - RNA, 23 nt, Homo sapiens
aaccagcccgucuucucucucug

SEQ ID NO: 1929719 - RNA, 18 nt, Homo sapiens
auggcgugugugccguga

SEQ ID NO: 1929720 - RNA, 15 nt, Homo sapiens
gugugcaaaggugag

SEQ ID NO: 1929721 - RNA, 23 nt, Homo sapiens
uucaugcuggccugugugauaca

SEQ ID NO: 1929722 - RNA, 23 nt, Homo sapiens
aucuacauacacaguggccaagc

SEQ ID NO: 1929723 - RNA, 15 nt, Homo sapiens
agacaccaugugcaa

SEQ ID NO: 1929724 - RNA, 15 nt, Homo sapiens
agaugauuguucaaa

SEQ ID NO: 1929725 - RNA, 19 nt, Homo sapiens
augucuaacaggacuugaa

SEQ ID NO: 1929726 - RNA, 17 nt, Homo sapiens
aagcucaacuguugcca

SEQ ID NO: 1929727 - RNA, 17 nt, Homo sapiens
cagauccaccugcacaa

SEQ ID NO: 1929728 - RNA, 20 nt, Homo sapiens
uggccaaccaaagacacugu

SEQ ID NO: 1929729 - RNA, 11 nt, Homo sapiens
ugcauggauuu

SEQ ID NO: 1929730 - RNA, 20 nt, Homo sapiens
ugccaaagaagccuugccau

SEQ ID NO: 1929731 - RNA, 17 nt, Homo sapiens
agcagagaccaccacau

SEQ ID NO: 1929732 - RNA, 21 nt, Homo sapiens
uccugcauagucuguuccuuu

SEQ ID NO: 1929733 - RNA, 12 nt, Homo sapiens
ucagcacuguaa

SEQ ID NO: 1929734 - RNA, 17 nt, Homo sapiens
cccugcugugugacuuu

SEQ ID NO: 1929735 - RNA, 16 nt, Homo sapiens
acaaccaaaaaauucu

SEQ ID NO: 1929736 - RNA, 19 nt, Homo sapiens
accccagcuuuucuugcca

SEQ ID NO: 1929737 - RNA, 21 nt, Homo sapiens
ggguaugucuuuaucaaagga

SEQ ID NO: 1929738 - RNA, 15 nt, Homo sapiens
uguaauugacacuau

SEQ ID NO: 1929739 - RNA, 23 nt, Homo sapiens
ccucagacccagggguccaggcc

SEQ ID NO: 1929740 - RNA, 19 nt, Homo sapiens
auuauuuaaacaucagcaa

SEQ ID NO: 1929741 - RNA, 18 nt, Homo sapiens
ucaguugugcagcuuuug

SEQ ID NO: 1929742 - RNA, 17 nt, Homo sapiens
ccaagucuguaccucaa

SEQ ID NO: 1929743 - RNA, 13 nt, Homo sapiens
aacugaaccaaau

SEQ ID NO: 1929744 - RNA, 14 nt, Homo sapiens
gaccacaccaagga

SEQ ID NO: 1929745 - RNA, 17 nt, Homo sapiens
acaauguuugauacucu

SEQ ID NO: 1929746 - RNA, 18 nt, Homo sapiens
caggccaggagacuguua

SEQ ID NO: 1929747 - RNA, 19 nt, Homo sapiens
acauaagcaaagacuauga

SEQ ID NO: 1929748 - RNA, 21 nt, Homo sapiens
cuuuugagacuuuuuggugga

SEQ ID NO: 1929749 - RNA, 18 nt, Homo sapiens
ugagaaauugugccaaag

SEQ ID NO: 1929750 - RNA, 18 nt, Homo sapiens
ggacccccacgauuggcc

SEQ ID NO: 1929751 - RNA, 16 nt, Homo sapiens
gccacacggaagcaag

SEQ ID NO: 1929752 - RNA, 20 nt, Homo sapiens
agagauuagccuguagcuua

SEQ ID NO: 1929753 - RNA, 15 nt, Homo sapiens
gucuauuguauauau

SEQ ID NO: 1929754 - RNA, 14 nt, Homo sapiens
uaaguaaacuaaug

SEQ ID NO: 1929755 - RNA, 14 nt, Homo sapiens
guuuacuugacaaa

SEQ ID NO: 1929756 - RNA, 22 nt, Homo sapiens
ucaggggugauaacucaggaag

SEQ ID NO: 1929757 - RNA, 21 nt, Homo sapiens
gcugcagggacagcccugaca

SEQ ID NO: 1929758 - RNA, 22 nt, Homo sapiens
guccuucacauuuacuagcugu

SEQ ID NO: 1929759 - RNA, 21 nt, Homo sapiens
auggcuccugcagcacuuuuu

SEQ ID NO: 1929760 - RNA, 15 nt, Homo sapiens
ucugcauguguguug

SEQ ID NO: 1929761 - RNA, 13 nt, Homo sapiens
uugagaagcacug

SEQ ID NO: 1929762 - RNA, 15 nt, Homo sapiens
augauaagauuuacc

SEQ ID NO: 1929763 - RNA, 15 nt, Homo sapiens
cacuugugacuuuug

SEQ ID NO: 1929764 - RNA, 21 nt, Homo sapiens
cagugcauagcgaagaccagu

SEQ ID NO: 1929765 - RNA, 12 nt, Homo sapiens
uucuuugcaaag

SEQ ID NO: 1929766 - RNA, 23 nt, Homo sapiens
uuaaaaaauauuugucauaugaa

SEQ ID NO: 1929767 - RNA, 20 nt, Homo sapiens
aggacggguaccaugcugcc

SEQ ID NO: 1929768 - RNA, 22 nt, Homo sapiens
ucauccuacccuaaugccaguu

SEQ ID NO: 1929769 - RNA, 20 nt, Homo sapiens
agcaggcaaaagacuugaau

SEQ ID NO: 1929770 - RNA, 16 nt, Homo sapiens
acauuaacggugcuaa

SEQ ID NO: 1929771 - RNA, 19 nt, Homo sapiens
guuuuccugaaauccucaa

SEQ ID NO: 1929772 - RNA, 18 nt, Homo sapiens
ugaggagacaucuacaca

SEQ ID NO: 1929773 - RNA, 20 nt, Homo sapiens
ccauuccggcccaccucccu

SEQ ID NO: 1929774 - RNA, 15 nt, Homo sapiens
agccacuuucugcca

SEQ ID NO: 1929775 - RNA, 23 nt, Homo sapiens
uacugcaaaugcuauauugcacu

SEQ ID NO: 1929776 - RNA, 20 nt, Homo sapiens
accuccacccagugauccca

SEQ ID NO: 1929777 - RNA, 15 nt, Homo sapiens
acagugccaacuccu

SEQ ID NO: 1929778 - RNA, 19 nt, Homo sapiens
gguaacugcuuucuguucc

SEQ ID NO: 1929779 - RNA, 24 nt, Homo sapiens
ggacaaaagggguuaauguuacuu

SEQ ID NO: 1929780 - RNA, 15 nt, Homo sapiens
uauuuauaaccaaca

SEQ ID NO: 1929781 - RNA, 20 nt, Homo sapiens
gacauuccuucuacauguaa

SEQ ID NO: 1929782 - RNA, 22 nt, Homo sapiens
agccucuggcaaguagcuuucu

SEQ ID NO: 1929783 - RNA, 13 nt, Homo sapiens
ccauguuggaucu

SEQ ID NO: 1929784 - RNA, 17 nt, Homo sapiens
ccugugcuggacuguuu

SEQ ID NO: 1929785 - RNA, 23 nt, Homo sapiens
ugaccccuguccccacacugacc

SEQ ID NO: 1929786 - RNA, 12 nt, Homo sapiens
auaacacugcuu

SEQ ID NO: 1929787 - RNA, 21 nt, Homo sapiens
aacuuuaauaagaucuagucu

SEQ ID NO: 1929788 - RNA, 19 nt, Homo sapiens
cuguucucaaaugcuaaau

SEQ ID NO: 1929789 - RNA, 19 nt, Homo sapiens
aaaaaucccauuuaugcaa

SEQ ID NO: 1929790 - RNA, 15 nt, Homo sapiens
cuucugcucagcucu

SEQ ID NO: 1929791 - RNA, 20 nt, Homo sapiens
uguugcccacauuaagcacu

SEQ ID NO: 1929792 - RNA, 14 nt, Homo sapiens
ugcuaccugugagc

SEQ ID NO: 1929793 - RNA, 21 nt, Homo sapiens
cuccacgaagccuuaagccau

SEQ ID NO: 1929794 - RNA, 19 nt, Homo sapiens
auaucuguguauuaucuca

SEQ ID NO: 1929795 - RNA, 17 nt, Homo sapiens
ucacccagagccagugu

SEQ ID NO: 1929796 - RNA, 16 nt, Homo sapiens
agacuagacuacucaa

SEQ ID NO: 1929797 - RNA, 17 nt, Homo sapiens
auguaagccaagucaug

SEQ ID NO: 1929798 - RNA, 21 nt, Homo sapiens
acacuaauguauuauauguaa

SEQ ID NO: 1929799 - RNA, 14 nt, Homo sapiens
ucagugaaagccag

SEQ ID NO: 1929800 - RNA, 20 nt, Homo sapiens
cuuuaaaaguaucuuuaaca

SEQ ID NO: 1929801 - RNA, 19 nt, Homo sapiens
uaccaagcauguuucacau

SEQ ID NO: 1929802 - RNA, 16 nt, Homo sapiens
agcaaaagaccaaauc

SEQ ID NO: 1929803 - RNA, 20 nt, Homo sapiens
augucuacaugccaugaccu

SEQ ID NO: 1929804 - RNA, 18 nt, Homo sapiens
uccagucaacaucgugga

SEQ ID NO: 1929805 - RNA, 16 nt, Homo sapiens
aucaauaaacagcagg

SEQ ID NO: 1929806 - RNA, 20 nt, Homo sapiens
uccuauccccggacgcaugc

SEQ ID NO: 1929807 - RNA, 21 nt, Homo sapiens
cagacuaugaauauuauagua

SEQ ID NO: 1929808 - RNA, 17 nt, Homo sapiens
ccacaauugaacuucca

SEQ ID NO: 1929809 - RNA, 20 nt, Homo sapiens
aauggcacgaucucagcuca

SEQ ID NO: 1929810 - RNA, 13 nt, Homo sapiens
gucuuucuuugcu

SEQ ID NO: 1929811 - RNA, 18 nt, Homo sapiens
agcuggaccaguggugcc

SEQ ID NO: 1929812 - RNA, 22 nt, Homo sapiens
agugguuagagcugcucagccu

SEQ ID NO: 1929813 - RNA, 16 nt, Homo sapiens
augaaugcuucuagaa

SEQ ID NO: 1929814 - RNA, 22 nt, Homo sapiens
auguccauuugucccaauagcu

SEQ ID NO: 1929815 - RNA, 23 nt, Homo sapiens
aaugcugagauccucauuuaugu

SEQ ID NO: 1929816 - RNA, 16 nt, Homo sapiens
uucugccuucuggaau

SEQ ID NO: 1929817 - RNA, 17 nt, Homo sapiens
aggcaagcguguucuca

SEQ ID NO: 1929818 - RNA, 20 nt, Homo sapiens
uuuccccaauuaauugcuau

SEQ ID NO: 1929819 - RNA, 20 nt, Homo sapiens
cacccucauucuacugaaaa

SEQ ID NO: 1929820 - RNA, 15 nt, Homo sapiens
gguuuuagcauuguc

SEQ ID NO: 1929821 - RNA, 20 nt, Homo sapiens
ugaagcaacagagaggaaau

SEQ ID NO: 1929822 - RNA, 18 nt, Homo sapiens
aagccuauguaugccaug

SEQ ID NO: 1929823 - RNA, 22 nt, Homo sapiens
augcagccaaccaagaugcaaa

SEQ ID NO: 1929824 - RNA, 14 nt, Homo sapiens
uggggaacagagcg

SEQ ID NO: 1929825 - RNA, 15 nt, Homo sapiens
ugccacauacaggug

SEQ ID NO: 1929826 - RNA, 17 nt, Homo sapiens
agaaucagguuuccaau

SEQ ID NO: 1929827 - RNA, 19 nt, Homo sapiens
acaaggccccucugcaacu

SEQ ID NO: 1929828 - RNA, 16 nt, Homo sapiens
uggaggugcugcucua

SEQ ID NO: 1929829 - RNA, 17 nt, Homo sapiens
uggacuuggucaccagc

SEQ ID NO: 1929830 - RNA, 21 nt, Homo sapiens
uaccuuaagauuuuucuuuuc

SEQ ID NO: 1929831 - RNA, 18 nt, Homo sapiens
cugcugugugaauuccca

SEQ ID NO: 1929832 - RNA, 17 nt, Homo sapiens
gcagaaaacauuguucc

SEQ ID NO: 1929833 - RNA, 21 nt, Homo sapiens
aaaugccacguggucacugug

SEQ ID NO: 1929834 - RNA, 14 nt, Homo sapiens
acuguguguugcca

SEQ ID NO: 1929835 - RNA, 20 nt, Homo sapiens
augauuguucaaagcacaga

SEQ ID NO: 1929836 - RNA, 17 nt, Homo sapiens
aucugucuugucauucc

SEQ ID NO: 1929837 - RNA, 12 nt, Homo sapiens
gaacacaggccc

SEQ ID NO: 1929838 - RNA, 12 nt, Homo sapiens
cacaacagccaa

SEQ ID NO: 1929839 - RNA, 15 nt, Homo sapiens
ccaaggaaaccgccu

SEQ ID NO: 1929840 - RNA, 23 nt, Homo sapiens
ugugggugcagcugucacagccc

SEQ ID NO: 1929841 - RNA, 18 nt, Homo sapiens
acuggguucggauuguga

SEQ ID NO: 1929842 - RNA, 14 nt, Homo sapiens
acacugaagcucuu

SEQ ID NO: 1929843 - RNA, 14 nt, Homo sapiens
ucaaccaacugcaa

SEQ ID NO: 1929844 - RNA, 15 nt, Homo sapiens
cuaagcacucuagaa

SEQ ID NO: 1929845 - RNA, 14 nt, Homo sapiens
gucucaauugggaa

SEQ ID NO: 1929846 - RNA, 12 nt, Homo sapiens
acagcuaauaau

SEQ ID NO: 1929847 - RNA, 24 nt, Homo sapiens
aagaucuuucaggacucuaccuca

SEQ ID NO: 1929848 - RNA, 21 nt, Homo sapiens
aaagugacuaauggcaugaga

SEQ ID NO: 1929849 - RNA, 14 nt, Homo sapiens
ggucugugugauga

SEQ ID NO: 1929850 - RNA, 19 nt, Homo sapiens
gaaaagcacuuugaaaaau

SEQ ID NO: 1929851 - RNA, 14 nt, Homo sapiens
aagggcuagauuau

SEQ ID NO: 1929852 - RNA, 22 nt, Homo sapiens
acucuauggguaucaaacagcu

SEQ ID NO: 1929853 - RNA, 21 nt, Homo sapiens
auuugauacauuuuuguacua

SEQ ID NO: 1929854 - RNA, 15 nt, Homo sapiens
uuccucucucccacc

SEQ ID NO: 1929855 - RNA, 17 nt, Homo sapiens
aaacuaagucagaaagu

SEQ ID NO: 1929856 - RNA, 15 nt, Homo sapiens
aggcaauacauguau

SEQ ID NO: 1929857 - RNA, 14 nt, Homo sapiens
gugagcaacugcga

SEQ ID NO: 1929858 - RNA, 19 nt, Homo sapiens
auguugccaccuguuaaaa

SEQ ID NO: 1929859 - RNA, 16 nt, Homo sapiens
gcaaucuccuuacugu

SEQ ID NO: 1929860 - RNA, 20 nt, Homo sapiens
agaagcaugaucacagcuca

SEQ ID NO: 1929861 - RNA, 14 nt, Homo sapiens
aacaaaauugcaau

SEQ ID NO: 1929862 - RNA, 20 nt, Homo sapiens
gcauugagccaguggugcua

SEQ ID NO: 1929863 - RNA, 16 nt, Homo sapiens
ucacacuaugugcaaa

SEQ ID NO: 1929864 - RNA, 17 nt, Homo sapiens
cauuuagucaugugacc

SEQ ID NO: 1929865 - RNA, 22 nt, Homo sapiens
uuaaaggagaaguagcugugaa

SEQ ID NO: 1929866 - RNA, 16 nt, Homo sapiens
guuauaagaaacagag

SEQ ID NO: 1929867 - RNA, 18 nt, Homo sapiens
cuuauauaauaacaauug

SEQ ID NO: 1929868 - RNA, 23 nt, Homo sapiens
ucaaauuuacugucuuaaaucag

SEQ ID NO: 1929869 - RNA, 15 nt, Homo sapiens
auucaccuguggaug

SEQ ID NO: 1929870 - RNA, 22 nt, Homo sapiens
cauucccgcagugggagcaaac

SEQ ID NO: 1929871 - RNA, 22 nt, Homo sapiens
uggagaaaauggguuuauucac

SEQ ID NO: 1929872 - RNA, 16 nt, Homo sapiens
ucauaacucugugauc

SEQ ID NO: 1929873 - RNA, 18 nt, Homo sapiens
uugccaaggaauguaaau

SEQ ID NO: 1929874 - RNA, 16 nt, Homo sapiens
acccaggcugccugag

SEQ ID NO: 1929875 - RNA, 14 nt, Homo sapiens
uguguucuguagag

SEQ ID NO: 1929876 - RNA, 9 nt, Homo sapiens
gaguucucu

SEQ ID NO: 1929877 - RNA, 21 nt, Homo sapiens
aaguguuuuaauuucuacaca

SEQ ID NO: 1929878 - RNA, 14 nt, Homo sapiens
cacuagaagcacag

SEQ ID NO: 1929879 - RNA, 17 nt, Homo sapiens
ucucuugccucagcuuc

SEQ ID NO: 1929880 - RNA, 15 nt, Homo sapiens
ucaguaacagugcag

SEQ ID NO: 1929881 - RNA, 12 nt, Homo sapiens
uacaucauaugu

SEQ ID NO: 1929882 - RNA, 14 nt, Homo sapiens
ucaaaacauugaua

SEQ ID NO: 1929883 - RNA, 15 nt, Homo sapiens
cacgcagcuggcaga

SEQ ID NO: 1929884 - RNA, 15 nt, Homo sapiens
cauuauuuugauuga

SEQ ID NO: 1929885 - RNA, 15 nt, Homo sapiens
guaggggauguggag

SEQ ID NO: 1929886 - RNA, 21 nt, Homo sapiens
ucuguaacugagcuccuccac

SEQ ID NO: 1929887 - RNA, 15 nt, Homo sapiens
gucgccccucagagc

SEQ ID NO: 1929888 - RNA, 12 nt, Homo sapiens
caagugccauuc

SEQ ID NO: 1929889 - RNA, 14 nt, Homo sapiens
aggcagaaagggaa

SEQ ID NO: 1929890 - RNA, 14 nt, Homo sapiens
aguaugggaucuga

SEQ ID NO: 1929891 - RNA, 14 nt, Homo sapiens
gcucgauuccucag

SEQ ID NO: 1929892 - RNA, 21 nt, Homo sapiens
aaccuacuuguaaacuugaaa

SEQ ID NO: 1929893 - RNA, 14 nt, Homo sapiens
uuuuaaacauucuu

SEQ ID NO: 1929894 - RNA, 18 nt, Homo sapiens
cucucccagucuacccag

SEQ ID NO: 1929895 - RNA, 18 nt, Homo sapiens
gagcaugacagccugcag

SEQ ID NO: 1929896 - RNA, 13 nt, Homo sapiens
ugaaucaaucugg

SEQ ID NO: 1929897 - RNA, 17 nt, Homo sapiens
uugccaaguuuuaagag

SEQ ID NO: 1929898 - RNA, 21 nt, Homo sapiens
uuucagguccagaguaguuuc

SEQ ID NO: 1929899 - RNA, 22 nt, Homo sapiens
gucucuguacgggccaguuucu

SEQ ID NO: 1929900 - RNA, 16 nt, Homo sapiens
uggaaguuguugcuau

SEQ ID NO: 1929901 - RNA, 12 nt, Homo sapiens
aaaaaccugccu

SEQ ID NO: 1929902 - RNA, 22 nt, Homo sapiens
guagucagaacuauaacauuca

SEQ ID NO: 1929903 - RNA, 22 nt, Homo sapiens
ccaaauauguuaagggcuuuaa

SEQ ID NO: 1929904 - RNA, 20 nt, Homo sapiens
aaggcagagcgcaaagugcu

SEQ ID NO: 1929905 - RNA, 18 nt, Homo sapiens
cuuccacaauggucucag

SEQ ID NO: 1929906 - RNA, 19 nt, Homo sapiens
caaagauaagguuauagua

SEQ ID NO: 1929907 - RNA, 15 nt, Homo sapiens
uaagaugcacugaaa

SEQ ID NO: 1929908 - RNA, 15 nt, Homo sapiens
cauaugauccaguua

SEQ ID NO: 1929909 - RNA, 18 nt, Homo sapiens
gggcagucguaaggguug

SEQ ID NO: 1929910 - RNA, 15 nt, Homo sapiens
cuuucugaauugcac

SEQ ID NO: 1929911 - RNA, 19 nt, Homo sapiens
gucucugcuccuacaucca

SEQ ID NO: 1929912 - RNA, 23 nt, Homo sapiens
caaagccacacucugggcuccag

SEQ ID NO: 1929913 - RNA, 22 nt, Homo sapiens
auaccagucaccuccugcuccu

SEQ ID NO: 1929914 - RNA, 15 nt, Homo sapiens
uugaagucaucauaa

SEQ ID NO: 1929915 - RNA, 21 nt, Homo sapiens
acagcugccaucgaccuggag

SEQ ID NO: 1929916 - RNA, 19 nt, Homo sapiens
cuccuuucuccugugaaug

SEQ ID NO: 1929917 - RNA, 23 nt, Homo sapiens
uggaaaauaagacaauaguauuu

SEQ ID NO: 1929918 - RNA, 16 nt, Homo sapiens
uguugaaaugguccau

SEQ ID NO: 1929919 - RNA, 14 nt, Homo sapiens
caugcacacaaaca

SEQ ID NO: 1929920 - RNA, 19 nt, Homo sapiens
uggccacccgcccacagcc

SEQ ID NO: 1929921 - RNA, 23 nt, Homo sapiens
guuuuuaaaugccacaagacaua

SEQ ID NO: 1929922 - RNA, 22 nt, Homo sapiens
ugcaaaaauuaauacacaaaua

SEQ ID NO: 1929923 - RNA, 23 nt, Homo sapiens
gaugaaauaacuccuucuuguag

SEQ ID NO: 1929924 - RNA, 13 nt, Homo sapiens
ucauguacuuccu

SEQ ID NO: 1929925 - RNA, 17 nt, Homo sapiens
ugacauguacgauucac

SEQ ID NO: 1929926 - RNA, 12 nt, Homo sapiens
caccccacugag

SEQ ID NO: 1929927 - RNA, 22 nt, Homo sapiens
ucuuuccaggcuucccugacuu

SEQ ID NO: 1929928 - RNA, 18 nt, Homo sapiens
auucugcaagcaauacaa

SEQ ID NO: 1929929 - RNA, 12 nt, Homo sapiens
cucacaguacug

SEQ ID NO: 1929930 - RNA, 19 nt, Homo sapiens
caugaaggucuaccugaaa

SEQ ID NO: 1929931 - RNA, 21 nt, Homo sapiens
aaucaccccucucagugcacc

SEQ ID NO: 1929932 - RNA, 18 nt, Homo sapiens
agauguuuaguaaucaua

SEQ ID NO: 1929933 - RNA, 19 nt, Homo sapiens
uacugucucucuugucaca

SEQ ID NO: 1929934 - RNA, 17 nt, Homo sapiens
auuggcuacuauggcaa

SEQ ID NO: 1929935 - RNA, 17 nt, Homo sapiens
ucuuagccccagacucu

SEQ ID NO: 1929936 - RNA, 19 nt, Homo sapiens
aagcauacaagauucuucc

SEQ ID NO: 1929937 - RNA, 22 nt, Homo sapiens
aaguggaaacaauaaaaccugg

SEQ ID NO: 1929938 - RNA, 13 nt, Homo sapiens
ggcuugaggccag

SEQ ID NO: 1929939 - RNA, 17 nt, Homo sapiens
acugguuggguuugcuu

SEQ ID NO: 1929940 - RNA, 14 nt, Homo sapiens
auucaggacuugaa

SEQ ID NO: 1929941 - RNA, 22 nt, Homo sapiens
cugauacacagaauauaaucuu

SEQ ID NO: 1929942 - RNA, 16 nt, Homo sapiens
aggcuuucuguugcca

SEQ ID NO: 1929943 - RNA, 20 nt, Homo sapiens
ucagucugauuaauuuguua

SEQ ID NO: 1929944 - RNA, 15 nt, Homo sapiens
uacuauugaaguaug

SEQ ID NO: 1929945 - RNA, 13 nt, Homo sapiens
agagcuuggacua

SEQ ID NO: 1929946 - RNA, 20 nt, Homo sapiens
aauucaucauugggcucacu

SEQ ID NO: 1929947 - RNA, 16 nt, Homo sapiens
uguggauacagugccc

SEQ ID NO: 1929948 - RNA, 22 nt, Homo sapiens
augcauaaagccaaauuuccag

SEQ ID NO: 1929949 - RNA, 17 nt, Homo sapiens
agccagaggucuggccc

SEQ ID NO: 1929950 - RNA, 22 nt, Homo sapiens
cugccuggauccagcucuggga

SEQ ID NO: 1929951 - RNA, 12 nt, Homo sapiens
ucuagauuugau

SEQ ID NO: 1929952 - RNA, 13 nt, Homo sapiens
aaaccacuguaua

SEQ ID NO: 1929953 - RNA, 12 nt, Homo sapiens
ccaauagcuuua

SEQ ID NO: 1929954 - RNA, 21 nt, Homo sapiens
uucgucggaggcaucauggaa

SEQ ID NO: 1929955 - RNA, 16 nt, Homo sapiens
cauucucccuccuucc

SEQ ID NO: 1929956 - RNA, 14 nt, Homo sapiens
agaccugacguccc

SEQ ID NO: 1929957 - RNA, 14 nt, Homo sapiens
caagagacauauaa

SEQ ID NO: 1929958 - RNA, 18 nt, Homo sapiens
ggcugccgcauuccugca

SEQ ID NO: 1929959 - RNA, 12 nt, Homo sapiens
acagagcgagac

SEQ ID NO: 1929960 - RNA, 17 nt, Homo sapiens
ugccauggacaugaguu

SEQ ID NO: 1929961 - RNA, 18 nt, Homo sapiens
uagcugagccuucugaug

SEQ ID NO: 1929962 - RNA, 23 nt, Homo sapiens
uggcugcuguugcuuaaaccacu

SEQ ID NO: 1929963 - RNA, 16 nt, Homo sapiens
acuauuacaccaaaua

SEQ ID NO: 1929964 - RNA, 14 nt, Homo sapiens
aaugggacugugag

SEQ ID NO: 1929965 - RNA, 15 nt, Homo sapiens
caccugucaaccuga

SEQ ID NO: 1929966 - RNA, 21 nt, Homo sapiens
uuucaccccaucccuccuuaa

SEQ ID NO: 1929967 - RNA, 19 nt, Homo sapiens
caugcuuguggccaaugca

SEQ ID NO: 1929968 - RNA, 12 nt, Homo sapiens
ccgaacaccauu

SEQ ID NO: 1929969 - RNA, 12 nt, Homo sapiens
uccuugcacacu

SEQ ID NO: 1929970 - RNA, 12 nt, Homo sapiens
aguccauuuuaa

SEQ ID NO: 1929971 - RNA, 19 nt, Homo sapiens
augucucuuuaaugucaca

SEQ ID NO: 1929972 - RNA, 14 nt, Homo sapiens
ugcauuaagugaaa

SEQ ID NO: 1929973 - RNA, 13 nt, Homo sapiens
cuugacuggggau

SEQ ID NO: 1929974 - RNA, 17 nt, Homo sapiens
aacaaaagugcuuugga

SEQ ID NO: 1929975 - RNA, 17 nt, Homo sapiens
gaaacugcgaggccagu

SEQ ID NO: 1929976 - RNA, 13 nt, Homo sapiens
agccucaucucuu

SEQ ID NO: 1929977 - RNA, 22 nt, Homo sapiens
acugcaguagugcaccaucuca

SEQ ID NO: 1929978 - RNA, 20 nt, Homo sapiens
uguccacacuaccaguuuca

SEQ ID NO: 1929979 - RNA, 18 nt, Homo sapiens
gcagagugauucaggggc

SEQ ID NO: 1929980 - RNA, 15 nt, Homo sapiens
gaaccucugucucau

SEQ ID NO: 1929981 - RNA, 14 nt, Homo sapiens
ucagggagacaaga

SEQ ID NO: 1929982 - RNA, 18 nt, Homo sapiens
augagcuccauguugcuu

SEQ ID NO: 1929983 - RNA, 21 nt, Homo sapiens
ucgauuuuuaagagccuucaa

SEQ ID NO: 1929984 - RNA, 22 nt, Homo sapiens
cauaacgcugacugcaaaaacu

SEQ ID NO: 1929985 - RNA, 20 nt, Homo sapiens
ucaggaugauacacuaugaa

SEQ ID NO: 1929986 - RNA, 19 nt, Homo sapiens
cuaaauguauauguugauu

SEQ ID NO: 1929987 - RNA, 22 nt, Homo sapiens
cucugcagauagugccucugca

SEQ ID NO: 1929988 - RNA, 15 nt, Homo sapiens
caguggacucuucca

SEQ ID NO: 1929989 - RNA, 12 nt, Homo sapiens
auugcauuugcu

SEQ ID NO: 1929990 - RNA, 16 nt, Homo sapiens
uuagggcuaucucagg

SEQ ID NO: 1929991 - RNA, 18 nt, Homo sapiens
auaauuaaaaccaucugg

SEQ ID NO: 1929992 - RNA, 23 nt, Homo sapiens
ccuuuguuuuuacgucauuacaa

SEQ ID NO: 1929993 - RNA, 17 nt, Homo sapiens
gaaaaauaccaacucag

SEQ ID NO: 1929994 - RNA, 13 nt, Homo sapiens
cagagugccccac

SEQ ID NO: 1929995 - RNA, 16 nt, Homo sapiens
guugcagucuaaccca

SEQ ID NO: 1929996 - RNA, 14 nt, Homo sapiens
uaauugcuucacag

SEQ ID NO: 1929997 - RNA, 19 nt, Homo sapiens
ccccagaacauacacugug

SEQ ID NO: 1929998 - RNA, 15 nt, Homo sapiens
cauucuaugacaaua

SEQ ID NO: 1929999 - RNA, 23 nt, Homo sapiens
ggacggcuguggaccguggacag

SEQ ID NO: 1930000 - RNA, 16 nt, Homo sapiens
aagugcgaguccucca

SEQ ID NO: 1930001 - RNA, 19 nt, Homo sapiens
cuauuggugcuugacucuc

SEQ ID NO: 1930002 - RNA, 17 nt, Homo sapiens
cuauucaaacagucuca

SEQ ID NO: 1930003 - RNA, 19 nt, Homo sapiens
aagauuccuguccuugaga

SEQ ID NO: 1930004 - RNA, 21 nt, Homo sapiens
gaauuuaucucuuuaguuagu

SEQ ID NO: 1930005 - RNA, 22 nt, Homo sapiens
accucauagcuaauuuuugcaa

SEQ ID NO: 1930006 - RNA, 22 nt, Homo sapiens
ccuuaguuacccugaucuggac

SEQ ID NO: 1930007 - RNA, 22 nt, Homo sapiens
uccgcuggauggggagucucau

SEQ ID NO: 1930008 - RNA, 16 nt, Homo sapiens
ucagggcagggcucau

SEQ ID NO: 1930009 - RNA, 22 nt, Homo sapiens
cagaggaugcaacaaauguggc

SEQ ID NO: 1930010 - RNA, 22 nt, Homo sapiens
gagcuaguuaaacagugccauu

SEQ ID NO: 1930011 - RNA, 12 nt, Homo sapiens
agcccucugugg

SEQ ID NO: 1930012 - RNA, 20 nt, Homo sapiens
accugaaguagaacuuaaga

SEQ ID NO: 1930013 - RNA, 23 nt, Homo sapiens
cauaugccuuggggaggacaaaa

SEQ ID NO: 1930014 - RNA, 21 nt, Homo sapiens
gaacauguccuacaacagccu

SEQ ID NO: 1930015 - RNA, 16 nt, Homo sapiens
aucccauacucucaau

SEQ ID NO: 1930016 - RNA, 14 nt, Homo sapiens
gagauaaacuacau

SEQ ID NO: 1930017 - RNA, 20 nt, Homo sapiens
aaaaugcaagccaucucuaa

SEQ ID NO: 1930018 - RNA, 15 nt, Homo sapiens
acauggaaaaauccu

SEQ ID NO: 1930019 - RNA, 14 nt, Homo sapiens
uucguucugcugac

SEQ ID NO: 1930020 - RNA, 22 nt, Homo sapiens
uuuaauucucauuuguucucac

SEQ ID NO: 1930021 - RNA, 22 nt, Homo sapiens
gaguuggcaugacucuugacuc

SEQ ID NO: 1930022 - RNA, 21 nt, Homo sapiens
aaccagcccgucuucucucuc

SEQ ID NO: 1930023 - RNA, 15 nt, Homo sapiens
acauagccucaccaa

SEQ ID NO: 1930024 - RNA, 23 nt, Homo sapiens
ggcuccucgcccccaccagugua

SEQ ID NO: 1930025 - RNA, 12 nt, Homo sapiens
cauuaucuauga

SEQ ID NO: 1930026 - RNA, 15 nt, Homo sapiens
uucuuacuaaucuga

SEQ ID NO: 1930027 - RNA, 20 nt, Homo sapiens
uguuuggauccugacucaaa

SEQ ID NO: 1930028 - RNA, 16 nt, Homo sapiens
ugccaucgggugccaa

SEQ ID NO: 1930029 - RNA, 14 nt, Homo sapiens
gcucugcacagaca

SEQ ID NO: 1930030 - RNA, 11 nt, Homo sapiens
gugcagaucac

SEQ ID NO: 1930031 - RNA, 16 nt, Homo sapiens
auauuccuuugaagau

SEQ ID NO: 1930032 - RNA, 16 nt, Homo sapiens
cugauuaggaauauga

SEQ ID NO: 1930033 - RNA, 22 nt, Homo sapiens
ugcuguuguaaacaacguguau

SEQ ID NO: 1930034 - RNA, 17 nt, Homo sapiens
ccugcuccagcagcaca

SEQ ID NO: 1930035 - RNA, 21 nt, Homo sapiens
gccgcauggccccuccaggaa

SEQ ID NO: 1930036 - RNA, 20 nt, Homo sapiens
aauaaaaaaaaaaggaugaa

SEQ ID NO: 1930037 - RNA, 20 nt, Homo sapiens
uuagccaucuugaagugaug

SEQ ID NO: 1930038 - RNA, 18 nt, Homo sapiens
gcccggcgccgggcacca

SEQ ID NO: 1930039 - RNA, 15 nt, Homo sapiens
auguuaacugaggaa

SEQ ID NO: 1930040 - RNA, 19 nt, Homo sapiens
ugaguugcacagcuaugaa

SEQ ID NO: 1930041 - RNA, 12 nt, Homo sapiens
uggugacuccag

SEQ ID NO: 1930042 - RNA, 20 nt, Homo sapiens
cauugugaagcaccuacuau

SEQ ID NO: 1930043 - RNA, 16 nt, Homo sapiens
caagaugcaacuagga

SEQ ID NO: 1930044 - RNA, 22 nt, Homo sapiens
gcaugaucuugagcaaguuccu

SEQ ID NO: 1930045 - RNA, 24 nt, Homo sapiens
agaauuuaguuuguacucagugga

SEQ ID NO: 1930046 - RNA, 12 nt, Homo sapiens
ucucuaucuuag

SEQ ID NO: 1930047 - RNA, 18 nt, Homo sapiens
ggcaaagugagacugaca

SEQ ID NO: 1930048 - RNA, 13 nt, Homo sapiens
ccuuucuccugau

SEQ ID NO: 1930049 - RNA, 20 nt, Homo sapiens
acugcuccuguggccuucca

SEQ ID NO: 1930050 - RNA, 16 nt, Homo sapiens
uccugguccaucucau

SEQ ID NO: 1930051 - RNA, 20 nt, Homo sapiens
uuuuauaggcauaccuccua

SEQ ID NO: 1930052 - RNA, 14 nt, Homo sapiens
gaagcagagggaca

SEQ ID NO: 1930053 - RNA, 13 nt, Homo sapiens
ucuucaagauuua

SEQ ID NO: 1930054 - RNA, 16 nt, Homo sapiens
cuuuuuuuuaugauca

SEQ ID NO: 1930055 - RNA, 13 nt, Homo sapiens
auaacuacuucca

SEQ ID NO: 1930056 - RNA, 12 nt, Homo sapiens
aaaccaaaaaua

SEQ ID NO: 1930057 - RNA, 20 nt, Homo sapiens
uguagaagaaagagcaacaa

SEQ ID NO: 1930058 - RNA, 19 nt, Homo sapiens
uuaaugccacaaaacugac

SEQ ID NO: 1930059 - RNA, 14 nt, Homo sapiens
uccuguguucuaga

SEQ ID NO: 1930060 - RNA, 18 nt, Homo sapiens
ccacccaccuaugugcca

SEQ ID NO: 1930061 - RNA, 20 nt, Homo sapiens
gacuguuucauucacugugc

SEQ ID NO: 1930062 - RNA, 17 nt, Homo sapiens
ugauugcugagagccau

SEQ ID NO: 1930063 - RNA, 21 nt, Homo sapiens
accaugccagacccacugaaa

SEQ ID NO: 1930064 - RNA, 14 nt, Homo sapiens
ugccauuacauugc

SEQ ID NO: 1930065 - RNA, 16 nt, Homo sapiens
auucagaagacuacua

SEQ ID NO: 1930066 - RNA, 13 nt, Homo sapiens
auuauuaauugca

SEQ ID NO: 1930067 - RNA, 21 nt, Homo sapiens
uaauacugaaccacuuugaua

SEQ ID NO: 1930068 - RNA, 19 nt, Homo sapiens
uagccugaauucuuuucaa

SEQ ID NO: 1930069 - RNA, 18 nt, Homo sapiens
accaucucuucauucaaa

SEQ ID NO: 1930070 - RNA, 14 nt, Homo sapiens
caugaaaaguuuuc

SEQ ID NO: 1930071 - RNA, 14 nt, Homo sapiens
uuuguccuacauuc

SEQ ID NO: 1930072 - RNA, 15 nt, Homo sapiens
cuccuuaccacugug

SEQ ID NO: 1930073 - RNA, 22 nt, Homo sapiens
uucaacaucuagugagcaguca

SEQ ID NO: 1930074 - RNA, 17 nt, Homo sapiens
ugccacugcucuccagc

SEQ ID NO: 1930075 - RNA, 19 nt, Homo sapiens
gucucucuucugcugucuc

SEQ ID NO: 1930076 - RNA, 22 nt, Homo sapiens
uggggcuuccauggugguuuca

SEQ ID NO: 1930077 - RNA, 15 nt, Homo sapiens
guuuauaccaagaga

SEQ ID NO: 1930078 - RNA, 22 nt, Homo sapiens
aguguucuguauuuuaaggugu

SEQ ID NO: 1930079 - RNA, 13 nt, Homo sapiens
cugacuacaaauu

SEQ ID NO: 1930080 - RNA, 23 nt, Homo sapiens
aguuuaacauuagcuaaaacugc

SEQ ID NO: 1930081 - RNA, 15 nt, Homo sapiens
gccaagggccucuug

SEQ ID NO: 1930082 - RNA, 18 nt, Homo sapiens
gcuccaucuccaguggga

SEQ ID NO: 1930083 - RNA, 12 nt, Homo sapiens
uggagcccugga

SEQ ID NO: 1930084 - RNA, 19 nt, Homo sapiens
ccuucuacagcagcacugu

SEQ ID NO: 1930085 - RNA, 18 nt, Homo sapiens
auauguuuucacuguauu

SEQ ID NO: 1930086 - RNA, 15 nt, Homo sapiens
cuguauaucagggua

SEQ ID NO: 1930087 - RNA, 17 nt, Homo sapiens
auacucaaaugguguca

SEQ ID NO: 1930088 - RNA, 18 nt, Homo sapiens
agccaggcaugguggcac

SEQ ID NO: 1930089 - RNA, 17 nt, Homo sapiens
ccagaggcagcuaaggg

SEQ ID NO: 1930090 - RNA, 22 nt, Homo sapiens
gccuggacuagagggaccucuc

SEQ ID NO: 1930091 - RNA, 16 nt, Homo sapiens
aaugaaaaacaaaaag

SEQ ID NO: 1930092 - RNA, 16 nt, Homo sapiens
acaaagagaaugagaa

SEQ ID NO: 1930093 - RNA, 14 nt, Homo sapiens
gcccagggccucug

SEQ ID NO: 1930094 - RNA, 15 nt, Homo sapiens
gucuugguacuugcu

SEQ ID NO: 1930095 - RNA, 14 nt, Homo sapiens
agucucccagaugu

SEQ ID NO: 1930096 - RNA, 15 nt, Homo sapiens
agcugguggacccag

SEQ ID NO: 1930097 - RNA, 14 nt, Homo sapiens
auuagcacagauuu

SEQ ID NO: 1930098 - RNA, 19 nt, Homo sapiens
auccagauguuaugcuccu

SEQ ID NO: 1930099 - RNA, 16 nt, Homo sapiens
ugcuggccacacagca

SEQ ID NO: 1930100 - RNA, 21 nt, Homo sapiens
cuaaaugcuggucuaggagcu

SEQ ID NO: 1930101 - RNA, 16 nt, Homo sapiens
aacuacaaacacaagc

SEQ ID NO: 1930102 - RNA, 19 nt, Homo sapiens
cauuaguuuuaaucucuua

SEQ ID NO: 1930103 - RNA, 23 nt, Homo sapiens
ugcagcacaguacucaggcagug

SEQ ID NO: 1930104 - RNA, 22 nt, Homo sapiens
uggaaugggggugugggggucc

SEQ ID NO: 1930105 - RNA, 20 nt, Homo sapiens
aggcaaagagaaaagccacg

SEQ ID NO: 1930106 - RNA, 22 nt, Homo sapiens
acggagccacuccucugacuca

SEQ ID NO: 1930107 - RNA, 22 nt, Homo sapiens
uguaagaugucuuccuaucaaa

SEQ ID NO: 1930108 - RNA, 17 nt, Homo sapiens
auguucugucaaaugug

SEQ ID NO: 1930109 - RNA, 13 nt, Homo sapiens
aaaggggcacugg

SEQ ID NO: 1930110 - RNA, 13 nt, Homo sapiens
aauaaggcacaaa

SEQ ID NO: 1930111 - RNA, 16 nt, Homo sapiens
accccacacccagggc

SEQ ID NO: 1930112 - RNA, 13 nt, Homo sapiens
auuugcuaugagc

SEQ ID NO: 1930113 - RNA, 15 nt, Homo sapiens
aacccaaacuuccca

SEQ ID NO: 1930114 - RNA, 15 nt, Homo sapiens
cacuggucugucuuu

SEQ ID NO: 1930115 - RNA, 21 nt, Homo sapiens
aaucacagcccucaugaucau

SEQ ID NO: 1930116 - RNA, 14 nt, Homo sapiens
acuccuccaaagca

SEQ ID NO: 1930117 - RNA, 16 nt, Homo sapiens
ucuguuuacaucaguu

SEQ ID NO: 1930118 - RNA, 15 nt, Homo sapiens
uccaagcccaguuca

SEQ ID NO: 1930119 - RNA, 22 nt, Homo sapiens
cuucacauuuuacgacaaggau

SEQ ID NO: 1930120 - RNA, 18 nt, Homo sapiens
cuccuucccuucuuugcu

SEQ ID NO: 1930121 - RNA, 19 nt, Homo sapiens
aauaacucaacuaacucca

SEQ ID NO: 1930122 - RNA, 16 nt, Homo sapiens
gacucugcacucucca

SEQ ID NO: 1930123 - RNA, 19 nt, Homo sapiens
gccccugcgggcuguggug

SEQ ID NO: 1930124 - RNA, 12 nt, Homo sapiens
aaugacuauaaa

SEQ ID NO: 1930125 - RNA, 12 nt, Homo sapiens
cagcauggccac

SEQ ID NO: 1930126 - RNA, 14 nt, Homo sapiens
ugaacuacuaaagu

SEQ ID NO: 1930127 - RNA, 12 nt, Homo sapiens
gcaccaucugcc

SEQ ID NO: 1930128 - RNA, 13 nt, Homo sapiens
cugaagccaggca

SEQ ID NO: 1930129 - RNA, 13 nt, Homo sapiens
gccucaacacuga

SEQ ID NO: 1930130 - RNA, 20 nt, Homo sapiens
accaauuccaccaagacagu

SEQ ID NO: 1930131 - RNA, 23 nt, Homo sapiens
acgucgcccgcugagcugagugg

SEQ ID NO: 1930132 - RNA, 19 nt, Homo sapiens
accauuucucagcaucgug

SEQ ID NO: 1930133 - RNA, 13 nt, Homo sapiens
uaaacagugccau

SEQ ID NO: 1930134 - RNA, 16 nt, Homo sapiens
caucucccucccacau

SEQ ID NO: 1930135 - RNA, 14 nt, Homo sapiens
uuguuuuuugccau

SEQ ID NO: 1930136 - RNA, 14 nt, Homo sapiens
gccuucauaagccu

SEQ ID NO: 1930137 - RNA, 18 nt, Homo sapiens
auaaacccucagagccuc

SEQ ID NO: 1930138 - RNA, 17 nt, Homo sapiens
uaaaaccagcauacagu

SEQ ID NO: 1930139 - RNA, 19 nt, Homo sapiens
gcuuuuaagaaacacaggg

SEQ ID NO: 1930140 - RNA, 13 nt, Homo sapiens
accucacugucag

SEQ ID NO: 1930141 - RNA, 15 nt, Homo sapiens
caaggaaaauggaca

SEQ ID NO: 1930142 - RNA, 21 nt, Homo sapiens
cacuggugggccauuagauuu

SEQ ID NO: 1930143 - RNA, 21 nt, Homo sapiens
cagauauguauuuaaauugaa

SEQ ID NO: 1930144 - RNA, 14 nt, Homo sapiens
cagaagcuugcaga

SEQ ID NO: 1930145 - RNA, 15 nt, Homo sapiens
auccaucaugcaaaa

SEQ ID NO: 1930146 - RNA, 20 nt, Homo sapiens
ggaaagucgugucugucaga

SEQ ID NO: 1930147 - RNA, 15 nt, Homo sapiens
acccugucugagaug

SEQ ID NO: 1930148 - RNA, 19 nt, Homo sapiens
uaauugcagucuaauguca

SEQ ID NO: 1930149 - RNA, 18 nt, Homo sapiens
ucuggcuacgacuuggga

SEQ ID NO: 1930150 - RNA, 21 nt, Homo sapiens
uacuggacacacuaaacucug

SEQ ID NO: 1930151 - RNA, 19 nt, Homo sapiens
cuuccacccccaccaucca

SEQ ID NO: 1930152 - RNA, 18 nt, Homo sapiens
ccuggaaugccaauguca

SEQ ID NO: 1930153 - RNA, 14 nt, Homo sapiens
cauccagacagucg

SEQ ID NO: 1930154 - RNA, 19 nt, Homo sapiens
uucugagcgagugcucuca

SEQ ID NO: 1930155 - RNA, 19 nt, Homo sapiens
guucuggcucuuccaggcu

SEQ ID NO: 1930156 - RNA, 22 nt, Homo sapiens
aguucucagcucuucugacuua

SEQ ID NO: 1930157 - RNA, 20 nt, Homo sapiens
cauacacaguggcaccuuca

SEQ ID NO: 1930158 - RNA, 16 nt, Homo sapiens
gcaauauguuagcaag

SEQ ID NO: 1930159 - RNA, 18 nt, Homo sapiens
acauuggcaaguguaaaa

SEQ ID NO: 1930160 - RNA, 11 nt, Homo sapiens
cucucuugccu

SEQ ID NO: 1930161 - RNA, 14 nt, Homo sapiens
uggacugcauuuaa

SEQ ID NO: 1930162 - RNA, 14 nt, Homo sapiens
uucacuuuuaggga

SEQ ID NO: 1930163 - RNA, 13 nt, Homo sapiens
aggccugagacac

SEQ ID NO: 1930164 - RNA, 12 nt, Homo sapiens
uccaacuauguc

SEQ ID NO: 1930165 - RNA, 19 nt, Homo sapiens
augucugagaucagugccu

SEQ ID NO: 1930166 - RNA, 15 nt, Homo sapiens
gucuccugagcaccc

SEQ ID NO: 1930167 - RNA, 17 nt, Homo sapiens
ugcuuugggaacugugu

SEQ ID NO: 1930168 - RNA, 17 nt, Homo sapiens
cccagcgguucacacag

SEQ ID NO: 1930169 - RNA, 19 nt, Homo sapiens
uaaaaagcaacaggccauu

SEQ ID NO: 1930170 - RNA, 21 nt, Homo sapiens
agugccagcaaugacaucuca

SEQ ID NO: 1930171 - RNA, 22 nt, Homo sapiens
ucccauuaaaaaugagauuucu

SEQ ID NO: 1930172 - RNA, 12 nt, Homo sapiens
aagcaaaugccu

SEQ ID NO: 1930173 - RNA, 21 nt, Homo sapiens
ggauucuggccuagucccuuc

SEQ ID NO: 1930174 - RNA, 20 nt, Homo sapiens
gacuacauauuugcacugaa

SEQ ID NO: 1930175 - RNA, 16 nt, Homo sapiens
uucuugggacugcugu

SEQ ID NO: 1930176 - RNA, 15 nt, Homo sapiens
ucaaaugaucaauaa

SEQ ID NO: 1930177 - RNA, 19 nt, Homo sapiens
uauguucccccuguuucag

SEQ ID NO: 1930178 - RNA, 13 nt, Homo sapiens
uaugagaaacugg

SEQ ID NO: 1930179 - RNA, 19 nt, Homo sapiens
auguauuuucuucaccucu

SEQ ID NO: 1930180 - RNA, 24 nt, Homo sapiens
cguuuuuaagguggaaacuccugu

SEQ ID NO: 1930181 - RNA, 23 nt, Homo sapiens
cugaagcugaccaacacuacaga

SEQ ID NO: 1930182 - RNA, 21 nt, Homo sapiens
augccucauuuuaucauagcc

SEQ ID NO: 1930183 - RNA, 17 nt, Homo sapiens
acuuuugggaaagggcu

SEQ ID NO: 1930184 - RNA, 21 nt, Homo sapiens
ucuuaccuuuugugguucuca

SEQ ID NO: 1930185 - RNA, 15 nt, Homo sapiens
aaucaaugugcuccu

SEQ ID NO: 1930186 - RNA, 17 nt, Homo sapiens
caauaaaaaccaaauua

SEQ ID NO: 1930187 - RNA, 16 nt, Homo sapiens
ucaaaauccacugacg

SEQ ID NO: 1930188 - RNA, 23 nt, Homo sapiens
aaacaagcauagaaauggaagaa

SEQ ID NO: 1930189 - RNA, 23 nt, Homo sapiens
cuccgggccuuucucuggcuucc

SEQ ID NO: 1930190 - RNA, 16 nt, Homo sapiens
cacacagcaguagcag

SEQ ID NO: 1930191 - RNA, 18 nt, Homo sapiens
cucugguggcugccagcu

SEQ ID NO: 1930192 - RNA, 14 nt, Homo sapiens
acuacuauauugau

SEQ ID NO: 1930193 - RNA, 11 nt, Homo sapiens
ugcauuucaac

SEQ ID NO: 1930194 - RNA, 19 nt, Homo sapiens
aggggcugcugaccuccac

SEQ ID NO: 1930195 - RNA, 14 nt, Homo sapiens
accaucuugcugac

SEQ ID NO: 1930196 - RNA, 20 nt, Homo sapiens
gcauucguaaacaccaaaua

SEQ ID NO: 1930197 - RNA, 19 nt, Homo sapiens
aaucuagacauucuuuuaa

SEQ ID NO: 1930198 - RNA, 19 nt, Homo sapiens
aauguuaccacuacuuuaa

SEQ ID NO: 1930199 - RNA, 17 nt, Homo sapiens
uauuauaaagugcuuua

SEQ ID NO: 1930200 - RNA, 13 nt, Homo sapiens
caaugaucuaggu

SEQ ID NO: 1930201 - RNA, 13 nt, Homo sapiens
uugggauccuauu

SEQ ID NO: 1930202 - RNA, 15 nt, Homo sapiens
ucccaguuucucaga

SEQ ID NO: 1930203 - RNA, 16 nt, Homo sapiens
uccauaaauguguucc

SEQ ID NO: 1930204 - RNA, 15 nt, Homo sapiens
aacucccuuucaugu

SEQ ID NO: 1930205 - RNA, 16 nt, Homo sapiens
uacagaaaucaauggu

SEQ ID NO: 1930206 - RNA, 20 nt, Homo sapiens
ucugcugaaggcagucauau

SEQ ID NO: 1930207 - RNA, 20 nt, Homo sapiens
ugccagcuuaucucaggggu

SEQ ID NO: 1930208 - RNA, 23 nt, Homo sapiens
cugucuucucucccacgugcaca

SEQ ID NO: 1930209 - RNA, 22 nt, Homo sapiens
acaugucaauuaaaaugcccau

SEQ ID NO: 1930210 - RNA, 19 nt, Homo sapiens
uuacacaguugcugucaua

SEQ ID NO: 1930211 - RNA, 19 nt, Homo sapiens
aggcugacauucacugagu

SEQ ID NO: 1930212 - RNA, 22 nt, Homo sapiens
ccagaaauccaucuaaauaccu

SEQ ID NO: 1930213 - RNA, 16 nt, Homo sapiens
ggaagcuacccaagga

SEQ ID NO: 1930214 - RNA, 17 nt, Homo sapiens
caagccccuucucucaa

SEQ ID NO: 1930215 - RNA, 14 nt, Homo sapiens
cuuagcaacuuggg

SEQ ID NO: 1930216 - RNA, 18 nt, Homo sapiens
auuauaauuuauggaauu

SEQ ID NO: 1930217 - RNA, 17 nt, Homo sapiens
cugcagaagucccaaga

SEQ ID NO: 1930218 - RNA, 14 nt, Homo sapiens
uguaauagccaaaa

SEQ ID NO: 1930219 - RNA, 19 nt, Homo sapiens
aaucccagcccccugacca

SEQ ID NO: 1930220 - RNA, 19 nt, Homo sapiens
acuaugucuagagccucuu

SEQ ID NO: 1930221 - RNA, 17 nt, Homo sapiens
agcuugaucugugauuu

SEQ ID NO: 1930222 - RNA, 20 nt, Homo sapiens
cccgccugauuggggccuca

SEQ ID NO: 1930223 - RNA, 15 nt, Homo sapiens
aaagucugaaucucc

SEQ ID NO: 1930224 - RNA, 21 nt, Homo sapiens
cgucaagagcaugcacaugcu

SEQ ID NO: 1930225 - RNA, 18 nt, Homo sapiens
gacuguggcaaacaaaac

SEQ ID NO: 1930226 - RNA, 18 nt, Homo sapiens
guaaaugugccaagaaua

SEQ ID NO: 1930227 - RNA, 20 nt, Homo sapiens
uuuacuaauccaacccauga

SEQ ID NO: 1930228 - RNA, 23 nt, Homo sapiens
agggucacuaaccaagccagaaa

SEQ ID NO: 1930229 - RNA, 23 nt, Homo sapiens
auucagugcuguacuugaugaca

SEQ ID NO: 1930230 - RNA, 12 nt, Homo sapiens
uuggacuacaua

SEQ ID NO: 1930231 - RNA, 23 nt, Homo sapiens
uauaaacuauaaccucuccuuca

SEQ ID NO: 1930232 - RNA, 19 nt, Homo sapiens
uagacuguuagacaaaagu

SEQ ID NO: 1930233 - RNA, 11 nt, Homo sapiens
ggcccagaccu

SEQ ID NO: 1930234 - RNA, 14 nt, Homo sapiens
gagcuugcaaugag

SEQ ID NO: 1930235 - RNA, 16 nt, Homo sapiens
acuagccccccagugg

SEQ ID NO: 1930236 - RNA, 19 nt, Homo sapiens
ugcugugggugcagcuguc

SEQ ID NO: 1930237 - RNA, 21 nt, Homo sapiens
uaaaggacugauuugaugccu

SEQ ID NO: 1930238 - RNA, 15 nt, Homo sapiens
ugaaugaaugagcca

SEQ ID NO: 1930239 - RNA, 19 nt, Homo sapiens
gaagcccaguaacugcccu

SEQ ID NO: 1930240 - RNA, 15 nt, Homo sapiens
gcaccuuuucaugua

SEQ ID NO: 1930241 - RNA, 20 nt, Homo sapiens
cccacagcacuacgaugugu

SEQ ID NO: 1930242 - RNA, 21 nt, Homo sapiens
ugaacauauguccauccauau

SEQ ID NO: 1930243 - RNA, 22 nt, Homo sapiens
auucaccaaaauagucuucuca

SEQ ID NO: 1930244 - RNA, 20 nt, Homo sapiens
ugacaaguauuuucuacuaa

SEQ ID NO: 1930245 - RNA, 18 nt, Homo sapiens
augcagggguggggagcg

SEQ ID NO: 1930246 - RNA, 21 nt, Homo sapiens
aagaguagaaaaggauugcuu

SEQ ID NO: 1930247 - RNA, 14 nt, Homo sapiens
ucggaacacauucu

SEQ ID NO: 1930248 - RNA, 22 nt, Homo sapiens
guccacccuuuggagaccaggc

SEQ ID NO: 1930249 - RNA, 13 nt, Homo sapiens
uucuccauacucu

SEQ ID NO: 1930250 - RNA, 18 nt, Homo sapiens
acuguaagucucaauuaa

SEQ ID NO: 1930251 - RNA, 22 nt, Homo sapiens
acaaaaggaaagaaacuaccuu

SEQ ID NO: 1930252 - RNA, 17 nt, Homo sapiens
cucagaccacuugcauu

SEQ ID NO: 1930253 - RNA, 15 nt, Homo sapiens
uuggcacugagauau

SEQ ID NO: 1930254 - RNA, 13 nt, Homo sapiens
caucaagcacuuc

SEQ ID NO: 1930255 - RNA, 12 nt, Homo sapiens
uuuuccaggaau

SEQ ID NO: 1930256 - RNA, 17 nt, Homo sapiens
cauuuguuuuguuuaca

SEQ ID NO: 1930257 - RNA, 17 nt, Homo sapiens
acggucaguuugguguc

SEQ ID NO: 1930258 - RNA, 22 nt, Homo sapiens
aaaaacccugcuaaaugacuua

SEQ ID NO: 1930259 - RNA, 16 nt, Homo sapiens
auugauaauuuagaca

SEQ ID NO: 1930260 - RNA, 23 nt, Homo sapiens
gcuguauuuugaaaaugcuuuag

SEQ ID NO: 1930261 - RNA, 16 nt, Homo sapiens
gaauaaacaggaaaau

SEQ ID NO: 1930262 - RNA, 20 nt, Homo sapiens
uguguaugugcucugugcca

SEQ ID NO: 1930263 - RNA, 22 nt, Homo sapiens
agggcucuuuccuccacaccau

SEQ ID NO: 1930264 - RNA, 15 nt, Homo sapiens
cccagagcagggugu

SEQ ID NO: 1930265 - RNA, 21 nt, Homo sapiens
aauggaaagauccccuaauaa

SEQ ID NO: 1930266 - RNA, 20 nt, Homo sapiens
gcccuggggccuguacaaaa

SEQ ID NO: 1930267 - RNA, 20 nt, Homo sapiens
guccacagaagugagcuccu

SEQ ID NO: 1930268 - RNA, 21 nt, Homo sapiens
gucucuuuaaugucacaggca

SEQ ID NO: 1930269 - RNA, 12 nt, Homo sapiens
agugucaccucc

SEQ ID NO: 1930270 - RNA, 20 nt, Homo sapiens
cgaggccuauuguugaauaa

SEQ ID NO: 1930271 - RNA, 22 nt, Homo sapiens
caucugccaacuguccuacuca

SEQ ID NO: 1930272 - RNA, 18 nt, Homo sapiens
ugccagacuuaaaucaca

SEQ ID NO: 1930273 - RNA, 19 nt, Homo sapiens
auguuuaaggaaaugugca

SEQ ID NO: 1930274 - RNA, 16 nt, Homo sapiens
ugugguaacucagugu

SEQ ID NO: 1930275 - RNA, 16 nt, Homo sapiens
acacagcuacagcuuu

SEQ ID NO: 1930276 - RNA, 23 nt, Homo sapiens
ugcuguugagaugguaacagauu

SEQ ID NO: 1930277 - RNA, 11 nt, Homo sapiens
cuacaggguga

SEQ ID NO: 1930278 - RNA, 21 nt, Homo sapiens
ucccugccugugacuuucaag

SEQ ID NO: 1930279 - RNA, 18 nt, Homo sapiens
uguaaagugcaaucauuu

SEQ ID NO: 1930280 - RNA, 22 nt, Homo sapiens
agacacuaaaaacuguuaauca

SEQ ID NO: 1930281 - RNA, 12 nt, Homo sapiens
cccaacaaugag

SEQ ID NO: 1930282 - RNA, 17 nt, Homo sapiens
gcugguguagcuacaga

SEQ ID NO: 1930283 - RNA, 14 nt, Homo sapiens
aauacaguaucuca

SEQ ID NO: 1930284 - RNA, 14 nt, Homo sapiens
gacuuuguguuauu

SEQ ID NO: 1930285 - RNA, 14 nt, Homo sapiens
ugguggucagggag

SEQ ID NO: 1930286 - RNA, 15 nt, Homo sapiens
caacacugcugucca

SEQ ID NO: 1930287 - RNA, 22 nt, Homo sapiens
augcaccaacccacugcccaug

SEQ ID NO: 1930288 - RNA, 13 nt, Homo sapiens
agaaguaacuuug

SEQ ID NO: 1930289 - RNA, 20 nt, Homo sapiens
aacauuucuauagccaaaaa

SEQ ID NO: 1930290 - RNA, 19 nt, Homo sapiens
uguaguguaccauucucag

SEQ ID NO: 1930291 - RNA, 19 nt, Homo sapiens
uggugaaaccccaucucua

SEQ ID NO: 1930292 - RNA, 21 nt, Homo sapiens
ucuuacauuuuucagacuuca

SEQ ID NO: 1930293 - RNA, 20 nt, Homo sapiens
cuaaauccuuuuguuuugaa

SEQ ID NO: 1930294 - RNA, 16 nt, Homo sapiens
ggaauuucccugugug

SEQ ID NO: 1930295 - RNA, 22 nt, Homo sapiens
cagcugaaagauugauuaauga

SEQ ID NO: 1930296 - RNA, 23 nt, Homo sapiens
gaucucgcuagguagaacacugc

SEQ ID NO: 1930297 - RNA, 20 nt, Homo sapiens
acacggugaaaccccgucuc

SEQ ID NO: 1930298 - RNA, 14 nt, Homo sapiens
guuuggcgggccaa

SEQ ID NO: 1930299 - RNA, 14 nt, Homo sapiens
ugaacuguauuuau

SEQ ID NO: 1930300 - RNA, 21 nt, Homo sapiens
auccuaugguuucuccaucca

SEQ ID NO: 1930301 - RNA, 13 nt, Homo sapiens
aggaaacaacagc

SEQ ID NO: 1930302 - RNA, 16 nt, Homo sapiens
guuagaaaaauagcug

SEQ ID NO: 1930303 - RNA, 10 nt, Homo sapiens
ucuccuugaa

SEQ ID NO: 1930304 - RNA, 18 nt, Homo sapiens
aagcccugugcuccaugg

SEQ ID NO: 1930305 - RNA, 12 nt, Homo sapiens
auacacugugaa

SEQ ID NO: 1930306 - RNA, 14 nt, Homo sapiens
cugucuuugcugag

SEQ ID NO: 1930307 - RNA, 21 nt, Homo sapiens
agaugcucuaucuugcucugu

SEQ ID NO: 1930308 - RNA, 13 nt, Homo sapiens
uccagacuaugca

SEQ ID NO: 1930309 - RNA, 20 nt, Homo sapiens
aaucauuuucauuccuaaag

SEQ ID NO: 1930310 - RNA, 14 nt, Homo sapiens
agggaggugguccu

SEQ ID NO: 1930311 - RNA, 15 nt, Homo sapiens
aguuaauacuuaaca

SEQ ID NO: 1930312 - RNA, 22 nt, Homo sapiens
uacucauccagaccccaugccu

SEQ ID NO: 1930313 - RNA, 20 nt, Homo sapiens
cagauguucugguaaacuga

SEQ ID NO: 1930314 - RNA, 18 nt, Homo sapiens
gcccacucaggggucacu

SEQ ID NO: 1930315 - RNA, 19 nt, Homo sapiens
ggcccuggggccuguacaa

SEQ ID NO: 1930316 - RNA, 23 nt, Homo sapiens
cacacugaauaagagagcaggau

SEQ ID NO: 1930317 - RNA, 16 nt, Homo sapiens
gaaggauguuuagcag

SEQ ID NO: 1930318 - RNA, 20 nt, Homo sapiens
ugucagcaucugaccaucug

SEQ ID NO: 1930319 - RNA, 17 nt, Homo sapiens
aacugggaaauaagcaa

SEQ ID NO: 1930320 - RNA, 13 nt, Homo sapiens
ccaacacuuugag

SEQ ID NO: 1930321 - RNA, 19 nt, Homo sapiens
agaacacacacauauacac

SEQ ID NO: 1930322 - RNA, 14 nt, Homo sapiens
ugaugcaggcagug

SEQ ID NO: 1930323 - RNA, 16 nt, Homo sapiens
cugugcccuccaaaga

SEQ ID NO: 1930324 - RNA, 13 nt, Homo sapiens
ucccacuaucugg

SEQ ID NO: 1930325 - RNA, 18 nt, Homo sapiens
aucuucuguuauuguuga

SEQ ID NO: 1930326 - RNA, 16 nt, Homo sapiens
acuguguggacuguga

SEQ ID NO: 1930327 - RNA, 19 nt, Homo sapiens
uaaaacauugaaugaaacu

SEQ ID NO: 1930328 - RNA, 12 nt, Homo sapiens
cagcacagccag

SEQ ID NO: 1930329 - RNA, 21 nt, Homo sapiens
ccugcucacaucugaaucucc

SEQ ID NO: 1930330 - RNA, 14 nt, Homo sapiens
uaagcccacuguua

SEQ ID NO: 1930331 - RNA, 17 nt, Homo sapiens
gacaauagggcugauaa

SEQ ID NO: 1930332 - RNA, 12 nt, Homo sapiens
aaauaguuccau

SEQ ID NO: 1930333 - RNA, 15 nt, Homo sapiens
cagccccuaccuuga

SEQ ID NO: 1930334 - RNA, 13 nt, Homo sapiens
ugaaggcuguaca

SEQ ID NO: 1930335 - RNA, 20 nt, Homo sapiens
ggcuugugggcacugugcca

SEQ ID NO: 1930336 - RNA, 15 nt, Homo sapiens
agcagagagcacagc

SEQ ID NO: 1930337 - RNA, 23 nt, Homo sapiens
gggauaaguaaguuugauuucau

SEQ ID NO: 1930338 - RNA, 14 nt, Homo sapiens
ggagguugcaguga

SEQ ID NO: 1930339 - RNA, 18 nt, Homo sapiens
ccggcugguggagcugcu

SEQ ID NO: 1930340 - RNA, 16 nt, Homo sapiens
ugugguugaaaaccac

SEQ ID NO: 1930341 - RNA, 15 nt, Homo sapiens
uggaugaaaauguuc

SEQ ID NO: 1930342 - RNA, 16 nt, Homo sapiens
aaaggccucaucuccu

SEQ ID NO: 1930343 - RNA, 20 nt, Homo sapiens
caaaguuguauguggcauga

SEQ ID NO: 1930344 - RNA, 21 nt, Homo sapiens
auaauugccuuuuccuaugua

SEQ ID NO: 1930345 - RNA, 18 nt, Homo sapiens
acuuaagauuugcucaug

SEQ ID NO: 1930346 - RNA, 16 nt, Homo sapiens
auaugaacggugagca

SEQ ID NO: 1930347 - RNA, 21 nt, Homo sapiens
gguguugccccuauuagcucu

SEQ ID NO: 1930348 - RNA, 15 nt, Homo sapiens
aguaugcauacuggu

SEQ ID NO: 1930349 - RNA, 17 nt, Homo sapiens
ccagguucaauguccuc

SEQ ID NO: 1930350 - RNA, 21 nt, Homo sapiens
gcccauggugagcucugggaa

SEQ ID NO: 1930351 - RNA, 20 nt, Homo sapiens
cuccaccuaguggcugucca

SEQ ID NO: 1930352 - RNA, 18 nt, Homo sapiens
gagagcucucucuucucu

SEQ ID NO: 1930353 - RNA, 17 nt, Homo sapiens
cucugccucuuaacucc

SEQ ID NO: 1930354 - RNA, 22 nt, Homo sapiens
ggucagcugggagccagugugc

SEQ ID NO: 1930355 - RNA, 19 nt, Homo sapiens
cggggucugcagcaaugaa

SEQ ID NO: 1930356 - RNA, 23 nt, Homo sapiens
uggcaugaaagugcgauaacuua

SEQ ID NO: 1930357 - RNA, 17 nt, Homo sapiens
ucauucauucauucacc

SEQ ID NO: 1930358 - RNA, 17 nt, Homo sapiens
gugagcaccugagcaug

SEQ ID NO: 1930359 - RNA, 19 nt, Homo sapiens
uaugcuguauccacaaauc

SEQ ID NO: 1930360 - RNA, 19 nt, Homo sapiens
ugggggagguccaagcaga

SEQ ID NO: 1930361 - RNA, 17 nt, Homo sapiens
acuaugccuguugaucu

SEQ ID NO: 1930362 - RNA, 23 nt, Homo sapiens
agucuggagggcuggucauucac

SEQ ID NO: 1930363 - RNA, 14 nt, Homo sapiens
uccacaucuucuca

SEQ ID NO: 1930364 - RNA, 16 nt, Homo sapiens
uaugacuccagaauuu

SEQ ID NO: 1930365 - RNA, 13 nt, Homo sapiens
ccaauuagacuug

SEQ ID NO: 1930366 - RNA, 22 nt, Homo sapiens
aauacugauguuccuagugaaa

SEQ ID NO: 1930367 - RNA, 20 nt, Homo sapiens
guguguggccucccuggcuc

SEQ ID NO: 1930368 - RNA, 15 nt, Homo sapiens
agccaaugaacagcu

SEQ ID NO: 1930369 - RNA, 16 nt, Homo sapiens
aucauaauuacauucc

SEQ ID NO: 1930370 - RNA, 19 nt, Homo sapiens
cccagaugggccacggcug

SEQ ID NO: 1930371 - RNA, 23 nt, Homo sapiens
agcccuagaggcgagccaggcaa

SEQ ID NO: 1930372 - RNA, 11 nt, Homo sapiens
aaucucuucau

SEQ ID NO: 1930373 - RNA, 13 nt, Homo sapiens
uucaggagucuca

SEQ ID NO: 1930374 - RNA, 14 nt, Homo sapiens
uauauuacaugguu

SEQ ID NO: 1930375 - RNA, 13 nt, Homo sapiens
uguaguacuccuu

SEQ ID NO: 1930376 - RNA, 18 nt, Homo sapiens
gaauuaaaacagcugcga

SEQ ID NO: 1930377 - RNA, 13 nt, Homo sapiens
aagacaauggcuu

SEQ ID NO: 1930378 - RNA, 18 nt, Homo sapiens
cacuaaccuuccaaaaau

SEQ ID NO: 1930379 - RNA, 23 nt, Homo sapiens
uuaagaguuagguuuaacauaaa

SEQ ID NO: 1930380 - RNA, 18 nt, Homo sapiens
acauuuuauuaagcuuuu

SEQ ID NO: 1930381 - RNA, 12 nt, Homo sapiens
gcauccuggaca

SEQ ID NO: 1930382 - RNA, 19 nt, Homo sapiens
ccaggcuggagugcagaag

SEQ ID NO: 1930383 - RNA, 22 nt, Homo sapiens
agucuaaaaaaggaauccucug

SEQ ID NO: 1930384 - RNA, 15 nt, Homo sapiens
gcuuuccacauuucu

SEQ ID NO: 1930385 - RNA, 15 nt, Homo sapiens
gcccuccacaccucu

SEQ ID NO: 1930386 - RNA, 15 nt, Homo sapiens
cugugugacuuugaa

SEQ ID NO: 1930387 - RNA, 15 nt, Homo sapiens
agggcccaucugccg

SEQ ID NO: 1930388 - RNA, 17 nt, Homo sapiens
cugaaaauuaacacugc

SEQ ID NO: 1930389 - RNA, 10 nt, Homo sapiens
ccuguucuca

SEQ ID NO: 1930390 - RNA, 21 nt, Homo sapiens
uauccaugcaccaaacuaaua

SEQ ID NO: 1930391 - RNA, 23 nt, Homo sapiens
ggacgccuguuguuuuggcucaa

SEQ ID NO: 1930392 - RNA, 14 nt, Homo sapiens
uuggaacagaaugu

SEQ ID NO: 1930393 - RNA, 18 nt, Homo sapiens
ccuugccaauagugucau

SEQ ID NO: 1930394 - RNA, 16 nt, Homo sapiens
accucuucccaugacu

SEQ ID NO: 1930395 - RNA, 21 nt, Homo sapiens
cauauauuuaacuuugcaaaa

SEQ ID NO: 1930396 - RNA, 18 nt, Homo sapiens
aggucaaggugagcagaa

SEQ ID NO: 1930397 - RNA, 20 nt, Homo sapiens
uuccagguggacaaagucaa

SEQ ID NO: 1930398 - RNA, 12 nt, Homo sapiens
aaaaauccacuc

SEQ ID NO: 1930399 - RNA, 17 nt, Homo sapiens
cacaugcacuacugaaa

SEQ ID NO: 1930400 - RNA, 17 nt, Homo sapiens
gcuuguuauaacgcaaa

SEQ ID NO: 1930401 - RNA, 21 nt, Homo sapiens
uacauauaagugauugcuggu

SEQ ID NO: 1930402 - RNA, 20 nt, Homo sapiens
ugaacucuuaggcacaucaa

SEQ ID NO: 1930403 - RNA, 16 nt, Homo sapiens
ugccagcuuaucucag

SEQ ID NO: 1930404 - RNA, 12 nt, Homo sapiens
cauggugaaggu

SEQ ID NO: 1930405 - RNA, 17 nt, Homo sapiens
uguuuguuucuguagaa

SEQ ID NO: 1930406 - RNA, 16 nt, Homo sapiens
caugucauuaugacau

SEQ ID NO: 1930407 - RNA, 21 nt, Homo sapiens
auucaaauugacugaagcaaa

SEQ ID NO: 1930408 - RNA, 14 nt, Homo sapiens
gaaauauuuggaaa

SEQ ID NO: 1930409 - RNA, 19 nt, Homo sapiens
ucaguguccucuugcucaa

SEQ ID NO: 1930410 - RNA, 22 nt, Homo sapiens
cccccacccaccuggauucccu

SEQ ID NO: 1930411 - RNA, 14 nt, Homo sapiens
ccugcuccaagagg

SEQ ID NO: 1930412 - RNA, 15 nt, Homo sapiens
auaauggaagccaaa

SEQ ID NO: 1930413 - RNA, 15 nt, Homo sapiens
guacuaaaucucacc

SEQ ID NO: 1930414 - RNA, 15 nt, Homo sapiens
cauuuacaauugcau

SEQ ID NO: 1930415 - RNA, 15 nt, Homo sapiens
gaugaaucauauuca

SEQ ID NO: 1930416 - RNA, 16 nt, Homo sapiens
uucaagaaaaucuuug

SEQ ID NO: 1930417 - RNA, 13 nt, Homo sapiens
cagagcauugcua

SEQ ID NO: 1930418 - RNA, 13 nt, Homo sapiens
aggaagcuuggcu

SEQ ID NO: 1930419 - RNA, 21 nt, Homo sapiens
agcaauuugaagagaaucuuu

SEQ ID NO: 1930420 - RNA, 15 nt, Homo sapiens
ccaaagugcugcgau

SEQ ID NO: 1930421 - RNA, 16 nt, Homo sapiens
agagacccccgugcca

SEQ ID NO: 1930422 - RNA, 17 nt, Homo sapiens
uaaagcacaugccuucu

SEQ ID NO: 1930423 - RNA, 15 nt, Homo sapiens
aaaggaggugggggc

SEQ ID NO: 1930424 - RNA, 16 nt, Homo sapiens
ugcauuuuaucaaaug

SEQ ID NO: 1930425 - RNA, 15 nt, Homo sapiens
uucuuaaauaagaaa

SEQ ID NO: 1930426 - RNA, 14 nt, Homo sapiens
agucugcauuacau

SEQ ID NO: 1930427 - RNA, 13 nt, Homo sapiens
ugaccagugccuu

SEQ ID NO: 1930428 - RNA, 14 nt, Homo sapiens
aaagagacaaagcu

SEQ ID NO: 1930429 - RNA, 17 nt, Homo sapiens
guuugcuuugcuuugua

SEQ ID NO: 1930430 - RNA, 13 nt, Homo sapiens
agacaucagaaca

SEQ ID NO: 1930431 - RNA, 12 nt, Homo sapiens
gacuccaagcug

SEQ ID NO: 1930432 - RNA, 23 nt, Homo sapiens
acuguggagaaauaaaaauaccu

SEQ ID NO: 1930433 - RNA, 20 nt, Homo sapiens
aauuugguaaaaaugcugcu

SEQ ID NO: 1930434 - RNA, 16 nt, Homo sapiens
uccuuuuugcaguaua

SEQ ID NO: 1930435 - RNA, 21 nt, Homo sapiens
uuuccaaugcugaaugccugu

SEQ ID NO: 1930436 - RNA, 20 nt, Homo sapiens
ucuuugugccucaacauacu

SEQ ID NO: 1930437 - RNA, 19 nt, Homo sapiens
cugaguaagaaaugcugcc

SEQ ID NO: 1930438 - RNA, 14 nt, Homo sapiens
gaguaaacuugaaa

SEQ ID NO: 1930439 - RNA, 17 nt, Homo sapiens
aaauaauucaugauuca

SEQ ID NO: 1930440 - RNA, 14 nt, Homo sapiens
ucccugacacuguc

SEQ ID NO: 1930441 - RNA, 12 nt, Homo sapiens
gccucagugaaa

SEQ ID NO: 1930442 - RNA, 14 nt, Homo sapiens
uggcuuccuuggcu

SEQ ID NO: 1930443 - RNA, 16 nt, Homo sapiens
caaaacuaaauuugaa

SEQ ID NO: 1930444 - RNA, 15 nt, Homo sapiens
caaaagucagucuua

SEQ ID NO: 1930445 - RNA, 13 nt, Homo sapiens
ugagcaaugucug

SEQ ID NO: 1930446 - RNA, 16 nt, Homo sapiens
caccugcucacaggga

SEQ ID NO: 1930447 - RNA, 15 nt, Homo sapiens
aguaggaggccucca

SEQ ID NO: 1930448 - RNA, 14 nt, Homo sapiens
ugauggcugaagaa

SEQ ID NO: 1930449 - RNA, 22 nt, Homo sapiens
acuacagcaugacguaguauua

SEQ ID NO: 1930450 - RNA, 23 nt, Homo sapiens
uauuguugaauaaauguaucuga

SEQ ID NO: 1930451 - RNA, 16 nt, Homo sapiens
cauuuuaguccagaga

SEQ ID NO: 1930452 - RNA, 18 nt, Homo sapiens
acaacaacgagauaccau

SEQ ID NO: 1930453 - RNA, 22 nt, Homo sapiens
uagaguguagccuaaagggcag

SEQ ID NO: 1930454 - RNA, 20 nt, Homo sapiens
uggagggcuagaaccuggca

SEQ ID NO: 1930455 - RNA, 19 nt, Homo sapiens
guggcaaaggagccuacuc

SEQ ID NO: 1930456 - RNA, 22 nt, Homo sapiens
ccuccagcacccccagugcagc

SEQ ID NO: 1930457 - RNA, 20 nt, Homo sapiens
caggcugcagugcaauggcg

SEQ ID NO: 1930458 - RNA, 19 nt, Homo sapiens
aaugcuuucccacucucag

SEQ ID NO: 1930459 - RNA, 15 nt, Homo sapiens
auggggauagaggaa

SEQ ID NO: 1930460 - RNA, 16 nt, Homo sapiens
ucaucuuggaacugca

SEQ ID NO: 1930461 - RNA, 20 nt, Homo sapiens
accccagcccccacagcccu

SEQ ID NO: 1930462 - RNA, 16 nt, Homo sapiens
uggagugucacaucuc

SEQ ID NO: 1930463 - RNA, 21 nt, Homo sapiens
cgucccauccagcuaccacca

SEQ ID NO: 1930464 - RNA, 12 nt, Homo sapiens
cugcugcacacu

SEQ ID NO: 1930465 - RNA, 18 nt, Homo sapiens
cacuuuuuuccugucaau

SEQ ID NO: 1930466 - RNA, 15 nt, Homo sapiens
cuaggucugaccaaa

SEQ ID NO: 1930467 - RNA, 20 nt, Homo sapiens
acuggggagucuuuguggau

SEQ ID NO: 1930468 - RNA, 23 nt, Homo sapiens
acccaaguuaguucaauccugau

SEQ ID NO: 1930469 - RNA, 15 nt, Homo sapiens
cauucuagauccugc

SEQ ID NO: 1930470 - RNA, 17 nt, Homo sapiens
uccacgucaacagaauu

SEQ ID NO: 1930471 - RNA, 17 nt, Homo sapiens
ucugucuauaggacuua

SEQ ID NO: 1930472 - RNA, 19 nt, Homo sapiens
cagcaggcucaggcacaua

SEQ ID NO: 1930473 - RNA, 19 nt, Homo sapiens
uuuuaaauaaaagcacaag

SEQ ID NO: 1930474 - RNA, 22 nt, Homo sapiens
auacauccacaggguuuugaca

SEQ ID NO: 1930475 - RNA, 14 nt, Homo sapiens
accugggucuuuau

SEQ ID NO: 1930476 - RNA, 21 nt, Homo sapiens
gaugaugguguuggugaaaau

SEQ ID NO: 1930477 - RNA, 17 nt, Homo sapiens
aauuauuuuucacucua

SEQ ID NO: 1930478 - RNA, 21 nt, Homo sapiens
ucauucuuuuugaaaugucaa

SEQ ID NO: 1930479 - RNA, 14 nt, Homo sapiens
gucuucacacugcg

SEQ ID NO: 1930480 - RNA, 13 nt, Homo sapiens
guguccagacuca

SEQ ID NO: 1930481 - RNA, 16 nt, Homo sapiens
guagagggcccuggug

SEQ ID NO: 1930482 - RNA, 22 nt, Homo sapiens
ugcaaaccuuuuuuaugaugcu

SEQ ID NO: 1930483 - RNA, 14 nt, Homo sapiens
guuuggaaauggag

SEQ ID NO: 1930484 - RNA, 22 nt, Homo sapiens
aggucagggagugcuggcucac

SEQ ID NO: 1930485 - RNA, 16 nt, Homo sapiens
aaacuugaaugcucca

SEQ ID NO: 1930486 - RNA, 14 nt, Homo sapiens
uucuuagugucacu

SEQ ID NO: 1930487 - RNA, 18 nt, Homo sapiens
ucuacuauccuugcuaag

SEQ ID NO: 1930488 - RNA, 20 nt, Homo sapiens
gcacugaauggcugaccuga

SEQ ID NO: 1930489 - RNA, 22 nt, Homo sapiens
ugcagaaggagucugaugcuca

SEQ ID NO: 1930490 - RNA, 20 nt, Homo sapiens
auuggaagaagcacugaugg

SEQ ID NO: 1930491 - RNA, 15 nt, Homo sapiens
aucuucccauaauaa

SEQ ID NO: 1930492 - RNA, 20 nt, Homo sapiens
aauaauagacucgcuaguca

SEQ ID NO: 1930493 - RNA, 14 nt, Homo sapiens
aaacaggauucuuu

SEQ ID NO: 1930494 - RNA, 16 nt, Homo sapiens
uaacaacauguuucca

SEQ ID NO: 1930495 - RNA, 22 nt, Homo sapiens
gacaaacagccucacuccucag

SEQ ID NO: 1930496 - RNA, 17 nt, Homo sapiens
cugaagggcaucaugca

SEQ ID NO: 1930497 - RNA, 23 nt, Homo sapiens
aauaaucgacuuuuuaaauguga

SEQ ID NO: 1930498 - RNA, 21 nt, Homo sapiens
cuccagagaccccaggaacaa

SEQ ID NO: 1930499 - RNA, 19 nt, Homo sapiens
aucuuuuucuauauucuca

SEQ ID NO: 1930500 - RNA, 19 nt, Homo sapiens
uuuaaaaaaaaaaacaaag

SEQ ID NO: 1930501 - RNA, 15 nt, Homo sapiens
gauacuguugaucuu

SEQ ID NO: 1930502 - RNA, 17 nt, Homo sapiens
ccaagggaaaggggugc

SEQ ID NO: 1930503 - RNA, 14 nt, Homo sapiens
ugaacacacaugga

SEQ ID NO: 1930504 - RNA, 16 nt, Homo sapiens
auuuaaaaagcucuuu

SEQ ID NO: 1930505 - RNA, 23 nt, Homo sapiens
gaguucuagaaccacuuccugcu

SEQ ID NO: 1930506 - RNA, 19 nt, Homo sapiens
agcauguguauuaaugucu

SEQ ID NO: 1930507 - RNA, 18 nt, Homo sapiens
cagggugguguaccugcu

SEQ ID NO: 1930508 - RNA, 19 nt, Homo sapiens
uauaaucccacccaccuca

SEQ ID NO: 1930509 - RNA, 13 nt, Homo sapiens
gacucagcugcca

SEQ ID NO: 1930510 - RNA, 22 nt, Homo sapiens
ucaaucacuugaaagugaacaa

SEQ ID NO: 1930511 - RNA, 14 nt, Homo sapiens
gcccaggcacaacu

SEQ ID NO: 1930512 - RNA, 22 nt, Homo sapiens
gcuggccugucucccuagggaa

SEQ ID NO: 1930513 - RNA, 14 nt, Homo sapiens
uggccggagucagu

SEQ ID NO: 1930514 - RNA, 19 nt, Homo sapiens
caaugggagcugaggccac

SEQ ID NO: 1930515 - RNA, 15 nt, Homo sapiens
guuguccugugucau

SEQ ID NO: 1930516 - RNA, 12 nt, Homo sapiens
guuaggucucaa

SEQ ID NO: 1930517 - RNA, 23 nt, Homo sapiens
uguucuuuaacccucacugggac

SEQ ID NO: 1930518 - RNA, 19 nt, Homo sapiens
aggugccucauagcauagc

SEQ ID NO: 1930519 - RNA, 17 nt, Homo sapiens
cuaacgacuucagggca

SEQ ID NO: 1930520 - RNA, 15 nt, Homo sapiens
uauccuaucucucca

SEQ ID NO: 1930521 - RNA, 20 nt, Homo sapiens
uccggucagccaagugcaga

SEQ ID NO: 1930522 - RNA, 12 nt, Homo sapiens
agaagaugcuua

SEQ ID NO: 1930523 - RNA, 23 nt, Homo sapiens
uuauuuuuaucaguuacacauga

SEQ ID NO: 1930524 - RNA, 17 nt, Homo sapiens
agaacacgauaaaccau

SEQ ID NO: 1930525 - RNA, 15 nt, Homo sapiens
ccuucuuauguuucu

SEQ ID NO: 1930526 - RNA, 18 nt, Homo sapiens
uucugggaacuuccucag

SEQ ID NO: 1930527 - RNA, 17 nt, Homo sapiens
ggaccagacacaggucc

SEQ ID NO: 1930528 - RNA, 20 nt, Homo sapiens
uucuuguauauuauggaaga

SEQ ID NO: 1930529 - RNA, 18 nt, Homo sapiens
uuugguuauaaauguaau

SEQ ID NO: 1930530 - RNA, 22 nt, Homo sapiens
gaaaaucgugacaacacuugug

SEQ ID NO: 1930531 - RNA, 15 nt, Homo sapiens
cuacucccucuucac

SEQ ID NO: 1930532 - RNA, 16 nt, Homo sapiens
caugacauagcacuug

SEQ ID NO: 1930533 - RNA, 21 nt, Homo sapiens
aucucugaucccuuccuuguu

SEQ ID NO: 1930534 - RNA, 20 nt, Homo sapiens
aacaggcuguucugcacuga

SEQ ID NO: 1930535 - RNA, 12 nt, Homo sapiens
aacucagaucac

SEQ ID NO: 1930536 - RNA, 20 nt, Homo sapiens
uguaaaacacaccaaucagc

SEQ ID NO: 1930537 - RNA, 16 nt, Homo sapiens
aagauuuaagugcaua

SEQ ID NO: 1930538 - RNA, 16 nt, Homo sapiens
augaagacccuaucuc

SEQ ID NO: 1930539 - RNA, 23 nt, Homo sapiens
gccgcaggugggugcugcccugu

SEQ ID NO: 1930540 - RNA, 23 nt, Homo sapiens
uaaaaaaguuucuaguaucacau

SEQ ID NO: 1930541 - RNA, 13 nt, Homo sapiens
uaaaaauagacac

SEQ ID NO: 1930542 - RNA, 19 nt, Homo sapiens
gcagaaagggccuugaauc

SEQ ID NO: 1930543 - RNA, 23 nt, Homo sapiens
auuauuccucaaaaaauugcaca

SEQ ID NO: 1930544 - RNA, 18 nt, Homo sapiens
gacagucuagcugccuca

SEQ ID NO: 1930545 - RNA, 12 nt, Homo sapiens
agcugcuuugac

SEQ ID NO: 1930546 - RNA, 14 nt, Homo sapiens
gagcgguaugcucu

SEQ ID NO: 1930547 - RNA, 20 nt, Homo sapiens
caaugaaauauugcuguaua

SEQ ID NO: 1930548 - RNA, 20 nt, Homo sapiens
cagauacugugagcuuacau

SEQ ID NO: 1930549 - RNA, 18 nt, Homo sapiens
ucuacccggcccagagac

SEQ ID NO: 1930550 - RNA, 23 nt, Homo sapiens
gauuucucuacuugucauaucac

SEQ ID NO: 1930551 - RNA, 17 nt, Homo sapiens
agagaugccagcccuuc

SEQ ID NO: 1930552 - RNA, 15 nt, Homo sapiens
acacaguuacagagu

SEQ ID NO: 1930553 - RNA, 15 nt, Homo sapiens
acagagauacacaga

SEQ ID NO: 1930554 - RNA, 16 nt, Homo sapiens
augcuaugcaugucug

SEQ ID NO: 1930555 - RNA, 12 nt, Homo sapiens
ugucagugcagc

SEQ ID NO: 1930556 - RNA, 22 nt, Homo sapiens
uguuccacuuggaaauggcaug

SEQ ID NO: 1930557 - RNA, 17 nt, Homo sapiens
caagauuaauuucauca

SEQ ID NO: 1930558 - RNA, 13 nt, Homo sapiens
acugagaauauaa

SEQ ID NO: 1930559 - RNA, 15 nt, Homo sapiens
gaagccuuaagccau

SEQ ID NO: 1930560 - RNA, 16 nt, Homo sapiens
ucaaguugugccaaau

SEQ ID NO: 1930561 - RNA, 18 nt, Homo sapiens
ggaacuggccacgcacag

SEQ ID NO: 1930562 - RNA, 23 nt, Homo sapiens
auucuucauuucgccuggugaau

SEQ ID NO: 1930563 - RNA, 21 nt, Homo sapiens
aaggcaggagaaucgcuuaaa

SEQ ID NO: 1930564 - RNA, 20 nt, Homo sapiens
aaaaacacagugcacucaga

SEQ ID NO: 1930565 - RNA, 18 nt, Homo sapiens
ugugcgcacacaugcuuc

SEQ ID NO: 1930566 - RNA, 23 nt, Homo sapiens
acuauaccaacugggccucugau

SEQ ID NO: 1930567 - RNA, 19 nt, Homo sapiens
ugcugggauuacaggugua

SEQ ID NO: 1930568 - RNA, 18 nt, Homo sapiens
auuuuuccaaaagccagu

SEQ ID NO: 1930569 - RNA, 14 nt, Homo sapiens
agaugacuucccaa

SEQ ID NO: 1930570 - RNA, 23 nt, Homo sapiens
caggaaaaggugauauccauucu

SEQ ID NO: 1930571 - RNA, 16 nt, Homo sapiens
aacauguuuauugagc

SEQ ID NO: 1930572 - RNA, 15 nt, Homo sapiens
aaaaaggacucugcu

SEQ ID NO: 1930573 - RNA, 23 nt, Homo sapiens
cuucuuaagauggcuacaccuca

SEQ ID NO: 1930574 - RNA, 15 nt, Homo sapiens
aaggagggagcugcu

SEQ ID NO: 1930575 - RNA, 23 nt, Homo sapiens
uauauggggggagugagcucucu

SEQ ID NO: 1930576 - RNA, 13 nt, Homo sapiens
uggaaugacugaa

SEQ ID NO: 1930577 - RNA, 20 nt, Homo sapiens
uccacuagcaccgaccccac

SEQ ID NO: 1930578 - RNA, 23 nt, Homo sapiens
ucugagcugucuaaaaguuacau

SEQ ID NO: 1930579 - RNA, 14 nt, Homo sapiens
uaucagugccauga

SEQ ID NO: 1930580 - RNA, 20 nt, Homo sapiens
caguucacacugcagagcua

SEQ ID NO: 1930581 - RNA, 17 nt, Homo sapiens
ccgucagagcagugacc

SEQ ID NO: 1930582 - RNA, 14 nt, Homo sapiens
uccuccuugcccag

SEQ ID NO: 1930583 - RNA, 14 nt, Homo sapiens
ugggcaaaggacau

SEQ ID NO: 1930584 - RNA, 20 nt, Homo sapiens
uugaacuguaaauaugucac

SEQ ID NO: 1930585 - RNA, 15 nt, Homo sapiens
acagccucagaauaa

SEQ ID NO: 1930586 - RNA, 16 nt, Homo sapiens
acuagagucugaacag

SEQ ID NO: 1930587 - RNA, 18 nt, Homo sapiens
agcauucuugucacaaua

SEQ ID NO: 1930588 - RNA, 18 nt, Homo sapiens
agugacaguauaaagggc

SEQ ID NO: 1930589 - RNA, 15 nt, Homo sapiens
cacacacacaguuug

SEQ ID NO: 1930590 - RNA, 14 nt, Homo sapiens
ccccuaagagccau

SEQ ID NO: 1930591 - RNA, 18 nt, Homo sapiens
uagucaaauuauguauug

SEQ ID NO: 1930592 - RNA, 17 nt, Homo sapiens
ccacugcccaaagccau

SEQ ID NO: 1930593 - RNA, 20 nt, Homo sapiens
auuuacauacucugcuuaga

SEQ ID NO: 1930594 - RNA, 13 nt, Homo sapiens
augggacauucca

SEQ ID NO: 1930595 - RNA, 24 nt, Homo sapiens
uaaagccacgcugugucccucaau

SEQ ID NO: 1930596 - RNA, 23 nt, Homo sapiens
uccaacagaguuauuuauuggcu

SEQ ID NO: 1930597 - RNA, 16 nt, Homo sapiens
uggcuaagggggacca

SEQ ID NO: 1930598 - RNA, 18 nt, Homo sapiens
agcaacuggugacugucc

SEQ ID NO: 1930599 - RNA, 23 nt, Homo sapiens
ucaccaggaggcggcagugcaac

SEQ ID NO: 1930600 - RNA, 23 nt, Homo sapiens
ugaaguguccugauggaggagac

SEQ ID NO: 1930601 - RNA, 19 nt, Homo sapiens
aagauaacaagaucuuuca

SEQ ID NO: 1930602 - RNA, 19 nt, Homo sapiens
uauuuaacccuuucuucaa

SEQ ID NO: 1930603 - RNA, 16 nt, Homo sapiens
aaagauggggucugua

SEQ ID NO: 1930604 - RNA, 21 nt, Homo sapiens
ugccugcuggggauuacucga

SEQ ID NO: 1930605 - RNA, 17 nt, Homo sapiens
ugggcuccuggggcuca

SEQ ID NO: 1930606 - RNA, 15 nt, Homo sapiens
ugaagcagcacugug

SEQ ID NO: 1930607 - RNA, 16 nt, Homo sapiens
ugccgccccgugccug

SEQ ID NO: 1930608 - RNA, 11 nt, Homo sapiens
cugucccugaa

SEQ ID NO: 1930609 - RNA, 18 nt, Homo sapiens
uugucacccaaagccugu

SEQ ID NO: 1930610 - RNA, 22 nt, Homo sapiens
ucccuuugucugucaaucacag

SEQ ID NO: 1930611 - RNA, 17 nt, Homo sapiens
gcuggagagaacccaga

SEQ ID NO: 1930612 - RNA, 14 nt, Homo sapiens
ccucauucuucucu

SEQ ID NO: 1930613 - RNA, 18 nt, Homo sapiens
aacccuccuucuguggca

SEQ ID NO: 1930614 - RNA, 14 nt, Homo sapiens
cuaggggacacuuc

SEQ ID NO: 1930615 - RNA, 20 nt, Homo sapiens
uuaaaagccaucaaacacaa

SEQ ID NO: 1930616 - RNA, 17 nt, Homo sapiens
uggaaggggacacguga

SEQ ID NO: 1930617 - RNA, 16 nt, Homo sapiens
ccaacccugcccacuu

SEQ ID NO: 1930618 - RNA, 20 nt, Homo sapiens
gcugagucugaauucugcuc

SEQ ID NO: 1930619 - RNA, 13 nt, Homo sapiens
uuccaaugccaau

SEQ ID NO: 1930620 - RNA, 21 nt, Homo sapiens
cccucuguggccugucucuau

SEQ ID NO: 1930621 - RNA, 14 nt, Homo sapiens
cuuacuuugaguua

SEQ ID NO: 1930622 - RNA, 23 nt, Homo sapiens
gcugcgucagaccaguacuggga

SEQ ID NO: 1930623 - RNA, 22 nt, Homo sapiens
acugaggccuucucaaacuuua

SEQ ID NO: 1930624 - RNA, 13 nt, Homo sapiens
ccagcaugcaucc

SEQ ID NO: 1930625 - RNA, 15 nt, Homo sapiens
cuuuuaacccagugu

SEQ ID NO: 1930626 - RNA, 19 nt, Homo sapiens
ucauccccaggggucccag

SEQ ID NO: 1930627 - RNA, 19 nt, Homo sapiens
aaugaagcaaugcuucauc

SEQ ID NO: 1930628 - RNA, 19 nt, Homo sapiens
cuaugaggggguuuggcac

SEQ ID NO: 1930629 - RNA, 19 nt, Homo sapiens
cuacagagcagacaguuaa

SEQ ID NO: 1930630 - RNA, 23 nt, Homo sapiens
uauccuaagacuaacaaaggcag

SEQ ID NO: 1930631 - RNA, 15 nt, Homo sapiens
uauguagauugccuu

SEQ ID NO: 1930632 - RNA, 15 nt, Homo sapiens
auuguugaaagccau

SEQ ID NO: 1930633 - RNA, 20 nt, Homo sapiens
aacauuucucaaaugcacau

SEQ ID NO: 1930634 - RNA, 18 nt, Homo sapiens
guguuuucucugaacaca

SEQ ID NO: 1930635 - RNA, 16 nt, Homo sapiens
cuggccuaaugagaua

SEQ ID NO: 1930636 - RNA, 15 nt, Homo sapiens
gacccacagccucca

SEQ ID NO: 1930637 - RNA, 13 nt, Homo sapiens
aaccuaauucuug

SEQ ID NO: 1930638 - RNA, 15 nt, Homo sapiens
aucuuaaacauaaua

SEQ ID NO: 1930639 - RNA, 21 nt, Homo sapiens
aguuggugacugggaaaguua

SEQ ID NO: 1930640 - RNA, 19 nt, Homo sapiens
uacagugauagaacaaaag

SEQ ID NO: 1930641 - RNA, 16 nt, Homo sapiens
ugcuucuguguaguca

SEQ ID NO: 1930642 - RNA, 22 nt, Homo sapiens
aucaucccagcugcucccaaau

SEQ ID NO: 1930643 - RNA, 23 nt, Homo sapiens
cauggcacugaggugccguguga

SEQ ID NO: 1930644 - RNA, 11 nt, Homo sapiens
aggucuaucaa

SEQ ID NO: 1930645 - RNA, 18 nt, Homo sapiens
uaaauagccuucaaaaag

SEQ ID NO: 1930646 - RNA, 20 nt, Homo sapiens
uucaguauuagaugcacuua

SEQ ID NO: 1930647 - RNA, 20 nt, Homo sapiens
aagaagcaguuuacucuaga

SEQ ID NO: 1930648 - RNA, 20 nt, Homo sapiens
gauuacuauugcaaaaggga

SEQ ID NO: 1930649 - RNA, 17 nt, Homo sapiens
gcucugaggacugcacc

SEQ ID NO: 1930650 - RNA, 16 nt, Homo sapiens
gggcucuacgucccag

SEQ ID NO: 1930651 - RNA, 13 nt, Homo sapiens
cauauacccagcu

SEQ ID NO: 1930652 - RNA, 13 nt, Homo sapiens
cagauacccaucu

SEQ ID NO: 1930653 - RNA, 20 nt, Homo sapiens
aaaacuuuccugacuuacaa

SEQ ID NO: 1930654 - RNA, 15 nt, Homo sapiens
uuagcuguccccuga

SEQ ID NO: 1930655 - RNA, 20 nt, Homo sapiens
cguggaauugugcugaguug

SEQ ID NO: 1930656 - RNA, 13 nt, Homo sapiens
auuugaagacaaa

SEQ ID NO: 1930657 - RNA, 18 nt, Homo sapiens
acaaaugauuuccacaaa

SEQ ID NO: 1930658 - RNA, 18 nt, Homo sapiens
ugauucacucaagaguuc

SEQ ID NO: 1930659 - RNA, 13 nt, Homo sapiens
cuacugcacugag

SEQ ID NO: 1930660 - RNA, 15 nt, Homo sapiens
aagguucacucucaa

SEQ ID NO: 1930661 - RNA, 13 nt, Homo sapiens
cuauaaucuguca

SEQ ID NO: 1930662 - RNA, 13 nt, Homo sapiens
cugccugugguga

SEQ ID NO: 1930663 - RNA, 21 nt, Homo sapiens
cagaggaaagaccaugugguu

SEQ ID NO: 1930664 - RNA, 19 nt, Homo sapiens
caaccuccgccuuccgggu

SEQ ID NO: 1930665 - RNA, 17 nt, Homo sapiens
uggcugcuccacugggu

SEQ ID NO: 1930666 - RNA, 18 nt, Homo sapiens
cugggaucgugcauuuga

SEQ ID NO: 1930667 - RNA, 13 nt, Homo sapiens
acugcaaauguca

SEQ ID NO: 1930668 - RNA, 16 nt, Homo sapiens
ccugaugcuaugguca

SEQ ID NO: 1930669 - RNA, 16 nt, Homo sapiens
acauaggaacauguag

SEQ ID NO: 1930670 - RNA, 21 nt, Homo sapiens
auuauuccucagauugcugaa

SEQ ID NO: 1930671 - RNA, 16 nt, Homo sapiens
cauucucucugcccaa

SEQ ID NO: 1930672 - RNA, 11 nt, Homo sapiens
cuugacagucu

SEQ ID NO: 1930673 - RNA, 19 nt, Homo sapiens
ccagaaaugucaugagauu

SEQ ID NO: 1930674 - RNA, 12 nt, Homo sapiens
uaucacauguau

SEQ ID NO: 1930675 - RNA, 18 nt, Homo sapiens
gaacacucugaauuccaa

SEQ ID NO: 1930676 - RNA, 14 nt, Homo sapiens
caaggaaucauguc

SEQ ID NO: 1930677 - RNA, 17 nt, Homo sapiens
uuucaaaacuaguucuu

SEQ ID NO: 1930678 - RNA, 16 nt, Homo sapiens
gcucucaaaucccucu

SEQ ID NO: 1930679 - RNA, 22 nt, Homo sapiens
cacugugacuuaagaagccuua

SEQ ID NO: 1930680 - RNA, 22 nt, Homo sapiens
ucuucacuggugagacaaugaa

SEQ ID NO: 1930681 - RNA, 13 nt, Homo sapiens
gcauuagcuacuu

SEQ ID NO: 1930682 - RNA, 16 nt, Homo sapiens
uauuuauguguucaca

SEQ ID NO: 1930683 - RNA, 13 nt, Homo sapiens
gucaguccuugac

SEQ ID NO: 1930684 - RNA, 20 nt, Homo sapiens
cuaguuuuauacaaagacag

SEQ ID NO: 1930685 - RNA, 20 nt, Homo sapiens
uaauaugugaucagcuuuca

SEQ ID NO: 1930686 - RNA, 20 nt, Homo sapiens
gacacuguggagacuuucug

SEQ ID NO: 1930687 - RNA, 20 nt, Homo sapiens
ccccuuuucugcauuuugcu

SEQ ID NO: 1930688 - RNA, 22 nt, Homo sapiens
uucaaguuaaagugaauaacca

SEQ ID NO: 1930689 - RNA, 20 nt, Homo sapiens
cacccugccccuuucuuccc

SEQ ID NO: 1930690 - RNA, 22 nt, Homo sapiens
cacauuuuaccaauaugcauuu

SEQ ID NO: 1930691 - RNA, 13 nt, Homo sapiens
agacaugccuugg

SEQ ID NO: 1930692 - RNA, 22 nt, Homo sapiens
aauuuuuauacauaucagaaaa

SEQ ID NO: 1930693 - RNA, 21 nt, Homo sapiens
agcuauuugauguaauacuuc

SEQ ID NO: 1930694 - RNA, 12 nt, Homo sapiens
uaaaauacucag

SEQ ID NO: 1930695 - RNA, 15 nt, Homo sapiens
cagcacaugugcugc

SEQ ID NO: 1930696 - RNA, 15 nt, Homo sapiens
cccaggcaugcaaug

SEQ ID NO: 1930697 - RNA, 12 nt, Homo sapiens
cuacacauauau

SEQ ID NO: 1930698 - RNA, 12 nt, Homo sapiens
cuuuacauauuc

SEQ ID NO: 1930699 - RNA, 19 nt, Homo sapiens
aaacaucacaccugcccua

SEQ ID NO: 1930700 - RNA, 15 nt, Homo sapiens
acaguguagugcuca

SEQ ID NO: 1930701 - RNA, 20 nt, Homo sapiens
auucacuguauguccuuggu

SEQ ID NO: 1930702 - RNA, 17 nt, Homo sapiens
uaagcauguuuucacua

SEQ ID NO: 1930703 - RNA, 19 nt, Homo sapiens
guuccuggcucagccucaa

SEQ ID NO: 1930704 - RNA, 14 nt, Homo sapiens
uugaagucuuguau

SEQ ID NO: 1930705 - RNA, 19 nt, Homo sapiens
gguggacaagggcccauga

SEQ ID NO: 1930706 - RNA, 22 nt, Homo sapiens
aaaaauucaugccccaguauua

SEQ ID NO: 1930707 - RNA, 23 nt, Homo sapiens
acugucucucuugucacauggaa

SEQ ID NO: 1930708 - RNA, 16 nt, Homo sapiens
guuuugcuaaaauuca

SEQ ID NO: 1930709 - RNA, 16 nt, Homo sapiens
ugauuuaucuaucacc

SEQ ID NO: 1930710 - RNA, 15 nt, Homo sapiens
uguagacuauuugcu

SEQ ID NO: 1930711 - RNA, 11 nt, Homo sapiens
caucaugccug

SEQ ID NO: 1930712 - RNA, 18 nt, Homo sapiens
cugguuugucaaacaaca

SEQ ID NO: 1930713 - RNA, 14 nt, Homo sapiens
gucauuuugcacug

SEQ ID NO: 1930714 - RNA, 22 nt, Homo sapiens
gcuucuccuucuccuucccauu

SEQ ID NO: 1930715 - RNA, 14 nt, Homo sapiens
aaugcaaugagcaa

SEQ ID NO: 1930716 - RNA, 16 nt, Homo sapiens
acagccaauacaauua

SEQ ID NO: 1930717 - RNA, 13 nt, Homo sapiens
aggugcugaugag

SEQ ID NO: 1930718 - RNA, 11 nt, Homo sapiens
acaucuucuca

SEQ ID NO: 1930719 - RNA, 14 nt, Homo sapiens
auagugcacacuug

SEQ ID NO: 1930720 - RNA, 14 nt, Homo sapiens
cuagaacaaacuaa

SEQ ID NO: 1930721 - RNA, 18 nt, Homo sapiens
gacuagaauuggugguga

SEQ ID NO: 1930722 - RNA, 22 nt, Homo sapiens
acccggcaggcuagaaccuggc

SEQ ID NO: 1930723 - RNA, 16 nt, Homo sapiens
ucaauaguauuaacua

SEQ ID NO: 1930724 - RNA, 20 nt, Homo sapiens
agaaaagguacauguuuaca

SEQ ID NO: 1930725 - RNA, 17 nt, Homo sapiens
aauauucugauuggucu

SEQ ID NO: 1930726 - RNA, 21 nt, Homo sapiens
auuacaacugcuacagagcag

SEQ ID NO: 1930727 - RNA, 22 nt, Homo sapiens
cagagggugggguacuggaguu

SEQ ID NO: 1930728 - RNA, 15 nt, Homo sapiens
cuacuccaauucaua

SEQ ID NO: 1930729 - RNA, 21 nt, Homo sapiens
gaggacagagcaggggcucca

SEQ ID NO: 1930730 - RNA, 21 nt, Homo sapiens
cuauuuggucucuuguaccca

SEQ ID NO: 1930731 - RNA, 15 nt, Homo sapiens
uuuacauacacugua

SEQ ID NO: 1930732 - RNA, 18 nt, Homo sapiens
gcucuaccaagacauaau

SEQ ID NO: 1930733 - RNA, 19 nt, Homo sapiens
aauuacuuuaacauuuugg

SEQ ID NO: 1930734 - RNA, 11 nt, Homo sapiens
accagcacauc

SEQ ID NO: 1930735 - RNA, 23 nt, Homo sapiens
ggcccauucagagcuauggugcu

SEQ ID NO: 1930736 - RNA, 19 nt, Homo sapiens
accaguuuaaccugaugca

SEQ ID NO: 1930737 - RNA, 13 nt, Homo sapiens
caaagagugcuaa

SEQ ID NO: 1930738 - RNA, 19 nt, Homo sapiens
uuuucuaauaccguggaug

SEQ ID NO: 1930739 - RNA, 16 nt, Homo sapiens
ggagauaauuguuuca

SEQ ID NO: 1930740 - RNA, 23 nt, Homo sapiens
cacagacuuccaccaugugcauc

SEQ ID NO: 1930741 - RNA, 18 nt, Homo sapiens
gggacuguaaaaccaccu

SEQ ID NO: 1930742 - RNA, 21 nt, Homo sapiens
ugaagaugcugaaacaggaga

SEQ ID NO: 1930743 - RNA, 18 nt, Homo sapiens
auguuuacagacugugag

SEQ ID NO: 1930744 - RNA, 16 nt, Homo sapiens
uccugugaagggacac

SEQ ID NO: 1930745 - RNA, 17 nt, Homo sapiens
ggauagcuauugcagcu

SEQ ID NO: 1930746 - RNA, 13 nt, Homo sapiens
aauugcugaggag

SEQ ID NO: 1930747 - RNA, 17 nt, Homo sapiens
gcuagucccugccugaa

SEQ ID NO: 1930748 - RNA, 17 nt, Homo sapiens
aggccagggucacugaa

SEQ ID NO: 1930749 - RNA, 17 nt, Homo sapiens
cuguaaggaacuggaac

SEQ ID NO: 1930750 - RNA, 18 nt, Homo sapiens
aaguucaguuuuuacuga

SEQ ID NO: 1930751 - RNA, 23 nt, Homo sapiens
ggccugcgacccugggggcacag

SEQ ID NO: 1930752 - RNA, 19 nt, Homo sapiens
aauccccaugccuguggcu

SEQ ID NO: 1930753 - RNA, 22 nt, Homo sapiens
gccuguaaucccagcacuuugg

SEQ ID NO: 1930754 - RNA, 17 nt, Homo sapiens
cuccacuguguccagag

SEQ ID NO: 1930755 - RNA, 15 nt, Homo sapiens
cuaucugugaaguua

SEQ ID NO: 1930756 - RNA, 13 nt, Homo sapiens
cgaguagggcuau

SEQ ID NO: 1930757 - RNA, 12 nt, Homo sapiens
uuauaauuugaa

SEQ ID NO: 1930758 - RNA, 18 nt, Homo sapiens
agagccugcaggaucuca

SEQ ID NO: 1930759 - RNA, 18 nt, Homo sapiens
ccuccagagauuugcuca

SEQ ID NO: 1930760 - RNA, 13 nt, Homo sapiens
aauggcucuguga

SEQ ID NO: 1930761 - RNA, 20 nt, Homo sapiens
aaacuccacauccuguggga

SEQ ID NO: 1930762 - RNA, 13 nt, Homo sapiens
aagccgagcucuc

SEQ ID NO: 1930763 - RNA, 17 nt, Homo sapiens
cacgcaacuauaguuuu

SEQ ID NO: 1930764 - RNA, 20 nt, Homo sapiens
uggaauacuuacucuugucg

SEQ ID NO: 1930765 - RNA, 17 nt, Homo sapiens
aucagcaaugccccaaa

SEQ ID NO: 1930766 - RNA, 21 nt, Homo sapiens
acauccaaggagaaacagaga

SEQ ID NO: 1930767 - RNA, 15 nt, Homo sapiens
cucauuuccaaucau

SEQ ID NO: 1930768 - RNA, 16 nt, Homo sapiens
ccggagccuccagcug

SEQ ID NO: 1930769 - RNA, 17 nt, Homo sapiens
cugaaucaucauaucua

SEQ ID NO: 1930770 - RNA, 23 nt, Homo sapiens
acccuccguuccuccucagccuc

SEQ ID NO: 1930771 - RNA, 13 nt, Homo sapiens
auggcuuacuuac

SEQ ID NO: 1930772 - RNA, 15 nt, Homo sapiens
gagcugcacuaucac

SEQ ID NO: 1930773 - RNA, 18 nt, Homo sapiens
aaacagaagaaguuauca

SEQ ID NO: 1930774 - RNA, 21 nt, Homo sapiens
caagacagauuaccaaagaag

SEQ ID NO: 1930775 - RNA, 14 nt, Homo sapiens
cuuccccugccucc

SEQ ID NO: 1930776 - RNA, 18 nt, Homo sapiens
ugaggauauggcagggaa

SEQ ID NO: 1930777 - RNA, 19 nt, Homo sapiens
uaacucuauuaaugagguc

SEQ ID NO: 1930778 - RNA, 23 nt, Homo sapiens
caagggcugagauucuucgugua

SEQ ID NO: 1930779 - RNA, 11 nt, Homo sapiens
aucagugcaug

SEQ ID NO: 1930780 - RNA, 11 nt, Homo sapiens
cagagugccac

SEQ ID NO: 1930781 - RNA, 21 nt, Homo sapiens
ccccacccaccccuccugggc

SEQ ID NO: 1930782 - RNA, 20 nt, Homo sapiens
caaaagguuuguguccagga

SEQ ID NO: 1930783 - RNA, 20 nt, Homo sapiens
gaauugcaaucuauaauauu

SEQ ID NO: 1930784 - RNA, 17 nt, Homo sapiens
cuucaaucaacaucucu

SEQ ID NO: 1930785 - RNA, 13 nt, Homo sapiens
cuagcacaguaaa

SEQ ID NO: 1930786 - RNA, 12 nt, Homo sapiens
cauucacuguga

SEQ ID NO: 1930787 - RNA, 16 nt, Homo sapiens
aguccagcacaaccuu

SEQ ID NO: 1930788 - RNA, 19 nt, Homo sapiens
ugacaccccugacuuuuau

SEQ ID NO: 1930789 - RNA, 17 nt, Homo sapiens
gguuacaaggggcugcu

SEQ ID NO: 1930790 - RNA, 22 nt, Homo sapiens
acucccacuggaacagcccauu

SEQ ID NO: 1930791 - RNA, 22 nt, Homo sapiens
cacuguacauuauaaaccuuca

SEQ ID NO: 1930792 - RNA, 22 nt, Homo sapiens
ccauggaagcuggcaggagaca

SEQ ID NO: 1930793 - RNA, 23 nt, Homo sapiens
agccgagauggcgcuauugcacu

SEQ ID NO: 1930794 - RNA, 18 nt, Homo sapiens
agacgugcgcgaugugac

SEQ ID NO: 1930795 - RNA, 15 nt, Homo sapiens
ugggccuucucagcu

SEQ ID NO: 1930796 - RNA, 22 nt, Homo sapiens
ccagggaaguuucguaugcacu

SEQ ID NO: 1930797 - RNA, 22 nt, Homo sapiens
agauacauuucaucugcugcug

SEQ ID NO: 1930798 - RNA, 18 nt, Homo sapiens
agugagugaaacucccac

SEQ ID NO: 1930799 - RNA, 18 nt, Homo sapiens
uuguagcaagaugagcaa

SEQ ID NO: 1930800 - RNA, 18 nt, Homo sapiens
gacagucuggccacuguc

SEQ ID NO: 1930801 - RNA, 16 nt, Homo sapiens
uagugacuaugaacuu

SEQ ID NO: 1930802 - RNA, 20 nt, Homo sapiens
ucucauaggcuaagucagcu

SEQ ID NO: 1930803 - RNA, 14 nt, Homo sapiens
cuucuguugaucuc

SEQ ID NO: 1930804 - RNA, 14 nt, Homo sapiens
cugggguugagggc

SEQ ID NO: 1930805 - RNA, 20 nt, Homo sapiens
auaaaaaucauucuacugaa

SEQ ID NO: 1930806 - RNA, 15 nt, Homo sapiens
ucaacauuacuguua

SEQ ID NO: 1930807 - RNA, 18 nt, Homo sapiens
augcgggcugggcagcug

SEQ ID NO: 1930808 - RNA, 18 nt, Homo sapiens
gguguuuuaagacugaau

SEQ ID NO: 1930809 - RNA, 22 nt, Homo sapiens
aauguagacugaaaagccaugu

SEQ ID NO: 1930810 - RNA, 16 nt, Homo sapiens
ccuaaggaaugacuuu

SEQ ID NO: 1930811 - RNA, 19 nt, Homo sapiens
uaguaacuguaugaaguca

SEQ ID NO: 1930812 - RNA, 17 nt, Homo sapiens
cucgucagccaccuggg

SEQ ID NO: 1930813 - RNA, 19 nt, Homo sapiens
gguggcccuugcaguucag

SEQ ID NO: 1930814 - RNA, 19 nt, Homo sapiens
cagucccucccuccuggcu

SEQ ID NO: 1930815 - RNA, 22 nt, Homo sapiens
uaaacuacaacgaacacaagaa

SEQ ID NO: 1930816 - RNA, 20 nt, Homo sapiens
ugaaugucuuuggcucaguu

SEQ ID NO: 1930817 - RNA, 16 nt, Homo sapiens
ccaagugucucuugac

SEQ ID NO: 1930818 - RNA, 19 nt, Homo sapiens
gaagauguauuucaucuca

SEQ ID NO: 1930819 - RNA, 17 nt, Homo sapiens
gaaaaucauauaaucuu

SEQ ID NO: 1930820 - RNA, 22 nt, Homo sapiens
agaauugauucauguucaucaa

SEQ ID NO: 1930821 - RNA, 14 nt, Homo sapiens
gugaauuuugccau

SEQ ID NO: 1930822 - RNA, 24 nt, Homo sapiens
uugccuuaaaccugaagaugucuc

SEQ ID NO: 1930823 - RNA, 15 nt, Homo sapiens
uauuaguacugcucu

SEQ ID NO: 1930824 - RNA, 23 nt, Homo sapiens
gcaagggaccuucaugcccuucu

SEQ ID NO: 1930825 - RNA, 15 nt, Homo sapiens
agugugcuugucauc

SEQ ID NO: 1930826 - RNA, 20 nt, Homo sapiens
gccucucugcuccaccuugu

SEQ ID NO: 1930827 - RNA, 17 nt, Homo sapiens
gcaagugguagcaagaa

SEQ ID NO: 1930828 - RNA, 16 nt, Homo sapiens
uggaucagcauuuuag

SEQ ID NO: 1930829 - RNA, 21 nt, Homo sapiens
ugcccccucuggugucuuuga

SEQ ID NO: 1930830 - RNA, 21 nt, Homo sapiens
uaccaaccugaaaguuccuuc

SEQ ID NO: 1930831 - RNA, 16 nt, Homo sapiens
cagaaguuaguuugua

SEQ ID NO: 1930832 - RNA, 19 nt, Homo sapiens
cacagauuugagcucagcc

SEQ ID NO: 1930833 - RNA, 20 nt, Homo sapiens
auagaugucuguaaccaaua

SEQ ID NO: 1930834 - RNA, 20 nt, Homo sapiens
ucaaagaauuacaguacaca

SEQ ID NO: 1930835 - RNA, 17 nt, Homo sapiens
uguaacgcaaguuccca

SEQ ID NO: 1930836 - RNA, 22 nt, Homo sapiens
augugauuuggaccauggcacu

SEQ ID NO: 1930837 - RNA, 16 nt, Homo sapiens
ucgacuaagacuuuuu

SEQ ID NO: 1930838 - RNA, 18 nt, Homo sapiens
ucuggaaagugaugucag

SEQ ID NO: 1930839 - RNA, 23 nt, Homo sapiens
aaggagggucacuggggcccaag

SEQ ID NO: 1930840 - RNA, 16 nt, Homo sapiens
aauggucauuuccaga

SEQ ID NO: 1930841 - RNA, 13 nt, Homo sapiens
gauugggggcccu

SEQ ID NO: 1930842 - RNA, 21 nt, Homo sapiens
gacauagcugugcuaugaggu

SEQ ID NO: 1930843 - RNA, 13 nt, Homo sapiens
agacuuccuguag

SEQ ID NO: 1930844 - RNA, 14 nt, Homo sapiens
ccaagaugggcaca

SEQ ID NO: 1930845 - RNA, 18 nt, Homo sapiens
aggcuuacuaaugcugcc

SEQ ID NO: 1930846 - RNA, 21 nt, Homo sapiens
uugagcuucauauaccagcaa

SEQ ID NO: 1930847 - RNA, 18 nt, Homo sapiens
cugcucucuuaugucaca

SEQ ID NO: 1930848 - RNA, 22 nt, Homo sapiens
ucccagccccaggggugccugu

SEQ ID NO: 1930849 - RNA, 16 nt, Homo sapiens
ugaaauauugugacuc

SEQ ID NO: 1930850 - RNA, 16 nt, Homo sapiens
cauauguaaagcacau

SEQ ID NO: 1930851 - RNA, 20 nt, Homo sapiens
agcugagaucgugcuacugc

SEQ ID NO: 1930852 - RNA, 22 nt, Homo sapiens
uccuugugcaaaauauuugacu

SEQ ID NO: 1930853 - RNA, 15 nt, Homo sapiens
uaacaugcaaagauc

SEQ ID NO: 1930854 - RNA, 16 nt, Homo sapiens
caagguugcacagcaa

SEQ ID NO: 1930855 - RNA, 13 nt, Homo sapiens
ugaagucacauuc

SEQ ID NO: 1930856 - RNA, 19 nt, Homo sapiens
aauuggcucuagucacugg

SEQ ID NO: 1930857 - RNA, 17 nt, Homo sapiens
caaaggugugcccugua

SEQ ID NO: 1930858 - RNA, 22 nt, Homo sapiens
cgugguguccucuguccgucug

SEQ ID NO: 1930859 - RNA, 17 nt, Homo sapiens
cugcacuuucacuaaga

SEQ ID NO: 1930860 - RNA, 23 nt, Homo sapiens
cuuaaggucauaaaaauauuguu

SEQ ID NO: 1930861 - RNA, 18 nt, Homo sapiens
cccaugcucugaugcagu

SEQ ID NO: 1930862 - RNA, 15 nt, Homo sapiens
ucaugccacugcacu

SEQ ID NO: 1930863 - RNA, 14 nt, Homo sapiens
uguuggaauucacu

SEQ ID NO: 1930864 - RNA, 22 nt, Homo sapiens
uauuuaaaaaauuauggaauau

SEQ ID NO: 1930865 - RNA, 14 nt, Homo sapiens
uucaaauguauuac

SEQ ID NO: 1930866 - RNA, 22 nt, Homo sapiens
ugaacuaccaucugauguuuca

SEQ ID NO: 1930867 - RNA, 23 nt, Homo sapiens
gcaguccaggccucucucugcuc

SEQ ID NO: 1930868 - RNA, 12 nt, Homo sapiens
caggcaccugcc

SEQ ID NO: 1930869 - RNA, 16 nt, Homo sapiens
uuccuggacacuuuac

SEQ ID NO: 1930870 - RNA, 22 nt, Homo sapiens
acagaaugauuuuagauuuucc

SEQ ID NO: 1930871 - RNA, 15 nt, Homo sapiens
uaccaagcagcucac

SEQ ID NO: 1930872 - RNA, 22 nt, Homo sapiens
cacaucauuuuuaagcacugua

SEQ ID NO: 1930873 - RNA, 16 nt, Homo sapiens
acagcugcuuccccag

SEQ ID NO: 1930874 - RNA, 13 nt, Homo sapiens
accccugaccuca

SEQ ID NO: 1930875 - RNA, 23 nt, Homo sapiens
acuggucagggcaaaccugccuc

SEQ ID NO: 1930876 - RNA, 22 nt, Homo sapiens
cuguuacuugaaauaccaguga

SEQ ID NO: 1930877 - RNA, 17 nt, Homo sapiens
acaucuuuuacauucug

SEQ ID NO: 1930878 - RNA, 17 nt, Homo sapiens
uuauaugaaauguuuca

SEQ ID NO: 1930879 - RNA, 19 nt, Homo sapiens
agccuuaagucuuacuguu

SEQ ID NO: 1930880 - RNA, 18 nt, Homo sapiens
agaaucguaauggguaua

SEQ ID NO: 1930881 - RNA, 17 nt, Homo sapiens
uaagaauuuaccagaaa

SEQ ID NO: 1930882 - RNA, 13 nt, Homo sapiens
agcaucaugccuc

SEQ ID NO: 1930883 - RNA, 21 nt, Homo sapiens
aaugccaggcagaaaacuggc

SEQ ID NO: 1930884 - RNA, 19 nt, Homo sapiens
cucuggaaagcaacuucau

SEQ ID NO: 1930885 - RNA, 17 nt, Homo sapiens
acuucacuaaugacgau

SEQ ID NO: 1930886 - RNA, 15 nt, Homo sapiens
agcuuccugucaaca

SEQ ID NO: 1930887 - RNA, 23 nt, Homo sapiens
gagaggagaaggagggagacaug

SEQ ID NO: 1930888 - RNA, 18 nt, Homo sapiens
cugucugugaauauccag

SEQ ID NO: 1930889 - RNA, 17 nt, Homo sapiens
agcuguggugucagaaa

SEQ ID NO: 1930890 - RNA, 23 nt, Homo sapiens
uguucgggguuuuuuguuaugaa

SEQ ID NO: 1930891 - RNA, 15 nt, Homo sapiens
aggggagagaucucc

SEQ ID NO: 1930892 - RNA, 20 nt, Homo sapiens
uaguaaucuacaaaggaaau

SEQ ID NO: 1930893 - RNA, 16 nt, Homo sapiens
agcagugaugaaaaug

SEQ ID NO: 1930894 - RNA, 11 nt, Homo sapiens
auucagaagac

SEQ ID NO: 1930895 - RNA, 15 nt, Homo sapiens
uagauccagugcuga

SEQ ID NO: 1930896 - RNA, 17 nt, Homo sapiens
uaauauuucaagugccu

SEQ ID NO: 1930897 - RNA, 20 nt, Homo sapiens
ggaacugcuugugcacugga

SEQ ID NO: 1930898 - RNA, 19 nt, Homo sapiens
guccaaggaaaccacagcu

SEQ ID NO: 1930899 - RNA, 15 nt, Homo sapiens
agcuuggcugcucag

SEQ ID NO: 1930900 - RNA, 17 nt, Homo sapiens
ccccuggacauauuccc

SEQ ID NO: 1930901 - RNA, 18 nt, Homo sapiens
ccugaagaucaagccagu

SEQ ID NO: 1930902 - RNA, 21 nt, Homo sapiens
uggaaguggaguugacucugg

SEQ ID NO: 1930903 - RNA, 19 nt, Homo sapiens
acucuuucuggccugccuu

SEQ ID NO: 1930904 - RNA, 16 nt, Homo sapiens
cacugacuccugugga

SEQ ID NO: 1930905 - RNA, 15 nt, Homo sapiens
agaugguagaacuaa

SEQ ID NO: 1930906 - RNA, 15 nt, Homo sapiens
cagauuaccaaagaa

SEQ ID NO: 1930907 - RNA, 21 nt, Homo sapiens
ugagcagggcccucagaggaa

SEQ ID NO: 1930908 - RNA, 23 nt, Homo sapiens
accucugauuacaauucugaugu

SEQ ID NO: 1930909 - RNA, 14 nt, Homo sapiens
gcccacacccaggc

SEQ ID NO: 1930910 - RNA, 14 nt, Homo sapiens
uagaguuggauuaa

SEQ ID NO: 1930911 - RNA, 12 nt, Homo sapiens
aaaauaugccuu

SEQ ID NO: 1930912 - RNA, 14 nt, Homo sapiens
caaacaccagucac

SEQ ID NO: 1930913 - RNA, 21 nt, Homo sapiens
uggaaaagaagaaacuuugcc

SEQ ID NO: 1930914 - RNA, 21 nt, Homo sapiens
caccaggauagagacuggaac

SEQ ID NO: 1930915 - RNA, 12 nt, Homo sapiens
ccaagaacagag

SEQ ID NO: 1930916 - RNA, 11 nt, Homo sapiens
uguuuucacaa

SEQ ID NO: 1930917 - RNA, 19 nt, Homo sapiens
agggggccaggugcacaga

SEQ ID NO: 1930918 - RNA, 23 nt, Homo sapiens
uuguuuggucacugcuacaccuu

SEQ ID NO: 1930919 - RNA, 22 nt, Homo sapiens
ggcugggaacaacuucagucca

SEQ ID NO: 1930920 - RNA, 16 nt, Homo sapiens
aaacggauuccaaaga

SEQ ID NO: 1930921 - RNA, 17 nt, Homo sapiens
uagggaaaacauuccau

SEQ ID NO: 1930922 - RNA, 14 nt, Homo sapiens
ccacagagaugcau

SEQ ID NO: 1930923 - RNA, 20 nt, Homo sapiens
acuggaaccaccuggacgaa

SEQ ID NO: 1930924 - RNA, 18 nt, Homo sapiens
agaauuucacaagcuauu

SEQ ID NO: 1930925 - RNA, 21 nt, Homo sapiens
caggguacccuuuggggagca

SEQ ID NO: 1930926 - RNA, 18 nt, Homo sapiens
cuauauugcuuaccugau

SEQ ID NO: 1930927 - RNA, 13 nt, Homo sapiens
cacccggacaggu

SEQ ID NO: 1930928 - RNA, 14 nt, Homo sapiens
ucccauagcacugc

SEQ ID NO: 1930929 - RNA, 20 nt, Homo sapiens
ccucucugcuggacguccag

SEQ ID NO: 1930930 - RNA, 16 nt, Homo sapiens
aaaggccuccaaagca

SEQ ID NO: 1930931 - RNA, 15 nt, Homo sapiens
uaaaugcacauuuca

SEQ ID NO: 1930932 - RNA, 21 nt, Homo sapiens
gacagugaagcagcacuguga

SEQ ID NO: 1930933 - RNA, 13 nt, Homo sapiens
guuuuuuugcaga

SEQ ID NO: 1930934 - RNA, 17 nt, Homo sapiens
gcagagcaaaaggggaa

SEQ ID NO: 1930935 - RNA, 13 nt, Homo sapiens
ugggugaagacau

SEQ ID NO: 1930936 - RNA, 15 nt, Homo sapiens
acucccugcugugug

SEQ ID NO: 1930937 - RNA, 18 nt, Homo sapiens
ucaagugauccacccacc

SEQ ID NO: 1930938 - RNA, 13 nt, Homo sapiens
acaaaaaaccaca

SEQ ID NO: 1930939 - RNA, 22 nt, Homo sapiens
gacaaauggacuauacauacua

SEQ ID NO: 1930940 - RNA, 19 nt, Homo sapiens
cucagcuguccugcagcaa

SEQ ID NO: 1930941 - RNA, 14 nt, Homo sapiens
uguaaagaugucag

SEQ ID NO: 1930942 - RNA, 18 nt, Homo sapiens
gcaauuuuauuaaaugca

SEQ ID NO: 1930943 - RNA, 16 nt, Homo sapiens
ccaguaacugcugucg

SEQ ID NO: 1930944 - RNA, 13 nt, Homo sapiens
auuucacaagcua

SEQ ID NO: 1930945 - RNA, 13 nt, Homo sapiens
caaauuucaugca

SEQ ID NO: 1930946 - RNA, 15 nt, Homo sapiens
aaauauuuugucuaa

SEQ ID NO: 1930947 - RNA, 20 nt, Homo sapiens
cuuuacuagauauccuggcc

SEQ ID NO: 1930948 - RNA, 15 nt, Homo sapiens
augguggccacagug

SEQ ID NO: 1930949 - RNA, 18 nt, Homo sapiens
augguugguuagugcaug

SEQ ID NO: 1930950 - RNA, 15 nt, Homo sapiens
caacgacugccguga

SEQ ID NO: 1930951 - RNA, 21 nt, Homo sapiens
cugaaauauacacacagcagu

SEQ ID NO: 1930952 - RNA, 19 nt, Homo sapiens
ggucugggcaccaccucug

SEQ ID NO: 1930953 - RNA, 13 nt, Homo sapiens
cugaugcacuguu

SEQ ID NO: 1930954 - RNA, 18 nt, Homo sapiens
aaugaucagcaucuguga

SEQ ID NO: 1930955 - RNA, 17 nt, Homo sapiens
cuugucucagauggugu

SEQ ID NO: 1930956 - RNA, 21 nt, Homo sapiens
gcaagugcaucuuugccucaa

SEQ ID NO: 1930957 - RNA, 18 nt, Homo sapiens
gcuggagauaguuucaaa

SEQ ID NO: 1930958 - RNA, 14 nt, Homo sapiens
ucaacagaaugcau

SEQ ID NO: 1930959 - RNA, 14 nt, Homo sapiens
acaacugauugcaa

SEQ ID NO: 1930960 - RNA, 23 nt, Homo sapiens
ggcuucaguuuuacucugcugca

SEQ ID NO: 1930961 - RNA, 17 nt, Homo sapiens
uucacagaugugugauu

SEQ ID NO: 1930962 - RNA, 18 nt, Homo sapiens
uuaauguagacauuaucu

SEQ ID NO: 1930963 - RNA, 12 nt, Homo sapiens
cccagauugcaa

SEQ ID NO: 1930964 - RNA, 22 nt, Homo sapiens
aaugcccuaccugccuguucuc

SEQ ID NO: 1930965 - RNA, 19 nt, Homo sapiens
acucagccggcagccagau

SEQ ID NO: 1930966 - RNA, 13 nt, Homo sapiens
cccaccuuugcca

SEQ ID NO: 1930967 - RNA, 20 nt, Homo sapiens
uacuugacuugaaugugcac

SEQ ID NO: 1930968 - RNA, 18 nt, Homo sapiens
aagcacagaauuugucag

SEQ ID NO: 1930969 - RNA, 14 nt, Homo sapiens
ccagggcaucacau

SEQ ID NO: 1930970 - RNA, 11 nt, Homo sapiens
gcacagccacc

SEQ ID NO: 1930971 - RNA, 13 nt, Homo sapiens
uuauaaaaucaaa

SEQ ID NO: 1930972 - RNA, 16 nt, Homo sapiens
aauaucacaguauuau

SEQ ID NO: 1930973 - RNA, 21 nt, Homo sapiens
uugucuguuuguuucaagaac

SEQ ID NO: 1930974 - RNA, 22 nt, Homo sapiens
ggagcguucuaaauaugaauga

SEQ ID NO: 1930975 - RNA, 20 nt, Homo sapiens
aguuuuagaaaugagaucua

SEQ ID NO: 1930976 - RNA, 23 nt, Homo sapiens
cagccuccugaguagcugggauu

SEQ ID NO: 1930977 - RNA, 14 nt, Homo sapiens
gggcucuaaacagg

SEQ ID NO: 1930978 - RNA, 18 nt, Homo sapiens
ccauuuaaacuaaccuuu

SEQ ID NO: 1930979 - RNA, 17 nt, Homo sapiens
aguugaaauucuauucu

SEQ ID NO: 1930980 - RNA, 20 nt, Homo sapiens
ugaaaugggaacaauaucaa

SEQ ID NO: 1930981 - RNA, 12 nt, Homo sapiens
uuagaauaucua

SEQ ID NO: 1930982 - RNA, 23 nt, Homo sapiens
ggcuuaacgugucugagagccau

SEQ ID NO: 1930983 - RNA, 16 nt, Homo sapiens
uggcucacaccuguaa

SEQ ID NO: 1930984 - RNA, 16 nt, Homo sapiens
gaguguagacuguggc

SEQ ID NO: 1930985 - RNA, 20 nt, Homo sapiens
ucagccaggugcugugacac

SEQ ID NO: 1930986 - RNA, 16 nt, Homo sapiens
augaagcuuuauacgu

SEQ ID NO: 1930987 - RNA, 22 nt, Homo sapiens
guugaugggggugugauuugug

SEQ ID NO: 1930988 - RNA, 19 nt, Homo sapiens
cauuucuuaacagucucca

SEQ ID NO: 1930989 - RNA, 13 nt, Homo sapiens
uaacuugcugcuu

SEQ ID NO: 1930990 - RNA, 16 nt, Homo sapiens
gucaaagcaaguuuca

SEQ ID NO: 1930991 - RNA, 14 nt, Homo sapiens
caucucacuuugcc

SEQ ID NO: 1930992 - RNA, 13 nt, Homo sapiens
gccaccucagggc

SEQ ID NO: 1930993 - RNA, 17 nt, Homo sapiens
guuauagcugcauuugu

SEQ ID NO: 1930994 - RNA, 21 nt, Homo sapiens
aaugucuuaaucaugagauaa

SEQ ID NO: 1930995 - RNA, 17 nt, Homo sapiens
cuggauggcaccagagg

SEQ ID NO: 1930996 - RNA, 21 nt, Homo sapiens
uaaucuagguguggcugugaa

SEQ ID NO: 1930997 - RNA, 19 nt, Homo sapiens
caaaauaaagcuguucuca

SEQ ID NO: 1930998 - RNA, 14 nt, Homo sapiens
agaaaugccacuca

SEQ ID NO: 1930999 - RNA, 19 nt, Homo sapiens
cauguaaagucaucaucaa

SEQ ID NO: 1931000 - RNA, 14 nt, Homo sapiens
caggagcaagugag

SEQ ID NO: 1931001 - RNA, 23 nt, Homo sapiens
aucucaggauaaaguuugcuaag

SEQ ID NO: 1931002 - RNA, 16 nt, Homo sapiens
uuugaaggacaacagc

SEQ ID NO: 1931003 - RNA, 18 nt, Homo sapiens
uuaaaccucucuucuacc

SEQ ID NO: 1931004 - RNA, 15 nt, Homo sapiens
ugcguaggaggaguu

SEQ ID NO: 1931005 - RNA, 23 nt, Homo sapiens
cggugagccggggccgucugugu

SEQ ID NO: 1931006 - RNA, 23 nt, Homo sapiens
ucuugggaggacacuuuugccaa

SEQ ID NO: 1931007 - RNA, 13 nt, Homo sapiens
ggacaucauucug

SEQ ID NO: 1931008 - RNA, 22 nt, Homo sapiens
uagucauaucuaucuaaucaga

SEQ ID NO: 1931009 - RNA, 16 nt, Homo sapiens
guuuucagucuucuga

SEQ ID NO: 1931010 - RNA, 17 nt, Homo sapiens
auccagccucaugggaa

SEQ ID NO: 1931011 - RNA, 16 nt, Homo sapiens
gcagcaggccagagaa

SEQ ID NO: 1931012 - RNA, 13 nt, Homo sapiens
uaaguucuaucag

SEQ ID NO: 1931013 - RNA, 17 nt, Homo sapiens
acuguucaggaguccaa

SEQ ID NO: 1931014 - RNA, 13 nt, Homo sapiens
aaaucugugccug

SEQ ID NO: 1931015 - RNA, 19 nt, Homo sapiens
uucccuaccauucagugau

SEQ ID NO: 1931016 - RNA, 20 nt, Homo sapiens
cagcaauuuaaauguuauga

SEQ ID NO: 1931017 - RNA, 17 nt, Homo sapiens
gacacguccaccccagu

SEQ ID NO: 1931018 - RNA, 13 nt, Homo sapiens
acugcggaccaag

SEQ ID NO: 1931019 - RNA, 19 nt, Homo sapiens
aacuccuccuuuaucauua

SEQ ID NO: 1931020 - RNA, 23 nt, Homo sapiens
guugcagcccuugugaugugauu

SEQ ID NO: 1931021 - RNA, 13 nt, Homo sapiens
aucaggcuguuau

SEQ ID NO: 1931022 - RNA, 22 nt, Homo sapiens
cauuuugggaccuauaucucag

SEQ ID NO: 1931023 - RNA, 14 nt, Homo sapiens
acugccucugccac

SEQ ID NO: 1931024 - RNA, 16 nt, Homo sapiens
cagcgucaacaucgug

SEQ ID NO: 1931025 - RNA, 19 nt, Homo sapiens
uaauuaccaguuuuccaga

SEQ ID NO: 1931026 - RNA, 13 nt, Homo sapiens
aguaauugucaau

SEQ ID NO: 1931027 - RNA, 13 nt, Homo sapiens
acaaguagcacac

SEQ ID NO: 1931028 - RNA, 23 nt, Homo sapiens
cauggccuaagggccacauccca

SEQ ID NO: 1931029 - RNA, 19 nt, Homo sapiens
uaaaugggggugcauuuga

SEQ ID NO: 1931030 - RNA, 20 nt, Homo sapiens
cacgcuucaaggauauacug

SEQ ID NO: 1931031 - RNA, 21 nt, Homo sapiens
ccaaaaaaaaaaaagaguccu

SEQ ID NO: 1931032 - RNA, 15 nt, Homo sapiens
guaucucuacuuucc

SEQ ID NO: 1931033 - RNA, 19 nt, Homo sapiens
ccagaucuugccuccagag

SEQ ID NO: 1931034 - RNA, 20 nt, Homo sapiens
aucuguuugaucccuguuac

SEQ ID NO: 1931035 - RNA, 21 nt, Homo sapiens
acuguuuauuaccagauucac

SEQ ID NO: 1931036 - RNA, 14 nt, Homo sapiens
aagauggggaccag

SEQ ID NO: 1931037 - RNA, 15 nt, Homo sapiens
gaagcuguaugccac

SEQ ID NO: 1931038 - RNA, 13 nt, Homo sapiens
cccagcugcacuu

SEQ ID NO: 1931039 - RNA, 18 nt, Homo sapiens
ccucccuuguggcagcaa

SEQ ID NO: 1931040 - RNA, 23 nt, Homo sapiens
gugacuggcccacacgugcauag

SEQ ID NO: 1931041 - RNA, 16 nt, Homo sapiens
aagcaguuacuaauau

SEQ ID NO: 1931042 - RNA, 12 nt, Homo sapiens
auaguguugcuu

SEQ ID NO: 1931043 - RNA, 14 nt, Homo sapiens
uauguacugccuua

SEQ ID NO: 1931044 - RNA, 14 nt, Homo sapiens
aaauuuaaccuacu

SEQ ID NO: 1931045 - RNA, 18 nt, Homo sapiens
ccucugcuaccaucucau

SEQ ID NO: 1931046 - RNA, 19 nt, Homo sapiens
auggacauucaugcucagu

SEQ ID NO: 1931047 - RNA, 18 nt, Homo sapiens
gaaaacaaucacacucau

SEQ ID NO: 1931048 - RNA, 16 nt, Homo sapiens
ucagugaaauaauuac

SEQ ID NO: 1931049 - RNA, 21 nt, Homo sapiens
cuuugauuuuuugcccagaga

SEQ ID NO: 1931050 - RNA, 13 nt, Homo sapiens
accauugugcauu

SEQ ID NO: 1931051 - RNA, 20 nt, Homo sapiens
uacacauguaucuaugcauu

SEQ ID NO: 1931052 - RNA, 12 nt, Homo sapiens
ccccuacaucaa

SEQ ID NO: 1931053 - RNA, 16 nt, Homo sapiens
gacaaagcuacuugaa

SEQ ID NO: 1931054 - RNA, 15 nt, Homo sapiens
cacaucuauugcaga

SEQ ID NO: 1931055 - RNA, 18 nt, Homo sapiens
gccuugcacggcugcucg

SEQ ID NO: 1931056 - RNA, 13 nt, Homo sapiens
uacauagcauuaa

SEQ ID NO: 1931057 - RNA, 13 nt, Homo sapiens
aaaaguacauauu

SEQ ID NO: 1931058 - RNA, 14 nt, Homo sapiens
ccgagcucaggggg

SEQ ID NO: 1931059 - RNA, 23 nt, Homo sapiens
gauaguaguuaggauaacuaaaa

SEQ ID NO: 1931060 - RNA, 12 nt, Homo sapiens
gugcaugugcac

SEQ ID NO: 1931061 - RNA, 12 nt, Homo sapiens
gcacaugugugc

SEQ ID NO: 1931062 - RNA, 13 nt, Homo sapiens
gaccagcuuugca

SEQ ID NO: 1931063 - RNA, 18 nt, Homo sapiens
uuaucacuucauucacau

SEQ ID NO: 1931064 - RNA, 14 nt, Homo sapiens
cucugggaggccau

SEQ ID NO: 1931065 - RNA, 14 nt, Homo sapiens
ucaauaaucaauga

SEQ ID NO: 1931066 - RNA, 16 nt, Homo sapiens
agaucagcauccaaaa

SEQ ID NO: 1931067 - RNA, 23 nt, Homo sapiens
gaagauacagagaugcaaugaua

SEQ ID NO: 1931068 - RNA, 12 nt, Homo sapiens
aaauaauaugca

SEQ ID NO: 1931069 - RNA, 12 nt, Homo sapiens
aaaaaauaugcu

SEQ ID NO: 1931070 - RNA, 23 nt, Homo sapiens
aggaaauuacugcccacuuguca

SEQ ID NO: 1931071 - RNA, 19 nt, Homo sapiens
gacagccuccuucagcccu

SEQ ID NO: 1931072 - RNA, 15 nt, Homo sapiens
ccaauuuuguugcau

SEQ ID NO: 1931073 - RNA, 14 nt, Homo sapiens
gcugcacuguuuau

SEQ ID NO: 1931074 - RNA, 23 nt, Homo sapiens
agcuggggaggugagagugcaga

SEQ ID NO: 1931075 - RNA, 21 nt, Homo sapiens
uaggcauguagcuacaggaca

SEQ ID NO: 1931076 - RNA, 20 nt, Homo sapiens
gcagcauuaaaaaaaaucaa

SEQ ID NO: 1931077 - RNA, 18 nt, Homo sapiens
agaucaauggcgcagugc

SEQ ID NO: 1931078 - RNA, 16 nt, Homo sapiens
aucauggcaacauaau

SEQ ID NO: 1931079 - RNA, 22 nt, Homo sapiens
acucuguauuacagcuuucaca

SEQ ID NO: 1931080 - RNA, 19 nt, Homo sapiens
ugguuuacauuuaaagcau

SEQ ID NO: 1931081 - RNA, 20 nt, Homo sapiens
agaucuuuuauuuugccaag

SEQ ID NO: 1931082 - RNA, 22 nt, Homo sapiens
cugggauuacaggugugagcca

SEQ ID NO: 1931083 - RNA, 22 nt, Homo sapiens
cuacagaagaaacuggggcucc

SEQ ID NO: 1931084 - RNA, 11 nt, Homo sapiens
guucagaguuc

SEQ ID NO: 1931085 - RNA, 17 nt, Homo sapiens
guaggucggcacuugga

SEQ ID NO: 1931086 - RNA, 17 nt, Homo sapiens
auggagagagccuuaua

SEQ ID NO: 1931087 - RNA, 19 nt, Homo sapiens
cuaaugagacugaccauau

SEQ ID NO: 1931088 - RNA, 15 nt, Homo sapiens
agucagagacagaua

SEQ ID NO: 1931089 - RNA, 11 nt, Homo sapiens
ucuagugcagg

SEQ ID NO: 1931090 - RNA, 14 nt, Homo sapiens
ggggacuaacccaa

SEQ ID NO: 1931091 - RNA, 20 nt, Homo sapiens
aacgaagaguucccuugaaa

SEQ ID NO: 1931092 - RNA, 22 nt, Homo sapiens
gcagcuggugccccaccugccu

SEQ ID NO: 1931093 - RNA, 16 nt, Homo sapiens
acuggcuucacauucu

SEQ ID NO: 1931094 - RNA, 18 nt, Homo sapiens
acugcacguggcuucuga

SEQ ID NO: 1931095 - RNA, 17 nt, Homo sapiens
ugggaucugucuuggca

SEQ ID NO: 1931096 - RNA, 13 nt, Homo sapiens
gucugccuaugca

SEQ ID NO: 1931097 - RNA, 15 nt, Homo sapiens
aauuuuccaguauaa

SEQ ID NO: 1931098 - RNA, 18 nt, Homo sapiens
cuggucuguugcugccac

SEQ ID NO: 1931099 - RNA, 20 nt, Homo sapiens
ccuuucaccacaugugcaca

SEQ ID NO: 1931100 - RNA, 23 nt, Homo sapiens
ugauguauaaagcaacuguuaug

SEQ ID NO: 1931101 - RNA, 19 nt, Homo sapiens
gcauuacugggaagacaau

SEQ ID NO: 1931102 - RNA, 15 nt, Homo sapiens
aauccuuuacauuca

SEQ ID NO: 1931103 - RNA, 18 nt, Homo sapiens
auuucaguaucaucucca

SEQ ID NO: 1931104 - RNA, 14 nt, Homo sapiens
guccuuucauuugu

SEQ ID NO: 1931105 - RNA, 14 nt, Homo sapiens
caaaaacagaauuu

SEQ ID NO: 1931106 - RNA, 21 nt, Homo sapiens
gaauaaaccaucaucuugcca

SEQ ID NO: 1931107 - RNA, 21 nt, Homo sapiens
gagaggucagccuugaccuaa

SEQ ID NO: 1931108 - RNA, 24 nt, Homo sapiens
ugccaagaccuuucaaagccauuu

SEQ ID NO: 1931109 - RNA, 17 nt, Homo sapiens
cugacuaacgccaucca

SEQ ID NO: 1931110 - RNA, 20 nt, Homo sapiens
augccaguaacugugcugua

SEQ ID NO: 1931111 - RNA, 22 nt, Homo sapiens
gggaacccuuaguucuaucuga

SEQ ID NO: 1931112 - RNA, 18 nt, Homo sapiens
gagaaaaaaacuucuuua

SEQ ID NO: 1931113 - RNA, 17 nt, Homo sapiens
uguggaaucuggaguga

SEQ ID NO: 1931114 - RNA, 16 nt, Homo sapiens
ccauguuuaagauuua

SEQ ID NO: 1931115 - RNA, 15 nt, Homo sapiens
uuguuacuggaagac

SEQ ID NO: 1931116 - RNA, 20 nt, Homo sapiens
ucaagugaggugacacucca

SEQ ID NO: 1931117 - RNA, 14 nt, Homo sapiens
cagccucuagggac

SEQ ID NO: 1931118 - RNA, 19 nt, Homo sapiens
uagauaugaagaaucugcu

SEQ ID NO: 1931119 - RNA, 14 nt, Homo sapiens
agagccuggagaag

SEQ ID NO: 1931120 - RNA, 16 nt, Homo sapiens
cuuggaccaugccaga

SEQ ID NO: 1931121 - RNA, 16 nt, Homo sapiens
ucccggcgcgcccucu

SEQ ID NO: 1931122 - RNA, 19 nt, Homo sapiens
uuauuucaaccagcacauu

SEQ ID NO: 1931123 - RNA, 13 nt, Homo sapiens
agagaggaagagc

SEQ ID NO: 1931124 - RNA, 16 nt, Homo sapiens
ggcacugggaagccua

SEQ ID NO: 1931125 - RNA, 11 nt, Homo sapiens
cacaaauauca

SEQ ID NO: 1931126 - RNA, 19 nt, Homo sapiens
ugauuuugaccuuguauug

SEQ ID NO: 1931127 - RNA, 11 nt, Homo sapiens
auuucuuccca

SEQ ID NO: 1931128 - RNA, 14 nt, Homo sapiens
acaaggugccuguu

SEQ ID NO: 1931129 - RNA, 19 nt, Homo sapiens
ggcugaaaagaagccucag

SEQ ID NO: 1931130 - RNA, 23 nt, Homo sapiens
ugugaauguuuagugugcugcug

SEQ ID NO: 1931131 - RNA, 15 nt, Homo sapiens
aucaucagacuagua

SEQ ID NO: 1931132 - RNA, 21 nt, Homo sapiens
aggguucaagccuuccaggga

SEQ ID NO: 1931133 - RNA, 21 nt, Homo sapiens
uucuuaaaauguuaacuggca

SEQ ID NO: 1931134 - RNA, 13 nt, Homo sapiens
agaaaucaggccu

SEQ ID NO: 1931135 - RNA, 23 nt, Homo sapiens
ccuuaagaaagcuauauaugaau

SEQ ID NO: 1931136 - RNA, 23 nt, Homo sapiens
cacauuuuuauaaaaaugagugc

SEQ ID NO: 1931137 - RNA, 12 nt, Homo sapiens
augcuucuagcc

SEQ ID NO: 1931138 - RNA, 12 nt, Homo sapiens
gucauucuggga

SEQ ID NO: 1931139 - RNA, 22 nt, Homo sapiens
uccccuacaucaaaugcucaag

SEQ ID NO: 1931140 - RNA, 16 nt, Homo sapiens
ugccuugugcuguuaa

SEQ ID NO: 1931141 - RNA, 14 nt, Homo sapiens
auggacagcgauga

SEQ ID NO: 1931142 - RNA, 20 nt, Homo sapiens
ucagauuauuuaaaugggaa

SEQ ID NO: 1931143 - RNA, 12 nt, Homo sapiens
gaucagcuggug

SEQ ID NO: 1931144 - RNA, 19 nt, Homo sapiens
cuuaccuagauucuacaua

SEQ ID NO: 1931145 - RNA, 21 nt, Homo sapiens
caaaaaugugcugccuagaaa

SEQ ID NO: 1931146 - RNA, 16 nt, Homo sapiens
agaauccacacuuccu

SEQ ID NO: 1931147 - RNA, 14 nt, Homo sapiens
gaaaccccaaugcu

SEQ ID NO: 1931148 - RNA, 20 nt, Homo sapiens
uuauauaagaccacuacagu

SEQ ID NO: 1931149 - RNA, 16 nt, Homo sapiens
agugauaacacuggag

SEQ ID NO: 1931150 - RNA, 18 nt, Homo sapiens
uuaccgagagccaaacag

SEQ ID NO: 1931151 - RNA, 16 nt, Homo sapiens
aguccuccaaaacaca

SEQ ID NO: 1931152 - RNA, 17 nt, Homo sapiens
guucacugaggggcccu

SEQ ID NO: 1931153 - RNA, 22 nt, Homo sapiens
uucugcagaaauuugcaacuca

SEQ ID NO: 1931154 - RNA, 15 nt, Homo sapiens
accacaccaaugcaa

SEQ ID NO: 1931155 - RNA, 17 nt, Homo sapiens
auggcagagcauccucu

SEQ ID NO: 1931156 - RNA, 19 nt, Homo sapiens
uucuauaccuuuuucuggu

SEQ ID NO: 1931157 - RNA, 20 nt, Homo sapiens
uuuacccuccuguaagcaac

SEQ ID NO: 1931158 - RNA, 13 nt, Homo sapiens
aaguggauuacaa

SEQ ID NO: 1931159 - RNA, 12 nt, Homo sapiens
cacugacuggaa

SEQ ID NO: 1931160 - RNA, 23 nt, Homo sapiens
ucaaaccgccggccacacugguc

SEQ ID NO: 1931161 - RNA, 19 nt, Homo sapiens
gcugaccugguacugaggu

SEQ ID NO: 1931162 - RNA, 16 nt, Homo sapiens
cagacauagacugcaa

SEQ ID NO: 1931163 - RNA, 16 nt, Homo sapiens
agaccuaccucagguu

SEQ ID NO: 1931164 - RNA, 18 nt, Homo sapiens
acaaccuguuaccacuuc

SEQ ID NO: 1931165 - RNA, 12 nt, Homo sapiens
gucagucaggga

SEQ ID NO: 1931166 - RNA, 12 nt, Homo sapiens
gucugucagggu

SEQ ID NO: 1931167 - RNA, 15 nt, Homo sapiens
cggucaccugugcua

SEQ ID NO: 1931168 - RNA, 17 nt, Homo sapiens
cggggccagcaccacuu

SEQ ID NO: 1931169 - RNA, 15 nt, Homo sapiens
ucagaugacuagaaa

SEQ ID NO: 1931170 - RNA, 16 nt, Homo sapiens
uaauuuuuuucuuaaa

SEQ ID NO: 1931171 - RNA, 21 nt, Homo sapiens
auggcacauggcuggcacuga

SEQ ID NO: 1931172 - RNA, 19 nt, Homo sapiens
ccuccaguuuuagguccuu

SEQ ID NO: 1931173 - RNA, 19 nt, Homo sapiens
gaugacaguggcaacugaa

SEQ ID NO: 1931174 - RNA, 14 nt, Homo sapiens
gauaaggagggcaa

SEQ ID NO: 1931175 - RNA, 16 nt, Homo sapiens
ucccugaaacauugca

SEQ ID NO: 1931176 - RNA, 15 nt, Homo sapiens
uaaaauugugaugcu

SEQ ID NO: 1931177 - RNA, 21 nt, Homo sapiens
uuaacaaaaggacaaccacag

SEQ ID NO: 1931178 - RNA, 18 nt, Homo sapiens
acucagcucuuggcucca

SEQ ID NO: 1931179 - RNA, 23 nt, Homo sapiens
ugggggccucuuuaccauagcuu

SEQ ID NO: 1931180 - RNA, 14 nt, Homo sapiens
acgccuuguuccug

SEQ ID NO: 1931181 - RNA, 16 nt, Homo sapiens
gaaacuaguaucucug

SEQ ID NO: 1931182 - RNA, 17 nt, Homo sapiens
aauguaucaacauauuu

SEQ ID NO: 1931183 - RNA, 23 nt, Homo sapiens
caguagugcaccaucucacugca

SEQ ID NO: 1931184 - RNA, 22 nt, Homo sapiens
acuuuuacacgaccauuugaua

SEQ ID NO: 1931185 - RNA, 12 nt, Homo sapiens
augaucuuggcu

SEQ ID NO: 1931186 - RNA, 23 nt, Homo sapiens
ugcgccugacauucacacagaga

SEQ ID NO: 1931187 - RNA, 22 nt, Homo sapiens
cucucagggaaagccucuggca

SEQ ID NO: 1931188 - RNA, 13 nt, Homo sapiens
caaguuuccauag

SEQ ID NO: 1931189 - RNA, 14 nt, Homo sapiens
gaaaucaaugcaag

SEQ ID NO: 1931190 - RNA, 14 nt, Homo sapiens
gacuucaaugauag

SEQ ID NO: 1931191 - RNA, 16 nt, Homo sapiens
acuggugcacuucuua

SEQ ID NO: 1931192 - RNA, 18 nt, Homo sapiens
cuauccuucucuuucaau

SEQ ID NO: 1931193 - RNA, 16 nt, Homo sapiens
uaaaaggaaucuggca

SEQ ID NO: 1931194 - RNA, 20 nt, Homo sapiens
uaccauagaaagaugacaaa

SEQ ID NO: 1931195 - RNA, 12 nt, Homo sapiens
acagcuggacag

SEQ ID NO: 1931196 - RNA, 12 nt, Homo sapiens
acaacuggacaa

SEQ ID NO: 1931197 - RNA, 12 nt, Homo sapiens
ugaacuggugaa

SEQ ID NO: 1931198 - RNA, 18 nt, Homo sapiens
auaaugaagaacacugua

SEQ ID NO: 1931199 - RNA, 10 nt, Homo sapiens
ugucuguccu

SEQ ID NO: 1931200 - RNA, 18 nt, Homo sapiens
uuuguaacuuccauguga

SEQ ID NO: 1931201 - RNA, 20 nt, Homo sapiens
gaaggacauuuucucuuuaa

SEQ ID NO: 1931202 - RNA, 14 nt, Homo sapiens
uagaagacugucag

SEQ ID NO: 1931203 - RNA, 20 nt, Homo sapiens
gucaucuuucuuuucuuuga

SEQ ID NO: 1931204 - RNA, 23 nt, Homo sapiens
cggggaggggaggaacagggaag

SEQ ID NO: 1931205 - RNA, 17 nt, Homo sapiens
uuauugauaaguucaua

SEQ ID NO: 1931206 - RNA, 13 nt, Homo sapiens
agcacugacaaua

SEQ ID NO: 1931207 - RNA, 15 nt, Homo sapiens
caccucccugcaaua

SEQ ID NO: 1931208 - RNA, 16 nt, Homo sapiens
uguguuuuaaacuggu

SEQ ID NO: 1931209 - RNA, 15 nt, Homo sapiens
ugcucccaugcucau

SEQ ID NO: 1931210 - RNA, 18 nt, Homo sapiens
accauuggaaacauuuaa

SEQ ID NO: 1931211 - RNA, 16 nt, Homo sapiens
guucacaaacugugaa

SEQ ID NO: 1931212 - RNA, 11 nt, Homo sapiens
uaagaaagcuu

SEQ ID NO: 1931213 - RNA, 23 nt, Homo sapiens
acguauuugaauggccuucauau

SEQ ID NO: 1931214 - RNA, 20 nt, Homo sapiens
ccuguucaccuuauguauua

SEQ ID NO: 1931215 - RNA, 23 nt, Homo sapiens
uggaccugccccggaccuaccuc

SEQ ID NO: 1931216 - RNA, 12 nt, Homo sapiens
auguagacauuu

SEQ ID NO: 1931217 - RNA, 12 nt, Homo sapiens
auuuagacaugu

SEQ ID NO: 1931218 - RNA, 18 nt, Homo sapiens
agggcagcuucagucucu

SEQ ID NO: 1931219 - RNA, 17 nt, Homo sapiens
ucuaacaggcacuuuga

SEQ ID NO: 1931220 - RNA, 21 nt, Homo sapiens
ccaguccccgaggagcugggc

SEQ ID NO: 1931221 - RNA, 13 nt, Homo sapiens
auaguuagcuuua

SEQ ID NO: 1931222 - RNA, 16 nt, Homo sapiens
agcaaaucgugccuug

SEQ ID NO: 1931223 - RNA, 15 nt, Homo sapiens
gucaauuguaacuaa

SEQ ID NO: 1931224 - RNA, 19 nt, Homo sapiens
ucuggcccuuacacacuca

SEQ ID NO: 1931225 - RNA, 17 nt, Homo sapiens
aauccuaaauaauguua

SEQ ID NO: 1931226 - RNA, 16 nt, Homo sapiens
agacacauuggcuuug

SEQ ID NO: 1931227 - RNA, 18 nt, Homo sapiens
uaaaauuuaccacagacu

SEQ ID NO: 1931228 - RNA, 14 nt, Homo sapiens
ccuuuuauguauuu

SEQ ID NO: 1931229 - RNA, 20 nt, Homo sapiens
ucccaccccuaccucuagua

SEQ ID NO: 1931230 - RNA, 13 nt, Homo sapiens
ucuguagggauuu

SEQ ID NO: 1931231 - RNA, 22 nt, Homo sapiens
ccaguacugggagauacagcca

SEQ ID NO: 1931232 - RNA, 12 nt, Homo sapiens
cauuuacuuaac

SEQ ID NO: 1931233 - RNA, 20 nt, Homo sapiens
aguauuuaucuccugucuac

SEQ ID NO: 1931234 - RNA, 20 nt, Homo sapiens
guuucacaacaggcauucca

SEQ ID NO: 1931235 - RNA, 12 nt, Homo sapiens
uaccuacauucu

SEQ ID NO: 1931236 - RNA, 19 nt, Homo sapiens
auguagacugaaaagccau

SEQ ID NO: 1931237 - RNA, 22 nt, Homo sapiens
ugggcaagagaugggacaagca

SEQ ID NO: 1931238 - RNA, 15 nt, Homo sapiens
uucaguuuugcuuau

SEQ ID NO: 1931239 - RNA, 22 nt, Homo sapiens
gcaguucuucaucaugagacaa

SEQ ID NO: 1931240 - RNA, 19 nt, Homo sapiens
uugacuugaaaugcucuuu

SEQ ID NO: 1931241 - RNA, 22 nt, Homo sapiens
cuggagagguuaaggugcaaua

SEQ ID NO: 1931242 - RNA, 15 nt, Homo sapiens
cuucauuucaggaag

SEQ ID NO: 1931243 - RNA, 13 nt, Homo sapiens
agcugucugcuca

SEQ ID NO: 1931244 - RNA, 15 nt, Homo sapiens
caugucaugugccac

SEQ ID NO: 1931245 - RNA, 22 nt, Homo sapiens
cauaugccuuggggaggacaaa

SEQ ID NO: 1931246 - RNA, 16 nt, Homo sapiens
cuccuuuuaugcucac

SEQ ID NO: 1931247 - RNA, 14 nt, Homo sapiens
ccauacagugacaa

SEQ ID NO: 1931248 - RNA, 17 nt, Homo sapiens
caagaguccuuacugaa

SEQ ID NO: 1931249 - RNA, 19 nt, Homo sapiens
aaauuccacacuaccacau

SEQ ID NO: 1931250 - RNA, 23 nt, Homo sapiens
agauccucugacagcuguccuga

SEQ ID NO: 1931251 - RNA, 17 nt, Homo sapiens
uuauuccuuauuucucu

SEQ ID NO: 1931252 - RNA, 14 nt, Homo sapiens
uggggaggccagug

SEQ ID NO: 1931253 - RNA, 18 nt, Homo sapiens
aauugguuaaucacuuaa

SEQ ID NO: 1931254 - RNA, 14 nt, Homo sapiens
ggcacccuggucug

SEQ ID NO: 1931255 - RNA, 15 nt, Homo sapiens
gucuuagcuuuacau

SEQ ID NO: 1931256 - RNA, 12 nt, Homo sapiens
ugaaaaauacuu

SEQ ID NO: 1931257 - RNA, 18 nt, Homo sapiens
aacuuuuuuuucucucuu

SEQ ID NO: 1931258 - RNA, 15 nt, Homo sapiens
agggaacagugccca

SEQ ID NO: 1931259 - RNA, 15 nt, Homo sapiens
agcugcuuccagugu

SEQ ID NO: 1931260 - RNA, 14 nt, Homo sapiens
uuacugauacuaca

SEQ ID NO: 1931261 - RNA, 17 nt, Homo sapiens
gccuugaacuguggcca

SEQ ID NO: 1931262 - RNA, 13 nt, Homo sapiens
agcaguaccaucu

SEQ ID NO: 1931263 - RNA, 20 nt, Homo sapiens
cuaauggaauaugcguaguu

SEQ ID NO: 1931264 - RNA, 19 nt, Homo sapiens
auaauauucagccagcuua

SEQ ID NO: 1931265 - RNA, 23 nt, Homo sapiens
cuggacagcuccgcgcucggggc

SEQ ID NO: 1931266 - RNA, 14 nt, Homo sapiens
uggccagcccuucc

SEQ ID NO: 1931267 - RNA, 17 nt, Homo sapiens
guaugucuauuugcaca

SEQ ID NO: 1931268 - RNA, 17 nt, Homo sapiens
cgcagcauuggugcuca

SEQ ID NO: 1931269 - RNA, 15 nt, Homo sapiens
cacuaaugcuuuaag

SEQ ID NO: 1931270 - RNA, 15 nt, Homo sapiens
auuauuugaacauug

SEQ ID NO: 1931271 - RNA, 18 nt, Homo sapiens
uccuagucuacuugaggc

SEQ ID NO: 1931272 - RNA, 21 nt, Homo sapiens
cucuggaucacagacacugca

SEQ ID NO: 1931273 - RNA, 15 nt, Homo sapiens
ugaggaccucagcuu

SEQ ID NO: 1931274 - RNA, 14 nt, Homo sapiens
ugauuuaguugcau

SEQ ID NO: 1931275 - RNA, 13 nt, Homo sapiens
uugagaucauguc

SEQ ID NO: 1931276 - RNA, 18 nt, Homo sapiens
caggauuaaaagccauga

SEQ ID NO: 1931277 - RNA, 15 nt, Homo sapiens
ugcaaccuuguacuu

SEQ ID NO: 1931278 - RNA, 16 nt, Homo sapiens
acaaagucaacuucca

SEQ ID NO: 1931279 - RNA, 12 nt, Homo sapiens
agauuucucacc

SEQ ID NO: 1931280 - RNA, 20 nt, Homo sapiens
uuuguuguuuuuaacaacua

SEQ ID NO: 1931281 - RNA, 11 nt, Homo sapiens
ccaacauccag

SEQ ID NO: 1931282 - RNA, 19 nt, Homo sapiens
aaauauccuuuaauugauc

SEQ ID NO: 1931283 - RNA, 22 nt, Homo sapiens
cuuccagaaccaacugcauugg

SEQ ID NO: 1931284 - RNA, 15 nt, Homo sapiens
gccgcugucucugag

SEQ ID NO: 1931285 - RNA, 13 nt, Homo sapiens
aguuuaaugauua

SEQ ID NO: 1931286 - RNA, 22 nt, Homo sapiens
gccagaggaaaucugaauguau

SEQ ID NO: 1931287 - RNA, 14 nt, Homo sapiens
ugcucauaugcaug

SEQ ID NO: 1931288 - RNA, 17 nt, Homo sapiens
cuggcuuuacagacaaa

SEQ ID NO: 1931289 - RNA, 16 nt, Homo sapiens
acuucgcacacaccca

SEQ ID NO: 1931290 - RNA, 19 nt, Homo sapiens
agaaaaagucaauguacuu

SEQ ID NO: 1931291 - RNA, 13 nt, Homo sapiens
aaguuugagauca

SEQ ID NO: 1931292 - RNA, 13 nt, Homo sapiens
gauagacacugga

SEQ ID NO: 1931293 - RNA, 19 nt, Homo sapiens
gaggggugcagaggcugug

SEQ ID NO: 1931294 - RNA, 21 nt, Homo sapiens
gagagugguuagaaggcuucu

SEQ ID NO: 1931295 - RNA, 19 nt, Homo sapiens
uuuccaaagaaaaguauug

SEQ ID NO: 1931296 - RNA, 12 nt, Homo sapiens
cucagaagaugg

SEQ ID NO: 1931297 - RNA, 17 nt, Homo sapiens
uggucuacccgugucua

SEQ ID NO: 1931298 - RNA, 14 nt, Homo sapiens
cuucaggacacuca

SEQ ID NO: 1931299 - RNA, 16 nt, Homo sapiens
aagcugaugaggaaua

SEQ ID NO: 1931300 - RNA, 17 nt, Homo sapiens
uuaaaauauaugaggcu

SEQ ID NO: 1931301 - RNA, 14 nt, Homo sapiens
uuuugucacugucu

SEQ ID NO: 1931302 - RNA, 20 nt, Homo sapiens
cuuaaggaacagcauuguga

SEQ ID NO: 1931303 - RNA, 14 nt, Homo sapiens
gcuguuuacugcuu

SEQ ID NO: 1931304 - RNA, 18 nt, Homo sapiens
gaagagagggcugagcca

SEQ ID NO: 1931305 - RNA, 16 nt, Homo sapiens
gaacuagcucuuuuau

SEQ ID NO: 1931306 - RNA, 15 nt, Homo sapiens
ggcaugucuccucaa

SEQ ID NO: 1931307 - RNA, 17 nt, Homo sapiens
agaguccagugcucugc

SEQ ID NO: 1931308 - RNA, 17 nt, Homo sapiens
aaaaggaaaaaaccaaa

SEQ ID NO: 1931309 - RNA, 17 nt, Homo sapiens
cuuuuugugauaugcac

SEQ ID NO: 1931310 - RNA, 14 nt, Homo sapiens
auaggcccagugag

SEQ ID NO: 1931311 - RNA, 19 nt, Homo sapiens
gcccagggcugcgucugca

SEQ ID NO: 1931312 - RNA, 23 nt, Homo sapiens
cucaguuucauuaacuggugaau

SEQ ID NO: 1931313 - RNA, 23 nt, Homo sapiens
uuacugagaaugaugguuuccaa

SEQ ID NO: 1931314 - RNA, 18 nt, Homo sapiens
cugguuauggaaggugac

SEQ ID NO: 1931315 - RNA, 16 nt, Homo sapiens
aagccuaucaaaggaa

SEQ ID NO: 1931316 - RNA, 19 nt, Homo sapiens
aguccccccucuugucucc

SEQ ID NO: 1931317 - RNA, 23 nt, Homo sapiens
uagcagggggggaaaugcauuua

SEQ ID NO: 1931318 - RNA, 19 nt, Homo sapiens
agcacagcuugaccugagg

SEQ ID NO: 1931319 - RNA, 21 nt, Homo sapiens
ugcccucugaaauaaugggau

SEQ ID NO: 1931320 - RNA, 14 nt, Homo sapiens
uaauaccacuacua

SEQ ID NO: 1931321 - RNA, 21 nt, Homo sapiens
gguccucugcaugucucaggc

SEQ ID NO: 1931322 - RNA, 22 nt, Homo sapiens
cacugcccuguucaugugccuc

SEQ ID NO: 1931323 - RNA, 10 nt, Homo sapiens
uggacacugu

SEQ ID NO: 1931324 - RNA, 13 nt, Homo sapiens
cauucccaugagc

SEQ ID NO: 1931325 - RNA, 16 nt, Homo sapiens
cuaugauggguggugu

SEQ ID NO: 1931326 - RNA, 15 nt, Homo sapiens
caggaugcucaguga

SEQ ID NO: 1931327 - RNA, 22 nt, Homo sapiens
gguugguagcagggaguaccca

SEQ ID NO: 1931328 - RNA, 17 nt, Homo sapiens
cugaaccaagauguaaa

SEQ ID NO: 1931329 - RNA, 19 nt, Homo sapiens
cugcaaacucacugcucaa

SEQ ID NO: 1931330 - RNA, 15 nt, Homo sapiens
gcccuggcaccugug

SEQ ID NO: 1931331 - RNA, 17 nt, Homo sapiens
acccuuggacaagacaa

SEQ ID NO: 1931332 - RNA, 16 nt, Homo sapiens
auuuuauuucucucag

SEQ ID NO: 1931333 - RNA, 16 nt, Homo sapiens
gcagacucgggaccaa

SEQ ID NO: 1931334 - RNA, 14 nt, Homo sapiens
cagcccaggccucc

SEQ ID NO: 1931335 - RNA, 12 nt, Homo sapiens
guggccucagaa

SEQ ID NO: 1931336 - RNA, 13 nt, Homo sapiens
ugcuauauccucu

SEQ ID NO: 1931337 - RNA, 15 nt, Homo sapiens
uggugaccagaccaa

SEQ ID NO: 1931338 - RNA, 18 nt, Homo sapiens
cugcacaugucuuguaca

SEQ ID NO: 1931339 - RNA, 21 nt, Homo sapiens
ugugaaaggguacuacagcuu

SEQ ID NO: 1931340 - RNA, 23 nt, Homo sapiens
gaauucucaagaccugaguauuu

SEQ ID NO: 1931341 - RNA, 15 nt, Homo sapiens
agucucaacaugugu

SEQ ID NO: 1931342 - RNA, 19 nt, Homo sapiens
uagaacuaucauuuuuaca

SEQ ID NO: 1931343 - RNA, 22 nt, Homo sapiens
ggccaagcaggcugguuugcaa

SEQ ID NO: 1931344 - RNA, 12 nt, Homo sapiens
uuggauuccagu

SEQ ID NO: 1931345 - RNA, 23 nt, Homo sapiens
accuacacagcuguuuccucacg

SEQ ID NO: 1931346 - RNA, 16 nt, Homo sapiens
gggacuccaagcccug

SEQ ID NO: 1931347 - RNA, 21 nt, Homo sapiens
cuaguuuauuggaaguguuca

SEQ ID NO: 1931348 - RNA, 14 nt, Homo sapiens
uuuccgacuaggag

SEQ ID NO: 1931349 - RNA, 21 nt, Homo sapiens
cacugucccggagcucaggcc

SEQ ID NO: 1931350 - RNA, 18 nt, Homo sapiens
cugaacaaagagagcuca

SEQ ID NO: 1931351 - RNA, 14 nt, Homo sapiens
gaagcacauuuuca

SEQ ID NO: 1931352 - RNA, 18 nt, Homo sapiens
uauuaaucuucagcugaa

SEQ ID NO: 1931353 - RNA, 20 nt, Homo sapiens
aaggauauagcaacaucuuu

SEQ ID NO: 1931354 - RNA, 22 nt, Homo sapiens
aaauauuaggagacacagggaa

SEQ ID NO: 1931355 - RNA, 16 nt, Homo sapiens
agugagcugagaucac

SEQ ID NO: 1931356 - RNA, 16 nt, Homo sapiens
agugagccgagaucau

SEQ ID NO: 1931357 - RNA, 15 nt, Homo sapiens
aauaaugaaugucau

SEQ ID NO: 1931358 - RNA, 15 nt, Homo sapiens
cggugcuauguguuu

SEQ ID NO: 1931359 - RNA, 13 nt, Homo sapiens
ucaugauucacaa

SEQ ID NO: 1931360 - RNA, 12 nt, Homo sapiens
auauacuuugaa

SEQ ID NO: 1931361 - RNA, 17 nt, Homo sapiens
gcuggcagccucaggag

SEQ ID NO: 1931362 - RNA, 16 nt, Homo sapiens
gcaccaaccuccagac

SEQ ID NO: 1931363 - RNA, 22 nt, Homo sapiens
auauacuuauagaauucaguca

SEQ ID NO: 1931364 - RNA, 16 nt, Homo sapiens
uaaaugacucuacuaa

SEQ ID NO: 1931365 - RNA, 17 nt, Homo sapiens
ugcgaccgugaccagga

SEQ ID NO: 1931366 - RNA, 17 nt, Homo sapiens
gagcugcuuccagugga

SEQ ID NO: 1931367 - RNA, 17 nt, Homo sapiens
cuccccauggggcagca

SEQ ID NO: 1931368 - RNA, 22 nt, Homo sapiens
auaaucaacugaauugcaaaau

SEQ ID NO: 1931369 - RNA, 19 nt, Homo sapiens
gagcuugggugcauuugcc

SEQ ID NO: 1931370 - RNA, 19 nt, Homo sapiens
augagacccuggugccugg

SEQ ID NO: 1931371 - RNA, 14 nt, Homo sapiens
cugaggcaagagaa

SEQ ID NO: 1931372 - RNA, 23 nt, Homo sapiens
ugagggugggggugcucucucug

SEQ ID NO: 1931373 - RNA, 16 nt, Homo sapiens
caagucucgcuacauu

SEQ ID NO: 1931374 - RNA, 15 nt, Homo sapiens
uuauacacaguggau

SEQ ID NO: 1931375 - RNA, 17 nt, Homo sapiens
augaauggagacuucua

SEQ ID NO: 1931376 - RNA, 14 nt, Homo sapiens
acaucacauuccag

SEQ ID NO: 1931377 - RNA, 15 nt, Homo sapiens
uuuugaugacuucag

SEQ ID NO: 1931378 - RNA, 23 nt, Homo sapiens
gcacuguuugaagauugccucuu

SEQ ID NO: 1931379 - RNA, 16 nt, Homo sapiens
ccuuuccccucucaua

SEQ ID NO: 1931380 - RNA, 14 nt, Homo sapiens
uaaacuacuguaau

SEQ ID NO: 1931381 - RNA, 14 nt, Homo sapiens
uguaaaacuaaaca

SEQ ID NO: 1931382 - RNA, 23 nt, Homo sapiens
ccuggaucaggguuguucuggga

SEQ ID NO: 1931383 - RNA, 13 nt, Homo sapiens
uaguaaaucuccc

SEQ ID NO: 1931384 - RNA, 23 nt, Homo sapiens
acuucucuugccuuaaauauauc

SEQ ID NO: 1931385 - RNA, 12 nt, Homo sapiens
uucaagacuuga

SEQ ID NO: 1931386 - RNA, 14 nt, Homo sapiens
gguuuuacauuuua

SEQ ID NO: 1931387 - RNA, 22 nt, Homo sapiens
ugcaaauggcuaccguuuuaca

SEQ ID NO: 1931388 - RNA, 14 nt, Homo sapiens
gcaggcuguuuccu

SEQ ID NO: 1931389 - RNA, 17 nt, Homo sapiens
agcuacagggcugauac

SEQ ID NO: 1931390 - RNA, 16 nt, Homo sapiens
ggggauggacaccccc

SEQ ID NO: 1931391 - RNA, 19 nt, Homo sapiens
acgaugcaauucuagccaa

SEQ ID NO: 1931392 - RNA, 20 nt, Homo sapiens
ucuggauaucaagguggaaa

SEQ ID NO: 1931393 - RNA, 20 nt, Homo sapiens
ccaugugccuuucuuugccu

SEQ ID NO: 1931394 - RNA, 15 nt, Homo sapiens
cuaaccuuccaaaaa

SEQ ID NO: 1931395 - RNA, 21 nt, Homo sapiens
gaaaugccaauaacacgucca

SEQ ID NO: 1931396 - RNA, 18 nt, Homo sapiens
ugugaacccaaaguguga

SEQ ID NO: 1931397 - RNA, 22 nt, Homo sapiens
ucauagaagaaaauccauucau

SEQ ID NO: 1931398 - RNA, 20 nt, Homo sapiens
cucaccuccaugacagcgcu

SEQ ID NO: 1931399 - RNA, 16 nt, Homo sapiens
uccagaggugauggua

SEQ ID NO: 1931400 - RNA, 17 nt, Homo sapiens
ugcuggggucauauaaa

SEQ ID NO: 1931401 - RNA, 22 nt, Homo sapiens
accuugccacccauucuucccg

SEQ ID NO: 1931402 - RNA, 17 nt, Homo sapiens
ccaaaggagacauauca

SEQ ID NO: 1931403 - RNA, 17 nt, Homo sapiens
agagcaggaaugggaag

SEQ ID NO: 1931404 - RNA, 19 nt, Homo sapiens
gagacggagucuugcccuc

SEQ ID NO: 1931405 - RNA, 16 nt, Homo sapiens
cugguauguguggaug

SEQ ID NO: 1931406 - RNA, 18 nt, Homo sapiens
aaucagcaagaagauccu

SEQ ID NO: 1931407 - RNA, 14 nt, Homo sapiens
cucagcccccugac

SEQ ID NO: 1931408 - RNA, 19 nt, Homo sapiens
caaagugcagggauuacag

SEQ ID NO: 1931409 - RNA, 15 nt, Homo sapiens
gagcucccaccuccc

SEQ ID NO: 1931410 - RNA, 16 nt, Homo sapiens
ggaacucagauccagg

SEQ ID NO: 1931411 - RNA, 19 nt, Homo sapiens
uaugggagcuuaacuuuau

SEQ ID NO: 1931412 - RNA, 14 nt, Homo sapiens
acggccaacacuuu

SEQ ID NO: 1931413 - RNA, 16 nt, Homo sapiens
auccagagagaagcac

SEQ ID NO: 1931414 - RNA, 17 nt, Homo sapiens
cccugccuugcugccuu

SEQ ID NO: 1931415 - RNA, 17 nt, Homo sapiens
gcacauuuggacauuuc

SEQ ID NO: 1931416 - RNA, 20 nt, Homo sapiens
gaggagcccacgacacugca

SEQ ID NO: 1931417 - RNA, 16 nt, Homo sapiens
ugaaaugcaucagguc

SEQ ID NO: 1931418 - RNA, 21 nt, Homo sapiens
ucuuauuuauaccucaguuug

SEQ ID NO: 1931419 - RNA, 17 nt, Homo sapiens
uggaccugcaccaaagc

SEQ ID NO: 1931420 - RNA, 20 nt, Homo sapiens
gcugcaccuucacucuccag

SEQ ID NO: 1931421 - RNA, 14 nt, Homo sapiens
ucuuagaagccaug

SEQ ID NO: 1931422 - RNA, 16 nt, Homo sapiens
aaacuuauuccuccuu

SEQ ID NO: 1931423 - RNA, 21 nt, Homo sapiens
uggacccaccugaaaugcagu

SEQ ID NO: 1931424 - RNA, 14 nt, Homo sapiens
auccugaacuuucu

SEQ ID NO: 1931425 - RNA, 17 nt, Homo sapiens
caaaaguguaccuguaa

SEQ ID NO: 1931426 - RNA, 18 nt, Homo sapiens
caaaagaaaccaugacaa

SEQ ID NO: 1931427 - RNA, 22 nt, Homo sapiens
aggacaguacacacuuggguaa

SEQ ID NO: 1931428 - RNA, 15 nt, Homo sapiens
uagcuuuuguuuaca

SEQ ID NO: 1931429 - RNA, 15 nt, Homo sapiens
cucuggagcaggucu

SEQ ID NO: 1931430 - RNA, 21 nt, Homo sapiens
uucucacauagguguugucaa

SEQ ID NO: 1931431 - RNA, 18 nt, Homo sapiens
agcaacaggcucacuggu

SEQ ID NO: 1931432 - RNA, 16 nt, Homo sapiens
uacuuaauacucaugc

SEQ ID NO: 1931433 - RNA, 13 nt, Homo sapiens
cacaauucaugga

SEQ ID NO: 1931434 - RNA, 14 nt, Homo sapiens
uuuuaccuggauau

SEQ ID NO: 1931435 - RNA, 13 nt, Homo sapiens
aaaaugugacuca

SEQ ID NO: 1931436 - RNA, 12 nt, Homo sapiens
agugauucuugc

SEQ ID NO: 1931437 - RNA, 17 nt, Homo sapiens
acucauuucacagccuu

SEQ ID NO: 1931438 - RNA, 13 nt, Homo sapiens
ugaaaguugccau

SEQ ID NO: 1931439 - RNA, 16 nt, Homo sapiens
ccugggggauaccagc

SEQ ID NO: 1931440 - RNA, 18 nt, Homo sapiens
gcgcuucccaacuucaua

SEQ ID NO: 1931441 - RNA, 21 nt, Homo sapiens
cuuuauaaaacauguacaaaa

SEQ ID NO: 1931442 - RNA, 11 nt, Homo sapiens
aaaacaucaga

SEQ ID NO: 1931443 - RNA, 20 nt, Homo sapiens
acaccugcuucagagcucaa

SEQ ID NO: 1931444 - RNA, 16 nt, Homo sapiens
aauuaggguauaugaa

SEQ ID NO: 1931445 - RNA, 15 nt, Homo sapiens
aaaguuccuucugua

SEQ ID NO: 1931446 - RNA, 19 nt, Homo sapiens
uccauguagaagagggaga

SEQ ID NO: 1931447 - RNA, 23 nt, Homo sapiens
uaugugagagaaagugugagcaa

SEQ ID NO: 1931448 - RNA, 12 nt, Homo sapiens
aauaaaggucac

SEQ ID NO: 1931449 - RNA, 11 nt, Homo sapiens
aucaccagaca

SEQ ID NO: 1931450 - RNA, 15 nt, Homo sapiens
cugcucucuguggug

SEQ ID NO: 1931451 - RNA, 20 nt, Homo sapiens
gggauauuugguuuggccau

SEQ ID NO: 1931452 - RNA, 15 nt, Homo sapiens
gaaaaucuaccaaga

SEQ ID NO: 1931453 - RNA, 18 nt, Homo sapiens
caguuucuaggcaccuca

SEQ ID NO: 1931454 - RNA, 20 nt, Homo sapiens
uguucaaagugugacauuca

SEQ ID NO: 1931455 - RNA, 21 nt, Homo sapiens
ucccuucuuugcuucuuuuuc

SEQ ID NO: 1931456 - RNA, 15 nt, Homo sapiens
uuucauuguucuugg

SEQ ID NO: 1931457 - RNA, 21 nt, Homo sapiens
uuaugucuauuuaagccucau

SEQ ID NO: 1931458 - RNA, 17 nt, Homo sapiens
auguucucugaggacac

SEQ ID NO: 1931459 - RNA, 16 nt, Homo sapiens
ucucuccagugcaccu

SEQ ID NO: 1931460 - RNA, 23 nt, Homo sapiens
caaagcacagcugggcaugccau

SEQ ID NO: 1931461 - RNA, 21 nt, Homo sapiens
ccaaggaggguguaauggagc

SEQ ID NO: 1931462 - RNA, 13 nt, Homo sapiens
cagugugucacac

SEQ ID NO: 1931463 - RNA, 23 nt, Homo sapiens
uaagauuuuuuaaauugucauaa

SEQ ID NO: 1931464 - RNA, 12 nt, Homo sapiens
aaaauuccugac

SEQ ID NO: 1931465 - RNA, 17 nt, Homo sapiens
ucagagaggcaugugau

SEQ ID NO: 1931466 - RNA, 19 nt, Homo sapiens
gagcaguccuuggccugcu

SEQ ID NO: 1931467 - RNA, 13 nt, Homo sapiens
cauuuggaaugaa

SEQ ID NO: 1931468 - RNA, 15 nt, Homo sapiens
gcuguggugagggaa

SEQ ID NO: 1931469 - RNA, 16 nt, Homo sapiens
gagugaagcaaaaacu

SEQ ID NO: 1931470 - RNA, 23 nt, Homo sapiens
auugauuuggggauguuugcccc

SEQ ID NO: 1931471 - RNA, 18 nt, Homo sapiens
aaauugaaaaugaccaaa

SEQ ID NO: 1931472 - RNA, 13 nt, Homo sapiens
aaagggacacaau

SEQ ID NO: 1931473 - RNA, 13 nt, Homo sapiens
aaggugagccaga

SEQ ID NO: 1931474 - RNA, 13 nt, Homo sapiens
aaauuauaaguaa

SEQ ID NO: 1931475 - RNA, 15 nt, Homo sapiens
acauucuucacuguc

SEQ ID NO: 1931476 - RNA, 20 nt, Homo sapiens
cauagaugagaaaacugaga

SEQ ID NO: 1931477 - RNA, 23 nt, Homo sapiens
aaauuuugucuuuaacucauaaa

SEQ ID NO: 1931478 - RNA, 21 nt, Homo sapiens
acuguuaaauaaggccucauc

SEQ ID NO: 1931479 - RNA, 16 nt, Homo sapiens
ucauccacuagugcaa

SEQ ID NO: 1931480 - RNA, 14 nt, Homo sapiens
agaguugugcacau

SEQ ID NO: 1931481 - RNA, 15 nt, Homo sapiens
ugggaggaaccugaa

SEQ ID NO: 1931482 - RNA, 13 nt, Homo sapiens
accccuuucccac

SEQ ID NO: 1931483 - RNA, 14 nt, Homo sapiens
ugaacagaauuuau

SEQ ID NO: 1931484 - RNA, 16 nt, Homo sapiens
caagucggcuguggag

SEQ ID NO: 1931485 - RNA, 22 nt, Homo sapiens
cugcccacaagccauaaaccaa

SEQ ID NO: 1931486 - RNA, 18 nt, Homo sapiens
gagcacacuuaugggcca

SEQ ID NO: 1931487 - RNA, 21 nt, Homo sapiens
cugcuaggggcuguugcauuu

SEQ ID NO: 1931488 - RNA, 14 nt, Homo sapiens
accagagucuuaag

SEQ ID NO: 1931489 - RNA, 19 nt, Homo sapiens
gccacugggagggggaccc

SEQ ID NO: 1931490 - RNA, 22 nt, Homo sapiens
ccaccuggauggaucugcucca

SEQ ID NO: 1931491 - RNA, 20 nt, Homo sapiens
cagaauguagcaucugagaa

SEQ ID NO: 1931492 - RNA, 22 nt, Homo sapiens
ucuccagcaauaauguuuucua

SEQ ID NO: 1931493 - RNA, 13 nt, Homo sapiens
uuauuaaagaaau

SEQ ID NO: 1931494 - RNA, 20 nt, Homo sapiens
ucccacauaauacauuccau

SEQ ID NO: 1931495 - RNA, 15 nt, Homo sapiens
agguccugcugugga

SEQ ID NO: 1931496 - RNA, 14 nt, Homo sapiens
gauggaacacacac

SEQ ID NO: 1931497 - RNA, 17 nt, Homo sapiens
uuacuuguaauuaugaa

SEQ ID NO: 1931498 - RNA, 23 nt, Homo sapiens
ucauugcgauuuaucuugcuuca

SEQ ID NO: 1931499 - RNA, 16 nt, Homo sapiens
gccuugguuuuaccug

SEQ ID NO: 1931500 - RNA, 22 nt, Homo sapiens
gccuuggggauucuuccaucug

SEQ ID NO: 1931501 - RNA, 23 nt, Homo sapiens
cauuugaaugugugaauucaaua

SEQ ID NO: 1931502 - RNA, 14 nt, Homo sapiens
auccccagcugccu

SEQ ID NO: 1931503 - RNA, 17 nt, Homo sapiens
uacgcauggcuuccucc

SEQ ID NO: 1931504 - RNA, 13 nt, Homo sapiens
agcaacuagcugg

SEQ ID NO: 1931505 - RNA, 15 nt, Homo sapiens
uucuaaagcuaguaa

SEQ ID NO: 1931506 - RNA, 23 nt, Homo sapiens
aaggggauuuuuaugucuggggc

SEQ ID NO: 1931507 - RNA, 13 nt, Homo sapiens
cacaucuuaccuc

SEQ ID NO: 1931508 - RNA, 15 nt, Homo sapiens
acuaaugcuaagaaa

SEQ ID NO: 1931509 - RNA, 11 nt, Homo sapiens
uuucugaagag

SEQ ID NO: 1931510 - RNA, 17 nt, Homo sapiens
aauguugcccacauuaa

SEQ ID NO: 1931511 - RNA, 13 nt, Homo sapiens
aaugcaaaaaucu

SEQ ID NO: 1931512 - RNA, 19 nt, Homo sapiens
ugaaacugaaagcacauga

SEQ ID NO: 1931513 - RNA, 21 nt, Homo sapiens
gcaaucucuugucucacaugc

SEQ ID NO: 1931514 - RNA, 22 nt, Homo sapiens
aguauuguuuugguuugcuacu

SEQ ID NO: 1931515 - RNA, 14 nt, Homo sapiens
uaaaauauuaauaa

SEQ ID NO: 1931516 - RNA, 14 nt, Homo sapiens
gccacaaugccucu

SEQ ID NO: 1931517 - RNA, 14 nt, Homo sapiens
auuuaaauauuaau

SEQ ID NO: 1931518 - RNA, 18 nt, Homo sapiens
caggagcaguuugccacc

SEQ ID NO: 1931519 - RNA, 10 nt, Homo sapiens
aaagggaugg

SEQ ID NO: 1931520 - RNA, 14 nt, Homo sapiens
cuguuacacugggc

SEQ ID NO: 1931521 - RNA, 19 nt, Homo sapiens
ugcagaggccaccuggauu

SEQ ID NO: 1931522 - RNA, 21 nt, Homo sapiens
gggucaaagccgguugcagag

SEQ ID NO: 1931523 - RNA, 13 nt, Homo sapiens
cuuuggcaacaga

SEQ ID NO: 1931524 - RNA, 17 nt, Homo sapiens
gcuuaagugagcagaac

SEQ ID NO: 1931525 - RNA, 14 nt, Homo sapiens
agagcaagccagga

SEQ ID NO: 1931526 - RNA, 23 nt, Homo sapiens
uucauacugaagaugcagcaaaa

SEQ ID NO: 1931527 - RNA, 22 nt, Homo sapiens
gcacaugacauagcacuugccg

SEQ ID NO: 1931528 - RNA, 16 nt, Homo sapiens
uugccgaaccaggagc

SEQ ID NO: 1931529 - RNA, 22 nt, Homo sapiens
ugcuacuucacugucaucuuca

SEQ ID NO: 1931530 - RNA, 12 nt, Homo sapiens
agaagaucucaa

SEQ ID NO: 1931531 - RNA, 16 nt, Homo sapiens
gacaguugauuuccaa

SEQ ID NO: 1931532 - RNA, 14 nt, Homo sapiens
augaaauaauucaa

SEQ ID NO: 1931533 - RNA, 21 nt, Homo sapiens
cacugcccaaagugcuuccaa

SEQ ID NO: 1931534 - RNA, 21 nt, Homo sapiens
ugcucauuuuuucuucuccua

SEQ ID NO: 1931535 - RNA, 14 nt, Homo sapiens
acuuccagcauuua

SEQ ID NO: 1931536 - RNA, 19 nt, Homo sapiens
ucucugaguuuaucugugg

SEQ ID NO: 1931537 - RNA, 15 nt, Homo sapiens
aacaaacaaacaauu

SEQ ID NO: 1931538 - RNA, 15 nt, Homo sapiens
ccaccaacauacucc

SEQ ID NO: 1931539 - RNA, 18 nt, Homo sapiens
aucaaugacaauggugcc

SEQ ID NO: 1931540 - RNA, 17 nt, Homo sapiens
uuaauaagcuacuagca

SEQ ID NO: 1931541 - RNA, 17 nt, Homo sapiens
guccagagucuaggcaa

SEQ ID NO: 1931542 - RNA, 18 nt, Homo sapiens
gcugauacuucuacaacu

SEQ ID NO: 1931543 - RNA, 14 nt, Homo sapiens
auaauaauuagcca

SEQ ID NO: 1931544 - RNA, 18 nt, Homo sapiens
gcaacuggccauuugcca

SEQ ID NO: 1931545 - RNA, 22 nt, Homo sapiens
ugaagccuccaacccuaagcca

SEQ ID NO: 1931546 - RNA, 21 nt, Homo sapiens
cagaugcugaaaauguccuug

SEQ ID NO: 1931547 - RNA, 13 nt, Homo sapiens
cuccugcuuccuc

SEQ ID NO: 1931548 - RNA, 23 nt, Homo sapiens
ugcugacggaagccaacuuggcu

SEQ ID NO: 1931549 - RNA, 18 nt, Homo sapiens
acaaaggcuauugaccga

SEQ ID NO: 1931550 - RNA, 22 nt, Homo sapiens
gccagaguauuggucuccucuc

SEQ ID NO: 1931551 - RNA, 21 nt, Homo sapiens
caugucguaguuacucucagg

SEQ ID NO: 1931552 - RNA, 23 nt, Homo sapiens
gaagccauuuccacuacagugag

SEQ ID NO: 1931553 - RNA, 18 nt, Homo sapiens
gagccaaccucacaggau

SEQ ID NO: 1931554 - RNA, 16 nt, Homo sapiens
ccugggcuuaugcccu

SEQ ID NO: 1931555 - RNA, 16 nt, Homo sapiens
uuagccuugauauucu

SEQ ID NO: 1931556 - RNA, 19 nt, Homo sapiens
auacuaccggcuacaucaa

SEQ ID NO: 1931557 - RNA, 17 nt, Homo sapiens
uguaacagucaaauauc

SEQ ID NO: 1931558 - RNA, 14 nt, Homo sapiens
gcuguuuuagcuga

SEQ ID NO: 1931559 - RNA, 19 nt, Homo sapiens
aggcccacgguuucagcua

SEQ ID NO: 1931560 - RNA, 15 nt, Homo sapiens
ccucagccaugggaa

SEQ ID NO: 1931561 - RNA, 21 nt, Homo sapiens
uacaaaacgcgcagaugugca

SEQ ID NO: 1931562 - RNA, 17 nt, Homo sapiens
gugugacauucaguguu

SEQ ID NO: 1931563 - RNA, 19 nt, Homo sapiens
augcuaggugucugggauc

SEQ ID NO: 1931564 - RNA, 18 nt, Homo sapiens
auauuuuuuauacuugaa

SEQ ID NO: 1931565 - RNA, 12 nt, Homo sapiens
gaugaugcuccu

SEQ ID NO: 1931566 - RNA, 16 nt, Homo sapiens
gacagauugccuguuu

SEQ ID NO: 1931567 - RNA, 17 nt, Homo sapiens
aucucaauugugcuuug

SEQ ID NO: 1931568 - RNA, 14 nt, Homo sapiens
ugaaguugugcaac

SEQ ID NO: 1931569 - RNA, 14 nt, Homo sapiens
ugaugcugugcuau

SEQ ID NO: 1931570 - RNA, 19 nt, Homo sapiens
uggaauuaugucugcugaa

SEQ ID NO: 1931571 - RNA, 17 nt, Homo sapiens
cuucugcauucacagcg

SEQ ID NO: 1931572 - RNA, 15 nt, Homo sapiens
ccuuuauucuggcag

SEQ ID NO: 1931573 - RNA, 10 nt, Homo sapiens
agcaugaacu

SEQ ID NO: 1931574 - RNA, 14 nt, Homo sapiens
cacuuuuucugucu

SEQ ID NO: 1931575 - RNA, 13 nt, Homo sapiens
cgccugagugagu

SEQ ID NO: 1931576 - RNA, 14 nt, Homo sapiens
agcuagaacacugc

SEQ ID NO: 1931577 - RNA, 14 nt, Homo sapiens
cagaagaaaggagc

SEQ ID NO: 1931578 - RNA, 20 nt, Homo sapiens
auaauucaaaggcauuucuu

SEQ ID NO: 1931579 - RNA, 13 nt, Homo sapiens
agaaaacuguggu

SEQ ID NO: 1931580 - RNA, 16 nt, Homo sapiens
cugcuccaucaccugg

SEQ ID NO: 1931581 - RNA, 22 nt, Homo sapiens
acuuuuaugugucucagaauau

SEQ ID NO: 1931582 - RNA, 20 nt, Homo sapiens
accugaaaacacugugcaca

SEQ ID NO: 1931583 - RNA, 20 nt, Homo sapiens
cuuuggaaaauaguuugcaa

SEQ ID NO: 1931584 - RNA, 14 nt, Homo sapiens
ugguccugcacugu

SEQ ID NO: 1931585 - RNA, 13 nt, Homo sapiens
aaaagaccuauga

SEQ ID NO: 1931586 - RNA, 20 nt, Homo sapiens
uguaagaaaacaaacuaaau

SEQ ID NO: 1931587 - RNA, 17 nt, Homo sapiens
ucuguacuaaacauuuc

SEQ ID NO: 1931588 - RNA, 13 nt, Homo sapiens
accaauuagcauu

SEQ ID NO: 1931589 - RNA, 16 nt, Homo sapiens
ugaaguaaaacaaaca

SEQ ID NO: 1931590 - RNA, 16 nt, Homo sapiens
agauaacuuacuguau

SEQ ID NO: 1931591 - RNA, 18 nt, Homo sapiens
ugagcagaaguggagcug

SEQ ID NO: 1931592 - RNA, 15 nt, Homo sapiens
cagcucugcaagaau

SEQ ID NO: 1931593 - RNA, 17 nt, Homo sapiens
gccuuaagacauuugaa

SEQ ID NO: 1931594 - RNA, 23 nt, Homo sapiens
ccacauaccuggcccaaccagac

SEQ ID NO: 1931595 - RNA, 20 nt, Homo sapiens
cuaaacaaugcugauuuggu

SEQ ID NO: 1931596 - RNA, 20 nt, Homo sapiens
auauacuuaauaaaacauuu

SEQ ID NO: 1931597 - RNA, 13 nt, Homo sapiens
agauggugcugag

SEQ ID NO: 1931598 - RNA, 11 nt, Homo sapiens
aauacugagaa

SEQ ID NO: 1931599 - RNA, 11 nt, Homo sapiens
gauacugaaaa

SEQ ID NO: 1931600 - RNA, 14 nt, Homo sapiens
uagccugcucugcc

SEQ ID NO: 1931601 - RNA, 12 nt, Homo sapiens
auguguauauau

SEQ ID NO: 1931602 - RNA, 16 nt, Homo sapiens
auuuuuuuaacacaua

SEQ ID NO: 1931603 - RNA, 14 nt, Homo sapiens
uuacaugauucauu

SEQ ID NO: 1931604 - RNA, 20 nt, Homo sapiens
ucaacaaggaucaggcugcu

SEQ ID NO: 1931605 - RNA, 12 nt, Homo sapiens
uuguuuugugaa

SEQ ID NO: 1931606 - RNA, 17 nt, Homo sapiens
augugcuaguccaugac

SEQ ID NO: 1931607 - RNA, 22 nt, Homo sapiens
acuuugggcuuaguauuucuca

SEQ ID NO: 1931608 - RNA, 19 nt, Homo sapiens
ccaggcugcagugcaaugg

SEQ ID NO: 1931609 - RNA, 13 nt, Homo sapiens
guaacgucuguaa

SEQ ID NO: 1931610 - RNA, 21 nt, Homo sapiens
auguucuaaauaaaaagcauu

SEQ ID NO: 1931611 - RNA, 12 nt, Homo sapiens
ggugugcugcuu

SEQ ID NO: 1931612 - RNA, 19 nt, Homo sapiens
ggcuguggaguguggcagu

SEQ ID NO: 1931613 - RNA, 19 nt, Homo sapiens
ucccuuuggaacuauuuac

SEQ ID NO: 1931614 - RNA, 22 nt, Homo sapiens
ucauuacagauuuaguuuacca

SEQ ID NO: 1931615 - RNA, 16 nt, Homo sapiens
ugaaaugcuggcauuu

SEQ ID NO: 1931616 - RNA, 15 nt, Homo sapiens
cacucuggagcauuu

SEQ ID NO: 1931617 - RNA, 21 nt, Homo sapiens
gacuugaaaugcucuuuugca

SEQ ID NO: 1931618 - RNA, 19 nt, Homo sapiens
gcaaauguuuacuguauca

SEQ ID NO: 1931619 - RNA, 18 nt, Homo sapiens
ucccuugugucuguugcu

SEQ ID NO: 1931620 - RNA, 23 nt, Homo sapiens
aaggugucccugccuucacugug

SEQ ID NO: 1931621 - RNA, 13 nt, Homo sapiens
agacucugucuca

SEQ ID NO: 1931622 - RNA, 15 nt, Homo sapiens
gaagggcucuaugga

SEQ ID NO: 1931623 - RNA, 19 nt, Homo sapiens
auugcaauguucaaugcca

SEQ ID NO: 1931624 - RNA, 18 nt, Homo sapiens
cugcagcagagccuggaa

SEQ ID NO: 1931625 - RNA, 21 nt, Homo sapiens
gucccuucagcaccugacccu

SEQ ID NO: 1931626 - RNA, 23 nt, Homo sapiens
aggguaaauaaaccacugugcgu

SEQ ID NO: 1931627 - RNA, 15 nt, Homo sapiens
cuuguuuauuucuga

SEQ ID NO: 1931628 - RNA, 20 nt, Homo sapiens
uaagccugcauucuuaacaa

SEQ ID NO: 1931629 - RNA, 22 nt, Homo sapiens
gcauaaaucuguuagcauuauu

SEQ ID NO: 1931630 - RNA, 19 nt, Homo sapiens
gaaguuuucuguagucauu

SEQ ID NO: 1931631 - RNA, 18 nt, Homo sapiens
ucaaaauaaaaagugaca

SEQ ID NO: 1931632 - RNA, 18 nt, Homo sapiens
cacuaaggccgugucucu

SEQ ID NO: 1931633 - RNA, 13 nt, Homo sapiens
augcaucaauaug

SEQ ID NO: 1931634 - RNA, 13 nt, Homo sapiens
aacauuuauuuca

SEQ ID NO: 1931635 - RNA, 19 nt, Homo sapiens
uugaagcacaaccacugua

SEQ ID NO: 1931636 - RNA, 15 nt, Homo sapiens
gcccagccugcucuc

SEQ ID NO: 1931637 - RNA, 23 nt, Homo sapiens
cuuugggggauucaaaugcauga

SEQ ID NO: 1931638 - RNA, 17 nt, Homo sapiens
auuguuuucuuuuacag

SEQ ID NO: 1931639 - RNA, 21 nt, Homo sapiens
acaccgcagggacaagcccug

SEQ ID NO: 1931640 - RNA, 19 nt, Homo sapiens
aaacccauucccucuccag

SEQ ID NO: 1931641 - RNA, 13 nt, Homo sapiens
ucuugaauguuga

SEQ ID NO: 1931642 - RNA, 17 nt, Homo sapiens
guacucuaaucaguccu

SEQ ID NO: 1931643 - RNA, 16 nt, Homo sapiens
auguggucaucaaaga

SEQ ID NO: 1931644 - RNA, 12 nt, Homo sapiens
gaaacaacuugg

SEQ ID NO: 1931645 - RNA, 14 nt, Homo sapiens
aaguuuuacugucu

SEQ ID NO: 1931646 - RNA, 20 nt, Homo sapiens
agagacccgagggcugcuuu

SEQ ID NO: 1931647 - RNA, 23 nt, Homo sapiens
agguuauuuauuuaaaugucuaa

SEQ ID NO: 1931648 - RNA, 13 nt, Homo sapiens
ggccuuagcagua

SEQ ID NO: 1931649 - RNA, 14 nt, Homo sapiens
uccaaaucaaggau

SEQ ID NO: 1931650 - RNA, 14 nt, Homo sapiens
uaggaaucaccaau

SEQ ID NO: 1931651 - RNA, 19 nt, Homo sapiens
cuuacacugaggacugugg

SEQ ID NO: 1931652 - RNA, 20 nt, Homo sapiens
cuguguuucuuuugguucca

SEQ ID NO: 1931653 - RNA, 16 nt, Homo sapiens
cuuaccugggaccuca

SEQ ID NO: 1931654 - RNA, 20 nt, Homo sapiens
guauuaaagauguguuguug

SEQ ID NO: 1931655 - RNA, 21 nt, Homo sapiens
aagcuaccccucaaacugcac

SEQ ID NO: 1931656 - RNA, 15 nt, Homo sapiens
aagugagacccaaag

SEQ ID NO: 1931657 - RNA, 15 nt, Homo sapiens
augagcaaaaccaaa

SEQ ID NO: 1931658 - RNA, 14 nt, Homo sapiens
ucuucccaugcauu

SEQ ID NO: 1931659 - RNA, 19 nt, Homo sapiens
uguaguuucugcauuucaa

SEQ ID NO: 1931660 - RNA, 20 nt, Homo sapiens
ggucugugggucaguccucu

SEQ ID NO: 1931661 - RNA, 20 nt, Homo sapiens
gccaaauguuccauaugugg

SEQ ID NO: 1931662 - RNA, 19 nt, Homo sapiens
agacaucuuugggccuguc

SEQ ID NO: 1931663 - RNA, 20 nt, Homo sapiens
ugucacaauacaguaaguaa

SEQ ID NO: 1931664 - RNA, 12 nt, Homo sapiens
augcaacuuccu

SEQ ID NO: 1931665 - RNA, 22 nt, Homo sapiens
caaaauccaaaaagcucugaaa

SEQ ID NO: 1931666 - RNA, 11 nt, Homo sapiens
uaagcaaaaac

SEQ ID NO: 1931667 - RNA, 21 nt, Homo sapiens
agggggcccugccugguggca

SEQ ID NO: 1931668 - RNA, 15 nt, Homo sapiens
ucuggggucugugau

SEQ ID NO: 1931669 - RNA, 15 nt, Homo sapiens
ccuagcaauacaggg

SEQ ID NO: 1931670 - RNA, 13 nt, Homo sapiens
agaaaaacaaaua

SEQ ID NO: 1931671 - RNA, 17 nt, Homo sapiens
ugcacccauugugauug

SEQ ID NO: 1931672 - RNA, 12 nt, Homo sapiens
auaauccuucca

SEQ ID NO: 1931673 - RNA, 13 nt, Homo sapiens
ugggaggcaagaa

SEQ ID NO: 1931674 - RNA, 18 nt, Homo sapiens
uuaggcaccuuaacugga

SEQ ID NO: 1931675 - RNA, 16 nt, Homo sapiens
auaaaugucacaauaa

SEQ ID NO: 1931676 - RNA, 17 nt, Homo sapiens
gaugcccaugguccagg

SEQ ID NO: 1931677 - RNA, 16 nt, Homo sapiens
auuugcaauuccugcu

SEQ ID NO: 1931678 - RNA, 15 nt, Homo sapiens
aaagguggacuggaa

SEQ ID NO: 1931679 - RNA, 20 nt, Homo sapiens
gcugccugcuuggcccggcc

SEQ ID NO: 1931680 - RNA, 20 nt, Homo sapiens
ugcccucauuuguggcccaa

SEQ ID NO: 1931681 - RNA, 17 nt, Homo sapiens
aagaaggguaagugcuu

SEQ ID NO: 1931682 - RNA, 13 nt, Homo sapiens
cgggggccugcaa

SEQ ID NO: 1931683 - RNA, 13 nt, Homo sapiens
cccuaaucuuuuc

SEQ ID NO: 1931684 - RNA, 16 nt, Homo sapiens
gagcaagcgcuguaaa

SEQ ID NO: 1931685 - RNA, 15 nt, Homo sapiens
uccugacaccugcuu

SEQ ID NO: 1931686 - RNA, 19 nt, Homo sapiens
gggccccacucagggaucu

SEQ ID NO: 1931687 - RNA, 18 nt, Homo sapiens
uuacuguccuaacucucc

SEQ ID NO: 1931688 - RNA, 21 nt, Homo sapiens
uucccuaaguccaacuacuaa

SEQ ID NO: 1931689 - RNA, 21 nt, Homo sapiens
gauucuauaaaacacaucauc

SEQ ID NO: 1931690 - RNA, 18 nt, Homo sapiens
ccugggcugugaugugaa

SEQ ID NO: 1931691 - RNA, 17 nt, Homo sapiens
aaugaugcaggugcaaa

SEQ ID NO: 1931692 - RNA, 23 nt, Homo sapiens
cuaagugauccucccaccucagc

SEQ ID NO: 1931693 - RNA, 13 nt, Homo sapiens
gugcgcucacagu

SEQ ID NO: 1931694 - RNA, 17 nt, Homo sapiens
ugaauauuagcauugcc

SEQ ID NO: 1931695 - RNA, 19 nt, Homo sapiens
gaguaccuuaaucugccau

SEQ ID NO: 1931696 - RNA, 17 nt, Homo sapiens
cacaaccuccuccucca

SEQ ID NO: 1931697 - RNA, 14 nt, Homo sapiens
uguugcugcaucuc

SEQ ID NO: 1931698 - RNA, 13 nt, Homo sapiens
cuuccucacaugg

SEQ ID NO: 1931699 - RNA, 20 nt, Homo sapiens
uguuaauaaaaguacauguu

SEQ ID NO: 1931700 - RNA, 21 nt, Homo sapiens
ucaaauuuguaaaguuagccu

SEQ ID NO: 1931701 - RNA, 19 nt, Homo sapiens
agacauacuccuuccauca

SEQ ID NO: 1931702 - RNA, 17 nt, Homo sapiens
aagucuuuguugcacca

SEQ ID NO: 1931703 - RNA, 14 nt, Homo sapiens
ccucacuuuacaca

SEQ ID NO: 1931704 - RNA, 15 nt, Homo sapiens
gaaucuucuguucca

SEQ ID NO: 1931705 - RNA, 17 nt, Homo sapiens
uaauuacauuaaaaugg

SEQ ID NO: 1931706 - RNA, 22 nt, Homo sapiens
augaugucuaccucagaauuaa

SEQ ID NO: 1931707 - RNA, 21 nt, Homo sapiens
uuacugaagaaaucuuuccag

SEQ ID NO: 1931708 - RNA, 14 nt, Homo sapiens
guuugugaaacaaa

SEQ ID NO: 1931709 - RNA, 20 nt, Homo sapiens
ccugcagccccuaagugcaa

SEQ ID NO: 1931710 - RNA, 21 nt, Homo sapiens
cacucuccaaacagucaccau

SEQ ID NO: 1931711 - RNA, 20 nt, Homo sapiens
caucuccccucagauuccac

SEQ ID NO: 1931712 - RNA, 14 nt, Homo sapiens
ccaaauugaacuca

SEQ ID NO: 1931713 - RNA, 22 nt, Homo sapiens
uaggucaagcuauuucucugga

SEQ ID NO: 1931714 - RNA, 18 nt, Homo sapiens
agaauuuaauguacagua

SEQ ID NO: 1931715 - RNA, 19 nt, Homo sapiens
cauccacacacagcagcuc

SEQ ID NO: 1931716 - RNA, 16 nt, Homo sapiens
uuguuuauuguaaaac

SEQ ID NO: 1931717 - RNA, 17 nt, Homo sapiens
ucacuauggucaaaaag

SEQ ID NO: 1931718 - RNA, 16 nt, Homo sapiens
ccaggcccaugccaag

SEQ ID NO: 1931719 - RNA, 15 nt, Homo sapiens
agagcaugcacaugc

SEQ ID NO: 1931720 - RNA, 17 nt, Homo sapiens
agggagucauugccuug

SEQ ID NO: 1931721 - RNA, 13 nt, Homo sapiens
agauucccucucc

SEQ ID NO: 1931722 - RNA, 13 nt, Homo sapiens
augauuucagaaa

SEQ ID NO: 1931723 - RNA, 13 nt, Homo sapiens
auacuuucaggca

SEQ ID NO: 1931724 - RNA, 17 nt, Homo sapiens
uuaagagaaaugagcuu

SEQ ID NO: 1931725 - RNA, 16 nt, Homo sapiens
aagaagcuucaugcca

SEQ ID NO: 1931726 - RNA, 20 nt, Homo sapiens
ucaaagccucaaaaccugau

SEQ ID NO: 1931727 - RNA, 20 nt, Homo sapiens
cuauuaccaccaccugcuca

SEQ ID NO: 1931728 - RNA, 16 nt, Homo sapiens
uggaacuuagccauuu

SEQ ID NO: 1931729 - RNA, 16 nt, Homo sapiens
ucagcuccuugaccua

SEQ ID NO: 1931730 - RNA, 17 nt, Homo sapiens
cuaucuccaaaugagac

SEQ ID NO: 1931731 - RNA, 14 nt, Homo sapiens
ggauuuuaguuuaa

SEQ ID NO: 1931732 - RNA, 14 nt, Homo sapiens
cugugcccucagau

SEQ ID NO: 1931733 - RNA, 17 nt, Homo sapiens
cuccuaaugcucugaaa

SEQ ID NO: 1931734 - RNA, 16 nt, Homo sapiens
cugccagaugcugaug

SEQ ID NO: 1931735 - RNA, 23 nt, Homo sapiens
gccauuacuacuguacacggacc

SEQ ID NO: 1931736 - RNA, 17 nt, Homo sapiens
guugccaugugugcuga

SEQ ID NO: 1931737 - RNA, 13 nt, Homo sapiens
ugucauacagaga

SEQ ID NO: 1931738 - RNA, 19 nt, Homo sapiens
ccucagccccagcccagac

SEQ ID NO: 1931739 - RNA, 18 nt, Homo sapiens
cuucgucugguuccucaa

SEQ ID NO: 1931740 - RNA, 19 nt, Homo sapiens
caguccgccgcugcacauc

SEQ ID NO: 1931741 - RNA, 12 nt, Homo sapiens
ggaagccaaagg

SEQ ID NO: 1931742 - RNA, 17 nt, Homo sapiens
auuuuauaccagcuuau

SEQ ID NO: 1931743 - RNA, 22 nt, Homo sapiens
aaaagugucaccuuuucuugcc

SEQ ID NO: 1931744 - RNA, 22 nt, Homo sapiens
caugaauuucuccuuuccuaca

SEQ ID NO: 1931745 - RNA, 16 nt, Homo sapiens
cucuccaucagcuccu

SEQ ID NO: 1931746 - RNA, 13 nt, Homo sapiens
ccacaucuucuca

SEQ ID NO: 1931747 - RNA, 14 nt, Homo sapiens
aucucccaugugca

SEQ ID NO: 1931748 - RNA, 22 nt, Homo sapiens
caaggccggagacccacagccc

SEQ ID NO: 1931749 - RNA, 13 nt, Homo sapiens
ucaagcucaaggc

SEQ ID NO: 1931750 - RNA, 13 nt, Homo sapiens
cauuaacuugaaa

SEQ ID NO: 1931751 - RNA, 18 nt, Homo sapiens
acuaagaucuguuaaaaa

SEQ ID NO: 1931752 - RNA, 16 nt, Homo sapiens
gcaccauacucaugca

SEQ ID NO: 1931753 - RNA, 19 nt, Homo sapiens
uguaaauuuaucaaugaug

SEQ ID NO: 1931754 - RNA, 17 nt, Homo sapiens
agaacacguuggcucag

SEQ ID NO: 1931755 - RNA, 15 nt, Homo sapiens
cuuggcguuccugcc

SEQ ID NO: 1931756 - RNA, 16 nt, Homo sapiens
cagauuagacacuaug

SEQ ID NO: 1931757 - RNA, 14 nt, Homo sapiens
ugaggcugugagca

SEQ ID NO: 1931758 - RNA, 16 nt, Homo sapiens
cacacuccaagauaug

SEQ ID NO: 1931759 - RNA, 15 nt, Homo sapiens
acuuccucugccaug

SEQ ID NO: 1931760 - RNA, 21 nt, Homo sapiens
ugaaaugcacuguauugcucc

SEQ ID NO: 1931761 - RNA, 20 nt, Homo sapiens
ugggaauugcgcucaggggc

SEQ ID NO: 1931762 - RNA, 20 nt, Homo sapiens
gagacuucacgggcaaucau

SEQ ID NO: 1931763 - RNA, 21 nt, Homo sapiens
caaauacuuagacaguaugca

SEQ ID NO: 1931764 - RNA, 21 nt, Homo sapiens
uacuuuuucuggucucuacca

SEQ ID NO: 1931765 - RNA, 17 nt, Homo sapiens
auacuuguugcugucac

SEQ ID NO: 1931766 - RNA, 20 nt, Homo sapiens
ugaauaaaauauugauuuca

SEQ ID NO: 1931767 - RNA, 14 nt, Homo sapiens
accuagaagaagcu

SEQ ID NO: 1931768 - RNA, 20 nt, Homo sapiens
cucacuccuaggagagccaa

SEQ ID NO: 1931769 - RNA, 13 nt, Homo sapiens
ucucuaaacuguu

SEQ ID NO: 1931770 - RNA, 23 nt, Homo sapiens
cagaagaaagaaauaaaccucau

SEQ ID NO: 1931771 - RNA, 19 nt, Homo sapiens
ucaccuccaagcauuucau

SEQ ID NO: 1931772 - RNA, 16 nt, Homo sapiens
caguagagugauagga

SEQ ID NO: 1931773 - RNA, 14 nt, Homo sapiens
ccccaucugagcug

SEQ ID NO: 1931774 - RNA, 18 nt, Homo sapiens
gacaaauauucugaauca

SEQ ID NO: 1931775 - RNA, 19 nt, Homo sapiens
auuaucuugauacauucaa

SEQ ID NO: 1931776 - RNA, 13 nt, Homo sapiens
acaaggugccugu

SEQ ID NO: 1931777 - RNA, 23 nt, Homo sapiens
cucaaccuugacuucugcccaaa

SEQ ID NO: 1931778 - RNA, 15 nt, Homo sapiens
ggcagugagugccau

SEQ ID NO: 1931779 - RNA, 23 nt, Homo sapiens
acugccugcagcugagauuccag

SEQ ID NO: 1931780 - RNA, 20 nt, Homo sapiens
aagacuucacugcagccuuu

SEQ ID NO: 1931781 - RNA, 21 nt, Homo sapiens
cacagauggaaucuuguuuaa

SEQ ID NO: 1931782 - RNA, 18 nt, Homo sapiens
auguugacaucacuggca

SEQ ID NO: 1931783 - RNA, 19 nt, Homo sapiens
ccccaagaccaucccugaa

SEQ ID NO: 1931784 - RNA, 14 nt, Homo sapiens
acuaaaaaugcauc

SEQ ID NO: 1931785 - RNA, 16 nt, Homo sapiens
uagguagcacagcacu

SEQ ID NO: 1931786 - RNA, 12 nt, Homo sapiens
cuuuuaagccag

SEQ ID NO: 1931787 - RNA, 12 nt, Homo sapiens
cuuguaagccau

SEQ ID NO: 1931788 - RNA, 21 nt, Homo sapiens
uuaaucuuaguguaugauuac

SEQ ID NO: 1931789 - RNA, 17 nt, Homo sapiens
guuguacuaacauauua

SEQ ID NO: 1931790 - RNA, 14 nt, Homo sapiens
uuugggauuugccg

SEQ ID NO: 1931791 - RNA, 15 nt, Homo sapiens
ugaagaugcucugug

SEQ ID NO: 1931792 - RNA, 23 nt, Homo sapiens
augggcucgcccaccagugacuu

SEQ ID NO: 1931793 - RNA, 17 nt, Homo sapiens
gguuuaauucagcagag

SEQ ID NO: 1931794 - RNA, 18 nt, Homo sapiens
aggacucggccacugugu

SEQ ID NO: 1931795 - RNA, 16 nt, Homo sapiens
uauacucuaaaaugga

SEQ ID NO: 1931796 - RNA, 21 nt, Homo sapiens
ccccaggggcugucccggagg

SEQ ID NO: 1931797 - RNA, 20 nt, Homo sapiens
ugguuuuuacucaaccaaau

SEQ ID NO: 1931798 - RNA, 18 nt, Homo sapiens
aggucccugcuuaccuga

SEQ ID NO: 1931799 - RNA, 16 nt, Homo sapiens
auuguuauagacagcu

SEQ ID NO: 1931800 - RNA, 21 nt, Homo sapiens
caguacuugugaaacacagcu

SEQ ID NO: 1931801 - RNA, 20 nt, Homo sapiens
cucucauggucaugggucug

SEQ ID NO: 1931802 - RNA, 16 nt, Homo sapiens
uaaacgguuccuggug

SEQ ID NO: 1931803 - RNA, 18 nt, Homo sapiens
uaguuggcaggagcuccu

SEQ ID NO: 1931804 - RNA, 17 nt, Homo sapiens
ccagaugaucccaguca

SEQ ID NO: 1931805 - RNA, 22 nt, Homo sapiens
auaacgguuaagaaagcacuua

SEQ ID NO: 1931806 - RNA, 14 nt, Homo sapiens
aauugccuguaaca

SEQ ID NO: 1931807 - RNA, 19 nt, Homo sapiens
acgauugaccuguccucuu

SEQ ID NO: 1931808 - RNA, 22 nt, Homo sapiens
ucggggaggagguugugucacu

SEQ ID NO: 1931809 - RNA, 21 nt, Homo sapiens
gaaugcauuauuuauugcugu

SEQ ID NO: 1931810 - RNA, 18 nt, Homo sapiens
cuguguuuuaaaaggcaa

SEQ ID NO: 1931811 - RNA, 17 nt, Homo sapiens
cacuguaguucuaagac

SEQ ID NO: 1931812 - RNA, 19 nt, Homo sapiens
gccuguaaucccagcuacu

SEQ ID NO: 1931813 - RNA, 14 nt, Homo sapiens
acuguaagcuuuua

SEQ ID NO: 1931814 - RNA, 19 nt, Homo sapiens
guccccagaccaguaguga

SEQ ID NO: 1931815 - RNA, 14 nt, Homo sapiens
aguuugcauuccag

SEQ ID NO: 1931816 - RNA, 23 nt, Homo sapiens
auacgggggcugugacucugggc

SEQ ID NO: 1931817 - RNA, 14 nt, Homo sapiens
cagauagcugccac

SEQ ID NO: 1931818 - RNA, 15 nt, Homo sapiens
uaacagaccacugua

SEQ ID NO: 1931819 - RNA, 15 nt, Homo sapiens
cacccuuagccacuu

SEQ ID NO: 1931820 - RNA, 15 nt, Homo sapiens
caaaaaaagcacaaa

SEQ ID NO: 1931821 - RNA, 18 nt, Homo sapiens
caagaaucagucuaucca

SEQ ID NO: 1931822 - RNA, 14 nt, Homo sapiens
gaguucuuugcaag

SEQ ID NO: 1931823 - RNA, 12 nt, Homo sapiens
uuuggcuaaaau

SEQ ID NO: 1931824 - RNA, 23 nt, Homo sapiens
uugaccgcaacucacacauuccc

SEQ ID NO: 1931825 - RNA, 21 nt, Homo sapiens
agaaucacuugacuuugccac

SEQ ID NO: 1931826 - RNA, 17 nt, Homo sapiens
gucauuugacugucuca

SEQ ID NO: 1931827 - RNA, 20 nt, Homo sapiens
uggcaucagugucuuuccac

SEQ ID NO: 1931828 - RNA, 15 nt, Homo sapiens
uuugaugugccuuaa

SEQ ID NO: 1931829 - RNA, 18 nt, Homo sapiens
uuacagcuuucugugcag

SEQ ID NO: 1931830 - RNA, 14 nt, Homo sapiens
ggagguucucccag

SEQ ID NO: 1931831 - RNA, 17 nt, Homo sapiens
ucuuugggauaaccuuu

SEQ ID NO: 1931832 - RNA, 22 nt, Homo sapiens
cagugaugucaaauugacugua

SEQ ID NO: 1931833 - RNA, 19 nt, Homo sapiens
cugccacacugauggcuca

SEQ ID NO: 1931834 - RNA, 14 nt, Homo sapiens
ggaggggucugccu

SEQ ID NO: 1931835 - RNA, 16 nt, Homo sapiens
cugcgacgcaggugua

SEQ ID NO: 1931836 - RNA, 13 nt, Homo sapiens
gacaacuucccaa

SEQ ID NO: 1931837 - RNA, 12 nt, Homo sapiens
gaauuaugauaa

SEQ ID NO: 1931838 - RNA, 22 nt, Homo sapiens
aaacauaaaaaccaaacccaga

SEQ ID NO: 1931839 - RNA, 20 nt, Homo sapiens
uucccauuguggcuccuauc

SEQ ID NO: 1931840 - RNA, 15 nt, Homo sapiens
auuaauaaagcauuc

SEQ ID NO: 1931841 - RNA, 19 nt, Homo sapiens
acuuuauaaauucauaacu

SEQ ID NO: 1931842 - RNA, 16 nt, Homo sapiens
uggcucuugccuguaa

SEQ ID NO: 1931843 - RNA, 15 nt, Homo sapiens
uuacagaaaauaugg

SEQ ID NO: 1931844 - RNA, 14 nt, Homo sapiens
acagcuuucacagu

SEQ ID NO: 1931845 - RNA, 18 nt, Homo sapiens
ccaugugccacacaccuu

SEQ ID NO: 1931846 - RNA, 19 nt, Homo sapiens
ucccaguaguuauaaaguc

SEQ ID NO: 1931847 - RNA, 18 nt, Homo sapiens
cugacacagugcucgacc

SEQ ID NO: 1931848 - RNA, 15 nt, Homo sapiens
aagccccacuugaag

SEQ ID NO: 1931849 - RNA, 19 nt, Homo sapiens
accaagucaggccaggugg

SEQ ID NO: 1931850 - RNA, 15 nt, Homo sapiens
aauaagcaucugugu

SEQ ID NO: 1931851 - RNA, 15 nt, Homo sapiens
uggacuuccauuugg

SEQ ID NO: 1931852 - RNA, 16 nt, Homo sapiens
acuugccacacacugu

SEQ ID NO: 1931853 - RNA, 13 nt, Homo sapiens
acccuucugggca

SEQ ID NO: 1931854 - RNA, 19 nt, Homo sapiens
guaccuuaauuugacuguc

SEQ ID NO: 1931855 - RNA, 15 nt, Homo sapiens
auucccagcuuccag

SEQ ID NO: 1931856 - RNA, 17 nt, Homo sapiens
auacaguguacauguac

SEQ ID NO: 1931857 - RNA, 19 nt, Homo sapiens
ugcaagagcccagaucacc

SEQ ID NO: 1931858 - RNA, 17 nt, Homo sapiens
auguuugcuauugacaa

SEQ ID NO: 1931859 - RNA, 14 nt, Homo sapiens
aauaguauuuauga

SEQ ID NO: 1931860 - RNA, 15 nt, Homo sapiens
aaguagugugcaguu

SEQ ID NO: 1931861 - RNA, 17 nt, Homo sapiens
agucuacacugccuuug

SEQ ID NO: 1931862 - RNA, 14 nt, Homo sapiens
uuuguacugauaua

SEQ ID NO: 1931863 - RNA, 20 nt, Homo sapiens
cauggcuuguagcccuuucc

SEQ ID NO: 1931864 - RNA, 12 nt, Homo sapiens
acucaaccaaau

SEQ ID NO: 1931865 - RNA, 23 nt, Homo sapiens
ugguuacugaggaccaaagauac

SEQ ID NO: 1931866 - RNA, 17 nt, Homo sapiens
uccuucacacaguucaa

SEQ ID NO: 1931867 - RNA, 18 nt, Homo sapiens
ucuauguguaugcaagua

SEQ ID NO: 1931868 - RNA, 17 nt, Homo sapiens
ccauguggguguggcag

SEQ ID NO: 1931869 - RNA, 13 nt, Homo sapiens
uuuuagauuccua

SEQ ID NO: 1931870 - RNA, 18 nt, Homo sapiens
uuguuucuuaauuuggaa

SEQ ID NO: 1931871 - RNA, 14 nt, Homo sapiens
uccaggauguggaa

SEQ ID NO: 1931872 - RNA, 20 nt, Homo sapiens
ccaccucggcacacacugug

SEQ ID NO: 1931873 - RNA, 16 nt, Homo sapiens
gcuuaauugacugaaa

SEQ ID NO: 1931874 - RNA, 20 nt, Homo sapiens
ucagagggcccaguggugcc

SEQ ID NO: 1931875 - RNA, 20 nt, Homo sapiens
caacuagggagugagugcaa

SEQ ID NO: 1931876 - RNA, 23 nt, Homo sapiens
uaagggagggggcgcuggagcuu

SEQ ID NO: 1931877 - RNA, 11 nt, Homo sapiens
uaauucauuaa

SEQ ID NO: 1931878 - RNA, 19 nt, Homo sapiens
cuagaaccuggagggcuag

SEQ ID NO: 1931879 - RNA, 16 nt, Homo sapiens
cuugguuuugccucuu

SEQ ID NO: 1931880 - RNA, 18 nt, Homo sapiens
ugaagaucucacucugcc

SEQ ID NO: 1931881 - RNA, 23 nt, Homo sapiens
uaacgacccacucugcuucuugc

SEQ ID NO: 1931882 - RNA, 23 nt, Homo sapiens
uguaguuccacuuauagccucug

SEQ ID NO: 1931883 - RNA, 19 nt, Homo sapiens
ugagaccucaaaucacugc

SEQ ID NO: 1931884 - RNA, 14 nt, Homo sapiens
ccuggaacaucuca

SEQ ID NO: 1931885 - RNA, 14 nt, Homo sapiens
auaacaucuaugaa

SEQ ID NO: 1931886 - RNA, 19 nt, Homo sapiens
uaaguaugcaaaauguuua

SEQ ID NO: 1931887 - RNA, 19 nt, Homo sapiens
agcagucucugccuugccu

SEQ ID NO: 1931888 - RNA, 13 nt, Homo sapiens
caaaauucucauu

SEQ ID NO: 1931889 - RNA, 22 nt, Homo sapiens
ggcuaaggccucuugcuggugc

SEQ ID NO: 1931890 - RNA, 21 nt, Homo sapiens
aucagaagcacuagugcugcc

SEQ ID NO: 1931891 - RNA, 14 nt, Homo sapiens
ccaaacaguaugau

SEQ ID NO: 1931892 - RNA, 20 nt, Homo sapiens
cauguuuguuucuguagaaa

SEQ ID NO: 1931893 - RNA, 13 nt, Homo sapiens
gucacauuccauu

SEQ ID NO: 1931894 - RNA, 20 nt, Homo sapiens
guuaucugucugcauuuuaa

SEQ ID NO: 1931895 - RNA, 14 nt, Homo sapiens
uucuucaugaucca

SEQ ID NO: 1931896 - RNA, 22 nt, Homo sapiens
ucugccuggagugcugugcugu

SEQ ID NO: 1931897 - RNA, 14 nt, Homo sapiens
agcgacuucagguc

SEQ ID NO: 1931898 - RNA, 17 nt, Homo sapiens
acugucaaguacaagca

SEQ ID NO: 1931899 - RNA, 15 nt, Homo sapiens
augacauagcacuug

SEQ ID NO: 1931900 - RNA, 16 nt, Homo sapiens
gcuaauuuuugcaaau

SEQ ID NO: 1931901 - RNA, 18 nt, Homo sapiens
cgguuuggauaaucuuaa

SEQ ID NO: 1931902 - RNA, 22 nt, Homo sapiens
aggaacccugaucucucagccc

SEQ ID NO: 1931903 - RNA, 14 nt, Homo sapiens
aauuuguguucuca

SEQ ID NO: 1931904 - RNA, 15 nt, Homo sapiens
gacacguucuugcca

SEQ ID NO: 1931905 - RNA, 22 nt, Homo sapiens
agaaaaucuuuccucuucucau

SEQ ID NO: 1931906 - RNA, 17 nt, Homo sapiens
aauugagcagcaugauu

SEQ ID NO: 1931907 - RNA, 13 nt, Homo sapiens
acuggaacauucc

SEQ ID NO: 1931908 - RNA, 23 nt, Homo sapiens
aaauucagaacagccugccuguc

SEQ ID NO: 1931909 - RNA, 13 nt, Homo sapiens
ggcacugucucug

SEQ ID NO: 1931910 - RNA, 14 nt, Homo sapiens
caagagacucuccu

SEQ ID NO: 1931911 - RNA, 19 nt, Homo sapiens
ccccuggaucuaccagcau

SEQ ID NO: 1931912 - RNA, 18 nt, Homo sapiens
agcugaaaaagauggaau

SEQ ID NO: 1931913 - RNA, 16 nt, Homo sapiens
gagggccauugaacuc

SEQ ID NO: 1931914 - RNA, 18 nt, Homo sapiens
ccaggcuggagugcagug

SEQ ID NO: 1931915 - RNA, 18 nt, Homo sapiens
ccaggcuagagugcaaug

SEQ ID NO: 1931916 - RNA, 12 nt, Homo sapiens
caagauugcacc

SEQ ID NO: 1931917 - RNA, 20 nt, Homo sapiens
gguagccagcacacagggca

SEQ ID NO: 1931918 - RNA, 20 nt, Homo sapiens
cccaggcuggacugcaauga

SEQ ID NO: 1931919 - RNA, 16 nt, Homo sapiens
uccuaccucuggugau

SEQ ID NO: 1931920 - RNA, 18 nt, Homo sapiens
uauuucagaacuuugaga

SEQ ID NO: 1931921 - RNA, 15 nt, Homo sapiens
uuuugaauaugccaa

SEQ ID NO: 1931922 - RNA, 11 nt, Homo sapiens
cuucaccugcg

SEQ ID NO: 1931923 - RNA, 17 nt, Homo sapiens
acaccguggugagcaua

SEQ ID NO: 1931924 - RNA, 17 nt, Homo sapiens
cucuuuuauacuguacu

SEQ ID NO: 1931925 - RNA, 23 nt, Homo sapiens
ggacaggggcgugggauugaauu

SEQ ID NO: 1931926 - RNA, 15 nt, Homo sapiens
cggccacagggcggu

SEQ ID NO: 1931927 - RNA, 19 nt, Homo sapiens
cacucuuguugugcucuuu

SEQ ID NO: 1931928 - RNA, 19 nt, Homo sapiens
cucucaacaggacuuaaca

SEQ ID NO: 1931929 - RNA, 18 nt, Homo sapiens
agaguggccccggcugca

SEQ ID NO: 1931930 - RNA, 15 nt, Homo sapiens
gagcaaaaugcugcu

SEQ ID NO: 1931931 - RNA, 22 nt, Homo sapiens
ucuugcucacagggacucucca

SEQ ID NO: 1931932 - RNA, 19 nt, Homo sapiens
gagagcgcuuuugucugca

SEQ ID NO: 1931933 - RNA, 16 nt, Homo sapiens
agaccauuugauuuuc

SEQ ID NO: 1931934 - RNA, 22 nt, Homo sapiens
aaaccuggaaucuacaagccaa

SEQ ID NO: 1931935 - RNA, 22 nt, Homo sapiens
gacauacauggaauagcaccug

SEQ ID NO: 1931936 - RNA, 19 nt, Homo sapiens
acaugcccagaccuucuca

SEQ ID NO: 1931937 - RNA, 21 nt, Homo sapiens
ggucaggcccuggugcgaaug

SEQ ID NO: 1931938 - RNA, 22 nt, Homo sapiens
gcaccuuuggaaacaacauuua

SEQ ID NO: 1931939 - RNA, 14 nt, Homo sapiens
aaugugcuguguga

SEQ ID NO: 1931940 - RNA, 14 nt, Homo sapiens
acugaaaacuguaa

SEQ ID NO: 1931941 - RNA, 16 nt, Homo sapiens
aaggaggcucuucuca

SEQ ID NO: 1931942 - RNA, 21 nt, Homo sapiens
auacucaagagcauaauggua

SEQ ID NO: 1931943 - RNA, 19 nt, Homo sapiens
uguacauaggcagcacuag

SEQ ID NO: 1931944 - RNA, 15 nt, Homo sapiens
cagaacuuccaaaga

SEQ ID NO: 1931945 - RNA, 16 nt, Homo sapiens
uauaaucuaauacuua

SEQ ID NO: 1931946 - RNA, 17 nt, Homo sapiens
caaggguuggaggcaau

SEQ ID NO: 1931947 - RNA, 20 nt, Homo sapiens
uaccugcuggaagaauucua

SEQ ID NO: 1931948 - RNA, 14 nt, Homo sapiens
ggcagcucaucucu

SEQ ID NO: 1931949 - RNA, 18 nt, Homo sapiens
gaaggauuuucugaccuu

SEQ ID NO: 1931950 - RNA, 19 nt, Homo sapiens
auaauuuuacaugucucau

SEQ ID NO: 1931951 - RNA, 16 nt, Homo sapiens
uaggcagacacaggga

SEQ ID NO: 1931952 - RNA, 19 nt, Homo sapiens
cuuauagaggaacuugaaa

SEQ ID NO: 1931953 - RNA, 20 nt, Homo sapiens
uggcucccaagccacauuca

SEQ ID NO: 1931954 - RNA, 23 nt, Homo sapiens
ugugccaccaagcauuccugcuc

SEQ ID NO: 1931955 - RNA, 13 nt, Homo sapiens
aaagaacuuuagc

SEQ ID NO: 1931956 - RNA, 21 nt, Homo sapiens
uucaaaccaguauacaagaua

SEQ ID NO: 1931957 - RNA, 15 nt, Homo sapiens
gcuucggacaaaaua

SEQ ID NO: 1931958 - RNA, 18 nt, Homo sapiens
caaacucauccucuuuua

SEQ ID NO: 1931959 - RNA, 14 nt, Homo sapiens
guaauuucugcaca

SEQ ID NO: 1931960 - RNA, 17 nt, Homo sapiens
caaaaucugcacaguca

SEQ ID NO: 1931961 - RNA, 13 nt, Homo sapiens
aaugaaaccaaag

SEQ ID NO: 1931962 - RNA, 14 nt, Homo sapiens
guaugacuaaagag

SEQ ID NO: 1931963 - RNA, 21 nt, Homo sapiens
aaacuauguucagaacuucau

SEQ ID NO: 1931964 - RNA, 23 nt, Homo sapiens
aauauauauuauauauaaucuaa

SEQ ID NO: 1931965 - RNA, 13 nt, Homo sapiens
uuucccuuuggca

SEQ ID NO: 1931966 - RNA, 14 nt, Homo sapiens
gccacaagcacaau

SEQ ID NO: 1931967 - RNA, 22 nt, Homo sapiens
cucugagcccccugaccuucca

SEQ ID NO: 1931968 - RNA, 13 nt, Homo sapiens
uuuggauuccuca

SEQ ID NO: 1931969 - RNA, 19 nt, Homo sapiens
cagggugcggccugagaua

SEQ ID NO: 1931970 - RNA, 19 nt, Homo sapiens
acugcgccaucaacuccag

SEQ ID NO: 1931971 - RNA, 21 nt, Homo sapiens
ccaggucucccgggaagccac

SEQ ID NO: 1931972 - RNA, 19 nt, Homo sapiens
ccaucagcuaaacaccacg

SEQ ID NO: 1931973 - RNA, 21 nt, Homo sapiens
uucauaugacauucaugccug

SEQ ID NO: 1931974 - RNA, 15 nt, Homo sapiens
cuugcaagggaccau

SEQ ID NO: 1931975 - RNA, 18 nt, Homo sapiens
auuuuaaagacucaaggu

SEQ ID NO: 1931976 - RNA, 22 nt, Homo sapiens
gcccuuacaguauuguuaccac

SEQ ID NO: 1931977 - RNA, 17 nt, Homo sapiens
ccuccaccuccuaggcu

SEQ ID NO: 1931978 - RNA, 15 nt, Homo sapiens
guggaugaagcagag

SEQ ID NO: 1931979 - RNA, 19 nt, Homo sapiens
augggagacuccaucucaa

SEQ ID NO: 1931980 - RNA, 22 nt, Homo sapiens
ggauaauguccaacuaaaaaca

SEQ ID NO: 1931981 - RNA, 20 nt, Homo sapiens
caugauguaaaaaauacaaa

SEQ ID NO: 1931982 - RNA, 19 nt, Homo sapiens
agacacacuggaugugauu

SEQ ID NO: 1931983 - RNA, 18 nt, Homo sapiens
cuuucuaagagaccugaa

SEQ ID NO: 1931984 - RNA, 18 nt, Homo sapiens
ugauggauuaacauauag

SEQ ID NO: 1931985 - RNA, 17 nt, Homo sapiens
aguuugcaaugucacaa

SEQ ID NO: 1931986 - RNA, 17 nt, Homo sapiens
aagugcauuuuuaucug

SEQ ID NO: 1931987 - RNA, 18 nt, Homo sapiens
auuaauaucaacucugaa

SEQ ID NO: 1931988 - RNA, 19 nt, Homo sapiens
cuuggcuagucacauauca

SEQ ID NO: 1931989 - RNA, 19 nt, Homo sapiens
uggaugaagcucuggccaa

SEQ ID NO: 1931990 - RNA, 22 nt, Homo sapiens
cugucuccucucuguuacucag

SEQ ID NO: 1931991 - RNA, 23 nt, Homo sapiens
cacaucccuggaaggacauccau

SEQ ID NO: 1931992 - RNA, 20 nt, Homo sapiens
ucaaaguugccuaaauccau

SEQ ID NO: 1931993 - RNA, 22 nt, Homo sapiens
ugaacccgaggcugagaaucag

SEQ ID NO: 1931994 - RNA, 18 nt, Homo sapiens
auguuagaaauaagacaa

SEQ ID NO: 1931995 - RNA, 13 nt, Homo sapiens
agaaaugcaaaac

SEQ ID NO: 1931996 - RNA, 14 nt, Homo sapiens
aaugccccaaggac

SEQ ID NO: 1931997 - RNA, 15 nt, Homo sapiens
ugauauacuaugacu

SEQ ID NO: 1931998 - RNA, 16 nt, Homo sapiens
cagauguuuccaagau

SEQ ID NO: 1931999 - RNA, 13 nt, Homo sapiens
aaggaauuccucu

SEQ ID NO: 1932000 - RNA, 15 nt, Homo sapiens
cugaaauacauauga

SEQ ID NO: 1932001 - RNA, 17 nt, Homo sapiens
guaauuuaaugcugcua

SEQ ID NO: 1932002 - RNA, 20 nt, Homo sapiens
ugcacugacagccuugccca

SEQ ID NO: 1932003 - RNA, 13 nt, Homo sapiens
gacccacccagcc

SEQ ID NO: 1932004 - RNA, 18 nt, Homo sapiens
cgaggccuggcucuggag

SEQ ID NO: 1932005 - RNA, 21 nt, Homo sapiens
gaggccuauaaugaagcuuua

SEQ ID NO: 1932006 - RNA, 18 nt, Homo sapiens
cugccuugauuagacucc

SEQ ID NO: 1932007 - RNA, 22 nt, Homo sapiens
aauuacuguuugaaacuuuuca

SEQ ID NO: 1932008 - RNA, 22 nt, Homo sapiens
uuguauuuuaauaaagauucca

SEQ ID NO: 1932009 - RNA, 23 nt, Homo sapiens
agcugaguuuccuaugggaacaa

SEQ ID NO: 1932010 - RNA, 18 nt, Homo sapiens
uucucauaaccucaagga

SEQ ID NO: 1932011 - RNA, 22 nt, Homo sapiens
uuauuuugaaauggaaauuaau

SEQ ID NO: 1932012 - RNA, 22 nt, Homo sapiens
gcucacuguccacaugugaacu

SEQ ID NO: 1932013 - RNA, 19 nt, Homo sapiens
auuuaaagcuuacucuguc

SEQ ID NO: 1932014 - RNA, 23 nt, Homo sapiens
cccacagcaggugcugagcaaag

SEQ ID NO: 1932015 - RNA, 15 nt, Homo sapiens
ccuuagaagucacac

SEQ ID NO: 1932016 - RNA, 13 nt, Homo sapiens
acauucauacugu

SEQ ID NO: 1932017 - RNA, 16 nt, Homo sapiens
uuguucaguugccaag

SEQ ID NO: 1932018 - RNA, 20 nt, Homo sapiens
agcucuauucuuugccuuag

SEQ ID NO: 1932019 - RNA, 23 nt, Homo sapiens
gagcuccugucccagcuccagga

SEQ ID NO: 1932020 - RNA, 15 nt, Homo sapiens
ugcuuggcccuucaa

SEQ ID NO: 1932021 - RNA, 18 nt, Homo sapiens
aguauuggcugaguccau

SEQ ID NO: 1932022 - RNA, 16 nt, Homo sapiens
aguccaggaaugaucc

SEQ ID NO: 1932023 - RNA, 16 nt, Homo sapiens
uucugagguaaccuca

SEQ ID NO: 1932024 - RNA, 15 nt, Homo sapiens
aagugauugacuuga

SEQ ID NO: 1932025 - RNA, 15 nt, Homo sapiens
uuucauccauuccua

SEQ ID NO: 1932026 - RNA, 15 nt, Homo sapiens
cugaccucacuguga

SEQ ID NO: 1932027 - RNA, 21 nt, Homo sapiens
uugaaaucuuggaguuucaag

SEQ ID NO: 1932028 - RNA, 13 nt, Homo sapiens
uaacccucucuuc

SEQ ID NO: 1932029 - RNA, 17 nt, Homo sapiens
cgcagccuagauaugaa

SEQ ID NO: 1932030 - RNA, 18 nt, Homo sapiens
auuagcugggcauggugg

SEQ ID NO: 1932031 - RNA, 14 nt, Homo sapiens
auauguugcucagu

SEQ ID NO: 1932032 - RNA, 16 nt, Homo sapiens
cuaacaucuaaaaaua

SEQ ID NO: 1932033 - RNA, 18 nt, Homo sapiens
uuuaaaccugacaauggu

SEQ ID NO: 1932034 - RNA, 13 nt, Homo sapiens
caaauuuacuuua

SEQ ID NO: 1932035 - RNA, 19 nt, Homo sapiens
ucuggaucuccugcugccu

SEQ ID NO: 1932036 - RNA, 17 nt, Homo sapiens
cucacaucugaaucucc

SEQ ID NO: 1932037 - RNA, 22 nt, Homo sapiens
uagaacaguggaaacuaugugu

SEQ ID NO: 1932038 - RNA, 18 nt, Homo sapiens
acauuccaguagccagua

SEQ ID NO: 1932039 - RNA, 18 nt, Homo sapiens
aggguuuuucucacugug

SEQ ID NO: 1932040 - RNA, 17 nt, Homo sapiens
cauuauuggacuuccau

SEQ ID NO: 1932041 - RNA, 23 nt, Homo sapiens
guuuucucugaucacaacuuuuc

SEQ ID NO: 1932042 - RNA, 17 nt, Homo sapiens
ccagaggaggugcccgg

SEQ ID NO: 1932043 - RNA, 14 nt, Homo sapiens
ggacaaacagcuca

SEQ ID NO: 1932044 - RNA, 23 nt, Homo sapiens
ggaccgcccccugucucucaggg

SEQ ID NO: 1932045 - RNA, 14 nt, Homo sapiens
cagaauauacuaaa

SEQ ID NO: 1932046 - RNA, 13 nt, Homo sapiens
ucaaaaucuguga

SEQ ID NO: 1932047 - RNA, 16 nt, Homo sapiens
ucucauuacugcuuca

SEQ ID NO: 1932048 - RNA, 17 nt, Homo sapiens
uauuaaaguuucauuag

SEQ ID NO: 1932049 - RNA, 14 nt, Homo sapiens
cacugaaguuugau

SEQ ID NO: 1932050 - RNA, 19 nt, Homo sapiens
aagagacuacagagucaaa

SEQ ID NO: 1932051 - RNA, 15 nt, Homo sapiens
cuuagucaugguguu

SEQ ID NO: 1932052 - RNA, 16 nt, Homo sapiens
aaacuacaucuugaaa

SEQ ID NO: 1932053 - RNA, 14 nt, Homo sapiens
cggcucacugcaac

SEQ ID NO: 1932054 - RNA, 15 nt, Homo sapiens
gcuaaauauuucuuu

SEQ ID NO: 1932055 - RNA, 21 nt, Homo sapiens
gagcauuguggcugucagcag

SEQ ID NO: 1932056 - RNA, 17 nt, Homo sapiens
caagauacgcucgccac

SEQ ID NO: 1932057 - RNA, 14 nt, Homo sapiens
auaaaguaacuuua

SEQ ID NO: 1932058 - RNA, 19 nt, Homo sapiens
gcuaaugaagaucauauac

SEQ ID NO: 1932059 - RNA, 17 nt, Homo sapiens
agaacagguucuuaaaa

SEQ ID NO: 1932060 - RNA, 18 nt, Homo sapiens
cuguagguuaaaugcagg

SEQ ID NO: 1932061 - RNA, 17 nt, Homo sapiens
uagcuacaucaguuuga

SEQ ID NO: 1932062 - RNA, 21 nt, Homo sapiens
acagugcccaugcaauggcuu

SEQ ID NO: 1932063 - RNA, 17 nt, Homo sapiens
caguugcaauaaacuca

SEQ ID NO: 1932064 - RNA, 23 nt, Homo sapiens
uuccagaacgcccuguguccaca

SEQ ID NO: 1932065 - RNA, 20 nt, Homo sapiens
auuuagccaggaaaggggug

SEQ ID NO: 1932066 - RNA, 23 nt, Homo sapiens
acgcauugucacagcuaccaaag

SEQ ID NO: 1932067 - RNA, 22 nt, Homo sapiens
gaaacucuggcucagccugucu

SEQ ID NO: 1932068 - RNA, 14 nt, Homo sapiens
ggucaccagcugcu

SEQ ID NO: 1932069 - RNA, 15 nt, Homo sapiens
agcuggauucacuug

SEQ ID NO: 1932070 - RNA, 14 nt, Homo sapiens
uagcagcugugaug

SEQ ID NO: 1932071 - RNA, 16 nt, Homo sapiens
cugucaccaagccuug

SEQ ID NO: 1932072 - RNA, 21 nt, Homo sapiens
ugaaauucaguuauaaaguca

SEQ ID NO: 1932073 - RNA, 23 nt, Homo sapiens
cuuucuuauacacaccugaauaa

SEQ ID NO: 1932074 - RNA, 15 nt, Homo sapiens
auuugauuuugccca

SEQ ID NO: 1932075 - RNA, 13 nt, Homo sapiens
cauaucacuauga

SEQ ID NO: 1932076 - RNA, 21 nt, Homo sapiens
agcgugcaguagagagcaaag

SEQ ID NO: 1932077 - RNA, 23 nt, Homo sapiens
uagaugucaagcugaaaacaaac

SEQ ID NO: 1932078 - RNA, 19 nt, Homo sapiens
acuaaccaaacaaugcaga

SEQ ID NO: 1932079 - RNA, 17 nt, Homo sapiens
gcaaccacacaccucac

SEQ ID NO: 1932080 - RNA, 16 nt, Homo sapiens
gcucugccacuguccg

SEQ ID NO: 1932081 - RNA, 16 nt, Homo sapiens
ggucacagagugagac

SEQ ID NO: 1932082 - RNA, 14 nt, Homo sapiens
cuccauaucagaag

SEQ ID NO: 1932083 - RNA, 15 nt, Homo sapiens
gggaagagugcauuu

SEQ ID NO: 1932084 - RNA, 20 nt, Homo sapiens
cugcacaugaaaguuuugca

SEQ ID NO: 1932085 - RNA, 14 nt, Homo sapiens
uuaugaaaugaccu

SEQ ID NO: 1932086 - RNA, 14 nt, Homo sapiens
cguggccgcugccc

SEQ ID NO: 1932087 - RNA, 18 nt, Homo sapiens
ugucauagacuccuuugc

SEQ ID NO: 1932088 - RNA, 17 nt, Homo sapiens
gugggauccucccucau

SEQ ID NO: 1932089 - RNA, 21 nt, Homo sapiens
gaggcucccucuuaacgcagc

SEQ ID NO: 1932090 - RNA, 16 nt, Homo sapiens
uuaaaaauagacacuc

SEQ ID NO: 1932091 - RNA, 14 nt, Homo sapiens
acucucagcaccaa

SEQ ID NO: 1932092 - RNA, 17 nt, Homo sapiens
cucccuguuccccagag

SEQ ID NO: 1932093 - RNA, 15 nt, Homo sapiens
cagaaaguuaugaaa

SEQ ID NO: 1932094 - RNA, 16 nt, Homo sapiens
uuuaaauuccacagau

SEQ ID NO: 1932095 - RNA, 21 nt, Homo sapiens
gacccaagagguggggaccaa

SEQ ID NO: 1932096 - RNA, 13 nt, Homo sapiens
aucugcacagugg

SEQ ID NO: 1932097 - RNA, 23 nt, Homo sapiens
agaugccucuuaggacuggugcc

SEQ ID NO: 1932098 - RNA, 12 nt, Homo sapiens
uagaugccaggg

SEQ ID NO: 1932099 - RNA, 18 nt, Homo sapiens
gggacgcccccaccagcu

SEQ ID NO: 1932100 - RNA, 18 nt, Homo sapiens
gcugcugagaaucuagcc

SEQ ID NO: 1932101 - RNA, 14 nt, Homo sapiens
acgaggaggaacca

SEQ ID NO: 1932102 - RNA, 13 nt, Homo sapiens
gagauagugcugg

SEQ ID NO: 1932103 - RNA, 19 nt, Homo sapiens
cccucagggcaaagccagg

SEQ ID NO: 1932104 - RNA, 22 nt, Homo sapiens
cugccaauaaauccugucuuau

SEQ ID NO: 1932105 - RNA, 17 nt, Homo sapiens
cuccaaggacuaaggcc

SEQ ID NO: 1932106 - RNA, 15 nt, Homo sapiens
aguauauaguauauu

SEQ ID NO: 1932107 - RNA, 15 nt, Homo sapiens
ugaaacacacaugga

SEQ ID NO: 1932108 - RNA, 20 nt, Homo sapiens
caacagauuuuauugaauga

SEQ ID NO: 1932109 - RNA, 22 nt, Homo sapiens
uuacauauauucccauguaaug

SEQ ID NO: 1932110 - RNA, 21 nt, Homo sapiens
gcccauguugagccaugagug

SEQ ID NO: 1932111 - RNA, 17 nt, Homo sapiens
gcccuccuggugcccac

SEQ ID NO: 1932112 - RNA, 17 nt, Homo sapiens
acagugagagacuccau

SEQ ID NO: 1932113 - RNA, 19 nt, Homo sapiens
accagugcaacagcacugg

SEQ ID NO: 1932114 - RNA, 13 nt, Homo sapiens
uguuacaaaaaga

SEQ ID NO: 1932115 - RNA, 19 nt, Homo sapiens
aaagcuaaauguacauguu

SEQ ID NO: 1932116 - RNA, 14 nt, Homo sapiens
cucuucaccacugu

SEQ ID NO: 1932117 - RNA, 17 nt, Homo sapiens
caaccucuuuuuccucc

SEQ ID NO: 1932118 - RNA, 22 nt, Homo sapiens
ugugcuguggguauucaccacc

SEQ ID NO: 1932119 - RNA, 18 nt, Homo sapiens
aaaugaggguggugaaua

SEQ ID NO: 1932120 - RNA, 18 nt, Homo sapiens
uggagccugggguguccu

SEQ ID NO: 1932121 - RNA, 18 nt, Homo sapiens
cucaucagacucugagua

SEQ ID NO: 1932122 - RNA, 15 nt, Homo sapiens
cucacauugagagua

SEQ ID NO: 1932123 - RNA, 14 nt, Homo sapiens
accuccuccugcug

SEQ ID NO: 1932124 - RNA, 13 nt, Homo sapiens
cuaaauaugaagg

SEQ ID NO: 1932125 - RNA, 14 nt, Homo sapiens
uaacagcaucuuua

SEQ ID NO: 1932126 - RNA, 13 nt, Homo sapiens
gaaaggaacugca

SEQ ID NO: 1932127 - RNA, 18 nt, Homo sapiens
aaggaaaaaaggaggaua

SEQ ID NO: 1932128 - RNA, 15 nt, Homo sapiens
cagaaggaaaggagg

SEQ ID NO: 1932129 - RNA, 15 nt, Homo sapiens
cugaccaaauggcca

SEQ ID NO: 1932130 - RNA, 15 nt, Homo sapiens
aaagccaacaaacca

SEQ ID NO: 1932131 - RNA, 20 nt, Homo sapiens
ucaguggcauucacaucuca

SEQ ID NO: 1932132 - RNA, 13 nt, Homo sapiens
gacaagucaugga

SEQ ID NO: 1932133 - RNA, 17 nt, Homo sapiens
auucuaaaacacaacaa

SEQ ID NO: 1932134 - RNA, 16 nt, Homo sapiens
gcuugggcuucauccu

SEQ ID NO: 1932135 - RNA, 19 nt, Homo sapiens
uggaggaggaaggcaagag

SEQ ID NO: 1932136 - RNA, 14 nt, Homo sapiens
cuccagaaucuugg

SEQ ID NO: 1932137 - RNA, 19 nt, Homo sapiens
cagcacagcgaagacugcu

SEQ ID NO: 1932138 - RNA, 18 nt, Homo sapiens
auacuggauacucugcuc

SEQ ID NO: 1932139 - RNA, 18 nt, Homo sapiens
ugugugaucugugggcac

SEQ ID NO: 1932140 - RNA, 13 nt, Homo sapiens
uucauaugcagua

SEQ ID NO: 1932141 - RNA, 16 nt, Homo sapiens
ucauggccacacugug

SEQ ID NO: 1932142 - RNA, 17 nt, Homo sapiens
cacaacuguugauggua

SEQ ID NO: 1932143 - RNA, 15 nt, Homo sapiens
cugccaucaugccug

SEQ ID NO: 1932144 - RNA, 20 nt, Homo sapiens
gaagguuggugaauuucaca

SEQ ID NO: 1932145 - RNA, 16 nt, Homo sapiens
agggacgacuuucuuu

SEQ ID NO: 1932146 - RNA, 22 nt, Homo sapiens
cucugagagggaaaggucuguc

SEQ ID NO: 1932147 - RNA, 14 nt, Homo sapiens
auuuaccagcuuaa

SEQ ID NO: 1932148 - RNA, 16 nt, Homo sapiens
uauccuuacaauguga

SEQ ID NO: 1932149 - RNA, 18 nt, Homo sapiens
cuuagccucccaaagugc

SEQ ID NO: 1932150 - RNA, 18 nt, Homo sapiens
cuugcacuuguuauauua

SEQ ID NO: 1932151 - RNA, 14 nt, Homo sapiens
uugagcccuggacc

SEQ ID NO: 1932152 - RNA, 16 nt, Homo sapiens
cagauuguaucaugug

SEQ ID NO: 1932153 - RNA, 14 nt, Homo sapiens
cuaagccugaugau

SEQ ID NO: 1932154 - RNA, 17 nt, Homo sapiens
uaaauauuacacaucaa

SEQ ID NO: 1932155 - RNA, 22 nt, Homo sapiens
uaagagugauuagagcugcaua

SEQ ID NO: 1932156 - RNA, 14 nt, Homo sapiens
uguaucuugccuaa

SEQ ID NO: 1932157 - RNA, 14 nt, Homo sapiens
uugaauuuagguga

SEQ ID NO: 1932158 - RNA, 14 nt, Homo sapiens
ccgaaaugcugucu

SEQ ID NO: 1932159 - RNA, 17 nt, Homo sapiens
augcuugguuguugcag

SEQ ID NO: 1932160 - RNA, 13 nt, Homo sapiens
gcauuuuacuacu

SEQ ID NO: 1932161 - RNA, 19 nt, Homo sapiens
ggagaagggaggguggcca

SEQ ID NO: 1932162 - RNA, 13 nt, Homo sapiens
cccuaagugccca

SEQ ID NO: 1932163 - RNA, 15 nt, Homo sapiens
agcaugguugcagau

SEQ ID NO: 1932164 - RNA, 16 nt, Homo sapiens
guccaucacuauucaa

SEQ ID NO: 1932165 - RNA, 12 nt, Homo sapiens
aucagcacugaa

SEQ ID NO: 1932166 - RNA, 15 nt, Homo sapiens
gaauaauggacaaag

SEQ ID NO: 1932167 - RNA, 17 nt, Homo sapiens
uggguaaaugcuuuuaa

SEQ ID NO: 1932168 - RNA, 20 nt, Homo sapiens
uguuaaauauuuacauauga

SEQ ID NO: 1932169 - RNA, 13 nt, Homo sapiens
aaaaaaaucaucu

SEQ ID NO: 1932170 - RNA, 17 nt, Homo sapiens
cugcccucucccugugu

SEQ ID NO: 1932171 - RNA, 17 nt, Homo sapiens
cugaccugcccaugucc

SEQ ID NO: 1932172 - RNA, 14 nt, Homo sapiens
ugucauauaucaaa

SEQ ID NO: 1932173 - RNA, 20 nt, Homo sapiens
caucauuacccuucccugca

SEQ ID NO: 1932174 - RNA, 16 nt, Homo sapiens
cccugcucccauuccu

SEQ ID NO: 1932175 - RNA, 18 nt, Homo sapiens
gagggcuggucauucaca

SEQ ID NO: 1932176 - RNA, 13 nt, Homo sapiens
aacuccagucucc

SEQ ID NO: 1932177 - RNA, 13 nt, Homo sapiens
gauggagacaccc

SEQ ID NO: 1932178 - RNA, 22 nt, Homo sapiens
ucagauucacacaugccacuau

SEQ ID NO: 1932179 - RNA, 19 nt, Homo sapiens
acagguuuucagcaacuca

SEQ ID NO: 1932180 - RNA, 22 nt, Homo sapiens
uaaacauugaagacccugucuc

SEQ ID NO: 1932181 - RNA, 17 nt, Homo sapiens
uaugcuaugcuauggaa

SEQ ID NO: 1932182 - RNA, 17 nt, Homo sapiens
gcuccagcgauggugcu

SEQ ID NO: 1932183 - RNA, 16 nt, Homo sapiens
ccagucaaaaccagag

SEQ ID NO: 1932184 - RNA, 15 nt, Homo sapiens
cacauuacauuaaca

SEQ ID NO: 1932185 - RNA, 22 nt, Homo sapiens
uuaugaaaugaccucuguccuc

SEQ ID NO: 1932186 - RNA, 22 nt, Homo sapiens
acacucuucugaauugacugua

SEQ ID NO: 1932187 - RNA, 17 nt, Homo sapiens
auggcugggaacaugac

SEQ ID NO: 1932188 - RNA, 16 nt, Homo sapiens
cucugcaaaaugucau

SEQ ID NO: 1932189 - RNA, 22 nt, Homo sapiens
uacacacccgccugacaccgug

SEQ ID NO: 1932190 - RNA, 19 nt, Homo sapiens
caucuugggaagggccaug

SEQ ID NO: 1932191 - RNA, 13 nt, Homo sapiens
gaaaaaccaauga

SEQ ID NO: 1932192 - RNA, 13 nt, Homo sapiens
gauggaccaaaag

SEQ ID NO: 1932193 - RNA, 16 nt, Homo sapiens
aggugagauaaauuaa

SEQ ID NO: 1932194 - RNA, 19 nt, Homo sapiens
agagugagacuccaccuca

SEQ ID NO: 1932195 - RNA, 14 nt, Homo sapiens
uccaacuccaggau

SEQ ID NO: 1932196 - RNA, 17 nt, Homo sapiens
ccccaacuaguagcuaa

SEQ ID NO: 1932197 - RNA, 22 nt, Homo sapiens
uuaaacgaaacaaagacaauuu

SEQ ID NO: 1932198 - RNA, 15 nt, Homo sapiens
ugacucuuccauuca

SEQ ID NO: 1932199 - RNA, 17 nt, Homo sapiens
ugauccuuuugugccau

SEQ ID NO: 1932200 - RNA, 16 nt, Homo sapiens
aacugcuugugcacug

SEQ ID NO: 1932201 - RNA, 19 nt, Homo sapiens
uaucacagcggggaugcuu

SEQ ID NO: 1932202 - RNA, 18 nt, Homo sapiens
agauguacaaaacaguuu

SEQ ID NO: 1932203 - RNA, 18 nt, Homo sapiens
uggcugauuuacuaacag

SEQ ID NO: 1932204 - RNA, 18 nt, Homo sapiens
auugugucauagaauuaa

SEQ ID NO: 1932205 - RNA, 21 nt, Homo sapiens
agccgagauugcgccacugca

SEQ ID NO: 1932206 - RNA, 19 nt, Homo sapiens
cacuuucauuauagcagag

SEQ ID NO: 1932207 - RNA, 13 nt, Homo sapiens
auacugacuuuca

SEQ ID NO: 1932208 - RNA, 22 nt, Homo sapiens
cccuuauuuguuuuguguuuca

SEQ ID NO: 1932209 - RNA, 15 nt, Homo sapiens
ccagaguuguucucu

SEQ ID NO: 1932210 - RNA, 20 nt, Homo sapiens
gacacauguauuuggugauu

SEQ ID NO: 1932211 - RNA, 13 nt, Homo sapiens
gcccacuucaggg

SEQ ID NO: 1932212 - RNA, 22 nt, Homo sapiens
ugucugucuccagcacccagaa

SEQ ID NO: 1932213 - RNA, 16 nt, Homo sapiens
gagcaccgccugugaa

SEQ ID NO: 1932214 - RNA, 23 nt, Homo sapiens
aaacaccagccgaggccacagaa

SEQ ID NO: 1932215 - RNA, 18 nt, Homo sapiens
agagaucuccaacucucu

SEQ ID NO: 1932216 - RNA, 21 nt, Homo sapiens
cuuuucucacaaaaaggcaaa

SEQ ID NO: 1932217 - RNA, 19 nt, Homo sapiens
guaaucuauuuuuccauau

SEQ ID NO: 1932218 - RNA, 19 nt, Homo sapiens
uucccaccugucaaccuga

SEQ ID NO: 1932219 - RNA, 20 nt, Homo sapiens
cucuggagugcuaacuugaa

SEQ ID NO: 1932220 - RNA, 15 nt, Homo sapiens
gaaaugaaugugcaa

SEQ ID NO: 1932221 - RNA, 21 nt, Homo sapiens
gaguuuagugugauaaaggca

SEQ ID NO: 1932222 - RNA, 15 nt, Homo sapiens
uagcugggauuugaa

SEQ ID NO: 1932223 - RNA, 13 nt, Homo sapiens
gucugccauuaca

SEQ ID NO: 1932224 - RNA, 21 nt, Homo sapiens
ucuagucaagcgauugucuga

SEQ ID NO: 1932225 - RNA, 13 nt, Homo sapiens
ccugggugacaaa

SEQ ID NO: 1932226 - RNA, 15 nt, Homo sapiens
cuguuccuuccugca

SEQ ID NO: 1932227 - RNA, 18 nt, Homo sapiens
ccaggcugaccacagcac

SEQ ID NO: 1932228 - RNA, 16 nt, Homo sapiens
gccucugggaggccag

SEQ ID NO: 1932229 - RNA, 19 nt, Homo sapiens
gaacauucacuuuuguuaa

SEQ ID NO: 1932230 - RNA, 21 nt, Homo sapiens
guaaauacacauagcauguaa

SEQ ID NO: 1932231 - RNA, 19 nt, Homo sapiens
ccacgggaagccuccguca

SEQ ID NO: 1932232 - RNA, 19 nt, Homo sapiens
cuacaagugcagcugugac

SEQ ID NO: 1932233 - RNA, 22 nt, Homo sapiens
ggucaggaggaaaagacuaaca

SEQ ID NO: 1932234 - RNA, 22 nt, Homo sapiens
cucccagggccuuaaaagccau

SEQ ID NO: 1932235 - RNA, 20 nt, Homo sapiens
cucuguggccagcugcaucu

SEQ ID NO: 1932236 - RNA, 13 nt, Homo sapiens
uggucaaccccac

SEQ ID NO: 1932237 - RNA, 16 nt, Homo sapiens
gaccugaaggaccucc

SEQ ID NO: 1932238 - RNA, 16 nt, Homo sapiens
auuuuguaaaaguggc

SEQ ID NO: 1932239 - RNA, 13 nt, Homo sapiens
gcugaagccaaac

SEQ ID NO: 1932240 - RNA, 23 nt, Homo sapiens
auugucaaauguaaauuuacuga

SEQ ID NO: 1932241 - RNA, 15 nt, Homo sapiens
cugcuuuuaaaacau

SEQ ID NO: 1932242 - RNA, 15 nt, Homo sapiens
ucgaauaaagugaau

SEQ ID NO: 1932243 - RNA, 19 nt, Homo sapiens
uuugggaccaucacugaga

SEQ ID NO: 1932244 - RNA, 17 nt, Homo sapiens
ugggucagguucuugcc

SEQ ID NO: 1932245 - RNA, 16 nt, Homo sapiens
auauuuauaacucauc

SEQ ID NO: 1932246 - RNA, 15 nt, Homo sapiens
aaagcuccucucuug

SEQ ID NO: 1932247 - RNA, 12 nt, Homo sapiens
agguagcacuac

SEQ ID NO: 1932248 - RNA, 18 nt, Homo sapiens
ucuuagcucuaccgggag

SEQ ID NO: 1932249 - RNA, 18 nt, Homo sapiens
gcaacuaauuuucuccca

SEQ ID NO: 1932250 - RNA, 16 nt, Homo sapiens
agauuuaagaauaccu

SEQ ID NO: 1932251 - RNA, 18 nt, Homo sapiens
uaucucucaaaacaauau

SEQ ID NO: 1932252 - RNA, 11 nt, Homo sapiens
ucaaguaauaa

SEQ ID NO: 1932253 - RNA, 13 nt, Homo sapiens
caaccccacuucc

SEQ ID NO: 1932254 - RNA, 20 nt, Homo sapiens
uguccagcaccuugugccug

SEQ ID NO: 1932255 - RNA, 10 nt, Homo sapiens
ggaagccagg

SEQ ID NO: 1932256 - RNA, 17 nt, Homo sapiens
cauggccacacugugac

SEQ ID NO: 1932257 - RNA, 16 nt, Homo sapiens
aggguguaauggagca

SEQ ID NO: 1932258 - RNA, 19 nt, Homo sapiens
cugggaggacucucuuagu

SEQ ID NO: 1932259 - RNA, 14 nt, Homo sapiens
aaagggcaaaaaga

SEQ ID NO: 1932260 - RNA, 12 nt, Homo sapiens
auuuuccaguga

SEQ ID NO: 1932261 - RNA, 21 nt, Homo sapiens
aagagcuggaugcacaucagg

SEQ ID NO: 1932262 - RNA, 19 nt, Homo sapiens
agaggaaagagucuucaac

SEQ ID NO: 1932263 - RNA, 14 nt, Homo sapiens
acauguugccucac

SEQ ID NO: 1932264 - RNA, 17 nt, Homo sapiens
ugugauuagacagaaca

SEQ ID NO: 1932265 - RNA, 20 nt, Homo sapiens
gagcacugcguuuuccuagc

SEQ ID NO: 1932266 - RNA, 21 nt, Homo sapiens
uccuuccugcccuguaccucu

SEQ ID NO: 1932267 - RNA, 15 nt, Homo sapiens
ucuucagaugccacu

SEQ ID NO: 1932268 - RNA, 17 nt, Homo sapiens
ugucuagcuguuucaaa

SEQ ID NO: 1932269 - RNA, 20 nt, Homo sapiens
aagcuacccaucugccagau

SEQ ID NO: 1932270 - RNA, 19 nt, Homo sapiens
ucccuacaucuaacucauc

SEQ ID NO: 1932271 - RNA, 17 nt, Homo sapiens
caguucccucccucaaa

SEQ ID NO: 1932272 - RNA, 22 nt, Homo sapiens
auuuaggaaaugggcagugaag

SEQ ID NO: 1932273 - RNA, 19 nt, Homo sapiens
aauguuuuccccaaaccau

SEQ ID NO: 1932274 - RNA, 17 nt, Homo sapiens
aauguggauucuuccca

SEQ ID NO: 1932275 - RNA, 23 nt, Homo sapiens
uccacagcuuuuacguaguaaaa

SEQ ID NO: 1932276 - RNA, 14 nt, Homo sapiens
ucuuucagaaggaa

SEQ ID NO: 1932277 - RNA, 14 nt, Homo sapiens
agcuucagacuuuu

SEQ ID NO: 1932278 - RNA, 17 nt, Homo sapiens
aaagaauuauuugccuu

SEQ ID NO: 1932279 - RNA, 17 nt, Homo sapiens
uccacguguguguguga

SEQ ID NO: 1932280 - RNA, 24 nt, Homo sapiens
ugcaccuagcugugcaagaccuag

SEQ ID NO: 1932281 - RNA, 18 nt, Homo sapiens
guuggccaggauggucuc

SEQ ID NO: 1932282 - RNA, 20 nt, Homo sapiens
ggagcauguuuuguauacaa

SEQ ID NO: 1932283 - RNA, 22 nt, Homo sapiens
uccuggacaaggcuaacauccc

SEQ ID NO: 1932284 - RNA, 17 nt, Homo sapiens
uucuuagucacaaaaua

SEQ ID NO: 1932285 - RNA, 12 nt, Homo sapiens
uuuuccacauuc

SEQ ID NO: 1932286 - RNA, 15 nt, Homo sapiens
ugucuuauuugcuau

SEQ ID NO: 1932287 - RNA, 20 nt, Homo sapiens
cagaauuuuaugcggcauuu

SEQ ID NO: 1932288 - RNA, 19 nt, Homo sapiens
auguuccucugucaaugaa

SEQ ID NO: 1932289 - RNA, 20 nt, Homo sapiens
guaaacuuggggauggcuga

SEQ ID NO: 1932290 - RNA, 14 nt, Homo sapiens
augcucagugccuu

SEQ ID NO: 1932291 - RNA, 14 nt, Homo sapiens
augugcagugcugu

SEQ ID NO: 1932292 - RNA, 13 nt, Homo sapiens
ucaacaugaguca

SEQ ID NO: 1932293 - RNA, 20 nt, Homo sapiens
gcagguuggaacuaugcagu

SEQ ID NO: 1932294 - RNA, 20 nt, Homo sapiens
auugggcaugauaagccgag

SEQ ID NO: 1932295 - RNA, 22 nt, Homo sapiens
ugggguuucucuuuuccacuga

SEQ ID NO: 1932296 - RNA, 14 nt, Homo sapiens
ucuugauguaaaau

SEQ ID NO: 1932297 - RNA, 18 nt, Homo sapiens
aggaugcuguguugucaa

SEQ ID NO: 1932298 - RNA, 12 nt, Homo sapiens
cugaaauuuccu

SEQ ID NO: 1932299 - RNA, 24 nt, Homo sapiens
uaguucuuaaaauuagugagauua

SEQ ID NO: 1932300 - RNA, 19 nt, Homo sapiens
caaucuguaaaacuaagaa

SEQ ID NO: 1932301 - RNA, 22 nt, Homo sapiens
ugacaucaugaggccggaugaa

SEQ ID NO: 1932302 - RNA, 17 nt, Homo sapiens
gacagaagaucuauauu

SEQ ID NO: 1932303 - RNA, 21 nt, Homo sapiens
uguuccuggaggucagcauuu

SEQ ID NO: 1932304 - RNA, 15 nt, Homo sapiens
uuuugucauauguau

SEQ ID NO: 1932305 - RNA, 20 nt, Homo sapiens
cuccugaccccgccaugcau

SEQ ID NO: 1932306 - RNA, 13 nt, Homo sapiens
ugcacugugacac

SEQ ID NO: 1932307 - RNA, 13 nt, Homo sapiens
auugcaccugcag

SEQ ID NO: 1932308 - RNA, 19 nt, Homo sapiens
caggauuaaaagccaugag

SEQ ID NO: 1932309 - RNA, 21 nt, Homo sapiens
auacuauauuuauacuguaua

SEQ ID NO: 1932310 - RNA, 20 nt, Homo sapiens
auuaaacuaguguuauacuu

SEQ ID NO: 1932311 - RNA, 17 nt, Homo sapiens
gaguuuaagucucugac

SEQ ID NO: 1932312 - RNA, 16 nt, Homo sapiens
gcugaaauaaaaugau

SEQ ID NO: 1932313 - RNA, 15 nt, Homo sapiens
aacagcuacaacagc

SEQ ID NO: 1932314 - RNA, 22 nt, Homo sapiens
cugcucccuaccccagggcccu

SEQ ID NO: 1932315 - RNA, 11 nt, Homo sapiens
cuuugggucua

SEQ ID NO: 1932316 - RNA, 16 nt, Homo sapiens
caggccccaccggcca

SEQ ID NO: 1932317 - RNA, 14 nt, Homo sapiens
augucuauguagcu

SEQ ID NO: 1932318 - RNA, 20 nt, Homo sapiens
augcuucccagagaagcuca

SEQ ID NO: 1932319 - RNA, 23 nt, Homo sapiens
gguagcugucuccaaaaaugcua

SEQ ID NO: 1932320 - RNA, 18 nt, Homo sapiens
uagacacaucaaaugccc

SEQ ID NO: 1932321 - RNA, 13 nt, Homo sapiens
ucuauggauucac

SEQ ID NO: 1932322 - RNA, 19 nt, Homo sapiens
agcuggugccugcuuugac

SEQ ID NO: 1932323 - RNA, 20 nt, Homo sapiens
aacaagggcugcaaugcccu

SEQ ID NO: 1932324 - RNA, 13 nt, Homo sapiens
cauuaucuugcag

SEQ ID NO: 1932325 - RNA, 15 nt, Homo sapiens
cuaagggcccaaagg

SEQ ID NO: 1932326 - RNA, 15 nt, Homo sapiens
uuagaaacucaggaa

SEQ ID NO: 1932327 - RNA, 11 nt, Homo sapiens
cuacacauguu

SEQ ID NO: 1932328 - RNA, 20 nt, Homo sapiens
uaaugauugacguacuuagc

SEQ ID NO: 1932329 - RNA, 18 nt, Homo sapiens
gggaaaggugcucaaaga

SEQ ID NO: 1932330 - RNA, 19 nt, Homo sapiens
aaagugaucaguaugcugu

SEQ ID NO: 1932331 - RNA, 21 nt, Homo sapiens
ggcugcucaggguucaucuga

SEQ ID NO: 1932332 - RNA, 16 nt, Homo sapiens
uauagcugacaucucc

SEQ ID NO: 1932333 - RNA, 19 nt, Homo sapiens
auuuaaacaugaagcacac

SEQ ID NO: 1932334 - RNA, 17 nt, Homo sapiens
caauuccccuacaucaa

SEQ ID NO: 1932335 - RNA, 14 nt, Homo sapiens
aacucuaagaccac

SEQ ID NO: 1932336 - RNA, 23 nt, Homo sapiens
ggacacuuaauacuaccuugaaa

SEQ ID NO: 1932337 - RNA, 12 nt, Homo sapiens
aauuaacacugc

SEQ ID NO: 1932338 - RNA, 17 nt, Homo sapiens
caagcugguauuuucau

SEQ ID NO: 1932339 - RNA, 22 nt, Homo sapiens
ccuuccucucucucuuccucuu

SEQ ID NO: 1932340 - RNA, 16 nt, Homo sapiens
ucugguagccugcaga

SEQ ID NO: 1932341 - RNA, 13 nt, Homo sapiens
ggaccaauaccuc

SEQ ID NO: 1932342 - RNA, 20 nt, Homo sapiens
aucuugccuaaaucccaaga

SEQ ID NO: 1932343 - RNA, 11 nt, Homo sapiens
gcaacaucucu

SEQ ID NO: 1932344 - RNA, 21 nt, Homo sapiens
gaagcccucugagcuccagag

SEQ ID NO: 1932345 - RNA, 15 nt, Homo sapiens
agaaccccugucaca

SEQ ID NO: 1932346 - RNA, 20 nt, Homo sapiens
cuggccuggcaguugaacag

SEQ ID NO: 1932347 - RNA, 18 nt, Homo sapiens
cguucagaggugcagcug

SEQ ID NO: 1932348 - RNA, 19 nt, Homo sapiens
aguuugcugaaagauaugu

SEQ ID NO: 1932349 - RNA, 18 nt, Homo sapiens
guugcugcuguccagugc

SEQ ID NO: 1932350 - RNA, 13 nt, Homo sapiens
auacucugcuauu

SEQ ID NO: 1932351 - RNA, 13 nt, Homo sapiens
cacuccugaaccc

SEQ ID NO: 1932352 - RNA, 15 nt, Homo sapiens
uaucagaguauguca

SEQ ID NO: 1932353 - RNA, 19 nt, Homo sapiens
cagcagagguuugcugaca

SEQ ID NO: 1932354 - RNA, 19 nt, Homo sapiens
acugaagaaacuucugcuu

SEQ ID NO: 1932355 - RNA, 15 nt, Homo sapiens
uaccagcaacuugaa

SEQ ID NO: 1932356 - RNA, 15 nt, Homo sapiens
uugaaaaugggcuca

SEQ ID NO: 1932357 - RNA, 13 nt, Homo sapiens
auucaccaaaaua

SEQ ID NO: 1932358 - RNA, 13 nt, Homo sapiens
uaaucccauuucc

SEQ ID NO: 1932359 - RNA, 20 nt, Homo sapiens
gcucacaugggacugggaua

SEQ ID NO: 1932360 - RNA, 13 nt, Homo sapiens
uucugccuaagcc

SEQ ID NO: 1932361 - RNA, 20 nt, Homo sapiens
aucaauuacugguccaaaag

SEQ ID NO: 1932362 - RNA, 21 nt, Homo sapiens
aaccagaggaagaaaaugagc

SEQ ID NO: 1932363 - RNA, 23 nt, Homo sapiens
ucuauggagguuggccacaguca

SEQ ID NO: 1932364 - RNA, 18 nt, Homo sapiens
uagaagccugcagcggca

SEQ ID NO: 1932365 - RNA, 22 nt, Homo sapiens
accuuuuauacuuuugaccaaa

SEQ ID NO: 1932366 - RNA, 21 nt, Homo sapiens
ugcaugucuuaaaugcucaua

SEQ ID NO: 1932367 - RNA, 13 nt, Homo sapiens
cccucaagcaaua

SEQ ID NO: 1932368 - RNA, 13 nt, Homo sapiens
caccaaagccacc

SEQ ID NO: 1932369 - RNA, 15 nt, Homo sapiens
ucaagcgauucuugu

SEQ ID NO: 1932370 - RNA, 15 nt, Homo sapiens
aaaaauggaacugug

SEQ ID NO: 1932371 - RNA, 13 nt, Homo sapiens
aacguaugugcuc

SEQ ID NO: 1932372 - RNA, 14 nt, Homo sapiens
uucauuaaugauga

SEQ ID NO: 1932373 - RNA, 21 nt, Homo sapiens
gaacagacaacagaagucaug

SEQ ID NO: 1932374 - RNA, 16 nt, Homo sapiens
gguaaagggacaguua

SEQ ID NO: 1932375 - RNA, 20 nt, Homo sapiens
accccagguaagauguuaau

SEQ ID NO: 1932376 - RNA, 19 nt, Homo sapiens
aacuaaauuugucuuucaa

SEQ ID NO: 1932377 - RNA, 20 nt, Homo sapiens
ucugaagggccccuugcaaa

SEQ ID NO: 1932378 - RNA, 16 nt, Homo sapiens
uacaauaaacugguau

SEQ ID NO: 1932379 - RNA, 14 nt, Homo sapiens
cacacaaccaugac

SEQ ID NO: 1932380 - RNA, 14 nt, Homo sapiens
accaaaacacugcc

SEQ ID NO: 1932381 - RNA, 12 nt, Homo sapiens
uggacagccagu

SEQ ID NO: 1932382 - RNA, 12 nt, Homo sapiens
ugcacagccacu

SEQ ID NO: 1932383 - RNA, 16 nt, Homo sapiens
uguaggcacaagacca

SEQ ID NO: 1932384 - RNA, 16 nt, Homo sapiens
cugcaaacccaugaag

SEQ ID NO: 1932385 - RNA, 19 nt, Homo sapiens
aaugguaggauaucuuggc

SEQ ID NO: 1932386 - RNA, 17 nt, Homo sapiens
cauuaaaauaguuacaa

SEQ ID NO: 1932387 - RNA, 14 nt, Homo sapiens
uaucugaguugacu

SEQ ID NO: 1932388 - RNA, 15 nt, Homo sapiens
aaggucucauucuuc

SEQ ID NO: 1932389 - RNA, 15 nt, Homo sapiens
uggggaccucaggcc

SEQ ID NO: 1932390 - RNA, 17 nt, Homo sapiens
gaugggguuucaccaug

SEQ ID NO: 1932391 - RNA, 17 nt, Homo sapiens
auuuuccuguguccaca

SEQ ID NO: 1932392 - RNA, 22 nt, Homo sapiens
gaaauaccacagcucagccacu

SEQ ID NO: 1932393 - RNA, 23 nt, Homo sapiens
ugaagaaaagacacugaagcuaa

SEQ ID NO: 1932394 - RNA, 19 nt, Homo sapiens
gaacacacagggcugugua

SEQ ID NO: 1932395 - RNA, 19 nt, Homo sapiens
guaucaucuuugccaagua

SEQ ID NO: 1932396 - RNA, 14 nt, Homo sapiens
cguguccgacucuu

SEQ ID NO: 1932397 - RNA, 16 nt, Homo sapiens
aacauuucucacugaa

SEQ ID NO: 1932398 - RNA, 22 nt, Homo sapiens
aaggucccgaggaugcugucag

SEQ ID NO: 1932399 - RNA, 19 nt, Homo sapiens
uaguuguaccgcaauguga

SEQ ID NO: 1932400 - RNA, 14 nt, Homo sapiens
acagcuaaccacuu

SEQ ID NO: 1932401 - RNA, 20 nt, Homo sapiens
augcugacagcucuucacag

SEQ ID NO: 1932402 - RNA, 15 nt, Homo sapiens
ugaaauaaacacugg

SEQ ID NO: 1932403 - RNA, 18 nt, Homo sapiens
gacacaacaucugagaca

SEQ ID NO: 1932404 - RNA, 23 nt, Homo sapiens
auccacccgggggagcccaguga

SEQ ID NO: 1932405 - RNA, 11 nt, Homo sapiens
guguguguacc

SEQ ID NO: 1932406 - RNA, 19 nt, Homo sapiens
accugguuccuguccucaa

SEQ ID NO: 1932407 - RNA, 22 nt, Homo sapiens
guaaaggauagacucacauuua

SEQ ID NO: 1932408 - RNA, 21 nt, Homo sapiens
cauagagacuugggaaugagc

SEQ ID NO: 1932409 - RNA, 17 nt, Homo sapiens
guauuccuguaauacua

SEQ ID NO: 1932410 - RNA, 17 nt, Homo sapiens
aagaaauuaaguacuua

SEQ ID NO: 1932411 - RNA, 13 nt, Homo sapiens
caaccuccagugu

SEQ ID NO: 1932412 - RNA, 15 nt, Homo sapiens
uaaaaagccuuacag

SEQ ID NO: 1932413 - RNA, 15 nt, Homo sapiens
caaccuacuuucaua

SEQ ID NO: 1932414 - RNA, 15 nt, Homo sapiens
gccccaucccaugcu

SEQ ID NO: 1932415 - RNA, 16 nt, Homo sapiens
uucaucugacuaugac

SEQ ID NO: 1932416 - RNA, 20 nt, Homo sapiens
cgccagacagauugcugaua

SEQ ID NO: 1932417 - RNA, 20 nt, Homo sapiens
aacugcuuuuaaaagugcac

SEQ ID NO: 1932418 - RNA, 19 nt, Homo sapiens
agcugagaucgugccauua

SEQ ID NO: 1932419 - RNA, 18 nt, Homo sapiens
ugcuuuuguuccaauguc

SEQ ID NO: 1932420 - RNA, 13 nt, Homo sapiens
ugcaguaaucucc

SEQ ID NO: 1932421 - RNA, 23 nt, Homo sapiens
uggagaagccacaggccugagau

SEQ ID NO: 1932422 - RNA, 22 nt, Homo sapiens
cccaugccugaggacuaugcca

SEQ ID NO: 1932423 - RNA, 20 nt, Homo sapiens
aaugaauucgaugcguauuc

SEQ ID NO: 1932424 - RNA, 21 nt, Homo sapiens
gugauacuaagguggaugcca

SEQ ID NO: 1932425 - RNA, 22 nt, Homo sapiens
ccaccuaaaagagaaugaugcu

SEQ ID NO: 1932426 - RNA, 18 nt, Homo sapiens
uccuccccacuagcauuu

SEQ ID NO: 1932427 - RNA, 17 nt, Homo sapiens
ccaagucuaaugaagag

SEQ ID NO: 1932428 - RNA, 19 nt, Homo sapiens
ugauguauuguugcuuuuu

SEQ ID NO: 1932429 - RNA, 16 nt, Homo sapiens
agagcgcggcuggcuc

SEQ ID NO: 1932430 - RNA, 14 nt, Homo sapiens
agcaugagccagcu

SEQ ID NO: 1932431 - RNA, 14 nt, Homo sapiens
cuuugcacauguga

SEQ ID NO: 1932432 - RNA, 17 nt, Homo sapiens
cuucccuuuuaaacaca

SEQ ID NO: 1932433 - RNA, 17 nt, Homo sapiens
cagcugaauucacuuaa

SEQ ID NO: 1932434 - RNA, 17 nt, Homo sapiens
aggccagugugucucug

SEQ ID NO: 1932435 - RNA, 16 nt, Homo sapiens
caacaauguguuguaa

SEQ ID NO: 1932436 - RNA, 15 nt, Homo sapiens
cuuauucucacagca

SEQ ID NO: 1932437 - RNA, 20 nt, Homo sapiens
uuugucaacacaaagacaug

SEQ ID NO: 1932438 - RNA, 16 nt, Homo sapiens
caauucagacaggcaa

SEQ ID NO: 1932439 - RNA, 18 nt, Homo sapiens
ucaggccccacuccuucc

SEQ ID NO: 1932440 - RNA, 16 nt, Homo sapiens
aacuaauaggaccuca

SEQ ID NO: 1932441 - RNA, 13 nt, Homo sapiens
gcuuacugagcug

SEQ ID NO: 1932442 - RNA, 18 nt, Homo sapiens
cucccuugggcacgugug

SEQ ID NO: 1932443 - RNA, 17 nt, Homo sapiens
accucuggacuggcuag

SEQ ID NO: 1932444 - RNA, 14 nt, Homo sapiens
cucugugaaaucag

SEQ ID NO: 1932445 - RNA, 20 nt, Homo sapiens
aagauaauuuguugggccau

SEQ ID NO: 1932446 - RNA, 16 nt, Homo sapiens
ccccugggacugcugc

SEQ ID NO: 1932447 - RNA, 16 nt, Homo sapiens
gauuaaguauaucuau

SEQ ID NO: 1932448 - RNA, 14 nt, Homo sapiens
ucugcaacuccauc

SEQ ID NO: 1932449 - RNA, 16 nt, Homo sapiens
auaucaagguuucaau

SEQ ID NO: 1932450 - RNA, 18 nt, Homo sapiens
ugagcacaucucucugcc

SEQ ID NO: 1932451 - RNA, 16 nt, Homo sapiens
uugccaaucauugcaa

SEQ ID NO: 1932452 - RNA, 19 nt, Homo sapiens
auggucaaugcuagcacaa

SEQ ID NO: 1932453 - RNA, 14 nt, Homo sapiens
cugcuuuuucucag

SEQ ID NO: 1932454 - RNA, 15 nt, Homo sapiens
cuucuuccaagaaau

SEQ ID NO: 1932455 - RNA, 12 nt, Homo sapiens
uuuaaacuuuga

SEQ ID NO: 1932456 - RNA, 13 nt, Homo sapiens
ccguucucuguau

SEQ ID NO: 1932457 - RNA, 13 nt, Homo sapiens
aggcccacucugu

SEQ ID NO: 1932458 - RNA, 18 nt, Homo sapiens
gcucguguuucacagugg

SEQ ID NO: 1932459 - RNA, 17 nt, Homo sapiens
acuagccaaaccucacc

SEQ ID NO: 1932460 - RNA, 16 nt, Homo sapiens
aacuuuugacaaucaa

SEQ ID NO: 1932461 - RNA, 17 nt, Homo sapiens
aggugucuuaagccuuu

SEQ ID NO: 1932462 - RNA, 13 nt, Homo sapiens
cacuagguuucac

SEQ ID NO: 1932463 - RNA, 17 nt, Homo sapiens
cgugagacccagugcac

SEQ ID NO: 1932464 - RNA, 14 nt, Homo sapiens
gucuuucacagugg

SEQ ID NO: 1932465 - RNA, 16 nt, Homo sapiens
cuuggcccagcacugc

SEQ ID NO: 1932466 - RNA, 21 nt, Homo sapiens
auuuuagccguacuuugcuaa

SEQ ID NO: 1932467 - RNA, 19 nt, Homo sapiens
aaaucaauuauugaaacag

SEQ ID NO: 1932468 - RNA, 14 nt, Homo sapiens
gucaaaaccagagc

SEQ ID NO: 1932469 - RNA, 17 nt, Homo sapiens
uggguacugacugagau

SEQ ID NO: 1932470 - RNA, 13 nt, Homo sapiens
ugucuucagagca

SEQ ID NO: 1932471 - RNA, 13 nt, Homo sapiens
uuuuauguucuug

SEQ ID NO: 1932472 - RNA, 19 nt, Homo sapiens
acuggugucacccuggaua

SEQ ID NO: 1932473 - RNA, 20 nt, Homo sapiens
uagaggugcucauucauuua

SEQ ID NO: 1932474 - RNA, 18 nt, Homo sapiens
cuuugaucuguuugucaa

SEQ ID NO: 1932475 - RNA, 18 nt, Homo sapiens
cuuuauaauugaugaugu

SEQ ID NO: 1932476 - RNA, 18 nt, Homo sapiens
uguaugcacgugugcaca

SEQ ID NO: 1932477 - RNA, 19 nt, Homo sapiens
gcagacacucaagagcccu

SEQ ID NO: 1932478 - RNA, 22 nt, Homo sapiens
guacucagcauggucuuaugca

SEQ ID NO: 1932479 - RNA, 22 nt, Homo sapiens
uucgaaacuccauugagucauu

SEQ ID NO: 1932480 - RNA, 20 nt, Homo sapiens
agcauugccuggacugacca

SEQ ID NO: 1932481 - RNA, 22 nt, Homo sapiens
guugaguuauuaauauguuauu

SEQ ID NO: 1932482 - RNA, 20 nt, Homo sapiens
cuagaguggcagccaagagc

SEQ ID NO: 1932483 - RNA, 13 nt, Homo sapiens
gcaggagcaguuu

SEQ ID NO: 1932484 - RNA, 15 nt, Homo sapiens
gcuguuccacuucuc

SEQ ID NO: 1932485 - RNA, 21 nt, Homo sapiens
gugacagacaggcucuuagca

SEQ ID NO: 1932486 - RNA, 17 nt, Homo sapiens
ugucuugccagccagaa

SEQ ID NO: 1932487 - RNA, 14 nt, Homo sapiens
guuggagugcagug

SEQ ID NO: 1932488 - RNA, 19 nt, Homo sapiens
acccaguggacucuuccac

SEQ ID NO: 1932489 - RNA, 18 nt, Homo sapiens
augaggggccacugaccc

SEQ ID NO: 1932490 - RNA, 14 nt, Homo sapiens
uacucucccauggc

SEQ ID NO: 1932491 - RNA, 23 nt, Homo sapiens
gacagacauuuucaauaauguga

SEQ ID NO: 1932492 - RNA, 21 nt, Homo sapiens
uucuguauuuuuuguuuguau

SEQ ID NO: 1932493 - RNA, 18 nt, Homo sapiens
cagcgcagggcuggcacg

SEQ ID NO: 1932494 - RNA, 18 nt, Homo sapiens
ugagagugagguggaauu

SEQ ID NO: 1932495 - RNA, 17 nt, Homo sapiens
caguaguaccaaaugcu

SEQ ID NO: 1932496 - RNA, 15 nt, Homo sapiens
agcacauauuugcau

SEQ ID NO: 1932497 - RNA, 18 nt, Homo sapiens
acauagagugaucuuucc

SEQ ID NO: 1932498 - RNA, 14 nt, Homo sapiens
gccugucuuuccca

SEQ ID NO: 1932499 - RNA, 14 nt, Homo sapiens
uggguaguaccugu

SEQ ID NO: 1932500 - RNA, 20 nt, Homo sapiens
gcuauggggauagaugugug

SEQ ID NO: 1932501 - RNA, 14 nt, Homo sapiens
uucccucugccuga

SEQ ID NO: 1932502 - RNA, 18 nt, Homo sapiens
ccugauguuuuucugugu

SEQ ID NO: 1932503 - RNA, 20 nt, Homo sapiens
agacagggucucacucuguc

SEQ ID NO: 1932504 - RNA, 18 nt, Homo sapiens
acaauccacaauucauuc

SEQ ID NO: 1932505 - RNA, 12 nt, Homo sapiens
aaacuaagccag

SEQ ID NO: 1932506 - RNA, 15 nt, Homo sapiens
ucuucuaauuccuca

SEQ ID NO: 1932507 - RNA, 17 nt, Homo sapiens
cuauauauaauucugua

SEQ ID NO: 1932508 - RNA, 17 nt, Homo sapiens
aaacauuuuucuggaga

SEQ ID NO: 1932509 - RNA, 14 nt, Homo sapiens
auucacagcccaga

SEQ ID NO: 1932510 - RNA, 21 nt, Homo sapiens
gauucagaucgaaauuggacu

SEQ ID NO: 1932511 - RNA, 19 nt, Homo sapiens
cagcuaauaaugaaguuau

SEQ ID NO: 1932512 - RNA, 16 nt, Homo sapiens
cugaccgugggcgggg

SEQ ID NO: 1932513 - RNA, 20 nt, Homo sapiens
agagcuauugccaaccaguu

SEQ ID NO: 1932514 - RNA, 12 nt, Homo sapiens
gaauccaugcuu

SEQ ID NO: 1932515 - RNA, 23 nt, Homo sapiens
agucccuuuaugcagagccacag

SEQ ID NO: 1932516 - RNA, 17 nt, Homo sapiens
ucugguguuugucaugg

SEQ ID NO: 1932517 - RNA, 14 nt, Homo sapiens
uacaugugcacauu

SEQ ID NO: 1932518 - RNA, 14 nt, Homo sapiens
acacagaugcacac

SEQ ID NO: 1932519 - RNA, 13 nt, Homo sapiens
ccuuccagccaca

SEQ ID NO: 1932520 - RNA, 14 nt, Homo sapiens
uuggaucaggacag

SEQ ID NO: 1932521 - RNA, 19 nt, Homo sapiens
ucuguuuccaggucagaaa

SEQ ID NO: 1932522 - RNA, 20 nt, Homo sapiens
uuucacgccugaggcaauua

SEQ ID NO: 1932523 - RNA, 12 nt, Homo sapiens
gguugacauuuu

SEQ ID NO: 1932524 - RNA, 20 nt, Homo sapiens
aagcacagauuugcauuuca

SEQ ID NO: 1932525 - RNA, 13 nt, Homo sapiens
cuagauaccacuu

SEQ ID NO: 1932526 - RNA, 14 nt, Homo sapiens
uuuuaagaaagugc

SEQ ID NO: 1932527 - RNA, 19 nt, Homo sapiens
ugcacuaaagccagccuga

SEQ ID NO: 1932528 - RNA, 16 nt, Homo sapiens
aaaugagagugguuag

SEQ ID NO: 1932529 - RNA, 22 nt, Homo sapiens
accaaacugggucuucagcuuu

SEQ ID NO: 1932530 - RNA, 16 nt, Homo sapiens
acaguauuuucccaau

SEQ ID NO: 1932531 - RNA, 14 nt, Homo sapiens
agugcccuacaaag

SEQ ID NO: 1932532 - RNA, 11 nt, Homo sapiens
agacgggaccg

SEQ ID NO: 1932533 - RNA, 21 nt, Homo sapiens
ccagaaauaaagaucucagga

SEQ ID NO: 1932534 - RNA, 21 nt, Homo sapiens
acuggucuuguggaauuggga

SEQ ID NO: 1932535 - RNA, 13 nt, Homo sapiens
uagcggucaauuu

SEQ ID NO: 1932536 - RNA, 18 nt, Homo sapiens
caagcuaauaaaauauca

SEQ ID NO: 1932537 - RNA, 18 nt, Homo sapiens
ccaguuauuuauuuccaa

SEQ ID NO: 1932538 - RNA, 15 nt, Homo sapiens
caaggccagugcuaa

SEQ ID NO: 1932539 - RNA, 12 nt, Homo sapiens
cuuuucaguuug

SEQ ID NO: 1932540 - RNA, 16 nt, Homo sapiens
aaaauccaauaaucag

SEQ ID NO: 1932541 - RNA, 16 nt, Homo sapiens
cugcagagcagcagca

SEQ ID NO: 1932542 - RNA, 18 nt, Homo sapiens
gacauuaagcaucacaaa

SEQ ID NO: 1932543 - RNA, 14 nt, Homo sapiens
auaauguugucaag

SEQ ID NO: 1932544 - RNA, 18 nt, Homo sapiens
guccucacgcagacacac

SEQ ID NO: 1932545 - RNA, 17 nt, Homo sapiens
uggucccaagacaugaa

SEQ ID NO: 1932546 - RNA, 16 nt, Homo sapiens
aguccuugcuuggcug

SEQ ID NO: 1932547 - RNA, 18 nt, Homo sapiens
ucuaucuugcaucuaccu

SEQ ID NO: 1932548 - RNA, 16 nt, Homo sapiens
uucauuuugggccuug

SEQ ID NO: 1932549 - RNA, 13 nt, Homo sapiens
auggggggagcac

SEQ ID NO: 1932550 - RNA, 21 nt, Homo sapiens
acaccuguaauuccagcacuu

SEQ ID NO: 1932551 - RNA, 19 nt, Homo sapiens
ccccuaacaaagaccauga

SEQ ID NO: 1932552 - RNA, 20 nt, Homo sapiens
cagcccauggcccugugcua

SEQ ID NO: 1932553 - RNA, 22 nt, Homo sapiens
aacaaacuuccaaacagugugu

SEQ ID NO: 1932554 - RNA, 12 nt, Homo sapiens
cagauacugucu

SEQ ID NO: 1932555 - RNA, 20 nt, Homo sapiens
ccuuuguguaaagaagggaa

SEQ ID NO: 1932556 - RNA, 15 nt, Homo sapiens
ggugcaguagugagc

SEQ ID NO: 1932557 - RNA, 16 nt, Homo sapiens
ccugcaccaugcugcu

SEQ ID NO: 1932558 - RNA, 13 nt, Homo sapiens
ugcccuuacccca

SEQ ID NO: 1932559 - RNA, 15 nt, Homo sapiens
uguugaguauuugcu

SEQ ID NO: 1932560 - RNA, 18 nt, Homo sapiens
ccuguagcgccaguguaa

SEQ ID NO: 1932561 - RNA, 18 nt, Homo sapiens
ucuaaccaaagguuuugc

SEQ ID NO: 1932562 - RNA, 17 nt, Homo sapiens
uccugugacacuuauaa

SEQ ID NO: 1932563 - RNA, 17 nt, Homo sapiens
ggcacauuccccuugcc

SEQ ID NO: 1932564 - RNA, 16 nt, Homo sapiens
aauuuuuugguacaaa

SEQ ID NO: 1932565 - RNA, 22 nt, Homo sapiens
cagaguaguccagguguucucc

SEQ ID NO: 1932566 - RNA, 16 nt, Homo sapiens
uaauuuuauuccagac

SEQ ID NO: 1932567 - RNA, 21 nt, Homo sapiens
caccugggagaaggucuccaa

SEQ ID NO: 1932568 - RNA, 14 nt, Homo sapiens
cagcacaaccuuca

SEQ ID NO: 1932569 - RNA, 21 nt, Homo sapiens
guaaauauuuguuacuuuuag

SEQ ID NO: 1932570 - RNA, 16 nt, Homo sapiens
acaauaaaacauuccu

SEQ ID NO: 1932571 - RNA, 15 nt, Homo sapiens
caaaucaaccccaga

SEQ ID NO: 1932572 - RNA, 16 nt, Homo sapiens
cuucauaucaucacaa

SEQ ID NO: 1932573 - RNA, 16 nt, Homo sapiens
gauuuccaguuuuucu

SEQ ID NO: 1932574 - RNA, 13 nt, Homo sapiens
acgaggugcagua

SEQ ID NO: 1932575 - RNA, 21 nt, Homo sapiens
cgggaaaauaaaccacugguc

SEQ ID NO: 1932576 - RNA, 16 nt, Homo sapiens
gaugcugauacuucua

SEQ ID NO: 1932577 - RNA, 19 nt, Homo sapiens
acaaaaaacuaucaacuac

SEQ ID NO: 1932578 - RNA, 19 nt, Homo sapiens
cucaguaaaucagugcagu

SEQ ID NO: 1932579 - RNA, 16 nt, Homo sapiens
ugaaaucagcaugaca

SEQ ID NO: 1932580 - RNA, 24 nt, Homo sapiens
acaccucccccuuucacacuggau

SEQ ID NO: 1932581 - RNA, 16 nt, Homo sapiens
aauguuaaagaacugc

SEQ ID NO: 1932582 - RNA, 21 nt, Homo sapiens
aggauggcguguccccugccu

SEQ ID NO: 1932583 - RNA, 18 nt, Homo sapiens
acucuuguggucaucaug

SEQ ID NO: 1932584 - RNA, 20 nt, Homo sapiens
uugucaagucagaacagcca

SEQ ID NO: 1932585 - RNA, 22 nt, Homo sapiens
gugauuauuuuuuauacuguau

SEQ ID NO: 1932586 - RNA, 16 nt, Homo sapiens
accuuggacauccucc

SEQ ID NO: 1932587 - RNA, 23 nt, Homo sapiens
cuauugacaucagcaucaccuag

SEQ ID NO: 1932588 - RNA, 12 nt, Homo sapiens
ccauacugagcc

SEQ ID NO: 1932589 - RNA, 21 nt, Homo sapiens
gacacccacucuccugugaga

SEQ ID NO: 1932590 - RNA, 19 nt, Homo sapiens
aauacaauauuaaguccaa

SEQ ID NO: 1932591 - RNA, 18 nt, Homo sapiens
aguauuguggggcucaua

SEQ ID NO: 1932592 - RNA, 18 nt, Homo sapiens
uauguucaaagacuguga

SEQ ID NO: 1932593 - RNA, 17 nt, Homo sapiens
cagccugccucugccac

SEQ ID NO: 1932594 - RNA, 20 nt, Homo sapiens
auuaauaaaagaguuaacau

SEQ ID NO: 1932595 - RNA, 16 nt, Homo sapiens
augaauguaauuuuga

SEQ ID NO: 1932596 - RNA, 16 nt, Homo sapiens
gauaaauaguguuauu

SEQ ID NO: 1932597 - RNA, 20 nt, Homo sapiens
gcgaucucagcucaccucaa

SEQ ID NO: 1932598 - RNA, 16 nt, Homo sapiens
cagaagcaguaauaau

SEQ ID NO: 1932599 - RNA, 14 nt, Homo sapiens
aggccagugucugg

SEQ ID NO: 1932600 - RNA, 22 nt, Homo sapiens
gagaccccuuguugcacugccc

SEQ ID NO: 1932601 - RNA, 18 nt, Homo sapiens
cagccuugcaacccaagg

SEQ ID NO: 1932602 - RNA, 19 nt, Homo sapiens
cuggggcuuuugugccagg

SEQ ID NO: 1932603 - RNA, 19 nt, Homo sapiens
cccugucccuucgagucca

SEQ ID NO: 1932604 - RNA, 23 nt, Homo sapiens
ucugccuuaaacacacauugcag

SEQ ID NO: 1932605 - RNA, 22 nt, Homo sapiens
cauuguuuaucgcaauuacuug

SEQ ID NO: 1932606 - RNA, 13 nt, Homo sapiens
caacagagcaaaa

SEQ ID NO: 1932607 - RNA, 20 nt, Homo sapiens
acuauauuuauugauuucaa

SEQ ID NO: 1932608 - RNA, 20 nt, Homo sapiens
aggcugcgacugaugaaggc

SEQ ID NO: 1932609 - RNA, 20 nt, Homo sapiens
gcaaagcaaauguugggaaa

SEQ ID NO: 1932610 - RNA, 20 nt, Homo sapiens
uuuagacuuccuguaggggg

SEQ ID NO: 1932611 - RNA, 18 nt, Homo sapiens
uugacauuuguuugguua

SEQ ID NO: 1932612 - RNA, 14 nt, Homo sapiens
ugggaaaguggagu

SEQ ID NO: 1932613 - RNA, 15 nt, Homo sapiens
uagggaugugugaga

SEQ ID NO: 1932614 - RNA, 21 nt, Homo sapiens
ugcacuuugugaguauucuau

SEQ ID NO: 1932615 - RNA, 22 nt, Homo sapiens
aaagauucuuuaaacuacugaa

SEQ ID NO: 1932616 - RNA, 22 nt, Homo sapiens
gcacuuggaaagguuucaagac

SEQ ID NO: 1932617 - RNA, 19 nt, Homo sapiens
aggagcccagcggcccaag

SEQ ID NO: 1932618 - RNA, 16 nt, Homo sapiens
gcuugggaucuucaau

SEQ ID NO: 1932619 - RNA, 14 nt, Homo sapiens
auuuucccuucccu

SEQ ID NO: 1932620 - RNA, 21 nt, Homo sapiens
gcacagagucaggaucucaca

SEQ ID NO: 1932621 - RNA, 14 nt, Homo sapiens
uuggcccaccugag

SEQ ID NO: 1932622 - RNA, 16 nt, Homo sapiens
augauuagcuuuguca

SEQ ID NO: 1932623 - RNA, 18 nt, Homo sapiens
gcucaaguugaugaauca

SEQ ID NO: 1932624 - RNA, 22 nt, Homo sapiens
uauauaaaauacacguguauau

SEQ ID NO: 1932625 - RNA, 13 nt, Homo sapiens
aguccaacugaac

SEQ ID NO: 1932626 - RNA, 16 nt, Homo sapiens
auacaguggaucucaa

SEQ ID NO: 1932627 - RNA, 12 nt, Homo sapiens
aauucagcucuu

SEQ ID NO: 1932628 - RNA, 13 nt, Homo sapiens
auuuacaaauguu

SEQ ID NO: 1932629 - RNA, 17 nt, Homo sapiens
aggcugggccaugucca

SEQ ID NO: 1932630 - RNA, 16 nt, Homo sapiens
cauuguacuagcugua

SEQ ID NO: 1932631 - RNA, 13 nt, Homo sapiens
ucaaaaagccacu

SEQ ID NO: 1932632 - RNA, 17 nt, Homo sapiens
auuuaauauuacagaua

SEQ ID NO: 1932633 - RNA, 21 nt, Homo sapiens
aauuagccuugauauucucca

SEQ ID NO: 1932634 - RNA, 19 nt, Homo sapiens
agacuguggcuagugacaa

SEQ ID NO: 1932635 - RNA, 22 nt, Homo sapiens
uuugaaaaacauacauuaucaa

SEQ ID NO: 1932636 - RNA, 15 nt, Homo sapiens
uacaaacacuacaga

SEQ ID NO: 1932637 - RNA, 19 nt, Homo sapiens
gucaaaaccagagcgagaa

SEQ ID NO: 1932638 - RNA, 18 nt, Homo sapiens
uguucuuacuguaacuac

SEQ ID NO: 1932639 - RNA, 15 nt, Homo sapiens
gacugagcucaaggu

SEQ ID NO: 1932640 - RNA, 17 nt, Homo sapiens
auaguagucucugugag

SEQ ID NO: 1932641 - RNA, 13 nt, Homo sapiens
accacugagcucu

SEQ ID NO: 1932642 - RNA, 20 nt, Homo sapiens
cuuucauaaacuucagggau

SEQ ID NO: 1932643 - RNA, 17 nt, Homo sapiens
auguauacgcacgcacc

SEQ ID NO: 1932644 - RNA, 20 nt, Homo sapiens
aggcccucugccugcacucc

SEQ ID NO: 1932645 - RNA, 22 nt, Homo sapiens
gcagguaccgugcucauugcua

SEQ ID NO: 1932646 - RNA, 13 nt, Homo sapiens
cauguguauuucc

SEQ ID NO: 1932647 - RNA, 14 nt, Homo sapiens
guauaugacugcau

SEQ ID NO: 1932648 - RNA, 22 nt, Homo sapiens
ccagccaucaaauagugaaugg

SEQ ID NO: 1932649 - RNA, 18 nt, Homo sapiens
caugauuucauguacugc

SEQ ID NO: 1932650 - RNA, 21 nt, Homo sapiens
gcccccagauagagcugggug

SEQ ID NO: 1932651 - RNA, 20 nt, Homo sapiens
ugaaagcaaccuucuugccu

SEQ ID NO: 1932652 - RNA, 15 nt, Homo sapiens
aaucuaaaucuucag

SEQ ID NO: 1932653 - RNA, 19 nt, Homo sapiens
uauuuuaagaauuucacaa

SEQ ID NO: 1932654 - RNA, 16 nt, Homo sapiens
gcuucugugcaauaaa

SEQ ID NO: 1932655 - RNA, 22 nt, Homo sapiens
cuuccaucccaaccagugccaa

SEQ ID NO: 1932656 - RNA, 17 nt, Homo sapiens
gccuuuguucacuguga

SEQ ID NO: 1932657 - RNA, 17 nt, Homo sapiens
acccuugugcauugugu

SEQ ID NO: 1932658 - RNA, 23 nt, Homo sapiens
ugccugcccccacacccacucca

SEQ ID NO: 1932659 - RNA, 22 nt, Homo sapiens
uaaguuuuaggguacaugugca

SEQ ID NO: 1932660 - RNA, 14 nt, Homo sapiens
uuaaucaugagaua

SEQ ID NO: 1932661 - RNA, 21 nt, Homo sapiens
ucccucugugucacuguaugu

SEQ ID NO: 1932662 - RNA, 14 nt, Homo sapiens
aaacugaacauauu

SEQ ID NO: 1932663 - RNA, 17 nt, Homo sapiens
aaucaugcuguguaaua

SEQ ID NO: 1932664 - RNA, 17 nt, Homo sapiens
ucaggagcuugcaagaa

SEQ ID NO: 1932665 - RNA, 19 nt, Homo sapiens
ccaaugacuuuuuauuuua

SEQ ID NO: 1932666 - RNA, 15 nt, Homo sapiens
uggaauuacugccuu

SEQ ID NO: 1932667 - RNA, 17 nt, Homo sapiens
aaaugaccccacugcag

SEQ ID NO: 1932668 - RNA, 14 nt, Homo sapiens
ucauuuugcacuga

SEQ ID NO: 1932669 - RNA, 18 nt, Homo sapiens
cuuauuuaaagcuuucaa

SEQ ID NO: 1932670 - RNA, 12 nt, Homo sapiens
ccaaaacacaga

SEQ ID NO: 1932671 - RNA, 15 nt, Homo sapiens
ggaggacgcucucug

SEQ ID NO: 1932672 - RNA, 20 nt, Homo sapiens
gacuaaccucuaacaacaaa

SEQ ID NO: 1932673 - RNA, 17 nt, Homo sapiens
ucaauacacaguacuuc

SEQ ID NO: 1932674 - RNA, 21 nt, Homo sapiens
gaacuccaggucuaaacagcu

SEQ ID NO: 1932675 - RNA, 12 nt, Homo sapiens
uuuauauaugaa

SEQ ID NO: 1932676 - RNA, 17 nt, Homo sapiens
ggacucaucaaagccuu

SEQ ID NO: 1932677 - RNA, 18 nt, Homo sapiens
caacacuggugacuccag

SEQ ID NO: 1932678 - RNA, 23 nt, Homo sapiens
aacucaaggacagccaccaagaa

SEQ ID NO: 1932679 - RNA, 13 nt, Homo sapiens
aggcuaugccauc

SEQ ID NO: 1932680 - RNA, 16 nt, Homo sapiens
aagagcuuaacagugu

SEQ ID NO: 1932681 - RNA, 14 nt, Homo sapiens
acucccucugggaa

SEQ ID NO: 1932682 - RNA, 12 nt, Homo sapiens
caaacauauaac

SEQ ID NO: 1932683 - RNA, 21 nt, Homo sapiens
uggcucucuccaggauccaga

SEQ ID NO: 1932684 - RNA, 17 nt, Homo sapiens
agggagugggcuaagca

SEQ ID NO: 1932685 - RNA, 23 nt, Homo sapiens
ccuauggguugucaauaguauua

SEQ ID NO: 1932686 - RNA, 15 nt, Homo sapiens
aaaauccuaaggaac

SEQ ID NO: 1932687 - RNA, 23 nt, Homo sapiens
gaugauucuuccagauaaugucc

SEQ ID NO: 1932688 - RNA, 18 nt, Homo sapiens
gucugccaaaaugcaaca

SEQ ID NO: 1932689 - RNA, 22 nt, Homo sapiens
caucaguguccucuugcucaaa

SEQ ID NO: 1932690 - RNA, 13 nt, Homo sapiens
gucaucugugcac

SEQ ID NO: 1932691 - RNA, 22 nt, Homo sapiens
aaaucucacuuuucuccaugag

SEQ ID NO: 1932692 - RNA, 14 nt, Homo sapiens
ugacuggccugcug

SEQ ID NO: 1932693 - RNA, 14 nt, Homo sapiens
aauagaaacauauc

SEQ ID NO: 1932694 - RNA, 18 nt, Homo sapiens
acagcagauuucagauca

SEQ ID NO: 1932695 - RNA, 13 nt, Homo sapiens
cauccaugugcua

SEQ ID NO: 1932696 - RNA, 16 nt, Homo sapiens
ggccauuaccaucucu

SEQ ID NO: 1932697 - RNA, 17 nt, Homo sapiens
cucucaggugaccaaaa

SEQ ID NO: 1932698 - RNA, 15 nt, Homo sapiens
agcccccacuccagu

SEQ ID NO: 1932699 - RNA, 19 nt, Homo sapiens
cuccuugggaggccccacu

SEQ ID NO: 1932700 - RNA, 18 nt, Homo sapiens
ggcaucaguagcaucugu

SEQ ID NO: 1932701 - RNA, 13 nt, Homo sapiens
gacauuccagggg

SEQ ID NO: 1932702 - RNA, 22 nt, Homo sapiens
ccaaacccagccucuagaacag

SEQ ID NO: 1932703 - RNA, 13 nt, Homo sapiens
aggaaaaugggua

SEQ ID NO: 1932704 - RNA, 13 nt, Homo sapiens
aauaaaaugauua

SEQ ID NO: 1932705 - RNA, 18 nt, Homo sapiens
uaaacugggggauauuau

SEQ ID NO: 1932706 - RNA, 17 nt, Homo sapiens
auuuucauucugccaaa

SEQ ID NO: 1932707 - RNA, 20 nt, Homo sapiens
augaauaugaugacaaucag

SEQ ID NO: 1932708 - RNA, 15 nt, Homo sapiens
ccaaauguccuuaaa

SEQ ID NO: 1932709 - RNA, 20 nt, Homo sapiens
gcugaagacaaaccacugua

SEQ ID NO: 1932710 - RNA, 14 nt, Homo sapiens
uugugaucucacac

SEQ ID NO: 1932711 - RNA, 18 nt, Homo sapiens
ucauuuccggacucucug

SEQ ID NO: 1932712 - RNA, 15 nt, Homo sapiens
uuaacagaaccagag

SEQ ID NO: 1932713 - RNA, 18 nt, Homo sapiens
aagagagggacaggcacu

SEQ ID NO: 1932714 - RNA, 21 nt, Homo sapiens
cuacucagccuagcacaggcu

SEQ ID NO: 1932715 - RNA, 19 nt, Homo sapiens
uucuggaagcuaccaaaaa

SEQ ID NO: 1932716 - RNA, 15 nt, Homo sapiens
aaauuuugagauuaa

SEQ ID NO: 1932717 - RNA, 11 nt, Homo sapiens
uacucagucag

SEQ ID NO: 1932718 - RNA, 12 nt, Homo sapiens
aaaugcagucau

SEQ ID NO: 1932719 - RNA, 22 nt, Homo sapiens
cagaugccuggacagaggacaa

SEQ ID NO: 1932720 - RNA, 19 nt, Homo sapiens
cugauaaugaaaauuauga

SEQ ID NO: 1932721 - RNA, 16 nt, Homo sapiens
guuuggaaaccacagu

SEQ ID NO: 1932722 - RNA, 14 nt, Homo sapiens
guaagacaggccag

SEQ ID NO: 1932723 - RNA, 19 nt, Homo sapiens
acuuuugcuuucuaccuga

SEQ ID NO: 1932724 - RNA, 15 nt, Homo sapiens
ggucgggacagcugu

SEQ ID NO: 1932725 - RNA, 17 nt, Homo sapiens
uagauauaacacuaugu

SEQ ID NO: 1932726 - RNA, 23 nt, Homo sapiens
ugguuuuuuuuuuuuugagacag

SEQ ID NO: 1932727 - RNA, 13 nt, Homo sapiens
ccggaggucauga

SEQ ID NO: 1932728 - RNA, 14 nt, Homo sapiens
cacaaauauaguug

SEQ ID NO: 1932729 - RNA, 13 nt, Homo sapiens
agcaugugucaga

SEQ ID NO: 1932730 - RNA, 15 nt, Homo sapiens
cagauguacacccac

SEQ ID NO: 1932731 - RNA, 18 nt, Homo sapiens
aggaacccaauuuucuua

SEQ ID NO: 1932732 - RNA, 17 nt, Homo sapiens
uaugauaaauauaacau

SEQ ID NO: 1932733 - RNA, 19 nt, Homo sapiens
guaaagccagccaugcauu

SEQ ID NO: 1932734 - RNA, 13 nt, Homo sapiens
acaaaaauuagcu

SEQ ID NO: 1932735 - RNA, 19 nt, Homo sapiens
auauuuauaaaugagcaaa

SEQ ID NO: 1932736 - RNA, 22 nt, Homo sapiens
guggcccucucuuaaugccacg

SEQ ID NO: 1932737 - RNA, 21 nt, Homo sapiens
augauucagaggucacuucau

SEQ ID NO: 1932738 - RNA, 23 nt, Homo sapiens
uaaguaucucaacaacaugucaa

SEQ ID NO: 1932739 - RNA, 21 nt, Homo sapiens
uucaagguaacuguacugggc

SEQ ID NO: 1932740 - RNA, 20 nt, Homo sapiens
uacaaauuuggccuuaagaa

SEQ ID NO: 1932741 - RNA, 22 nt, Homo sapiens
aaagcuuuauuaccaguggcgu

SEQ ID NO: 1932742 - RNA, 15 nt, Homo sapiens
aagaggcuacuguaa

SEQ ID NO: 1932743 - RNA, 22 nt, Homo sapiens
aacccacaagcugccucugaca

SEQ ID NO: 1932744 - RNA, 21 nt, Homo sapiens
caacucaacuaggcucauacu

SEQ ID NO: 1932745 - RNA, 17 nt, Homo sapiens
auuaauacucugcagug

SEQ ID NO: 1932746 - RNA, 22 nt, Homo sapiens
ugagcugcaacuucuuacuucc

SEQ ID NO: 1932747 - RNA, 16 nt, Homo sapiens
acaguguacaaugccu

SEQ ID NO: 1932748 - RNA, 15 nt, Homo sapiens
ggggcacagcugucu

SEQ ID NO: 1932749 - RNA, 12 nt, Homo sapiens
gcaacuaacuaa

SEQ ID NO: 1932750 - RNA, 15 nt, Homo sapiens
auguaauuuaugcaa

SEQ ID NO: 1932751 - RNA, 20 nt, Homo sapiens
agucuucugguuuucuagcc

SEQ ID NO: 1932752 - RNA, 13 nt, Homo sapiens
uccucugcuugcc

SEQ ID NO: 1932753 - RNA, 13 nt, Homo sapiens
agaucccaacacu

SEQ ID NO: 1932754 - RNA, 22 nt, Homo sapiens
cggaugugugucucaccccuca

SEQ ID NO: 1932755 - RNA, 16 nt, Homo sapiens
aguggggugcucuggu

SEQ ID NO: 1932756 - RNA, 14 nt, Homo sapiens
uuaccaaguacaaa

SEQ ID NO: 1932757 - RNA, 18 nt, Homo sapiens
auguuacaccagccuuuc

SEQ ID NO: 1932758 - RNA, 22 nt, Homo sapiens
cucauuguagaaaagcuauaaa

SEQ ID NO: 1932759 - RNA, 14 nt, Homo sapiens
gccacuuuccucuu

SEQ ID NO: 1932760 - RNA, 17 nt, Homo sapiens
uguguccaugugugugc

SEQ ID NO: 1932761 - RNA, 21 nt, Homo sapiens
augucacugccugacauucac

SEQ ID NO: 1932762 - RNA, 22 nt, Homo sapiens
acaauggcgugaucucagcuca

SEQ ID NO: 1932763 - RNA, 17 nt, Homo sapiens
gagggggaguagccaag

SEQ ID NO: 1932764 - RNA, 17 nt, Homo sapiens
auuuggacuugcugaau

SEQ ID NO: 1932765 - RNA, 16 nt, Homo sapiens
acgucaaacaugaagu

SEQ ID NO: 1932766 - RNA, 18 nt, Homo sapiens
cuucucaucauauuguau

SEQ ID NO: 1932767 - RNA, 14 nt, Homo sapiens
cugggcuggcacug

SEQ ID NO: 1932768 - RNA, 15 nt, Homo sapiens
cauccugguuuccac

SEQ ID NO: 1932769 - RNA, 15 nt, Homo sapiens
gacaaggaagcagag

SEQ ID NO: 1932770 - RNA, 15 nt, Homo sapiens
agggagaagagggaa

SEQ ID NO: 1932771 - RNA, 22 nt, Homo sapiens
cacguugugaugaagcugaggc

SEQ ID NO: 1932772 - RNA, 22 nt, Homo sapiens
uuagcucuguucuuuauaacaa

SEQ ID NO: 1932773 - RNA, 16 nt, Homo sapiens
cuugauuagaccuaau

SEQ ID NO: 1932774 - RNA, 18 nt, Homo sapiens
ugcugcugcccccaccuc

SEQ ID NO: 1932775 - RNA, 23 nt, Homo sapiens
gcccucuaugguguggcaaagcc

SEQ ID NO: 1932776 - RNA, 20 nt, Homo sapiens
gagcuuguaauaaauacugc

SEQ ID NO: 1932777 - RNA, 22 nt, Homo sapiens
cagcuuguuuacaugcuuauuc

SEQ ID NO: 1932778 - RNA, 23 nt, Homo sapiens
auucacaaaugggaucuaauuaa

SEQ ID NO: 1932779 - RNA, 20 nt, Homo sapiens
augaaguggaaaaaggagag

SEQ ID NO: 1932780 - RNA, 17 nt, Homo sapiens
cucuggggucuuuuuau

SEQ ID NO: 1932781 - RNA, 17 nt, Homo sapiens
uuaaauauuucugcaca

SEQ ID NO: 1932782 - RNA, 22 nt, Homo sapiens
aacagugccuggcacacaguaa

SEQ ID NO: 1932783 - RNA, 16 nt, Homo sapiens
ucaacuuuugaccaaa

SEQ ID NO: 1932784 - RNA, 21 nt, Homo sapiens
uucauucaggcaacgcacaaa

SEQ ID NO: 1932785 - RNA, 13 nt, Homo sapiens
ucuggaugcauuu

SEQ ID NO: 1932786 - RNA, 13 nt, Homo sapiens
cauguaugucuug

SEQ ID NO: 1932787 - RNA, 14 nt, Homo sapiens
gucacagccaugaa

SEQ ID NO: 1932788 - RNA, 21 nt, Homo sapiens
gacagccaagggcagaucaca

SEQ ID NO: 1932789 - RNA, 18 nt, Homo sapiens
uccuguugaaaagccaug

SEQ ID NO: 1932790 - RNA, 13 nt, Homo sapiens
gccaacugcugau

SEQ ID NO: 1932791 - RNA, 18 nt, Homo sapiens
cugcugagagggcugcug

SEQ ID NO: 1932792 - RNA, 14 nt, Homo sapiens
auacaaacaagcac

SEQ ID NO: 1932793 - RNA, 15 nt, Homo sapiens
acagucuggugcuug

SEQ ID NO: 1932794 - RNA, 19 nt, Homo sapiens
auaauaaauuaacauuaua

SEQ ID NO: 1932795 - RNA, 20 nt, Homo sapiens
gcucaucagaaacucaaaag

SEQ ID NO: 1932796 - RNA, 23 nt, Homo sapiens
auaucuucaggacuauuucacua

SEQ ID NO: 1932797 - RNA, 23 nt, Homo sapiens
cuucaaggcucuucuuccucacc

SEQ ID NO: 1932798 - RNA, 13 nt, Homo sapiens
cuugaaaguuuuc

SEQ ID NO: 1932799 - RNA, 22 nt, Homo sapiens
cuugcacucacaacggacacuu

SEQ ID NO: 1932800 - RNA, 13 nt, Homo sapiens
ggcuucaaggaug

SEQ ID NO: 1932801 - RNA, 20 nt, Homo sapiens
augcuuauaagcaacaugaa

SEQ ID NO: 1932802 - RNA, 21 nt, Homo sapiens
aucugccggcccccaggacaa

SEQ ID NO: 1932803 - RNA, 12 nt, Homo sapiens
auggugcugaau

SEQ ID NO: 1932804 - RNA, 19 nt, Homo sapiens
caguuguggugugccaugc

SEQ ID NO: 1932805 - RNA, 20 nt, Homo sapiens
cuaacuuacaaagauucucu

SEQ ID NO: 1932806 - RNA, 20 nt, Homo sapiens
aagaucgccuggcucaguca

SEQ ID NO: 1932807 - RNA, 14 nt, Homo sapiens
cuugaagguggcua

SEQ ID NO: 1932808 - RNA, 13 nt, Homo sapiens
ucccaaagcacaa

SEQ ID NO: 1932809 - RNA, 20 nt, Homo sapiens
cuccauagagcagugcacau

SEQ ID NO: 1932810 - RNA, 13 nt, Homo sapiens
cuguuagcaauau

SEQ ID NO: 1932811 - RNA, 20 nt, Homo sapiens
accacuauucuuaacuauuc

SEQ ID NO: 1932812 - RNA, 21 nt, Homo sapiens
ucuucccaccucagugcccac

SEQ ID NO: 1932813 - RNA, 15 nt, Homo sapiens
ugaauuuuugcaaua

SEQ ID NO: 1932814 - RNA, 13 nt, Homo sapiens
uuuucucucugga

SEQ ID NO: 1932815 - RNA, 17 nt, Homo sapiens
gaacuuggcacacucuc

SEQ ID NO: 1932816 - RNA, 18 nt, Homo sapiens
caaaagggcagcugugau

SEQ ID NO: 1932817 - RNA, 19 nt, Homo sapiens
agagacugaaaacuugccg

SEQ ID NO: 1932818 - RNA, 21 nt, Homo sapiens
uccuagauuacaucugccuua

SEQ ID NO: 1932819 - RNA, 21 nt, Homo sapiens
gugggaaugugguaguaccca

SEQ ID NO: 1932820 - RNA, 14 nt, Homo sapiens
uaauuacagccuua

SEQ ID NO: 1932821 - RNA, 14 nt, Homo sapiens
aucuacagaacugg

SEQ ID NO: 1932822 - RNA, 21 nt, Homo sapiens
aucuccugacagaaggugcca

SEQ ID NO: 1932823 - RNA, 18 nt, Homo sapiens
ucuuuucuccuuuaccag

SEQ ID NO: 1932824 - RNA, 23 nt, Homo sapiens
acuaacugaggagcuaguguuaa

SEQ ID NO: 1932825 - RNA, 13 nt, Homo sapiens
agucuucuguaua

SEQ ID NO: 1932826 - RNA, 21 nt, Homo sapiens
ucuguaguuauucugaugaua

SEQ ID NO: 1932827 - RNA, 15 nt, Homo sapiens
ccuuugcaaugcaag

SEQ ID NO: 1932828 - RNA, 22 nt, Homo sapiens
cuuagcuauccuuggcuuucag

SEQ ID NO: 1932829 - RNA, 14 nt, Homo sapiens
aagcuugucaaaga

SEQ ID NO: 1932830 - RNA, 20 nt, Homo sapiens
cacacacgugcgugcgagca

SEQ ID NO: 1932831 - RNA, 22 nt, Homo sapiens
auauuccauauauuagcauuua

SEQ ID NO: 1932832 - RNA, 19 nt, Homo sapiens
auggaugggggaacucaga

SEQ ID NO: 1932833 - RNA, 16 nt, Homo sapiens
uaauucauggcauuga

SEQ ID NO: 1932834 - RNA, 19 nt, Homo sapiens
aggguuucugagcugcucu

SEQ ID NO: 1932835 - RNA, 14 nt, Homo sapiens
caucuuuaacacaa

SEQ ID NO: 1932836 - RNA, 14 nt, Homo sapiens
acauuuuacauuaa

SEQ ID NO: 1932837 - RNA, 15 nt, Homo sapiens
aagaucacaccacua

SEQ ID NO: 1932838 - RNA, 17 nt, Homo sapiens
ugugugaacacgugugu

SEQ ID NO: 1932839 - RNA, 22 nt, Homo sapiens
gcaaaagugcaguagugucacu

SEQ ID NO: 1932840 - RNA, 22 nt, Homo sapiens
cugacacggccucccucugcua

SEQ ID NO: 1932841 - RNA, 19 nt, Homo sapiens
augagacaggaaaaaccaa

SEQ ID NO: 1932842 - RNA, 21 nt, Homo sapiens
agugcauauuccuuucuauca

SEQ ID NO: 1932843 - RNA, 15 nt, Homo sapiens
caaaaccucaugaca

SEQ ID NO: 1932844 - RNA, 18 nt, Homo sapiens
uuuccccaccuuccuuac

SEQ ID NO: 1932845 - RNA, 21 nt, Homo sapiens
uuauauaggcauuucacaaaa

SEQ ID NO: 1932846 - RNA, 19 nt, Homo sapiens
gucucucucuucucucuag

SEQ ID NO: 1932847 - RNA, 13 nt, Homo sapiens
cauaguccagaga

SEQ ID NO: 1932848 - RNA, 15 nt, Homo sapiens
auacauaggcaucau

SEQ ID NO: 1932849 - RNA, 17 nt, Homo sapiens
uagaauggggcuuccau

SEQ ID NO: 1932850 - RNA, 14 nt, Homo sapiens
aauuucauuuuccu

SEQ ID NO: 1932851 - RNA, 19 nt, Homo sapiens
ugaaucacaacgggccagc

SEQ ID NO: 1932852 - RNA, 16 nt, Homo sapiens
cucuuccacauuccca

SEQ ID NO: 1932853 - RNA, 11 nt, Homo sapiens
uggacaugggc

SEQ ID NO: 1932854 - RNA, 20 nt, Homo sapiens
uguauaaaauguaacacuga

SEQ ID NO: 1932855 - RNA, 22 nt, Homo sapiens
aaguagaucugcuuucuguuca

SEQ ID NO: 1932856 - RNA, 19 nt, Homo sapiens
agaugugauauucuaagac

SEQ ID NO: 1932857 - RNA, 13 nt, Homo sapiens
gaaacacuaaaga

SEQ ID NO: 1932858 - RNA, 18 nt, Homo sapiens
aguggcccugauccagga

SEQ ID NO: 1932859 - RNA, 12 nt, Homo sapiens
aacacauuucaa

SEQ ID NO: 1932860 - RNA, 14 nt, Homo sapiens
aagaauagcuuuaa

SEQ ID NO: 1932861 - RNA, 14 nt, Homo sapiens
cccaucuggaugua

SEQ ID NO: 1932862 - RNA, 16 nt, Homo sapiens
guaaccaaaacagcau

SEQ ID NO: 1932863 - RNA, 19 nt, Homo sapiens
auagaagaugaaucauuga

SEQ ID NO: 1932864 - RNA, 15 nt, Homo sapiens
uuugaaaacauacac

SEQ ID NO: 1932865 - RNA, 18 nt, Homo sapiens
aucuaaagccaguggcag

SEQ ID NO: 1932866 - RNA, 15 nt, Homo sapiens
cuucauccaauguga

SEQ ID NO: 1932867 - RNA, 23 nt, Homo sapiens
uauugcuaauauaauagaugaca

SEQ ID NO: 1932868 - RNA, 14 nt, Homo sapiens
uguacccugcugua

SEQ ID NO: 1932869 - RNA, 16 nt, Homo sapiens
cuagguaauuugccac

SEQ ID NO: 1932870 - RNA, 13 nt, Homo sapiens
uccccuugucugc

SEQ ID NO: 1932871 - RNA, 22 nt, Homo sapiens
aacacacaccaauuggaugaua

SEQ ID NO: 1932872 - RNA, 21 nt, Homo sapiens
uguucagucacaugugcucuc

SEQ ID NO: 1932873 - RNA, 14 nt, Homo sapiens
ucuacgccagggga

SEQ ID NO: 1932874 - RNA, 20 nt, Homo sapiens
aauuacccauaaacagcaca

SEQ ID NO: 1932875 - RNA, 16 nt, Homo sapiens
uaagaaauuucuaguu

SEQ ID NO: 1932876 - RNA, 17 nt, Homo sapiens
gcuaggaagaacuugaa

SEQ ID NO: 1932877 - RNA, 23 nt, Homo sapiens
auuucucccuguuauaagcagca

SEQ ID NO: 1932878 - RNA, 16 nt, Homo sapiens
aaagaaugcucuuuac

SEQ ID NO: 1932879 - RNA, 15 nt, Homo sapiens
auccagcucaucccc

SEQ ID NO: 1932880 - RNA, 14 nt, Homo sapiens
uauaguuuugucac

SEQ ID NO: 1932881 - RNA, 20 nt, Homo sapiens
guguuggaaaaugugcaaua

SEQ ID NO: 1932882 - RNA, 14 nt, Homo sapiens
ugacgcacugcuca

SEQ ID NO: 1932883 - RNA, 18 nt, Homo sapiens
ugugccuuccagauccuc

SEQ ID NO: 1932884 - RNA, 17 nt, Homo sapiens
uaccuaguggcccuuca

SEQ ID NO: 1932885 - RNA, 12 nt, Homo sapiens
uugcauauguau

SEQ ID NO: 1932886 - RNA, 20 nt, Homo sapiens
aguacccuuggccuuuacag

SEQ ID NO: 1932887 - RNA, 11 nt, Homo sapiens
cuccugccauu

SEQ ID NO: 1932888 - RNA, 20 nt, Homo sapiens
agggggccaggcgguggcuu

SEQ ID NO: 1932889 - RNA, 16 nt, Homo sapiens
cagcccaacugugaga

SEQ ID NO: 1932890 - RNA, 11 nt, Homo sapiens
uaagugcugcu

SEQ ID NO: 1932891 - RNA, 16 nt, Homo sapiens
aagaaggagcugagaa

SEQ ID NO: 1932892 - RNA, 15 nt, Homo sapiens
caaagaaagaugaaa

SEQ ID NO: 1932893 - RNA, 22 nt, Homo sapiens
uucuguucaacauguaccucac

SEQ ID NO: 1932894 - RNA, 18 nt, Homo sapiens
caaauacacauacauaua

SEQ ID NO: 1932895 - RNA, 11 nt, Homo sapiens
ucgggaaaauu

SEQ ID NO: 1932896 - RNA, 20 nt, Homo sapiens
gcaugcccuccccacuuccc

SEQ ID NO: 1932897 - RNA, 14 nt, Homo sapiens
guguaaguaauuau

SEQ ID NO: 1932898 - RNA, 14 nt, Homo sapiens
acauccacaugcac

SEQ ID NO: 1932899 - RNA, 15 nt, Homo sapiens
aaacggaugaguuau

SEQ ID NO: 1932900 - RNA, 15 nt, Homo sapiens
caaauaaaaauaaca

SEQ ID NO: 1932901 - RNA, 16 nt, Homo sapiens
aaccauccacuuacau

SEQ ID NO: 1932902 - RNA, 14 nt, Homo sapiens
auguucaguguaau

SEQ ID NO: 1932903 - RNA, 22 nt, Homo sapiens
ucagaaugggggcuuucgggga

SEQ ID NO: 1932904 - RNA, 22 nt, Homo sapiens
aaaauguaugcauguugucuaa

SEQ ID NO: 1932905 - RNA, 21 nt, Homo sapiens
cuguaaauacuguaaaugcau

SEQ ID NO: 1932906 - RNA, 11 nt, Homo sapiens
uuuacauuuca

SEQ ID NO: 1932907 - RNA, 22 nt, Homo sapiens
ggcucaagcuauccuugcaccu

SEQ ID NO: 1932908 - RNA, 12 nt, Homo sapiens
caaugaugcccu

SEQ ID NO: 1932909 - RNA, 15 nt, Homo sapiens
uuuaaaaaaaauccu

SEQ ID NO: 1932910 - RNA, 15 nt, Homo sapiens
uuacuguguaucuca

SEQ ID NO: 1932911 - RNA, 13 nt, Homo sapiens
acuguucuguccu

SEQ ID NO: 1932912 - RNA, 14 nt, Homo sapiens
ucuucuacuuuaag

SEQ ID NO: 1932913 - RNA, 22 nt, Homo sapiens
aguuugcugccauggacauaaa

SEQ ID NO: 1932914 - RNA, 15 nt, Homo sapiens
gcaguccaggccucu

SEQ ID NO: 1932915 - RNA, 19 nt, Homo sapiens
gcaaggaauuuucaccucc

SEQ ID NO: 1932916 - RNA, 21 nt, Homo sapiens
cucggaacuuacuguguaaau

SEQ ID NO: 1932917 - RNA, 20 nt, Homo sapiens
uugauugcguggaauugugc

SEQ ID NO: 1932918 - RNA, 21 nt, Homo sapiens
acuaauuugaauaaacucucc

SEQ ID NO: 1932919 - RNA, 23 nt, Homo sapiens
gcuaaccucacugccucauggca

SEQ ID NO: 1932920 - RNA, 18 nt, Homo sapiens
cauuggagcaagcuugcc

SEQ ID NO: 1932921 - RNA, 16 nt, Homo sapiens
ugcucuucaucauaua

SEQ ID NO: 1932922 - RNA, 17 nt, Homo sapiens
uuagagauacccucuga

SEQ ID NO: 1932923 - RNA, 13 nt, Homo sapiens
gugacacagcagc

SEQ ID NO: 1932924 - RNA, 15 nt, Homo sapiens
ggauuuccagggaua

SEQ ID NO: 1932925 - RNA, 21 nt, Homo sapiens
ggcugcuggaaacacagucac

SEQ ID NO: 1932926 - RNA, 23 nt, Homo sapiens
cguuuugugugguggcaccuccu

SEQ ID NO: 1932927 - RNA, 19 nt, Homo sapiens
uccugggcacgcacugggu

SEQ ID NO: 1932928 - RNA, 16 nt, Homo sapiens
aguauuuagaagccaa

SEQ ID NO: 1932929 - RNA, 16 nt, Homo sapiens
augucuuuuuacccuu

SEQ ID NO: 1932930 - RNA, 17 nt, Homo sapiens
cccagcacgugggucua

SEQ ID NO: 1932931 - RNA, 18 nt, Homo sapiens
aaacagagaacccugugg

SEQ ID NO: 1932932 - RNA, 19 nt, Homo sapiens
uugaauccgaagaaugaca

SEQ ID NO: 1932933 - RNA, 15 nt, Homo sapiens
cuaugaacuagagac

SEQ ID NO: 1932934 - RNA, 24 nt, Homo sapiens
cuguugccaggagauggaauauca

SEQ ID NO: 1932935 - RNA, 19 nt, Homo sapiens
auucacaagacccaaaagg

SEQ ID NO: 1932936 - RNA, 14 nt, Homo sapiens
cugagaucgugcua

SEQ ID NO: 1932937 - RNA, 14 nt, Homo sapiens
ccaaguaccaguau

SEQ ID NO: 1932938 - RNA, 20 nt, Homo sapiens
cucgcucagucagugcacua

SEQ ID NO: 1932939 - RNA, 22 nt, Homo sapiens
agcuaaucucgguagaugucau

SEQ ID NO: 1932940 - RNA, 18 nt, Homo sapiens
cucuguaaguguagcuca

SEQ ID NO: 1932941 - RNA, 17 nt, Homo sapiens
aacaucagcugaauuca

SEQ ID NO: 1932942 - RNA, 20 nt, Homo sapiens
acaacgggccagcucuagua

SEQ ID NO: 1932943 - RNA, 15 nt, Homo sapiens
cuggaacauuccagu

SEQ ID NO: 1932944 - RNA, 16 nt, Homo sapiens
uagaggaacuucugaa

SEQ ID NO: 1932945 - RNA, 22 nt, Homo sapiens
uuugccugauccuccaacagcu

SEQ ID NO: 1932946 - RNA, 12 nt, Homo sapiens
agagccacuggg

SEQ ID NO: 1932947 - RNA, 23 nt, Homo sapiens
ugggauaucacuuccaugacaua

SEQ ID NO: 1932948 - RNA, 15 nt, Homo sapiens
aauuauguaaugcaa

SEQ ID NO: 1932949 - RNA, 16 nt, Homo sapiens
cuugguacaguugcag

SEQ ID NO: 1932950 - RNA, 12 nt, Homo sapiens
caaaggaaguuu

SEQ ID NO: 1932951 - RNA, 19 nt, Homo sapiens
ugcccuaacuguacauuuc

SEQ ID NO: 1932952 - RNA, 12 nt, Homo sapiens
ugcuaagugugc

SEQ ID NO: 1932953 - RNA, 14 nt, Homo sapiens
cucaugauguauug

SEQ ID NO: 1932954 - RNA, 15 nt, Homo sapiens
auucaauccuacuuu

SEQ ID NO: 1932955 - RNA, 14 nt, Homo sapiens
accaggccacuugc

SEQ ID NO: 1932956 - RNA, 18 nt, Homo sapiens
acaauuacuaaauuguau

SEQ ID NO: 1932957 - RNA, 16 nt, Homo sapiens
cugugaguauugcuua

SEQ ID NO: 1932958 - RNA, 19 nt, Homo sapiens
cucacagaguuuauaguua

SEQ ID NO: 1932959 - RNA, 14 nt, Homo sapiens
uagacacagauaau

SEQ ID NO: 1932960 - RNA, 15 nt, Homo sapiens
uaucccaccaaccuc

SEQ ID NO: 1932961 - RNA, 22 nt, Homo sapiens
caaaagcaagacuguugcucaa

SEQ ID NO: 1932962 - RNA, 18 nt, Homo sapiens
gugcacugcuuugggauu

SEQ ID NO: 1932963 - RNA, 20 nt, Homo sapiens
aaaucauauuuaccugugaa

SEQ ID NO: 1932964 - RNA, 18 nt, Homo sapiens
uaacgaaugguacuacaa

SEQ ID NO: 1932965 - RNA, 13 nt, Homo sapiens
gcagaagaacaga

SEQ ID NO: 1932966 - RNA, 18 nt, Homo sapiens
uaaaccauugugcauucu

SEQ ID NO: 1932967 - RNA, 19 nt, Homo sapiens
cuaacucauuguauuccuc

SEQ ID NO: 1932968 - RNA, 18 nt, Homo sapiens
uuaauauuuccaauguga

SEQ ID NO: 1932969 - RNA, 18 nt, Homo sapiens
aaaacugccacaagcaca

SEQ ID NO: 1932970 - RNA, 13 nt, Homo sapiens
cagaguggagucu

SEQ ID NO: 1932971 - RNA, 15 nt, Homo sapiens
agacuucuuugcaac

SEQ ID NO: 1932972 - RNA, 16 nt, Homo sapiens
aaauaagcuuaucuua

SEQ ID NO: 1932973 - RNA, 14 nt, Homo sapiens
ggcugcacaacagc

SEQ ID NO: 1932974 - RNA, 18 nt, Homo sapiens
uugaaacuaucucaugcc

SEQ ID NO: 1932975 - RNA, 21 nt, Homo sapiens
cccccugacauuaucuuggau

SEQ ID NO: 1932976 - RNA, 23 nt, Homo sapiens
ucccagacggucaggaaaacugu

SEQ ID NO: 1932977 - RNA, 16 nt, Homo sapiens
augaaaggaucucuga

SEQ ID NO: 1932978 - RNA, 18 nt, Homo sapiens
ucuuccugauacaugacu

SEQ ID NO: 1932979 - RNA, 12 nt, Homo sapiens
cugcauguuaca

SEQ ID NO: 1932980 - RNA, 17 nt, Homo sapiens
uguaacuguuacaguaa

SEQ ID NO: 1932981 - RNA, 17 nt, Homo sapiens
aguuaguaucuuuauua

SEQ ID NO: 1932982 - RNA, 17 nt, Homo sapiens
aguagaugauuuccuua

SEQ ID NO: 1932983 - RNA, 20 nt, Homo sapiens
ggcucucagcucagcgccag

SEQ ID NO: 1932984 - RNA, 15 nt, Homo sapiens
uccgacaccacuggg

SEQ ID NO: 1932985 - RNA, 22 nt, Homo sapiens
cucuccuuaaccuccagcagac

SEQ ID NO: 1932986 - RNA, 20 nt, Homo sapiens
ugaagugcaugggucagggu

SEQ ID NO: 1932987 - RNA, 22 nt, Homo sapiens
cccaaguggugaaugacacgcc

SEQ ID NO: 1932988 - RNA, 20 nt, Homo sapiens
ugcugugcuagugccugaga

SEQ ID NO: 1932989 - RNA, 17 nt, Homo sapiens
acgugccugugauccca

SEQ ID NO: 1932990 - RNA, 23 nt, Homo sapiens
acacaagcuugucaaugauuuca

SEQ ID NO: 1932991 - RNA, 14 nt, Homo sapiens
uaauacuuccaaau

SEQ ID NO: 1932992 - RNA, 18 nt, Homo sapiens
cugggauugggaaggagu

SEQ ID NO: 1932993 - RNA, 12 nt, Homo sapiens
gcagacaggaag

SEQ ID NO: 1932994 - RNA, 12 nt, Homo sapiens
ucuuacaguauu

SEQ ID NO: 1932995 - RNA, 22 nt, Homo sapiens
uuacuguugugaccugaaguuc

SEQ ID NO: 1932996 - RNA, 15 nt, Homo sapiens
cacacagacaggguu

SEQ ID NO: 1932997 - RNA, 22 nt, Homo sapiens
cuguguauuuacaugaauguau

SEQ ID NO: 1932998 - RNA, 21 nt, Homo sapiens
uacccaccugagcuuuggaca

SEQ ID NO: 1932999 - RNA, 23 nt, Homo sapiens
auuuccuuucuacaauuucaauu

SEQ ID NO: 1933000 - RNA, 20 nt, Homo sapiens
uuuaauaucugagaagugua

SEQ ID NO: 1933001 - RNA, 18 nt, Homo sapiens
acuuuacaugacacagcu

SEQ ID NO: 1933002 - RNA, 22 nt, Homo sapiens
cccaaucucugccauaucagug

SEQ ID NO: 1933003 - RNA, 14 nt, Homo sapiens
cucacaauuguaaa

SEQ ID NO: 1933004 - RNA, 20 nt, Homo sapiens
auuaguugaaaggccucaag

SEQ ID NO: 1933005 - RNA, 18 nt, Homo sapiens
gagccaggcacacacugu

SEQ ID NO: 1933006 - RNA, 17 nt, Homo sapiens
gagguucaaaaguaaga

SEQ ID NO: 1933007 - RNA, 19 nt, Homo sapiens
ucauugguacccacuugcu

SEQ ID NO: 1933008 - RNA, 20 nt, Homo sapiens
cugugcccagcuuccaugcu

SEQ ID NO: 1933009 - RNA, 15 nt, Homo sapiens
cuuccuccccagucu

SEQ ID NO: 1933010 - RNA, 23 nt, Homo sapiens
aggcgugcugguccccuccucag

SEQ ID NO: 1933011 - RNA, 20 nt, Homo sapiens
ccuaugguuuuucuguguca

SEQ ID NO: 1933012 - RNA, 23 nt, Homo sapiens
uuccuaguagucagcuagaucau

SEQ ID NO: 1933013 - RNA, 19 nt, Homo sapiens
acauacuccuuccaucaaa

SEQ ID NO: 1933014 - RNA, 16 nt, Homo sapiens
caaagagacuaugaug

SEQ ID NO: 1933015 - RNA, 22 nt, Homo sapiens
ugcagaugcaagccuguaucag

SEQ ID NO: 1933016 - RNA, 18 nt, Homo sapiens
caauacuuuucaggcacu

SEQ ID NO: 1933017 - RNA, 12 nt, Homo sapiens
uuuaaguaggaa

SEQ ID NO: 1933018 - RNA, 18 nt, Homo sapiens
uauagaucacugcccuuu

SEQ ID NO: 1933019 - RNA, 21 nt, Homo sapiens
uucuccacacagcaaugacau

SEQ ID NO: 1933020 - RNA, 17 nt, Homo sapiens
uuccaugauacuuuaau

SEQ ID NO: 1933021 - RNA, 18 nt, Homo sapiens
ugcagggcugggaagaag

SEQ ID NO: 1933022 - RNA, 13 nt, Homo sapiens
acgucuccugcug

SEQ ID NO: 1933023 - RNA, 22 nt, Homo sapiens
gagucaucuauucaagcacuua

SEQ ID NO: 1933024 - RNA, 17 nt, Homo sapiens
caaaaucccuauuuaau

SEQ ID NO: 1933025 - RNA, 16 nt, Homo sapiens
gcaaugcaugauacua

SEQ ID NO: 1933026 - RNA, 22 nt, Homo sapiens
ucugcuuuaguuucacauugca

SEQ ID NO: 1933027 - RNA, 18 nt, Homo sapiens
cuuccuccucgcugccag

SEQ ID NO: 1933028 - RNA, 13 nt, Homo sapiens
aaaaugcauuuaa

SEQ ID NO: 1933029 - RNA, 20 nt, Homo sapiens
aaaguaaaaacaaagaaauu

SEQ ID NO: 1933030 - RNA, 15 nt, Homo sapiens
aucuguguuuguacu

SEQ ID NO: 1933031 - RNA, 14 nt, Homo sapiens
auaaugacauguau

SEQ ID NO: 1933032 - RNA, 18 nt, Homo sapiens
ccguggggggaagcacau

SEQ ID NO: 1933033 - RNA, 20 nt, Homo sapiens
uggaaaaaugccaucaaaug

SEQ ID NO: 1933034 - RNA, 13 nt, Homo sapiens
gaggaaacuugca

SEQ ID NO: 1933035 - RNA, 14 nt, Homo sapiens
ugaaaugauaugac

SEQ ID NO: 1933036 - RNA, 18 nt, Homo sapiens
gaaguagcagugucugua

SEQ ID NO: 1933037 - RNA, 22 nt, Homo sapiens
acuaauguauuaauaccacuga

SEQ ID NO: 1933038 - RNA, 16 nt, Homo sapiens
ugacuaguagauuucu

SEQ ID NO: 1933039 - RNA, 16 nt, Homo sapiens
ccaauuacuugaagua

SEQ ID NO: 1933040 - RNA, 23 nt, Homo sapiens
cuaaaauaagggcagagucacac

SEQ ID NO: 1933041 - RNA, 15 nt, Homo sapiens
cagucuccccacucc

SEQ ID NO: 1933042 - RNA, 12 nt, Homo sapiens
accauaacacuu

SEQ ID NO: 1933043 - RNA, 22 nt, Homo sapiens
gcaucauuauuugcagagacag

SEQ ID NO: 1933044 - RNA, 11 nt, Homo sapiens
cuauugagauc

SEQ ID NO: 1933045 - RNA, 19 nt, Homo sapiens
gaugccucgcucuuuucaa

SEQ ID NO: 1933046 - RNA, 13 nt, Homo sapiens
gucuuucuccuca

SEQ ID NO: 1933047 - RNA, 22 nt, Homo sapiens
cacaggcugggcugggcacugc

SEQ ID NO: 1933048 - RNA, 15 nt, Homo sapiens
acagagaugaaagag

SEQ ID NO: 1933049 - RNA, 17 nt, Homo sapiens
gauugccucucuagaca

SEQ ID NO: 1933050 - RNA, 15 nt, Homo sapiens
gagaccaauugcacu

SEQ ID NO: 1933051 - RNA, 13 nt, Homo sapiens
aaauaaucugaca

SEQ ID NO: 1933052 - RNA, 15 nt, Homo sapiens
guccacaaggggcuu

SEQ ID NO: 1933053 - RNA, 22 nt, Homo sapiens
cugcauuuagggaguauucuaa

SEQ ID NO: 1933054 - RNA, 23 nt, Homo sapiens
caugaugugaagaguuucacaaa

SEQ ID NO: 1933055 - RNA, 15 nt, Homo sapiens
cuuuuaaaaggagca

SEQ ID NO: 1933056 - RNA, 12 nt, Homo sapiens
caaacaaugaaa

SEQ ID NO: 1933057 - RNA, 18 nt, Homo sapiens
gacuugaauguacaaaga

SEQ ID NO: 1933058 - RNA, 14 nt, Homo sapiens
cccuaccugucaac

SEQ ID NO: 1933059 - RNA, 19 nt, Homo sapiens
uccuuggagccacugggau

SEQ ID NO: 1933060 - RNA, 14 nt, Homo sapiens
gaccaaaaagggga

SEQ ID NO: 1933061 - RNA, 23 nt, Homo sapiens
cuuacucccuaucuaacacuuuu

SEQ ID NO: 1933062 - RNA, 12 nt, Homo sapiens
aaucuucuacuu

SEQ ID NO: 1933063 - RNA, 23 nt, Homo sapiens
aagggguguuugggcagcugggg

SEQ ID NO: 1933064 - RNA, 13 nt, Homo sapiens
uguugcaaacuca

SEQ ID NO: 1933065 - RNA, 22 nt, Homo sapiens
gaaccuuaaugacaacacuuaa

SEQ ID NO: 1933066 - RNA, 20 nt, Homo sapiens
agacugaaccagagcuggaa

SEQ ID NO: 1933067 - RNA, 13 nt, Homo sapiens
uaaagcagucaug

SEQ ID NO: 1933068 - RNA, 17 nt, Homo sapiens
cagaggguagggcagca

SEQ ID NO: 1933069 - RNA, 18 nt, Homo sapiens
guucuaccaagaacugaa

SEQ ID NO: 1933070 - RNA, 15 nt, Homo sapiens
gcucagugaucucac

SEQ ID NO: 1933071 - RNA, 23 nt, Homo sapiens
aauuuucagcagagaccuuccaa

SEQ ID NO: 1933072 - RNA, 21 nt, Homo sapiens
acaaaccagccuggggccuuc

SEQ ID NO: 1933073 - RNA, 18 nt, Homo sapiens
caaucagaccacauuuga

SEQ ID NO: 1933074 - RNA, 19 nt, Homo sapiens
aucugcauaaauuuuacag

SEQ ID NO: 1933075 - RNA, 20 nt, Homo sapiens
agguuaaugcagggacugua

SEQ ID NO: 1933076 - RNA, 9 nt, Homo sapiens
accaaaaaa

SEQ ID NO: 1933077 - RNA, 9 nt, Homo sapiens
uccaaaaau

SEQ ID NO: 1933078 - RNA, 17 nt, Homo sapiens
agucugcauaaacuuca

SEQ ID NO: 1933079 - RNA, 14 nt, Homo sapiens
cccugccagacuga

SEQ ID NO: 1933080 - RNA, 20 nt, Homo sapiens
aagcuauauguuauggcuua

SEQ ID NO: 1933081 - RNA, 17 nt, Homo sapiens
uccacucuccucuucca

SEQ ID NO: 1933082 - RNA, 18 nt, Homo sapiens
uagaaauucagcauuuga

SEQ ID NO: 1933083 - RNA, 23 nt, Homo sapiens
accgccggccagcugggaucuga

SEQ ID NO: 1933084 - RNA, 16 nt, Homo sapiens
ugcuucuccccagaau

SEQ ID NO: 1933085 - RNA, 18 nt, Homo sapiens
auagugaaacagcuuucu

SEQ ID NO: 1933086 - RNA, 14 nt, Homo sapiens
cugggaugugguau

SEQ ID NO: 1933087 - RNA, 23 nt, Homo sapiens
cacaaagcggcucuaaaccucag

SEQ ID NO: 1933088 - RNA, 18 nt, Homo sapiens
agugccuuucuucucucc

SEQ ID NO: 1933089 - RNA, 17 nt, Homo sapiens
uccagguaacuuugaag

SEQ ID NO: 1933090 - RNA, 12 nt, Homo sapiens
aucaaacauaau

SEQ ID NO: 1933091 - RNA, 23 nt, Homo sapiens
cggauggaccaaccugcucuguc

SEQ ID NO: 1933092 - RNA, 21 nt, Homo sapiens
cugcaggaucccuacugccaa

SEQ ID NO: 1933093 - RNA, 18 nt, Homo sapiens
ccauucagaaagcuucaa

SEQ ID NO: 1933094 - RNA, 20 nt, Homo sapiens
ugugacacacuacaccacac

SEQ ID NO: 1933095 - RNA, 16 nt, Homo sapiens
gaaggucccucagaca

SEQ ID NO: 1933096 - RNA, 17 nt, Homo sapiens
accauuuuuuaaggaaa

SEQ ID NO: 1933097 - RNA, 17 nt, Homo sapiens
aucaguauuaagcuaau

SEQ ID NO: 1933098 - RNA, 14 nt, Homo sapiens
aucccaaagccaac

SEQ ID NO: 1933099 - RNA, 20 nt, Homo sapiens
cuucuucccuuaacuccaag

SEQ ID NO: 1933100 - RNA, 20 nt, Homo sapiens
cacugccccagacacagugc

SEQ ID NO: 1933101 - RNA, 19 nt, Homo sapiens
ccuauagagucaaccacca

SEQ ID NO: 1933102 - RNA, 20 nt, Homo sapiens
guagagacgguguuuugcca

SEQ ID NO: 1933103 - RNA, 16 nt, Homo sapiens
augguagacugugaca

SEQ ID NO: 1933104 - RNA, 19 nt, Homo sapiens
ucuagaauccccacaggga

SEQ ID NO: 1933105 - RNA, 19 nt, Homo sapiens
ggaaauuagccacauguac

SEQ ID NO: 1933106 - RNA, 22 nt, Homo sapiens
uuuacuggaccccgccucccag

SEQ ID NO: 1933107 - RNA, 12 nt, Homo sapiens
cccugcacacac

SEQ ID NO: 1933108 - RNA, 15 nt, Homo sapiens
gggcccagcccagag

SEQ ID NO: 1933109 - RNA, 12 nt, Homo sapiens
acuaagugaugc

SEQ ID NO: 1933110 - RNA, 20 nt, Homo sapiens
ugaaggcaguggcaggggag

SEQ ID NO: 1933111 - RNA, 17 nt, Homo sapiens
ucaagggccagucagca

SEQ ID NO: 1933112 - RNA, 21 nt, Homo sapiens
ucagauaaugccaccaaagga

SEQ ID NO: 1933113 - RNA, 11 nt, Homo sapiens
uuaugcugcug

SEQ ID NO: 1933114 - RNA, 13 nt, Homo sapiens
aaucacaaugaga

SEQ ID NO: 1933115 - RNA, 16 nt, Homo sapiens
uccucuucaccaggug

SEQ ID NO: 1933116 - RNA, 19 nt, Homo sapiens
acccagugagacagaccgc

SEQ ID NO: 1933117 - RNA, 18 nt, Homo sapiens
cccaacgaaaagcacauc

SEQ ID NO: 1933118 - RNA, 13 nt, Homo sapiens
cuagacacacaaa

SEQ ID NO: 1933119 - RNA, 20 nt, Homo sapiens
aaacucagggacagagccau

SEQ ID NO: 1933120 - RNA, 16 nt, Homo sapiens
acuuauuaagagcaaa

SEQ ID NO: 1933121 - RNA, 16 nt, Homo sapiens
aggaguugauaugcaa

SEQ ID NO: 1933122 - RNA, 23 nt, Homo sapiens
gauuuggaagggaaacuuucaaa

SEQ ID NO: 1933123 - RNA, 20 nt, Homo sapiens
gagccccgccucacacccac

SEQ ID NO: 1933124 - RNA, 18 nt, Homo sapiens
ugcacacagaaugcucag

SEQ ID NO: 1933125 - RNA, 12 nt, Homo sapiens
augggauuuggu

SEQ ID NO: 1933126 - RNA, 14 nt, Homo sapiens
gagcaggaggccaa

SEQ ID NO: 1933127 - RNA, 18 nt, Homo sapiens
cuaggaagagcaggacuc

SEQ ID NO: 1933128 - RNA, 21 nt, Homo sapiens
acauuacaauccugcauuguu

SEQ ID NO: 1933129 - RNA, 15 nt, Homo sapiens
cugaugcugggaccc

SEQ ID NO: 1933130 - RNA, 20 nt, Homo sapiens
ggauauuugguuuggccauc

SEQ ID NO: 1933131 - RNA, 13 nt, Homo sapiens
ggcccacccugcu

SEQ ID NO: 1933132 - RNA, 13 nt, Homo sapiens
cuucaagugccaa

SEQ ID NO: 1933133 - RNA, 21 nt, Homo sapiens
ugauacucccaccucugccuu

SEQ ID NO: 1933134 - RNA, 21 nt, Homo sapiens
uucauguggcucagugccuuc

SEQ ID NO: 1933135 - RNA, 12 nt, Homo sapiens
acaaacugcaca

SEQ ID NO: 1933136 - RNA, 15 nt, Homo sapiens
ugcugaaugcauuca

SEQ ID NO: 1933137 - RNA, 16 nt, Homo sapiens
uguguguguguauaca

SEQ ID NO: 1933138 - RNA, 12 nt, Homo sapiens
uaaaaucuguaa

SEQ ID NO: 1933139 - RNA, 22 nt, Homo sapiens
auaagaacagagugccugcauu

SEQ ID NO: 1933140 - RNA, 14 nt, Homo sapiens
cugcacuguaaaau

SEQ ID NO: 1933141 - RNA, 22 nt, Homo sapiens
cagaaguggaauccaguguggc

SEQ ID NO: 1933142 - RNA, 20 nt, Homo sapiens
ugacuacauuggaagcuuug

SEQ ID NO: 1933143 - RNA, 17 nt, Homo sapiens
cacucacagauguuuga

SEQ ID NO: 1933144 - RNA, 12 nt, Homo sapiens
aauucacuuuau

SEQ ID NO: 1933145 - RNA, 22 nt, Homo sapiens
ucuaauucuguaggacuuugaa

SEQ ID NO: 1933146 - RNA, 17 nt, Homo sapiens
auaaaauggaagcaauu

SEQ ID NO: 1933147 - RNA, 21 nt, Homo sapiens
ucaaguaauccaccugccucg

SEQ ID NO: 1933148 - RNA, 18 nt, Homo sapiens
auucagcgggagcacugc

SEQ ID NO: 1933149 - RNA, 16 nt, Homo sapiens
uaaagcuguguuccca

SEQ ID NO: 1933150 - RNA, 14 nt, Homo sapiens
ggcuguucauggca

SEQ ID NO: 1933151 - RNA, 14 nt, Homo sapiens
ugacuggcucaaga

SEQ ID NO: 1933152 - RNA, 21 nt, Homo sapiens
caacacagagcugaguccucu

SEQ ID NO: 1933153 - RNA, 12 nt, Homo sapiens
ccacuacugcua

SEQ ID NO: 1933154 - RNA, 21 nt, Homo sapiens
cuaagccuguugcugaaguca

SEQ ID NO: 1933155 - RNA, 13 nt, Homo sapiens
aaauacauaugca

SEQ ID NO: 1933156 - RNA, 12 nt, Homo sapiens
acuggcauuaau

SEQ ID NO: 1933157 - RNA, 17 nt, Homo sapiens
ugcaguggcgugaucuu

SEQ ID NO: 1933158 - RNA, 17 nt, Homo sapiens
ugcaguggugugaucuc

SEQ ID NO: 1933159 - RNA, 17 nt, Homo sapiens
ucugauaggaaugugaa

SEQ ID NO: 1933160 - RNA, 23 nt, Homo sapiens
cgguggucaccaugccaaugaag

SEQ ID NO: 1933161 - RNA, 18 nt, Homo sapiens
gaagagaaggaagccaua

SEQ ID NO: 1933162 - RNA, 16 nt, Homo sapiens
agggaaaaaacaugua

SEQ ID NO: 1933163 - RNA, 19 nt, Homo sapiens
ugccuuccuacccucucua

SEQ ID NO: 1933164 - RNA, 17 nt, Homo sapiens
aauugucuuaaaaccag

SEQ ID NO: 1933165 - RNA, 14 nt, Homo sapiens
gacacuuguacaau

SEQ ID NO: 1933166 - RNA, 19 nt, Homo sapiens
acugguuagugaugcaguu

SEQ ID NO: 1933167 - RNA, 20 nt, Homo sapiens
caacccaauaguuguugauu

SEQ ID NO: 1933168 - RNA, 17 nt, Homo sapiens
ccugaugcagccugugg

SEQ ID NO: 1933169 - RNA, 17 nt, Homo sapiens
ccugcagcccaccagac

SEQ ID NO: 1933170 - RNA, 22 nt, Homo sapiens
cugggauuacagggaugagcca

SEQ ID NO: 1933171 - RNA, 13 nt, Homo sapiens
agccuggaugcca

SEQ ID NO: 1933172 - RNA, 21 nt, Homo sapiens
cuuuauuucucucaucuguua

SEQ ID NO: 1933173 - RNA, 22 nt, Homo sapiens
aauuggcucuagucacuggcau

SEQ ID NO: 1933174 - RNA, 17 nt, Homo sapiens
cagaacaucgauaugua

SEQ ID NO: 1933175 - RNA, 23 nt, Homo sapiens
uggcaucuuuuuaauaccaggaa

SEQ ID NO: 1933176 - RNA, 20 nt, Homo sapiens
aaccaaugcugaugaccuua

SEQ ID NO: 1933177 - RNA, 18 nt, Homo sapiens
uaaagagagugagcauga

SEQ ID NO: 1933178 - RNA, 18 nt, Homo sapiens
ccauucaagucuuucuaa

SEQ ID NO: 1933179 - RNA, 16 nt, Homo sapiens
agcgagccacaggaac

SEQ ID NO: 1933180 - RNA, 14 nt, Homo sapiens
gccauuccuggaau

SEQ ID NO: 1933181 - RNA, 17 nt, Homo sapiens
cccggcucaagugaucc

SEQ ID NO: 1933182 - RNA, 11 nt, Homo sapiens
uucaugcacug

SEQ ID NO: 1933183 - RNA, 20 nt, Homo sapiens
cccaggcccacucagggguc

SEQ ID NO: 1933184 - RNA, 19 nt, Homo sapiens
agaauugcuggaacccagg

SEQ ID NO: 1933185 - RNA, 17 nt, Homo sapiens
cuuccagccuaggccug

SEQ ID NO: 1933186 - RNA, 18 nt, Homo sapiens
agcaggagauuugcuuga

SEQ ID NO: 1933187 - RNA, 23 nt, Homo sapiens
uaagaaggaguucugacauucau

SEQ ID NO: 1933188 - RNA, 19 nt, Homo sapiens
uuacaacuuauaauuacaa

SEQ ID NO: 1933189 - RNA, 15 nt, Homo sapiens
gggcuuacacgugga

SEQ ID NO: 1933190 - RNA, 15 nt, Homo sapiens
gagcaggagugcuca

SEQ ID NO: 1933191 - RNA, 21 nt, Homo sapiens
ugcuuuagucacuaauugcuu

SEQ ID NO: 1933192 - RNA, 20 nt, Homo sapiens
caaaccuacugcccacauuu

SEQ ID NO: 1933193 - RNA, 16 nt, Homo sapiens
caugcacucacaaaga

SEQ ID NO: 1933194 - RNA, 23 nt, Homo sapiens
agccagaagacugacaaagucau

SEQ ID NO: 1933195 - RNA, 15 nt, Homo sapiens
cuuuauugcugugaa

SEQ ID NO: 1933196 - RNA, 21 nt, Homo sapiens
guuucucuugaagaacugacu

SEQ ID NO: 1933197 - RNA, 15 nt, Homo sapiens
agccuggguguaaaa

SEQ ID NO: 1933198 - RNA, 14 nt, Homo sapiens
ugcuggcugaagag

SEQ ID NO: 1933199 - RNA, 13 nt, Homo sapiens
cagggaacugacc

SEQ ID NO: 1933200 - RNA, 17 nt, Homo sapiens
uuccaguuguuacugaa

SEQ ID NO: 1933201 - RNA, 14 nt, Homo sapiens
auuguaaacuagua

SEQ ID NO: 1933202 - RNA, 14 nt, Homo sapiens
aauugcaacaaugc

SEQ ID NO: 1933203 - RNA, 17 nt, Homo sapiens
agagucaaaugggaaaa

SEQ ID NO: 1933204 - RNA, 14 nt, Homo sapiens
gcagacagugcaca

SEQ ID NO: 1933205 - RNA, 13 nt, Homo sapiens
uucuacagauauu

SEQ ID NO: 1933206 - RNA, 18 nt, Homo sapiens
agugccgccugugcccac

SEQ ID NO: 1933207 - RNA, 16 nt, Homo sapiens
acaugaacccaaaaag

SEQ ID NO: 1933208 - RNA, 19 nt, Homo sapiens
ccugaauuaaagucuacac

SEQ ID NO: 1933209 - RNA, 15 nt, Homo sapiens
cgugacuguggcaca

SEQ ID NO: 1933210 - RNA, 21 nt, Homo sapiens
agauauaagacuuaauauguu

SEQ ID NO: 1933211 - RNA, 13 nt, Homo sapiens
ugcuuagauuucu

SEQ ID NO: 1933212 - RNA, 14 nt, Homo sapiens
caugugguacuuga

SEQ ID NO: 1933213 - RNA, 21 nt, Homo sapiens
cugcuaguggugagcauguaa

SEQ ID NO: 1933214 - RNA, 21 nt, Homo sapiens
ugauacaaauugcagacugug

SEQ ID NO: 1933215 - RNA, 13 nt, Homo sapiens
agcugaaugccuc

SEQ ID NO: 1933216 - RNA, 18 nt, Homo sapiens
ugcaaaauauuugacuau

SEQ ID NO: 1933217 - RNA, 21 nt, Homo sapiens
aagaagcucgccccaccucca

SEQ ID NO: 1933218 - RNA, 15 nt, Homo sapiens
uguugaggauguguc

SEQ ID NO: 1933219 - RNA, 20 nt, Homo sapiens
uugaugguuucuaucugcaa

SEQ ID NO: 1933220 - RNA, 14 nt, Homo sapiens
ccaaaguuauccag

SEQ ID NO: 1933221 - RNA, 22 nt, Homo sapiens
cagugagccgcaucuucuccau

SEQ ID NO: 1933222 - RNA, 19 nt, Homo sapiens
cuuaauaaaauaauucuca

SEQ ID NO: 1933223 - RNA, 14 nt, Homo sapiens
guaagaaggcaaua

SEQ ID NO: 1933224 - RNA, 13 nt, Homo sapiens
uggagacuugcuu

SEQ ID NO: 1933225 - RNA, 21 nt, Homo sapiens
caaucugaaacagcuucaugg

SEQ ID NO: 1933226 - RNA, 21 nt, Homo sapiens
ggacagucuggccacugucaa

SEQ ID NO: 1933227 - RNA, 23 nt, Homo sapiens
ccuuagaacuuugcauagcagcu

SEQ ID NO: 1933228 - RNA, 18 nt, Homo sapiens
cacaacugcaauaacuuc

SEQ ID NO: 1933229 - RNA, 22 nt, Homo sapiens
caagcuuguuaucagcuuucag

SEQ ID NO: 1933230 - RNA, 13 nt, Homo sapiens
guauauuauaugu

SEQ ID NO: 1933231 - RNA, 16 nt, Homo sapiens
cuggagccaacugcug

SEQ ID NO: 1933232 - RNA, 13 nt, Homo sapiens
ugaggacacugau

SEQ ID NO: 1933233 - RNA, 17 nt, Homo sapiens
acuuauuucagccaaaa

SEQ ID NO: 1933234 - RNA, 16 nt, Homo sapiens
uguuucugcaguauuc

SEQ ID NO: 1933235 - RNA, 16 nt, Homo sapiens
ccauguaggcuaagaa

SEQ ID NO: 1933236 - RNA, 19 nt, Homo sapiens
caggagcgccucguucucu

SEQ ID NO: 1933237 - RNA, 14 nt, Homo sapiens
cucuacuccacaga

SEQ ID NO: 1933238 - RNA, 19 nt, Homo sapiens
ccgggcuggccugugccua

SEQ ID NO: 1933239 - RNA, 15 nt, Homo sapiens
gaaguggggacauca

SEQ ID NO: 1933240 - RNA, 22 nt, Homo sapiens
cugguaaauauauuucaaaacu

SEQ ID NO: 1933241 - RNA, 20 nt, Homo sapiens
gcaaacucuccaccacacgu

SEQ ID NO: 1933242 - RNA, 18 nt, Homo sapiens
aaagucuuagcugagaac

SEQ ID NO: 1933243 - RNA, 21 nt, Homo sapiens
cccuuuuguaucuuaagccaa

SEQ ID NO: 1933244 - RNA, 18 nt, Homo sapiens
acaguaccggauucucuc

SEQ ID NO: 1933245 - RNA, 14 nt, Homo sapiens
cuggaccucagguu

SEQ ID NO: 1933246 - RNA, 14 nt, Homo sapiens
agaaagauagcuug

SEQ ID NO: 1933247 - RNA, 21 nt, Homo sapiens
ucucuuuucccuccuuuccuu

SEQ ID NO: 1933248 - RNA, 14 nt, Homo sapiens
cuuucucugugaaa

SEQ ID NO: 1933249 - RNA, 18 nt, Homo sapiens
uaacuagaaaucugccaa

SEQ ID NO: 1933250 - RNA, 13 nt, Homo sapiens
cuuucaaagagaa

SEQ ID NO: 1933251 - RNA, 20 nt, Homo sapiens
agaucacgccauugcacucc

SEQ ID NO: 1933252 - RNA, 19 nt, Homo sapiens
uggacagucaggguucacu

SEQ ID NO: 1933253 - RNA, 15 nt, Homo sapiens
auuagaaguuaccaa

SEQ ID NO: 1933254 - RNA, 23 nt, Homo sapiens
uuuucggccccauguaucucagu

SEQ ID NO: 1933255 - RNA, 19 nt, Homo sapiens
ucaucaacuaccauucuau

SEQ ID NO: 1933256 - RNA, 18 nt, Homo sapiens
ucuccacucuugugguca

SEQ ID NO: 1933257 - RNA, 23 nt, Homo sapiens
accauauugugcuucacaguaga

SEQ ID NO: 1933258 - RNA, 18 nt, Homo sapiens
cauaaaacaaaaccaagc

SEQ ID NO: 1933259 - RNA, 23 nt, Homo sapiens
acaugggcugugauuacugcaau

SEQ ID NO: 1933260 - RNA, 16 nt, Homo sapiens
agaucucugaagccac

SEQ ID NO: 1933261 - RNA, 22 nt, Homo sapiens
gugagccaaagcuuaugugaca

SEQ ID NO: 1933262 - RNA, 17 nt, Homo sapiens
guauacuaccauaguga

SEQ ID NO: 1933263 - RNA, 22 nt, Homo sapiens
cuucucuuuaacucaggacucc

SEQ ID NO: 1933264 - RNA, 12 nt, Homo sapiens
gcugccaucacc

SEQ ID NO: 1933265 - RNA, 15 nt, Homo sapiens
cuuauaugugacacu

SEQ ID NO: 1933266 - RNA, 21 nt, Homo sapiens
guuuucugagcccgggcugcc

SEQ ID NO: 1933267 - RNA, 17 nt, Homo sapiens
uggauaagggaauaaua

SEQ ID NO: 1933268 - RNA, 18 nt, Homo sapiens
caggaagggaaagccaga

SEQ ID NO: 1933269 - RNA, 22 nt, Homo sapiens
acuauguuucucagauuccuuu

SEQ ID NO: 1933270 - RNA, 13 nt, Homo sapiens
uccaguguuuaca

SEQ ID NO: 1933271 - RNA, 15 nt, Homo sapiens
ucccacacugugaac

SEQ ID NO: 1933272 - RNA, 13 nt, Homo sapiens
uugaagucuuuaa

SEQ ID NO: 1933273 - RNA, 16 nt, Homo sapiens
agccaaacaccacuuu

SEQ ID NO: 1933274 - RNA, 18 nt, Homo sapiens
uuccuuucuacaauuuca

SEQ ID NO: 1933275 - RNA, 19 nt, Homo sapiens
caaaacuggaccaccagag

SEQ ID NO: 1933276 - RNA, 21 nt, Homo sapiens
aaagagauggugcuaaaccau

SEQ ID NO: 1933277 - RNA, 19 nt, Homo sapiens
cuuuucucacaaaaaggca

SEQ ID NO: 1933278 - RNA, 17 nt, Homo sapiens
uccuugacuucuuugag

SEQ ID NO: 1933279 - RNA, 13 nt, Homo sapiens
ugaguuagcuuuc

SEQ ID NO: 1933280 - RNA, 21 nt, Homo sapiens
auuacuaggguuuugccauca

SEQ ID NO: 1933281 - RNA, 15 nt, Homo sapiens
ugucucagaagugaa

SEQ ID NO: 1933282 - RNA, 12 nt, Homo sapiens
aucuguguuaca

SEQ ID NO: 1933283 - RNA, 12 nt, Homo sapiens
aacuguguuuca

SEQ ID NO: 1933284 - RNA, 12 nt, Homo sapiens
uuaaguguaaau

SEQ ID NO: 1933285 - RNA, 15 nt, Homo sapiens
cacuggcaccaagug

SEQ ID NO: 1933286 - RNA, 19 nt, Homo sapiens
uaaaaagaugguugccaag

SEQ ID NO: 1933287 - RNA, 19 nt, Homo sapiens
cuccacuggucugucuuug

SEQ ID NO: 1933288 - RNA, 20 nt, Homo sapiens
ccaucaccugaaacacugga

SEQ ID NO: 1933289 - RNA, 23 nt, Homo sapiens
ccaauuuuggggugugacacuuu

SEQ ID NO: 1933290 - RNA, 19 nt, Homo sapiens
cuccauaccucgaacauca

SEQ ID NO: 1933291 - RNA, 12 nt, Homo sapiens
aauauccaagac

SEQ ID NO: 1933292 - RNA, 15 nt, Homo sapiens
acucaaguucaagga

SEQ ID NO: 1933293 - RNA, 14 nt, Homo sapiens
uccgugagccucag

SEQ ID NO: 1933294 - RNA, 18 nt, Homo sapiens
ucucuucaauaaaccaca

SEQ ID NO: 1933295 - RNA, 21 nt, Homo sapiens
uuagaaagcauuugaaugcau

SEQ ID NO: 1933296 - RNA, 22 nt, Homo sapiens
cuccagacacaccugaacacau

SEQ ID NO: 1933297 - RNA, 16 nt, Homo sapiens
ugacggcuggggaccc

SEQ ID NO: 1933298 - RNA, 19 nt, Homo sapiens
aaacauaaacacauuucca

SEQ ID NO: 1933299 - RNA, 16 nt, Homo sapiens
auagugggacccuguc

SEQ ID NO: 1933300 - RNA, 17 nt, Homo sapiens
aauuuacuguugcccau

SEQ ID NO: 1933301 - RNA, 17 nt, Homo sapiens
caguaauuugcaauuug

SEQ ID NO: 1933302 - RNA, 20 nt, Homo sapiens
ugagaagucacucacacugg

SEQ ID NO: 1933303 - RNA, 18 nt, Homo sapiens
guuugauaaaaagaucaa

SEQ ID NO: 1933304 - RNA, 18 nt, Homo sapiens
gcaauacaacuuuaccau

SEQ ID NO: 1933305 - RNA, 21 nt, Homo sapiens
uacguggcaaauuaacuugag

SEQ ID NO: 1933306 - RNA, 21 nt, Homo sapiens
caaaaauuaacucaagaugga

SEQ ID NO: 1933307 - RNA, 20 nt, Homo sapiens
ccuggaaggcagccaggcug

SEQ ID NO: 1933308 - RNA, 16 nt, Homo sapiens
cuguuucuucuuguga

SEQ ID NO: 1933309 - RNA, 23 nt, Homo sapiens
auuugcauuugcucuuucaucuc

SEQ ID NO: 1933310 - RNA, 14 nt, Homo sapiens
gugugauugcacgu

SEQ ID NO: 1933311 - RNA, 14 nt, Homo sapiens
aggcuccagccaca

SEQ ID NO: 1933312 - RNA, 12 nt, Homo sapiens
ugguuaaaucau

SEQ ID NO: 1933313 - RNA, 21 nt, Homo sapiens
gaacacuucagccugugcagg

SEQ ID NO: 1933314 - RNA, 15 nt, Homo sapiens
aggcucucaugucuc

SEQ ID NO: 1933315 - RNA, 17 nt, Homo sapiens
aguggguguugcacaga

SEQ ID NO: 1933316 - RNA, 23 nt, Homo sapiens
gcccuaggaggagaacuugaaca

SEQ ID NO: 1933317 - RNA, 17 nt, Homo sapiens
agaaccuuaaagaacca

SEQ ID NO: 1933318 - RNA, 18 nt, Homo sapiens
gacauacaccuaugucau

SEQ ID NO: 1933319 - RNA, 12 nt, Homo sapiens
aaacacugccug

SEQ ID NO: 1933320 - RNA, 22 nt, Homo sapiens
acagucuuguauuaaguuguua

SEQ ID NO: 1933321 - RNA, 15 nt, Homo sapiens
aaaacccagcaugua

SEQ ID NO: 1933322 - RNA, 12 nt, Homo sapiens
uguguuugcaaa

SEQ ID NO: 1933323 - RNA, 19 nt, Homo sapiens
ugccccugcccacacggca

SEQ ID NO: 1933324 - RNA, 12 nt, Homo sapiens
uugauacuugaa

SEQ ID NO: 1933325 - RNA, 16 nt, Homo sapiens
gagugaggccauagca

SEQ ID NO: 1933326 - RNA, 13 nt, Homo sapiens
gugauuaccucuc

SEQ ID NO: 1933327 - RNA, 14 nt, Homo sapiens
aaagacaagacauu

SEQ ID NO: 1933328 - RNA, 15 nt, Homo sapiens
agugacacagcagcu

SEQ ID NO: 1933329 - RNA, 20 nt, Homo sapiens
cugauuuuaucauucugcuu

SEQ ID NO: 1933330 - RNA, 20 nt, Homo sapiens
auaacuuuguuuagcccaaa

SEQ ID NO: 1933331 - RNA, 13 nt, Homo sapiens
gcauuagugggaa

SEQ ID NO: 1933332 - RNA, 21 nt, Homo sapiens
ucucugcuuuggaaaucacac

SEQ ID NO: 1933333 - RNA, 12 nt, Homo sapiens
aaauaguacuaa

SEQ ID NO: 1933334 - RNA, 16 nt, Homo sapiens
gcaugcugagucaugu

SEQ ID NO: 1933335 - RNA, 20 nt, Homo sapiens
agugcaguggcacgaucuca

SEQ ID NO: 1933336 - RNA, 22 nt, Homo sapiens
cuggguacaagagccauguacc

SEQ ID NO: 1933337 - RNA, 20 nt, Homo sapiens
ccagugaggaugcugcagug

SEQ ID NO: 1933338 - RNA, 18 nt, Homo sapiens
cacaagaaucacuugaac

SEQ ID NO: 1933339 - RNA, 19 nt, Homo sapiens
ccagcuuagcaacugcugg

SEQ ID NO: 1933340 - RNA, 22 nt, Homo sapiens
ccccagccagcgccuccaggcc

SEQ ID NO: 1933341 - RNA, 18 nt, Homo sapiens
aggggugucccaguccca

SEQ ID NO: 1933342 - RNA, 19 nt, Homo sapiens
cuuccauccaucuuuccau

SEQ ID NO: 1933343 - RNA, 22 nt, Homo sapiens
gcacugaauaaagcacgugcaa

SEQ ID NO: 1933344 - RNA, 23 nt, Homo sapiens
auggaaauuaaaacucauuuagg

SEQ ID NO: 1933345 - RNA, 21 nt, Homo sapiens
gaaguaagcaaagacuuuccu

SEQ ID NO: 1933346 - RNA, 16 nt, Homo sapiens
gccugggggauguacc

SEQ ID NO: 1933347 - RNA, 18 nt, Homo sapiens
uauucaguaauaacucua

SEQ ID NO: 1933348 - RNA, 17 nt, Homo sapiens
agauuagguagacuuug

SEQ ID NO: 1933349 - RNA, 22 nt, Homo sapiens
gccuuuauuucuguaucugaca

SEQ ID NO: 1933350 - RNA, 22 nt, Homo sapiens
uagauuaagauuuuacuuuaac

SEQ ID NO: 1933351 - RNA, 22 nt, Homo sapiens
uaaaacauuuuuuagucuguaa

SEQ ID NO: 1933352 - RNA, 14 nt, Homo sapiens
ggcuucagcuccag

SEQ ID NO: 1933353 - RNA, 15 nt, Homo sapiens
agaaauauauauaac

SEQ ID NO: 1933354 - RNA, 14 nt, Homo sapiens
accaucguccuucc

SEQ ID NO: 1933355 - RNA, 16 nt, Homo sapiens
acuccuaguaauuuaa

SEQ ID NO: 1933356 - RNA, 14 nt, Homo sapiens
aacaaaacagcagc

SEQ ID NO: 1933357 - RNA, 17 nt, Homo sapiens
acguuuuuggacacugu

SEQ ID NO: 1933358 - RNA, 16 nt, Homo sapiens
uaaaaaagaucuccaa

SEQ ID NO: 1933359 - RNA, 14 nt, Homo sapiens
cagcaagacuuuau

SEQ ID NO: 1933360 - RNA, 16 nt, Homo sapiens
ucauuccauucuggaa

SEQ ID NO: 1933361 - RNA, 15 nt, Homo sapiens
ugaacacuguucuac

SEQ ID NO: 1933362 - RNA, 14 nt, Homo sapiens
aacaccaagcacag

SEQ ID NO: 1933363 - RNA, 17 nt, Homo sapiens
uuauaggggauacuuga

SEQ ID NO: 1933364 - RNA, 18 nt, Homo sapiens
uucuuaacccuuuccaga

SEQ ID NO: 1933365 - RNA, 19 nt, Homo sapiens
gaaaauuggauucccuuaa

SEQ ID NO: 1933366 - RNA, 20 nt, Homo sapiens
cugucuuaaggcaucugaca

SEQ ID NO: 1933367 - RNA, 23 nt, Homo sapiens
agggcacucucugccagcuccac

SEQ ID NO: 1933368 - RNA, 14 nt, Homo sapiens
gcccagaugaucac

SEQ ID NO: 1933369 - RNA, 17 nt, Homo sapiens
auguacaguuauggauu

SEQ ID NO: 1933370 - RNA, 19 nt, Homo sapiens
aacuugauguuccugggau

SEQ ID NO: 1933371 - RNA, 21 nt, Homo sapiens
aagaaucccacccccacuuca

SEQ ID NO: 1933372 - RNA, 17 nt, Homo sapiens
gcaguacuuuaccuccu

SEQ ID NO: 1933373 - RNA, 18 nt, Homo sapiens
uuccccaaugacuaauga

SEQ ID NO: 1933374 - RNA, 17 nt, Homo sapiens
gaacucuugacuuccug

SEQ ID NO: 1933375 - RNA, 16 nt, Homo sapiens
agauggaaaagaaauu

SEQ ID NO: 1933376 - RNA, 18 nt, Homo sapiens
agagcauuuuuuaugaua

SEQ ID NO: 1933377 - RNA, 13 nt, Homo sapiens
uaaucaagacucu

SEQ ID NO: 1933378 - RNA, 21 nt, Homo sapiens
caucgauuuucuauuauggaa

SEQ ID NO: 1933379 - RNA, 18 nt, Homo sapiens
uguaggguaccuuccagu

SEQ ID NO: 1933380 - RNA, 18 nt, Homo sapiens
ugauaaagcaguauuugg

SEQ ID NO: 1933381 - RNA, 18 nt, Homo sapiens
ucaugccaaguaucuuuc

SEQ ID NO: 1933382 - RNA, 19 nt, Homo sapiens
agucaacccucuuacaaga

SEQ ID NO: 1933383 - RNA, 21 nt, Homo sapiens
agccagucuuugaacugcagc

SEQ ID NO: 1933384 - RNA, 21 nt, Homo sapiens
auuuugaaaaacugcucauau

SEQ ID NO: 1933385 - RNA, 23 nt, Homo sapiens
uguggucugugugugacaccacc

SEQ ID NO: 1933386 - RNA, 14 nt, Homo sapiens
agauauuucacauu

SEQ ID NO: 1933387 - RNA, 20 nt, Homo sapiens
uuucagagaaauacuuucag

SEQ ID NO: 1933388 - RNA, 21 nt, Homo sapiens
augacuucugccccagcuuua

SEQ ID NO: 1933389 - RNA, 17 nt, Homo sapiens
cagcugaggcugucauu

SEQ ID NO: 1933390 - RNA, 22 nt, Homo sapiens
acuugugggccccccuugccuc

SEQ ID NO: 1933391 - RNA, 21 nt, Homo sapiens
gucauuuaaaaagauauugua

SEQ ID NO: 1933392 - RNA, 17 nt, Homo sapiens
gaucuuucuuuccaaaa

SEQ ID NO: 1933393 - RNA, 16 nt, Homo sapiens
uauugccuuugccucu

SEQ ID NO: 1933394 - RNA, 20 nt, Homo sapiens
acggagccacuccucugacu

SEQ ID NO: 1933395 - RNA, 18 nt, Homo sapiens
ggacccuggccuaaagaa

SEQ ID NO: 1933396 - RNA, 15 nt, Homo sapiens
gguuuuuucaauuua

SEQ ID NO: 1933397 - RNA, 23 nt, Homo sapiens
gaguaccuccagucacacucccc

SEQ ID NO: 1933398 - RNA, 18 nt, Homo sapiens
cauagauccccccacuga

SEQ ID NO: 1933399 - RNA, 21 nt, Homo sapiens
ucccgcaccugucugaacugu

SEQ ID NO: 1933400 - RNA, 15 nt, Homo sapiens
aaguucucaauguga

SEQ ID NO: 1933401 - RNA, 22 nt, Homo sapiens
cucaguagauacuaaagcaaau

SEQ ID NO: 1933402 - RNA, 12 nt, Homo sapiens
ggcccucacuca

SEQ ID NO: 1933403 - RNA, 19 nt, Homo sapiens
ccgaguccccgggcaucuu

SEQ ID NO: 1933404 - RNA, 17 nt, Homo sapiens
ucaccuuaggcagggaa

SEQ ID NO: 1933405 - RNA, 16 nt, Homo sapiens
gaaaacugucugggag

SEQ ID NO: 1933406 - RNA, 11 nt, Homo sapiens
gcuagaacuuu

SEQ ID NO: 1933407 - RNA, 17 nt, Homo sapiens
ucugugauaacucugca

SEQ ID NO: 1933408 - RNA, 14 nt, Homo sapiens
aguccucuuuccuu

SEQ ID NO: 1933409 - RNA, 20 nt, Homo sapiens
uuguaagaguggaaccaaca

SEQ ID NO: 1933410 - RNA, 15 nt, Homo sapiens
cuccucccuggguug

SEQ ID NO: 1933411 - RNA, 17 nt, Homo sapiens
agcaaucugucuuuaga

SEQ ID NO: 1933412 - RNA, 20 nt, Homo sapiens
gccuuguacagucugcuccu

SEQ ID NO: 1933413 - RNA, 18 nt, Homo sapiens
aaugcagaauucuugagu

SEQ ID NO: 1933414 - RNA, 17 nt, Homo sapiens
aagagcaaccaguauca

SEQ ID NO: 1933415 - RNA, 20 nt, Homo sapiens
gucacaauccugucccucac

SEQ ID NO: 1933416 - RNA, 12 nt, Homo sapiens
cacaugcuggug

SEQ ID NO: 1933417 - RNA, 15 nt, Homo sapiens
gaaucuuuguuagau

SEQ ID NO: 1933418 - RNA, 17 nt, Homo sapiens
uuauaaccaacuuuucu

SEQ ID NO: 1933419 - RNA, 20 nt, Homo sapiens
ugugacagauuauacagaau

SEQ ID NO: 1933420 - RNA, 17 nt, Homo sapiens
uuaaaacucuggugaua

SEQ ID NO: 1933421 - RNA, 20 nt, Homo sapiens
ccugaguucauccaggccca

SEQ ID NO: 1933422 - RNA, 21 nt, Homo sapiens
ccugagauacugaagugcagc

SEQ ID NO: 1933423 - RNA, 13 nt, Homo sapiens
cuguugggaacca

SEQ ID NO: 1933424 - RNA, 17 nt, Homo sapiens
ucuccagacccaccaca

SEQ ID NO: 1933425 - RNA, 21 nt, Homo sapiens
ccuuuaaagaugaacucugaa

SEQ ID NO: 1933426 - RNA, 21 nt, Homo sapiens
uaaugaguuucacagugugau

SEQ ID NO: 1933427 - RNA, 15 nt, Homo sapiens
uaacuauacuugaua

SEQ ID NO: 1933428 - RNA, 20 nt, Homo sapiens
gaugccaaggggcugaguga

SEQ ID NO: 1933429 - RNA, 12 nt, Homo sapiens
cucuaguauuua

SEQ ID NO: 1933430 - RNA, 14 nt, Homo sapiens
ugucauucagaguc

SEQ ID NO: 1933431 - RNA, 20 nt, Homo sapiens
acuguuucagaaaacauaau

SEQ ID NO: 1933432 - RNA, 16 nt, Homo sapiens
ucaagcaaauguuuaa

SEQ ID NO: 1933433 - RNA, 16 nt, Homo sapiens
ugcucagggaaaagca

SEQ ID NO: 1933434 - RNA, 15 nt, Homo sapiens
gagucugaggccuga

SEQ ID NO: 1933435 - RNA, 16 nt, Homo sapiens
ccuccagccccuguag

SEQ ID NO: 1933436 - RNA, 18 nt, Homo sapiens
uguugguguauuugccag

SEQ ID NO: 1933437 - RNA, 15 nt, Homo sapiens
ccggggaagcugcca

SEQ ID NO: 1933438 - RNA, 19 nt, Homo sapiens
ccucaucuccuaaaaggca

SEQ ID NO: 1933439 - RNA, 17 nt, Homo sapiens
acuucucaccagcaguc

SEQ ID NO: 1933440 - RNA, 22 nt, Homo sapiens
uggcuagauucuaacauauugc

SEQ ID NO: 1933441 - RNA, 23 nt, Homo sapiens
gacuuuagaaauaaauguaccug

SEQ ID NO: 1933442 - RNA, 12 nt, Homo sapiens
cuuguugcugca

SEQ ID NO: 1933443 - RNA, 14 nt, Homo sapiens
cauacuacauacaa

SEQ ID NO: 1933444 - RNA, 12 nt, Homo sapiens
ccauuuccaugg

SEQ ID NO: 1933445 - RNA, 17 nt, Homo sapiens
cuugggaaauaugucaa

SEQ ID NO: 1933446 - RNA, 22 nt, Homo sapiens
cagaaggaucuucaucugacua

SEQ ID NO: 1933447 - RNA, 19 nt, Homo sapiens
ugaccugguccacagggca

SEQ ID NO: 1933448 - RNA, 16 nt, Homo sapiens
gcccaggcucaagccc

SEQ ID NO: 1933449 - RNA, 13 nt, Homo sapiens
cccucgacacuca

SEQ ID NO: 1933450 - RNA, 14 nt, Homo sapiens
ucuugaaggugcug

SEQ ID NO: 1933451 - RNA, 12 nt, Homo sapiens
aacuucucugag

SEQ ID NO: 1933452 - RNA, 22 nt, Homo sapiens
gccuaugauauuccccauuucc

SEQ ID NO: 1933453 - RNA, 21 nt, Homo sapiens
ucgcccuggacugugugcuca

SEQ ID NO: 1933454 - RNA, 22 nt, Homo sapiens
auagcuuuaguccuucucaccu

SEQ ID NO: 1933455 - RNA, 15 nt, Homo sapiens
aagauaauucacucu

SEQ ID NO: 1933456 - RNA, 20 nt, Homo sapiens
gcagccacuuucugccagca

SEQ ID NO: 1933457 - RNA, 20 nt, Homo sapiens
gcuuucauguaaacugugca

SEQ ID NO: 1933458 - RNA, 13 nt, Homo sapiens
ugaauauucccaa

SEQ ID NO: 1933459 - RNA, 15 nt, Homo sapiens
ucaguucucuucacu

SEQ ID NO: 1933460 - RNA, 14 nt, Homo sapiens
gcaagaugcaaaug

SEQ ID NO: 1933461 - RNA, 14 nt, Homo sapiens
ucugaccagcuuuu

SEQ ID NO: 1933462 - RNA, 15 nt, Homo sapiens
aaugcugcuuugucc

SEQ ID NO: 1933463 - RNA, 24 nt, Homo sapiens
ugaaggggaaccccggggugccca

SEQ ID NO: 1933464 - RNA, 17 nt, Homo sapiens
ccaucuccucagcaccc

SEQ ID NO: 1933465 - RNA, 19 nt, Homo sapiens
acaaucagcccagugcaaa

SEQ ID NO: 1933466 - RNA, 17 nt, Homo sapiens
agugaaaacaaguccuu

SEQ ID NO: 1933467 - RNA, 13 nt, Homo sapiens
auuaguuugacac

SEQ ID NO: 1933468 - RNA, 23 nt, Homo sapiens
aaggcuucucuuaaacacuaaaa

SEQ ID NO: 1933469 - RNA, 21 nt, Homo sapiens
gcccuccccacaaugccagac

SEQ ID NO: 1933470 - RNA, 15 nt, Homo sapiens
ucaaaacccuaaaau

SEQ ID NO: 1933471 - RNA, 16 nt, Homo sapiens
gacagugcauuugccu

SEQ ID NO: 1933472 - RNA, 17 nt, Homo sapiens
uaccuguaauagccuca

SEQ ID NO: 1933473 - RNA, 14 nt, Homo sapiens
acuaggcacugugg

SEQ ID NO: 1933474 - RNA, 21 nt, Homo sapiens
auugcacuagagaaacuugaa

SEQ ID NO: 1933475 - RNA, 23 nt, Homo sapiens
gaaauaucgcugaugcagacaca

SEQ ID NO: 1933476 - RNA, 18 nt, Homo sapiens
acuccccuacaucaaaug

SEQ ID NO: 1933477 - RNA, 17 nt, Homo sapiens
uggcaaauggaggcuuu

SEQ ID NO: 1933478 - RNA, 15 nt, Homo sapiens
gugucuauuuggcaa

SEQ ID NO: 1933479 - RNA, 17 nt, Homo sapiens
agaagcaucaccaugca

SEQ ID NO: 1933480 - RNA, 20 nt, Homo sapiens
uaaacaagcugugguaugau

SEQ ID NO: 1933481 - RNA, 20 nt, Homo sapiens
cucaccccgaggcccugcau

SEQ ID NO: 1933482 - RNA, 20 nt, Homo sapiens
caucugacucacaagaagac

SEQ ID NO: 1933483 - RNA, 22 nt, Homo sapiens
agcggcugucacacccaugagc

SEQ ID NO: 1933484 - RNA, 17 nt, Homo sapiens
ugccagcugugugagaa

SEQ ID NO: 1933485 - RNA, 13 nt, Homo sapiens
ucauuaguauucc

SEQ ID NO: 1933486 - RNA, 19 nt, Homo sapiens
cuuuucuggaauguaauca

SEQ ID NO: 1933487 - RNA, 18 nt, Homo sapiens
caucuguuaucaaacugc

SEQ ID NO: 1933488 - RNA, 23 nt, Homo sapiens
guaauauucccuuuuaggugagg

SEQ ID NO: 1933489 - RNA, 18 nt, Homo sapiens
cugaaggggcacaccacu

SEQ ID NO: 1933490 - RNA, 22 nt, Homo sapiens
caagacaauucuucuucuucca

SEQ ID NO: 1933491 - RNA, 18 nt, Homo sapiens
uuauuaggauuccaccuu

SEQ ID NO: 1933492 - RNA, 19 nt, Homo sapiens
agaaagaaaugucugccau

SEQ ID NO: 1933493 - RNA, 17 nt, Homo sapiens
cccugucucuacuaaaa

SEQ ID NO: 1933494 - RNA, 16 nt, Homo sapiens
agccgcggggacaccg

SEQ ID NO: 1933495 - RNA, 14 nt, Homo sapiens
auguugcccagugu

SEQ ID NO: 1933496 - RNA, 21 nt, Homo sapiens
acuuacagugccaacauuuaa

SEQ ID NO: 1933497 - RNA, 14 nt, Homo sapiens
aaauguuuugaugg

SEQ ID NO: 1933498 - RNA, 12 nt, Homo sapiens
ccacauguuuca

SEQ ID NO: 1933499 - RNA, 13 nt, Homo sapiens
aaugucaguucau

SEQ ID NO: 1933500 - RNA, 19 nt, Homo sapiens
cgugauaugcugcuuguga

SEQ ID NO: 1933501 - RNA, 23 nt, Homo sapiens
aguuuaggaguaagagucuuguu

SEQ ID NO: 1933502 - RNA, 16 nt, Homo sapiens
acaguugccacaucac

SEQ ID NO: 1933503 - RNA, 21 nt, Homo sapiens
cuggauaacuguaaaagggcu

SEQ ID NO: 1933504 - RNA, 14 nt, Homo sapiens
ccuaguagaacuca

SEQ ID NO: 1933505 - RNA, 23 nt, Homo sapiens
gcaaaucuuucuguaaacagaau

SEQ ID NO: 1933506 - RNA, 18 nt, Homo sapiens
agauuuuugauaucucaa

SEQ ID NO: 1933507 - RNA, 23 nt, Homo sapiens
acaauuucagaauuuugggacau

SEQ ID NO: 1933508 - RNA, 13 nt, Homo sapiens
gccaucuaugcag

SEQ ID NO: 1933509 - RNA, 16 nt, Homo sapiens
cccucucuugccuuuc

SEQ ID NO: 1933510 - RNA, 15 nt, Homo sapiens
ucugaagucacugca

SEQ ID NO: 1933511 - RNA, 22 nt, Homo sapiens
augaacuuguaaaggaauuuaa

SEQ ID NO: 1933512 - RNA, 15 nt, Homo sapiens
cagauuacuccuucc

SEQ ID NO: 1933513 - RNA, 16 nt, Homo sapiens
uucuuuaccaguuucu

SEQ ID NO: 1933514 - RNA, 19 nt, Homo sapiens
ccucaaaaaucaucaaagu

SEQ ID NO: 1933515 - RNA, 23 nt, Homo sapiens
agaauauugucccuuugagcaga

SEQ ID NO: 1933516 - RNA, 15 nt, Homo sapiens
cagcugcucccacac

SEQ ID NO: 1933517 - RNA, 21 nt, Homo sapiens
ggaaugcugggcuguuuacuu

SEQ ID NO: 1933518 - RNA, 23 nt, Homo sapiens
ggacaccucccaggggacuguuc

SEQ ID NO: 1933519 - RNA, 15 nt, Homo sapiens
uugcgauacacugca

SEQ ID NO: 1933520 - RNA, 18 nt, Homo sapiens
ccauacaaauuaucuuuu

SEQ ID NO: 1933521 - RNA, 18 nt, Homo sapiens
cuggcuuaaaauguaauu

SEQ ID NO: 1933522 - RNA, 14 nt, Homo sapiens
ggcucuuucuaucc

SEQ ID NO: 1933523 - RNA, 19 nt, Homo sapiens
gaacuauucugggggcccg

SEQ ID NO: 1933524 - RNA, 18 nt, Homo sapiens
ucuaauaaagucauuugu

SEQ ID NO: 1933525 - RNA, 16 nt, Homo sapiens
ucaaucacagucucag

SEQ ID NO: 1933526 - RNA, 17 nt, Homo sapiens
ugaagcuuuaaguuaag

SEQ ID NO: 1933527 - RNA, 21 nt, Homo sapiens
auauuugcugauacuaucucu

SEQ ID NO: 1933528 - RNA, 14 nt, Homo sapiens
gaggaucagcacug

SEQ ID NO: 1933529 - RNA, 18 nt, Homo sapiens
cuaucagcggcagcauuc

SEQ ID NO: 1933530 - RNA, 21 nt, Homo sapiens
auuuaaaaaaauacaguauuc

SEQ ID NO: 1933531 - RNA, 21 nt, Homo sapiens
cauucccagggaccuuggaaa

SEQ ID NO: 1933532 - RNA, 20 nt, Homo sapiens
ccugaauaaaguaaugccuc

SEQ ID NO: 1933533 - RNA, 15 nt, Homo sapiens
agaucccagugugaa

SEQ ID NO: 1933534 - RNA, 20 nt, Homo sapiens
acuccgggaccauugaccuc

SEQ ID NO: 1933535 - RNA, 20 nt, Homo sapiens
gauuaucuuguacagccuuu

SEQ ID NO: 1933536 - RNA, 14 nt, Homo sapiens
agcugaagcuacag

SEQ ID NO: 1933537 - RNA, 18 nt, Homo sapiens
caauaaaauacuuugguu

SEQ ID NO: 1933538 - RNA, 15 nt, Homo sapiens
cuccugugcugcgau

SEQ ID NO: 1933539 - RNA, 15 nt, Homo sapiens
uacugggagaaucac

SEQ ID NO: 1933540 - RNA, 15 nt, Homo sapiens
caguggcucauaaaa

SEQ ID NO: 1933541 - RNA, 13 nt, Homo sapiens
aggguggugaccu

SEQ ID NO: 1933542 - RNA, 13 nt, Homo sapiens
aggggccugugug

SEQ ID NO: 1933543 - RNA, 22 nt, Homo sapiens
ucauaauugucaaaaaccagaa

SEQ ID NO: 1933544 - RNA, 15 nt, Homo sapiens
ugcccauugucuuau

SEQ ID NO: 1933545 - RNA, 20 nt, Homo sapiens
auggccacauccaacauuuc

SEQ ID NO: 1933546 - RNA, 17 nt, Homo sapiens
aaucuguguaacuguaa

SEQ ID NO: 1933547 - RNA, 15 nt, Homo sapiens
aguugaauuuuacau

SEQ ID NO: 1933548 - RNA, 18 nt, Homo sapiens
uccccgcagagcucccuu

SEQ ID NO: 1933549 - RNA, 14 nt, Homo sapiens
ucaaauugcuuaaa

SEQ ID NO: 1933550 - RNA, 23 nt, Homo sapiens
ggcucacagauuuaaagcaucau

SEQ ID NO: 1933551 - RNA, 15 nt, Homo sapiens
uugugccacuguacu

SEQ ID NO: 1933552 - RNA, 17 nt, Homo sapiens
gaucuuccucacaccac

SEQ ID NO: 1933553 - RNA, 16 nt, Homo sapiens
uugcaaaccaucccag

SEQ ID NO: 1933554 - RNA, 23 nt, Homo sapiens
auuccaguugcaauucauaacua

SEQ ID NO: 1933555 - RNA, 21 nt, Homo sapiens
aggagagggaguacaaagaca

SEQ ID NO: 1933556 - RNA, 16 nt, Homo sapiens
aaauguacauuaauua

SEQ ID NO: 1933557 - RNA, 11 nt, Homo sapiens
gauucaaugug

SEQ ID NO: 1933558 - RNA, 18 nt, Homo sapiens
gagccuguguuagugucu

SEQ ID NO: 1933559 - RNA, 15 nt, Homo sapiens
uccuaugcaguguca

SEQ ID NO: 1933560 - RNA, 17 nt, Homo sapiens
cauugcuguucuacuuu

SEQ ID NO: 1933561 - RNA, 10 nt, Homo sapiens
uccaguggac

SEQ ID NO: 1933562 - RNA, 16 nt, Homo sapiens
ugagcuuggacuugca

SEQ ID NO: 1933563 - RNA, 20 nt, Homo sapiens
gcaaagacaaaagaaacuua

SEQ ID NO: 1933564 - RNA, 18 nt, Homo sapiens
gcucagauuguaauaugu

SEQ ID NO: 1933565 - RNA, 14 nt, Homo sapiens
gaaaagaaagugaa

SEQ ID NO: 1933566 - RNA, 23 nt, Homo sapiens
uaaagcaaagcaaaugaacacac

SEQ ID NO: 1933567 - RNA, 20 nt, Homo sapiens
gggugaccagccacucaaag

SEQ ID NO: 1933568 - RNA, 17 nt, Homo sapiens
cuucuuugauaguguaa

SEQ ID NO: 1933569 - RNA, 19 nt, Homo sapiens
ccuggcagucucaguccaa

SEQ ID NO: 1933570 - RNA, 19 nt, Homo sapiens
aaauaguuuaugauuccac

SEQ ID NO: 1933571 - RNA, 21 nt, Homo sapiens
uuuccuuugaauagcagguag

SEQ ID NO: 1933572 - RNA, 16 nt, Homo sapiens
ccuuucaguacucuua

SEQ ID NO: 1933573 - RNA, 16 nt, Homo sapiens
uuucaaggaaagugaa

SEQ ID NO: 1933574 - RNA, 20 nt, Homo sapiens
aagucccuuugugacuucaa

SEQ ID NO: 1933575 - RNA, 16 nt, Homo sapiens
aagacagauacuccuc

SEQ ID NO: 1933576 - RNA, 14 nt, Homo sapiens
aaauaaaaauauuc

SEQ ID NO: 1933577 - RNA, 16 nt, Homo sapiens
aaggugaaagugcagu

SEQ ID NO: 1933578 - RNA, 14 nt, Homo sapiens
auacccaguggaau

SEQ ID NO: 1933579 - RNA, 18 nt, Homo sapiens
ccaagccuaucauuguag

SEQ ID NO: 1933580 - RNA, 16 nt, Homo sapiens
gcugaagaacaucugg

SEQ ID NO: 1933581 - RNA, 20 nt, Homo sapiens
aacuuccauagcuucaucca

SEQ ID NO: 1933582 - RNA, 20 nt, Homo sapiens
acauucauuuucucaguuga

SEQ ID NO: 1933583 - RNA, 19 nt, Homo sapiens
uuugucccagccuggggcu

SEQ ID NO: 1933584 - RNA, 13 nt, Homo sapiens
ucccuaauucuuc

SEQ ID NO: 1933585 - RNA, 22 nt, Homo sapiens
aaacuacuauuuuucuuuccaa

SEQ ID NO: 1933586 - RNA, 15 nt, Homo sapiens
gagccaccaguucuc

SEQ ID NO: 1933587 - RNA, 20 nt, Homo sapiens
uuucucccacauauucacau

SEQ ID NO: 1933588 - RNA, 22 nt, Homo sapiens
uguagcauccuguuuguaucau

SEQ ID NO: 1933589 - RNA, 19 nt, Homo sapiens
uaggugcccagaaugaggc

SEQ ID NO: 1933590 - RNA, 17 nt, Homo sapiens
cugguaguucauuguaa

SEQ ID NO: 1933591 - RNA, 22 nt, Homo sapiens
aaaucuuaaaagcccuaaguga

SEQ ID NO: 1933592 - RNA, 17 nt, Homo sapiens
cuaugacauuacuguau

SEQ ID NO: 1933593 - RNA, 18 nt, Homo sapiens
agccaccacaccuggcua

SEQ ID NO: 1933594 - RNA, 16 nt, Homo sapiens
augucaaauaucucag

SEQ ID NO: 1933595 - RNA, 23 nt, Homo sapiens
uccccuccuuggcuuuaugcaaa

SEQ ID NO: 1933596 - RNA, 17 nt, Homo sapiens
gcccuuccccuucccac

SEQ ID NO: 1933597 - RNA, 23 nt, Homo sapiens
accccuugcccaaccaaugcaca

SEQ ID NO: 1933598 - RNA, 15 nt, Homo sapiens
ucacagagugugcug

SEQ ID NO: 1933599 - RNA, 12 nt, Homo sapiens
auauagcacaua

SEQ ID NO: 1933600 - RNA, 13 nt, Homo sapiens
ugugauacagagu

SEQ ID NO: 1933601 - RNA, 14 nt, Homo sapiens
cagucucuucugau

SEQ ID NO: 1933602 - RNA, 19 nt, Homo sapiens
auuccugccaccacugggc

SEQ ID NO: 1933603 - RNA, 14 nt, Homo sapiens
accagccaaccugg

SEQ ID NO: 1933604 - RNA, 23 nt, Homo sapiens
cugggguggggguggggagaccu

SEQ ID NO: 1933605 - RNA, 19 nt, Homo sapiens
guggcaggggcaguggccu

SEQ ID NO: 1933606 - RNA, 16 nt, Homo sapiens
uucuaacucacaggca

SEQ ID NO: 1933607 - RNA, 15 nt, Homo sapiens
cagaaauuuaauuca

SEQ ID NO: 1933608 - RNA, 16 nt, Homo sapiens
uggucucgaugcugcu

SEQ ID NO: 1933609 - RNA, 15 nt, Homo sapiens
auuuaaagcuuucaa

SEQ ID NO: 1933610 - RNA, 22 nt, Homo sapiens
gauauuauacaggaaagcaaua

SEQ ID NO: 1933611 - RNA, 13 nt, Homo sapiens
uccugaaucugau

SEQ ID NO: 1933612 - RNA, 22 nt, Homo sapiens
cugcuccaccagcagcauggca

SEQ ID NO: 1933613 - RNA, 23 nt, Homo sapiens
ucuuaaagcauuucaggccagug

SEQ ID NO: 1933614 - RNA, 15 nt, Homo sapiens
uacaauuuuagucac

SEQ ID NO: 1933615 - RNA, 12 nt, Homo sapiens
cagggugggccu

SEQ ID NO: 1933616 - RNA, 23 nt, Homo sapiens
caguggcggggggguuuugccua

SEQ ID NO: 1933617 - RNA, 15 nt, Homo sapiens
aacacuguacugagg

SEQ ID NO: 1933618 - RNA, 21 nt, Homo sapiens
augcuuuccuuuucuuccuuc

SEQ ID NO: 1933619 - RNA, 15 nt, Homo sapiens
aaauagaaacuugcu

SEQ ID NO: 1933620 - RNA, 17 nt, Homo sapiens
ugcuugcaauguaguca

SEQ ID NO: 1933621 - RNA, 16 nt, Homo sapiens
auuuuaguguguaaaa

SEQ ID NO: 1933622 - RNA, 22 nt, Homo sapiens
agagugugcuugucaucugcca

SEQ ID NO: 1933623 - RNA, 12 nt, Homo sapiens
guuggugugaau

SEQ ID NO: 1933624 - RNA, 17 nt, Homo sapiens
aagaauuauuuuauaca

SEQ ID NO: 1933625 - RNA, 22 nt, Homo sapiens
gaccacagacgggcacacagac

SEQ ID NO: 1933626 - RNA, 20 nt, Homo sapiens
ucaacauacuguugaugucu

SEQ ID NO: 1933627 - RNA, 16 nt, Homo sapiens
ggcgacugucaugugg

SEQ ID NO: 1933628 - RNA, 22 nt, Homo sapiens
cagcggugccucaacacccugg

SEQ ID NO: 1933629 - RNA, 23 nt, Homo sapiens
gugcuuguucuuccucuuaccug

SEQ ID NO: 1933630 - RNA, 13 nt, Homo sapiens
acucgaugcacug

SEQ ID NO: 1933631 - RNA, 18 nt, Homo sapiens
acacacauggaugcacac

SEQ ID NO: 1933632 - RNA, 19 nt, Homo sapiens
agugaugcaggcaguguaa

SEQ ID NO: 1933633 - RNA, 19 nt, Homo sapiens
uuggauuugcucagugucu

SEQ ID NO: 1933634 - RNA, 18 nt, Homo sapiens
gaccagggauuuccauga

SEQ ID NO: 1933635 - RNA, 23 nt, Homo sapiens
cacugugggaaggccagcugccc

SEQ ID NO: 1933636 - RNA, 13 nt, Homo sapiens
agauuuugcaccu

SEQ ID NO: 1933637 - RNA, 13 nt, Homo sapiens
acccaaugaauga

SEQ ID NO: 1933638 - RNA, 18 nt, Homo sapiens
gauguuaggcugggccca

SEQ ID NO: 1933639 - RNA, 15 nt, Homo sapiens
aucagagaguguaca

SEQ ID NO: 1933640 - RNA, 21 nt, Homo sapiens
auggaaaacaggagauccuaa

SEQ ID NO: 1933641 - RNA, 17 nt, Homo sapiens
uaccaauguaacacugg

SEQ ID NO: 1933642 - RNA, 14 nt, Homo sapiens
acuauuaagggaaa

SEQ ID NO: 1933643 - RNA, 19 nt, Homo sapiens
acugcuaggggagagcucu

SEQ ID NO: 1933644 - RNA, 18 nt, Homo sapiens
aaucuccucgacugcuuu

SEQ ID NO: 1933645 - RNA, 21 nt, Homo sapiens
cugauuuguauuaaaauugua

SEQ ID NO: 1933646 - RNA, 19 nt, Homo sapiens
uccccucccuggcucccau

SEQ ID NO: 1933647 - RNA, 20 nt, Homo sapiens
uccauuucccacaucuuucc

SEQ ID NO: 1933648 - RNA, 14 nt, Homo sapiens
augggucagggugu

SEQ ID NO: 1933649 - RNA, 15 nt, Homo sapiens
ggucauccaaacuca

SEQ ID NO: 1933650 - RNA, 16 nt, Homo sapiens
cuaaccuaucuaugaa

SEQ ID NO: 1933651 - RNA, 16 nt, Homo sapiens
uggugccccacagcua

SEQ ID NO: 1933652 - RNA, 22 nt, Homo sapiens
augucuccuuugcucuugccaa

SEQ ID NO: 1933653 - RNA, 23 nt, Homo sapiens
gcacacuuacaguauacauauau

SEQ ID NO: 1933654 - RNA, 15 nt, Homo sapiens
aaugaauaagcuuuc

SEQ ID NO: 1933655 - RNA, 22 nt, Homo sapiens
gccuuccacgcugucuccagac

SEQ ID NO: 1933656 - RNA, 22 nt, Homo sapiens
aauuauuuaugugaaagucaaa

SEQ ID NO: 1933657 - RNA, 14 nt, Homo sapiens
cugcaagcacugca

SEQ ID NO: 1933658 - RNA, 15 nt, Homo sapiens
cuuucuacacuguau

SEQ ID NO: 1933659 - RNA, 15 nt, Homo sapiens
gguuaaaacauaagc

SEQ ID NO: 1933660 - RNA, 15 nt, Homo sapiens
uaucuugauaaacua

SEQ ID NO: 1933661 - RNA, 19 nt, Homo sapiens
aguuacuauccuggcuuug

SEQ ID NO: 1933662 - RNA, 18 nt, Homo sapiens
guggcuucccgcucagcc

SEQ ID NO: 1933663 - RNA, 13 nt, Homo sapiens
caggagacugggc

SEQ ID NO: 1933664 - RNA, 22 nt, Homo sapiens
auagaauggaggggacuccaaa

SEQ ID NO: 1933665 - RNA, 18 nt, Homo sapiens
aaguacuuaaacuuccac

SEQ ID NO: 1933666 - RNA, 22 nt, Homo sapiens
uauauguccuuggguugcuggu

SEQ ID NO: 1933667 - RNA, 19 nt, Homo sapiens
auuucuuugauuuaacuga

SEQ ID NO: 1933668 - RNA, 18 nt, Homo sapiens
auauucaacagcucacca

SEQ ID NO: 1933669 - RNA, 16 nt, Homo sapiens
uccccagaugugacua

SEQ ID NO: 1933670 - RNA, 14 nt, Homo sapiens
uauuaauucuucac

SEQ ID NO: 1933671 - RNA, 13 nt, Homo sapiens
cuguuaccauuca

SEQ ID NO: 1933672 - RNA, 19 nt, Homo sapiens
ugaaauuuuccaaugucug

SEQ ID NO: 1933673 - RNA, 13 nt, Homo sapiens
uaccggauucucu

SEQ ID NO: 1933674 - RNA, 11 nt, Homo sapiens
ccugacugugu

SEQ ID NO: 1933675 - RNA, 18 nt, Homo sapiens
ggcaaugaaaauuuuaag

SEQ ID NO: 1933676 - RNA, 20 nt, Homo sapiens
gaaaauuggacauuaagcau

SEQ ID NO: 1933677 - RNA, 14 nt, Homo sapiens
ucuauguggcugua

SEQ ID NO: 1933678 - RNA, 19 nt, Homo sapiens
cagucauggccugagaugc

SEQ ID NO: 1933679 - RNA, 12 nt, Homo sapiens
uaaaaaugcaua

SEQ ID NO: 1933680 - RNA, 12 nt, Homo sapiens
ucuaaaugccaa

SEQ ID NO: 1933681 - RNA, 22 nt, Homo sapiens
aacuaaggacaggauggcugug

SEQ ID NO: 1933682 - RNA, 15 nt, Homo sapiens
ccccuguucuggcag

SEQ ID NO: 1933683 - RNA, 16 nt, Homo sapiens
aaaggagaacuaucca

SEQ ID NO: 1933684 - RNA, 21 nt, Homo sapiens
cacuaaucacaaacugaauga

SEQ ID NO: 1933685 - RNA, 18 nt, Homo sapiens
cuugagcugugugccaca

SEQ ID NO: 1933686 - RNA, 14 nt, Homo sapiens
cugacuccaagagg

SEQ ID NO: 1933687 - RNA, 18 nt, Homo sapiens
uaaagggaggauugaaag

SEQ ID NO: 1933688 - RNA, 21 nt, Homo sapiens
gcacaugccucucucaggcca

SEQ ID NO: 1933689 - RNA, 22 nt, Homo sapiens
ccccuggggugcaggcgccuca

SEQ ID NO: 1933690 - RNA, 15 nt, Homo sapiens
ucaaauuaucuucac

SEQ ID NO: 1933691 - RNA, 19 nt, Homo sapiens
aaaccucaucucucuaaca

SEQ ID NO: 1933692 - RNA, 21 nt, Homo sapiens
uuuuaaagcauauuggugcua

SEQ ID NO: 1933693 - RNA, 13 nt, Homo sapiens
uauaaagugcuuu

SEQ ID NO: 1933694 - RNA, 22 nt, Homo sapiens
uagggcugauaauacacacagu

SEQ ID NO: 1933695 - RNA, 17 nt, Homo sapiens
uaacuaauacuacugug

SEQ ID NO: 1933696 - RNA, 23 nt, Homo sapiens
agaugcucuacuuuuuccuuuua

SEQ ID NO: 1933697 - RNA, 15 nt, Homo sapiens
cucuguccaaucagg

SEQ ID NO: 1933698 - RNA, 11 nt, Homo sapiens
auaauuccaca

SEQ ID NO: 1933699 - RNA, 17 nt, Homo sapiens
ucaugcagcaggugcaa

SEQ ID NO: 1933700 - RNA, 17 nt, Homo sapiens
aguggagaccuuucuag

SEQ ID NO: 1933701 - RNA, 15 nt, Homo sapiens
cugcucccgucuguc

SEQ ID NO: 1933702 - RNA, 17 nt, Homo sapiens
cagguagcauagcucug

SEQ ID NO: 1933703 - RNA, 23 nt, Homo sapiens
guccaucuccaucggaacagaaa

SEQ ID NO: 1933704 - RNA, 17 nt, Homo sapiens
aucugcuguugccagug

SEQ ID NO: 1933705 - RNA, 23 nt, Homo sapiens
uuuauaaaugaagaugcauuuua

SEQ ID NO: 1933706 - RNA, 20 nt, Homo sapiens
ugucucuacuaaaaaugcaa

SEQ ID NO: 1933707 - RNA, 20 nt, Homo sapiens
ucucagaccugcgcacucca

SEQ ID NO: 1933708 - RNA, 16 nt, Homo sapiens
cuccaaagagaccagc

SEQ ID NO: 1933709 - RNA, 12 nt, Homo sapiens
augaucagcaaa

SEQ ID NO: 1933710 - RNA, 19 nt, Homo sapiens
uaauuggauauugaugaaa

SEQ ID NO: 1933711 - RNA, 21 nt, Homo sapiens
cugugcguuuuagaguaugca

SEQ ID NO: 1933712 - RNA, 20 nt, Homo sapiens
uaauuaaugucaguauuuca

SEQ ID NO: 1933713 - RNA, 22 nt, Homo sapiens
cuguucuauucaucucaaggaa

SEQ ID NO: 1933714 - RNA, 22 nt, Homo sapiens
ggacucucugccugcuuccugg

SEQ ID NO: 1933715 - RNA, 17 nt, Homo sapiens
auuuuacccuuuagacu

SEQ ID NO: 1933716 - RNA, 16 nt, Homo sapiens
uguacuacaguauacu

SEQ ID NO: 1933717 - RNA, 17 nt, Homo sapiens
cuccuucuuccuagcca

SEQ ID NO: 1933718 - RNA, 16 nt, Homo sapiens
gacacagcaucagcuc

SEQ ID NO: 1933719 - RNA, 18 nt, Homo sapiens
aauauaagcugccauaua

SEQ ID NO: 1933720 - RNA, 16 nt, Homo sapiens
accucuggcuuugucu

SEQ ID NO: 1933721 - RNA, 15 nt, Homo sapiens
aaacuguaugugcug

SEQ ID NO: 1933722 - RNA, 22 nt, Homo sapiens
cauuugccaauuuuccuacucu

SEQ ID NO: 1933723 - RNA, 17 nt, Homo sapiens
ccuggucaacaugguga

SEQ ID NO: 1933724 - RNA, 15 nt, Homo sapiens
ccucuuuucucugug

SEQ ID NO: 1933725 - RNA, 13 nt, Homo sapiens
cuccccaccuuca

SEQ ID NO: 1933726 - RNA, 13 nt, Homo sapiens
uuucccacuucca

SEQ ID NO: 1933727 - RNA, 22 nt, Homo sapiens
ggaggcaggaguuucguuuuca

SEQ ID NO: 1933728 - RNA, 22 nt, Homo sapiens
uauuaucuacaaacacugcaga

SEQ ID NO: 1933729 - RNA, 20 nt, Homo sapiens
augggcucuuccaacaagga

SEQ ID NO: 1933730 - RNA, 14 nt, Homo sapiens
ugaaggcaugccua

SEQ ID NO: 1933731 - RNA, 22 nt, Homo sapiens
caccggagaagaaccauuuaca

SEQ ID NO: 1933732 - RNA, 16 nt, Homo sapiens
gaauaguaauuuagaa

SEQ ID NO: 1933733 - RNA, 22 nt, Homo sapiens
auuuggaguucacagccuagaa

SEQ ID NO: 1933734 - RNA, 17 nt, Homo sapiens
agacccgaacuggccug

SEQ ID NO: 1933735 - RNA, 23 nt, Homo sapiens
cccuuucacacuguggugucucu

SEQ ID NO: 1933736 - RNA, 23 nt, Homo sapiens
acccaguguuuuaggagcaugag

SEQ ID NO: 1933737 - RNA, 19 nt, Homo sapiens
uguuggggggccccacgga

SEQ ID NO: 1933738 - RNA, 17 nt, Homo sapiens
guugaagccacugccuu

SEQ ID NO: 1933739 - RNA, 18 nt, Homo sapiens
auucuuuccaugccacga

SEQ ID NO: 1933740 - RNA, 16 nt, Homo sapiens
uagacaguagauacca

SEQ ID NO: 1933741 - RNA, 13 nt, Homo sapiens
ucacugauuuuca

SEQ ID NO: 1933742 - RNA, 14 nt, Homo sapiens
aacugggcauuuca

SEQ ID NO: 1933743 - RNA, 19 nt, Homo sapiens
ugcuauuuuuauacaguga

SEQ ID NO: 1933744 - RNA, 22 nt, Homo sapiens
uguguagggggguuucagggcu

SEQ ID NO: 1933745 - RNA, 17 nt, Homo sapiens
aacauguuuuaacauua

SEQ ID NO: 1933746 - RNA, 16 nt, Homo sapiens
ccucauuuugugaugu

SEQ ID NO: 1933747 - RNA, 20 nt, Homo sapiens
ucaugacaauggcagaugua

SEQ ID NO: 1933748 - RNA, 17 nt, Homo sapiens
acucaauggccuaaaac

SEQ ID NO: 1933749 - RNA, 22 nt, Homo sapiens
uaacacacagagcucaccuguu

SEQ ID NO: 1933750 - RNA, 16 nt, Homo sapiens
caggauuacuagucaa

SEQ ID NO: 1933751 - RNA, 19 nt, Homo sapiens
ucuuuuuucuuccuauuuc

SEQ ID NO: 1933752 - RNA, 18 nt, Homo sapiens
ccagacuuccuccuuucc

SEQ ID NO: 1933753 - RNA, 17 nt, Homo sapiens
gacagucaccuauccac

SEQ ID NO: 1933754 - RNA, 21 nt, Homo sapiens
ugagguaccaguuguauuuaa

SEQ ID NO: 1933755 - RNA, 14 nt, Homo sapiens
gucuagaggugaga

SEQ ID NO: 1933756 - RNA, 15 nt, Homo sapiens
cauggaucugcauaa

SEQ ID NO: 1933757 - RNA, 18 nt, Homo sapiens
uuccagcacuuuguauga

SEQ ID NO: 1933758 - RNA, 13 nt, Homo sapiens
aaaauuuuggaaa

SEQ ID NO: 1933759 - RNA, 18 nt, Homo sapiens
agcauaaguuucugggac

SEQ ID NO: 1933760 - RNA, 17 nt, Homo sapiens
uuucaugucauuugaca

SEQ ID NO: 1933761 - RNA, 17 nt, Homo sapiens
cuaggcauuugcugaau

SEQ ID NO: 1933762 - RNA, 19 nt, Homo sapiens
acuaaccagagucagcaca

SEQ ID NO: 1933763 - RNA, 20 nt, Homo sapiens
ggggagugugugugggguuu

SEQ ID NO: 1933764 - RNA, 17 nt, Homo sapiens
gcaaaacuccaucucaa

SEQ ID NO: 1933765 - RNA, 22 nt, Homo sapiens
uuuacuuauaaaauacaucuca

SEQ ID NO: 1933766 - RNA, 14 nt, Homo sapiens
ugucacucacaaaa

SEQ ID NO: 1933767 - RNA, 20 nt, Homo sapiens
cccagggcaccauccagcuc

SEQ ID NO: 1933768 - RNA, 11 nt, Homo sapiens
guguacauuuu

SEQ ID NO: 1933769 - RNA, 17 nt, Homo sapiens
acaguauacgcuccauc

SEQ ID NO: 1933770 - RNA, 19 nt, Homo sapiens
cuagcagaggaaaguguaa

SEQ ID NO: 1933771 - RNA, 19 nt, Homo sapiens
ucuuauaugcagaacacau

SEQ ID NO: 1933772 - RNA, 19 nt, Homo sapiens
aggagugcaagcagcacuc

SEQ ID NO: 1933773 - RNA, 16 nt, Homo sapiens
aguaguuaaaacagcu

SEQ ID NO: 1933774 - RNA, 22 nt, Homo sapiens
auuggacuccaggccugaccag

SEQ ID NO: 1933775 - RNA, 22 nt, Homo sapiens
auuaucuugaauguaguauuca

SEQ ID NO: 1933776 - RNA, 18 nt, Homo sapiens
gaaaauagccaguuccug

SEQ ID NO: 1933777 - RNA, 15 nt, Homo sapiens
aaugucacuguuaua

SEQ ID NO: 1933778 - RNA, 16 nt, Homo sapiens
ggguuaggacucucca

SEQ ID NO: 1933779 - RNA, 21 nt, Homo sapiens
uggggaaauaaaucuagcaaa

SEQ ID NO: 1933780 - RNA, 20 nt, Homo sapiens
caugcaagaaguacugccaa

SEQ ID NO: 1933781 - RNA, 13 nt, Homo sapiens
guacaaucuuuca

SEQ ID NO: 1933782 - RNA, 22 nt, Homo sapiens
ccccuguagagugggagcugag

SEQ ID NO: 1933783 - RNA, 20 nt, Homo sapiens
auuagcauucugguuuugac

SEQ ID NO: 1933784 - RNA, 22 nt, Homo sapiens
gcuuugcaaaaugagacuuucu

SEQ ID NO: 1933785 - RNA, 17 nt, Homo sapiens
aguccuaucugcgagaa

SEQ ID NO: 1933786 - RNA, 13 nt, Homo sapiens
ugagacuugccag

SEQ ID NO: 1933787 - RNA, 16 nt, Homo sapiens
uaaccuagaaguauuu

SEQ ID NO: 1933788 - RNA, 17 nt, Homo sapiens
gcauuacuauucacuga

SEQ ID NO: 1933789 - RNA, 15 nt, Homo sapiens
uacagguuacaugag

SEQ ID NO: 1933790 - RNA, 20 nt, Homo sapiens
gccugcuggagaaaccuuca

SEQ ID NO: 1933791 - RNA, 21 nt, Homo sapiens
uuggaacauacuguucacuca

SEQ ID NO: 1933792 - RNA, 20 nt, Homo sapiens
uggcucagaguccaauguac

SEQ ID NO: 1933793 - RNA, 23 nt, Homo sapiens
auucagguaauacaaacuauaua

SEQ ID NO: 1933794 - RNA, 19 nt, Homo sapiens
uagagagggaaggucucag

SEQ ID NO: 1933795 - RNA, 14 nt, Homo sapiens
caagggaaucugua

SEQ ID NO: 1933796 - RNA, 18 nt, Homo sapiens
gacuuaaaauagucucau

SEQ ID NO: 1933797 - RNA, 13 nt, Homo sapiens
cagugaagacaga

SEQ ID NO: 1933798 - RNA, 13 nt, Homo sapiens
uuuugagcacaaa

SEQ ID NO: 1933799 - RNA, 20 nt, Homo sapiens
uugaaauauaguaaacacuu

SEQ ID NO: 1933800 - RNA, 14 nt, Homo sapiens
uuggaggaaugaca

SEQ ID NO: 1933801 - RNA, 15 nt, Homo sapiens
uaauuuaauguauua

SEQ ID NO: 1933802 - RNA, 15 nt, Homo sapiens
agaucgggagcaaac

SEQ ID NO: 1933803 - RNA, 13 nt, Homo sapiens
uauuuaaauucca

SEQ ID NO: 1933804 - RNA, 14 nt, Homo sapiens
accuuuuacucuuc

SEQ ID NO: 1933805 - RNA, 15 nt, Homo sapiens
gcuggaacacugcug

SEQ ID NO: 1933806 - RNA, 21 nt, Homo sapiens
cagaguggccccucaccuggg

SEQ ID NO: 1933807 - RNA, 16 nt, Homo sapiens
agaaggggacugccac

SEQ ID NO: 1933808 - RNA, 20 nt, Homo sapiens
acugccauauacucuucaag

SEQ ID NO: 1933809 - RNA, 23 nt, Homo sapiens
agaggaacaagcaugucucucug

SEQ ID NO: 1933810 - RNA, 16 nt, Homo sapiens
aacacuugaagccauc

SEQ ID NO: 1933811 - RNA, 17 nt, Homo sapiens
ucuaugaucauugcuuu

SEQ ID NO: 1933812 - RNA, 11 nt, Homo sapiens
cccugccugag

SEQ ID NO: 1933813 - RNA, 20 nt, Homo sapiens
cuugauuaagaucucagugg

SEQ ID NO: 1933814 - RNA, 24 nt, Homo sapiens
agaaugcacaagaauggaucacaa

SEQ ID NO: 1933815 - RNA, 20 nt, Homo sapiens
aacagauaucuucaguuuaa

SEQ ID NO: 1933816 - RNA, 18 nt, Homo sapiens
uaguacaugcucugucca

SEQ ID NO: 1933817 - RNA, 19 nt, Homo sapiens
gaacuguuuaacacuuuuu

SEQ ID NO: 1933818 - RNA, 21 nt, Homo sapiens
auggguuucuccagagggaau

SEQ ID NO: 1933819 - RNA, 14 nt, Homo sapiens
ugccuuguucaagg

SEQ ID NO: 1933820 - RNA, 14 nt, Homo sapiens
uucuccagacaaac

SEQ ID NO: 1933821 - RNA, 23 nt, Homo sapiens
agucuuaacaacagcuucuugcu

SEQ ID NO: 1933822 - RNA, 15 nt, Homo sapiens
uugauuaaacuguau

SEQ ID NO: 1933823 - RNA, 15 nt, Homo sapiens
aucaaaucucuucca

SEQ ID NO: 1933824 - RNA, 13 nt, Homo sapiens
aagacaguguaca

SEQ ID NO: 1933825 - RNA, 13 nt, Homo sapiens
ucaggcccaggca

SEQ ID NO: 1933826 - RNA, 22 nt, Homo sapiens
cauccaagagggacuccaagcc

SEQ ID NO: 1933827 - RNA, 22 nt, Homo sapiens
cuugaaaugcucuuuugcacaa

SEQ ID NO: 1933828 - RNA, 22 nt, Homo sapiens
aacugcauuuuuaaucagugga

SEQ ID NO: 1933829 - RNA, 14 nt, Homo sapiens
uguaaaaucuugca

SEQ ID NO: 1933830 - RNA, 23 nt, Homo sapiens
ugaauuugcaaaguacuguaaga

SEQ ID NO: 1933831 - RNA, 19 nt, Homo sapiens
gcaugccuugugcuguuaa

SEQ ID NO: 1933832 - RNA, 16 nt, Homo sapiens
acauuccaucuuacau

SEQ ID NO: 1933833 - RNA, 19 nt, Homo sapiens
uuucucaacuggguccaga

SEQ ID NO: 1933834 - RNA, 17 nt, Homo sapiens
ccaucacugguugcacu

SEQ ID NO: 1933835 - RNA, 19 nt, Homo sapiens
augcugaugaaucacuguu

SEQ ID NO: 1933836 - RNA, 15 nt, Homo sapiens
uugcaaagcauuuga

SEQ ID NO: 1933837 - RNA, 12 nt, Homo sapiens
ucagguagccac

SEQ ID NO: 1933838 - RNA, 18 nt, Homo sapiens
cuuccuagauaugauaaa

SEQ ID NO: 1933839 - RNA, 13 nt, Homo sapiens
gagcucuuggccu

SEQ ID NO: 1933840 - RNA, 23 nt, Homo sapiens
cuccuugccucugcucugugcac

SEQ ID NO: 1933841 - RNA, 17 nt, Homo sapiens
agucucugaaugaagcu

SEQ ID NO: 1933842 - RNA, 18 nt, Homo sapiens
uucuauugggauauccuu

SEQ ID NO: 1933843 - RNA, 18 nt, Homo sapiens
caaaaggguguauagugu

SEQ ID NO: 1933844 - RNA, 22 nt, Homo sapiens
cuuagauuauguucaaugaaua

SEQ ID NO: 1933845 - RNA, 18 nt, Homo sapiens
cuccaggacuccacugga

SEQ ID NO: 1933846 - RNA, 16 nt, Homo sapiens
acaaaauaauaccuua

SEQ ID NO: 1933847 - RNA, 19 nt, Homo sapiens
acgugaagccacaggagcc

SEQ ID NO: 1933848 - RNA, 20 nt, Homo sapiens
cuaguucaaauuauuuggaa

SEQ ID NO: 1933849 - RNA, 17 nt, Homo sapiens
aguaacaggaaaccacu

SEQ ID NO: 1933850 - RNA, 23 nt, Homo sapiens
cuaaagcaguguuuucaccucau

SEQ ID NO: 1933851 - RNA, 19 nt, Homo sapiens
ggcucagauuguaauaugu

SEQ ID NO: 1933852 - RNA, 14 nt, Homo sapiens
aaaaccugacuuca

SEQ ID NO: 1933853 - RNA, 16 nt, Homo sapiens
aagagccaaguuccaa

SEQ ID NO: 1933854 - RNA, 16 nt, Homo sapiens
cccuagcccugguuag

SEQ ID NO: 1933855 - RNA, 17 nt, Homo sapiens
gcugggagcacuggugu

SEQ ID NO: 1933856 - RNA, 17 nt, Homo sapiens
uuaccucuauauaccaa

SEQ ID NO: 1933857 - RNA, 17 nt, Homo sapiens
aucaauuuguaauugcu

SEQ ID NO: 1933858 - RNA, 15 nt, Homo sapiens
cuguuggcagagcuu

SEQ ID NO: 1933859 - RNA, 17 nt, Homo sapiens
agcaaccuccacauguu

SEQ ID NO: 1933860 - RNA, 21 nt, Homo sapiens
gaagcucccacacccaccucu

SEQ ID NO: 1933861 - RNA, 23 nt, Homo sapiens
ucuccaagcccuucugucuguca

SEQ ID NO: 1933862 - RNA, 17 nt, Homo sapiens
ccuaauaauuguaucua

SEQ ID NO: 1933863 - RNA, 17 nt, Homo sapiens
cugguauacauugaauu

SEQ ID NO: 1933864 - RNA, 17 nt, Homo sapiens
cacagcacugccugcca

SEQ ID NO: 1933865 - RNA, 20 nt, Homo sapiens
uauaaucuuucaaaccagcu

SEQ ID NO: 1933866 - RNA, 17 nt, Homo sapiens
gaguaaucuuguugguu

SEQ ID NO: 1933867 - RNA, 15 nt, Homo sapiens
aguaaccguccagca

SEQ ID NO: 1933868 - RNA, 14 nt, Homo sapiens
gaucagaugaacuc

SEQ ID NO: 1933869 - RNA, 11 nt, Homo sapiens
acagugaaugu

SEQ ID NO: 1933870 - RNA, 12 nt, Homo sapiens
gucuaaaaccuu

SEQ ID NO: 1933871 - RNA, 19 nt, Homo sapiens
guccaugaagcacugagca

SEQ ID NO: 1933872 - RNA, 16 nt, Homo sapiens
caagcuuuuuugccac

SEQ ID NO: 1933873 - RNA, 20 nt, Homo sapiens
gcacccugcgccuccagagg

SEQ ID NO: 1933874 - RNA, 22 nt, Homo sapiens
gaauuuuggaaaaaugucacug

SEQ ID NO: 1933875 - RNA, 16 nt, Homo sapiens
ccccgacacacggggc

SEQ ID NO: 1933876 - RNA, 22 nt, Homo sapiens
cuccaacaucccuuauaccacu

SEQ ID NO: 1933877 - RNA, 22 nt, Homo sapiens
cagugcacauuucauaguuuca

SEQ ID NO: 1933878 - RNA, 14 nt, Homo sapiens
aaccauagcacagg

SEQ ID NO: 1933879 - RNA, 17 nt, Homo sapiens
ugcugccagacacugag

SEQ ID NO: 1933880 - RNA, 14 nt, Homo sapiens
auggcaugcugaaa

SEQ ID NO: 1933881 - RNA, 11 nt, Homo sapiens
ugcgugccugc

SEQ ID NO: 1933882 - RNA, 15 nt, Homo sapiens
aggacacauggauuu

SEQ ID NO: 1933883 - RNA, 18 nt, Homo sapiens
ugacccuugcugugaauu

SEQ ID NO: 1933884 - RNA, 12 nt, Homo sapiens
aauugugcuuau

SEQ ID NO: 1933885 - RNA, 17 nt, Homo sapiens
agauucacuuaacaaac

SEQ ID NO: 1933886 - RNA, 11 nt, Homo sapiens
acaccacaggc

SEQ ID NO: 1933887 - RNA, 20 nt, Homo sapiens
ggaacaauaaaaugucuucu

SEQ ID NO: 1933888 - RNA, 17 nt, Homo sapiens
cuuauauaaauguacag

SEQ ID NO: 1933889 - RNA, 17 nt, Homo sapiens
cacaucccaucgucucg

SEQ ID NO: 1933890 - RNA, 13 nt, Homo sapiens
aaaauguggcagg

SEQ ID NO: 1933891 - RNA, 13 nt, Homo sapiens
ugcuuaccuguga

SEQ ID NO: 1933892 - RNA, 23 nt, Homo sapiens
ccuucgacagcauuuuccucugc

SEQ ID NO: 1933893 - RNA, 16 nt, Homo sapiens
caaauccccuccccaa

SEQ ID NO: 1933894 - RNA, 20 nt, Homo sapiens
accagccccaccaugcaacu

SEQ ID NO: 1933895 - RNA, 16 nt, Homo sapiens
gacaugaaagguuggc

SEQ ID NO: 1933896 - RNA, 16 nt, Homo sapiens
uacaaagguuccauuc

SEQ ID NO: 1933897 - RNA, 15 nt, Homo sapiens
cuugaaaagacauca

SEQ ID NO: 1933898 - RNA, 16 nt, Homo sapiens
uugaguuucucuccac

SEQ ID NO: 1933899 - RNA, 18 nt, Homo sapiens
uccacagaagugagcucc

SEQ ID NO: 1933900 - RNA, 18 nt, Homo sapiens
auaaagacaaaugcugcg

SEQ ID NO: 1933901 - RNA, 20 nt, Homo sapiens
ugcgaauucuugcuugagga

SEQ ID NO: 1933902 - RNA, 19 nt, Homo sapiens
ucagauggagguucucaga

SEQ ID NO: 1933903 - RNA, 19 nt, Homo sapiens
gaagggcucuuucucucug

SEQ ID NO: 1933904 - RNA, 20 nt, Homo sapiens
uucugcaucaguucacugcu

SEQ ID NO: 1933905 - RNA, 15 nt, Homo sapiens
uaacuggacaugaag

SEQ ID NO: 1933906 - RNA, 13 nt, Homo sapiens
agcuguugaucuu

SEQ ID NO: 1933907 - RNA, 13 nt, Homo sapiens
ugcauuuguucag

SEQ ID NO: 1933908 - RNA, 18 nt, Homo sapiens
gacaguccacaggggcca

SEQ ID NO: 1933909 - RNA, 23 nt, Homo sapiens
ugaggugagcaucaucuucuggg

SEQ ID NO: 1933910 - RNA, 19 nt, Homo sapiens
aauguagaccugugagaaa

SEQ ID NO: 1933911 - RNA, 20 nt, Homo sapiens
ugcacacguuugugagcucc

SEQ ID NO: 1933912 - RNA, 16 nt, Homo sapiens
gaagacaaccaucaca

SEQ ID NO: 1933913 - RNA, 16 nt, Homo sapiens
acucuaggacucugca

SEQ ID NO: 1933914 - RNA, 18 nt, Homo sapiens
ugauacauuagcagcuau

SEQ ID NO: 1933915 - RNA, 15 nt, Homo sapiens
gggcaaacagaagaa

SEQ ID NO: 1933916 - RNA, 16 nt, Homo sapiens
ggggugccaguuugaa

SEQ ID NO: 1933917 - RNA, 23 nt, Homo sapiens
acacaaaacaacaaaaaccaaaa

SEQ ID NO: 1933918 - RNA, 18 nt, Homo sapiens
gugcugaaggaauggaag

SEQ ID NO: 1933919 - RNA, 16 nt, Homo sapiens
ugccaaaauacauuga

SEQ ID NO: 1933920 - RNA, 20 nt, Homo sapiens
aauuacacuuugaacuacua

SEQ ID NO: 1933921 - RNA, 17 nt, Homo sapiens
gguaaccccauacucuc

SEQ ID NO: 1933922 - RNA, 16 nt, Homo sapiens
caggaaagaugcauuu

SEQ ID NO: 1933923 - RNA, 15 nt, Homo sapiens
gaauucuuuugccaa

SEQ ID NO: 1933924 - RNA, 12 nt, Homo sapiens
auaaagcugucu

SEQ ID NO: 1933925 - RNA, 21 nt, Homo sapiens
uuauacuucucuauuaucuca

SEQ ID NO: 1933926 - RNA, 14 nt, Homo sapiens
auggugucaugcca

SEQ ID NO: 1933927 - RNA, 16 nt, Homo sapiens
agcauuaaaguucuag

SEQ ID NO: 1933928 - RNA, 16 nt, Homo sapiens
aguucuuaagcauuug

SEQ ID NO: 1933929 - RNA, 18 nt, Homo sapiens
uccauuuauuaagcagua

SEQ ID NO: 1933930 - RNA, 16 nt, Homo sapiens
accagaacaguaugaa

SEQ ID NO: 1933931 - RNA, 16 nt, Homo sapiens
aauuuaaggcaaaaaa

SEQ ID NO: 1933932 - RNA, 21 nt, Homo sapiens
gaaggacuaugaaaagcuaga

SEQ ID NO: 1933933 - RNA, 21 nt, Homo sapiens
cucagggucugcuucccccac

SEQ ID NO: 1933934 - RNA, 14 nt, Homo sapiens
uggcauaccuuuaa

SEQ ID NO: 1933935 - RNA, 21 nt, Homo sapiens
ggguuggcuguuccagacuca

SEQ ID NO: 1933936 - RNA, 23 nt, Homo sapiens
auuuuuguuuuuguacaguuuuu

SEQ ID NO: 1933937 - RNA, 22 nt, Homo sapiens
ucugaauggugcuguuucuaua

SEQ ID NO: 1933938 - RNA, 19 nt, Homo sapiens
ucuuucaagggaccucucc

SEQ ID NO: 1933939 - RNA, 12 nt, Homo sapiens
auuuaacuuucc

SEQ ID NO: 1933940 - RNA, 17 nt, Homo sapiens
cuagagcuagauguguc

SEQ ID NO: 1933941 - RNA, 19 nt, Homo sapiens
uggagaugcagcuacugga

SEQ ID NO: 1933942 - RNA, 21 nt, Homo sapiens
guucaaucuggauucauauuu

SEQ ID NO: 1933943 - RNA, 15 nt, Homo sapiens
agccucaugugugaa

SEQ ID NO: 1933944 - RNA, 17 nt, Homo sapiens
gagauaggggcagauag

SEQ ID NO: 1933945 - RNA, 22 nt, Homo sapiens
agccggggguggugacaugugc

SEQ ID NO: 1933946 - RNA, 20 nt, Homo sapiens
guguuugggauacugcuuau

SEQ ID NO: 1933947 - RNA, 20 nt, Homo sapiens
ggcccuuaccuuuccugaug

SEQ ID NO: 1933948 - RNA, 17 nt, Homo sapiens
uauacauguauagugag

SEQ ID NO: 1933949 - RNA, 12 nt, Homo sapiens
acagaaccacug

SEQ ID NO: 1933950 - RNA, 12 nt, Homo sapiens
ugagaaccugug

SEQ ID NO: 1933951 - RNA, 21 nt, Homo sapiens
agccuuggauguauaugucau

SEQ ID NO: 1933952 - RNA, 15 nt, Homo sapiens
acauaucuuguuaga

SEQ ID NO: 1933953 - RNA, 18 nt, Homo sapiens
agcggagaggaagccagc

SEQ ID NO: 1933954 - RNA, 17 nt, Homo sapiens
gcuugugauaugcacgu

SEQ ID NO: 1933955 - RNA, 18 nt, Homo sapiens
uguccuugugaugugcac

SEQ ID NO: 1933956 - RNA, 20 nt, Homo sapiens
caggacgccuggagaagggu

SEQ ID NO: 1933957 - RNA, 14 nt, Homo sapiens
ucauacccaugcac

SEQ ID NO: 1933958 - RNA, 20 nt, Homo sapiens
caggacuggggcuugccagg

SEQ ID NO: 1933959 - RNA, 14 nt, Homo sapiens
gauauauauuaucu

SEQ ID NO: 1933960 - RNA, 13 nt, Homo sapiens
ccacccaaaacac

SEQ ID NO: 1933961 - RNA, 13 nt, Homo sapiens
guccuaaggccca

SEQ ID NO: 1933962 - RNA, 20 nt, Homo sapiens
uggucugccucugagccacu

SEQ ID NO: 1933963 - RNA, 23 nt, Homo sapiens
gaggguuggguucaucugagcaa

SEQ ID NO: 1933964 - RNA, 17 nt, Homo sapiens
caccauucauuccaugu

SEQ ID NO: 1933965 - RNA, 15 nt, Homo sapiens
cuuaggccagugaug

SEQ ID NO: 1933966 - RNA, 13 nt, Homo sapiens
uaaagaaaaccuu

SEQ ID NO: 1933967 - RNA, 14 nt, Homo sapiens
agaaauaacaaauu

SEQ ID NO: 1933968 - RNA, 14 nt, Homo sapiens
cagcucaaaggcac

SEQ ID NO: 1933969 - RNA, 16 nt, Homo sapiens
cacauuaccauucaua

SEQ ID NO: 1933970 - RNA, 18 nt, Homo sapiens
cauucacagcuacgugug

SEQ ID NO: 1933971 - RNA, 17 nt, Homo sapiens
cugaaaggaacacuggc

SEQ ID NO: 1933972 - RNA, 15 nt, Homo sapiens
cuccuccugcauguc

SEQ ID NO: 1933973 - RNA, 22 nt, Homo sapiens
cuucaaccccaaggucagcucc

SEQ ID NO: 1933974 - RNA, 14 nt, Homo sapiens
auggugaaaugcag

SEQ ID NO: 1933975 - RNA, 21 nt, Homo sapiens
acccugaauucauugucucag

SEQ ID NO: 1933976 - RNA, 22 nt, Homo sapiens
ugaauauuuuucuguaguguga

SEQ ID NO: 1933977 - RNA, 14 nt, Homo sapiens
agcacaggcauauu

SEQ ID NO: 1933978 - RNA, 14 nt, Homo sapiens
cacacgugcauaga

SEQ ID NO: 1933979 - RNA, 21 nt, Homo sapiens
ugaaaccaacucuugcucuca

SEQ ID NO: 1933980 - RNA, 18 nt, Homo sapiens
ugccaauugagggcauua

SEQ ID NO: 1933981 - RNA, 22 nt, Homo sapiens
gucugcccugaacccacugcug

SEQ ID NO: 1933982 - RNA, 18 nt, Homo sapiens
aaaaauauguauccucua

SEQ ID NO: 1933983 - RNA, 21 nt, Homo sapiens
uggcuucugugcacuagccug

SEQ ID NO: 1933984 - RNA, 15 nt, Homo sapiens
cagccaggcaagaaa

SEQ ID NO: 1933985 - RNA, 22 nt, Homo sapiens
cucuguggccagcugcaucugu

SEQ ID NO: 1933986 - RNA, 18 nt, Homo sapiens
cauguacuacagcuauau

SEQ ID NO: 1933987 - RNA, 14 nt, Homo sapiens
uuuuacuugaauca

SEQ ID NO: 1933988 - RNA, 18 nt, Homo sapiens
ugccaaaggaugugauau

SEQ ID NO: 1933989 - RNA, 22 nt, Homo sapiens
cagcacugggaaccuagcuaca

SEQ ID NO: 1933990 - RNA, 17 nt, Homo sapiens
uaacuuugaagccauaa

SEQ ID NO: 1933991 - RNA, 12 nt, Homo sapiens
acaagugguggu

SEQ ID NO: 1933992 - RNA, 23 nt, Homo sapiens
aaguugcuaacuuaaaaaacugc

SEQ ID NO: 1933993 - RNA, 22 nt, Homo sapiens
aacuuacacugaucaauuucaa

SEQ ID NO: 1933994 - RNA, 14 nt, Homo sapiens
gaauacuuaacuca

SEQ ID NO: 1933995 - RNA, 23 nt, Homo sapiens
uuugagaauuauaaaauuaacau

SEQ ID NO: 1933996 - RNA, 19 nt, Homo sapiens
cuauggugcucagcccuga

SEQ ID NO: 1933997 - RNA, 17 nt, Homo sapiens
ccagcagaucccagcuc

SEQ ID NO: 1933998 - RNA, 16 nt, Homo sapiens
augugugaaguaugca

SEQ ID NO: 1933999 - RNA, 14 nt, Homo sapiens
uuuagaaagcuuaa

SEQ ID NO: 1934000 - RNA, 19 nt, Homo sapiens
agacaacucugcuugcuca

SEQ ID NO: 1934001 - RNA, 23 nt, Homo sapiens
uguguauuauaauucaaaggcau

SEQ ID NO: 1934002 - RNA, 15 nt, Homo sapiens
caucacacacaugga

SEQ ID NO: 1934003 - RNA, 23 nt, Homo sapiens
gccaggugcuuuucccuauccac

SEQ ID NO: 1934004 - RNA, 20 nt, Homo sapiens
cucuuaaggcauugagggcu

SEQ ID NO: 1934005 - RNA, 12 nt, Homo sapiens
aauccauuugag

SEQ ID NO: 1934006 - RNA, 17 nt, Homo sapiens
acuucauuaauuucaau

SEQ ID NO: 1934007 - RNA, 17 nt, Homo sapiens
uauccuccuguucugaa

SEQ ID NO: 1934008 - RNA, 18 nt, Homo sapiens
ggccaaugaaauugaaga

SEQ ID NO: 1934009 - RNA, 19 nt, Homo sapiens
ugggugcauaucuucccag

SEQ ID NO: 1934010 - RNA, 19 nt, Homo sapiens
uucccaagaguauccuacc

SEQ ID NO: 1934011 - RNA, 18 nt, Homo sapiens
acaaauaaguuacccuca

SEQ ID NO: 1934012 - RNA, 18 nt, Homo sapiens
auuggaauucuacuggaa

SEQ ID NO: 1934013 - RNA, 19 nt, Homo sapiens
aacaaaaacuguugcuauu

SEQ ID NO: 1934014 - RNA, 19 nt, Homo sapiens
cugcccagagccacagaaa

SEQ ID NO: 1934015 - RNA, 13 nt, Homo sapiens
gaaguguucacau

SEQ ID NO: 1934016 - RNA, 21 nt, Homo sapiens
ccagaauaaaacgcaaagggc

SEQ ID NO: 1934017 - RNA, 14 nt, Homo sapiens
uguuauagcuuuaa

SEQ ID NO: 1934018 - RNA, 17 nt, Homo sapiens
ucauuguuaaccacagc

SEQ ID NO: 1934019 - RNA, 13 nt, Homo sapiens
cauaucacucaau

SEQ ID NO: 1934020 - RNA, 21 nt, Homo sapiens
ucuccccuugucugcacuguu

SEQ ID NO: 1934021 - RNA, 15 nt, Homo sapiens
aucaauucccuugaa

SEQ ID NO: 1934022 - RNA, 17 nt, Homo sapiens
uuccagugcauguugcc

SEQ ID NO: 1934023 - RNA, 14 nt, Homo sapiens
ugggagugagggau

SEQ ID NO: 1934024 - RNA, 14 nt, Homo sapiens
acucauugucucag

SEQ ID NO: 1934025 - RNA, 15 nt, Homo sapiens
ggaauaugcuaguga

SEQ ID NO: 1934026 - RNA, 23 nt, Homo sapiens
caccaggaauccccaacaugcac

SEQ ID NO: 1934027 - RNA, 22 nt, Homo sapiens
ccccgcucccagauguaaagaa

SEQ ID NO: 1934028 - RNA, 23 nt, Homo sapiens
agggcagggugaccuacucccca

SEQ ID NO: 1934029 - RNA, 20 nt, Homo sapiens
aacuuccuuucugugccuca

SEQ ID NO: 1934030 - RNA, 14 nt, Homo sapiens
auuuuguaaucuca

SEQ ID NO: 1934031 - RNA, 23 nt, Homo sapiens
ccuacuuuauguauggagcucua

SEQ ID NO: 1934032 - RNA, 18 nt, Homo sapiens
cuuugcucccugcaagaa

SEQ ID NO: 1934033 - RNA, 14 nt, Homo sapiens
cuugucugcuaaau

SEQ ID NO: 1934034 - RNA, 21 nt, Homo sapiens
gaccggaggcaaaaggcagug

SEQ ID NO: 1934035 - RNA, 20 nt, Homo sapiens
ugacuuugggcaagccaagu

SEQ ID NO: 1934036 - RNA, 14 nt, Homo sapiens
cugaggacauggag

SEQ ID NO: 1934037 - RNA, 14 nt, Homo sapiens
aagaaaagaaugua

SEQ ID NO: 1934038 - RNA, 13 nt, Homo sapiens
accaaggaugaau

SEQ ID NO: 1934039 - RNA, 14 nt, Homo sapiens
aaauaagcauuuag

SEQ ID NO: 1934040 - RNA, 18 nt, Homo sapiens
acaaacugcagcugugag

SEQ ID NO: 1934041 - RNA, 20 nt, Homo sapiens
guuucuuugacuucaaugua

SEQ ID NO: 1934042 - RNA, 18 nt, Homo sapiens
caugcugaaaacuacaca

SEQ ID NO: 1934043 - RNA, 18 nt, Homo sapiens
ucagaaaagaagugaagu

SEQ ID NO: 1934044 - RNA, 20 nt, Homo sapiens
cuuacgcugcucuccugaca

SEQ ID NO: 1934045 - RNA, 13 nt, Homo sapiens
uugguugcuggaa

SEQ ID NO: 1934046 - RNA, 18 nt, Homo sapiens
aauguuuuuuauacuuca

SEQ ID NO: 1934047 - RNA, 23 nt, Homo sapiens
agugaggccuuauugccaggagg

SEQ ID NO: 1934048 - RNA, 15 nt, Homo sapiens
ugauguuuccuggaa

SEQ ID NO: 1934049 - RNA, 10 nt, Homo sapiens
uccaccagcc

SEQ ID NO: 1934050 - RNA, 13 nt, Homo sapiens
caagaacacugga

SEQ ID NO: 1934051 - RNA, 19 nt, Homo sapiens
gcuuggcugucucaucccc

SEQ ID NO: 1934052 - RNA, 23 nt, Homo sapiens
cucuucugagcacagauguuccc

SEQ ID NO: 1934053 - RNA, 15 nt, Homo sapiens
cagaaaggaguuauu

SEQ ID NO: 1934054 - RNA, 19 nt, Homo sapiens
aauauuuuauauuguuaua

SEQ ID NO: 1934055 - RNA, 14 nt, Homo sapiens
aagaacccuucuca

SEQ ID NO: 1934056 - RNA, 20 nt, Homo sapiens
uuugcauuuucaucuacuca

SEQ ID NO: 1934057 - RNA, 19 nt, Homo sapiens
acucuggggugcugccuga

SEQ ID NO: 1934058 - RNA, 16 nt, Homo sapiens
cccucaggccagugcc

SEQ ID NO: 1934059 - RNA, 16 nt, Homo sapiens
cccugggcuuugucau

SEQ ID NO: 1934060 - RNA, 19 nt, Homo sapiens
uguguaaauguuaugacuc

SEQ ID NO: 1934061 - RNA, 15 nt, Homo sapiens
agccaauguuuucca

SEQ ID NO: 1934062 - RNA, 15 nt, Homo sapiens
cagaagcaaaggaga

SEQ ID NO: 1934063 - RNA, 14 nt, Homo sapiens
gagguuggggacac

SEQ ID NO: 1934064 - RNA, 19 nt, Homo sapiens
uaaauguauuccuguaggg

SEQ ID NO: 1934065 - RNA, 19 nt, Homo sapiens
ggaauggggaccuggggug

SEQ ID NO: 1934066 - RNA, 13 nt, Homo sapiens
ugcgagacucuga

SEQ ID NO: 1934067 - RNA, 13 nt, Homo sapiens
ugcaggacucuag

SEQ ID NO: 1934068 - RNA, 14 nt, Homo sapiens
uguucuguuacaaa

SEQ ID NO: 1934069 - RNA, 12 nt, Homo sapiens
aaugguguuaca

SEQ ID NO: 1934070 - RNA, 18 nt, Homo sapiens
aucucagauacuuaugaa

SEQ ID NO: 1934071 - RNA, 11 nt, Homo sapiens
gugugccaaac

SEQ ID NO: 1934072 - RNA, 23 nt, Homo sapiens
acugugagcaaggagcacaagcc

SEQ ID NO: 1934073 - RNA, 18 nt, Homo sapiens
gcagacauguauuucuua

SEQ ID NO: 1934074 - RNA, 14 nt, Homo sapiens
gcccaggcacuggg

SEQ ID NO: 1934075 - RNA, 21 nt, Homo sapiens
aucauauugguauucacuaau

SEQ ID NO: 1934076 - RNA, 14 nt, Homo sapiens
ucugagaccaaagu

SEQ ID NO: 1934077 - RNA, 20 nt, Homo sapiens
guaggaaccugcacacgagc

SEQ ID NO: 1934078 - RNA, 17 nt, Homo sapiens
uacuggggaaacuggcc

SEQ ID NO: 1934079 - RNA, 17 nt, Homo sapiens
cuacucagaucugcacu

SEQ ID NO: 1934080 - RNA, 21 nt, Homo sapiens
ugaugccauaaauacaagauu

SEQ ID NO: 1934081 - RNA, 23 nt, Homo sapiens
auuagauuuauucgccugauaag

SEQ ID NO: 1934082 - RNA, 18 nt, Homo sapiens
uucauagcuugcaguuuc

SEQ ID NO: 1934083 - RNA, 18 nt, Homo sapiens
cucccccguggugccugc

SEQ ID NO: 1934084 - RNA, 22 nt, Homo sapiens
aggauaacuggcacccagagaa

SEQ ID NO: 1934085 - RNA, 15 nt, Homo sapiens
cauccuaugcuuaau

SEQ ID NO: 1934086 - RNA, 22 nt, Homo sapiens
cacugugcugagucugaaggcu

SEQ ID NO: 1934087 - RNA, 14 nt, Homo sapiens
aucuuauucccaau

SEQ ID NO: 1934088 - RNA, 14 nt, Homo sapiens
cuuaauuuacuuua

SEQ ID NO: 1934089 - RNA, 17 nt, Homo sapiens
uuuccaaaacuguccag

SEQ ID NO: 1934090 - RNA, 21 nt, Homo sapiens
uguuaaugcuuucccacucuc

SEQ ID NO: 1934091 - RNA, 18 nt, Homo sapiens
gagguccgacaaaccugg

SEQ ID NO: 1934092 - RNA, 20 nt, Homo sapiens
caauucuaguguaaaucaug

SEQ ID NO: 1934093 - RNA, 19 nt, Homo sapiens
ucucaacauggaaaaaucc

SEQ ID NO: 1934094 - RNA, 17 nt, Homo sapiens
caccccuaccucuagua

SEQ ID NO: 1934095 - RNA, 14 nt, Homo sapiens
acagagacaucucc

SEQ ID NO: 1934096 - RNA, 20 nt, Homo sapiens
ucuucccuuaggcaauggug

SEQ ID NO: 1934097 - RNA, 22 nt, Homo sapiens
aacaacaaagacaugcuuucca

SEQ ID NO: 1934098 - RNA, 22 nt, Homo sapiens
agcuacaaucuguucaauguuu

SEQ ID NO: 1934099 - RNA, 24 nt, Homo sapiens
ugaggccacacccagaguagccau

SEQ ID NO: 1934100 - RNA, 15 nt, Homo sapiens
uuauacuacaauaau

SEQ ID NO: 1934101 - RNA, 14 nt, Homo sapiens
agcaacuuauguau

SEQ ID NO: 1934102 - RNA, 21 nt, Homo sapiens
ccugaacuauaacaccugcca

SEQ ID NO: 1934103 - RNA, 16 nt, Homo sapiens
uguacaauuacuguga

SEQ ID NO: 1934104 - RNA, 21 nt, Homo sapiens
aaguuggguuuucuccauuca

SEQ ID NO: 1934105 - RNA, 15 nt, Homo sapiens
uacacaagugcacag

SEQ ID NO: 1934106 - RNA, 19 nt, Homo sapiens
gacacuucccaagaaggcc

SEQ ID NO: 1934107 - RNA, 16 nt, Homo sapiens
cuuuuuguuaugcaaa

SEQ ID NO: 1934108 - RNA, 17 nt, Homo sapiens
auaaggcugcaacugga

SEQ ID NO: 1934109 - RNA, 21 nt, Homo sapiens
aggaauaguggacauggucac

SEQ ID NO: 1934110 - RNA, 16 nt, Homo sapiens
ugacaggcagugccau

SEQ ID NO: 1934111 - RNA, 21 nt, Homo sapiens
ucaaagucuaacauauucaau

SEQ ID NO: 1934112 - RNA, 14 nt, Homo sapiens
uccagcuccuguaa

SEQ ID NO: 1934113 - RNA, 16 nt, Homo sapiens
guacugugcaguuuuc

SEQ ID NO: 1934114 - RNA, 13 nt, Homo sapiens
aauucuaaacuga

SEQ ID NO: 1934115 - RNA, 13 nt, Homo sapiens
cuguaucugugua

SEQ ID NO: 1934116 - RNA, 13 nt, Homo sapiens
ccucaucugcuca

SEQ ID NO: 1934117 - RNA, 13 nt, Homo sapiens
cucacucugucac

SEQ ID NO: 1934118 - RNA, 20 nt, Homo sapiens
cuacagcucuuaaauguagc

SEQ ID NO: 1934119 - RNA, 21 nt, Homo sapiens
uccuugggcgucucccccaga

SEQ ID NO: 1934120 - RNA, 18 nt, Homo sapiens
ccccaugccuguccagcc

SEQ ID NO: 1934121 - RNA, 13 nt, Homo sapiens
aauauggacauau

SEQ ID NO: 1934122 - RNA, 13 nt, Homo sapiens
aauaaauugugaa

SEQ ID NO: 1934123 - RNA, 14 nt, Homo sapiens
uacaagcauuugcc

SEQ ID NO: 1934124 - RNA, 15 nt, Homo sapiens
gaagaaccauuuaca

SEQ ID NO: 1934125 - RNA, 10 nt, Homo sapiens
ucccuaucua

SEQ ID NO: 1934126 - RNA, 13 nt, Homo sapiens
uccaaaagacaaa

SEQ ID NO: 1934127 - RNA, 13 nt, Homo sapiens
auuuaugaccuca

SEQ ID NO: 1934128 - RNA, 13 nt, Homo sapiens
uaaaagaugccgu

SEQ ID NO: 1934129 - RNA, 15 nt, Homo sapiens
acacagacugcgauu

SEQ ID NO: 1934130 - RNA, 15 nt, Homo sapiens
ucccagauccaggaa

SEQ ID NO: 1934131 - RNA, 22 nt, Homo sapiens
cuugaagaaccucucacuucac

SEQ ID NO: 1934132 - RNA, 17 nt, Homo sapiens
uaaacaugcauugugaa

SEQ ID NO: 1934133 - RNA, 11 nt, Homo sapiens
ucgcagacuua

SEQ ID NO: 1934134 - RNA, 20 nt, Homo sapiens
aagcacuuacaccaguuuga

SEQ ID NO: 1934135 - RNA, 13 nt, Homo sapiens
ugauuuuacuuag

SEQ ID NO: 1934136 - RNA, 15 nt, Homo sapiens
agcaagagacaauaa

SEQ ID NO: 1934137 - RNA, 15 nt, Homo sapiens
accacuauucaauuu

SEQ ID NO: 1934138 - RNA, 22 nt, Homo sapiens
aauacuauuggacagacacaga

SEQ ID NO: 1934139 - RNA, 15 nt, Homo sapiens
uuaauaaguauaucu

SEQ ID NO: 1934140 - RNA, 18 nt, Homo sapiens
acgcaucagacagaugga

SEQ ID NO: 1934141 - RNA, 21 nt, Homo sapiens
cccuuggucgccuagacugga

SEQ ID NO: 1934142 - RNA, 14 nt, Homo sapiens
agcucccuccucag

SEQ ID NO: 1934143 - RNA, 16 nt, Homo sapiens
ccaggccugagcaaca

SEQ ID NO: 1934144 - RNA, 14 nt, Homo sapiens
ccacccuguuccug

SEQ ID NO: 1934145 - RNA, 18 nt, Homo sapiens
accaaucagcacucugua

SEQ ID NO: 1934146 - RNA, 15 nt, Homo sapiens
guuuggggacauaaa

SEQ ID NO: 1934147 - RNA, 20 nt, Homo sapiens
ccaugugucauguaauacug

SEQ ID NO: 1934148 - RNA, 13 nt, Homo sapiens
gcugcgcacugug

SEQ ID NO: 1934149 - RNA, 15 nt, Homo sapiens
gcauggauacuacag

SEQ ID NO: 1934150 - RNA, 20 nt, Homo sapiens
caacagccugacaacauuuc

SEQ ID NO: 1934151 - RNA, 19 nt, Homo sapiens
auuauacacaucuggcuca

SEQ ID NO: 1934152 - RNA, 13 nt, Homo sapiens
aucuguacuuugg

SEQ ID NO: 1934153 - RNA, 13 nt, Homo sapiens
accuguacucugg

SEQ ID NO: 1934154 - RNA, 18 nt, Homo sapiens
cagcugaggagcugugag

SEQ ID NO: 1934155 - RNA, 14 nt, Homo sapiens
ugguaaaauacuuc

SEQ ID NO: 1934156 - RNA, 23 nt, Homo sapiens
aggugcccacuccgccagccaca

SEQ ID NO: 1934157 - RNA, 20 nt, Homo sapiens
agaaaaggccaauauaccua

SEQ ID NO: 1934158 - RNA, 17 nt, Homo sapiens
aacauguccuaauucuu

SEQ ID NO: 1934159 - RNA, 18 nt, Homo sapiens
cucuggaaaaugugaccc

SEQ ID NO: 1934160 - RNA, 14 nt, Homo sapiens
aaaugcuguucuca

SEQ ID NO: 1934161 - RNA, 23 nt, Homo sapiens
uucugugucacgugacccugugc

SEQ ID NO: 1934162 - RNA, 12 nt, Homo sapiens
uaacugcuucuu

SEQ ID NO: 1934163 - RNA, 12 nt, Homo sapiens
caucugcuccau

SEQ ID NO: 1934164 - RNA, 20 nt, Homo sapiens
uaaucccagcuacuugggag

SEQ ID NO: 1934165 - RNA, 15 nt, Homo sapiens
ugaaugcuccaguca

SEQ ID NO: 1934166 - RNA, 13 nt, Homo sapiens
auuuagcuuacau

SEQ ID NO: 1934167 - RNA, 20 nt, Homo sapiens
ugaaccucaagcugcaucua

SEQ ID NO: 1934168 - RNA, 15 nt, Homo sapiens
ucacugugucucaug

SEQ ID NO: 1934169 - RNA, 21 nt, Homo sapiens
ccacagagaaguuuguagcca

SEQ ID NO: 1934170 - RNA, 14 nt, Homo sapiens
gcacaacaaaggau

SEQ ID NO: 1934171 - RNA, 16 nt, Homo sapiens
acuucauuuauaugaa

SEQ ID NO: 1934172 - RNA, 18 nt, Homo sapiens
cuucccugauggccuuug

SEQ ID NO: 1934173 - RNA, 18 nt, Homo sapiens
agugagcguagcagcuca

SEQ ID NO: 1934174 - RNA, 14 nt, Homo sapiens
cccuaaacugugaa

SEQ ID NO: 1934175 - RNA, 12 nt, Homo sapiens
aaagauaagugu

SEQ ID NO: 1934176 - RNA, 13 nt, Homo sapiens
aaccuccuaaaau

SEQ ID NO: 1934177 - RNA, 20 nt, Homo sapiens
auuaagagagugaacauauc

SEQ ID NO: 1934178 - RNA, 22 nt, Homo sapiens
uggccauuuuguaccagggcuc

SEQ ID NO: 1934179 - RNA, 22 nt, Homo sapiens
uaucaugauccucccuaucaag

SEQ ID NO: 1934180 - RNA, 12 nt, Homo sapiens
ugcagagugcag

SEQ ID NO: 1934181 - RNA, 15 nt, Homo sapiens
gcagaugcugcugaa

SEQ ID NO: 1934182 - RNA, 13 nt, Homo sapiens
aagauacacuccu

SEQ ID NO: 1934183 - RNA, 16 nt, Homo sapiens
aggccacaccaucucc

SEQ ID NO: 1934184 - RNA, 23 nt, Homo sapiens
gugucucagggugcagaggucag

SEQ ID NO: 1934185 - RNA, 12 nt, Homo sapiens
aagagccaguuu

SEQ ID NO: 1934186 - RNA, 11 nt, Homo sapiens
uuuacauauau

SEQ ID NO: 1934187 - RNA, 16 nt, Homo sapiens
ggcgggcagggguucc

SEQ ID NO: 1934188 - RNA, 13 nt, Homo sapiens
agcugagcaggga

SEQ ID NO: 1934189 - RNA, 21 nt, Homo sapiens
auggugaaaccucaucucuac

SEQ ID NO: 1934190 - RNA, 17 nt, Homo sapiens
gucuacauacuuucauc

SEQ ID NO: 1934191 - RNA, 15 nt, Homo sapiens
cugggcuugucugua

SEQ ID NO: 1934192 - RNA, 21 nt, Homo sapiens
uggagaaggucacaacccuuc

SEQ ID NO: 1934193 - RNA, 21 nt, Homo sapiens
ucuauauuauauaaauaguau

SEQ ID NO: 1934194 - RNA, 14 nt, Homo sapiens
agcuugcugagggg

SEQ ID NO: 1934195 - RNA, 23 nt, Homo sapiens
cuguguguuuucccaaagcacuu

SEQ ID NO: 1934196 - RNA, 15 nt, Homo sapiens
uuauuuucuacuuac

SEQ ID NO: 1934197 - RNA, 13 nt, Homo sapiens
cccuuucauacaa

SEQ ID NO: 1934198 - RNA, 19 nt, Homo sapiens
aaguaucuuuccagcaugu

SEQ ID NO: 1934199 - RNA, 15 nt, Homo sapiens
agucuugcucuguca

SEQ ID NO: 1934200 - RNA, 22 nt, Homo sapiens
uuuccagacuuugaaacuauua

SEQ ID NO: 1934201 - RNA, 16 nt, Homo sapiens
cccagcccaccugcuc

SEQ ID NO: 1934202 - RNA, 19 nt, Homo sapiens
uagccagugcuccaggcac

SEQ ID NO: 1934203 - RNA, 20 nt, Homo sapiens
auaguuggagguauccugug

SEQ ID NO: 1934204 - RNA, 17 nt, Homo sapiens
gcauuuucaacauugau

SEQ ID NO: 1934205 - RNA, 17 nt, Homo sapiens
gauuaccgacacuguca

SEQ ID NO: 1934206 - RNA, 15 nt, Homo sapiens
aauugcauacuuugu

SEQ ID NO: 1934207 - RNA, 18 nt, Homo sapiens
agcuccuccccugcuacc

SEQ ID NO: 1934208 - RNA, 13 nt, Homo sapiens
agagcacuuuuaa

SEQ ID NO: 1934209 - RNA, 23 nt, Homo sapiens
uauuuuucaaagauguguugcua

SEQ ID NO: 1934210 - RNA, 22 nt, Homo sapiens
guucuugguguuugacuguaau

SEQ ID NO: 1934211 - RNA, 22 nt, Homo sapiens
uaccaaagccaauaaaugaacu

SEQ ID NO: 1934212 - RNA, 17 nt, Homo sapiens
caccugcuggggaccuc

SEQ ID NO: 1934213 - RNA, 14 nt, Homo sapiens
cuagguaacaguuu

SEQ ID NO: 1934214 - RNA, 19 nt, Homo sapiens
gacaaauaucuuuuuugga

SEQ ID NO: 1934215 - RNA, 14 nt, Homo sapiens
agaagucuugagaa

SEQ ID NO: 1934216 - RNA, 18 nt, Homo sapiens
ggugagguaccagccuug

SEQ ID NO: 1934217 - RNA, 23 nt, Homo sapiens
gucugggaaagcagaguggugga

SEQ ID NO: 1934218 - RNA, 17 nt, Homo sapiens
caggcaagagaauugaa

SEQ ID NO: 1934219 - RNA, 20 nt, Homo sapiens
uaaaacauugguuauauuac

SEQ ID NO: 1934220 - RNA, 20 nt, Homo sapiens
uacuuucaucuauucuuucc

SEQ ID NO: 1934221 - RNA, 17 nt, Homo sapiens
agccccuccucccucaa

SEQ ID NO: 1934222 - RNA, 11 nt, Homo sapiens
uauuugucauu

SEQ ID NO: 1934223 - RNA, 20 nt, Homo sapiens
uuggugaaaauuaggguugg

SEQ ID NO: 1934224 - RNA, 22 nt, Homo sapiens
ggguccacccuguccuaugacu

SEQ ID NO: 1934225 - RNA, 13 nt, Homo sapiens
cuuccccuucucg

SEQ ID NO: 1934226 - RNA, 14 nt, Homo sapiens
ucuaagagaucugg

SEQ ID NO: 1934227 - RNA, 20 nt, Homo sapiens
cuccugaccucaagugaucc

SEQ ID NO: 1934228 - RNA, 14 nt, Homo sapiens
aaaauccaaaugag

SEQ ID NO: 1934229 - RNA, 20 nt, Homo sapiens
caacuacuucucuugcauac

SEQ ID NO: 1934230 - RNA, 21 nt, Homo sapiens
ucuugcuauggggagaaaaga

SEQ ID NO: 1934231 - RNA, 16 nt, Homo sapiens
aacucauacugugcug

SEQ ID NO: 1934232 - RNA, 16 nt, Homo sapiens
ucucuuugccauuucu

SEQ ID NO: 1934233 - RNA, 19 nt, Homo sapiens
cagaggggugcugcuccua

SEQ ID NO: 1934234 - RNA, 13 nt, Homo sapiens
cagggcaaaauau

SEQ ID NO: 1934235 - RNA, 15 nt, Homo sapiens
ucaacaaucacaacc

SEQ ID NO: 1934236 - RNA, 23 nt, Homo sapiens
uggagacaccaaccgacaggccc

SEQ ID NO: 1934237 - RNA, 21 nt, Homo sapiens
cuagggcacuuuaagucagug

SEQ ID NO: 1934238 - RNA, 18 nt, Homo sapiens
aaggaagggccaccacac

SEQ ID NO: 1934239 - RNA, 16 nt, Homo sapiens
gcauguguauuuccag

SEQ ID NO: 1934240 - RNA, 19 nt, Homo sapiens
cugagggagacugcaaaug

SEQ ID NO: 1934241 - RNA, 18 nt, Homo sapiens
acuuuuagcuacugcuaa

SEQ ID NO: 1934242 - RNA, 15 nt, Homo sapiens
ugaagugaggacaaa

SEQ ID NO: 1934243 - RNA, 15 nt, Homo sapiens
aacacugucaucugu

SEQ ID NO: 1934244 - RNA, 15 nt, Homo sapiens
ggcaucauucucuaa

SEQ ID NO: 1934245 - RNA, 21 nt, Homo sapiens
ucccaacuucgccagccucca

SEQ ID NO: 1934246 - RNA, 13 nt, Homo sapiens
ugcggagcaagag

SEQ ID NO: 1934247 - RNA, 20 nt, Homo sapiens
ccaaagagucucuggcucag

SEQ ID NO: 1934248 - RNA, 14 nt, Homo sapiens
cuggaaaccaaaua

SEQ ID NO: 1934249 - RNA, 18 nt, Homo sapiens
uccaggaaaacugggaca

SEQ ID NO: 1934250 - RNA, 16 nt, Homo sapiens
uaaucucuauguagaa

SEQ ID NO: 1934251 - RNA, 16 nt, Homo sapiens
caaauuuauugauguu

SEQ ID NO: 1934252 - RNA, 14 nt, Homo sapiens
agaaggccagcccu

SEQ ID NO: 1934253 - RNA, 23 nt, Homo sapiens
cagagagccauuuugugaaugga

SEQ ID NO: 1934254 - RNA, 18 nt, Homo sapiens
gugcacaauaaagggggu

SEQ ID NO: 1934255 - RNA, 15 nt, Homo sapiens
aucucccaucuuccu

SEQ ID NO: 1934256 - RNA, 16 nt, Homo sapiens
auuccuguuacuuuac

SEQ ID NO: 1934257 - RNA, 11 nt, Homo sapiens
gaaugguggag

SEQ ID NO: 1934258 - RNA, 19 nt, Homo sapiens
agccagggggacuagcccc

SEQ ID NO: 1934259 - RNA, 20 nt, Homo sapiens
auggagugggugucucugca

SEQ ID NO: 1934260 - RNA, 16 nt, Homo sapiens
gcggugccaugaaggg

SEQ ID NO: 1934261 - RNA, 13 nt, Homo sapiens
ucuucagagacag

SEQ ID NO: 1934262 - RNA, 22 nt, Homo sapiens
gacuuucuaaugggcuuucccc

SEQ ID NO: 1934263 - RNA, 19 nt, Homo sapiens
uaaccgaacuggugcuuua

SEQ ID NO: 1934264 - RNA, 23 nt, Homo sapiens
uaaaaaaaaaaaaaaaagugaug

SEQ ID NO: 1934265 - RNA, 13 nt, Homo sapiens
uguuggacaccca

SEQ ID NO: 1934266 - RNA, 13 nt, Homo sapiens
cuguuauacacag

SEQ ID NO: 1934267 - RNA, 23 nt, Homo sapiens
ccaagaaacacugccugcccucu

SEQ ID NO: 1934268 - RNA, 16 nt, Homo sapiens
uagaucuuaggcaaaa

SEQ ID NO: 1934269 - RNA, 12 nt, Homo sapiens
ccagaguguccu

SEQ ID NO: 1934270 - RNA, 13 nt, Homo sapiens
aacuuucuucaaa

SEQ ID NO: 1934271 - RNA, 14 nt, Homo sapiens
aaaugcuacugaaa

SEQ ID NO: 1934272 - RNA, 17 nt, Homo sapiens
gcaaaauauaucacuuu

SEQ ID NO: 1934273 - RNA, 16 nt, Homo sapiens
auuaucugucauucaa

SEQ ID NO: 1934274 - RNA, 14 nt, Homo sapiens
cucugcauagacaa

SEQ ID NO: 1934275 - RNA, 15 nt, Homo sapiens
uccagguuuaugaau

SEQ ID NO: 1934276 - RNA, 19 nt, Homo sapiens
uucuagggaccagcaauac

SEQ ID NO: 1934277 - RNA, 15 nt, Homo sapiens
aaagaguucccugca

SEQ ID NO: 1934278 - RNA, 13 nt, Homo sapiens
gccagcagcaccu

SEQ ID NO: 1934279 - RNA, 16 nt, Homo sapiens
cucauacccaugcaca

SEQ ID NO: 1934280 - RNA, 13 nt, Homo sapiens
ugcacgguacaaa

SEQ ID NO: 1934281 - RNA, 12 nt, Homo sapiens
ucucgcaaaaac

SEQ ID NO: 1934282 - RNA, 12 nt, Homo sapiens
ucuggcaaaaag

SEQ ID NO: 1934283 - RNA, 18 nt, Homo sapiens
uaggugggauuacaggug

SEQ ID NO: 1934284 - RNA, 22 nt, Homo sapiens
cagugggcauagucagugucgu

SEQ ID NO: 1934285 - RNA, 23 nt, Homo sapiens
auccuuuguucucccaaaucuga

SEQ ID NO: 1934286 - RNA, 20 nt, Homo sapiens
caggccagucacccugugac

SEQ ID NO: 1934287 - RNA, 19 nt, Homo sapiens
acucugacuggcacagucu

SEQ ID NO: 1934288 - RNA, 19 nt, Homo sapiens
aagcugcggcccugaucuc

SEQ ID NO: 1934289 - RNA, 16 nt, Homo sapiens
cacuucaaaacaguau

SEQ ID NO: 1934290 - RNA, 11 nt, Homo sapiens
gagcugggaug

SEQ ID NO: 1934291 - RNA, 13 nt, Homo sapiens
auacuuacugaac

SEQ ID NO: 1934292 - RNA, 14 nt, Homo sapiens
acaauaaagacuga

SEQ ID NO: 1934293 - RNA, 20 nt, Homo sapiens
aaauaagagaaaaaauuaaa

SEQ ID NO: 1934294 - RNA, 14 nt, Homo sapiens
ugaaccauggugaa

SEQ ID NO: 1934295 - RNA, 16 nt, Homo sapiens
gcuguuucuggaaaug

SEQ ID NO: 1934296 - RNA, 19 nt, Homo sapiens
ccuguagucccagcacuuu

SEQ ID NO: 1934297 - RNA, 17 nt, Homo sapiens
ccucauccuccacugaa

SEQ ID NO: 1934298 - RNA, 23 nt, Homo sapiens
auaagugggucaaguacaccagc

SEQ ID NO: 1934299 - RNA, 14 nt, Homo sapiens
ccuuggcuuuaugc

SEQ ID NO: 1934300 - RNA, 11 nt, Homo sapiens
ugcugcuccua

SEQ ID NO: 1934301 - RNA, 16 nt, Homo sapiens
acaccauuuuggcaag

SEQ ID NO: 1934302 - RNA, 13 nt, Homo sapiens
gaugguggcacau

SEQ ID NO: 1934303 - RNA, 17 nt, Homo sapiens
acuugaagaaggaaaga

SEQ ID NO: 1934304 - RNA, 20 nt, Homo sapiens
gaaggcucguuuggcuuuau

SEQ ID NO: 1934305 - RNA, 18 nt, Homo sapiens
ucauucugccugcuccau

SEQ ID NO: 1934306 - RNA, 12 nt, Homo sapiens
agagaaggcagg

SEQ ID NO: 1934307 - RNA, 13 nt, Homo sapiens
uggagagcacugc

SEQ ID NO: 1934308 - RNA, 12 nt, Homo sapiens
acuccaucucaa

SEQ ID NO: 1934309 - RNA, 12 nt, Homo sapiens
uguacaucagac

SEQ ID NO: 1934310 - RNA, 15 nt, Homo sapiens
uucuuaaaaugugcu

SEQ ID NO: 1934311 - RNA, 20 nt, Homo sapiens
uguauuuaccuucuaccucu

SEQ ID NO: 1934312 - RNA, 14 nt, Homo sapiens
aaagcaauaaccuc

SEQ ID NO: 1934313 - RNA, 11 nt, Homo sapiens
uggcugugaaa

SEQ ID NO: 1934314 - RNA, 18 nt, Homo sapiens
caucuagggaaugggacu

SEQ ID NO: 1934315 - RNA, 21 nt, Homo sapiens
cacugaaacugguugaagggu

SEQ ID NO: 1934316 - RNA, 20 nt, Homo sapiens
cgccaaggcuggagugcagu

SEQ ID NO: 1934317 - RNA, 14 nt, Homo sapiens
agagaccugagucu

SEQ ID NO: 1934318 - RNA, 19 nt, Homo sapiens
cugaguacuccacacugca

SEQ ID NO: 1934319 - RNA, 18 nt, Homo sapiens
uuugcaacaagacaaagc

SEQ ID NO: 1934320 - RNA, 14 nt, Homo sapiens
uccaaaaccuuccu

SEQ ID NO: 1934321 - RNA, 19 nt, Homo sapiens
uaagucaaaauaaucugaa

SEQ ID NO: 1934322 - RNA, 13 nt, Homo sapiens
aauauuuucuaca

SEQ ID NO: 1934323 - RNA, 16 nt, Homo sapiens
auaucacuuccaugac

SEQ ID NO: 1934324 - RNA, 18 nt, Homo sapiens
auguuuucccuuuauuca

SEQ ID NO: 1934325 - RNA, 21 nt, Homo sapiens
cagaucaucuuggaacugcau

SEQ ID NO: 1934326 - RNA, 18 nt, Homo sapiens
gccaaguuuuaaauauua

SEQ ID NO: 1934327 - RNA, 17 nt, Homo sapiens
agagccccuccuuccuu

SEQ ID NO: 1934328 - RNA, 14 nt, Homo sapiens
uguuuuacauucca

SEQ ID NO: 1934329 - RNA, 19 nt, Homo sapiens
aagucuuguagaaaucuca

SEQ ID NO: 1934330 - RNA, 21 nt, Homo sapiens
ccagcacuuugggaggcugag

SEQ ID NO: 1934331 - RNA, 17 nt, Homo sapiens
gaagccaagggggaccu

SEQ ID NO: 1934332 - RNA, 22 nt, Homo sapiens
agaggagauaaauauuuugcau

SEQ ID NO: 1934333 - RNA, 16 nt, Homo sapiens
guaaauaaugcuuuga

SEQ ID NO: 1934334 - RNA, 16 nt, Homo sapiens
uggaauuacugaaagu

SEQ ID NO: 1934335 - RNA, 22 nt, Homo sapiens
agaaagguaaacaaacaaauaa

SEQ ID NO: 1934336 - RNA, 15 nt, Homo sapiens
uguccagcacaccug

SEQ ID NO: 1934337 - RNA, 15 nt, Homo sapiens
ccagcacaggcaccu

SEQ ID NO: 1934338 - RNA, 14 nt, Homo sapiens
auuuacccuuuucc

SEQ ID NO: 1934339 - RNA, 13 nt, Homo sapiens
cugcuggaaacac

SEQ ID NO: 1934340 - RNA, 16 nt, Homo sapiens
uauauuuuaaauaccc

SEQ ID NO: 1934341 - RNA, 20 nt, Homo sapiens
auuucauaccuaucaucuua

SEQ ID NO: 1934342 - RNA, 17 nt, Homo sapiens
cuaacugaaggugcagu

SEQ ID NO: 1934343 - RNA, 16 nt, Homo sapiens
cguuaacaguuccuuu

SEQ ID NO: 1934344 - RNA, 22 nt, Homo sapiens
cuggcccaggguguuugcagcu

SEQ ID NO: 1934345 - RNA, 20 nt, Homo sapiens
aaaacccaccaaaaccaaga

SEQ ID NO: 1934346 - RNA, 21 nt, Homo sapiens
uucuaauuugcacuaaugugu

SEQ ID NO: 1934347 - RNA, 16 nt, Homo sapiens
gcccugcugugggaga

SEQ ID NO: 1934348 - RNA, 20 nt, Homo sapiens
guuccaccuggggcuucccu

SEQ ID NO: 1934349 - RNA, 23 nt, Homo sapiens
aagccaggaacagggaccagcuc

SEQ ID NO: 1934350 - RNA, 21 nt, Homo sapiens
cucuggguuuugggauuuggg

SEQ ID NO: 1934351 - RNA, 12 nt, Homo sapiens
augugagugugu

SEQ ID NO: 1934352 - RNA, 18 nt, Homo sapiens
auggaagccaacacauca

SEQ ID NO: 1934353 - RNA, 15 nt, Homo sapiens
uaaaauuauuuuucc

SEQ ID NO: 1934354 - RNA, 14 nt, Homo sapiens
ucaacuuauuucug

SEQ ID NO: 1934355 - RNA, 20 nt, Homo sapiens
uguuucuccuguuggcucac

SEQ ID NO: 1934356 - RNA, 15 nt, Homo sapiens
gaucaagaagaucau

SEQ ID NO: 1934357 - RNA, 14 nt, Homo sapiens
agcagcauuuacag

SEQ ID NO: 1934358 - RNA, 10 nt, Homo sapiens
ucguguucac

SEQ ID NO: 1934359 - RNA, 17 nt, Homo sapiens
ucagaugggcagcagcu

SEQ ID NO: 1934360 - RNA, 20 nt, Homo sapiens
gcaaugaagauccaagcaaa

SEQ ID NO: 1934361 - RNA, 16 nt, Homo sapiens
gcuugcaggaaccagc

SEQ ID NO: 1934362 - RNA, 15 nt, Homo sapiens
aaggugaaaaaagcu

SEQ ID NO: 1934363 - RNA, 18 nt, Homo sapiens
accauuucacccagacag

SEQ ID NO: 1934364 - RNA, 15 nt, Homo sapiens
uccauuugcuuuguc

SEQ ID NO: 1934365 - RNA, 21 nt, Homo sapiens
acuuuuucuuguauucaugaa

SEQ ID NO: 1934366 - RNA, 12 nt, Homo sapiens
cuuguuggccau

SEQ ID NO: 1934367 - RNA, 23 nt, Homo sapiens
gaccucucaacagaucugugggc

SEQ ID NO: 1934368 - RNA, 17 nt, Homo sapiens
agccaguuguugccaac

SEQ ID NO: 1934369 - RNA, 15 nt, Homo sapiens
acacaggccugauaa

SEQ ID NO: 1934370 - RNA, 13 nt, Homo sapiens
gcacuagaacuuu

SEQ ID NO: 1934371 - RNA, 17 nt, Homo sapiens
aauuggcaucauucucc

SEQ ID NO: 1934372 - RNA, 14 nt, Homo sapiens
aauugcuacauucu

SEQ ID NO: 1934373 - RNA, 12 nt, Homo sapiens
agcaacugugaa

SEQ ID NO: 1934374 - RNA, 23 nt, Homo sapiens
uggccgucccuaagcaugugucc

SEQ ID NO: 1934375 - RNA, 22 nt, Homo sapiens
cuuuugagccaacaacucugau

SEQ ID NO: 1934376 - RNA, 22 nt, Homo sapiens
ggccacccccuauccucugagu

SEQ ID NO: 1934377 - RNA, 19 nt, Homo sapiens
auuuuggguggccaaagug

SEQ ID NO: 1934378 - RNA, 18 nt, Homo sapiens
ucagcucccacaaaugac

SEQ ID NO: 1934379 - RNA, 17 nt, Homo sapiens
ugguuugaacacaauuc

SEQ ID NO: 1934380 - RNA, 14 nt, Homo sapiens
auucaaauucugcc

SEQ ID NO: 1934381 - RNA, 15 nt, Homo sapiens
aauggcgaaugucau

SEQ ID NO: 1934382 - RNA, 16 nt, Homo sapiens
gaaaauaggauuugca

SEQ ID NO: 1934383 - RNA, 16 nt, Homo sapiens
uugcaaugcaagcccu

SEQ ID NO: 1934384 - RNA, 23 nt, Homo sapiens
uuuggccuaacccucagaaacac

SEQ ID NO: 1934385 - RNA, 20 nt, Homo sapiens
gucaucaaauauuaccaaaa

SEQ ID NO: 1934386 - RNA, 18 nt, Homo sapiens
uguauauuuuuauauugu

SEQ ID NO: 1934387 - RNA, 22 nt, Homo sapiens
uaagcccggauagacuuauugc

SEQ ID NO: 1934388 - RNA, 18 nt, Homo sapiens
aaaacuuuaaucccacuu

SEQ ID NO: 1934389 - RNA, 19 nt, Homo sapiens
agcccuccgccauucucaa

SEQ ID NO: 1934390 - RNA, 12 nt, Homo sapiens
ccgcuagucuua

SEQ ID NO: 1934391 - RNA, 15 nt, Homo sapiens
aaaucaagugcaccu

SEQ ID NO: 1934392 - RNA, 18 nt, Homo sapiens
cccaagcuggagugaagu

SEQ ID NO: 1934393 - RNA, 23 nt, Homo sapiens
uccugaagguguuuuucauucac

SEQ ID NO: 1934394 - RNA, 14 nt, Homo sapiens
uucaguaaacacca

SEQ ID NO: 1934395 - RNA, 23 nt, Homo sapiens
gaaaauacauucuuaaacuaguu

SEQ ID NO: 1934396 - RNA, 18 nt, Homo sapiens
cguuuuuccaguucacau

SEQ ID NO: 1934397 - RNA, 12 nt, Homo sapiens
cugcagacaccu

SEQ ID NO: 1934398 - RNA, 14 nt, Homo sapiens
uuuuauaauacaaa

SEQ ID NO: 1934399 - RNA, 14 nt, Homo sapiens
cccagugugugcuc

SEQ ID NO: 1934400 - RNA, 17 nt, Homo sapiens
ggcaaccagaccauugu

SEQ ID NO: 1934401 - RNA, 23 nt, Homo sapiens
uuucauuagaggaagaaaaccag

SEQ ID NO: 1934402 - RNA, 22 nt, Homo sapiens
gccucuuccucccucccugcag

SEQ ID NO: 1934403 - RNA, 20 nt, Homo sapiens
ugucaguuuuguacauagca

SEQ ID NO: 1934404 - RNA, 19 nt, Homo sapiens
auuugcuggacaaccaaca

SEQ ID NO: 1934405 - RNA, 16 nt, Homo sapiens
aaaaauuuuuauguaa

SEQ ID NO: 1934406 - RNA, 18 nt, Homo sapiens
agucaucuccaucagcug

SEQ ID NO: 1934407 - RNA, 22 nt, Homo sapiens
ucaagcgauucucuugccucaa

SEQ ID NO: 1934408 - RNA, 13 nt, Homo sapiens
gaaguuugcaucu

SEQ ID NO: 1934409 - RNA, 13 nt, Homo sapiens
guuucucccccau

SEQ ID NO: 1934410 - RNA, 23 nt, Homo sapiens
ugugcuuuugcauuaaacuguga

SEQ ID NO: 1934411 - RNA, 12 nt, Homo sapiens
aaaacuuaucac

SEQ ID NO: 1934412 - RNA, 17 nt, Homo sapiens
cucagcacacaugcauc

SEQ ID NO: 1934413 - RNA, 20 nt, Homo sapiens
guccacucugaauaccaagu

SEQ ID NO: 1934414 - RNA, 22 nt, Homo sapiens
gaaaaaaacugggauaacugau

SEQ ID NO: 1934415 - RNA, 15 nt, Homo sapiens
ucuaaugacauucaa

SEQ ID NO: 1934416 - RNA, 16 nt, Homo sapiens
uggagaaaagcacuua

SEQ ID NO: 1934417 - RNA, 15 nt, Homo sapiens
aaaguaaagacugua

SEQ ID NO: 1934418 - RNA, 13 nt, Homo sapiens
acacuuucaggac

SEQ ID NO: 1934419 - RNA, 16 nt, Homo sapiens
ggcaggcacugccaaa

SEQ ID NO: 1934420 - RNA, 21 nt, Homo sapiens
uguccuucccacggccacugc

SEQ ID NO: 1934421 - RNA, 21 nt, Homo sapiens
aaagcuaaacaaaacuugcau

SEQ ID NO: 1934422 - RNA, 13 nt, Homo sapiens
uggcuguccuugu

SEQ ID NO: 1934423 - RNA, 22 nt, Homo sapiens
ugcugauguauuucaagucucu

SEQ ID NO: 1934424 - RNA, 15 nt, Homo sapiens
agcagcuaucucuca

SEQ ID NO: 1934425 - RNA, 23 nt, Homo sapiens
caaaucugauuucauuacauuuc

SEQ ID NO: 1934426 - RNA, 22 nt, Homo sapiens
uaaugauaaaaauaaugcauuu

SEQ ID NO: 1934427 - RNA, 12 nt, Homo sapiens
ucaguggugguc

SEQ ID NO: 1934428 - RNA, 21 nt, Homo sapiens
uguuuuguaggagacuugcca

SEQ ID NO: 1934429 - RNA, 15 nt, Homo sapiens
guuucaaacuccuga

SEQ ID NO: 1934430 - RNA, 17 nt, Homo sapiens
uaaaaggauuauuacua

SEQ ID NO: 1934431 - RNA, 15 nt, Homo sapiens
acaguaaacacucca

SEQ ID NO: 1934432 - RNA, 12 nt, Homo sapiens
acuuugaaaaua

SEQ ID NO: 1934433 - RNA, 21 nt, Homo sapiens
ucagaagggagcuagccagag

SEQ ID NO: 1934434 - RNA, 15 nt, Homo sapiens
acugcugugaaugug

SEQ ID NO: 1934435 - RNA, 23 nt, Homo sapiens
acacuggugugaccugagggcag

SEQ ID NO: 1934436 - RNA, 14 nt, Homo sapiens
uucauccccuuccu

SEQ ID NO: 1934437 - RNA, 17 nt, Homo sapiens
augcuguacacauauuu

SEQ ID NO: 1934438 - RNA, 19 nt, Homo sapiens
uuggacaaaccuugaaaau

SEQ ID NO: 1934439 - RNA, 21 nt, Homo sapiens
cgcacaaggcugaccaagaga

SEQ ID NO: 1934440 - RNA, 21 nt, Homo sapiens
aaaacugauucucuaugacau

SEQ ID NO: 1934441 - RNA, 17 nt, Homo sapiens
cuauaaauggugucaua

SEQ ID NO: 1934442 - RNA, 19 nt, Homo sapiens
ccaugcuucagugaacaua

SEQ ID NO: 1934443 - RNA, 21 nt, Homo sapiens
uaaccuucuggcuuccuucuc

SEQ ID NO: 1934444 - RNA, 20 nt, Homo sapiens
aggugcucuuccucaucuca

SEQ ID NO: 1934445 - RNA, 16 nt, Homo sapiens
accuggggaugaagcu

SEQ ID NO: 1934446 - RNA, 14 nt, Homo sapiens
aggaugcauacauu

SEQ ID NO: 1934447 - RNA, 14 nt, Homo sapiens
acccagagcuguau

SEQ ID NO: 1934448 - RNA, 17 nt, Homo sapiens
ucaaaagggccaaagaa

SEQ ID NO: 1934449 - RNA, 20 nt, Homo sapiens
caagcagcugaagaaaaaau

SEQ ID NO: 1934450 - RNA, 18 nt, Homo sapiens
ucaggaaggcuucuugcu

SEQ ID NO: 1934451 - RNA, 20 nt, Homo sapiens
uaagcauaagcuuaugcuua

SEQ ID NO: 1934452 - RNA, 18 nt, Homo sapiens
gaacuucaggugugacuc

SEQ ID NO: 1934453 - RNA, 12 nt, Homo sapiens
gcacacugccaa

SEQ ID NO: 1934454 - RNA, 21 nt, Homo sapiens
acacccagccucaguccuccc

SEQ ID NO: 1934455 - RNA, 18 nt, Homo sapiens
cugguuuuaccccagcuc

SEQ ID NO: 1934456 - RNA, 15 nt, Homo sapiens
ugucaauuugaugua

SEQ ID NO: 1934457 - RNA, 11 nt, Homo sapiens
cccauuucaga

SEQ ID NO: 1934458 - RNA, 12 nt, Homo sapiens
gaccuuugcacg

SEQ ID NO: 1934459 - RNA, 17 nt, Homo sapiens
ucuucuugagcugaccc

SEQ ID NO: 1934460 - RNA, 15 nt, Homo sapiens
cagccucaggaugag

SEQ ID NO: 1934461 - RNA, 16 nt, Homo sapiens
cuaagcuggagugcag

SEQ ID NO: 1934462 - RNA, 23 nt, Homo sapiens
cagaaagaaguuaacuacagugu

SEQ ID NO: 1934463 - RNA, 15 nt, Homo sapiens
gcccagagccuggcu

SEQ ID NO: 1934464 - RNA, 21 nt, Homo sapiens
gaaggagaguccccugaaggu

SEQ ID NO: 1934465 - RNA, 13 nt, Homo sapiens
aagaugagccugg

SEQ ID NO: 1934466 - RNA, 20 nt, Homo sapiens
ucaauuuuuuuucugaacaa

SEQ ID NO: 1934467 - RNA, 14 nt, Homo sapiens
cagaaaacaaacac

SEQ ID NO: 1934468 - RNA, 23 nt, Homo sapiens
cuguuaaauuuucucuaaacugu

SEQ ID NO: 1934469 - RNA, 12 nt, Homo sapiens
uuucuaccucag

SEQ ID NO: 1934470 - RNA, 15 nt, Homo sapiens
ggaaccuguacuggg

SEQ ID NO: 1934471 - RNA, 14 nt, Homo sapiens
ucugucuaguucca

SEQ ID NO: 1934472 - RNA, 22 nt, Homo sapiens
aauaugggaaagacaugcagcu

SEQ ID NO: 1934473 - RNA, 17 nt, Homo sapiens
ccuggaggcggcaaagg

SEQ ID NO: 1934474 - RNA, 14 nt, Homo sapiens
uuucaaaucauucc

SEQ ID NO: 1934475 - RNA, 19 nt, Homo sapiens
cuuaccagggucuuugcag

SEQ ID NO: 1934476 - RNA, 19 nt, Homo sapiens
cagaaaaggcugcugugaa

SEQ ID NO: 1934477 - RNA, 16 nt, Homo sapiens
ugacucgggccuuaga

SEQ ID NO: 1934478 - RNA, 16 nt, Homo sapiens
uaaaaagaccaugcau

SEQ ID NO: 1934479 - RNA, 20 nt, Homo sapiens
cuaagauacugcugaugcug

SEQ ID NO: 1934480 - RNA, 17 nt, Homo sapiens
aaguccggcggaauuca

SEQ ID NO: 1934481 - RNA, 11 nt, Homo sapiens
ccuccaaggaa

SEQ ID NO: 1934482 - RNA, 22 nt, Homo sapiens
acuucagaugacaaggauuaga

SEQ ID NO: 1934483 - RNA, 21 nt, Homo sapiens
aaauagcucuguggguuuuaa

SEQ ID NO: 1934484 - RNA, 20 nt, Homo sapiens
augaacacuuauaagugaag

SEQ ID NO: 1934485 - RNA, 18 nt, Homo sapiens
ucuccuuuggccauucca

SEQ ID NO: 1934486 - RNA, 20 nt, Homo sapiens
aaccugcaaagaucuguccu

SEQ ID NO: 1934487 - RNA, 21 nt, Homo sapiens
aaaccuguucaagucuaccaa

SEQ ID NO: 1934488 - RNA, 17 nt, Homo sapiens
cauucagagagcagcuu

SEQ ID NO: 1934489 - RNA, 20 nt, Homo sapiens
ucggaagcuccagaagaaca

SEQ ID NO: 1934490 - RNA, 13 nt, Homo sapiens
aguugcuguaugu

SEQ ID NO: 1934491 - RNA, 16 nt, Homo sapiens
gcaacaaccaccaccu

SEQ ID NO: 1934492 - RNA, 18 nt, Homo sapiens
cugauacacaccugauga

SEQ ID NO: 1934493 - RNA, 18 nt, Homo sapiens
uguccuuuuucacuuuga

SEQ ID NO: 1934494 - RNA, 16 nt, Homo sapiens
cagcuuucugugcaga

SEQ ID NO: 1934495 - RNA, 21 nt, Homo sapiens
cuugauaagaccaccaccuca

SEQ ID NO: 1934496 - RNA, 12 nt, Homo sapiens
guuaaguauuuu

SEQ ID NO: 1934497 - RNA, 16 nt, Homo sapiens
caucucauuccaacuu

SEQ ID NO: 1934498 - RNA, 19 nt, Homo sapiens
cuguuuaauguucugugau

SEQ ID NO: 1934499 - RNA, 20 nt, Homo sapiens
uccaggauagucuaagggag

SEQ ID NO: 1934500 - RNA, 18 nt, Homo sapiens
caaaaugaaugcauuggc

SEQ ID NO: 1934501 - RNA, 14 nt, Homo sapiens
uggugaucagugca

SEQ ID NO: 1934502 - RNA, 16 nt, Homo sapiens
acaguagauuuuccaa

SEQ ID NO: 1934503 - RNA, 21 nt, Homo sapiens
uuuuagaagauucuauguuaa

SEQ ID NO: 1934504 - RNA, 18 nt, Homo sapiens
uugauucagucuucugga

SEQ ID NO: 1934505 - RNA, 18 nt, Homo sapiens
ggugagagggccgggcag

SEQ ID NO: 1934506 - RNA, 13 nt, Homo sapiens
aggcucugugccu

SEQ ID NO: 1934507 - RNA, 20 nt, Homo sapiens
caaugcaccuagcugugcaa

SEQ ID NO: 1934508 - RNA, 21 nt, Homo sapiens
caaauacuguauauucaggac

SEQ ID NO: 1934509 - RNA, 19 nt, Homo sapiens
cauuagaccaagcuugucc

SEQ ID NO: 1934510 - RNA, 17 nt, Homo sapiens
gcccugaggcugugagc

SEQ ID NO: 1934511 - RNA, 17 nt, Homo sapiens
gcccugcaccugugcag

SEQ ID NO: 1934512 - RNA, 19 nt, Homo sapiens
auauauguauaauuucaca

SEQ ID NO: 1934513 - RNA, 23 nt, Homo sapiens
caggaccuugcuuccuucucauc

SEQ ID NO: 1934514 - RNA, 17 nt, Homo sapiens
caaaugaaauucugccu

SEQ ID NO: 1934515 - RNA, 20 nt, Homo sapiens
gcaguaaauacuugcaguug

SEQ ID NO: 1934516 - RNA, 23 nt, Homo sapiens
caugauuauuuuuuuaaaaagcg

SEQ ID NO: 1934517 - RNA, 17 nt, Homo sapiens
accuguggguugugcua

SEQ ID NO: 1934518 - RNA, 15 nt, Homo sapiens
aguaccacucaggcc

SEQ ID NO: 1934519 - RNA, 23 nt, Homo sapiens
aaguagccucugggaucugccaa

SEQ ID NO: 1934520 - RNA, 17 nt, Homo sapiens
cugaacaggaauccuua

SEQ ID NO: 1934521 - RNA, 19 nt, Homo sapiens
guagcauuggucagggaaa

SEQ ID NO: 1934522 - RNA, 15 nt, Homo sapiens
guauucuguuggcca

SEQ ID NO: 1934523 - RNA, 15 nt, Homo sapiens
uccuuuaggaucuca

SEQ ID NO: 1934524 - RNA, 15 nt, Homo sapiens
uuguucaguugacuu

SEQ ID NO: 1934525 - RNA, 15 nt, Homo sapiens
cuuuucauaaccuag

SEQ ID NO: 1934526 - RNA, 20 nt, Homo sapiens
accaacaaacccaacucuaa

SEQ ID NO: 1934527 - RNA, 18 nt, Homo sapiens
ucagauuauaacuguugu

SEQ ID NO: 1934528 - RNA, 22 nt, Homo sapiens
acaccauaagcuacugccaucc

SEQ ID NO: 1934529 - RNA, 22 nt, Homo sapiens
auucagcaaaaaucucccagug

SEQ ID NO: 1934530 - RNA, 19 nt, Homo sapiens
uugcauuccagaaccaaau

SEQ ID NO: 1934531 - RNA, 19 nt, Homo sapiens
uccauuuuuuuucaaacaa

SEQ ID NO: 1934532 - RNA, 20 nt, Homo sapiens
ccucugagacagagagccaa

SEQ ID NO: 1934533 - RNA, 19 nt, Homo sapiens
acugggcucacugcaggca

SEQ ID NO: 1934534 - RNA, 19 nt, Homo sapiens
uaaugaguuuuacauuaca

SEQ ID NO: 1934535 - RNA, 15 nt, Homo sapiens
cuuuuccucuauuga

SEQ ID NO: 1934536 - RNA, 13 nt, Homo sapiens
gacaccacuggga

SEQ ID NO: 1934537 - RNA, 14 nt, Homo sapiens
ugucacugguggau

SEQ ID NO: 1934538 - RNA, 16 nt, Homo sapiens
uaauaaugcuggaugg

SEQ ID NO: 1934539 - RNA, 12 nt, Homo sapiens
cuuuccaucucu

SEQ ID NO: 1934540 - RNA, 23 nt, Homo sapiens
agauaacaagaucuuucaggaaa

SEQ ID NO: 1934541 - RNA, 16 nt, Homo sapiens
gagccacucuguuccu

SEQ ID NO: 1934542 - RNA, 14 nt, Homo sapiens
uguuuacagugaug

SEQ ID NO: 1934543 - RNA, 23 nt, Homo sapiens
uauaaauuucugucuuucugcua

SEQ ID NO: 1934544 - RNA, 20 nt, Homo sapiens
aaagcagaugagcuguggac

SEQ ID NO: 1934545 - RNA, 14 nt, Homo sapiens
agucuguaaaauac

SEQ ID NO: 1934546 - RNA, 21 nt, Homo sapiens
ccucagauuccgcaccaauaa

SEQ ID NO: 1934547 - RNA, 19 nt, Homo sapiens
agaggcugcugaaaaccau

SEQ ID NO: 1934548 - RNA, 16 nt, Homo sapiens
auugaaguaaacugca

SEQ ID NO: 1934549 - RNA, 19 nt, Homo sapiens
auuacauuucaaaccaauu

SEQ ID NO: 1934550 - RNA, 19 nt, Homo sapiens
ugagucccagagccaauca

SEQ ID NO: 1934551 - RNA, 21 nt, Homo sapiens
aacugcucuuuuauacuguac

SEQ ID NO: 1934552 - RNA, 16 nt, Homo sapiens
uacaugcuuugugaac

SEQ ID NO: 1934553 - RNA, 11 nt, Homo sapiens
accacauuuga

SEQ ID NO: 1934554 - RNA, 16 nt, Homo sapiens
aguugaacagaacugc

SEQ ID NO: 1934555 - RNA, 16 nt, Homo sapiens
gucaauuaaacagcug

SEQ ID NO: 1934556 - RNA, 13 nt, Homo sapiens
agaucacuugagc

SEQ ID NO: 1934557 - RNA, 13 nt, Homo sapiens
acauaacuucaga

SEQ ID NO: 1934558 - RNA, 16 nt, Homo sapiens
uuacuaugaucucagg

SEQ ID NO: 1934559 - RNA, 18 nt, Homo sapiens
ugcgggcaccuacaaggu

SEQ ID NO: 1934560 - RNA, 14 nt, Homo sapiens
uuuaucugugauua

SEQ ID NO: 1934561 - RNA, 14 nt, Homo sapiens
guauaagcaucugc

SEQ ID NO: 1934562 - RNA, 19 nt, Homo sapiens
cuuuagugguggccauuua

SEQ ID NO: 1934563 - RNA, 15 nt, Homo sapiens
ugucaggcaguagca

SEQ ID NO: 1934564 - RNA, 22 nt, Homo sapiens
cacgagcuagcuucugcaaugu

SEQ ID NO: 1934565 - RNA, 14 nt, Homo sapiens
uaauuccaauauga

SEQ ID NO: 1934566 - RNA, 19 nt, Homo sapiens
gauugaauuaaaacagcug

SEQ ID NO: 1934567 - RNA, 14 nt, Homo sapiens
aaaauguauaccaa

SEQ ID NO: 1934568 - RNA, 14 nt, Homo sapiens
aagucaucuacuua

SEQ ID NO: 1934569 - RNA, 14 nt, Homo sapiens
gaggaucuggagaa

SEQ ID NO: 1934570 - RNA, 21 nt, Homo sapiens
uauuugccauucagucuagcu

SEQ ID NO: 1934571 - RNA, 18 nt, Homo sapiens
cuccuccagccaagauga

SEQ ID NO: 1934572 - RNA, 15 nt, Homo sapiens
ugcacagagauaugc

SEQ ID NO: 1934573 - RNA, 14 nt, Homo sapiens
uaaucugaaauucu

SEQ ID NO: 1934574 - RNA, 14 nt, Homo sapiens
auucaagauuacaa

SEQ ID NO: 1934575 - RNA, 15 nt, Homo sapiens
uagagugguuauuca

SEQ ID NO: 1934576 - RNA, 17 nt, Homo sapiens
aaagauuuguuuuguca

SEQ ID NO: 1934577 - RNA, 20 nt, Homo sapiens
uucaggggcgggugcauugu

SEQ ID NO: 1934578 - RNA, 17 nt, Homo sapiens
auuucagugguucagau

SEQ ID NO: 1934579 - RNA, 22 nt, Homo sapiens
cugcucagaaugccgcaugaca

SEQ ID NO: 1934580 - RNA, 15 nt, Homo sapiens
gcaagcacaucugca

SEQ ID NO: 1934581 - RNA, 14 nt, Homo sapiens
gaauacuugaacca

SEQ ID NO: 1934582 - RNA, 22 nt, Homo sapiens
ugucaggggcucccacaggauc

SEQ ID NO: 1934583 - RNA, 15 nt, Homo sapiens
aaguaauuugaauag

SEQ ID NO: 1934584 - RNA, 16 nt, Homo sapiens
uaucugaaaugugaua

SEQ ID NO: 1934585 - RNA, 17 nt, Homo sapiens
guugagaugccuguuga

SEQ ID NO: 1934586 - RNA, 19 nt, Homo sapiens
cuuuccauggcaaaugggc

SEQ ID NO: 1934587 - RNA, 17 nt, Homo sapiens
uuaucaacugcugcuuc

SEQ ID NO: 1934588 - RNA, 18 nt, Homo sapiens
cuaaauaaaaaauucaaa

SEQ ID NO: 1934589 - RNA, 13 nt, Homo sapiens
agcaauauuccag

SEQ ID NO: 1934590 - RNA, 22 nt, Homo sapiens
aauagucucauugccaaggcau

SEQ ID NO: 1934591 - RNA, 16 nt, Homo sapiens
uaugcuggcuuuucac

SEQ ID NO: 1934592 - RNA, 21 nt, Homo sapiens
uguaucuagccuggaaccaag

SEQ ID NO: 1934593 - RNA, 18 nt, Homo sapiens
cuuuuacaacugccucga

SEQ ID NO: 1934594 - RNA, 21 nt, Homo sapiens
caacaaugugaggggucccua

SEQ ID NO: 1934595 - RNA, 24 nt, Homo sapiens
ccucacuuguccuccugauccuga

SEQ ID NO: 1934596 - RNA, 21 nt, Homo sapiens
ggcaaagagauuaaaaugaca

SEQ ID NO: 1934597 - RNA, 22 nt, Homo sapiens
guccaagugugugugcgugugu

SEQ ID NO: 1934598 - RNA, 12 nt, Homo sapiens
agacaaccaaaa

SEQ ID NO: 1934599 - RNA, 14 nt, Homo sapiens
gaguuggggcugcc

SEQ ID NO: 1934600 - RNA, 13 nt, Homo sapiens
auuacgugcaaua

SEQ ID NO: 1934601 - RNA, 20 nt, Homo sapiens
gcgagagguggagugucaca

SEQ ID NO: 1934602 - RNA, 16 nt, Homo sapiens
gcaaauauugucauaa

SEQ ID NO: 1934603 - RNA, 23 nt, Homo sapiens
caguacuauggagugcucacaaa

SEQ ID NO: 1934604 - RNA, 18 nt, Homo sapiens
ugauuugaaggcaaaaau

SEQ ID NO: 1934605 - RNA, 18 nt, Homo sapiens
ucugcacagcuuuuccaa

SEQ ID NO: 1934606 - RNA, 15 nt, Homo sapiens
cacucuucuguaaau

SEQ ID NO: 1934607 - RNA, 21 nt, Homo sapiens
aacgucugguccuaaccagug

SEQ ID NO: 1934608 - RNA, 17 nt, Homo sapiens
caguaauuaacauauca

SEQ ID NO: 1934609 - RNA, 18 nt, Homo sapiens
gagauguccauagucaaa

SEQ ID NO: 1934610 - RNA, 17 nt, Homo sapiens
gacuuugcagauggaaa

SEQ ID NO: 1934611 - RNA, 14 nt, Homo sapiens
aagacucacugugu

SEQ ID NO: 1934612 - RNA, 13 nt, Homo sapiens
aaauaugcaugua

SEQ ID NO: 1934613 - RNA, 16 nt, Homo sapiens
acacacagaugcacac

SEQ ID NO: 1934614 - RNA, 23 nt, Homo sapiens
aaccugacagcaaacacagucac

SEQ ID NO: 1934615 - RNA, 16 nt, Homo sapiens
uguggaugugauugcc

SEQ ID NO: 1934616 - RNA, 14 nt, Homo sapiens
ugccugccacugag

SEQ ID NO: 1934617 - RNA, 20 nt, Homo sapiens
caccuggguccaucagagaa

SEQ ID NO: 1934618 - RNA, 20 nt, Homo sapiens
auucagauggcaauuucacu

SEQ ID NO: 1934619 - RNA, 13 nt, Homo sapiens
uccuggaggacca

SEQ ID NO: 1934620 - RNA, 13 nt, Homo sapiens
cucacauuggcaa

SEQ ID NO: 1934621 - RNA, 11 nt, Homo sapiens
cauguuugcag

SEQ ID NO: 1934622 - RNA, 15 nt, Homo sapiens
accgagugaggccau

SEQ ID NO: 1934623 - RNA, 23 nt, Homo sapiens
cacaguguuuccugaguagcagu

SEQ ID NO: 1934624 - RNA, 17 nt, Homo sapiens
ucuguaaggaacuggaa

SEQ ID NO: 1934625 - RNA, 17 nt, Homo sapiens
aagcaugaaacauuuca

SEQ ID NO: 1934626 - RNA, 13 nt, Homo sapiens
aauggucacagag

SEQ ID NO: 1934627 - RNA, 16 nt, Homo sapiens
gaugucuguaaccaau

SEQ ID NO: 1934628 - RNA, 17 nt, Homo sapiens
gaagugugggucugugu

SEQ ID NO: 1934629 - RNA, 15 nt, Homo sapiens
auguuauagaacuuc

SEQ ID NO: 1934630 - RNA, 12 nt, Homo sapiens
gccagcagcucc

SEQ ID NO: 1934631 - RNA, 17 nt, Homo sapiens
aacgagaagacaaacuc

SEQ ID NO: 1934632 - RNA, 15 nt, Homo sapiens
uagaaugaugcacau

SEQ ID NO: 1934633 - RNA, 21 nt, Homo sapiens
uauugccaacuggaaagucaa

SEQ ID NO: 1934634 - RNA, 16 nt, Homo sapiens
uugugccgacacuguu

SEQ ID NO: 1934635 - RNA, 19 nt, Homo sapiens
aucaaucuggcuucugcau

SEQ ID NO: 1934636 - RNA, 16 nt, Homo sapiens
acuuucaaaagcaaac

SEQ ID NO: 1934637 - RNA, 19 nt, Homo sapiens
gagggccgugagggguccc

SEQ ID NO: 1934638 - RNA, 18 nt, Homo sapiens
ugaaguaaaagagggacc

SEQ ID NO: 1934639 - RNA, 20 nt, Homo sapiens
caauaggauuuaauuuguug

SEQ ID NO: 1934640 - RNA, 22 nt, Homo sapiens
augcauggaggacucuccucuu

SEQ ID NO: 1934641 - RNA, 17 nt, Homo sapiens
ugccucugaaaugccuc

SEQ ID NO: 1934642 - RNA, 23 nt, Homo sapiens
auuagugggauuuuaugccaguu

SEQ ID NO: 1934643 - RNA, 22 nt, Homo sapiens
cuuuucaagacuuccucaugaa

SEQ ID NO: 1934644 - RNA, 14 nt, Homo sapiens
gcaguagugagcag

SEQ ID NO: 1934645 - RNA, 23 nt, Homo sapiens
uagauugcagaaaauucugugcc

SEQ ID NO: 1934646 - RNA, 12 nt, Homo sapiens
ugcuauuugccu

SEQ ID NO: 1934647 - RNA, 13 nt, Homo sapiens
cguggucccugag

SEQ ID NO: 1934648 - RNA, 15 nt, Homo sapiens
gucauaacucagccc

SEQ ID NO: 1934649 - RNA, 17 nt, Homo sapiens
ucuccuuaccucuggaa

SEQ ID NO: 1934650 - RNA, 16 nt, Homo sapiens
auugcccgaaaccaga

SEQ ID NO: 1934651 - RNA, 21 nt, Homo sapiens
acagcaaauuucuugaugaaa

SEQ ID NO: 1934652 - RNA, 12 nt, Homo sapiens
caaaugauuuca

SEQ ID NO: 1934653 - RNA, 11 nt, Homo sapiens
ccuguccuccc

SEQ ID NO: 1934654 - RNA, 14 nt, Homo sapiens
gagaaaagacaaau

SEQ ID NO: 1934655 - RNA, 17 nt, Homo sapiens
acuuuuaaacugcaguu

SEQ ID NO: 1934656 - RNA, 18 nt, Homo sapiens
gcuccaaaugcagcuuua

SEQ ID NO: 1934657 - RNA, 22 nt, Homo sapiens
gguuaugucccaugaccuugac

SEQ ID NO: 1934658 - RNA, 13 nt, Homo sapiens
ccccugcuccuga

SEQ ID NO: 1934659 - RNA, 19 nt, Homo sapiens
uagauuuguaguugcauau

SEQ ID NO: 1934660 - RNA, 13 nt, Homo sapiens
gaggacacuucaa

SEQ ID NO: 1934661 - RNA, 16 nt, Homo sapiens
cuguuuguagacuuaa

SEQ ID NO: 1934662 - RNA, 14 nt, Homo sapiens
uuaaugugcugcug

SEQ ID NO: 1934663 - RNA, 23 nt, Homo sapiens
caaauaucccguguuaccuuucu

SEQ ID NO: 1934664 - RNA, 15 nt, Homo sapiens
ucccauuucuacucu

SEQ ID NO: 1934665 - RNA, 18 nt, Homo sapiens
uguagacuuacuuuccua

SEQ ID NO: 1934666 - RNA, 17 nt, Homo sapiens
accuaauucgaugaagg

SEQ ID NO: 1934667 - RNA, 14 nt, Homo sapiens
uggcaacaaugccc

SEQ ID NO: 1934668 - RNA, 13 nt, Homo sapiens
aaauaugaagguu

SEQ ID NO: 1934669 - RNA, 22 nt, Homo sapiens
ccaucucugugauuaccucuca

SEQ ID NO: 1934670 - RNA, 22 nt, Homo sapiens
gcagguuccuuaucugucacac

SEQ ID NO: 1934671 - RNA, 15 nt, Homo sapiens
gcugauuuuaacaau

SEQ ID NO: 1934672 - RNA, 21 nt, Homo sapiens
ccccaagaggggcgggcucag

SEQ ID NO: 1934673 - RNA, 19 nt, Homo sapiens
aggaaaugcuccuccaggg

SEQ ID NO: 1934674 - RNA, 12 nt, Homo sapiens
aaaugucacugc

SEQ ID NO: 1934675 - RNA, 14 nt, Homo sapiens
cagcaucggaaaga

SEQ ID NO: 1934676 - RNA, 14 nt, Homo sapiens
agaaagcaaacuua

SEQ ID NO: 1934677 - RNA, 16 nt, Homo sapiens
cuagugaaacugccca

SEQ ID NO: 1934678 - RNA, 12 nt, Homo sapiens
aaucagggccac

SEQ ID NO: 1934679 - RNA, 21 nt, Homo sapiens
gcccagauucuaccacacagc

SEQ ID NO: 1934680 - RNA, 21 nt, Homo sapiens
uauuugacauucuucacuguc

SEQ ID NO: 1934681 - RNA, 18 nt, Homo sapiens
acaacuaagugauuugua

SEQ ID NO: 1934682 - RNA, 18 nt, Homo sapiens
uauugcagucaaucucuu

SEQ ID NO: 1934683 - RNA, 14 nt, Homo sapiens
aagacgacuguggu

SEQ ID NO: 1934684 - RNA, 16 nt, Homo sapiens
gucucuggucuuccag

SEQ ID NO: 1934685 - RNA, 11 nt, Homo sapiens
cauagcauuau

SEQ ID NO: 1934686 - RNA, 12 nt, Homo sapiens
gcuccugugcag

SEQ ID NO: 1934687 - RNA, 15 nt, Homo sapiens
ugcacugugaaggac

SEQ ID NO: 1934688 - RNA, 21 nt, Homo sapiens
ccagucccagacaauuccauu

SEQ ID NO: 1934689 - RNA, 18 nt, Homo sapiens
gacuucugcccauucucu

SEQ ID NO: 1934690 - RNA, 21 nt, Homo sapiens
acuauuuucauucucuuguua

SEQ ID NO: 1934691 - RNA, 17 nt, Homo sapiens
acacuugcaaccuaccu

SEQ ID NO: 1934692 - RNA, 20 nt, Homo sapiens
aacucuucagaacacacaga

SEQ ID NO: 1934693 - RNA, 18 nt, Homo sapiens
augcagccccaucuccuc

SEQ ID NO: 1934694 - RNA, 19 nt, Homo sapiens
augccccuugguccuggca

SEQ ID NO: 1934695 - RNA, 20 nt, Homo sapiens
ggcuggaguguaguggcgcg

SEQ ID NO: 1934696 - RNA, 14 nt, Homo sapiens
ugagccugcaucuu

SEQ ID NO: 1934697 - RNA, 16 nt, Homo sapiens
uucacuuauugacuau

SEQ ID NO: 1934698 - RNA, 11 nt, Homo sapiens
uuucaguucau

SEQ ID NO: 1934699 - RNA, 21 nt, Homo sapiens
uuuacuauguaaaugcuugau

SEQ ID NO: 1934700 - RNA, 14 nt, Homo sapiens
ugcccugcuugcaa

SEQ ID NO: 1934701 - RNA, 13 nt, Homo sapiens
ugggcauuucaau

SEQ ID NO: 1934702 - RNA, 22 nt, Homo sapiens
agaaguggcuacugacuacccu

SEQ ID NO: 1934703 - RNA, 20 nt, Homo sapiens
ugcaauuuuaacacacauaa

SEQ ID NO: 1934704 - RNA, 15 nt, Homo sapiens
gcauuuccagccuau

SEQ ID NO: 1934705 - RNA, 18 nt, Homo sapiens
auuuucauuuguacaagg

SEQ ID NO: 1934706 - RNA, 20 nt, Homo sapiens
cauagauccuaagccauaaa

SEQ ID NO: 1934707 - RNA, 21 nt, Homo sapiens
agauucccuuccggugcgugu

SEQ ID NO: 1934708 - RNA, 15 nt, Homo sapiens
cauccauauuguuga

SEQ ID NO: 1934709 - RNA, 15 nt, Homo sapiens
auucaaauggacaaa

SEQ ID NO: 1934710 - RNA, 19 nt, Homo sapiens
agguagacauggauuugau

SEQ ID NO: 1934711 - RNA, 14 nt, Homo sapiens
cuagguagggucac

SEQ ID NO: 1934712 - RNA, 14 nt, Homo sapiens
ccaggcugccugug

SEQ ID NO: 1934713 - RNA, 21 nt, Homo sapiens
agccucagaauaaaagaugau

SEQ ID NO: 1934714 - RNA, 23 nt, Homo sapiens
uggaacgcuaaugaaacacagcu

SEQ ID NO: 1934715 - RNA, 19 nt, Homo sapiens
ggcacgaucucaacucacu

SEQ ID NO: 1934716 - RNA, 16 nt, Homo sapiens
cuucuaauccaugugc

SEQ ID NO: 1934717 - RNA, 22 nt, Homo sapiens
acuggggccuguguagccagug

SEQ ID NO: 1934718 - RNA, 19 nt, Homo sapiens
caccuccaccacaucugcc

SEQ ID NO: 1934719 - RNA, 16 nt, Homo sapiens
gauugugagugccuug

SEQ ID NO: 1934720 - RNA, 19 nt, Homo sapiens
uccagaugaaggaaaggaa

SEQ ID NO: 1934721 - RNA, 13 nt, Homo sapiens
aacuguaagucau

SEQ ID NO: 1934722 - RNA, 20 nt, Homo sapiens
ugcuagccucacgaaacugg

SEQ ID NO: 1934723 - RNA, 17 nt, Homo sapiens
ccacccccuucagugcc

SEQ ID NO: 1934724 - RNA, 20 nt, Homo sapiens
gagucuucuccaauguccaa

SEQ ID NO: 1934725 - RNA, 15 nt, Homo sapiens
uuguacacugcugua

SEQ ID NO: 1934726 - RNA, 19 nt, Homo sapiens
aggccccagccucccugaa

SEQ ID NO: 1934727 - RNA, 21 nt, Homo sapiens
cccaguguaaagaauaaauga

SEQ ID NO: 1934728 - RNA, 15 nt, Homo sapiens
cacuaauugcuuucu

SEQ ID NO: 1934729 - RNA, 21 nt, Homo sapiens
uauauauuuaauugauuucug

SEQ ID NO: 1934730 - RNA, 18 nt, Homo sapiens
agaaggagggagacauga

SEQ ID NO: 1934731 - RNA, 21 nt, Homo sapiens
gccuuugcuuuacagcacugu

SEQ ID NO: 1934732 - RNA, 17 nt, Homo sapiens
agguggcaacaaugccc

SEQ ID NO: 1934733 - RNA, 14 nt, Homo sapiens
cuuugcucccugca

SEQ ID NO: 1934734 - RNA, 18 nt, Homo sapiens
acagauucugauucccuu

SEQ ID NO: 1934735 - RNA, 22 nt, Homo sapiens
augcuugugauuuuugaacaau

SEQ ID NO: 1934736 - RNA, 20 nt, Homo sapiens
gucauuaagcgggaucccag

SEQ ID NO: 1934737 - RNA, 22 nt, Homo sapiens
uauaucacagagccacucuuca

SEQ ID NO: 1934738 - RNA, 20 nt, Homo sapiens
aagaaauaccugagacuggg

SEQ ID NO: 1934739 - RNA, 17 nt, Homo sapiens
uacuuagaccaaaagca

SEQ ID NO: 1934740 - RNA, 14 nt, Homo sapiens
aauagucauuccaa

SEQ ID NO: 1934741 - RNA, 13 nt, Homo sapiens
ggcuagaucauga

SEQ ID NO: 1934742 - RNA, 14 nt, Homo sapiens
acuaauuaggcaag

SEQ ID NO: 1934743 - RNA, 20 nt, Homo sapiens
uuucacuugcacaucaugga

SEQ ID NO: 1934744 - RNA, 21 nt, Homo sapiens
ggauuguucuggucuuacuca

SEQ ID NO: 1934745 - RNA, 17 nt, Homo sapiens
uuauguauuuaugaccu

SEQ ID NO: 1934746 - RNA, 13 nt, Homo sapiens
gaagcaucaauaa

SEQ ID NO: 1934747 - RNA, 21 nt, Homo sapiens
gaaagcuggacugaccaaaga

SEQ ID NO: 1934748 - RNA, 15 nt, Homo sapiens
ucaaaagcagaauuu

SEQ ID NO: 1934749 - RNA, 21 nt, Homo sapiens
agauuaccaaagaagauuuug

SEQ ID NO: 1934750 - RNA, 12 nt, Homo sapiens
gaacuugcacaa

SEQ ID NO: 1934751 - RNA, 22 nt, Homo sapiens
ucaacacgacugcaagcuccau

SEQ ID NO: 1934752 - RNA, 19 nt, Homo sapiens
ucagaugggaaaucugccu

SEQ ID NO: 1934753 - RNA, 19 nt, Homo sapiens
caugaacaucauggacuga

SEQ ID NO: 1934754 - RNA, 15 nt, Homo sapiens
augauaaaauagcca

SEQ ID NO: 1934755 - RNA, 14 nt, Homo sapiens
gaaacuuagaucau

SEQ ID NO: 1934756 - RNA, 20 nt, Homo sapiens
uguccugaugcuuuugucua

SEQ ID NO: 1934757 - RNA, 13 nt, Homo sapiens
guuuccauggcuu

SEQ ID NO: 1934758 - RNA, 16 nt, Homo sapiens
ggggucaaaauuugcu

SEQ ID NO: 1934759 - RNA, 19 nt, Homo sapiens
aacgccaagggcagcacca

SEQ ID NO: 1934760 - RNA, 14 nt, Homo sapiens
auaaaaaaucugaa

SEQ ID NO: 1934761 - RNA, 14 nt, Homo sapiens
uuaaaaaaacugaa

SEQ ID NO: 1934762 - RNA, 12 nt, Homo sapiens
gagcgacaguga

SEQ ID NO: 1934763 - RNA, 22 nt, Homo sapiens
uuaaucuagagaaggcauuuca

SEQ ID NO: 1934764 - RNA, 20 nt, Homo sapiens
cuucagguuccuccuaggcg

SEQ ID NO: 1934765 - RNA, 16 nt, Homo sapiens
agugaugaaccagagu

SEQ ID NO: 1934766 - RNA, 20 nt, Homo sapiens
caagcugugacuucuccagg

SEQ ID NO: 1934767 - RNA, 17 nt, Homo sapiens
gucuccccaugugccug

SEQ ID NO: 1934768 - RNA, 15 nt, Homo sapiens
cagugccugugagca

SEQ ID NO: 1934769 - RNA, 15 nt, Homo sapiens
cuuuccuucaucucc

SEQ ID NO: 1934770 - RNA, 10 nt, Homo sapiens
ucugcaaugc

SEQ ID NO: 1934771 - RNA, 22 nt, Homo sapiens
cacggauuuagucccacccuau

SEQ ID NO: 1934772 - RNA, 22 nt, Homo sapiens
cuuucucuuguaaacguuucag

SEQ ID NO: 1934773 - RNA, 20 nt, Homo sapiens
uaaaauauuuagucuaagau

SEQ ID NO: 1934774 - RNA, 18 nt, Homo sapiens
gcuguauugcccccaugg

SEQ ID NO: 1934775 - RNA, 15 nt, Homo sapiens
ucucaauucuucccu

SEQ ID NO: 1934776 - RNA, 22 nt, Homo sapiens
uaguaauuucacucucugcauu

SEQ ID NO: 1934777 - RNA, 22 nt, Homo sapiens
caacugaaaaaaacauauccaa

SEQ ID NO: 1934778 - RNA, 14 nt, Homo sapiens
gaauucgcuguuac

SEQ ID NO: 1934779 - RNA, 12 nt, Homo sapiens
cccuucauacuu

SEQ ID NO: 1934780 - RNA, 22 nt, Homo sapiens
uaauuuaguggauggaauauca

SEQ ID NO: 1934781 - RNA, 20 nt, Homo sapiens
cuuucagaaaauucccauga

SEQ ID NO: 1934782 - RNA, 11 nt, Homo sapiens
acuaaagccag

SEQ ID NO: 1934783 - RNA, 13 nt, Homo sapiens
uguuugcacugug

SEQ ID NO: 1934784 - RNA, 13 nt, Homo sapiens
gcccucuggacag

SEQ ID NO: 1934785 - RNA, 20 nt, Homo sapiens
ugaaugaaaauacaucuuuu

SEQ ID NO: 1934786 - RNA, 15 nt, Homo sapiens
uuuguugagcaugac

SEQ ID NO: 1934787 - RNA, 13 nt, Homo sapiens
ugccaagacuccu

SEQ ID NO: 1934788 - RNA, 22 nt, Homo sapiens
ugauuauuuugugcaacauaac

SEQ ID NO: 1934789 - RNA, 11 nt, Homo sapiens
caauuuaguuc

SEQ ID NO: 1934790 - RNA, 23 nt, Homo sapiens
ugaguacucauaaaggacacugg

SEQ ID NO: 1934791 - RNA, 18 nt, Homo sapiens
acuugguuuuuggcucuu

SEQ ID NO: 1934792 - RNA, 18 nt, Homo sapiens
cggauguaacgcugccac

SEQ ID NO: 1934793 - RNA, 19 nt, Homo sapiens
ugugaaguuagguucuuaa

SEQ ID NO: 1934794 - RNA, 21 nt, Homo sapiens
acaguuuccaaauugcccuau

SEQ ID NO: 1934795 - RNA, 15 nt, Homo sapiens
gguaaaaaauauagc

SEQ ID NO: 1934796 - RNA, 16 nt, Homo sapiens
uauuuuuguacauuug

SEQ ID NO: 1934797 - RNA, 15 nt, Homo sapiens
ggaccauaucaggag

SEQ ID NO: 1934798 - RNA, 12 nt, Homo sapiens
aauucaaaaaug

SEQ ID NO: 1934799 - RNA, 12 nt, Homo sapiens
aaaguaaaagca

SEQ ID NO: 1934800 - RNA, 21 nt, Homo sapiens
ggacccuggaccauuccagga

SEQ ID NO: 1934801 - RNA, 18 nt, Homo sapiens
aagacuucucuacccauc

SEQ ID NO: 1934802 - RNA, 16 nt, Homo sapiens
acuuucucacaugugg

SEQ ID NO: 1934803 - RNA, 15 nt, Homo sapiens
auaaagaccugagaa

SEQ ID NO: 1934804 - RNA, 15 nt, Homo sapiens
ccggaaccacagggc

SEQ ID NO: 1934805 - RNA, 15 nt, Homo sapiens
agcaauuagugauau

SEQ ID NO: 1934806 - RNA, 13 nt, Homo sapiens
auaaacugugaga

SEQ ID NO: 1934807 - RNA, 15 nt, Homo sapiens
agagaaggggcccaa

SEQ ID NO: 1934808 - RNA, 15 nt, Homo sapiens
aagccuggaagccau

SEQ ID NO: 1934809 - RNA, 15 nt, Homo sapiens
gaaccugggaaccau

SEQ ID NO: 1934810 - RNA, 22 nt, Homo sapiens
uaccacagaaguucaauacuca

SEQ ID NO: 1934811 - RNA, 14 nt, Homo sapiens
aauuacuacuuugu

SEQ ID NO: 1934812 - RNA, 15 nt, Homo sapiens
accggcuacaucaaa

SEQ ID NO: 1934813 - RNA, 22 nt, Homo sapiens
caccuuuucagcgauguaugca

SEQ ID NO: 1934814 - RNA, 16 nt, Homo sapiens
ugugcuaauaaguuug

SEQ ID NO: 1934815 - RNA, 18 nt, Homo sapiens
ucucgaacugcuggauuc

SEQ ID NO: 1934816 - RNA, 14 nt, Homo sapiens
aauguaaaauccau

SEQ ID NO: 1934817 - RNA, 20 nt, Homo sapiens
auaccacuaauuuucgcuua

SEQ ID NO: 1934818 - RNA, 14 nt, Homo sapiens
uuauggcugcugaa

SEQ ID NO: 1934819 - RNA, 15 nt, Homo sapiens
cuaucccaagccaac

SEQ ID NO: 1934820 - RNA, 18 nt, Homo sapiens
agaaaagcaugcauauca

SEQ ID NO: 1934821 - RNA, 13 nt, Homo sapiens
ccucaaacugcac

SEQ ID NO: 1934822 - RNA, 12 nt, Homo sapiens
uauacauaucag

SEQ ID NO: 1934823 - RNA, 20 nt, Homo sapiens
uaguauaauaauuacugguu

SEQ ID NO: 1934824 - RNA, 23 nt, Homo sapiens
caaaauccuuacuuccagcaaaa

SEQ ID NO: 1934825 - RNA, 20 nt, Homo sapiens
aaacuaaagaaaaauuauua

SEQ ID NO: 1934826 - RNA, 20 nt, Homo sapiens
uuuauuauguccauuauuca

SEQ ID NO: 1934827 - RNA, 13 nt, Homo sapiens
aaguuuguuauag

SEQ ID NO: 1934828 - RNA, 13 nt, Homo sapiens
uucugcaaaacau

SEQ ID NO: 1934829 - RNA, 20 nt, Homo sapiens
uacucgggaggcugaggcag

SEQ ID NO: 1934830 - RNA, 22 nt, Homo sapiens
auauagcucgagcaaaauucaa

SEQ ID NO: 1934831 - RNA, 14 nt, Homo sapiens
caagauucuacuug

SEQ ID NO: 1934832 - RNA, 18 nt, Homo sapiens
uuauuuuuaaaaagaaau

SEQ ID NO: 1934833 - RNA, 17 nt, Homo sapiens
uacaucaaaugcucaag

SEQ ID NO: 1934834 - RNA, 22 nt, Homo sapiens
acaaaaguuuuuuauuagcauu

SEQ ID NO: 1934835 - RNA, 13 nt, Homo sapiens
aagcacauguaau

SEQ ID NO: 1934836 - RNA, 14 nt, Homo sapiens
cuguaaaauuuguu

SEQ ID NO: 1934837 - RNA, 18 nt, Homo sapiens
ugggacuuagaacaccgc

SEQ ID NO: 1934838 - RNA, 17 nt, Homo sapiens
accacaacccuguugcu

SEQ ID NO: 1934839 - RNA, 15 nt, Homo sapiens
cacauuuucuuuauc

SEQ ID NO: 1934840 - RNA, 19 nt, Homo sapiens
acagcucuguaguuuauga

SEQ ID NO: 1934841 - RNA, 17 nt, Homo sapiens
gggcugaguuugcacag

SEQ ID NO: 1934842 - RNA, 14 nt, Homo sapiens
ugggaagaaguaaa

SEQ ID NO: 1934843 - RNA, 22 nt, Homo sapiens
cccacaccauaagcuacugcca

SEQ ID NO: 1934844 - RNA, 17 nt, Homo sapiens
uuucaaaguguugaugg

SEQ ID NO: 1934845 - RNA, 20 nt, Homo sapiens
cuucaccaggaccaguucac

SEQ ID NO: 1934846 - RNA, 20 nt, Homo sapiens
caaugcccaguaaaauuuca

SEQ ID NO: 1934847 - RNA, 12 nt, Homo sapiens
caucugcaaaag

SEQ ID NO: 1934848 - RNA, 14 nt, Homo sapiens
ggaggccaauaaaa

SEQ ID NO: 1934849 - RNA, 15 nt, Homo sapiens
aagucagcucuuguc

SEQ ID NO: 1934850 - RNA, 16 nt, Homo sapiens
aggacgugggccucca

SEQ ID NO: 1934851 - RNA, 12 nt, Homo sapiens
aaagaaaaccau

SEQ ID NO: 1934852 - RNA, 23 nt, Homo sapiens
accccagugguauccugugacau

SEQ ID NO: 1934853 - RNA, 22 nt, Homo sapiens
gaggagaaacucuagacugcaa

SEQ ID NO: 1934854 - RNA, 16 nt, Homo sapiens
cagauugacaagguag

SEQ ID NO: 1934855 - RNA, 20 nt, Homo sapiens
uaaaucaggacagguggugc

SEQ ID NO: 1934856 - RNA, 17 nt, Homo sapiens
ucucccucccuugccac

SEQ ID NO: 1934857 - RNA, 23 nt, Homo sapiens
cuuccgcuuugaaagaagcaaga

SEQ ID NO: 1934858 - RNA, 16 nt, Homo sapiens
uggucucuauacuaca

SEQ ID NO: 1934859 - RNA, 19 nt, Homo sapiens
uacuaucacugaacaaacu

SEQ ID NO: 1934860 - RNA, 22 nt, Homo sapiens
uacaccaaugcccaacugccug

SEQ ID NO: 1934861 - RNA, 17 nt, Homo sapiens
agaaauaaagcaucuca

SEQ ID NO: 1934862 - RNA, 18 nt, Homo sapiens
agugugugugugcaugug

SEQ ID NO: 1934863 - RNA, 13 nt, Homo sapiens
auggaaaguuugu

SEQ ID NO: 1934864 - RNA, 17 nt, Homo sapiens
gcacaugcaccuaccca

SEQ ID NO: 1934865 - RNA, 23 nt, Homo sapiens
aauuugcucauaugaacuuucau

SEQ ID NO: 1934866 - RNA, 14 nt, Homo sapiens
uucugcucuaagaa

SEQ ID NO: 1934867 - RNA, 23 nt, Homo sapiens
gaagaccaugccuaggaacauuu

SEQ ID NO: 1934868 - RNA, 19 nt, Homo sapiens
gauaaauuuaaagucuaag

SEQ ID NO: 1934869 - RNA, 21 nt, Homo sapiens
aggcauucuggaccucugggu

SEQ ID NO: 1934870 - RNA, 15 nt, Homo sapiens
uaaguugcuuccuaa

SEQ ID NO: 1934871 - RNA, 15 nt, Homo sapiens
ucuccagcccugacu

SEQ ID NO: 1934872 - RNA, 21 nt, Homo sapiens
cuuaaauauauaauguugcca

SEQ ID NO: 1934873 - RNA, 14 nt, Homo sapiens
uuggcuucagggga

SEQ ID NO: 1934874 - RNA, 22 nt, Homo sapiens
aaacgauuuugaacauacuuca

SEQ ID NO: 1934875 - RNA, 18 nt, Homo sapiens
ggucacccaacucaagga

SEQ ID NO: 1934876 - RNA, 22 nt, Homo sapiens
cagaacacugucuugaagacaa

SEQ ID NO: 1934877 - RNA, 21 nt, Homo sapiens
gaacucccgggccccaaucca

SEQ ID NO: 1934878 - RNA, 22 nt, Homo sapiens
ucucuuccucauauuucagcag

SEQ ID NO: 1934879 - RNA, 12 nt, Homo sapiens
ucagcugcugaa

SEQ ID NO: 1934880 - RNA, 17 nt, Homo sapiens
ccuaggcauuugcugaa

SEQ ID NO: 1934881 - RNA, 18 nt, Homo sapiens
auuaucgggaacaguguu

SEQ ID NO: 1934882 - RNA, 17 nt, Homo sapiens
cagggcagugcuaguga

SEQ ID NO: 1934883 - RNA, 21 nt, Homo sapiens
cugggaguguccuuaguguau

SEQ ID NO: 1934884 - RNA, 14 nt, Homo sapiens
ucacugugucucau

SEQ ID NO: 1934885 - RNA, 19 nt, Homo sapiens
ugcugaauccccuauccca

SEQ ID NO: 1934886 - RNA, 14 nt, Homo sapiens
cacauuucuuugaa

SEQ ID NO: 1934887 - RNA, 23 nt, Homo sapiens
ugcauuuauaaauguguggugcu

SEQ ID NO: 1934888 - RNA, 19 nt, Homo sapiens
ccaccucggcacacacugu

SEQ ID NO: 1934889 - RNA, 23 nt, Homo sapiens
guggaagauuucuugacuauuuc

SEQ ID NO: 1934890 - RNA, 17 nt, Homo sapiens
ucuaacagcaaauaaca

SEQ ID NO: 1934891 - RNA, 20 nt, Homo sapiens
ucacauccuguaagugcuua

SEQ ID NO: 1934892 - RNA, 13 nt, Homo sapiens
uaacaacuuugaa

SEQ ID NO: 1934893 - RNA, 17 nt, Homo sapiens
gucacgugacccugugc

SEQ ID NO: 1934894 - RNA, 20 nt, Homo sapiens
agugagauauuugguaccau

SEQ ID NO: 1934895 - RNA, 13 nt, Homo sapiens
gcgggacugcugg

SEQ ID NO: 1934896 - RNA, 22 nt, Homo sapiens
guugcucaaaucuauucagaca

SEQ ID NO: 1934897 - RNA, 15 nt, Homo sapiens
caaguuuuucagaaa

SEQ ID NO: 1934898 - RNA, 20 nt, Homo sapiens
agagagaaaguuucguuaua

SEQ ID NO: 1934899 - RNA, 12 nt, Homo sapiens
uuucaccugaga

SEQ ID NO: 1934900 - RNA, 22 nt, Homo sapiens
aguguugugcacuucaugucau

SEQ ID NO: 1934901 - RNA, 14 nt, Homo sapiens
uuuguucacuguga

SEQ ID NO: 1934902 - RNA, 22 nt, Homo sapiens
ccaggacggggcacaaguguca

SEQ ID NO: 1934903 - RNA, 21 nt, Homo sapiens
acauccaaccccccaccugcc

SEQ ID NO: 1934904 - RNA, 15 nt, Homo sapiens
aacauauacuuccau

SEQ ID NO: 1934905 - RNA, 18 nt, Homo sapiens
gguaauuuguaucugaag

SEQ ID NO: 1934906 - RNA, 14 nt, Homo sapiens
uaauuuaacaaacu

SEQ ID NO: 1934907 - RNA, 23 nt, Homo sapiens
aguguggggcgggggucuauaca

SEQ ID NO: 1934908 - RNA, 22 nt, Homo sapiens
gagagugggggugggggguccc

SEQ ID NO: 1934909 - RNA, 21 nt, Homo sapiens
aggcccaaugagguggcucau

SEQ ID NO: 1934910 - RNA, 20 nt, Homo sapiens
uuacauagaucagccauuaa

SEQ ID NO: 1934911 - RNA, 16 nt, Homo sapiens
uuggugcuaaaccaca

SEQ ID NO: 1934912 - RNA, 15 nt, Homo sapiens
uaguuuaggcuggaa

SEQ ID NO: 1934913 - RNA, 22 nt, Homo sapiens
aggugcugacaaagaugaccug

SEQ ID NO: 1934914 - RNA, 21 nt, Homo sapiens
ucuugcaagcaacaagcuauu

SEQ ID NO: 1934915 - RNA, 20 nt, Homo sapiens
cugucaucaauuaaaggcaa

SEQ ID NO: 1934916 - RNA, 18 nt, Homo sapiens
uuaugauuaaucugauua

SEQ ID NO: 1934917 - RNA, 21 nt, Homo sapiens
aguuucagagaccauugcaau

SEQ ID NO: 1934918 - RNA, 22 nt, Homo sapiens
aauaaacccuuaacuggcauag

SEQ ID NO: 1934919 - RNA, 11 nt, Homo sapiens
aaaacccggga

SEQ ID NO: 1934920 - RNA, 20 nt, Homo sapiens
cacucagugauugcaauuug

SEQ ID NO: 1934921 - RNA, 16 nt, Homo sapiens
cgccgccucacugcag

SEQ ID NO: 1934922 - RNA, 20 nt, Homo sapiens
ugcuuuccagccugggcaac

SEQ ID NO: 1934923 - RNA, 23 nt, Homo sapiens
uauuuuacuacuucucucuguau

SEQ ID NO: 1934924 - RNA, 18 nt, Homo sapiens
acucuuuggaacaacagc

SEQ ID NO: 1934925 - RNA, 16 nt, Homo sapiens
ugucccaguaaagcca

SEQ ID NO: 1934926 - RNA, 18 nt, Homo sapiens
aaaauacaguauucugua

SEQ ID NO: 1934927 - RNA, 18 nt, Homo sapiens
aucugcuguccagacagc

SEQ ID NO: 1934928 - RNA, 15 nt, Homo sapiens
guugaugaagcacau

SEQ ID NO: 1934929 - RNA, 17 nt, Homo sapiens
agguuggccuuacuguu

SEQ ID NO: 1934930 - RNA, 18 nt, Homo sapiens
uugccaccucuaacagca

SEQ ID NO: 1934931 - RNA, 17 nt, Homo sapiens
ucuaugagcaugccaag

SEQ ID NO: 1934932 - RNA, 12 nt, Homo sapiens
ccugucuuuacu

SEQ ID NO: 1934933 - RNA, 18 nt, Homo sapiens
auagagucucacuguguc

SEQ ID NO: 1934934 - RNA, 21 nt, Homo sapiens
uuccagguggcaucagugucu

SEQ ID NO: 1934935 - RNA, 15 nt, Homo sapiens
uaacuuaacugaaau

SEQ ID NO: 1934936 - RNA, 22 nt, Homo sapiens
gacaucgguguucuucuuccca

SEQ ID NO: 1934937 - RNA, 16 nt, Homo sapiens
ucacuguucaugaaua

SEQ ID NO: 1934938 - RNA, 19 nt, Homo sapiens
uauaauugaugauguugua

SEQ ID NO: 1934939 - RNA, 16 nt, Homo sapiens
gaaacucuacccugaa

SEQ ID NO: 1934940 - RNA, 19 nt, Homo sapiens
aaugccucugcugugggcu

SEQ ID NO: 1934941 - RNA, 12 nt, Homo sapiens
agagguuugcuu

SEQ ID NO: 1934942 - RNA, 22 nt, Homo sapiens
aacauuuggcauuccugaauaa

SEQ ID NO: 1934943 - RNA, 19 nt, Homo sapiens
gaagccuuuguaaauuguc

SEQ ID NO: 1934944 - RNA, 19 nt, Homo sapiens
agauucagguaauacaaac

SEQ ID NO: 1934945 - RNA, 17 nt, Homo sapiens
caaggcauccccagugc

SEQ ID NO: 1934946 - RNA, 21 nt, Homo sapiens
ccugaggcuccugugcuacuu

SEQ ID NO: 1934947 - RNA, 16 nt, Homo sapiens
cacuaccuccucaggg

SEQ ID NO: 1934948 - RNA, 16 nt, Homo sapiens
cauaugagagcucuag

SEQ ID NO: 1934949 - RNA, 16 nt, Homo sapiens
aagaaauccaaauuuc

SEQ ID NO: 1934950 - RNA, 16 nt, Homo sapiens
uaagguauugugcauc

SEQ ID NO: 1934951 - RNA, 15 nt, Homo sapiens
uguuucuggggacac

SEQ ID NO: 1934952 - RNA, 15 nt, Homo sapiens
cagggagaaacccac

SEQ ID NO: 1934953 - RNA, 22 nt, Homo sapiens
ucauuccaccauggcuaaggca

SEQ ID NO: 1934954 - RNA, 22 nt, Homo sapiens
ggcaaggauggguccagaagac

SEQ ID NO: 1934955 - RNA, 18 nt, Homo sapiens
acauggcaaguacaguac

SEQ ID NO: 1934956 - RNA, 20 nt, Homo sapiens
caaugaaguugaaaaucaua

SEQ ID NO: 1934957 - RNA, 24 nt, Homo sapiens
guaugaaauuggaccugaacuguu

SEQ ID NO: 1934958 - RNA, 21 nt, Homo sapiens
uaaaauauaauuuucaaaaag

SEQ ID NO: 1934959 - RNA, 20 nt, Homo sapiens
uucacaggcagugcauguga

SEQ ID NO: 1934960 - RNA, 15 nt, Homo sapiens
gaaauaaaucagaga

SEQ ID NO: 1934961 - RNA, 23 nt, Homo sapiens
ccaucuaaaacucauacaaugau

SEQ ID NO: 1934962 - RNA, 21 nt, Homo sapiens
cauaggcaaagcaaucaagca

SEQ ID NO: 1934963 - RNA, 13 nt, Homo sapiens
uuaguuccacaaa

SEQ ID NO: 1934964 - RNA, 13 nt, Homo sapiens
agaguugagcaca

SEQ ID NO: 1934965 - RNA, 15 nt, Homo sapiens
ugaaaauuaaggaaa

SEQ ID NO: 1934966 - RNA, 15 nt, Homo sapiens
ucaaaauauuucuca

SEQ ID NO: 1934967 - RNA, 15 nt, Homo sapiens
acuuucuucuaccag

SEQ ID NO: 1934968 - RNA, 17 nt, Homo sapiens
uccuaggaaggggacug

SEQ ID NO: 1934969 - RNA, 15 nt, Homo sapiens
auccauaauuauuaa

SEQ ID NO: 1934970 - RNA, 23 nt, Homo sapiens
uucauuaaaauagauuaucccac

SEQ ID NO: 1934971 - RNA, 18 nt, Homo sapiens
ggagcauagaagccacau

SEQ ID NO: 1934972 - RNA, 14 nt, Homo sapiens
uugaagaaggguua

SEQ ID NO: 1934973 - RNA, 20 nt, Homo sapiens
cuuugaaaacacuacacagg

SEQ ID NO: 1934974 - RNA, 14 nt, Homo sapiens
uguuuucaacauug

SEQ ID NO: 1934975 - RNA, 15 nt, Homo sapiens
cucauccacuuucca

SEQ ID NO: 1934976 - RNA, 13 nt, Homo sapiens
augaaguguuucc

SEQ ID NO: 1934977 - RNA, 18 nt, Homo sapiens
aauacaauaaguuaacua

SEQ ID NO: 1934978 - RNA, 13 nt, Homo sapiens
auuuagcuguaaa

SEQ ID NO: 1934979 - RNA, 20 nt, Homo sapiens
gucugcucggccgucuucac

SEQ ID NO: 1934980 - RNA, 15 nt, Homo sapiens
uaugugugugugugc

SEQ ID NO: 1934981 - RNA, 15 nt, Homo sapiens
uacacaugugcacac

SEQ ID NO: 1934982 - RNA, 17 nt, Homo sapiens
acuugaaauaccaguga

SEQ ID NO: 1934983 - RNA, 13 nt, Homo sapiens
acacuaaccaaac

SEQ ID NO: 1934984 - RNA, 12 nt, Homo sapiens
uugauagcagaa

SEQ ID NO: 1934985 - RNA, 20 nt, Homo sapiens
augcccauuugugaagcuua

SEQ ID NO: 1934986 - RNA, 16 nt, Homo sapiens
gaccugagccagaccu

SEQ ID NO: 1934987 - RNA, 16 nt, Homo sapiens
acaucucccucccaca

SEQ ID NO: 1934988 - RNA, 17 nt, Homo sapiens
cgcugagggcaggguuc

SEQ ID NO: 1934989 - RNA, 18 nt, Homo sapiens
ggcagagucagcugcuga

SEQ ID NO: 1934990 - RNA, 14 nt, Homo sapiens
auuguggucauuuc

SEQ ID NO: 1934991 - RNA, 13 nt, Homo sapiens
caaggaauccuga

SEQ ID NO: 1934992 - RNA, 22 nt, Homo sapiens
ugggcagaucucccacaugcca

SEQ ID NO: 1934993 - RNA, 17 nt, Homo sapiens
cuuuucaaacacacaca

SEQ ID NO: 1934994 - RNA, 21 nt, Homo sapiens
cggcaguauuuucuguuuuua

SEQ ID NO: 1934995 - RNA, 12 nt, Homo sapiens
aucaacaaacca

SEQ ID NO: 1934996 - RNA, 16 nt, Homo sapiens
aaagccccagaaauca

SEQ ID NO: 1934997 - RNA, 13 nt, Homo sapiens
gggcaagaaggaa

SEQ ID NO: 1934998 - RNA, 14 nt, Homo sapiens
ugaacagaggccac

SEQ ID NO: 1934999 - RNA, 21 nt, Homo sapiens
accgcgcccagccucaucucu

SEQ ID NO: 1935000 - RNA, 20 nt, Homo sapiens
ugacaccgucccucagugau

SEQ ID NO: 1935001 - RNA, 19 nt, Homo sapiens
gcaggcacaaaucuugggu

SEQ ID NO: 1935002 - RNA, 18 nt, Homo sapiens
gauguuuccagacuuccu

SEQ ID NO: 1935003 - RNA, 19 nt, Homo sapiens
agcaugugugugucucuau

SEQ ID NO: 1935004 - RNA, 12 nt, Homo sapiens
ugaucaauccuu

SEQ ID NO: 1935005 - RNA, 16 nt, Homo sapiens
uugcccaucagccauu

SEQ ID NO: 1935006 - RNA, 15 nt, Homo sapiens
cuucuggcauaacua

SEQ ID NO: 1935007 - RNA, 16 nt, Homo sapiens
cuguggcauuuccaaa

SEQ ID NO: 1935008 - RNA, 19 nt, Homo sapiens
uccuaaaggcccacuggca

SEQ ID NO: 1935009 - RNA, 13 nt, Homo sapiens
auuucuacgugga

SEQ ID NO: 1935010 - RNA, 20 nt, Homo sapiens
gucucgauuagacuccaugu

SEQ ID NO: 1935011 - RNA, 16 nt, Homo sapiens
ccaaauaaaacuugag

SEQ ID NO: 1935012 - RNA, 17 nt, Homo sapiens
ugucagauaaguguaaa

SEQ ID NO: 1935013 - RNA, 12 nt, Homo sapiens
cucaugccugua

SEQ ID NO: 1935014 - RNA, 15 nt, Homo sapiens
ugucucucaugacca

SEQ ID NO: 1935015 - RNA, 11 nt, Homo sapiens
aaccaugaccu

SEQ ID NO: 1935016 - RNA, 23 nt, Homo sapiens
uacaaucaugaacagcucugaga

SEQ ID NO: 1935017 - RNA, 22 nt, Homo sapiens
augugugucuuuuuguaucuca

SEQ ID NO: 1935018 - RNA, 21 nt, Homo sapiens
aucuagcaguaaauacuugca

SEQ ID NO: 1935019 - RNA, 21 nt, Homo sapiens
aggaccuuccuuccucuugca

SEQ ID NO: 1935020 - RNA, 18 nt, Homo sapiens
ugguacuguagcagggga

SEQ ID NO: 1935021 - RNA, 14 nt, Homo sapiens
gacuccagaucugc

SEQ ID NO: 1935022 - RNA, 15 nt, Homo sapiens
accauuauagccuca

SEQ ID NO: 1935023 - RNA, 19 nt, Homo sapiens
caauauugccugugcuucu

SEQ ID NO: 1935024 - RNA, 19 nt, Homo sapiens
ggcccccggggaggggcca

SEQ ID NO: 1935025 - RNA, 21 nt, Homo sapiens
gaagauaacgccuucccuaag

SEQ ID NO: 1935026 - RNA, 21 nt, Homo sapiens
gauggaccuccuucgcuggaa

SEQ ID NO: 1935027 - RNA, 16 nt, Homo sapiens
uucgaaauguaaauau

SEQ ID NO: 1935028 - RNA, 13 nt, Homo sapiens
ugacucaccuguu

SEQ ID NO: 1935029 - RNA, 18 nt, Homo sapiens
acaagaccccgucucaaa

SEQ ID NO: 1935030 - RNA, 22 nt, Homo sapiens
ccauucuggaagugacuuuggc

SEQ ID NO: 1935031 - RNA, 18 nt, Homo sapiens
uauccuacugagcauuug

SEQ ID NO: 1935032 - RNA, 22 nt, Homo sapiens
cagauauauacacacaguggau

SEQ ID NO: 1935033 - RNA, 16 nt, Homo sapiens
aggaccuccuaccccc

SEQ ID NO: 1935034 - RNA, 15 nt, Homo sapiens
uagugcacuccaaga

SEQ ID NO: 1935035 - RNA, 16 nt, Homo sapiens
acuacgacuggcaucu

SEQ ID NO: 1935036 - RNA, 18 nt, Homo sapiens
cucacauccucugucuau

SEQ ID NO: 1935037 - RNA, 15 nt, Homo sapiens
gaauacuuucauuau

SEQ ID NO: 1935038 - RNA, 20 nt, Homo sapiens
aguggcgugaucucggcuca

SEQ ID NO: 1935039 - RNA, 22 nt, Homo sapiens
cucaaagggugccuucuagcug

SEQ ID NO: 1935040 - RNA, 18 nt, Homo sapiens
accugcacaaacauagac

SEQ ID NO: 1935041 - RNA, 18 nt, Homo sapiens
cuggaaggaccugcuccc

SEQ ID NO: 1935042 - RNA, 11 nt, Homo sapiens
cuccccagugc

SEQ ID NO: 1935043 - RNA, 22 nt, Homo sapiens
aaucagcccagugucccugagc

SEQ ID NO: 1935044 - RNA, 18 nt, Homo sapiens
gaaagcagggacuugaac

SEQ ID NO: 1935045 - RNA, 12 nt, Homo sapiens
aggacaagcaug

SEQ ID NO: 1935046 - RNA, 12 nt, Homo sapiens
aucauacaaaua

SEQ ID NO: 1935047 - RNA, 13 nt, Homo sapiens
uacaucuaaguca

SEQ ID NO: 1935048 - RNA, 15 nt, Homo sapiens
cuggguucuuuggaa

SEQ ID NO: 1935049 - RNA, 13 nt, Homo sapiens
auucuucugucaa

SEQ ID NO: 1935050 - RNA, 20 nt, Homo sapiens
gcugcuuucuuguugcugca

SEQ ID NO: 1935051 - RNA, 14 nt, Homo sapiens
uauuauuguagucu

SEQ ID NO: 1935052 - RNA, 15 nt, Homo sapiens
gaccacucaauccau

SEQ ID NO: 1935053 - RNA, 17 nt, Homo sapiens
agaaaagcaauacuguu

SEQ ID NO: 1935054 - RNA, 18 nt, Homo sapiens
ucauuuucauauuguaau

SEQ ID NO: 1935055 - RNA, 22 nt, Homo sapiens
uuccaucuccaggagacuuuca

SEQ ID NO: 1935056 - RNA, 14 nt, Homo sapiens
ggcaugaagcacau

SEQ ID NO: 1935057 - RNA, 16 nt, Homo sapiens
acaaacuacuguguca

SEQ ID NO: 1935058 - RNA, 13 nt, Homo sapiens
gacaagugccuga

SEQ ID NO: 1935059 - RNA, 16 nt, Homo sapiens
uccauauucuguauua

SEQ ID NO: 1935060 - RNA, 15 nt, Homo sapiens
ccacccaugugaggg

SEQ ID NO: 1935061 - RNA, 13 nt, Homo sapiens
uuaaugcuucauu

SEQ ID NO: 1935062 - RNA, 20 nt, Homo sapiens
aguccuacccugaaccuaug

SEQ ID NO: 1935063 - RNA, 23 nt, Homo sapiens
cagucuauuccaggcaugcacaa

SEQ ID NO: 1935064 - RNA, 16 nt, Homo sapiens
aucacaucacuaccua

SEQ ID NO: 1935065 - RNA, 14 nt, Homo sapiens
aggaggguggcacu

SEQ ID NO: 1935066 - RNA, 17 nt, Homo sapiens
acuucaaaaacauuuca

SEQ ID NO: 1935067 - RNA, 17 nt, Homo sapiens
ucuuacuugacuugaau

SEQ ID NO: 1935068 - RNA, 21 nt, Homo sapiens
cucaaccuccuguggaaccca

SEQ ID NO: 1935069 - RNA, 12 nt, Homo sapiens
cauguuucucac

SEQ ID NO: 1935070 - RNA, 12 nt, Homo sapiens
cacuagccugug

SEQ ID NO: 1935071 - RNA, 22 nt, Homo sapiens
cuagcauguaaggccuuucaau

SEQ ID NO: 1935072 - RNA, 16 nt, Homo sapiens
auaaguuccauguuaa

SEQ ID NO: 1935073 - RNA, 22 nt, Homo sapiens
ggaguccaggcccccagccccu

SEQ ID NO: 1935074 - RNA, 22 nt, Homo sapiens
aucaugaagaagcucuugacca

SEQ ID NO: 1935075 - RNA, 16 nt, Homo sapiens
cuccugguaacagcua

SEQ ID NO: 1935076 - RNA, 13 nt, Homo sapiens
cggccaacacuuu

SEQ ID NO: 1935077 - RNA, 14 nt, Homo sapiens
accaauauuaccau

SEQ ID NO: 1935078 - RNA, 21 nt, Homo sapiens
agcaggugcuacaacauguga

SEQ ID NO: 1935079 - RNA, 14 nt, Homo sapiens
gggugcuuccuugu

SEQ ID NO: 1935080 - RNA, 12 nt, Homo sapiens
ccaugacaugga

SEQ ID NO: 1935081 - RNA, 21 nt, Homo sapiens
ucugcagggggugugucugcu

SEQ ID NO: 1935082 - RNA, 20 nt, Homo sapiens
gaaugcagcaguaaauccaa

SEQ ID NO: 1935083 - RNA, 14 nt, Homo sapiens
uuaauaacacuuca

SEQ ID NO: 1935084 - RNA, 16 nt, Homo sapiens
acaaaaggagccaagc

SEQ ID NO: 1935085 - RNA, 19 nt, Homo sapiens
caaagauuucucaguauca

SEQ ID NO: 1935086 - RNA, 18 nt, Homo sapiens
ugaauggggucucaaagu

SEQ ID NO: 1935087 - RNA, 13 nt, Homo sapiens
ccugagcuaaaua

SEQ ID NO: 1935088 - RNA, 17 nt, Homo sapiens
uuuaacuuaauggcaca

SEQ ID NO: 1935089 - RNA, 16 nt, Homo sapiens
agcuuugugacuguau

SEQ ID NO: 1935090 - RNA, 21 nt, Homo sapiens
caagcugccgaaccaaaagaa

SEQ ID NO: 1935091 - RNA, 17 nt, Homo sapiens
uguucaaagugugacau

SEQ ID NO: 1935092 - RNA, 12 nt, Homo sapiens
cugucaguucuc

SEQ ID NO: 1935093 - RNA, 14 nt, Homo sapiens
uuuggugacuucac

SEQ ID NO: 1935094 - RNA, 16 nt, Homo sapiens
gccuuuuauggaccaa

SEQ ID NO: 1935095 - RNA, 22 nt, Homo sapiens
aaaacaauuugcauaauacuaa

SEQ ID NO: 1935096 - RNA, 17 nt, Homo sapiens
aggcugcgacugaugaa

SEQ ID NO: 1935097 - RNA, 14 nt, Homo sapiens
cccuccccagugcc

SEQ ID NO: 1935098 - RNA, 17 nt, Homo sapiens
gcccuauuucuugauaa

SEQ ID NO: 1935099 - RNA, 19 nt, Homo sapiens
cgugaacugcgugccagug

SEQ ID NO: 1935100 - RNA, 16 nt, Homo sapiens
uaucugacaaugcuga

SEQ ID NO: 1935101 - RNA, 21 nt, Homo sapiens
uaagcaccugccucagcaauu

SEQ ID NO: 1935102 - RNA, 18 nt, Homo sapiens
gacuuucuguguaccacu

SEQ ID NO: 1935103 - RNA, 17 nt, Homo sapiens
uccccacgaacuggccu

SEQ ID NO: 1935104 - RNA, 20 nt, Homo sapiens
uaagcacacuugacaucaac

SEQ ID NO: 1935105 - RNA, 14 nt, Homo sapiens
aggcuggagugcaa

SEQ ID NO: 1935106 - RNA, 22 nt, Homo sapiens
gccacaagaauaagcagcaaau

SEQ ID NO: 1935107 - RNA, 19 nt, Homo sapiens
uaugugucagccaugacca

SEQ ID NO: 1935108 - RNA, 21 nt, Homo sapiens
cauuucaucucauuuaaggga

SEQ ID NO: 1935109 - RNA, 19 nt, Homo sapiens
uagcugaguuuaacaugug

SEQ ID NO: 1935110 - RNA, 12 nt, Homo sapiens
gcuggcagaguu

SEQ ID NO: 1935111 - RNA, 15 nt, Homo sapiens
aaaggagccugugaa

SEQ ID NO: 1935112 - RNA, 22 nt, Homo sapiens
gugugcuucccaaauacauuaa

SEQ ID NO: 1935113 - RNA, 11 nt, Homo sapiens
ucaggugguua

SEQ ID NO: 1935114 - RNA, 17 nt, Homo sapiens
ccuagcacacacuuuug

SEQ ID NO: 1935115 - RNA, 19 nt, Homo sapiens
ccaaguuggucuuacuuug

SEQ ID NO: 1935116 - RNA, 21 nt, Homo sapiens
ccuuccugggcagcccagaga

SEQ ID NO: 1935117 - RNA, 20 nt, Homo sapiens
ucacauucuuauaaauauga

SEQ ID NO: 1935118 - RNA, 14 nt, Homo sapiens
aaaggccaggguca

SEQ ID NO: 1935119 - RNA, 20 nt, Homo sapiens
gagaugggguuucacugugu

SEQ ID NO: 1935120 - RNA, 21 nt, Homo sapiens
cugugguuuuucuaauggacu

SEQ ID NO: 1935121 - RNA, 13 nt, Homo sapiens
ucaaaugugcugu

SEQ ID NO: 1935122 - RNA, 17 nt, Homo sapiens
cucuggcaaucuugccc

SEQ ID NO: 1935123 - RNA, 21 nt, Homo sapiens
ugggcaacagagcaagacucc

SEQ ID NO: 1935124 - RNA, 17 nt, Homo sapiens
uaaaacaaaauuugacu

SEQ ID NO: 1935125 - RNA, 20 nt, Homo sapiens
uauugauguuuccagaaaau

SEQ ID NO: 1935126 - RNA, 13 nt, Homo sapiens
ucaggcuucucau

SEQ ID NO: 1935127 - RNA, 20 nt, Homo sapiens
agaacucauuagcuguguga

SEQ ID NO: 1935128 - RNA, 24 nt, Homo sapiens
uugcuguuggcaucuugcugcuaa

SEQ ID NO: 1935129 - RNA, 21 nt, Homo sapiens
acaaaaugacauuuugccaaa

SEQ ID NO: 1935130 - RNA, 14 nt, Homo sapiens
aaaauucauuugcu

SEQ ID NO: 1935131 - RNA, 14 nt, Homo sapiens
aggcagaucuuuaa

SEQ ID NO: 1935132 - RNA, 22 nt, Homo sapiens
gaaaagaacuaggacugaacua

SEQ ID NO: 1935133 - RNA, 19 nt, Homo sapiens
aguauuugguuuuccauuc

SEQ ID NO: 1935134 - RNA, 19 nt, Homo sapiens
agaaaauggacguguuaug

SEQ ID NO: 1935135 - RNA, 16 nt, Homo sapiens
gaacuaaaauucuguc

SEQ ID NO: 1935136 - RNA, 15 nt, Homo sapiens
ccugggaggagagaa

SEQ ID NO: 1935137 - RNA, 23 nt, Homo sapiens
gucagcugcuucugcugccuagg

SEQ ID NO: 1935138 - RNA, 20 nt, Homo sapiens
acccgccuagcugcugucac

SEQ ID NO: 1935139 - RNA, 22 nt, Homo sapiens
uuauaauaguaagccccuguga

SEQ ID NO: 1935140 - RNA, 13 nt, Homo sapiens
ucagccagguuug

SEQ ID NO: 1935141 - RNA, 11 nt, Homo sapiens
gacacacugua

SEQ ID NO: 1935142 - RNA, 19 nt, Homo sapiens
cagaggcagcuucuuugcc

SEQ ID NO: 1935143 - RNA, 11 nt, Homo sapiens
uaaacacuuuc

SEQ ID NO: 1935144 - RNA, 16 nt, Homo sapiens
cccaauaaagccuuuu

SEQ ID NO: 1935145 - RNA, 16 nt, Homo sapiens
aacuuacuauucauua

SEQ ID NO: 1935146 - RNA, 16 nt, Homo sapiens
ggaaguaaagccucaa

SEQ ID NO: 1935147 - RNA, 20 nt, Homo sapiens
uaaaauuacauugagguucc

SEQ ID NO: 1935148 - RNA, 20 nt, Homo sapiens
uugagaaccagucuccucac

SEQ ID NO: 1935149 - RNA, 14 nt, Homo sapiens
gucugugugcugag

SEQ ID NO: 1935150 - RNA, 13 nt, Homo sapiens
caggcccuccacu

SEQ ID NO: 1935151 - RNA, 12 nt, Homo sapiens
ccuggugcucuu

SEQ ID NO: 1935152 - RNA, 23 nt, Homo sapiens
ucaggcucuguggagggcauuug

SEQ ID NO: 1935153 - RNA, 19 nt, Homo sapiens
ugaagcaggagaaucacuu

SEQ ID NO: 1935154 - RNA, 14 nt, Homo sapiens
ccagggcuccagga

SEQ ID NO: 1935155 - RNA, 14 nt, Homo sapiens
ugcaugcuugcaua

SEQ ID NO: 1935156 - RNA, 12 nt, Homo sapiens
ugagaaagggau

SEQ ID NO: 1935157 - RNA, 12 nt, Homo sapiens
uccaccacaaga

SEQ ID NO: 1935158 - RNA, 17 nt, Homo sapiens
caguggcgcgaucucag

SEQ ID NO: 1935159 - RNA, 13 nt, Homo sapiens
uagagaguugaga

SEQ ID NO: 1935160 - RNA, 22 nt, Homo sapiens
aaggagauauggcuaguggcaa

SEQ ID NO: 1935161 - RNA, 14 nt, Homo sapiens
ugggaaugcaauau

SEQ ID NO: 1935162 - RNA, 15 nt, Homo sapiens
uucacagauggaauc

SEQ ID NO: 1935163 - RNA, 21 nt, Homo sapiens
uaauuuaugcagagacagcug

SEQ ID NO: 1935164 - RNA, 16 nt, Homo sapiens
aaaauaccaaucacaa

SEQ ID NO: 1935165 - RNA, 18 nt, Homo sapiens
ccaaagacuacacuguug

SEQ ID NO: 1935166 - RNA, 19 nt, Homo sapiens
acagugaauguguguaugu

SEQ ID NO: 1935167 - RNA, 13 nt, Homo sapiens
augcaccuaccca

SEQ ID NO: 1935168 - RNA, 22 nt, Homo sapiens
aaacuggcaaaauaguucugca

SEQ ID NO: 1935169 - RNA, 17 nt, Homo sapiens
uagugacuuuggcauuu

SEQ ID NO: 1935170 - RNA, 17 nt, Homo sapiens
agucucagagaccagca

SEQ ID NO: 1935171 - RNA, 15 nt, Homo sapiens
auaccaaguugauac

SEQ ID NO: 1935172 - RNA, 22 nt, Homo sapiens
accccuggggggacuucccaaa

SEQ ID NO: 1935173 - RNA, 12 nt, Homo sapiens
gacucacuccau

SEQ ID NO: 1935174 - RNA, 15 nt, Homo sapiens
guacccccccagggg

SEQ ID NO: 1935175 - RNA, 18 nt, Homo sapiens
aaaccauggcagacucac

SEQ ID NO: 1935176 - RNA, 17 nt, Homo sapiens
aggcucacgaagggcau

SEQ ID NO: 1935177 - RNA, 17 nt, Homo sapiens
gaauugccuguucauaa

SEQ ID NO: 1935178 - RNA, 14 nt, Homo sapiens
gguuucaccauauu

SEQ ID NO: 1935179 - RNA, 19 nt, Homo sapiens
gacauccccacucacgaau

SEQ ID NO: 1935180 - RNA, 15 nt, Homo sapiens
aaauuauacuuuaua

SEQ ID NO: 1935181 - RNA, 15 nt, Homo sapiens
guguuuuauugacau

SEQ ID NO: 1935182 - RNA, 15 nt, Homo sapiens
gaaauaaauaaucua

SEQ ID NO: 1935183 - RNA, 16 nt, Homo sapiens
ccucccauaauuucau

SEQ ID NO: 1935184 - RNA, 21 nt, Homo sapiens
ucccaaacuccucuccuggau

SEQ ID NO: 1935185 - RNA, 20 nt, Homo sapiens
aaugauuaaauuaugaagcu

SEQ ID NO: 1935186 - RNA, 13 nt, Homo sapiens
guccaguuuccaa

SEQ ID NO: 1935187 - RNA, 22 nt, Homo sapiens
aaauguuauuuuuuaauuauua

SEQ ID NO: 1935188 - RNA, 13 nt, Homo sapiens
agaauacacagga

SEQ ID NO: 1935189 - RNA, 21 nt, Homo sapiens
ggcuuagacuucgacucagga

SEQ ID NO: 1935190 - RNA, 18 nt, Homo sapiens
uacaaaucaaagauuugu

SEQ ID NO: 1935191 - RNA, 13 nt, Homo sapiens
ggacuagcuggau

SEQ ID NO: 1935192 - RNA, 13 nt, Homo sapiens
uucugaggggugu

SEQ ID NO: 1935193 - RNA, 18 nt, Homo sapiens
aaccagaucugucuccaa

SEQ ID NO: 1935194 - RNA, 22 nt, Homo sapiens
gcagcucagcucuuuggaucag

SEQ ID NO: 1935195 - RNA, 19 nt, Homo sapiens
agggcugucaucugugcac

SEQ ID NO: 1935196 - RNA, 12 nt, Homo sapiens
ugguaugaucac

SEQ ID NO: 1935197 - RNA, 14 nt, Homo sapiens
cuagcaaccugccu

SEQ ID NO: 1935198 - RNA, 17 nt, Homo sapiens
cagcuuauaugugacac

SEQ ID NO: 1935199 - RNA, 12 nt, Homo sapiens
ccucucauucca

SEQ ID NO: 1935200 - RNA, 13 nt, Homo sapiens
aguaugugcauau

SEQ ID NO: 1935201 - RNA, 13 nt, Homo sapiens
agugugugcaugu

SEQ ID NO: 1935202 - RNA, 17 nt, Homo sapiens
uagcgcuggcucaggaa

SEQ ID NO: 1935203 - RNA, 19 nt, Homo sapiens
cccaugugagucccuguga

SEQ ID NO: 1935204 - RNA, 21 nt, Homo sapiens
gccagaggcucuaauguacaa

SEQ ID NO: 1935205 - RNA, 24 nt, Homo sapiens
ccccagcugaccugguacugaggu

SEQ ID NO: 1935206 - RNA, 18 nt, Homo sapiens
uaaaagcaauuccaaccu

SEQ ID NO: 1935207 - RNA, 11 nt, Homo sapiens
uaaagcaaagu

SEQ ID NO: 1935208 - RNA, 15 nt, Homo sapiens
cgaggcgaugccacg

SEQ ID NO: 1935209 - RNA, 12 nt, Homo sapiens
guuucuuucuag

SEQ ID NO: 1935210 - RNA, 14 nt, Homo sapiens
uuuuaaacauaucc

SEQ ID NO: 1935211 - RNA, 22 nt, Homo sapiens
aagcuaucagcaauacucauca

SEQ ID NO: 1935212 - RNA, 14 nt, Homo sapiens
gaggaaauccauug

SEQ ID NO: 1935213 - RNA, 15 nt, Homo sapiens
aaacccaucagacag

SEQ ID NO: 1935214 - RNA, 12 nt, Homo sapiens
uuggcagugugu

SEQ ID NO: 1935215 - RNA, 18 nt, Homo sapiens
gauuuugaaucaagcaau

SEQ ID NO: 1935216 - RNA, 19 nt, Homo sapiens
uggguuggaaaacaguauu

SEQ ID NO: 1935217 - RNA, 15 nt, Homo sapiens
gccuuaaugcuucau

SEQ ID NO: 1935218 - RNA, 22 nt, Homo sapiens
caagucccuggaaaaggagcuu

SEQ ID NO: 1935219 - RNA, 13 nt, Homo sapiens
guugauucuugcc

SEQ ID NO: 1935220 - RNA, 17 nt, Homo sapiens
cuuaauccaccaaguuu

SEQ ID NO: 1935221 - RNA, 13 nt, Homo sapiens
cccuucuugccau

SEQ ID NO: 1935222 - RNA, 17 nt, Homo sapiens
gcaauuagcauucuguc

SEQ ID NO: 1935223 - RNA, 13 nt, Homo sapiens
uggauuucaucac

SEQ ID NO: 1935224 - RNA, 18 nt, Homo sapiens
gccugcuuugacgggcca

SEQ ID NO: 1935225 - RNA, 18 nt, Homo sapiens
ugccuggcccauucuuga

SEQ ID NO: 1935226 - RNA, 20 nt, Homo sapiens
ugagcuggggacucagggac

SEQ ID NO: 1935227 - RNA, 21 nt, Homo sapiens
gaaagagaucacccacuccua

SEQ ID NO: 1935228 - RNA, 18 nt, Homo sapiens
uugcucuuacuacacuga

SEQ ID NO: 1935229 - RNA, 13 nt, Homo sapiens
cuuuccacuuugu

SEQ ID NO: 1935230 - RNA, 21 nt, Homo sapiens
cucacauacccacacauucca

SEQ ID NO: 1935231 - RNA, 18 nt, Homo sapiens
gagggaggaacaccugau

SEQ ID NO: 1935232 - RNA, 15 nt, Homo sapiens
uaaguguuugucaua

SEQ ID NO: 1935233 - RNA, 12 nt, Homo sapiens
ccagcauucuca

SEQ ID NO: 1935234 - RNA, 12 nt, Homo sapiens
ugacaugugcaa

SEQ ID NO: 1935235 - RNA, 13 nt, Homo sapiens
cagcaccagugaa

SEQ ID NO: 1935236 - RNA, 22 nt, Homo sapiens
auagcagccuuucucucuuuau

SEQ ID NO: 1935237 - RNA, 19 nt, Homo sapiens
aaacuaguuuccaguggau

SEQ ID NO: 1935238 - RNA, 14 nt, Homo sapiens
ucccaggcugaggc

SEQ ID NO: 1935239 - RNA, 23 nt, Homo sapiens
uacuuccuccuagcaaccaacuu

SEQ ID NO: 1935240 - RNA, 20 nt, Homo sapiens
gaauaagcuuuuaaugcucc

SEQ ID NO: 1935241 - RNA, 14 nt, Homo sapiens
ugagguguugcuaa

SEQ ID NO: 1935242 - RNA, 21 nt, Homo sapiens
caacccaggcaguaccauuca

SEQ ID NO: 1935243 - RNA, 15 nt, Homo sapiens
auuucaucaugacug

SEQ ID NO: 1935244 - RNA, 13 nt, Homo sapiens
aaaauguccaaaa

SEQ ID NO: 1935245 - RNA, 22 nt, Homo sapiens
caggaagaccaaggccucggca

SEQ ID NO: 1935246 - RNA, 14 nt, Homo sapiens
uuuucaacauaacu

SEQ ID NO: 1935247 - RNA, 16 nt, Homo sapiens
uauggcuauucuugaa

SEQ ID NO: 1935248 - RNA, 14 nt, Homo sapiens
agcgaccucucugc

SEQ ID NO: 1935249 - RNA, 13 nt, Homo sapiens
ucucuagugcagg

SEQ ID NO: 1935250 - RNA, 20 nt, Homo sapiens
gccagucugcagaagcauuu

SEQ ID NO: 1935251 - RNA, 11 nt, Homo sapiens
ucuaucaaaau

SEQ ID NO: 1935252 - RNA, 19 nt, Homo sapiens
ccacagcaaccccaggcug

SEQ ID NO: 1935253 - RNA, 15 nt, Homo sapiens
augugcugcaaagag

SEQ ID NO: 1935254 - RNA, 16 nt, Homo sapiens
cagagcgcacagggag

SEQ ID NO: 1935255 - RNA, 15 nt, Homo sapiens
gguccccauccccac

SEQ ID NO: 1935256 - RNA, 13 nt, Homo sapiens
ggagcugcucaac

SEQ ID NO: 1935257 - RNA, 18 nt, Homo sapiens
uguauacacuuaaacuug

SEQ ID NO: 1935258 - RNA, 16 nt, Homo sapiens
cuccuuggcuuaccug

SEQ ID NO: 1935259 - RNA, 22 nt, Homo sapiens
cucaaaucauuuaagaaggagu

SEQ ID NO: 1935260 - RNA, 22 nt, Homo sapiens
aaguaagccauguaucucagga

SEQ ID NO: 1935261 - RNA, 22 nt, Homo sapiens
caggcccuguccuaagcacuuu

SEQ ID NO: 1935262 - RNA, 13 nt, Homo sapiens
uaaucacaguguu

SEQ ID NO: 1935263 - RNA, 18 nt, Homo sapiens
uucccaucuuuacuccca

SEQ ID NO: 1935264 - RNA, 20 nt, Homo sapiens
caaguauugcgaaugugcag

SEQ ID NO: 1935265 - RNA, 17 nt, Homo sapiens
accaagggaucugccau

SEQ ID NO: 1935266 - RNA, 15 nt, Homo sapiens
gguggcugucccuuc

SEQ ID NO: 1935267 - RNA, 14 nt, Homo sapiens
uuccuccacuucau

SEQ ID NO: 1935268 - RNA, 16 nt, Homo sapiens
auccuucagcacagga

SEQ ID NO: 1935269 - RNA, 17 nt, Homo sapiens
cugcuccuacaagggaa

SEQ ID NO: 1935270 - RNA, 21 nt, Homo sapiens
gauaugaagagcaacugggac

SEQ ID NO: 1935271 - RNA, 19 nt, Homo sapiens
gcuauuggcccagcuuuua

SEQ ID NO: 1935272 - RNA, 15 nt, Homo sapiens
gagcagagcuuccac

SEQ ID NO: 1935273 - RNA, 20 nt, Homo sapiens
gaggaaaaauaaagacaaau

SEQ ID NO: 1935274 - RNA, 13 nt, Homo sapiens
ugaaagauggguc

SEQ ID NO: 1935275 - RNA, 19 nt, Homo sapiens
aagacaauggccauugugu

SEQ ID NO: 1935276 - RNA, 21 nt, Homo sapiens
uccaagaauguuguuagcuuu

SEQ ID NO: 1935277 - RNA, 16 nt, Homo sapiens
gcacugcguacaaaca

SEQ ID NO: 1935278 - RNA, 15 nt, Homo sapiens
aaccuuugugcccua

SEQ ID NO: 1935279 - RNA, 17 nt, Homo sapiens
uauuuuccaugcuauaa

SEQ ID NO: 1935280 - RNA, 14 nt, Homo sapiens
ugcccaaccucagc

SEQ ID NO: 1935281 - RNA, 20 nt, Homo sapiens
cagaacagaugcugagccau

SEQ ID NO: 1935282 - RNA, 21 nt, Homo sapiens
cuaaaaggugaccaaugaugg

SEQ ID NO: 1935283 - RNA, 20 nt, Homo sapiens
ccuccugugcuauuuguaca

SEQ ID NO: 1935284 - RNA, 18 nt, Homo sapiens
aacaauaaagacugagac

SEQ ID NO: 1935285 - RNA, 22 nt, Homo sapiens
ggaaaaaaaaaaauaugagauu

SEQ ID NO: 1935286 - RNA, 22 nt, Homo sapiens
aggcugaucucgaacuccuaac

SEQ ID NO: 1935287 - RNA, 16 nt, Homo sapiens
aaugugaucauaugag

SEQ ID NO: 1935288 - RNA, 20 nt, Homo sapiens
uaccaauaaagugacccugu

SEQ ID NO: 1935289 - RNA, 21 nt, Homo sapiens
gcaauggaagcccucaaagaa

SEQ ID NO: 1935290 - RNA, 15 nt, Homo sapiens
uaccaagaacagagu

SEQ ID NO: 1935291 - RNA, 14 nt, Homo sapiens
agggcaucacuggg

SEQ ID NO: 1935292 - RNA, 16 nt, Homo sapiens
auaugggcucaaguca

SEQ ID NO: 1935293 - RNA, 20 nt, Homo sapiens
aaaucccaccuuuaccccac

SEQ ID NO: 1935294 - RNA, 14 nt, Homo sapiens
ucaagauucuacuu

SEQ ID NO: 1935295 - RNA, 19 nt, Homo sapiens
uccucucccauccuugaug

SEQ ID NO: 1935296 - RNA, 17 nt, Homo sapiens
cuccuuuuccacuuuaa

SEQ ID NO: 1935297 - RNA, 17 nt, Homo sapiens
auaccugucccccugac

SEQ ID NO: 1935298 - RNA, 19 nt, Homo sapiens
cagugccucagugcugcaa

SEQ ID NO: 1935299 - RNA, 22 nt, Homo sapiens
acauuucaccccacucuguaca

SEQ ID NO: 1935300 - RNA, 17 nt, Homo sapiens
cuauucuugauguaaaa

SEQ ID NO: 1935301 - RNA, 16 nt, Homo sapiens
uuuuaugaaagcacug

SEQ ID NO: 1935302 - RNA, 15 nt, Homo sapiens
cucccuuguguuccu

SEQ ID NO: 1935303 - RNA, 22 nt, Homo sapiens
auuucauuucagccacuucugc

SEQ ID NO: 1935304 - RNA, 14 nt, Homo sapiens
uucuguauucugac

SEQ ID NO: 1935305 - RNA, 15 nt, Homo sapiens
gccagcccacugggc

SEQ ID NO: 1935306 - RNA, 12 nt, Homo sapiens
ccaguccuuaau

SEQ ID NO: 1935307 - RNA, 15 nt, Homo sapiens
ugcagucucccagau

SEQ ID NO: 1935308 - RNA, 14 nt, Homo sapiens
uauaaauaacuaau

SEQ ID NO: 1935309 - RNA, 14 nt, Homo sapiens
cugcguucuuucaa

SEQ ID NO: 1935310 - RNA, 16 nt, Homo sapiens
uaaaacaauaauaaua

SEQ ID NO: 1935311 - RNA, 13 nt, Homo sapiens
uaaaacauuauga

SEQ ID NO: 1935312 - RNA, 16 nt, Homo sapiens
uuuagugaucacagca

SEQ ID NO: 1935313 - RNA, 19 nt, Homo sapiens
gcaggaacugaaaaccagu

SEQ ID NO: 1935314 - RNA, 14 nt, Homo sapiens
acuacgacuggcau

SEQ ID NO: 1935315 - RNA, 16 nt, Homo sapiens
gcacaagaaucacuug

SEQ ID NO: 1935316 - RNA, 16 nt, Homo sapiens
gccaggccaacugccc

SEQ ID NO: 1935317 - RNA, 17 nt, Homo sapiens
agaaauuaccuguggau

SEQ ID NO: 1935318 - RNA, 17 nt, Homo sapiens
auagcuacaguguaaua

SEQ ID NO: 1935319 - RNA, 14 nt, Homo sapiens
uccagaauccacaa

SEQ ID NO: 1935320 - RNA, 19 nt, Homo sapiens
caugacaaacacacaucca

SEQ ID NO: 1935321 - RNA, 14 nt, Homo sapiens
cucaguaccucccc

SEQ ID NO: 1935322 - RNA, 17 nt, Homo sapiens
uucagauugacaaggua

SEQ ID NO: 1935323 - RNA, 17 nt, Homo sapiens
caggacuucugugcauu

SEQ ID NO: 1935324 - RNA, 16 nt, Homo sapiens
aacuuuucuaccauuu

SEQ ID NO: 1935325 - RNA, 18 nt, Homo sapiens
cuucagaacaaucugagu

SEQ ID NO: 1935326 - RNA, 21 nt, Homo sapiens
uagcaaugaauuaguugcauu

SEQ ID NO: 1935327 - RNA, 15 nt, Homo sapiens
aagaaaugucugcca

SEQ ID NO: 1935328 - RNA, 13 nt, Homo sapiens
ucuguguggugcc

SEQ ID NO: 1935329 - RNA, 17 nt, Homo sapiens
uuucaacuugcaauuug

SEQ ID NO: 1935330 - RNA, 14 nt, Homo sapiens
ucauauuuugccac

SEQ ID NO: 1935331 - RNA, 23 nt, Homo sapiens
aaccuuauuuugauaaaauguaa

SEQ ID NO: 1935332 - RNA, 20 nt, Homo sapiens
uuaauauuaccaacuacauu

SEQ ID NO: 1935333 - RNA, 13 nt, Homo sapiens
caagucuagcuuu

SEQ ID NO: 1935334 - RNA, 14 nt, Homo sapiens
cucagcccugagau

SEQ ID NO: 1935335 - RNA, 18 nt, Homo sapiens
uuuuaacuucaccuuaaa

SEQ ID NO: 1935336 - RNA, 11 nt, Homo sapiens
cuucacugaca

SEQ ID NO: 1935337 - RNA, 15 nt, Homo sapiens
ugcgucugcacugau

SEQ ID NO: 1935338 - RNA, 15 nt, Homo sapiens
ggcccuucacugucc

SEQ ID NO: 1935339 - RNA, 18 nt, Homo sapiens
aaacaaaaaaccacaaaa

SEQ ID NO: 1935340 - RNA, 19 nt, Homo sapiens
ccuagaagggucacuuuaa

SEQ ID NO: 1935341 - RNA, 13 nt, Homo sapiens
cccugacuguaua

SEQ ID NO: 1935342 - RNA, 17 nt, Homo sapiens
uaacaaacaucacucug

SEQ ID NO: 1935343 - RNA, 21 nt, Homo sapiens
auugugugucacaagaauuua

SEQ ID NO: 1935344 - RNA, 13 nt, Homo sapiens
cuccuacugagga

SEQ ID NO: 1935345 - RNA, 18 nt, Homo sapiens
aucauuuauaauacuguu

SEQ ID NO: 1935346 - RNA, 18 nt, Homo sapiens
agaguccagaucuugccu

SEQ ID NO: 1935347 - RNA, 19 nt, Homo sapiens
gcuguaccggccacugcaa

SEQ ID NO: 1935348 - RNA, 13 nt, Homo sapiens
cgcggcucuccag

SEQ ID NO: 1935349 - RNA, 21 nt, Homo sapiens
ucccuauacagagguccugcc

SEQ ID NO: 1935350 - RNA, 19 nt, Homo sapiens
ugguacucccaaacugaca

SEQ ID NO: 1935351 - RNA, 20 nt, Homo sapiens
uucuuaguggaagacaauac

SEQ ID NO: 1935352 - RNA, 13 nt, Homo sapiens
gaauaaagccaca

SEQ ID NO: 1935353 - RNA, 18 nt, Homo sapiens
aggugaucucaguucucu

SEQ ID NO: 1935354 - RNA, 15 nt, Homo sapiens
agauggaacacugga

SEQ ID NO: 1935355 - RNA, 20 nt, Homo sapiens
augggaagaaaaaggaaaca

SEQ ID NO: 1935356 - RNA, 15 nt, Homo sapiens
ccuggucauuucaaa

SEQ ID NO: 1935357 - RNA, 21 nt, Homo sapiens
gauaucacuuccaugacauaa

SEQ ID NO: 1935358 - RNA, 23 nt, Homo sapiens
guuacuuuuuuaguaacaauuca

SEQ ID NO: 1935359 - RNA, 14 nt, Homo sapiens
ugauugcuggcaac

SEQ ID NO: 1935360 - RNA, 22 nt, Homo sapiens
agaucugcaccaccaugcccag

SEQ ID NO: 1935361 - RNA, 16 nt, Homo sapiens
uuguucucccaaaaca

SEQ ID NO: 1935362 - RNA, 22 nt, Homo sapiens
ugcaguuugaaauucugaauuu

SEQ ID NO: 1935363 - RNA, 20 nt, Homo sapiens
gcauguuggcccagaccuca

SEQ ID NO: 1935364 - RNA, 23 nt, Homo sapiens
aaggcagcugccucugcucccuc

SEQ ID NO: 1935365 - RNA, 17 nt, Homo sapiens
uuaauucagcuuuagaa

SEQ ID NO: 1935366 - RNA, 17 nt, Homo sapiens
augggcugagcuagccu

SEQ ID NO: 1935367 - RNA, 16 nt, Homo sapiens
caggacaaaaugcaaa

SEQ ID NO: 1935368 - RNA, 18 nt, Homo sapiens
acuggggaaagugcauuu

SEQ ID NO: 1935369 - RNA, 16 nt, Homo sapiens
uccuaaguagcugggu

SEQ ID NO: 1935370 - RNA, 17 nt, Homo sapiens
guuaagugucauuucuu

SEQ ID NO: 1935371 - RNA, 13 nt, Homo sapiens
uacaauugucauu

SEQ ID NO: 1935372 - RNA, 13 nt, Homo sapiens
aacuccaaugaaa

SEQ ID NO: 1935373 - RNA, 15 nt, Homo sapiens
caauuaaagaaauaa

SEQ ID NO: 1935374 - RNA, 15 nt, Homo sapiens
gugagccacugugcc

SEQ ID NO: 1935375 - RNA, 19 nt, Homo sapiens
auuagcccgcuagcauuag

SEQ ID NO: 1935376 - RNA, 21 nt, Homo sapiens
ugacccaggccuggccaguca

SEQ ID NO: 1935377 - RNA, 19 nt, Homo sapiens
ugcccugggauguccacag

SEQ ID NO: 1935378 - RNA, 22 nt, Homo sapiens
auauuuuagauuacaggauuaa

SEQ ID NO: 1935379 - RNA, 17 nt, Homo sapiens
acagccgccaggagcua

SEQ ID NO: 1935380 - RNA, 22 nt, Homo sapiens
acuccggcuuguccucaucucu

SEQ ID NO: 1935381 - RNA, 21 nt, Homo sapiens
accuuugccuuccaacugcca

SEQ ID NO: 1935382 - RNA, 21 nt, Homo sapiens
uauaaugugauuuuuuuuaga

SEQ ID NO: 1935383 - RNA, 15 nt, Homo sapiens
guggaaaacucacag

SEQ ID NO: 1935384 - RNA, 22 nt, Homo sapiens
uucuuucugcaugacuauugua

SEQ ID NO: 1935385 - RNA, 17 nt, Homo sapiens
uuuaaauguuacuggua

SEQ ID NO: 1935386 - RNA, 15 nt, Homo sapiens
augaugauaguauaa

SEQ ID NO: 1935387 - RNA, 19 nt, Homo sapiens
ucugcucaaaacuuucaaa

SEQ ID NO: 1935388 - RNA, 16 nt, Homo sapiens
gguucuggaacagcuu

SEQ ID NO: 1935389 - RNA, 15 nt, Homo sapiens
agcauuuucaaugau

SEQ ID NO: 1935390 - RNA, 15 nt, Homo sapiens
aguuggagugcaaug

SEQ ID NO: 1935391 - RNA, 20 nt, Homo sapiens
aauuagaaacaacauagcaa

SEQ ID NO: 1935392 - RNA, 20 nt, Homo sapiens
gagaugcugguaauggccau

SEQ ID NO: 1935393 - RNA, 21 nt, Homo sapiens
acaagucauaccuacauucaa

SEQ ID NO: 1935394 - RNA, 20 nt, Homo sapiens
ucuggcccgcaauacuguag

SEQ ID NO: 1935395 - RNA, 16 nt, Homo sapiens
ugaggccuccugccau

SEQ ID NO: 1935396 - RNA, 19 nt, Homo sapiens
gcacaccuguuauugccaa

SEQ ID NO: 1935397 - RNA, 21 nt, Homo sapiens
aggaaaccucacgacugguca

SEQ ID NO: 1935398 - RNA, 12 nt, Homo sapiens
acauuugugcuc

SEQ ID NO: 1935399 - RNA, 21 nt, Homo sapiens
aguggacaccgcucaguauua

SEQ ID NO: 1935400 - RNA, 19 nt, Homo sapiens
uacaaccuaaaaaauuccu

SEQ ID NO: 1935401 - RNA, 17 nt, Homo sapiens
uaauuuccucugacaug

SEQ ID NO: 1935402 - RNA, 14 nt, Homo sapiens
ccuguuuguacugu

SEQ ID NO: 1935403 - RNA, 20 nt, Homo sapiens
ggaaagagagcaccacguga

SEQ ID NO: 1935404 - RNA, 19 nt, Homo sapiens
uaaaagaaaaaaaccaaag

SEQ ID NO: 1935405 - RNA, 18 nt, Homo sapiens
aacccagacaaccaaaac

SEQ ID NO: 1935406 - RNA, 21 nt, Homo sapiens
ucccuggaggagaaguauucc

SEQ ID NO: 1935407 - RNA, 17 nt, Homo sapiens
cuuuugaaucaaucugg

SEQ ID NO: 1935408 - RNA, 17 nt, Homo sapiens
gugaggggcucucucau

SEQ ID NO: 1935409 - RNA, 18 nt, Homo sapiens
agguagccgggcucugca

SEQ ID NO: 1935410 - RNA, 22 nt, Homo sapiens
aaauauuguauccuuuauuucu

SEQ ID NO: 1935411 - RNA, 15 nt, Homo sapiens
caauccccagacuca

SEQ ID NO: 1935412 - RNA, 17 nt, Homo sapiens
gaugucuccacuuucac

SEQ ID NO: 1935413 - RNA, 21 nt, Homo sapiens
aacaauaaagcauuuugcaaa

SEQ ID NO: 1935414 - RNA, 23 nt, Homo sapiens
gagacccguagaugccagggcug

SEQ ID NO: 1935415 - RNA, 15 nt, Homo sapiens
ccugcuuugcaucuu

SEQ ID NO: 1935416 - RNA, 15 nt, Homo sapiens
cuuaggaaggaguau

SEQ ID NO: 1935417 - RNA, 17 nt, Homo sapiens
aguacgaaccuacaguu

SEQ ID NO: 1935418 - RNA, 20 nt, Homo sapiens
cgaaauaacaauguuaagga

SEQ ID NO: 1935419 - RNA, 13 nt, Homo sapiens
cuguguauuccaa

SEQ ID NO: 1935420 - RNA, 12 nt, Homo sapiens
ugacaacuguga

SEQ ID NO: 1935421 - RNA, 19 nt, Homo sapiens
uccccauuuccacuguaua

SEQ ID NO: 1935422 - RNA, 18 nt, Homo sapiens
ccuuugaaagcuguauaa

SEQ ID NO: 1935423 - RNA, 21 nt, Homo sapiens
uugcaauaccaauguucuaaa

SEQ ID NO: 1935424 - RNA, 15 nt, Homo sapiens
gcccagucgacccca

SEQ ID NO: 1935425 - RNA, 15 nt, Homo sapiens
gcuuuguugugagaa

SEQ ID NO: 1935426 - RNA, 23 nt, Homo sapiens
acucgauuuuaccauauggaaua

SEQ ID NO: 1935427 - RNA, 18 nt, Homo sapiens
cugugcaggauauuugca

SEQ ID NO: 1935428 - RNA, 22 nt, Homo sapiens
aaaagaagaccguuuaccuaga

SEQ ID NO: 1935429 - RNA, 16 nt, Homo sapiens
cacuagccuaggucau

SEQ ID NO: 1935430 - RNA, 19 nt, Homo sapiens
augauaaaccugccaagag

SEQ ID NO: 1935431 - RNA, 20 nt, Homo sapiens
gugacuuucaagcuacucac

SEQ ID NO: 1935432 - RNA, 20 nt, Homo sapiens
uggaauauaauaugucuuca

SEQ ID NO: 1935433 - RNA, 15 nt, Homo sapiens
aaacauaagccacag

SEQ ID NO: 1935434 - RNA, 15 nt, Homo sapiens
ccucgccccaaaguu

SEQ ID NO: 1935435 - RNA, 12 nt, Homo sapiens
acucaccugccc

SEQ ID NO: 1935436 - RNA, 15 nt, Homo sapiens
auaauuuucugaaag

SEQ ID NO: 1935437 - RNA, 17 nt, Homo sapiens
ccuguggcuaauggagg

SEQ ID NO: 1935438 - RNA, 14 nt, Homo sapiens
uacauguaccugac

SEQ ID NO: 1935439 - RNA, 13 nt, Homo sapiens
aaaagaaacugug

SEQ ID NO: 1935440 - RNA, 18 nt, Homo sapiens
ugaacacaauugauacuu

SEQ ID NO: 1935441 - RNA, 18 nt, Homo sapiens
agggagcuugccacacuc

SEQ ID NO: 1935442 - RNA, 20 nt, Homo sapiens
uuuacacauguaucuaugca

SEQ ID NO: 1935443 - RNA, 14 nt, Homo sapiens
aauauaaccuccca

SEQ ID NO: 1935444 - RNA, 18 nt, Homo sapiens
auuuacuuuuuauuugca

SEQ ID NO: 1935445 - RNA, 20 nt, Homo sapiens
gagugcuuguccccuaagag

SEQ ID NO: 1935446 - RNA, 20 nt, Homo sapiens
ggcucgucagccaccuggga

SEQ ID NO: 1935447 - RNA, 21 nt, Homo sapiens
cucaaaaucugugaccuguca

SEQ ID NO: 1935448 - RNA, 13 nt, Homo sapiens
aauuguaagcaug

SEQ ID NO: 1935449 - RNA, 22 nt, Homo sapiens
agaugaaaagcuaccaucacuu

SEQ ID NO: 1935450 - RNA, 20 nt, Homo sapiens
ugcaucguggagacagggca

SEQ ID NO: 1935451 - RNA, 23 nt, Homo sapiens
cucucugguaccgagccccugaa

SEQ ID NO: 1935452 - RNA, 22 nt, Homo sapiens
cuguuacauccugcuacacuca

SEQ ID NO: 1935453 - RNA, 20 nt, Homo sapiens
agaucaggagugacagauca

SEQ ID NO: 1935454 - RNA, 22 nt, Homo sapiens
auguguguguaugcuacuacaa

SEQ ID NO: 1935455 - RNA, 17 nt, Homo sapiens
uuacugauucauacauu

SEQ ID NO: 1935456 - RNA, 12 nt, Homo sapiens
aaauaugcaucu

SEQ ID NO: 1935457 - RNA, 18 nt, Homo sapiens
uguaucggagacagugau

SEQ ID NO: 1935458 - RNA, 18 nt, Homo sapiens
uuuguaaaacaaugccau

SEQ ID NO: 1935459 - RNA, 15 nt, Homo sapiens
aaagcaggugcccag

SEQ ID NO: 1935460 - RNA, 15 nt, Homo sapiens
ugagggccugcugga

SEQ ID NO: 1935461 - RNA, 21 nt, Homo sapiens
cucuauguagugccgcucuug

SEQ ID NO: 1935462 - RNA, 17 nt, Homo sapiens
uacguccugccuggcac

SEQ ID NO: 1935463 - RNA, 23 nt, Homo sapiens
ugcauuaccacacucagcuaauu

SEQ ID NO: 1935464 - RNA, 15 nt, Homo sapiens
cagucccagcacauu

SEQ ID NO: 1935465 - RNA, 15 nt, Homo sapiens
aaugcauaagcuuuu

SEQ ID NO: 1935466 - RNA, 16 nt, Homo sapiens
agggugggcagccuau

SEQ ID NO: 1935467 - RNA, 13 nt, Homo sapiens
uccuugugguuuu

SEQ ID NO: 1935468 - RNA, 18 nt, Homo sapiens
cuuccaugauacuuuaau

SEQ ID NO: 1935469 - RNA, 13 nt, Homo sapiens
ugaccacagacac

SEQ ID NO: 1935470 - RNA, 22 nt, Homo sapiens
gaccucgaaugcuccuaaaaga

SEQ ID NO: 1935471 - RNA, 14 nt, Homo sapiens
accuugcuuuggac

SEQ ID NO: 1935472 - RNA, 16 nt, Homo sapiens
aggacacaagaacuaa

SEQ ID NO: 1935473 - RNA, 19 nt, Homo sapiens
uacuuaaaaauagucuucc

SEQ ID NO: 1935474 - RNA, 14 nt, Homo sapiens
ugcaaggggcugca

SEQ ID NO: 1935475 - RNA, 15 nt, Homo sapiens
uaugcuacacagaca

SEQ ID NO: 1935476 - RNA, 14 nt, Homo sapiens
uaaagcugugagca

SEQ ID NO: 1935477 - RNA, 17 nt, Homo sapiens
gacugaccaucaugccc

SEQ ID NO: 1935478 - RNA, 15 nt, Homo sapiens
ggugcugccgugccc

SEQ ID NO: 1935479 - RNA, 22 nt, Homo sapiens
aaaccccuccagaacucccacc

SEQ ID NO: 1935480 - RNA, 23 nt, Homo sapiens
uccuucuguggcaacuuguacug

SEQ ID NO: 1935481 - RNA, 22 nt, Homo sapiens
cucucuuuauaagaacccuggu

SEQ ID NO: 1935482 - RNA, 18 nt, Homo sapiens
ccgauucccaacugagug

SEQ ID NO: 1935483 - RNA, 23 nt, Homo sapiens
uugguguuaaaacacuucugucc

SEQ ID NO: 1935484 - RNA, 17 nt, Homo sapiens
cacuggauucauuucau

SEQ ID NO: 1935485 - RNA, 16 nt, Homo sapiens
cuugaaguguuuucau

SEQ ID NO: 1935486 - RNA, 13 nt, Homo sapiens
aauacuuacuucu

SEQ ID NO: 1935487 - RNA, 19 nt, Homo sapiens
acugcaacaacgccuggug

SEQ ID NO: 1935488 - RNA, 21 nt, Homo sapiens
aaguguaugcacgugugcaca

SEQ ID NO: 1935489 - RNA, 15 nt, Homo sapiens
gauuucaggcagcag

SEQ ID NO: 1935490 - RNA, 14 nt, Homo sapiens
ggaaguucaaggaa

SEQ ID NO: 1935491 - RNA, 22 nt, Homo sapiens
acacaggaacucugugugagag

SEQ ID NO: 1935492 - RNA, 20 nt, Homo sapiens
ugcccuuaaacauuggacag

SEQ ID NO: 1935493 - RNA, 12 nt, Homo sapiens
auuuaacuugag

SEQ ID NO: 1935494 - RNA, 21 nt, Homo sapiens
gaguucugggauuucuucuca

SEQ ID NO: 1935495 - RNA, 22 nt, Homo sapiens
uuccaguuuguuuauuacuuau

SEQ ID NO: 1935496 - RNA, 12 nt, Homo sapiens
uccuucuugccu

SEQ ID NO: 1935497 - RNA, 19 nt, Homo sapiens
cauagccaagaucccaucu

SEQ ID NO: 1935498 - RNA, 21 nt, Homo sapiens
ccuuuuuuguuuuuucaaaau

SEQ ID NO: 1935499 - RNA, 12 nt, Homo sapiens
ugcgaugcagcg

SEQ ID NO: 1935500 - RNA, 12 nt, Homo sapiens
uuucaugcauuc

SEQ ID NO: 1935501 - RNA, 23 nt, Homo sapiens
uccugagguggauuuacugagag

SEQ ID NO: 1935502 - RNA, 24 nt, Homo sapiens
uacuuugggacgcccacguggcag

SEQ ID NO: 1935503 - RNA, 13 nt, Homo sapiens
cagggaaugccag

SEQ ID NO: 1935504 - RNA, 19 nt, Homo sapiens
uaauaauguguacauuagu

SEQ ID NO: 1935505 - RNA, 23 nt, Homo sapiens
uuuguaaaacaaugccaugaaca

SEQ ID NO: 1935506 - RNA, 17 nt, Homo sapiens
uaccauuuuucauucac

SEQ ID NO: 1935507 - RNA, 16 nt, Homo sapiens
uaaauugcaucacugu

SEQ ID NO: 1935508 - RNA, 14 nt, Homo sapiens
cuugaguagaucug

SEQ ID NO: 1935509 - RNA, 19 nt, Homo sapiens
caaaaaaugugagcuauaa

SEQ ID NO: 1935510 - RNA, 14 nt, Homo sapiens
ugcuacauacucca

SEQ ID NO: 1935511 - RNA, 14 nt, Homo sapiens
ccagucacugugag

SEQ ID NO: 1935512 - RNA, 21 nt, Homo sapiens
gaggggacuauuuaugaaggc

SEQ ID NO: 1935513 - RNA, 12 nt, Homo sapiens
acucagacuguu

SEQ ID NO: 1935514 - RNA, 22 nt, Homo sapiens
cacuauuaaucuuucuuuugau

SEQ ID NO: 1935515 - RNA, 14 nt, Homo sapiens
agcaacaccaaaaa

SEQ ID NO: 1935516 - RNA, 14 nt, Homo sapiens
agacucaccaccua

SEQ ID NO: 1935517 - RNA, 15 nt, Homo sapiens
ccacagucaguggag

SEQ ID NO: 1935518 - RNA, 20 nt, Homo sapiens
uggggagaggggagugcauu

SEQ ID NO: 1935519 - RNA, 21 nt, Homo sapiens
gaaucccagcccccugaccac

SEQ ID NO: 1935520 - RNA, 17 nt, Homo sapiens
gccauggugauggugua

SEQ ID NO: 1935521 - RNA, 17 nt, Homo sapiens
aggucuggcugcuugcc

SEQ ID NO: 1935522 - RNA, 15 nt, Homo sapiens
cauuguagcucuuug

SEQ ID NO: 1935523 - RNA, 14 nt, Homo sapiens
uuaauguauucccu

SEQ ID NO: 1935524 - RNA, 19 nt, Homo sapiens
caaggcagggcccagcaua

SEQ ID NO: 1935525 - RNA, 19 nt, Homo sapiens
uguugaaucacaguaucag

SEQ ID NO: 1935526 - RNA, 22 nt, Homo sapiens
ugaccuggaaucagugaagcca

SEQ ID NO: 1935527 - RNA, 23 nt, Homo sapiens
cugcauuagagcccauuucaauu

SEQ ID NO: 1935528 - RNA, 19 nt, Homo sapiens
cugacuucacuaggcauug

SEQ ID NO: 1935529 - RNA, 22 nt, Homo sapiens
gucucugacaaagugugucuca

SEQ ID NO: 1935530 - RNA, 21 nt, Homo sapiens
uacuuuuaaaugcaaucucuu

SEQ ID NO: 1935531 - RNA, 22 nt, Homo sapiens
ccuuuuagggaauaauauucaa

SEQ ID NO: 1935532 - RNA, 15 nt, Homo sapiens
cugacaaaaguucca

SEQ ID NO: 1935533 - RNA, 18 nt, Homo sapiens
aaaauaaugcaccacuuu

SEQ ID NO: 1935534 - RNA, 22 nt, Homo sapiens
aagcccagcacuugaauuguua

SEQ ID NO: 1935535 - RNA, 17 nt, Homo sapiens
gugcagaagaauccgag

SEQ ID NO: 1935536 - RNA, 20 nt, Homo sapiens
ugagauuuaccagggaugua

SEQ ID NO: 1935537 - RNA, 18 nt, Homo sapiens
cgcccaacguuugccucc

SEQ ID NO: 1935538 - RNA, 17 nt, Homo sapiens
ucugccuaacuuguaaa

SEQ ID NO: 1935539 - RNA, 14 nt, Homo sapiens
uaaaguaugugcau

SEQ ID NO: 1935540 - RNA, 13 nt, Homo sapiens
agaucacacauca

SEQ ID NO: 1935541 - RNA, 19 nt, Homo sapiens
cagcccugcgccaccucac

SEQ ID NO: 1935542 - RNA, 23 nt, Homo sapiens
ggaggauugcagguggaacucag

SEQ ID NO: 1935543 - RNA, 20 nt, Homo sapiens
caugucaaauugcaaucagg

SEQ ID NO: 1935544 - RNA, 19 nt, Homo sapiens
ccucaguuucccuaucucg

SEQ ID NO: 1935545 - RNA, 12 nt, Homo sapiens
ugguuuuuacug

SEQ ID NO: 1935546 - RNA, 15 nt, Homo sapiens
cuuuggaaguuuuac

SEQ ID NO: 1935547 - RNA, 15 nt, Homo sapiens
ggcaguggcagggga

SEQ ID NO: 1935548 - RNA, 16 nt, Homo sapiens
cuaaauaccucaauca

SEQ ID NO: 1935549 - RNA, 23 nt, Homo sapiens
caaagggaacugaagaccuccac

SEQ ID NO: 1935550 - RNA, 20 nt, Homo sapiens
guacuucuucauccauagac

SEQ ID NO: 1935551 - RNA, 20 nt, Homo sapiens
caugaaguggaaaaaggaga

SEQ ID NO: 1935552 - RNA, 18 nt, Homo sapiens
gcacucuguaaaaugcac

SEQ ID NO: 1935553 - RNA, 23 nt, Homo sapiens
ccugcuucuuuccagaaaccaaa

SEQ ID NO: 1935554 - RNA, 23 nt, Homo sapiens
gaaacuccagaugccacaaugga

SEQ ID NO: 1935555 - RNA, 20 nt, Homo sapiens
ggacuaaguguaccagagaa

SEQ ID NO: 1935556 - RNA, 20 nt, Homo sapiens
ccaaguaugacaaccucuuu

SEQ ID NO: 1935557 - RNA, 20 nt, Homo sapiens
ugcaaacacagcucucucca

SEQ ID NO: 1935558 - RNA, 24 nt, Homo sapiens
aauacuuuugggauguuaccuuca

SEQ ID NO: 1935559 - RNA, 18 nt, Homo sapiens
uaaugucuucuaauaucc

SEQ ID NO: 1935560 - RNA, 18 nt, Homo sapiens
aauugcaaauaaaccacu

SEQ ID NO: 1935561 - RNA, 15 nt, Homo sapiens
ggcgagcacugugag

SEQ ID NO: 1935562 - RNA, 13 nt, Homo sapiens
ucguccugggacu

SEQ ID NO: 1935563 - RNA, 13 nt, Homo sapiens
agaccugagcugg

SEQ ID NO: 1935564 - RNA, 13 nt, Homo sapiens
guuuucuaaagua

SEQ ID NO: 1935565 - RNA, 17 nt, Homo sapiens
aaacagcagcacuuuuu

SEQ ID NO: 1935566 - RNA, 17 nt, Homo sapiens
cuauuauacuguauuaa

SEQ ID NO: 1935567 - RNA, 15 nt, Homo sapiens
ugugcuguucaaguu

SEQ ID NO: 1935568 - RNA, 11 nt, Homo sapiens
auugacaaaug

SEQ ID NO: 1935569 - RNA, 16 nt, Homo sapiens
caagaaacacugccug

SEQ ID NO: 1935570 - RNA, 15 nt, Homo sapiens
guaauacaucaaaga

SEQ ID NO: 1935571 - RNA, 20 nt, Homo sapiens
uaaaagaugguaaaccagau

SEQ ID NO: 1935572 - RNA, 15 nt, Homo sapiens
ggguauugaaugugg

SEQ ID NO: 1935573 - RNA, 21 nt, Homo sapiens
uuccuagaaacugacacaugc

SEQ ID NO: 1935574 - RNA, 23 nt, Homo sapiens
caugcugaaagucuucaugguga

SEQ ID NO: 1935575 - RNA, 16 nt, Homo sapiens
uugcacuauugcacau

SEQ ID NO: 1935576 - RNA, 14 nt, Homo sapiens
ccuuuccagguauu

SEQ ID NO: 1935577 - RNA, 23 nt, Homo sapiens
gaacaguccauaacuuaccucug

SEQ ID NO: 1935578 - RNA, 23 nt, Homo sapiens
uaagcccagcucugcuuuuucca

SEQ ID NO: 1935579 - RNA, 16 nt, Homo sapiens
aaaauaguaaagccaa

SEQ ID NO: 1935580 - RNA, 15 nt, Homo sapiens
uuguguucaaucugu

SEQ ID NO: 1935581 - RNA, 20 nt, Homo sapiens
uuauuucugaucuauacaaa

SEQ ID NO: 1935582 - RNA, 18 nt, Homo sapiens
aacaacagaaacuucuca

SEQ ID NO: 1935583 - RNA, 17 nt, Homo sapiens
uucagguuagugacauu

SEQ ID NO: 1935584 - RNA, 23 nt, Homo sapiens
cuucaucuugagccugagccuua

SEQ ID NO: 1935585 - RNA, 11 nt, Homo sapiens
guuagagccau

SEQ ID NO: 1935586 - RNA, 19 nt, Homo sapiens
auccaugcaccuaccuuag

SEQ ID NO: 1935587 - RNA, 15 nt, Homo sapiens
aaauuagccggucau

SEQ ID NO: 1935588 - RNA, 15 nt, Homo sapiens
uugcaccaacuuuga

SEQ ID NO: 1935589 - RNA, 22 nt, Homo sapiens
auuucacuuaaacuuugucacu

SEQ ID NO: 1935590 - RNA, 13 nt, Homo sapiens
agcaaagacaaaa

SEQ ID NO: 1935591 - RNA, 16 nt, Homo sapiens
agauccuuuuccagaa

SEQ ID NO: 1935592 - RNA, 21 nt, Homo sapiens
gauagcuucaccccaauccca

SEQ ID NO: 1935593 - RNA, 22 nt, Homo sapiens
uugacaugggacauuugcucau

SEQ ID NO: 1935594 - RNA, 12 nt, Homo sapiens
ugaaacuaucuc

SEQ ID NO: 1935595 - RNA, 21 nt, Homo sapiens
gagccaagauugcaccacugc

SEQ ID NO: 1935596 - RNA, 23 nt, Homo sapiens
cgccucccagccccaggggugcc

SEQ ID NO: 1935597 - RNA, 18 nt, Homo sapiens
uuguuaccuuuaugguuu

SEQ ID NO: 1935598 - RNA, 18 nt, Homo sapiens
aacuuugccagucuuuaa

SEQ ID NO: 1935599 - RNA, 14 nt, Homo sapiens
cuccacucuucucu

SEQ ID NO: 1935600 - RNA, 23 nt, Homo sapiens
uuucaggggcgggugcauuguag

SEQ ID NO: 1935601 - RNA, 18 nt, Homo sapiens
cagagcaagacugucuca

SEQ ID NO: 1935602 - RNA, 17 nt, Homo sapiens
uaaauacacugugaaga

SEQ ID NO: 1935603 - RNA, 13 nt, Homo sapiens
acucccacuuuuc

SEQ ID NO: 1935604 - RNA, 15 nt, Homo sapiens
ggaauggagcuguau

SEQ ID NO: 1935605 - RNA, 16 nt, Homo sapiens
uccuugcaucacuggg

SEQ ID NO: 1935606 - RNA, 14 nt, Homo sapiens
uuaaugacucuuuc

SEQ ID NO: 1935607 - RNA, 22 nt, Homo sapiens
ugaacuaccuauaguagucugu

SEQ ID NO: 1935608 - RNA, 18 nt, Homo sapiens
ucugccagcauaauacuu

SEQ ID NO: 1935609 - RNA, 17 nt, Homo sapiens
gagguacaaaaguuacu

SEQ ID NO: 1935610 - RNA, 15 nt, Homo sapiens
uagugaaaugccaca

SEQ ID NO: 1935611 - RNA, 15 nt, Homo sapiens
gagcucuacaggccu

SEQ ID NO: 1935612 - RNA, 12 nt, Homo sapiens
cuagaaauaucu

SEQ ID NO: 1935613 - RNA, 15 nt, Homo sapiens
uuuuauuacacuaaa

SEQ ID NO: 1935614 - RNA, 20 nt, Homo sapiens
gauccauccaucuccaggga

SEQ ID NO: 1935615 - RNA, 16 nt, Homo sapiens
uaaguaaauacaguag

SEQ ID NO: 1935616 - RNA, 16 nt, Homo sapiens
cacaacaggcauucca

SEQ ID NO: 1935617 - RNA, 19 nt, Homo sapiens
guauuaauccccaucauua

SEQ ID NO: 1935618 - RNA, 19 nt, Homo sapiens
accagcagaucccagcuca

SEQ ID NO: 1935619 - RNA, 16 nt, Homo sapiens
cacaaccucaccaaac

SEQ ID NO: 1935620 - RNA, 14 nt, Homo sapiens
gcagccaaccaaga

SEQ ID NO: 1935621 - RNA, 18 nt, Homo sapiens
auucuuuguauaugcauu

SEQ ID NO: 1935622 - RNA, 19 nt, Homo sapiens
cuaccucucagcugcugaa

SEQ ID NO: 1935623 - RNA, 15 nt, Homo sapiens
caguccuuaauguca

SEQ ID NO: 1935624 - RNA, 21 nt, Homo sapiens
cccagacucuaaauauuucau

SEQ ID NO: 1935625 - RNA, 16 nt, Homo sapiens
uuaaugacaaugaagu

SEQ ID NO: 1935626 - RNA, 23 nt, Homo sapiens
gucuuugaacugcagcaaucaca

SEQ ID NO: 1935627 - RNA, 19 nt, Homo sapiens
uuugguuuucaucaugauu

SEQ ID NO: 1935628 - RNA, 18 nt, Homo sapiens
gcagccaaacccaugagg

SEQ ID NO: 1935629 - RNA, 20 nt, Homo sapiens
auagauugugaauaaugauu

SEQ ID NO: 1935630 - RNA, 13 nt, Homo sapiens
acaguugugagau

SEQ ID NO: 1935631 - RNA, 20 nt, Homo sapiens
cuguuucccuucccuuccac

SEQ ID NO: 1935632 - RNA, 21 nt, Homo sapiens
caauauuaaauacagacacua

SEQ ID NO: 1935633 - RNA, 14 nt, Homo sapiens
aacccacccggcug

SEQ ID NO: 1935634 - RNA, 18 nt, Homo sapiens
agccugggggcuccucac

SEQ ID NO: 1935635 - RNA, 22 nt, Homo sapiens
caugagucucacuagcacaugg

SEQ ID NO: 1935636 - RNA, 20 nt, Homo sapiens
cagccaagggcagaucacag

SEQ ID NO: 1935637 - RNA, 13 nt, Homo sapiens
uuaaagaaagugu

SEQ ID NO: 1935638 - RNA, 13 nt, Homo sapiens
acacccuguacug

SEQ ID NO: 1935639 - RNA, 21 nt, Homo sapiens
aaugaauagaggggcauucac

SEQ ID NO: 1935640 - RNA, 19 nt, Homo sapiens
auagugaagcaauuugaaa

SEQ ID NO: 1935641 - RNA, 13 nt, Homo sapiens
agaauuugcuaau

SEQ ID NO: 1935642 - RNA, 19 nt, Homo sapiens
auuucuucacucaaucucu

SEQ ID NO: 1935643 - RNA, 18 nt, Homo sapiens
acaaauuguauggugaua

SEQ ID NO: 1935644 - RNA, 14 nt, Homo sapiens
cccgcccaugcugu

SEQ ID NO: 1935645 - RNA, 22 nt, Homo sapiens
acaagguggucaacaacauucc

SEQ ID NO: 1935646 - RNA, 18 nt, Homo sapiens
uucaggcagccaguguga

SEQ ID NO: 1935647 - RNA, 14 nt, Homo sapiens
acuguguucagugc

SEQ ID NO: 1935648 - RNA, 22 nt, Homo sapiens
uucugggggagacaugcucucc

SEQ ID NO: 1935649 - RNA, 14 nt, Homo sapiens
uugcaaaggguaau

SEQ ID NO: 1935650 - RNA, 17 nt, Homo sapiens
uuggguucacagugcau

SEQ ID NO: 1935651 - RNA, 14 nt, Homo sapiens
caucuuuaacacag

SEQ ID NO: 1935652 - RNA, 19 nt, Homo sapiens
caaauauuggguugggcac

SEQ ID NO: 1935653 - RNA, 22 nt, Homo sapiens
ccuccaucaccugaaacacugg

SEQ ID NO: 1935654 - RNA, 22 nt, Homo sapiens
uaucuuagugguuccccaccga

SEQ ID NO: 1935655 - RNA, 20 nt, Homo sapiens
uauauauuucuuuguuauca

SEQ ID NO: 1935656 - RNA, 22 nt, Homo sapiens
caucccacaugaucuugagauu

SEQ ID NO: 1935657 - RNA, 19 nt, Homo sapiens
cuugcuggaugcugcugua

SEQ ID NO: 1935658 - RNA, 12 nt, Homo sapiens
uggcccaggugc

SEQ ID NO: 1935659 - RNA, 15 nt, Homo sapiens
aaacauucuaugugu

SEQ ID NO: 1935660 - RNA, 24 nt, Homo sapiens
gcauauauuggguuccauucucac

SEQ ID NO: 1935661 - RNA, 13 nt, Homo sapiens
cucuuggaugcag

SEQ ID NO: 1935662 - RNA, 22 nt, Homo sapiens
guccaucuccagacucuaccac

SEQ ID NO: 1935663 - RNA, 18 nt, Homo sapiens
ccuaggauccccccaugc

SEQ ID NO: 1935664 - RNA, 20 nt, Homo sapiens
uuguggaagacaagucugug

SEQ ID NO: 1935665 - RNA, 19 nt, Homo sapiens
uagcaucagaccugcauug

SEQ ID NO: 1935666 - RNA, 15 nt, Homo sapiens
cucugccuuaucuca

SEQ ID NO: 1935667 - RNA, 20 nt, Homo sapiens
ucucuauucuuuccaugaca

SEQ ID NO: 1935668 - RNA, 16 nt, Homo sapiens
gcagaagcccugaugu

SEQ ID NO: 1935669 - RNA, 17 nt, Homo sapiens
uagaggaagaccaaaaa

SEQ ID NO: 1935670 - RNA, 20 nt, Homo sapiens
gagaaucucagcgugggcca

SEQ ID NO: 1935671 - RNA, 17 nt, Homo sapiens
caccuuccucugccuuu

SEQ ID NO: 1935672 - RNA, 15 nt, Homo sapiens
auagauauuuucaca

SEQ ID NO: 1935673 - RNA, 19 nt, Homo sapiens
gaccuggagcagcugacuu

SEQ ID NO: 1935674 - RNA, 22 nt, Homo sapiens
aaccugggagccggaggcugca

SEQ ID NO: 1935675 - RNA, 16 nt, Homo sapiens
aguauaauaauuacug

SEQ ID NO: 1935676 - RNA, 14 nt, Homo sapiens
cacacccauucaca

SEQ ID NO: 1935677 - RNA, 21 nt, Homo sapiens
aaugagcagcccuuacaguau

SEQ ID NO: 1935678 - RNA, 17 nt, Homo sapiens
ucuucucaaagauuuga

SEQ ID NO: 1935679 - RNA, 15 nt, Homo sapiens
aauuuauugaguuuu

SEQ ID NO: 1935680 - RNA, 16 nt, Homo sapiens
gauuacuguuuacuga

SEQ ID NO: 1935681 - RNA, 22 nt, Homo sapiens
acuuauaauuaugcuaccuacu

SEQ ID NO: 1935682 - RNA, 15 nt, Homo sapiens
caggacuuaacauca

SEQ ID NO: 1935683 - RNA, 23 nt, Homo sapiens
acuugcaucguggagacagggca

SEQ ID NO: 1935684 - RNA, 21 nt, Homo sapiens
gcucuagccugggcaacaaca

SEQ ID NO: 1935685 - RNA, 20 nt, Homo sapiens
gacagggucuugcucuguca

SEQ ID NO: 1935686 - RNA, 21 nt, Homo sapiens
uacuagcuuuugaaauccaga

SEQ ID NO: 1935687 - RNA, 17 nt, Homo sapiens
aucugggucaauccaca

SEQ ID NO: 1935688 - RNA, 22 nt, Homo sapiens
acuauagccuaggugacagagu

SEQ ID NO: 1935689 - RNA, 12 nt, Homo sapiens
cuccaucuccag

SEQ ID NO: 1935690 - RNA, 15 nt, Homo sapiens
accuacuuacaugca

SEQ ID NO: 1935691 - RNA, 19 nt, Homo sapiens
agagcuggggagggagagc

SEQ ID NO: 1935692 - RNA, 20 nt, Homo sapiens
uuuauauagcaagugcuauu

SEQ ID NO: 1935693 - RNA, 13 nt, Homo sapiens
ggacaaccuggac

SEQ ID NO: 1935694 - RNA, 15 nt, Homo sapiens
cuuuacuagugccaa

SEQ ID NO: 1935695 - RNA, 12 nt, Homo sapiens
ucauucugugac

SEQ ID NO: 1935696 - RNA, 21 nt, Homo sapiens
uucuaggugcccgaguagcau

SEQ ID NO: 1935697 - RNA, 11 nt, Homo sapiens
ucuugccaaaa

SEQ ID NO: 1935698 - RNA, 11 nt, Homo sapiens
acuugccauaa

SEQ ID NO: 1935699 - RNA, 21 nt, Homo sapiens
ugcccacuuccccuuccccaa

SEQ ID NO: 1935700 - RNA, 12 nt, Homo sapiens
uuuuaacaguuu

SEQ ID NO: 1935701 - RNA, 12 nt, Homo sapiens
gcucaacaucuc

SEQ ID NO: 1935702 - RNA, 20 nt, Homo sapiens
cauauaccauuuuaugaguu

SEQ ID NO: 1935703 - RNA, 14 nt, Homo sapiens
ugguaucacugaac

SEQ ID NO: 1935704 - RNA, 18 nt, Homo sapiens
gagcuugggcaauuuauc

SEQ ID NO: 1935705 - RNA, 16 nt, Homo sapiens
guaaaaccacagcagu

SEQ ID NO: 1935706 - RNA, 21 nt, Homo sapiens
gugaagaucacguuccuuccc

SEQ ID NO: 1935707 - RNA, 22 nt, Homo sapiens
gaacacaaguuccugauaacuu

SEQ ID NO: 1935708 - RNA, 20 nt, Homo sapiens
cuguggagauggacucagga

SEQ ID NO: 1935709 - RNA, 13 nt, Homo sapiens
uucuucuugcuac

SEQ ID NO: 1935710 - RNA, 15 nt, Homo sapiens
cagugggggugccug

SEQ ID NO: 1935711 - RNA, 15 nt, Homo sapiens
aacaugcuuaagggg

SEQ ID NO: 1935712 - RNA, 21 nt, Homo sapiens
ucugucugaauggugcgugaa

SEQ ID NO: 1935713 - RNA, 19 nt, Homo sapiens
cucuugaucagugugcuaa

SEQ ID NO: 1935714 - RNA, 23 nt, Homo sapiens
guuggugcugcuuucuuguugcu

SEQ ID NO: 1935715 - RNA, 20 nt, Homo sapiens
agcugauggggcaaacucaa

SEQ ID NO: 1935716 - RNA, 16 nt, Homo sapiens
uaaauggguagagaaa

SEQ ID NO: 1935717 - RNA, 14 nt, Homo sapiens
auuuagaugagauc

SEQ ID NO: 1935718 - RNA, 23 nt, Homo sapiens
caacagcaucuucccaaaaccau

SEQ ID NO: 1935719 - RNA, 23 nt, Homo sapiens
agaugaagagcuucaugugacac

SEQ ID NO: 1935720 - RNA, 14 nt, Homo sapiens
aguagcuuaucuca

SEQ ID NO: 1935721 - RNA, 20 nt, Homo sapiens
aagugcugagauuacaggca

SEQ ID NO: 1935722 - RNA, 20 nt, Homo sapiens
augugugagauaacuuccuu

SEQ ID NO: 1935723 - RNA, 22 nt, Homo sapiens
cacagccgggugugugucugca

SEQ ID NO: 1935724 - RNA, 15 nt, Homo sapiens
aggcagcugagacca

SEQ ID NO: 1935725 - RNA, 15 nt, Homo sapiens
cuuaauguuuauucc

SEQ ID NO: 1935726 - RNA, 17 nt, Homo sapiens
auggaauaacauaucaa

SEQ ID NO: 1935727 - RNA, 14 nt, Homo sapiens
aucaugaagcacau

SEQ ID NO: 1935728 - RNA, 13 nt, Homo sapiens
cugucucauauga

SEQ ID NO: 1935729 - RNA, 22 nt, Homo sapiens
agaauucugggcaagucaccca

SEQ ID NO: 1935730 - RNA, 16 nt, Homo sapiens
aauauguguacacaua

SEQ ID NO: 1935731 - RNA, 11 nt, Homo sapiens
cauguaaaaua

SEQ ID NO: 1935732 - RNA, 19 nt, Homo sapiens
cuuccagugcaacacugaa

SEQ ID NO: 1935733 - RNA, 22 nt, Homo sapiens
augaaauuggaccugaacuguu

SEQ ID NO: 1935734 - RNA, 16 nt, Homo sapiens
aaacuccugaccucaa

SEQ ID NO: 1935735 - RNA, 16 nt, Homo sapiens
acaaaacugccaaaaa

SEQ ID NO: 1935736 - RNA, 17 nt, Homo sapiens
uuguacugugcaguuuu

SEQ ID NO: 1935737 - RNA, 12 nt, Homo sapiens
ugguucuaagaa

SEQ ID NO: 1935738 - RNA, 20 nt, Homo sapiens
acaaacauggauacuuccug

SEQ ID NO: 1935739 - RNA, 13 nt, Homo sapiens
ccaggcaugcaau

SEQ ID NO: 1935740 - RNA, 16 nt, Homo sapiens
ucugcaacauuugaca

SEQ ID NO: 1935741 - RNA, 17 nt, Homo sapiens
caauaugcaaugugaag

SEQ ID NO: 1935742 - RNA, 13 nt, Homo sapiens
ugucaacaucaaa

SEQ ID NO: 1935743 - RNA, 20 nt, Homo sapiens
uugugcuuuaaaaaugcaau

SEQ ID NO: 1935744 - RNA, 17 nt, Homo sapiens
acuguguguguccuaca

SEQ ID NO: 1935745 - RNA, 12 nt, Homo sapiens
ccaaaguucuaa

SEQ ID NO: 1935746 - RNA, 15 nt, Homo sapiens
gccaggcagauccca

SEQ ID NO: 1935747 - RNA, 11 nt, Homo sapiens
cagauaacaua

SEQ ID NO: 1935748 - RNA, 14 nt, Homo sapiens
cucaggcaccucau

SEQ ID NO: 1935749 - RNA, 15 nt, Homo sapiens
ucagguagaccauau

SEQ ID NO: 1935750 - RNA, 20 nt, Homo sapiens
aaccucagccuggccagaca

SEQ ID NO: 1935751 - RNA, 16 nt, Homo sapiens
uuaacauaguaauucu

SEQ ID NO: 1935752 - RNA, 15 nt, Homo sapiens
acgcaccaaucagca

SEQ ID NO: 1935753 - RNA, 18 nt, Homo sapiens
gaagauucuccugugcua

SEQ ID NO: 1935754 - RNA, 20 nt, Homo sapiens
gaugcugcaguuccaaaaga

SEQ ID NO: 1935755 - RNA, 22 nt, Homo sapiens
uauguuguguuuuuuuucauua

SEQ ID NO: 1935756 - RNA, 23 nt, Homo sapiens
gauugaaaaaaagggcacucuga

SEQ ID NO: 1935757 - RNA, 20 nt, Homo sapiens
caucaagaauggggaucaca

SEQ ID NO: 1935758 - RNA, 13 nt, Homo sapiens
aagaaaaauggau

SEQ ID NO: 1935759 - RNA, 15 nt, Homo sapiens
ucuuugcaacaauaa

SEQ ID NO: 1935760 - RNA, 15 nt, Homo sapiens
uggccucugugccau

SEQ ID NO: 1935761 - RNA, 13 nt, Homo sapiens
aacauguaugugc

SEQ ID NO: 1935762 - RNA, 17 nt, Homo sapiens
cucagagaucuugcauu

SEQ ID NO: 1935763 - RNA, 12 nt, Homo sapiens
uuaaagucagaa

SEQ ID NO: 1935764 - RNA, 22 nt, Homo sapiens
ucacaugcguaaacgacacucu

SEQ ID NO: 1935765 - RNA, 14 nt, Homo sapiens
cagacucgggacca

SEQ ID NO: 1935766 - RNA, 16 nt, Homo sapiens
acucuuguacaaaaga

SEQ ID NO: 1935767 - RNA, 13 nt, Homo sapiens
aaaauuagugagu

SEQ ID NO: 1935768 - RNA, 17 nt, Homo sapiens
acuccugugucugugua

SEQ ID NO: 1935769 - RNA, 14 nt, Homo sapiens
auacacaagcaaug

SEQ ID NO: 1935770 - RNA, 22 nt, Homo sapiens
gaggauugagauaacauuucca

SEQ ID NO: 1935771 - RNA, 20 nt, Homo sapiens
caggcuuucaagaagugcca

SEQ ID NO: 1935772 - RNA, 17 nt, Homo sapiens
gucuuggaacuugccug

SEQ ID NO: 1935773 - RNA, 15 nt, Homo sapiens
ggggaugucucucau

SEQ ID NO: 1935774 - RNA, 14 nt, Homo sapiens
uuuguaccagugaa

SEQ ID NO: 1935775 - RNA, 17 nt, Homo sapiens
uuagaucucauaaugcu

SEQ ID NO: 1935776 - RNA, 22 nt, Homo sapiens
agauuuuaacuaauaaugcugg

SEQ ID NO: 1935777 - RNA, 13 nt, Homo sapiens
auugacugucacg

SEQ ID NO: 1935778 - RNA, 16 nt, Homo sapiens
cuucucccuucuuggg

SEQ ID NO: 1935779 - RNA, 15 nt, Homo sapiens
gccuaauaguaacug

SEQ ID NO: 1935780 - RNA, 20 nt, Homo sapiens
uaaauuauaaguaacuuguc

SEQ ID NO: 1935781 - RNA, 15 nt, Homo sapiens
auaacugacaaacca

SEQ ID NO: 1935782 - RNA, 15 nt, Homo sapiens
auuuaugacauuaca

SEQ ID NO: 1935783 - RNA, 19 nt, Homo sapiens
auaaguucuaguugcuugu

SEQ ID NO: 1935784 - RNA, 17 nt, Homo sapiens
cuugaaaagauugcaaa

SEQ ID NO: 1935785 - RNA, 18 nt, Homo sapiens
accccuuagccucccuga

SEQ ID NO: 1935786 - RNA, 18 nt, Homo sapiens
auauacuugacucuaaua

SEQ ID NO: 1935787 - RNA, 14 nt, Homo sapiens
agaaggcagugucc

SEQ ID NO: 1935788 - RNA, 16 nt, Homo sapiens
cauaguacuggcacaa

SEQ ID NO: 1935789 - RNA, 11 nt, Homo sapiens
caaauucuccu

SEQ ID NO: 1935790 - RNA, 11 nt, Homo sapiens
ccuauucucaa

SEQ ID NO: 1935791 - RNA, 21 nt, Homo sapiens
ccuugaccucagugaaagcag

SEQ ID NO: 1935792 - RNA, 15 nt, Homo sapiens
uaaucguaagccaug

SEQ ID NO: 1935793 - RNA, 21 nt, Homo sapiens
ucugagaggggagaguccagu

SEQ ID NO: 1935794 - RNA, 17 nt, Homo sapiens
uuuaaaaaucugccacc

SEQ ID NO: 1935795 - RNA, 9 nt, Homo sapiens
caaagccuc

SEQ ID NO: 1935796 - RNA, 22 nt, Homo sapiens
ugaggcuuuaaaacuuauccuc

SEQ ID NO: 1935797 - RNA, 16 nt, Homo sapiens
cugcucaagaagacau

SEQ ID NO: 1935798 - RNA, 12 nt, Homo sapiens
acauuccaugac

SEQ ID NO: 1935799 - RNA, 16 nt, Homo sapiens
gaaauuguacuuccag

SEQ ID NO: 1935800 - RNA, 18 nt, Homo sapiens
cuccaggcccgucugucc

SEQ ID NO: 1935801 - RNA, 16 nt, Homo sapiens
uccacccuuuggagac

SEQ ID NO: 1935802 - RNA, 17 nt, Homo sapiens
cuaaaaaauggugggag

SEQ ID NO: 1935803 - RNA, 20 nt, Homo sapiens
uuucaaaacaagauguguca

SEQ ID NO: 1935804 - RNA, 18 nt, Homo sapiens
uucagcugcuuugacaaa

SEQ ID NO: 1935805 - RNA, 18 nt, Homo sapiens
auaauucaaagcaccaaa

SEQ ID NO: 1935806 - RNA, 20 nt, Homo sapiens
aagcagcuggugcuccaagc

SEQ ID NO: 1935807 - RNA, 21 nt, Homo sapiens
acugccaucuuggacuuguca

SEQ ID NO: 1935808 - RNA, 14 nt, Homo sapiens
uagccagacacucu

SEQ ID NO: 1935809 - RNA, 14 nt, Homo sapiens
ugguuagacgccuu

SEQ ID NO: 1935810 - RNA, 21 nt, Homo sapiens
cuggcacuuaguagguccuca

SEQ ID NO: 1935811 - RNA, 23 nt, Homo sapiens
ugguuaagggacuugucccaagu

SEQ ID NO: 1935812 - RNA, 20 nt, Homo sapiens
gaagaaauuuaugaagcaga

SEQ ID NO: 1935813 - RNA, 14 nt, Homo sapiens
acguuggugcaagu

SEQ ID NO: 1935814 - RNA, 18 nt, Homo sapiens
ugaaguguauaugauucu

SEQ ID NO: 1935815 - RNA, 12 nt, Homo sapiens
cacuugccccag

SEQ ID NO: 1935816 - RNA, 16 nt, Homo sapiens
uagacuuccuguaggg

SEQ ID NO: 1935817 - RNA, 17 nt, Homo sapiens
caacauucccccaacau

SEQ ID NO: 1935818 - RNA, 15 nt, Homo sapiens
accuuaaaugaaaaa

SEQ ID NO: 1935819 - RNA, 12 nt, Homo sapiens
guguggcccaag

SEQ ID NO: 1935820 - RNA, 15 nt, Homo sapiens
uucauauaaauggaa

SEQ ID NO: 1935821 - RNA, 22 nt, Homo sapiens
cucagcuggaugauggucuuca

SEQ ID NO: 1935822 - RNA, 12 nt, Homo sapiens
gccucaagaaca

SEQ ID NO: 1935823 - RNA, 18 nt, Homo sapiens
accuugggggaagacuuu

SEQ ID NO: 1935824 - RNA, 18 nt, Homo sapiens
caaacaaccuucagcuuu

SEQ ID NO: 1935825 - RNA, 16 nt, Homo sapiens
cuccaaggagcauguc

SEQ ID NO: 1935826 - RNA, 14 nt, Homo sapiens
cuccugcugcucac

SEQ ID NO: 1935827 - RNA, 19 nt, Homo sapiens
cagauuccuggcagagcca

SEQ ID NO: 1935828 - RNA, 24 nt, Homo sapiens
gaacuuuaagcaacaagaccacca

SEQ ID NO: 1935829 - RNA, 23 nt, Homo sapiens
cauucugccgcccccuccugaac

SEQ ID NO: 1935830 - RNA, 21 nt, Homo sapiens
ccccucccaucauuacccuuc

SEQ ID NO: 1935831 - RNA, 20 nt, Homo sapiens
ucuuugcccaguucauccca

SEQ ID NO: 1935832 - RNA, 16 nt, Homo sapiens
acaaaaaugaacugaa

SEQ ID NO: 1935833 - RNA, 18 nt, Homo sapiens
auuggagugcagcuaaca

SEQ ID NO: 1935834 - RNA, 18 nt, Homo sapiens
caccaaggcccagaggaa

SEQ ID NO: 1935835 - RNA, 19 nt, Homo sapiens
cugggauucccaccaaggu

SEQ ID NO: 1935836 - RNA, 19 nt, Homo sapiens
gcacuuuagaucacuugag

SEQ ID NO: 1935837 - RNA, 23 nt, Homo sapiens
uaaggcauguggccuuuaucuca

SEQ ID NO: 1935838 - RNA, 19 nt, Homo sapiens
aaccacaggcagcauuuag

SEQ ID NO: 1935839 - RNA, 17 nt, Homo sapiens
ucggaauucccugaguc

SEQ ID NO: 1935840 - RNA, 14 nt, Homo sapiens
guccccuaccccca

SEQ ID NO: 1935841 - RNA, 20 nt, Homo sapiens
uacaguagaauaugaucaaa

SEQ ID NO: 1935842 - RNA, 23 nt, Homo sapiens
cucuguagcuagcaauagguuug

SEQ ID NO: 1935843 - RNA, 18 nt, Homo sapiens
gauaucugcagggacaga

SEQ ID NO: 1935844 - RNA, 19 nt, Homo sapiens
ugcuuccacuucuaugcaa

SEQ ID NO: 1935845 - RNA, 17 nt, Homo sapiens
aggcaaaguuuacagau

SEQ ID NO: 1935846 - RNA, 22 nt, Homo sapiens
ccuacuuagacccagucauucu

SEQ ID NO: 1935847 - RNA, 21 nt, Homo sapiens
gugaucuauucauuguuucaa

SEQ ID NO: 1935848 - RNA, 17 nt, Homo sapiens
ugaaucuguacauguuc

SEQ ID NO: 1935849 - RNA, 19 nt, Homo sapiens
acacugacaaagucauccc

SEQ ID NO: 1935850 - RNA, 18 nt, Homo sapiens
uggcuuuagcuaccucac

SEQ ID NO: 1935851 - RNA, 15 nt, Homo sapiens
gucugccuucugcug

SEQ ID NO: 1935852 - RNA, 15 nt, Homo sapiens
uuuugauaauggcuu

SEQ ID NO: 1935853 - RNA, 15 nt, Homo sapiens
gaaaaugugacccag

SEQ ID NO: 1935854 - RNA, 15 nt, Homo sapiens
acauaauacccagga

SEQ ID NO: 1935855 - RNA, 17 nt, Homo sapiens
uccacuugaagcacuua

SEQ ID NO: 1935856 - RNA, 18 nt, Homo sapiens
agaagaauuggccaucuu

SEQ ID NO: 1935857 - RNA, 23 nt, Homo sapiens
gcaauuuuaguguauuaaucaua

SEQ ID NO: 1935858 - RNA, 20 nt, Homo sapiens
auggaauuuuucauugauau

SEQ ID NO: 1935859 - RNA, 17 nt, Homo sapiens
ucaggagagugugcaac

SEQ ID NO: 1935860 - RNA, 13 nt, Homo sapiens
aaaacaugacuuu

SEQ ID NO: 1935861 - RNA, 22 nt, Homo sapiens
acuuguuuuucccaucucuucc

SEQ ID NO: 1935862 - RNA, 22 nt, Homo sapiens
uugcuacagaggaaacaauauu

SEQ ID NO: 1935863 - RNA, 19 nt, Homo sapiens
agcuaccugcucagcccug

SEQ ID NO: 1935864 - RNA, 13 nt, Homo sapiens
ucagaaacagcuu

SEQ ID NO: 1935865 - RNA, 13 nt, Homo sapiens
guacuaaugugaa

SEQ ID NO: 1935866 - RNA, 22 nt, Homo sapiens
uuauagaauaaaagcuguggaa

SEQ ID NO: 1935867 - RNA, 18 nt, Homo sapiens
ucuccaaguaaagccacg

SEQ ID NO: 1935868 - RNA, 20 nt, Homo sapiens
cuuccagcucagaacccauc

SEQ ID NO: 1935869 - RNA, 14 nt, Homo sapiens
acugguuagauuca

SEQ ID NO: 1935870 - RNA, 18 nt, Homo sapiens
gaauuggaaaggaaaaga

SEQ ID NO: 1935871 - RNA, 20 nt, Homo sapiens
caagaagugggagugggaga

SEQ ID NO: 1935872 - RNA, 22 nt, Homo sapiens
ugcccucccauguugcaugccu

SEQ ID NO: 1935873 - RNA, 15 nt, Homo sapiens
caaagaauauuccau

SEQ ID NO: 1935874 - RNA, 13 nt, Homo sapiens
uccucuauugaug

SEQ ID NO: 1935875 - RNA, 22 nt, Homo sapiens
uaggaacuacugaggaucagag

SEQ ID NO: 1935876 - RNA, 19 nt, Homo sapiens
gucauugauagaacuacuu

SEQ ID NO: 1935877 - RNA, 18 nt, Homo sapiens
cccugugcgucucagugu

SEQ ID NO: 1935878 - RNA, 12 nt, Homo sapiens
gugugcacagaa

SEQ ID NO: 1935879 - RNA, 15 nt, Homo sapiens
ucagccuuagcucuc

SEQ ID NO: 1935880 - RNA, 17 nt, Homo sapiens
ccauggcuggaugugca

SEQ ID NO: 1935881 - RNA, 16 nt, Homo sapiens
acguguagauaauuaa

SEQ ID NO: 1935882 - RNA, 16 nt, Homo sapiens
uauauaauucuguaca

SEQ ID NO: 1935883 - RNA, 16 nt, Homo sapiens
cagcagccucacugca

SEQ ID NO: 1935884 - RNA, 15 nt, Homo sapiens
uacuuuccaaucuca

SEQ ID NO: 1935885 - RNA, 14 nt, Homo sapiens
ccuucaaaacacuc

SEQ ID NO: 1935886 - RNA, 13 nt, Homo sapiens
cuccuaaccuaga

SEQ ID NO: 1935887 - RNA, 22 nt, Homo sapiens
agcauggguuagugcuauggug

SEQ ID NO: 1935888 - RNA, 19 nt, Homo sapiens
guuuaaaauaaaacucuca

SEQ ID NO: 1935889 - RNA, 19 nt, Homo sapiens
gaggaaucuaaacaaacag

SEQ ID NO: 1935890 - RNA, 23 nt, Homo sapiens
ugucuucaaggcuucagucucau

SEQ ID NO: 1935891 - RNA, 17 nt, Homo sapiens
acugacaaccucaucca

SEQ ID NO: 1935892 - RNA, 15 nt, Homo sapiens
cugucucaagcucuu

SEQ ID NO: 1935893 - RNA, 19 nt, Homo sapiens
aauucuggcaggaccucac

SEQ ID NO: 1935894 - RNA, 17 nt, Homo sapiens
uucuuccccauggaaca

SEQ ID NO: 1935895 - RNA, 15 nt, Homo sapiens
uggcucacacugaga

SEQ ID NO: 1935896 - RNA, 23 nt, Homo sapiens
aaagucugaguaagaaacuucau

SEQ ID NO: 1935897 - RNA, 22 nt, Homo sapiens
agcccuuauuuguggggugaga

SEQ ID NO: 1935898 - RNA, 22 nt, Homo sapiens
gucuggauaacuuccacagggu

SEQ ID NO: 1935899 - RNA, 15 nt, Homo sapiens
uccaccucagugcac

SEQ ID NO: 1935900 - RNA, 13 nt, Homo sapiens
uccagacacuuaa

SEQ ID NO: 1935901 - RNA, 15 nt, Homo sapiens
auauauacauucuau

SEQ ID NO: 1935902 - RNA, 23 nt, Homo sapiens
ccuucaaugcaaaauacaugaug

SEQ ID NO: 1935903 - RNA, 14 nt, Homo sapiens
ugccugccacugug

SEQ ID NO: 1935904 - RNA, 21 nt, Homo sapiens
cagacuacuucuuccccagau

SEQ ID NO: 1935905 - RNA, 18 nt, Homo sapiens
ccugcugaacacaguguc

SEQ ID NO: 1935906 - RNA, 18 nt, Homo sapiens
ggaucccaggccagggaa

SEQ ID NO: 1935907 - RNA, 14 nt, Homo sapiens
ggccaugcaagugg

SEQ ID NO: 1935908 - RNA, 22 nt, Homo sapiens
ucaaauuugccaugacauuuca

SEQ ID NO: 1935909 - RNA, 18 nt, Homo sapiens
gguauauaaauuuuccca

SEQ ID NO: 1935910 - RNA, 23 nt, Homo sapiens
aagcgcuauuucaggcacaucau

SEQ ID NO: 1935911 - RNA, 21 nt, Homo sapiens
acugcuguuuuuaugauucag

SEQ ID NO: 1935912 - RNA, 21 nt, Homo sapiens
auucaggcaugcgaaugagcu

SEQ ID NO: 1935913 - RNA, 20 nt, Homo sapiens
acgcucccccgcagucccca

SEQ ID NO: 1935914 - RNA, 14 nt, Homo sapiens
agaaauauaugcag

SEQ ID NO: 1935915 - RNA, 14 nt, Homo sapiens
aggaagauauacau

SEQ ID NO: 1935916 - RNA, 18 nt, Homo sapiens
gaucuugaauagucucau

SEQ ID NO: 1935917 - RNA, 23 nt, Homo sapiens
gacccagucagaguugugcacau

SEQ ID NO: 1935918 - RNA, 22 nt, Homo sapiens
gaaggugcaguugaauucagug

SEQ ID NO: 1935919 - RNA, 12 nt, Homo sapiens
ucuuucagagag

SEQ ID NO: 1935920 - RNA, 19 nt, Homo sapiens
ccuggaaucuacaagccaa

SEQ ID NO: 1935921 - RNA, 23 nt, Homo sapiens
acaagaaucuagaaaaucagauc

SEQ ID NO: 1935922 - RNA, 15 nt, Homo sapiens
aaauaaauacauucu

SEQ ID NO: 1935923 - RNA, 23 nt, Homo sapiens
caggccaccccgcugauggagcc

SEQ ID NO: 1935924 - RNA, 22 nt, Homo sapiens
cugcagcagucgcccaagcaga

SEQ ID NO: 1935925 - RNA, 23 nt, Homo sapiens
ggccaggugguugucuuauugca

SEQ ID NO: 1935926 - RNA, 14 nt, Homo sapiens
cucugcuuccagca

SEQ ID NO: 1935927 - RNA, 20 nt, Homo sapiens
caaaggcugacauucacuga

SEQ ID NO: 1935928 - RNA, 14 nt, Homo sapiens
gaucugcacugggu

SEQ ID NO: 1935929 - RNA, 17 nt, Homo sapiens
gugguuuuugagccaug

SEQ ID NO: 1935930 - RNA, 20 nt, Homo sapiens
aaagaugcagccgccuuccu

SEQ ID NO: 1935931 - RNA, 15 nt, Homo sapiens
uuaaaugucaguuac

SEQ ID NO: 1935932 - RNA, 16 nt, Homo sapiens
aagacagucuuugggu

SEQ ID NO: 1935933 - RNA, 22 nt, Homo sapiens
uaaggcaggagaauggcgugaa

SEQ ID NO: 1935934 - RNA, 21 nt, Homo sapiens
auccauuuggacaaaauggaa

SEQ ID NO: 1935935 - RNA, 18 nt, Homo sapiens
caacugcaggaaaacccu

SEQ ID NO: 1935936 - RNA, 16 nt, Homo sapiens
ggauuaccaguagaug

SEQ ID NO: 1935937 - RNA, 21 nt, Homo sapiens
cuccccauacuuccugggaug

SEQ ID NO: 1935938 - RNA, 22 nt, Homo sapiens
ucccacuuggccaagcagggag

SEQ ID NO: 1935939 - RNA, 15 nt, Homo sapiens
gguuuaccaguuuau

SEQ ID NO: 1935940 - RNA, 13 nt, Homo sapiens
aagaugcacugaa

SEQ ID NO: 1935941 - RNA, 17 nt, Homo sapiens
cagggugguggcacauu

SEQ ID NO: 1935942 - RNA, 12 nt, Homo sapiens
auuuauucucag

SEQ ID NO: 1935943 - RNA, 23 nt, Homo sapiens
cuagcagauacauggcaacgugu

SEQ ID NO: 1935944 - RNA, 19 nt, Homo sapiens
agcaggcguucagcucacu

SEQ ID NO: 1935945 - RNA, 21 nt, Homo sapiens
agacucuguccuuccaugcaa

SEQ ID NO: 1935946 - RNA, 20 nt, Homo sapiens
aacagcuaacaauaaagugu

SEQ ID NO: 1935947 - RNA, 18 nt, Homo sapiens
ucacucccuaaagcccuc

SEQ ID NO: 1935948 - RNA, 20 nt, Homo sapiens
uaucacucaauuucucugag

SEQ ID NO: 1935949 - RNA, 16 nt, Homo sapiens
uccucaauuccaggga

SEQ ID NO: 1935950 - RNA, 21 nt, Homo sapiens
gcauagggucuggaacaccag

SEQ ID NO: 1935951 - RNA, 19 nt, Homo sapiens
acucuggcugcucccugac

SEQ ID NO: 1935952 - RNA, 21 nt, Homo sapiens
uggcagcccuauuucaguuua

SEQ ID NO: 1935953 - RNA, 13 nt, Homo sapiens
uuguuucuuucug

SEQ ID NO: 1935954 - RNA, 17 nt, Homo sapiens
acaguuuuagaauacau

SEQ ID NO: 1935955 - RNA, 19 nt, Homo sapiens
gcagauaucugcauguguc

SEQ ID NO: 1935956 - RNA, 19 nt, Homo sapiens
uguauucaugaacuuggcu

SEQ ID NO: 1935957 - RNA, 20 nt, Homo sapiens
aagcugacauugacccagac

SEQ ID NO: 1935958 - RNA, 16 nt, Homo sapiens
auuuuaaauacaaaag

SEQ ID NO: 1935959 - RNA, 21 nt, Homo sapiens
ggggcccugccugguggcaag

SEQ ID NO: 1935960 - RNA, 15 nt, Homo sapiens
cugaguggaugacaa

SEQ ID NO: 1935961 - RNA, 19 nt, Homo sapiens
acuuucccccacacccaga

SEQ ID NO: 1935962 - RNA, 16 nt, Homo sapiens
agccacugguuucuca

SEQ ID NO: 1935963 - RNA, 23 nt, Homo sapiens
uuauucuuccaacacauuucacu

SEQ ID NO: 1935964 - RNA, 14 nt, Homo sapiens
cacuuguauaaaug

SEQ ID NO: 1935965 - RNA, 23 nt, Homo sapiens
agcugcuuccuccccuccuggca

SEQ ID NO: 1935966 - RNA, 19 nt, Homo sapiens
caggccgagaugugcaaca

SEQ ID NO: 1935967 - RNA, 13 nt, Homo sapiens
cucauaacuagag

SEQ ID NO: 1935968 - RNA, 12 nt, Homo sapiens
aauaaaacauca

SEQ ID NO: 1935969 - RNA, 10 nt, Homo sapiens
ggcagccacc

SEQ ID NO: 1935970 - RNA, 16 nt, Homo sapiens
ccagaggcuggaccac

SEQ ID NO: 1935971 - RNA, 23 nt, Homo sapiens
uagcaauugacagagaauaacuc

SEQ ID NO: 1935972 - RNA, 21 nt, Homo sapiens
gcauuaauggacuccacugaa

SEQ ID NO: 1935973 - RNA, 21 nt, Homo sapiens
ucaaguuaugauucagugcau

SEQ ID NO: 1935974 - RNA, 16 nt, Homo sapiens
uaucuuucgugauaaa

SEQ ID NO: 1935975 - RNA, 18 nt, Homo sapiens
ugcgacugcgaacacuga

SEQ ID NO: 1935976 - RNA, 20 nt, Homo sapiens
caagucauggacauucaugc

SEQ ID NO: 1935977 - RNA, 23 nt, Homo sapiens
uaucucaaacuacuggcaauuug

SEQ ID NO: 1935978 - RNA, 23 nt, Homo sapiens
gcaguucugaguguuuaauuuca

SEQ ID NO: 1935979 - RNA, 12 nt, Homo sapiens
uacacaguacuu

SEQ ID NO: 1935980 - RNA, 17 nt, Homo sapiens
auccuagacugcuccug

SEQ ID NO: 1935981 - RNA, 20 nt, Homo sapiens
caccccagggacagggcccu

SEQ ID NO: 1935982 - RNA, 13 nt, Homo sapiens
gagcucugaccca

SEQ ID NO: 1935983 - RNA, 15 nt, Homo sapiens
ggagugcagugccac

SEQ ID NO: 1935984 - RNA, 12 nt, Homo sapiens
ggacaagcccug

SEQ ID NO: 1935985 - RNA, 12 nt, Homo sapiens
aauaaaugauua

SEQ ID NO: 1935986 - RNA, 20 nt, Homo sapiens
ucccaacucacugugcuccu

SEQ ID NO: 1935987 - RNA, 20 nt, Homo sapiens
cauuucuucuacucuugaga

SEQ ID NO: 1935988 - RNA, 14 nt, Homo sapiens
auauuaauauguac

SEQ ID NO: 1935989 - RNA, 19 nt, Homo sapiens
cuauguugcccaggcaggu

SEQ ID NO: 1935990 - RNA, 19 nt, Homo sapiens
uaucauuuauuuacaucua

SEQ ID NO: 1935991 - RNA, 17 nt, Homo sapiens
agcuggacccugaccag

SEQ ID NO: 1935992 - RNA, 22 nt, Homo sapiens
ugucaaaugugucucacaucua

SEQ ID NO: 1935993 - RNA, 19 nt, Homo sapiens
uaagauauuaacugagaag

SEQ ID NO: 1935994 - RNA, 23 nt, Homo sapiens
ucccaccucuucucuuccuguaa

SEQ ID NO: 1935995 - RNA, 18 nt, Homo sapiens
gugaguaagagcuggugu

SEQ ID NO: 1935996 - RNA, 15 nt, Homo sapiens
auuucuuuguuauca

SEQ ID NO: 1935997 - RNA, 20 nt, Homo sapiens
uccaggauuuauaaagcaaa

SEQ ID NO: 1935998 - RNA, 21 nt, Homo sapiens
gcaugucuccucaacccacau

SEQ ID NO: 1935999 - RNA, 15 nt, Homo sapiens
cauguuacugccaaa

SEQ ID NO: 1936000 - RNA, 21 nt, Homo sapiens
caaaucuaguuuccuauggaa

SEQ ID NO: 1936001 - RNA, 19 nt, Homo sapiens
gaucuggcccuugcuuacc

SEQ ID NO: 1936002 - RNA, 18 nt, Homo sapiens
accagccauacuuaucuc

SEQ ID NO: 1936003 - RNA, 18 nt, Homo sapiens
cuuuuauugacacagaaa

SEQ ID NO: 1936004 - RNA, 17 nt, Homo sapiens
auggggucccugcugca

SEQ ID NO: 1936005 - RNA, 14 nt, Homo sapiens
ugaccucagcugca

SEQ ID NO: 1936006 - RNA, 17 nt, Homo sapiens
cgcacccucccuagcuc

SEQ ID NO: 1936007 - RNA, 19 nt, Homo sapiens
gcccagugcauaugcaaug

SEQ ID NO: 1936008 - RNA, 16 nt, Homo sapiens
cacugugagcaccuga

SEQ ID NO: 1936009 - RNA, 20 nt, Homo sapiens
gagagggggcucuccaaagg

SEQ ID NO: 1936010 - RNA, 19 nt, Homo sapiens
gcagguggugggacacugg

SEQ ID NO: 1936011 - RNA, 15 nt, Homo sapiens
cuuacaugcauuacu

SEQ ID NO: 1936012 - RNA, 18 nt, Homo sapiens
cacuguucuuguauugua

SEQ ID NO: 1936013 - RNA, 23 nt, Homo sapiens
gagcuggcccagggggccuggag

SEQ ID NO: 1936014 - RNA, 15 nt, Homo sapiens
uccuggcugagagag

SEQ ID NO: 1936015 - RNA, 17 nt, Homo sapiens
aucucaacaaaucucag

SEQ ID NO: 1936016 - RNA, 17 nt, Homo sapiens
guaguggcauccauuuc

SEQ ID NO: 1936017 - RNA, 17 nt, Homo sapiens
gggaggcugauuucuca

SEQ ID NO: 1936018 - RNA, 14 nt, Homo sapiens
accaccgacucuca

SEQ ID NO: 1936019 - RNA, 21 nt, Homo sapiens
ccucauauacuugaauauuau

SEQ ID NO: 1936020 - RNA, 13 nt, Homo sapiens
acaagagcuccuu

SEQ ID NO: 1936021 - RNA, 20 nt, Homo sapiens
caaugcuucuguugaucuca

SEQ ID NO: 1936022 - RNA, 16 nt, Homo sapiens
gccucagaauaaaaga

SEQ ID NO: 1936023 - RNA, 15 nt, Homo sapiens
ugggaacacaaugcc

SEQ ID NO: 1936024 - RNA, 18 nt, Homo sapiens
ucuaccuuuucuggcaaa

SEQ ID NO: 1936025 - RNA, 21 nt, Homo sapiens
cccauagacuuauaagucuaa

SEQ ID NO: 1936026 - RNA, 16 nt, Homo sapiens
gaaccgugauaagccu

SEQ ID NO: 1936027 - RNA, 16 nt, Homo sapiens
uagucuuagguuucca

SEQ ID NO: 1936028 - RNA, 20 nt, Homo sapiens
ugaacauuuaguacccugca

SEQ ID NO: 1936029 - RNA, 22 nt, Homo sapiens
agguacuucaggggcacuucau

SEQ ID NO: 1936030 - RNA, 20 nt, Homo sapiens
aaaccaucuaugugaauauu

SEQ ID NO: 1936031 - RNA, 20 nt, Homo sapiens
uauucaaauuugugucauac

SEQ ID NO: 1936032 - RNA, 15 nt, Homo sapiens
ccgugcuaacugugu

SEQ ID NO: 1936033 - RNA, 15 nt, Homo sapiens
augugacuugcaaua

SEQ ID NO: 1936034 - RNA, 20 nt, Homo sapiens
ggacacuugcucaugcccug

SEQ ID NO: 1936035 - RNA, 19 nt, Homo sapiens
uaucugcaugugucaugaa

SEQ ID NO: 1936036 - RNA, 18 nt, Homo sapiens
aaucccagugacuuagga

SEQ ID NO: 1936037 - RNA, 14 nt, Homo sapiens
acugggcucaagag

SEQ ID NO: 1936038 - RNA, 22 nt, Homo sapiens
uuugcccugcccucucccaaaa

SEQ ID NO: 1936039 - RNA, 16 nt, Homo sapiens
gcucuaacaugcaaua

SEQ ID NO: 1936040 - RNA, 18 nt, Homo sapiens
aaguagggacuucugucu

SEQ ID NO: 1936041 - RNA, 14 nt, Homo sapiens
ugguuucagcacua

SEQ ID NO: 1936042 - RNA, 14 nt, Homo sapiens
cuccagacaccagu

SEQ ID NO: 1936043 - RNA, 18 nt, Homo sapiens
cacauauggacucugcac

SEQ ID NO: 1936044 - RNA, 16 nt, Homo sapiens
gaggugaacaagcaaa

SEQ ID NO: 1936045 - RNA, 11 nt, Homo sapiens
cucugcuccuc

SEQ ID NO: 1936046 - RNA, 22 nt, Homo sapiens
cucaguuuccucaccagaaaaa

SEQ ID NO: 1936047 - RNA, 13 nt, Homo sapiens
cauugaaguauua

SEQ ID NO: 1936048 - RNA, 15 nt, Homo sapiens
ggcccagccacugca

SEQ ID NO: 1936049 - RNA, 15 nt, Homo sapiens
cucucucacaaauca

SEQ ID NO: 1936050 - RNA, 17 nt, Homo sapiens
gcuggcagaaagggaac

SEQ ID NO: 1936051 - RNA, 17 nt, Homo sapiens
ccuugcaagaauggaga

SEQ ID NO: 1936052 - RNA, 19 nt, Homo sapiens
accugggaaagccaugacc

SEQ ID NO: 1936053 - RNA, 22 nt, Homo sapiens
gcuaugucaggcuuucaucuaa

SEQ ID NO: 1936054 - RNA, 16 nt, Homo sapiens
cuguauauacaauaac

SEQ ID NO: 1936055 - RNA, 15 nt, Homo sapiens
ugcaguuguucuuua

SEQ ID NO: 1936056 - RNA, 22 nt, Homo sapiens
acugccuggguuccaauccugg

SEQ ID NO: 1936057 - RNA, 23 nt, Homo sapiens
aacaaagugagacccccaucucu

SEQ ID NO: 1936058 - RNA, 18 nt, Homo sapiens
uaugcuauugaaguuuug

SEQ ID NO: 1936059 - RNA, 19 nt, Homo sapiens
gaaaacuuagagagguaca

SEQ ID NO: 1936060 - RNA, 22 nt, Homo sapiens
ccuuacaaaugauugcuuuuaa

SEQ ID NO: 1936061 - RNA, 14 nt, Homo sapiens
cacaugacauagca

SEQ ID NO: 1936062 - RNA, 21 nt, Homo sapiens
uaaaucaaaccaggugcaauu

SEQ ID NO: 1936063 - RNA, 14 nt, Homo sapiens
auguauaaagugau

SEQ ID NO: 1936064 - RNA, 21 nt, Homo sapiens
cugcaccuuuuugcaugauau

SEQ ID NO: 1936065 - RNA, 20 nt, Homo sapiens
ugcucuggggcacuguugag

SEQ ID NO: 1936066 - RNA, 16 nt, Homo sapiens
uuguauggaagccacc

SEQ ID NO: 1936067 - RNA, 19 nt, Homo sapiens
gcauggccccuccaggaac

SEQ ID NO: 1936068 - RNA, 19 nt, Homo sapiens
gcccaaugagguggcucau

SEQ ID NO: 1936069 - RNA, 11 nt, Homo sapiens
cugagaucucc

SEQ ID NO: 1936070 - RNA, 13 nt, Homo sapiens
cagaauucuucag

SEQ ID NO: 1936071 - RNA, 14 nt, Homo sapiens
ggaagcaaggaaau

SEQ ID NO: 1936072 - RNA, 15 nt, Homo sapiens
cacacggaugcacac

SEQ ID NO: 1936073 - RNA, 20 nt, Homo sapiens
ucucauuuccagcuucucag

SEQ ID NO: 1936074 - RNA, 14 nt, Homo sapiens
aguuauuuucagac

SEQ ID NO: 1936075 - RNA, 19 nt, Homo sapiens
acaaagagguguacaggua

SEQ ID NO: 1936076 - RNA, 20 nt, Homo sapiens
uuugagugugggacuccagg

SEQ ID NO: 1936077 - RNA, 20 nt, Homo sapiens
uuugccucugcacgugcaca

SEQ ID NO: 1936078 - RNA, 14 nt, Homo sapiens
gggccccugcacac

SEQ ID NO: 1936079 - RNA, 20 nt, Homo sapiens
aaaguugagggaaagagcuu

SEQ ID NO: 1936080 - RNA, 23 nt, Homo sapiens
uaacuguaguguagucaggugcu

SEQ ID NO: 1936081 - RNA, 12 nt, Homo sapiens
cauauaucacua

SEQ ID NO: 1936082 - RNA, 20 nt, Homo sapiens
gccuuggggcugaugcaguu

SEQ ID NO: 1936083 - RNA, 20 nt, Homo sapiens
aacaggagaccccuuugcag

SEQ ID NO: 1936084 - RNA, 17 nt, Homo sapiens
caauacaugcugcuaau

SEQ ID NO: 1936085 - RNA, 13 nt, Homo sapiens
gaggggugcugcc

SEQ ID NO: 1936086 - RNA, 18 nt, Homo sapiens
acuaaccuggguucccuu

SEQ ID NO: 1936087 - RNA, 11 nt, Homo sapiens
acauacugcug

SEQ ID NO: 1936088 - RNA, 23 nt, Homo sapiens
uuguagaaaaaucccuccaccuu

SEQ ID NO: 1936089 - RNA, 21 nt, Homo sapiens
aucagucuuggaauacuugaa

SEQ ID NO: 1936090 - RNA, 16 nt, Homo sapiens
ucacaccaccugacag

SEQ ID NO: 1936091 - RNA, 21 nt, Homo sapiens
uaaaguuuuaggguacaguuu

SEQ ID NO: 1936092 - RNA, 18 nt, Homo sapiens
uuccucauuagcauuuug

SEQ ID NO: 1936093 - RNA, 22 nt, Homo sapiens
cagugucucgaugccauaauca

SEQ ID NO: 1936094 - RNA, 16 nt, Homo sapiens
uagaauacucagggaa

SEQ ID NO: 1936095 - RNA, 16 nt, Homo sapiens
caggauccccaaggca

SEQ ID NO: 1936096 - RNA, 12 nt, Homo sapiens
uuagcucugaga

SEQ ID NO: 1936097 - RNA, 14 nt, Homo sapiens
aagaaggauaccaa

SEQ ID NO: 1936098 - RNA, 21 nt, Homo sapiens
ucaagcagaaaaacaggcaca

SEQ ID NO: 1936099 - RNA, 19 nt, Homo sapiens
aagauggcucagaggggga

SEQ ID NO: 1936100 - RNA, 19 nt, Homo sapiens
gcaugagucagucugauga

SEQ ID NO: 1936101 - RNA, 16 nt, Homo sapiens
aauuccccuacaucaa

SEQ ID NO: 1936102 - RNA, 13 nt, Homo sapiens
ugaguagggacuc

SEQ ID NO: 1936103 - RNA, 18 nt, Homo sapiens
caugaccaaaaaccaaaa

SEQ ID NO: 1936104 - RNA, 13 nt, Homo sapiens
cacuguuugccau

SEQ ID NO: 1936105 - RNA, 13 nt, Homo sapiens
uuguucugaguaa

SEQ ID NO: 1936106 - RNA, 15 nt, Homo sapiens
acucaauaugugauu

SEQ ID NO: 1936107 - RNA, 19 nt, Homo sapiens
cuagugaauguaaaaugca

SEQ ID NO: 1936108 - RNA, 18 nt, Homo sapiens
ugugaagcaggucuuuca

SEQ ID NO: 1936109 - RNA, 20 nt, Homo sapiens
uucaguagaauuuuaguccu

SEQ ID NO: 1936110 - RNA, 17 nt, Homo sapiens
cuuggagucuuccaaac

SEQ ID NO: 1936111 - RNA, 17 nt, Homo sapiens
uugaauguaagaacaug

SEQ ID NO: 1936112 - RNA, 17 nt, Homo sapiens
gugcucaauagcuugaa

SEQ ID NO: 1936113 - RNA, 17 nt, Homo sapiens
ggcaggucuaguguucc

SEQ ID NO: 1936114 - RNA, 20 nt, Homo sapiens
agcacuagaauauuuaaaac

SEQ ID NO: 1936115 - RNA, 18 nt, Homo sapiens
uuaacaggauauuagaca

SEQ ID NO: 1936116 - RNA, 17 nt, Homo sapiens
cccagcccucaguuuuc

SEQ ID NO: 1936117 - RNA, 19 nt, Homo sapiens
aauaaucacaaaaucacaa

SEQ ID NO: 1936118 - RNA, 14 nt, Homo sapiens
auucaagccuguga

SEQ ID NO: 1936119 - RNA, 16 nt, Homo sapiens
uaagaucugaauucua

SEQ ID NO: 1936120 - RNA, 13 nt, Homo sapiens
gauuuuugcaaua

SEQ ID NO: 1936121 - RNA, 13 nt, Homo sapiens
agagggagugcau

SEQ ID NO: 1936122 - RNA, 15 nt, Homo sapiens
gaaaguccaguuuau

SEQ ID NO: 1936123 - RNA, 12 nt, Homo sapiens
gacacaaggcac

SEQ ID NO: 1936124 - RNA, 16 nt, Homo sapiens
uagaaaugagaccaca

SEQ ID NO: 1936125 - RNA, 15 nt, Homo sapiens
ucauccuauugucuu

SEQ ID NO: 1936126 - RNA, 15 nt, Homo sapiens
acagguaaaugggca

SEQ ID NO: 1936127 - RNA, 19 nt, Homo sapiens
uuaucacacuucugugaga

SEQ ID NO: 1936128 - RNA, 12 nt, Homo sapiens
aaagcacacuca

SEQ ID NO: 1936129 - RNA, 14 nt, Homo sapiens
guauauuacaccaa

SEQ ID NO: 1936130 - RNA, 17 nt, Homo sapiens
ccuuucaucacacuggg

SEQ ID NO: 1936131 - RNA, 13 nt, Homo sapiens
auguaugcuguuu

SEQ ID NO: 1936132 - RNA, 20 nt, Homo sapiens
uacagcuggguggcacugcc

SEQ ID NO: 1936133 - RNA, 15 nt, Homo sapiens
uucuguuagcugcuc

SEQ ID NO: 1936134 - RNA, 14 nt, Homo sapiens
cucaagaaaucaaa

SEQ ID NO: 1936135 - RNA, 19 nt, Homo sapiens
gcacacagggcaguccuua

SEQ ID NO: 1936136 - RNA, 14 nt, Homo sapiens
agggagaacgggaa

SEQ ID NO: 1936137 - RNA, 17 nt, Homo sapiens
gaugccuccccaagacu

SEQ ID NO: 1936138 - RNA, 16 nt, Homo sapiens
cuucaaguuagcucag

SEQ ID NO: 1936139 - RNA, 15 nt, Homo sapiens
ccugggcccuugugc

SEQ ID NO: 1936140 - RNA, 18 nt, Homo sapiens
cucucaccucuaacauca

SEQ ID NO: 1936141 - RNA, 16 nt, Homo sapiens
aacacucagcugcuuc

SEQ ID NO: 1936142 - RNA, 13 nt, Homo sapiens
auacuagaauuca

SEQ ID NO: 1936143 - RNA, 21 nt, Homo sapiens
ggcuugaaagucuaacuuuuu

SEQ ID NO: 1936144 - RNA, 22 nt, Homo sapiens
gccugcagcugagauuccagaa

SEQ ID NO: 1936145 - RNA, 17 nt, Homo sapiens
uuugguuuggaguacaa

SEQ ID NO: 1936146 - RNA, 15 nt, Homo sapiens
ggcuccugauggugu

SEQ ID NO: 1936147 - RNA, 15 nt, Homo sapiens
caagacuacuaggga

SEQ ID NO: 1936148 - RNA, 18 nt, Homo sapiens
ugagaaccauaggacugu

SEQ ID NO: 1936149 - RNA, 18 nt, Homo sapiens
aagcagguggcaucucua

SEQ ID NO: 1936150 - RNA, 19 nt, Homo sapiens
aagagcccaauuaccagaa

SEQ ID NO: 1936151 - RNA, 21 nt, Homo sapiens
gcgcccuuaacugcauccagc

SEQ ID NO: 1936152 - RNA, 13 nt, Homo sapiens
guucucacuggga

SEQ ID NO: 1936153 - RNA, 23 nt, Homo sapiens
agacuccucggccuggcuccuac

SEQ ID NO: 1936154 - RNA, 14 nt, Homo sapiens
uccugcguccucug

SEQ ID NO: 1936155 - RNA, 19 nt, Homo sapiens
ucuaagaaguuuuguucug

SEQ ID NO: 1936156 - RNA, 23 nt, Homo sapiens
uguuaggacauaaacccuugcca

SEQ ID NO: 1936157 - RNA, 19 nt, Homo sapiens
aucaaaaaugaaucacuuc

SEQ ID NO: 1936158 - RNA, 19 nt, Homo sapiens
uuauaauaauguucucugg

SEQ ID NO: 1936159 - RNA, 15 nt, Homo sapiens
uuggaagguauuuaa

SEQ ID NO: 1936160 - RNA, 16 nt, Homo sapiens
agcccccgcuguaaug

SEQ ID NO: 1936161 - RNA, 22 nt, Homo sapiens
auccacaaaaacaacuuauuau

SEQ ID NO: 1936162 - RNA, 17 nt, Homo sapiens
uagcaaggggcucagaa

SEQ ID NO: 1936163 - RNA, 20 nt, Homo sapiens
aucaguccaucccagaggga

SEQ ID NO: 1936164 - RNA, 17 nt, Homo sapiens
cagaagcagaagugcaa

SEQ ID NO: 1936165 - RNA, 19 nt, Homo sapiens
aggggagcaguggccauca

SEQ ID NO: 1936166 - RNA, 16 nt, Homo sapiens
aaaggggaacugucaa

SEQ ID NO: 1936167 - RNA, 17 nt, Homo sapiens
auuguguuccugaagaa

SEQ ID NO: 1936168 - RNA, 13 nt, Homo sapiens
aaguauuuccaac

SEQ ID NO: 1936169 - RNA, 21 nt, Homo sapiens
uuagugaucaaauugugcagu

SEQ ID NO: 1936170 - RNA, 20 nt, Homo sapiens
aaucagccucgcucuugucu

SEQ ID NO: 1936171 - RNA, 22 nt, Homo sapiens
cagccagaucgggagcaaacca

SEQ ID NO: 1936172 - RNA, 19 nt, Homo sapiens
uauuucccuaccaaccaag

SEQ ID NO: 1936173 - RNA, 21 nt, Homo sapiens
uuaaaauacugauacauccau

SEQ ID NO: 1936174 - RNA, 16 nt, Homo sapiens
guuccuccaagagguc

SEQ ID NO: 1936175 - RNA, 14 nt, Homo sapiens
caagaaugugcacu

SEQ ID NO: 1936176 - RNA, 22 nt, Homo sapiens
cagacaggcuggaguugcugaa

SEQ ID NO: 1936177 - RNA, 23 nt, Homo sapiens
cucaagcagucuacccaccucag

SEQ ID NO: 1936178 - RNA, 14 nt, Homo sapiens
uccuuuuucacuuu

SEQ ID NO: 1936179 - RNA, 14 nt, Homo sapiens
uccuccuucacucc

SEQ ID NO: 1936180 - RNA, 14 nt, Homo sapiens
agugugaucccaag

SEQ ID NO: 1936181 - RNA, 14 nt, Homo sapiens
acuuucacaucucu

SEQ ID NO: 1936182 - RNA, 12 nt, Homo sapiens
aguuacuugaau

SEQ ID NO: 1936183 - RNA, 17 nt, Homo sapiens
ucugggugccuuaagga

SEQ ID NO: 1936184 - RNA, 21 nt, Homo sapiens
acuuccuuggacucauuuuaa

SEQ ID NO: 1936185 - RNA, 22 nt, Homo sapiens
caauaaacuccuacuaaauccc

SEQ ID NO: 1936186 - RNA, 21 nt, Homo sapiens
aaaugauaagugacaaaagca

SEQ ID NO: 1936187 - RNA, 15 nt, Homo sapiens
aagaaaauaucacug

SEQ ID NO: 1936188 - RNA, 13 nt, Homo sapiens
uuucaaagugaua

SEQ ID NO: 1936189 - RNA, 18 nt, Homo sapiens
cuggagagaacacagugc

SEQ ID NO: 1936190 - RNA, 14 nt, Homo sapiens
augacugcaaaagu

SEQ ID NO: 1936191 - RNA, 14 nt, Homo sapiens
cagagccauccacc

SEQ ID NO: 1936192 - RNA, 15 nt, Homo sapiens
uaaacacaugcauac

SEQ ID NO: 1936193 - RNA, 16 nt, Homo sapiens
uuuucaagcuacgugu

SEQ ID NO: 1936194 - RNA, 13 nt, Homo sapiens
ugaagaguauuaa

SEQ ID NO: 1936195 - RNA, 14 nt, Homo sapiens
auacagaaaugcaa

SEQ ID NO: 1936196 - RNA, 11 nt, Homo sapiens
acacacugagu

SEQ ID NO: 1936197 - RNA, 11 nt, Homo sapiens
ugacacugucu

SEQ ID NO: 1936198 - RNA, 15 nt, Homo sapiens
ugcauuucugcucuc

SEQ ID NO: 1936199 - RNA, 16 nt, Homo sapiens
aggaaggugcuugccu

SEQ ID NO: 1936200 - RNA, 18 nt, Homo sapiens
acccugaccauugcccua

SEQ ID NO: 1936201 - RNA, 18 nt, Homo sapiens
uaagauguucacuguggc

SEQ ID NO: 1936202 - RNA, 24 nt, Homo sapiens
uguggacaggacuaacacucagaa

SEQ ID NO: 1936203 - RNA, 17 nt, Homo sapiens
aauguucauacugaugu

SEQ ID NO: 1936204 - RNA, 22 nt, Homo sapiens
gcuucuguguuuggaacagcua

SEQ ID NO: 1936205 - RNA, 21 nt, Homo sapiens
uaaaauucuauuauacuacaa

SEQ ID NO: 1936206 - RNA, 21 nt, Homo sapiens
aaaaauuuauuuauauuucaa

SEQ ID NO: 1936207 - RNA, 22 nt, Homo sapiens
cccuggacaggcuucgucucag

SEQ ID NO: 1936208 - RNA, 19 nt, Homo sapiens
gucucauuaucuccaugau

SEQ ID NO: 1936209 - RNA, 15 nt, Homo sapiens
guaaaagucuaccug

SEQ ID NO: 1936210 - RNA, 14 nt, Homo sapiens
acccucuugaauau

SEQ ID NO: 1936211 - RNA, 18 nt, Homo sapiens
cgcacagggcaugccugg

SEQ ID NO: 1936212 - RNA, 24 nt, Homo sapiens
cucccgacagcccaucaccucuaa

SEQ ID NO: 1936213 - RNA, 15 nt, Homo sapiens
ccucuacccacuucu

SEQ ID NO: 1936214 - RNA, 15 nt, Homo sapiens
acaccaguaauccca

SEQ ID NO: 1936215 - RNA, 21 nt, Homo sapiens
ccugauuacaaugcugucugu

SEQ ID NO: 1936216 - RNA, 21 nt, Homo sapiens
ccaaaauuuugucccaucucu

SEQ ID NO: 1936217 - RNA, 15 nt, Homo sapiens
agagacaacaaaaau

SEQ ID NO: 1936218 - RNA, 12 nt, Homo sapiens
ggacaucaccug

SEQ ID NO: 1936219 - RNA, 14 nt, Homo sapiens
gaaucuauuucacu

SEQ ID NO: 1936220 - RNA, 22 nt, Homo sapiens
aauccgagauaggguggcacau

SEQ ID NO: 1936221 - RNA, 21 nt, Homo sapiens
uuaauuucuacacacccauag

SEQ ID NO: 1936222 - RNA, 22 nt, Homo sapiens
uggaggaccgccccacccugga

SEQ ID NO: 1936223 - RNA, 18 nt, Homo sapiens
gaaauuuuuaaaaauaca

SEQ ID NO: 1936224 - RNA, 17 nt, Homo sapiens
ggccugacugacuuuuu

SEQ ID NO: 1936225 - RNA, 21 nt, Homo sapiens
acgggcaaagaaaacacacaa

SEQ ID NO: 1936226 - RNA, 18 nt, Homo sapiens
gauggaguauacaugacu

SEQ ID NO: 1936227 - RNA, 20 nt, Homo sapiens
acacuaacaaaagcaugaaa

SEQ ID NO: 1936228 - RNA, 17 nt, Homo sapiens
guuaaaaauauuuucug

SEQ ID NO: 1936229 - RNA, 13 nt, Homo sapiens
cuugguaaucuuc

SEQ ID NO: 1936230 - RNA, 13 nt, Homo sapiens
agugccugugauc

SEQ ID NO: 1936231 - RNA, 18 nt, Homo sapiens
aauugagggacugagcca

SEQ ID NO: 1936232 - RNA, 23 nt, Homo sapiens
caugaugagucugaaggcauuug

SEQ ID NO: 1936233 - RNA, 15 nt, Homo sapiens
accaaucaugaauua

SEQ ID NO: 1936234 - RNA, 18 nt, Homo sapiens
cauacccacacauuccag

SEQ ID NO: 1936235 - RNA, 21 nt, Homo sapiens
augaagaauauaccauuucaa

SEQ ID NO: 1936236 - RNA, 18 nt, Homo sapiens
cgcgggaggcaccagcuc

SEQ ID NO: 1936237 - RNA, 13 nt, Homo sapiens
ugcccacaggccg

SEQ ID NO: 1936238 - RNA, 19 nt, Homo sapiens
auagauaggucagugcaaa

SEQ ID NO: 1936239 - RNA, 20 nt, Homo sapiens
uaaaaaugccuacacaguaa

SEQ ID NO: 1936240 - RNA, 13 nt, Homo sapiens
cguuauacugaaa

SEQ ID NO: 1936241 - RNA, 19 nt, Homo sapiens
gaggaccugcgcaaagggc

SEQ ID NO: 1936242 - RNA, 16 nt, Homo sapiens
aagguugcgaugccuu

SEQ ID NO: 1936243 - RNA, 18 nt, Homo sapiens
caugaaauucuuccuaau

SEQ ID NO: 1936244 - RNA, 19 nt, Homo sapiens
acagagaagcggauuucca

SEQ ID NO: 1936245 - RNA, 11 nt, Homo sapiens
gcuauggugcu

SEQ ID NO: 1936246 - RNA, 21 nt, Homo sapiens
cuuaguuacucauucagggau

SEQ ID NO: 1936247 - RNA, 15 nt, Homo sapiens
gccaaucuuguuuua

SEQ ID NO: 1936248 - RNA, 20 nt, Homo sapiens
uugggauauccuuucacucu

SEQ ID NO: 1936249 - RNA, 19 nt, Homo sapiens
aguguuuggguauauucau

SEQ ID NO: 1936250 - RNA, 21 nt, Homo sapiens
ugucuggcccgcaauacugua

SEQ ID NO: 1936251 - RNA, 14 nt, Homo sapiens
uagcaguaugugug

SEQ ID NO: 1936252 - RNA, 14 nt, Homo sapiens
ugucugcucugcau

SEQ ID NO: 1936253 - RNA, 18 nt, Homo sapiens
ccuaaagaaauaaucucu

SEQ ID NO: 1936254 - RNA, 16 nt, Homo sapiens
uuauauagcaguaaaa

SEQ ID NO: 1936255 - RNA, 16 nt, Homo sapiens
auuccuguugcugucu

SEQ ID NO: 1936256 - RNA, 16 nt, Homo sapiens
aagaaccacagcacuu

SEQ ID NO: 1936257 - RNA, 18 nt, Homo sapiens
gccuuccccuggcacugg

SEQ ID NO: 1936258 - RNA, 22 nt, Homo sapiens
aaauuggacauuaagcaucaca

SEQ ID NO: 1936259 - RNA, 18 nt, Homo sapiens
ggcaggcccauucagagc

SEQ ID NO: 1936260 - RNA, 18 nt, Homo sapiens
cguguguguuauuucccc

SEQ ID NO: 1936261 - RNA, 12 nt, Homo sapiens
uuaaaaacucac

SEQ ID NO: 1936262 - RNA, 19 nt, Homo sapiens
uccagauagcugaaugagu

SEQ ID NO: 1936263 - RNA, 15 nt, Homo sapiens
gcgccacccgggcaa

SEQ ID NO: 1936264 - RNA, 15 nt, Homo sapiens
auugucaauauauua

SEQ ID NO: 1936265 - RNA, 23 nt, Homo sapiens
aagaggguccuuuaguaccugaa

SEQ ID NO: 1936266 - RNA, 15 nt, Homo sapiens
ggugugaacagggaa

SEQ ID NO: 1936267 - RNA, 20 nt, Homo sapiens
uuugguggggagucugagaa

SEQ ID NO: 1936268 - RNA, 17 nt, Homo sapiens
acaguuugugcucuacu

SEQ ID NO: 1936269 - RNA, 16 nt, Homo sapiens
gagugguuuccaaugu

SEQ ID NO: 1936270 - RNA, 23 nt, Homo sapiens
cccauuggugcuaccuggcucuc

SEQ ID NO: 1936271 - RNA, 14 nt, Homo sapiens
auugcuugagcuca

SEQ ID NO: 1936272 - RNA, 21 nt, Homo sapiens
agccugagcaaaaagaccagc

SEQ ID NO: 1936273 - RNA, 13 nt, Homo sapiens
ugaguauugcuga

SEQ ID NO: 1936274 - RNA, 13 nt, Homo sapiens
ccaagaugccuga

SEQ ID NO: 1936275 - RNA, 16 nt, Homo sapiens
uuccaaaaacauuuua

SEQ ID NO: 1936276 - RNA, 12 nt, Homo sapiens
uacugcuguaau

SEQ ID NO: 1936277 - RNA, 17 nt, Homo sapiens
cagcacccucuccagau

SEQ ID NO: 1936278 - RNA, 20 nt, Homo sapiens
gcugaaauugaaaaguuauu

SEQ ID NO: 1936279 - RNA, 22 nt, Homo sapiens
cauuucuagguucuucaagaau

SEQ ID NO: 1936280 - RNA, 15 nt, Homo sapiens
uggcagauuuuacaa

SEQ ID NO: 1936281 - RNA, 19 nt, Homo sapiens
uguaagagaaaauauuacu

SEQ ID NO: 1936282 - RNA, 22 nt, Homo sapiens
gcauagagaacgggaguggcca

SEQ ID NO: 1936283 - RNA, 22 nt, Homo sapiens
gcacaucugcauuuucacccca

SEQ ID NO: 1936284 - RNA, 17 nt, Homo sapiens
aucuguuuuauaccuug

SEQ ID NO: 1936285 - RNA, 22 nt, Homo sapiens
gacaacgaacauggcaugugaa

SEQ ID NO: 1936286 - RNA, 19 nt, Homo sapiens
acacagcaacauccagaaa

SEQ ID NO: 1936287 - RNA, 15 nt, Homo sapiens
uguaaaaacuuucac

SEQ ID NO: 1936288 - RNA, 17 nt, Homo sapiens
caaguucuggaucuuau

SEQ ID NO: 1936289 - RNA, 18 nt, Homo sapiens
agagugaauacacuggaa

SEQ ID NO: 1936290 - RNA, 20 nt, Homo sapiens
uauuuggcuugucacaggaa

SEQ ID NO: 1936291 - RNA, 21 nt, Homo sapiens
cagaccccuccccucguguca

SEQ ID NO: 1936292 - RNA, 22 nt, Homo sapiens
ugaaaaggugaagcuggcugug

SEQ ID NO: 1936293 - RNA, 15 nt, Homo sapiens
ggaagguggggcccu

SEQ ID NO: 1936294 - RNA, 14 nt, Homo sapiens
ccuuccauuucuuc

SEQ ID NO: 1936295 - RNA, 14 nt, Homo sapiens
ccccuaauuuucca

SEQ ID NO: 1936296 - RNA, 23 nt, Homo sapiens
cugaagccuccguggaacauucu

SEQ ID NO: 1936297 - RNA, 15 nt, Homo sapiens
ccucguguccugcua

SEQ ID NO: 1936298 - RNA, 21 nt, Homo sapiens
auguaaagauauuuuuaucuu

SEQ ID NO: 1936299 - RNA, 21 nt, Homo sapiens
aaaacacccaaaaauaucucc

SEQ ID NO: 1936300 - RNA, 22 nt, Homo sapiens
aaaugggggcaggaaagccaca

SEQ ID NO: 1936301 - RNA, 23 nt, Homo sapiens
gaucuaaauagcccuuggaucag

SEQ ID NO: 1936302 - RNA, 14 nt, Homo sapiens
cauucagcaucaga

SEQ ID NO: 1936303 - RNA, 21 nt, Homo sapiens
cuuugggccagacaugccaca

SEQ ID NO: 1936304 - RNA, 21 nt, Homo sapiens
cagcaaggccuugguggagca

SEQ ID NO: 1936305 - RNA, 22 nt, Homo sapiens
uucgaaugaaauaaagucaaau

SEQ ID NO: 1936306 - RNA, 21 nt, Homo sapiens
ugaaccguuugugauugccau

SEQ ID NO: 1936307 - RNA, 17 nt, Homo sapiens
cucuuagcuuacaggaa

SEQ ID NO: 1936308 - RNA, 18 nt, Homo sapiens
uccaaggaguuccaugaa

SEQ ID NO: 1936309 - RNA, 19 nt, Homo sapiens
ucuaagguaguaacuuucc

SEQ ID NO: 1936310 - RNA, 19 nt, Homo sapiens
agauucuccacuuggccaa

SEQ ID NO: 1936311 - RNA, 22 nt, Homo sapiens
gaagagccagccguaaugggga

SEQ ID NO: 1936312 - RNA, 14 nt, Homo sapiens
uguaaguacuucca

SEQ ID NO: 1936313 - RNA, 15 nt, Homo sapiens
cuaauguugacuuua

SEQ ID NO: 1936314 - RNA, 17 nt, Homo sapiens
ccacacugaaaccaaaa

SEQ ID NO: 1936315 - RNA, 15 nt, Homo sapiens
augugcgaagcaaga

SEQ ID NO: 1936316 - RNA, 21 nt, Homo sapiens
aaagguagcuuuucccaaacu

SEQ ID NO: 1936317 - RNA, 19 nt, Homo sapiens
uucuaauaacugcaguguu

SEQ ID NO: 1936318 - RNA, 12 nt, Homo sapiens
guucgugcugug

SEQ ID NO: 1936319 - RNA, 19 nt, Homo sapiens
agaugauuaaacagacuuu

SEQ ID NO: 1936320 - RNA, 19 nt, Homo sapiens
aaaggucccugagcucuug

SEQ ID NO: 1936321 - RNA, 17 nt, Homo sapiens
ccggucccccaugccac

SEQ ID NO: 1936322 - RNA, 18 nt, Homo sapiens
aaaucagccagacauggu

SEQ ID NO: 1936323 - RNA, 15 nt, Homo sapiens
gagcagaaacagcca

SEQ ID NO: 1936324 - RNA, 13 nt, Homo sapiens
uacucaaguuuca

SEQ ID NO: 1936325 - RNA, 13 nt, Homo sapiens
aggcaauggugaa

SEQ ID NO: 1936326 - RNA, 21 nt, Homo sapiens
ccauuccuggaaucaaggaau

SEQ ID NO: 1936327 - RNA, 21 nt, Homo sapiens
ugcagaaugacuccaccuucu

SEQ ID NO: 1936328 - RNA, 18 nt, Homo sapiens
ucacaagaaguagcuuca

SEQ ID NO: 1936329 - RNA, 14 nt, Homo sapiens
uauuuaagaggaaa

SEQ ID NO: 1936330 - RNA, 18 nt, Homo sapiens
auuuuauaccaaagccaa

SEQ ID NO: 1936331 - RNA, 14 nt, Homo sapiens
aaugugacuacuua

SEQ ID NO: 1936332 - RNA, 16 nt, Homo sapiens
gaggggcguguguucc

SEQ ID NO: 1936333 - RNA, 16 nt, Homo sapiens
augcuugaaaccagaa

SEQ ID NO: 1936334 - RNA, 15 nt, Homo sapiens
ucccugagcagcuua

SEQ ID NO: 1936335 - RNA, 15 nt, Homo sapiens
cugcacuuggccuca

SEQ ID NO: 1936336 - RNA, 17 nt, Homo sapiens
ugugcccaggguuuugc

SEQ ID NO: 1936337 - RNA, 14 nt, Homo sapiens
cgugcacaccagug

SEQ ID NO: 1936338 - RNA, 20 nt, Homo sapiens
uuucaauaucuuuauugcau

SEQ ID NO: 1936339 - RNA, 14 nt, Homo sapiens
gagccuauaucagu

SEQ ID NO: 1936340 - RNA, 13 nt, Homo sapiens
ucacuucuuccau

SEQ ID NO: 1936341 - RNA, 17 nt, Homo sapiens
uucagaguccuugcaaa

SEQ ID NO: 1936342 - RNA, 14 nt, Homo sapiens
cuuucaacuagaaa

SEQ ID NO: 1936343 - RNA, 20 nt, Homo sapiens
cugggagcacaggcacugca

SEQ ID NO: 1936344 - RNA, 16 nt, Homo sapiens
uuagagcugccugugc

SEQ ID NO: 1936345 - RNA, 22 nt, Homo sapiens
ugguuauuggaaggcaagucau

SEQ ID NO: 1936346 - RNA, 13 nt, Homo sapiens
aaacacuuuccca

SEQ ID NO: 1936347 - RNA, 20 nt, Homo sapiens
cauguauuuguucgcaauua

SEQ ID NO: 1936348 - RNA, 19 nt, Homo sapiens
auugauugaaucauugccu

SEQ ID NO: 1936349 - RNA, 12 nt, Homo sapiens
uaaguacucuaa

SEQ ID NO: 1936350 - RNA, 16 nt, Homo sapiens
ugaccggugcuuuuau

SEQ ID NO: 1936351 - RNA, 18 nt, Homo sapiens
ugauugaucacacagugu

SEQ ID NO: 1936352 - RNA, 21 nt, Homo sapiens
cuuucucuccccuccucugaa

SEQ ID NO: 1936353 - RNA, 16 nt, Homo sapiens
uauuuaagaucacagu

SEQ ID NO: 1936354 - RNA, 23 nt, Homo sapiens
ccaucuuuugugagauguaauug

SEQ ID NO: 1936355 - RNA, 23 nt, Homo sapiens
cuagaauggauucaacacugugc

SEQ ID NO: 1936356 - RNA, 20 nt, Homo sapiens
uaggaagauaaaaaaacugu

SEQ ID NO: 1936357 - RNA, 19 nt, Homo sapiens
auuuucaugcuguucauga

SEQ ID NO: 1936358 - RNA, 15 nt, Homo sapiens
acauccauguuccga

SEQ ID NO: 1936359 - RNA, 13 nt, Homo sapiens
ucuaaaguucuaa

SEQ ID NO: 1936360 - RNA, 13 nt, Homo sapiens
ccaggaguccagg

SEQ ID NO: 1936361 - RNA, 13 nt, Homo sapiens
auucuaguauucu

SEQ ID NO: 1936362 - RNA, 18 nt, Homo sapiens
cucuccagcaucaauucc

SEQ ID NO: 1936363 - RNA, 17 nt, Homo sapiens
aagggugccuucuagcu

SEQ ID NO: 1936364 - RNA, 15 nt, Homo sapiens
cagugccagcaccug

SEQ ID NO: 1936365 - RNA, 15 nt, Homo sapiens
cagagcgcaaagugc

SEQ ID NO: 1936366 - RNA, 23 nt, Homo sapiens
caucugggcaaaacccacagaag

SEQ ID NO: 1936367 - RNA, 23 nt, Homo sapiens
ggcacauguauacauauguagcu

SEQ ID NO: 1936368 - RNA, 14 nt, Homo sapiens
aguaagcugcugaa

SEQ ID NO: 1936369 - RNA, 18 nt, Homo sapiens
gccuccauguccucuuca

SEQ ID NO: 1936370 - RNA, 18 nt, Homo sapiens
cuuuccacccucucucca

SEQ ID NO: 1936371 - RNA, 14 nt, Homo sapiens
aaaagacacugcag

SEQ ID NO: 1936372 - RNA, 16 nt, Homo sapiens
uugaacauacuucauc

SEQ ID NO: 1936373 - RNA, 21 nt, Homo sapiens
agccuucugaugagacugcag

SEQ ID NO: 1936374 - RNA, 12 nt, Homo sapiens
uaaauaagcaaa

SEQ ID NO: 1936375 - RNA, 20 nt, Homo sapiens
uggaagaggcaccuguccca

SEQ ID NO: 1936376 - RNA, 18 nt, Homo sapiens
uuucuuccaagacuccag

SEQ ID NO: 1936377 - RNA, 20 nt, Homo sapiens
cuggcgugcaguggugcgau

SEQ ID NO: 1936378 - RNA, 23 nt, Homo sapiens
aaaaguucagggaccguccaggg

SEQ ID NO: 1936379 - RNA, 19 nt, Homo sapiens
uucuuuaaauaaaacccuu

SEQ ID NO: 1936380 - RNA, 20 nt, Homo sapiens
cccagcuggagcauugcagc

SEQ ID NO: 1936381 - RNA, 20 nt, Homo sapiens
guuagucuccccaccucuuc

SEQ ID NO: 1936382 - RNA, 22 nt, Homo sapiens
cuggacuuuuccucucaugucu

SEQ ID NO: 1936383 - RNA, 12 nt, Homo sapiens
ucuuucuuuauu

SEQ ID NO: 1936384 - RNA, 12 nt, Homo sapiens
gaaaucuugcaa

SEQ ID NO: 1936385 - RNA, 21 nt, Homo sapiens
acucgcuuguaaauaccagga

SEQ ID NO: 1936386 - RNA, 17 nt, Homo sapiens
aauucuuagucacaaaa

SEQ ID NO: 1936387 - RNA, 18 nt, Homo sapiens
uaauacagcuucuaacuc

SEQ ID NO: 1936388 - RNA, 12 nt, Homo sapiens
cuccuguuucag

SEQ ID NO: 1936389 - RNA, 18 nt, Homo sapiens
agcacucggccuaaauag

SEQ ID NO: 1936390 - RNA, 20 nt, Homo sapiens
auuuccuuacagaacuacuu

SEQ ID NO: 1936391 - RNA, 16 nt, Homo sapiens
uccaaauauuguuaag

SEQ ID NO: 1936392 - RNA, 18 nt, Homo sapiens
gaggcaguuccauuucau

SEQ ID NO: 1936393 - RNA, 23 nt, Homo sapiens
cauuggauccuccccgacugugg

SEQ ID NO: 1936394 - RNA, 22 nt, Homo sapiens
ugccagcucucugauuccccaa

SEQ ID NO: 1936395 - RNA, 14 nt, Homo sapiens
auaacaaacacuga

SEQ ID NO: 1936396 - RNA, 17 nt, Homo sapiens
cugacaaugaagggaaa

SEQ ID NO: 1936397 - RNA, 13 nt, Homo sapiens
gauguggguucca

SEQ ID NO: 1936398 - RNA, 13 nt, Homo sapiens
agcuccagcuuua

SEQ ID NO: 1936399 - RNA, 13 nt, Homo sapiens
agcuacagcuuuc

SEQ ID NO: 1936400 - RNA, 13 nt, Homo sapiens
ugacaagcacuau

SEQ ID NO: 1936401 - RNA, 20 nt, Homo sapiens
uagcaacaugcuucaugaaa

SEQ ID NO: 1936402 - RNA, 15 nt, Homo sapiens
acgccauugcacucc

SEQ ID NO: 1936403 - RNA, 20 nt, Homo sapiens
acaucaagacuaucuacaaa

SEQ ID NO: 1936404 - RNA, 12 nt, Homo sapiens
ucauucuaucaa

SEQ ID NO: 1936405 - RNA, 19 nt, Homo sapiens
cuaaaaauucuuaacuuuu

SEQ ID NO: 1936406 - RNA, 13 nt, Homo sapiens
aacucuucagugc

SEQ ID NO: 1936407 - RNA, 17 nt, Homo sapiens
acucacuaauucauuaa

SEQ ID NO: 1936408 - RNA, 17 nt, Homo sapiens
acacacauauacauaua

SEQ ID NO: 1936409 - RNA, 18 nt, Homo sapiens
ggaaugugccaccugucc

SEQ ID NO: 1936410 - RNA, 13 nt, Homo sapiens
gcacuugugaucc

SEQ ID NO: 1936411 - RNA, 13 nt, Homo sapiens
gcuguugugaagc

SEQ ID NO: 1936412 - RNA, 22 nt, Homo sapiens
acucagucuagugaagauguug

SEQ ID NO: 1936413 - RNA, 23 nt, Homo sapiens
ccuucacagcuaagaugccaugu

SEQ ID NO: 1936414 - RNA, 13 nt, Homo sapiens
agucagcauucuu

SEQ ID NO: 1936415 - RNA, 19 nt, Homo sapiens
ggaaccuccuuaccuggag

SEQ ID NO: 1936416 - RNA, 15 nt, Homo sapiens
agagaggaguccuuu

SEQ ID NO: 1936417 - RNA, 15 nt, Homo sapiens
ugcucuguuguaggg

SEQ ID NO: 1936418 - RNA, 15 nt, Homo sapiens
uuaaaauuacauucu

SEQ ID NO: 1936419 - RNA, 17 nt, Homo sapiens
gaagauggaaaaaguau

SEQ ID NO: 1936420 - RNA, 18 nt, Homo sapiens
cuccuuuggaauggugua

SEQ ID NO: 1936421 - RNA, 12 nt, Homo sapiens
cauagaaaaacu

SEQ ID NO: 1936422 - RNA, 22 nt, Homo sapiens
acccucccaugcgggugcacac

SEQ ID NO: 1936423 - RNA, 14 nt, Homo sapiens
aacgccacggagcu

SEQ ID NO: 1936424 - RNA, 22 nt, Homo sapiens
cuuguuuuacccuauacaucca

SEQ ID NO: 1936425 - RNA, 12 nt, Homo sapiens
cuuacagugacu

SEQ ID NO: 1936426 - RNA, 17 nt, Homo sapiens
ugccuaagacauguaac

SEQ ID NO: 1936427 - RNA, 20 nt, Homo sapiens
ucgaucuguacgaaauguga

SEQ ID NO: 1936428 - RNA, 14 nt, Homo sapiens
guagcccagcacug

SEQ ID NO: 1936429 - RNA, 14 nt, Homo sapiens
guccuugcaccuga

SEQ ID NO: 1936430 - RNA, 12 nt, Homo sapiens
ucauuaggcaaa

SEQ ID NO: 1936431 - RNA, 18 nt, Homo sapiens
gucauaccuacauucaag

SEQ ID NO: 1936432 - RNA, 14 nt, Homo sapiens
uaccugagacauau

SEQ ID NO: 1936433 - RNA, 23 nt, Homo sapiens
cuuaaucuucagaggugcuaaau

SEQ ID NO: 1936434 - RNA, 18 nt, Homo sapiens
agacaagauauuguacau

SEQ ID NO: 1936435 - RNA, 14 nt, Homo sapiens
guucaaaagcaauc

SEQ ID NO: 1936436 - RNA, 17 nt, Homo sapiens
auccuaccagaaggaaa

SEQ ID NO: 1936437 - RNA, 12 nt, Homo sapiens
aaaacuccacuc

SEQ ID NO: 1936438 - RNA, 23 nt, Homo sapiens
cuauuguugaugggcacuugaga

SEQ ID NO: 1936439 - RNA, 16 nt, Homo sapiens
cuuguguucaaucugu

SEQ ID NO: 1936440 - RNA, 19 nt, Homo sapiens
gagggguaagagaggaugu

SEQ ID NO: 1936441 - RNA, 18 nt, Homo sapiens
cuccauaaaguacaaaug

SEQ ID NO: 1936442 - RNA, 21 nt, Homo sapiens
augaccuugaaugaugccaug

SEQ ID NO: 1936443 - RNA, 10 nt, Homo sapiens
aagcuuucuc

SEQ ID NO: 1936444 - RNA, 16 nt, Homo sapiens
cauuucaggugugaga

SEQ ID NO: 1936445 - RNA, 16 nt, Homo sapiens
ucaauuuaauuuugca

SEQ ID NO: 1936446 - RNA, 17 nt, Homo sapiens
acacccuggaguggcau

SEQ ID NO: 1936447 - RNA, 19 nt, Homo sapiens
ugauggaccagcccugaga

SEQ ID NO: 1936448 - RNA, 19 nt, Homo sapiens
cucaguggugccugcauuu

SEQ ID NO: 1936449 - RNA, 22 nt, Homo sapiens
ucuuugggccagacaugccaca

SEQ ID NO: 1936450 - RNA, 23 nt, Homo sapiens
cuuaucaacauuuguuccaugag

SEQ ID NO: 1936451 - RNA, 18 nt, Homo sapiens
cugcuuugagaaaucuca

SEQ ID NO: 1936452 - RNA, 23 nt, Homo sapiens
uaauuggcaugaaggugucauac

SEQ ID NO: 1936453 - RNA, 14 nt, Homo sapiens
ccuuugugcucugu

SEQ ID NO: 1936454 - RNA, 14 nt, Homo sapiens
cagugagauaucau

SEQ ID NO: 1936455 - RNA, 23 nt, Homo sapiens
guccugauuacaaugcugucugu

SEQ ID NO: 1936456 - RNA, 16 nt, Homo sapiens
augacaguagcauuga

SEQ ID NO: 1936457 - RNA, 14 nt, Homo sapiens
cugugaaauucuca

SEQ ID NO: 1936458 - RNA, 22 nt, Homo sapiens
ucagccuggggcucucugaccc

SEQ ID NO: 1936459 - RNA, 19 nt, Homo sapiens
caaccugaucccacgaggg

SEQ ID NO: 1936460 - RNA, 20 nt, Homo sapiens
auaccccacuccacaucaac

SEQ ID NO: 1936461 - RNA, 15 nt, Homo sapiens
cuccuaaugcuuuau

SEQ ID NO: 1936462 - RNA, 21 nt, Homo sapiens
gaaauaauuguuguucuguua

SEQ ID NO: 1936463 - RNA, 23 nt, Homo sapiens
acuaaaagauugagaaguuacuu

SEQ ID NO: 1936464 - RNA, 15 nt, Homo sapiens
gcugaaaguucuugc

SEQ ID NO: 1936465 - RNA, 14 nt, Homo sapiens
acccauauuacaga

SEQ ID NO: 1936466 - RNA, 16 nt, Homo sapiens
cagaaccaccccggcc

SEQ ID NO: 1936467 - RNA, 17 nt, Homo sapiens
uccuugcaaccaggcag

SEQ ID NO: 1936468 - RNA, 20 nt, Homo sapiens
gcccaagugaggagugccag

SEQ ID NO: 1936469 - RNA, 18 nt, Homo sapiens
ucuguugguccacugugu

SEQ ID NO: 1936470 - RNA, 19 nt, Homo sapiens
ucuuugcucuaauuuugga

SEQ ID NO: 1936471 - RNA, 23 nt, Homo sapiens
acagcccuuccucccauuuccca

SEQ ID NO: 1936472 - RNA, 15 nt, Homo sapiens
uaaagccaagcacuu

SEQ ID NO: 1936473 - RNA, 12 nt, Homo sapiens
uauguaucuacc

SEQ ID NO: 1936474 - RNA, 13 nt, Homo sapiens
cauacacuuuguu

SEQ ID NO: 1936475 - RNA, 18 nt, Homo sapiens
accuuucuaaaccucucu

SEQ ID NO: 1936476 - RNA, 23 nt, Homo sapiens
gaagagccuugcggaagguucua

SEQ ID NO: 1936477 - RNA, 20 nt, Homo sapiens
cuaaguuauuuuaugacaug

SEQ ID NO: 1936478 - RNA, 16 nt, Homo sapiens
cucauguuggggcucu

SEQ ID NO: 1936479 - RNA, 23 nt, Homo sapiens
ucuggacaggcacuaucuggguu

SEQ ID NO: 1936480 - RNA, 16 nt, Homo sapiens
ccuuuuugccauuuca

SEQ ID NO: 1936481 - RNA, 13 nt, Homo sapiens
augcucaagcccc

SEQ ID NO: 1936482 - RNA, 13 nt, Homo sapiens
uaaaguauugucu

SEQ ID NO: 1936483 - RNA, 15 nt, Homo sapiens
auuuuagaugcaaug

SEQ ID NO: 1936484 - RNA, 18 nt, Homo sapiens
ugauggcaaaaacaaagg

SEQ ID NO: 1936485 - RNA, 23 nt, Homo sapiens
gugauuuuuuuuuucuuuuuacu

SEQ ID NO: 1936486 - RNA, 18 nt, Homo sapiens
auuauaaugauuacuaau

SEQ ID NO: 1936487 - RNA, 13 nt, Homo sapiens
cugcugauccaga

SEQ ID NO: 1936488 - RNA, 16 nt, Homo sapiens
ugcuagaagaauuuga

SEQ ID NO: 1936489 - RNA, 21 nt, Homo sapiens
uacuagcaucuuagugccuuu

SEQ ID NO: 1936490 - RNA, 16 nt, Homo sapiens
gcauuuuauuaaacuu

SEQ ID NO: 1936491 - RNA, 18 nt, Homo sapiens
cugguagaccacugccau

SEQ ID NO: 1936492 - RNA, 22 nt, Homo sapiens
ugagacuacaagugugugccac

SEQ ID NO: 1936493 - RNA, 16 nt, Homo sapiens
aaacauuugcuggaga

SEQ ID NO: 1936494 - RNA, 19 nt, Homo sapiens
gacagagggacagugggcu

SEQ ID NO: 1936495 - RNA, 15 nt, Homo sapiens
ugugcucuacaucuc

SEQ ID NO: 1936496 - RNA, 17 nt, Homo sapiens
aaagagguuuucacaaa

SEQ ID NO: 1936497 - RNA, 15 nt, Homo sapiens
ucaccaugugacaca

SEQ ID NO: 1936498 - RNA, 15 nt, Homo sapiens
auccauaaugcauuc

SEQ ID NO: 1936499 - RNA, 21 nt, Homo sapiens
cuuggugaaacuacaucucca

SEQ ID NO: 1936500 - RNA, 21 nt, Homo sapiens
aagcuguuauucuuguuauac

SEQ ID NO: 1936501 - RNA, 19 nt, Homo sapiens
cauagugauagagugcagu

SEQ ID NO: 1936502 - RNA, 13 nt, Homo sapiens
uuccacugacagg

SEQ ID NO: 1936503 - RNA, 18 nt, Homo sapiens
cuucagaacugcccuugc

SEQ ID NO: 1936504 - RNA, 20 nt, Homo sapiens
auuaugggcgugaaccacca

SEQ ID NO: 1936505 - RNA, 14 nt, Homo sapiens
aggcuggagcuggc

SEQ ID NO: 1936506 - RNA, 21 nt, Homo sapiens
cugcuguccacaugaccucca

SEQ ID NO: 1936507 - RNA, 18 nt, Homo sapiens
gaggagguauuguaagcu

SEQ ID NO: 1936508 - RNA, 18 nt, Homo sapiens
ucacuuuccaccaagugu

SEQ ID NO: 1936509 - RNA, 13 nt, Homo sapiens
caucaugcuccac

SEQ ID NO: 1936510 - RNA, 20 nt, Homo sapiens
auauuucuuaucaccacagu

SEQ ID NO: 1936511 - RNA, 13 nt, Homo sapiens
aaagcuaucuuaa

SEQ ID NO: 1936512 - RNA, 13 nt, Homo sapiens
ccaagugccugcu

SEQ ID NO: 1936513 - RNA, 24 nt, Homo sapiens
gaagcgucgccccaguggcacuga

SEQ ID NO: 1936514 - RNA, 18 nt, Homo sapiens
ggaacuuuagugaaacau

SEQ ID NO: 1936515 - RNA, 14 nt, Homo sapiens
agcuugauugcuca

SEQ ID NO: 1936516 - RNA, 19 nt, Homo sapiens
agaggcuuccuucauuucc

SEQ ID NO: 1936517 - RNA, 14 nt, Homo sapiens
cacagacgggcaca

SEQ ID NO: 1936518 - RNA, 15 nt, Homo sapiens
ccagcagcagcuuuc

SEQ ID NO: 1936519 - RNA, 12 nt, Homo sapiens
aguccuguugaa

SEQ ID NO: 1936520 - RNA, 14 nt, Homo sapiens
acuaaaugaacuaa

SEQ ID NO: 1936521 - RNA, 14 nt, Homo sapiens
cagaaagcaaggac

SEQ ID NO: 1936522 - RNA, 14 nt, Homo sapiens
auggcauauggucc

SEQ ID NO: 1936523 - RNA, 16 nt, Homo sapiens
uacuggggaucagagu

SEQ ID NO: 1936524 - RNA, 15 nt, Homo sapiens
cuuggguaucaauga

SEQ ID NO: 1936525 - RNA, 15 nt, Homo sapiens
agccccuagaugaag

SEQ ID NO: 1936526 - RNA, 22 nt, Homo sapiens
uguaauauuacuuuaacaugcc

SEQ ID NO: 1936527 - RNA, 14 nt, Homo sapiens
uauugugaucuauc

SEQ ID NO: 1936528 - RNA, 20 nt, Homo sapiens
uacauuuugaaggugaugca

SEQ ID NO: 1936529 - RNA, 14 nt, Homo sapiens
ugugaaugaucucu

SEQ ID NO: 1936530 - RNA, 22 nt, Homo sapiens
caugugugugcaagugugugca

SEQ ID NO: 1936531 - RNA, 14 nt, Homo sapiens
uugacucuugaaua

SEQ ID NO: 1936532 - RNA, 15 nt, Homo sapiens
guuccgccacuccag

SEQ ID NO: 1936533 - RNA, 14 nt, Homo sapiens
uaacuauauuugcu

SEQ ID NO: 1936534 - RNA, 15 nt, Homo sapiens
uuuucccucgcuggg

SEQ ID NO: 1936535 - RNA, 15 nt, Homo sapiens
agauuccggauccua

SEQ ID NO: 1936536 - RNA, 12 nt, Homo sapiens
ucuuuggcaaag

SEQ ID NO: 1936537 - RNA, 22 nt, Homo sapiens
cuuaagaacugcccagccucag

SEQ ID NO: 1936538 - RNA, 15 nt, Homo sapiens
gaccccuauccugau

SEQ ID NO: 1936539 - RNA, 18 nt, Homo sapiens
gagucagucuucacuugc

SEQ ID NO: 1936540 - RNA, 22 nt, Homo sapiens
gccccagugccaagcacagugc

SEQ ID NO: 1936541 - RNA, 21 nt, Homo sapiens
guuuggcuagguaucauucaa

SEQ ID NO: 1936542 - RNA, 13 nt, Homo sapiens
cccacuuugccac

SEQ ID NO: 1936543 - RNA, 21 nt, Homo sapiens
cacacuucaguauagcauugg

SEQ ID NO: 1936544 - RNA, 19 nt, Homo sapiens
auauauuuuuaagacuuuu

SEQ ID NO: 1936545 - RNA, 15 nt, Homo sapiens
uaaaaauuguuauaa

SEQ ID NO: 1936546 - RNA, 12 nt, Homo sapiens
aucccuuuacau

SEQ ID NO: 1936547 - RNA, 17 nt, Homo sapiens
cuguagacuagugccgu

SEQ ID NO: 1936548 - RNA, 18 nt, Homo sapiens
caucacacuugucugcag

SEQ ID NO: 1936549 - RNA, 20 nt, Homo sapiens
caaaaaaaguuuguuacuuu

SEQ ID NO: 1936550 - RNA, 21 nt, Homo sapiens
cccagcugggaagaacaugcu

SEQ ID NO: 1936551 - RNA, 22 nt, Homo sapiens
aauggggggcgggccagggugg

SEQ ID NO: 1936552 - RNA, 16 nt, Homo sapiens
gguggaucuguccaag

SEQ ID NO: 1936553 - RNA, 15 nt, Homo sapiens
auugagacacuguca

SEQ ID NO: 1936554 - RNA, 12 nt, Homo sapiens
ggaaauugcaaa

SEQ ID NO: 1936555 - RNA, 16 nt, Homo sapiens
cagacuccagccugaa

SEQ ID NO: 1936556 - RNA, 16 nt, Homo sapiens
cagaucguucauugcc

SEQ ID NO: 1936557 - RNA, 23 nt, Homo sapiens
uucagaagaaucuuccuggcaca

SEQ ID NO: 1936558 - RNA, 22 nt, Homo sapiens
gaacuuuccccaauuacagggu

SEQ ID NO: 1936559 - RNA, 20 nt, Homo sapiens
agugcacaacauuacaggga

SEQ ID NO: 1936560 - RNA, 18 nt, Homo sapiens
ucggagacagugaucucc

SEQ ID NO: 1936561 - RNA, 13 nt, Homo sapiens
gcacaaucucaca

SEQ ID NO: 1936562 - RNA, 15 nt, Homo sapiens
ucuauuuuacuuugu

SEQ ID NO: 1936563 - RNA, 23 nt, Homo sapiens
gaucuuaaauuuugugauaugga

SEQ ID NO: 1936564 - RNA, 22 nt, Homo sapiens
guucuauaauaaguuuugauau

SEQ ID NO: 1936565 - RNA, 23 nt, Homo sapiens
aauuaucaccaugacaccugcca

SEQ ID NO: 1936566 - RNA, 15 nt, Homo sapiens
ccacaaacucuuucc

SEQ ID NO: 1936567 - RNA, 18 nt, Homo sapiens
acacagagaaauacaaaa

SEQ ID NO: 1936568 - RNA, 22 nt, Homo sapiens
acuuugacguaauuaaauccaa

SEQ ID NO: 1936569 - RNA, 18 nt, Homo sapiens
uguaacaggaacaaagua

SEQ ID NO: 1936570 - RNA, 17 nt, Homo sapiens
cggaaagccuuccucaa

SEQ ID NO: 1936571 - RNA, 19 nt, Homo sapiens
uuguuaaaaugagcauuga

SEQ ID NO: 1936572 - RNA, 12 nt, Homo sapiens
caaucucuuaau

SEQ ID NO: 1936573 - RNA, 18 nt, Homo sapiens
caguuagcaacaaaucca

SEQ ID NO: 1936574 - RNA, 12 nt, Homo sapiens
aauggagcucag

SEQ ID NO: 1936575 - RNA, 11 nt, Homo sapiens
ugcuccaugag

SEQ ID NO: 1936576 - RNA, 20 nt, Homo sapiens
aauuuuaaagcaaucuuggc

SEQ ID NO: 1936577 - RNA, 12 nt, Homo sapiens
cggucuugcaaa

SEQ ID NO: 1936578 - RNA, 23 nt, Homo sapiens
gcagcagguaccagcacggcccu

SEQ ID NO: 1936579 - RNA, 18 nt, Homo sapiens
ugaggggacaggccugug

SEQ ID NO: 1936580 - RNA, 20 nt, Homo sapiens
uggagguugcagugagccaa

SEQ ID NO: 1936581 - RNA, 20 nt, Homo sapiens
aagcuacgggcacaacugga

SEQ ID NO: 1936582 - RNA, 16 nt, Homo sapiens
uaauggaugguugaau

SEQ ID NO: 1936583 - RNA, 15 nt, Homo sapiens
caugauguagagugu

SEQ ID NO: 1936584 - RNA, 19 nt, Homo sapiens
agguaauccggagugagca

SEQ ID NO: 1936585 - RNA, 18 nt, Homo sapiens
aucacauaaagaaauuca

SEQ ID NO: 1936586 - RNA, 14 nt, Homo sapiens
aagaacaugcaguu

SEQ ID NO: 1936587 - RNA, 23 nt, Homo sapiens
gcgcacuucccauuuguguuuca

SEQ ID NO: 1936588 - RNA, 16 nt, Homo sapiens
caaaaggaagacugga

SEQ ID NO: 1936589 - RNA, 18 nt, Homo sapiens
agucguggggugugcugg

SEQ ID NO: 1936590 - RNA, 21 nt, Homo sapiens
uggaagggaagugagaaacca

SEQ ID NO: 1936591 - RNA, 22 nt, Homo sapiens
auugcaaagaaaauucucaagu

SEQ ID NO: 1936592 - RNA, 19 nt, Homo sapiens
uacucuugagacuacuuca

SEQ ID NO: 1936593 - RNA, 17 nt, Homo sapiens
cgcacgcucgcugccau

SEQ ID NO: 1936594 - RNA, 18 nt, Homo sapiens
cauacauauugcuguauu

SEQ ID NO: 1936595 - RNA, 22 nt, Homo sapiens
aauauauauaguuagauuccaa

SEQ ID NO: 1936596 - RNA, 19 nt, Homo sapiens
cucagcuguccagcugcaa

SEQ ID NO: 1936597 - RNA, 21 nt, Homo sapiens
cucugagacucgcgacaaugc

SEQ ID NO: 1936598 - RNA, 15 nt, Homo sapiens
auuuaucugaucaag

SEQ ID NO: 1936599 - RNA, 15 nt, Homo sapiens
cuucucauuacuugu

SEQ ID NO: 1936600 - RNA, 18 nt, Homo sapiens
uuuggaaaccacagucag

SEQ ID NO: 1936601 - RNA, 17 nt, Homo sapiens
agcacugggcucugaug

SEQ ID NO: 1936602 - RNA, 18 nt, Homo sapiens
auggcuuuuuuugccuac

SEQ ID NO: 1936603 - RNA, 20 nt, Homo sapiens
gagacacacuuaacuacuua

SEQ ID NO: 1936604 - RNA, 14 nt, Homo sapiens
ggagggcaguuuuc

SEQ ID NO: 1936605 - RNA, 23 nt, Homo sapiens
uagggcaacaauacaugcugcua

SEQ ID NO: 1936606 - RNA, 21 nt, Homo sapiens
uuagcaguacccuagccucaa

SEQ ID NO: 1936607 - RNA, 19 nt, Homo sapiens
gcugucaggugugcaugaa

SEQ ID NO: 1936608 - RNA, 20 nt, Homo sapiens
gacuaaaaaggccccugugg

SEQ ID NO: 1936609 - RNA, 18 nt, Homo sapiens
uuagaguccuaguuuucc

SEQ ID NO: 1936610 - RNA, 22 nt, Homo sapiens
guuagagcaggacugaugucuc

SEQ ID NO: 1936611 - RNA, 18 nt, Homo sapiens
uccaguaggaaaagcaau

SEQ ID NO: 1936612 - RNA, 13 nt, Homo sapiens
auuuaucugcaag

SEQ ID NO: 1936613 - RNA, 17 nt, Homo sapiens
uugcaaauaacuuacaa

SEQ ID NO: 1936614 - RNA, 15 nt, Homo sapiens
acauugugacugugu

SEQ ID NO: 1936615 - RNA, 23 nt, Homo sapiens
ugagcugcaucccugcuccccac

SEQ ID NO: 1936616 - RNA, 17 nt, Homo sapiens
uuagagauugccccaga

SEQ ID NO: 1936617 - RNA, 18 nt, Homo sapiens
ggcagcaucagggacaca

SEQ ID NO: 1936618 - RNA, 16 nt, Homo sapiens
uaguuuuacacucuag

SEQ ID NO: 1936619 - RNA, 18 nt, Homo sapiens
cucaaacuccugaccuca

SEQ ID NO: 1936620 - RNA, 20 nt, Homo sapiens
auuucuuugauugugaaaca

SEQ ID NO: 1936621 - RNA, 21 nt, Homo sapiens
aggccguuggcugugcuguau

SEQ ID NO: 1936622 - RNA, 13 nt, Homo sapiens
aaaugcuguuuau

SEQ ID NO: 1936623 - RNA, 23 nt, Homo sapiens
uguuugugcuccguagcuucuag

SEQ ID NO: 1936624 - RNA, 15 nt, Homo sapiens
guaucaccauacauu

SEQ ID NO: 1936625 - RNA, 19 nt, Homo sapiens
ucaaaugucagagcuaugu

SEQ ID NO: 1936626 - RNA, 14 nt, Homo sapiens
cucaauucacauag

SEQ ID NO: 1936627 - RNA, 19 nt, Homo sapiens
auauggagaaaugaacaaa

SEQ ID NO: 1936628 - RNA, 14 nt, Homo sapiens
cagauagcugcauu

SEQ ID NO: 1936629 - RNA, 17 nt, Homo sapiens
cucuucugggaacuucc

SEQ ID NO: 1936630 - RNA, 11 nt, Homo sapiens
acaugcucugc

SEQ ID NO: 1936631 - RNA, 16 nt, Homo sapiens
accucuauauuugcuc

SEQ ID NO: 1936632 - RNA, 15 nt, Homo sapiens
ucuugacagcuauaa

SEQ ID NO: 1936633 - RNA, 17 nt, Homo sapiens
acagggaauacauugua

SEQ ID NO: 1936634 - RNA, 15 nt, Homo sapiens
gccugcuuugcuuua

SEQ ID NO: 1936635 - RNA, 20 nt, Homo sapiens
gagccaccaugccgggccau

SEQ ID NO: 1936636 - RNA, 20 nt, Homo sapiens
ggcugggcgucuaugcugcu

SEQ ID NO: 1936637 - RNA, 16 nt, Homo sapiens
acacaaugcccaacuu

SEQ ID NO: 1936638 - RNA, 23 nt, Homo sapiens
auccugggcuggcuugagggaau

SEQ ID NO: 1936639 - RNA, 20 nt, Homo sapiens
ugucuugucgccgcccagga

SEQ ID NO: 1936640 - RNA, 18 nt, Homo sapiens
gacuuauggaacagggau

SEQ ID NO: 1936641 - RNA, 18 nt, Homo sapiens
aauaauuuuauuaugcaa

SEQ ID NO: 1936642 - RNA, 23 nt, Homo sapiens
cacaagaccaagguauacaucuu

SEQ ID NO: 1936643 - RNA, 14 nt, Homo sapiens
aacugagguuuaca

SEQ ID NO: 1936644 - RNA, 22 nt, Homo sapiens
caugguuauugaugaguuucuu

SEQ ID NO: 1936645 - RNA, 19 nt, Homo sapiens
accccuuguuuagcauaua

SEQ ID NO: 1936646 - RNA, 17 nt, Homo sapiens
agaggucucucuggaaa

SEQ ID NO: 1936647 - RNA, 21 nt, Homo sapiens
ugugcaguguugacaguucau

SEQ ID NO: 1936648 - RNA, 17 nt, Homo sapiens
aguuucuaagauucuaa

SEQ ID NO: 1936649 - RNA, 22 nt, Homo sapiens
acauuggguggggcuccuggga

SEQ ID NO: 1936650 - RNA, 18 nt, Homo sapiens
cugaaggugcaguugaau

SEQ ID NO: 1936651 - RNA, 16 nt, Homo sapiens
cauugacaagaacuga

SEQ ID NO: 1936652 - RNA, 16 nt, Homo sapiens
cucccgggaagccacc

SEQ ID NO: 1936653 - RNA, 19 nt, Homo sapiens
uuacuaguagccaaaagga

SEQ ID NO: 1936654 - RNA, 18 nt, Homo sapiens
ucuagauuauggagcuuu

SEQ ID NO: 1936655 - RNA, 21 nt, Homo sapiens
auugaguuccaguugaaguua

SEQ ID NO: 1936656 - RNA, 13 nt, Homo sapiens
auagaacuacuuu

SEQ ID NO: 1936657 - RNA, 14 nt, Homo sapiens
ucauuuuauugcua

SEQ ID NO: 1936658 - RNA, 19 nt, Homo sapiens
agauguccaagugccacgu

SEQ ID NO: 1936659 - RNA, 23 nt, Homo sapiens
ccugggagguagagguugcacug

SEQ ID NO: 1936660 - RNA, 17 nt, Homo sapiens
gccugagggcgagggga

SEQ ID NO: 1936661 - RNA, 17 nt, Homo sapiens
aucugacaaugaggcaa

SEQ ID NO: 1936662 - RNA, 19 nt, Homo sapiens
aggguucaaauuccugcaa

SEQ ID NO: 1936663 - RNA, 22 nt, Homo sapiens
ccagggcucccuuauguccacc

SEQ ID NO: 1936664 - RNA, 22 nt, Homo sapiens
uccucauuuuugaauacaggca

SEQ ID NO: 1936665 - RNA, 18 nt, Homo sapiens
caucugcuaauauaaaug

SEQ ID NO: 1936666 - RNA, 18 nt, Homo sapiens
ucuggaggagcucugcag

SEQ ID NO: 1936667 - RNA, 14 nt, Homo sapiens
aucccguguugcca

SEQ ID NO: 1936668 - RNA, 18 nt, Homo sapiens
uuacugaaguucagugau

SEQ ID NO: 1936669 - RNA, 15 nt, Homo sapiens
cccaaaacaguucua

SEQ ID NO: 1936670 - RNA, 19 nt, Homo sapiens
uccuucacucccaaaugca

SEQ ID NO: 1936671 - RNA, 11 nt, Homo sapiens
ccuugaugaag

SEQ ID NO: 1936672 - RNA, 21 nt, Homo sapiens
aaauguucaauaugagucuca

SEQ ID NO: 1936673 - RNA, 14 nt, Homo sapiens
acacagggcugcug

SEQ ID NO: 1936674 - RNA, 14 nt, Homo sapiens
auaaccccugccug

SEQ ID NO: 1936675 - RNA, 15 nt, Homo sapiens
cacugcaacuuguga

SEQ ID NO: 1936676 - RNA, 12 nt, Homo sapiens
uacauucacuuc

SEQ ID NO: 1936677 - RNA, 12 nt, Homo sapiens
guuucuaugcaa

SEQ ID NO: 1936678 - RNA, 17 nt, Homo sapiens
ucuacaccaacgccaag

SEQ ID NO: 1936679 - RNA, 12 nt, Homo sapiens
uaugaucagagc

SEQ ID NO: 1936680 - RNA, 23 nt, Homo sapiens
ugccauggucaccaaacaggaag

SEQ ID NO: 1936681 - RNA, 17 nt, Homo sapiens
ccgcugugccaggcgag

SEQ ID NO: 1936682 - RNA, 23 nt, Homo sapiens
uuauggcagaagggaauugcuca

SEQ ID NO: 1936683 - RNA, 23 nt, Homo sapiens
cucaagggccaugugguuuugca

SEQ ID NO: 1936684 - RNA, 21 nt, Homo sapiens
cuuauuuugugaacuauauca

SEQ ID NO: 1936685 - RNA, 14 nt, Homo sapiens
auucagaacuugua

SEQ ID NO: 1936686 - RNA, 17 nt, Homo sapiens
cccuuacccaccuguca

SEQ ID NO: 1936687 - RNA, 15 nt, Homo sapiens
uuugaguuucucuca

SEQ ID NO: 1936688 - RNA, 23 nt, Homo sapiens
cuuguuucagcuucucugcuaga

SEQ ID NO: 1936689 - RNA, 24 nt, Homo sapiens
aucucuaacauaugauacugaugc

SEQ ID NO: 1936690 - RNA, 21 nt, Homo sapiens
ugagccaaagagaaugccauu

SEQ ID NO: 1936691 - RNA, 11 nt, Homo sapiens
uugaccaaaga

SEQ ID NO: 1936692 - RNA, 21 nt, Homo sapiens
acauguuaguuuuucuuacuu

SEQ ID NO: 1936693 - RNA, 23 nt, Homo sapiens
uuccuuaaagcauuugcaacagc

SEQ ID NO: 1936694 - RNA, 19 nt, Homo sapiens
aaaacagguauauacuuug

SEQ ID NO: 1936695 - RNA, 14 nt, Homo sapiens
agggugucugucag

SEQ ID NO: 1936696 - RNA, 16 nt, Homo sapiens
ugaccauuauucacag

SEQ ID NO: 1936697 - RNA, 16 nt, Homo sapiens
auugacauuauagaca

SEQ ID NO: 1936698 - RNA, 12 nt, Homo sapiens
acugaccaucau

SEQ ID NO: 1936699 - RNA, 15 nt, Homo sapiens
uaaaagcaaaacugc

SEQ ID NO: 1936700 - RNA, 18 nt, Homo sapiens
aacucauuugaaugcuua

SEQ ID NO: 1936701 - RNA, 22 nt, Homo sapiens
ccacucuaugaguuggacuuca

SEQ ID NO: 1936702 - RNA, 18 nt, Homo sapiens
cacauugaaugcgcuuua

SEQ ID NO: 1936703 - RNA, 15 nt, Homo sapiens
uugccagagccuuaa

SEQ ID NO: 1936704 - RNA, 18 nt, Homo sapiens
cacccacuucccugcagg

SEQ ID NO: 1936705 - RNA, 23 nt, Homo sapiens
gcuuaugaaaccuguacauaugu

SEQ ID NO: 1936706 - RNA, 20 nt, Homo sapiens
guccuucuugaauucaugua

SEQ ID NO: 1936707 - RNA, 14 nt, Homo sapiens
cagaggagugcagc

SEQ ID NO: 1936708 - RNA, 12 nt, Homo sapiens
cgcagucucuua

SEQ ID NO: 1936709 - RNA, 17 nt, Homo sapiens
aaucauuuuaagugcau

SEQ ID NO: 1936710 - RNA, 17 nt, Homo sapiens
gguuuccaacaauucag

SEQ ID NO: 1936711 - RNA, 18 nt, Homo sapiens
uuuacuauuuauuuacau

SEQ ID NO: 1936712 - RNA, 18 nt, Homo sapiens
cuaccuagggcacuuuaa

SEQ ID NO: 1936713 - RNA, 23 nt, Homo sapiens
ugagaacacagccgauucaccug

SEQ ID NO: 1936714 - RNA, 19 nt, Homo sapiens
acaucuaagccucuaacag

SEQ ID NO: 1936715 - RNA, 19 nt, Homo sapiens
cccuguccuaagcacuuua

SEQ ID NO: 1936716 - RNA, 14 nt, Homo sapiens
uggggccugugcac

SEQ ID NO: 1936717 - RNA, 17 nt, Homo sapiens
cauguuuuuucugcaau

SEQ ID NO: 1936718 - RNA, 18 nt, Homo sapiens
cugacuccaagcugcaug

SEQ ID NO: 1936719 - RNA, 14 nt, Homo sapiens
auguccacuuaaaa

SEQ ID NO: 1936720 - RNA, 23 nt, Homo sapiens
gaggacuuguuaaagagcacugg

SEQ ID NO: 1936721 - RNA, 15 nt, Homo sapiens
cuguguacacaagau

SEQ ID NO: 1936722 - RNA, 16 nt, Homo sapiens
ugcaaugacacagucu

SEQ ID NO: 1936723 - RNA, 18 nt, Homo sapiens
ccucccaaaguacuggga

SEQ ID NO: 1936724 - RNA, 14 nt, Homo sapiens
acuggagcuccgau

SEQ ID NO: 1936725 - RNA, 18 nt, Homo sapiens
gacaggacuaacacucag

SEQ ID NO: 1936726 - RNA, 21 nt, Homo sapiens
uccccaccugcacuccaucca

SEQ ID NO: 1936727 - RNA, 14 nt, Homo sapiens
agccuggcuccaaa

SEQ ID NO: 1936728 - RNA, 12 nt, Homo sapiens
guguauacaugu

SEQ ID NO: 1936729 - RNA, 21 nt, Homo sapiens
uauaagcccaauaucagcucu

SEQ ID NO: 1936730 - RNA, 13 nt, Homo sapiens
cuguaaugaaucu

SEQ ID NO: 1936731 - RNA, 13 nt, Homo sapiens
cugcuaugaauua

SEQ ID NO: 1936732 - RNA, 16 nt, Homo sapiens
cuucugccaccugccu

SEQ ID NO: 1936733 - RNA, 17 nt, Homo sapiens
aaggcaaagagaccacu

SEQ ID NO: 1936734 - RNA, 22 nt, Homo sapiens
uguaaaguugccuuuauuugcu

SEQ ID NO: 1936735 - RNA, 16 nt, Homo sapiens
gaccuaauaucauuuu

SEQ ID NO: 1936736 - RNA, 11 nt, Homo sapiens
uccagcacauc

SEQ ID NO: 1936737 - RNA, 20 nt, Homo sapiens
guccucccaauuucagacuc

SEQ ID NO: 1936738 - RNA, 23 nt, Homo sapiens
cagagaagcucucgggcuaggaa

SEQ ID NO: 1936739 - RNA, 23 nt, Homo sapiens
cuuugguccuggugcugccgagg

SEQ ID NO: 1936740 - RNA, 23 nt, Homo sapiens
cacugacuucuaaguaaaaccac

SEQ ID NO: 1936741 - RNA, 15 nt, Homo sapiens
gaggcaagaaccagu

SEQ ID NO: 1936742 - RNA, 13 nt, Homo sapiens
auguauaaauguu

SEQ ID NO: 1936743 - RNA, 13 nt, Homo sapiens
acauucaugcuca

SEQ ID NO: 1936744 - RNA, 19 nt, Homo sapiens
cacagaauaguuuacacac

SEQ ID NO: 1936745 - RNA, 15 nt, Homo sapiens
ccuauacacuagaca

SEQ ID NO: 1936746 - RNA, 19 nt, Homo sapiens
cacccaguaccgcaucucc

SEQ ID NO: 1936747 - RNA, 21 nt, Homo sapiens
cacugccagggguucuugagc

SEQ ID NO: 1936748 - RNA, 20 nt, Homo sapiens
uuucaacuugucucuauaau

SEQ ID NO: 1936749 - RNA, 15 nt, Homo sapiens
ugaugccguccugcu

SEQ ID NO: 1936750 - RNA, 15 nt, Homo sapiens
cacaugcuacaagac

SEQ ID NO: 1936751 - RNA, 17 nt, Homo sapiens
auuuguaauugaacuua

SEQ ID NO: 1936752 - RNA, 22 nt, Homo sapiens
ccagccuccagggcauugcuca

SEQ ID NO: 1936753 - RNA, 19 nt, Homo sapiens
aagugugccacauggacuu

SEQ ID NO: 1936754 - RNA, 14 nt, Homo sapiens
auuucacgcuuuua

SEQ ID NO: 1936755 - RNA, 18 nt, Homo sapiens
uucaguuaucacuacaga

SEQ ID NO: 1936756 - RNA, 17 nt, Homo sapiens
auauaaagaaauaccug

SEQ ID NO: 1936757 - RNA, 19 nt, Homo sapiens
ccauuucucacuaguguca

SEQ ID NO: 1936758 - RNA, 20 nt, Homo sapiens
ccaacauuccuuguuuguaa

SEQ ID NO: 1936759 - RNA, 18 nt, Homo sapiens
uaucuccugucuacaguu

SEQ ID NO: 1936760 - RNA, 14 nt, Homo sapiens
gaccccgucauggg

SEQ ID NO: 1936761 - RNA, 18 nt, Homo sapiens
cuugauguauugggguca

SEQ ID NO: 1936762 - RNA, 18 nt, Homo sapiens
caauauacauaauacaug

SEQ ID NO: 1936763 - RNA, 14 nt, Homo sapiens
ucugggaaguccua

SEQ ID NO: 1936764 - RNA, 12 nt, Homo sapiens
gaauccaagcuc

SEQ ID NO: 1936765 - RNA, 13 nt, Homo sapiens
acacccagggucu

SEQ ID NO: 1936766 - RNA, 23 nt, Homo sapiens
ccucacacugggacuugcaaaaa

SEQ ID NO: 1936767 - RNA, 19 nt, Homo sapiens
uccaccccuuguuccaucu

SEQ ID NO: 1936768 - RNA, 18 nt, Homo sapiens
cagcuggcacugucucug

SEQ ID NO: 1936769 - RNA, 21 nt, Homo sapiens
gaccacagcagggauugggau

SEQ ID NO: 1936770 - RNA, 13 nt, Homo sapiens
gacauaugcauuu

SEQ ID NO: 1936771 - RNA, 12 nt, Homo sapiens
uauuccugguca

SEQ ID NO: 1936772 - RNA, 17 nt, Homo sapiens
ugauuccccuaguugag

SEQ ID NO: 1936773 - RNA, 12 nt, Homo sapiens
ccagaauacuga

SEQ ID NO: 1936774 - RNA, 17 nt, Homo sapiens
gaaggaguuucacccug

SEQ ID NO: 1936775 - RNA, 17 nt, Homo sapiens
gaaggaucauucaaaag

SEQ ID NO: 1936776 - RNA, 20 nt, Homo sapiens
cuugaugccauaugccuugg

SEQ ID NO: 1936777 - RNA, 22 nt, Homo sapiens
caggucugcaggccaccagcug

SEQ ID NO: 1936778 - RNA, 18 nt, Homo sapiens
cccagaaugccuccugca

SEQ ID NO: 1936779 - RNA, 16 nt, Homo sapiens
cucccagggacaugua

SEQ ID NO: 1936780 - RNA, 11 nt, Homo sapiens
uagaagccaag

SEQ ID NO: 1936781 - RNA, 14 nt, Homo sapiens
gcugauugaagaca

SEQ ID NO: 1936782 - RNA, 12 nt, Homo sapiens
acuucuaugcaa

SEQ ID NO: 1936783 - RNA, 14 nt, Homo sapiens
gggacaguuuguaa

SEQ ID NO: 1936784 - RNA, 16 nt, Homo sapiens
uuucaccaaggaaaua

SEQ ID NO: 1936785 - RNA, 13 nt, Homo sapiens
caugcauuacuua

SEQ ID NO: 1936786 - RNA, 14 nt, Homo sapiens
ccuucaaugaauua

SEQ ID NO: 1936787 - RNA, 22 nt, Homo sapiens
ucccccuaaaccccugucccau

SEQ ID NO: 1936788 - RNA, 16 nt, Homo sapiens
gggcuuuggggcuggu

SEQ ID NO: 1936789 - RNA, 18 nt, Homo sapiens
ugaaguuugugggggcca

SEQ ID NO: 1936790 - RNA, 17 nt, Homo sapiens
ccuggaggaaucacugg

SEQ ID NO: 1936791 - RNA, 19 nt, Homo sapiens
uaacuaguguuucugcaga

SEQ ID NO: 1936792 - RNA, 20 nt, Homo sapiens
uccugcaacgcugccuuuca

SEQ ID NO: 1936793 - RNA, 12 nt, Homo sapiens
ccacccaaacag

SEQ ID NO: 1936794 - RNA, 11 nt, Homo sapiens
cuuccugauga

SEQ ID NO: 1936795 - RNA, 19 nt, Homo sapiens
ucgaacgcgugugugccug

SEQ ID NO: 1936796 - RNA, 20 nt, Homo sapiens
gauccaagcagccugagcaa

SEQ ID NO: 1936797 - RNA, 14 nt, Homo sapiens
cagaccaguacugg

SEQ ID NO: 1936798 - RNA, 15 nt, Homo sapiens
cagccuccaacucca

SEQ ID NO: 1936799 - RNA, 19 nt, Homo sapiens
cgaguaacuccccucaggg

SEQ ID NO: 1936800 - RNA, 17 nt, Homo sapiens
cugugcuguguuuaauc

SEQ ID NO: 1936801 - RNA, 22 nt, Homo sapiens
aacaccacuuugucucugagaa

SEQ ID NO: 1936802 - RNA, 13 nt, Homo sapiens
cucaccgccugcu

SEQ ID NO: 1936803 - RNA, 20 nt, Homo sapiens
aaaguucauaacagugccau

SEQ ID NO: 1936804 - RNA, 16 nt, Homo sapiens
uuuuuuggugguucug

SEQ ID NO: 1936805 - RNA, 14 nt, Homo sapiens
aaagccacaaggcu

SEQ ID NO: 1936806 - RNA, 14 nt, Homo sapiens
acuuuacaaaccau

SEQ ID NO: 1936807 - RNA, 17 nt, Homo sapiens
guuaccagagauuuacc

SEQ ID NO: 1936808 - RNA, 17 nt, Homo sapiens
cuaauagaacuuguuaa

SEQ ID NO: 1936809 - RNA, 19 nt, Homo sapiens
aguagauuuuaaagacaaa

SEQ ID NO: 1936810 - RNA, 14 nt, Homo sapiens
caugcccagccaau

SEQ ID NO: 1936811 - RNA, 17 nt, Homo sapiens
uauccuguuuucaugga

SEQ ID NO: 1936812 - RNA, 23 nt, Homo sapiens
uaagagacagagccuuguucuau

SEQ ID NO: 1936813 - RNA, 15 nt, Homo sapiens
cuggggaaggaccaa

SEQ ID NO: 1936814 - RNA, 12 nt, Homo sapiens
uaguuugcacuu

SEQ ID NO: 1936815 - RNA, 17 nt, Homo sapiens
acuaaauuugauacuua

SEQ ID NO: 1936816 - RNA, 20 nt, Homo sapiens
cgcaccuaaccacuggucau

SEQ ID NO: 1936817 - RNA, 17 nt, Homo sapiens
uacaaguaaagcccaga

SEQ ID NO: 1936818 - RNA, 19 nt, Homo sapiens
gcauuccuuacuugcacug

SEQ ID NO: 1936819 - RNA, 14 nt, Homo sapiens
cgcuuccuccggcu

SEQ ID NO: 1936820 - RNA, 13 nt, Homo sapiens
gaugaaacauuca

SEQ ID NO: 1936821 - RNA, 23 nt, Homo sapiens
ugaagucaugcguuuaaucacau

SEQ ID NO: 1936822 - RNA, 16 nt, Homo sapiens
ucccgccucccgccac

SEQ ID NO: 1936823 - RNA, 14 nt, Homo sapiens
ccucaaacauuuau

SEQ ID NO: 1936824 - RNA, 15 nt, Homo sapiens
agaugcucugugaaa

SEQ ID NO: 1936825 - RNA, 20 nt, Homo sapiens
auguuccuuucgaaagcaau

SEQ ID NO: 1936826 - RNA, 22 nt, Homo sapiens
aggcaguauuauugagcucuau

SEQ ID NO: 1936827 - RNA, 22 nt, Homo sapiens
aaaauccuauaucuguuuguau

SEQ ID NO: 1936828 - RNA, 12 nt, Homo sapiens
auuccuaugcca

SEQ ID NO: 1936829 - RNA, 14 nt, Homo sapiens
uguaaucauauaau

SEQ ID NO: 1936830 - RNA, 12 nt, Homo sapiens
auuucuagacag

SEQ ID NO: 1936831 - RNA, 22 nt, Homo sapiens
uaaguagcuggguuuacaggca

SEQ ID NO: 1936832 - RNA, 14 nt, Homo sapiens
cagaaauccaucua

SEQ ID NO: 1936833 - RNA, 22 nt, Homo sapiens
aggaguacaccccaacagcacc

SEQ ID NO: 1936834 - RNA, 11 nt, Homo sapiens
auuuucaccuc

SEQ ID NO: 1936835 - RNA, 12 nt, Homo sapiens
uguccuuucuca

SEQ ID NO: 1936836 - RNA, 14 nt, Homo sapiens
aacauugcugccua

SEQ ID NO: 1936837 - RNA, 21 nt, Homo sapiens
ugcugacuccacgauccugcc

SEQ ID NO: 1936838 - RNA, 14 nt, Homo sapiens
gaaucacucuugug

SEQ ID NO: 1936839 - RNA, 20 nt, Homo sapiens
accucuuugucccagaguua

SEQ ID NO: 1936840 - RNA, 23 nt, Homo sapiens
uuuucacgggaacucuccaaaua

SEQ ID NO: 1936841 - RNA, 16 nt, Homo sapiens
ccuugcugaccuccca

SEQ ID NO: 1936842 - RNA, 17 nt, Homo sapiens
gauuaagggacauuucu

SEQ ID NO: 1936843 - RNA, 17 nt, Homo sapiens
cuccauauuuauuuaaa

SEQ ID NO: 1936844 - RNA, 17 nt, Homo sapiens
aaaggucacacuaccau

SEQ ID NO: 1936845 - RNA, 11 nt, Homo sapiens
aauacagugag

SEQ ID NO: 1936846 - RNA, 13 nt, Homo sapiens
aauacagaaucaa

SEQ ID NO: 1936847 - RNA, 15 nt, Homo sapiens
gguugcacguuaaaa

SEQ ID NO: 1936848 - RNA, 14 nt, Homo sapiens
cugaauguccugac

SEQ ID NO: 1936849 - RNA, 20 nt, Homo sapiens
caccacgguggucacuggaa

SEQ ID NO: 1936850 - RNA, 16 nt, Homo sapiens
ucaauacuuacauauc

SEQ ID NO: 1936851 - RNA, 15 nt, Homo sapiens
ugugcagcuucgagg

SEQ ID NO: 1936852 - RNA, 12 nt, Homo sapiens
auuucaaaggga

SEQ ID NO: 1936853 - RNA, 18 nt, Homo sapiens
acucucccuuguccuccu

SEQ ID NO: 1936854 - RNA, 16 nt, Homo sapiens
uccucaguaacauuuc

SEQ ID NO: 1936855 - RNA, 21 nt, Homo sapiens
gagcauucagacuccaaacag

SEQ ID NO: 1936856 - RNA, 22 nt, Homo sapiens
ggaaucuucuccaguaugaaau

SEQ ID NO: 1936857 - RNA, 13 nt, Homo sapiens
cauuucuaaggug

SEQ ID NO: 1936858 - RNA, 15 nt, Homo sapiens
auaaagccacuucug

SEQ ID NO: 1936859 - RNA, 19 nt, Homo sapiens
uauauguauaucuguguaa

SEQ ID NO: 1936860 - RNA, 21 nt, Homo sapiens
guaaaucuuugugaacauucu

SEQ ID NO: 1936861 - RNA, 21 nt, Homo sapiens
ggaagccaaaccucugugagc

SEQ ID NO: 1936862 - RNA, 15 nt, Homo sapiens
accccauaccccuua

SEQ ID NO: 1936863 - RNA, 17 nt, Homo sapiens
acucugcaucagcacug

SEQ ID NO: 1936864 - RNA, 13 nt, Homo sapiens
acugaugagacaa

SEQ ID NO: 1936865 - RNA, 17 nt, Homo sapiens
ugcaucuuccacuggaa

SEQ ID NO: 1936866 - RNA, 16 nt, Homo sapiens
gcccacccccugcugg

SEQ ID NO: 1936867 - RNA, 18 nt, Homo sapiens
cagucugauauucaccua

SEQ ID NO: 1936868 - RNA, 14 nt, Homo sapiens
agugugagcagggc

SEQ ID NO: 1936869 - RNA, 15 nt, Homo sapiens
ucccaauagcacuuu

SEQ ID NO: 1936870 - RNA, 14 nt, Homo sapiens
aaccuccagccucc

SEQ ID NO: 1936871 - RNA, 16 nt, Homo sapiens
uugugguggugcuaaa

SEQ ID NO: 1936872 - RNA, 14 nt, Homo sapiens
aaaaugcagccuua

SEQ ID NO: 1936873 - RNA, 20 nt, Homo sapiens
gugugugggcacguguggau

SEQ ID NO: 1936874 - RNA, 17 nt, Homo sapiens
ucuugcauugacauuau

SEQ ID NO: 1936875 - RNA, 13 nt, Homo sapiens
ggcacacuacaga

SEQ ID NO: 1936876 - RNA, 16 nt, Homo sapiens
auuaaccacuucagcu

SEQ ID NO: 1936877 - RNA, 16 nt, Homo sapiens
aucacugaucuuguca

SEQ ID NO: 1936878 - RNA, 22 nt, Homo sapiens
ugcagcauggucccugccuuag

SEQ ID NO: 1936879 - RNA, 17 nt, Homo sapiens
caucacaaccagauuug

SEQ ID NO: 1936880 - RNA, 22 nt, Homo sapiens
cgucaggagcagcaucauucag

SEQ ID NO: 1936881 - RNA, 16 nt, Homo sapiens
uacuaagauacuccau

SEQ ID NO: 1936882 - RNA, 16 nt, Homo sapiens
aguuucccacauucca

SEQ ID NO: 1936883 - RNA, 19 nt, Homo sapiens
caaaggcaccugaaugugu

SEQ ID NO: 1936884 - RNA, 22 nt, Homo sapiens
gaaucaguccuagaauguuuca

SEQ ID NO: 1936885 - RNA, 17 nt, Homo sapiens
gaacccaacaguucaug

SEQ ID NO: 1936886 - RNA, 23 nt, Homo sapiens
acaaagauauuuguacuuugaca

SEQ ID NO: 1936887 - RNA, 17 nt, Homo sapiens
aaagcugacaucuguaa

SEQ ID NO: 1936888 - RNA, 12 nt, Homo sapiens
gccuccaagaaa

SEQ ID NO: 1936889 - RNA, 15 nt, Homo sapiens
auauaaaguguaaua

SEQ ID NO: 1936890 - RNA, 20 nt, Homo sapiens
uguaucuguaauuaauauuc

SEQ ID NO: 1936891 - RNA, 21 nt, Homo sapiens
ucuccccucccuuguccuuga

SEQ ID NO: 1936892 - RNA, 18 nt, Homo sapiens
acauacuuuuucaagauu

SEQ ID NO: 1936893 - RNA, 13 nt, Homo sapiens
agaacucccacaa

SEQ ID NO: 1936894 - RNA, 21 nt, Homo sapiens
cguguguguugucugaacaug

SEQ ID NO: 1936895 - RNA, 18 nt, Homo sapiens
gagagggaagagugcauu

SEQ ID NO: 1936896 - RNA, 16 nt, Homo sapiens
aaaaauaaacacuucc

SEQ ID NO: 1936897 - RNA, 16 nt, Homo sapiens
ccuggcugaugaucca

SEQ ID NO: 1936898 - RNA, 16 nt, Homo sapiens
ugcaagauuguuuuca

SEQ ID NO: 1936899 - RNA, 17 nt, Homo sapiens
aacagcuugcugucacu

SEQ ID NO: 1936900 - RNA, 17 nt, Homo sapiens
cauaaaaagcagaauuu

SEQ ID NO: 1936901 - RNA, 15 nt, Homo sapiens
cugcuucucuuucac

SEQ ID NO: 1936902 - RNA, 18 nt, Homo sapiens
ugucccccuacccaccga

SEQ ID NO: 1936903 - RNA, 13 nt, Homo sapiens
uacaucaaagagu

SEQ ID NO: 1936904 - RNA, 19 nt, Homo sapiens
agcuuuuauggaugauuaa

SEQ ID NO: 1936905 - RNA, 13 nt, Homo sapiens
auguccaggaaag

SEQ ID NO: 1936906 - RNA, 23 nt, Homo sapiens
gcucccaagggauggugcccugu

SEQ ID NO: 1936907 - RNA, 17 nt, Homo sapiens
uagaacaucccugggca

SEQ ID NO: 1936908 - RNA, 11 nt, Homo sapiens
agagcccucca

SEQ ID NO: 1936909 - RNA, 20 nt, Homo sapiens
aagagaucacaauacucaaa

SEQ ID NO: 1936910 - RNA, 19 nt, Homo sapiens
acuccaaaccuuacucuga

SEQ ID NO: 1936911 - RNA, 15 nt, Homo sapiens
guaaucuaaguauau

SEQ ID NO: 1936912 - RNA, 15 nt, Homo sapiens
cuuaacugugugaag

SEQ ID NO: 1936913 - RNA, 19 nt, Homo sapiens
uuuuauauucuaagccagu

SEQ ID NO: 1936914 - RNA, 17 nt, Homo sapiens
uaguugcugucauccac

SEQ ID NO: 1936915 - RNA, 22 nt, Homo sapiens
uacaaguaauauuauuacuuua

SEQ ID NO: 1936916 - RNA, 18 nt, Homo sapiens
caaagugcggcugccauu

SEQ ID NO: 1936917 - RNA, 21 nt, Homo sapiens
gcuccccuuggaccuccaggg

SEQ ID NO: 1936918 - RNA, 21 nt, Homo sapiens
cagcuuaagaguccaacucac

SEQ ID NO: 1936919 - RNA, 20 nt, Homo sapiens
aucauggaucaaccaaguua

SEQ ID NO: 1936920 - RNA, 24 nt, Homo sapiens
auuuugugaauuugggacauaaua

SEQ ID NO: 1936921 - RNA, 16 nt, Homo sapiens
ugagacuccaccucaa

SEQ ID NO: 1936922 - RNA, 18 nt, Homo sapiens
acugagaaauuauacuua

SEQ ID NO: 1936923 - RNA, 17 nt, Homo sapiens
aacaucaguucaugccu

SEQ ID NO: 1936924 - RNA, 22 nt, Homo sapiens
ugcaugauuuuauacauaguca

SEQ ID NO: 1936925 - RNA, 17 nt, Homo sapiens
augucagaagugcagaa

SEQ ID NO: 1936926 - RNA, 19 nt, Homo sapiens
uugagcagaagaucaagga

SEQ ID NO: 1936927 - RNA, 20 nt, Homo sapiens
uuauugcaucuguuauucac

SEQ ID NO: 1936928 - RNA, 24 nt, Homo sapiens
aauaaaacuauuuaaaauuggcac

SEQ ID NO: 1936929 - RNA, 16 nt, Homo sapiens
agcaggugcugggcug

SEQ ID NO: 1936930 - RNA, 22 nt, Homo sapiens
ugccuaucuuuaaacauuucaa

SEQ ID NO: 1936931 - RNA, 14 nt, Homo sapiens
uccaugccuuccau

SEQ ID NO: 1936932 - RNA, 20 nt, Homo sapiens
cacaagcaacagacucucac

SEQ ID NO: 1936933 - RNA, 19 nt, Homo sapiens
ccuucucuacacucuugua

SEQ ID NO: 1936934 - RNA, 15 nt, Homo sapiens
acaugcuuaccagau

SEQ ID NO: 1936935 - RNA, 21 nt, Homo sapiens
agcacauuuuaaaagugccau

SEQ ID NO: 1936936 - RNA, 13 nt, Homo sapiens
cccuugcuucuca

SEQ ID NO: 1936937 - RNA, 16 nt, Homo sapiens
aauaaaugaacugacu

SEQ ID NO: 1936938 - RNA, 13 nt, Homo sapiens
ccugugagggagu

SEQ ID NO: 1936939 - RNA, 11 nt, Homo sapiens
aaaacuacuga

SEQ ID NO: 1936940 - RNA, 22 nt, Homo sapiens
ggcggaucuuuggacagaagca

SEQ ID NO: 1936941 - RNA, 19 nt, Homo sapiens
ccugacccacaggaacugg

SEQ ID NO: 1936942 - RNA, 20 nt, Homo sapiens
uaaaacauugaauuguagua

SEQ ID NO: 1936943 - RNA, 21 nt, Homo sapiens
gaacauuucaguugccauuga

SEQ ID NO: 1936944 - RNA, 23 nt, Homo sapiens
auuuacaagaagaacucaccagg

SEQ ID NO: 1936945 - RNA, 15 nt, Homo sapiens
uccuccaucuagaga

SEQ ID NO: 1936946 - RNA, 19 nt, Homo sapiens
agccuggccccugugcacc

SEQ ID NO: 1936947 - RNA, 15 nt, Homo sapiens
acuguggccuggcau

SEQ ID NO: 1936948 - RNA, 13 nt, Homo sapiens
gaguccacuccca

SEQ ID NO: 1936949 - RNA, 19 nt, Homo sapiens
aguggggagacuucuuggc

SEQ ID NO: 1936950 - RNA, 14 nt, Homo sapiens
uuuccugcuccagu

SEQ ID NO: 1936951 - RNA, 14 nt, Homo sapiens
caaauguauagaau

SEQ ID NO: 1936952 - RNA, 20 nt, Homo sapiens
uagaauauuuauuaccucug

SEQ ID NO: 1936953 - RNA, 18 nt, Homo sapiens
aaagcaacagacuucuca

SEQ ID NO: 1936954 - RNA, 22 nt, Homo sapiens
auuacaaggucagagagaggaa

SEQ ID NO: 1936955 - RNA, 19 nt, Homo sapiens
augaacacaaauguguauu

SEQ ID NO: 1936956 - RNA, 18 nt, Homo sapiens
caacgcuuuuuuggauca

SEQ ID NO: 1936957 - RNA, 15 nt, Homo sapiens
ugagagagacaggca

SEQ ID NO: 1936958 - RNA, 18 nt, Homo sapiens
auuuuaaacauauccaag

SEQ ID NO: 1936959 - RNA, 17 nt, Homo sapiens
cucagcaacagccagug

SEQ ID NO: 1936960 - RNA, 22 nt, Homo sapiens
uuuagguugcacauucacugaa

SEQ ID NO: 1936961 - RNA, 17 nt, Homo sapiens
gacuuugauagauuucu

SEQ ID NO: 1936962 - RNA, 14 nt, Homo sapiens
guugagaacaaaaa

SEQ ID NO: 1936963 - RNA, 15 nt, Homo sapiens
agggagaaggcaggu

SEQ ID NO: 1936964 - RNA, 20 nt, Homo sapiens
cuuccaauaguuagaucuac

SEQ ID NO: 1936965 - RNA, 15 nt, Homo sapiens
uggauaacuuuacag

SEQ ID NO: 1936966 - RNA, 14 nt, Homo sapiens
ccuucuuuccagag

SEQ ID NO: 1936967 - RNA, 20 nt, Homo sapiens
gccagaaucagguuuccaau

SEQ ID NO: 1936968 - RNA, 18 nt, Homo sapiens
uucugaaucaccuaccuu

SEQ ID NO: 1936969 - RNA, 20 nt, Homo sapiens
cuuucuucccuacaguugaa

SEQ ID NO: 1936970 - RNA, 14 nt, Homo sapiens
aaccgagcaauuuu

SEQ ID NO: 1936971 - RNA, 19 nt, Homo sapiens
cugcuuccgagauccccag

SEQ ID NO: 1936972 - RNA, 16 nt, Homo sapiens
auacguuucuguggag

SEQ ID NO: 1936973 - RNA, 17 nt, Homo sapiens
aucacauuccucugccc

SEQ ID NO: 1936974 - RNA, 12 nt, Homo sapiens
guacaacacugg

SEQ ID NO: 1936975 - RNA, 13 nt, Homo sapiens
ugugcccugacca

SEQ ID NO: 1936976 - RNA, 22 nt, Homo sapiens
aguccagcccuggaucucccaa

SEQ ID NO: 1936977 - RNA, 22 nt, Homo sapiens
cuccaagcgcgguuacuauggc

SEQ ID NO: 1936978 - RNA, 20 nt, Homo sapiens
gcacauauacacauuuucaa

SEQ ID NO: 1936979 - RNA, 12 nt, Homo sapiens
caguguuuccaa

SEQ ID NO: 1936980 - RNA, 17 nt, Homo sapiens
auugcagccccucagcc

SEQ ID NO: 1936981 - RNA, 15 nt, Homo sapiens
aggcguagggccagg

SEQ ID NO: 1936982 - RNA, 16 nt, Homo sapiens
auggcaccaucuuggc

SEQ ID NO: 1936983 - RNA, 14 nt, Homo sapiens
uucuggacacuguc

SEQ ID NO: 1936984 - RNA, 15 nt, Homo sapiens
uaucaaauacauuua

SEQ ID NO: 1936985 - RNA, 20 nt, Homo sapiens
aaauuggcuaaucaguauac

SEQ ID NO: 1936986 - RNA, 18 nt, Homo sapiens
ucgcucccgggacucacu

SEQ ID NO: 1936987 - RNA, 14 nt, Homo sapiens
auuuuugugcacau

SEQ ID NO: 1936988 - RNA, 20 nt, Homo sapiens
gaaucugcugagaggcacca

SEQ ID NO: 1936989 - RNA, 13 nt, Homo sapiens
gccugaggugccc

SEQ ID NO: 1936990 - RNA, 17 nt, Homo sapiens
uguuuuuacaguggaau

SEQ ID NO: 1936991 - RNA, 13 nt, Homo sapiens
gugaauuauaugu

SEQ ID NO: 1936992 - RNA, 19 nt, Homo sapiens
ugagggaagaggaucucca

SEQ ID NO: 1936993 - RNA, 22 nt, Homo sapiens
agaggugccggggaggggcaga

SEQ ID NO: 1936994 - RNA, 12 nt, Homo sapiens
agcaugcacaug

SEQ ID NO: 1936995 - RNA, 15 nt, Homo sapiens
aucuguacauacugu

SEQ ID NO: 1936996 - RNA, 13 nt, Homo sapiens
aauaaacccucag

SEQ ID NO: 1936997 - RNA, 16 nt, Homo sapiens
cagcccaggcagagau

SEQ ID NO: 1936998 - RNA, 16 nt, Homo sapiens
cauugacagcaauuca

SEQ ID NO: 1936999 - RNA, 21 nt, Homo sapiens
cuuuggaauguugaauugcau

SEQ ID NO: 1937000 - RNA, 17 nt, Homo sapiens
uggcuucgucauuugca

SEQ ID NO: 1937001 - RNA, 15 nt, Homo sapiens
caaaccacuguacau

SEQ ID NO: 1937002 - RNA, 12 nt, Homo sapiens
uguacguaaugu

SEQ ID NO: 1937003 - RNA, 14 nt, Homo sapiens
ggggccuguuacac

SEQ ID NO: 1937004 - RNA, 21 nt, Homo sapiens
uagagguccucaugggucccu

SEQ ID NO: 1937005 - RNA, 18 nt, Homo sapiens
gagcucagagaggcuaga

SEQ ID NO: 1937006 - RNA, 17 nt, Homo sapiens
cagaaacuaagaaucau

SEQ ID NO: 1937007 - RNA, 12 nt, Homo sapiens
ucugcuguagaa

SEQ ID NO: 1937008 - RNA, 18 nt, Homo sapiens
gaaagauaggacuaaagu

SEQ ID NO: 1937009 - RNA, 21 nt, Homo sapiens
gcuaugaacagaaacuacauu

SEQ ID NO: 1937010 - RNA, 13 nt, Homo sapiens
caugcaugugcuu

SEQ ID NO: 1937011 - RNA, 15 nt, Homo sapiens
agcaggaacuuugcc

SEQ ID NO: 1937012 - RNA, 15 nt, Homo sapiens
uagaagaaaguaaaa

SEQ ID NO: 1937013 - RNA, 22 nt, Homo sapiens
cauaguuucaaaucuguaauca

SEQ ID NO: 1937014 - RNA, 18 nt, Homo sapiens
acaagaguuucaaaacau

SEQ ID NO: 1937015 - RNA, 15 nt, Homo sapiens
aaacuuuuuguucau

SEQ ID NO: 1937016 - RNA, 16 nt, Homo sapiens
caacauccuuaaguca

SEQ ID NO: 1937017 - RNA, 15 nt, Homo sapiens
gaccagucacucccu

SEQ ID NO: 1937018 - RNA, 19 nt, Homo sapiens
cgcuugcuggccaguccac

SEQ ID NO: 1937019 - RNA, 17 nt, Homo sapiens
ccucaagacucaccuca

SEQ ID NO: 1937020 - RNA, 16 nt, Homo sapiens
uggccacagacagcuu

SEQ ID NO: 1937021 - RNA, 16 nt, Homo sapiens
ggcuuuguugcuggaa

SEQ ID NO: 1937022 - RNA, 14 nt, Homo sapiens
cugaaaaugcaaag

SEQ ID NO: 1937023 - RNA, 16 nt, Homo sapiens
cccagagcacuuugca

SEQ ID NO: 1937024 - RNA, 14 nt, Homo sapiens
ccuccaccagugug

SEQ ID NO: 1937025 - RNA, 17 nt, Homo sapiens
acuaugguucccaauaa

SEQ ID NO: 1937026 - RNA, 19 nt, Homo sapiens
accuggcagccacaacugc

SEQ ID NO: 1937027 - RNA, 15 nt, Homo sapiens
uaaguaagucucaag

SEQ ID NO: 1937028 - RNA, 12 nt, Homo sapiens
ccucaguuauac

SEQ ID NO: 1937029 - RNA, 14 nt, Homo sapiens
auaaucauggcucu

SEQ ID NO: 1937030 - RNA, 14 nt, Homo sapiens
accacaccaggcug

SEQ ID NO: 1937031 - RNA, 22 nt, Homo sapiens
aaggucggaccagcuuuuccca

SEQ ID NO: 1937032 - RNA, 15 nt, Homo sapiens
ugugcaaaugugcug

SEQ ID NO: 1937033 - RNA, 15 nt, Homo sapiens
cucagugacucagaa

SEQ ID NO: 1937034 - RNA, 15 nt, Homo sapiens
ggggcugaggggcaa

SEQ ID NO: 1937035 - RNA, 15 nt, Homo sapiens
ucugcccuagggaga

SEQ ID NO: 1937036 - RNA, 15 nt, Homo sapiens
ugacagcucuuacca

SEQ ID NO: 1937037 - RNA, 15 nt, Homo sapiens
gccuuuaagaaccuu

SEQ ID NO: 1937038 - RNA, 20 nt, Homo sapiens
gugaucuaucaauagucaag

SEQ ID NO: 1937039 - RNA, 18 nt, Homo sapiens
gggcagucggcuccucaa

SEQ ID NO: 1937040 - RNA, 12 nt, Homo sapiens
cagugaugacua

SEQ ID NO: 1937041 - RNA, 21 nt, Homo sapiens
acagggugacucacagccgca

SEQ ID NO: 1937042 - RNA, 16 nt, Homo sapiens
ccugcaaucccagcua

SEQ ID NO: 1937043 - RNA, 15 nt, Homo sapiens
gguaauuuucuuuga

SEQ ID NO: 1937044 - RNA, 18 nt, Homo sapiens
cgguucaaaccugugaag

SEQ ID NO: 1937045 - RNA, 19 nt, Homo sapiens
aggaagccggugucccugg

SEQ ID NO: 1937046 - RNA, 15 nt, Homo sapiens
gcugguagcucaggu

SEQ ID NO: 1937047 - RNA, 19 nt, Homo sapiens
aucagaaaaagcaguauua

SEQ ID NO: 1937048 - RNA, 23 nt, Homo sapiens
gaagaaccugacauccacuguuu

SEQ ID NO: 1937049 - RNA, 19 nt, Homo sapiens
agugagagucucccuccau

SEQ ID NO: 1937050 - RNA, 14 nt, Homo sapiens
accaagcugugacc

SEQ ID NO: 1937051 - RNA, 16 nt, Homo sapiens
ugagagacacacugaa

SEQ ID NO: 1937052 - RNA, 21 nt, Homo sapiens
gccuccacagcgagggcagcu

SEQ ID NO: 1937053 - RNA, 17 nt, Homo sapiens
aacuaggugcauauuua

SEQ ID NO: 1937054 - RNA, 16 nt, Homo sapiens
guugguggggggucca

SEQ ID NO: 1937055 - RNA, 14 nt, Homo sapiens
uuaaaaugugaaga

SEQ ID NO: 1937056 - RNA, 13 nt, Homo sapiens
uggcuugaugucc

SEQ ID NO: 1937057 - RNA, 23 nt, Homo sapiens
ugaaacuuguuuauuauguacaa

SEQ ID NO: 1937058 - RNA, 17 nt, Homo sapiens
ccccacagagacacuuu

SEQ ID NO: 1937059 - RNA, 21 nt, Homo sapiens
cagagaagguaaggugugaac

SEQ ID NO: 1937060 - RNA, 18 nt, Homo sapiens
gugauucgcccaccucag

SEQ ID NO: 1937061 - RNA, 14 nt, Homo sapiens
uggugcuuacagga

SEQ ID NO: 1937062 - RNA, 15 nt, Homo sapiens
ugguccaccuccuga

SEQ ID NO: 1937063 - RNA, 22 nt, Homo sapiens
gacgggacagccuucagcugca

SEQ ID NO: 1937064 - RNA, 20 nt, Homo sapiens
gagaaccauaggacuguggc

SEQ ID NO: 1937065 - RNA, 15 nt, Homo sapiens
auuauuccuccagga

SEQ ID NO: 1937066 - RNA, 19 nt, Homo sapiens
uuccacaaagaaaauuccu

SEQ ID NO: 1937067 - RNA, 13 nt, Homo sapiens
ccuuuccugauga

SEQ ID NO: 1937068 - RNA, 21 nt, Homo sapiens
cuauuucuuuuuuaagucaaa

SEQ ID NO: 1937069 - RNA, 21 nt, Homo sapiens
gugaaaaaucuuaaguaccaa

SEQ ID NO: 1937070 - RNA, 21 nt, Homo sapiens
cguagccaucuccguggccaa

SEQ ID NO: 1937071 - RNA, 12 nt, Homo sapiens
aggcaagcacuu

SEQ ID NO: 1937072 - RNA, 12 nt, Homo sapiens
uggcaagcucuu

SEQ ID NO: 1937073 - RNA, 15 nt, Homo sapiens
ccuucggcagcuacu

SEQ ID NO: 1937074 - RNA, 23 nt, Homo sapiens
acauccugcuuucccuccccaaa

SEQ ID NO: 1937075 - RNA, 19 nt, Homo sapiens
acugagguugggguguacu

SEQ ID NO: 1937076 - RNA, 15 nt, Homo sapiens
cagggaagcccagcu

SEQ ID NO: 1937077 - RNA, 21 nt, Homo sapiens
caacuaaugagggaaaucugu

SEQ ID NO: 1937078 - RNA, 21 nt, Homo sapiens
uaccuggcagcaaacugcugc

SEQ ID NO: 1937079 - RNA, 18 nt, Homo sapiens
acugaaaaucuggugcuc

SEQ ID NO: 1937080 - RNA, 18 nt, Homo sapiens
gagauguggaaaagccaa

SEQ ID NO: 1937081 - RNA, 23 nt, Homo sapiens
aucucuacaaaaaauaaaaacac

SEQ ID NO: 1937082 - RNA, 23 nt, Homo sapiens
acuaguuuuuccuaucauguuaa

SEQ ID NO: 1937083 - RNA, 16 nt, Homo sapiens
cugauuacacaaaaca

SEQ ID NO: 1937084 - RNA, 15 nt, Homo sapiens
ggcuuucccaacagc

SEQ ID NO: 1937085 - RNA, 16 nt, Homo sapiens
aaaccuaggucuccag

SEQ ID NO: 1937086 - RNA, 12 nt, Homo sapiens
cuuaacugucac

SEQ ID NO: 1937087 - RNA, 12 nt, Homo sapiens
uuuaugguucuc

SEQ ID NO: 1937088 - RNA, 16 nt, Homo sapiens
agcuccccggcacugc

SEQ ID NO: 1937089 - RNA, 17 nt, Homo sapiens
auuuaaguaauuuugcc

SEQ ID NO: 1937090 - RNA, 16 nt, Homo sapiens
acauccccaccuucca

SEQ ID NO: 1937091 - RNA, 23 nt, Homo sapiens
gugugaauguagcuuccaccuca

SEQ ID NO: 1937092 - RNA, 13 nt, Homo sapiens
aaaaauugacuua

SEQ ID NO: 1937093 - RNA, 23 nt, Homo sapiens
uucucucccaggggcuggcuuca

SEQ ID NO: 1937094 - RNA, 17 nt, Homo sapiens
auuaucacgcagaucac

SEQ ID NO: 1937095 - RNA, 21 nt, Homo sapiens
agcagggcuauauuucaguga

SEQ ID NO: 1937096 - RNA, 15 nt, Homo sapiens
uaccucuauauacca

SEQ ID NO: 1937097 - RNA, 18 nt, Homo sapiens
uaaacacauacauugcca

SEQ ID NO: 1937098 - RNA, 14 nt, Homo sapiens
acucagaacccagg

SEQ ID NO: 1937099 - RNA, 14 nt, Homo sapiens
caucagaaaacagg

SEQ ID NO: 1937100 - RNA, 17 nt, Homo sapiens
gccacacuggaauccag

SEQ ID NO: 1937101 - RNA, 22 nt, Homo sapiens
ucaaaacuuucguuguuauuau

SEQ ID NO: 1937102 - RNA, 13 nt, Homo sapiens
ucuuucuuuccaa

SEQ ID NO: 1937103 - RNA, 13 nt, Homo sapiens
auuaucuuaucua

SEQ ID NO: 1937104 - RNA, 13 nt, Homo sapiens
gacuacuugauau

SEQ ID NO: 1937105 - RNA, 17 nt, Homo sapiens
ggcaucucugagcaauu

SEQ ID NO: 1937106 - RNA, 15 nt, Homo sapiens
aaaccaaccagcuga

SEQ ID NO: 1937107 - RNA, 20 nt, Homo sapiens
ggcaaggaauuuucaccucc

SEQ ID NO: 1937108 - RNA, 19 nt, Homo sapiens
cuucuaaauuauaccauga

SEQ ID NO: 1937109 - RNA, 15 nt, Homo sapiens
aaaaauuacugugaa

SEQ ID NO: 1937110 - RNA, 13 nt, Homo sapiens
auacauuaugcuu

SEQ ID NO: 1937111 - RNA, 13 nt, Homo sapiens
cuaucucacugcu

SEQ ID NO: 1937112 - RNA, 13 nt, Homo sapiens
acaacagcaucuu

SEQ ID NO: 1937113 - RNA, 17 nt, Homo sapiens
gacgcaccuugcugcag

SEQ ID NO: 1937114 - RNA, 13 nt, Homo sapiens
augugaugcccuc

SEQ ID NO: 1937115 - RNA, 14 nt, Homo sapiens
acacagaggaccca

SEQ ID NO: 1937116 - RNA, 20 nt, Homo sapiens
ccuccccuggggacagcaag

SEQ ID NO: 1937117 - RNA, 12 nt, Homo sapiens
gaaaaucuuaca

SEQ ID NO: 1937118 - RNA, 15 nt, Homo sapiens
cgagugugauuugaa

SEQ ID NO: 1937119 - RNA, 11 nt, Homo sapiens
ccauggcacug

SEQ ID NO: 1937120 - RNA, 15 nt, Homo sapiens
caaaguaacagccuu

SEQ ID NO: 1937121 - RNA, 15 nt, Homo sapiens
cuauguguaugcaag

SEQ ID NO: 1937122 - RNA, 15 nt, Homo sapiens
aaacguuucaguaau

SEQ ID NO: 1937123 - RNA, 19 nt, Homo sapiens
gacaccugcccagugggcc

SEQ ID NO: 1937124 - RNA, 21 nt, Homo sapiens
caaaggaugugauauauaagu

SEQ ID NO: 1937125 - RNA, 11 nt, Homo sapiens
ucggaugucag

SEQ ID NO: 1937126 - RNA, 13 nt, Homo sapiens
aaguuuauuucca

SEQ ID NO: 1937127 - RNA, 22 nt, Homo sapiens
uuuaaauauauauuauucucau

SEQ ID NO: 1937128 - RNA, 22 nt, Homo sapiens
cacccuuuccucuuaauuccca

SEQ ID NO: 1937129 - RNA, 22 nt, Homo sapiens
caaagacuacauauugucacug

SEQ ID NO: 1937130 - RNA, 22 nt, Homo sapiens
uacaaguuuucauaagcacacu

SEQ ID NO: 1937131 - RNA, 18 nt, Homo sapiens
caugacuuuauauggaug

SEQ ID NO: 1937132 - RNA, 15 nt, Homo sapiens
gaugacagugaugcu

SEQ ID NO: 1937133 - RNA, 17 nt, Homo sapiens
aaaaaucaggagauucc

SEQ ID NO: 1937134 - RNA, 11 nt, Homo sapiens
aagaucuuuca

SEQ ID NO: 1937135 - RNA, 13 nt, Homo sapiens
uagggcugagcac

SEQ ID NO: 1937136 - RNA, 21 nt, Homo sapiens
ugaugccaugggcccucucag

SEQ ID NO: 1937137 - RNA, 16 nt, Homo sapiens
aaccaaggaaagugaa

SEQ ID NO: 1937138 - RNA, 15 nt, Homo sapiens
cagugcccaucuucc

SEQ ID NO: 1937139 - RNA, 13 nt, Homo sapiens
uguuaagcaauuc

SEQ ID NO: 1937140 - RNA, 22 nt, Homo sapiens
cagacauaaaggaaaagacaca

SEQ ID NO: 1937141 - RNA, 12 nt, Homo sapiens
agacacugugca

SEQ ID NO: 1937142 - RNA, 17 nt, Homo sapiens
cauuaauacuguaguua

SEQ ID NO: 1937143 - RNA, 16 nt, Homo sapiens
auccaaauuaaaggaa

SEQ ID NO: 1937144 - RNA, 15 nt, Homo sapiens
auuuuauagcuacua

SEQ ID NO: 1937145 - RNA, 12 nt, Homo sapiens
ugucaaugucuu

SEQ ID NO: 1937146 - RNA, 21 nt, Homo sapiens
cuuugaaguggcaccuaauaa

SEQ ID NO: 1937147 - RNA, 22 nt, Homo sapiens
agugguaaaaguauuugcuuaa

SEQ ID NO: 1937148 - RNA, 19 nt, Homo sapiens
agcuugccguaggauuugg

SEQ ID NO: 1937149 - RNA, 19 nt, Homo sapiens
gcccagggacacccacaca

SEQ ID NO: 1937150 - RNA, 18 nt, Homo sapiens
auagaagagaaaugcugc

SEQ ID NO: 1937151 - RNA, 14 nt, Homo sapiens
uguaaaaagacaaa

SEQ ID NO: 1937152 - RNA, 16 nt, Homo sapiens
agugaagcugggagaa

SEQ ID NO: 1937153 - RNA, 17 nt, Homo sapiens
aauaccacuuaccucaa

SEQ ID NO: 1937154 - RNA, 14 nt, Homo sapiens
aggcacccuuagcc

SEQ ID NO: 1937155 - RNA, 13 nt, Homo sapiens
agggaaagccucu

SEQ ID NO: 1937156 - RNA, 17 nt, Homo sapiens
gauuugauaccauggca

SEQ ID NO: 1937157 - RNA, 21 nt, Homo sapiens
gccaggguuucgagaagcugc

SEQ ID NO: 1937158 - RNA, 12 nt, Homo sapiens
aagcuucuaucc

SEQ ID NO: 1937159 - RNA, 18 nt, Homo sapiens
ucaguaacacagugcagu

SEQ ID NO: 1937160 - RNA, 23 nt, Homo sapiens
cuuuuuaaccuuccaagacugaa

SEQ ID NO: 1937161 - RNA, 21 nt, Homo sapiens
caucuagggaguaugaagaau

SEQ ID NO: 1937162 - RNA, 20 nt, Homo sapiens
caacagaccuaagaaauagc

SEQ ID NO: 1937163 - RNA, 16 nt, Homo sapiens
agugggcugugacucc

SEQ ID NO: 1937164 - RNA, 13 nt, Homo sapiens
gggagaacucauu

SEQ ID NO: 1937165 - RNA, 20 nt, Homo sapiens
ugccuguaaucucagcacuu

SEQ ID NO: 1937166 - RNA, 18 nt, Homo sapiens
uccuucuacagaaccuga

SEQ ID NO: 1937167 - RNA, 14 nt, Homo sapiens
cucuacugccucaa

SEQ ID NO: 1937168 - RNA, 20 nt, Homo sapiens
cuuaauaaauccuugaauca

SEQ ID NO: 1937169 - RNA, 13 nt, Homo sapiens
cugaaaguacaaa

SEQ ID NO: 1937170 - RNA, 19 nt, Homo sapiens
acauuuuccugagaccuca

SEQ ID NO: 1937171 - RNA, 17 nt, Homo sapiens
augcagaaccacaaaca

SEQ ID NO: 1937172 - RNA, 14 nt, Homo sapiens
cuuaguuguuauca

SEQ ID NO: 1937173 - RNA, 21 nt, Homo sapiens
guauucccccaucuagccauu

SEQ ID NO: 1937174 - RNA, 15 nt, Homo sapiens
auugcuuuagacaaa

SEQ ID NO: 1937175 - RNA, 12 nt, Homo sapiens
aaucugagcaaa

SEQ ID NO: 1937176 - RNA, 22 nt, Homo sapiens
gugaccccucagggguuucauu

SEQ ID NO: 1937177 - RNA, 17 nt, Homo sapiens
caaaaccaacucucuac

SEQ ID NO: 1937178 - RNA, 20 nt, Homo sapiens
agcccauggcccccaauaaa

SEQ ID NO: 1937179 - RNA, 19 nt, Homo sapiens
uggaacacucucugagaug

SEQ ID NO: 1937180 - RNA, 16 nt, Homo sapiens
ggcuucucaggccucu

SEQ ID NO: 1937181 - RNA, 14 nt, Homo sapiens
acaugugucugugu

SEQ ID NO: 1937182 - RNA, 21 nt, Homo sapiens
aaucauguuggauagucagcu

SEQ ID NO: 1937183 - RNA, 19 nt, Homo sapiens
uaaaguuucuugcauuuau

SEQ ID NO: 1937184 - RNA, 20 nt, Homo sapiens
cuugucuuuuuguuaugcaa

SEQ ID NO: 1937185 - RNA, 18 nt, Homo sapiens
acugcaugcacuucuuac

SEQ ID NO: 1937186 - RNA, 22 nt, Homo sapiens
uccuuuucccaaagcaucccuc

SEQ ID NO: 1937187 - RNA, 18 nt, Homo sapiens
aguuuauacagaacucac

SEQ ID NO: 1937188 - RNA, 18 nt, Homo sapiens
cacaugccaagcacugug

SEQ ID NO: 1937189 - RNA, 15 nt, Homo sapiens
cuuaauucugaccaa

SEQ ID NO: 1937190 - RNA, 22 nt, Homo sapiens
uuugagauggagucuugcucug

SEQ ID NO: 1937191 - RNA, 17 nt, Homo sapiens
ucuuaauuuugguugua

SEQ ID NO: 1937192 - RNA, 17 nt, Homo sapiens
augguuaccgaggaccc

SEQ ID NO: 1937193 - RNA, 16 nt, Homo sapiens
ggcaguacaguggcuu

SEQ ID NO: 1937194 - RNA, 18 nt, Homo sapiens
aacaccgagugaggccau

SEQ ID NO: 1937195 - RNA, 13 nt, Homo sapiens
agaggcacucagu

SEQ ID NO: 1937196 - RNA, 23 nt, Homo sapiens
cuucguugcugcauuuucuucac

SEQ ID NO: 1937197 - RNA, 15 nt, Homo sapiens
ccaaaaaaguuacaa

SEQ ID NO: 1937198 - RNA, 11 nt, Homo sapiens
uuugucuuuca

SEQ ID NO: 1937199 - RNA, 13 nt, Homo sapiens
cuuucaaaagccu

SEQ ID NO: 1937200 - RNA, 16 nt, Homo sapiens
aggcagugcaguacuc

SEQ ID NO: 1937201 - RNA, 13 nt, Homo sapiens
uugacaggauuau

SEQ ID NO: 1937202 - RNA, 14 nt, Homo sapiens
uuucguaugcacuc

SEQ ID NO: 1937203 - RNA, 23 nt, Homo sapiens
acauauuugcacugaagcagaau

SEQ ID NO: 1937204 - RNA, 18 nt, Homo sapiens
cugaaauauuuucuuccu

SEQ ID NO: 1937205 - RNA, 16 nt, Homo sapiens
cccaggcugugcagcg

SEQ ID NO: 1937206 - RNA, 16 nt, Homo sapiens
ucaucaggaguuccag

SEQ ID NO: 1937207 - RNA, 17 nt, Homo sapiens
ccagaucaccaccccuu

SEQ ID NO: 1937208 - RNA, 15 nt, Homo sapiens
uuggcggcucuagcc

SEQ ID NO: 1937209 - RNA, 19 nt, Homo sapiens
ggccaugagggcuggagac

SEQ ID NO: 1937210 - RNA, 14 nt, Homo sapiens
agcugcaacggaau

SEQ ID NO: 1937211 - RNA, 12 nt, Homo sapiens
accucccacugc

SEQ ID NO: 1937212 - RNA, 22 nt, Homo sapiens
uagagagggugguuuuccucaa

SEQ ID NO: 1937213 - RNA, 15 nt, Homo sapiens
uaauuaaaacacaac

SEQ ID NO: 1937214 - RNA, 22 nt, Homo sapiens
aaaguguacaauuuucauccca

SEQ ID NO: 1937215 - RNA, 14 nt, Homo sapiens
agauuuuaccuauc

SEQ ID NO: 1937216 - RNA, 14 nt, Homo sapiens
uacagcucuggcca

SEQ ID NO: 1937217 - RNA, 19 nt, Homo sapiens
accaugugguucacguaca

SEQ ID NO: 1937218 - RNA, 13 nt, Homo sapiens
gaaaaccaucaca

SEQ ID NO: 1937219 - RNA, 15 nt, Homo sapiens
ugacuaagagucucc

SEQ ID NO: 1937220 - RNA, 22 nt, Homo sapiens
accaaucaucuuaacuuggcua

SEQ ID NO: 1937221 - RNA, 21 nt, Homo sapiens
ugagcacaaaauuaugcaaau

SEQ ID NO: 1937222 - RNA, 19 nt, Homo sapiens
uaaauguauaugucauuua

SEQ ID NO: 1937223 - RNA, 13 nt, Homo sapiens
guagaugucauua

SEQ ID NO: 1937224 - RNA, 13 nt, Homo sapiens
guuucugucaagc

SEQ ID NO: 1937225 - RNA, 14 nt, Homo sapiens
gcuuagauuucaua

SEQ ID NO: 1937226 - RNA, 19 nt, Homo sapiens
caauugcuucugugcaaua

SEQ ID NO: 1937227 - RNA, 18 nt, Homo sapiens
ccggcaggcccugcagug

SEQ ID NO: 1937228 - RNA, 19 nt, Homo sapiens
uuugacaugggggugccag

SEQ ID NO: 1937229 - RNA, 19 nt, Homo sapiens
auguuuugagucagugcau

SEQ ID NO: 1937230 - RNA, 23 nt, Homo sapiens
gccuccauauugcucucauuuca

SEQ ID NO: 1937231 - RNA, 14 nt, Homo sapiens
ugggauacaaccuc

SEQ ID NO: 1937232 - RNA, 16 nt, Homo sapiens
cagcuugguuccagga

SEQ ID NO: 1937233 - RNA, 17 nt, Homo sapiens
auaacuuauuugcccua

SEQ ID NO: 1937234 - RNA, 15 nt, Homo sapiens
cucacucuguuuccu

SEQ ID NO: 1937235 - RNA, 17 nt, Homo sapiens
caacaauccaucucuca

SEQ ID NO: 1937236 - RNA, 20 nt, Homo sapiens
ugagauuuccuccuggccuu

SEQ ID NO: 1937237 - RNA, 14 nt, Homo sapiens
cgcaacuggcucaa

SEQ ID NO: 1937238 - RNA, 16 nt, Homo sapiens
auccuuacuagauuca

SEQ ID NO: 1937239 - RNA, 12 nt, Homo sapiens
uuagauugcaaa

SEQ ID NO: 1937240 - RNA, 14 nt, Homo sapiens
auacugucaaacaa

SEQ ID NO: 1937241 - RNA, 16 nt, Homo sapiens
ugggaaauaugaaugc

SEQ ID NO: 1937242 - RNA, 15 nt, Homo sapiens
ugagcgcugaugauu

SEQ ID NO: 1937243 - RNA, 16 nt, Homo sapiens
uaguuggucuuuccau

SEQ ID NO: 1937244 - RNA, 14 nt, Homo sapiens
agucuccaugaaga

SEQ ID NO: 1937245 - RNA, 12 nt, Homo sapiens
cgggcacuguca

SEQ ID NO: 1937246 - RNA, 16 nt, Homo sapiens
gaaauuuaaacucuga

SEQ ID NO: 1937247 - RNA, 21 nt, Homo sapiens
uauuguaaaguucaauuucaa

SEQ ID NO: 1937248 - RNA, 23 nt, Homo sapiens
cuuuugugaauuaggcuguaacu

SEQ ID NO: 1937249 - RNA, 14 nt, Homo sapiens
uuugaucaguugaa

SEQ ID NO: 1937250 - RNA, 11 nt, Homo sapiens
uuaagaccaag

SEQ ID NO: 1937251 - RNA, 14 nt, Homo sapiens
uuuugaccaaaaaa

SEQ ID NO: 1937252 - RNA, 21 nt, Homo sapiens
uuggcaggcugaggugagaag

SEQ ID NO: 1937253 - RNA, 20 nt, Homo sapiens
cccaacuauuaaagugccau

SEQ ID NO: 1937254 - RNA, 23 nt, Homo sapiens
aguucucccuguacaguguuacc

SEQ ID NO: 1937255 - RNA, 18 nt, Homo sapiens
caaucucugauucuguca

SEQ ID NO: 1937256 - RNA, 18 nt, Homo sapiens
gccaagaggcuguuccca

SEQ ID NO: 1937257 - RNA, 20 nt, Homo sapiens
acagaacccuccaccccuac

SEQ ID NO: 1937258 - RNA, 19 nt, Homo sapiens
auugagcuagaaaucacaa

SEQ ID NO: 1937259 - RNA, 21 nt, Homo sapiens
aagaaaaaaauaauuuuauga

SEQ ID NO: 1937260 - RNA, 17 nt, Homo sapiens
uauagaaccaugaauuc

SEQ ID NO: 1937261 - RNA, 19 nt, Homo sapiens
cacagaugucuuaaaagac

SEQ ID NO: 1937262 - RNA, 15 nt, Homo sapiens
cuuccccaucuccau

SEQ ID NO: 1937263 - RNA, 17 nt, Homo sapiens
gaggaacacugcacucu

SEQ ID NO: 1937264 - RNA, 14 nt, Homo sapiens
caauucaguucuag

SEQ ID NO: 1937265 - RNA, 20 nt, Homo sapiens
uucucccuggauuuuuacca

SEQ ID NO: 1937266 - RNA, 22 nt, Homo sapiens
acuugagaccuaaucucuguaa

SEQ ID NO: 1937267 - RNA, 23 nt, Homo sapiens
gagugccuuuucgagacuggcag

SEQ ID NO: 1937268 - RNA, 15 nt, Homo sapiens
aauucccaagcuuuu

SEQ ID NO: 1937269 - RNA, 12 nt, Homo sapiens
gcaucugaccau

SEQ ID NO: 1937270 - RNA, 21 nt, Homo sapiens
uaucgaaauaacaauguuaag

SEQ ID NO: 1937271 - RNA, 11 nt, Homo sapiens
uucuacuguaa

SEQ ID NO: 1937272 - RNA, 11 nt, Homo sapiens
uuauacuguac

SEQ ID NO: 1937273 - RNA, 12 nt, Homo sapiens
uggaguugacug

SEQ ID NO: 1937274 - RNA, 17 nt, Homo sapiens
aucauagcacuggucac

SEQ ID NO: 1937275 - RNA, 20 nt, Homo sapiens
gaugcuggcagccauggcca

SEQ ID NO: 1937276 - RNA, 14 nt, Homo sapiens
ccuaucaucaguua

SEQ ID NO: 1937277 - RNA, 22 nt, Homo sapiens
gcaugccuccaaaaauucacau

SEQ ID NO: 1937278 - RNA, 23 nt, Homo sapiens
agaaugaugcugugcauaucacu

SEQ ID NO: 1937279 - RNA, 14 nt, Homo sapiens
ucuggaacugucug

SEQ ID NO: 1937280 - RNA, 20 nt, Homo sapiens
cauuccugaaagaaacaguu

SEQ ID NO: 1937281 - RNA, 23 nt, Homo sapiens
agacugaauuuuaaauguucaca

SEQ ID NO: 1937282 - RNA, 23 nt, Homo sapiens
aguccugguccuggcugcacucu

SEQ ID NO: 1937283 - RNA, 19 nt, Homo sapiens
cuuguacaguuaacucucc

SEQ ID NO: 1937284 - RNA, 20 nt, Homo sapiens
aauccacaacuuguaccaag

SEQ ID NO: 1937285 - RNA, 21 nt, Homo sapiens
uucuggcccagggaauccagc

SEQ ID NO: 1937286 - RNA, 19 nt, Homo sapiens
uuuaaaaauaaauucaaau

SEQ ID NO: 1937287 - RNA, 17 nt, Homo sapiens
uuggaaugggcagcuca

SEQ ID NO: 1937288 - RNA, 20 nt, Homo sapiens
cuuugcucccuguugcugaa

SEQ ID NO: 1937289 - RNA, 11 nt, Homo sapiens
cacaugcuuuu

SEQ ID NO: 1937290 - RNA, 17 nt, Homo sapiens
gcuuuugcuugcaaugu

SEQ ID NO: 1937291 - RNA, 20 nt, Homo sapiens
ugcuaauaugacauaugaca

SEQ ID NO: 1937292 - RNA, 17 nt, Homo sapiens
cagcccagagacuuugu

SEQ ID NO: 1937293 - RNA, 15 nt, Homo sapiens
uagaccaaaucuugu

SEQ ID NO: 1937294 - RNA, 20 nt, Homo sapiens
auaaaaucuuuccaucucau

SEQ ID NO: 1937295 - RNA, 21 nt, Homo sapiens
uaguuuucuccuuuuacuuca

SEQ ID NO: 1937296 - RNA, 13 nt, Homo sapiens
caaaccuuacucu

SEQ ID NO: 1937297 - RNA, 22 nt, Homo sapiens
cucagcuaagcucacguccuga

SEQ ID NO: 1937298 - RNA, 14 nt, Homo sapiens
aaggccuugagcaa

SEQ ID NO: 1937299 - RNA, 17 nt, Homo sapiens
ugaaacaaauaaucaca

SEQ ID NO: 1937300 - RNA, 18 nt, Homo sapiens
uucaguugcuuugcccaa

SEQ ID NO: 1937301 - RNA, 21 nt, Homo sapiens
uccaaugguaggaauuucaag

SEQ ID NO: 1937302 - RNA, 22 nt, Homo sapiens
ugagagccagaugccuccccaa

SEQ ID NO: 1937303 - RNA, 18 nt, Homo sapiens
cagcgaaugaaugcugua

SEQ ID NO: 1937304 - RNA, 14 nt, Homo sapiens
ggggcacuguuucu

SEQ ID NO: 1937305 - RNA, 18 nt, Homo sapiens
uccccuucaaacaaauaa

SEQ ID NO: 1937306 - RNA, 14 nt, Homo sapiens
uagcugacaaugca

SEQ ID NO: 1937307 - RNA, 17 nt, Homo sapiens
gcuccacgcagucugcu

SEQ ID NO: 1937308 - RNA, 22 nt, Homo sapiens
gccuggaucucacaagcacuuu

SEQ ID NO: 1937309 - RNA, 21 nt, Homo sapiens
ugacuggcacccaauguuuga

SEQ ID NO: 1937310 - RNA, 14 nt, Homo sapiens
uuccuuuuguaaaa

SEQ ID NO: 1937311 - RNA, 20 nt, Homo sapiens
aaugcauauuugccacaaaa

SEQ ID NO: 1937312 - RNA, 13 nt, Homo sapiens
cucagaaagccaa

SEQ ID NO: 1937313 - RNA, 13 nt, Homo sapiens
auaaaguaccaca

SEQ ID NO: 1937314 - RNA, 19 nt, Homo sapiens
gcucugaacacacacgcca

SEQ ID NO: 1937315 - RNA, 18 nt, Homo sapiens
ucacugaugcagaaagac

SEQ ID NO: 1937316 - RNA, 20 nt, Homo sapiens
cuguuuguaaauuauuugcu

SEQ ID NO: 1937317 - RNA, 22 nt, Homo sapiens
ucauuauuuuuuacaauggcca

SEQ ID NO: 1937318 - RNA, 22 nt, Homo sapiens
uacuuuuucugguguguuaaca

SEQ ID NO: 1937319 - RNA, 18 nt, Homo sapiens
uuuggucgaggaguaaca

SEQ ID NO: 1937320 - RNA, 16 nt, Homo sapiens
caauccugaaugugcc

SEQ ID NO: 1937321 - RNA, 14 nt, Homo sapiens
caccugugugccca

SEQ ID NO: 1937322 - RNA, 14 nt, Homo sapiens
cuacaagauuuaga

SEQ ID NO: 1937323 - RNA, 13 nt, Homo sapiens
ccaggcuggaacu

SEQ ID NO: 1937324 - RNA, 16 nt, Homo sapiens
aguugguggggccagg

SEQ ID NO: 1937325 - RNA, 17 nt, Homo sapiens
uucauccagcuacuuag

SEQ ID NO: 1937326 - RNA, 12 nt, Homo sapiens
uuagacuugaaa

SEQ ID NO: 1937327 - RNA, 15 nt, Homo sapiens
ugccaugccucaaga

SEQ ID NO: 1937328 - RNA, 18 nt, Homo sapiens
aaauacggcuuuuccaau

SEQ ID NO: 1937329 - RNA, 14 nt, Homo sapiens
cuacucugugccag

SEQ ID NO: 1937330 - RNA, 20 nt, Homo sapiens
caucuaccgaccugucuccc

SEQ ID NO: 1937331 - RNA, 15 nt, Homo sapiens
gaaauugauguuacu

SEQ ID NO: 1937332 - RNA, 20 nt, Homo sapiens
ugaaaauaaccaugaauaca

SEQ ID NO: 1937333 - RNA, 22 nt, Homo sapiens
aagggaaccauguauaugagcu

SEQ ID NO: 1937334 - RNA, 19 nt, Homo sapiens
gccugagacacagcccuga

SEQ ID NO: 1937335 - RNA, 15 nt, Homo sapiens
aagcaggguccaugu

SEQ ID NO: 1937336 - RNA, 12 nt, Homo sapiens
agcccauaucac

SEQ ID NO: 1937337 - RNA, 12 nt, Homo sapiens
accacauaugaa

SEQ ID NO: 1937338 - RNA, 15 nt, Homo sapiens
cucagccaagcacag

SEQ ID NO: 1937339 - RNA, 20 nt, Homo sapiens
uaaauagggaaaauaaucuc

SEQ ID NO: 1937340 - RNA, 18 nt, Homo sapiens
gcgcgugauagaagaaaa

SEQ ID NO: 1937341 - RNA, 14 nt, Homo sapiens
agaugaguuuugcc

SEQ ID NO: 1937342 - RNA, 15 nt, Homo sapiens
aggcugaagcaggau

SEQ ID NO: 1937343 - RNA, 23 nt, Homo sapiens
ggaucagcaacccuuccugcugc

SEQ ID NO: 1937344 - RNA, 18 nt, Homo sapiens
agagugcuauaaaagacu

SEQ ID NO: 1937345 - RNA, 18 nt, Homo sapiens
cuuuucauuaaagaaugu

SEQ ID NO: 1937346 - RNA, 18 nt, Homo sapiens
uacaaaugugaaacggaa

SEQ ID NO: 1937347 - RNA, 20 nt, Homo sapiens
uuuguuacaaaaagacaaaa

SEQ ID NO: 1937348 - RNA, 14 nt, Homo sapiens
cacacauugugcuu

SEQ ID NO: 1937349 - RNA, 14 nt, Homo sapiens
cucagccucugcaa

SEQ ID NO: 1937350 - RNA, 14 nt, Homo sapiens
agaaaugagucugu

SEQ ID NO: 1937351 - RNA, 16 nt, Homo sapiens
gaauuuuuaagcaaau

SEQ ID NO: 1937352 - RNA, 14 nt, Homo sapiens
uguguguaccugug

SEQ ID NO: 1937353 - RNA, 14 nt, Homo sapiens
caauagcaugcaaa

SEQ ID NO: 1937354 - RNA, 16 nt, Homo sapiens
uaauuaguaagugagu

SEQ ID NO: 1937355 - RNA, 11 nt, Homo sapiens
cauuuacuguu

SEQ ID NO: 1937356 - RNA, 11 nt, Homo sapiens
caguuacugug

SEQ ID NO: 1937357 - RNA, 23 nt, Homo sapiens
uguuuagaagagccugacugugu

SEQ ID NO: 1937358 - RNA, 13 nt, Homo sapiens
uggcagcucagag

SEQ ID NO: 1937359 - RNA, 23 nt, Homo sapiens
cggacaugaaaggacccugugag

SEQ ID NO: 1937360 - RNA, 17 nt, Homo sapiens
cugaacacccuccuuca

SEQ ID NO: 1937361 - RNA, 18 nt, Homo sapiens
uuaaagcuuaaacugaau

SEQ ID NO: 1937362 - RNA, 13 nt, Homo sapiens
auaaucauuuauc

SEQ ID NO: 1937363 - RNA, 16 nt, Homo sapiens
aagggugcccaccucu

SEQ ID NO: 1937364 - RNA, 23 nt, Homo sapiens
aggggagguggccagcccgcaga

SEQ ID NO: 1937365 - RNA, 15 nt, Homo sapiens
gaucccucucuggau

SEQ ID NO: 1937366 - RNA, 17 nt, Homo sapiens
aauaguaguuagcuuaa

SEQ ID NO: 1937367 - RNA, 19 nt, Homo sapiens
ggaaaguuugggaagggau

SEQ ID NO: 1937368 - RNA, 15 nt, Homo sapiens
gaagcagcauccucc

SEQ ID NO: 1937369 - RNA, 19 nt, Homo sapiens
ggccccauccagcaugugu

SEQ ID NO: 1937370 - RNA, 21 nt, Homo sapiens
ucacuaagcuguggcuggaau

SEQ ID NO: 1937371 - RNA, 16 nt, Homo sapiens
uccugauauaacacuu

SEQ ID NO: 1937372 - RNA, 15 nt, Homo sapiens
uuccuuaaacugugu

SEQ ID NO: 1937373 - RNA, 16 nt, Homo sapiens
uaccuugguuaacuua

SEQ ID NO: 1937374 - RNA, 17 nt, Homo sapiens
uuuugucagaaaagagc

SEQ ID NO: 1937375 - RNA, 17 nt, Homo sapiens
ucacucaaaaaggugug

SEQ ID NO: 1937376 - RNA, 16 nt, Homo sapiens
uccagaccccagaacu

SEQ ID NO: 1937377 - RNA, 17 nt, Homo sapiens
ggauuaaccucugcacu

SEQ ID NO: 1937378 - RNA, 19 nt, Homo sapiens
uuaaugcaagagaacauuu

SEQ ID NO: 1937379 - RNA, 23 nt, Homo sapiens
ucauccagacucagagcucucuc

SEQ ID NO: 1937380 - RNA, 17 nt, Homo sapiens
uucuacugucaaaugau

SEQ ID NO: 1937381 - RNA, 10 nt, Homo sapiens
gcacugaccg

SEQ ID NO: 1937382 - RNA, 15 nt, Homo sapiens
auggugugaguccaa

SEQ ID NO: 1937383 - RNA, 18 nt, Homo sapiens
cccugacaucaucauucu

SEQ ID NO: 1937384 - RNA, 17 nt, Homo sapiens
auaaacugaagagcuua

SEQ ID NO: 1937385 - RNA, 17 nt, Homo sapiens
cuaaagccaaaggucua

SEQ ID NO: 1937386 - RNA, 18 nt, Homo sapiens
uagauaccacugaaugaa

SEQ ID NO: 1937387 - RNA, 17 nt, Homo sapiens
uagcuagaagugggcca

SEQ ID NO: 1937388 - RNA, 14 nt, Homo sapiens
cucgcucugucacc

SEQ ID NO: 1937389 - RNA, 21 nt, Homo sapiens
agcuucccccccaccacaggc

SEQ ID NO: 1937390 - RNA, 13 nt, Homo sapiens
uaggacagcauau

SEQ ID NO: 1937391 - RNA, 19 nt, Homo sapiens
cugugagacagugggaaau

SEQ ID NO: 1937392 - RNA, 13 nt, Homo sapiens
cuacucauucccc

SEQ ID NO: 1937393 - RNA, 12 nt, Homo sapiens
gguuacuacccu

SEQ ID NO: 1937394 - RNA, 16 nt, Homo sapiens
ugcaacuuaaguauau

SEQ ID NO: 1937395 - RNA, 13 nt, Homo sapiens
ucuguaaucacau

SEQ ID NO: 1937396 - RNA, 13 nt, Homo sapiens
cucagggaucuca

SEQ ID NO: 1937397 - RNA, 17 nt, Homo sapiens
ugaaagaggcauuccca

SEQ ID NO: 1937398 - RNA, 18 nt, Homo sapiens
uucucgggguccagugca

SEQ ID NO: 1937399 - RNA, 19 nt, Homo sapiens
cacugccgacaucagcauu

SEQ ID NO: 1937400 - RNA, 15 nt, Homo sapiens
cacccaggugauguu

SEQ ID NO: 1937401 - RNA, 14 nt, Homo sapiens
gcucaaaaugccac

SEQ ID NO: 1937402 - RNA, 19 nt, Homo sapiens
agguacagcgggcugugcc

SEQ ID NO: 1937403 - RNA, 17 nt, Homo sapiens
agggaagcacuugcuca

SEQ ID NO: 1937404 - RNA, 13 nt, Homo sapiens
ugccaaaguaguc

SEQ ID NO: 1937405 - RNA, 13 nt, Homo sapiens
aacuggagggugg

SEQ ID NO: 1937406 - RNA, 14 nt, Homo sapiens
agaugagugauccu

SEQ ID NO: 1937407 - RNA, 19 nt, Homo sapiens
cuccugguguggaagagcu

SEQ ID NO: 1937408 - RNA, 22 nt, Homo sapiens
gccguuuucuugcucaaaggga

SEQ ID NO: 1937409 - RNA, 13 nt, Homo sapiens
ccuuuucagggcc

SEQ ID NO: 1937410 - RNA, 18 nt, Homo sapiens
ucaugcuccaagacuuua

SEQ ID NO: 1937411 - RNA, 18 nt, Homo sapiens
cuugacccccuugagggu

SEQ ID NO: 1937412 - RNA, 12 nt, Homo sapiens
cugccacugugg

SEQ ID NO: 1937413 - RNA, 18 nt, Homo sapiens
gagccaccgcgcccggcc

SEQ ID NO: 1937414 - RNA, 23 nt, Homo sapiens
gaaggcaaauauaagcugggaaa

SEQ ID NO: 1937415 - RNA, 21 nt, Homo sapiens
ggacuuaaaacaaaccuugug

SEQ ID NO: 1937416 - RNA, 15 nt, Homo sapiens
uguauaaugugcuuu

SEQ ID NO: 1937417 - RNA, 20 nt, Homo sapiens
aaucucuguuauguacugua

SEQ ID NO: 1937418 - RNA, 15 nt, Homo sapiens
agccggccugagaaa

SEQ ID NO: 1937419 - RNA, 16 nt, Homo sapiens
agucucucacccucau

SEQ ID NO: 1937420 - RNA, 16 nt, Homo sapiens
cuugcaauaccaaugu

SEQ ID NO: 1937421 - RNA, 17 nt, Homo sapiens
acccagaguagccauga

SEQ ID NO: 1937422 - RNA, 19 nt, Homo sapiens
aaccugaaggugcugacaa

SEQ ID NO: 1937423 - RNA, 23 nt, Homo sapiens
aaaaguccucuggauugagauac

SEQ ID NO: 1937424 - RNA, 16 nt, Homo sapiens
auuuuuuuuugaagca

SEQ ID NO: 1937425 - RNA, 18 nt, Homo sapiens
ugcacagaagcacaugca

SEQ ID NO: 1937426 - RNA, 12 nt, Homo sapiens
cgugucagcuca

SEQ ID NO: 1937427 - RNA, 19 nt, Homo sapiens
uaagacugauaauuuuaca

SEQ ID NO: 1937428 - RNA, 17 nt, Homo sapiens
ccuucccgguccgcccg

SEQ ID NO: 1937429 - RNA, 19 nt, Homo sapiens
cugaggccccugccuccaa

SEQ ID NO: 1937430 - RNA, 13 nt, Homo sapiens
gcauauaaaugua

SEQ ID NO: 1937431 - RNA, 20 nt, Homo sapiens
ugugcucuacaucucguaug

SEQ ID NO: 1937432 - RNA, 19 nt, Homo sapiens
ugucugggugcuacugggg

SEQ ID NO: 1937433 - RNA, 20 nt, Homo sapiens
auacacuuuauuaauauaac

SEQ ID NO: 1937434 - RNA, 20 nt, Homo sapiens
gaacagagggugaaagggac

SEQ ID NO: 1937435 - RNA, 22 nt, Homo sapiens
gaagauuauuuacugacauaua

SEQ ID NO: 1937436 - RNA, 18 nt, Homo sapiens
uucuuccaacaugugaug

SEQ ID NO: 1937437 - RNA, 14 nt, Homo sapiens
ucccaggaguacac

SEQ ID NO: 1937438 - RNA, 18 nt, Homo sapiens
uaaguuuuguuuguucac

SEQ ID NO: 1937439 - RNA, 20 nt, Homo sapiens
ccagauuguggggugcagcu

SEQ ID NO: 1937440 - RNA, 17 nt, Homo sapiens
ugugaagcucacacuga

SEQ ID NO: 1937441 - RNA, 13 nt, Homo sapiens
uugaucuuuggaa

SEQ ID NO: 1937442 - RNA, 13 nt, Homo sapiens
uaaccuugccuua

SEQ ID NO: 1937443 - RNA, 15 nt, Homo sapiens
acccagggacacucc

SEQ ID NO: 1937444 - RNA, 15 nt, Homo sapiens
acuauccucacuccc

SEQ ID NO: 1937445 - RNA, 15 nt, Homo sapiens
cauaacagaacaaga

SEQ ID NO: 1937446 - RNA, 21 nt, Homo sapiens
aggccuugagggcgucuucua

SEQ ID NO: 1937447 - RNA, 15 nt, Homo sapiens
uguuagacuugcucc

SEQ ID NO: 1937448 - RNA, 17 nt, Homo sapiens
cauugcuucugcuaaau

SEQ ID NO: 1937449 - RNA, 11 nt, Homo sapiens
aguuacagggc

SEQ ID NO: 1937450 - RNA, 17 nt, Homo sapiens
ugcuggaucacagcugc

SEQ ID NO: 1937451 - RNA, 13 nt, Homo sapiens
aacugaaugacuu

SEQ ID NO: 1937452 - RNA, 18 nt, Homo sapiens
cggccaagugaaggagcc

SEQ ID NO: 1937453 - RNA, 17 nt, Homo sapiens
ucuucuuccccuuuguc

SEQ ID NO: 1937454 - RNA, 21 nt, Homo sapiens
guuuugacuugccacugccau

SEQ ID NO: 1937455 - RNA, 13 nt, Homo sapiens
ugcagaucaagaa

SEQ ID NO: 1937456 - RNA, 13 nt, Homo sapiens
aacagaucuggaa

SEQ ID NO: 1937457 - RNA, 20 nt, Homo sapiens
uagccuaaaugauggugcuu

SEQ ID NO: 1937458 - RNA, 17 nt, Homo sapiens
ucuuaaguaccagaagc

SEQ ID NO: 1937459 - RNA, 13 nt, Homo sapiens
cuucuccaagaag

SEQ ID NO: 1937460 - RNA, 19 nt, Homo sapiens
ucuacauagugacaugcac

SEQ ID NO: 1937461 - RNA, 22 nt, Homo sapiens
ugcucucauaaugaagacauag

SEQ ID NO: 1937462 - RNA, 14 nt, Homo sapiens
ccacacucuccauc

SEQ ID NO: 1937463 - RNA, 14 nt, Homo sapiens
ucuaauguuuacua

SEQ ID NO: 1937464 - RNA, 12 nt, Homo sapiens
aaaaaugcacug

SEQ ID NO: 1937465 - RNA, 20 nt, Homo sapiens
aggcuggagugcaguggcgu

SEQ ID NO: 1937466 - RNA, 22 nt, Homo sapiens
gauuggccccacugacguuggc

SEQ ID NO: 1937467 - RNA, 22 nt, Homo sapiens
auucugaggguccacuacucaa

SEQ ID NO: 1937468 - RNA, 15 nt, Homo sapiens
cugcaugcucaggac

SEQ ID NO: 1937469 - RNA, 15 nt, Homo sapiens
gaauaaaugccuuua

SEQ ID NO: 1937470 - RNA, 15 nt, Homo sapiens
aacuaaauagcaugu

SEQ ID NO: 1937471 - RNA, 14 nt, Homo sapiens
augggucagugccc

SEQ ID NO: 1937472 - RNA, 17 nt, Homo sapiens
aaucuuccuggcacaau

SEQ ID NO: 1937473 - RNA, 21 nt, Homo sapiens
uaagugcauuuauugccucua

SEQ ID NO: 1937474 - RNA, 14 nt, Homo sapiens
cggugacaaauggc

SEQ ID NO: 1937475 - RNA, 12 nt, Homo sapiens
cauuacccucag

SEQ ID NO: 1937476 - RNA, 21 nt, Homo sapiens
gaaacucuuuggaacaacagc

SEQ ID NO: 1937477 - RNA, 14 nt, Homo sapiens
cuauuucuaugcaa

SEQ ID NO: 1937478 - RNA, 19 nt, Homo sapiens
uacugacgcucaguaacca

SEQ ID NO: 1937479 - RNA, 12 nt, Homo sapiens
ggguguggcaaa

SEQ ID NO: 1937480 - RNA, 17 nt, Homo sapiens
aauaaaaagugccuaaa

SEQ ID NO: 1937481 - RNA, 11 nt, Homo sapiens
gagacacucca

SEQ ID NO: 1937482 - RNA, 18 nt, Homo sapiens
aggcacuguggcucugca

SEQ ID NO: 1937483 - RNA, 14 nt, Homo sapiens
ugccccacccuaac

SEQ ID NO: 1937484 - RNA, 13 nt, Homo sapiens
uccaaaugccaac

SEQ ID NO: 1937485 - RNA, 19 nt, Homo sapiens
caaaaggaggcucuucuca

SEQ ID NO: 1937486 - RNA, 17 nt, Homo sapiens
aucaaagccuggccuaa

SEQ ID NO: 1937487 - RNA, 23 nt, Homo sapiens
ugacccacuuaccuugcaucuca

SEQ ID NO: 1937488 - RNA, 16 nt, Homo sapiens
aaggacaaagugccaa

SEQ ID NO: 1937489 - RNA, 17 nt, Homo sapiens
accacaaugacagaaau

SEQ ID NO: 1937490 - RNA, 21 nt, Homo sapiens
acaagagcaaaacucagucuc

SEQ ID NO: 1937491 - RNA, 14 nt, Homo sapiens
cuacacacagauga

SEQ ID NO: 1937492 - RNA, 21 nt, Homo sapiens
ccacuuucccacgucacuuga

SEQ ID NO: 1937493 - RNA, 12 nt, Homo sapiens
aaucaugcaaaa

SEQ ID NO: 1937494 - RNA, 19 nt, Homo sapiens
ccucagacaauccacucuc

SEQ ID NO: 1937495 - RNA, 19 nt, Homo sapiens
uuugacaacgccaacugcc

SEQ ID NO: 1937496 - RNA, 15 nt, Homo sapiens
ucauuuucuauucac

SEQ ID NO: 1937497 - RNA, 23 nt, Homo sapiens
acccuuccugccaagccagggac

SEQ ID NO: 1937498 - RNA, 14 nt, Homo sapiens
auauuucaugugcu

SEQ ID NO: 1937499 - RNA, 16 nt, Homo sapiens
gcuggcugguggaaca

SEQ ID NO: 1937500 - RNA, 16 nt, Homo sapiens
acaccugccucugacc

SEQ ID NO: 1937501 - RNA, 18 nt, Homo sapiens
gucacugagcacagucag

SEQ ID NO: 1937502 - RNA, 15 nt, Homo sapiens
acuugacagacugua

SEQ ID NO: 1937503 - RNA, 18 nt, Homo sapiens
cuuguuuuacccuauaca

SEQ ID NO: 1937504 - RNA, 18 nt, Homo sapiens
ucaggaguucgaaaccag

SEQ ID NO: 1937505 - RNA, 23 nt, Homo sapiens
agucuggagugggauaggagcag

SEQ ID NO: 1937506 - RNA, 14 nt, Homo sapiens
auuccaaacauaca

SEQ ID NO: 1937507 - RNA, 20 nt, Homo sapiens
ugcccauccugccauccuca

SEQ ID NO: 1937508 - RNA, 18 nt, Homo sapiens
ccugggccauaugugcua

SEQ ID NO: 1937509 - RNA, 21 nt, Homo sapiens
aacaaucuaagggucucucau

SEQ ID NO: 1937510 - RNA, 14 nt, Homo sapiens
aggcucccaaaaga

SEQ ID NO: 1937511 - RNA, 14 nt, Homo sapiens
gauucaagagccag

SEQ ID NO: 1937512 - RNA, 22 nt, Homo sapiens
uuggagggcccagcccaaguga

SEQ ID NO: 1937513 - RNA, 22 nt, Homo sapiens
cuucucuguugucaaacugaaa

SEQ ID NO: 1937514 - RNA, 13 nt, Homo sapiens
uggaggacuccag

SEQ ID NO: 1937515 - RNA, 13 nt, Homo sapiens
aacuuaccaacuu

SEQ ID NO: 1937516 - RNA, 13 nt, Homo sapiens
aucugaccaucug

SEQ ID NO: 1937517 - RNA, 13 nt, Homo sapiens
aaagaaccaaaga

SEQ ID NO: 1937518 - RNA, 23 nt, Homo sapiens
acccuggggcaggggugcuuccu

SEQ ID NO: 1937519 - RNA, 22 nt, Homo sapiens
aguggcacggagagaaggccca

SEQ ID NO: 1937520 - RNA, 23 nt, Homo sapiens
gccaggaaacccucuucuucccu

SEQ ID NO: 1937521 - RNA, 21 nt, Homo sapiens
uguugcagccucaaccaacaa

SEQ ID NO: 1937522 - RNA, 14 nt, Homo sapiens
uuaaaaaaguggug

SEQ ID NO: 1937523 - RNA, 15 nt, Homo sapiens
ccuucagcaccugac

SEQ ID NO: 1937524 - RNA, 17 nt, Homo sapiens
accucaaguguccugaa

SEQ ID NO: 1937525 - RNA, 19 nt, Homo sapiens
augaguuucuuaacccuuu

SEQ ID NO: 1937526 - RNA, 19 nt, Homo sapiens
uacagucagcacagaacac

SEQ ID NO: 1937527 - RNA, 18 nt, Homo sapiens
gagcuaaggccaaugggc

SEQ ID NO: 1937528 - RNA, 22 nt, Homo sapiens
uccacauccuuucuaaacaaga

SEQ ID NO: 1937529 - RNA, 17 nt, Homo sapiens
gaaauaaacacuggugc

SEQ ID NO: 1937530 - RNA, 19 nt, Homo sapiens
ucauugcccacuucugugu

SEQ ID NO: 1937531 - RNA, 20 nt, Homo sapiens
ugugacuuuuucagaguugc

SEQ ID NO: 1937532 - RNA, 20 nt, Homo sapiens
cccucugcagauacacugcu

SEQ ID NO: 1937533 - RNA, 12 nt, Homo sapiens
aaagcacagugu

SEQ ID NO: 1937534 - RNA, 13 nt, Homo sapiens
aauucauguugcc

SEQ ID NO: 1937535 - RNA, 21 nt, Homo sapiens
aagagauuucaacauaucauu

SEQ ID NO: 1937536 - RNA, 12 nt, Homo sapiens
uucuuuuccacu

SEQ ID NO: 1937537 - RNA, 18 nt, Homo sapiens
gcuguggccggcacucca

SEQ ID NO: 1937538 - RNA, 15 nt, Homo sapiens
auguacacacacaga

SEQ ID NO: 1937539 - RNA, 20 nt, Homo sapiens
acaggauggcaggaggcauc

SEQ ID NO: 1937540 - RNA, 20 nt, Homo sapiens
gauccaggaacacaugcaca

SEQ ID NO: 1937541 - RNA, 22 nt, Homo sapiens
ugcccuguugguuucacagaua

SEQ ID NO: 1937542 - RNA, 14 nt, Homo sapiens
acagauaaaugaca

SEQ ID NO: 1937543 - RNA, 17 nt, Homo sapiens
accuccaagcauuucau

SEQ ID NO: 1937544 - RNA, 17 nt, Homo sapiens
uggacagauugccuguu

SEQ ID NO: 1937545 - RNA, 14 nt, Homo sapiens
cugauguguucucu

SEQ ID NO: 1937546 - RNA, 13 nt, Homo sapiens
uguugcaagcccc

SEQ ID NO: 1937547 - RNA, 12 nt, Homo sapiens
uuauuacuguug

SEQ ID NO: 1937548 - RNA, 21 nt, Homo sapiens
agacauaaguaaaugagccuu

SEQ ID NO: 1937549 - RNA, 23 nt, Homo sapiens
gauauguuauacugaaccaggcc

SEQ ID NO: 1937550 - RNA, 16 nt, Homo sapiens
augucccaccacaguc

SEQ ID NO: 1937551 - RNA, 20 nt, Homo sapiens
cccuguguugucccaucugc

SEQ ID NO: 1937552 - RNA, 20 nt, Homo sapiens
ucuaaauauuucaugauuca

SEQ ID NO: 1937553 - RNA, 14 nt, Homo sapiens
cacgcagccaggac

SEQ ID NO: 1937554 - RNA, 22 nt, Homo sapiens
aaauggcaugacauauguagau

SEQ ID NO: 1937555 - RNA, 12 nt, Homo sapiens
aauaaaccacaa

SEQ ID NO: 1937556 - RNA, 21 nt, Homo sapiens
caauuugguuuagaaugcugc

SEQ ID NO: 1937557 - RNA, 15 nt, Homo sapiens
ugaaaaugacauuaa

SEQ ID NO: 1937558 - RNA, 22 nt, Homo sapiens
ggcacccacaaauaaaugacaa

SEQ ID NO: 1937559 - RNA, 15 nt, Homo sapiens
uaauagaguauguga

SEQ ID NO: 1937560 - RNA, 11 nt, Homo sapiens
ucagcuacaaa

SEQ ID NO: 1937561 - RNA, 23 nt, Homo sapiens
uccccacgagggcuggcuggccu

SEQ ID NO: 1937562 - RNA, 21 nt, Homo sapiens
gagaacaaagagugaaauauu

SEQ ID NO: 1937563 - RNA, 20 nt, Homo sapiens
cuugcuuuccaaguaaaggu

SEQ ID NO: 1937564 - RNA, 23 nt, Homo sapiens
auguaaaaucuucagcuggugga

SEQ ID NO: 1937565 - RNA, 16 nt, Homo sapiens
caucucuagggaccag

SEQ ID NO: 1937566 - RNA, 19 nt, Homo sapiens
aaggccccaccuucuaucu

SEQ ID NO: 1937567 - RNA, 18 nt, Homo sapiens
gaaauuaacacccaaaag

SEQ ID NO: 1937568 - RNA, 18 nt, Homo sapiens
gcauauuaguugaugaaa

SEQ ID NO: 1937569 - RNA, 16 nt, Homo sapiens
cuuguuguaaaaagcc

SEQ ID NO: 1937570 - RNA, 13 nt, Homo sapiens
ucugugaauuucu

SEQ ID NO: 1937571 - RNA, 17 nt, Homo sapiens
cuguccaaccagacuuu

SEQ ID NO: 1937572 - RNA, 14 nt, Homo sapiens
cauucaacugaaca

SEQ ID NO: 1937573 - RNA, 16 nt, Homo sapiens
gaauaaagacuugugc

SEQ ID NO: 1937574 - RNA, 17 nt, Homo sapiens
caccaacauucuguguu

SEQ ID NO: 1937575 - RNA, 13 nt, Homo sapiens
cuguuuacuuuag

SEQ ID NO: 1937576 - RNA, 19 nt, Homo sapiens
agaaauugugugugcaaga

SEQ ID NO: 1937577 - RNA, 17 nt, Homo sapiens
accaguuaaaagcauuu

SEQ ID NO: 1937578 - RNA, 22 nt, Homo sapiens
acaguuacacuugacagacaaa

SEQ ID NO: 1937579 - RNA, 14 nt, Homo sapiens
uagaguugggacaa

SEQ ID NO: 1937580 - RNA, 11 nt, Homo sapiens
gccugcugagc

SEQ ID NO: 1937581 - RNA, 11 nt, Homo sapiens
gcuugcugagu

SEQ ID NO: 1937582 - RNA, 12 nt, Homo sapiens
gagaucugcaca

SEQ ID NO: 1937583 - RNA, 20 nt, Homo sapiens
gagaaauaaagcacauuuga

SEQ ID NO: 1937584 - RNA, 13 nt, Homo sapiens
uuccucuccagcc

SEQ ID NO: 1937585 - RNA, 18 nt, Homo sapiens
ccaggaccccuguccagg

SEQ ID NO: 1937586 - RNA, 23 nt, Homo sapiens
gguaggugccgcuacaguuuuua

SEQ ID NO: 1937587 - RNA, 14 nt, Homo sapiens
aaaaauguaccaaa

SEQ ID NO: 1937588 - RNA, 22 nt, Homo sapiens
ucucccaggcugcuggagugca

SEQ ID NO: 1937589 - RNA, 13 nt, Homo sapiens
gcuauaggugcua

SEQ ID NO: 1937590 - RNA, 15 nt, Homo sapiens
aaaaugugucugcaa

SEQ ID NO: 1937591 - RNA, 18 nt, Homo sapiens
ugccuuagggacagaauu

SEQ ID NO: 1937592 - RNA, 17 nt, Homo sapiens
uaucccccaccaaaaac

SEQ ID NO: 1937593 - RNA, 16 nt, Homo sapiens
gggugaagcuggggac

SEQ ID NO: 1937594 - RNA, 23 nt, Homo sapiens
agaaucuauaguucacugacaca

SEQ ID NO: 1937595 - RNA, 21 nt, Homo sapiens
cccaucagcacucuguaaaac

SEQ ID NO: 1937596 - RNA, 18 nt, Homo sapiens
ccccacccuccucuugga

SEQ ID NO: 1937597 - RNA, 22 nt, Homo sapiens
ccugaccaggggcccuaccugg

SEQ ID NO: 1937598 - RNA, 12 nt, Homo sapiens
agauuugcucau

SEQ ID NO: 1937599 - RNA, 12 nt, Homo sapiens
aguuuugcucuu

SEQ ID NO: 1937600 - RNA, 13 nt, Homo sapiens
uucaaaauguauu

SEQ ID NO: 1937601 - RNA, 15 nt, Homo sapiens
uuaguaaggcugugu

SEQ ID NO: 1937602 - RNA, 11 nt, Homo sapiens
ggccacacugg

SEQ ID NO: 1937603 - RNA, 13 nt, Homo sapiens
aacugugcaguga

SEQ ID NO: 1937604 - RNA, 13 nt, Homo sapiens
uacccuccuguaa

SEQ ID NO: 1937605 - RNA, 19 nt, Homo sapiens
ucaggaggcaucuggaaag

SEQ ID NO: 1937606 - RNA, 15 nt, Homo sapiens
uauacacauggaugc

SEQ ID NO: 1937607 - RNA, 21 nt, Homo sapiens
auuuccccuuuugcauucucc

SEQ ID NO: 1937608 - RNA, 20 nt, Homo sapiens
ggcagccaagagccaucuga

SEQ ID NO: 1937609 - RNA, 18 nt, Homo sapiens
cacacuugggagcaaaag

SEQ ID NO: 1937610 - RNA, 17 nt, Homo sapiens
cuucagguucucaugau

SEQ ID NO: 1937611 - RNA, 19 nt, Homo sapiens
cagucugcuucagugcagu

SEQ ID NO: 1937612 - RNA, 17 nt, Homo sapiens
aguccagaugugccuag

SEQ ID NO: 1937613 - RNA, 15 nt, Homo sapiens
aggcgucaccaucca

SEQ ID NO: 1937614 - RNA, 13 nt, Homo sapiens
gagcaggacucac

SEQ ID NO: 1937615 - RNA, 14 nt, Homo sapiens
uagaaaaaggagcu

SEQ ID NO: 1937616 - RNA, 20 nt, Homo sapiens
ccugagaaccccucugggaa

SEQ ID NO: 1937617 - RNA, 23 nt, Homo sapiens
cacugcaguagugcaccaucuca

SEQ ID NO: 1937618 - RNA, 22 nt, Homo sapiens
cuguaucagucuuucuugagca

SEQ ID NO: 1937619 - RNA, 18 nt, Homo sapiens
guaaggacuugugccucu

SEQ ID NO: 1937620 - RNA, 14 nt, Homo sapiens
ugcauuucuuuauu

SEQ ID NO: 1937621 - RNA, 13 nt, Homo sapiens
gagcuucaguaua

SEQ ID NO: 1937622 - RNA, 18 nt, Homo sapiens
uucaauaaaccacaagca

SEQ ID NO: 1937623 - RNA, 23 nt, Homo sapiens
gcuucuggaauuuguucaaguuu

SEQ ID NO: 1937624 - RNA, 21 nt, Homo sapiens
ucuuuuggaaaguacuaugaa

SEQ ID NO: 1937625 - RNA, 18 nt, Homo sapiens
ggaaacagcaugaauaaa

SEQ ID NO: 1937626 - RNA, 19 nt, Homo sapiens
gccaggguaguaagaauua

SEQ ID NO: 1937627 - RNA, 15 nt, Homo sapiens
gacaacgaugaugcu

SEQ ID NO: 1937628 - RNA, 23 nt, Homo sapiens
cauauaccacccauagugcuuca

SEQ ID NO: 1937629 - RNA, 16 nt, Homo sapiens
uaagcuaauuccacac

SEQ ID NO: 1937630 - RNA, 13 nt, Homo sapiens
agugcccucucug

SEQ ID NO: 1937631 - RNA, 12 nt, Homo sapiens
ucugucuguccu

SEQ ID NO: 1937632 - RNA, 21 nt, Homo sapiens
cagcccgugcaacggaagcca

SEQ ID NO: 1937633 - RNA, 21 nt, Homo sapiens
gcugacuuuucugacccaugu

SEQ ID NO: 1937634 - RNA, 23 nt, Homo sapiens
uccucagggccacguuaccacag

SEQ ID NO: 1937635 - RNA, 15 nt, Homo sapiens
uuagaacugccaaag

SEQ ID NO: 1937636 - RNA, 17 nt, Homo sapiens
auccugacaaaagggac

SEQ ID NO: 1937637 - RNA, 15 nt, Homo sapiens
uaguacuucuucugu

SEQ ID NO: 1937638 - RNA, 22 nt, Homo sapiens
aaagccucagcaacagccagug

SEQ ID NO: 1937639 - RNA, 13 nt, Homo sapiens
augaaugcagauu

SEQ ID NO: 1937640 - RNA, 21 nt, Homo sapiens
ucaccuugcauuucaaaaugg

SEQ ID NO: 1937641 - RNA, 15 nt, Homo sapiens
accacccugggaccc

SEQ ID NO: 1937642 - RNA, 14 nt, Homo sapiens
aaugaaauuugcaa

SEQ ID NO: 1937643 - RNA, 16 nt, Homo sapiens
uccauucauccuucca

SEQ ID NO: 1937644 - RNA, 18 nt, Homo sapiens
cugagacagacacacagc

SEQ ID NO: 1937645 - RNA, 13 nt, Homo sapiens
ugggucaugugca

SEQ ID NO: 1937646 - RNA, 17 nt, Homo sapiens
guggugagaggcaucca

SEQ ID NO: 1937647 - RNA, 15 nt, Homo sapiens
ccaggccccaggaag

SEQ ID NO: 1937648 - RNA, 16 nt, Homo sapiens
uaggucuccucagggu

SEQ ID NO: 1937649 - RNA, 22 nt, Homo sapiens
guaaugauguaggggccaagca

SEQ ID NO: 1937650 - RNA, 22 nt, Homo sapiens
acacuucaaggugacagaagga

SEQ ID NO: 1937651 - RNA, 16 nt, Homo sapiens
acccauucacuacagg

SEQ ID NO: 1937652 - RNA, 18 nt, Homo sapiens
gccaagaaucaagcuaga

SEQ ID NO: 1937653 - RNA, 13 nt, Homo sapiens
ggcuuacugagcu

SEQ ID NO: 1937654 - RNA, 15 nt, Homo sapiens
ggccccacauugcac

SEQ ID NO: 1937655 - RNA, 15 nt, Homo sapiens
guaggagacacagau

SEQ ID NO: 1937656 - RNA, 18 nt, Homo sapiens
ggccuguacggacacugu

SEQ ID NO: 1937657 - RNA, 19 nt, Homo sapiens
ggcugcagcagaggccuga

SEQ ID NO: 1937658 - RNA, 15 nt, Homo sapiens
aguacccagugccua

SEQ ID NO: 1937659 - RNA, 14 nt, Homo sapiens
aaucucuugccugc

SEQ ID NO: 1937660 - RNA, 17 nt, Homo sapiens
augucuuuaucaaagga

SEQ ID NO: 1937661 - RNA, 14 nt, Homo sapiens
ccagacggcuccac

SEQ ID NO: 1937662 - RNA, 20 nt, Homo sapiens
caaagugacuguuuggcuua

SEQ ID NO: 1937663 - RNA, 14 nt, Homo sapiens
aucaaaaaguuuau

SEQ ID NO: 1937664 - RNA, 17 nt, Homo sapiens
uuugcaugucugcauga

SEQ ID NO: 1937665 - RNA, 21 nt, Homo sapiens
aguauuauaggccaaacuggc

SEQ ID NO: 1937666 - RNA, 17 nt, Homo sapiens
aacugacccuuccuuca

SEQ ID NO: 1937667 - RNA, 18 nt, Homo sapiens
agggcacccaaaacucaa

SEQ ID NO: 1937668 - RNA, 20 nt, Homo sapiens
auuuuccuuaggaaaaacau

SEQ ID NO: 1937669 - RNA, 20 nt, Homo sapiens
agaccaacucucuccuguau

SEQ ID NO: 1937670 - RNA, 20 nt, Homo sapiens
gugguaugguuguauacaca

SEQ ID NO: 1937671 - RNA, 21 nt, Homo sapiens
uuucauaugaggggacccagc

SEQ ID NO: 1937672 - RNA, 17 nt, Homo sapiens
agacaaugguuguguag

SEQ ID NO: 1937673 - RNA, 18 nt, Homo sapiens
gauuacaggcgcacacca

SEQ ID NO: 1937674 - RNA, 16 nt, Homo sapiens
acaugauugaaaccaa

SEQ ID NO: 1937675 - RNA, 21 nt, Homo sapiens
ucacauggugcuacgccugca

SEQ ID NO: 1937676 - RNA, 21 nt, Homo sapiens
auaucaucagcauaccuuuau

SEQ ID NO: 1937677 - RNA, 13 nt, Homo sapiens
uaucauucugcuu

SEQ ID NO: 1937678 - RNA, 15 nt, Homo sapiens
cagaagggagugaaa

SEQ ID NO: 1937679 - RNA, 11 nt, Homo sapiens
cuauucugcua

SEQ ID NO: 1937680 - RNA, 22 nt, Homo sapiens
aacaaagugacuguuuggcuua

SEQ ID NO: 1937681 - RNA, 21 nt, Homo sapiens
gugugaucuuaauauauuuga

SEQ ID NO: 1937682 - RNA, 17 nt, Homo sapiens
ugagcucccccuuccca

SEQ ID NO: 1937683 - RNA, 18 nt, Homo sapiens
agcugcaguuagcacaga

SEQ ID NO: 1937684 - RNA, 20 nt, Homo sapiens
uuccaggcugagccaugagg

SEQ ID NO: 1937685 - RNA, 20 nt, Homo sapiens
caguguuagcuuaguucucu

SEQ ID NO: 1937686 - RNA, 12 nt, Homo sapiens
cugacugacaaa

SEQ ID NO: 1937687 - RNA, 16 nt, Homo sapiens
auauaaauauccccag

SEQ ID NO: 1937688 - RNA, 17 nt, Homo sapiens
cuccgugcuuaaccaaa

SEQ ID NO: 1937689 - RNA, 15 nt, Homo sapiens
aguauugcagccaaa

SEQ ID NO: 1937690 - RNA, 14 nt, Homo sapiens
ggaguacaccccaa

SEQ ID NO: 1937691 - RNA, 13 nt, Homo sapiens
uuacagaucauau

SEQ ID NO: 1937692 - RNA, 21 nt, Homo sapiens
cuuggcaggaugaugcuguca

SEQ ID NO: 1937693 - RNA, 20 nt, Homo sapiens
caagugaggugacacuccag

SEQ ID NO: 1937694 - RNA, 16 nt, Homo sapiens
cgcauagacugaggua

SEQ ID NO: 1937695 - RNA, 16 nt, Homo sapiens
uuguaucugucuuucc

SEQ ID NO: 1937696 - RNA, 21 nt, Homo sapiens
aggucuccaccccucaagcca

SEQ ID NO: 1937697 - RNA, 23 nt, Homo sapiens
uuggauuuuugacucuggcaaag

SEQ ID NO: 1937698 - RNA, 18 nt, Homo sapiens
gcuaugcaguacauugua

SEQ ID NO: 1937699 - RNA, 14 nt, Homo sapiens
cagcuaaugaauug

SEQ ID NO: 1937700 - RNA, 20 nt, Homo sapiens
ggaccagccgcccagaucau

SEQ ID NO: 1937701 - RNA, 17 nt, Homo sapiens
ugacaguaaaucucaca

SEQ ID NO: 1937702 - RNA, 15 nt, Homo sapiens
uuugcuaccugaaca

SEQ ID NO: 1937703 - RNA, 22 nt, Homo sapiens
ccucccucgcauccgccucuga

SEQ ID NO: 1937704 - RNA, 22 nt, Homo sapiens
uuguaacgacuucuccaucucc

SEQ ID NO: 1937705 - RNA, 19 nt, Homo sapiens
uaugaguggaaaaagccaa

SEQ ID NO: 1937706 - RNA, 22 nt, Homo sapiens
accuguguguucuuuugauaca

SEQ ID NO: 1937707 - RNA, 17 nt, Homo sapiens
cucacccccaugaucca

SEQ ID NO: 1937708 - RNA, 14 nt, Homo sapiens
acagaaacuccugu

SEQ ID NO: 1937709 - RNA, 21 nt, Homo sapiens
gcaacaagaccaccacuucga

SEQ ID NO: 1937710 - RNA, 13 nt, Homo sapiens
aauaagagcaguc

SEQ ID NO: 1937711 - RNA, 21 nt, Homo sapiens
gggcccaaauucuuucagugg

SEQ ID NO: 1937712 - RNA, 22 nt, Homo sapiens
uugagcaguaggauauuggcau

SEQ ID NO: 1937713 - RNA, 15 nt, Homo sapiens
ucauccccugugaau

SEQ ID NO: 1937714 - RNA, 23 nt, Homo sapiens
auuaaagaaaauaugcauaauca

SEQ ID NO: 1937715 - RNA, 17 nt, Homo sapiens
ccuaacccuacaugcau

SEQ ID NO: 1937716 - RNA, 17 nt, Homo sapiens
gcagaagccugagcuca

SEQ ID NO: 1937717 - RNA, 14 nt, Homo sapiens
acauauuaucucau

SEQ ID NO: 1937718 - RNA, 14 nt, Homo sapiens
aaccugaaagggca

SEQ ID NO: 1937719 - RNA, 18 nt, Homo sapiens
ccguucgcccccauguga

SEQ ID NO: 1937720 - RNA, 17 nt, Homo sapiens
uguaaauagaaccagcc

SEQ ID NO: 1937721 - RNA, 12 nt, Homo sapiens
aggaacugcuug

SEQ ID NO: 1937722 - RNA, 23 nt, Homo sapiens
ccagucuggaaaacagaaaccau

SEQ ID NO: 1937723 - RNA, 19 nt, Homo sapiens
cagagauggaugcauguuc

SEQ ID NO: 1937724 - RNA, 23 nt, Homo sapiens
gcgagaggugagcuacuuuguga

SEQ ID NO: 1937725 - RNA, 23 nt, Homo sapiens
uuucccuguguacccuccaugua

SEQ ID NO: 1937726 - RNA, 13 nt, Homo sapiens
uaaauacuugccu

SEQ ID NO: 1937727 - RNA, 13 nt, Homo sapiens
uacacacuugacc

SEQ ID NO: 1937728 - RNA, 15 nt, Homo sapiens
aucccaaauguggaa

SEQ ID NO: 1937729 - RNA, 16 nt, Homo sapiens
cauuagaauagucaua

SEQ ID NO: 1937730 - RNA, 14 nt, Homo sapiens
gcaccuugcuccca

SEQ ID NO: 1937731 - RNA, 18 nt, Homo sapiens
caggaaaacugggacaua

SEQ ID NO: 1937732 - RNA, 20 nt, Homo sapiens
cauguaaccacugcacuuuc

SEQ ID NO: 1937733 - RNA, 13 nt, Homo sapiens
agugagacagacu

SEQ ID NO: 1937734 - RNA, 13 nt, Homo sapiens
agagugacaguca

SEQ ID NO: 1937735 - RNA, 15 nt, Homo sapiens
aauaauugauuucaa

SEQ ID NO: 1937736 - RNA, 18 nt, Homo sapiens
uucgcagccuagauauga

SEQ ID NO: 1937737 - RNA, 22 nt, Homo sapiens
ggcuguaaauccuagacuugaa

SEQ ID NO: 1937738 - RNA, 13 nt, Homo sapiens
ucccgucucgccu

SEQ ID NO: 1937739 - RNA, 13 nt, Homo sapiens
augaaaccaaagc

SEQ ID NO: 1937740 - RNA, 15 nt, Homo sapiens
uugauguauuuagcu

SEQ ID NO: 1937741 - RNA, 15 nt, Homo sapiens
gagcaucugucucaa

SEQ ID NO: 1937742 - RNA, 18 nt, Homo sapiens
cucccugauuaauggagg

SEQ ID NO: 1937743 - RNA, 17 nt, Homo sapiens
uuguacuuuuuauucaa

SEQ ID NO: 1937744 - RNA, 21 nt, Homo sapiens
acacggaggcccccaguauug

SEQ ID NO: 1937745 - RNA, 19 nt, Homo sapiens
caugacgcacugcucaaga

SEQ ID NO: 1937746 - RNA, 21 nt, Homo sapiens
acaaugguuuuguuucuuucc

SEQ ID NO: 1937747 - RNA, 23 nt, Homo sapiens
cuggcguccucucccuccuggcc

SEQ ID NO: 1937748 - RNA, 18 nt, Homo sapiens
aacagcaguguucugggu

SEQ ID NO: 1937749 - RNA, 14 nt, Homo sapiens
aggggaaccugucc

SEQ ID NO: 1937750 - RNA, 18 nt, Homo sapiens
agcugcucagaucccacu

SEQ ID NO: 1937751 - RNA, 13 nt, Homo sapiens
acacauugcugau

SEQ ID NO: 1937752 - RNA, 20 nt, Homo sapiens
ugaccuugcugauggugaca

SEQ ID NO: 1937753 - RNA, 15 nt, Homo sapiens
ugaaaagcuugucca

SEQ ID NO: 1937754 - RNA, 13 nt, Homo sapiens
caggcaucaggaa

SEQ ID NO: 1937755 - RNA, 20 nt, Homo sapiens
gcacuggauaaacaaaggua

SEQ ID NO: 1937756 - RNA, 20 nt, Homo sapiens
auauguaacuggaaucucaa

SEQ ID NO: 1937757 - RNA, 17 nt, Homo sapiens
ccuaaggaaacugcuuu

SEQ ID NO: 1937758 - RNA, 13 nt, Homo sapiens
uugccuccaugcc

SEQ ID NO: 1937759 - RNA, 19 nt, Homo sapiens
acccacugccagacaugcc

SEQ ID NO: 1937760 - RNA, 13 nt, Homo sapiens
cugauaaugcuca

SEQ ID NO: 1937761 - RNA, 13 nt, Homo sapiens
cugcaaaugcuau

SEQ ID NO: 1937762 - RNA, 15 nt, Homo sapiens
aauauuugcuaugaa

SEQ ID NO: 1937763 - RNA, 21 nt, Homo sapiens
acuuugguuauuggaaggcaa

SEQ ID NO: 1937764 - RNA, 17 nt, Homo sapiens
ucauuucagauaaacaa

SEQ ID NO: 1937765 - RNA, 14 nt, Homo sapiens
ucguagccaucucu

SEQ ID NO: 1937766 - RNA, 19 nt, Homo sapiens
ugaacguguauguaccuag

SEQ ID NO: 1937767 - RNA, 23 nt, Homo sapiens
aauaaauggaaagacauccugug

SEQ ID NO: 1937768 - RNA, 18 nt, Homo sapiens
aguuuggaaguguuaacu

SEQ ID NO: 1937769 - RNA, 16 nt, Homo sapiens
cagcgucccagucucu

SEQ ID NO: 1937770 - RNA, 22 nt, Homo sapiens
cuucccaggaucccucccagau

SEQ ID NO: 1937771 - RNA, 23 nt, Homo sapiens
cuuccucgagaccauacagccag

SEQ ID NO: 1937772 - RNA, 20 nt, Homo sapiens
uucccaccugcuggagugaa

SEQ ID NO: 1937773 - RNA, 22 nt, Homo sapiens
ucugaaaaaguguuuuuacaua

SEQ ID NO: 1937774 - RNA, 15 nt, Homo sapiens
ucccaacgugcaaag

SEQ ID NO: 1937775 - RNA, 22 nt, Homo sapiens
aaacuuguguucaaucugugaa

SEQ ID NO: 1937776 - RNA, 17 nt, Homo sapiens
cuacauuugcaugccuu

SEQ ID NO: 1937777 - RNA, 13 nt, Homo sapiens
cuucuaguggucu

SEQ ID NO: 1937778 - RNA, 19 nt, Homo sapiens
cccagccugccccagccuc

SEQ ID NO: 1937779 - RNA, 19 nt, Homo sapiens
cagacacauugucaucaga

SEQ ID NO: 1937780 - RNA, 13 nt, Homo sapiens
cuuuuuaauuucu

SEQ ID NO: 1937781 - RNA, 17 nt, Homo sapiens
ccaccgcuggagcuccu

SEQ ID NO: 1937782 - RNA, 20 nt, Homo sapiens
cuggcuccagagauggucac

SEQ ID NO: 1937783 - RNA, 11 nt, Homo sapiens
cugucuguccc

SEQ ID NO: 1937784 - RNA, 17 nt, Homo sapiens
ugccauuugcugcuuaa

SEQ ID NO: 1937785 - RNA, 19 nt, Homo sapiens
acccucuuagaaaaaccac

SEQ ID NO: 1937786 - RNA, 22 nt, Homo sapiens
caacaguggggaagagugacuc

SEQ ID NO: 1937787 - RNA, 20 nt, Homo sapiens
acaccacuaaccauccccaa

SEQ ID NO: 1937788 - RNA, 13 nt, Homo sapiens
cuggacacauuau

SEQ ID NO: 1937789 - RNA, 19 nt, Homo sapiens
gugaacgcugugaugcugu

SEQ ID NO: 1937790 - RNA, 17 nt, Homo sapiens
uuuuucccccacugcga

SEQ ID NO: 1937791 - RNA, 17 nt, Homo sapiens
cuguccugaccaucgca

SEQ ID NO: 1937792 - RNA, 16 nt, Homo sapiens
cuguccuuucagucug

SEQ ID NO: 1937793 - RNA, 15 nt, Homo sapiens
gugcgagugugugca

SEQ ID NO: 1937794 - RNA, 19 nt, Homo sapiens
gugccucagcuucccaagc

SEQ ID NO: 1937795 - RNA, 17 nt, Homo sapiens
uccucuuuaccuguuca

SEQ ID NO: 1937796 - RNA, 14 nt, Homo sapiens
cuguagcugagcac

SEQ ID NO: 1937797 - RNA, 20 nt, Homo sapiens
agaaguguggucagagggga

SEQ ID NO: 1937798 - RNA, 18 nt, Homo sapiens
uuuauuuucauucugcca

SEQ ID NO: 1937799 - RNA, 12 nt, Homo sapiens
aaccgucccuga

SEQ ID NO: 1937800 - RNA, 15 nt, Homo sapiens
agaaaauuuuguaaa

SEQ ID NO: 1937801 - RNA, 19 nt, Homo sapiens
aaaacaucauuacugccau

SEQ ID NO: 1937802 - RNA, 15 nt, Homo sapiens
cugagguaaaaacug

SEQ ID NO: 1937803 - RNA, 18 nt, Homo sapiens
acaaaauugcagauacca

SEQ ID NO: 1937804 - RNA, 20 nt, Homo sapiens
cagagagguggggauccugc

SEQ ID NO: 1937805 - RNA, 19 nt, Homo sapiens
cacauucuaaaggcuugau

SEQ ID NO: 1937806 - RNA, 16 nt, Homo sapiens
uuggaggcccuaggcg

SEQ ID NO: 1937807 - RNA, 19 nt, Homo sapiens
agaccagguggaauuacuu

SEQ ID NO: 1937808 - RNA, 13 nt, Homo sapiens
aauguuaaauuca

SEQ ID NO: 1937809 - RNA, 21 nt, Homo sapiens
ggcuggauucuaucuacauaa

SEQ ID NO: 1937810 - RNA, 16 nt, Homo sapiens
cguugcgggguggagu

SEQ ID NO: 1937811 - RNA, 21 nt, Homo sapiens
ugacugaaguaauaacugaug

SEQ ID NO: 1937812 - RNA, 23 nt, Homo sapiens
ucuuaaauuugauuuacauauau

SEQ ID NO: 1937813 - RNA, 16 nt, Homo sapiens
gccaaucagaagcuaa

SEQ ID NO: 1937814 - RNA, 22 nt, Homo sapiens
caauggcauagcuggacuugau

SEQ ID NO: 1937815 - RNA, 22 nt, Homo sapiens
gcauucagcacaccccaaggga

SEQ ID NO: 1937816 - RNA, 22 nt, Homo sapiens
uuugcacuuucaggaacacucu

SEQ ID NO: 1937817 - RNA, 15 nt, Homo sapiens
auggacauuuugggc

SEQ ID NO: 1937818 - RNA, 14 nt, Homo sapiens
uacauauguagaua

SEQ ID NO: 1937819 - RNA, 14 nt, Homo sapiens
gaccagcucucuuc

SEQ ID NO: 1937820 - RNA, 14 nt, Homo sapiens
cucccuuaauaaac

SEQ ID NO: 1937821 - RNA, 23 nt, Homo sapiens
uaagaaacauccauauugcacaa

SEQ ID NO: 1937822 - RNA, 19 nt, Homo sapiens
auuaguuuaaaaagaaauu

SEQ ID NO: 1937823 - RNA, 13 nt, Homo sapiens
cugaagugguuca

SEQ ID NO: 1937824 - RNA, 11 nt, Homo sapiens
augaauucuua

SEQ ID NO: 1937825 - RNA, 21 nt, Homo sapiens
gucaaggcuucagugagccau

SEQ ID NO: 1937826 - RNA, 15 nt, Homo sapiens
ugguagaugacaaau

SEQ ID NO: 1937827 - RNA, 18 nt, Homo sapiens
caggccuccgucuuccca

SEQ ID NO: 1937828 - RNA, 19 nt, Homo sapiens
guguucacuaaacucugaa

SEQ ID NO: 1937829 - RNA, 16 nt, Homo sapiens
aagacgcguagcagca

SEQ ID NO: 1937830 - RNA, 22 nt, Homo sapiens
cacuguuuuuuggcuugcuuau

SEQ ID NO: 1937831 - RNA, 15 nt, Homo sapiens
aaccaccagguguca

SEQ ID NO: 1937832 - RNA, 15 nt, Homo sapiens
cccaccccagaagau

SEQ ID NO: 1937833 - RNA, 15 nt, Homo sapiens
cuccgccaaugcacg

SEQ ID NO: 1937834 - RNA, 21 nt, Homo sapiens
ugcuuuaauauaaaugcaaau

SEQ ID NO: 1937835 - RNA, 14 nt, Homo sapiens
guaaauaauacauu

SEQ ID NO: 1937836 - RNA, 23 nt, Homo sapiens
ggauauucuccucggacugugug

SEQ ID NO: 1937837 - RNA, 16 nt, Homo sapiens
agcucaggacugccau

SEQ ID NO: 1937838 - RNA, 15 nt, Homo sapiens
cauagcaccauuccu

SEQ ID NO: 1937839 - RNA, 22 nt, Homo sapiens
ccaauaaauuuguaacuuugca

SEQ ID NO: 1937840 - RNA, 16 nt, Homo sapiens
ccagcaccucaugcag

SEQ ID NO: 1937841 - RNA, 19 nt, Homo sapiens
ucuguagcucaaucugcaa

SEQ ID NO: 1937842 - RNA, 13 nt, Homo sapiens
agcagauuccaca

SEQ ID NO: 1937843 - RNA, 16 nt, Homo sapiens
ccuagaauaaucucau

SEQ ID NO: 1937844 - RNA, 22 nt, Homo sapiens
caguuaaacugugaagcuauug

SEQ ID NO: 1937845 - RNA, 22 nt, Homo sapiens
aggcuucccugacuugcuuuag

SEQ ID NO: 1937846 - RNA, 23 nt, Homo sapiens
uguuccaauuugacaaaacccac

SEQ ID NO: 1937847 - RNA, 23 nt, Homo sapiens
uacagggcaaaagggcagcugug

SEQ ID NO: 1937848 - RNA, 16 nt, Homo sapiens
ugucacuuaauaauca

SEQ ID NO: 1937849 - RNA, 20 nt, Homo sapiens
cuucaugucuuaaccuaccu

SEQ ID NO: 1937850 - RNA, 13 nt, Homo sapiens
gcaagcugagcug

SEQ ID NO: 1937851 - RNA, 15 nt, Homo sapiens
gcugggagagccaag

SEQ ID NO: 1937852 - RNA, 23 nt, Homo sapiens
ucuagucagaguauaauuuuggu

SEQ ID NO: 1937853 - RNA, 16 nt, Homo sapiens
cucaacuaccauuccu

SEQ ID NO: 1937854 - RNA, 12 nt, Homo sapiens
uugcuugaauuu

SEQ ID NO: 1937855 - RNA, 19 nt, Homo sapiens
cuguuucuaccuauaugca

SEQ ID NO: 1937856 - RNA, 16 nt, Homo sapiens
uguagcuuuauccuua

SEQ ID NO: 1937857 - RNA, 15 nt, Homo sapiens
ggugguaugugacac

SEQ ID NO: 1937858 - RNA, 16 nt, Homo sapiens
aucagccaaguuuuau

SEQ ID NO: 1937859 - RNA, 15 nt, Homo sapiens
auauuauaguauuca

SEQ ID NO: 1937860 - RNA, 20 nt, Homo sapiens
aggagaagaggggucaagag

SEQ ID NO: 1937861 - RNA, 15 nt, Homo sapiens
gcuacuucugaaacu

SEQ ID NO: 1937862 - RNA, 22 nt, Homo sapiens
cuguuuuuuuuuuuuagccaua

SEQ ID NO: 1937863 - RNA, 15 nt, Homo sapiens
gucugagagccauaa

SEQ ID NO: 1937864 - RNA, 13 nt, Homo sapiens
acauuuugacaca

SEQ ID NO: 1937865 - RNA, 14 nt, Homo sapiens
ugccugaacacugc

SEQ ID NO: 1937866 - RNA, 17 nt, Homo sapiens
agaaacaaauaauagca

SEQ ID NO: 1937867 - RNA, 11 nt, Homo sapiens
augucugugau

SEQ ID NO: 1937868 - RNA, 16 nt, Homo sapiens
aagauaaaaccagagc

SEQ ID NO: 1937869 - RNA, 18 nt, Homo sapiens
uuauccccguuucuugca

SEQ ID NO: 1937870 - RNA, 19 nt, Homo sapiens
ccaggguuucucugaagaa

SEQ ID NO: 1937871 - RNA, 19 nt, Homo sapiens
aauucuuacaaacaugugg

SEQ ID NO: 1937872 - RNA, 18 nt, Homo sapiens
caugaagauaaacuguuc

SEQ ID NO: 1937873 - RNA, 17 nt, Homo sapiens
agaaagcucaucucagc

SEQ ID NO: 1937874 - RNA, 19 nt, Homo sapiens
gagugagacuccaucucaa

SEQ ID NO: 1937875 - RNA, 17 nt, Homo sapiens
cuugaguagacuuggac

SEQ ID NO: 1937876 - RNA, 17 nt, Homo sapiens
aacaucuggaguccuau

SEQ ID NO: 1937877 - RNA, 18 nt, Homo sapiens
uauuaaagaugcagguuu

SEQ ID NO: 1937878 - RNA, 15 nt, Homo sapiens
gagaauaacacuggc

SEQ ID NO: 1937879 - RNA, 14 nt, Homo sapiens
aggagauuacaauu

SEQ ID NO: 1937880 - RNA, 21 nt, Homo sapiens
agaguccuggagcuggcucua

SEQ ID NO: 1937881 - RNA, 22 nt, Homo sapiens
ccuucucuuccuucacuuugca

SEQ ID NO: 1937882 - RNA, 11 nt, Homo sapiens
acucagugcag

SEQ ID NO: 1937883 - RNA, 18 nt, Homo sapiens
aaggacaaaaaaccucag

SEQ ID NO: 1937884 - RNA, 13 nt, Homo sapiens
uagacauuuauca

SEQ ID NO: 1937885 - RNA, 20 nt, Homo sapiens
ugagcacugaaccacauuca

SEQ ID NO: 1937886 - RNA, 17 nt, Homo sapiens
guauuuagcugccaaau

SEQ ID NO: 1937887 - RNA, 19 nt, Homo sapiens
acagccccucuggacacag

SEQ ID NO: 1937888 - RNA, 20 nt, Homo sapiens
uuaaaugcauguccucaaaa

SEQ ID NO: 1937889 - RNA, 20 nt, Homo sapiens
aaauagcugaaaagggcacu

SEQ ID NO: 1937890 - RNA, 18 nt, Homo sapiens
ccaucaggccuaaucuca

SEQ ID NO: 1937891 - RNA, 19 nt, Homo sapiens
augugaaggacaugagacu

SEQ ID NO: 1937892 - RNA, 19 nt, Homo sapiens
guaucucuucagucucuau

SEQ ID NO: 1937893 - RNA, 16 nt, Homo sapiens
uaugauccaggauugg

SEQ ID NO: 1937894 - RNA, 13 nt, Homo sapiens
cucccacuuucug

SEQ ID NO: 1937895 - RNA, 13 nt, Homo sapiens
cugugacuuugcc

SEQ ID NO: 1937896 - RNA, 13 nt, Homo sapiens
uccccacucccug

SEQ ID NO: 1937897 - RNA, 17 nt, Homo sapiens
acucuauaagauuccaa

SEQ ID NO: 1937898 - RNA, 23 nt, Homo sapiens
accaaaugaguccaaacuggaau

SEQ ID NO: 1937899 - RNA, 16 nt, Homo sapiens
aaucacauccacaaaa

SEQ ID NO: 1937900 - RNA, 15 nt, Homo sapiens
cagaugauuguucaa

SEQ ID NO: 1937901 - RNA, 15 nt, Homo sapiens
acuaucacugaacaa

SEQ ID NO: 1937902 - RNA, 21 nt, Homo sapiens
caaacccacgauuuucuccag

SEQ ID NO: 1937903 - RNA, 21 nt, Homo sapiens
uggauaugacccacacugcca

SEQ ID NO: 1937904 - RNA, 14 nt, Homo sapiens
gaccucugcaagag

SEQ ID NO: 1937905 - RNA, 14 nt, Homo sapiens
uucagccuuucuaa

SEQ ID NO: 1937906 - RNA, 15 nt, Homo sapiens
agcaaguguucacaa

SEQ ID NO: 1937907 - RNA, 13 nt, Homo sapiens
cgugggucaugca

SEQ ID NO: 1937908 - RNA, 23 nt, Homo sapiens
ggaaauaaauggugccugggaug

SEQ ID NO: 1937909 - RNA, 12 nt, Homo sapiens
acagcauugcuu

SEQ ID NO: 1937910 - RNA, 11 nt, Homo sapiens
cacggcugcug

SEQ ID NO: 1937911 - RNA, 22 nt, Homo sapiens
ucgccguguuacuguugcacug

SEQ ID NO: 1937912 - RNA, 21 nt, Homo sapiens
caacuuucuguuggauuccau

SEQ ID NO: 1937913 - RNA, 13 nt, Homo sapiens
cucaguuccugcc

SEQ ID NO: 1937914 - RNA, 17 nt, Homo sapiens
gggugccgcgagccagg

SEQ ID NO: 1937915 - RNA, 20 nt, Homo sapiens
agucccggaggccuucccuu

SEQ ID NO: 1937916 - RNA, 19 nt, Homo sapiens
cagaaauuccaacuccuga

SEQ ID NO: 1937917 - RNA, 22 nt, Homo sapiens
aaacuccuuguuaauccaguga

SEQ ID NO: 1937918 - RNA, 17 nt, Homo sapiens
gaauauuaagcacauua

SEQ ID NO: 1937919 - RNA, 18 nt, Homo sapiens
ugacuuaguguacaugaa

SEQ ID NO: 1937920 - RNA, 15 nt, Homo sapiens
gauuuacaguuucaa

SEQ ID NO: 1937921 - RNA, 20 nt, Homo sapiens
auguguuuauucauccagca

SEQ ID NO: 1937922 - RNA, 15 nt, Homo sapiens
ugcuugacuaucaca

SEQ ID NO: 1937923 - RNA, 18 nt, Homo sapiens
accugcuucauucaagcu

SEQ ID NO: 1937924 - RNA, 18 nt, Homo sapiens
aguuucaaacuuacuauu

SEQ ID NO: 1937925 - RNA, 23 nt, Homo sapiens
caucacuccucugucauaugcag

SEQ ID NO: 1937926 - RNA, 19 nt, Homo sapiens
ugccagugcuaaacuacug

SEQ ID NO: 1937927 - RNA, 15 nt, Homo sapiens
aagaaaagacuuuug

SEQ ID NO: 1937928 - RNA, 17 nt, Homo sapiens
gaagaucuugauggugu

SEQ ID NO: 1937929 - RNA, 18 nt, Homo sapiens
ccucuuuuucugaagcua

SEQ ID NO: 1937930 - RNA, 12 nt, Homo sapiens
ucagaacagcug

SEQ ID NO: 1937931 - RNA, 18 nt, Homo sapiens
ucuagucucugauuugca

SEQ ID NO: 1937932 - RNA, 15 nt, Homo sapiens
uggggaaguguucca

SEQ ID NO: 1937933 - RNA, 18 nt, Homo sapiens
gagccccucaugccacag

SEQ ID NO: 1937934 - RNA, 17 nt, Homo sapiens
agagcugaaaauggaga

SEQ ID NO: 1937935 - RNA, 19 nt, Homo sapiens
cagaaaaucuaccaagaac

SEQ ID NO: 1937936 - RNA, 15 nt, Homo sapiens
ucuaaacauuuuggg

SEQ ID NO: 1937937 - RNA, 16 nt, Homo sapiens
uuacuguggcugucug

SEQ ID NO: 1937938 - RNA, 16 nt, Homo sapiens
cacuuugguaaugugu

SEQ ID NO: 1937939 - RNA, 22 nt, Homo sapiens
gggauuaaggcgugagccacug

SEQ ID NO: 1937940 - RNA, 23 nt, Homo sapiens
acuguugagaccuuguggucucg

SEQ ID NO: 1937941 - RNA, 21 nt, Homo sapiens
caauaagaaaugaacaaaaga

SEQ ID NO: 1937942 - RNA, 15 nt, Homo sapiens
uaaauguucuaauaa

SEQ ID NO: 1937943 - RNA, 15 nt, Homo sapiens
cuucaagagcaucug

SEQ ID NO: 1937944 - RNA, 15 nt, Homo sapiens
agcaggucaggacuc

SEQ ID NO: 1937945 - RNA, 19 nt, Homo sapiens
guuauuucucugauuugca

SEQ ID NO: 1937946 - RNA, 19 nt, Homo sapiens
gaaggcgcugggugccugc

SEQ ID NO: 1937947 - RNA, 12 nt, Homo sapiens
aauucagucuuu

SEQ ID NO: 1937948 - RNA, 21 nt, Homo sapiens
aucagucuuucuugagcagau

SEQ ID NO: 1937949 - RNA, 13 nt, Homo sapiens
cucaugauccaac

SEQ ID NO: 1937950 - RNA, 13 nt, Homo sapiens
aacaguucuugga

SEQ ID NO: 1937951 - RNA, 22 nt, Homo sapiens
uauuuuuuaugaaacauuacag

SEQ ID NO: 1937952 - RNA, 16 nt, Homo sapiens
uagaaacacacauuuc

SEQ ID NO: 1937953 - RNA, 21 nt, Homo sapiens
uuaaaaucacaaacucaucca

SEQ ID NO: 1937954 - RNA, 20 nt, Homo sapiens
aaauuaccauaaaaugucag

SEQ ID NO: 1937955 - RNA, 16 nt, Homo sapiens
ucagucuacacucaca

SEQ ID NO: 1937956 - RNA, 21 nt, Homo sapiens
agccauucugugugugacucu

SEQ ID NO: 1937957 - RNA, 23 nt, Homo sapiens
caaaaauguuguauuggcuauga

SEQ ID NO: 1937958 - RNA, 13 nt, Homo sapiens
aagaaguugcuaa

SEQ ID NO: 1937959 - RNA, 18 nt, Homo sapiens
uaagguacacuguuucca

SEQ ID NO: 1937960 - RNA, 11 nt, Homo sapiens
ccuucacuuac

SEQ ID NO: 1937961 - RNA, 20 nt, Homo sapiens
agaggacuacucagcacugu

SEQ ID NO: 1937962 - RNA, 16 nt, Homo sapiens
aucauuuuauuaucac

SEQ ID NO: 1937963 - RNA, 19 nt, Homo sapiens
gccucuagaacagccagac

SEQ ID NO: 1937964 - RNA, 22 nt, Homo sapiens
aaugauuuagguacgucaaagc

SEQ ID NO: 1937965 - RNA, 13 nt, Homo sapiens
uagaagacaauuu

SEQ ID NO: 1937966 - RNA, 17 nt, Homo sapiens
cagugaaagcagucauc

SEQ ID NO: 1937967 - RNA, 15 nt, Homo sapiens
gccagagaagugaca

SEQ ID NO: 1937968 - RNA, 14 nt, Homo sapiens
auuccgauacaaag

SEQ ID NO: 1937969 - RNA, 14 nt, Homo sapiens
caggcaauuucacc

SEQ ID NO: 1937970 - RNA, 20 nt, Homo sapiens
ccccaucguuacccauuucu

SEQ ID NO: 1937971 - RNA, 16 nt, Homo sapiens
ugaaacauuugcaaaa

SEQ ID NO: 1937972 - RNA, 14 nt, Homo sapiens
ucacuaauauagua

SEQ ID NO: 1937973 - RNA, 18 nt, Homo sapiens
auucaguuccaauacuuc

SEQ ID NO: 1937974 - RNA, 20 nt, Homo sapiens
ugaugugauacaaauugaua

SEQ ID NO: 1937975 - RNA, 17 nt, Homo sapiens
cuaggagauaccaccga

SEQ ID NO: 1937976 - RNA, 16 nt, Homo sapiens
guuucuuuugguucca

SEQ ID NO: 1937977 - RNA, 12 nt, Homo sapiens
uaaaaugcaaua

SEQ ID NO: 1937978 - RNA, 12 nt, Homo sapiens
ccugccugcauu

SEQ ID NO: 1937979 - RNA, 17 nt, Homo sapiens
gaguacaccccaacagc

SEQ ID NO: 1937980 - RNA, 17 nt, Homo sapiens
aauuaagagauacauuc

SEQ ID NO: 1937981 - RNA, 22 nt, Homo sapiens
cuggccucagccgacugcacag

SEQ ID NO: 1937982 - RNA, 16 nt, Homo sapiens
uggauuccacacugca

SEQ ID NO: 1937983 - RNA, 13 nt, Homo sapiens
auucagagcucaa

SEQ ID NO: 1937984 - RNA, 21 nt, Homo sapiens
uugucaaaacuccacucagca

SEQ ID NO: 1937985 - RNA, 21 nt, Homo sapiens
cuguuggucaaaaucugcaaa

SEQ ID NO: 1937986 - RNA, 18 nt, Homo sapiens
cucaagugucucagucca

SEQ ID NO: 1937987 - RNA, 22 nt, Homo sapiens
agagcggaaggagggagcucug

SEQ ID NO: 1937988 - RNA, 21 nt, Homo sapiens
uguuaaccaaauuuugagcaa

SEQ ID NO: 1937989 - RNA, 19 nt, Homo sapiens
ucuccuggucgcuuugcca

SEQ ID NO: 1937990 - RNA, 17 nt, Homo sapiens
uaauucuuacacugccu

SEQ ID NO: 1937991 - RNA, 19 nt, Homo sapiens
ucacucuugccaaccugua

SEQ ID NO: 1937992 - RNA, 20 nt, Homo sapiens
ccucuuuuuucuaucugcca

SEQ ID NO: 1937993 - RNA, 18 nt, Homo sapiens
aaucacuggcuguuaauc

SEQ ID NO: 1937994 - RNA, 19 nt, Homo sapiens
ugggggagggaagaccaga

SEQ ID NO: 1937995 - RNA, 14 nt, Homo sapiens
ucaucuagcuccau

SEQ ID NO: 1937996 - RNA, 17 nt, Homo sapiens
cccuuuauguacaggau

SEQ ID NO: 1937997 - RNA, 21 nt, Homo sapiens
augcuuguggccaaugcaucc

SEQ ID NO: 1937998 - RNA, 15 nt, Homo sapiens
gacaugcccugugug

SEQ ID NO: 1937999 - RNA, 15 nt, Homo sapiens
guuugucaacacaaa

SEQ ID NO: 1938000 - RNA, 17 nt, Homo sapiens
acaauaauucauauucu

SEQ ID NO: 1938001 - RNA, 22 nt, Homo sapiens
acaccuaagagaaaaagaucga

SEQ ID NO: 1938002 - RNA, 13 nt, Homo sapiens
guaccucuaagua

SEQ ID NO: 1938003 - RNA, 18 nt, Homo sapiens
gaacacacagacuuucug

SEQ ID NO: 1938004 - RNA, 11 nt, Homo sapiens
aaauugucaaa

SEQ ID NO: 1938005 - RNA, 19 nt, Homo sapiens
gucuuuaaaagucauucaa

SEQ ID NO: 1938006 - RNA, 19 nt, Homo sapiens
auucagguauuuguaauag

SEQ ID NO: 1938007 - RNA, 18 nt, Homo sapiens
cauuuuaugauaaauaau

SEQ ID NO: 1938008 - RNA, 22 nt, Homo sapiens
uuucaaucucaucugauaugca

SEQ ID NO: 1938009 - RNA, 22 nt, Homo sapiens
ccuacuuucuccugaaacccaa

SEQ ID NO: 1938010 - RNA, 17 nt, Homo sapiens
ucaaaugcuacucagua

SEQ ID NO: 1938011 - RNA, 20 nt, Homo sapiens
auuaggaucuaugcaauuuu

SEQ ID NO: 1938012 - RNA, 22 nt, Homo sapiens
uugaggguccucaguccacugc

SEQ ID NO: 1938013 - RNA, 20 nt, Homo sapiens
auuuugcuaagacauaaucu

SEQ ID NO: 1938014 - RNA, 17 nt, Homo sapiens
caaugccgccugucaau

SEQ ID NO: 1938015 - RNA, 21 nt, Homo sapiens
uacuuagagaugcuacuguca

SEQ ID NO: 1938016 - RNA, 20 nt, Homo sapiens
gaacuggauaaaaucuucca

SEQ ID NO: 1938017 - RNA, 17 nt, Homo sapiens
uguaaacaaaaugaagc

SEQ ID NO: 1938018 - RNA, 21 nt, Homo sapiens
uuuuuggggaaaaaagcacau

SEQ ID NO: 1938019 - RNA, 12 nt, Homo sapiens
uuuacaaaguau

SEQ ID NO: 1938020 - RNA, 22 nt, Homo sapiens
uuuaccauaaaaauccuucuca

SEQ ID NO: 1938021 - RNA, 16 nt, Homo sapiens
ucuccgucucccaaag

SEQ ID NO: 1938022 - RNA, 16 nt, Homo sapiens
gcccagaggcuccauc

SEQ ID NO: 1938023 - RNA, 17 nt, Homo sapiens
uuaaaggucauaugcac

SEQ ID NO: 1938024 - RNA, 24 nt, Homo sapiens
aaagaagauuuugccacauuugau

SEQ ID NO: 1938025 - RNA, 21 nt, Homo sapiens
uggccacgagguuaaagaagc

SEQ ID NO: 1938026 - RNA, 19 nt, Homo sapiens
ugaaauuuaauauagcuau

SEQ ID NO: 1938027 - RNA, 13 nt, Homo sapiens
cgagccuucucac

SEQ ID NO: 1938028 - RNA, 13 nt, Homo sapiens
cagcucccugugc

SEQ ID NO: 1938029 - RNA, 16 nt, Homo sapiens
uucugauacguguaug

SEQ ID NO: 1938030 - RNA, 21 nt, Homo sapiens
uacccacuuuguggauuugau

SEQ ID NO: 1938031 - RNA, 15 nt, Homo sapiens
uuagucgagccaagu

SEQ ID NO: 1938032 - RNA, 14 nt, Homo sapiens
aauccuagcacagc

SEQ ID NO: 1938033 - RNA, 14 nt, Homo sapiens
uguaaggacgccuu

SEQ ID NO: 1938034 - RNA, 15 nt, Homo sapiens
ccuguuccugccaca

SEQ ID NO: 1938035 - RNA, 18 nt, Homo sapiens
ucacaacaggcauuccag

SEQ ID NO: 1938036 - RNA, 21 nt, Homo sapiens
uccaucauacauuagugccau

SEQ ID NO: 1938037 - RNA, 21 nt, Homo sapiens
gaaauuggaagaagcacugau

SEQ ID NO: 1938038 - RNA, 20 nt, Homo sapiens
ggccaggggugcuccugugc

SEQ ID NO: 1938039 - RNA, 17 nt, Homo sapiens
guuaccaugucuuucuc

SEQ ID NO: 1938040 - RNA, 18 nt, Homo sapiens
gcccuuaaggacaaaaau

SEQ ID NO: 1938041 - RNA, 14 nt, Homo sapiens
caggacccucagga

SEQ ID NO: 1938042 - RNA, 18 nt, Homo sapiens
uuaguuuuuaaaauaucu

SEQ ID NO: 1938043 - RNA, 21 nt, Homo sapiens
ucauaacuuggccauguucuc

SEQ ID NO: 1938044 - RNA, 18 nt, Homo sapiens
uuugacagagucucaauc

SEQ ID NO: 1938045 - RNA, 20 nt, Homo sapiens
cauggguguuuugaucucug

SEQ ID NO: 1938046 - RNA, 19 nt, Homo sapiens
ccuggggauucacccagug

SEQ ID NO: 1938047 - RNA, 11 nt, Homo sapiens
ggcagacucac

SEQ ID NO: 1938048 - RNA, 21 nt, Homo sapiens
gcacaguaucuuuucuuucaa

SEQ ID NO: 1938049 - RNA, 15 nt, Homo sapiens
cauucacagcccaga

SEQ ID NO: 1938050 - RNA, 20 nt, Homo sapiens
cagacaaauacuuagacagu

SEQ ID NO: 1938051 - RNA, 23 nt, Homo sapiens
guaaugaguuuaaaaaucaacuu

SEQ ID NO: 1938052 - RNA, 22 nt, Homo sapiens
guggcauucacaucucauguaa

SEQ ID NO: 1938053 - RNA, 13 nt, Homo sapiens
gcaccccacugca

SEQ ID NO: 1938054 - RNA, 20 nt, Homo sapiens
cauuucucuuccccuuagaa

SEQ ID NO: 1938055 - RNA, 16 nt, Homo sapiens
guuacagcuacuauaa

SEQ ID NO: 1938056 - RNA, 22 nt, Homo sapiens
accuuacauuugaaaucuauga

SEQ ID NO: 1938057 - RNA, 20 nt, Homo sapiens
ucaaauuuuuaaguaauuuc

SEQ ID NO: 1938058 - RNA, 21 nt, Homo sapiens
cuucaggauacuguaguuucc

SEQ ID NO: 1938059 - RNA, 14 nt, Homo sapiens
guuuucuuucucac

SEQ ID NO: 1938060 - RNA, 16 nt, Homo sapiens
gucugagaauuuccaa

SEQ ID NO: 1938061 - RNA, 19 nt, Homo sapiens
aaaacuacuguuaacacug

SEQ ID NO: 1938062 - RNA, 15 nt, Homo sapiens
uggagcaugcaacac

SEQ ID NO: 1938063 - RNA, 14 nt, Homo sapiens
ccuugaaugggcug

SEQ ID NO: 1938064 - RNA, 20 nt, Homo sapiens
aaaaauaaccaaaaaaugug

SEQ ID NO: 1938065 - RNA, 21 nt, Homo sapiens
accccgucgaggggcucucag

SEQ ID NO: 1938066 - RNA, 15 nt, Homo sapiens
auugucaacacuaua

SEQ ID NO: 1938067 - RNA, 18 nt, Homo sapiens
ugcaagcagggcucugcc

SEQ ID NO: 1938068 - RNA, 15 nt, Homo sapiens
cggggccagcacuuc

SEQ ID NO: 1938069 - RNA, 19 nt, Homo sapiens
auggaauucccuccugagu

SEQ ID NO: 1938070 - RNA, 19 nt, Homo sapiens
uaccagagccguuacuaca

SEQ ID NO: 1938071 - RNA, 23 nt, Homo sapiens
aaauaccgagggaucaaucugca

SEQ ID NO: 1938072 - RNA, 21 nt, Homo sapiens
aauacuguaagucucaauuaa

SEQ ID NO: 1938073 - RNA, 15 nt, Homo sapiens
cauauuaacaugcuu

SEQ ID NO: 1938074 - RNA, 15 nt, Homo sapiens
uguauauaugugcaa

SEQ ID NO: 1938075 - RNA, 14 nt, Homo sapiens
aaaagucucacaaa

SEQ ID NO: 1938076 - RNA, 23 nt, Homo sapiens
uagaauggaagccuccaccugca

SEQ ID NO: 1938077 - RNA, 14 nt, Homo sapiens
agagaauaaauuaa

SEQ ID NO: 1938078 - RNA, 18 nt, Homo sapiens
cuuagaaggcacugggaa

SEQ ID NO: 1938079 - RNA, 20 nt, Homo sapiens
ccagauggccgggacaugca

SEQ ID NO: 1938080 - RNA, 15 nt, Homo sapiens
guacucggcuuccug

SEQ ID NO: 1938081 - RNA, 17 nt, Homo sapiens
auaauaaaauucauucc

SEQ ID NO: 1938082 - RNA, 22 nt, Homo sapiens
uacuauauuuauugauuucaag

SEQ ID NO: 1938083 - RNA, 12 nt, Homo sapiens
uagcuccuuccc

SEQ ID NO: 1938084 - RNA, 23 nt, Homo sapiens
ucuucuagaauccccacagggaa

SEQ ID NO: 1938085 - RNA, 16 nt, Homo sapiens
aacacugcagcauuuu

SEQ ID NO: 1938086 - RNA, 23 nt, Homo sapiens
uauuacugguaggaacuugagaa

SEQ ID NO: 1938087 - RNA, 16 nt, Homo sapiens
cauagaugaacuauua

SEQ ID NO: 1938088 - RNA, 23 nt, Homo sapiens
cugggcuguaacguggcacuggu

SEQ ID NO: 1938089 - RNA, 17 nt, Homo sapiens
ucuuuuuuagcucucuu

SEQ ID NO: 1938090 - RNA, 17 nt, Homo sapiens
gagagcaugcuauccca

SEQ ID NO: 1938091 - RNA, 16 nt, Homo sapiens
ugacuaauagagcucc

SEQ ID NO: 1938092 - RNA, 15 nt, Homo sapiens
ucauuuccccuccca

SEQ ID NO: 1938093 - RNA, 17 nt, Homo sapiens
ucaaucccucaaaacaa

SEQ ID NO: 1938094 - RNA, 22 nt, Homo sapiens
caaauaagcaucuguguaaccu

SEQ ID NO: 1938095 - RNA, 21 nt, Homo sapiens
ugugguccagguccuuuccac

SEQ ID NO: 1938096 - RNA, 12 nt, Homo sapiens
auaauaugcagu

SEQ ID NO: 1938097 - RNA, 16 nt, Homo sapiens
ucuuggcucacugcaa

SEQ ID NO: 1938098 - RNA, 20 nt, Homo sapiens
acagugagaccccuucucaa

SEQ ID NO: 1938099 - RNA, 14 nt, Homo sapiens
ugacgacagugcau

SEQ ID NO: 1938100 - RNA, 13 nt, Homo sapiens
aagccacaggagc

SEQ ID NO: 1938101 - RNA, 15 nt, Homo sapiens
guacguugugcauuu

SEQ ID NO: 1938102 - RNA, 22 nt, Homo sapiens
uauuuguauuuucaagacuuua

SEQ ID NO: 1938103 - RNA, 22 nt, Homo sapiens
aucuuugcacuccaaucauuca

SEQ ID NO: 1938104 - RNA, 13 nt, Homo sapiens
uguaucagaguug

SEQ ID NO: 1938105 - RNA, 20 nt, Homo sapiens
gaaaugcuugcucaggcuca

SEQ ID NO: 1938106 - RNA, 21 nt, Homo sapiens
uccauucuuggcaucuacucu

SEQ ID NO: 1938107 - RNA, 16 nt, Homo sapiens
agaaaauugcugugcc

SEQ ID NO: 1938108 - RNA, 19 nt, Homo sapiens
caugguuuuucacauugca

SEQ ID NO: 1938109 - RNA, 15 nt, Homo sapiens
cugggaaacaguccc

SEQ ID NO: 1938110 - RNA, 17 nt, Homo sapiens
cuacuuucucaaaaugg

SEQ ID NO: 1938111 - RNA, 15 nt, Homo sapiens
acacccacagaagga

SEQ ID NO: 1938112 - RNA, 23 nt, Homo sapiens
aaauauuuuccaaagagccaugu

SEQ ID NO: 1938113 - RNA, 17 nt, Homo sapiens
cuucaaaccccuacuga

SEQ ID NO: 1938114 - RNA, 13 nt, Homo sapiens
uugacagcaugaa

SEQ ID NO: 1938115 - RNA, 22 nt, Homo sapiens
uguaucuuucuuucucuaaugu

SEQ ID NO: 1938116 - RNA, 21 nt, Homo sapiens
uggagaauguggagaacuaaa

SEQ ID NO: 1938117 - RNA, 13 nt, Homo sapiens
uuccauugauuca

SEQ ID NO: 1938118 - RNA, 14 nt, Homo sapiens
agccaugccagcug

SEQ ID NO: 1938119 - RNA, 13 nt, Homo sapiens
ucaggauucuguu

SEQ ID NO: 1938120 - RNA, 15 nt, Homo sapiens
auaacuacauuaaaa

SEQ ID NO: 1938121 - RNA, 15 nt, Homo sapiens
acagcccccucugcc

SEQ ID NO: 1938122 - RNA, 23 nt, Homo sapiens
uuuagaaaagaaagcaaacuuaa

SEQ ID NO: 1938123 - RNA, 23 nt, Homo sapiens
augauauuuuaugcaaacaguuc

SEQ ID NO: 1938124 - RNA, 18 nt, Homo sapiens
gaacuuggcacacucucc

SEQ ID NO: 1938125 - RNA, 15 nt, Homo sapiens
gaaucaucauaucua

SEQ ID NO: 1938126 - RNA, 19 nt, Homo sapiens
acuaauguguaagacaaaa

SEQ ID NO: 1938127 - RNA, 15 nt, Homo sapiens
agaauaaaagaugau

SEQ ID NO: 1938128 - RNA, 15 nt, Homo sapiens
uacugaaauacauau

SEQ ID NO: 1938129 - RNA, 15 nt, Homo sapiens
auuauuuaauuugua

SEQ ID NO: 1938130 - RNA, 16 nt, Homo sapiens
cagcaaggauggagcu

SEQ ID NO: 1938131 - RNA, 12 nt, Homo sapiens
ggaccacugcau

SEQ ID NO: 1938132 - RNA, 15 nt, Homo sapiens
aaacucccaauggau

SEQ ID NO: 1938133 - RNA, 16 nt, Homo sapiens
uagguugaaauucaua

SEQ ID NO: 1938134 - RNA, 19 nt, Homo sapiens
guucccagcaaaguuuuca

SEQ ID NO: 1938135 - RNA, 15 nt, Homo sapiens
caguuuucguagguu

SEQ ID NO: 1938136 - RNA, 13 nt, Homo sapiens
aguauccacuuug

SEQ ID NO: 1938137 - RNA, 17 nt, Homo sapiens
uagcagugaguacucau

SEQ ID NO: 1938138 - RNA, 16 nt, Homo sapiens
cuuaagagacacucca

SEQ ID NO: 1938139 - RNA, 13 nt, Homo sapiens
cacucuuguacaa

SEQ ID NO: 1938140 - RNA, 11 nt, Homo sapiens
gccauucugau

SEQ ID NO: 1938141 - RNA, 21 nt, Homo sapiens
uugaauaccauuaaaacugcu

SEQ ID NO: 1938142 - RNA, 16 nt, Homo sapiens
cagcaaaauguugaag

SEQ ID NO: 1938143 - RNA, 22 nt, Homo sapiens
acauccccaucccucuacuuuc

SEQ ID NO: 1938144 - RNA, 14 nt, Homo sapiens
ugcacugaaaugga

SEQ ID NO: 1938145 - RNA, 18 nt, Homo sapiens
cccugaucuagugcagua

SEQ ID NO: 1938146 - RNA, 17 nt, Homo sapiens
gauucaauucaacacuc

SEQ ID NO: 1938147 - RNA, 16 nt, Homo sapiens
acauuuugaucacucu

SEQ ID NO: 1938148 - RNA, 15 nt, Homo sapiens
ugccuggacugacca

SEQ ID NO: 1938149 - RNA, 19 nt, Homo sapiens
agugcaaauccauagcaca

SEQ ID NO: 1938150 - RNA, 15 nt, Homo sapiens
guacucucugcucua

SEQ ID NO: 1938151 - RNA, 13 nt, Homo sapiens
uguccccuacccc

SEQ ID NO: 1938152 - RNA, 12 nt, Homo sapiens
agcuacuggaau

SEQ ID NO: 1938153 - RNA, 19 nt, Homo sapiens
uccauccacacacagcagc

SEQ ID NO: 1938154 - RNA, 19 nt, Homo sapiens
uuggacuggauaagugcua

SEQ ID NO: 1938155 - RNA, 18 nt, Homo sapiens
acagaaagauuugaugua

SEQ ID NO: 1938156 - RNA, 15 nt, Homo sapiens
ugacacacagcacuc

SEQ ID NO: 1938157 - RNA, 19 nt, Homo sapiens
ugcaagcacagcauaccug

SEQ ID NO: 1938158 - RNA, 19 nt, Homo sapiens
cuccauccggcuccuguca

SEQ ID NO: 1938159 - RNA, 15 nt, Homo sapiens
acacaaacuggcuua

SEQ ID NO: 1938160 - RNA, 14 nt, Homo sapiens
ggcuccacuacaga

SEQ ID NO: 1938161 - RNA, 14 nt, Homo sapiens
aacauauguccauc

SEQ ID NO: 1938162 - RNA, 17 nt, Homo sapiens
uauucccugcacacaca

SEQ ID NO: 1938163 - RNA, 19 nt, Homo sapiens
ccaggcuggccagcauggu

SEQ ID NO: 1938164 - RNA, 21 nt, Homo sapiens
ucuacaguuaggguugaguua

SEQ ID NO: 1938165 - RNA, 18 nt, Homo sapiens
uacuucauacaacauaua

SEQ ID NO: 1938166 - RNA, 13 nt, Homo sapiens
ggucugugacugg

SEQ ID NO: 1938167 - RNA, 16 nt, Homo sapiens
cuuguccucauucuug

SEQ ID NO: 1938168 - RNA, 20 nt, Homo sapiens
ccauaccccugccuggguuu

SEQ ID NO: 1938169 - RNA, 19 nt, Homo sapiens
ugaacuguaaauaugucac

SEQ ID NO: 1938170 - RNA, 22 nt, Homo sapiens
gcccagcggccccucccacaca

SEQ ID NO: 1938171 - RNA, 22 nt, Homo sapiens
aacggagggugaagagcauagu

SEQ ID NO: 1938172 - RNA, 15 nt, Homo sapiens
cugacgcagcacaag

SEQ ID NO: 1938173 - RNA, 15 nt, Homo sapiens
auauuuuuuuguaga

SEQ ID NO: 1938174 - RNA, 20 nt, Homo sapiens
caggaggcagcuguugcagu

SEQ ID NO: 1938175 - RNA, 17 nt, Homo sapiens
ucaaggcccucagagau

SEQ ID NO: 1938176 - RNA, 18 nt, Homo sapiens
gccuuuggucuccuggau

SEQ ID NO: 1938177 - RNA, 19 nt, Homo sapiens
uaggggauggggaggaaga

SEQ ID NO: 1938178 - RNA, 15 nt, Homo sapiens
acuuucuucugaaua

SEQ ID NO: 1938179 - RNA, 18 nt, Homo sapiens
aaaugcuguauuuuuaca

SEQ ID NO: 1938180 - RNA, 13 nt, Homo sapiens
cuauaaguguuca

SEQ ID NO: 1938181 - RNA, 15 nt, Homo sapiens
acauuauuacuccuu

SEQ ID NO: 1938182 - RNA, 18 nt, Homo sapiens
uaccuaguagucauuuca

SEQ ID NO: 1938183 - RNA, 12 nt, Homo sapiens
cuuugagugaag

SEQ ID NO: 1938184 - RNA, 18 nt, Homo sapiens
uggaaugaaauaauucaa

SEQ ID NO: 1938185 - RNA, 16 nt, Homo sapiens
ucaguggacccugugg

SEQ ID NO: 1938186 - RNA, 20 nt, Homo sapiens
cagacuucucccgugagcca

SEQ ID NO: 1938187 - RNA, 17 nt, Homo sapiens
gauagaacuacuuugaa

SEQ ID NO: 1938188 - RNA, 17 nt, Homo sapiens
ccuggcuccuugcagca

SEQ ID NO: 1938189 - RNA, 22 nt, Homo sapiens
acuaucgucaggaaaccaaaua

SEQ ID NO: 1938190 - RNA, 16 nt, Homo sapiens
uucuagggcugggaaa

SEQ ID NO: 1938191 - RNA, 15 nt, Homo sapiens
ucacuucaauccuca

SEQ ID NO: 1938192 - RNA, 14 nt, Homo sapiens
cugggcugcucuca

SEQ ID NO: 1938193 - RNA, 19 nt, Homo sapiens
uuauugggcaagugauuga

SEQ ID NO: 1938194 - RNA, 23 nt, Homo sapiens
ugccuuuuccuauguaaauauua

SEQ ID NO: 1938195 - RNA, 13 nt, Homo sapiens
caggccaccugcc

SEQ ID NO: 1938196 - RNA, 13 nt, Homo sapiens
cuggccaccagcc

SEQ ID NO: 1938197 - RNA, 13 nt, Homo sapiens
augccaccaucca

SEQ ID NO: 1938198 - RNA, 20 nt, Homo sapiens
cagccucccgaguagcugag

SEQ ID NO: 1938199 - RNA, 15 nt, Homo sapiens
aaagaucuacaugaa

SEQ ID NO: 1938200 - RNA, 23 nt, Homo sapiens
auuggcaauaugaauauauauua

SEQ ID NO: 1938201 - RNA, 13 nt, Homo sapiens
uccugaacuucac

SEQ ID NO: 1938202 - RNA, 16 nt, Homo sapiens
cuguagaucagggaua

SEQ ID NO: 1938203 - RNA, 17 nt, Homo sapiens
uggcuacacacaaacca

SEQ ID NO: 1938204 - RNA, 14 nt, Homo sapiens
cgcacuaacccagc

SEQ ID NO: 1938205 - RNA, 19 nt, Homo sapiens
aauguuauccaacuauuaa

SEQ ID NO: 1938206 - RNA, 15 nt, Homo sapiens
ucagaaaagugacag

SEQ ID NO: 1938207 - RNA, 22 nt, Homo sapiens
acccggcucccccugcuucuca

SEQ ID NO: 1938208 - RNA, 17 nt, Homo sapiens
cuggccuaccacagcug

SEQ ID NO: 1938209 - RNA, 22 nt, Homo sapiens
auggcucccgaguacaguagua

SEQ ID NO: 1938210 - RNA, 17 nt, Homo sapiens
auaggccagaguugcaa

SEQ ID NO: 1938211 - RNA, 14 nt, Homo sapiens
uagcugucucucaa

SEQ ID NO: 1938212 - RNA, 20 nt, Homo sapiens
uauuauaccaaaauguugcu

SEQ ID NO: 1938213 - RNA, 17 nt, Homo sapiens
auuauaauauacuauau

SEQ ID NO: 1938214 - RNA, 22 nt, Homo sapiens
cagaacaccugaggacaggagu

SEQ ID NO: 1938215 - RNA, 14 nt, Homo sapiens
gucuuagacuuuga

SEQ ID NO: 1938216 - RNA, 24 nt, Homo sapiens
ugcugucuaugauuguacuuugaa

SEQ ID NO: 1938217 - RNA, 21 nt, Homo sapiens
gaacugcuggauucaagugau

SEQ ID NO: 1938218 - RNA, 20 nt, Homo sapiens
acaggugcugaacugugcau

SEQ ID NO: 1938219 - RNA, 16 nt, Homo sapiens
caugcaaggcacugua

SEQ ID NO: 1938220 - RNA, 15 nt, Homo sapiens
aaauuaacuuuacau

SEQ ID NO: 1938221 - RNA, 23 nt, Homo sapiens
cucugaaguuaaaaugauuuaca

SEQ ID NO: 1938222 - RNA, 20 nt, Homo sapiens
cguggaauucaccuguguuu

SEQ ID NO: 1938223 - RNA, 14 nt, Homo sapiens
ugcaaacccaguga

SEQ ID NO: 1938224 - RNA, 13 nt, Homo sapiens
auaaaaaacaguc

SEQ ID NO: 1938225 - RNA, 18 nt, Homo sapiens
gcccuuuccccccauguu

SEQ ID NO: 1938226 - RNA, 15 nt, Homo sapiens
cagcugagacaggcc

SEQ ID NO: 1938227 - RNA, 20 nt, Homo sapiens
augcggaguccauuauuuga

SEQ ID NO: 1938228 - RNA, 21 nt, Homo sapiens
caaagcccucccuaccuacca

SEQ ID NO: 1938229 - RNA, 20 nt, Homo sapiens
aggaauaaagacuugugcau

SEQ ID NO: 1938230 - RNA, 16 nt, Homo sapiens
cuuggugccggucaca

SEQ ID NO: 1938231 - RNA, 13 nt, Homo sapiens
uauguagcacuac

SEQ ID NO: 1938232 - RNA, 18 nt, Homo sapiens
ccugaaggaaaaugacuc

SEQ ID NO: 1938233 - RNA, 12 nt, Homo sapiens
gggagacuggaa

SEQ ID NO: 1938234 - RNA, 13 nt, Homo sapiens
cgcugcaggaaac

SEQ ID NO: 1938235 - RNA, 22 nt, Homo sapiens
aggaaaacacuauuuccaaaag

SEQ ID NO: 1938236 - RNA, 24 nt, Homo sapiens
aggccuugaagaauacacugugac

SEQ ID NO: 1938237 - RNA, 17 nt, Homo sapiens
ugcuuuuuuaaccaagg

SEQ ID NO: 1938238 - RNA, 19 nt, Homo sapiens
ucucaguuauguaguuucu

SEQ ID NO: 1938239 - RNA, 18 nt, Homo sapiens
ccuucugcccaucuucca

SEQ ID NO: 1938240 - RNA, 20 nt, Homo sapiens
cuaucauggacuacaccagg

SEQ ID NO: 1938241 - RNA, 14 nt, Homo sapiens
caaggggacauucc

SEQ ID NO: 1938242 - RNA, 19 nt, Homo sapiens
gaaaugaggccuacucuaa

SEQ ID NO: 1938243 - RNA, 22 nt, Homo sapiens
acuagaauuuaguuuguacuca

SEQ ID NO: 1938244 - RNA, 16 nt, Homo sapiens
uaggcuggaauguucc

SEQ ID NO: 1938245 - RNA, 15 nt, Homo sapiens
agugcaguggcacca

SEQ ID NO: 1938246 - RNA, 21 nt, Homo sapiens
cugcuggaaggcagcuugugg

SEQ ID NO: 1938247 - RNA, 14 nt, Homo sapiens
ccucacucucgcca

SEQ ID NO: 1938248 - RNA, 21 nt, Homo sapiens
cauguaggaguguuuaucuuu

SEQ ID NO: 1938249 - RNA, 17 nt, Homo sapiens
cacaacuuugcuuuuag

SEQ ID NO: 1938250 - RNA, 18 nt, Homo sapiens
ucuaaagaaaaaugccug

SEQ ID NO: 1938251 - RNA, 18 nt, Homo sapiens
auaacuuucucugugaaa

SEQ ID NO: 1938252 - RNA, 18 nt, Homo sapiens
gguguucuguuucaaugu

SEQ ID NO: 1938253 - RNA, 18 nt, Homo sapiens
guauucaguaaggcagug

SEQ ID NO: 1938254 - RNA, 21 nt, Homo sapiens
auacaaagcaaacaaacucaa

SEQ ID NO: 1938255 - RNA, 15 nt, Homo sapiens
gugugacccugggca

SEQ ID NO: 1938256 - RNA, 19 nt, Homo sapiens
uugugguaacuugcugcuu

SEQ ID NO: 1938257 - RNA, 12 nt, Homo sapiens
aagccacauggu

SEQ ID NO: 1938258 - RNA, 13 nt, Homo sapiens
aagaauaauucaa

SEQ ID NO: 1938259 - RNA, 17 nt, Homo sapiens
cccagaguauugggauu

SEQ ID NO: 1938260 - RNA, 17 nt, Homo sapiens
acaugccccguuuuuga

SEQ ID NO: 1938261 - RNA, 15 nt, Homo sapiens
ucccagcuacucggg

SEQ ID NO: 1938262 - RNA, 23 nt, Homo sapiens
gaaauguguucuguaauggggac

SEQ ID NO: 1938263 - RNA, 23 nt, Homo sapiens
auagcuauggaaggucuugcgca

SEQ ID NO: 1938264 - RNA, 20 nt, Homo sapiens
aaugcauuccagaacaaauu

SEQ ID NO: 1938265 - RNA, 18 nt, Homo sapiens
ccuguucucucugugcuc

SEQ ID NO: 1938266 - RNA, 15 nt, Homo sapiens
guuuagggucccuaa

SEQ ID NO: 1938267 - RNA, 13 nt, Homo sapiens
uucauuacuaaaa

SEQ ID NO: 1938268 - RNA, 17 nt, Homo sapiens
uguccucuucugugagu

SEQ ID NO: 1938269 - RNA, 13 nt, Homo sapiens
aggucugcuccug

SEQ ID NO: 1938270 - RNA, 20 nt, Homo sapiens
gacaucccccuccuugccgc

SEQ ID NO: 1938271 - RNA, 22 nt, Homo sapiens
cuguugcaaacucagugcaaac

SEQ ID NO: 1938272 - RNA, 16 nt, Homo sapiens
agaagcaguugcaaua

SEQ ID NO: 1938273 - RNA, 17 nt, Homo sapiens
ucccagacacauucaca

SEQ ID NO: 1938274 - RNA, 21 nt, Homo sapiens
uuguuucaagacugacauuuu

SEQ ID NO: 1938275 - RNA, 21 nt, Homo sapiens
aauguuuuagaaugagacuua

SEQ ID NO: 1938276 - RNA, 22 nt, Homo sapiens
uuagggcaucgcuccuccucac

SEQ ID NO: 1938277 - RNA, 21 nt, Homo sapiens
cguuuucgaggaagaaccugu

SEQ ID NO: 1938278 - RNA, 23 nt, Homo sapiens
guuggaaccguguccagcacaga

SEQ ID NO: 1938279 - RNA, 20 nt, Homo sapiens
agcagauugcagaaauacag

SEQ ID NO: 1938280 - RNA, 19 nt, Homo sapiens
agcuccagaauauggaaac

SEQ ID NO: 1938281 - RNA, 19 nt, Homo sapiens
cauauuuagcuuugcacau

SEQ ID NO: 1938282 - RNA, 18 nt, Homo sapiens
guuucaccucuuugcucc

SEQ ID NO: 1938283 - RNA, 21 nt, Homo sapiens
aucccagggcucccugccauu

SEQ ID NO: 1938284 - RNA, 15 nt, Homo sapiens
cuuucuguugccaca

SEQ ID NO: 1938285 - RNA, 12 nt, Homo sapiens
ugccaugucaca

SEQ ID NO: 1938286 - RNA, 21 nt, Homo sapiens
acacauuuuuuaaaugcaccu

SEQ ID NO: 1938287 - RNA, 16 nt, Homo sapiens
gcaccacgggcuuuua

SEQ ID NO: 1938288 - RNA, 16 nt, Homo sapiens
gauuagguagacuuug

SEQ ID NO: 1938289 - RNA, 11 nt, Homo sapiens
cuuacauaguu

SEQ ID NO: 1938290 - RNA, 15 nt, Homo sapiens
aauuucuucauguga

SEQ ID NO: 1938291 - RNA, 20 nt, Homo sapiens
agacugacugaguagcucau

SEQ ID NO: 1938292 - RNA, 21 nt, Homo sapiens
uauuaaaauuuuuugauguca

SEQ ID NO: 1938293 - RNA, 21 nt, Homo sapiens
aaagaagucuuggaaacagac

SEQ ID NO: 1938294 - RNA, 15 nt, Homo sapiens
accacuccauuccca

SEQ ID NO: 1938295 - RNA, 17 nt, Homo sapiens
auacccuuuaucucugu

SEQ ID NO: 1938296 - RNA, 15 nt, Homo sapiens
auggaggaacaguau

SEQ ID NO: 1938297 - RNA, 12 nt, Homo sapiens
ucguuacauugu

SEQ ID NO: 1938298 - RNA, 23 nt, Homo sapiens
auaacuuuuuugagucauugacu

SEQ ID NO: 1938299 - RNA, 15 nt, Homo sapiens
caaacacccaugccc

SEQ ID NO: 1938300 - RNA, 20 nt, Homo sapiens
auucugagaugacuauucag

SEQ ID NO: 1938301 - RNA, 21 nt, Homo sapiens
gcaaaaaaaaaaauuacauua

SEQ ID NO: 1938302 - RNA, 19 nt, Homo sapiens
uauuuaaaaaaaaagucag

SEQ ID NO: 1938303 - RNA, 22 nt, Homo sapiens
cuacugggacugcaaccuagac

SEQ ID NO: 1938304 - RNA, 20 nt, Homo sapiens
agcaugucucaauaguaaaa

SEQ ID NO: 1938305 - RNA, 14 nt, Homo sapiens
ucacagagcacugu

SEQ ID NO: 1938306 - RNA, 13 nt, Homo sapiens
cugccuggaucca

SEQ ID NO: 1938307 - RNA, 18 nt, Homo sapiens
cuuuauugcucacugucc

SEQ ID NO: 1938308 - RNA, 21 nt, Homo sapiens
uucuacuuuuuccuuccugcc

SEQ ID NO: 1938309 - RNA, 19 nt, Homo sapiens
uucuggcgcaagagaacau

SEQ ID NO: 1938310 - RNA, 19 nt, Homo sapiens
uagucgggaugucagcaga

SEQ ID NO: 1938311 - RNA, 15 nt, Homo sapiens
uucucacccugugaa

SEQ ID NO: 1938312 - RNA, 22 nt, Homo sapiens
uagggcagccgaguggaggaaa

SEQ ID NO: 1938313 - RNA, 12 nt, Homo sapiens
caugaaucuuuu

SEQ ID NO: 1938314 - RNA, 15 nt, Homo sapiens
uaaagauacaguguc

SEQ ID NO: 1938315 - RNA, 21 nt, Homo sapiens
cagcagcaccuccuccaugca

SEQ ID NO: 1938316 - RNA, 16 nt, Homo sapiens
ucauauccaagaucaa

SEQ ID NO: 1938317 - RNA, 21 nt, Homo sapiens
aggagccauugcucuccuaga

SEQ ID NO: 1938318 - RNA, 22 nt, Homo sapiens
aaaagucuggcccacugugcag

SEQ ID NO: 1938319 - RNA, 20 nt, Homo sapiens
ccuguaccucaucccaugag

SEQ ID NO: 1938320 - RNA, 16 nt, Homo sapiens
gauuuccuucugcuau

SEQ ID NO: 1938321 - RNA, 13 nt, Homo sapiens
auucuugaaguca

SEQ ID NO: 1938322 - RNA, 23 nt, Homo sapiens
cuggggguccucucugagucaaa

SEQ ID NO: 1938323 - RNA, 15 nt, Homo sapiens
cucugaccugcacug

SEQ ID NO: 1938324 - RNA, 17 nt, Homo sapiens
cuuuagaugguggcaca

SEQ ID NO: 1938325 - RNA, 12 nt, Homo sapiens
cucaacuucuuu

SEQ ID NO: 1938326 - RNA, 18 nt, Homo sapiens
aaaagcaucauuacaaua

SEQ ID NO: 1938327 - RNA, 13 nt, Homo sapiens
aaaacugccuguu

SEQ ID NO: 1938328 - RNA, 20 nt, Homo sapiens
uaaggcccaccccaagucca

SEQ ID NO: 1938329 - RNA, 19 nt, Homo sapiens
ccggucuaaagugagcucu

SEQ ID NO: 1938330 - RNA, 12 nt, Homo sapiens
cuuccuauccau

SEQ ID NO: 1938331 - RNA, 12 nt, Homo sapiens
acucaaugggag

SEQ ID NO: 1938332 - RNA, 21 nt, Homo sapiens
guguguaaauaauuugcacug

SEQ ID NO: 1938333 - RNA, 12 nt, Homo sapiens
agccucuguccc

SEQ ID NO: 1938334 - RNA, 15 nt, Homo sapiens
agaaauaauacccug

SEQ ID NO: 1938335 - RNA, 19 nt, Homo sapiens
aucgugaugggccccucag

SEQ ID NO: 1938336 - RNA, 22 nt, Homo sapiens
auccguuugccaaucauugcaa

SEQ ID NO: 1938337 - RNA, 22 nt, Homo sapiens
cuuaucuuuuggagcaaauuga

SEQ ID NO: 1938338 - RNA, 19 nt, Homo sapiens
gcaugcaggucuccaugaa

SEQ ID NO: 1938339 - RNA, 16 nt, Homo sapiens
caacggccgacugccu

SEQ ID NO: 1938340 - RNA, 17 nt, Homo sapiens
gauuacagaaacugaug

SEQ ID NO: 1938341 - RNA, 12 nt, Homo sapiens
ucugaacuaauu

SEQ ID NO: 1938342 - RNA, 20 nt, Homo sapiens
aucuggccuaugacccugug

SEQ ID NO: 1938343 - RNA, 16 nt, Homo sapiens
agcagucccugcuuau

SEQ ID NO: 1938344 - RNA, 23 nt, Homo sapiens
gcuauggucagguuauacuccuc

SEQ ID NO: 1938345 - RNA, 17 nt, Homo sapiens
gaauggaaaacugccug

SEQ ID NO: 1938346 - RNA, 18 nt, Homo sapiens
aggauauaguagccauga

SEQ ID NO: 1938347 - RNA, 19 nt, Homo sapiens
aagguucccucccacucua

SEQ ID NO: 1938348 - RNA, 16 nt, Homo sapiens
augguuacucuuguca

SEQ ID NO: 1938349 - RNA, 22 nt, Homo sapiens
caaaauaguucuauuucuaucu

SEQ ID NO: 1938350 - RNA, 19 nt, Homo sapiens
cuuuaacaacauguuucca

SEQ ID NO: 1938351 - RNA, 23 nt, Homo sapiens
uucacaauauccaaugaagaagg

SEQ ID NO: 1938352 - RNA, 13 nt, Homo sapiens
gugaauuagcuca

SEQ ID NO: 1938353 - RNA, 13 nt, Homo sapiens
cugauuuaccucu

SEQ ID NO: 1938354 - RNA, 23 nt, Homo sapiens
gugcuuguggucacacuguggaa

SEQ ID NO: 1938355 - RNA, 17 nt, Homo sapiens
uacuuucuuuacauacc

SEQ ID NO: 1938356 - RNA, 16 nt, Homo sapiens
accuguucuaccaagc

SEQ ID NO: 1938357 - RNA, 18 nt, Homo sapiens
ugcuacaagaaugcaaaa

SEQ ID NO: 1938358 - RNA, 17 nt, Homo sapiens
gcacacaugguuuccaa

SEQ ID NO: 1938359 - RNA, 14 nt, Homo sapiens
gcaccugggugcuc

SEQ ID NO: 1938360 - RNA, 18 nt, Homo sapiens
caggagcauguccuaucc

SEQ ID NO: 1938361 - RNA, 20 nt, Homo sapiens
caauguugcaacacauucau

SEQ ID NO: 1938362 - RNA, 21 nt, Homo sapiens
gcuccccacaccuuccagggc

SEQ ID NO: 1938363 - RNA, 14 nt, Homo sapiens
caggucuagacuuu

SEQ ID NO: 1938364 - RNA, 15 nt, Homo sapiens
cuugagguacucugc

SEQ ID NO: 1938365 - RNA, 23 nt, Homo sapiens
ugacugccagccccaugccaugg

SEQ ID NO: 1938366 - RNA, 14 nt, Homo sapiens
ucugucuacugugg

SEQ ID NO: 1938367 - RNA, 19 nt, Homo sapiens
ugauauugcccaggcuguu

SEQ ID NO: 1938368 - RNA, 11 nt, Homo sapiens
aaaaacuucca

SEQ ID NO: 1938369 - RNA, 20 nt, Homo sapiens
ucuucugcaaaaauggauau

SEQ ID NO: 1938370 - RNA, 20 nt, Homo sapiens
auuuauucuuggugaagaug

SEQ ID NO: 1938371 - RNA, 15 nt, Homo sapiens
uucuucuugagcuga

SEQ ID NO: 1938372 - RNA, 15 nt, Homo sapiens
caccuggcauucugu

SEQ ID NO: 1938373 - RNA, 17 nt, Homo sapiens
gccuacagccacauccc

SEQ ID NO: 1938374 - RNA, 16 nt, Homo sapiens
gaauaaaccauuuuua

SEQ ID NO: 1938375 - RNA, 19 nt, Homo sapiens
cccaguccggugccuucca

SEQ ID NO: 1938376 - RNA, 22 nt, Homo sapiens
ggugauuacauaaucuguacaa

SEQ ID NO: 1938377 - RNA, 23 nt, Homo sapiens
ucugaagaauccuguaagccccu

SEQ ID NO: 1938378 - RNA, 16 nt, Homo sapiens
auauucuuuucugcaa

SEQ ID NO: 1938379 - RNA, 20 nt, Homo sapiens
aucaauaaagaaaacuucca

SEQ ID NO: 1938380 - RNA, 22 nt, Homo sapiens
cagcccaaaaguuuauuggacu

SEQ ID NO: 1938381 - RNA, 13 nt, Homo sapiens
cagaaagccacaa

SEQ ID NO: 1938382 - RNA, 18 nt, Homo sapiens
gcucacacccuaccuucc

SEQ ID NO: 1938383 - RNA, 13 nt, Homo sapiens
cuccuagccugcu

SEQ ID NO: 1938384 - RNA, 15 nt, Homo sapiens
uggugcacaccugua

SEQ ID NO: 1938385 - RNA, 16 nt, Homo sapiens
cacuuguuuggugcua

SEQ ID NO: 1938386 - RNA, 15 nt, Homo sapiens
cuccaagaccacccu

SEQ ID NO: 1938387 - RNA, 21 nt, Homo sapiens
uaauuuuucuuuauugcuuac

SEQ ID NO: 1938388 - RNA, 16 nt, Homo sapiens
agacauaaauguucac

SEQ ID NO: 1938389 - RNA, 21 nt, Homo sapiens
aaguguuaaggcaacauuccu

SEQ ID NO: 1938390 - RNA, 18 nt, Homo sapiens
auuaucucacuugugcca

SEQ ID NO: 1938391 - RNA, 14 nt, Homo sapiens
cuggaaaagcacuu

SEQ ID NO: 1938392 - RNA, 16 nt, Homo sapiens
auaacuugagaccuaa

SEQ ID NO: 1938393 - RNA, 18 nt, Homo sapiens
auuuuccucucucacaaa

SEQ ID NO: 1938394 - RNA, 15 nt, Homo sapiens
ggaaacccucuccau

SEQ ID NO: 1938395 - RNA, 13 nt, Homo sapiens
caugaagcacuga

SEQ ID NO: 1938396 - RNA, 13 nt, Homo sapiens
aauuuagcccuuu

SEQ ID NO: 1938397 - RNA, 14 nt, Homo sapiens
gaaaacaaacccag

SEQ ID NO: 1938398 - RNA, 16 nt, Homo sapiens
ggaguaagugacacuu

SEQ ID NO: 1938399 - RNA, 18 nt, Homo sapiens
gauuacaggugugaacca

SEQ ID NO: 1938400 - RNA, 14 nt, Homo sapiens
caucugcauuccca

SEQ ID NO: 1938401 - RNA, 23 nt, Homo sapiens
gggauuuuaguuguccucagguu

SEQ ID NO: 1938402 - RNA, 21 nt, Homo sapiens
gacaguuacucuucaguuuua

SEQ ID NO: 1938403 - RNA, 14 nt, Homo sapiens
ugauguacauuaca

SEQ ID NO: 1938404 - RNA, 12 nt, Homo sapiens
aaguaacuuuau

SEQ ID NO: 1938405 - RNA, 18 nt, Homo sapiens
gauucaccucuuccucug

SEQ ID NO: 1938406 - RNA, 21 nt, Homo sapiens
uacuguugugaaaaucuguca

SEQ ID NO: 1938407 - RNA, 17 nt, Homo sapiens
agcgggggccuugaaga

SEQ ID NO: 1938408 - RNA, 12 nt, Homo sapiens
cuuccccugugg

SEQ ID NO: 1938409 - RNA, 17 nt, Homo sapiens
uauauuggcacugcuaa

SEQ ID NO: 1938410 - RNA, 22 nt, Homo sapiens
gaaauuuuuguguaaaauaagg

SEQ ID NO: 1938411 - RNA, 23 nt, Homo sapiens
ccaucucccgcguggaguucucc

SEQ ID NO: 1938412 - RNA, 13 nt, Homo sapiens
gacaagacaaaac

SEQ ID NO: 1938413 - RNA, 20 nt, Homo sapiens
guaaacuuaacuguucuuug

SEQ ID NO: 1938414 - RNA, 15 nt, Homo sapiens
gauggggcauauuca

SEQ ID NO: 1938415 - RNA, 20 nt, Homo sapiens
acaccaggauuuaaguuuca

SEQ ID NO: 1938416 - RNA, 20 nt, Homo sapiens
acucauaaaggacacuggau

SEQ ID NO: 1938417 - RNA, 20 nt, Homo sapiens
gagaucaucacuuccuugcc

SEQ ID NO: 1938418 - RNA, 20 nt, Homo sapiens
ccugccggccgcccagacac

SEQ ID NO: 1938419 - RNA, 16 nt, Homo sapiens
auagauuguaauacac

SEQ ID NO: 1938420 - RNA, 18 nt, Homo sapiens
aacucaggaggcagaggu

SEQ ID NO: 1938421 - RNA, 18 nt, Homo sapiens
ggccuucaggacucuaga

SEQ ID NO: 1938422 - RNA, 13 nt, Homo sapiens
aagcccaaccucu

SEQ ID NO: 1938423 - RNA, 14 nt, Homo sapiens
ugauguuacuguau

SEQ ID NO: 1938424 - RNA, 14 nt, Homo sapiens
ugaugauacuguaa

SEQ ID NO: 1938425 - RNA, 18 nt, Homo sapiens
acacucauuuccaaucau

SEQ ID NO: 1938426 - RNA, 16 nt, Homo sapiens
gaugugccuagacacg

SEQ ID NO: 1938427 - RNA, 22 nt, Homo sapiens
acacacaccugucugugcagau

SEQ ID NO: 1938428 - RNA, 19 nt, Homo sapiens
guucaugcuucuacuguga

SEQ ID NO: 1938429 - RNA, 19 nt, Homo sapiens
guuuaccucuucuaugcaa

SEQ ID NO: 1938430 - RNA, 16 nt, Homo sapiens
accucugaggaccuca

SEQ ID NO: 1938431 - RNA, 17 nt, Homo sapiens
auccuuuuccaucccac

SEQ ID NO: 1938432 - RNA, 20 nt, Homo sapiens
agacagauguggacaugcac

SEQ ID NO: 1938433 - RNA, 16 nt, Homo sapiens
cugaaaucagugccua

SEQ ID NO: 1938434 - RNA, 22 nt, Homo sapiens
aauuuuaagcuguacacuuuca

SEQ ID NO: 1938435 - RNA, 22 nt, Homo sapiens
auaguuaucuuuuaauuacaga

SEQ ID NO: 1938436 - RNA, 14 nt, Homo sapiens
ugccucaaguucca

SEQ ID NO: 1938437 - RNA, 20 nt, Homo sapiens
guaaggcaauccuaagcaaa

SEQ ID NO: 1938438 - RNA, 13 nt, Homo sapiens
uccuacuguaaua

SEQ ID NO: 1938439 - RNA, 22 nt, Homo sapiens
uuuaaaauacugauacauccau

SEQ ID NO: 1938440 - RNA, 16 nt, Homo sapiens
aguauuacugcugcug

SEQ ID NO: 1938441 - RNA, 19 nt, Homo sapiens
uuaaauggagaaaggaccc

SEQ ID NO: 1938442 - RNA, 16 nt, Homo sapiens
acuaguggggcuuaau

SEQ ID NO: 1938443 - RNA, 22 nt, Homo sapiens
gagaugcagucacuuauugucc

SEQ ID NO: 1938444 - RNA, 16 nt, Homo sapiens
cacauguucaacuauu

SEQ ID NO: 1938445 - RNA, 22 nt, Homo sapiens
aaaacauacaagagacauauaa

SEQ ID NO: 1938446 - RNA, 19 nt, Homo sapiens
agauguuuuggggacucau

SEQ ID NO: 1938447 - RNA, 18 nt, Homo sapiens
ggcaagacaccuucccag

SEQ ID NO: 1938448 - RNA, 13 nt, Homo sapiens
acuuucaucuuaa

SEQ ID NO: 1938449 - RNA, 13 nt, Homo sapiens
aaaauuacaaaga

SEQ ID NO: 1938450 - RNA, 19 nt, Homo sapiens
accuauuuccagaaauaca

SEQ ID NO: 1938451 - RNA, 23 nt, Homo sapiens
auuuaaauagcuuuuuucucuga

SEQ ID NO: 1938452 - RNA, 16 nt, Homo sapiens
agcucuaguauuucca

SEQ ID NO: 1938453 - RNA, 12 nt, Homo sapiens
aaagaggccaaa

SEQ ID NO: 1938454 - RNA, 16 nt, Homo sapiens
agacaaugcuuuccau

SEQ ID NO: 1938455 - RNA, 18 nt, Homo sapiens
ucaggaaucagaaaucau

SEQ ID NO: 1938456 - RNA, 18 nt, Homo sapiens
ugcugaggccucgagggg

SEQ ID NO: 1938457 - RNA, 15 nt, Homo sapiens
ucuucacagcacauu

SEQ ID NO: 1938458 - RNA, 15 nt, Homo sapiens
gaaaccagugacuca

SEQ ID NO: 1938459 - RNA, 13 nt, Homo sapiens
gagauggguccug

SEQ ID NO: 1938460 - RNA, 14 nt, Homo sapiens
cuguccaauaugaa

SEQ ID NO: 1938461 - RNA, 20 nt, Homo sapiens
aggcacuucuuaacagacaa

SEQ ID NO: 1938462 - RNA, 17 nt, Homo sapiens
aaagcccagacuuuagu

SEQ ID NO: 1938463 - RNA, 14 nt, Homo sapiens
uacuccacacauaa

SEQ ID NO: 1938464 - RNA, 16 nt, Homo sapiens
cuguuccuguccagca

SEQ ID NO: 1938465 - RNA, 15 nt, Homo sapiens
ggaaggacuaugaca

SEQ ID NO: 1938466 - RNA, 14 nt, Homo sapiens
gcacuucagaauuc

SEQ ID NO: 1938467 - RNA, 14 nt, Homo sapiens
ugguaaauugccau

SEQ ID NO: 1938468 - RNA, 23 nt, Homo sapiens
gcuucaugggccuggaugcagau

SEQ ID NO: 1938469 - RNA, 14 nt, Homo sapiens
auaguaaaacuaaa

SEQ ID NO: 1938470 - RNA, 16 nt, Homo sapiens
ggagcuuccagugcau

SEQ ID NO: 1938471 - RNA, 18 nt, Homo sapiens
aagauguuucaaaaaauc

SEQ ID NO: 1938472 - RNA, 12 nt, Homo sapiens
ugaaucuucaca

SEQ ID NO: 1938473 - RNA, 14 nt, Homo sapiens
uauaauuauuccuu

SEQ ID NO: 1938474 - RNA, 15 nt, Homo sapiens
uuucccaugauuuca

SEQ ID NO: 1938475 - RNA, 18 nt, Homo sapiens
agaaauaaaauauggacu

SEQ ID NO: 1938476 - RNA, 14 nt, Homo sapiens
caguguuucaauuc

SEQ ID NO: 1938477 - RNA, 15 nt, Homo sapiens
ucaauuucaguguau

SEQ ID NO: 1938478 - RNA, 21 nt, Homo sapiens
uucaaaugucaguucauaaua

SEQ ID NO: 1938479 - RNA, 18 nt, Homo sapiens
uuauaccaaagauuacua

SEQ ID NO: 1938480 - RNA, 14 nt, Homo sapiens
gcuccgggugcgug

SEQ ID NO: 1938481 - RNA, 21 nt, Homo sapiens
augugggugucagucagggac

SEQ ID NO: 1938482 - RNA, 20 nt, Homo sapiens
aaccaacagaaaacauccca

SEQ ID NO: 1938483 - RNA, 21 nt, Homo sapiens
ugaucuagugcaguaaaggga

SEQ ID NO: 1938484 - RNA, 14 nt, Homo sapiens
uauguacacaacuu

SEQ ID NO: 1938485 - RNA, 14 nt, Homo sapiens
gaaggagaagucua

SEQ ID NO: 1938486 - RNA, 14 nt, Homo sapiens
ugucaagagucgcu

SEQ ID NO: 1938487 - RNA, 17 nt, Homo sapiens
uccugaagugaccucac

SEQ ID NO: 1938488 - RNA, 20 nt, Homo sapiens
aaaauuaggccguuccuuca

SEQ ID NO: 1938489 - RNA, 16 nt, Homo sapiens
ucuguugaucucagua

SEQ ID NO: 1938490 - RNA, 15 nt, Homo sapiens
ugcauacacucucaa

SEQ ID NO: 1938491 - RNA, 23 nt, Homo sapiens
aguuugaguuacuaucaugucaa

SEQ ID NO: 1938492 - RNA, 17 nt, Homo sapiens
ggaccagcccauuggcc

SEQ ID NO: 1938493 - RNA, 18 nt, Homo sapiens
gcaaaggcccccaucaca

SEQ ID NO: 1938494 - RNA, 16 nt, Homo sapiens
gaaccccccacucccu

SEQ ID NO: 1938495 - RNA, 13 nt, Homo sapiens
ggaaaagguuguu

SEQ ID NO: 1938496 - RNA, 17 nt, Homo sapiens
cugugugcuacuaacag

SEQ ID NO: 1938497 - RNA, 22 nt, Homo sapiens
uucaugacgaagacgccaaaaa

SEQ ID NO: 1938498 - RNA, 22 nt, Homo sapiens
ccaugcaauaauacaacuauca

SEQ ID NO: 1938499 - RNA, 19 nt, Homo sapiens
agaaaaugaaaugcauauu

SEQ ID NO: 1938500 - RNA, 16 nt, Homo sapiens
uuugcccaccagauca

SEQ ID NO: 1938501 - RNA, 13 nt, Homo sapiens
aaauaaaaagaga

SEQ ID NO: 1938502 - RNA, 13 nt, Homo sapiens
aaguaaaaaggga

SEQ ID NO: 1938503 - RNA, 21 nt, Homo sapiens
uuuccacacuuaaauucucua

SEQ ID NO: 1938504 - RNA, 18 nt, Homo sapiens
gccugucuguuacacugg

SEQ ID NO: 1938505 - RNA, 18 nt, Homo sapiens
ugccaaauuuuagauuua

SEQ ID NO: 1938506 - RNA, 23 nt, Homo sapiens
ugaauuuuaguuugguucacuua

SEQ ID NO: 1938507 - RNA, 15 nt, Homo sapiens
ccaggcuccagcaca

SEQ ID NO: 1938508 - RNA, 22 nt, Homo sapiens
uccuuggauaauuccccaagag

SEQ ID NO: 1938509 - RNA, 18 nt, Homo sapiens
cuggaguuauugaagcag

SEQ ID NO: 1938510 - RNA, 20 nt, Homo sapiens
cuauggacagcauugccagu

SEQ ID NO: 1938511 - RNA, 18 nt, Homo sapiens
ugagggugcugacuggcu

SEQ ID NO: 1938512 - RNA, 14 nt, Homo sapiens
acauguacugagac

SEQ ID NO: 1938513 - RNA, 16 nt, Homo sapiens
uagaaaggucauccaa

SEQ ID NO: 1938514 - RNA, 22 nt, Homo sapiens
aggccuccugugacuggcagca

SEQ ID NO: 1938515 - RNA, 15 nt, Homo sapiens
gaacagaugcugagc

SEQ ID NO: 1938516 - RNA, 21 nt, Homo sapiens
ucagcccgccaagguagccau

SEQ ID NO: 1938517 - RNA, 15 nt, Homo sapiens
cugagacucacagga

SEQ ID NO: 1938518 - RNA, 23 nt, Homo sapiens
auacuacaaccucacagaagcug

SEQ ID NO: 1938519 - RNA, 16 nt, Homo sapiens
uuugaagagugugagg

SEQ ID NO: 1938520 - RNA, 19 nt, Homo sapiens
uuccuccccgagucagggc

SEQ ID NO: 1938521 - RNA, 21 nt, Homo sapiens
uaaauaacuggaaaacagaac

SEQ ID NO: 1938522 - RNA, 13 nt, Homo sapiens
cuuguagcuguaa

SEQ ID NO: 1938523 - RNA, 21 nt, Homo sapiens
aagacuguaaauuccaaagau

SEQ ID NO: 1938524 - RNA, 15 nt, Homo sapiens
aaagacagaauguca

SEQ ID NO: 1938525 - RNA, 15 nt, Homo sapiens
gugggagaaggacua

SEQ ID NO: 1938526 - RNA, 17 nt, Homo sapiens
ugagauguuauuacugu

SEQ ID NO: 1938527 - RNA, 22 nt, Homo sapiens
ccaugaauucuugaguuuacau

SEQ ID NO: 1938528 - RNA, 19 nt, Homo sapiens
agcuacucacuuaucugau

SEQ ID NO: 1938529 - RNA, 14 nt, Homo sapiens
uaucucugagacag

SEQ ID NO: 1938530 - RNA, 15 nt, Homo sapiens
ggagaggucucagug

SEQ ID NO: 1938531 - RNA, 20 nt, Homo sapiens
acgguagugccugaaauuuc

SEQ ID NO: 1938532 - RNA, 16 nt, Homo sapiens
auuuuauuccagacag

SEQ ID NO: 1938533 - RNA, 20 nt, Homo sapiens
auaagcacauccaacuacuc

SEQ ID NO: 1938534 - RNA, 16 nt, Homo sapiens
accacauuccaugacg

SEQ ID NO: 1938535 - RNA, 17 nt, Homo sapiens
gcaugauccaagcaaga

SEQ ID NO: 1938536 - RNA, 14 nt, Homo sapiens
gaggauaugucuca

SEQ ID NO: 1938537 - RNA, 15 nt, Homo sapiens
ccucuccaacugccu

SEQ ID NO: 1938538 - RNA, 14 nt, Homo sapiens
gacauugcuuucaa

SEQ ID NO: 1938539 - RNA, 14 nt, Homo sapiens
agaguuucuccuuu

SEQ ID NO: 1938540 - RNA, 20 nt, Homo sapiens
uggaaugccgcugucucuga

SEQ ID NO: 1938541 - RNA, 20 nt, Homo sapiens
aguauuguacaaaguauuaa

SEQ ID NO: 1938542 - RNA, 23 nt, Homo sapiens
gaucuagguuuaacucagaucac

SEQ ID NO: 1938543 - RNA, 15 nt, Homo sapiens
augcagaagagggaa

SEQ ID NO: 1938544 - RNA, 19 nt, Homo sapiens
uaauucauugugauuuauu

SEQ ID NO: 1938545 - RNA, 17 nt, Homo sapiens
uucuaagacuacuauga

SEQ ID NO: 1938546 - RNA, 18 nt, Homo sapiens
caguucccccaaccucag

SEQ ID NO: 1938547 - RNA, 23 nt, Homo sapiens
ccugcuggggaccucaccugcug

SEQ ID NO: 1938548 - RNA, 22 nt, Homo sapiens
gagacuggaaaaauccugagca

SEQ ID NO: 1938549 - RNA, 16 nt, Homo sapiens
aaauauuauuaucuca

SEQ ID NO: 1938550 - RNA, 16 nt, Homo sapiens
ugccauggaaccuucc

SEQ ID NO: 1938551 - RNA, 22 nt, Homo sapiens
gaaaugccacgugccauugucu

SEQ ID NO: 1938552 - RNA, 16 nt, Homo sapiens
cauguaaugacacuuc

SEQ ID NO: 1938553 - RNA, 15 nt, Homo sapiens
cacuagugacaguuu

SEQ ID NO: 1938554 - RNA, 23 nt, Homo sapiens
aaauaagacggauuuauuuuucc

SEQ ID NO: 1938555 - RNA, 12 nt, Homo sapiens
aggcugcagauu

SEQ ID NO: 1938556 - RNA, 18 nt, Homo sapiens
gcugaucauugcaguauc

SEQ ID NO: 1938557 - RNA, 19 nt, Homo sapiens
uguaauauuuacaauguau

SEQ ID NO: 1938558 - RNA, 16 nt, Homo sapiens
gacugaagaccagcug

SEQ ID NO: 1938559 - RNA, 19 nt, Homo sapiens
ccucuuaaugucucaaaau

SEQ ID NO: 1938560 - RNA, 12 nt, Homo sapiens
agccucuggccg

SEQ ID NO: 1938561 - RNA, 22 nt, Homo sapiens
gagcaagaucuugucuccacua

SEQ ID NO: 1938562 - RNA, 17 nt, Homo sapiens
acuuguuuuuauauuga

SEQ ID NO: 1938563 - RNA, 12 nt, Homo sapiens
agaccugcucag

SEQ ID NO: 1938564 - RNA, 23 nt, Homo sapiens
aggcuggagugaucucagcucac

SEQ ID NO: 1938565 - RNA, 17 nt, Homo sapiens
agaucuuuaaacugcuu

SEQ ID NO: 1938566 - RNA, 16 nt, Homo sapiens
ucuaauaucccagaaa

SEQ ID NO: 1938567 - RNA, 23 nt, Homo sapiens
augauaaauucacauaggcaaua

SEQ ID NO: 1938568 - RNA, 14 nt, Homo sapiens
gaaugccggggaca

SEQ ID NO: 1938569 - RNA, 15 nt, Homo sapiens
ugacuuggcuggugu

SEQ ID NO: 1938570 - RNA, 19 nt, Homo sapiens
acauuccaguccuuugaga

SEQ ID NO: 1938571 - RNA, 18 nt, Homo sapiens
cacugucccuugccucaa

SEQ ID NO: 1938572 - RNA, 12 nt, Homo sapiens
gagagugugcuc

SEQ ID NO: 1938573 - RNA, 22 nt, Homo sapiens
agccagucuaguuccugaugac

SEQ ID NO: 1938574 - RNA, 14 nt, Homo sapiens
cugaucgauuugca

SEQ ID NO: 1938575 - RNA, 19 nt, Homo sapiens
aaauucaaauuauucuacc

SEQ ID NO: 1938576 - RNA, 12 nt, Homo sapiens
uccaguuugcaa

SEQ ID NO: 1938577 - RNA, 19 nt, Homo sapiens
uauuggacugauaaucucu

SEQ ID NO: 1938578 - RNA, 15 nt, Homo sapiens
ccacuuugcuaccau

SEQ ID NO: 1938579 - RNA, 21 nt, Homo sapiens
ucuuggugugauugcacagaa

SEQ ID NO: 1938580 - RNA, 19 nt, Homo sapiens
aggggaagagauuagucuc

SEQ ID NO: 1938581 - RNA, 15 nt, Homo sapiens
uucugaaacuggagu

SEQ ID NO: 1938582 - RNA, 20 nt, Homo sapiens
caagagucuggggaccagcu

SEQ ID NO: 1938583 - RNA, 15 nt, Homo sapiens
gaucugaacccagcu

SEQ ID NO: 1938584 - RNA, 16 nt, Homo sapiens
aauguccccuuagguc

SEQ ID NO: 1938585 - RNA, 13 nt, Homo sapiens
uucaaugugaauu

SEQ ID NO: 1938586 - RNA, 15 nt, Homo sapiens
cagauggucccauua

SEQ ID NO: 1938587 - RNA, 13 nt, Homo sapiens
auauguaucuuug

SEQ ID NO: 1938588 - RNA, 13 nt, Homo sapiens
cuaccuauauucc

SEQ ID NO: 1938589 - RNA, 20 nt, Homo sapiens
uaugaaggacuauuaauucc

SEQ ID NO: 1938590 - RNA, 19 nt, Homo sapiens
aacucagcuguccagcugc

SEQ ID NO: 1938591 - RNA, 19 nt, Homo sapiens
aaauacuguaacacuguau

SEQ ID NO: 1938592 - RNA, 19 nt, Homo sapiens
uccauggccaggcugccug

SEQ ID NO: 1938593 - RNA, 21 nt, Homo sapiens
acuggaacguuucacugcaaa

SEQ ID NO: 1938594 - RNA, 19 nt, Homo sapiens
guccuggaaaucgagguga

SEQ ID NO: 1938595 - RNA, 12 nt, Homo sapiens
cagauaugcaca

SEQ ID NO: 1938596 - RNA, 13 nt, Homo sapiens
ugaagugcugcuc

SEQ ID NO: 1938597 - RNA, 22 nt, Homo sapiens
caccaggagggaguggcagcua

SEQ ID NO: 1938598 - RNA, 22 nt, Homo sapiens
gccaguggagacuggaacacaa

SEQ ID NO: 1938599 - RNA, 13 nt, Homo sapiens
agcugcgugccac

SEQ ID NO: 1938600 - RNA, 18 nt, Homo sapiens
acauuucccugugcugac

SEQ ID NO: 1938601 - RNA, 16 nt, Homo sapiens
gacaucuccucacccc

SEQ ID NO: 1938602 - RNA, 15 nt, Homo sapiens
acaaagguugcagug

SEQ ID NO: 1938603 - RNA, 15 nt, Homo sapiens
cuuggccuugcagcu

SEQ ID NO: 1938604 - RNA, 12 nt, Homo sapiens
uuucagcuaaag

SEQ ID NO: 1938605 - RNA, 22 nt, Homo sapiens
agggcacccuaguucuaccuca

SEQ ID NO: 1938606 - RNA, 19 nt, Homo sapiens
caagcaaaaucauggaaug

SEQ ID NO: 1938607 - RNA, 18 nt, Homo sapiens
aggcaguucaaagcagga

SEQ ID NO: 1938608 - RNA, 14 nt, Homo sapiens
cucagaagcacaga

SEQ ID NO: 1938609 - RNA, 14 nt, Homo sapiens
auggaaagaaggaa

SEQ ID NO: 1938610 - RNA, 16 nt, Homo sapiens
aaaagugugagcagug

SEQ ID NO: 1938611 - RNA, 17 nt, Homo sapiens
cagcacuggugaacuga

SEQ ID NO: 1938612 - RNA, 17 nt, Homo sapiens
gcaggaaauaccaacug

SEQ ID NO: 1938613 - RNA, 13 nt, Homo sapiens
auucaaugcauuu

SEQ ID NO: 1938614 - RNA, 14 nt, Homo sapiens
auuccaacagcuca

SEQ ID NO: 1938615 - RNA, 23 nt, Homo sapiens
gacuuguuuagagagccugucac

SEQ ID NO: 1938616 - RNA, 19 nt, Homo sapiens
ggccacgggggcaguguga

SEQ ID NO: 1938617 - RNA, 20 nt, Homo sapiens
aacuuccuacguauccugca

SEQ ID NO: 1938618 - RNA, 11 nt, Homo sapiens
uugauggaccc

SEQ ID NO: 1938619 - RNA, 11 nt, Homo sapiens
uccguuugcaa

SEQ ID NO: 1938620 - RNA, 19 nt, Homo sapiens
uucucugccgcuaccuccc

SEQ ID NO: 1938621 - RNA, 15 nt, Homo sapiens
ucuuuaaucagcuua

SEQ ID NO: 1938622 - RNA, 16 nt, Homo sapiens
gauuuaaucugccaag

SEQ ID NO: 1938623 - RNA, 18 nt, Homo sapiens
gaacucuacuucagucaa

SEQ ID NO: 1938624 - RNA, 14 nt, Homo sapiens
augaacauccaaau

SEQ ID NO: 1938625 - RNA, 16 nt, Homo sapiens
uggaccagugaccaaa

SEQ ID NO: 1938626 - RNA, 19 nt, Homo sapiens
ucccugaagucuugcauug

SEQ ID NO: 1938627 - RNA, 18 nt, Homo sapiens
aacaugacacugaccuug

SEQ ID NO: 1938628 - RNA, 23 nt, Homo sapiens
cacuauuaaguggguuugcccca

SEQ ID NO: 1938629 - RNA, 13 nt, Homo sapiens
acucauugucuca

SEQ ID NO: 1938630 - RNA, 18 nt, Homo sapiens
cuccagagggaauugcag

SEQ ID NO: 1938631 - RNA, 15 nt, Homo sapiens
auuuaaaaacauuuu

SEQ ID NO: 1938632 - RNA, 22 nt, Homo sapiens
uacuguaaagaauuuagcugua

SEQ ID NO: 1938633 - RNA, 18 nt, Homo sapiens
uggggacagaguguccuu

SEQ ID NO: 1938634 - RNA, 16 nt, Homo sapiens
acccugagacuuggcu

SEQ ID NO: 1938635 - RNA, 16 nt, Homo sapiens
agaacaaacucugaaa

SEQ ID NO: 1938636 - RNA, 23 nt, Homo sapiens
aaagcucacuaagaagcuugaau

SEQ ID NO: 1938637 - RNA, 21 nt, Homo sapiens
uuuaaggcaaugguuucacau

SEQ ID NO: 1938638 - RNA, 16 nt, Homo sapiens
cauacauauauacauu

SEQ ID NO: 1938639 - RNA, 16 nt, Homo sapiens
uacuguaacacuguau

SEQ ID NO: 1938640 - RNA, 16 nt, Homo sapiens
aagggugacuuuucau

SEQ ID NO: 1938641 - RNA, 15 nt, Homo sapiens
ggccacaccaucucc

SEQ ID NO: 1938642 - RNA, 19 nt, Homo sapiens
ggcugauuucaaaugcagu

SEQ ID NO: 1938643 - RNA, 17 nt, Homo sapiens
uagcauauagauugucc

SEQ ID NO: 1938644 - RNA, 22 nt, Homo sapiens
cacaugcauggcauuuguucca

SEQ ID NO: 1938645 - RNA, 17 nt, Homo sapiens
cagaaaccuuccagaga

SEQ ID NO: 1938646 - RNA, 15 nt, Homo sapiens
uuaucugcuguuccu

SEQ ID NO: 1938647 - RNA, 12 nt, Homo sapiens
aagcuucaggga

SEQ ID NO: 1938648 - RNA, 19 nt, Homo sapiens
ucacauuccugacccucac

SEQ ID NO: 1938649 - RNA, 19 nt, Homo sapiens
acccaggauccccaaggca

SEQ ID NO: 1938650 - RNA, 21 nt, Homo sapiens
augguuccacagaagcuuugu

SEQ ID NO: 1938651 - RNA, 12 nt, Homo sapiens
auauaacuugaa

SEQ ID NO: 1938652 - RNA, 23 nt, Homo sapiens
uagcaccccccauuggggcuaua

SEQ ID NO: 1938653 - RNA, 13 nt, Homo sapiens
ggguccccaagga

SEQ ID NO: 1938654 - RNA, 23 nt, Homo sapiens
uaucuccugacagaaggugccac

SEQ ID NO: 1938655 - RNA, 20 nt, Homo sapiens
caggugccacugaccgggau

SEQ ID NO: 1938656 - RNA, 15 nt, Homo sapiens
agcaacacagaggaa

SEQ ID NO: 1938657 - RNA, 23 nt, Homo sapiens
uuaaauauauuucuugcuauugu

SEQ ID NO: 1938658 - RNA, 18 nt, Homo sapiens
gccguuguacuccagccu

SEQ ID NO: 1938659 - RNA, 16 nt, Homo sapiens
acuuccuccacagucc

SEQ ID NO: 1938660 - RNA, 13 nt, Homo sapiens
auauaaauuuauc

SEQ ID NO: 1938661 - RNA, 13 nt, Homo sapiens
ucuccaauacuca

SEQ ID NO: 1938662 - RNA, 20 nt, Homo sapiens
accaugauuaaccacuucag

SEQ ID NO: 1938663 - RNA, 20 nt, Homo sapiens
cuuucuccauuguaaaccac

SEQ ID NO: 1938664 - RNA, 15 nt, Homo sapiens
auccuccugccucag

SEQ ID NO: 1938665 - RNA, 17 nt, Homo sapiens
acucuuauuguccuucu

SEQ ID NO: 1938666 - RNA, 20 nt, Homo sapiens
caggugcccgccaccgugcc

SEQ ID NO: 1938667 - RNA, 19 nt, Homo sapiens
cguuucccguuagucucug

SEQ ID NO: 1938668 - RNA, 20 nt, Homo sapiens
aagauuuucuccacaguguu

SEQ ID NO: 1938669 - RNA, 13 nt, Homo sapiens
cugcgcaccaucu

SEQ ID NO: 1938670 - RNA, 13 nt, Homo sapiens
aauagcacaugau

SEQ ID NO: 1938671 - RNA, 15 nt, Homo sapiens
cagggccucugucaa

SEQ ID NO: 1938672 - RNA, 23 nt, Homo sapiens
cucuccacuaccccgacuauccc

SEQ ID NO: 1938673 - RNA, 17 nt, Homo sapiens
aacagaaagcauccuaa

SEQ ID NO: 1938674 - RNA, 21 nt, Homo sapiens
uguccuggggaauacuggcca

SEQ ID NO: 1938675 - RNA, 16 nt, Homo sapiens
gcuuguuccacugcaa

SEQ ID NO: 1938676 - RNA, 15 nt, Homo sapiens
aaauugacagaugaa

SEQ ID NO: 1938677 - RNA, 11 nt, Homo sapiens
uaagcaaaaaa

SEQ ID NO: 1938678 - RNA, 17 nt, Homo sapiens
agaucuuugugccaaac

SEQ ID NO: 1938679 - RNA, 16 nt, Homo sapiens
guagguagauaccaaa

SEQ ID NO: 1938680 - RNA, 16 nt, Homo sapiens
caccuguugcaccuca

SEQ ID NO: 1938681 - RNA, 15 nt, Homo sapiens
uuaaauggcaguauu

SEQ ID NO: 1938682 - RNA, 18 nt, Homo sapiens
auuuuguaccaaguaaau

SEQ ID NO: 1938683 - RNA, 11 nt, Homo sapiens
ucauuauuagu

SEQ ID NO: 1938684 - RNA, 13 nt, Homo sapiens
acuauaucuguau

SEQ ID NO: 1938685 - RNA, 20 nt, Homo sapiens
cucuaauuaaaaugugcagu

SEQ ID NO: 1938686 - RNA, 19 nt, Homo sapiens
guaaaagugaauuaucuuu

SEQ ID NO: 1938687 - RNA, 18 nt, Homo sapiens
auacaugcauacaaagag

SEQ ID NO: 1938688 - RNA, 19 nt, Homo sapiens
gcucccaccggugccaaac

SEQ ID NO: 1938689 - RNA, 12 nt, Homo sapiens
cagcauaugcag

SEQ ID NO: 1938690 - RNA, 15 nt, Homo sapiens
cuggugggcagagag

SEQ ID NO: 1938691 - RNA, 22 nt, Homo sapiens
agauaaagauuucuaguaggca

SEQ ID NO: 1938692 - RNA, 18 nt, Homo sapiens
accuaaacccucugugaa

SEQ ID NO: 1938693 - RNA, 19 nt, Homo sapiens
auccuuuauuucugauaag

SEQ ID NO: 1938694 - RNA, 21 nt, Homo sapiens
gucauacaagucauggucaca

SEQ ID NO: 1938695 - RNA, 15 nt, Homo sapiens
cuauaacuucuuccu

SEQ ID NO: 1938696 - RNA, 21 nt, Homo sapiens
guaaauaauauaaaauguuuc

SEQ ID NO: 1938697 - RNA, 13 nt, Homo sapiens
aacuucauucuaa

SEQ ID NO: 1938698 - RNA, 13 nt, Homo sapiens
aauuucauuccaa

SEQ ID NO: 1938699 - RNA, 14 nt, Homo sapiens
ggcaccugggucca

SEQ ID NO: 1938700 - RNA, 23 nt, Homo sapiens
uggccugcugggcucuccaccuc

SEQ ID NO: 1938701 - RNA, 12 nt, Homo sapiens
acugagcuguga

SEQ ID NO: 1938702 - RNA, 17 nt, Homo sapiens
ugccuagaggugcucau

SEQ ID NO: 1938703 - RNA, 19 nt, Homo sapiens
auuugaaugcuuaauucaa

SEQ ID NO: 1938704 - RNA, 19 nt, Homo sapiens
gaauaguucccuagucuau

SEQ ID NO: 1938705 - RNA, 15 nt, Homo sapiens
cccuagcuguauaua

SEQ ID NO: 1938706 - RNA, 15 nt, Homo sapiens
cucauucugcaauga

SEQ ID NO: 1938707 - RNA, 20 nt, Homo sapiens
uuuaucauauauauacauac

SEQ ID NO: 1938708 - RNA, 18 nt, Homo sapiens
agcaggcucucaggccag

SEQ ID NO: 1938709 - RNA, 19 nt, Homo sapiens
ugcuuauuaaaugagcgac

SEQ ID NO: 1938710 - RNA, 20 nt, Homo sapiens
agccugacaacagccugaga

SEQ ID NO: 1938711 - RNA, 23 nt, Homo sapiens
gggcuggaggcccaggcugggaa

SEQ ID NO: 1938712 - RNA, 18 nt, Homo sapiens
cuuucuuuagcaugcuac

SEQ ID NO: 1938713 - RNA, 16 nt, Homo sapiens
gcccugacaugcacac

SEQ ID NO: 1938714 - RNA, 16 nt, Homo sapiens
cagaccauucaggaca

SEQ ID NO: 1938715 - RNA, 13 nt, Homo sapiens
acuacugcuaaug

SEQ ID NO: 1938716 - RNA, 19 nt, Homo sapiens
gccucugggcagccugcuu

SEQ ID NO: 1938717 - RNA, 21 nt, Homo sapiens
augccuaguuauucauuguua

SEQ ID NO: 1938718 - RNA, 22 nt, Homo sapiens
cucuucagguucuuagugucac

SEQ ID NO: 1938719 - RNA, 22 nt, Homo sapiens
acuguaugaucaaauguuuaau

SEQ ID NO: 1938720 - RNA, 19 nt, Homo sapiens
caugcuggguucugcacag

SEQ ID NO: 1938721 - RNA, 20 nt, Homo sapiens
cugccucuucuggccuggug

SEQ ID NO: 1938722 - RNA, 14 nt, Homo sapiens
agcccaagccuugu

SEQ ID NO: 1938723 - RNA, 18 nt, Homo sapiens
cugaaagaggaaugaagu

SEQ ID NO: 1938724 - RNA, 18 nt, Homo sapiens
ucuuuauaaucuacuccu

SEQ ID NO: 1938725 - RNA, 17 nt, Homo sapiens
ggacguggguugcacug

SEQ ID NO: 1938726 - RNA, 12 nt, Homo sapiens
aacacagugccc

SEQ ID NO: 1938727 - RNA, 17 nt, Homo sapiens
auuauuuguuacuguau

SEQ ID NO: 1938728 - RNA, 13 nt, Homo sapiens
cagggcugcauug

SEQ ID NO: 1938729 - RNA, 18 nt, Homo sapiens
caguuuagguucuaggua

SEQ ID NO: 1938730 - RNA, 18 nt, Homo sapiens
aggauaaccuugugccuu

SEQ ID NO: 1938731 - RNA, 12 nt, Homo sapiens
cccagccuauga

SEQ ID NO: 1938732 - RNA, 14 nt, Homo sapiens
ccaaaauacaaugu

SEQ ID NO: 1938733 - RNA, 15 nt, Homo sapiens
cuguaaucagcaaua

SEQ ID NO: 1938734 - RNA, 19 nt, Homo sapiens
ggcucugggaccaugguga

SEQ ID NO: 1938735 - RNA, 23 nt, Homo sapiens
ugcuucaccagacuuuucucuag

SEQ ID NO: 1938736 - RNA, 14 nt, Homo sapiens
cauucaauuugcua

SEQ ID NO: 1938737 - RNA, 16 nt, Homo sapiens
guguuuugucuucaac

SEQ ID NO: 1938738 - RNA, 17 nt, Homo sapiens
cuauauacaugugugua

SEQ ID NO: 1938739 - RNA, 22 nt, Homo sapiens
cugagcucuccaggccaggugg

SEQ ID NO: 1938740 - RNA, 18 nt, Homo sapiens
auccaccuccuucucugu

SEQ ID NO: 1938741 - RNA, 17 nt, Homo sapiens
gcugggugggcaucuca

SEQ ID NO: 1938742 - RNA, 19 nt, Homo sapiens
accucgucaagagcaugca

SEQ ID NO: 1938743 - RNA, 21 nt, Homo sapiens
gcaguauuguucguucugaua

SEQ ID NO: 1938744 - RNA, 18 nt, Homo sapiens
cauguccuacaacagccu

SEQ ID NO: 1938745 - RNA, 15 nt, Homo sapiens
caagggaaaggcaag

SEQ ID NO: 1938746 - RNA, 15 nt, Homo sapiens
cuacagggugucugu

SEQ ID NO: 1938747 - RNA, 19 nt, Homo sapiens
aauuuuuaccuaaucucca

SEQ ID NO: 1938748 - RNA, 19 nt, Homo sapiens
caauuucacagaguacaaa

SEQ ID NO: 1938749 - RNA, 16 nt, Homo sapiens
uagacaaucacuacaa

SEQ ID NO: 1938750 - RNA, 15 nt, Homo sapiens
acuccucauaccuca

SEQ ID NO: 1938751 - RNA, 20 nt, Homo sapiens
cuguugucaaaaaguuccau

SEQ ID NO: 1938752 - RNA, 16 nt, Homo sapiens
ggaggauuacuugaaa

SEQ ID NO: 1938753 - RNA, 13 nt, Homo sapiens
aggcaggaggagc

SEQ ID NO: 1938754 - RNA, 14 nt, Homo sapiens
acuggccaugguga

SEQ ID NO: 1938755 - RNA, 16 nt, Homo sapiens
accccagccauccagg

SEQ ID NO: 1938756 - RNA, 18 nt, Homo sapiens
cacuccuggccucacauu

SEQ ID NO: 1938757 - RNA, 14 nt, Homo sapiens
aaucaucaaaaaga

SEQ ID NO: 1938758 - RNA, 16 nt, Homo sapiens
augcauuugcacuauu

SEQ ID NO: 1938759 - RNA, 21 nt, Homo sapiens
aacuuucccuccaccagugug

SEQ ID NO: 1938760 - RNA, 14 nt, Homo sapiens
uaaccauuugcacu

SEQ ID NO: 1938761 - RNA, 14 nt, Homo sapiens
gugauuggaccagg

SEQ ID NO: 1938762 - RNA, 21 nt, Homo sapiens
auauguacauaggcagcacua

SEQ ID NO: 1938763 - RNA, 13 nt, Homo sapiens
aaaagcugggcag

SEQ ID NO: 1938764 - RNA, 13 nt, Homo sapiens
aaaaccugggcac

SEQ ID NO: 1938765 - RNA, 13 nt, Homo sapiens
agcaacuggaaaa

SEQ ID NO: 1938766 - RNA, 23 nt, Homo sapiens
auugaccauuuuuuaauuuacuu

SEQ ID NO: 1938767 - RNA, 21 nt, Homo sapiens
cucucccgcaggucugaaguu

SEQ ID NO: 1938768 - RNA, 17 nt, Homo sapiens
uaaaacuuuauggacac

SEQ ID NO: 1938769 - RNA, 18 nt, Homo sapiens
aaagccccucucuguuga

SEQ ID NO: 1938770 - RNA, 15 nt, Homo sapiens
uuucagauaaaucau

SEQ ID NO: 1938771 - RNA, 16 nt, Homo sapiens
uaaauaaaauuuguug

SEQ ID NO: 1938772 - RNA, 17 nt, Homo sapiens
cacacaccgauguacac

SEQ ID NO: 1938773 - RNA, 17 nt, Homo sapiens
agggcaggguucuagaa

SEQ ID NO: 1938774 - RNA, 13 nt, Homo sapiens
ucugacuugacaa

SEQ ID NO: 1938775 - RNA, 16 nt, Homo sapiens
ucucacuguugcccag

SEQ ID NO: 1938776 - RNA, 15 nt, Homo sapiens
cccucacuuguccuc

SEQ ID NO: 1938777 - RNA, 20 nt, Homo sapiens
caagugacaugccauccauu

SEQ ID NO: 1938778 - RNA, 20 nt, Homo sapiens
gcaaguuaacuuggaaauca

SEQ ID NO: 1938779 - RNA, 14 nt, Homo sapiens
cugccagcuuguga

SEQ ID NO: 1938780 - RNA, 16 nt, Homo sapiens
ugugaacccaggacaa

SEQ ID NO: 1938781 - RNA, 15 nt, Homo sapiens
gauugaggacuacuu

SEQ ID NO: 1938782 - RNA, 18 nt, Homo sapiens
cauccucagcuucuuccc

SEQ ID NO: 1938783 - RNA, 21 nt, Homo sapiens
uucuagaaacaggaaacaccg

SEQ ID NO: 1938784 - RNA, 22 nt, Homo sapiens
aagauuuuuuuuguaacuucaa

SEQ ID NO: 1938785 - RNA, 15 nt, Homo sapiens
augaccugcagucag

SEQ ID NO: 1938786 - RNA, 14 nt, Homo sapiens
aggcuguucuccag

SEQ ID NO: 1938787 - RNA, 17 nt, Homo sapiens
gauaaccuugugccuug

SEQ ID NO: 1938788 - RNA, 23 nt, Homo sapiens
ucagcaucugaccaucugugacu

SEQ ID NO: 1938789 - RNA, 17 nt, Homo sapiens
uauacacacauauacau

SEQ ID NO: 1938790 - RNA, 17 nt, Homo sapiens
ccagcuucucaguuucu

SEQ ID NO: 1938791 - RNA, 13 nt, Homo sapiens
ugucuauucuugu

SEQ ID NO: 1938792 - RNA, 15 nt, Homo sapiens
acaugacucagcaua

SEQ ID NO: 1938793 - RNA, 20 nt, Homo sapiens
aggcuuaucagggaguuaca

SEQ ID NO: 1938794 - RNA, 21 nt, Homo sapiens
ggaauugugugauguuuaaca

SEQ ID NO: 1938795 - RNA, 20 nt, Homo sapiens
aaguagaauuauaucuaauu

SEQ ID NO: 1938796 - RNA, 19 nt, Homo sapiens
aaagccgaacugguaccau

SEQ ID NO: 1938797 - RNA, 17 nt, Homo sapiens
cacaguccucauuuacu

SEQ ID NO: 1938798 - RNA, 21 nt, Homo sapiens
gaaaaccacuuuauugcaaug

SEQ ID NO: 1938799 - RNA, 20 nt, Homo sapiens
caaugugggcagagauugga

SEQ ID NO: 1938800 - RNA, 14 nt, Homo sapiens
auguaucaguuuuc

SEQ ID NO: 1938801 - RNA, 19 nt, Homo sapiens
gcagaauucauuaugcugu

SEQ ID NO: 1938802 - RNA, 17 nt, Homo sapiens
uuacugaagucuuacua

SEQ ID NO: 1938803 - RNA, 20 nt, Homo sapiens
agcucagcaacaaggcugca

SEQ ID NO: 1938804 - RNA, 15 nt, Homo sapiens
auggacaaaggccug

SEQ ID NO: 1938805 - RNA, 16 nt, Homo sapiens
uuucaaauugagagaa

SEQ ID NO: 1938806 - RNA, 21 nt, Homo sapiens
ccugugggaguccacuuuccu

SEQ ID NO: 1938807 - RNA, 15 nt, Homo sapiens
uacaggcagcacaga

SEQ ID NO: 1938808 - RNA, 19 nt, Homo sapiens
aaccccuccucccucagac

SEQ ID NO: 1938809 - RNA, 17 nt, Homo sapiens
cuuaacucugaugguuc

SEQ ID NO: 1938810 - RNA, 21 nt, Homo sapiens
gauuucauucugaaacauaau

SEQ ID NO: 1938811 - RNA, 20 nt, Homo sapiens
uucaaguauaacaacuuuga

SEQ ID NO: 1938812 - RNA, 22 nt, Homo sapiens
ccaaagcccugguaaaagggau

SEQ ID NO: 1938813 - RNA, 19 nt, Homo sapiens
uccuccccaccuguagcug

SEQ ID NO: 1938814 - RNA, 18 nt, Homo sapiens
uuuuuauacaauggaaua

SEQ ID NO: 1938815 - RNA, 17 nt, Homo sapiens
uuaggagugauuacuaa

SEQ ID NO: 1938816 - RNA, 20 nt, Homo sapiens
uauaccugggcauacuaaua

SEQ ID NO: 1938817 - RNA, 16 nt, Homo sapiens
acacugccucugaguu

SEQ ID NO: 1938818 - RNA, 23 nt, Homo sapiens
agaacucucugucuucucuccac

SEQ ID NO: 1938819 - RNA, 16 nt, Homo sapiens
caccuacauuaucuca

SEQ ID NO: 1938820 - RNA, 17 nt, Homo sapiens
auugccucuaugugcaa

SEQ ID NO: 1938821 - RNA, 13 nt, Homo sapiens
aaagguacuauau

SEQ ID NO: 1938822 - RNA, 18 nt, Homo sapiens
agcugagaccagggucuu

SEQ ID NO: 1938823 - RNA, 10 nt, Homo sapiens
ucauauugau

SEQ ID NO: 1938824 - RNA, 24 nt, Homo sapiens
aucucuuguucgcacaaucuacac

SEQ ID NO: 1938825 - RNA, 15 nt, Homo sapiens
guggaaacucauggc

SEQ ID NO: 1938826 - RNA, 20 nt, Homo sapiens
cuuguuaagugcagucugau

SEQ ID NO: 1938827 - RNA, 23 nt, Homo sapiens
gaguuuuuaguggaagcuucuaa

SEQ ID NO: 1938828 - RNA, 19 nt, Homo sapiens
uucacagccagacuggcac

SEQ ID NO: 1938829 - RNA, 21 nt, Homo sapiens
cacauguccuauuacugaugu

SEQ ID NO: 1938830 - RNA, 14 nt, Homo sapiens
cucugcacaugucu

SEQ ID NO: 1938831 - RNA, 13 nt, Homo sapiens
agguuacuaaagg

SEQ ID NO: 1938832 - RNA, 13 nt, Homo sapiens
aaagguucacagg

SEQ ID NO: 1938833 - RNA, 13 nt, Homo sapiens
cccucuuccacuc

SEQ ID NO: 1938834 - RNA, 22 nt, Homo sapiens
caaagacacaagcaaccaaugg

SEQ ID NO: 1938835 - RNA, 16 nt, Homo sapiens
uccacgcucaucuugc

SEQ ID NO: 1938836 - RNA, 20 nt, Homo sapiens
ugcauccauguaaucuauuc

SEQ ID NO: 1938837 - RNA, 14 nt, Homo sapiens
uggucacacucuca

SEQ ID NO: 1938838 - RNA, 11 nt, Homo sapiens
ugcgcccuuca

SEQ ID NO: 1938839 - RNA, 17 nt, Homo sapiens
guuugaaucuacauuca

SEQ ID NO: 1938840 - RNA, 15 nt, Homo sapiens
ucaagucaguucugu

SEQ ID NO: 1938841 - RNA, 20 nt, Homo sapiens
gaccccagagggaccagcug

SEQ ID NO: 1938842 - RNA, 22 nt, Homo sapiens
uuuucaaguugagaacaaaaau

SEQ ID NO: 1938843 - RNA, 17 nt, Homo sapiens
cugcagaaguacuccua

SEQ ID NO: 1938844 - RNA, 17 nt, Homo sapiens
ccugacucuuccccaua

SEQ ID NO: 1938845 - RNA, 24 nt, Homo sapiens
uuuagcuguauucauauauugcau

SEQ ID NO: 1938846 - RNA, 14 nt, Homo sapiens
aggaagguguuuca

SEQ ID NO: 1938847 - RNA, 19 nt, Homo sapiens
gaauggacauccuguauaa

SEQ ID NO: 1938848 - RNA, 13 nt, Homo sapiens
uaaaaacauuccc

SEQ ID NO: 1938849 - RNA, 24 nt, Homo sapiens
caggcuuggaaucuggguaauuaa

SEQ ID NO: 1938850 - RNA, 18 nt, Homo sapiens
cgagacauagaauaguau

SEQ ID NO: 1938851 - RNA, 16 nt, Homo sapiens
aaauguucaagucaug

SEQ ID NO: 1938852 - RNA, 22 nt, Homo sapiens
uccagccauuccugaagcccac

SEQ ID NO: 1938853 - RNA, 14 nt, Homo sapiens
gcaagcaccaggcu

SEQ ID NO: 1938854 - RNA, 22 nt, Homo sapiens
ccccgucacgugcgcugggcac

SEQ ID NO: 1938855 - RNA, 19 nt, Homo sapiens
ugaaaaggguguugcuaag

SEQ ID NO: 1938856 - RNA, 13 nt, Homo sapiens
accaucuuacaga

SEQ ID NO: 1938857 - RNA, 16 nt, Homo sapiens
ggagaaucgcuuaaac

SEQ ID NO: 1938858 - RNA, 21 nt, Homo sapiens
aggaagguaugugucagccau

SEQ ID NO: 1938859 - RNA, 14 nt, Homo sapiens
aauuauggcauuuu

SEQ ID NO: 1938860 - RNA, 16 nt, Homo sapiens
agaucacguugcaaug

SEQ ID NO: 1938861 - RNA, 18 nt, Homo sapiens
uggaaauauucuaugacc

SEQ ID NO: 1938862 - RNA, 13 nt, Homo sapiens
accucaugccacc

SEQ ID NO: 1938863 - RNA, 16 nt, Homo sapiens
ggcugcggcuugccca

SEQ ID NO: 1938864 - RNA, 20 nt, Homo sapiens
ccagcuggaucccagggaaa

SEQ ID NO: 1938865 - RNA, 18 nt, Homo sapiens
ggugucuggaaaagcacu

SEQ ID NO: 1938866 - RNA, 13 nt, Homo sapiens
uguaaccauuucu

SEQ ID NO: 1938867 - RNA, 20 nt, Homo sapiens
gacuaggguaaucugacuuc

SEQ ID NO: 1938868 - RNA, 13 nt, Homo sapiens
gucccucccugcc

SEQ ID NO: 1938869 - RNA, 22 nt, Homo sapiens
aggucaucaugaaagguuaaaa

SEQ ID NO: 1938870 - RNA, 19 nt, Homo sapiens
ucuaaaguguuuagcuguc

SEQ ID NO: 1938871 - RNA, 20 nt, Homo sapiens
aaccugcagccccucaugcc

SEQ ID NO: 1938872 - RNA, 21 nt, Homo sapiens
gaaaacaugcuacacacugca

SEQ ID NO: 1938873 - RNA, 16 nt, Homo sapiens
auccucgcucccggga

SEQ ID NO: 1938874 - RNA, 18 nt, Homo sapiens
acuguaugugggaauuua

SEQ ID NO: 1938875 - RNA, 17 nt, Homo sapiens
agcucuauaagagcugg

SEQ ID NO: 1938876 - RNA, 14 nt, Homo sapiens
cauggaguguuuga

SEQ ID NO: 1938877 - RNA, 16 nt, Homo sapiens
ucagauguuuaaaaca

SEQ ID NO: 1938878 - RNA, 14 nt, Homo sapiens
ugauuuaccucaua

SEQ ID NO: 1938879 - RNA, 17 nt, Homo sapiens
auugcucagagaaauau

SEQ ID NO: 1938880 - RNA, 13 nt, Homo sapiens
uuaagggggaaaa

SEQ ID NO: 1938881 - RNA, 15 nt, Homo sapiens
ccaagcacuucacag

SEQ ID NO: 1938882 - RNA, 19 nt, Homo sapiens
ccuaaggcacccacaaaua

SEQ ID NO: 1938883 - RNA, 19 nt, Homo sapiens
aguccccagacucugccua

SEQ ID NO: 1938884 - RNA, 13 nt, Homo sapiens
agagaacuggagg

SEQ ID NO: 1938885 - RNA, 17 nt, Homo sapiens
aguguguguggcagcag

SEQ ID NO: 1938886 - RNA, 18 nt, Homo sapiens
cagcuuauagucuuccag

SEQ ID NO: 1938887 - RNA, 20 nt, Homo sapiens
accagcccugaccccagugu

SEQ ID NO: 1938888 - RNA, 20 nt, Homo sapiens
aggcuggaguguaguggcau

SEQ ID NO: 1938889 - RNA, 20 nt, Homo sapiens
aggcuggagugcaguggcac

SEQ ID NO: 1938890 - RNA, 14 nt, Homo sapiens
ucuccagcaguuag

SEQ ID NO: 1938891 - RNA, 22 nt, Homo sapiens
cuuucuuuagaauuuuuaccca

SEQ ID NO: 1938892 - RNA, 15 nt, Homo sapiens
ccuguaccucagugg

SEQ ID NO: 1938893 - RNA, 15 nt, Homo sapiens
ugagucagacuguca

SEQ ID NO: 1938894 - RNA, 15 nt, Homo sapiens
aauccauagauuucg

SEQ ID NO: 1938895 - RNA, 23 nt, Homo sapiens
uggaggaccuuggccuguucauu

SEQ ID NO: 1938896 - RNA, 18 nt, Homo sapiens
uaaaauagaggcuuugag

SEQ ID NO: 1938897 - RNA, 23 nt, Homo sapiens
ugggccuagggacagacugcaag

SEQ ID NO: 1938898 - RNA, 19 nt, Homo sapiens
acuugggggccauccugcc

SEQ ID NO: 1938899 - RNA, 16 nt, Homo sapiens
ccauggcucagggugg

SEQ ID NO: 1938900 - RNA, 17 nt, Homo sapiens
guuucuaggcaccucag

SEQ ID NO: 1938901 - RNA, 17 nt, Homo sapiens
aauguuuucuuugcaaa

SEQ ID NO: 1938902 - RNA, 12 nt, Homo sapiens
agugacacccag

SEQ ID NO: 1938903 - RNA, 22 nt, Homo sapiens
cacagauuccuggcagagccau

SEQ ID NO: 1938904 - RNA, 19 nt, Homo sapiens
auuuagcccucacauuaga

SEQ ID NO: 1938905 - RNA, 19 nt, Homo sapiens
uaaucuuucuccacuguuc

SEQ ID NO: 1938906 - RNA, 21 nt, Homo sapiens
ugaaaaaugguaauuguugcu

SEQ ID NO: 1938907 - RNA, 15 nt, Homo sapiens
ucaagugagccagga

SEQ ID NO: 1938908 - RNA, 20 nt, Homo sapiens
aggcaggcccagccucugcc

SEQ ID NO: 1938909 - RNA, 16 nt, Homo sapiens
uggcaauauccaaaua

SEQ ID NO: 1938910 - RNA, 18 nt, Homo sapiens
acccucucucugaucucc

SEQ ID NO: 1938911 - RNA, 22 nt, Homo sapiens
uuauauaaguuaaagagacaaa

SEQ ID NO: 1938912 - RNA, 17 nt, Homo sapiens
gggcacugccagcccac

SEQ ID NO: 1938913 - RNA, 24 nt, Homo sapiens
ccacaauuauauaaaucauuucaa

SEQ ID NO: 1938914 - RNA, 15 nt, Homo sapiens
gcuuaacgugucuga

SEQ ID NO: 1938915 - RNA, 22 nt, Homo sapiens
cagcugccuuuuaagaggucuu

SEQ ID NO: 1938916 - RNA, 19 nt, Homo sapiens
ggauacaggugacagugaa

SEQ ID NO: 1938917 - RNA, 21 nt, Homo sapiens
gccugcacagugaagugcugg

SEQ ID NO: 1938918 - RNA, 14 nt, Homo sapiens
auguuugcauuucc

SEQ ID NO: 1938919 - RNA, 21 nt, Homo sapiens
gaauaugggguugguguucuc

SEQ ID NO: 1938920 - RNA, 16 nt, Homo sapiens
caggaaauacuuugua

SEQ ID NO: 1938921 - RNA, 15 nt, Homo sapiens
acaggucaaccaugg

SEQ ID NO: 1938922 - RNA, 13 nt, Homo sapiens
gacaaaccagagc

SEQ ID NO: 1938923 - RNA, 16 nt, Homo sapiens
gaggcucgagcucggg

SEQ ID NO: 1938924 - RNA, 18 nt, Homo sapiens
ucaauugcagaugccaaa

SEQ ID NO: 1938925 - RNA, 15 nt, Homo sapiens
uccugccccaggugu

SEQ ID NO: 1938926 - RNA, 21 nt, Homo sapiens
cgugagcuccggaauagaugu

SEQ ID NO: 1938927 - RNA, 20 nt, Homo sapiens
aaugaagaugaugcuauuaa

SEQ ID NO: 1938928 - RNA, 19 nt, Homo sapiens
guucccuguucuuccucca

SEQ ID NO: 1938929 - RNA, 17 nt, Homo sapiens
uacucuugcugcacuua

SEQ ID NO: 1938930 - RNA, 16 nt, Homo sapiens
aagcacuagccuuccc

SEQ ID NO: 1938931 - RNA, 18 nt, Homo sapiens
aagggaccaagcgaccaa

SEQ ID NO: 1938932 - RNA, 23 nt, Homo sapiens
cguaacagauuuuguuggcauag

SEQ ID NO: 1938933 - RNA, 17 nt, Homo sapiens
gcccuccucccugucau

SEQ ID NO: 1938934 - RNA, 20 nt, Homo sapiens
gacagaauuaggaccugguu

SEQ ID NO: 1938935 - RNA, 16 nt, Homo sapiens
cagcucagaacccagg

SEQ ID NO: 1938936 - RNA, 21 nt, Homo sapiens
cacgcguccacauacacugca

SEQ ID NO: 1938937 - RNA, 20 nt, Homo sapiens
cugagcgaugggcaucacac

SEQ ID NO: 1938938 - RNA, 19 nt, Homo sapiens
uugguggccuaauuuacaa

SEQ ID NO: 1938939 - RNA, 23 nt, Homo sapiens
uagcccuaaaaugacaagccuuc

SEQ ID NO: 1938940 - RNA, 19 nt, Homo sapiens
uucagacuuaaagcacuga

SEQ ID NO: 1938941 - RNA, 18 nt, Homo sapiens
aacacacauggaugcaca

SEQ ID NO: 1938942 - RNA, 18 nt, Homo sapiens
agcccacccugcugccuu

SEQ ID NO: 1938943 - RNA, 22 nt, Homo sapiens
cccagccugcucccuagccaga

SEQ ID NO: 1938944 - RNA, 22 nt, Homo sapiens
ucuacucuuaaauauacaacuu

SEQ ID NO: 1938945 - RNA, 14 nt, Homo sapiens
uuaaauagcauuau

SEQ ID NO: 1938946 - RNA, 14 nt, Homo sapiens
cuuaaaaguaauaa

SEQ ID NO: 1938947 - RNA, 20 nt, Homo sapiens
cauggauucaaccaacugca

SEQ ID NO: 1938948 - RNA, 14 nt, Homo sapiens
gggugccgcugucu

SEQ ID NO: 1938949 - RNA, 23 nt, Homo sapiens
auggccucaaaaaucagggccac

SEQ ID NO: 1938950 - RNA, 23 nt, Homo sapiens
accaucuguauguuaggugacau

SEQ ID NO: 1938951 - RNA, 17 nt, Homo sapiens
aaccugggcauuguuga

SEQ ID NO: 1938952 - RNA, 18 nt, Homo sapiens
cucaacccugugaucuau

SEQ ID NO: 1938953 - RNA, 14 nt, Homo sapiens
ucccugcacccaug

SEQ ID NO: 1938954 - RNA, 15 nt, Homo sapiens
cuauguuucaucuug

SEQ ID NO: 1938955 - RNA, 20 nt, Homo sapiens
cuuaauaauuuuuaccuaau

SEQ ID NO: 1938956 - RNA, 19 nt, Homo sapiens
gacauccccacccuuggag

SEQ ID NO: 1938957 - RNA, 15 nt, Homo sapiens
cauauucaucagcag

SEQ ID NO: 1938958 - RNA, 15 nt, Homo sapiens
ucuuaaaaacaacga

SEQ ID NO: 1938959 - RNA, 15 nt, Homo sapiens
uguagaaugauuuca

SEQ ID NO: 1938960 - RNA, 20 nt, Homo sapiens
ugccccguccacggcucuag

SEQ ID NO: 1938961 - RNA, 21 nt, Homo sapiens
cuaguuucacguaaauauuca

SEQ ID NO: 1938962 - RNA, 17 nt, Homo sapiens
aacuccccuacaucaaa

SEQ ID NO: 1938963 - RNA, 20 nt, Homo sapiens
acagacaggaauuuagaaaa

SEQ ID NO: 1938964 - RNA, 21 nt, Homo sapiens
auuuaguaauaguccaauauu

SEQ ID NO: 1938965 - RNA, 18 nt, Homo sapiens
cuguccuguuucugucaa

SEQ ID NO: 1938966 - RNA, 21 nt, Homo sapiens
uuacugaggaaauauuuccau

SEQ ID NO: 1938967 - RNA, 11 nt, Homo sapiens
gcuuccuugcc

SEQ ID NO: 1938968 - RNA, 22 nt, Homo sapiens
uagaaauguuuagguuacuaaa

SEQ ID NO: 1938969 - RNA, 16 nt, Homo sapiens
ccaggcuuacugagcu

SEQ ID NO: 1938970 - RNA, 21 nt, Homo sapiens
gggcaggggcugcauccucag

SEQ ID NO: 1938971 - RNA, 20 nt, Homo sapiens
ugcacauucucccuugauuc

SEQ ID NO: 1938972 - RNA, 16 nt, Homo sapiens
ugauacugcaacuuua

SEQ ID NO: 1938973 - RNA, 15 nt, Homo sapiens
caguugcuuugccca

SEQ ID NO: 1938974 - RNA, 17 nt, Homo sapiens
cagacacaggucccuga

SEQ ID NO: 1938975 - RNA, 14 nt, Homo sapiens
gaauagugccugaa

SEQ ID NO: 1938976 - RNA, 23 nt, Homo sapiens
gcaacaucaguuuaaacaaaggg

SEQ ID NO: 1938977 - RNA, 20 nt, Homo sapiens
gaauacucugcccucuagag

SEQ ID NO: 1938978 - RNA, 13 nt, Homo sapiens
agcacuuugcaac

SEQ ID NO: 1938979 - RNA, 23 nt, Homo sapiens
auccuuugaguuauaguuugcuu

SEQ ID NO: 1938980 - RNA, 17 nt, Homo sapiens
uggggucuguucuugaa

SEQ ID NO: 1938981 - RNA, 14 nt, Homo sapiens
aguacucaguaaau

SEQ ID NO: 1938982 - RNA, 20 nt, Homo sapiens
accacugcagaagacaguau

SEQ ID NO: 1938983 - RNA, 12 nt, Homo sapiens
ccacgaugcagu

SEQ ID NO: 1938984 - RNA, 18 nt, Homo sapiens
auguaauuauguucuaag

SEQ ID NO: 1938985 - RNA, 21 nt, Homo sapiens
aggugagcaaccaguuggcua

SEQ ID NO: 1938986 - RNA, 20 nt, Homo sapiens
cugccaguacucccugcuaa

SEQ ID NO: 1938987 - RNA, 13 nt, Homo sapiens
uugcauacauucu

SEQ ID NO: 1938988 - RNA, 23 nt, Homo sapiens
gacuaaauuuggggacagauuca

SEQ ID NO: 1938989 - RNA, 19 nt, Homo sapiens
ccccugaaguagaucauaa

SEQ ID NO: 1938990 - RNA, 22 nt, Homo sapiens
uagaagccacuauuacugggac

SEQ ID NO: 1938991 - RNA, 22 nt, Homo sapiens
uuccaucauuucugucuuuaag

SEQ ID NO: 1938992 - RNA, 15 nt, Homo sapiens
ucaacuguauaguuu

SEQ ID NO: 1938993 - RNA, 18 nt, Homo sapiens
guuggcaaacgagacuuu

SEQ ID NO: 1938994 - RNA, 22 nt, Homo sapiens
guggcaucucuaauuggaagaa

SEQ ID NO: 1938995 - RNA, 22 nt, Homo sapiens
aaagcuagaggagauugcucug

SEQ ID NO: 1938996 - RNA, 14 nt, Homo sapiens
acuucagauuucaa

SEQ ID NO: 1938997 - RNA, 13 nt, Homo sapiens
cgccugcugggga

SEQ ID NO: 1938998 - RNA, 20 nt, Homo sapiens
aauacauuuuauaucuggau

SEQ ID NO: 1938999 - RNA, 14 nt, Homo sapiens
caaaaaccaaacac

SEQ ID NO: 1939000 - RNA, 16 nt, Homo sapiens
aaguuauuuuuguaca

SEQ ID NO: 1939001 - RNA, 19 nt, Homo sapiens
acaacgcaccagacacuca

SEQ ID NO: 1939002 - RNA, 19 nt, Homo sapiens
cuggauuugcaggugaaca

SEQ ID NO: 1939003 - RNA, 13 nt, Homo sapiens
aacuuaggaagga

SEQ ID NO: 1939004 - RNA, 17 nt, Homo sapiens
gaaaaacaccagcuuug

SEQ ID NO: 1939005 - RNA, 14 nt, Homo sapiens
uuaaagguauuuau

SEQ ID NO: 1939006 - RNA, 16 nt, Homo sapiens
gugucacagcuuugug

SEQ ID NO: 1939007 - RNA, 18 nt, Homo sapiens
caggagauggaauaucaa

SEQ ID NO: 1939008 - RNA, 24 nt, Homo sapiens
aguaacuuauuuuguacuaguguc

SEQ ID NO: 1939009 - RNA, 14 nt, Homo sapiens
uuuaagcagucuca

SEQ ID NO: 1939010 - RNA, 16 nt, Homo sapiens
ucccaggacaagccag

SEQ ID NO: 1939011 - RNA, 16 nt, Homo sapiens
caccaggaucagccag

SEQ ID NO: 1939012 - RNA, 18 nt, Homo sapiens
ggcccaguucacccugau

SEQ ID NO: 1939013 - RNA, 20 nt, Homo sapiens
gagaggaguucaaugaucua

SEQ ID NO: 1939014 - RNA, 23 nt, Homo sapiens
ugucacuccaaaccuuacucuga

SEQ ID NO: 1939015 - RNA, 20 nt, Homo sapiens
cucugagaacuccucauucc

SEQ ID NO: 1939016 - RNA, 16 nt, Homo sapiens
aaauccaggcuggugu

SEQ ID NO: 1939017 - RNA, 15 nt, Homo sapiens
agguucacaccauuu

SEQ ID NO: 1939018 - RNA, 20 nt, Homo sapiens
uacacaggaggcugaggcag

SEQ ID NO: 1939019 - RNA, 18 nt, Homo sapiens
gacuaugaucucauccca

SEQ ID NO: 1939020 - RNA, 14 nt, Homo sapiens
uaaaguacuacauc

SEQ ID NO: 1939021 - RNA, 13 nt, Homo sapiens
caaaaacacaaau

SEQ ID NO: 1939022 - RNA, 18 nt, Homo sapiens
ugccccagcagugccuug

SEQ ID NO: 1939023 - RNA, 13 nt, Homo sapiens
augauacaaugaa

SEQ ID NO: 1939024 - RNA, 22 nt, Homo sapiens
auugcagugaacuuccagacag

SEQ ID NO: 1939025 - RNA, 14 nt, Homo sapiens
uucucacucagaug

SEQ ID NO: 1939026 - RNA, 17 nt, Homo sapiens
accacggucacaccuca

SEQ ID NO: 1939027 - RNA, 23 nt, Homo sapiens
ugaauauagccugccucaguggc

SEQ ID NO: 1939028 - RNA, 15 nt, Homo sapiens
aaucaaaugugcauc

SEQ ID NO: 1939029 - RNA, 19 nt, Homo sapiens
ugcuuagucccucaugcaa

SEQ ID NO: 1939030 - RNA, 18 nt, Homo sapiens
ugaauucuggaaucacaa

SEQ ID NO: 1939031 - RNA, 21 nt, Homo sapiens
uggcauauuuuucacauaucu

SEQ ID NO: 1939032 - RNA, 22 nt, Homo sapiens
caggcugggugacagagcgaga

SEQ ID NO: 1939033 - RNA, 14 nt, Homo sapiens
aguuaacuacagug

SEQ ID NO: 1939034 - RNA, 14 nt, Homo sapiens
aaguagcuguaaga

SEQ ID NO: 1939035 - RNA, 12 nt, Homo sapiens
agcacuucccac

SEQ ID NO: 1939036 - RNA, 20 nt, Homo sapiens
cugguggagaaagcacugac

SEQ ID NO: 1939037 - RNA, 20 nt, Homo sapiens
cugcaccagugugacaucua

SEQ ID NO: 1939038 - RNA, 18 nt, Homo sapiens
cgagcacauaccaugugc

SEQ ID NO: 1939039 - RNA, 21 nt, Homo sapiens
aggaaaggggcgagcacccac

SEQ ID NO: 1939040 - RNA, 12 nt, Homo sapiens
gaaccacuccca

SEQ ID NO: 1939041 - RNA, 19 nt, Homo sapiens
uuugagacggagucucuca

SEQ ID NO: 1939042 - RNA, 20 nt, Homo sapiens
ucaguaagacgacaaggaaa

SEQ ID NO: 1939043 - RNA, 21 nt, Homo sapiens
ggucaggagaaugaaacagcu

SEQ ID NO: 1939044 - RNA, 19 nt, Homo sapiens
accucccuucccaccuacu

SEQ ID NO: 1939045 - RNA, 18 nt, Homo sapiens
acucaaguuuuuacaaaa

SEQ ID NO: 1939046 - RNA, 19 nt, Homo sapiens
caauccuaugucauuucua

SEQ ID NO: 1939047 - RNA, 16 nt, Homo sapiens
gacuauggaaauguag

SEQ ID NO: 1939048 - RNA, 15 nt, Homo sapiens
ggccgaguaccuuaa

SEQ ID NO: 1939049 - RNA, 13 nt, Homo sapiens
ucucguugcccua

SEQ ID NO: 1939050 - RNA, 20 nt, Homo sapiens
cagaacauucgaaucucugc

SEQ ID NO: 1939051 - RNA, 20 nt, Homo sapiens
cuccugauauaacacuuucc

SEQ ID NO: 1939052 - RNA, 16 nt, Homo sapiens
uaacucagacauucca

SEQ ID NO: 1939053 - RNA, 19 nt, Homo sapiens
uggaggcaugcuaagaaua

SEQ ID NO: 1939054 - RNA, 14 nt, Homo sapiens
cacugaauuccauu

SEQ ID NO: 1939055 - RNA, 19 nt, Homo sapiens
auauuuccuucaccaccuc

SEQ ID NO: 1939056 - RNA, 22 nt, Homo sapiens
uguuuuccccaauuauccuccu

SEQ ID NO: 1939057 - RNA, 24 nt, Homo sapiens
uggauuugcaggugaacagccucc

SEQ ID NO: 1939058 - RNA, 19 nt, Homo sapiens
auacccaggaagagcugac

SEQ ID NO: 1939059 - RNA, 15 nt, Homo sapiens
accucugcacaagcu

SEQ ID NO: 1939060 - RNA, 14 nt, Homo sapiens
agauggauucucca

SEQ ID NO: 1939061 - RNA, 20 nt, Homo sapiens
ccguccucgagcaacugcug

SEQ ID NO: 1939062 - RNA, 18 nt, Homo sapiens
gcugugccaggacuguga

SEQ ID NO: 1939063 - RNA, 17 nt, Homo sapiens
caggagcagcaucauuc

SEQ ID NO: 1939064 - RNA, 12 nt, Homo sapiens
cggaaucucagc

SEQ ID NO: 1939065 - RNA, 13 nt, Homo sapiens
auaaaaauacaaa

SEQ ID NO: 1939066 - RNA, 17 nt, Homo sapiens
aguuaguuuguauauau

SEQ ID NO: 1939067 - RNA, 22 nt, Homo sapiens
uaccuuccccacaucugagaga

SEQ ID NO: 1939068 - RNA, 22 nt, Homo sapiens
uguaagacaaaaagcuacuuau

SEQ ID NO: 1939069 - RNA, 16 nt, Homo sapiens
auauccauuguggaaa

SEQ ID NO: 1939070 - RNA, 17 nt, Homo sapiens
gccuggccccucagggu

SEQ ID NO: 1939071 - RNA, 16 nt, Homo sapiens
ugaaggagaaaaugca

SEQ ID NO: 1939072 - RNA, 23 nt, Homo sapiens
aauguucagaaagccuauuccau

SEQ ID NO: 1939073 - RNA, 14 nt, Homo sapiens
uuuuaauugcaaca

SEQ ID NO: 1939074 - RNA, 12 nt, Homo sapiens
agugcaguggcu

SEQ ID NO: 1939075 - RNA, 17 nt, Homo sapiens
uaaguaccacucaggcc

SEQ ID NO: 1939076 - RNA, 14 nt, Homo sapiens
gcccagugcacuug

SEQ ID NO: 1939077 - RNA, 17 nt, Homo sapiens
ccucaguucuugccacu

SEQ ID NO: 1939078 - RNA, 20 nt, Homo sapiens
ugcagucggugguaccugag

SEQ ID NO: 1939079 - RNA, 19 nt, Homo sapiens
ccagauagcagggcaugaa

SEQ ID NO: 1939080 - RNA, 20 nt, Homo sapiens
cagccccuagaaacccaagc

SEQ ID NO: 1939081 - RNA, 20 nt, Homo sapiens
ugccccucccccacuuucaa

SEQ ID NO: 1939082 - RNA, 15 nt, Homo sapiens
gcaccggcucaggag

SEQ ID NO: 1939083 - RNA, 11 nt, Homo sapiens
cuaaacuguau

SEQ ID NO: 1939084 - RNA, 16 nt, Homo sapiens
gaacguaucaauacag

SEQ ID NO: 1939085 - RNA, 20 nt, Homo sapiens
ugaacaccuauugcacuugg

SEQ ID NO: 1939086 - RNA, 22 nt, Homo sapiens
cugggaguucccugaacaucug

SEQ ID NO: 1939087 - RNA, 11 nt, Homo sapiens
aaauggugguc

SEQ ID NO: 1939088 - RNA, 15 nt, Homo sapiens
acauuugguuuucau

SEQ ID NO: 1939089 - RNA, 13 nt, Homo sapiens
aaauagagaucuu

SEQ ID NO: 1939090 - RNA, 19 nt, Homo sapiens
uuuuguacaguuaucauga

SEQ ID NO: 1939091 - RNA, 19 nt, Homo sapiens
uauuucuuuuuugccaaau

SEQ ID NO: 1939092 - RNA, 14 nt, Homo sapiens
aaaggaauguguaa

SEQ ID NO: 1939093 - RNA, 18 nt, Homo sapiens
agaaacuguuacuguccu

SEQ ID NO: 1939094 - RNA, 13 nt, Homo sapiens
cauuucuccaugg

SEQ ID NO: 1939095 - RNA, 19 nt, Homo sapiens
gugguucagacaagacaga

SEQ ID NO: 1939096 - RNA, 12 nt, Homo sapiens
ugaaacuuuauc

SEQ ID NO: 1939097 - RNA, 20 nt, Homo sapiens
ccuuuaaaaaugcaccacuu

SEQ ID NO: 1939098 - RNA, 22 nt, Homo sapiens
aagggauuguagauaacacuga

SEQ ID NO: 1939099 - RNA, 17 nt, Homo sapiens
ugagccccugagcccaa

SEQ ID NO: 1939100 - RNA, 17 nt, Homo sapiens
cucacucacucacucca

SEQ ID NO: 1939101 - RNA, 16 nt, Homo sapiens
gaugucauuaaugugu

SEQ ID NO: 1939102 - RNA, 20 nt, Homo sapiens
auccguuuucauuguucacu

SEQ ID NO: 1939103 - RNA, 21 nt, Homo sapiens
ccugaagaacaguaacugcca

SEQ ID NO: 1939104 - RNA, 15 nt, Homo sapiens
ucagguucuucaggg

SEQ ID NO: 1939105 - RNA, 19 nt, Homo sapiens
ucuuucuguuauugcacua

SEQ ID NO: 1939106 - RNA, 19 nt, Homo sapiens
gucugaaugucacugacag

SEQ ID NO: 1939107 - RNA, 17 nt, Homo sapiens
guaugcuacaaucugug

SEQ ID NO: 1939108 - RNA, 19 nt, Homo sapiens
caggauaauaaaacaugua

SEQ ID NO: 1939109 - RNA, 16 nt, Homo sapiens
aacuaggagucuucac

SEQ ID NO: 1939110 - RNA, 18 nt, Homo sapiens
auucucuugaaggugcug

SEQ ID NO: 1939111 - RNA, 13 nt, Homo sapiens
ggacuagccacuu

SEQ ID NO: 1939112 - RNA, 22 nt, Homo sapiens
ccaucugucuugccagccagaa

SEQ ID NO: 1939113 - RNA, 19 nt, Homo sapiens
ugagguggugccuucucac

SEQ ID NO: 1939114 - RNA, 18 nt, Homo sapiens
gaaaucauugugugucuu

SEQ ID NO: 1939115 - RNA, 15 nt, Homo sapiens
uccucaaaaaucauc

SEQ ID NO: 1939116 - RNA, 13 nt, Homo sapiens
uuuauaauaaaca

SEQ ID NO: 1939117 - RNA, 21 nt, Homo sapiens
uuucacuaaaagucuccaaaa

SEQ ID NO: 1939118 - RNA, 17 nt, Homo sapiens
aaagaugccauaggaga

SEQ ID NO: 1939119 - RNA, 22 nt, Homo sapiens
guaagagucacaauuugcaaau

SEQ ID NO: 1939120 - RNA, 16 nt, Homo sapiens
gaauugaacgacugua

SEQ ID NO: 1939121 - RNA, 13 nt, Homo sapiens
agcaacugaagac

SEQ ID NO: 1939122 - RNA, 23 nt, Homo sapiens
aauuaucuuaucuacugacugaa

SEQ ID NO: 1939123 - RNA, 16 nt, Homo sapiens
cagcaguuuccugcca

SEQ ID NO: 1939124 - RNA, 14 nt, Homo sapiens
cucccuguuuuagu

SEQ ID NO: 1939125 - RNA, 15 nt, Homo sapiens
uccccaagggcccug

SEQ ID NO: 1939126 - RNA, 14 nt, Homo sapiens
cuguugcuugaaua

SEQ ID NO: 1939127 - RNA, 12 nt, Homo sapiens
agccacacucug

SEQ ID NO: 1939128 - RNA, 11 nt, Homo sapiens
ccagggccaug

SEQ ID NO: 1939129 - RNA, 20 nt, Homo sapiens
ggaugauguuguacgcacug

SEQ ID NO: 1939130 - RNA, 22 nt, Homo sapiens
ccucugucaaugaaaaaaagua

SEQ ID NO: 1939131 - RNA, 15 nt, Homo sapiens
gcuucucccauuucc

SEQ ID NO: 1939132 - RNA, 20 nt, Homo sapiens
cagaucaagaguuuuggaga

SEQ ID NO: 1939133 - RNA, 16 nt, Homo sapiens
uaacuggcuuacuucc

SEQ ID NO: 1939134 - RNA, 21 nt, Homo sapiens
agggggcaagcuuugcuccuu

SEQ ID NO: 1939135 - RNA, 16 nt, Homo sapiens
ucucaggaccucugua

SEQ ID NO: 1939136 - RNA, 16 nt, Homo sapiens
uacauauacacaaaga

SEQ ID NO: 1939137 - RNA, 17 nt, Homo sapiens
ucaccuugcucugccau

SEQ ID NO: 1939138 - RNA, 15 nt, Homo sapiens
gcacugccugccaag

SEQ ID NO: 1939139 - RNA, 21 nt, Homo sapiens
acagaguaaauagcauucucu

SEQ ID NO: 1939140 - RNA, 20 nt, Homo sapiens
aggaacuuuccccagaucaa

SEQ ID NO: 1939141 - RNA, 22 nt, Homo sapiens
gcuuuguaucagucagugcugg

SEQ ID NO: 1939142 - RNA, 14 nt, Homo sapiens
ccauccccuggacu

SEQ ID NO: 1939143 - RNA, 22 nt, Homo sapiens
cuggcacaccagaagugccaug

SEQ ID NO: 1939144 - RNA, 19 nt, Homo sapiens
gcugucuuuucuuugccau

SEQ ID NO: 1939145 - RNA, 18 nt, Homo sapiens
uugaauaugccaaacaca

SEQ ID NO: 1939146 - RNA, 19 nt, Homo sapiens
caacagcaagucacccauc

SEQ ID NO: 1939147 - RNA, 17 nt, Homo sapiens
cuggggaggcugagacu

SEQ ID NO: 1939148 - RNA, 20 nt, Homo sapiens
ucaggaacacccccaugaca

SEQ ID NO: 1939149 - RNA, 17 nt, Homo sapiens
gagguucugagaccagu

SEQ ID NO: 1939150 - RNA, 17 nt, Homo sapiens
cauuaaaaaaauuccau

SEQ ID NO: 1939151 - RNA, 23 nt, Homo sapiens
aguaacaaauaaagugcaguuua

SEQ ID NO: 1939152 - RNA, 14 nt, Homo sapiens
ccaggacgcaugca

SEQ ID NO: 1939153 - RNA, 20 nt, Homo sapiens
uuacauuuuaggacacugcg

SEQ ID NO: 1939154 - RNA, 16 nt, Homo sapiens
cacaccugcacaccgu

SEQ ID NO: 1939155 - RNA, 23 nt, Homo sapiens
aagaagucuggccauuuuggaaa

SEQ ID NO: 1939156 - RNA, 13 nt, Homo sapiens
agguugagggcaa

SEQ ID NO: 1939157 - RNA, 12 nt, Homo sapiens
uuaaagaaugca

SEQ ID NO: 1939158 - RNA, 15 nt, Homo sapiens
ccaguucugcaaaga

SEQ ID NO: 1939159 - RNA, 18 nt, Homo sapiens
aauucauccucuuaccag

SEQ ID NO: 1939160 - RNA, 20 nt, Homo sapiens
cucucaaauccugaugcugu

SEQ ID NO: 1939161 - RNA, 19 nt, Homo sapiens
uaggguuuaaaauagggga

SEQ ID NO: 1939162 - RNA, 14 nt, Homo sapiens
gaaccuuaaugaca

SEQ ID NO: 1939163 - RNA, 13 nt, Homo sapiens
ugacggacucaga

SEQ ID NO: 1939164 - RNA, 18 nt, Homo sapiens
cccuccacccacuaggug

SEQ ID NO: 1939165 - RNA, 22 nt, Homo sapiens
agcuauuggccucccaaaagac

SEQ ID NO: 1939166 - RNA, 10 nt, Homo sapiens
aucugucaca

SEQ ID NO: 1939167 - RNA, 23 nt, Homo sapiens
auagauauuccuauugugcaaug

SEQ ID NO: 1939168 - RNA, 15 nt, Homo sapiens
cuggagucagguguc

SEQ ID NO: 1939169 - RNA, 17 nt, Homo sapiens
cuguuuuucggacaguu

SEQ ID NO: 1939170 - RNA, 21 nt, Homo sapiens
aacucuccaauguucuauuaa

SEQ ID NO: 1939171 - RNA, 16 nt, Homo sapiens
acugcagccucugccu

SEQ ID NO: 1939172 - RNA, 19 nt, Homo sapiens
cacucccuucuccuugaua

SEQ ID NO: 1939173 - RNA, 19 nt, Homo sapiens
aaaauauguauuuaccaaa

SEQ ID NO: 1939174 - RNA, 17 nt, Homo sapiens
caaggaaaaaugcugcu

SEQ ID NO: 1939175 - RNA, 15 nt, Homo sapiens
aaggagucugcacau

SEQ ID NO: 1939176 - RNA, 18 nt, Homo sapiens
aggauuuucacacauuca

SEQ ID NO: 1939177 - RNA, 17 nt, Homo sapiens
auccagaacugcacucu

SEQ ID NO: 1939178 - RNA, 22 nt, Homo sapiens
cauaauaaaaggcauucaucuu

SEQ ID NO: 1939179 - RNA, 12 nt, Homo sapiens
gaaaaucuguaa

SEQ ID NO: 1939180 - RNA, 15 nt, Homo sapiens
ccuagagacagugau

SEQ ID NO: 1939181 - RNA, 17 nt, Homo sapiens
agucacuugaugugcca

SEQ ID NO: 1939182 - RNA, 20 nt, Homo sapiens
uccugauauagaucacauaa

SEQ ID NO: 1939183 - RNA, 20 nt, Homo sapiens
cucauuauuaccacuuagaa

SEQ ID NO: 1939184 - RNA, 13 nt, Homo sapiens
cccaaugugaccu

SEQ ID NO: 1939185 - RNA, 20 nt, Homo sapiens
ugaaugccucccccaucucc

SEQ ID NO: 1939186 - RNA, 19 nt, Homo sapiens
cuuauaucauguaccucag

SEQ ID NO: 1939187 - RNA, 15 nt, Homo sapiens
cugggccugaccaaa

SEQ ID NO: 1939188 - RNA, 17 nt, Homo sapiens
guaagaaaaaucugcua

SEQ ID NO: 1939189 - RNA, 20 nt, Homo sapiens
cugcagccccaucuaccaca

SEQ ID NO: 1939190 - RNA, 22 nt, Homo sapiens
gaguaccaugaggguugcuauu

SEQ ID NO: 1939191 - RNA, 16 nt, Homo sapiens
cuaagcuucacuguaa

SEQ ID NO: 1939192 - RNA, 20 nt, Homo sapiens
agaugguguaugcuguaucc

SEQ ID NO: 1939193 - RNA, 17 nt, Homo sapiens
agcuuccucuucuacca

SEQ ID NO: 1939194 - RNA, 12 nt, Homo sapiens
cuccaggcuuca

SEQ ID NO: 1939195 - RNA, 17 nt, Homo sapiens
acaacuguggucaaucc

SEQ ID NO: 1939196 - RNA, 19 nt, Homo sapiens
aaacuuuuuuucuguacca

SEQ ID NO: 1939197 - RNA, 19 nt, Homo sapiens
agggcugcgacgcuugcuc

SEQ ID NO: 1939198 - RNA, 15 nt, Homo sapiens
uagaagccaucugac

SEQ ID NO: 1939199 - RNA, 12 nt, Homo sapiens
aaaauauauaca

SEQ ID NO: 1939200 - RNA, 23 nt, Homo sapiens
cuuucccucccuuccucuuucca

SEQ ID NO: 1939201 - RNA, 23 nt, Homo sapiens
uuccuaacugucugacuuauaau

SEQ ID NO: 1939202 - RNA, 19 nt, Homo sapiens
ccuuccugcuguccuucuc

SEQ ID NO: 1939203 - RNA, 21 nt, Homo sapiens
uacuaccccaggacgcaugca

SEQ ID NO: 1939204 - RNA, 16 nt, Homo sapiens
ccagucacuucugggg

SEQ ID NO: 1939205 - RNA, 18 nt, Homo sapiens
gaaaagggcagaggcaag

SEQ ID NO: 1939206 - RNA, 22 nt, Homo sapiens
gaaacccaaugacggcaaccuc

SEQ ID NO: 1939207 - RNA, 14 nt, Homo sapiens
ucauaaauacaaga

SEQ ID NO: 1939208 - RNA, 14 nt, Homo sapiens
uuaaguauauauau

SEQ ID NO: 1939209 - RNA, 15 nt, Homo sapiens
aagcaccaaagggaa

SEQ ID NO: 1939210 - RNA, 15 nt, Homo sapiens
ggucaugcacugagg

SEQ ID NO: 1939211 - RNA, 15 nt, Homo sapiens
cuauccauucucucc

SEQ ID NO: 1939212 - RNA, 18 nt, Homo sapiens
cgcaaggccugugcugca

SEQ ID NO: 1939213 - RNA, 20 nt, Homo sapiens
ucuuggcucacuacagccuc

SEQ ID NO: 1939214 - RNA, 18 nt, Homo sapiens
uaaauaguuuaugauucc

SEQ ID NO: 1939215 - RNA, 15 nt, Homo sapiens
ccucccugcacuuca

SEQ ID NO: 1939216 - RNA, 15 nt, Homo sapiens
uaccugagauggagg

SEQ ID NO: 1939217 - RNA, 22 nt, Homo sapiens
gacacagucuaacaaauuccaa

SEQ ID NO: 1939218 - RNA, 15 nt, Homo sapiens
cuucaccucacugaa

SEQ ID NO: 1939219 - RNA, 13 nt, Homo sapiens
auguaugcugauu

SEQ ID NO: 1939220 - RNA, 18 nt, Homo sapiens
accauucaggacacaggg

SEQ ID NO: 1939221 - RNA, 19 nt, Homo sapiens
caguuuacauuuaggcauu

SEQ ID NO: 1939222 - RNA, 21 nt, Homo sapiens
gggaaccaugaagacaggaug

SEQ ID NO: 1939223 - RNA, 17 nt, Homo sapiens
guuucugucaagcauau

SEQ ID NO: 1939224 - RNA, 17 nt, Homo sapiens
ucuguaaaagugucugu

SEQ ID NO: 1939225 - RNA, 15 nt, Homo sapiens
cuauuuccaccauca

SEQ ID NO: 1939226 - RNA, 13 nt, Homo sapiens
aauguuccugaaa

SEQ ID NO: 1939227 - RNA, 15 nt, Homo sapiens
uccaucguccauccu

SEQ ID NO: 1939228 - RNA, 20 nt, Homo sapiens
auauuuuuaaaaaucuaccu

SEQ ID NO: 1939229 - RNA, 12 nt, Homo sapiens
uaguagccauga

SEQ ID NO: 1939230 - RNA, 18 nt, Homo sapiens
uguuuucaaaaccaagua

SEQ ID NO: 1939231 - RNA, 19 nt, Homo sapiens
auugggcuucaaucacugu

SEQ ID NO: 1939232 - RNA, 14 nt, Homo sapiens
auuucuacuuucag

SEQ ID NO: 1939233 - RNA, 19 nt, Homo sapiens
uuuguaguguuauugccag

SEQ ID NO: 1939234 - RNA, 15 nt, Homo sapiens
ccacuugaacucuuu

SEQ ID NO: 1939235 - RNA, 19 nt, Homo sapiens
guuaccguucaccaguugc

SEQ ID NO: 1939236 - RNA, 16 nt, Homo sapiens
uuaaagguagucaaga

SEQ ID NO: 1939237 - RNA, 14 nt, Homo sapiens
ccaggcaugcaaug

SEQ ID NO: 1939238 - RNA, 16 nt, Homo sapiens
acaucccggcacuguu

SEQ ID NO: 1939239 - RNA, 20 nt, Homo sapiens
agccuuagcauccccuguga

SEQ ID NO: 1939240 - RNA, 14 nt, Homo sapiens
cccuccuuuccaaa

SEQ ID NO: 1939241 - RNA, 19 nt, Homo sapiens
uugagaccuaaucucugua

SEQ ID NO: 1939242 - RNA, 17 nt, Homo sapiens
aggguugcuucaaugau

SEQ ID NO: 1939243 - RNA, 21 nt, Homo sapiens
ugaaaagggcagaaauaccac

SEQ ID NO: 1939244 - RNA, 12 nt, Homo sapiens
guguaugucuau

SEQ ID NO: 1939245 - RNA, 21 nt, Homo sapiens
uggaaacuguugguugagaua

SEQ ID NO: 1939246 - RNA, 22 nt, Homo sapiens
guuuuccuuuuaacaauaugca

SEQ ID NO: 1939247 - RNA, 19 nt, Homo sapiens
acuauggagugcaccaaag

SEQ ID NO: 1939248 - RNA, 14 nt, Homo sapiens
acuggcccaagugg

SEQ ID NO: 1939249 - RNA, 18 nt, Homo sapiens
gagaaguggcaucaguca

SEQ ID NO: 1939250 - RNA, 23 nt, Homo sapiens
ugcuuguuaaauucuaguuuuau

SEQ ID NO: 1939251 - RNA, 19 nt, Homo sapiens
agggccuugauuuccagcc

SEQ ID NO: 1939252 - RNA, 15 nt, Homo sapiens
cauccguggcugcag

SEQ ID NO: 1939253 - RNA, 20 nt, Homo sapiens
gaugguuuuauucuuugaga

SEQ ID NO: 1939254 - RNA, 19 nt, Homo sapiens
accucagacaauccacucu

SEQ ID NO: 1939255 - RNA, 12 nt, Homo sapiens
ggaggcugagac

SEQ ID NO: 1939256 - RNA, 15 nt, Homo sapiens
agaccguugguucca

SEQ ID NO: 1939257 - RNA, 15 nt, Homo sapiens
ucuuccacauuccca

SEQ ID NO: 1939258 - RNA, 21 nt, Homo sapiens
gacaacauuucucaaaugcac

SEQ ID NO: 1939259 - RNA, 21 nt, Homo sapiens
cacugcccccugcugccaugu

SEQ ID NO: 1939260 - RNA, 21 nt, Homo sapiens
auaagcucaauuuaauuuugc

SEQ ID NO: 1939261 - RNA, 17 nt, Homo sapiens
gcgccuaccaccaugcc

SEQ ID NO: 1939262 - RNA, 22 nt, Homo sapiens
aguuugcaaucuuauguugauc

SEQ ID NO: 1939263 - RNA, 17 nt, Homo sapiens
cauaaauaaaaguacag

SEQ ID NO: 1939264 - RNA, 19 nt, Homo sapiens
ucaaaugugaccaugugaa

SEQ ID NO: 1939265 - RNA, 21 nt, Homo sapiens
ccuaugucauuucuacuuuga

SEQ ID NO: 1939266 - RNA, 15 nt, Homo sapiens
aaaucuggugcucaa

SEQ ID NO: 1939267 - RNA, 23 nt, Homo sapiens
aaucaaggagucuucuaauguaa

SEQ ID NO: 1939268 - RNA, 18 nt, Homo sapiens
auggaugagacuacuuca

SEQ ID NO: 1939269 - RNA, 19 nt, Homo sapiens
gcuuuuggucucccuggga

SEQ ID NO: 1939270 - RNA, 22 nt, Homo sapiens
gcgcccagcuccugacacugcu

SEQ ID NO: 1939271 - RNA, 14 nt, Homo sapiens
ccagacgccauuua

SEQ ID NO: 1939272 - RNA, 16 nt, Homo sapiens
ucugguguuugucaug

SEQ ID NO: 1939273 - RNA, 22 nt, Homo sapiens
aagcaaaguucaacuuauuuca

SEQ ID NO: 1939274 - RNA, 20 nt, Homo sapiens
guggauuccagcauuugcca

SEQ ID NO: 1939275 - RNA, 21 nt, Homo sapiens
auguuucugcuagcuauauau

SEQ ID NO: 1939276 - RNA, 12 nt, Homo sapiens
agacaugaacug

SEQ ID NO: 1939277 - RNA, 22 nt, Homo sapiens
gaggccccuucuagguggcaag

SEQ ID NO: 1939278 - RNA, 15 nt, Homo sapiens
uacagguaugugcca

SEQ ID NO: 1939279 - RNA, 15 nt, Homo sapiens
gucuccuacuccuga

SEQ ID NO: 1939280 - RNA, 19 nt, Homo sapiens
cuagacaagguugcuguug

SEQ ID NO: 1939281 - RNA, 21 nt, Homo sapiens
uuguagagccagggucucacu

SEQ ID NO: 1939282 - RNA, 22 nt, Homo sapiens
cgcaccugucgguggcugccuu

SEQ ID NO: 1939283 - RNA, 16 nt, Homo sapiens
aaucuuacaacaggcu

SEQ ID NO: 1939284 - RNA, 14 nt, Homo sapiens
acguaaacuuccua

SEQ ID NO: 1939285 - RNA, 21 nt, Homo sapiens
auagaagaugggaaaaccaug

SEQ ID NO: 1939286 - RNA, 12 nt, Homo sapiens
cgguuuuagcuu

SEQ ID NO: 1939287 - RNA, 17 nt, Homo sapiens
gaagcuuccaugaugca

SEQ ID NO: 1939288 - RNA, 13 nt, Homo sapiens
ggcccaggugagu

SEQ ID NO: 1939289 - RNA, 14 nt, Homo sapiens
ugaggcccugugau

SEQ ID NO: 1939290 - RNA, 16 nt, Homo sapiens
uugcuugagcaggauu

SEQ ID NO: 1939291 - RNA, 22 nt, Homo sapiens
cagugggacccacagucacaca

SEQ ID NO: 1939292 - RNA, 20 nt, Homo sapiens
auuuuuguaguuagacaaua

SEQ ID NO: 1939293 - RNA, 22 nt, Homo sapiens
auauuggucauugccuugccaa

SEQ ID NO: 1939294 - RNA, 21 nt, Homo sapiens
ccuaaaauuguaugaaaaucc

SEQ ID NO: 1939295 - RNA, 19 nt, Homo sapiens
accaucacugccaucacau

SEQ ID NO: 1939296 - RNA, 14 nt, Homo sapiens
uaaaaccuccuucu

SEQ ID NO: 1939297 - RNA, 15 nt, Homo sapiens
uccagauucagggag

SEQ ID NO: 1939298 - RNA, 17 nt, Homo sapiens
caauuacagcaaaaagg

SEQ ID NO: 1939299 - RNA, 18 nt, Homo sapiens
ugcacuuuuaaaccucuc

SEQ ID NO: 1939300 - RNA, 20 nt, Homo sapiens
uguuagcuuguauauauauu

SEQ ID NO: 1939301 - RNA, 22 nt, Homo sapiens
uugguugagauaguugguucuu

SEQ ID NO: 1939302 - RNA, 15 nt, Homo sapiens
ccauuuaaaaaacau

SEQ ID NO: 1939303 - RNA, 21 nt, Homo sapiens
cagaaauuuggcauugaucuu

SEQ ID NO: 1939304 - RNA, 17 nt, Homo sapiens
acagcccucaugaucau

SEQ ID NO: 1939305 - RNA, 20 nt, Homo sapiens
caaaagcuuauucaucuguu

SEQ ID NO: 1939306 - RNA, 23 nt, Homo sapiens
uaaaaguagacaaucacagggag

SEQ ID NO: 1939307 - RNA, 17 nt, Homo sapiens
gagacucugugaucuaa

SEQ ID NO: 1939308 - RNA, 14 nt, Homo sapiens
aucuagccaaagag

SEQ ID NO: 1939309 - RNA, 18 nt, Homo sapiens
uugaauuuugaaccaugu

SEQ ID NO: 1939310 - RNA, 16 nt, Homo sapiens
gugaccccugaccuca

SEQ ID NO: 1939311 - RNA, 19 nt, Homo sapiens
uuuucuucuuuuugcuuca

SEQ ID NO: 1939312 - RNA, 16 nt, Homo sapiens
uccauccuugagucaa

SEQ ID NO: 1939313 - RNA, 13 nt, Homo sapiens
aauggggccagau

SEQ ID NO: 1939314 - RNA, 16 nt, Homo sapiens
uuggcuuucauguuau

SEQ ID NO: 1939315 - RNA, 17 nt, Homo sapiens
aauuaucuauccuugau

SEQ ID NO: 1939316 - RNA, 11 nt, Homo sapiens
uaagugauaua

SEQ ID NO: 1939317 - RNA, 19 nt, Homo sapiens
gcccugcagagggaccaga

SEQ ID NO: 1939318 - RNA, 20 nt, Homo sapiens
aauuuggagucugacugugc

SEQ ID NO: 1939319 - RNA, 19 nt, Homo sapiens
uucauuucagauaaacaac

SEQ ID NO: 1939320 - RNA, 20 nt, Homo sapiens
gcucaaaguacuacagcaaa

SEQ ID NO: 1939321 - RNA, 16 nt, Homo sapiens
acuaacaaagacagcu

SEQ ID NO: 1939322 - RNA, 22 nt, Homo sapiens
caaauaugugguccaucucuga

SEQ ID NO: 1939323 - RNA, 9 nt, Homo sapiens
cccuaccuu

SEQ ID NO: 1939324 - RNA, 23 nt, Homo sapiens
aaauauauaaugguuuacugcug

SEQ ID NO: 1939325 - RNA, 19 nt, Homo sapiens
ccaguacuugucauaugua

SEQ ID NO: 1939326 - RNA, 15 nt, Homo sapiens
aucugauuugcauau

SEQ ID NO: 1939327 - RNA, 15 nt, Homo sapiens
cacuagaggaauaua

SEQ ID NO: 1939328 - RNA, 19 nt, Homo sapiens
cuuuggaccacuccccuca

SEQ ID NO: 1939329 - RNA, 17 nt, Homo sapiens
cuaguuuguuagugcau

SEQ ID NO: 1939330 - RNA, 22 nt, Homo sapiens
uuucaaaggccacauaccucuc

SEQ ID NO: 1939331 - RNA, 22 nt, Homo sapiens
agguucauugcgugauucaaug

SEQ ID NO: 1939332 - RNA, 12 nt, Homo sapiens
guaagaaaguga

SEQ ID NO: 1939333 - RNA, 12 nt, Homo sapiens
aaaagaaaaaga

SEQ ID NO: 1939334 - RNA, 15 nt, Homo sapiens
aauaaguacauauag

SEQ ID NO: 1939335 - RNA, 19 nt, Homo sapiens
cuggcccccacauggugau

SEQ ID NO: 1939336 - RNA, 13 nt, Homo sapiens
ccgucucuuuaaa

SEQ ID NO: 1939337 - RNA, 20 nt, Homo sapiens
gauauaauucuuaugccaua

SEQ ID NO: 1939338 - RNA, 22 nt, Homo sapiens
acuccuuccuucaggacucugc

SEQ ID NO: 1939339 - RNA, 19 nt, Homo sapiens
aucgggaguagcaaggaag

SEQ ID NO: 1939340 - RNA, 13 nt, Homo sapiens
aaggugcacugcu

SEQ ID NO: 1939341 - RNA, 14 nt, Homo sapiens
agucucugcugcua

SEQ ID NO: 1939342 - RNA, 20 nt, Homo sapiens
cucaggaaaaaccagccacu

SEQ ID NO: 1939343 - RNA, 18 nt, Homo sapiens
ugcugggggaaguggcca

SEQ ID NO: 1939344 - RNA, 13 nt, Homo sapiens
ccaauucaauaca

SEQ ID NO: 1939345 - RNA, 20 nt, Homo sapiens
aagcccaggagccucacugg

SEQ ID NO: 1939346 - RNA, 20 nt, Homo sapiens
agugccaacaauccuagugc

SEQ ID NO: 1939347 - RNA, 23 nt, Homo sapiens
ccugcggaggguuugguucuuga

SEQ ID NO: 1939348 - RNA, 16 nt, Homo sapiens
ugggccucuucugccu

SEQ ID NO: 1939349 - RNA, 15 nt, Homo sapiens
aaagaugauuucuca

SEQ ID NO: 1939350 - RNA, 21 nt, Homo sapiens
acggagacuuucaaacauaua

SEQ ID NO: 1939351 - RNA, 22 nt, Homo sapiens
auaaaagugaagugaaucugau

SEQ ID NO: 1939352 - RNA, 22 nt, Homo sapiens
cacccaggauccccaaggcacu

SEQ ID NO: 1939353 - RNA, 23 nt, Homo sapiens
cuggagggguggcccagagccau

SEQ ID NO: 1939354 - RNA, 21 nt, Homo sapiens
ugaauggaggcagagaccucc

SEQ ID NO: 1939355 - RNA, 18 nt, Homo sapiens
gggcucgguggcccaggu

SEQ ID NO: 1939356 - RNA, 19 nt, Homo sapiens
agaucguucucugccucac

SEQ ID NO: 1939357 - RNA, 23 nt, Homo sapiens
cagcugugugugcccguggugag

SEQ ID NO: 1939358 - RNA, 16 nt, Homo sapiens
aggggccggccagugg

SEQ ID NO: 1939359 - RNA, 21 nt, Homo sapiens
ucacaagugaaaaacauccag

SEQ ID NO: 1939360 - RNA, 23 nt, Homo sapiens
cuaccugcccucucucaguuauu

SEQ ID NO: 1939361 - RNA, 16 nt, Homo sapiens
aaauaaauuugcacug

SEQ ID NO: 1939362 - RNA, 16 nt, Homo sapiens
agaaacugacacaugc

SEQ ID NO: 1939363 - RNA, 23 nt, Homo sapiens
auuaaaaaggaaaguuugccagg

SEQ ID NO: 1939364 - RNA, 16 nt, Homo sapiens
aaacagcuugaugcug

SEQ ID NO: 1939365 - RNA, 16 nt, Homo sapiens
uaugcuauccucuuau

SEQ ID NO: 1939366 - RNA, 13 nt, Homo sapiens
uuggaagucuaag

SEQ ID NO: 1939367 - RNA, 11 nt, Homo sapiens
ccaagcaccuc

SEQ ID NO: 1939368 - RNA, 22 nt, Homo sapiens
cucaggucccaggcuccuaugc

SEQ ID NO: 1939369 - RNA, 21 nt, Homo sapiens
cuaauuuccucugacauguaa

SEQ ID NO: 1939370 - RNA, 14 nt, Homo sapiens
gccgcgcaucagac

SEQ ID NO: 1939371 - RNA, 16 nt, Homo sapiens
auucaugaugaacuca

SEQ ID NO: 1939372 - RNA, 21 nt, Homo sapiens
gccaucaaagaguccuggacg

SEQ ID NO: 1939373 - RNA, 21 nt, Homo sapiens
acccacaguguuaccugacuu

SEQ ID NO: 1939374 - RNA, 17 nt, Homo sapiens
uugaaauguucugucaa

SEQ ID NO: 1939375 - RNA, 14 nt, Homo sapiens
uuaacugcagugua

SEQ ID NO: 1939376 - RNA, 17 nt, Homo sapiens
cgcuguguucaucgacu

SEQ ID NO: 1939377 - RNA, 16 nt, Homo sapiens
ucauaaguuggaccag

SEQ ID NO: 1939378 - RNA, 12 nt, Homo sapiens
aucacugaauuu

SEQ ID NO: 1939379 - RNA, 21 nt, Homo sapiens
ucuaacaucuagcuggcuucc

SEQ ID NO: 1939380 - RNA, 14 nt, Homo sapiens
cucuuuugagcuaa

SEQ ID NO: 1939381 - RNA, 22 nt, Homo sapiens
cacuaucugggugcaugaucuu

SEQ ID NO: 1939382 - RNA, 23 nt, Homo sapiens
caaucuguaucuuugacaauucu

SEQ ID NO: 1939383 - RNA, 14 nt, Homo sapiens
gauacccaucccau

SEQ ID NO: 1939384 - RNA, 14 nt, Homo sapiens
cauguaaaaucuuc

SEQ ID NO: 1939385 - RNA, 14 nt, Homo sapiens
cugccuuugugcuc

SEQ ID NO: 1939386 - RNA, 16 nt, Homo sapiens
ucuccuguauaaucuc

SEQ ID NO: 1939387 - RNA, 15 nt, Homo sapiens
agccucauucacugu

SEQ ID NO: 1939388 - RNA, 23 nt, Homo sapiens
uuccccacaaacccccaccagca

SEQ ID NO: 1939389 - RNA, 15 nt, Homo sapiens
cagucagcauucuua

SEQ ID NO: 1939390 - RNA, 16 nt, Homo sapiens
gggcacggagggcagu

SEQ ID NO: 1939391 - RNA, 21 nt, Homo sapiens
auggaggggagggaucuccug

SEQ ID NO: 1939392 - RNA, 13 nt, Homo sapiens
acugugcuacugu

SEQ ID NO: 1939393 - RNA, 18 nt, Homo sapiens
gacgguuaaauacugugu

SEQ ID NO: 1939394 - RNA, 13 nt, Homo sapiens
ugacuccuaccug

SEQ ID NO: 1939395 - RNA, 18 nt, Homo sapiens
cuauaucauaaauacaag

SEQ ID NO: 1939396 - RNA, 18 nt, Homo sapiens
uuuuaauuuauacuggca

SEQ ID NO: 1939397 - RNA, 20 nt, Homo sapiens
uuuuucugaacaaaagcagg

SEQ ID NO: 1939398 - RNA, 22 nt, Homo sapiens
cgcuaccucccuccccgucuca

SEQ ID NO: 1939399 - RNA, 13 nt, Homo sapiens
accaucucuaguu

SEQ ID NO: 1939400 - RNA, 13 nt, Homo sapiens
ucuauuauauucg

SEQ ID NO: 1939401 - RNA, 22 nt, Homo sapiens
cauugcacuuuauaaacacugu

SEQ ID NO: 1939402 - RNA, 15 nt, Homo sapiens
cauacaauggccaac

SEQ ID NO: 1939403 - RNA, 14 nt, Homo sapiens
gucaaggcucaguc

SEQ ID NO: 1939404 - RNA, 21 nt, Homo sapiens
cagacugaacuuacacuguau

SEQ ID NO: 1939405 - RNA, 23 nt, Homo sapiens
uauuuuaauguauauuugcugca

SEQ ID NO: 1939406 - RNA, 12 nt, Homo sapiens
uccaaaccucca

SEQ ID NO: 1939407 - RNA, 16 nt, Homo sapiens
acugagccaugcucag

SEQ ID NO: 1939408 - RNA, 22 nt, Homo sapiens
uaacucuguaaaagugucugua

SEQ ID NO: 1939409 - RNA, 16 nt, Homo sapiens
aauguuuucauuuuac

SEQ ID NO: 1939410 - RNA, 20 nt, Homo sapiens
auuccaggaaaacugggaca

SEQ ID NO: 1939411 - RNA, 17 nt, Homo sapiens
aaugcagggcacaugau

SEQ ID NO: 1939412 - RNA, 17 nt, Homo sapiens
gcuggagcccagcguca

SEQ ID NO: 1939413 - RNA, 22 nt, Homo sapiens
cccgauuuguuuauuugcaauu

SEQ ID NO: 1939414 - RNA, 19 nt, Homo sapiens
ggcaugguggugagcaccu

SEQ ID NO: 1939415 - RNA, 11 nt, Homo sapiens
gaucucucuug

SEQ ID NO: 1939416 - RNA, 15 nt, Homo sapiens
ucuccuccacucuga

SEQ ID NO: 1939417 - RNA, 22 nt, Homo sapiens
auacaaauaccuuuaaauugau

SEQ ID NO: 1939418 - RNA, 17 nt, Homo sapiens
aaaacaggagccuacca

SEQ ID NO: 1939419 - RNA, 17 nt, Homo sapiens
uaucaauaagugccauu

SEQ ID NO: 1939420 - RNA, 16 nt, Homo sapiens
aaucuuguacauuaua

SEQ ID NO: 1939421 - RNA, 19 nt, Homo sapiens
uuguaauguagacagacuu

SEQ ID NO: 1939422 - RNA, 19 nt, Homo sapiens
caccagccucagugcagcc

SEQ ID NO: 1939423 - RNA, 17 nt, Homo sapiens
acaaauuuuaacuucuu

SEQ ID NO: 1939424 - RNA, 21 nt, Homo sapiens
ccacccucugggaguccccau

SEQ ID NO: 1939425 - RNA, 19 nt, Homo sapiens
cuccugaccucaggugauu

SEQ ID NO: 1939426 - RNA, 16 nt, Homo sapiens
acguccaccccagugc

SEQ ID NO: 1939427 - RNA, 21 nt, Homo sapiens
aagggcugauugggauuucca

SEQ ID NO: 1939428 - RNA, 13 nt, Homo sapiens
agacauuggcuua

SEQ ID NO: 1939429 - RNA, 16 nt, Homo sapiens
agcauuuagugcacag

SEQ ID NO: 1939430 - RNA, 13 nt, Homo sapiens
uaauauguacuaa

SEQ ID NO: 1939431 - RNA, 16 nt, Homo sapiens
gauccagugcugagca

SEQ ID NO: 1939432 - RNA, 17 nt, Homo sapiens
ggccaggccuuggggac

SEQ ID NO: 1939433 - RNA, 13 nt, Homo sapiens
ucuccugcaaaag

SEQ ID NO: 1939434 - RNA, 19 nt, Homo sapiens
cuaccuggguccuuuucag

SEQ ID NO: 1939435 - RNA, 22 nt, Homo sapiens
uuguuggggaggggaaugggag

SEQ ID NO: 1939436 - RNA, 21 nt, Homo sapiens
gcaaagucaucaaagauugag

SEQ ID NO: 1939437 - RNA, 20 nt, Homo sapiens
gauaaucacaauacaucccu

SEQ ID NO: 1939438 - RNA, 20 nt, Homo sapiens
ccucauuccccaaccacuuc

SEQ ID NO: 1939439 - RNA, 21 nt, Homo sapiens
gccucuccacuguuucaugag

SEQ ID NO: 1939440 - RNA, 21 nt, Homo sapiens
ucacccaggcugcagugcaau

SEQ ID NO: 1939441 - RNA, 16 nt, Homo sapiens
ugcauaagugcaugac

SEQ ID NO: 1939442 - RNA, 15 nt, Homo sapiens
ucugcacagcuccuc

SEQ ID NO: 1939443 - RNA, 15 nt, Homo sapiens
uucgcugagucccag

SEQ ID NO: 1939444 - RNA, 23 nt, Homo sapiens
caggaguuggaauguuguaguua

SEQ ID NO: 1939445 - RNA, 17 nt, Homo sapiens
auccuuauucagccuua

SEQ ID NO: 1939446 - RNA, 22 nt, Homo sapiens
aguagccuaacacacuccaaga

SEQ ID NO: 1939447 - RNA, 19 nt, Homo sapiens
ggaggcccugcacugccag

SEQ ID NO: 1939448 - RNA, 14 nt, Homo sapiens
uccucaguccacug

SEQ ID NO: 1939449 - RNA, 19 nt, Homo sapiens
auucaggagaguguauaug

SEQ ID NO: 1939450 - RNA, 12 nt, Homo sapiens
cucaguucaaug

SEQ ID NO: 1939451 - RNA, 23 nt, Homo sapiens
gaaguaacaaaagaagugacauc

SEQ ID NO: 1939452 - RNA, 16 nt, Homo sapiens
ucuuuauuuuuugcca

SEQ ID NO: 1939453 - RNA, 18 nt, Homo sapiens
uuuuauuuccacauaaag

SEQ ID NO: 1939454 - RNA, 21 nt, Homo sapiens
agaucgauccuggauucacuc

SEQ ID NO: 1939455 - RNA, 16 nt, Homo sapiens
cuccgcgccuugccuc

SEQ ID NO: 1939456 - RNA, 23 nt, Homo sapiens
acaaugcaguacaggacauauau

SEQ ID NO: 1939457 - RNA, 16 nt, Homo sapiens
cucauuucauucucac

SEQ ID NO: 1939458 - RNA, 20 nt, Homo sapiens
acugcaaaccauggugagaa

SEQ ID NO: 1939459 - RNA, 16 nt, Homo sapiens
uucagaagugagcuuu

SEQ ID NO: 1939460 - RNA, 18 nt, Homo sapiens
agugcaucagauguaaca

SEQ ID NO: 1939461 - RNA, 17 nt, Homo sapiens
acauaaacaauucaugc

SEQ ID NO: 1939462 - RNA, 17 nt, Homo sapiens
cuuuggucaauauuuga

SEQ ID NO: 1939463 - RNA, 12 nt, Homo sapiens
cuuggccagaag

SEQ ID NO: 1939464 - RNA, 12 nt, Homo sapiens
ucccacacuguc

SEQ ID NO: 1939465 - RNA, 17 nt, Homo sapiens
agggagacccugggaga

SEQ ID NO: 1939466 - RNA, 13 nt, Homo sapiens
cugugugccccac

SEQ ID NO: 1939467 - RNA, 20 nt, Homo sapiens
agaacuuuaagucucaccca

SEQ ID NO: 1939468 - RNA, 15 nt, Homo sapiens
aaaccccaaacuguu

SEQ ID NO: 1939469 - RNA, 18 nt, Homo sapiens
caagcuaugugagcucac

SEQ ID NO: 1939470 - RNA, 20 nt, Homo sapiens
accccuccaguuuugccuga

SEQ ID NO: 1939471 - RNA, 15 nt, Homo sapiens
aaccagccacacaga

SEQ ID NO: 1939472 - RNA, 17 nt, Homo sapiens
auccucaccauccacag

SEQ ID NO: 1939473 - RNA, 22 nt, Homo sapiens
cuuaaaacagaaaggugcagga

SEQ ID NO: 1939474 - RNA, 16 nt, Homo sapiens
guuuaauaacauauua

SEQ ID NO: 1939475 - RNA, 15 nt, Homo sapiens
gccugggagcccaga

SEQ ID NO: 1939476 - RNA, 17 nt, Homo sapiens
cagucagcgagugcuug

SEQ ID NO: 1939477 - RNA, 21 nt, Homo sapiens
agugccacccaccuuugccac

SEQ ID NO: 1939478 - RNA, 19 nt, Homo sapiens
auuuuaggcaaaguccaua

SEQ ID NO: 1939479 - RNA, 15 nt, Homo sapiens
uuaauaaucucaugc

SEQ ID NO: 1939480 - RNA, 16 nt, Homo sapiens
gcugcugugugccuuc

SEQ ID NO: 1939481 - RNA, 16 nt, Homo sapiens
uauuucuacugucaaa

SEQ ID NO: 1939482 - RNA, 15 nt, Homo sapiens
ggcucaacauugugu

SEQ ID NO: 1939483 - RNA, 20 nt, Homo sapiens
auacagugcugcuggcuuuu

SEQ ID NO: 1939484 - RNA, 14 nt, Homo sapiens
auagcaucucagga

SEQ ID NO: 1939485 - RNA, 18 nt, Homo sapiens
cccaaacaaugugcugga

SEQ ID NO: 1939486 - RNA, 16 nt, Homo sapiens
ugauucuuacauauga

SEQ ID NO: 1939487 - RNA, 13 nt, Homo sapiens
accuuccauguca

SEQ ID NO: 1939488 - RNA, 22 nt, Homo sapiens
agagagcaucugcaacaaaaag

SEQ ID NO: 1939489 - RNA, 18 nt, Homo sapiens
aucaaugaagcaaguaca

SEQ ID NO: 1939490 - RNA, 19 nt, Homo sapiens
uagaaaaguuauguagaaa

SEQ ID NO: 1939491 - RNA, 19 nt, Homo sapiens
gcuccugaaucccuuucag

SEQ ID NO: 1939492 - RNA, 23 nt, Homo sapiens
agaacauuuuaauucaucccaac

SEQ ID NO: 1939493 - RNA, 20 nt, Homo sapiens
uaauauuuuuguauuucucu

SEQ ID NO: 1939494 - RNA, 15 nt, Homo sapiens
gcaucagcacagcuc

SEQ ID NO: 1939495 - RNA, 22 nt, Homo sapiens
gcuucuagucuggaacugcugc

SEQ ID NO: 1939496 - RNA, 16 nt, Homo sapiens
ggcugccaggcaccau

SEQ ID NO: 1939497 - RNA, 13 nt, Homo sapiens
uguagcucuaugg

SEQ ID NO: 1939498 - RNA, 20 nt, Homo sapiens
aagcaguuccugucccacau

SEQ ID NO: 1939499 - RNA, 13 nt, Homo sapiens
uacagcuaugaag

SEQ ID NO: 1939500 - RNA, 17 nt, Homo sapiens
cccuguggaugcugcug

SEQ ID NO: 1939501 - RNA, 14 nt, Homo sapiens
aaggaaguggaaug

SEQ ID NO: 1939502 - RNA, 16 nt, Homo sapiens
uguuuugugguaucau

SEQ ID NO: 1939503 - RNA, 17 nt, Homo sapiens
gccagguccugugcuau

SEQ ID NO: 1939504 - RNA, 17 nt, Homo sapiens
aucucaguauugucagg

SEQ ID NO: 1939505 - RNA, 21 nt, Homo sapiens
ccaggccaguuugaagacuac

SEQ ID NO: 1939506 - RNA, 13 nt, Homo sapiens
uaccaccagacag

SEQ ID NO: 1939507 - RNA, 13 nt, Homo sapiens
uuuuaucuuuuag

SEQ ID NO: 1939508 - RNA, 23 nt, Homo sapiens
ucuccuuuaaacagacucgcuuu

SEQ ID NO: 1939509 - RNA, 18 nt, Homo sapiens
aauguaaaaauccuuuug

SEQ ID NO: 1939510 - RNA, 23 nt, Homo sapiens
caaccuuuguaagaaaaccaaaa

SEQ ID NO: 1939511 - RNA, 19 nt, Homo sapiens
gaggcuggguucauuugug

SEQ ID NO: 1939512 - RNA, 19 nt, Homo sapiens
ccuccauggcagaagucaa

SEQ ID NO: 1939513 - RNA, 19 nt, Homo sapiens
cuucacgauuaacugugaa

SEQ ID NO: 1939514 - RNA, 21 nt, Homo sapiens
aaccuuguuuggggcacagua

SEQ ID NO: 1939515 - RNA, 22 nt, Homo sapiens
gugcaauaagauugguguucgu

SEQ ID NO: 1939516 - RNA, 23 nt, Homo sapiens
guccaugugaaacauguugccaa

SEQ ID NO: 1939517 - RNA, 12 nt, Homo sapiens
caguccuuccac

SEQ ID NO: 1939518 - RNA, 22 nt, Homo sapiens
gauauaacauucaguucccacc

SEQ ID NO: 1939519 - RNA, 14 nt, Homo sapiens
cacacaaguggaga

SEQ ID NO: 1939520 - RNA, 15 nt, Homo sapiens
cugccacugaccuca

SEQ ID NO: 1939521 - RNA, 17 nt, Homo sapiens
ucccuucuuugcacuuu

SEQ ID NO: 1939522 - RNA, 19 nt, Homo sapiens
aaagaagccaggugcaaaa

SEQ ID NO: 1939523 - RNA, 12 nt, Homo sapiens
auuaaccaucuu

SEQ ID NO: 1939524 - RNA, 13 nt, Homo sapiens
cugucacuacugg

SEQ ID NO: 1939525 - RNA, 16 nt, Homo sapiens
auuaacauaagaaaag

SEQ ID NO: 1939526 - RNA, 13 nt, Homo sapiens
uccuaauacuguc

SEQ ID NO: 1939527 - RNA, 22 nt, Homo sapiens
ccccauucucugccuguacuga

SEQ ID NO: 1939528 - RNA, 22 nt, Homo sapiens
caagugauggucauucauauca

SEQ ID NO: 1939529 - RNA, 20 nt, Homo sapiens
acugcagccugggcucccuc

SEQ ID NO: 1939530 - RNA, 19 nt, Homo sapiens
ugcugugccccaccacguc

SEQ ID NO: 1939531 - RNA, 12 nt, Homo sapiens
uacaaggacuuu

SEQ ID NO: 1939532 - RNA, 18 nt, Homo sapiens
ugcacucagcucuuggcu

SEQ ID NO: 1939533 - RNA, 19 nt, Homo sapiens
gcucccagggacugacacg

SEQ ID NO: 1939534 - RNA, 15 nt, Homo sapiens
aauauagcaucuuuc

SEQ ID NO: 1939535 - RNA, 17 nt, Homo sapiens
aucggugcugucagccc

SEQ ID NO: 1939536 - RNA, 16 nt, Homo sapiens
cuucauuguaaaucac

SEQ ID NO: 1939537 - RNA, 21 nt, Homo sapiens
caugcccagaccuucucacac

SEQ ID NO: 1939538 - RNA, 15 nt, Homo sapiens
cuggggccacccagc

SEQ ID NO: 1939539 - RNA, 14 nt, Homo sapiens
ugccccucccugcc

SEQ ID NO: 1939540 - RNA, 18 nt, Homo sapiens
ucaaaguaaaacuugcug

SEQ ID NO: 1939541 - RNA, 19 nt, Homo sapiens
aucagcaaugccccaaacu

SEQ ID NO: 1939542 - RNA, 17 nt, Homo sapiens
acucccuugguggcaag

SEQ ID NO: 1939543 - RNA, 16 nt, Homo sapiens
aaaaguuuugaugaaa

SEQ ID NO: 1939544 - RNA, 23 nt, Homo sapiens
cguaaagugccuuauaggaauuu

SEQ ID NO: 1939545 - RNA, 14 nt, Homo sapiens
cucaauuugcagua

SEQ ID NO: 1939546 - RNA, 18 nt, Homo sapiens
uucagacuuggacuauga

SEQ ID NO: 1939547 - RNA, 12 nt, Homo sapiens
guucuguagaaa

SEQ ID NO: 1939548 - RNA, 17 nt, Homo sapiens
cagagaaaacagcaaua

SEQ ID NO: 1939549 - RNA, 11 nt, Homo sapiens
gaaaugcauuu

SEQ ID NO: 1939550 - RNA, 11 nt, Homo sapiens
uuaaugcagau

SEQ ID NO: 1939551 - RNA, 18 nt, Homo sapiens
agaaugaauaauaauuau

SEQ ID NO: 1939552 - RNA, 15 nt, Homo sapiens
aggaagaacaucugg

SEQ ID NO: 1939553 - RNA, 21 nt, Homo sapiens
uccaucaccugaaacacugga

SEQ ID NO: 1939554 - RNA, 21 nt, Homo sapiens
ugggcugguaucucagaaagu

SEQ ID NO: 1939555 - RNA, 14 nt, Homo sapiens
aaagugacuauuca

SEQ ID NO: 1939556 - RNA, 13 nt, Homo sapiens
uguguugcaagau

SEQ ID NO: 1939557 - RNA, 12 nt, Homo sapiens
aucaaaaagccu

SEQ ID NO: 1939558 - RNA, 17 nt, Homo sapiens
guagcugggauuacaga

SEQ ID NO: 1939559 - RNA, 13 nt, Homo sapiens
auagauuaccuga

SEQ ID NO: 1939560 - RNA, 18 nt, Homo sapiens
cuacgugacuguggcaca

SEQ ID NO: 1939561 - RNA, 11 nt, Homo sapiens
gaaaagacucu

SEQ ID NO: 1939562 - RNA, 14 nt, Homo sapiens
cugguacugagguu

SEQ ID NO: 1939563 - RNA, 17 nt, Homo sapiens
caaaaaaguuacaacuu

SEQ ID NO: 1939564 - RNA, 23 nt, Homo sapiens
guuuuaaauuauaagaugucauc

SEQ ID NO: 1939565 - RNA, 14 nt, Homo sapiens
ccgcagcuucaggg

SEQ ID NO: 1939566 - RNA, 22 nt, Homo sapiens
ugggauuucaccguauuagcca

SEQ ID NO: 1939567 - RNA, 23 nt, Homo sapiens
gaaagaucguuuaaaaacaaagg

SEQ ID NO: 1939568 - RNA, 17 nt, Homo sapiens
ugaggagugccagcuca

SEQ ID NO: 1939569 - RNA, 21 nt, Homo sapiens
cugaugaaaaggucagacuga

SEQ ID NO: 1939570 - RNA, 17 nt, Homo sapiens
caaguauuuugcuauau

SEQ ID NO: 1939571 - RNA, 12 nt, Homo sapiens
cuccauacucua

SEQ ID NO: 1939572 - RNA, 20 nt, Homo sapiens
ggacagugggcuaugccacu

SEQ ID NO: 1939573 - RNA, 18 nt, Homo sapiens
ucacacucauccacacuu

SEQ ID NO: 1939574 - RNA, 22 nt, Homo sapiens
cauuugaauaggcaaacccaaa

SEQ ID NO: 1939575 - RNA, 16 nt, Homo sapiens
caaaccccgaccaccu

SEQ ID NO: 1939576 - RNA, 18 nt, Homo sapiens
cuugaguugaagaucuuu

SEQ ID NO: 1939577 - RNA, 16 nt, Homo sapiens
agauuagaaagacuuu

SEQ ID NO: 1939578 - RNA, 14 nt, Homo sapiens
uccucucugaguca

SEQ ID NO: 1939579 - RNA, 23 nt, Homo sapiens
cuauagccuaggugacagaguga

SEQ ID NO: 1939580 - RNA, 18 nt, Homo sapiens
accccuacacacacacuc

SEQ ID NO: 1939581 - RNA, 20 nt, Homo sapiens
cagauacugucucuuucaug

SEQ ID NO: 1939582 - RNA, 13 nt, Homo sapiens
ccuuuuuaaucca

SEQ ID NO: 1939583 - RNA, 21 nt, Homo sapiens
agaaguggggcagcagcagug

SEQ ID NO: 1939584 - RNA, 15 nt, Homo sapiens
uucacaccuagcguc

SEQ ID NO: 1939585 - RNA, 19 nt, Homo sapiens
cacuugcuggcugugaaac

SEQ ID NO: 1939586 - RNA, 14 nt, Homo sapiens
ucuaaucuagugac

SEQ ID NO: 1939587 - RNA, 17 nt, Homo sapiens
cagguacagagaaggaa

SEQ ID NO: 1939588 - RNA, 16 nt, Homo sapiens
uuaaagaucaugacau

SEQ ID NO: 1939589 - RNA, 16 nt, Homo sapiens
cucauugcugcccguu

SEQ ID NO: 1939590 - RNA, 20 nt, Homo sapiens
agcucguggugggugcucaa

SEQ ID NO: 1939591 - RNA, 16 nt, Homo sapiens
cagagugaaucaucca

SEQ ID NO: 1939592 - RNA, 12 nt, Homo sapiens
augccaccaccc

SEQ ID NO: 1939593 - RNA, 19 nt, Homo sapiens
uaucuaguguguccuguga

SEQ ID NO: 1939594 - RNA, 16 nt, Homo sapiens
gguggcucaugccugu

SEQ ID NO: 1939595 - RNA, 23 nt, Homo sapiens
caaagacuuguuaaauguauaca

SEQ ID NO: 1939596 - RNA, 16 nt, Homo sapiens
agaggcucuggacagc

SEQ ID NO: 1939597 - RNA, 23 nt, Homo sapiens
gcugcuaaagggagaaaugccag

SEQ ID NO: 1939598 - RNA, 17 nt, Homo sapiens
aauuaaaacacuuucaa

SEQ ID NO: 1939599 - RNA, 23 nt, Homo sapiens
augccucagcccugacccugugg

SEQ ID NO: 1939600 - RNA, 11 nt, Homo sapiens
aucacuugagg

SEQ ID NO: 1939601 - RNA, 16 nt, Homo sapiens
aagagucaugucaaau

SEQ ID NO: 1939602 - RNA, 17 nt, Homo sapiens
guuuuaaaaaaucucaa

SEQ ID NO: 1939603 - RNA, 16 nt, Homo sapiens
uaccaggaugugcuau

SEQ ID NO: 1939604 - RNA, 19 nt, Homo sapiens
agacccaccccaccugcag

SEQ ID NO: 1939605 - RNA, 23 nt, Homo sapiens
uuuggguaaaaucuguaauugau

SEQ ID NO: 1939606 - RNA, 18 nt, Homo sapiens
aaccauaaagggugccag

SEQ ID NO: 1939607 - RNA, 19 nt, Homo sapiens
gaagaauuauaacccagaa

SEQ ID NO: 1939608 - RNA, 14 nt, Homo sapiens
guguuggcugccug

SEQ ID NO: 1939609 - RNA, 17 nt, Homo sapiens
guccccagcccacugga

SEQ ID NO: 1939610 - RNA, 17 nt, Homo sapiens
aaauaaagcugauagca

SEQ ID NO: 1939611 - RNA, 16 nt, Homo sapiens
ccucccccagaccucc

SEQ ID NO: 1939612 - RNA, 23 nt, Homo sapiens
cuggcugguggagaacucaaggc

SEQ ID NO: 1939613 - RNA, 19 nt, Homo sapiens
acaauguuuauaaaggcca

SEQ ID NO: 1939614 - RNA, 12 nt, Homo sapiens
gcagcacuggaa

SEQ ID NO: 1939615 - RNA, 21 nt, Homo sapiens
agccaucuaaugcuuguuuau

SEQ ID NO: 1939616 - RNA, 23 nt, Homo sapiens
gacaaaaagccuuuuccagaaga

SEQ ID NO: 1939617 - RNA, 15 nt, Homo sapiens
cucugauggcacuuu

SEQ ID NO: 1939618 - RNA, 15 nt, Homo sapiens
aaggcuuuaucucag

SEQ ID NO: 1939619 - RNA, 15 nt, Homo sapiens
acaagcuacauaugu

SEQ ID NO: 1939620 - RNA, 19 nt, Homo sapiens
aauauacauuuguugguaa

SEQ ID NO: 1939621 - RNA, 17 nt, Homo sapiens
aggaaccauaugugcua

SEQ ID NO: 1939622 - RNA, 16 nt, Homo sapiens
auguuacugaccagca

SEQ ID NO: 1939623 - RNA, 19 nt, Homo sapiens
uugcaguaucggcacugua

SEQ ID NO: 1939624 - RNA, 17 nt, Homo sapiens
ggaaccaaaauguauaa

SEQ ID NO: 1939625 - RNA, 16 nt, Homo sapiens
aaagccuuaacuaaga

SEQ ID NO: 1939626 - RNA, 17 nt, Homo sapiens
acgugcaggacagcucu

SEQ ID NO: 1939627 - RNA, 18 nt, Homo sapiens
agcugaaagaggccaaac

SEQ ID NO: 1939628 - RNA, 21 nt, Homo sapiens
cugggucucgcuuuguugccc

SEQ ID NO: 1939629 - RNA, 20 nt, Homo sapiens
uccucaacugggaaccuuca

SEQ ID NO: 1939630 - RNA, 20 nt, Homo sapiens
agagugucucagggugcaga

SEQ ID NO: 1939631 - RNA, 15 nt, Homo sapiens
aguuucucaaaaccc

SEQ ID NO: 1939632 - RNA, 17 nt, Homo sapiens
auguuuuagccagugau

SEQ ID NO: 1939633 - RNA, 18 nt, Homo sapiens
gccauugcauuccagccu

SEQ ID NO: 1939634 - RNA, 20 nt, Homo sapiens
gagcauuauuccuggucaaa

SEQ ID NO: 1939635 - RNA, 23 nt, Homo sapiens
uuaaaucaacuuuaucauaugcu

SEQ ID NO: 1939636 - RNA, 17 nt, Homo sapiens
agccuaggcccucauga

SEQ ID NO: 1939637 - RNA, 18 nt, Homo sapiens
auaaaaauuccagaauga

SEQ ID NO: 1939638 - RNA, 13 nt, Homo sapiens
acauacaaaauaa

SEQ ID NO: 1939639 - RNA, 23 nt, Homo sapiens
agucucagagaccagcacucagc

SEQ ID NO: 1939640 - RNA, 15 nt, Homo sapiens
cuuccugucugagua

SEQ ID NO: 1939641 - RNA, 12 nt, Homo sapiens
augaagugaauu

SEQ ID NO: 1939642 - RNA, 21 nt, Homo sapiens
uccauagauccccccacugag

SEQ ID NO: 1939643 - RNA, 14 nt, Homo sapiens
aguuugaucaaauc

SEQ ID NO: 1939644 - RNA, 15 nt, Homo sapiens
acuuucaaaguggau

SEQ ID NO: 1939645 - RNA, 15 nt, Homo sapiens
gauaaguguccccua

SEQ ID NO: 1939646 - RNA, 17 nt, Homo sapiens
ucccaauccaguggacu

SEQ ID NO: 1939647 - RNA, 19 nt, Homo sapiens
cuucaucccauuccaggca

SEQ ID NO: 1939648 - RNA, 16 nt, Homo sapiens
cacuucacuaccaaau

SEQ ID NO: 1939649 - RNA, 19 nt, Homo sapiens
aaauucaaagaaguacuuu

SEQ ID NO: 1939650 - RNA, 21 nt, Homo sapiens
cagcauagggucacuuugcca

SEQ ID NO: 1939651 - RNA, 19 nt, Homo sapiens
gcuaaaagcaucccuguga

SEQ ID NO: 1939652 - RNA, 13 nt, Homo sapiens
ccuauucugccau

SEQ ID NO: 1939653 - RNA, 16 nt, Homo sapiens
acucgcuucucuguga

SEQ ID NO: 1939654 - RNA, 20 nt, Homo sapiens
ugagacagagucuuccucug

SEQ ID NO: 1939655 - RNA, 22 nt, Homo sapiens
uucaugaauaaaaacuuugcag

SEQ ID NO: 1939656 - RNA, 14 nt, Homo sapiens
accucccaccauaa

SEQ ID NO: 1939657 - RNA, 19 nt, Homo sapiens
caauaaaaguguccauuga

SEQ ID NO: 1939658 - RNA, 22 nt, Homo sapiens
ccaaaugugugcccagcuuaua

SEQ ID NO: 1939659 - RNA, 21 nt, Homo sapiens
gcucaaggaaggaugccuuau

SEQ ID NO: 1939660 - RNA, 17 nt, Homo sapiens
cccagguggagggcaca

SEQ ID NO: 1939661 - RNA, 17 nt, Homo sapiens
cucucccacgugcacag

SEQ ID NO: 1939662 - RNA, 17 nt, Homo sapiens
aucuucaagguguaaaa

SEQ ID NO: 1939663 - RNA, 20 nt, Homo sapiens
ugaguaguggccacuggggu

SEQ ID NO: 1939664 - RNA, 22 nt, Homo sapiens
aaaaugcuguucagaaauauga

SEQ ID NO: 1939665 - RNA, 21 nt, Homo sapiens
cagcagugagcuucuauuaaa

SEQ ID NO: 1939666 - RNA, 15 nt, Homo sapiens
uccccaauuccucug

SEQ ID NO: 1939667 - RNA, 20 nt, Homo sapiens
acacucccccagccccagag

SEQ ID NO: 1939668 - RNA, 13 nt, Homo sapiens
acuauugagauau

SEQ ID NO: 1939669 - RNA, 20 nt, Homo sapiens
ugcugcagacaaguggacag

SEQ ID NO: 1939670 - RNA, 17 nt, Homo sapiens
agaaaaaaagagugaaa

SEQ ID NO: 1939671 - RNA, 21 nt, Homo sapiens
ugaaaauauagacauucucac

SEQ ID NO: 1939672 - RNA, 19 nt, Homo sapiens
auucuccuccuauugccuc

SEQ ID NO: 1939673 - RNA, 21 nt, Homo sapiens
gcugacaaggcgucucuucaa

SEQ ID NO: 1939674 - RNA, 16 nt, Homo sapiens
ggacuuggagagcaaa

SEQ ID NO: 1939675 - RNA, 20 nt, Homo sapiens
ucacuagaugccaaugacau

SEQ ID NO: 1939676 - RNA, 16 nt, Homo sapiens
aaaccccugaccucaa

SEQ ID NO: 1939677 - RNA, 17 nt, Homo sapiens
ccaucuggcucagcaua

SEQ ID NO: 1939678 - RNA, 15 nt, Homo sapiens
uagaaucuacuuuaa

SEQ ID NO: 1939679 - RNA, 14 nt, Homo sapiens
agccuggaugccau

SEQ ID NO: 1939680 - RNA, 18 nt, Homo sapiens
cgcuagguagaacacugc

SEQ ID NO: 1939681 - RNA, 18 nt, Homo sapiens
uuaaaacuaggcauuugu

SEQ ID NO: 1939682 - RNA, 21 nt, Homo sapiens
caacaucgguguggacuacag

SEQ ID NO: 1939683 - RNA, 22 nt, Homo sapiens
ggcaaccuugucucuaugccag

SEQ ID NO: 1939684 - RNA, 12 nt, Homo sapiens
agaaaaggaaaa

SEQ ID NO: 1939685 - RNA, 14 nt, Homo sapiens
ugcuaugaccauga

SEQ ID NO: 1939686 - RNA, 21 nt, Homo sapiens
uuguuauccuguuuuugcaaa

SEQ ID NO: 1939687 - RNA, 18 nt, Homo sapiens
cacagaaguggaauuuga

SEQ ID NO: 1939688 - RNA, 20 nt, Homo sapiens
agugcaguggcaucaucuca

SEQ ID NO: 1939689 - RNA, 17 nt, Homo sapiens
caacaaagaggacacca

SEQ ID NO: 1939690 - RNA, 14 nt, Homo sapiens
uuccuaaacuuuca

SEQ ID NO: 1939691 - RNA, 17 nt, Homo sapiens
cagaaauaaaaguauga

SEQ ID NO: 1939692 - RNA, 15 nt, Homo sapiens
uuaagguuaugcacu

SEQ ID NO: 1939693 - RNA, 23 nt, Homo sapiens
ucuaaccaagaggcugguuuugg

SEQ ID NO: 1939694 - RNA, 21 nt, Homo sapiens
uccuucuuguaguagucucau

SEQ ID NO: 1939695 - RNA, 13 nt, Homo sapiens
cuucuaguuucac

SEQ ID NO: 1939696 - RNA, 19 nt, Homo sapiens
cgaugugcgcacacacaga

SEQ ID NO: 1939697 - RNA, 18 nt, Homo sapiens
uguuuucuacuuugccac

SEQ ID NO: 1939698 - RNA, 18 nt, Homo sapiens
cgccuucccuccugcuuu

SEQ ID NO: 1939699 - RNA, 18 nt, Homo sapiens
gaaaugauuuacuggaau

SEQ ID NO: 1939700 - RNA, 17 nt, Homo sapiens
guugacugcugaauuaa

SEQ ID NO: 1939701 - RNA, 22 nt, Homo sapiens
cuggcuucuguugcgccacuga

SEQ ID NO: 1939702 - RNA, 22 nt, Homo sapiens
cagccuugcaaauaaucacaga

SEQ ID NO: 1939703 - RNA, 23 nt, Homo sapiens
guguauauaguaugaaugcagug

SEQ ID NO: 1939704 - RNA, 14 nt, Homo sapiens
agugccauuccacu

SEQ ID NO: 1939705 - RNA, 11 nt, Homo sapiens
ucacuaccugu

SEQ ID NO: 1939706 - RNA, 18 nt, Homo sapiens
acccucaucuuucuucca

SEQ ID NO: 1939707 - RNA, 21 nt, Homo sapiens
ucauaauuaaaaagagccuua

SEQ ID NO: 1939708 - RNA, 21 nt, Homo sapiens
gucaggacaagggcucagagg

SEQ ID NO: 1939709 - RNA, 14 nt, Homo sapiens
caaagcccacuuug

SEQ ID NO: 1939710 - RNA, 18 nt, Homo sapiens
gcccgacagccuggcaca

SEQ ID NO: 1939711 - RNA, 23 nt, Homo sapiens
uuauguacuguacuaauucuuac

SEQ ID NO: 1939712 - RNA, 14 nt, Homo sapiens
aauccuaagacaca

SEQ ID NO: 1939713 - RNA, 20 nt, Homo sapiens
uguuacuugaaauaccagug

SEQ ID NO: 1939714 - RNA, 18 nt, Homo sapiens
aggcuucugauacgugua

SEQ ID NO: 1939715 - RNA, 12 nt, Homo sapiens
aaugcuuuccau

SEQ ID NO: 1939716 - RNA, 16 nt, Homo sapiens
gccaugagaugauaca

SEQ ID NO: 1939717 - RNA, 17 nt, Homo sapiens
ugauaucuggccuaaaa

SEQ ID NO: 1939718 - RNA, 17 nt, Homo sapiens
acccaucuucauuaaag

SEQ ID NO: 1939719 - RNA, 18 nt, Homo sapiens
acaacgccgagugcacug

SEQ ID NO: 1939720 - RNA, 20 nt, Homo sapiens
caaugcccugugcaugccau

SEQ ID NO: 1939721 - RNA, 21 nt, Homo sapiens
uacaugccuuuccagugcugc

SEQ ID NO: 1939722 - RNA, 19 nt, Homo sapiens
auucuggucuucacugcca

SEQ ID NO: 1939723 - RNA, 15 nt, Homo sapiens
agaaaggaaccuguc

SEQ ID NO: 1939724 - RNA, 12 nt, Homo sapiens
gaccacaccacu

SEQ ID NO: 1939725 - RNA, 16 nt, Homo sapiens
aaacuaugcuauuaaa

SEQ ID NO: 1939726 - RNA, 19 nt, Homo sapiens
aacuuagcuugcacaugaa

SEQ ID NO: 1939727 - RNA, 17 nt, Homo sapiens
cuccagggaaaaugacu

SEQ ID NO: 1939728 - RNA, 16 nt, Homo sapiens
cauuccuccaccugcc

SEQ ID NO: 1939729 - RNA, 17 nt, Homo sapiens
uguuuaaacuuugacaa

SEQ ID NO: 1939730 - RNA, 15 nt, Homo sapiens
guuugcuccagugau

SEQ ID NO: 1939731 - RNA, 20 nt, Homo sapiens
ucccacacacaaaccaagag

SEQ ID NO: 1939732 - RNA, 20 nt, Homo sapiens
ucuauuaauaucaacucuga

SEQ ID NO: 1939733 - RNA, 10 nt, Homo sapiens
ucucauuucu

SEQ ID NO: 1939734 - RNA, 23 nt, Homo sapiens
aacuuuaaacauugacgauuccu

SEQ ID NO: 1939735 - RNA, 14 nt, Homo sapiens
acaacgugcaacug

SEQ ID NO: 1939736 - RNA, 21 nt, Homo sapiens
ccccuguucucuuccacucuc

SEQ ID NO: 1939737 - RNA, 15 nt, Homo sapiens
gacuuggagagcaaa

SEQ ID NO: 1939738 - RNA, 19 nt, Homo sapiens
uaaaaaucauugauuguca

SEQ ID NO: 1939739 - RNA, 13 nt, Homo sapiens
acacuccuugcau

SEQ ID NO: 1939740 - RNA, 17 nt, Homo sapiens
gagaaucccuggcaaag

SEQ ID NO: 1939741 - RNA, 15 nt, Homo sapiens
ucagggaagcccuga

SEQ ID NO: 1939742 - RNA, 12 nt, Homo sapiens
cagggaaacuca

SEQ ID NO: 1939743 - RNA, 23 nt, Homo sapiens
agugagggaaggauguuuagcag

SEQ ID NO: 1939744 - RNA, 13 nt, Homo sapiens
ucagccacugagg

SEQ ID NO: 1939745 - RNA, 17 nt, Homo sapiens
ccaagugccggacuagc

SEQ ID NO: 1939746 - RNA, 10 nt, Homo sapiens
agccagugac

SEQ ID NO: 1939747 - RNA, 19 nt, Homo sapiens
caguauuucaacugcugua

SEQ ID NO: 1939748 - RNA, 14 nt, Homo sapiens
aggacuuccaucug

SEQ ID NO: 1939749 - RNA, 18 nt, Homo sapiens
ucacugaaagacaccauu

SEQ ID NO: 1939750 - RNA, 12 nt, Homo sapiens
aguccuagcccc

SEQ ID NO: 1939751 - RNA, 13 nt, Homo sapiens
aucacacaacuca

SEQ ID NO: 1939752 - RNA, 19 nt, Homo sapiens
ugggaagaaagaaugcaag

SEQ ID NO: 1939753 - RNA, 17 nt, Homo sapiens
auugaaagaaccagaga

SEQ ID NO: 1939754 - RNA, 22 nt, Homo sapiens
cauuuauugccucuaugugcaa

SEQ ID NO: 1939755 - RNA, 12 nt, Homo sapiens
gugguaaucuac

SEQ ID NO: 1939756 - RNA, 17 nt, Homo sapiens
cagggaagugcucugau

SEQ ID NO: 1939757 - RNA, 13 nt, Homo sapiens
gcagaggacgcac

SEQ ID NO: 1939758 - RNA, 20 nt, Homo sapiens
ccugacuguccuacaauauc

SEQ ID NO: 1939759 - RNA, 16 nt, Homo sapiens
accaacucucucugcc

SEQ ID NO: 1939760 - RNA, 20 nt, Homo sapiens
cacugcacagugcaucucag

SEQ ID NO: 1939761 - RNA, 13 nt, Homo sapiens
cagcugcaccugc

SEQ ID NO: 1939762 - RNA, 16 nt, Homo sapiens
guccaaaauguugauc

SEQ ID NO: 1939763 - RNA, 21 nt, Homo sapiens
ugcguugaggccgcaucuuuc

SEQ ID NO: 1939764 - RNA, 14 nt, Homo sapiens
gcuguugcucagga

SEQ ID NO: 1939765 - RNA, 21 nt, Homo sapiens
uggcuaccgauuucagcacau

SEQ ID NO: 1939766 - RNA, 22 nt, Homo sapiens
uaagcugcuggaaaccucaugc

SEQ ID NO: 1939767 - RNA, 17 nt, Homo sapiens
acauaguagcaauggau

SEQ ID NO: 1939768 - RNA, 22 nt, Homo sapiens
uaaaauuagauuagaaagacuu

SEQ ID NO: 1939769 - RNA, 14 nt, Homo sapiens
ucccucgcuguaug

SEQ ID NO: 1939770 - RNA, 16 nt, Homo sapiens
agugauucuugugccu

SEQ ID NO: 1939771 - RNA, 14 nt, Homo sapiens
cuuuucaccaauga

SEQ ID NO: 1939772 - RNA, 16 nt, Homo sapiens
agguacagcagaaagg

SEQ ID NO: 1939773 - RNA, 20 nt, Homo sapiens
guuucuacuuccccauuuca

SEQ ID NO: 1939774 - RNA, 21 nt, Homo sapiens
cuugaagguuuguccacauuc

SEQ ID NO: 1939775 - RNA, 14 nt, Homo sapiens
ucacucugcugcug

SEQ ID NO: 1939776 - RNA, 13 nt, Homo sapiens
gaaaccugugauu

SEQ ID NO: 1939777 - RNA, 14 nt, Homo sapiens
ggcaugugagauga

SEQ ID NO: 1939778 - RNA, 20 nt, Homo sapiens
auucacauaguuuauuucaa

SEQ ID NO: 1939779 - RNA, 19 nt, Homo sapiens
aagacuuucuaaaucucua

SEQ ID NO: 1939780 - RNA, 18 nt, Homo sapiens
ugcuucccagguucaagc

SEQ ID NO: 1939781 - RNA, 22 nt, Homo sapiens
aaugagguggcucaugccugua

SEQ ID NO: 1939782 - RNA, 20 nt, Homo sapiens
aggaaugagauuaauuccuu

SEQ ID NO: 1939783 - RNA, 23 nt, Homo sapiens
aauguuuccaaccuggaguauaa

SEQ ID NO: 1939784 - RNA, 20 nt, Homo sapiens
auuagaaggcagacuuucua

SEQ ID NO: 1939785 - RNA, 13 nt, Homo sapiens
ccaaagugccugg

SEQ ID NO: 1939786 - RNA, 21 nt, Homo sapiens
gagucaauuaaacagcugguc

SEQ ID NO: 1939787 - RNA, 23 nt, Homo sapiens
uauuuuguaagcuauaacauauu

SEQ ID NO: 1939788 - RNA, 19 nt, Homo sapiens
cuguacuaaggagcaugau

SEQ ID NO: 1939789 - RNA, 12 nt, Homo sapiens
gccaacccagcc

SEQ ID NO: 1939790 - RNA, 16 nt, Homo sapiens
aacauacugcauuuca

SEQ ID NO: 1939791 - RNA, 19 nt, Homo sapiens
cucccaaauaaacuccuua

SEQ ID NO: 1939792 - RNA, 14 nt, Homo sapiens
gauguuuacauguc

SEQ ID NO: 1939793 - RNA, 19 nt, Homo sapiens
gaaaauaauauuaaaucua

SEQ ID NO: 1939794 - RNA, 20 nt, Homo sapiens
cuaggagcugguguggccaa

SEQ ID NO: 1939795 - RNA, 20 nt, Homo sapiens
caaagaggcugccccucuca

SEQ ID NO: 1939796 - RNA, 13 nt, Homo sapiens
ugcuuuaucuacu

SEQ ID NO: 1939797 - RNA, 17 nt, Homo sapiens
cuaaaucuucagcauag

SEQ ID NO: 1939798 - RNA, 15 nt, Homo sapiens
guuagcucauuugag

SEQ ID NO: 1939799 - RNA, 20 nt, Homo sapiens
gccucuccuuaaaugcuucu

SEQ ID NO: 1939800 - RNA, 19 nt, Homo sapiens
acacaaaauacagcacuuu

SEQ ID NO: 1939801 - RNA, 17 nt, Homo sapiens
ugguuaagacuacugaa

SEQ ID NO: 1939802 - RNA, 23 nt, Homo sapiens
acagagaaaagcuuggaaagcca

SEQ ID NO: 1939803 - RNA, 16 nt, Homo sapiens
auucucugcugcaucu

SEQ ID NO: 1939804 - RNA, 21 nt, Homo sapiens
ccuucugugccggcuuucaag

SEQ ID NO: 1939805 - RNA, 23 nt, Homo sapiens
acaaagcccuguccuucagucuu

SEQ ID NO: 1939806 - RNA, 13 nt, Homo sapiens
auugccugccaga

SEQ ID NO: 1939807 - RNA, 16 nt, Homo sapiens
uaguugccgccaaaca

SEQ ID NO: 1939808 - RNA, 21 nt, Homo sapiens
gcagaauucaaaagugauuau

SEQ ID NO: 1939809 - RNA, 15 nt, Homo sapiens
auaguacauaaucuu

SEQ ID NO: 1939810 - RNA, 21 nt, Homo sapiens
guuagagacuaucuaauugag

SEQ ID NO: 1939811 - RNA, 21 nt, Homo sapiens
gccuccucacccaccucuuca

SEQ ID NO: 1939812 - RNA, 22 nt, Homo sapiens
cacuuguucuguacuuguaaaa

SEQ ID NO: 1939813 - RNA, 21 nt, Homo sapiens
caggcagaggagaguaccccc

SEQ ID NO: 1939814 - RNA, 18 nt, Homo sapiens
cuaaaggacucuccagcc

SEQ ID NO: 1939815 - RNA, 15 nt, Homo sapiens
auuaaagguucugaa

SEQ ID NO: 1939816 - RNA, 18 nt, Homo sapiens
acuuucauguacuaugga

SEQ ID NO: 1939817 - RNA, 16 nt, Homo sapiens
agcugcagccacuuuc

SEQ ID NO: 1939818 - RNA, 19 nt, Homo sapiens
uguccacaaauguccucag

SEQ ID NO: 1939819 - RNA, 19 nt, Homo sapiens
agaaaaaaagagugaaaaa

SEQ ID NO: 1939820 - RNA, 18 nt, Homo sapiens
ccugagcaaaaagaccag

SEQ ID NO: 1939821 - RNA, 11 nt, Homo sapiens
acaaacugcaa

SEQ ID NO: 1939822 - RNA, 15 nt, Homo sapiens
cacccacgugcauuc

SEQ ID NO: 1939823 - RNA, 16 nt, Homo sapiens
guugaagggcaguguu

SEQ ID NO: 1939824 - RNA, 17 nt, Homo sapiens
gcaucaauacaaccagc

SEQ ID NO: 1939825 - RNA, 16 nt, Homo sapiens
gcccggggcagcugcc

SEQ ID NO: 1939826 - RNA, 17 nt, Homo sapiens
cuugggacucaggucug

SEQ ID NO: 1939827 - RNA, 14 nt, Homo sapiens
agaaaaccuguauu

SEQ ID NO: 1939828 - RNA, 14 nt, Homo sapiens
cauccucacacaga

SEQ ID NO: 1939829 - RNA, 17 nt, Homo sapiens
aaccugaagacugagga

SEQ ID NO: 1939830 - RNA, 22 nt, Homo sapiens
uccuucuuaacucucuguuaca

SEQ ID NO: 1939831 - RNA, 12 nt, Homo sapiens
aaauaaauucaa

SEQ ID NO: 1939832 - RNA, 17 nt, Homo sapiens
cagcuccugaccaaaga

SEQ ID NO: 1939833 - RNA, 14 nt, Homo sapiens
guacgggccaguuu

SEQ ID NO: 1939834 - RNA, 16 nt, Homo sapiens
uaauauuaacuaaaua

SEQ ID NO: 1939835 - RNA, 14 nt, Homo sapiens
cccaccacuggcca

SEQ ID NO: 1939836 - RNA, 20 nt, Homo sapiens
ccugguagaucaagcauuac

SEQ ID NO: 1939837 - RNA, 22 nt, Homo sapiens
acugggcccuggggaagguauc

SEQ ID NO: 1939838 - RNA, 13 nt, Homo sapiens
aucuugugugauu

SEQ ID NO: 1939839 - RNA, 21 nt, Homo sapiens
uuaaagaagucauaaacagca

SEQ ID NO: 1939840 - RNA, 13 nt, Homo sapiens
uaaguacagagaa

SEQ ID NO: 1939841 - RNA, 18 nt, Homo sapiens
gggggaaggcugcaaagu

SEQ ID NO: 1939842 - RNA, 16 nt, Homo sapiens
uuugacacgcaguugc

SEQ ID NO: 1939843 - RNA, 20 nt, Homo sapiens
gagcaccuuugcacaggaug

SEQ ID NO: 1939844 - RNA, 21 nt, Homo sapiens
aagcccaauuuugacccuggu

SEQ ID NO: 1939845 - RNA, 22 nt, Homo sapiens
agcugcccacaacuugccaaaa

SEQ ID NO: 1939846 - RNA, 14 nt, Homo sapiens
uggaacuguacacu

SEQ ID NO: 1939847 - RNA, 21 nt, Homo sapiens
aaggcaaagccccuggaaaug

SEQ ID NO: 1939848 - RNA, 20 nt, Homo sapiens
uuaagccaucucagauucug

SEQ ID NO: 1939849 - RNA, 22 nt, Homo sapiens
uucagauuuuaaaaagucuuca

SEQ ID NO: 1939850 - RNA, 19 nt, Homo sapiens
guauuuuaaaacauaagaa

SEQ ID NO: 1939851 - RNA, 23 nt, Homo sapiens
gccgcagagaaaugccccagugu

SEQ ID NO: 1939852 - RNA, 24 nt, Homo sapiens
gggugggauuugccagaugccaaa

SEQ ID NO: 1939853 - RNA, 12 nt, Homo sapiens
ugauaugcauau

SEQ ID NO: 1939854 - RNA, 19 nt, Homo sapiens
auaugaugguggucaucca

SEQ ID NO: 1939855 - RNA, 14 nt, Homo sapiens
cagcacaugcacac

SEQ ID NO: 1939856 - RNA, 21 nt, Homo sapiens
ccaaaggaagaacuggauaaa

SEQ ID NO: 1939857 - RNA, 21 nt, Homo sapiens
ugcugcagggacagcccugac

SEQ ID NO: 1939858 - RNA, 15 nt, Homo sapiens
uccaggccauuuaau

SEQ ID NO: 1939859 - RNA, 21 nt, Homo sapiens
caaccuguucacgugacuccu

SEQ ID NO: 1939860 - RNA, 18 nt, Homo sapiens
ccaaacagcuguauuuau

SEQ ID NO: 1939861 - RNA, 18 nt, Homo sapiens
caaaacuuccugauuuga

SEQ ID NO: 1939862 - RNA, 18 nt, Homo sapiens
ucugugcacugauugcau

SEQ ID NO: 1939863 - RNA, 23 nt, Homo sapiens
ccucagugccacuugacauuccu

SEQ ID NO: 1939864 - RNA, 15 nt, Homo sapiens
aucaguggaacucaa

SEQ ID NO: 1939865 - RNA, 14 nt, Homo sapiens
acuccuggcuucau

SEQ ID NO: 1939866 - RNA, 23 nt, Homo sapiens
cuuuugaccaaauaaaguaccau

SEQ ID NO: 1939867 - RNA, 17 nt, Homo sapiens
aaagucaaaguguugcu

SEQ ID NO: 1939868 - RNA, 22 nt, Homo sapiens
ucaugggacuaaaugaacuaau

SEQ ID NO: 1939869 - RNA, 14 nt, Homo sapiens
gguuucugauugca

SEQ ID NO: 1939870 - RNA, 14 nt, Homo sapiens
acucaaaggccaga

SEQ ID NO: 1939871 - RNA, 20 nt, Homo sapiens
aaucuacacgcauguaugca

SEQ ID NO: 1939872 - RNA, 15 nt, Homo sapiens
ggagaguggaccugu

SEQ ID NO: 1939873 - RNA, 22 nt, Homo sapiens
agcggccccuugacucugggga

SEQ ID NO: 1939874 - RNA, 15 nt, Homo sapiens
agaugggcagcagcu

SEQ ID NO: 1939875 - RNA, 21 nt, Homo sapiens
uccccugaggaauaugucaua

SEQ ID NO: 1939876 - RNA, 15 nt, Homo sapiens
caguuucagcucacu

SEQ ID NO: 1939877 - RNA, 18 nt, Homo sapiens
acaguuuaucaugaagcc

SEQ ID NO: 1939878 - RNA, 19 nt, Homo sapiens
aguuuuucagaaagcauua

SEQ ID NO: 1939879 - RNA, 20 nt, Homo sapiens
aaugaucagacuugauuuac

SEQ ID NO: 1939880 - RNA, 22 nt, Homo sapiens
ccauuaacaaauguaucacuag

SEQ ID NO: 1939881 - RNA, 22 nt, Homo sapiens
ucuccaugaauuaguucuccua

SEQ ID NO: 1939882 - RNA, 18 nt, Homo sapiens
cuugaaguagacauggaa

SEQ ID NO: 1939883 - RNA, 23 nt, Homo sapiens
uccauccugcuagcaccucccca

SEQ ID NO: 1939884 - RNA, 22 nt, Homo sapiens
aguugccaucugcgugacaaua

SEQ ID NO: 1939885 - RNA, 18 nt, Homo sapiens
caccaggauuuauacaua

SEQ ID NO: 1939886 - RNA, 23 nt, Homo sapiens
accguuuccuuucauuuacugug

SEQ ID NO: 1939887 - RNA, 13 nt, Homo sapiens
auacauaagacca

SEQ ID NO: 1939888 - RNA, 20 nt, Homo sapiens
aacuuuggcuuucauauucu

SEQ ID NO: 1939889 - RNA, 18 nt, Homo sapiens
ugacaagccaaugugaau

SEQ ID NO: 1939890 - RNA, 18 nt, Homo sapiens
uauacugugaaguuacau

SEQ ID NO: 1939891 - RNA, 12 nt, Homo sapiens
ccacuacugcag

SEQ ID NO: 1939892 - RNA, 18 nt, Homo sapiens
caauuaucaaaaaacaga

SEQ ID NO: 1939893 - RNA, 22 nt, Homo sapiens
aucauuuuaagaagacaugaca

SEQ ID NO: 1939894 - RNA, 16 nt, Homo sapiens
cacgccuguaauccca

SEQ ID NO: 1939895 - RNA, 15 nt, Homo sapiens
agccagaauguuucc

SEQ ID NO: 1939896 - RNA, 15 nt, Homo sapiens
gcagcagcagcagca

SEQ ID NO: 1939897 - RNA, 18 nt, Homo sapiens
gcuucuccuuggcugaga

SEQ ID NO: 1939898 - RNA, 18 nt, Homo sapiens
gcguccaugcucagagug

SEQ ID NO: 1939899 - RNA, 19 nt, Homo sapiens
cuggcccucuguggucaca

SEQ ID NO: 1939900 - RNA, 18 nt, Homo sapiens
aaaauaaaagaucuugaa

SEQ ID NO: 1939901 - RNA, 19 nt, Homo sapiens
acuucacagagugugcugg

SEQ ID NO: 1939902 - RNA, 13 nt, Homo sapiens
uguaggacuguau

SEQ ID NO: 1939903 - RNA, 22 nt, Homo sapiens
cuccccgggaccgcgcuagggc

SEQ ID NO: 1939904 - RNA, 13 nt, Homo sapiens
aagggaggcacuu

SEQ ID NO: 1939905 - RNA, 14 nt, Homo sapiens
uguccauagauaua

SEQ ID NO: 1939906 - RNA, 23 nt, Homo sapiens
ugcuucagacauguaauguuguu

SEQ ID NO: 1939907 - RNA, 16 nt, Homo sapiens
cacuuccucuucuuca

SEQ ID NO: 1939908 - RNA, 23 nt, Homo sapiens
uagaacaccugagcugcugcaug

SEQ ID NO: 1939909 - RNA, 11 nt, Homo sapiens
uuaugccuguc

SEQ ID NO: 1939910 - RNA, 22 nt, Homo sapiens
agggagggacacuuacccaagg

SEQ ID NO: 1939911 - RNA, 16 nt, Homo sapiens
augagaacaguaugaa

SEQ ID NO: 1939912 - RNA, 16 nt, Homo sapiens
uccccucucagcauuu

SEQ ID NO: 1939913 - RNA, 16 nt, Homo sapiens
cacuaaaauucacuua

SEQ ID NO: 1939914 - RNA, 19 nt, Homo sapiens
cagggagaaggcauugcuu

SEQ ID NO: 1939915 - RNA, 24 nt, Homo sapiens
aucucuauguagaaaucucaucuu

SEQ ID NO: 1939916 - RNA, 22 nt, Homo sapiens
gcucuuuuggguaucaacaccu

SEQ ID NO: 1939917 - RNA, 11 nt, Homo sapiens
uggccagucau

SEQ ID NO: 1939918 - RNA, 15 nt, Homo sapiens
agcagcuggcacuga

SEQ ID NO: 1939919 - RNA, 19 nt, Homo sapiens
uaaggucuccaaaccagac

SEQ ID NO: 1939920 - RNA, 21 nt, Homo sapiens
acagagaagccaucaccucag

SEQ ID NO: 1939921 - RNA, 19 nt, Homo sapiens
uaucagggcacagucucca

SEQ ID NO: 1939922 - RNA, 21 nt, Homo sapiens
aggcuaagaugagauuugcca

SEQ ID NO: 1939923 - RNA, 23 nt, Homo sapiens
caaagccccuacaacuccagcca

SEQ ID NO: 1939924 - RNA, 24 nt, Homo sapiens
auauaauucuguacauagccuaua

SEQ ID NO: 1939925 - RNA, 21 nt, Homo sapiens
gaggucuguacguuaccucuu

SEQ ID NO: 1939926 - RNA, 16 nt, Homo sapiens
gaagcacagagggcua

SEQ ID NO: 1939927 - RNA, 19 nt, Homo sapiens
uucagaagccuaauuccag

SEQ ID NO: 1939928 - RNA, 22 nt, Homo sapiens
ugacaguauaaagggcaaagga

SEQ ID NO: 1939929 - RNA, 16 nt, Homo sapiens
cucggcccuguagccc

SEQ ID NO: 1939930 - RNA, 16 nt, Homo sapiens
agcuucuaccuggaaa

SEQ ID NO: 1939931 - RNA, 14 nt, Homo sapiens
accugugugcuugg

SEQ ID NO: 1939932 - RNA, 16 nt, Homo sapiens
acuugaaaacuucuca

SEQ ID NO: 1939933 - RNA, 23 nt, Homo sapiens
aauuagucuuggaaaaaaaccac

SEQ ID NO: 1939934 - RNA, 23 nt, Homo sapiens
ugagaauauaauacuguauuuga

SEQ ID NO: 1939935 - RNA, 21 nt, Homo sapiens
uccagguuuuucuggcauuuu

SEQ ID NO: 1939936 - RNA, 23 nt, Homo sapiens
uggcccucccucccuagcccuuc

SEQ ID NO: 1939937 - RNA, 12 nt, Homo sapiens
ugaaaagugaag

SEQ ID NO: 1939938 - RNA, 15 nt, Homo sapiens
agcuuuccucaaaaa

SEQ ID NO: 1939939 - RNA, 14 nt, Homo sapiens
aacuuacaccugga

SEQ ID NO: 1939940 - RNA, 14 nt, Homo sapiens
aaaugaacauuuca

SEQ ID NO: 1939941 - RNA, 18 nt, Homo sapiens
cugcucacaguaacccaa

SEQ ID NO: 1939942 - RNA, 16 nt, Homo sapiens
acacucaagugccauu

SEQ ID NO: 1939943 - RNA, 16 nt, Homo sapiens
uguaagauuuuuaccu

SEQ ID NO: 1939944 - RNA, 12 nt, Homo sapiens
ccacccuaucau

SEQ ID NO: 1939945 - RNA, 12 nt, Homo sapiens
ucucccuaccuu

SEQ ID NO: 1939946 - RNA, 18 nt, Homo sapiens
ugacuauaaaaacugccc

SEQ ID NO: 1939947 - RNA, 18 nt, Homo sapiens
acuuuccaucccaaaggc

SEQ ID NO: 1939948 - RNA, 22 nt, Homo sapiens
acaauuguuaugaucuacucau

SEQ ID NO: 1939949 - RNA, 22 nt, Homo sapiens
cuacuggggacugugcucacua

SEQ ID NO: 1939950 - RNA, 11 nt, Homo sapiens
cccuucacugu

SEQ ID NO: 1939951 - RNA, 16 nt, Homo sapiens
ucuguaaugguacuga

SEQ ID NO: 1939952 - RNA, 20 nt, Homo sapiens
caaacugaauggcaaugaaa

SEQ ID NO: 1939953 - RNA, 14 nt, Homo sapiens
ccuucugacuguuu

SEQ ID NO: 1939954 - RNA, 11 nt, Homo sapiens
uggggccugug

SEQ ID NO: 1939955 - RNA, 18 nt, Homo sapiens
uucaccuaccgaguucaa

SEQ ID NO: 1939956 - RNA, 14 nt, Homo sapiens
acccuuccaucuga

SEQ ID NO: 1939957 - RNA, 17 nt, Homo sapiens
ccuuggguccauuuucu

SEQ ID NO: 1939958 - RNA, 16 nt, Homo sapiens
aaauuauaaaccaagg

SEQ ID NO: 1939959 - RNA, 22 nt, Homo sapiens
augguuuucaacaagccugaaa

SEQ ID NO: 1939960 - RNA, 14 nt, Homo sapiens
gcaagcgugcugcc

SEQ ID NO: 1939961 - RNA, 19 nt, Homo sapiens
caggaauuagagaagcuga

SEQ ID NO: 1939962 - RNA, 13 nt, Homo sapiens
agcacauggccau

SEQ ID NO: 1939963 - RNA, 21 nt, Homo sapiens
aaauuccuacucccucuucca

SEQ ID NO: 1939964 - RNA, 20 nt, Homo sapiens
uccaccuuguuacacauuau

SEQ ID NO: 1939965 - RNA, 16 nt, Homo sapiens
aaauaaucucaaagga

SEQ ID NO: 1939966 - RNA, 23 nt, Homo sapiens
gggcuggcccagggcugcaaugc

SEQ ID NO: 1939967 - RNA, 22 nt, Homo sapiens
auacaguagaagcucacaaaua

SEQ ID NO: 1939968 - RNA, 21 nt, Homo sapiens
ugcaucauucuuucugcuaua

SEQ ID NO: 1939969 - RNA, 22 nt, Homo sapiens
uaacaugacacauuugaaauca

SEQ ID NO: 1939970 - RNA, 18 nt, Homo sapiens
aacugcuugaacccagga

SEQ ID NO: 1939971 - RNA, 19 nt, Homo sapiens
caucugcuuguauuuucca

SEQ ID NO: 1939972 - RNA, 13 nt, Homo sapiens
cuauuuugagcau

SEQ ID NO: 1939973 - RNA, 19 nt, Homo sapiens
cccuuccucccauuuccca

SEQ ID NO: 1939974 - RNA, 22 nt, Homo sapiens
uccagacuugggaaacuauuca

SEQ ID NO: 1939975 - RNA, 16 nt, Homo sapiens
augugcacugccugca

SEQ ID NO: 1939976 - RNA, 20 nt, Homo sapiens
ccuggaaacagcaguguaua

SEQ ID NO: 1939977 - RNA, 14 nt, Homo sapiens
uuuagaucucugaa

SEQ ID NO: 1939978 - RNA, 22 nt, Homo sapiens
caguuccacuggggcaagcucc

SEQ ID NO: 1939979 - RNA, 21 nt, Homo sapiens
ugcccuucuuccauucccaga

SEQ ID NO: 1939980 - RNA, 16 nt, Homo sapiens
cccaggaaaaacugga

SEQ ID NO: 1939981 - RNA, 19 nt, Homo sapiens
ccuggagggcuacagcauc

SEQ ID NO: 1939982 - RNA, 18 nt, Homo sapiens
acuccucucaacugccuc

SEQ ID NO: 1939983 - RNA, 15 nt, Homo sapiens
aagccaguccagaag

SEQ ID NO: 1939984 - RNA, 14 nt, Homo sapiens
ccuguuccugccac

SEQ ID NO: 1939985 - RNA, 16 nt, Homo sapiens
ugguuacucuggugcu

SEQ ID NO: 1939986 - RNA, 23 nt, Homo sapiens
cucuccaugaucccaccucccau

SEQ ID NO: 1939987 - RNA, 21 nt, Homo sapiens
acugccgugcauuagcacaga

SEQ ID NO: 1939988 - RNA, 21 nt, Homo sapiens
cccagcuuaauggcucaugac

SEQ ID NO: 1939989 - RNA, 18 nt, Homo sapiens
gcacucacccaugugcca

SEQ ID NO: 1939990 - RNA, 18 nt, Homo sapiens
ugggagaguaccugugug

SEQ ID NO: 1939991 - RNA, 19 nt, Homo sapiens
aaucgcaaggccugugcug

SEQ ID NO: 1939992 - RNA, 18 nt, Homo sapiens
gagcacucauuccuuccc

SEQ ID NO: 1939993 - RNA, 19 nt, Homo sapiens
gcuccuguucacaccagag

SEQ ID NO: 1939994 - RNA, 13 nt, Homo sapiens
agaucaccaccug

SEQ ID NO: 1939995 - RNA, 17 nt, Homo sapiens
agcuuccgccgucucaa

SEQ ID NO: 1939996 - RNA, 20 nt, Homo sapiens
gaguguuuuuacauugaucu

SEQ ID NO: 1939997 - RNA, 14 nt, Homo sapiens
accucuuccuugau

SEQ ID NO: 1939998 - RNA, 14 nt, Homo sapiens
cucucaucacugaa

SEQ ID NO: 1939999 - RNA, 14 nt, Homo sapiens
aauuuaggaccaau

SEQ ID NO: 1940000 - RNA, 15 nt, Homo sapiens
aauuuucacugcugc

SEQ ID NO: 1940001 - RNA, 13 nt, Homo sapiens
uacugaugaaaua

SEQ ID NO: 1940002 - RNA, 23 nt, Homo sapiens
uuucaauuauagugucaugcaga

SEQ ID NO: 1940003 - RNA, 12 nt, Homo sapiens
auaagcaugauc

SEQ ID NO: 1940004 - RNA, 13 nt, Homo sapiens
guggaacauucug

SEQ ID NO: 1940005 - RNA, 14 nt, Homo sapiens
uuucacucacaucu

SEQ ID NO: 1940006 - RNA, 22 nt, Homo sapiens
uugaauaaauguaucugaauau

SEQ ID NO: 1940007 - RNA, 17 nt, Homo sapiens
aggccugccgcuuugau

SEQ ID NO: 1940008 - RNA, 18 nt, Homo sapiens
uuaaaauauguaugucua

SEQ ID NO: 1940009 - RNA, 23 nt, Homo sapiens
agaaguacagggcagaaccaaga

SEQ ID NO: 1940010 - RNA, 18 nt, Homo sapiens
auacccacacagucacag

SEQ ID NO: 1940011 - RNA, 14 nt, Homo sapiens
ugugucaaugccac

SEQ ID NO: 1940012 - RNA, 22 nt, Homo sapiens
uccaaucccccagcgcuuagaa

SEQ ID NO: 1940013 - RNA, 14 nt, Homo sapiens
gguuauuucaauuc

SEQ ID NO: 1940014 - RNA, 19 nt, Homo sapiens
ugcgaaccuuucagucucc

SEQ ID NO: 1940015 - RNA, 15 nt, Homo sapiens
agucugucucugcua

SEQ ID NO: 1940016 - RNA, 13 nt, Homo sapiens
cuggauccagcuc

SEQ ID NO: 1940017 - RNA, 19 nt, Homo sapiens
ugccgcauuuccuuucagu

SEQ ID NO: 1940018 - RNA, 21 nt, Homo sapiens
agacaccaccacccuugccau

SEQ ID NO: 1940019 - RNA, 19 nt, Homo sapiens
gcuggucucugcugaaggu

SEQ ID NO: 1940020 - RNA, 19 nt, Homo sapiens
ugcauaauaacuacuucca

SEQ ID NO: 1940021 - RNA, 19 nt, Homo sapiens
aguguuagaaaaaacugga

SEQ ID NO: 1940022 - RNA, 15 nt, Homo sapiens
caucaaaaugaauag

SEQ ID NO: 1940023 - RNA, 17 nt, Homo sapiens
cccggggcuccacugaa

SEQ ID NO: 1940024 - RNA, 21 nt, Homo sapiens
uccucccaucuccuuccccca

SEQ ID NO: 1940025 - RNA, 20 nt, Homo sapiens
uucgaaaccuguccauaaag

SEQ ID NO: 1940026 - RNA, 22 nt, Homo sapiens
uaguuuaccucauccaugcacu

SEQ ID NO: 1940027 - RNA, 20 nt, Homo sapiens
cuaauuuuggauaauauuca

SEQ ID NO: 1940028 - RNA, 23 nt, Homo sapiens
ucuccacaaaaacucuuauuacu

SEQ ID NO: 1940029 - RNA, 16 nt, Homo sapiens
acuauuuuaacuggga

SEQ ID NO: 1940030 - RNA, 19 nt, Homo sapiens
ccugacaaguuauuacugu

SEQ ID NO: 1940031 - RNA, 19 nt, Homo sapiens
cugagcacgcuaccaaauc

SEQ ID NO: 1940032 - RNA, 22 nt, Homo sapiens
uauuaaagaucugcaacuacua

SEQ ID NO: 1940033 - RNA, 17 nt, Homo sapiens
cuauugaguggcagugu

SEQ ID NO: 1940034 - RNA, 15 nt, Homo sapiens
gcucagggaccaugg

SEQ ID NO: 1940035 - RNA, 22 nt, Homo sapiens
aggccuauaaccccagcucccu

SEQ ID NO: 1940036 - RNA, 20 nt, Homo sapiens
gaaaguaaagaaaggggaga

SEQ ID NO: 1940037 - RNA, 15 nt, Homo sapiens
cagagaggagucaga

SEQ ID NO: 1940038 - RNA, 20 nt, Homo sapiens
agaggcagcuucuagacaga

SEQ ID NO: 1940039 - RNA, 16 nt, Homo sapiens
uugaugcuacaggauu

SEQ ID NO: 1940040 - RNA, 18 nt, Homo sapiens
aagagcacguuuuccauu

SEQ ID NO: 1940041 - RNA, 16 nt, Homo sapiens
auggcaggggcaaagg

SEQ ID NO: 1940042 - RNA, 13 nt, Homo sapiens
cacagagcuacau

SEQ ID NO: 1940043 - RNA, 16 nt, Homo sapiens
uaacagaaauuguaua

SEQ ID NO: 1940044 - RNA, 21 nt, Homo sapiens
gaaaacguaucaccuuuccca

SEQ ID NO: 1940045 - RNA, 16 nt, Homo sapiens
cuugucccagccucag

SEQ ID NO: 1940046 - RNA, 15 nt, Homo sapiens
guaaaguauuugaug

SEQ ID NO: 1940047 - RNA, 19 nt, Homo sapiens
ucuugcaucugggccagaa

SEQ ID NO: 1940048 - RNA, 16 nt, Homo sapiens
gguagggccagcucac

SEQ ID NO: 1940049 - RNA, 17 nt, Homo sapiens
aaauuggacugucuuua

SEQ ID NO: 1940050 - RNA, 17 nt, Homo sapiens
uguaguccgugcugaca

SEQ ID NO: 1940051 - RNA, 11 nt, Homo sapiens
acaaacuaagg

SEQ ID NO: 1940052 - RNA, 18 nt, Homo sapiens
aauuaauuugaccaucuc

SEQ ID NO: 1940053 - RNA, 20 nt, Homo sapiens
uaacugauguuccacaaaac

SEQ ID NO: 1940054 - RNA, 21 nt, Homo sapiens
gccuccagaacuuagcaauuu

SEQ ID NO: 1940055 - RNA, 15 nt, Homo sapiens
agaaccaagaacaua

SEQ ID NO: 1940056 - RNA, 13 nt, Homo sapiens
gaugucuguucua

SEQ ID NO: 1940057 - RNA, 18 nt, Homo sapiens
ugacuuuccucccauuuu

SEQ ID NO: 1940058 - RNA, 17 nt, Homo sapiens
gggauaaacugagccug

SEQ ID NO: 1940059 - RNA, 16 nt, Homo sapiens
ccagguguguggugca

SEQ ID NO: 1940060 - RNA, 14 nt, Homo sapiens
uaaucuuugcuuua

SEQ ID NO: 1940061 - RNA, 21 nt, Homo sapiens
cagcccuugaagucacccggc

SEQ ID NO: 1940062 - RNA, 20 nt, Homo sapiens
auuuaacauuaucuaguuca

SEQ ID NO: 1940063 - RNA, 16 nt, Homo sapiens
gagggaugcagugccu

SEQ ID NO: 1940064 - RNA, 21 nt, Homo sapiens
cauugugcaauugauauugcc

SEQ ID NO: 1940065 - RNA, 18 nt, Homo sapiens
caaaauaaaaagugacac

SEQ ID NO: 1940066 - RNA, 18 nt, Homo sapiens
ggggagucagucauguca

SEQ ID NO: 1940067 - RNA, 18 nt, Homo sapiens
aggugacaaaccauuucc

SEQ ID NO: 1940068 - RNA, 15 nt, Homo sapiens
uccucagccuccuca

SEQ ID NO: 1940069 - RNA, 14 nt, Homo sapiens
ucacucccagucca

SEQ ID NO: 1940070 - RNA, 19 nt, Homo sapiens
caggagcuugauccagacc

SEQ ID NO: 1940071 - RNA, 15 nt, Homo sapiens
cuuacuaaaugcaga

SEQ ID NO: 1940072 - RNA, 15 nt, Homo sapiens
aucucaggauuucac

SEQ ID NO: 1940073 - RNA, 22 nt, Homo sapiens
cugugccugggcccugggcuga

SEQ ID NO: 1940074 - RNA, 20 nt, Homo sapiens
agagauggggucucacagug

SEQ ID NO: 1940075 - RNA, 22 nt, Homo sapiens
uugccucuacuuugauucugau

SEQ ID NO: 1940076 - RNA, 23 nt, Homo sapiens
ucuuuugugagaagaugggggcu

SEQ ID NO: 1940077 - RNA, 18 nt, Homo sapiens
caacugcccagagccaca

SEQ ID NO: 1940078 - RNA, 22 nt, Homo sapiens
aaauuugggggacuuacaugau

SEQ ID NO: 1940079 - RNA, 13 nt, Homo sapiens
uuaagaacuuuaa

SEQ ID NO: 1940080 - RNA, 17 nt, Homo sapiens
ugaagaaaaguauugca

SEQ ID NO: 1940081 - RNA, 14 nt, Homo sapiens
auaaauauauauuc

SEQ ID NO: 1940082 - RNA, 21 nt, Homo sapiens
uccaggacugugccagcacaa

SEQ ID NO: 1940083 - RNA, 20 nt, Homo sapiens
aauauuucccauuugugcca

SEQ ID NO: 1940084 - RNA, 14 nt, Homo sapiens
cagcuuuacugugg

SEQ ID NO: 1940085 - RNA, 14 nt, Homo sapiens
cggggcacugcagg

SEQ ID NO: 1940086 - RNA, 22 nt, Homo sapiens
cagagcuggguggggacaguga

SEQ ID NO: 1940087 - RNA, 18 nt, Homo sapiens
aaaaccauggucucucug

SEQ ID NO: 1940088 - RNA, 18 nt, Homo sapiens
caucauaugaauguucuu

SEQ ID NO: 1940089 - RNA, 18 nt, Homo sapiens
acgagagguaugccugua

SEQ ID NO: 1940090 - RNA, 14 nt, Homo sapiens
agccgcaaauccau

SEQ ID NO: 1940091 - RNA, 20 nt, Homo sapiens
ucccacgggaccuggggcuu

SEQ ID NO: 1940092 - RNA, 18 nt, Homo sapiens
guauaauuugcuggaaca

SEQ ID NO: 1940093 - RNA, 13 nt, Homo sapiens
auccgaaguauga

SEQ ID NO: 1940094 - RNA, 15 nt, Homo sapiens
acugccaugccucaa

SEQ ID NO: 1940095 - RNA, 14 nt, Homo sapiens
auguuugccaugag

SEQ ID NO: 1940096 - RNA, 17 nt, Homo sapiens
gagcuauggcccagaaa

SEQ ID NO: 1940097 - RNA, 16 nt, Homo sapiens
auguuuguccugaaca

SEQ ID NO: 1940098 - RNA, 19 nt, Homo sapiens
uauaaaggccagcgccaga

SEQ ID NO: 1940099 - RNA, 12 nt, Homo sapiens
aguaaaccacaa

SEQ ID NO: 1940100 - RNA, 15 nt, Homo sapiens
ugaaucugacuuuag

SEQ ID NO: 1940101 - RNA, 16 nt, Homo sapiens
cugauuggccacugga

SEQ ID NO: 1940102 - RNA, 16 nt, Homo sapiens
cuauuuggaaagcacu

SEQ ID NO: 1940103 - RNA, 14 nt, Homo sapiens
uuucagccaugaua

SEQ ID NO: 1940104 - RNA, 12 nt, Homo sapiens
ugucauugcugg

SEQ ID NO: 1940105 - RNA, 18 nt, Homo sapiens
auauguagcccucaugau

SEQ ID NO: 1940106 - RNA, 23 nt, Homo sapiens
gucuccacggccugcccagucga

SEQ ID NO: 1940107 - RNA, 22 nt, Homo sapiens
gcugaccauaacagugccagcu

SEQ ID NO: 1940108 - RNA, 15 nt, Homo sapiens
aacauggagcuguca

SEQ ID NO: 1940109 - RNA, 12 nt, Homo sapiens
ugaauacacuua

SEQ ID NO: 1940110 - RNA, 16 nt, Homo sapiens
aaguaguagugucuuc

SEQ ID NO: 1940111 - RNA, 19 nt, Homo sapiens
ucuucuccuggaguugcau

SEQ ID NO: 1940112 - RNA, 21 nt, Homo sapiens
auccuuguugacacggccaug

SEQ ID NO: 1940113 - RNA, 21 nt, Homo sapiens
ucucugagcacccaagccagg

SEQ ID NO: 1940114 - RNA, 15 nt, Homo sapiens
augaacccugcccug

SEQ ID NO: 1940115 - RNA, 16 nt, Homo sapiens
ugagguucuugggaua

SEQ ID NO: 1940116 - RNA, 17 nt, Homo sapiens
acccuccaaacacuggg

SEQ ID NO: 1940117 - RNA, 17 nt, Homo sapiens
aauuuuauaugcacagu

SEQ ID NO: 1940118 - RNA, 13 nt, Homo sapiens
cccuugaaccagc

SEQ ID NO: 1940119 - RNA, 13 nt, Homo sapiens
acauaacacacau

SEQ ID NO: 1940120 - RNA, 14 nt, Homo sapiens
ggcacaaucucggc

SEQ ID NO: 1940121 - RNA, 14 nt, Homo sapiens
gcgcuucuggucug

SEQ ID NO: 1940122 - RNA, 14 nt, Homo sapiens
ugugugaucuugau

SEQ ID NO: 1940123 - RNA, 14 nt, Homo sapiens
caacgauuagcuuu

SEQ ID NO: 1940124 - RNA, 16 nt, Homo sapiens
aaauucaagagccucc

SEQ ID NO: 1940125 - RNA, 15 nt, Homo sapiens
gacagcacacgguga

SEQ ID NO: 1940126 - RNA, 16 nt, Homo sapiens
gacauucuuaguuaau

SEQ ID NO: 1940127 - RNA, 21 nt, Homo sapiens
aagcagaauuuaaguugguaa

SEQ ID NO: 1940128 - RNA, 18 nt, Homo sapiens
uccaaaucuuaauucaac

SEQ ID NO: 1940129 - RNA, 16 nt, Homo sapiens
uccauccuuccaacau

SEQ ID NO: 1940130 - RNA, 17 nt, Homo sapiens
acagagugcaacccagu

SEQ ID NO: 1940131 - RNA, 15 nt, Homo sapiens
uagaagauaacuggc

SEQ ID NO: 1940132 - RNA, 20 nt, Homo sapiens
aaauuugggaccugcuucau

SEQ ID NO: 1940133 - RNA, 14 nt, Homo sapiens
uucauucauacuca

SEQ ID NO: 1940134 - RNA, 16 nt, Homo sapiens
cgucuacccagacuca

SEQ ID NO: 1940135 - RNA, 13 nt, Homo sapiens
cuauccuugauga

SEQ ID NO: 1940136 - RNA, 15 nt, Homo sapiens
aacccaaugccugug

SEQ ID NO: 1940137 - RNA, 15 nt, Homo sapiens
uucauagaaaccucu

SEQ ID NO: 1940138 - RNA, 17 nt, Homo sapiens
gcugaggcagaacucac

SEQ ID NO: 1940139 - RNA, 11 nt, Homo sapiens
uacauggaaua

SEQ ID NO: 1940140 - RNA, 18 nt, Homo sapiens
cauggcuggaugugcauc

SEQ ID NO: 1940141 - RNA, 16 nt, Homo sapiens
uucuugaaaagccuug

SEQ ID NO: 1940142 - RNA, 12 nt, Homo sapiens
ggaaaacgugaa

SEQ ID NO: 1940143 - RNA, 18 nt, Homo sapiens
acaacuaaaaaaaaugca

SEQ ID NO: 1940144 - RNA, 19 nt, Homo sapiens
gggccucagccuccaggca

SEQ ID NO: 1940145 - RNA, 15 nt, Homo sapiens
uaauaaacuacacaa

SEQ ID NO: 1940146 - RNA, 15 nt, Homo sapiens
aucaaaacauaucaa

SEQ ID NO: 1940147 - RNA, 17 nt, Homo sapiens
ccaaaauaccagagccu

SEQ ID NO: 1940148 - RNA, 14 nt, Homo sapiens
cuaugacccugugc

SEQ ID NO: 1940149 - RNA, 21 nt, Homo sapiens
cagacaucggccuccaugacc

SEQ ID NO: 1940150 - RNA, 12 nt, Homo sapiens
ugcugcuuuaau

SEQ ID NO: 1940151 - RNA, 17 nt, Homo sapiens
augugaaccacccaugu

SEQ ID NO: 1940152 - RNA, 16 nt, Homo sapiens
auuucuaccugaguga

SEQ ID NO: 1940153 - RNA, 16 nt, Homo sapiens
acaggauggugggcag

SEQ ID NO: 1940154 - RNA, 15 nt, Homo sapiens
acccuggaacuggag

SEQ ID NO: 1940155 - RNA, 16 nt, Homo sapiens
uacacacgcacacagu

SEQ ID NO: 1940156 - RNA, 13 nt, Homo sapiens
auaaacauuuuau

SEQ ID NO: 1940157 - RNA, 13 nt, Homo sapiens
uaauucauaauua

SEQ ID NO: 1940158 - RNA, 22 nt, Homo sapiens
accucgcuguugucacaucuca

SEQ ID NO: 1940159 - RNA, 17 nt, Homo sapiens
uaccuuugucugccauu

SEQ ID NO: 1940160 - RNA, 14 nt, Homo sapiens
gucauucauucaag

SEQ ID NO: 1940161 - RNA, 14 nt, Homo sapiens
uggggccgggaccc

SEQ ID NO: 1940162 - RNA, 18 nt, Homo sapiens
caggauauucacucugug

SEQ ID NO: 1940163 - RNA, 13 nt, Homo sapiens
guugcacuggcca

SEQ ID NO: 1940164 - RNA, 11 nt, Homo sapiens
acuguggcuuc

SEQ ID NO: 1940165 - RNA, 13 nt, Homo sapiens
aggagcucaagaa

SEQ ID NO: 1940166 - RNA, 12 nt, Homo sapiens
gcuagugccuga

SEQ ID NO: 1940167 - RNA, 13 nt, Homo sapiens
guugagauccagu

SEQ ID NO: 1940168 - RNA, 21 nt, Homo sapiens
aaucauguuuuuaaaugcaua

SEQ ID NO: 1940169 - RNA, 19 nt, Homo sapiens
uaagaggaugaagugauau

SEQ ID NO: 1940170 - RNA, 16 nt, Homo sapiens
guuggaaaguaacugu

SEQ ID NO: 1940171 - RNA, 20 nt, Homo sapiens
aggccccaucagcaucccac

SEQ ID NO: 1940172 - RNA, 11 nt, Homo sapiens
gcgugcacuug

SEQ ID NO: 1940173 - RNA, 14 nt, Homo sapiens
uaaaaaaaauguga

SEQ ID NO: 1940174 - RNA, 18 nt, Homo sapiens
uccuagauuuagcacaau

SEQ ID NO: 1940175 - RNA, 18 nt, Homo sapiens
cuguucuugcugcuagaa

SEQ ID NO: 1940176 - RNA, 22 nt, Homo sapiens
auucgccaucugauccccaugc

SEQ ID NO: 1940177 - RNA, 17 nt, Homo sapiens
uaacaugacuucugccc

SEQ ID NO: 1940178 - RNA, 18 nt, Homo sapiens
aauauguauaaacuuaca

SEQ ID NO: 1940179 - RNA, 21 nt, Homo sapiens
auuugauucuaaauggcuuuu

SEQ ID NO: 1940180 - RNA, 17 nt, Homo sapiens
agugaaacuccgucuca

SEQ ID NO: 1940181 - RNA, 17 nt, Homo sapiens
cgugaaaccccgucucu

SEQ ID NO: 1940182 - RNA, 17 nt, Homo sapiens
gagacggaguuucacuc

SEQ ID NO: 1940183 - RNA, 22 nt, Homo sapiens
ccauaagggucccccacucuaa

SEQ ID NO: 1940184 - RNA, 19 nt, Homo sapiens
uugcugugugaaaucuuuc

SEQ ID NO: 1940185 - RNA, 21 nt, Homo sapiens
gguauaucuagguuuaugaca

SEQ ID NO: 1940186 - RNA, 19 nt, Homo sapiens
gagaguacaccccaacagc

SEQ ID NO: 1940187 - RNA, 23 nt, Homo sapiens
auuagggcaaggugugguagcuc

SEQ ID NO: 1940188 - RNA, 10 nt, Homo sapiens
uccugccaca

SEQ ID NO: 1940189 - RNA, 14 nt, Homo sapiens
ccagaaacaaaaag

SEQ ID NO: 1940190 - RNA, 13 nt, Homo sapiens
agugugacagggc

SEQ ID NO: 1940191 - RNA, 19 nt, Homo sapiens
uugaaaaaugagagcugua

SEQ ID NO: 1940192 - RNA, 18 nt, Homo sapiens
agcaagcacuugaugcca

SEQ ID NO: 1940193 - RNA, 17 nt, Homo sapiens
caaacuccugacuucag

SEQ ID NO: 1940194 - RNA, 21 nt, Homo sapiens
auuaaauaccuauaugaauau

SEQ ID NO: 1940195 - RNA, 14 nt, Homo sapiens
cuuguauauacaua

SEQ ID NO: 1940196 - RNA, 21 nt, Homo sapiens
aagcugaucauaagugaauuu

SEQ ID NO: 1940197 - RNA, 23 nt, Homo sapiens
cauuagcugcccaggaugcugcu

SEQ ID NO: 1940198 - RNA, 13 nt, Homo sapiens
ccuuggaccucag

SEQ ID NO: 1940199 - RNA, 13 nt, Homo sapiens
auuaugacaccuu

SEQ ID NO: 1940200 - RNA, 21 nt, Homo sapiens
agugccuuaaacucuguuaca

SEQ ID NO: 1940201 - RNA, 18 nt, Homo sapiens
cuguuaucuucacuuuua

SEQ ID NO: 1940202 - RNA, 17 nt, Homo sapiens
ucacuugaucaugcugc

SEQ ID NO: 1940203 - RNA, 16 nt, Homo sapiens
caggcucugagacaca

SEQ ID NO: 1940204 - RNA, 17 nt, Homo sapiens
accucuggcacccaucu

SEQ ID NO: 1940205 - RNA, 20 nt, Homo sapiens
uguaucacucacugccaaaa

SEQ ID NO: 1940206 - RNA, 23 nt, Homo sapiens
cucuuuaguugauuuaaacucuu

SEQ ID NO: 1940207 - RNA, 17 nt, Homo sapiens
ccuguggaaauaugcaa

SEQ ID NO: 1940208 - RNA, 19 nt, Homo sapiens
cccaggguuucugcacugg

SEQ ID NO: 1940209 - RNA, 22 nt, Homo sapiens
aaguacuacuguagaacugcaa

SEQ ID NO: 1940210 - RNA, 19 nt, Homo sapiens
uaaguuucucagcucccau

SEQ ID NO: 1940211 - RNA, 16 nt, Homo sapiens
gcaagagaaacugcag

SEQ ID NO: 1940212 - RNA, 22 nt, Homo sapiens
uguaauagaaauaaaccuauga

SEQ ID NO: 1940213 - RNA, 22 nt, Homo sapiens
uagcucuuuuauuuuccugcug

SEQ ID NO: 1940214 - RNA, 22 nt, Homo sapiens
cacaguuguuuguguaggaaca

SEQ ID NO: 1940215 - RNA, 23 nt, Homo sapiens
cuuguuucacacuagucacauuc

SEQ ID NO: 1940216 - RNA, 13 nt, Homo sapiens
ccaaccaguuuga

SEQ ID NO: 1940217 - RNA, 18 nt, Homo sapiens
uguggcuuauggauucau

SEQ ID NO: 1940218 - RNA, 22 nt, Homo sapiens
aggucaccgcgaggccuauugu

SEQ ID NO: 1940219 - RNA, 15 nt, Homo sapiens
gauaaagaauauuua

SEQ ID NO: 1940220 - RNA, 21 nt, Homo sapiens
cugcaccaccgaccaacucca

SEQ ID NO: 1940221 - RNA, 19 nt, Homo sapiens
gauguaccaggcucucgca

SEQ ID NO: 1940222 - RNA, 17 nt, Homo sapiens
agauuucagggagacaa

SEQ ID NO: 1940223 - RNA, 18 nt, Homo sapiens
ugaggaaaugccacaaau

SEQ ID NO: 1940224 - RNA, 14 nt, Homo sapiens
auaauagaugaugg

SEQ ID NO: 1940225 - RNA, 22 nt, Homo sapiens
cugacuuugcccccuugcccau

SEQ ID NO: 1940226 - RNA, 20 nt, Homo sapiens
cagaaacuccagacuuguag

SEQ ID NO: 1940227 - RNA, 14 nt, Homo sapiens
ucagugaaguagca

SEQ ID NO: 1940228 - RNA, 19 nt, Homo sapiens
augaaaugauaaagauguc

SEQ ID NO: 1940229 - RNA, 21 nt, Homo sapiens
auaaguguguguuuuucauaa

SEQ ID NO: 1940230 - RNA, 21 nt, Homo sapiens
uguuaguauuuuaauccugua

SEQ ID NO: 1940231 - RNA, 17 nt, Homo sapiens
aaaugaauuuaucauuu

SEQ ID NO: 1940232 - RNA, 13 nt, Homo sapiens
ccagacagcuccc

SEQ ID NO: 1940233 - RNA, 17 nt, Homo sapiens
uaugccuaaucuguaau

SEQ ID NO: 1940234 - RNA, 21 nt, Homo sapiens
agacacccaguggaaccaaaa

SEQ ID NO: 1940235 - RNA, 19 nt, Homo sapiens
caagcuuggucaaacuuuu

SEQ ID NO: 1940236 - RNA, 13 nt, Homo sapiens
uuaauuacaaaca

SEQ ID NO: 1940237 - RNA, 19 nt, Homo sapiens
caggugauguccuguaaac

SEQ ID NO: 1940238 - RNA, 13 nt, Homo sapiens
cuacugcuucaau

SEQ ID NO: 1940239 - RNA, 20 nt, Homo sapiens
cugaaguacuaacacaagga

SEQ ID NO: 1940240 - RNA, 17 nt, Homo sapiens
cauuuuuuaaaaaagca

SEQ ID NO: 1940241 - RNA, 17 nt, Homo sapiens
acacguccuuuccugaa

SEQ ID NO: 1940242 - RNA, 19 nt, Homo sapiens
ggcuccagcucuggcacag

SEQ ID NO: 1940243 - RNA, 17 nt, Homo sapiens
cuguuuucccauugcag

SEQ ID NO: 1940244 - RNA, 12 nt, Homo sapiens
uaacauugcuga

SEQ ID NO: 1940245 - RNA, 22 nt, Homo sapiens
cugcaaccuucgccucccagga

SEQ ID NO: 1940246 - RNA, 19 nt, Homo sapiens
aaauuucucuacugucuca

SEQ ID NO: 1940247 - RNA, 18 nt, Homo sapiens
aaggaacauguacuguua

SEQ ID NO: 1940248 - RNA, 15 nt, Homo sapiens
ucauacuacauacaa

SEQ ID NO: 1940249 - RNA, 16 nt, Homo sapiens
uggcuguggggacccc

SEQ ID NO: 1940250 - RNA, 18 nt, Homo sapiens
uugccagaugcaauacaa

SEQ ID NO: 1940251 - RNA, 21 nt, Homo sapiens
cagaaucuuguccaaguuguu

SEQ ID NO: 1940252 - RNA, 18 nt, Homo sapiens
gccugaucuccaggcaaa

SEQ ID NO: 1940253 - RNA, 13 nt, Homo sapiens
augggacugaugu

SEQ ID NO: 1940254 - RNA, 18 nt, Homo sapiens
cuuuggacauggaaagaa

SEQ ID NO: 1940255 - RNA, 17 nt, Homo sapiens
aagaaauuuuucuagua

SEQ ID NO: 1940256 - RNA, 13 nt, Homo sapiens
auggaagaguuaa

SEQ ID NO: 1940257 - RNA, 17 nt, Homo sapiens
cuagccccucacuucca

SEQ ID NO: 1940258 - RNA, 23 nt, Homo sapiens
ggagcugccgcaaggcccugucc

SEQ ID NO: 1940259 - RNA, 19 nt, Homo sapiens
gucuguccauuaucuauau

SEQ ID NO: 1940260 - RNA, 20 nt, Homo sapiens
aacuccgugcuuaaccaaag

SEQ ID NO: 1940261 - RNA, 16 nt, Homo sapiens
uucauuguaugaugug

SEQ ID NO: 1940262 - RNA, 16 nt, Homo sapiens
cuaugcuguucacugg

SEQ ID NO: 1940263 - RNA, 20 nt, Homo sapiens
gagcaaauugacaugcuguu

SEQ ID NO: 1940264 - RNA, 19 nt, Homo sapiens
uacccugcucaacauuuaa

SEQ ID NO: 1940265 - RNA, 23 nt, Homo sapiens
cauaauuucuucacucaaucucu

SEQ ID NO: 1940266 - RNA, 23 nt, Homo sapiens
gaagugugaggcggcccugacca

SEQ ID NO: 1940267 - RNA, 12 nt, Homo sapiens
ccugcagcaugu

SEQ ID NO: 1940268 - RNA, 16 nt, Homo sapiens
aagcugauuuuugucu

SEQ ID NO: 1940269 - RNA, 20 nt, Homo sapiens
augccagcuguacugaguuc

SEQ ID NO: 1940270 - RNA, 23 nt, Homo sapiens
gacaauaugauuuuaaauuugaa

SEQ ID NO: 1940271 - RNA, 21 nt, Homo sapiens
ggagcuagcugaguaugcuga

SEQ ID NO: 1940272 - RNA, 19 nt, Homo sapiens
aagaguuucuuaacuuacu

SEQ ID NO: 1940273 - RNA, 22 nt, Homo sapiens
augagcaauucuccugccucag

SEQ ID NO: 1940274 - RNA, 17 nt, Homo sapiens
acauauuuauugugcau

SEQ ID NO: 1940275 - RNA, 18 nt, Homo sapiens
cugcagacaaaaagaaca

SEQ ID NO: 1940276 - RNA, 12 nt, Homo sapiens
uggacaaaucac

SEQ ID NO: 1940277 - RNA, 12 nt, Homo sapiens
gcaccaaaggga

SEQ ID NO: 1940278 - RNA, 14 nt, Homo sapiens
cuucucugucucug

SEQ ID NO: 1940279 - RNA, 18 nt, Homo sapiens
auacugcuguauaaggua

SEQ ID NO: 1940280 - RNA, 16 nt, Homo sapiens
ugggauuugcugugua

SEQ ID NO: 1940281 - RNA, 16 nt, Homo sapiens
agcuuacuagcacuuu

SEQ ID NO: 1940282 - RNA, 22 nt, Homo sapiens
uucauuuaggugaggaagcaaa

SEQ ID NO: 1940283 - RNA, 20 nt, Homo sapiens
acauaugucugucuuugcaa

SEQ ID NO: 1940284 - RNA, 20 nt, Homo sapiens
gggccgggaggcagugcuga

SEQ ID NO: 1940285 - RNA, 21 nt, Homo sapiens
ccaacauuaaaagccaccccc

SEQ ID NO: 1940286 - RNA, 16 nt, Homo sapiens
uaacauuuccucuuuc

SEQ ID NO: 1940287 - RNA, 12 nt, Homo sapiens
cucuugacuacu

SEQ ID NO: 1940288 - RNA, 17 nt, Homo sapiens
gugcacugucacuuugc

SEQ ID NO: 1940289 - RNA, 23 nt, Homo sapiens
ugccugcuuuucacugcugcaag

SEQ ID NO: 1940290 - RNA, 22 nt, Homo sapiens
auugaaccuuugugcccuauca

SEQ ID NO: 1940291 - RNA, 19 nt, Homo sapiens
uucuaaauaaaaagcauua

SEQ ID NO: 1940292 - RNA, 14 nt, Homo sapiens
aguccgcucuucca

SEQ ID NO: 1940293 - RNA, 15 nt, Homo sapiens
cccaaaaugugaugc

SEQ ID NO: 1940294 - RNA, 16 nt, Homo sapiens
cccagccuguggugcu

SEQ ID NO: 1940295 - RNA, 19 nt, Homo sapiens
uguauugugcgcuaaacuu

SEQ ID NO: 1940296 - RNA, 21 nt, Homo sapiens
agucacuuaacuuacaugacu

SEQ ID NO: 1940297 - RNA, 19 nt, Homo sapiens
cuugcaugaauuacuguau

SEQ ID NO: 1940298 - RNA, 22 nt, Homo sapiens
agccuggccccaggccccagac

SEQ ID NO: 1940299 - RNA, 18 nt, Homo sapiens
uaaaaaugaaugucuugu

SEQ ID NO: 1940300 - RNA, 19 nt, Homo sapiens
uaaugagcguuaacacagu

SEQ ID NO: 1940301 - RNA, 11 nt, Homo sapiens
caacaggaaau

SEQ ID NO: 1940302 - RNA, 16 nt, Homo sapiens
gcugugugcucuccaa

SEQ ID NO: 1940303 - RNA, 19 nt, Homo sapiens
uuauuaaaguacaaccaua

SEQ ID NO: 1940304 - RNA, 19 nt, Homo sapiens
aggggagagaagguggucu

SEQ ID NO: 1940305 - RNA, 17 nt, Homo sapiens
gcaccuccagccugaac

SEQ ID NO: 1940306 - RNA, 12 nt, Homo sapiens
ucucuacuuuaa

SEQ ID NO: 1940307 - RNA, 14 nt, Homo sapiens
uuaaggucauaaaa

SEQ ID NO: 1940308 - RNA, 16 nt, Homo sapiens
gagcacauagagcuuu

SEQ ID NO: 1940309 - RNA, 15 nt, Homo sapiens
uccuucuauacaugu

SEQ ID NO: 1940310 - RNA, 20 nt, Homo sapiens
uagacaaaccaucuccuccu

SEQ ID NO: 1940311 - RNA, 18 nt, Homo sapiens
auggaacaggcucagauc

SEQ ID NO: 1940312 - RNA, 20 nt, Homo sapiens
accuugugacccagcacugc

SEQ ID NO: 1940313 - RNA, 15 nt, Homo sapiens
ggccaugggugcaug

SEQ ID NO: 1940314 - RNA, 22 nt, Homo sapiens
uuuucuaaaugcuuuuccuuug

SEQ ID NO: 1940315 - RNA, 15 nt, Homo sapiens
caagacccucucagg

SEQ ID NO: 1940316 - RNA, 22 nt, Homo sapiens
uauaaacugagaggucacaaag

SEQ ID NO: 1940317 - RNA, 23 nt, Homo sapiens
uacuguuuugggccuccaugccc

SEQ ID NO: 1940318 - RNA, 18 nt, Homo sapiens
cuuucucugccagugaca

SEQ ID NO: 1940319 - RNA, 12 nt, Homo sapiens
ucucuaucauua

SEQ ID NO: 1940320 - RNA, 13 nt, Homo sapiens
ucaacauuucuca

SEQ ID NO: 1940321 - RNA, 13 nt, Homo sapiens
ccucaauuccaac

SEQ ID NO: 1940322 - RNA, 19 nt, Homo sapiens
cccagcucuucucuuccua

SEQ ID NO: 1940323 - RNA, 23 nt, Homo sapiens
aaauuauguuugccacuuugcaa

SEQ ID NO: 1940324 - RNA, 21 nt, Homo sapiens
uccacugaaaccucuguucuc

SEQ ID NO: 1940325 - RNA, 21 nt, Homo sapiens
cugagcagcauggauucugca

SEQ ID NO: 1940326 - RNA, 20 nt, Homo sapiens
cucaguaacacagugcagug

SEQ ID NO: 1940327 - RNA, 15 nt, Homo sapiens
cauccccuuuccucc

SEQ ID NO: 1940328 - RNA, 21 nt, Homo sapiens
agaccuaccucagguugcugg

SEQ ID NO: 1940329 - RNA, 19 nt, Homo sapiens
uuuuuccuagccuguuucu

SEQ ID NO: 1940330 - RNA, 15 nt, Homo sapiens
ucugcuggucuucaa

SEQ ID NO: 1940331 - RNA, 21 nt, Homo sapiens
caugcaagaacucaucacugu

SEQ ID NO: 1940332 - RNA, 17 nt, Homo sapiens
cauuguuaccucuauau

SEQ ID NO: 1940333 - RNA, 22 nt, Homo sapiens
auuagcauucugguuuugacau

SEQ ID NO: 1940334 - RNA, 16 nt, Homo sapiens
cgccuggguccuccca

SEQ ID NO: 1940335 - RNA, 16 nt, Homo sapiens
uggaacagucuuccca

SEQ ID NO: 1940336 - RNA, 14 nt, Homo sapiens
aaguuaacaucaag

SEQ ID NO: 1940337 - RNA, 14 nt, Homo sapiens
acacucaacaauaa

SEQ ID NO: 1940338 - RNA, 16 nt, Homo sapiens
gcuucugugcaccugg

SEQ ID NO: 1940339 - RNA, 16 nt, Homo sapiens
gcacuaaugcuuuaag

SEQ ID NO: 1940340 - RNA, 18 nt, Homo sapiens
ucuuuacuaacacuggcu

SEQ ID NO: 1940341 - RNA, 21 nt, Homo sapiens
gcugcuggaggaaaacugaga

SEQ ID NO: 1940342 - RNA, 23 nt, Homo sapiens
gcuggagagaacacagugcuauu

SEQ ID NO: 1940343 - RNA, 21 nt, Homo sapiens
uucaggacgguugucacuuau

SEQ ID NO: 1940344 - RNA, 22 nt, Homo sapiens
acauucuuauaaauaugaagcu

SEQ ID NO: 1940345 - RNA, 23 nt, Homo sapiens
ucaggugccgggcgcaggaacug

SEQ ID NO: 1940346 - RNA, 13 nt, Homo sapiens
cugagcuuugaaa

SEQ ID NO: 1940347 - RNA, 16 nt, Homo sapiens
agacucuuaccuacaa

SEQ ID NO: 1940348 - RNA, 17 nt, Homo sapiens
aguaugguggguugguu

SEQ ID NO: 1940349 - RNA, 14 nt, Homo sapiens
guuucucuauugua

SEQ ID NO: 1940350 - RNA, 14 nt, Homo sapiens
agcuguugaaguca

SEQ ID NO: 1940351 - RNA, 16 nt, Homo sapiens
uaaauuuaacaaguga

SEQ ID NO: 1940352 - RNA, 14 nt, Homo sapiens
agcuacauguucuu

SEQ ID NO: 1940353 - RNA, 13 nt, Homo sapiens
ggcugguuugcaa

SEQ ID NO: 1940354 - RNA, 12 nt, Homo sapiens
uagcagcuauau

SEQ ID NO: 1940355 - RNA, 18 nt, Homo sapiens
augcaauuugauaaucag

SEQ ID NO: 1940356 - RNA, 21 nt, Homo sapiens
ucaagguuuuaaaacagucua

SEQ ID NO: 1940357 - RNA, 20 nt, Homo sapiens
cuaggaagagucuacccgac

SEQ ID NO: 1940358 - RNA, 18 nt, Homo sapiens
acucucaccaaaugagaa

SEQ ID NO: 1940359 - RNA, 24 nt, Homo sapiens
uucuauguacuaguacuguguacu

SEQ ID NO: 1940360 - RNA, 20 nt, Homo sapiens
cauauauacacacacaaaga

SEQ ID NO: 1940361 - RNA, 14 nt, Homo sapiens
caagcgacgacaga

SEQ ID NO: 1940362 - RNA, 15 nt, Homo sapiens
gggaucacagcguuu

SEQ ID NO: 1940363 - RNA, 19 nt, Homo sapiens
uggcaaccuggcucuggcc

SEQ ID NO: 1940364 - RNA, 16 nt, Homo sapiens
aucuucuuuccaccuu

SEQ ID NO: 1940365 - RNA, 13 nt, Homo sapiens
uuacacucuugau

SEQ ID NO: 1940366 - RNA, 17 nt, Homo sapiens
uaugacacucuagucaa

SEQ ID NO: 1940367 - RNA, 15 nt, Homo sapiens
ucagugaaagccaga

SEQ ID NO: 1940368 - RNA, 18 nt, Homo sapiens
ucugccaaucuguacaaa

SEQ ID NO: 1940369 - RNA, 14 nt, Homo sapiens
uccauacuuuggau

SEQ ID NO: 1940370 - RNA, 19 nt, Homo sapiens
cuaaucauccaaugcucaa

SEQ ID NO: 1940371 - RNA, 21 nt, Homo sapiens
acagaaaaccucaagggcuuu

SEQ ID NO: 1940372 - RNA, 20 nt, Homo sapiens
ggagacuuaauagacauuuu

SEQ ID NO: 1940373 - RNA, 17 nt, Homo sapiens
aaauacugauacaucca

SEQ ID NO: 1940374 - RNA, 14 nt, Homo sapiens
cugccagacacugc

SEQ ID NO: 1940375 - RNA, 15 nt, Homo sapiens
uguauacaccaagug

SEQ ID NO: 1940376 - RNA, 18 nt, Homo sapiens
gaaaagguccuugccucc

SEQ ID NO: 1940377 - RNA, 19 nt, Homo sapiens
aauguauuuugaaaacacu

SEQ ID NO: 1940378 - RNA, 21 nt, Homo sapiens
uaacugaaggagaaggugccc

SEQ ID NO: 1940379 - RNA, 13 nt, Homo sapiens
aacaaaauggacu

SEQ ID NO: 1940380 - RNA, 19 nt, Homo sapiens
agcaucccauuuugccaau

SEQ ID NO: 1940381 - RNA, 20 nt, Homo sapiens
aaugacagagagaggcagau

SEQ ID NO: 1940382 - RNA, 16 nt, Homo sapiens
ucaccugggcugugau

SEQ ID NO: 1940383 - RNA, 17 nt, Homo sapiens
cagcugccaguguccug

SEQ ID NO: 1940384 - RNA, 22 nt, Homo sapiens
cucauaugccaccccaugugcc

SEQ ID NO: 1940385 - RNA, 18 nt, Homo sapiens
ucccuugcuuagccugug

SEQ ID NO: 1940386 - RNA, 21 nt, Homo sapiens
cccuccauccggcuccuguca

SEQ ID NO: 1940387 - RNA, 19 nt, Homo sapiens
uguuuuuuuuuuccacuua

SEQ ID NO: 1940388 - RNA, 19 nt, Homo sapiens
auagccacuugcucagcca

SEQ ID NO: 1940389 - RNA, 22 nt, Homo sapiens
ugaauaaacugaaaauggaccu

SEQ ID NO: 1940390 - RNA, 12 nt, Homo sapiens
uaaugcuuuuau

SEQ ID NO: 1940391 - RNA, 16 nt, Homo sapiens
auuugaaugcuuaauu

SEQ ID NO: 1940392 - RNA, 20 nt, Homo sapiens
cauauaacgcagucuaauua

SEQ ID NO: 1940393 - RNA, 23 nt, Homo sapiens
cagagaucacacacaccaaacca

SEQ ID NO: 1940394 - RNA, 16 nt, Homo sapiens
caguuagguagcuuua

SEQ ID NO: 1940395 - RNA, 18 nt, Homo sapiens
caaaaagccacaaugaac

SEQ ID NO: 1940396 - RNA, 13 nt, Homo sapiens
uuaagaaauucca

SEQ ID NO: 1940397 - RNA, 17 nt, Homo sapiens
caggagaccuggcacug

SEQ ID NO: 1940398 - RNA, 18 nt, Homo sapiens
gagucuccucucugagac

SEQ ID NO: 1940399 - RNA, 15 nt, Homo sapiens
cucgagaugggugcu

SEQ ID NO: 1940400 - RNA, 22 nt, Homo sapiens
guccaguacaaaagcacuggaa

SEQ ID NO: 1940401 - RNA, 16 nt, Homo sapiens
acauuggaaagcacac

SEQ ID NO: 1940402 - RNA, 15 nt, Homo sapiens
cuaaugauguucucu

SEQ ID NO: 1940403 - RNA, 16 nt, Homo sapiens
caaggauccugugcug

SEQ ID NO: 1940404 - RNA, 19 nt, Homo sapiens
auuuuguuuuugucuuaaa

SEQ ID NO: 1940405 - RNA, 18 nt, Homo sapiens
cuuugcucuuucuugacu

SEQ ID NO: 1940406 - RNA, 17 nt, Homo sapiens
aguagccucugggaucu

SEQ ID NO: 1940407 - RNA, 20 nt, Homo sapiens
cucuuacguuuaacauacaa

SEQ ID NO: 1940408 - RNA, 15 nt, Homo sapiens
uggagcccgugcagu

SEQ ID NO: 1940409 - RNA, 20 nt, Homo sapiens
uuccauuuccaguucaucua

SEQ ID NO: 1940410 - RNA, 20 nt, Homo sapiens
cuccagcccagacccagugg

SEQ ID NO: 1940411 - RNA, 21 nt, Homo sapiens
acucuguccacucuuguucaa

SEQ ID NO: 1940412 - RNA, 21 nt, Homo sapiens
cagggaggggucccugcaaaa

SEQ ID NO: 1940413 - RNA, 13 nt, Homo sapiens
uuauuguauauau

SEQ ID NO: 1940414 - RNA, 13 nt, Homo sapiens
uauuuguauuaau

SEQ ID NO: 1940415 - RNA, 17 nt, Homo sapiens
guccuuccuugacuguc

SEQ ID NO: 1940416 - RNA, 18 nt, Homo sapiens
cuggugaaggaucuugcc

SEQ ID NO: 1940417 - RNA, 21 nt, Homo sapiens
augaugaaaacuaaggauuuu

SEQ ID NO: 1940418 - RNA, 13 nt, Homo sapiens
caacucacuucca

SEQ ID NO: 1940419 - RNA, 15 nt, Homo sapiens
gucagcaugucucag

SEQ ID NO: 1940420 - RNA, 19 nt, Homo sapiens
uaaaagcagcaucugcuaa

SEQ ID NO: 1940421 - RNA, 12 nt, Homo sapiens
ggguccaccagg

SEQ ID NO: 1940422 - RNA, 16 nt, Homo sapiens
uguggagcagagcucu

SEQ ID NO: 1940423 - RNA, 14 nt, Homo sapiens
ccugguaccagagg

SEQ ID NO: 1940424 - RNA, 16 nt, Homo sapiens
aguaugcacuuggccu

SEQ ID NO: 1940425 - RNA, 16 nt, Homo sapiens
aagaacaacacuaauu

SEQ ID NO: 1940426 - RNA, 21 nt, Homo sapiens
cuuuaaaaaagcaaauuucau

SEQ ID NO: 1940427 - RNA, 14 nt, Homo sapiens
uaaaaucuaauuca

SEQ ID NO: 1940428 - RNA, 22 nt, Homo sapiens
guauggucuuggcagcaccugu

SEQ ID NO: 1940429 - RNA, 17 nt, Homo sapiens
ucaaacuagugcaugaa

SEQ ID NO: 1940430 - RNA, 14 nt, Homo sapiens
uggccucaucucag

SEQ ID NO: 1940431 - RNA, 12 nt, Homo sapiens
acuuaauggcac

SEQ ID NO: 1940432 - RNA, 17 nt, Homo sapiens
uguaaucccagcacuug

SEQ ID NO: 1940433 - RNA, 20 nt, Homo sapiens
cuauguaucuaccaucuaau

SEQ ID NO: 1940434 - RNA, 19 nt, Homo sapiens
aaauaaauucugacuuaug

SEQ ID NO: 1940435 - RNA, 19 nt, Homo sapiens
ccucagaaggccccagaga

SEQ ID NO: 1940436 - RNA, 15 nt, Homo sapiens
agucugucucuguca

SEQ ID NO: 1940437 - RNA, 11 nt, Homo sapiens
guacagauuag

SEQ ID NO: 1940438 - RNA, 20 nt, Homo sapiens
ccuuacaacucggggacaaa

SEQ ID NO: 1940439 - RNA, 22 nt, Homo sapiens
ccccuguauucucagcacuuug

SEQ ID NO: 1940440 - RNA, 13 nt, Homo sapiens
uccuauaccuuac

SEQ ID NO: 1940441 - RNA, 11 nt, Homo sapiens
gcuggcugugc

SEQ ID NO: 1940442 - RNA, 18 nt, Homo sapiens
acacagcccagaaggcca

SEQ ID NO: 1940443 - RNA, 21 nt, Homo sapiens
ggaaacagagaacccuguggg

SEQ ID NO: 1940444 - RNA, 15 nt, Homo sapiens
cauggcucucugcag

SEQ ID NO: 1940445 - RNA, 21 nt, Homo sapiens
cauaaacaacuuaauguucug

SEQ ID NO: 1940446 - RNA, 21 nt, Homo sapiens
gagcacaggcaacauuacaaa

SEQ ID NO: 1940447 - RNA, 19 nt, Homo sapiens
cacauucugcuaugaauua

SEQ ID NO: 1940448 - RNA, 19 nt, Homo sapiens
uauguacuuuuccauuuau

SEQ ID NO: 1940449 - RNA, 22 nt, Homo sapiens
guuuauguaacuuccuguggau

SEQ ID NO: 1940450 - RNA, 20 nt, Homo sapiens
gugcuuucauauuuuccaaa

SEQ ID NO: 1940451 - RNA, 21 nt, Homo sapiens
auugccaauaaugugugagaa

SEQ ID NO: 1940452 - RNA, 21 nt, Homo sapiens
guuucccaaugguguuuuucu

SEQ ID NO: 1940453 - RNA, 14 nt, Homo sapiens
auacucaugaauga

SEQ ID NO: 1940454 - RNA, 23 nt, Homo sapiens
auguuugaaaauuagagaucaug

SEQ ID NO: 1940455 - RNA, 19 nt, Homo sapiens
gacccacgaacgcucuuag

SEQ ID NO: 1940456 - RNA, 15 nt, Homo sapiens
auaauauguacaaau

SEQ ID NO: 1940457 - RNA, 13 nt, Homo sapiens
agugugcugggca

SEQ ID NO: 1940458 - RNA, 17 nt, Homo sapiens
uuuguccacccacuuag

SEQ ID NO: 1940459 - RNA, 15 nt, Homo sapiens
cucgugugauuuccu

SEQ ID NO: 1940460 - RNA, 18 nt, Homo sapiens
uugggaaguuacuguuac

SEQ ID NO: 1940461 - RNA, 17 nt, Homo sapiens
agcaccuacuuacaugc

SEQ ID NO: 1940462 - RNA, 13 nt, Homo sapiens
ccauauacauaua

SEQ ID NO: 1940463 - RNA, 14 nt, Homo sapiens
gaaaccccaucucu

SEQ ID NO: 1940464 - RNA, 15 nt, Homo sapiens
cauuuuaagugcaug

SEQ ID NO: 1940465 - RNA, 14 nt, Homo sapiens
uaaaacuugguucu

SEQ ID NO: 1940466 - RNA, 16 nt, Homo sapiens
uggaagacuucuaaag

SEQ ID NO: 1940467 - RNA, 13 nt, Homo sapiens
uccuuaaaauaaa

SEQ ID NO: 1940468 - RNA, 16 nt, Homo sapiens
gcaguauggccauggg

SEQ ID NO: 1940469 - RNA, 16 nt, Homo sapiens
accgauagcaggugaa

SEQ ID NO: 1940470 - RNA, 23 nt, Homo sapiens
ugauguccaaacuuaacagauca

SEQ ID NO: 1940471 - RNA, 21 nt, Homo sapiens
uuggagagcagcaggugcugu

SEQ ID NO: 1940472 - RNA, 23 nt, Homo sapiens
ucugucaggcauugaaugacaag

SEQ ID NO: 1940473 - RNA, 20 nt, Homo sapiens
uuugucaacaaaaagacaug

SEQ ID NO: 1940474 - RNA, 17 nt, Homo sapiens
accuauccuuacauuuc

SEQ ID NO: 1940475 - RNA, 20 nt, Homo sapiens
caucuuuaucuguucuugcu

SEQ ID NO: 1940476 - RNA, 24 nt, Homo sapiens
uuuccuggcacugcuuccagugag

SEQ ID NO: 1940477 - RNA, 22 nt, Homo sapiens
ucgacuugaucgugcagcugcu

SEQ ID NO: 1940478 - RNA, 15 nt, Homo sapiens
gagguuaagcacuuu

SEQ ID NO: 1940479 - RNA, 13 nt, Homo sapiens
guccaucucugaa

SEQ ID NO: 1940480 - RNA, 15 nt, Homo sapiens
uguaauggucucuga

SEQ ID NO: 1940481 - RNA, 16 nt, Homo sapiens
auuuuuuugaacucuu

SEQ ID NO: 1940482 - RNA, 13 nt, Homo sapiens
uugccauguguuu

SEQ ID NO: 1940483 - RNA, 23 nt, Homo sapiens
cacaccuuggagaaguggcauca

SEQ ID NO: 1940484 - RNA, 16 nt, Homo sapiens
gagagagccacggaga

SEQ ID NO: 1940485 - RNA, 15 nt, Homo sapiens
cuuucuuucauucuc

SEQ ID NO: 1940486 - RNA, 19 nt, Homo sapiens
agacaggagaaacacuuga

SEQ ID NO: 1940487 - RNA, 20 nt, Homo sapiens
agcaguccagagucuaggca

SEQ ID NO: 1940488 - RNA, 11 nt, Homo sapiens
auaaagacaga

SEQ ID NO: 1940489 - RNA, 11 nt, Homo sapiens
uuuaagacugu

SEQ ID NO: 1940490 - RNA, 13 nt, Homo sapiens
gggaagaaacgga

SEQ ID NO: 1940491 - RNA, 19 nt, Homo sapiens
caaguauaacaacuuugaa

SEQ ID NO: 1940492 - RNA, 20 nt, Homo sapiens
auggcuacuaagcacaugaa

SEQ ID NO: 1940493 - RNA, 15 nt, Homo sapiens
uauggaaaugugaga

SEQ ID NO: 1940494 - RNA, 17 nt, Homo sapiens
acucacuucucagcuga

SEQ ID NO: 1940495 - RNA, 19 nt, Homo sapiens
uccuugugaagaugauaua

SEQ ID NO: 1940496 - RNA, 17 nt, Homo sapiens
agaggaagagugcaaaa

SEQ ID NO: 1940497 - RNA, 19 nt, Homo sapiens
ccaaagcccucccuaccua

SEQ ID NO: 1940498 - RNA, 15 nt, Homo sapiens
aacagugaaagcccu

SEQ ID NO: 1940499 - RNA, 19 nt, Homo sapiens
cagcccugggcacauagca

SEQ ID NO: 1940500 - RNA, 21 nt, Homo sapiens
ugguaauauaguuauugcaca

SEQ ID NO: 1940501 - RNA, 20 nt, Homo sapiens
agaaguccccuuccauccca

SEQ ID NO: 1940502 - RNA, 14 nt, Homo sapiens
cugaaagcacugua

SEQ ID NO: 1940503 - RNA, 14 nt, Homo sapiens
uuuuaaaugacuug

SEQ ID NO: 1940504 - RNA, 20 nt, Homo sapiens
agccuucuuguguaauguaa

SEQ ID NO: 1940505 - RNA, 15 nt, Homo sapiens
agggguuucuucaag

SEQ ID NO: 1940506 - RNA, 16 nt, Homo sapiens
ugacaauguugcauuu

SEQ ID NO: 1940507 - RNA, 22 nt, Homo sapiens
acuugaggccugagacacagcc

SEQ ID NO: 1940508 - RNA, 15 nt, Homo sapiens
caggagacauuacua

SEQ ID NO: 1940509 - RNA, 19 nt, Homo sapiens
uacaaacaaaggauuugaa

SEQ ID NO: 1940510 - RNA, 18 nt, Homo sapiens
guauuuugcuagugcauu

SEQ ID NO: 1940511 - RNA, 15 nt, Homo sapiens
ggagugguuccugug

SEQ ID NO: 1940512 - RNA, 20 nt, Homo sapiens
agagacugcuugacaaagga

SEQ ID NO: 1940513 - RNA, 15 nt, Homo sapiens
uggaagacaaauaca

SEQ ID NO: 1940514 - RNA, 16 nt, Homo sapiens
acccucccacucccau

SEQ ID NO: 1940515 - RNA, 21 nt, Homo sapiens
cuaguuuuugacuugcuccua

SEQ ID NO: 1940516 - RNA, 24 nt, Homo sapiens
gaaacacaaacgauuuggaucaaa

SEQ ID NO: 1940517 - RNA, 22 nt, Homo sapiens
aguuuggcugcugucauaacau

SEQ ID NO: 1940518 - RNA, 17 nt, Homo sapiens
uugcaauugcucuucuc

SEQ ID NO: 1940519 - RNA, 13 nt, Homo sapiens
caccaucuggaag

SEQ ID NO: 1940520 - RNA, 18 nt, Homo sapiens
cauugguuuuuguaguau

SEQ ID NO: 1940521 - RNA, 14 nt, Homo sapiens
cagcagcacccaug

SEQ ID NO: 1940522 - RNA, 17 nt, Homo sapiens
gcaacauuuguauggau

SEQ ID NO: 1940523 - RNA, 13 nt, Homo sapiens
cgccagcugggag

SEQ ID NO: 1940524 - RNA, 21 nt, Homo sapiens
uuuauggauuaaaaacugcuu

SEQ ID NO: 1940525 - RNA, 11 nt, Homo sapiens
cuuauguuaca

SEQ ID NO: 1940526 - RNA, 18 nt, Homo sapiens
gaggcagcacgugcacaa

SEQ ID NO: 1940527 - RNA, 16 nt, Homo sapiens
auuuaaagaaaaccac

SEQ ID NO: 1940528 - RNA, 17 nt, Homo sapiens
caaauuuucacauaaaa

SEQ ID NO: 1940529 - RNA, 22 nt, Homo sapiens
gaucacacacaccaaaccagac

SEQ ID NO: 1940530 - RNA, 17 nt, Homo sapiens
gccuuggauacuccaug

SEQ ID NO: 1940531 - RNA, 21 nt, Homo sapiens
auauuaaaaguuaagcaaaua

SEQ ID NO: 1940532 - RNA, 19 nt, Homo sapiens
uuccccucaacaugcugcc

SEQ ID NO: 1940533 - RNA, 19 nt, Homo sapiens
uaggaaaaaaagauuucca

SEQ ID NO: 1940534 - RNA, 20 nt, Homo sapiens
aaugacacagucuuggcuca

SEQ ID NO: 1940535 - RNA, 18 nt, Homo sapiens
cuucuucccucccuaucu

SEQ ID NO: 1940536 - RNA, 18 nt, Homo sapiens
gauuuguuaccaguaaaa

SEQ ID NO: 1940537 - RNA, 15 nt, Homo sapiens
aauuuguaaugauuu

SEQ ID NO: 1940538 - RNA, 13 nt, Homo sapiens
cuucucuuucaca

SEQ ID NO: 1940539 - RNA, 17 nt, Homo sapiens
ugaaaggcuuuccucag

SEQ ID NO: 1940540 - RNA, 14 nt, Homo sapiens
ccaugauacuuuaa

SEQ ID NO: 1940541 - RNA, 15 nt, Homo sapiens
gucaaggacuccugu

SEQ ID NO: 1940542 - RNA, 15 nt, Homo sapiens
caaaaggagaacugu

SEQ ID NO: 1940543 - RNA, 14 nt, Homo sapiens
uuugugaugcauuu

SEQ ID NO: 1940544 - RNA, 23 nt, Homo sapiens
gaacugugcauagugcugggaug

SEQ ID NO: 1940545 - RNA, 15 nt, Homo sapiens
cagcugcaucugaua

SEQ ID NO: 1940546 - RNA, 22 nt, Homo sapiens
acacuguauauaaacauaucaa

SEQ ID NO: 1940547 - RNA, 21 nt, Homo sapiens
caggugauccacccaccucag

SEQ ID NO: 1940548 - RNA, 18 nt, Homo sapiens
aaagucaaauuuacuuua

SEQ ID NO: 1940549 - RNA, 20 nt, Homo sapiens
ugaggucaggaguucaagac

SEQ ID NO: 1940550 - RNA, 20 nt, Homo sapiens
guccucagcugcucccacac

SEQ ID NO: 1940551 - RNA, 22 nt, Homo sapiens
cagacauuuucaauaaugugaa

SEQ ID NO: 1940552 - RNA, 15 nt, Homo sapiens
ugcuucccaaauaca

SEQ ID NO: 1940553 - RNA, 16 nt, Homo sapiens
ucuggccacugucaag

SEQ ID NO: 1940554 - RNA, 14 nt, Homo sapiens
ucccuaggcccaag

SEQ ID NO: 1940555 - RNA, 23 nt, Homo sapiens
gaaguggguggggacagaccagc

SEQ ID NO: 1940556 - RNA, 20 nt, Homo sapiens
aguauggugcuggguccuua

SEQ ID NO: 1940557 - RNA, 22 nt, Homo sapiens
ccacgagcuguuuacuagggau

SEQ ID NO: 1940558 - RNA, 20 nt, Homo sapiens
ccauacuucuguuuccaucu

SEQ ID NO: 1940559 - RNA, 21 nt, Homo sapiens
uaugacaaccucuuugagacg

SEQ ID NO: 1940560 - RNA, 16 nt, Homo sapiens
ggcuucucaauagagu

SEQ ID NO: 1940561 - RNA, 23 nt, Homo sapiens
ccucaaggguuauagacugccau

SEQ ID NO: 1940562 - RNA, 23 nt, Homo sapiens
gaccucuuccuccucgcugccag

SEQ ID NO: 1940563 - RNA, 22 nt, Homo sapiens
uccccggccacgucugugcucu

SEQ ID NO: 1940564 - RNA, 15 nt, Homo sapiens
gcuuugaaaaugcag

SEQ ID NO: 1940565 - RNA, 16 nt, Homo sapiens
uauuaaccuaccugug

SEQ ID NO: 1940566 - RNA, 16 nt, Homo sapiens
uauccuuacacucccc

SEQ ID NO: 1940567 - RNA, 20 nt, Homo sapiens
aucucggcucacugcaagcu

SEQ ID NO: 1940568 - RNA, 23 nt, Homo sapiens
uagcaacugcuggggagacaaau

SEQ ID NO: 1940569 - RNA, 22 nt, Homo sapiens
aagaaaauauagucacaggaaa

SEQ ID NO: 1940570 - RNA, 19 nt, Homo sapiens
auaugcccucaucauccca

SEQ ID NO: 1940571 - RNA, 20 nt, Homo sapiens
uucuguucugcaacuccauc

SEQ ID NO: 1940572 - RNA, 15 nt, Homo sapiens
ugcugaucgugcuaa

SEQ ID NO: 1940573 - RNA, 23 nt, Homo sapiens
cugucaacaaggggucaauguca

SEQ ID NO: 1940574 - RNA, 22 nt, Homo sapiens
gcccccacccaccuuccuugcg

SEQ ID NO: 1940575 - RNA, 15 nt, Homo sapiens
uuuaaccuacuagac

SEQ ID NO: 1940576 - RNA, 13 nt, Homo sapiens
uagauuucuaaag

SEQ ID NO: 1940577 - RNA, 22 nt, Homo sapiens
ugggcccaacaggcccuuggua

SEQ ID NO: 1940578 - RNA, 19 nt, Homo sapiens
cuauacuuucucacaugug

SEQ ID NO: 1940579 - RNA, 18 nt, Homo sapiens
auaaaagccgcccagugg

SEQ ID NO: 1940580 - RNA, 24 nt, Homo sapiens
augagagcagagcccccauggccu

SEQ ID NO: 1940581 - RNA, 16 nt, Homo sapiens
ucucccugccuguggc

SEQ ID NO: 1940582 - RNA, 23 nt, Homo sapiens
cccgggagacugaacugcagggu

SEQ ID NO: 1940583 - RNA, 22 nt, Homo sapiens
acaauuagucaaaccacuguua

SEQ ID NO: 1940584 - RNA, 21 nt, Homo sapiens
auaauuaaauuuugaguucua

SEQ ID NO: 1940585 - RNA, 15 nt, Homo sapiens
gcacuaacacugggu

SEQ ID NO: 1940586 - RNA, 15 nt, Homo sapiens
auaucuuuauugcau

SEQ ID NO: 1940587 - RNA, 23 nt, Homo sapiens
caagaccagagacccaacagcag

SEQ ID NO: 1940588 - RNA, 14 nt, Homo sapiens
gcagaauccagcua

SEQ ID NO: 1940589 - RNA, 13 nt, Homo sapiens
aaaugaacugacu

SEQ ID NO: 1940590 - RNA, 17 nt, Homo sapiens
cucacaucucccuucca

SEQ ID NO: 1940591 - RNA, 15 nt, Homo sapiens
accaacacugcucac

SEQ ID NO: 1940592 - RNA, 18 nt, Homo sapiens
cugcuguccccuuggcag

SEQ ID NO: 1940593 - RNA, 19 nt, Homo sapiens
gaaugagagcgacacagac

SEQ ID NO: 1940594 - RNA, 22 nt, Homo sapiens
aagucccucuccuggugcucca

SEQ ID NO: 1940595 - RNA, 23 nt, Homo sapiens
uguaguugggccuaaauaaauga

SEQ ID NO: 1940596 - RNA, 19 nt, Homo sapiens
cuucaagaagucacuguca

SEQ ID NO: 1940597 - RNA, 22 nt, Homo sapiens
uuuggauucuaaauacaugcca

SEQ ID NO: 1940598 - RNA, 22 nt, Homo sapiens
cuagaggcuuccuucauuuccu

SEQ ID NO: 1940599 - RNA, 14 nt, Homo sapiens
ucaccuuccagugu

SEQ ID NO: 1940600 - RNA, 16 nt, Homo sapiens
gcugcagugcaugggg

SEQ ID NO: 1940601 - RNA, 12 nt, Homo sapiens
uugugcugccag

SEQ ID NO: 1940602 - RNA, 20 nt, Homo sapiens
ccugaaauaaacacuggugc

SEQ ID NO: 1940603 - RNA, 23 nt, Homo sapiens
uugaagaaaauucagaaugaagu

SEQ ID NO: 1940604 - RNA, 22 nt, Homo sapiens
aucuaugaaauaucaugcucca

SEQ ID NO: 1940605 - RNA, 22 nt, Homo sapiens
uaauacuauauuuauacuguau

SEQ ID NO: 1940606 - RNA, 14 nt, Homo sapiens
gauaaaauccaaaa

SEQ ID NO: 1940607 - RNA, 20 nt, Homo sapiens
uccgaagagugaagggcagu

SEQ ID NO: 1940608 - RNA, 21 nt, Homo sapiens
gcucagccccagcuuaucucc

SEQ ID NO: 1940609 - RNA, 14 nt, Homo sapiens
ucuccaaaugagau

SEQ ID NO: 1940610 - RNA, 23 nt, Homo sapiens
guccaggggucugucugcuuugg

SEQ ID NO: 1940611 - RNA, 20 nt, Homo sapiens
uaaaaaguguuuaucuucag

SEQ ID NO: 1940612 - RNA, 17 nt, Homo sapiens
uccuaugcugcaauaca

SEQ ID NO: 1940613 - RNA, 23 nt, Homo sapiens
uguuuggcuuauaaacacauuga

SEQ ID NO: 1940614 - RNA, 13 nt, Homo sapiens
gcccagguugcug

SEQ ID NO: 1940615 - RNA, 13 nt, Homo sapiens
uaccccagucacu

SEQ ID NO: 1940616 - RNA, 17 nt, Homo sapiens
gaggcaccucaagaaga

SEQ ID NO: 1940617 - RNA, 15 nt, Homo sapiens
gcuagagugcagugg

SEQ ID NO: 1940618 - RNA, 15 nt, Homo sapiens
gcuggagugcaaugg

SEQ ID NO: 1940619 - RNA, 13 nt, Homo sapiens
agaucaaaacagu

SEQ ID NO: 1940620 - RNA, 22 nt, Homo sapiens
ucaagaagcguuaugugcagua

SEQ ID NO: 1940621 - RNA, 20 nt, Homo sapiens
gccuaaugcugugugaugca

SEQ ID NO: 1940622 - RNA, 12 nt, Homo sapiens
cauguacaucca

SEQ ID NO: 1940623 - RNA, 17 nt, Homo sapiens
cggcuuuucuuggccaa

SEQ ID NO: 1940624 - RNA, 13 nt, Homo sapiens
caaacugccaguu

SEQ ID NO: 1940625 - RNA, 19 nt, Homo sapiens
uaacccccaaauacucuga

SEQ ID NO: 1940626 - RNA, 14 nt, Homo sapiens
caucaucacuguaa

SEQ ID NO: 1940627 - RNA, 23 nt, Homo sapiens
aaguccgaggccuggcucuggag

SEQ ID NO: 1940628 - RNA, 21 nt, Homo sapiens
cuucaaaugcaaauucaucau

SEQ ID NO: 1940629 - RNA, 16 nt, Homo sapiens
uucccccuaauucuua

SEQ ID NO: 1940630 - RNA, 13 nt, Homo sapiens
gaaaacacuuuca

SEQ ID NO: 1940631 - RNA, 14 nt, Homo sapiens
uugcacugcugcau

SEQ ID NO: 1940632 - RNA, 21 nt, Homo sapiens
uacaaaagcaauuuucauuua

SEQ ID NO: 1940633 - RNA, 18 nt, Homo sapiens
agcuuuguguuuacuuuu

SEQ ID NO: 1940634 - RNA, 19 nt, Homo sapiens
gcuguaugcggaauuccac

SEQ ID NO: 1940635 - RNA, 21 nt, Homo sapiens
uaaggauaugagccuuugcac

SEQ ID NO: 1940636 - RNA, 23 nt, Homo sapiens
cucucuuuaaaucaaguccuuua

SEQ ID NO: 1940637 - RNA, 17 nt, Homo sapiens
cuguccaccaagaucaa

SEQ ID NO: 1940638 - RNA, 18 nt, Homo sapiens
cacgugugcacacacacc

SEQ ID NO: 1940639 - RNA, 18 nt, Homo sapiens
caggacauguacugagac

SEQ ID NO: 1940640 - RNA, 15 nt, Homo sapiens
agauuuggcccucau

SEQ ID NO: 1940641 - RNA, 17 nt, Homo sapiens
guccccaguuugcagaa

SEQ ID NO: 1940642 - RNA, 17 nt, Homo sapiens
ugucugugugcuacuaa

SEQ ID NO: 1940643 - RNA, 14 nt, Homo sapiens
acugaccaucugca

SEQ ID NO: 1940644 - RNA, 17 nt, Homo sapiens
gcagaggccaugaagaa

SEQ ID NO: 1940645 - RNA, 20 nt, Homo sapiens
aaauagcacacuuuuccaca

SEQ ID NO: 1940646 - RNA, 14 nt, Homo sapiens
uuguaauuaaggaa

SEQ ID NO: 1940647 - RNA, 19 nt, Homo sapiens
cuuggacuauuauaauuua

SEQ ID NO: 1940648 - RNA, 16 nt, Homo sapiens
cgccaaggcuggagug

SEQ ID NO: 1940649 - RNA, 13 nt, Homo sapiens
acuguucuaaagc

SEQ ID NO: 1940650 - RNA, 23 nt, Homo sapiens
aacugccuuauuaaagcaaaaau

SEQ ID NO: 1940651 - RNA, 16 nt, Homo sapiens
auauagcguucccaac

SEQ ID NO: 1940652 - RNA, 17 nt, Homo sapiens
acagacauuuuguguga

SEQ ID NO: 1940653 - RNA, 20 nt, Homo sapiens
acccccauucucaucugcac

SEQ ID NO: 1940654 - RNA, 15 nt, Homo sapiens
aggaccuuuccacca

SEQ ID NO: 1940655 - RNA, 22 nt, Homo sapiens
ccuuccaauccuuaaacugcca

SEQ ID NO: 1940656 - RNA, 12 nt, Homo sapiens
uggaaaauguuc

SEQ ID NO: 1940657 - RNA, 20 nt, Homo sapiens
aaacguggcaggacuuccau

SEQ ID NO: 1940658 - RNA, 13 nt, Homo sapiens
ccagugaaucugu

SEQ ID NO: 1940659 - RNA, 15 nt, Homo sapiens
uaaacuuccaaguca

SEQ ID NO: 1940660 - RNA, 11 nt, Homo sapiens
uaaagguuuau

SEQ ID NO: 1940661 - RNA, 20 nt, Homo sapiens
ucauuguauuuuuaacacca

SEQ ID NO: 1940662 - RNA, 14 nt, Homo sapiens
ugaguuguggugga

SEQ ID NO: 1940663 - RNA, 16 nt, Homo sapiens
gccaucccgucuucuc

SEQ ID NO: 1940664 - RNA, 16 nt, Homo sapiens
auuuauuaacuaauca

SEQ ID NO: 1940665 - RNA, 21 nt, Homo sapiens
gccgcauuccugcacucagaa

SEQ ID NO: 1940666 - RNA, 17 nt, Homo sapiens
uaugaauggagauuuga

SEQ ID NO: 1940667 - RNA, 21 nt, Homo sapiens
caagacuuauggaacagggau

SEQ ID NO: 1940668 - RNA, 12 nt, Homo sapiens
aguuaggauauu

SEQ ID NO: 1940669 - RNA, 13 nt, Homo sapiens
uuauucuuccuca

SEQ ID NO: 1940670 - RNA, 22 nt, Homo sapiens
ccagauuggcucacacugagaa

SEQ ID NO: 1940671 - RNA, 21 nt, Homo sapiens
uggggucuuugugguagcuua

SEQ ID NO: 1940672 - RNA, 14 nt, Homo sapiens
caugaagcaagaau

SEQ ID NO: 1940673 - RNA, 18 nt, Homo sapiens
cccagaggccaacacugu

SEQ ID NO: 1940674 - RNA, 17 nt, Homo sapiens
auaaaaacuuugcagaa

SEQ ID NO: 1940675 - RNA, 23 nt, Homo sapiens
aacacuugaugccguuucuuuca

SEQ ID NO: 1940676 - RNA, 23 nt, Homo sapiens
aggaaggaagcuguugcuuucuu

SEQ ID NO: 1940677 - RNA, 23 nt, Homo sapiens
gcuuccuccccucggaaggugcg

SEQ ID NO: 1940678 - RNA, 20 nt, Homo sapiens
uagauuagaaagacuuucua

SEQ ID NO: 1940679 - RNA, 17 nt, Homo sapiens
ucuuucuagcuaaugga

SEQ ID NO: 1940680 - RNA, 20 nt, Homo sapiens
ccuuuaggaagguauguguc

SEQ ID NO: 1940681 - RNA, 16 nt, Homo sapiens
auaccagcucagggga

SEQ ID NO: 1940682 - RNA, 15 nt, Homo sapiens
cauuauauuuaggga

SEQ ID NO: 1940683 - RNA, 18 nt, Homo sapiens
caucgugaucacugagcc

SEQ ID NO: 1940684 - RNA, 16 nt, Homo sapiens
uacaaaaaacugcagu

SEQ ID NO: 1940685 - RNA, 18 nt, Homo sapiens
cugguuuccgaaaggcaa

SEQ ID NO: 1940686 - RNA, 17 nt, Homo sapiens
aauuuauaaugaauacu

SEQ ID NO: 1940687 - RNA, 19 nt, Homo sapiens
gggacagacuaagggcgcu

SEQ ID NO: 1940688 - RNA, 16 nt, Homo sapiens
gaaaguacauuuggag

SEQ ID NO: 1940689 - RNA, 15 nt, Homo sapiens
ggcagaaccaaagcu

SEQ ID NO: 1940690 - RNA, 19 nt, Homo sapiens
uacccaccuagaacacuaa

SEQ ID NO: 1940691 - RNA, 18 nt, Homo sapiens
ccccugaccuuccaaacc

SEQ ID NO: 1940692 - RNA, 21 nt, Homo sapiens
cucaaugcuuuccacauuucu

SEQ ID NO: 1940693 - RNA, 21 nt, Homo sapiens
caugagccucagcauccuggc

SEQ ID NO: 1940694 - RNA, 12 nt, Homo sapiens
aguggcuucucu

SEQ ID NO: 1940695 - RNA, 18 nt, Homo sapiens
aaggaccucagcugcuuc

SEQ ID NO: 1940696 - RNA, 20 nt, Homo sapiens
agugcauuaaacugaaucac

SEQ ID NO: 1940697 - RNA, 21 nt, Homo sapiens
cacaguuggcccgggugcagg

SEQ ID NO: 1940698 - RNA, 13 nt, Homo sapiens
uucuuuaccucag

SEQ ID NO: 1940699 - RNA, 15 nt, Homo sapiens
guggacucucugaca

SEQ ID NO: 1940700 - RNA, 16 nt, Homo sapiens
cuagcauggcugccaa

SEQ ID NO: 1940701 - RNA, 11 nt, Homo sapiens
cccaguucucg

SEQ ID NO: 1940702 - RNA, 15 nt, Homo sapiens
auaaaauuauuccuu

SEQ ID NO: 1940703 - RNA, 15 nt, Homo sapiens
ucugggagucacaca

SEQ ID NO: 1940704 - RNA, 19 nt, Homo sapiens
agcaacauugacccagaaa

SEQ ID NO: 1940705 - RNA, 13 nt, Homo sapiens
ucuauuaguuuca

SEQ ID NO: 1940706 - RNA, 17 nt, Homo sapiens
aacccaccaaucuacuu

SEQ ID NO: 1940707 - RNA, 14 nt, Homo sapiens
auccccccacugag

SEQ ID NO: 1940708 - RNA, 21 nt, Homo sapiens
caaugcuauggacugcacaaa

SEQ ID NO: 1940709 - RNA, 14 nt, Homo sapiens
uugcugcuuuccag

SEQ ID NO: 1940710 - RNA, 14 nt, Homo sapiens
cagauccucacaac

SEQ ID NO: 1940711 - RNA, 15 nt, Homo sapiens
cccucugucuuguga

SEQ ID NO: 1940712 - RNA, 23 nt, Homo sapiens
aacucguguucacucagcacuuu

SEQ ID NO: 1940713 - RNA, 18 nt, Homo sapiens
uaagugcaaacacagcau

SEQ ID NO: 1940714 - RNA, 20 nt, Homo sapiens
ccagaaauuuaccacaaaag

SEQ ID NO: 1940715 - RNA, 15 nt, Homo sapiens
uaaacaccuccucau

SEQ ID NO: 1940716 - RNA, 17 nt, Homo sapiens
auuuuguggcauuugaa

SEQ ID NO: 1940717 - RNA, 14 nt, Homo sapiens
agaugcagguuuga

SEQ ID NO: 1940718 - RNA, 19 nt, Homo sapiens
augccagcuucucucucca

SEQ ID NO: 1940719 - RNA, 16 nt, Homo sapiens
ucuggcuucugcauua

SEQ ID NO: 1940720 - RNA, 17 nt, Homo sapiens
gagcuagggcugcugcu

SEQ ID NO: 1940721 - RNA, 15 nt, Homo sapiens
caaagucaucaaaga

SEQ ID NO: 1940722 - RNA, 13 nt, Homo sapiens
ugaauacuugaac

SEQ ID NO: 1940723 - RNA, 13 nt, Homo sapiens
gcaccacugcacu

SEQ ID NO: 1940724 - RNA, 22 nt, Homo sapiens
uuuacguuaaaauuacuuugaa

SEQ ID NO: 1940725 - RNA, 23 nt, Homo sapiens
acagguuuaaggcugaggcugcc

SEQ ID NO: 1940726 - RNA, 17 nt, Homo sapiens
aaucuccucgacugcuu

SEQ ID NO: 1940727 - RNA, 15 nt, Homo sapiens
ucccaacagccaaga

SEQ ID NO: 1940728 - RNA, 14 nt, Homo sapiens
cugccugagcuucc

SEQ ID NO: 1940729 - RNA, 14 nt, Homo sapiens
cagcaaagucugca

SEQ ID NO: 1940730 - RNA, 22 nt, Homo sapiens
aauauaucuuaaugcagacaaa

SEQ ID NO: 1940731 - RNA, 12 nt, Homo sapiens
uuuguacagaga

SEQ ID NO: 1940732 - RNA, 19 nt, Homo sapiens
gacuuggagccccuuggag

SEQ ID NO: 1940733 - RNA, 16 nt, Homo sapiens
uaaucuguacaaugaa

SEQ ID NO: 1940734 - RNA, 17 nt, Homo sapiens
uguuccaggauguggaa

SEQ ID NO: 1940735 - RNA, 21 nt, Homo sapiens
cagcacccagguuuugcacuc

SEQ ID NO: 1940736 - RNA, 20 nt, Homo sapiens
aaaugcucucagagcaccuc

SEQ ID NO: 1940737 - RNA, 23 nt, Homo sapiens
agcuuuuaggaaaggcugaugau

SEQ ID NO: 1940738 - RNA, 18 nt, Homo sapiens
augcucaguuggugcugc

SEQ ID NO: 1940739 - RNA, 18 nt, Homo sapiens
gcaaaaacuuucaugccu

SEQ ID NO: 1940740 - RNA, 22 nt, Homo sapiens
aaucuaugccuaaaaaguauca

SEQ ID NO: 1940741 - RNA, 16 nt, Homo sapiens
gcacugacaaugggca

SEQ ID NO: 1940742 - RNA, 13 nt, Homo sapiens
acuccaagcugca

SEQ ID NO: 1940743 - RNA, 17 nt, Homo sapiens
ugggacagggcaaacaa

SEQ ID NO: 1940744 - RNA, 16 nt, Homo sapiens
uucuccaacagagugg

SEQ ID NO: 1940745 - RNA, 13 nt, Homo sapiens
uaaaaugcagugg

SEQ ID NO: 1940746 - RNA, 20 nt, Homo sapiens
uuaauuacuucuuaguaugu

SEQ ID NO: 1940747 - RNA, 18 nt, Homo sapiens
cuaugaagaaaacagcug

SEQ ID NO: 1940748 - RNA, 20 nt, Homo sapiens
ccaaagggaaaacucuucau

SEQ ID NO: 1940749 - RNA, 23 nt, Homo sapiens
cuaagugacacaaauugaagcau

SEQ ID NO: 1940750 - RNA, 23 nt, Homo sapiens
ccugggggcccauucugcaugcc

SEQ ID NO: 1940751 - RNA, 22 nt, Homo sapiens
aggucucgcugaugcugggcug

SEQ ID NO: 1940752 - RNA, 14 nt, Homo sapiens
ucauuuaagggaaa

SEQ ID NO: 1940753 - RNA, 19 nt, Homo sapiens
aaggagaggauuuggcucg

SEQ ID NO: 1940754 - RNA, 19 nt, Homo sapiens
gcaacccgguuuaccaguu

SEQ ID NO: 1940755 - RNA, 16 nt, Homo sapiens
aucucaacauggaaaa

SEQ ID NO: 1940756 - RNA, 22 nt, Homo sapiens
ugcuucuaguucugccaggaga

SEQ ID NO: 1940757 - RNA, 22 nt, Homo sapiens
accuacaauuuucccuugauaa

SEQ ID NO: 1940758 - RNA, 14 nt, Homo sapiens
acuauuuuccagcc

SEQ ID NO: 1940759 - RNA, 21 nt, Homo sapiens
uucucuuccuacaugucuaca

SEQ ID NO: 1940760 - RNA, 21 nt, Homo sapiens
agaacucuugacuuccugcca

SEQ ID NO: 1940761 - RNA, 22 nt, Homo sapiens
uucagugcaccuacugcuuacu

SEQ ID NO: 1940762 - RNA, 14 nt, Homo sapiens
aucugacauaguua

SEQ ID NO: 1940763 - RNA, 14 nt, Homo sapiens
uucuuucaaagugu

SEQ ID NO: 1940764 - RNA, 21 nt, Homo sapiens
caugccaggaagcacguucac

SEQ ID NO: 1940765 - RNA, 14 nt, Homo sapiens
agaggaacaagcuu

SEQ ID NO: 1940766 - RNA, 19 nt, Homo sapiens
cagaugccugcagugccac

SEQ ID NO: 1940767 - RNA, 18 nt, Homo sapiens
auguguagccugugcaug

SEQ ID NO: 1940768 - RNA, 17 nt, Homo sapiens
uuucuugcaagcuccag

SEQ ID NO: 1940769 - RNA, 20 nt, Homo sapiens
agggauggugcccuguucuc

SEQ ID NO: 1940770 - RNA, 16 nt, Homo sapiens
aucagauggcauaaau

SEQ ID NO: 1940771 - RNA, 13 nt, Homo sapiens
uuauguguucuaa

SEQ ID NO: 1940772 - RNA, 16 nt, Homo sapiens
cauccaccucaucacu

SEQ ID NO: 1940773 - RNA, 21 nt, Homo sapiens
agacuagauucucaccugccu

SEQ ID NO: 1940774 - RNA, 14 nt, Homo sapiens
auccacccaccuca

SEQ ID NO: 1940775 - RNA, 22 nt, Homo sapiens
gcgggaacggggguacacggug

SEQ ID NO: 1940776 - RNA, 16 nt, Homo sapiens
auacaguguacucuua

SEQ ID NO: 1940777 - RNA, 19 nt, Homo sapiens
gcaauauucucuguacaua

SEQ ID NO: 1940778 - RNA, 12 nt, Homo sapiens
gaugggaccaac

SEQ ID NO: 1940779 - RNA, 21 nt, Homo sapiens
aucuguguaaaaucugacaua

SEQ ID NO: 1940780 - RNA, 15 nt, Homo sapiens
gaguaguaaucucac

SEQ ID NO: 1940781 - RNA, 22 nt, Homo sapiens
ggacaagugguaugaccaguga

SEQ ID NO: 1940782 - RNA, 20 nt, Homo sapiens
cuguaaucccagcacuuuag

SEQ ID NO: 1940783 - RNA, 16 nt, Homo sapiens
ucaugugcuauagaca

SEQ ID NO: 1940784 - RNA, 21 nt, Homo sapiens
gccaacauggugagacccugu

SEQ ID NO: 1940785 - RNA, 17 nt, Homo sapiens
ugcuuuuaaaagugcac

SEQ ID NO: 1940786 - RNA, 14 nt, Homo sapiens
uccuuggcuuuaug

SEQ ID NO: 1940787 - RNA, 14 nt, Homo sapiens
ccugaucugugaua

SEQ ID NO: 1940788 - RNA, 22 nt, Homo sapiens
uaaaggcuucucauccacugug

SEQ ID NO: 1940789 - RNA, 13 nt, Homo sapiens
cuucuuacuggaa

SEQ ID NO: 1940790 - RNA, 22 nt, Homo sapiens
augacagugaauauugcuuuua

SEQ ID NO: 1940791 - RNA, 13 nt, Homo sapiens
aagagggggaccu

SEQ ID NO: 1940792 - RNA, 21 nt, Homo sapiens
cagauuuuucugaagggcaua

SEQ ID NO: 1940793 - RNA, 15 nt, Homo sapiens
uugaauuacagggaa

SEQ ID NO: 1940794 - RNA, 15 nt, Homo sapiens
aaggaagccacagcu

SEQ ID NO: 1940795 - RNA, 19 nt, Homo sapiens
cugaccgggucacacaaag

SEQ ID NO: 1940796 - RNA, 21 nt, Homo sapiens
ugccuuuagggguguguauuc

SEQ ID NO: 1940797 - RNA, 12 nt, Homo sapiens
uauuccagagac

SEQ ID NO: 1940798 - RNA, 19 nt, Homo sapiens
gguccuuuucaaaauucaa

SEQ ID NO: 1940799 - RNA, 14 nt, Homo sapiens
uaggaguucacuuc

SEQ ID NO: 1940800 - RNA, 13 nt, Homo sapiens
aguuggagugcaa

SEQ ID NO: 1940801 - RNA, 12 nt, Homo sapiens
ggaggauguucu

SEQ ID NO: 1940802 - RNA, 16 nt, Homo sapiens
ucucccuggggucaca

SEQ ID NO: 1940803 - RNA, 14 nt, Homo sapiens
aacuacaaacacaa

SEQ ID NO: 1940804 - RNA, 21 nt, Homo sapiens
ucacccugaggugagcaucau

SEQ ID NO: 1940805 - RNA, 17 nt, Homo sapiens
auacuaaacaucauuga

SEQ ID NO: 1940806 - RNA, 20 nt, Homo sapiens
ccacagucccaucugcuuca

SEQ ID NO: 1940807 - RNA, 15 nt, Homo sapiens
guagauauuaauuaa

SEQ ID NO: 1940808 - RNA, 15 nt, Homo sapiens
uuagauagugauauu

SEQ ID NO: 1940809 - RNA, 16 nt, Homo sapiens
gcucugucuucuuugc

SEQ ID NO: 1940810 - RNA, 17 nt, Homo sapiens
gcaaacaaccugaaucu

SEQ ID NO: 1940811 - RNA, 14 nt, Homo sapiens
uaauuuguauuucc

SEQ ID NO: 1940812 - RNA, 18 nt, Homo sapiens
aacauagaaaaaugaugu

SEQ ID NO: 1940813 - RNA, 13 nt, Homo sapiens
acacacuuuugca

SEQ ID NO: 1940814 - RNA, 19 nt, Homo sapiens
caguguuccauuugaacca

SEQ ID NO: 1940815 - RNA, 15 nt, Homo sapiens
cuuucugucuuuaag

SEQ ID NO: 1940816 - RNA, 22 nt, Homo sapiens
ggcagcaggauagagugggaca

SEQ ID NO: 1940817 - RNA, 12 nt, Homo sapiens
uccaaguacuuu

SEQ ID NO: 1940818 - RNA, 12 nt, Homo sapiens
cccaaguauuuu

SEQ ID NO: 1940819 - RNA, 18 nt, Homo sapiens
ugcacaaugggcaauucu

SEQ ID NO: 1940820 - RNA, 19 nt, Homo sapiens
ugugugcacaugugugcgu

SEQ ID NO: 1940821 - RNA, 21 nt, Homo sapiens
gaaaaacuaacuagacuaaga

SEQ ID NO: 1940822 - RNA, 15 nt, Homo sapiens
acuuuggaacaagau

SEQ ID NO: 1940823 - RNA, 20 nt, Homo sapiens
agagggugccggaaagagag

SEQ ID NO: 1940824 - RNA, 23 nt, Homo sapiens
cccuuccgacaggagcacugcau

SEQ ID NO: 1940825 - RNA, 18 nt, Homo sapiens
uaauuguacuaaagccaa

SEQ ID NO: 1940826 - RNA, 16 nt, Homo sapiens
caggccagcgcugcaa

SEQ ID NO: 1940827 - RNA, 23 nt, Homo sapiens
acuguccggccccgagucacuca

SEQ ID NO: 1940828 - RNA, 19 nt, Homo sapiens
cuaacaaagaacaagcauu

SEQ ID NO: 1940829 - RNA, 21 nt, Homo sapiens
cacucagaguucuauacugua

SEQ ID NO: 1940830 - RNA, 18 nt, Homo sapiens
aagucucugugaauugaa

SEQ ID NO: 1940831 - RNA, 21 nt, Homo sapiens
ccaagucauuugaggaucuca

SEQ ID NO: 1940832 - RNA, 20 nt, Homo sapiens
acaaaaacuuagaugggcau

SEQ ID NO: 1940833 - RNA, 21 nt, Homo sapiens
ucuuugacauuuuugccaaaa

SEQ ID NO: 1940834 - RNA, 21 nt, Homo sapiens
uccucucuggacuuucuccaa

SEQ ID NO: 1940835 - RNA, 21 nt, Homo sapiens
aaggucugagccacagcagca

SEQ ID NO: 1940836 - RNA, 13 nt, Homo sapiens
ggaaggacuauga

SEQ ID NO: 1940837 - RNA, 21 nt, Homo sapiens
agaagagucccggagcucaag

SEQ ID NO: 1940838 - RNA, 21 nt, Homo sapiens
uccagaccccagaacuagaaa

SEQ ID NO: 1940839 - RNA, 12 nt, Homo sapiens
caucaaggucag

SEQ ID NO: 1940840 - RNA, 13 nt, Homo sapiens
cauuuagcacaau

SEQ ID NO: 1940841 - RNA, 18 nt, Homo sapiens
gcagaguggcugcaguua

SEQ ID NO: 1940842 - RNA, 14 nt, Homo sapiens
caauucuuuauaca

SEQ ID NO: 1940843 - RNA, 14 nt, Homo sapiens
cucuuguacuugau

SEQ ID NO: 1940844 - RNA, 17 nt, Homo sapiens
agaggcuguggcuggug

SEQ ID NO: 1940845 - RNA, 17 nt, Homo sapiens
uguacuuccuguguacu

SEQ ID NO: 1940846 - RNA, 17 nt, Homo sapiens
agcagcucaccauggcu

SEQ ID NO: 1940847 - RNA, 18 nt, Homo sapiens
acaguauaucuuaagaua

SEQ ID NO: 1940848 - RNA, 22 nt, Homo sapiens
uuucaaaagguauuauacaugu

SEQ ID NO: 1940849 - RNA, 21 nt, Homo sapiens
gugggaaccaaacaccuucag

SEQ ID NO: 1940850 - RNA, 15 nt, Homo sapiens
auuguguuacuauaa

SEQ ID NO: 1940851 - RNA, 20 nt, Homo sapiens
aagagagguccagcccccca

SEQ ID NO: 1940852 - RNA, 20 nt, Homo sapiens
ucuggaacgcucuaggcaga

SEQ ID NO: 1940853 - RNA, 14 nt, Homo sapiens
uaaaggaacuaauc

SEQ ID NO: 1940854 - RNA, 13 nt, Homo sapiens
auucaaucaaagc

SEQ ID NO: 1940855 - RNA, 19 nt, Homo sapiens
auccuuuuauucuccagaa

SEQ ID NO: 1940856 - RNA, 17 nt, Homo sapiens
gcuuuggcgccccaugg

SEQ ID NO: 1940857 - RNA, 11 nt, Homo sapiens
caacaugguga

SEQ ID NO: 1940858 - RNA, 16 nt, Homo sapiens
gcuggcagaaagggaa

SEQ ID NO: 1940859 - RNA, 15 nt, Homo sapiens
accuacccaugaccu

SEQ ID NO: 1940860 - RNA, 15 nt, Homo sapiens
ccggcuccugugcug

SEQ ID NO: 1940861 - RNA, 17 nt, Homo sapiens
uaauuaguugauugcug

SEQ ID NO: 1940862 - RNA, 15 nt, Homo sapiens
auacuuuauuguggg

SEQ ID NO: 1940863 - RNA, 22 nt, Homo sapiens
uaucauuaucuuugcuguuauu

SEQ ID NO: 1940864 - RNA, 19 nt, Homo sapiens
agucuacucuuaagccauc

SEQ ID NO: 1940865 - RNA, 16 nt, Homo sapiens
ccucaauucauauuua

SEQ ID NO: 1940866 - RNA, 17 nt, Homo sapiens
gaaauuuggcuauaauc

SEQ ID NO: 1940867 - RNA, 21 nt, Homo sapiens
uuggccuuguggauaagggag

SEQ ID NO: 1940868 - RNA, 20 nt, Homo sapiens
uucaaaguuaagaaucuuua

SEQ ID NO: 1940869 - RNA, 14 nt, Homo sapiens
gaaaggagcaauga

SEQ ID NO: 1940870 - RNA, 23 nt, Homo sapiens
uugugccucaacauacuguugau

SEQ ID NO: 1940871 - RNA, 19 nt, Homo sapiens
gaagccauauucacaccuc

SEQ ID NO: 1940872 - RNA, 17 nt, Homo sapiens
gcugggacuuggauccc

SEQ ID NO: 1940873 - RNA, 17 nt, Homo sapiens
caacuucaguugagagg

SEQ ID NO: 1940874 - RNA, 23 nt, Homo sapiens
cagguaccccagcucugcuugcc

SEQ ID NO: 1940875 - RNA, 19 nt, Homo sapiens
ccuuuucuuuuguuacugu

SEQ ID NO: 1940876 - RNA, 17 nt, Homo sapiens
acaucauucaugacaac

SEQ ID NO: 1940877 - RNA, 17 nt, Homo sapiens
cuaaagagcuacuucua

SEQ ID NO: 1940878 - RNA, 21 nt, Homo sapiens
ucagacuuuguguucauuuca

SEQ ID NO: 1940879 - RNA, 23 nt, Homo sapiens
gcacucccuccagcacaaacaca

SEQ ID NO: 1940880 - RNA, 21 nt, Homo sapiens
gggaaaaguuagucaauccug

SEQ ID NO: 1940881 - RNA, 21 nt, Homo sapiens
agaacuucccugauugaccug

SEQ ID NO: 1940882 - RNA, 18 nt, Homo sapiens
ugagaaauuuaaacuaua

SEQ ID NO: 1940883 - RNA, 17 nt, Homo sapiens
cuaaagaauucuugaaa

SEQ ID NO: 1940884 - RNA, 17 nt, Homo sapiens
agauaauuugcauauuc

SEQ ID NO: 1940885 - RNA, 21 nt, Homo sapiens
agguagauuguuuuguucaca

SEQ ID NO: 1940886 - RNA, 19 nt, Homo sapiens
gagccaaaggcauccaggc

SEQ ID NO: 1940887 - RNA, 15 nt, Homo sapiens
ggaauacugugcaua

SEQ ID NO: 1940888 - RNA, 14 nt, Homo sapiens
augacuccauucaa

SEQ ID NO: 1940889 - RNA, 22 nt, Homo sapiens
cuggguuccuccucuccuacuc

SEQ ID NO: 1940890 - RNA, 14 nt, Homo sapiens
gguuuuaagccagg

SEQ ID NO: 1940891 - RNA, 21 nt, Homo sapiens
cucugguggcaggugccuugu

SEQ ID NO: 1940892 - RNA, 15 nt, Homo sapiens
acagggugucuguca

SEQ ID NO: 1940893 - RNA, 15 nt, Homo sapiens
gaacgcgacuuccac

SEQ ID NO: 1940894 - RNA, 16 nt, Homo sapiens
gccucugcuuacuuuu

SEQ ID NO: 1940895 - RNA, 20 nt, Homo sapiens
caucacccucuuccugugau

SEQ ID NO: 1940896 - RNA, 19 nt, Homo sapiens
gaaguaagccucaucauca

SEQ ID NO: 1940897 - RNA, 21 nt, Homo sapiens
ccugcauaugcuucugauggu

SEQ ID NO: 1940898 - RNA, 19 nt, Homo sapiens
ccuguggccaacugcaaaa

SEQ ID NO: 1940899 - RNA, 23 nt, Homo sapiens
augagggccaccaggaagcacag

SEQ ID NO: 1940900 - RNA, 12 nt, Homo sapiens
aaaccuuacuua

SEQ ID NO: 1940901 - RNA, 15 nt, Homo sapiens
acagccuacagccag

SEQ ID NO: 1940902 - RNA, 14 nt, Homo sapiens
gggugcagggaugu

SEQ ID NO: 1940903 - RNA, 23 nt, Homo sapiens
gugagacuguguuguacagcuag

SEQ ID NO: 1940904 - RNA, 15 nt, Homo sapiens
cacaaacuccaucca

SEQ ID NO: 1940905 - RNA, 22 nt, Homo sapiens
aguuagaauaauaaauauuuag

SEQ ID NO: 1940906 - RNA, 20 nt, Homo sapiens
cucagcuucccaaguagcug

SEQ ID NO: 1940907 - RNA, 17 nt, Homo sapiens
ucauccccacaaucugg

SEQ ID NO: 1940908 - RNA, 19 nt, Homo sapiens
gacaggguuucaccauguu

SEQ ID NO: 1940909 - RNA, 16 nt, Homo sapiens
cacggagggauugauc

SEQ ID NO: 1940910 - RNA, 13 nt, Homo sapiens
cuggcucacagcc

SEQ ID NO: 1940911 - RNA, 17 nt, Homo sapiens
ucgguuugguagacuug

SEQ ID NO: 1940912 - RNA, 15 nt, Homo sapiens
ccauuagaagauauu

SEQ ID NO: 1940913 - RNA, 17 nt, Homo sapiens
ugcagucgcuugccaaa

SEQ ID NO: 1940914 - RNA, 22 nt, Homo sapiens
aaauccauuugagucugcuccu

SEQ ID NO: 1940915 - RNA, 13 nt, Homo sapiens
uucacacagugaa

SEQ ID NO: 1940916 - RNA, 20 nt, Homo sapiens
ucgguggucuccaccuguca

SEQ ID NO: 1940917 - RNA, 15 nt, Homo sapiens
guacaaacccaaaaa

SEQ ID NO: 1940918 - RNA, 18 nt, Homo sapiens
caggagagcuucccccaa

SEQ ID NO: 1940919 - RNA, 18 nt, Homo sapiens
uccaucuagucacaaaga

SEQ ID NO: 1940920 - RNA, 13 nt, Homo sapiens
auauuuaaaggga

SEQ ID NO: 1940921 - RNA, 18 nt, Homo sapiens
acaauaaaaauuccaaau

SEQ ID NO: 1940922 - RNA, 18 nt, Homo sapiens
uccaagcuucaagugaua

SEQ ID NO: 1940923 - RNA, 20 nt, Homo sapiens
acugccucauggcaucaucc

SEQ ID NO: 1940924 - RNA, 17 nt, Homo sapiens
cuguacucuuaucuggg

SEQ ID NO: 1940925 - RNA, 22 nt, Homo sapiens
acaauuaagagagugaacauau

SEQ ID NO: 1940926 - RNA, 21 nt, Homo sapiens
agacugaucauccaggccuca

SEQ ID NO: 1940927 - RNA, 17 nt, Homo sapiens
agacugaccaucuccca

SEQ ID NO: 1940928 - RNA, 18 nt, Homo sapiens
guuaaauaauauggcuau

SEQ ID NO: 1940929 - RNA, 15 nt, Homo sapiens
accacagacgccacc

SEQ ID NO: 1940930 - RNA, 22 nt, Homo sapiens
guaacuugcaaugggcagcuau

SEQ ID NO: 1940931 - RNA, 17 nt, Homo sapiens
cuuugugccaucacuga

SEQ ID NO: 1940932 - RNA, 14 nt, Homo sapiens
augaaagugcaaag

SEQ ID NO: 1940933 - RNA, 22 nt, Homo sapiens
caaaucacaaaaaaacuguuau

SEQ ID NO: 1940934 - RNA, 19 nt, Homo sapiens
ugcggacagcccuuccucc

SEQ ID NO: 1940935 - RNA, 14 nt, Homo sapiens
aauaaaaggaccac

SEQ ID NO: 1940936 - RNA, 21 nt, Homo sapiens
cgcauugccacggaaacauac

SEQ ID NO: 1940937 - RNA, 17 nt, Homo sapiens
gagccugcaaacucacu

SEQ ID NO: 1940938 - RNA, 20 nt, Homo sapiens
ucucucuuauuuguauccua

SEQ ID NO: 1940939 - RNA, 17 nt, Homo sapiens
ugacaugcaucaucuca

SEQ ID NO: 1940940 - RNA, 12 nt, Homo sapiens
uggucacuggaa

SEQ ID NO: 1940941 - RNA, 21 nt, Homo sapiens
caacuaggaccucauaucuuc

SEQ ID NO: 1940942 - RNA, 14 nt, Homo sapiens
aacggacacugaaa

SEQ ID NO: 1940943 - RNA, 15 nt, Homo sapiens
cccagaucugguccc

SEQ ID NO: 1940944 - RNA, 14 nt, Homo sapiens
aaaccaucuggccu

SEQ ID NO: 1940945 - RNA, 24 nt, Homo sapiens
uugcugggguuggagguuucacuu

SEQ ID NO: 1940946 - RNA, 18 nt, Homo sapiens
acagacccaggucuucca

SEQ ID NO: 1940947 - RNA, 22 nt, Homo sapiens
cuuaucaguaguaucaaugauu

SEQ ID NO: 1940948 - RNA, 18 nt, Homo sapiens
auuguugacaacugugac

SEQ ID NO: 1940949 - RNA, 23 nt, Homo sapiens
agaaaacucugguaaaugaucac

SEQ ID NO: 1940950 - RNA, 13 nt, Homo sapiens
agguggugauaug

SEQ ID NO: 1940951 - RNA, 15 nt, Homo sapiens
cauguugacugucuu

SEQ ID NO: 1940952 - RNA, 21 nt, Homo sapiens
cuguuuucggccuucuguggc

SEQ ID NO: 1940953 - RNA, 19 nt, Homo sapiens
uaugguuuuauaacuauau

SEQ ID NO: 1940954 - RNA, 16 nt, Homo sapiens
cuuggacccaccugug

SEQ ID NO: 1940955 - RNA, 21 nt, Homo sapiens
cccuugcccgccagccagugg

SEQ ID NO: 1940956 - RNA, 17 nt, Homo sapiens
aaguaaccucuacaggc

SEQ ID NO: 1940957 - RNA, 17 nt, Homo sapiens
ugacauugcuuuacugu

SEQ ID NO: 1940958 - RNA, 15 nt, Homo sapiens
aacaaggugcacaga

SEQ ID NO: 1940959 - RNA, 15 nt, Homo sapiens
ccuccccagaucugu

SEQ ID NO: 1940960 - RNA, 21 nt, Homo sapiens
caccacuuuacuuguguuaua

SEQ ID NO: 1940961 - RNA, 13 nt, Homo sapiens
uaugcaagcacaa

SEQ ID NO: 1940962 - RNA, 19 nt, Homo sapiens
aagcccccagggccuccag

SEQ ID NO: 1940963 - RNA, 15 nt, Homo sapiens
guuuugguucacuau

SEQ ID NO: 1940964 - RNA, 23 nt, Homo sapiens
agcagccagccaacccuuucauu

SEQ ID NO: 1940965 - RNA, 23 nt, Homo sapiens
ggccucucuacaagcagcaggaa

SEQ ID NO: 1940966 - RNA, 16 nt, Homo sapiens
cauuguuaggugcuga

SEQ ID NO: 1940967 - RNA, 21 nt, Homo sapiens
uauaaagaagaacuugcaugg

SEQ ID NO: 1940968 - RNA, 14 nt, Homo sapiens
ggagaucugaggug

SEQ ID NO: 1940969 - RNA, 12 nt, Homo sapiens
gcgggcaccugu

SEQ ID NO: 1940970 - RNA, 20 nt, Homo sapiens
gcgcagaaaacaaaagcccu

SEQ ID NO: 1940971 - RNA, 19 nt, Homo sapiens
cacagccaacguucaugca

SEQ ID NO: 1940972 - RNA, 13 nt, Homo sapiens
ggaauuccaauau

SEQ ID NO: 1940973 - RNA, 16 nt, Homo sapiens
cagugaucucacuuaa

SEQ ID NO: 1940974 - RNA, 17 nt, Homo sapiens
ccucccaacagcgcuuu

SEQ ID NO: 1940975 - RNA, 18 nt, Homo sapiens
uauaauauuauacugcua

SEQ ID NO: 1940976 - RNA, 13 nt, Homo sapiens
ccaggcugccguc

SEQ ID NO: 1940977 - RNA, 22 nt, Homo sapiens
agaaaaggagcauccuuaccuc

SEQ ID NO: 1940978 - RNA, 17 nt, Homo sapiens
aaaguaagaacagcuca

SEQ ID NO: 1940979 - RNA, 21 nt, Homo sapiens
uauggaccaauuagcauucca

SEQ ID NO: 1940980 - RNA, 21 nt, Homo sapiens
cauuuguggucugacuccuug

SEQ ID NO: 1940981 - RNA, 19 nt, Homo sapiens
aaaaugucucaauggugcu

SEQ ID NO: 1940982 - RNA, 22 nt, Homo sapiens
cucaccagcgcuugaagccuga

SEQ ID NO: 1940983 - RNA, 17 nt, Homo sapiens
ucuccacucacugcauu

SEQ ID NO: 1940984 - RNA, 14 nt, Homo sapiens
acagucagcucucu

SEQ ID NO: 1940985 - RNA, 16 nt, Homo sapiens
aguuaaauaugcaucu

SEQ ID NO: 1940986 - RNA, 15 nt, Homo sapiens
cguuucaaccucucu

SEQ ID NO: 1940987 - RNA, 19 nt, Homo sapiens
cuccauacgcguucuaggc

SEQ ID NO: 1940988 - RNA, 15 nt, Homo sapiens
uuagucucaugugaa

SEQ ID NO: 1940989 - RNA, 18 nt, Homo sapiens
agaaagaaaugucugcca

SEQ ID NO: 1940990 - RNA, 15 nt, Homo sapiens
ugggccucaguucaa

SEQ ID NO: 1940991 - RNA, 11 nt, Homo sapiens
agaaccaaaga

SEQ ID NO: 1940992 - RNA, 21 nt, Homo sapiens
uauucuagugauaagaauucu

SEQ ID NO: 1940993 - RNA, 15 nt, Homo sapiens
gugaggagucugggu

SEQ ID NO: 1940994 - RNA, 15 nt, Homo sapiens
uauguuuacacuguc

SEQ ID NO: 1940995 - RNA, 24 nt, Homo sapiens
ccacuccuuauauugcugugagau

SEQ ID NO: 1940996 - RNA, 20 nt, Homo sapiens
cuuuuucaaaaaacauuaaa

SEQ ID NO: 1940997 - RNA, 14 nt, Homo sapiens
aggugggccuggga

SEQ ID NO: 1940998 - RNA, 14 nt, Homo sapiens
ucccagcuacaggg

SEQ ID NO: 1940999 - RNA, 19 nt, Homo sapiens
uucacgggcaaucaugagc

SEQ ID NO: 1941000 - RNA, 22 nt, Homo sapiens
ugucagccaccucccucugcca

SEQ ID NO: 1941001 - RNA, 20 nt, Homo sapiens
ggcccaggcuagagugcagu

SEQ ID NO: 1941002 - RNA, 23 nt, Homo sapiens
uuucaguacuucagcaagagaga

SEQ ID NO: 1941003 - RNA, 20 nt, Homo sapiens
agccuggcuccaaacccucg

SEQ ID NO: 1941004 - RNA, 14 nt, Homo sapiens
cagcuguugcagug

SEQ ID NO: 1941005 - RNA, 14 nt, Homo sapiens
ucacacaagggaag

SEQ ID NO: 1941006 - RNA, 17 nt, Homo sapiens
ggaagguaagauguuuc

SEQ ID NO: 1941007 - RNA, 18 nt, Homo sapiens
ucuaaauugaucauucau

SEQ ID NO: 1941008 - RNA, 18 nt, Homo sapiens
gacuaagccuaccugcuc

SEQ ID NO: 1941009 - RNA, 19 nt, Homo sapiens
cacaggaacugggagauaa

SEQ ID NO: 1941010 - RNA, 22 nt, Homo sapiens
agcuguuguacguacuacggag

SEQ ID NO: 1941011 - RNA, 13 nt, Homo sapiens
aaagcauuuugca

SEQ ID NO: 1941012 - RNA, 19 nt, Homo sapiens
aaaauagccuauccuuaau

SEQ ID NO: 1941013 - RNA, 19 nt, Homo sapiens
gagaugguauauccuugcg

SEQ ID NO: 1941014 - RNA, 18 nt, Homo sapiens
caaggucugaacccuucc

SEQ ID NO: 1941015 - RNA, 22 nt, Homo sapiens
ugucagaugcugugcaaauguu

SEQ ID NO: 1941016 - RNA, 15 nt, Homo sapiens
gucuggcccacugug

SEQ ID NO: 1941017 - RNA, 18 nt, Homo sapiens
ucuggggcacuaaauuca

SEQ ID NO: 1941018 - RNA, 14 nt, Homo sapiens
gacccgcucuccau

SEQ ID NO: 1941019 - RNA, 12 nt, Homo sapiens
aacagcauguac

SEQ ID NO: 1941020 - RNA, 11 nt, Homo sapiens
ggccucuugcu

SEQ ID NO: 1941021 - RNA, 19 nt, Homo sapiens
guuccccuaaucuaucacu

SEQ ID NO: 1941022 - RNA, 22 nt, Homo sapiens
ucaaaaaauuauuuuaggcaaa

SEQ ID NO: 1941023 - RNA, 16 nt, Homo sapiens
guaaucccagcacuuu

SEQ ID NO: 1941024 - RNA, 14 nt, Homo sapiens
uggagcuugcagug

SEQ ID NO: 1941025 - RNA, 17 nt, Homo sapiens
uggaugccaaccgguca

SEQ ID NO: 1941026 - RNA, 15 nt, Homo sapiens
aucggaguaucugaa

SEQ ID NO: 1941027 - RNA, 19 nt, Homo sapiens
gcaauggugcgaucucagc

SEQ ID NO: 1941028 - RNA, 16 nt, Homo sapiens
aaagagcucagacauu

SEQ ID NO: 1941029 - RNA, 18 nt, Homo sapiens
ucaucuggaguucucaaa

SEQ ID NO: 1941030 - RNA, 22 nt, Homo sapiens
aguuucuuuuuuaauagaauau

SEQ ID NO: 1941031 - RNA, 20 nt, Homo sapiens
cuagguugaaaauguuauag

SEQ ID NO: 1941032 - RNA, 20 nt, Homo sapiens
cagacaggauguucaacuua

SEQ ID NO: 1941033 - RNA, 16 nt, Homo sapiens
guuucaaaauucucau

SEQ ID NO: 1941034 - RNA, 18 nt, Homo sapiens
ccaauucaccaacacagu

SEQ ID NO: 1941035 - RNA, 16 nt, Homo sapiens
cucgagaagauucaau

SEQ ID NO: 1941036 - RNA, 19 nt, Homo sapiens
ccagucugcagaagcauuu

SEQ ID NO: 1941037 - RNA, 20 nt, Homo sapiens
ccaagaagcccuccuugcca

SEQ ID NO: 1941038 - RNA, 24 nt, Homo sapiens
auugagaguaaaugacugucuuau

SEQ ID NO: 1941039 - RNA, 17 nt, Homo sapiens
cagccagaggaaccagc

SEQ ID NO: 1941040 - RNA, 19 nt, Homo sapiens
gggagaagguuucauugcc

SEQ ID NO: 1941041 - RNA, 23 nt, Homo sapiens
gucagcagggggguuggguucca

SEQ ID NO: 1941042 - RNA, 15 nt, Homo sapiens
ugcaccgccucaggg

SEQ ID NO: 1941043 - RNA, 16 nt, Homo sapiens
aguuacuuacugccuu

SEQ ID NO: 1941044 - RNA, 16 nt, Homo sapiens
cugugcuggccaugga

SEQ ID NO: 1941045 - RNA, 17 nt, Homo sapiens
auauuugaaagaaguca

SEQ ID NO: 1941046 - RNA, 19 nt, Homo sapiens
cacuggaacauuccagugg

SEQ ID NO: 1941047 - RNA, 18 nt, Homo sapiens
accagcucugaacuucca

SEQ ID NO: 1941048 - RNA, 19 nt, Homo sapiens
agauauggaaaauagugau

SEQ ID NO: 1941049 - RNA, 20 nt, Homo sapiens
acauuucauuaaccaaagaa

SEQ ID NO: 1941050 - RNA, 22 nt, Homo sapiens
gaugauauggagguucaaugag

SEQ ID NO: 1941051 - RNA, 14 nt, Homo sapiens
gcgcacuuuccacu

SEQ ID NO: 1941052 - RNA, 21 nt, Homo sapiens
gugggcccccaaugacaccca

SEQ ID NO: 1941053 - RNA, 17 nt, Homo sapiens
acauaccuggcccaacc

SEQ ID NO: 1941054 - RNA, 19 nt, Homo sapiens
gccaggaaagcagcaaagg

SEQ ID NO: 1941055 - RNA, 21 nt, Homo sapiens
aguguugaucagaucuuacaa

SEQ ID NO: 1941056 - RNA, 17 nt, Homo sapiens
auacuaccaagugacca

SEQ ID NO: 1941057 - RNA, 22 nt, Homo sapiens
gggugagagucuggguccaggc

SEQ ID NO: 1941058 - RNA, 17 nt, Homo sapiens
accuggacccaaagagg

SEQ ID NO: 1941059 - RNA, 16 nt, Homo sapiens
aguauauaacuaacaa

SEQ ID NO: 1941060 - RNA, 17 nt, Homo sapiens
ucuguugcaaacucagu

SEQ ID NO: 1941061 - RNA, 17 nt, Homo sapiens
ucaaaauugagugguuu

SEQ ID NO: 1941062 - RNA, 20 nt, Homo sapiens
gccccauggcagcuccugac

SEQ ID NO: 1941063 - RNA, 13 nt, Homo sapiens
cccuuugugacuu

SEQ ID NO: 1941064 - RNA, 14 nt, Homo sapiens
uaucucccaacaga

SEQ ID NO: 1941065 - RNA, 20 nt, Homo sapiens
aaauagauaaacuauacacu

SEQ ID NO: 1941066 - RNA, 15 nt, Homo sapiens
gauucucgacucuuu

SEQ ID NO: 1941067 - RNA, 18 nt, Homo sapiens
cagaucugcccacaucuu

SEQ ID NO: 1941068 - RNA, 19 nt, Homo sapiens
acagguggcaggaccagga

SEQ ID NO: 1941069 - RNA, 14 nt, Homo sapiens
ggggaccagcuugg

SEQ ID NO: 1941070 - RNA, 18 nt, Homo sapiens
caccugcacgugaucugc

SEQ ID NO: 1941071 - RNA, 18 nt, Homo sapiens
gaaagaguccuauuugca

SEQ ID NO: 1941072 - RNA, 13 nt, Homo sapiens
guccaccucccau

SEQ ID NO: 1941073 - RNA, 16 nt, Homo sapiens
accacaagccugagaa

SEQ ID NO: 1941074 - RNA, 22 nt, Homo sapiens
ucuggggacagacaaggugccu

SEQ ID NO: 1941075 - RNA, 11 nt, Homo sapiens
aaaagauguau

SEQ ID NO: 1941076 - RNA, 22 nt, Homo sapiens
uuuaaagcauauuggugcuaga

SEQ ID NO: 1941077 - RNA, 17 nt, Homo sapiens
gacuccagaucugcacc

SEQ ID NO: 1941078 - RNA, 22 nt, Homo sapiens
aguuuuguuuguucacacuccu

SEQ ID NO: 1941079 - RNA, 18 nt, Homo sapiens
ccaaauguagcaggugua

SEQ ID NO: 1941080 - RNA, 14 nt, Homo sapiens
uuuauaauacccuu

SEQ ID NO: 1941081 - RNA, 20 nt, Homo sapiens
uuacaaaguaauuucuuuga

SEQ ID NO: 1941082 - RNA, 21 nt, Homo sapiens
cgggcgcggccagccccggcc

SEQ ID NO: 1941083 - RNA, 20 nt, Homo sapiens
uucaugacuuuuccauguau

SEQ ID NO: 1941084 - RNA, 21 nt, Homo sapiens
uucuuuaaaauguaaagccau

SEQ ID NO: 1941085 - RNA, 15 nt, Homo sapiens
ccucccgggucacuu

SEQ ID NO: 1941086 - RNA, 14 nt, Homo sapiens
uuuccuuucuuagc

SEQ ID NO: 1941087 - RNA, 16 nt, Homo sapiens
gaggccuguccugacc

SEQ ID NO: 1941088 - RNA, 19 nt, Homo sapiens
cacaccuacaccucuugaa

SEQ ID NO: 1941089 - RNA, 16 nt, Homo sapiens
gcuuucugaacucgcu

SEQ ID NO: 1941090 - RNA, 15 nt, Homo sapiens
ugcccagggaguccu

SEQ ID NO: 1941091 - RNA, 14 nt, Homo sapiens
uaggaaugcucaau

SEQ ID NO: 1941092 - RNA, 18 nt, Homo sapiens
uguaugcaguauucuugc

SEQ ID NO: 1941093 - RNA, 23 nt, Homo sapiens
gugccuucuaaauggcaugacau

SEQ ID NO: 1941094 - RNA, 18 nt, Homo sapiens
caaugaaggagauagauu

SEQ ID NO: 1941095 - RNA, 21 nt, Homo sapiens
ugcaaaccuguucaucuugcc

SEQ ID NO: 1941096 - RNA, 20 nt, Homo sapiens
uaggauuacuaggugcccag

SEQ ID NO: 1941097 - RNA, 15 nt, Homo sapiens
ucaaauuuccuuuca

SEQ ID NO: 1941098 - RNA, 23 nt, Homo sapiens
ugauaccauggcacugacaaugg

SEQ ID NO: 1941099 - RNA, 17 nt, Homo sapiens
cuuggcugcuguaucuu

SEQ ID NO: 1941100 - RNA, 21 nt, Homo sapiens
cauugcuuuuaaaacuacuua

SEQ ID NO: 1941101 - RNA, 22 nt, Homo sapiens
auuuugaggccagaggugcugu

SEQ ID NO: 1941102 - RNA, 16 nt, Homo sapiens
aauuagcauggccaca

SEQ ID NO: 1941103 - RNA, 14 nt, Homo sapiens
uaaagcgcagauaa

SEQ ID NO: 1941104 - RNA, 22 nt, Homo sapiens
uggaaauguggucaucaaagau

SEQ ID NO: 1941105 - RNA, 19 nt, Homo sapiens
ugcuguuuaauuccuggaa

SEQ ID NO: 1941106 - RNA, 16 nt, Homo sapiens
cuuuuuacucaaagag

SEQ ID NO: 1941107 - RNA, 13 nt, Homo sapiens
cugguuugcuugg

SEQ ID NO: 1941108 - RNA, 16 nt, Homo sapiens
aagugccagcauucca

SEQ ID NO: 1941109 - RNA, 22 nt, Homo sapiens
ccucucagauucuuaucuggca

SEQ ID NO: 1941110 - RNA, 17 nt, Homo sapiens
gacccauccaguucucu

SEQ ID NO: 1941111 - RNA, 17 nt, Homo sapiens
uaacccugucacccaca

SEQ ID NO: 1941112 - RNA, 17 nt, Homo sapiens
aaacauugacacauaca

SEQ ID NO: 1941113 - RNA, 16 nt, Homo sapiens
cugcaugaccuaucag

SEQ ID NO: 1941114 - RNA, 12 nt, Homo sapiens
uuagccccauga

SEQ ID NO: 1941115 - RNA, 22 nt, Homo sapiens
uguucaacuauuaauggaucau

SEQ ID NO: 1941116 - RNA, 14 nt, Homo sapiens
auagcccugugaag

SEQ ID NO: 1941117 - RNA, 13 nt, Homo sapiens
accucuaacugau

SEQ ID NO: 1941118 - RNA, 19 nt, Homo sapiens
gacgggguuucaccguguu

SEQ ID NO: 1941119 - RNA, 20 nt, Homo sapiens
cuauuauagcaacuuuaaga

SEQ ID NO: 1941120 - RNA, 21 nt, Homo sapiens
caacaaggggucaaugucaua

SEQ ID NO: 1941121 - RNA, 15 nt, Homo sapiens
caaaguuuaacacaa

SEQ ID NO: 1941122 - RNA, 20 nt, Homo sapiens
gcuuuugcuggucacugcca

SEQ ID NO: 1941123 - RNA, 19 nt, Homo sapiens
gcccucuguggucacagag

SEQ ID NO: 1941124 - RNA, 15 nt, Homo sapiens
cccagggcagggugg

SEQ ID NO: 1941125 - RNA, 19 nt, Homo sapiens
uaaacacaaauugugaaga

SEQ ID NO: 1941126 - RNA, 20 nt, Homo sapiens
uaaagugacuaauggcauga

SEQ ID NO: 1941127 - RNA, 15 nt, Homo sapiens
uucaacgaugugacu

SEQ ID NO: 1941128 - RNA, 15 nt, Homo sapiens
uuugcagaugcacau

SEQ ID NO: 1941129 - RNA, 22 nt, Homo sapiens
cuucauuucaggaagacugaca

SEQ ID NO: 1941130 - RNA, 17 nt, Homo sapiens
uggaugaugaaacauuc

SEQ ID NO: 1941131 - RNA, 19 nt, Homo sapiens
uuguaaguuuaugucuaaa

SEQ ID NO: 1941132 - RNA, 19 nt, Homo sapiens
guaacaagaaaacauaaga

SEQ ID NO: 1941133 - RNA, 19 nt, Homo sapiens
gaguucgagaccagccuga

SEQ ID NO: 1941134 - RNA, 16 nt, Homo sapiens
acgcaguaacuaaagc

SEQ ID NO: 1941135 - RNA, 16 nt, Homo sapiens
ggacaugcccugugug

SEQ ID NO: 1941136 - RNA, 18 nt, Homo sapiens
ggaagaaugaacacuccc

SEQ ID NO: 1941137 - RNA, 21 nt, Homo sapiens
ucacauacaauuugcacuguu

SEQ ID NO: 1941138 - RNA, 16 nt, Homo sapiens
uuuacugguugcaugg

SEQ ID NO: 1941139 - RNA, 18 nt, Homo sapiens
accccgcuguaagcuccu

SEQ ID NO: 1941140 - RNA, 23 nt, Homo sapiens
aaugcauaaaagacaagcacuuu

SEQ ID NO: 1941141 - RNA, 16 nt, Homo sapiens
aauaaaauaaguggau

SEQ ID NO: 1941142 - RNA, 17 nt, Homo sapiens
ugccaagacagugaagu

SEQ ID NO: 1941143 - RNA, 17 nt, Homo sapiens
ucuguaaguguagcuca

SEQ ID NO: 1941144 - RNA, 22 nt, Homo sapiens
uugggggaggggagacuuugau

SEQ ID NO: 1941145 - RNA, 23 nt, Homo sapiens
uaucaaggauguucuggcuuuac

SEQ ID NO: 1941146 - RNA, 22 nt, Homo sapiens
ucaccucacugaaaacaucugg

SEQ ID NO: 1941147 - RNA, 18 nt, Homo sapiens
auaggugagauaaauuaa

SEQ ID NO: 1941148 - RNA, 17 nt, Homo sapiens
aaaagcauguuaugugu

SEQ ID NO: 1941149 - RNA, 17 nt, Homo sapiens
cccauaggcccacacac

SEQ ID NO: 1941150 - RNA, 15 nt, Homo sapiens
aggucccugacauuu

SEQ ID NO: 1941151 - RNA, 16 nt, Homo sapiens
aagaaugaacacuccc

SEQ ID NO: 1941152 - RNA, 16 nt, Homo sapiens
ggauucagcaugucca

SEQ ID NO: 1941153 - RNA, 22 nt, Homo sapiens
caucaguacuuguuucuaugca

SEQ ID NO: 1941154 - RNA, 22 nt, Homo sapiens
augguaugcacaauuccaugac

SEQ ID NO: 1941155 - RNA, 16 nt, Homo sapiens
ugaccccgccaugcau

SEQ ID NO: 1941156 - RNA, 14 nt, Homo sapiens
ugacauuauaugca

SEQ ID NO: 1941157 - RNA, 21 nt, Homo sapiens
guuuuucaagaaaacuggaaa

SEQ ID NO: 1941158 - RNA, 14 nt, Homo sapiens
agcuggaaaaccuc

SEQ ID NO: 1941159 - RNA, 18 nt, Homo sapiens
ccaacaguuugaugcuga

SEQ ID NO: 1941160 - RNA, 15 nt, Homo sapiens
cacaaaauuaugcaa

SEQ ID NO: 1941161 - RNA, 19 nt, Homo sapiens
uacaggcauacacaugcac

SEQ ID NO: 1941162 - RNA, 16 nt, Homo sapiens
uaugauggaacaguga

SEQ ID NO: 1941163 - RNA, 22 nt, Homo sapiens
agcugcugcacacacucaccuc

SEQ ID NO: 1941164 - RNA, 22 nt, Homo sapiens
uaaaccaaaaauuauguguugc

SEQ ID NO: 1941165 - RNA, 17 nt, Homo sapiens
cucagcuggacugcauu

SEQ ID NO: 1941166 - RNA, 22 nt, Homo sapiens
aguagcaggucaaaaaccugcc

SEQ ID NO: 1941167 - RNA, 18 nt, Homo sapiens
caagaagauaggcucuca

SEQ ID NO: 1941168 - RNA, 17 nt, Homo sapiens
ggcuaccucaccugggc

SEQ ID NO: 1941169 - RNA, 19 nt, Homo sapiens
uuuuucgauaaacuaacua

SEQ ID NO: 1941170 - RNA, 22 nt, Homo sapiens
aaguggccuuaagucuuuuuga

SEQ ID NO: 1941171 - RNA, 23 nt, Homo sapiens
ggacaguaucccacauccaacuc

SEQ ID NO: 1941172 - RNA, 15 nt, Homo sapiens
uggaacgugaacuca

SEQ ID NO: 1941173 - RNA, 18 nt, Homo sapiens
acaaauuugugugacaga

SEQ ID NO: 1941174 - RNA, 23 nt, Homo sapiens
gguuagaaccagcagaagccaga

SEQ ID NO: 1941175 - RNA, 20 nt, Homo sapiens
ccuacaaagcucugaauuca

SEQ ID NO: 1941176 - RNA, 23 nt, Homo sapiens
aggguagucugguuucuagacuu

SEQ ID NO: 1941177 - RNA, 18 nt, Homo sapiens
uaaauaagagauuuggag

SEQ ID NO: 1941178 - RNA, 20 nt, Homo sapiens
uaccaggggaggcagugucu

SEQ ID NO: 1941179 - RNA, 16 nt, Homo sapiens
gaagugguucuauguc

SEQ ID NO: 1941180 - RNA, 16 nt, Homo sapiens
gugccucuugggagac

SEQ ID NO: 1941181 - RNA, 20 nt, Homo sapiens
aaccccucugcuuuuaacuc

SEQ ID NO: 1941182 - RNA, 14 nt, Homo sapiens
gaaggccuuuucac

SEQ ID NO: 1941183 - RNA, 13 nt, Homo sapiens
aagaauguauucg

SEQ ID NO: 1941184 - RNA, 24 nt, Homo sapiens
uacaucaccuuuuugacuuuucca

SEQ ID NO: 1941185 - RNA, 21 nt, Homo sapiens
caggcauggcuggugccugaa

SEQ ID NO: 1941186 - RNA, 20 nt, Homo sapiens
cacccugcugcuggugcaca

SEQ ID NO: 1941187 - RNA, 17 nt, Homo sapiens
cugugcuacacuggaua

SEQ ID NO: 1941188 - RNA, 16 nt, Homo sapiens
gagggaggagaaugag

SEQ ID NO: 1941189 - RNA, 20 nt, Homo sapiens
gucaagaagaggaaagggag

SEQ ID NO: 1941190 - RNA, 13 nt, Homo sapiens
uguguuacauaca

SEQ ID NO: 1941191 - RNA, 11 nt, Homo sapiens
gguaugucuuu

SEQ ID NO: 1941192 - RNA, 22 nt, Homo sapiens
aauuaaguuuuggguaagugug

SEQ ID NO: 1941193 - RNA, 16 nt, Homo sapiens
aguccaggacuggguc

SEQ ID NO: 1941194 - RNA, 16 nt, Homo sapiens
auuuugguaaaucaca

SEQ ID NO: 1941195 - RNA, 12 nt, Homo sapiens
agagauguuaaa

SEQ ID NO: 1941196 - RNA, 21 nt, Homo sapiens
uggcucagucagacauggcca

SEQ ID NO: 1941197 - RNA, 17 nt, Homo sapiens
uguaacgaugcacuuug

SEQ ID NO: 1941198 - RNA, 15 nt, Homo sapiens
aucuuguaggaucua

SEQ ID NO: 1941199 - RNA, 21 nt, Homo sapiens
ccuuugcucuuauaaaaucaa

SEQ ID NO: 1941200 - RNA, 21 nt, Homo sapiens
ucuuaacuucuccccauuucc

SEQ ID NO: 1941201 - RNA, 18 nt, Homo sapiens
ucuacauuuuauuacacu

SEQ ID NO: 1941202 - RNA, 16 nt, Homo sapiens
aucacaacauuccuca

SEQ ID NO: 1941203 - RNA, 16 nt, Homo sapiens
ugccaaccuguaauaa

SEQ ID NO: 1941204 - RNA, 13 nt, Homo sapiens
gugauacaaugcu

SEQ ID NO: 1941205 - RNA, 18 nt, Homo sapiens
aggcaauccuaagcaaaa

SEQ ID NO: 1941206 - RNA, 16 nt, Homo sapiens
auuuuggcaaagccag

SEQ ID NO: 1941207 - RNA, 15 nt, Homo sapiens
guaaacaacaaacuu

SEQ ID NO: 1941208 - RNA, 19 nt, Homo sapiens
caguccucccagacuaccu

SEQ ID NO: 1941209 - RNA, 17 nt, Homo sapiens
auuccccauugccuccu

SEQ ID NO: 1941210 - RNA, 15 nt, Homo sapiens
acguuuaacauugau

SEQ ID NO: 1941211 - RNA, 16 nt, Homo sapiens
aggcacacacugugcu

SEQ ID NO: 1941212 - RNA, 15 nt, Homo sapiens
cacacauggaugcac

SEQ ID NO: 1941213 - RNA, 15 nt, Homo sapiens
auagcgaauacaaaa

SEQ ID NO: 1941214 - RNA, 14 nt, Homo sapiens
augauuuuuuacaa

SEQ ID NO: 1941215 - RNA, 15 nt, Homo sapiens
ggcuuuaucucaggg

SEQ ID NO: 1941216 - RNA, 18 nt, Homo sapiens
ucaccaagccacugauac

SEQ ID NO: 1941217 - RNA, 23 nt, Homo sapiens
uagaacacugccaacugaucugu

SEQ ID NO: 1941218 - RNA, 16 nt, Homo sapiens
uuaaaacaguauuuau

SEQ ID NO: 1941219 - RNA, 14 nt, Homo sapiens
uggucccaucugca

SEQ ID NO: 1941220 - RNA, 24 nt, Homo sapiens
gcugaugagugauugacacacagc

SEQ ID NO: 1941221 - RNA, 15 nt, Homo sapiens
cucaguugagaaaca

SEQ ID NO: 1941222 - RNA, 13 nt, Homo sapiens
aagucaagcucca

SEQ ID NO: 1941223 - RNA, 13 nt, Homo sapiens
augucaagcacca

SEQ ID NO: 1941224 - RNA, 13 nt, Homo sapiens
aaguauuguuaau

SEQ ID NO: 1941225 - RNA, 15 nt, Homo sapiens
gcccucagacauuua

SEQ ID NO: 1941226 - RNA, 16 nt, Homo sapiens
acucuuaugaaauggg

SEQ ID NO: 1941227 - RNA, 16 nt, Homo sapiens
caaacuccugccugag

SEQ ID NO: 1941228 - RNA, 15 nt, Homo sapiens
gguggacuucagugu

SEQ ID NO: 1941229 - RNA, 15 nt, Homo sapiens
ccagucauggccaaa

SEQ ID NO: 1941230 - RNA, 20 nt, Homo sapiens
aaugacuuugaaaaccuggc

SEQ ID NO: 1941231 - RNA, 22 nt, Homo sapiens
auuuuaagguucucagaccucc

SEQ ID NO: 1941232 - RNA, 15 nt, Homo sapiens
uuagaaauugcauuu

SEQ ID NO: 1941233 - RNA, 19 nt, Homo sapiens
aauaaugauuuucuugcca

SEQ ID NO: 1941234 - RNA, 15 nt, Homo sapiens
uacauuucuguucau

SEQ ID NO: 1941235 - RNA, 19 nt, Homo sapiens
auuguuuugagcuuuccau

SEQ ID NO: 1941236 - RNA, 11 nt, Homo sapiens
aacaugcaaua

SEQ ID NO: 1941237 - RNA, 20 nt, Homo sapiens
cuaugccuuuuacgagugcu

SEQ ID NO: 1941238 - RNA, 20 nt, Homo sapiens
aauugguauuaacuaugauc

SEQ ID NO: 1941239 - RNA, 15 nt, Homo sapiens
acuuaagcacaagca

SEQ ID NO: 1941240 - RNA, 22 nt, Homo sapiens
auauucaaugaacuuccauuug

SEQ ID NO: 1941241 - RNA, 15 nt, Homo sapiens
ucauuuucuacguca

SEQ ID NO: 1941242 - RNA, 22 nt, Homo sapiens
cauauuaagaauagucucuggg

SEQ ID NO: 1941243 - RNA, 17 nt, Homo sapiens
ugaagacggauuacuaa

SEQ ID NO: 1941244 - RNA, 15 nt, Homo sapiens
uccagccaacauuua

SEQ ID NO: 1941245 - RNA, 19 nt, Homo sapiens
acaugccucugccaaagga

SEQ ID NO: 1941246 - RNA, 21 nt, Homo sapiens
aauggcuugucuuugcuacuu

SEQ ID NO: 1941247 - RNA, 11 nt, Homo sapiens
ggggugcccuc

SEQ ID NO: 1941248 - RNA, 15 nt, Homo sapiens
aagaaggcucacaga

SEQ ID NO: 1941249 - RNA, 20 nt, Homo sapiens
ugacaagguucccaagacaa

SEQ ID NO: 1941250 - RNA, 21 nt, Homo sapiens
ugcccugggaggcagugaugg

SEQ ID NO: 1941251 - RNA, 18 nt, Homo sapiens
gcccacucccaggaccaa

SEQ ID NO: 1941252 - RNA, 22 nt, Homo sapiens
cucaaacucccgaccucaggug

SEQ ID NO: 1941253 - RNA, 13 nt, Homo sapiens
auugaaugugauu

SEQ ID NO: 1941254 - RNA, 16 nt, Homo sapiens
uagcuuauacaaaaca

SEQ ID NO: 1941255 - RNA, 20 nt, Homo sapiens
ucuccagucuuccaccugga

SEQ ID NO: 1941256 - RNA, 18 nt, Homo sapiens
caagugauucuccugccu

SEQ ID NO: 1941257 - RNA, 21 nt, Homo sapiens
ucaccguggaccuuccugcca

SEQ ID NO: 1941258 - RNA, 16 nt, Homo sapiens
aauaaaauuuaacuca

SEQ ID NO: 1941259 - RNA, 17 nt, Homo sapiens
uuucccucucccagucc

SEQ ID NO: 1941260 - RNA, 13 nt, Homo sapiens
aagucucugugaa

SEQ ID NO: 1941261 - RNA, 14 nt, Homo sapiens
cauaaacaauucau

SEQ ID NO: 1941262 - RNA, 23 nt, Homo sapiens
aucaagacugcaaacccuuucau

SEQ ID NO: 1941263 - RNA, 13 nt, Homo sapiens
acaaaaacacagc

SEQ ID NO: 1941264 - RNA, 14 nt, Homo sapiens
ccucaacacugaag

SEQ ID NO: 1941265 - RNA, 14 nt, Homo sapiens
agccccgccuguca

SEQ ID NO: 1941266 - RNA, 18 nt, Homo sapiens
ucguacuuucacaucucu

SEQ ID NO: 1941267 - RNA, 15 nt, Homo sapiens
auagacauucucaca

SEQ ID NO: 1941268 - RNA, 13 nt, Homo sapiens
auguuucugcuau

SEQ ID NO: 1941269 - RNA, 14 nt, Homo sapiens
gaaaucuaaucucu

SEQ ID NO: 1941270 - RNA, 15 nt, Homo sapiens
cuugauuuaaucacc

SEQ ID NO: 1941271 - RNA, 16 nt, Homo sapiens
gcccccagcccuggga

SEQ ID NO: 1941272 - RNA, 22 nt, Homo sapiens
ugaccucacuucuggcacugug

SEQ ID NO: 1941273 - RNA, 19 nt, Homo sapiens
ccuuugcacagugguuaau

SEQ ID NO: 1941274 - RNA, 23 nt, Homo sapiens
agcggagaucgcaucauugcacu

SEQ ID NO: 1941275 - RNA, 14 nt, Homo sapiens
caccagugacuuuu

SEQ ID NO: 1941276 - RNA, 21 nt, Homo sapiens
cucucccagucuacccagaga

SEQ ID NO: 1941277 - RNA, 20 nt, Homo sapiens
uccagaacgcccugugucca

SEQ ID NO: 1941278 - RNA, 18 nt, Homo sapiens
agaaaggaacucugggca

SEQ ID NO: 1941279 - RNA, 19 nt, Homo sapiens
ggccgggugggcggcacag

SEQ ID NO: 1941280 - RNA, 19 nt, Homo sapiens
aaugaauuuacagaacagu

SEQ ID NO: 1941281 - RNA, 13 nt, Homo sapiens
accaaauggccag

SEQ ID NO: 1941282 - RNA, 14 nt, Homo sapiens
aauagacacuugag

SEQ ID NO: 1941283 - RNA, 16 nt, Homo sapiens
cuguauaaacacaauc

SEQ ID NO: 1941284 - RNA, 23 nt, Homo sapiens
uaugaugagaggccagcacauua

SEQ ID NO: 1941285 - RNA, 17 nt, Homo sapiens
agaacucgaugcacuga

SEQ ID NO: 1941286 - RNA, 15 nt, Homo sapiens
cacuuaaacuuuguc

SEQ ID NO: 1941287 - RNA, 17 nt, Homo sapiens
gcccuuucaaagcacuu

SEQ ID NO: 1941288 - RNA, 19 nt, Homo sapiens
ugcauauuuagcuuugcac

SEQ ID NO: 1941289 - RNA, 15 nt, Homo sapiens
aggaugcaugcaggg

SEQ ID NO: 1941290 - RNA, 18 nt, Homo sapiens
cuaggaggaaaauuccau

SEQ ID NO: 1941291 - RNA, 12 nt, Homo sapiens
uuguuaaugcau

SEQ ID NO: 1941292 - RNA, 21 nt, Homo sapiens
agaguuuuuauuuuguuacaa

SEQ ID NO: 1941293 - RNA, 23 nt, Homo sapiens
uagugccagguggcucagugcca

SEQ ID NO: 1941294 - RNA, 15 nt, Homo sapiens
ugucugugaugucag

SEQ ID NO: 1941295 - RNA, 11 nt, Homo sapiens
cugacaucucc

SEQ ID NO: 1941296 - RNA, 22 nt, Homo sapiens
uaaacgaggcaaugacugugag

SEQ ID NO: 1941297 - RNA, 15 nt, Homo sapiens
caaucggcugcauug

SEQ ID NO: 1941298 - RNA, 23 nt, Homo sapiens
ccuugggcacuuuuuaauucacc

SEQ ID NO: 1941299 - RNA, 19 nt, Homo sapiens
aaaacuaauguacuguaca

SEQ ID NO: 1941300 - RNA, 15 nt, Homo sapiens
ugggaugcacucuca

SEQ ID NO: 1941301 - RNA, 18 nt, Homo sapiens
cuaaucacuccaacccug

SEQ ID NO: 1941302 - RNA, 17 nt, Homo sapiens
acacacagcuucuagug

SEQ ID NO: 1941303 - RNA, 17 nt, Homo sapiens
gcacugcccauggacag

SEQ ID NO: 1941304 - RNA, 22 nt, Homo sapiens
caagguguggccugcacugggu

SEQ ID NO: 1941305 - RNA, 15 nt, Homo sapiens
accaaaaagaccaga

SEQ ID NO: 1941306 - RNA, 20 nt, Homo sapiens
uuccaacauuucucacugaa

SEQ ID NO: 1941307 - RNA, 19 nt, Homo sapiens
cugcaccccucugcccuca

SEQ ID NO: 1941308 - RNA, 22 nt, Homo sapiens
aaugagaagucaacagugaaau

SEQ ID NO: 1941309 - RNA, 20 nt, Homo sapiens
auaacuuuucaccaaugagc

SEQ ID NO: 1941310 - RNA, 19 nt, Homo sapiens
uaacauagccaaaauguga

SEQ ID NO: 1941311 - RNA, 19 nt, Homo sapiens
ccaccacugauauccuccu

SEQ ID NO: 1941312 - RNA, 17 nt, Homo sapiens
ccaacuugccaaaaugu

SEQ ID NO: 1941313 - RNA, 15 nt, Homo sapiens
gcacugucacuuugc

SEQ ID NO: 1941314 - RNA, 14 nt, Homo sapiens
aagugagacccaaa

SEQ ID NO: 1941315 - RNA, 13 nt, Homo sapiens
aaccuaauauuca

SEQ ID NO: 1941316 - RNA, 13 nt, Homo sapiens
auuuuaauaacua

SEQ ID NO: 1941317 - RNA, 15 nt, Homo sapiens
cacuucgccauucau

SEQ ID NO: 1941318 - RNA, 20 nt, Homo sapiens
aaguggcuacugacuacccu

SEQ ID NO: 1941319 - RNA, 23 nt, Homo sapiens
gcagccaaccccauccucacaca

SEQ ID NO: 1941320 - RNA, 18 nt, Homo sapiens
cagcacgaguggccaguu

SEQ ID NO: 1941321 - RNA, 20 nt, Homo sapiens
cacuggggcguuuccuacug

SEQ ID NO: 1941322 - RNA, 14 nt, Homo sapiens
cucacuguauccag

SEQ ID NO: 1941323 - RNA, 23 nt, Homo sapiens
cccaccuccgcugggaggaaccu

SEQ ID NO: 1941324 - RNA, 11 nt, Homo sapiens
gaaaaguuauu

SEQ ID NO: 1941325 - RNA, 18 nt, Homo sapiens
uaagauauauacauggaa

SEQ ID NO: 1941326 - RNA, 20 nt, Homo sapiens
ugcagguugggaaugaggcu

SEQ ID NO: 1941327 - RNA, 13 nt, Homo sapiens
cgccgaauccugu

SEQ ID NO: 1941328 - RNA, 20 nt, Homo sapiens
aauggucacaauaaaugcca

SEQ ID NO: 1941329 - RNA, 15 nt, Homo sapiens
auuauacuacaauaa

SEQ ID NO: 1941330 - RNA, 22 nt, Homo sapiens
cacacugauguagauaacagcu

SEQ ID NO: 1941331 - RNA, 12 nt, Homo sapiens
cgcgcucgccca

SEQ ID NO: 1941332 - RNA, 23 nt, Homo sapiens
ccaaauccagugugcaccccucc

SEQ ID NO: 1941333 - RNA, 21 nt, Homo sapiens
acuguccugaccaucgcacac

SEQ ID NO: 1941334 - RNA, 12 nt, Homo sapiens
caugaagcacau

SEQ ID NO: 1941335 - RNA, 16 nt, Homo sapiens
uagaauggaugugcuc

SEQ ID NO: 1941336 - RNA, 16 nt, Homo sapiens
auggugagaugcagcu

SEQ ID NO: 1941337 - RNA, 21 nt, Homo sapiens
uaacaugcaccuugcucccaa

SEQ ID NO: 1941338 - RNA, 14 nt, Homo sapiens
gcaggcuggaguua

SEQ ID NO: 1941339 - RNA, 19 nt, Homo sapiens
gaacuggggcuuugccuug

SEQ ID NO: 1941340 - RNA, 16 nt, Homo sapiens
aaauggcuuacuuaca

SEQ ID NO: 1941341 - RNA, 16 nt, Homo sapiens
cgaguuuucugaccag

SEQ ID NO: 1941342 - RNA, 14 nt, Homo sapiens
aguguccucuugcu

SEQ ID NO: 1941343 - RNA, 19 nt, Homo sapiens
aaauauuuucuacuuuaaa

SEQ ID NO: 1941344 - RNA, 19 nt, Homo sapiens
caaguuuucaguacaaauc

SEQ ID NO: 1941345 - RNA, 20 nt, Homo sapiens
cuuccaggauggauguuggg

SEQ ID NO: 1941346 - RNA, 12 nt, Homo sapiens
agcuuucaagga

SEQ ID NO: 1941347 - RNA, 22 nt, Homo sapiens
gagauacauguugccucaccag

SEQ ID NO: 1941348 - RNA, 22 nt, Homo sapiens
uauaccauuuccguaauucuua

SEQ ID NO: 1941349 - RNA, 19 nt, Homo sapiens
guaccuccagucacacucc

SEQ ID NO: 1941350 - RNA, 16 nt, Homo sapiens
acuugcuaacaaauca

SEQ ID NO: 1941351 - RNA, 16 nt, Homo sapiens
aauuaucaaaaagcua

SEQ ID NO: 1941352 - RNA, 14 nt, Homo sapiens
uccucugaacaaaa

SEQ ID NO: 1941353 - RNA, 13 nt, Homo sapiens
cgcgauucaggac

SEQ ID NO: 1941354 - RNA, 16 nt, Homo sapiens
auuuccagcuucucag

SEQ ID NO: 1941355 - RNA, 19 nt, Homo sapiens
cccuggguuagacugccag

SEQ ID NO: 1941356 - RNA, 14 nt, Homo sapiens
ccccugccagugaa

SEQ ID NO: 1941357 - RNA, 17 nt, Homo sapiens
auugaacugcaggugac

SEQ ID NO: 1941358 - RNA, 12 nt, Homo sapiens
gccaacugaaaa

SEQ ID NO: 1941359 - RNA, 21 nt, Homo sapiens
acagacuuccaccaugugcau

SEQ ID NO: 1941360 - RNA, 17 nt, Homo sapiens
uuagcuuauugauccca

SEQ ID NO: 1941361 - RNA, 19 nt, Homo sapiens
aguugaugaaauaucaaga

SEQ ID NO: 1941362 - RNA, 17 nt, Homo sapiens
uaacuuuauugcauaua

SEQ ID NO: 1941363 - RNA, 17 nt, Homo sapiens
ugcuuagagacuaucaa

SEQ ID NO: 1941364 - RNA, 22 nt, Homo sapiens
gcaggaggcuagcaaagcuuaa

SEQ ID NO: 1941365 - RNA, 12 nt, Homo sapiens
aagacaccauuu

SEQ ID NO: 1941366 - RNA, 16 nt, Homo sapiens
agggacagaugaaugc

SEQ ID NO: 1941367 - RNA, 15 nt, Homo sapiens
ccaguauaagcauuu

SEQ ID NO: 1941368 - RNA, 15 nt, Homo sapiens
auggcccagcagcuu

SEQ ID NO: 1941369 - RNA, 17 nt, Homo sapiens
acgauacagcuuggcac

SEQ ID NO: 1941370 - RNA, 13 nt, Homo sapiens
auuucucauauca

SEQ ID NO: 1941371 - RNA, 14 nt, Homo sapiens
guaaacaaaccaca

SEQ ID NO: 1941372 - RNA, 18 nt, Homo sapiens
gcacuguccagggcccau

SEQ ID NO: 1941373 - RNA, 13 nt, Homo sapiens
ugauauaccaaau

SEQ ID NO: 1941374 - RNA, 13 nt, Homo sapiens
acuuucauuugaa

SEQ ID NO: 1941375 - RNA, 13 nt, Homo sapiens
ucuuacauaugau

SEQ ID NO: 1941376 - RNA, 14 nt, Homo sapiens
ccaucucuacugaa

SEQ ID NO: 1941377 - RNA, 24 nt, Homo sapiens
acaaauuagccauuucacucucaa

SEQ ID NO: 1941378 - RNA, 19 nt, Homo sapiens
uccccucucugcuccagac

SEQ ID NO: 1941379 - RNA, 17 nt, Homo sapiens
uccuuaggugugagguc

SEQ ID NO: 1941380 - RNA, 15 nt, Homo sapiens
ccagccccuaccuug

SEQ ID NO: 1941381 - RNA, 19 nt, Homo sapiens
ggagugcucucucagcacu

SEQ ID NO: 1941382 - RNA, 20 nt, Homo sapiens
cuguuaaacaacucuuuaaa

SEQ ID NO: 1941383 - RNA, 21 nt, Homo sapiens
ugacauggaucagcaacucca

SEQ ID NO: 1941384 - RNA, 14 nt, Homo sapiens
aacaacguaaacuu

SEQ ID NO: 1941385 - RNA, 17 nt, Homo sapiens
cagagugaaaugccauu

SEQ ID NO: 1941386 - RNA, 21 nt, Homo sapiens
guagagagagaaaaguaacug

SEQ ID NO: 1941387 - RNA, 19 nt, Homo sapiens
aaaucugcuuguauuccaa

SEQ ID NO: 1941388 - RNA, 20 nt, Homo sapiens
accaccagcuguguccaaaa

SEQ ID NO: 1941389 - RNA, 16 nt, Homo sapiens
gugccugcuccuguac

SEQ ID NO: 1941390 - RNA, 17 nt, Homo sapiens
ccccuauggaauuuaua

SEQ ID NO: 1941391 - RNA, 11 nt, Homo sapiens
uaacuaugauu

SEQ ID NO: 1941392 - RNA, 20 nt, Homo sapiens
gagcucuccacccacucaca

SEQ ID NO: 1941393 - RNA, 13 nt, Homo sapiens
cgcaucuugccuc

SEQ ID NO: 1941394 - RNA, 18 nt, Homo sapiens
aaacauuuuuaucuauca

SEQ ID NO: 1941395 - RNA, 19 nt, Homo sapiens
uuauuacauugcugccuuu

SEQ ID NO: 1941396 - RNA, 20 nt, Homo sapiens
uaaaguuuguuauagucuau

SEQ ID NO: 1941397 - RNA, 14 nt, Homo sapiens
gggaaguaacagac

SEQ ID NO: 1941398 - RNA, 20 nt, Homo sapiens
cauuuaaagaaagaaugcau

SEQ ID NO: 1941399 - RNA, 12 nt, Homo sapiens
agggcagcacug

SEQ ID NO: 1941400 - RNA, 16 nt, Homo sapiens
aauguacaugucaaua

SEQ ID NO: 1941401 - RNA, 23 nt, Homo sapiens
uccuuaggucugcccugcuugca

SEQ ID NO: 1941402 - RNA, 18 nt, Homo sapiens
uggcaccugcacacucca

SEQ ID NO: 1941403 - RNA, 22 nt, Homo sapiens
caugugaaguguauaugauucu

SEQ ID NO: 1941404 - RNA, 18 nt, Homo sapiens
agcugaacaauaggcugu

SEQ ID NO: 1941405 - RNA, 17 nt, Homo sapiens
ugaacagcuugcugcua

SEQ ID NO: 1941406 - RNA, 16 nt, Homo sapiens
uacaaaaaugagcuag

SEQ ID NO: 1941407 - RNA, 15 nt, Homo sapiens
ucaucagaaacaauu

SEQ ID NO: 1941408 - RNA, 19 nt, Homo sapiens
ugccccacagucuccggcc

SEQ ID NO: 1941409 - RNA, 23 nt, Homo sapiens
ugcugaaucccaucaggcuguua

SEQ ID NO: 1941410 - RNA, 13 nt, Homo sapiens
cugaaacaucuca

SEQ ID NO: 1941411 - RNA, 23 nt, Homo sapiens
caacaauguguuguaaaaauguc

SEQ ID NO: 1941412 - RNA, 23 nt, Homo sapiens
gugaauuuuucuaaaggugcuau

SEQ ID NO: 1941413 - RNA, 15 nt, Homo sapiens
gugucacuugugcuu

SEQ ID NO: 1941414 - RNA, 23 nt, Homo sapiens
acuucuggcacugugacuacuau

SEQ ID NO: 1941415 - RNA, 15 nt, Homo sapiens
aucuugggaccucca

SEQ ID NO: 1941416 - RNA, 19 nt, Homo sapiens
uuccuuuuuguugauucca

SEQ ID NO: 1941417 - RNA, 19 nt, Homo sapiens
acuuuuauaauacauuaag

SEQ ID NO: 1941418 - RNA, 16 nt, Homo sapiens
agcaggagaaucacuu

SEQ ID NO: 1941419 - RNA, 16 nt, Homo sapiens
cuaauggggacacaga

SEQ ID NO: 1941420 - RNA, 20 nt, Homo sapiens
cagaggcagccucugcacuc

SEQ ID NO: 1941421 - RNA, 12 nt, Homo sapiens
agccccacugac

SEQ ID NO: 1941422 - RNA, 12 nt, Homo sapiens
uacaccacaaaa

SEQ ID NO: 1941423 - RNA, 20 nt, Homo sapiens
aaugagacauaggccaugaa

SEQ ID NO: 1941424 - RNA, 13 nt, Homo sapiens
ccuggaaaggggg

SEQ ID NO: 1941425 - RNA, 16 nt, Homo sapiens
augggucauucucacc

SEQ ID NO: 1941426 - RNA, 16 nt, Homo sapiens
caaaccaagcaaagga

SEQ ID NO: 1941427 - RNA, 23 nt, Homo sapiens
ccucagacucagagguccaggcc

SEQ ID NO: 1941428 - RNA, 20 nt, Homo sapiens
cccuucaaugcaaaauacau

SEQ ID NO: 1941429 - RNA, 17 nt, Homo sapiens
uuuaaggugaguucuca

SEQ ID NO: 1941430 - RNA, 23 nt, Homo sapiens
ugacaacauuuuuguacauuaug

SEQ ID NO: 1941431 - RNA, 19 nt, Homo sapiens
auccagaccaaccuuccau

SEQ ID NO: 1941432 - RNA, 22 nt, Homo sapiens
caaagcugccugugccaugccc

SEQ ID NO: 1941433 - RNA, 22 nt, Homo sapiens
gcauuuauugccucuaugugca

SEQ ID NO: 1941434 - RNA, 15 nt, Homo sapiens
uggggcaggggugcu

SEQ ID NO: 1941435 - RNA, 21 nt, Homo sapiens
aggaagccuuccccuaccccu

SEQ ID NO: 1941436 - RNA, 15 nt, Homo sapiens
gcuuuacuuugccca

SEQ ID NO: 1941437 - RNA, 16 nt, Homo sapiens
guacagcgggcugugc

SEQ ID NO: 1941438 - RNA, 19 nt, Homo sapiens
aaauggggauauguuaacu

SEQ ID NO: 1941439 - RNA, 20 nt, Homo sapiens
acugacaugauuagcagaag

SEQ ID NO: 1941440 - RNA, 21 nt, Homo sapiens
cuuuuuuuuuuuuuccuuuga

SEQ ID NO: 1941441 - RNA, 16 nt, Homo sapiens
uguuagagugucuuaa

SEQ ID NO: 1941442 - RNA, 19 nt, Homo sapiens
cagaugauccuugcacaga

SEQ ID NO: 1941443 - RNA, 20 nt, Homo sapiens
aaggugcuggacuguuacug

SEQ ID NO: 1941444 - RNA, 17 nt, Homo sapiens
ggcggcuucgcgcugga

SEQ ID NO: 1941445 - RNA, 21 nt, Homo sapiens
guuauuuagggaacugcuuga

SEQ ID NO: 1941446 - RNA, 16 nt, Homo sapiens
agcucugacauucuga

SEQ ID NO: 1941447 - RNA, 15 nt, Homo sapiens
gugccuguaauccca

SEQ ID NO: 1941448 - RNA, 11 nt, Homo sapiens
cuaauguauua

SEQ ID NO: 1941449 - RNA, 13 nt, Homo sapiens
agugucaacucuu

SEQ ID NO: 1941450 - RNA, 12 nt, Homo sapiens
ggguaagugcuu

SEQ ID NO: 1941451 - RNA, 24 nt, Homo sapiens
ggacuugggcgggacacaggcucc

SEQ ID NO: 1941452 - RNA, 21 nt, Homo sapiens
gauggcauuagagggagccca

SEQ ID NO: 1941453 - RNA, 14 nt, Homo sapiens
uauuauaaacuaua

SEQ ID NO: 1941454 - RNA, 16 nt, Homo sapiens
acuaauaauagcauuc

SEQ ID NO: 1941455 - RNA, 16 nt, Homo sapiens
aaggcucacagauuua

SEQ ID NO: 1941456 - RNA, 15 nt, Homo sapiens
uaucaaaugugaugg

SEQ ID NO: 1941457 - RNA, 23 nt, Homo sapiens
uaauaaagaaauaauacccugcc

SEQ ID NO: 1941458 - RNA, 13 nt, Homo sapiens
uggaaagguccug

SEQ ID NO: 1941459 - RNA, 22 nt, Homo sapiens
uucaccguggcuaccauuguca

SEQ ID NO: 1941460 - RNA, 15 nt, Homo sapiens
cguucuuucaaugcu

SEQ ID NO: 1941461 - RNA, 22 nt, Homo sapiens
uggggcaggaaagcaugcauug

SEQ ID NO: 1941462 - RNA, 20 nt, Homo sapiens
guagaaagugauccauacuu

SEQ ID NO: 1941463 - RNA, 17 nt, Homo sapiens
cacagcccucaugauca

SEQ ID NO: 1941464 - RNA, 12 nt, Homo sapiens
cuugucuuggca

SEQ ID NO: 1941465 - RNA, 18 nt, Homo sapiens
uuagcauccugccuuaga

SEQ ID NO: 1941466 - RNA, 16 nt, Homo sapiens
cugauaccacugcacu

SEQ ID NO: 1941467 - RNA, 19 nt, Homo sapiens
ggcugcugaaaaccaucug

SEQ ID NO: 1941468 - RNA, 13 nt, Homo sapiens
ccauuguuuuuca

SEQ ID NO: 1941469 - RNA, 22 nt, Homo sapiens
guauagcuuaccugaacaggaa

SEQ ID NO: 1941470 - RNA, 13 nt, Homo sapiens
ccccaugcuuccu

SEQ ID NO: 1941471 - RNA, 18 nt, Homo sapiens
gaaaaggacuucuggcua

SEQ ID NO: 1941472 - RNA, 19 nt, Homo sapiens
gcaccgcuggguucugacu

SEQ ID NO: 1941473 - RNA, 18 nt, Homo sapiens
cugugcagggacgucuca

SEQ ID NO: 1941474 - RNA, 20 nt, Homo sapiens
ugaugacuccuccccagaaa

SEQ ID NO: 1941475 - RNA, 18 nt, Homo sapiens
aaaaaccauaaacauuug

SEQ ID NO: 1941476 - RNA, 22 nt, Homo sapiens
cacccuuguccuugagugcucu

SEQ ID NO: 1941477 - RNA, 23 nt, Homo sapiens
gcguggcaacccucacuguguug

SEQ ID NO: 1941478 - RNA, 18 nt, Homo sapiens
cugucaauaaacagcuuc

SEQ ID NO: 1941479 - RNA, 12 nt, Homo sapiens
uuuugugauuca

SEQ ID NO: 1941480 - RNA, 12 nt, Homo sapiens
ccuugugaccca

SEQ ID NO: 1941481 - RNA, 20 nt, Homo sapiens
gcuauucccucaaaucugag

SEQ ID NO: 1941482 - RNA, 23 nt, Homo sapiens
auuuauauaaaauguuuaaucuc

SEQ ID NO: 1941483 - RNA, 12 nt, Homo sapiens
uguacugugacc

SEQ ID NO: 1941484 - RNA, 14 nt, Homo sapiens
cguaagaacauguu

SEQ ID NO: 1941485 - RNA, 17 nt, Homo sapiens
aaagacuucugucauaa

SEQ ID NO: 1941486 - RNA, 17 nt, Homo sapiens
ccuuuaaauaucauucu

SEQ ID NO: 1941487 - RNA, 14 nt, Homo sapiens
caggugagugccac

SEQ ID NO: 1941488 - RNA, 14 nt, Homo sapiens
uuccaagcaaguau

SEQ ID NO: 1941489 - RNA, 20 nt, Homo sapiens
acuucagauguuuccaagau

SEQ ID NO: 1941490 - RNA, 22 nt, Homo sapiens
acucucacuccacccagaguag

SEQ ID NO: 1941491 - RNA, 16 nt, Homo sapiens
caccaauaaagccuuc

SEQ ID NO: 1941492 - RNA, 22 nt, Homo sapiens
uuccaggagcauagaagccaca

SEQ ID NO: 1941493 - RNA, 21 nt, Homo sapiens
caucagugaccaccaacauuc

SEQ ID NO: 1941494 - RNA, 22 nt, Homo sapiens
accgaagggacuggaucugcag

SEQ ID NO: 1941495 - RNA, 16 nt, Homo sapiens
agcaaaggaucuggac

SEQ ID NO: 1941496 - RNA, 14 nt, Homo sapiens
cacaaauacauucc

SEQ ID NO: 1941497 - RNA, 13 nt, Homo sapiens
acauaauugauua

SEQ ID NO: 1941498 - RNA, 16 nt, Homo sapiens
ugacauaauauauucu

SEQ ID NO: 1941499 - RNA, 20 nt, Homo sapiens
gaaacauugaacucauaucu

SEQ ID NO: 1941500 - RNA, 21 nt, Homo sapiens
aaagucaccacuccauuccca

SEQ ID NO: 1941501 - RNA, 16 nt, Homo sapiens
uguagcagaaaccaag

SEQ ID NO: 1941502 - RNA, 23 nt, Homo sapiens
uucucugggcugaauguauguca

SEQ ID NO: 1941503 - RNA, 14 nt, Homo sapiens
cauucacuagcuuu

SEQ ID NO: 1941504 - RNA, 14 nt, Homo sapiens
ucggagcucagugc

SEQ ID NO: 1941505 - RNA, 13 nt, Homo sapiens
cacagaggaugcu

SEQ ID NO: 1941506 - RNA, 18 nt, Homo sapiens
aauauaguaccugaaaaa

SEQ ID NO: 1941507 - RNA, 21 nt, Homo sapiens
augacuuccucacauggucug

SEQ ID NO: 1941508 - RNA, 20 nt, Homo sapiens
ccuuauuuuuacuuguaugu

SEQ ID NO: 1941509 - RNA, 18 nt, Homo sapiens
aguagcaacccugugaua

SEQ ID NO: 1941510 - RNA, 17 nt, Homo sapiens
caauaaugaguucacua

SEQ ID NO: 1941511 - RNA, 21 nt, Homo sapiens
uuaaaacugaacuugaagcua

SEQ ID NO: 1941512 - RNA, 14 nt, Homo sapiens
uaggauuucagcca

SEQ ID NO: 1941513 - RNA, 23 nt, Homo sapiens
uccugaauaaagcagacaggugu

SEQ ID NO: 1941514 - RNA, 19 nt, Homo sapiens
gggaccuaagccacguuaa

SEQ ID NO: 1941515 - RNA, 16 nt, Homo sapiens
auuuaacagugcaaaa

SEQ ID NO: 1941516 - RNA, 19 nt, Homo sapiens
cagaaccggccuggagcuc

SEQ ID NO: 1941517 - RNA, 22 nt, Homo sapiens
cuguacauaguccuuuuaucuc

SEQ ID NO: 1941518 - RNA, 17 nt, Homo sapiens
caaaacacucaucuccu

SEQ ID NO: 1941519 - RNA, 13 nt, Homo sapiens
uuggaacaaucac

SEQ ID NO: 1941520 - RNA, 21 nt, Homo sapiens
gauccgucuuuggccuccucc

SEQ ID NO: 1941521 - RNA, 23 nt, Homo sapiens
cuggguacugaaagccuuaggga

SEQ ID NO: 1941522 - RNA, 21 nt, Homo sapiens
cuuuuuucacggaaguuuuca

SEQ ID NO: 1941523 - RNA, 15 nt, Homo sapiens
ggcauagccauucau

SEQ ID NO: 1941524 - RNA, 14 nt, Homo sapiens
aagauccuacccca

SEQ ID NO: 1941525 - RNA, 18 nt, Homo sapiens
caaagccaucuuccugcc

SEQ ID NO: 1941526 - RNA, 16 nt, Homo sapiens
cagucccucacaccug

SEQ ID NO: 1941527 - RNA, 14 nt, Homo sapiens
ccaagcuucugagu

SEQ ID NO: 1941528 - RNA, 15 nt, Homo sapiens
gguuaucugggcaua

SEQ ID NO: 1941529 - RNA, 19 nt, Homo sapiens
accaggccuccaagccagg

SEQ ID NO: 1941530 - RNA, 13 nt, Homo sapiens
cccaugaaacagc

SEQ ID NO: 1941531 - RNA, 17 nt, Homo sapiens
agugauuugggggugca

SEQ ID NO: 1941532 - RNA, 19 nt, Homo sapiens
gccggaucucgaggcuugc

SEQ ID NO: 1941533 - RNA, 12 nt, Homo sapiens
aaucaugaucac

SEQ ID NO: 1941534 - RNA, 13 nt, Homo sapiens
acugaauucugaa

SEQ ID NO: 1941535 - RNA, 16 nt, Homo sapiens
ggacaucacagggugg

SEQ ID NO: 1941536 - RNA, 18 nt, Homo sapiens
auuuucuguguguuccug

SEQ ID NO: 1941537 - RNA, 14 nt, Homo sapiens
ggcccucagugaga

SEQ ID NO: 1941538 - RNA, 13 nt, Homo sapiens
ccagccaugguga

SEQ ID NO: 1941539 - RNA, 20 nt, Homo sapiens
caagcuuugguuuaugguuu

SEQ ID NO: 1941540 - RNA, 15 nt, Homo sapiens
auguggcccucugga

SEQ ID NO: 1941541 - RNA, 13 nt, Homo sapiens
aucucagcucacu

SEQ ID NO: 1941542 - RNA, 21 nt, Homo sapiens
gauuuugcugagaugaagcua

SEQ ID NO: 1941543 - RNA, 18 nt, Homo sapiens
guaauauaaugaugcugu

SEQ ID NO: 1941544 - RNA, 15 nt, Homo sapiens
gguggaaaaacugag

SEQ ID NO: 1941545 - RNA, 17 nt, Homo sapiens
cauagagacuugggaau

SEQ ID NO: 1941546 - RNA, 16 nt, Homo sapiens
ugccgucugugacauu

SEQ ID NO: 1941547 - RNA, 14 nt, Homo sapiens
uuccaugacaucaa

SEQ ID NO: 1941548 - RNA, 13 nt, Homo sapiens
aaaacaaauccau

SEQ ID NO: 1941549 - RNA, 14 nt, Homo sapiens
ucagccuugcaaau

SEQ ID NO: 1941550 - RNA, 19 nt, Homo sapiens
aaugucaagacagggaagg

SEQ ID NO: 1941551 - RNA, 18 nt, Homo sapiens
aacuucuccugaaugcau

SEQ ID NO: 1941552 - RNA, 23 nt, Homo sapiens
uuuacuagaacacagaaagccua

SEQ ID NO: 1941553 - RNA, 16 nt, Homo sapiens
ugaaaggaaaugcacc

SEQ ID NO: 1941554 - RNA, 23 nt, Homo sapiens
agaguauauuuaagaagccaagg

SEQ ID NO: 1941555 - RNA, 16 nt, Homo sapiens
cuuaaaacauggugcc

SEQ ID NO: 1941556 - RNA, 14 nt, Homo sapiens
aagcaacaggccau

SEQ ID NO: 1941557 - RNA, 15 nt, Homo sapiens
ugaacucuguaaaac

SEQ ID NO: 1941558 - RNA, 23 nt, Homo sapiens
gccugccuguccccccgcacuuu

SEQ ID NO: 1941559 - RNA, 18 nt, Homo sapiens
cuuuccucagcaccuggg

SEQ ID NO: 1941560 - RNA, 15 nt, Homo sapiens
ugacaucacagcagc

SEQ ID NO: 1941561 - RNA, 16 nt, Homo sapiens
acucucaggcauggau

SEQ ID NO: 1941562 - RNA, 21 nt, Homo sapiens
guuugaacucuucuuugccag

SEQ ID NO: 1941563 - RNA, 14 nt, Homo sapiens
aauaugucaguuug

SEQ ID NO: 1941564 - RNA, 19 nt, Homo sapiens
cuguagaacaccccugugc

SEQ ID NO: 1941565 - RNA, 17 nt, Homo sapiens
uuuuaacaacuaugauu

SEQ ID NO: 1941566 - RNA, 14 nt, Homo sapiens
agugucagccaugg

SEQ ID NO: 1941567 - RNA, 22 nt, Homo sapiens
ucauguauauguguucauuaaa

SEQ ID NO: 1941568 - RNA, 12 nt, Homo sapiens
uucagagaucau

SEQ ID NO: 1941569 - RNA, 20 nt, Homo sapiens
uuuggggacagaguguccuu

SEQ ID NO: 1941570 - RNA, 22 nt, Homo sapiens
cagagcacccagaucagacucu

SEQ ID NO: 1941571 - RNA, 23 nt, Homo sapiens
gacagacgccugcuuuugcaaau

SEQ ID NO: 1941572 - RNA, 20 nt, Homo sapiens
cauugucaccucugugaccc

SEQ ID NO: 1941573 - RNA, 22 nt, Homo sapiens
guuuuucuucaacaucaauguu

SEQ ID NO: 1941574 - RNA, 15 nt, Homo sapiens
ucuccacacaggugu

SEQ ID NO: 1941575 - RNA, 16 nt, Homo sapiens
gcuccccucacucugu

SEQ ID NO: 1941576 - RNA, 13 nt, Homo sapiens
gcaagacuugaac

SEQ ID NO: 1941577 - RNA, 21 nt, Homo sapiens
gcaucauuuccccaacagggc

SEQ ID NO: 1941578 - RNA, 14 nt, Homo sapiens
cauguucugugcau

SEQ ID NO: 1941579 - RNA, 19 nt, Homo sapiens
ucauuuauuugacauagau

SEQ ID NO: 1941580 - RNA, 16 nt, Homo sapiens
ucucaaaguguacaaa

SEQ ID NO: 1941581 - RNA, 19 nt, Homo sapiens
cugugucaguggaugcugc

SEQ ID NO: 1941582 - RNA, 14 nt, Homo sapiens
acccauuuuugcuc

SEQ ID NO: 1941583 - RNA, 21 nt, Homo sapiens
ugucucuugacuggcucaaga

SEQ ID NO: 1941584 - RNA, 16 nt, Homo sapiens
cgcauacacacaugcc

SEQ ID NO: 1941585 - RNA, 16 nt, Homo sapiens
ucugauuggugauuca

SEQ ID NO: 1941586 - RNA, 21 nt, Homo sapiens
acaauacuuuucaggcacuuu

SEQ ID NO: 1941587 - RNA, 13 nt, Homo sapiens
accugcauucaac

SEQ ID NO: 1941588 - RNA, 22 nt, Homo sapiens
ugcaucagugacugaauucugc

SEQ ID NO: 1941589 - RNA, 15 nt, Homo sapiens
uacccaugcuuuguu

SEQ ID NO: 1941590 - RNA, 23 nt, Homo sapiens
ugauccucuacugugcaucuccu

SEQ ID NO: 1941591 - RNA, 16 nt, Homo sapiens
uuugguagaugacaaa

SEQ ID NO: 1941592 - RNA, 15 nt, Homo sapiens
ugaaacuccaucuca

SEQ ID NO: 1941593 - RNA, 20 nt, Homo sapiens
ccagggaggaauugggguuu

SEQ ID NO: 1941594 - RNA, 16 nt, Homo sapiens
gaaccuguccuugcac

SEQ ID NO: 1941595 - RNA, 15 nt, Homo sapiens
agaaagcuaucucug

SEQ ID NO: 1941596 - RNA, 17 nt, Homo sapiens
cccuccucucccaguga

SEQ ID NO: 1941597 - RNA, 18 nt, Homo sapiens
guuucacagccuauaacc

SEQ ID NO: 1941598 - RNA, 12 nt, Homo sapiens
caagagcucaag

SEQ ID NO: 1941599 - RNA, 12 nt, Homo sapiens
cucuagcucucu

SEQ ID NO: 1941600 - RNA, 12 nt, Homo sapiens
cagcagcucagc

SEQ ID NO: 1941601 - RNA, 15 nt, Homo sapiens
uuaccagucaaugca

SEQ ID NO: 1941602 - RNA, 14 nt, Homo sapiens
acuaguagauuucu

SEQ ID NO: 1941603 - RNA, 17 nt, Homo sapiens
gguauaauuuuuaucca

SEQ ID NO: 1941604 - RNA, 12 nt, Homo sapiens
uccauguugacu

SEQ ID NO: 1941605 - RNA, 22 nt, Homo sapiens
accucaacauugcauggugcua

SEQ ID NO: 1941606 - RNA, 13 nt, Homo sapiens
uuacuuucucugu

SEQ ID NO: 1941607 - RNA, 21 nt, Homo sapiens
ucugcacccagccaaacacau

SEQ ID NO: 1941608 - RNA, 13 nt, Homo sapiens
gguuucacuugca

SEQ ID NO: 1941609 - RNA, 13 nt, Homo sapiens
aagccucucagua

SEQ ID NO: 1941610 - RNA, 13 nt, Homo sapiens
aucccucucucua

SEQ ID NO: 1941611 - RNA, 19 nt, Homo sapiens
cccaaaggaacacugacau

SEQ ID NO: 1941612 - RNA, 18 nt, Homo sapiens
uuaugcuauuuggacaau

SEQ ID NO: 1941613 - RNA, 18 nt, Homo sapiens
ucaccuuuuccuugcuga

SEQ ID NO: 1941614 - RNA, 21 nt, Homo sapiens
acgcugggcuucacggcugcc

SEQ ID NO: 1941615 - RNA, 16 nt, Homo sapiens
agaagcugcccucagc

SEQ ID NO: 1941616 - RNA, 21 nt, Homo sapiens
uguguucacuacauugugcaa

SEQ ID NO: 1941617 - RNA, 18 nt, Homo sapiens
ucuccagaacccauuuga

SEQ ID NO: 1941618 - RNA, 16 nt, Homo sapiens
guuuauauuguggaau

SEQ ID NO: 1941619 - RNA, 20 nt, Homo sapiens
ccaagacuuuugucugauca

SEQ ID NO: 1941620 - RNA, 14 nt, Homo sapiens
uggguacugacuga

SEQ ID NO: 1941621 - RNA, 15 nt, Homo sapiens
acucuguuccuggcu

SEQ ID NO: 1941622 - RNA, 18 nt, Homo sapiens
uuggacugacuaccagcu

SEQ ID NO: 1941623 - RNA, 13 nt, Homo sapiens
agaaagauuucau

SEQ ID NO: 1941624 - RNA, 18 nt, Homo sapiens
cagaagccugaugcugac

SEQ ID NO: 1941625 - RNA, 18 nt, Homo sapiens
auauuuuuaaagcuuuca

SEQ ID NO: 1941626 - RNA, 15 nt, Homo sapiens
cuugggcgggacaca

SEQ ID NO: 1941627 - RNA, 21 nt, Homo sapiens
aucaugaagcacaucaauuac

SEQ ID NO: 1941628 - RNA, 21 nt, Homo sapiens
ugagcauauguuccaugccug

SEQ ID NO: 1941629 - RNA, 21 nt, Homo sapiens
ucagcaaacuaaccagcauuc

SEQ ID NO: 1941630 - RNA, 22 nt, Homo sapiens
uuggcuguagaaggagacagag

SEQ ID NO: 1941631 - RNA, 12 nt, Homo sapiens
ccacuacuguag

SEQ ID NO: 1941632 - RNA, 16 nt, Homo sapiens
aaguucucaagcugcc

SEQ ID NO: 1941633 - RNA, 21 nt, Homo sapiens
ucuugggcccaggacuguuga

SEQ ID NO: 1941634 - RNA, 23 nt, Homo sapiens
ucugaaaggaagacauuuucuac

SEQ ID NO: 1941635 - RNA, 23 nt, Homo sapiens
cucaugccacagugguacucugu

SEQ ID NO: 1941636 - RNA, 16 nt, Homo sapiens
auaaauacugcuguau

SEQ ID NO: 1941637 - RNA, 13 nt, Homo sapiens
uucuuuguauuau

SEQ ID NO: 1941638 - RNA, 18 nt, Homo sapiens
cagacacaggucccugag

SEQ ID NO: 1941639 - RNA, 12 nt, Homo sapiens
agaggggacgca

SEQ ID NO: 1941640 - RNA, 22 nt, Homo sapiens
uuauggagucauuuuuacaaug

SEQ ID NO: 1941641 - RNA, 15 nt, Homo sapiens
uggcuuacaaaaaga

SEQ ID NO: 1941642 - RNA, 17 nt, Homo sapiens
uuucuuaauuuguaacu

SEQ ID NO: 1941643 - RNA, 23 nt, Homo sapiens
gaccugguacaaaugcacgucac

SEQ ID NO: 1941644 - RNA, 23 nt, Homo sapiens
ccccacagaaccuucaacccagu

SEQ ID NO: 1941645 - RNA, 20 nt, Homo sapiens
auuuauugccuggaguguga

SEQ ID NO: 1941646 - RNA, 15 nt, Homo sapiens
gggugugugugggca

SEQ ID NO: 1941647 - RNA, 19 nt, Homo sapiens
guaguugggauuacaggug

SEQ ID NO: 1941648 - RNA, 16 nt, Homo sapiens
gccaaucuguacaaaa

SEQ ID NO: 1941649 - RNA, 21 nt, Homo sapiens
aucagcaauuucagaaccaaa

SEQ ID NO: 1941650 - RNA, 15 nt, Homo sapiens
aaucaaaugauuuca

SEQ ID NO: 1941651 - RNA, 15 nt, Homo sapiens
gccuaucaaaggaaa

SEQ ID NO: 1941652 - RNA, 18 nt, Homo sapiens
ugcucuccuucacucuga

SEQ ID NO: 1941653 - RNA, 20 nt, Homo sapiens
auagcucucaucacuaccuu

SEQ ID NO: 1941654 - RNA, 18 nt, Homo sapiens
auuauuaaaagaugucuc

SEQ ID NO: 1941655 - RNA, 13 nt, Homo sapiens
auuucaucaugac

SEQ ID NO: 1941656 - RNA, 15 nt, Homo sapiens
ugugaauccagugaa

SEQ ID NO: 1941657 - RNA, 12 nt, Homo sapiens
guugaaaagcca

SEQ ID NO: 1941658 - RNA, 12 nt, Homo sapiens
uggagaccauua

SEQ ID NO: 1941659 - RNA, 18 nt, Homo sapiens
gaaaagaacacuugccca

SEQ ID NO: 1941660 - RNA, 19 nt, Homo sapiens
ugagagacacacugaagaa

SEQ ID NO: 1941661 - RNA, 13 nt, Homo sapiens
cuaaggaguaauc

SEQ ID NO: 1941662 - RNA, 17 nt, Homo sapiens
guauaaauguacaucag

SEQ ID NO: 1941663 - RNA, 20 nt, Homo sapiens
ccuugggcuauuuggacuca

SEQ ID NO: 1941664 - RNA, 22 nt, Homo sapiens
ccacccuuuacuccccagagca

SEQ ID NO: 1941665 - RNA, 12 nt, Homo sapiens
augaugcaaauc

SEQ ID NO: 1941666 - RNA, 17 nt, Homo sapiens
ucuuuguugauguuuag

SEQ ID NO: 1941667 - RNA, 23 nt, Homo sapiens
cauuuaaaaagcucacugcugau

SEQ ID NO: 1941668 - RNA, 14 nt, Homo sapiens
uuggggaaauccau

SEQ ID NO: 1941669 - RNA, 19 nt, Homo sapiens
uuuauuauauuuuucccua

SEQ ID NO: 1941670 - RNA, 10 nt, Homo sapiens
gccuucacag

SEQ ID NO: 1941671 - RNA, 18 nt, Homo sapiens
cucuccucuuugauguca

SEQ ID NO: 1941672 - RNA, 20 nt, Homo sapiens
augaacaaugugugggauaa

SEQ ID NO: 1941673 - RNA, 22 nt, Homo sapiens
ucucaagaagaacaucuuuaug

SEQ ID NO: 1941674 - RNA, 19 nt, Homo sapiens
ugaacuucaaaagcuuuuu

SEQ ID NO: 1941675 - RNA, 12 nt, Homo sapiens
ccucccuggcau

SEQ ID NO: 1941676 - RNA, 14 nt, Homo sapiens
gcggaguugugcac

SEQ ID NO: 1941677 - RNA, 14 nt, Homo sapiens
auaaugcaauagaa

SEQ ID NO: 1941678 - RNA, 15 nt, Homo sapiens
auuuucuagacuuuc

SEQ ID NO: 1941679 - RNA, 17 nt, Homo sapiens
agaaacuucggggcugc

SEQ ID NO: 1941680 - RNA, 20 nt, Homo sapiens
augcacugugggauguguuc

SEQ ID NO: 1941681 - RNA, 18 nt, Homo sapiens
ccugcaggccccagccaa

SEQ ID NO: 1941682 - RNA, 14 nt, Homo sapiens
gacacaauccucaa

SEQ ID NO: 1941683 - RNA, 22 nt, Homo sapiens
uguuccuaaaaaucuguggcaa

SEQ ID NO: 1941684 - RNA, 16 nt, Homo sapiens
caaccuuguugcuuua

SEQ ID NO: 1941685 - RNA, 22 nt, Homo sapiens
gggaagggggcuguguguccuu

SEQ ID NO: 1941686 - RNA, 18 nt, Homo sapiens
ucgagaccauccuggcua

SEQ ID NO: 1941687 - RNA, 21 nt, Homo sapiens
caggugggguggagucccaga

SEQ ID NO: 1941688 - RNA, 23 nt, Homo sapiens
uggaaggcagaccugaaucacaa

SEQ ID NO: 1941689 - RNA, 19 nt, Homo sapiens
cugaaagucuucaugguga

SEQ ID NO: 1941690 - RNA, 15 nt, Homo sapiens
agaaaaucacacuua

SEQ ID NO: 1941691 - RNA, 13 nt, Homo sapiens
uacacuaguccau

SEQ ID NO: 1941692 - RNA, 15 nt, Homo sapiens
agugcugaacagugg

SEQ ID NO: 1941693 - RNA, 15 nt, Homo sapiens
acucugaaagaccua

SEQ ID NO: 1941694 - RNA, 13 nt, Homo sapiens
guugaaauggcau

SEQ ID NO: 1941695 - RNA, 17 nt, Homo sapiens
cuggacuccacgaugcc

SEQ ID NO: 1941696 - RNA, 13 nt, Homo sapiens
ccccaucugucca

SEQ ID NO: 1941697 - RNA, 23 nt, Homo sapiens
acagcauaggguccacuuuggua

SEQ ID NO: 1941698 - RNA, 12 nt, Homo sapiens
ggucuuugcucc

SEQ ID NO: 1941699 - RNA, 14 nt, Homo sapiens
aauaaauacugcag

SEQ ID NO: 1941700 - RNA, 15 nt, Homo sapiens
acucaugaucaagau

SEQ ID NO: 1941701 - RNA, 22 nt, Homo sapiens
cucugacgccgcgcacucagcc

SEQ ID NO: 1941702 - RNA, 23 nt, Homo sapiens
acgccuggugccccagcaccaac

SEQ ID NO: 1941703 - RNA, 12 nt, Homo sapiens
ucuacaacugau

SEQ ID NO: 1941704 - RNA, 23 nt, Homo sapiens
agauauuguaccaggaugugcua

SEQ ID NO: 1941705 - RNA, 23 nt, Homo sapiens
aguuuccacaggcagcaucccaa

SEQ ID NO: 1941706 - RNA, 22 nt, Homo sapiens
caaguggaccuuaggccuuccu

SEQ ID NO: 1941707 - RNA, 13 nt, Homo sapiens
gaagauaacuggc

SEQ ID NO: 1941708 - RNA, 19 nt, Homo sapiens
uaaauagaugaguccuguu

SEQ ID NO: 1941709 - RNA, 20 nt, Homo sapiens
accugcauguguuguacaau

SEQ ID NO: 1941710 - RNA, 13 nt, Homo sapiens
auaucauacuucc

SEQ ID NO: 1941711 - RNA, 19 nt, Homo sapiens
uggauucaacacugugcac

SEQ ID NO: 1941712 - RNA, 20 nt, Homo sapiens
gaccccagcugccaaggaaa

SEQ ID NO: 1941713 - RNA, 16 nt, Homo sapiens
ugccacuaaacuacau

SEQ ID NO: 1941714 - RNA, 16 nt, Homo sapiens
caggcuacaguugaua

SEQ ID NO: 1941715 - RNA, 19 nt, Homo sapiens
cuacuucggagaggccaag

SEQ ID NO: 1941716 - RNA, 20 nt, Homo sapiens
gccccacuucacccccaacu

SEQ ID NO: 1941717 - RNA, 18 nt, Homo sapiens
cucagaauaaaagaugau

SEQ ID NO: 1941718 - RNA, 21 nt, Homo sapiens
accuggagggcuagaaccuag

SEQ ID NO: 1941719 - RNA, 22 nt, Homo sapiens
agucccaucucaccucuaggcc

SEQ ID NO: 1941720 - RNA, 19 nt, Homo sapiens
gcugcuuccugucugagua

SEQ ID NO: 1941721 - RNA, 12 nt, Homo sapiens
uggaagauuugu

SEQ ID NO: 1941722 - RNA, 15 nt, Homo sapiens
uagaggauguaucuc

SEQ ID NO: 1941723 - RNA, 22 nt, Homo sapiens
gcaucuuccccaacgaaaagca

SEQ ID NO: 1941724 - RNA, 24 nt, Homo sapiens
ggagaauuauauagguugugcaaa

SEQ ID NO: 1941725 - RNA, 16 nt, Homo sapiens
cucuugggaagcaguu

SEQ ID NO: 1941726 - RNA, 17 nt, Homo sapiens
cuuucuccaggaccaau

SEQ ID NO: 1941727 - RNA, 22 nt, Homo sapiens
aaaagcauguacaguguucugu

SEQ ID NO: 1941728 - RNA, 13 nt, Homo sapiens
cccaacuugccaa

SEQ ID NO: 1941729 - RNA, 20 nt, Homo sapiens
ugcuucucccacuuggccaa

SEQ ID NO: 1941730 - RNA, 21 nt, Homo sapiens
agaggccuuggccaagcugcu

SEQ ID NO: 1941731 - RNA, 14 nt, Homo sapiens
gaggggcagggaag

SEQ ID NO: 1941732 - RNA, 15 nt, Homo sapiens
aggaguucugcucau

SEQ ID NO: 1941733 - RNA, 15 nt, Homo sapiens
cuuaaaaauaacuag

SEQ ID NO: 1941734 - RNA, 17 nt, Homo sapiens
uguacaauuacugugag

SEQ ID NO: 1941735 - RNA, 21 nt, Homo sapiens
guugcccgaaacuaagccagg

SEQ ID NO: 1941736 - RNA, 14 nt, Homo sapiens
uauuugcuauucaa

SEQ ID NO: 1941737 - RNA, 23 nt, Homo sapiens
uuuccuuauucaggaagauaaaa

SEQ ID NO: 1941738 - RNA, 21 nt, Homo sapiens
auuccguuaggaauaacacug

SEQ ID NO: 1941739 - RNA, 21 nt, Homo sapiens
agugugaauaaagugcugcgg

SEQ ID NO: 1941740 - RNA, 22 nt, Homo sapiens
accaggcuggggccaggggacc

SEQ ID NO: 1941741 - RNA, 17 nt, Homo sapiens
gccaggccuuggggaca

SEQ ID NO: 1941742 - RNA, 18 nt, Homo sapiens
aauaccccuaacauacug

SEQ ID NO: 1941743 - RNA, 18 nt, Homo sapiens
caccuccaccacaucugc

SEQ ID NO: 1941744 - RNA, 21 nt, Homo sapiens
cagaggcauuuaaaauggaaa

SEQ ID NO: 1941745 - RNA, 20 nt, Homo sapiens
gacgugaccaugguguuguu

SEQ ID NO: 1941746 - RNA, 15 nt, Homo sapiens
uuacaaaguguguau

SEQ ID NO: 1941747 - RNA, 15 nt, Homo sapiens
uuuuaguucuguaga

SEQ ID NO: 1941748 - RNA, 15 nt, Homo sapiens
ccucuaagacaaagu

SEQ ID NO: 1941749 - RNA, 15 nt, Homo sapiens
ccaauaugacucaga

SEQ ID NO: 1941750 - RNA, 14 nt, Homo sapiens
cuucucggcucagg

SEQ ID NO: 1941751 - RNA, 19 nt, Homo sapiens
acagaguagaaacucaaaa

SEQ ID NO: 1941752 - RNA, 19 nt, Homo sapiens
ggccagcugucgcaucuca

SEQ ID NO: 1941753 - RNA, 16 nt, Homo sapiens
auggccaaggggccag

SEQ ID NO: 1941754 - RNA, 23 nt, Homo sapiens
ucuguucuguuggaugacuuuga

SEQ ID NO: 1941755 - RNA, 15 nt, Homo sapiens
gccccaucagcagcu

SEQ ID NO: 1941756 - RNA, 18 nt, Homo sapiens
uguacaaauauaagaaua

SEQ ID NO: 1941757 - RNA, 13 nt, Homo sapiens
cugaauuaguaau

SEQ ID NO: 1941758 - RNA, 18 nt, Homo sapiens
gcaaaagguugacucaua

SEQ ID NO: 1941759 - RNA, 17 nt, Homo sapiens
ugcagaaauugaccuga

SEQ ID NO: 1941760 - RNA, 24 nt, Homo sapiens
uuccuuucccuuuagcacguuuaa

SEQ ID NO: 1941761 - RNA, 14 nt, Homo sapiens
cuucccuaguucuu

SEQ ID NO: 1941762 - RNA, 15 nt, Homo sapiens
aaggcuauugcugag

SEQ ID NO: 1941763 - RNA, 14 nt, Homo sapiens
agaacuaaaggugg

SEQ ID NO: 1941764 - RNA, 15 nt, Homo sapiens
uuguaucaugugcua

SEQ ID NO: 1941765 - RNA, 16 nt, Homo sapiens
uacauuuuauuacacu

SEQ ID NO: 1941766 - RNA, 21 nt, Homo sapiens
gucaguuucauggaggggaaa

SEQ ID NO: 1941767 - RNA, 14 nt, Homo sapiens
aaaaguacauguau

SEQ ID NO: 1941768 - RNA, 14 nt, Homo sapiens
cagaacaccuaugc

SEQ ID NO: 1941769 - RNA, 18 nt, Homo sapiens
aggagcagugcaggcaca

SEQ ID NO: 1941770 - RNA, 21 nt, Homo sapiens
agccugaauuggcuaugcagu

SEQ ID NO: 1941771 - RNA, 16 nt, Homo sapiens
guugcuuauugggagu

SEQ ID NO: 1941772 - RNA, 13 nt, Homo sapiens
aguguucaagaaa

SEQ ID NO: 1941773 - RNA, 19 nt, Homo sapiens
accuuagauuagcucugga

SEQ ID NO: 1941774 - RNA, 17 nt, Homo sapiens
ucaagucuccuccaugg

SEQ ID NO: 1941775 - RNA, 18 nt, Homo sapiens
gcacugguguugagcaau

SEQ ID NO: 1941776 - RNA, 13 nt, Homo sapiens
ucgcaagagccau

SEQ ID NO: 1941777 - RNA, 14 nt, Homo sapiens
acauucacugagug

SEQ ID NO: 1941778 - RNA, 14 nt, Homo sapiens
ucagagacagauac

SEQ ID NO: 1941779 - RNA, 20 nt, Homo sapiens
acacagcuugucucuugccu

SEQ ID NO: 1941780 - RNA, 12 nt, Homo sapiens
ccugugagauaa

SEQ ID NO: 1941781 - RNA, 19 nt, Homo sapiens
auaauuagaguuuguguau

SEQ ID NO: 1941782 - RNA, 17 nt, Homo sapiens
acaucagcaauuucaga

SEQ ID NO: 1941783 - RNA, 14 nt, Homo sapiens
uguaaagauauugu

SEQ ID NO: 1941784 - RNA, 17 nt, Homo sapiens
aacuauguuuuaucguc

SEQ ID NO: 1941785 - RNA, 14 nt, Homo sapiens
uuagcuaauaaaga

SEQ ID NO: 1941786 - RNA, 19 nt, Homo sapiens
ucaaauggacaauaccaga

SEQ ID NO: 1941787 - RNA, 19 nt, Homo sapiens
augucuugaaaacauguua

SEQ ID NO: 1941788 - RNA, 19 nt, Homo sapiens
aauagaaaaauuguaauag

SEQ ID NO: 1941789 - RNA, 18 nt, Homo sapiens
agugccaaaaacaacaac

SEQ ID NO: 1941790 - RNA, 16 nt, Homo sapiens
ccugagaaacaaucac

SEQ ID NO: 1941791 - RNA, 15 nt, Homo sapiens
ucaucacacacaugg

SEQ ID NO: 1941792 - RNA, 21 nt, Homo sapiens
acagugaaguucaaaugcccu

SEQ ID NO: 1941793 - RNA, 15 nt, Homo sapiens
agagcuugucagcaa

SEQ ID NO: 1941794 - RNA, 20 nt, Homo sapiens
guucaacugcuuacucccaa

SEQ ID NO: 1941795 - RNA, 12 nt, Homo sapiens
guauugcaccuu

SEQ ID NO: 1941796 - RNA, 15 nt, Homo sapiens
gcucaaauauugaau

SEQ ID NO: 1941797 - RNA, 18 nt, Homo sapiens
caggccaccucagucuca

SEQ ID NO: 1941798 - RNA, 22 nt, Homo sapiens
ggucaggcggggugcuguggug

SEQ ID NO: 1941799 - RNA, 19 nt, Homo sapiens
acaugugccgaaugugcag

SEQ ID NO: 1941800 - RNA, 16 nt, Homo sapiens
cggggaggaaccacug

SEQ ID NO: 1941801 - RNA, 21 nt, Homo sapiens
uccuguccccaaaaugugaug

SEQ ID NO: 1941802 - RNA, 22 nt, Homo sapiens
uagggaagaguucugaucugua

SEQ ID NO: 1941803 - RNA, 14 nt, Homo sapiens
agccauuugggaga

SEQ ID NO: 1941804 - RNA, 21 nt, Homo sapiens
ccuauuuuaauaaacacucuu

SEQ ID NO: 1941805 - RNA, 20 nt, Homo sapiens
agacccaacccaugccccug

SEQ ID NO: 1941806 - RNA, 22 nt, Homo sapiens
uccugcgaaggcugggcacugc

SEQ ID NO: 1941807 - RNA, 15 nt, Homo sapiens
uaaaauaguaugaaa

SEQ ID NO: 1941808 - RNA, 22 nt, Homo sapiens
aggacaaaauaaggaacaugaa

SEQ ID NO: 1941809 - RNA, 17 nt, Homo sapiens
gauccuucagcacagga

SEQ ID NO: 1941810 - RNA, 14 nt, Homo sapiens
agauccuaaacucu

SEQ ID NO: 1941811 - RNA, 17 nt, Homo sapiens
aggauguauaaaauggu

SEQ ID NO: 1941812 - RNA, 19 nt, Homo sapiens
ugcuaucggggaagccaga

SEQ ID NO: 1941813 - RNA, 15 nt, Homo sapiens
aucccugaaauccag

SEQ ID NO: 1941814 - RNA, 22 nt, Homo sapiens
agauccucaauaaacauuucau

SEQ ID NO: 1941815 - RNA, 17 nt, Homo sapiens
gcacccgccaccaugcc

SEQ ID NO: 1941816 - RNA, 15 nt, Homo sapiens
cccagcaccugccag

SEQ ID NO: 1941817 - RNA, 12 nt, Homo sapiens
aauauaguccaa

SEQ ID NO: 1941818 - RNA, 16 nt, Homo sapiens
cugucuuccucugcaa

SEQ ID NO: 1941819 - RNA, 14 nt, Homo sapiens
cugauggauuccaa

SEQ ID NO: 1941820 - RNA, 22 nt, Homo sapiens
ucuccagcuccucuccagacac

SEQ ID NO: 1941821 - RNA, 12 nt, Homo sapiens
aagauuucugcu

SEQ ID NO: 1941822 - RNA, 21 nt, Homo sapiens
gcucugcaauuccccucugcu

SEQ ID NO: 1941823 - RNA, 21 nt, Homo sapiens
aacuacuauuuuuagcaaugu

SEQ ID NO: 1941824 - RNA, 22 nt, Homo sapiens
gcgcuggguauuggaaauggau

SEQ ID NO: 1941825 - RNA, 22 nt, Homo sapiens
ucccagagcauugcuauuuauc

SEQ ID NO: 1941826 - RNA, 19 nt, Homo sapiens
cccaaugacacccaugcca

SEQ ID NO: 1941827 - RNA, 19 nt, Homo sapiens
uucaaaauguucuauuuaa

SEQ ID NO: 1941828 - RNA, 13 nt, Homo sapiens
acagcaaaggaac

SEQ ID NO: 1941829 - RNA, 15 nt, Homo sapiens
uugguuucagccaag

SEQ ID NO: 1941830 - RNA, 15 nt, Homo sapiens
uuuaaauuccacuga

SEQ ID NO: 1941831 - RNA, 21 nt, Homo sapiens
cuuuuuaauuggcccuguaca

SEQ ID NO: 1941832 - RNA, 18 nt, Homo sapiens
uuugcuagcagaaaucua

SEQ ID NO: 1941833 - RNA, 22 nt, Homo sapiens
ucccuugggcuggagaauuuag

SEQ ID NO: 1941834 - RNA, 21 nt, Homo sapiens
cagcggagaggaccccauucu

SEQ ID NO: 1941835 - RNA, 17 nt, Homo sapiens
ugaagaggccuaaguca

SEQ ID NO: 1941836 - RNA, 13 nt, Homo sapiens
uauaaccaaaagg

SEQ ID NO: 1941837 - RNA, 22 nt, Homo sapiens
agaaaauuaagggccgauuuaa

SEQ ID NO: 1941838 - RNA, 23 nt, Homo sapiens
aaaagcaaauaguagauggcaaa

SEQ ID NO: 1941839 - RNA, 15 nt, Homo sapiens
cagagcaagacuguc

SEQ ID NO: 1941840 - RNA, 18 nt, Homo sapiens
cuuuccuaaaccauucac

SEQ ID NO: 1941841 - RNA, 13 nt, Homo sapiens
ggcaaacaagcac

SEQ ID NO: 1941842 - RNA, 14 nt, Homo sapiens
acucacaagcaauc

SEQ ID NO: 1941843 - RNA, 17 nt, Homo sapiens
ugugauugcacagaauu

SEQ ID NO: 1941844 - RNA, 15 nt, Homo sapiens
gguuccggaauccug

SEQ ID NO: 1941845 - RNA, 18 nt, Homo sapiens
auaguuaugugauuuucc

SEQ ID NO: 1941846 - RNA, 20 nt, Homo sapiens
cagaguuucucucuguugcc

SEQ ID NO: 1941847 - RNA, 17 nt, Homo sapiens
agacauacuccuuccau

SEQ ID NO: 1941848 - RNA, 16 nt, Homo sapiens
uagagugucucagggu

SEQ ID NO: 1941849 - RNA, 22 nt, Homo sapiens
aucuaauauggccacaguaguc

SEQ ID NO: 1941850 - RNA, 17 nt, Homo sapiens
uacuauuugaagcaaug

SEQ ID NO: 1941851 - RNA, 19 nt, Homo sapiens
uggaggccucacacccaga

SEQ ID NO: 1941852 - RNA, 18 nt, Homo sapiens
gcucccugacagcaccug

SEQ ID NO: 1941853 - RNA, 17 nt, Homo sapiens
augugaggaaaugauga

SEQ ID NO: 1941854 - RNA, 23 nt, Homo sapiens
uucaccuauuaccaguguucccu

SEQ ID NO: 1941855 - RNA, 23 nt, Homo sapiens
ucagcacguaguuugcauuccag

SEQ ID NO: 1941856 - RNA, 19 nt, Homo sapiens
uauucuuaaaaugcaauau

SEQ ID NO: 1941857 - RNA, 19 nt, Homo sapiens
uggucugccuucugcugaa

SEQ ID NO: 1941858 - RNA, 20 nt, Homo sapiens
uaauucuuauggcugcugaa

SEQ ID NO: 1941859 - RNA, 20 nt, Homo sapiens
acaggcgccugccaucaugc

SEQ ID NO: 1941860 - RNA, 18 nt, Homo sapiens
aaggguuaggacucucca

SEQ ID NO: 1941861 - RNA, 12 nt, Homo sapiens
gcaguccuuugu

SEQ ID NO: 1941862 - RNA, 21 nt, Homo sapiens
ucauggcaucauugcauucca

SEQ ID NO: 1941863 - RNA, 17 nt, Homo sapiens
guuugagaaaugcauag

SEQ ID NO: 1941864 - RNA, 23 nt, Homo sapiens
agguuucaccucccaaacccagc

SEQ ID NO: 1941865 - RNA, 17 nt, Homo sapiens
uucugggcugggaacca

SEQ ID NO: 1941866 - RNA, 20 nt, Homo sapiens
ccauucugucucuguacugu

SEQ ID NO: 1941867 - RNA, 18 nt, Homo sapiens
gccacugguuucucagaa

SEQ ID NO: 1941868 - RNA, 20 nt, Homo sapiens
aacccggcuaugggacugca

SEQ ID NO: 1941869 - RNA, 13 nt, Homo sapiens
uaaacauguguuu

SEQ ID NO: 1941870 - RNA, 16 nt, Homo sapiens
cuuaaaauaagugaau

SEQ ID NO: 1941871 - RNA, 15 nt, Homo sapiens
aaacauauguauaca

SEQ ID NO: 1941872 - RNA, 15 nt, Homo sapiens
auuuacuugaucauu

SEQ ID NO: 1941873 - RNA, 15 nt, Homo sapiens
gucuauauaaccaca

SEQ ID NO: 1941874 - RNA, 21 nt, Homo sapiens
gucccucugccuugcacaaaa

SEQ ID NO: 1941875 - RNA, 22 nt, Homo sapiens
cuaugauauauuuauaucauau

SEQ ID NO: 1941876 - RNA, 18 nt, Homo sapiens
uggaaaagggucuuggga

SEQ ID NO: 1941877 - RNA, 17 nt, Homo sapiens
acugcaugcaagcucag

SEQ ID NO: 1941878 - RNA, 16 nt, Homo sapiens
cauacuacacauucaa

SEQ ID NO: 1941879 - RNA, 15 nt, Homo sapiens
auugucccucugccc

SEQ ID NO: 1941880 - RNA, 18 nt, Homo sapiens
uggccaggacacacugaa

SEQ ID NO: 1941881 - RNA, 18 nt, Homo sapiens
cauugguuauauuaccaa

SEQ ID NO: 1941882 - RNA, 19 nt, Homo sapiens
gguucaccaggucagggag

SEQ ID NO: 1941883 - RNA, 21 nt, Homo sapiens
augucaacagccauuuaggca

SEQ ID NO: 1941884 - RNA, 23 nt, Homo sapiens
cagggggguuggguuccagacag

SEQ ID NO: 1941885 - RNA, 22 nt, Homo sapiens
uauaauuaaagaaaauugccaa

SEQ ID NO: 1941886 - RNA, 14 nt, Homo sapiens
gcaucucacuuuau

SEQ ID NO: 1941887 - RNA, 15 nt, Homo sapiens
ccccucccccaucuc

SEQ ID NO: 1941888 - RNA, 17 nt, Homo sapiens
uugguccaacaguuuga

SEQ ID NO: 1941889 - RNA, 19 nt, Homo sapiens
gaaaaucauuugaggucag

SEQ ID NO: 1941890 - RNA, 13 nt, Homo sapiens
cguggacacccca

SEQ ID NO: 1941891 - RNA, 14 nt, Homo sapiens
caguggaucucaau

SEQ ID NO: 1941892 - RNA, 13 nt, Homo sapiens
uauguauuuucag

SEQ ID NO: 1941893 - RNA, 14 nt, Homo sapiens
caccaccaccggcc

SEQ ID NO: 1941894 - RNA, 14 nt, Homo sapiens
gggaaugcaauccu

SEQ ID NO: 1941895 - RNA, 11 nt, Homo sapiens
ccuugagaaac

SEQ ID NO: 1941896 - RNA, 20 nt, Homo sapiens
agcauuagcuggcgcauauu

SEQ ID NO: 1941897 - RNA, 20 nt, Homo sapiens
ccgaagucuuuuguucgcau

SEQ ID NO: 1941898 - RNA, 12 nt, Homo sapiens
gcucacgugugu

SEQ ID NO: 1941899 - RNA, 17 nt, Homo sapiens
ugaaauaacagccuuaa

SEQ ID NO: 1941900 - RNA, 15 nt, Homo sapiens
gcaaggaaugacuca

SEQ ID NO: 1941901 - RNA, 24 nt, Homo sapiens
gaggcuugcccaggagcaagugag

SEQ ID NO: 1941902 - RNA, 20 nt, Homo sapiens
acuccagccugggugacaga

SEQ ID NO: 1941903 - RNA, 15 nt, Homo sapiens
ggagccgcugcugag

SEQ ID NO: 1941904 - RNA, 16 nt, Homo sapiens
caacauaguauucaug

SEQ ID NO: 1941905 - RNA, 17 nt, Homo sapiens
aggugccagucuuccag

SEQ ID NO: 1941906 - RNA, 22 nt, Homo sapiens
cagagaacagucauguaugcaa

SEQ ID NO: 1941907 - RNA, 19 nt, Homo sapiens
ucuuguccacagucuccca

SEQ ID NO: 1941908 - RNA, 14 nt, Homo sapiens
acaagaagacuguc

SEQ ID NO: 1941909 - RNA, 17 nt, Homo sapiens
ccacuggacaacacuga

SEQ ID NO: 1941910 - RNA, 15 nt, Homo sapiens
uuuaaaaaauucucu

SEQ ID NO: 1941911 - RNA, 20 nt, Homo sapiens
aaaugcuuauguuagaaaua

SEQ ID NO: 1941912 - RNA, 20 nt, Homo sapiens
ugugaccagucugacccuua

SEQ ID NO: 1941913 - RNA, 15 nt, Homo sapiens
aaagugaucuugaga

SEQ ID NO: 1941914 - RNA, 20 nt, Homo sapiens
acaggccugauaacucugua

SEQ ID NO: 1941915 - RNA, 19 nt, Homo sapiens
uuuguaaaaauguccccac

SEQ ID NO: 1941916 - RNA, 17 nt, Homo sapiens
ugucuuuaauuucagga

SEQ ID NO: 1941917 - RNA, 21 nt, Homo sapiens
ucauaauugucaaaaaccaga

SEQ ID NO: 1941918 - RNA, 15 nt, Homo sapiens
gacacuuuaccucuu

SEQ ID NO: 1941919 - RNA, 21 nt, Homo sapiens
uacuugauuaaggacuacaga

SEQ ID NO: 1941920 - RNA, 19 nt, Homo sapiens
ccaagccacugauaccauu

SEQ ID NO: 1941921 - RNA, 20 nt, Homo sapiens
acagucucaggaaaucaaau

SEQ ID NO: 1941922 - RNA, 14 nt, Homo sapiens
accuggagaacuuc

SEQ ID NO: 1941923 - RNA, 14 nt, Homo sapiens
gaaaugaugagaaa

SEQ ID NO: 1941924 - RNA, 16 nt, Homo sapiens
uggggaaaacuugcag

SEQ ID NO: 1941925 - RNA, 19 nt, Homo sapiens
ugaaaugggaacaauauca

SEQ ID NO: 1941926 - RNA, 17 nt, Homo sapiens
gagauguugcccauuua

SEQ ID NO: 1941927 - RNA, 21 nt, Homo sapiens
caggaauaauguuuugggaaa

SEQ ID NO: 1941928 - RNA, 22 nt, Homo sapiens
caggaggcuuuaagcuccagcu

SEQ ID NO: 1941929 - RNA, 21 nt, Homo sapiens
ucaguaacagugcaguacuca

SEQ ID NO: 1941930 - RNA, 21 nt, Homo sapiens
aagcucuggugacaccagccu

SEQ ID NO: 1941931 - RNA, 12 nt, Homo sapiens
cugccgacuccc

SEQ ID NO: 1941932 - RNA, 21 nt, Homo sapiens
cugagaacucaggcuuugagu

SEQ ID NO: 1941933 - RNA, 15 nt, Homo sapiens
agcuucugcugggcu

SEQ ID NO: 1941934 - RNA, 22 nt, Homo sapiens
cuccuuuggaaugcuguauuaa

SEQ ID NO: 1941935 - RNA, 23 nt, Homo sapiens
aggacacagauaggauggggugu

SEQ ID NO: 1941936 - RNA, 21 nt, Homo sapiens
acggaucugcugggcucugcc

SEQ ID NO: 1941937 - RNA, 21 nt, Homo sapiens
agguugcaguagcaguggaug

SEQ ID NO: 1941938 - RNA, 15 nt, Homo sapiens
ugaguagcugggacu

SEQ ID NO: 1941939 - RNA, 18 nt, Homo sapiens
cucccuguguggcugcug

SEQ ID NO: 1941940 - RNA, 22 nt, Homo sapiens
cagcagcuuuuccaccccagga

SEQ ID NO: 1941941 - RNA, 22 nt, Homo sapiens
gugguuaggcagcaagcuuugg

SEQ ID NO: 1941942 - RNA, 21 nt, Homo sapiens
auuuuaugcugcuguuuacaa

SEQ ID NO: 1941943 - RNA, 22 nt, Homo sapiens
cugagauaggaggaucacuuga

SEQ ID NO: 1941944 - RNA, 22 nt, Homo sapiens
gacggugcucacucccaaggga

SEQ ID NO: 1941945 - RNA, 23 nt, Homo sapiens
gcauggggcggguccuagcuguu

SEQ ID NO: 1941946 - RNA, 13 nt, Homo sapiens
uugcuauggaaac

SEQ ID NO: 1941947 - RNA, 15 nt, Homo sapiens
acuuugauaucugau

SEQ ID NO: 1941948 - RNA, 22 nt, Homo sapiens
aaaacuugauguguuaucucuu

SEQ ID NO: 1941949 - RNA, 12 nt, Homo sapiens
gaugcagcauuu

SEQ ID NO: 1941950 - RNA, 19 nt, Homo sapiens
gcugccuuugaucacagga

SEQ ID NO: 1941951 - RNA, 16 nt, Homo sapiens
agacucuguaaccacc

SEQ ID NO: 1941952 - RNA, 13 nt, Homo sapiens
gaagccacagacu

SEQ ID NO: 1941953 - RNA, 15 nt, Homo sapiens
acgccuguaauccca

SEQ ID NO: 1941954 - RNA, 19 nt, Homo sapiens
caggauuuucaaguuauuc

SEQ ID NO: 1941955 - RNA, 15 nt, Homo sapiens
aaugaaggugugcua

SEQ ID NO: 1941956 - RNA, 15 nt, Homo sapiens
gugauauaugcaugu

SEQ ID NO: 1941957 - RNA, 14 nt, Homo sapiens
guagaaagccaaau

SEQ ID NO: 1941958 - RNA, 18 nt, Homo sapiens
caguaaaaacuguucucu

SEQ ID NO: 1941959 - RNA, 19 nt, Homo sapiens
cagcucuguaguuucuuga

SEQ ID NO: 1941960 - RNA, 19 nt, Homo sapiens
agugaucugcccaccucag

SEQ ID NO: 1941961 - RNA, 17 nt, Homo sapiens
augaagauacugaaaua

SEQ ID NO: 1941962 - RNA, 13 nt, Homo sapiens
cucugacaaagug

SEQ ID NO: 1941963 - RNA, 17 nt, Homo sapiens
ugcucaccagaucucag

SEQ ID NO: 1941964 - RNA, 11 nt, Homo sapiens
uuugcauuuca

SEQ ID NO: 1941965 - RNA, 13 nt, Homo sapiens
uguggucucagga

SEQ ID NO: 1941966 - RNA, 12 nt, Homo sapiens
cagacaggugug

SEQ ID NO: 1941967 - RNA, 15 nt, Homo sapiens
aacaaccuggucaca

SEQ ID NO: 1941968 - RNA, 21 nt, Homo sapiens
gcccuaaccccuuccagauca

SEQ ID NO: 1941969 - RNA, 21 nt, Homo sapiens
ugagacaggaaaaaccaacag

SEQ ID NO: 1941970 - RNA, 23 nt, Homo sapiens
auauuuucauucacaacuaugaa

SEQ ID NO: 1941971 - RNA, 16 nt, Homo sapiens
uucaccugccaccaca

SEQ ID NO: 1941972 - RNA, 16 nt, Homo sapiens
agcuacaggacauuuu

SEQ ID NO: 1941973 - RNA, 21 nt, Homo sapiens
aagucacacgcuuuugaauua

SEQ ID NO: 1941974 - RNA, 23 nt, Homo sapiens
cucaaaccugugcugaccaaaga

SEQ ID NO: 1941975 - RNA, 21 nt, Homo sapiens
uuuguaucuuaaaucugugaa

SEQ ID NO: 1941976 - RNA, 17 nt, Homo sapiens
auaugcaauauuuacau

SEQ ID NO: 1941977 - RNA, 22 nt, Homo sapiens
ugcugacaaccauuaaagucag

SEQ ID NO: 1941978 - RNA, 18 nt, Homo sapiens
ccaggucugcagcuccag

SEQ ID NO: 1941979 - RNA, 18 nt, Homo sapiens
ggaggauucgagcaucag

SEQ ID NO: 1941980 - RNA, 15 nt, Homo sapiens
uucuauugacuucaa

SEQ ID NO: 1941981 - RNA, 17 nt, Homo sapiens
aagguucuuacugcuug

SEQ ID NO: 1941982 - RNA, 17 nt, Homo sapiens
gcagcagaaaacaaaca

SEQ ID NO: 1941983 - RNA, 14 nt, Homo sapiens
aguucccucuugcu

SEQ ID NO: 1941984 - RNA, 14 nt, Homo sapiens
aggugucucugggc

SEQ ID NO: 1941985 - RNA, 21 nt, Homo sapiens
aacugaugaguaaacugaggc

SEQ ID NO: 1941986 - RNA, 14 nt, Homo sapiens
cugaugcagccugu

SEQ ID NO: 1941987 - RNA, 22 nt, Homo sapiens
cuaaauauggacugcucaggaa

SEQ ID NO: 1941988 - RNA, 12 nt, Homo sapiens
ucuaugcuuauu

SEQ ID NO: 1941989 - RNA, 12 nt, Homo sapiens
gccuugcugaca

SEQ ID NO: 1941990 - RNA, 22 nt, Homo sapiens
cuguggccacagcagcuuugua

SEQ ID NO: 1941991 - RNA, 13 nt, Homo sapiens
gaauugauuagga

SEQ ID NO: 1941992 - RNA, 23 nt, Homo sapiens
uuaagggaacugaaucacuuaaa

SEQ ID NO: 1941993 - RNA, 16 nt, Homo sapiens
caguuugcauuccccu

SEQ ID NO: 1941994 - RNA, 22 nt, Homo sapiens
agaagucaugaagcccaaguga

SEQ ID NO: 1941995 - RNA, 19 nt, Homo sapiens
ugcaguagugcaguucacc

SEQ ID NO: 1941996 - RNA, 14 nt, Homo sapiens
ggaaauaugucaaa

SEQ ID NO: 1941997 - RNA, 23 nt, Homo sapiens
cgcaauuuuaccuaguuugcacu

SEQ ID NO: 1941998 - RNA, 16 nt, Homo sapiens
aaaggaaaaggucuga

SEQ ID NO: 1941999 - RNA, 13 nt, Homo sapiens
uuuuuauagguuu

SEQ ID NO: 1942000 - RNA, 11 nt, Homo sapiens
gagaaaaccug

SEQ ID NO: 1942001 - RNA, 18 nt, Homo sapiens
acagagggugaaagggac

SEQ ID NO: 1942002 - RNA, 18 nt, Homo sapiens
cauaugugugugugugca

SEQ ID NO: 1942003 - RNA, 15 nt, Homo sapiens
agguugcacauucac

SEQ ID NO: 1942004 - RNA, 23 nt, Homo sapiens
cuggcccuccacccccaccucaa

SEQ ID NO: 1942005 - RNA, 16 nt, Homo sapiens
uggaagcaaagacaaa

SEQ ID NO: 1942006 - RNA, 16 nt, Homo sapiens
uccuaaaacaauccug

SEQ ID NO: 1942007 - RNA, 21 nt, Homo sapiens
ccagacucgccaacaugguga

SEQ ID NO: 1942008 - RNA, 19 nt, Homo sapiens
aggggacaaguagccaccu

SEQ ID NO: 1942009 - RNA, 14 nt, Homo sapiens
uguaaaacuaucug

SEQ ID NO: 1942010 - RNA, 17 nt, Homo sapiens
ucuauuuccacugaaca

SEQ ID NO: 1942011 - RNA, 12 nt, Homo sapiens
uaugcagugaua

SEQ ID NO: 1942012 - RNA, 14 nt, Homo sapiens
caggugcugccauc

SEQ ID NO: 1942013 - RNA, 16 nt, Homo sapiens
ggaaacccagcucaca

SEQ ID NO: 1942014 - RNA, 20 nt, Homo sapiens
ggaccaaagcagcugcagcc

SEQ ID NO: 1942015 - RNA, 15 nt, Homo sapiens
agcugaggacucugc

SEQ ID NO: 1942016 - RNA, 12 nt, Homo sapiens
aacaaagcccuu

SEQ ID NO: 1942017 - RNA, 15 nt, Homo sapiens
cagcuccacaguguu

SEQ ID NO: 1942018 - RNA, 13 nt, Homo sapiens
cccuaccuugaaa

SEQ ID NO: 1942019 - RNA, 21 nt, Homo sapiens
auguauuuuacaguacauguu

SEQ ID NO: 1942020 - RNA, 17 nt, Homo sapiens
uuuuccagauuugcuca

SEQ ID NO: 1942021 - RNA, 18 nt, Homo sapiens
ucacagaguagaaacuca

SEQ ID NO: 1942022 - RNA, 12 nt, Homo sapiens
uccacacauaaa

SEQ ID NO: 1942023 - RNA, 17 nt, Homo sapiens
ccugaucaccaggugaa

SEQ ID NO: 1942024 - RNA, 17 nt, Homo sapiens
cccaccucccaccaaca

SEQ ID NO: 1942025 - RNA, 12 nt, Homo sapiens
ugagaccuucag

SEQ ID NO: 1942026 - RNA, 15 nt, Homo sapiens
agaaaaaagugcaac

SEQ ID NO: 1942027 - RNA, 19 nt, Homo sapiens
gcagugagcccagaucgca

SEQ ID NO: 1942028 - RNA, 14 nt, Homo sapiens
ccagccucaucucu

SEQ ID NO: 1942029 - RNA, 13 nt, Homo sapiens
auaugaacauaua

SEQ ID NO: 1942030 - RNA, 13 nt, Homo sapiens
augagaacaugaa

SEQ ID NO: 1942031 - RNA, 13 nt, Homo sapiens
uucaaaacuucag

SEQ ID NO: 1942032 - RNA, 13 nt, Homo sapiens
uuaaaaacuuaag

SEQ ID NO: 1942033 - RNA, 13 nt, Homo sapiens
gggagaacgggaa

SEQ ID NO: 1942034 - RNA, 14 nt, Homo sapiens
gaagagaccaagac

SEQ ID NO: 1942035 - RNA, 20 nt, Homo sapiens
guauguugucauaacauuua

SEQ ID NO: 1942036 - RNA, 19 nt, Homo sapiens
uguguuauuucacuugcca

SEQ ID NO: 1942037 - RNA, 16 nt, Homo sapiens
ucugguaagguuucua

SEQ ID NO: 1942038 - RNA, 14 nt, Homo sapiens
aucaugcauuguug

SEQ ID NO: 1942039 - RNA, 18 nt, Homo sapiens
cucuuuccuucuugccuu

SEQ ID NO: 1942040 - RNA, 22 nt, Homo sapiens
ugcaggucuccaccugcacauu

SEQ ID NO: 1942041 - RNA, 20 nt, Homo sapiens
uuuaaccucuagagucacug

SEQ ID NO: 1942042 - RNA, 22 nt, Homo sapiens
ccaauaacacguccacuuucaa

SEQ ID NO: 1942043 - RNA, 18 nt, Homo sapiens
uguacauguaacauuaaa

SEQ ID NO: 1942044 - RNA, 18 nt, Homo sapiens
ucauucccacugcacuug

SEQ ID NO: 1942045 - RNA, 15 nt, Homo sapiens
acauucuugcuaauu

SEQ ID NO: 1942046 - RNA, 15 nt, Homo sapiens
auugcucaucagcuu

SEQ ID NO: 1942047 - RNA, 22 nt, Homo sapiens
cacugacccuggucaccagagg

SEQ ID NO: 1942048 - RNA, 16 nt, Homo sapiens
uaccaaaggugcuaca

SEQ ID NO: 1942049 - RNA, 21 nt, Homo sapiens
caccacgcagaccaccagcau

SEQ ID NO: 1942050 - RNA, 14 nt, Homo sapiens
ccuuguugcagaug

SEQ ID NO: 1942051 - RNA, 15 nt, Homo sapiens
auuuauuccuuccaa

SEQ ID NO: 1942052 - RNA, 14 nt, Homo sapiens
aacaugcuaccuga

SEQ ID NO: 1942053 - RNA, 21 nt, Homo sapiens
cccaccaacucugcacuccau

SEQ ID NO: 1942054 - RNA, 17 nt, Homo sapiens
uggucccaggcuuccca

SEQ ID NO: 1942055 - RNA, 19 nt, Homo sapiens
auuaccuccuguguggaag

SEQ ID NO: 1942056 - RNA, 20 nt, Homo sapiens
uguaauauuguaaauacugg

SEQ ID NO: 1942057 - RNA, 18 nt, Homo sapiens
ugucaucacuaguggcaa

SEQ ID NO: 1942058 - RNA, 17 nt, Homo sapiens
ggaaggacuuuggcaag

SEQ ID NO: 1942059 - RNA, 17 nt, Homo sapiens
cuuaaaaugggaucuca

SEQ ID NO: 1942060 - RNA, 14 nt, Homo sapiens
acuguguguugaca

SEQ ID NO: 1942061 - RNA, 23 nt, Homo sapiens
uauuugaaauacuaaaagcaaau

SEQ ID NO: 1942062 - RNA, 20 nt, Homo sapiens
aggcagguggauugcuugag

SEQ ID NO: 1942063 - RNA, 15 nt, Homo sapiens
gucuguccuuuccca

SEQ ID NO: 1942064 - RNA, 19 nt, Homo sapiens
cucuaguugaguuucuggc

SEQ ID NO: 1942065 - RNA, 18 nt, Homo sapiens
agcugcucgcacagauua

SEQ ID NO: 1942066 - RNA, 20 nt, Homo sapiens
cuuccuuucccaagccuucg

SEQ ID NO: 1942067 - RNA, 15 nt, Homo sapiens
auaugauugugcaca

SEQ ID NO: 1942068 - RNA, 18 nt, Homo sapiens
cacaagugucugugcaug

SEQ ID NO: 1942069 - RNA, 17 nt, Homo sapiens
uuaagaguaacaguuug

SEQ ID NO: 1942070 - RNA, 14 nt, Homo sapiens
uaggacuacacuga

SEQ ID NO: 1942071 - RNA, 19 nt, Homo sapiens
ccuagucuucuguguaugu

SEQ ID NO: 1942072 - RNA, 14 nt, Homo sapiens
gacauucacugagu

SEQ ID NO: 1942073 - RNA, 16 nt, Homo sapiens
caaaguccauacuccu

SEQ ID NO: 1942074 - RNA, 13 nt, Homo sapiens
uaaugggacacua

SEQ ID NO: 1942075 - RNA, 17 nt, Homo sapiens
gaccccugcuccugacu

SEQ ID NO: 1942076 - RNA, 21 nt, Homo sapiens
auaguaaaauucuacuguaug

SEQ ID NO: 1942077 - RNA, 19 nt, Homo sapiens
ugccccaggacugucauuu

SEQ ID NO: 1942078 - RNA, 16 nt, Homo sapiens
auauggacacugugac

SEQ ID NO: 1942079 - RNA, 20 nt, Homo sapiens
gaaacaaguauuuugcuaua

SEQ ID NO: 1942080 - RNA, 13 nt, Homo sapiens
auuggcagugugu

SEQ ID NO: 1942081 - RNA, 15 nt, Homo sapiens
uccugucaccaucaa

SEQ ID NO: 1942082 - RNA, 20 nt, Homo sapiens
uaugugucacugcauggcuu

SEQ ID NO: 1942083 - RNA, 15 nt, Homo sapiens
auucgcccaccucag

SEQ ID NO: 1942084 - RNA, 20 nt, Homo sapiens
aauugaaaaccucuuuccaa

SEQ ID NO: 1942085 - RNA, 14 nt, Homo sapiens
agacacacacacac

SEQ ID NO: 1942086 - RNA, 14 nt, Homo sapiens
acauugacagauug

SEQ ID NO: 1942087 - RNA, 23 nt, Homo sapiens
acacagcccugcuucugacauaa

SEQ ID NO: 1942088 - RNA, 20 nt, Homo sapiens
ccaaauuuagaaagcuuaag

SEQ ID NO: 1942089 - RNA, 16 nt, Homo sapiens
agaacuuuagcuauuu

SEQ ID NO: 1942090 - RNA, 19 nt, Homo sapiens
ugcucagucccuacugagu

SEQ ID NO: 1942091 - RNA, 20 nt, Homo sapiens
caaguuuuuuauacugcacu

SEQ ID NO: 1942092 - RNA, 20 nt, Homo sapiens
uggaauuuuucuguacuuca

SEQ ID NO: 1942093 - RNA, 13 nt, Homo sapiens
aguauaauuugcu

SEQ ID NO: 1942094 - RNA, 14 nt, Homo sapiens
auaauaugaugcca

SEQ ID NO: 1942095 - RNA, 13 nt, Homo sapiens
gguuaacaguaaa

SEQ ID NO: 1942096 - RNA, 21 nt, Homo sapiens
gaacuauuagacaugaaaucu

SEQ ID NO: 1942097 - RNA, 14 nt, Homo sapiens
agugagacuguguu

SEQ ID NO: 1942098 - RNA, 14 nt, Homo sapiens
acugcaagcauuuu

SEQ ID NO: 1942099 - RNA, 20 nt, Homo sapiens
gaaaaguugccgaagaugag

SEQ ID NO: 1942100 - RNA, 20 nt, Homo sapiens
aauuuucuaugaauugcuaa

SEQ ID NO: 1942101 - RNA, 19 nt, Homo sapiens
ucuggaacauagaaauaua

SEQ ID NO: 1942102 - RNA, 15 nt, Homo sapiens
gcagaggucagacua

SEQ ID NO: 1942103 - RNA, 15 nt, Homo sapiens
uccguuaugccaccu

SEQ ID NO: 1942104 - RNA, 16 nt, Homo sapiens
agucgaccgcacuuau

SEQ ID NO: 1942105 - RNA, 16 nt, Homo sapiens
cuuggaucagaugaac

SEQ ID NO: 1942106 - RNA, 21 nt, Homo sapiens
uggcgaguccagacaccauca

SEQ ID NO: 1942107 - RNA, 13 nt, Homo sapiens
acugaaaacaguc

SEQ ID NO: 1942108 - RNA, 15 nt, Homo sapiens
agaaaaacaaauuca

SEQ ID NO: 1942109 - RNA, 20 nt, Homo sapiens
agauaacagauuaguaguua

SEQ ID NO: 1942110 - RNA, 12 nt, Homo sapiens
ccagggugcaug

SEQ ID NO: 1942111 - RNA, 15 nt, Homo sapiens
ccagagccaugccag

SEQ ID NO: 1942112 - RNA, 12 nt, Homo sapiens
ccaggacugagc

SEQ ID NO: 1942113 - RNA, 16 nt, Homo sapiens
gaaacccugagagucu

SEQ ID NO: 1942114 - RNA, 23 nt, Homo sapiens
caaugccaaaaaaagacagggcu

SEQ ID NO: 1942115 - RNA, 18 nt, Homo sapiens
agccuuugccgugagcau

SEQ ID NO: 1942116 - RNA, 13 nt, Homo sapiens
cuuccagcaauaa

SEQ ID NO: 1942117 - RNA, 14 nt, Homo sapiens
ucacauucaggaag

SEQ ID NO: 1942118 - RNA, 14 nt, Homo sapiens
ccuaccugucuucu

SEQ ID NO: 1942119 - RNA, 18 nt, Homo sapiens
aaauacaguauucccacu

SEQ ID NO: 1942120 - RNA, 16 nt, Homo sapiens
ucuuucccaaaggcau

SEQ ID NO: 1942121 - RNA, 18 nt, Homo sapiens
auaguucuaaacuaucaa

SEQ ID NO: 1942122 - RNA, 15 nt, Homo sapiens
ccuaauaucaauuug

SEQ ID NO: 1942123 - RNA, 17 nt, Homo sapiens
gcacagaagguugcuau

SEQ ID NO: 1942124 - RNA, 16 nt, Homo sapiens
aauaaucccaaggcaa

SEQ ID NO: 1942125 - RNA, 20 nt, Homo sapiens
ggagugccugcuguggaccc

SEQ ID NO: 1942126 - RNA, 13 nt, Homo sapiens
uauagaaugaacu

SEQ ID NO: 1942127 - RNA, 17 nt, Homo sapiens
cauggagaccgugacca

SEQ ID NO: 1942128 - RNA, 20 nt, Homo sapiens
cgcuugaccauguugcacug

SEQ ID NO: 1942129 - RNA, 15 nt, Homo sapiens
gaaacaccaguguua

SEQ ID NO: 1942130 - RNA, 22 nt, Homo sapiens
gcagucaggggucaggugucag

SEQ ID NO: 1942131 - RNA, 13 nt, Homo sapiens
ccaaauguauucu

SEQ ID NO: 1942132 - RNA, 12 nt, Homo sapiens
ccauuugaagca

SEQ ID NO: 1942133 - RNA, 23 nt, Homo sapiens
uacuaaauguauuuuagacuucc

SEQ ID NO: 1942134 - RNA, 11 nt, Homo sapiens
agcccagagac

SEQ ID NO: 1942135 - RNA, 13 nt, Homo sapiens
aaauuacccaguu

SEQ ID NO: 1942136 - RNA, 22 nt, Homo sapiens
agccguccaagaacaagucacc

SEQ ID NO: 1942137 - RNA, 14 nt, Homo sapiens
uuuaaacaguuuag

SEQ ID NO: 1942138 - RNA, 21 nt, Homo sapiens
uaagaaagaaaggaaagaagg

SEQ ID NO: 1942139 - RNA, 21 nt, Homo sapiens
gacacuagccugugcacgcgc

SEQ ID NO: 1942140 - RNA, 16 nt, Homo sapiens
auaucagaagugccaa

SEQ ID NO: 1942141 - RNA, 20 nt, Homo sapiens
ucccuuuuuacacuuuaugg

SEQ ID NO: 1942142 - RNA, 20 nt, Homo sapiens
accucaggaccaugugauaa

SEQ ID NO: 1942143 - RNA, 22 nt, Homo sapiens
agcccauggagauugaccugga

SEQ ID NO: 1942144 - RNA, 18 nt, Homo sapiens
ugcagagugcccagaacu

SEQ ID NO: 1942145 - RNA, 17 nt, Homo sapiens
cucaccuugcucugcca

SEQ ID NO: 1942146 - RNA, 14 nt, Homo sapiens
acacaugccuuaaa

SEQ ID NO: 1942147 - RNA, 18 nt, Homo sapiens
gauuuuacaaaagaugua

SEQ ID NO: 1942148 - RNA, 21 nt, Homo sapiens
auaguuugcuguugcauugua

SEQ ID NO: 1942149 - RNA, 19 nt, Homo sapiens
ucaugugccuugaacauau

SEQ ID NO: 1942150 - RNA, 21 nt, Homo sapiens
caaaaggucuauggcucaugu

SEQ ID NO: 1942151 - RNA, 13 nt, Homo sapiens
agcccuccauucc

SEQ ID NO: 1942152 - RNA, 18 nt, Homo sapiens
auagauuguuuugccacu

SEQ ID NO: 1942153 - RNA, 19 nt, Homo sapiens
acucaagucccccaagacc

SEQ ID NO: 1942154 - RNA, 17 nt, Homo sapiens
ugucacagccauaguca

SEQ ID NO: 1942155 - RNA, 23 nt, Homo sapiens
agcaucauuguaaauuauuucau

SEQ ID NO: 1942156 - RNA, 17 nt, Homo sapiens
ugcuuuaucuacuuuag

SEQ ID NO: 1942157 - RNA, 15 nt, Homo sapiens
ggagcaaaacaaagc

SEQ ID NO: 1942158 - RNA, 16 nt, Homo sapiens
cacuuuccuuucaaua

SEQ ID NO: 1942159 - RNA, 21 nt, Homo sapiens
cucggcccugcccagcuuugu

SEQ ID NO: 1942160 - RNA, 14 nt, Homo sapiens
uggagacaaacuug

SEQ ID NO: 1942161 - RNA, 22 nt, Homo sapiens
cuaccaaguuucauaccaaaua

SEQ ID NO: 1942162 - RNA, 17 nt, Homo sapiens
ccuagacuagagggcag

SEQ ID NO: 1942163 - RNA, 22 nt, Homo sapiens
ucuccagccaucaagagacuga

SEQ ID NO: 1942164 - RNA, 16 nt, Homo sapiens
uauauaacaacaaacu

SEQ ID NO: 1942165 - RNA, 16 nt, Homo sapiens
ggaucccaucaaagaa

SEQ ID NO: 1942166 - RNA, 20 nt, Homo sapiens
guccucaguguccucagggg

SEQ ID NO: 1942167 - RNA, 15 nt, Homo sapiens
aggcugccccucuca

SEQ ID NO: 1942168 - RNA, 12 nt, Homo sapiens
aaucaggaaaga

SEQ ID NO: 1942169 - RNA, 20 nt, Homo sapiens
aaucuauuuugucugauauu

SEQ ID NO: 1942170 - RNA, 22 nt, Homo sapiens
gucuugucugagaacaaauaca

SEQ ID NO: 1942171 - RNA, 20 nt, Homo sapiens
uguagaagaggaaguuuuaa

SEQ ID NO: 1942172 - RNA, 15 nt, Homo sapiens
accuccagggagcac

SEQ ID NO: 1942173 - RNA, 13 nt, Homo sapiens
gucuguuaacuua

SEQ ID NO: 1942174 - RNA, 18 nt, Homo sapiens
cccauuagcccacugccu

SEQ ID NO: 1942175 - RNA, 19 nt, Homo sapiens
gccacugggauucauggcu

SEQ ID NO: 1942176 - RNA, 18 nt, Homo sapiens
uccaauggaacaguagcu

SEQ ID NO: 1942177 - RNA, 16 nt, Homo sapiens
gccuguaaucccagca

SEQ ID NO: 1942178 - RNA, 18 nt, Homo sapiens
cuguuuccauagcaccau

SEQ ID NO: 1942179 - RNA, 15 nt, Homo sapiens
cucucgcacaaugca

SEQ ID NO: 1942180 - RNA, 11 nt, Homo sapiens
ccauuuacacg

SEQ ID NO: 1942181 - RNA, 18 nt, Homo sapiens
uaccaaguguguugggaa

SEQ ID NO: 1942182 - RNA, 19 nt, Homo sapiens
uuguagaguuuugucauuc

SEQ ID NO: 1942183 - RNA, 12 nt, Homo sapiens
caaccacugcuu

SEQ ID NO: 1942184 - RNA, 20 nt, Homo sapiens
ucuccaagugcggcacugca

SEQ ID NO: 1942185 - RNA, 12 nt, Homo sapiens
acucacacuggc

SEQ ID NO: 1942186 - RNA, 15 nt, Homo sapiens
uggaaacacugccuu

SEQ ID NO: 1942187 - RNA, 22 nt, Homo sapiens
uaagaaaaauuuguauacuaau

SEQ ID NO: 1942188 - RNA, 13 nt, Homo sapiens
cccacaguggaaa

SEQ ID NO: 1942189 - RNA, 20 nt, Homo sapiens
uuaagauguggaacaacagc

SEQ ID NO: 1942190 - RNA, 12 nt, Homo sapiens
agcucaucucag

SEQ ID NO: 1942191 - RNA, 21 nt, Homo sapiens
auaaugcgugcauaccacuuu

SEQ ID NO: 1942192 - RNA, 23 nt, Homo sapiens
ugaccccuccuuucuuccuccaa

SEQ ID NO: 1942193 - RNA, 16 nt, Homo sapiens
uggagaccagccagag

SEQ ID NO: 1942194 - RNA, 18 nt, Homo sapiens
ucccauuaaagagccagu

SEQ ID NO: 1942195 - RNA, 22 nt, Homo sapiens
uugaagauuuaugaugcacuua

SEQ ID NO: 1942196 - RNA, 15 nt, Homo sapiens
acuucaaagcugaau

SEQ ID NO: 1942197 - RNA, 14 nt, Homo sapiens
ugggagaucagcca

SEQ ID NO: 1942198 - RNA, 14 nt, Homo sapiens
uucugaguucuggu

SEQ ID NO: 1942199 - RNA, 19 nt, Homo sapiens
cugaagaaguuauaccuuc

SEQ ID NO: 1942200 - RNA, 16 nt, Homo sapiens
gacacuucagaucuga

SEQ ID NO: 1942201 - RNA, 15 nt, Homo sapiens
gacagcccuccuuga

SEQ ID NO: 1942202 - RNA, 13 nt, Homo sapiens
ugugcagauauca

SEQ ID NO: 1942203 - RNA, 23 nt, Homo sapiens
cccugcagcuggaaugugccaca

SEQ ID NO: 1942204 - RNA, 13 nt, Homo sapiens
uauaggacucuca

SEQ ID NO: 1942205 - RNA, 13 nt, Homo sapiens
uuucuuccaugau

SEQ ID NO: 1942206 - RNA, 13 nt, Homo sapiens
ugguggcucuuca

SEQ ID NO: 1942207 - RNA, 16 nt, Homo sapiens
cuuuuuccagcaaaau

SEQ ID NO: 1942208 - RNA, 21 nt, Homo sapiens
aaggccuugcugucaugugaa

SEQ ID NO: 1942209 - RNA, 23 nt, Homo sapiens
cacaggagauuccagucuacuug

SEQ ID NO: 1942210 - RNA, 19 nt, Homo sapiens
gcccuucuggagaugacaa

SEQ ID NO: 1942211 - RNA, 21 nt, Homo sapiens
aaguacuacauuuucuuuugu

SEQ ID NO: 1942212 - RNA, 21 nt, Homo sapiens
uaagugcacaccgugugccau

SEQ ID NO: 1942213 - RNA, 21 nt, Homo sapiens
agaacggcaugugaauucugu

SEQ ID NO: 1942214 - RNA, 16 nt, Homo sapiens
cuuuuauaaagcaugu

SEQ ID NO: 1942215 - RNA, 18 nt, Homo sapiens
uaaaaugacaagcacuau

SEQ ID NO: 1942216 - RNA, 17 nt, Homo sapiens
ugauugucuccucccag

SEQ ID NO: 1942217 - RNA, 18 nt, Homo sapiens
agucuuguuuuuuauuca

SEQ ID NO: 1942218 - RNA, 14 nt, Homo sapiens
auggaacagugaaa

SEQ ID NO: 1942219 - RNA, 21 nt, Homo sapiens
ucacugucuguugcuucagua

SEQ ID NO: 1942220 - RNA, 23 nt, Homo sapiens
acccacuguccgcgguggacucu

SEQ ID NO: 1942221 - RNA, 13 nt, Homo sapiens
ugugacacacugg

SEQ ID NO: 1942222 - RNA, 13 nt, Homo sapiens
acuugcacuguua

SEQ ID NO: 1942223 - RNA, 13 nt, Homo sapiens
uuggcuuugccag

SEQ ID NO: 1942224 - RNA, 14 nt, Homo sapiens
ucuucgauguacuu

SEQ ID NO: 1942225 - RNA, 23 nt, Homo sapiens
aucagcccugggauagugcuguc

SEQ ID NO: 1942226 - RNA, 19 nt, Homo sapiens
acauaaaaccugagcagca

SEQ ID NO: 1942227 - RNA, 18 nt, Homo sapiens
aaaagggaaguaagcaaa

SEQ ID NO: 1942228 - RNA, 15 nt, Homo sapiens
aacuuuugugcuccc

SEQ ID NO: 1942229 - RNA, 13 nt, Homo sapiens
cuaaauucaggug

SEQ ID NO: 1942230 - RNA, 16 nt, Homo sapiens
gacuagaugauggaug

SEQ ID NO: 1942231 - RNA, 14 nt, Homo sapiens
cgucuccucaggac

SEQ ID NO: 1942232 - RNA, 12 nt, Homo sapiens
cugcuauuuuag

SEQ ID NO: 1942233 - RNA, 21 nt, Homo sapiens
acuuauaaauuucauugauua

SEQ ID NO: 1942234 - RNA, 19 nt, Homo sapiens
gaacagaucaggaauucua

SEQ ID NO: 1942235 - RNA, 22 nt, Homo sapiens
auaacugcccagcggacagugg

SEQ ID NO: 1942236 - RNA, 21 nt, Homo sapiens
aguauuuuagugaacuugaaa

SEQ ID NO: 1942237 - RNA, 19 nt, Homo sapiens
cggcaucgggccaucucag

SEQ ID NO: 1942238 - RNA, 21 nt, Homo sapiens
aguaauuuuguuuaugcugcu

SEQ ID NO: 1942239 - RNA, 19 nt, Homo sapiens
cuacuuugccacagauuau

SEQ ID NO: 1942240 - RNA, 16 nt, Homo sapiens
uauaaagcaacuguua

SEQ ID NO: 1942241 - RNA, 14 nt, Homo sapiens
gcagcugaugcugu

SEQ ID NO: 1942242 - RNA, 16 nt, Homo sapiens
gggugauuucagagag

SEQ ID NO: 1942243 - RNA, 13 nt, Homo sapiens
acaacaauguguu

SEQ ID NO: 1942244 - RNA, 23 nt, Homo sapiens
cguguucaaagagcaauauucca

SEQ ID NO: 1942245 - RNA, 17 nt, Homo sapiens
aaaaccugaaauuccaa

SEQ ID NO: 1942246 - RNA, 15 nt, Homo sapiens
uucuuagcagugucu

SEQ ID NO: 1942247 - RNA, 18 nt, Homo sapiens
guauuaagagcaauucaa

SEQ ID NO: 1942248 - RNA, 21 nt, Homo sapiens
uuccucccccaguuccuccca

SEQ ID NO: 1942249 - RNA, 18 nt, Homo sapiens
cacuucauauagcauuga

SEQ ID NO: 1942250 - RNA, 13 nt, Homo sapiens
cucugaugcaaua

SEQ ID NO: 1942251 - RNA, 19 nt, Homo sapiens
uugcacauuugaauucauu

SEQ ID NO: 1942252 - RNA, 17 nt, Homo sapiens
aacccaggcaggcauuu

SEQ ID NO: 1942253 - RNA, 17 nt, Homo sapiens
uaggcaccucugugcug

SEQ ID NO: 1942254 - RNA, 22 nt, Homo sapiens
cagaggucaggaagcaggggug

SEQ ID NO: 1942255 - RNA, 21 nt, Homo sapiens
gaguguugggcaugugaucac

SEQ ID NO: 1942256 - RNA, 20 nt, Homo sapiens
cagcacuggugaacugagcu

SEQ ID NO: 1942257 - RNA, 17 nt, Homo sapiens
ucuucucuguuacaaaa

SEQ ID NO: 1942258 - RNA, 23 nt, Homo sapiens
ggagcuuccuguccucccagcuc

SEQ ID NO: 1942259 - RNA, 12 nt, Homo sapiens
ccugaaggcaca

SEQ ID NO: 1942260 - RNA, 12 nt, Homo sapiens
auuccaguauca

SEQ ID NO: 1942261 - RNA, 14 nt, Homo sapiens
caacaagggcagug

SEQ ID NO: 1942262 - RNA, 17 nt, Homo sapiens
guuagugagggccucaa

SEQ ID NO: 1942263 - RNA, 17 nt, Homo sapiens
cucagaaccauuucacc

SEQ ID NO: 1942264 - RNA, 19 nt, Homo sapiens
guuuuucuggugcuuuaua

SEQ ID NO: 1942265 - RNA, 13 nt, Homo sapiens
auuagagaagcug

SEQ ID NO: 1942266 - RNA, 18 nt, Homo sapiens
auaagcaggacagaggau

SEQ ID NO: 1942267 - RNA, 19 nt, Homo sapiens
cagugggccugguagcaca

SEQ ID NO: 1942268 - RNA, 15 nt, Homo sapiens
aucauuaugaaguca

SEQ ID NO: 1942269 - RNA, 17 nt, Homo sapiens
aaacugcccccucugcc

SEQ ID NO: 1942270 - RNA, 19 nt, Homo sapiens
guguugguguauuugccag

SEQ ID NO: 1942271 - RNA, 14 nt, Homo sapiens
acaaaacaauuacu

SEQ ID NO: 1942272 - RNA, 13 nt, Homo sapiens
auuagauaaucaa

SEQ ID NO: 1942273 - RNA, 14 nt, Homo sapiens
cacuauuggacuuu

SEQ ID NO: 1942274 - RNA, 14 nt, Homo sapiens
gucugagaccacuu

SEQ ID NO: 1942275 - RNA, 12 nt, Homo sapiens
aagagucucucc

SEQ ID NO: 1942276 - RNA, 17 nt, Homo sapiens
uaaauucuuuucacugu

SEQ ID NO: 1942277 - RNA, 15 nt, Homo sapiens
ucuugcuaccuguga

SEQ ID NO: 1942278 - RNA, 12 nt, Homo sapiens
agguuagggcau

SEQ ID NO: 1942279 - RNA, 18 nt, Homo sapiens
ucugcagagacuucuagg

SEQ ID NO: 1942280 - RNA, 22 nt, Homo sapiens
aauguuccuuucgaaagcaaug

SEQ ID NO: 1942281 - RNA, 21 nt, Homo sapiens
cuacacgauccgcaacccaug

SEQ ID NO: 1942282 - RNA, 15 nt, Homo sapiens
gaaugacaacagaag

SEQ ID NO: 1942283 - RNA, 15 nt, Homo sapiens
aagugaaccaucuca

SEQ ID NO: 1942284 - RNA, 18 nt, Homo sapiens
uuuaacgauuaaguccaa

SEQ ID NO: 1942285 - RNA, 14 nt, Homo sapiens
cagauacugugagc

SEQ ID NO: 1942286 - RNA, 19 nt, Homo sapiens
gccccguccuugugccagg

SEQ ID NO: 1942287 - RNA, 14 nt, Homo sapiens
ugcugcuccaugga

SEQ ID NO: 1942288 - RNA, 17 nt, Homo sapiens
agacacaccaggcaaca

SEQ ID NO: 1942289 - RNA, 19 nt, Homo sapiens
caggaucagcuccaucuca

SEQ ID NO: 1942290 - RNA, 17 nt, Homo sapiens
caugaagauaaauccaa

SEQ ID NO: 1942291 - RNA, 14 nt, Homo sapiens
caucccuucaaccc

SEQ ID NO: 1942292 - RNA, 14 nt, Homo sapiens
ucaacauuucuaca

SEQ ID NO: 1942293 - RNA, 17 nt, Homo sapiens
ccuguguuucuugccuc

SEQ ID NO: 1942294 - RNA, 23 nt, Homo sapiens
caucacugaucuaagcaguggca

SEQ ID NO: 1942295 - RNA, 17 nt, Homo sapiens
acuuugggaggccaagg

SEQ ID NO: 1942296 - RNA, 15 nt, Homo sapiens
cuucuaagggaucca

SEQ ID NO: 1942297 - RNA, 22 nt, Homo sapiens
acucaucauuuaauccuuguga

SEQ ID NO: 1942298 - RNA, 19 nt, Homo sapiens
acacuagucagaaaauugg

SEQ ID NO: 1942299 - RNA, 14 nt, Homo sapiens
uuuccagaacugca

SEQ ID NO: 1942300 - RNA, 14 nt, Homo sapiens
acagaagauuacaa

SEQ ID NO: 1942301 - RNA, 15 nt, Homo sapiens
uaggaagacauaaaa

SEQ ID NO: 1942302 - RNA, 17 nt, Homo sapiens
uagugagccugggccag

SEQ ID NO: 1942303 - RNA, 21 nt, Homo sapiens
aaauaacccuuucugugguaa

SEQ ID NO: 1942304 - RNA, 17 nt, Homo sapiens
cguggugggugcucaag

SEQ ID NO: 1942305 - RNA, 21 nt, Homo sapiens
aucugugggucugggagucac

SEQ ID NO: 1942306 - RNA, 23 nt, Homo sapiens
cuuuggugaacauugcaauagaa

SEQ ID NO: 1942307 - RNA, 14 nt, Homo sapiens
gaaacauucacuuu

SEQ ID NO: 1942308 - RNA, 14 nt, Homo sapiens
gugccucugcccaa

SEQ ID NO: 1942309 - RNA, 17 nt, Homo sapiens
aacugcauugcugauuc

SEQ ID NO: 1942310 - RNA, 13 nt, Homo sapiens
ccaccuguacugu

SEQ ID NO: 1942311 - RNA, 23 nt, Homo sapiens
gccuucuccacagggacacaguc

SEQ ID NO: 1942312 - RNA, 12 nt, Homo sapiens
gguauuuagcca

SEQ ID NO: 1942313 - RNA, 14 nt, Homo sapiens
cauuguauucuguu

SEQ ID NO: 1942314 - RNA, 19 nt, Homo sapiens
gacaauuuauaauuugaau

SEQ ID NO: 1942315 - RNA, 21 nt, Homo sapiens
auuuuuauaaauaugugaaaa

SEQ ID NO: 1942316 - RNA, 19 nt, Homo sapiens
ccucaauccuccauuugcu

SEQ ID NO: 1942317 - RNA, 11 nt, Homo sapiens
caacauaugca

SEQ ID NO: 1942318 - RNA, 11 nt, Homo sapiens
caccauaugcc

SEQ ID NO: 1942319 - RNA, 20 nt, Homo sapiens
gcugagacagguuaaggggu

SEQ ID NO: 1942320 - RNA, 15 nt, Homo sapiens
caagauaucagcaua

SEQ ID NO: 1942321 - RNA, 15 nt, Homo sapiens
aauaucagauuucau

SEQ ID NO: 1942322 - RNA, 19 nt, Homo sapiens
uugaugaaaacaagucaga

SEQ ID NO: 1942323 - RNA, 16 nt, Homo sapiens
aggcugauuacugaaa

SEQ ID NO: 1942324 - RNA, 16 nt, Homo sapiens
aagugauuugccugua

SEQ ID NO: 1942325 - RNA, 21 nt, Homo sapiens
agaaucccggcugucaagggg

SEQ ID NO: 1942326 - RNA, 13 nt, Homo sapiens
cauagcauuugug

SEQ ID NO: 1942327 - RNA, 22 nt, Homo sapiens
aaaggcagauuaaaagcacaag

SEQ ID NO: 1942328 - RNA, 22 nt, Homo sapiens
aauugaagaaagucagcucuug

SEQ ID NO: 1942329 - RNA, 12 nt, Homo sapiens
aguaacugugac

SEQ ID NO: 1942330 - RNA, 20 nt, Homo sapiens
uuuugagaauacacuaucaa

SEQ ID NO: 1942331 - RNA, 17 nt, Homo sapiens
uaugugaccuugccaug

SEQ ID NO: 1942332 - RNA, 15 nt, Homo sapiens
uauucugauuccacu

SEQ ID NO: 1942333 - RNA, 16 nt, Homo sapiens
agcauuacaguauuuu

SEQ ID NO: 1942334 - RNA, 21 nt, Homo sapiens
aaaugcugcuuccacucaggg

SEQ ID NO: 1942335 - RNA, 19 nt, Homo sapiens
aaacuuaccuuuacugaag

SEQ ID NO: 1942336 - RNA, 16 nt, Homo sapiens
auauuccugugacuuc

SEQ ID NO: 1942337 - RNA, 19 nt, Homo sapiens
cauauuuugccacugccuu

SEQ ID NO: 1942338 - RNA, 15 nt, Homo sapiens
uaacauucccacugc

SEQ ID NO: 1942339 - RNA, 15 nt, Homo sapiens
cugggccucaguuuc

SEQ ID NO: 1942340 - RNA, 20 nt, Homo sapiens
cuauguuaaugaguauguaa

SEQ ID NO: 1942341 - RNA, 17 nt, Homo sapiens
caaaucauuuguuuaaa

SEQ ID NO: 1942342 - RNA, 21 nt, Homo sapiens
guauugccuugugaauuugcu

SEQ ID NO: 1942343 - RNA, 21 nt, Homo sapiens
ggucaccaaacggugaauauu

SEQ ID NO: 1942344 - RNA, 17 nt, Homo sapiens
gcaaacuuuguauuaau

SEQ ID NO: 1942345 - RNA, 21 nt, Homo sapiens
cuaccaguaucuccauccuua

SEQ ID NO: 1942346 - RNA, 16 nt, Homo sapiens
ugaccugugucacuac

SEQ ID NO: 1942347 - RNA, 18 nt, Homo sapiens
cugccuaugcacugaaga

SEQ ID NO: 1942348 - RNA, 19 nt, Homo sapiens
gaaaaaauuagcugggcau

SEQ ID NO: 1942349 - RNA, 17 nt, Homo sapiens
agaauguggucugucag

SEQ ID NO: 1942350 - RNA, 22 nt, Homo sapiens
uguaaaaugugaagugaaugaa

SEQ ID NO: 1942351 - RNA, 15 nt, Homo sapiens
gcuucuguugaucuc

SEQ ID NO: 1942352 - RNA, 15 nt, Homo sapiens
gugcacaucucugcu

SEQ ID NO: 1942353 - RNA, 13 nt, Homo sapiens
ugucccccccuaa

SEQ ID NO: 1942354 - RNA, 22 nt, Homo sapiens
uuuccaagggucuuccuccuaa

SEQ ID NO: 1942355 - RNA, 11 nt, Homo sapiens
guuaaugcaga

SEQ ID NO: 1942356 - RNA, 14 nt, Homo sapiens
aagcaugcauauca

SEQ ID NO: 1942357 - RNA, 18 nt, Homo sapiens
cuccuggcucacagccac

SEQ ID NO: 1942358 - RNA, 23 nt, Homo sapiens
ugacaugggccuuuaagaaccuu

SEQ ID NO: 1942359 - RNA, 20 nt, Homo sapiens
uuuccgugagagucaucuca

SEQ ID NO: 1942360 - RNA, 19 nt, Homo sapiens
gcucaugccuguaaucuca

SEQ ID NO: 1942361 - RNA, 14 nt, Homo sapiens
ccaguucuacugac

SEQ ID NO: 1942362 - RNA, 17 nt, Homo sapiens
auggacucuucccccac

SEQ ID NO: 1942363 - RNA, 12 nt, Homo sapiens
aucuuuggacag

SEQ ID NO: 1942364 - RNA, 17 nt, Homo sapiens
acugaucaggaccucca

SEQ ID NO: 1942365 - RNA, 16 nt, Homo sapiens
uggaacaggcucagau

SEQ ID NO: 1942366 - RNA, 13 nt, Homo sapiens
caagaauagcauu

SEQ ID NO: 1942367 - RNA, 15 nt, Homo sapiens
acugauaucagaguu

SEQ ID NO: 1942368 - RNA, 20 nt, Homo sapiens
ugaaauccacacaucuuuag

SEQ ID NO: 1942369 - RNA, 19 nt, Homo sapiens
cugaaguucaugcucccag

SEQ ID NO: 1942370 - RNA, 17 nt, Homo sapiens
aucuccacagcagcaaa

SEQ ID NO: 1942371 - RNA, 17 nt, Homo sapiens
uuggcauaauagucaau

SEQ ID NO: 1942372 - RNA, 21 nt, Homo sapiens
gacuauggagugcaccaaaga

SEQ ID NO: 1942373 - RNA, 14 nt, Homo sapiens
gugccaccucagac

SEQ ID NO: 1942374 - RNA, 19 nt, Homo sapiens
agcaccccugucucuagcc

SEQ ID NO: 1942375 - RNA, 17 nt, Homo sapiens
agaaagcuuugaauacu

SEQ ID NO: 1942376 - RNA, 16 nt, Homo sapiens
guuuuuacaguggaau

SEQ ID NO: 1942377 - RNA, 21 nt, Homo sapiens
ggcaucugcucuagauucaua

SEQ ID NO: 1942378 - RNA, 15 nt, Homo sapiens
uaaacauucuaucua

SEQ ID NO: 1942379 - RNA, 22 nt, Homo sapiens
aggguugggguagcccauguua

SEQ ID NO: 1942380 - RNA, 16 nt, Homo sapiens
uuagaauguugaaaag

SEQ ID NO: 1942381 - RNA, 17 nt, Homo sapiens
gaacagaaccucccaaa

SEQ ID NO: 1942382 - RNA, 11 nt, Homo sapiens
auaagcacucc

SEQ ID NO: 1942383 - RNA, 17 nt, Homo sapiens
uggagugcaguggugcg

SEQ ID NO: 1942384 - RNA, 14 nt, Homo sapiens
ccaaauuacgugua

SEQ ID NO: 1942385 - RNA, 14 nt, Homo sapiens
auaaguuacuugaa

SEQ ID NO: 1942386 - RNA, 19 nt, Homo sapiens
ucugcuugguguaaaccau

SEQ ID NO: 1942387 - RNA, 16 nt, Homo sapiens
uuuacccugugucaga

SEQ ID NO: 1942388 - RNA, 16 nt, Homo sapiens
accgcuuauccccuca

SEQ ID NO: 1942389 - RNA, 20 nt, Homo sapiens
acugaaccauuccaacuuca

SEQ ID NO: 1942390 - RNA, 14 nt, Homo sapiens
uguugucucauaga

SEQ ID NO: 1942391 - RNA, 17 nt, Homo sapiens
uggggccuugaugacug

SEQ ID NO: 1942392 - RNA, 15 nt, Homo sapiens
agggauagcgcuguu

SEQ ID NO: 1942393 - RNA, 19 nt, Homo sapiens
uucccacagccucuuccuc

SEQ ID NO: 1942394 - RNA, 13 nt, Homo sapiens
uucaacuguauag

SEQ ID NO: 1942395 - RNA, 23 nt, Homo sapiens
uguaucccccacccacuauccca

SEQ ID NO: 1942396 - RNA, 16 nt, Homo sapiens
caccuaaguacuuaaa

SEQ ID NO: 1942397 - RNA, 16 nt, Homo sapiens
auuggacagacacaga

SEQ ID NO: 1942398 - RNA, 22 nt, Homo sapiens
cuugugaggagcuggaaacaca

SEQ ID NO: 1942399 - RNA, 14 nt, Homo sapiens
auguggacuuuuac

SEQ ID NO: 1942400 - RNA, 20 nt, Homo sapiens
ucuuuuaugagcagaaggaa

SEQ ID NO: 1942401 - RNA, 17 nt, Homo sapiens
gaaaaugugaacaugga

SEQ ID NO: 1942402 - RNA, 12 nt, Homo sapiens
gauuaccauuca

SEQ ID NO: 1942403 - RNA, 17 nt, Homo sapiens
cucuuaauuuucaggaa

SEQ ID NO: 1942404 - RNA, 12 nt, Homo sapiens
aagaauuucaca

SEQ ID NO: 1942405 - RNA, 14 nt, Homo sapiens
ugccuggacacugu

SEQ ID NO: 1942406 - RNA, 16 nt, Homo sapiens
agacugugauguaucu

SEQ ID NO: 1942407 - RNA, 21 nt, Homo sapiens
ucuguacauguucuugucaua

SEQ ID NO: 1942408 - RNA, 23 nt, Homo sapiens
guugagaccuuugauuuuuugcc

SEQ ID NO: 1942409 - RNA, 21 nt, Homo sapiens
aaauccuuccuaaacccaaug

SEQ ID NO: 1942410 - RNA, 21 nt, Homo sapiens
gugcagagaugacuguccaag

SEQ ID NO: 1942411 - RNA, 14 nt, Homo sapiens
gcucacugcucaca

SEQ ID NO: 1942412 - RNA, 20 nt, Homo sapiens
aacuggauugcagacuguuc

SEQ ID NO: 1942413 - RNA, 14 nt, Homo sapiens
acauucucugaccu

SEQ ID NO: 1942414 - RNA, 17 nt, Homo sapiens
cugccggcucuaguacc

SEQ ID NO: 1942415 - RNA, 18 nt, Homo sapiens
augacgacauacaugcua

SEQ ID NO: 1942416 - RNA, 19 nt, Homo sapiens
uguucuguuugcuguggaa

SEQ ID NO: 1942417 - RNA, 19 nt, Homo sapiens
uguuuacagcacuacucug

SEQ ID NO: 1942418 - RNA, 17 nt, Homo sapiens
ggacacacggucagggu

SEQ ID NO: 1942419 - RNA, 19 nt, Homo sapiens
cacacccaggcccaugcca

SEQ ID NO: 1942420 - RNA, 15 nt, Homo sapiens
aaguuaacuuccaau

SEQ ID NO: 1942421 - RNA, 18 nt, Homo sapiens
caagagaaguacuaucuu

SEQ ID NO: 1942422 - RNA, 15 nt, Homo sapiens
gggauugaaaaucau

SEQ ID NO: 1942423 - RNA, 18 nt, Homo sapiens
gccaggcaugguggccca

SEQ ID NO: 1942424 - RNA, 14 nt, Homo sapiens
ccagacaaccaaaa

SEQ ID NO: 1942425 - RNA, 14 nt, Homo sapiens
acaaacaaacagaa

SEQ ID NO: 1942426 - RNA, 22 nt, Homo sapiens
uguccaucagccaggacaguca

SEQ ID NO: 1942427 - RNA, 15 nt, Homo sapiens
auaaacaccauuuca

SEQ ID NO: 1942428 - RNA, 22 nt, Homo sapiens
aaugugccauuuugcauuuuca

SEQ ID NO: 1942429 - RNA, 19 nt, Homo sapiens
cauaugugaaauggccaaa

SEQ ID NO: 1942430 - RNA, 22 nt, Homo sapiens
accugaugugcaguuuaaucuu

SEQ ID NO: 1942431 - RNA, 22 nt, Homo sapiens
aagauaaauucaugcacuuuua

SEQ ID NO: 1942432 - RNA, 17 nt, Homo sapiens
gccucagcccugacccu

SEQ ID NO: 1942433 - RNA, 17 nt, Homo sapiens
gaugaccauacucagac

SEQ ID NO: 1942434 - RNA, 19 nt, Homo sapiens
uuauaucagacugcuuuga

SEQ ID NO: 1942435 - RNA, 23 nt, Homo sapiens
gaucuaguucagaaggaagcaaa

SEQ ID NO: 1942436 - RNA, 20 nt, Homo sapiens
agacaggcgcuggacagagg

SEQ ID NO: 1942437 - RNA, 15 nt, Homo sapiens
gaugucauacagaga

SEQ ID NO: 1942438 - RNA, 19 nt, Homo sapiens
aauccauccaaaguucccu

SEQ ID NO: 1942439 - RNA, 19 nt, Homo sapiens
agaccuucugaagaucuca

SEQ ID NO: 1942440 - RNA, 17 nt, Homo sapiens
ccucccuuggguucuga

SEQ ID NO: 1942441 - RNA, 20 nt, Homo sapiens
ugauagauuucuacacugag

SEQ ID NO: 1942442 - RNA, 14 nt, Homo sapiens
uugccauguuggcc

SEQ ID NO: 1942443 - RNA, 14 nt, Homo sapiens
ccacaaugccagac

SEQ ID NO: 1942444 - RNA, 11 nt, Homo sapiens
uuguacugaua

SEQ ID NO: 1942445 - RNA, 16 nt, Homo sapiens
ugguaacagcucucuu

SEQ ID NO: 1942446 - RNA, 19 nt, Homo sapiens
agauuuucugguucuacuu

SEQ ID NO: 1942447 - RNA, 18 nt, Homo sapiens
ucuagcuucaugccucag

SEQ ID NO: 1942448 - RNA, 22 nt, Homo sapiens
caaaauacagauuugaauagca

SEQ ID NO: 1942449 - RNA, 20 nt, Homo sapiens
uacaugaugcccugcugacc

SEQ ID NO: 1942450 - RNA, 21 nt, Homo sapiens
ugaagugcaugggucagggug

SEQ ID NO: 1942451 - RNA, 16 nt, Homo sapiens
agagggagagcagaga

SEQ ID NO: 1942452 - RNA, 21 nt, Homo sapiens
aaaagucuggcccacugugca

SEQ ID NO: 1942453 - RNA, 17 nt, Homo sapiens
cagcugggaaggccgca

SEQ ID NO: 1942454 - RNA, 20 nt, Homo sapiens
agagcaggggagcuugggac

SEQ ID NO: 1942455 - RNA, 17 nt, Homo sapiens
aaucugugaugacauuc

SEQ ID NO: 1942456 - RNA, 14 nt, Homo sapiens
gaccacuggcagaa

SEQ ID NO: 1942457 - RNA, 23 nt, Homo sapiens
cucuagaggcaucaccugggacc

SEQ ID NO: 1942458 - RNA, 14 nt, Homo sapiens
acaaagcaugguau

SEQ ID NO: 1942459 - RNA, 14 nt, Homo sapiens
ucagucacagccac

SEQ ID NO: 1942460 - RNA, 22 nt, Homo sapiens
auauuuuuaauaaaaguugcaa

SEQ ID NO: 1942461 - RNA, 14 nt, Homo sapiens
uaauuuguacaggg

SEQ ID NO: 1942462 - RNA, 20 nt, Homo sapiens
uaagcuuuggacccaaggaa

SEQ ID NO: 1942463 - RNA, 16 nt, Homo sapiens
augugaaucaugguuu

SEQ ID NO: 1942464 - RNA, 10 nt, Homo sapiens
augugccuuu

SEQ ID NO: 1942465 - RNA, 23 nt, Homo sapiens
guuuguuaaaagaaaacacuguc

SEQ ID NO: 1942466 - RNA, 10 nt, Homo sapiens
aagugccuua

SEQ ID NO: 1942467 - RNA, 18 nt, Homo sapiens
aguuccuuacuguuuaca

SEQ ID NO: 1942468 - RNA, 17 nt, Homo sapiens
agagcccgggagcugcu

SEQ ID NO: 1942469 - RNA, 13 nt, Homo sapiens
ccaugcugugagc

SEQ ID NO: 1942470 - RNA, 19 nt, Homo sapiens
aagcacuagaucucccuua

SEQ ID NO: 1942471 - RNA, 20 nt, Homo sapiens
aaccuucgccaccuggguuc

SEQ ID NO: 1942472 - RNA, 12 nt, Homo sapiens
gcacacuuguau

SEQ ID NO: 1942473 - RNA, 20 nt, Homo sapiens
caacuuauaaagcauugcaa

SEQ ID NO: 1942474 - RNA, 12 nt, Homo sapiens
ugguacuuugca

SEQ ID NO: 1942475 - RNA, 16 nt, Homo sapiens
aaauugccaacauaag

SEQ ID NO: 1942476 - RNA, 16 nt, Homo sapiens
acaguauuuugacaaa

SEQ ID NO: 1942477 - RNA, 12 nt, Homo sapiens
ugggugagaaau

SEQ ID NO: 1942478 - RNA, 12 nt, Homo sapiens
uguuggugacaa

SEQ ID NO: 1942479 - RNA, 17 nt, Homo sapiens
gguuccuuuugaagcuc

SEQ ID NO: 1942480 - RNA, 18 nt, Homo sapiens
gaacugaaaacaagccau

SEQ ID NO: 1942481 - RNA, 15 nt, Homo sapiens
aucuauaaugucagc

SEQ ID NO: 1942482 - RNA, 17 nt, Homo sapiens
accagcaucaccugccu

SEQ ID NO: 1942483 - RNA, 17 nt, Homo sapiens
augagcuuuacagcaga

SEQ ID NO: 1942484 - RNA, 22 nt, Homo sapiens
aaaguguccauugacauguaca

SEQ ID NO: 1942485 - RNA, 18 nt, Homo sapiens
guggcauguuuugugcau

SEQ ID NO: 1942486 - RNA, 20 nt, Homo sapiens
acaaucaugaacagcucuga

SEQ ID NO: 1942487 - RNA, 17 nt, Homo sapiens
gagggaggucacuggaa

SEQ ID NO: 1942488 - RNA, 18 nt, Homo sapiens
cugucauggugcaauuug

SEQ ID NO: 1942489 - RNA, 21 nt, Homo sapiens
uugguauuaauuugacugugc

SEQ ID NO: 1942490 - RNA, 20 nt, Homo sapiens
acugaaaaugucacauucua

SEQ ID NO: 1942491 - RNA, 17 nt, Homo sapiens
uuugcuagcaguaaaag

SEQ ID NO: 1942492 - RNA, 23 nt, Homo sapiens
acucucccaaacccccaauagcu

SEQ ID NO: 1942493 - RNA, 14 nt, Homo sapiens
aaccuccaccuccc

SEQ ID NO: 1942494 - RNA, 12 nt, Homo sapiens
cagcacauauuu

SEQ ID NO: 1942495 - RNA, 22 nt, Homo sapiens
uaaaauguauuuuucacaaagg

SEQ ID NO: 1942496 - RNA, 19 nt, Homo sapiens
ccuuaauaugaucugugga

SEQ ID NO: 1942497 - RNA, 20 nt, Homo sapiens
uauaguagacacacuaucau

SEQ ID NO: 1942498 - RNA, 12 nt, Homo sapiens
auguguauacac

SEQ ID NO: 1942499 - RNA, 22 nt, Homo sapiens
uugguugaacuaugcugaagag

SEQ ID NO: 1942500 - RNA, 14 nt, Homo sapiens
ugcucuuugcugca

SEQ ID NO: 1942501 - RNA, 17 nt, Homo sapiens
uaaauuacguagguuua

SEQ ID NO: 1942502 - RNA, 17 nt, Homo sapiens
ccugcugauguggcaac

SEQ ID NO: 1942503 - RNA, 20 nt, Homo sapiens
uauauguauauacacaucca

SEQ ID NO: 1942504 - RNA, 20 nt, Homo sapiens
gaagcaucgcuccucuccag

SEQ ID NO: 1942505 - RNA, 15 nt, Homo sapiens
auuucagaggaggaa

SEQ ID NO: 1942506 - RNA, 19 nt, Homo sapiens
caucauuuuuaagcacugu

SEQ ID NO: 1942507 - RNA, 15 nt, Homo sapiens
cuucacggacaggaa

SEQ ID NO: 1942508 - RNA, 22 nt, Homo sapiens
uccugcggcucagccuugcaca

SEQ ID NO: 1942509 - RNA, 22 nt, Homo sapiens
cacccugagcucggggacaggu

SEQ ID NO: 1942510 - RNA, 21 nt, Homo sapiens
ugugcggccuggucuaccugu

SEQ ID NO: 1942511 - RNA, 15 nt, Homo sapiens
gucccucccugccug

SEQ ID NO: 1942512 - RNA, 21 nt, Homo sapiens
uggaccugcccugggccacac

SEQ ID NO: 1942513 - RNA, 16 nt, Homo sapiens
uuaaacauacgacuua

SEQ ID NO: 1942514 - RNA, 22 nt, Homo sapiens
uauacugcauuagcccaagaga

SEQ ID NO: 1942515 - RNA, 13 nt, Homo sapiens
aguuauucuugca

SEQ ID NO: 1942516 - RNA, 20 nt, Homo sapiens
cuagcugagcuuuaaaucau

SEQ ID NO: 1942517 - RNA, 19 nt, Homo sapiens
caaucauguucuggugguu

SEQ ID NO: 1942518 - RNA, 12 nt, Homo sapiens
gaccucauuuac

SEQ ID NO: 1942519 - RNA, 20 nt, Homo sapiens
ccugggucuuuaugcaugaa

SEQ ID NO: 1942520 - RNA, 19 nt, Homo sapiens
agccuggagccccugugug

SEQ ID NO: 1942521 - RNA, 17 nt, Homo sapiens
uuucucauuaauuuugg

SEQ ID NO: 1942522 - RNA, 20 nt, Homo sapiens
ugucugaacccaggcagcug

SEQ ID NO: 1942523 - RNA, 18 nt, Homo sapiens
cauacaugucacauuuag

SEQ ID NO: 1942524 - RNA, 14 nt, Homo sapiens
auuuaaacaacagc

SEQ ID NO: 1942525 - RNA, 18 nt, Homo sapiens
auccaccaagaacauaag

SEQ ID NO: 1942526 - RNA, 14 nt, Homo sapiens
gucuccauaggaca

SEQ ID NO: 1942527 - RNA, 18 nt, Homo sapiens
caggauauccaaggccac

SEQ ID NO: 1942528 - RNA, 22 nt, Homo sapiens
cugauuuaggagaagccaggaa

SEQ ID NO: 1942529 - RNA, 17 nt, Homo sapiens
ccaaagaauauuccauu

SEQ ID NO: 1942530 - RNA, 22 nt, Homo sapiens
gacaggcuagcuagcuguguua

SEQ ID NO: 1942531 - RNA, 13 nt, Homo sapiens
ucuagugaaugaa

SEQ ID NO: 1942532 - RNA, 22 nt, Homo sapiens
ucuaaacuuucccuauacuuag

SEQ ID NO: 1942533 - RNA, 20 nt, Homo sapiens
cagacuggcaauaaacuccu

SEQ ID NO: 1942534 - RNA, 15 nt, Homo sapiens
caacugagaagccaa

SEQ ID NO: 1942535 - RNA, 22 nt, Homo sapiens
gcccaggagcgcagcugcauuu

SEQ ID NO: 1942536 - RNA, 14 nt, Homo sapiens
guguacaugugcuu

SEQ ID NO: 1942537 - RNA, 23 nt, Homo sapiens
agacaacuucccaaagcacaaag

SEQ ID NO: 1942538 - RNA, 17 nt, Homo sapiens
gaccaccaccaggacug

SEQ ID NO: 1942539 - RNA, 17 nt, Homo sapiens
gacauucuuagcuguaa

SEQ ID NO: 1942540 - RNA, 18 nt, Homo sapiens
ugcucuguuuugcaugga

SEQ ID NO: 1942541 - RNA, 21 nt, Homo sapiens
cuauagugaacucccaucuau

SEQ ID NO: 1942542 - RNA, 16 nt, Homo sapiens
uauuucugucauucaa

SEQ ID NO: 1942543 - RNA, 18 nt, Homo sapiens
uggagaagcuagaaggca

SEQ ID NO: 1942544 - RNA, 21 nt, Homo sapiens
gccccuuccuccuucaugccu

SEQ ID NO: 1942545 - RNA, 18 nt, Homo sapiens
guaucuauuuguacaauu

SEQ ID NO: 1942546 - RNA, 18 nt, Homo sapiens
ugcuugccgaaacuggaa

SEQ ID NO: 1942547 - RNA, 14 nt, Homo sapiens
ucaugcucucuaua

SEQ ID NO: 1942548 - RNA, 21 nt, Homo sapiens
uugacaguuuuugacauuuau

SEQ ID NO: 1942549 - RNA, 15 nt, Homo sapiens
agccaaccccugugg

SEQ ID NO: 1942550 - RNA, 11 nt, Homo sapiens
acaaugcauuu

SEQ ID NO: 1942551 - RNA, 14 nt, Homo sapiens
ccaacugcugauca

SEQ ID NO: 1942552 - RNA, 20 nt, Homo sapiens
auuaucacagugaaugcacu

SEQ ID NO: 1942553 - RNA, 15 nt, Homo sapiens
uggaaaauaccagug

SEQ ID NO: 1942554 - RNA, 13 nt, Homo sapiens
acacaccugguga

SEQ ID NO: 1942555 - RNA, 12 nt, Homo sapiens
cgugaguggucu

SEQ ID NO: 1942556 - RNA, 13 nt, Homo sapiens
agagaccugcuca

SEQ ID NO: 1942557 - RNA, 20 nt, Homo sapiens
accuccacccccuccuguca

SEQ ID NO: 1942558 - RNA, 22 nt, Homo sapiens
gauaaauuacuaauuaucuuau

SEQ ID NO: 1942559 - RNA, 14 nt, Homo sapiens
uagugacaugcagu

SEQ ID NO: 1942560 - RNA, 16 nt, Homo sapiens
uuacagacaugagccu

SEQ ID NO: 1942561 - RNA, 14 nt, Homo sapiens
gugccgccugcucc

SEQ ID NO: 1942562 - RNA, 14 nt, Homo sapiens
uuaacaaucaaaaa

SEQ ID NO: 1942563 - RNA, 15 nt, Homo sapiens
uguagaagauggacu

SEQ ID NO: 1942564 - RNA, 13 nt, Homo sapiens
uuuauuaccucug

SEQ ID NO: 1942565 - RNA, 23 nt, Homo sapiens
uuauguauaaaauguaacacuga

SEQ ID NO: 1942566 - RNA, 17 nt, Homo sapiens
cuucucuccacaguguu

SEQ ID NO: 1942567 - RNA, 18 nt, Homo sapiens
augaagguggaacaagca

SEQ ID NO: 1942568 - RNA, 22 nt, Homo sapiens
cuugcuucucccauuuccugau

SEQ ID NO: 1942569 - RNA, 15 nt, Homo sapiens
cuccugccauagucu

SEQ ID NO: 1942570 - RNA, 15 nt, Homo sapiens
cuguuuucaucacaa

SEQ ID NO: 1942571 - RNA, 20 nt, Homo sapiens
uuucuuccuuaaacuccugu

SEQ ID NO: 1942572 - RNA, 17 nt, Homo sapiens
cugcuugugaucucaca

SEQ ID NO: 1942573 - RNA, 22 nt, Homo sapiens
aaauauaauuguuuuuuaucuu

SEQ ID NO: 1942574 - RNA, 22 nt, Homo sapiens
aaaggguugggagcugaugaaa

SEQ ID NO: 1942575 - RNA, 17 nt, Homo sapiens
ucugccauaucagugaa

SEQ ID NO: 1942576 - RNA, 14 nt, Homo sapiens
cuaucucuacugaa

SEQ ID NO: 1942577 - RNA, 18 nt, Homo sapiens
auaucaugucuugugcau

SEQ ID NO: 1942578 - RNA, 20 nt, Homo sapiens
cagugugagcauuugucucu

SEQ ID NO: 1942579 - RNA, 18 nt, Homo sapiens
agggcgcucuuccaggca

SEQ ID NO: 1942580 - RNA, 21 nt, Homo sapiens
cuuugccaucaagaaacauuc

SEQ ID NO: 1942581 - RNA, 19 nt, Homo sapiens
acugauagggguucaugcu

SEQ ID NO: 1942582 - RNA, 17 nt, Homo sapiens
acccuccuccacuccac

SEQ ID NO: 1942583 - RNA, 19 nt, Homo sapiens
aacggcuuggcagccaguc

SEQ ID NO: 1942584 - RNA, 16 nt, Homo sapiens
augagaaaucaugccu

SEQ ID NO: 1942585 - RNA, 17 nt, Homo sapiens
uguccaggcacugagau

SEQ ID NO: 1942586 - RNA, 16 nt, Homo sapiens
gcugccucccaucuca

SEQ ID NO: 1942587 - RNA, 20 nt, Homo sapiens
aauaccccuaacauacugca

SEQ ID NO: 1942588 - RNA, 17 nt, Homo sapiens
gagacaccaccuauacc

SEQ ID NO: 1942589 - RNA, 17 nt, Homo sapiens
aguuacugaucacagga

SEQ ID NO: 1942590 - RNA, 20 nt, Homo sapiens
aucuccuccaauguccugaa

SEQ ID NO: 1942591 - RNA, 20 nt, Homo sapiens
aauucucuaguuugauuaaa

SEQ ID NO: 1942592 - RNA, 18 nt, Homo sapiens
ugcugaacucaaugugca

SEQ ID NO: 1942593 - RNA, 23 nt, Homo sapiens
acauaaucauggauuauguugac

SEQ ID NO: 1942594 - RNA, 23 nt, Homo sapiens
gaacacagguguuggaagccagg

SEQ ID NO: 1942595 - RNA, 19 nt, Homo sapiens
uucugaaggccaacgugga

SEQ ID NO: 1942596 - RNA, 14 nt, Homo sapiens
aucuuaauguauau

SEQ ID NO: 1942597 - RNA, 20 nt, Homo sapiens
ucugguuagaaaaaggacuc

SEQ ID NO: 1942598 - RNA, 18 nt, Homo sapiens
aguggacagucuggccac

SEQ ID NO: 1942599 - RNA, 19 nt, Homo sapiens
ugaaggaguccuugcauca

SEQ ID NO: 1942600 - RNA, 19 nt, Homo sapiens
uuacaacuuguauuuccaa

SEQ ID NO: 1942601 - RNA, 13 nt, Homo sapiens
uugggaagaccag

SEQ ID NO: 1942602 - RNA, 16 nt, Homo sapiens
uaccaggggaggcagu

SEQ ID NO: 1942603 - RNA, 22 nt, Homo sapiens
aaggaguaggacaaaguuguca

SEQ ID NO: 1942604 - RNA, 23 nt, Homo sapiens
ugaaaguagagcuagcugccacu

SEQ ID NO: 1942605 - RNA, 16 nt, Homo sapiens
cuguuucuuagauucu

SEQ ID NO: 1942606 - RNA, 16 nt, Homo sapiens
cuuugcauauuauaaa

SEQ ID NO: 1942607 - RNA, 17 nt, Homo sapiens
acuguauuuacuuguua

SEQ ID NO: 1942608 - RNA, 17 nt, Homo sapiens
agaugcugggauagcca

SEQ ID NO: 1942609 - RNA, 13 nt, Homo sapiens
uaauuuucgcuua

SEQ ID NO: 1942610 - RNA, 17 nt, Homo sapiens
uguaaucccagcacuuu

SEQ ID NO: 1942611 - RNA, 23 nt, Homo sapiens
uccccuguuugcaugagaaaagu

SEQ ID NO: 1942612 - RNA, 11 nt, Homo sapiens
cagauucagug

SEQ ID NO: 1942613 - RNA, 11 nt, Homo sapiens
gacauucacuc

SEQ ID NO: 1942614 - RNA, 23 nt, Homo sapiens
cucuccugcgugugcccacugaa

SEQ ID NO: 1942615 - RNA, 14 nt, Homo sapiens
gaugacuggucucu

SEQ ID NO: 1942616 - RNA, 12 nt, Homo sapiens
aacaagaucugc

SEQ ID NO: 1942617 - RNA, 15 nt, Homo sapiens
acaucugcagcucuu

SEQ ID NO: 1942618 - RNA, 14 nt, Homo sapiens
cugaaugacaucaa

SEQ ID NO: 1942619 - RNA, 19 nt, Homo sapiens
ugagagcugcuuugaggca

SEQ ID NO: 1942620 - RNA, 21 nt, Homo sapiens
uggaaccaaaaaucacuguca

SEQ ID NO: 1942621 - RNA, 22 nt, Homo sapiens
uagcagaugcuggucauguguu

SEQ ID NO: 1942622 - RNA, 13 nt, Homo sapiens
ucacaugccuugc

SEQ ID NO: 1942623 - RNA, 13 nt, Homo sapiens
cugcugaugcuca

SEQ ID NO: 1942624 - RNA, 13 nt, Homo sapiens
uuuuucaagagcu

SEQ ID NO: 1942625 - RNA, 17 nt, Homo sapiens
caaagaaaugaacauuc

SEQ ID NO: 1942626 - RNA, 14 nt, Homo sapiens
cugucucacuggca

SEQ ID NO: 1942627 - RNA, 14 nt, Homo sapiens
gucgcacagucucu

SEQ ID NO: 1942628 - RNA, 15 nt, Homo sapiens
ugggcaccuaagcaa

SEQ ID NO: 1942629 - RNA, 20 nt, Homo sapiens
auguauuuguuugcaauuuu

SEQ ID NO: 1942630 - RNA, 16 nt, Homo sapiens
agcaguccccagugau

SEQ ID NO: 1942631 - RNA, 19 nt, Homo sapiens
guaucuuccuuucuugucu

SEQ ID NO: 1942632 - RNA, 21 nt, Homo sapiens
ugcaguaaaguuccaugaaga

SEQ ID NO: 1942633 - RNA, 16 nt, Homo sapiens
gaauucaaagcuugug

SEQ ID NO: 1942634 - RNA, 21 nt, Homo sapiens
caucuucucauucccaugugg

SEQ ID NO: 1942635 - RNA, 17 nt, Homo sapiens
uuugaacuagaguuuag

SEQ ID NO: 1942636 - RNA, 18 nt, Homo sapiens
aucccucgggugugcuau

SEQ ID NO: 1942637 - RNA, 21 nt, Homo sapiens
agccacgaacacgcaugccuc

SEQ ID NO: 1942638 - RNA, 16 nt, Homo sapiens
gacugacccugaucag

SEQ ID NO: 1942639 - RNA, 20 nt, Homo sapiens
cacuguagcuuuacaaggag

SEQ ID NO: 1942640 - RNA, 14 nt, Homo sapiens
cacuaauacuacug

SEQ ID NO: 1942641 - RNA, 22 nt, Homo sapiens
uaucauuggaugauauguugau

SEQ ID NO: 1942642 - RNA, 15 nt, Homo sapiens
aaauaaaagcacuua

SEQ ID NO: 1942643 - RNA, 20 nt, Homo sapiens
aauaauagggaaaauaccua

SEQ ID NO: 1942644 - RNA, 14 nt, Homo sapiens
gcucaguagccuuu

SEQ ID NO: 1942645 - RNA, 14 nt, Homo sapiens
uuaccaaaucucag

SEQ ID NO: 1942646 - RNA, 15 nt, Homo sapiens
caggagggagcauag

SEQ ID NO: 1942647 - RNA, 14 nt, Homo sapiens
gugacccacugcgc

SEQ ID NO: 1942648 - RNA, 15 nt, Homo sapiens
cuguuucuccacaac

SEQ ID NO: 1942649 - RNA, 12 nt, Homo sapiens
uggaugugaugg

SEQ ID NO: 1942650 - RNA, 15 nt, Homo sapiens
auauccuuagcccau

SEQ ID NO: 1942651 - RNA, 23 nt, Homo sapiens
uucuaaucuuguuaaauugcuua

SEQ ID NO: 1942652 - RNA, 13 nt, Homo sapiens
ugaacugcugauu

SEQ ID NO: 1942653 - RNA, 22 nt, Homo sapiens
aaaguuaauucucaccauuccu

SEQ ID NO: 1942654 - RNA, 16 nt, Homo sapiens
agugccuuuacuucag

SEQ ID NO: 1942655 - RNA, 17 nt, Homo sapiens
caaugaccacauccuga

SEQ ID NO: 1942656 - RNA, 18 nt, Homo sapiens
gauuugcccacguaccca

SEQ ID NO: 1942657 - RNA, 20 nt, Homo sapiens
cugagggacauaucagugac

SEQ ID NO: 1942658 - RNA, 17 nt, Homo sapiens
caaagucuccagcccac

SEQ ID NO: 1942659 - RNA, 22 nt, Homo sapiens
uuaaguuugaaacuaacucaua

SEQ ID NO: 1942660 - RNA, 19 nt, Homo sapiens
cuuuuccuggacacuuuac

SEQ ID NO: 1942661 - RNA, 21 nt, Homo sapiens
uuuucucaccugucaucucac

SEQ ID NO: 1942662 - RNA, 18 nt, Homo sapiens
gucuaaaguuacuacuga

SEQ ID NO: 1942663 - RNA, 22 nt, Homo sapiens
aauuuuguaucaccucuucaca

SEQ ID NO: 1942664 - RNA, 15 nt, Homo sapiens
ugcugcuugucaaau

SEQ ID NO: 1942665 - RNA, 14 nt, Homo sapiens
ugcacaaugucuug

SEQ ID NO: 1942666 - RNA, 20 nt, Homo sapiens
ggauauaagugauaguuuau

SEQ ID NO: 1942667 - RNA, 14 nt, Homo sapiens
ccaauggcuguaaa

SEQ ID NO: 1942668 - RNA, 23 nt, Homo sapiens
ccugagugggcgugguaccugcu

SEQ ID NO: 1942669 - RNA, 16 nt, Homo sapiens
agccagccuugcuccu

SEQ ID NO: 1942670 - RNA, 22 nt, Homo sapiens
aauuugugugagagcuguacau

SEQ ID NO: 1942671 - RNA, 19 nt, Homo sapiens
gaaauguuacauguagaaa

SEQ ID NO: 1942672 - RNA, 23 nt, Homo sapiens
gucagaacagagugcaacccagu

SEQ ID NO: 1942673 - RNA, 15 nt, Homo sapiens
ccacccccugccaau

SEQ ID NO: 1942674 - RNA, 17 nt, Homo sapiens
ccaucugugugcaacua

SEQ ID NO: 1942675 - RNA, 20 nt, Homo sapiens
ucauuaggaggccgagguag

SEQ ID NO: 1942676 - RNA, 12 nt, Homo sapiens
ggaggcauucuu

SEQ ID NO: 1942677 - RNA, 16 nt, Homo sapiens
cauaauuacuauguca

SEQ ID NO: 1942678 - RNA, 19 nt, Homo sapiens
aguugagaaagaagagaag

SEQ ID NO: 1942679 - RNA, 17 nt, Homo sapiens
aaguugcauagguuuaa

SEQ ID NO: 1942680 - RNA, 12 nt, Homo sapiens
uaccuuacugaa

SEQ ID NO: 1942681 - RNA, 19 nt, Homo sapiens
aauggacaaacagugcacu

SEQ ID NO: 1942682 - RNA, 24 nt, Homo sapiens
aaaacagaccagcauaguucugca

SEQ ID NO: 1942683 - RNA, 17 nt, Homo sapiens
guuuagaagagccugac

SEQ ID NO: 1942684 - RNA, 19 nt, Homo sapiens
guaagacucgggauuagua

SEQ ID NO: 1942685 - RNA, 11 nt, Homo sapiens
ucugucuuccu

SEQ ID NO: 1942686 - RNA, 23 nt, Homo sapiens
ugagcacugagggucuggugcca

SEQ ID NO: 1942687 - RNA, 11 nt, Homo sapiens
ucuucagccac

SEQ ID NO: 1942688 - RNA, 22 nt, Homo sapiens
uggauuccucuaagaucuugcc

SEQ ID NO: 1942689 - RNA, 19 nt, Homo sapiens
uaggucuguaauuuauuaa

SEQ ID NO: 1942690 - RNA, 14 nt, Homo sapiens
gcgguggaccaaag

SEQ ID NO: 1942691 - RNA, 21 nt, Homo sapiens
gcagaaauauauuaugaaaau

SEQ ID NO: 1942692 - RNA, 21 nt, Homo sapiens
uacaauaaaacuuugcugcca

SEQ ID NO: 1942693 - RNA, 19 nt, Homo sapiens
gauagaaccaccauaguga

SEQ ID NO: 1942694 - RNA, 15 nt, Homo sapiens
caugcccagcuugga

SEQ ID NO: 1942695 - RNA, 15 nt, Homo sapiens
cuguaaacuuggaau

SEQ ID NO: 1942696 - RNA, 21 nt, Homo sapiens
guuuagaugagguugagcuau

SEQ ID NO: 1942697 - RNA, 23 nt, Homo sapiens
aauucauucucugugguauccaa

SEQ ID NO: 1942698 - RNA, 23 nt, Homo sapiens
cuuuuauaggugagaaaaaaaca

SEQ ID NO: 1942699 - RNA, 21 nt, Homo sapiens
uauaagguguuuucuguguaa

SEQ ID NO: 1942700 - RNA, 13 nt, Homo sapiens
aaaauucaucugu

SEQ ID NO: 1942701 - RNA, 22 nt, Homo sapiens
uggccgcuccucccucagaaaa

SEQ ID NO: 1942702 - RNA, 16 nt, Homo sapiens
aaggagagacauggaa

SEQ ID NO: 1942703 - RNA, 12 nt, Homo sapiens
cacuucuuaggg

SEQ ID NO: 1942704 - RNA, 13 nt, Homo sapiens
aguuuuucagucu

SEQ ID NO: 1942705 - RNA, 13 nt, Homo sapiens
auuuauucauuca

SEQ ID NO: 1942706 - RNA, 11 nt, Homo sapiens
acguuguguaa

SEQ ID NO: 1942707 - RNA, 20 nt, Homo sapiens
gacaucaccaaguguggaau

SEQ ID NO: 1942708 - RNA, 23 nt, Homo sapiens
cagcacuacaacuuaauugcucu

SEQ ID NO: 1942709 - RNA, 17 nt, Homo sapiens
uggcuuuaagccauuau

SEQ ID NO: 1942710 - RNA, 17 nt, Homo sapiens
acagggcucccgaguca

SEQ ID NO: 1942711 - RNA, 15 nt, Homo sapiens
uaagcacugugcuaa

SEQ ID NO: 1942712 - RNA, 13 nt, Homo sapiens
uaauauaguagau

SEQ ID NO: 1942713 - RNA, 22 nt, Homo sapiens
guuuuaacuuauuguugcugaa

SEQ ID NO: 1942714 - RNA, 14 nt, Homo sapiens
guucugaacuggaa

SEQ ID NO: 1942715 - RNA, 16 nt, Homo sapiens
cauaccagaaagcucu

SEQ ID NO: 1942716 - RNA, 18 nt, Homo sapiens
acaugcuaugcugaagac

SEQ ID NO: 1942717 - RNA, 22 nt, Homo sapiens
uagucucuggcaagaugcuuua

SEQ ID NO: 1942718 - RNA, 24 nt, Homo sapiens
ccauccagcaugugugugucucua

SEQ ID NO: 1942719 - RNA, 16 nt, Homo sapiens
uacaucuagcaauuuc

SEQ ID NO: 1942720 - RNA, 14 nt, Homo sapiens
cuccuuuccugcaa

SEQ ID NO: 1942721 - RNA, 17 nt, Homo sapiens
cagcaucugccaggaca

SEQ ID NO: 1942722 - RNA, 20 nt, Homo sapiens
cguuguaguaaaugcgugcu

SEQ ID NO: 1942723 - RNA, 13 nt, Homo sapiens
acacagcuaccuc

SEQ ID NO: 1942724 - RNA, 18 nt, Homo sapiens
ggaaucagaagcacuagu

SEQ ID NO: 1942725 - RNA, 20 nt, Homo sapiens
ccagucgggggaacugaggc

SEQ ID NO: 1942726 - RNA, 18 nt, Homo sapiens
accauauggaaugccaaa

SEQ ID NO: 1942727 - RNA, 23 nt, Homo sapiens
gcaagaguaggguagaccaaauc

SEQ ID NO: 1942728 - RNA, 19 nt, Homo sapiens
aagcauuguauacauugau

SEQ ID NO: 1942729 - RNA, 18 nt, Homo sapiens
gauguuuaguaauacagc

SEQ ID NO: 1942730 - RNA, 15 nt, Homo sapiens
ugaagagaagcugag

SEQ ID NO: 1942731 - RNA, 15 nt, Homo sapiens
aaauuaaauacauaa

SEQ ID NO: 1942732 - RNA, 19 nt, Homo sapiens
uccugcagcaaacacucca

SEQ ID NO: 1942733 - RNA, 22 nt, Homo sapiens
ucuaacagcacagggaagcaaa

SEQ ID NO: 1942734 - RNA, 18 nt, Homo sapiens
uguagaucaagugugcau

SEQ ID NO: 1942735 - RNA, 15 nt, Homo sapiens
guuuuaauguagauu

SEQ ID NO: 1942736 - RNA, 14 nt, Homo sapiens
ucacuguacugcau

SEQ ID NO: 1942737 - RNA, 14 nt, Homo sapiens
agaaucgcuuaaac

SEQ ID NO: 1942738 - RNA, 22 nt, Homo sapiens
gauaauaaauuauacacuauga

SEQ ID NO: 1942739 - RNA, 23 nt, Homo sapiens
auuucaguaguggugaugguugu

SEQ ID NO: 1942740 - RNA, 22 nt, Homo sapiens
aacacacagacccaagauucau

SEQ ID NO: 1942741 - RNA, 23 nt, Homo sapiens
ugaaagagaaaaugcgucucucc

SEQ ID NO: 1942742 - RNA, 19 nt, Homo sapiens
gcucccacacuugugccag

SEQ ID NO: 1942743 - RNA, 18 nt, Homo sapiens
ucucaugucuuugcugca

SEQ ID NO: 1942744 - RNA, 18 nt, Homo sapiens
cccugucucugcaucuga

SEQ ID NO: 1942745 - RNA, 16 nt, Homo sapiens
aauuucauaccuauca

SEQ ID NO: 1942746 - RNA, 15 nt, Homo sapiens
auccaauaccucuug

SEQ ID NO: 1942747 - RNA, 14 nt, Homo sapiens
ccgcccgcauagca

SEQ ID NO: 1942748 - RNA, 23 nt, Homo sapiens
uauaacaccaucuggagucuucc

SEQ ID NO: 1942749 - RNA, 18 nt, Homo sapiens
aaacguguaaauugcaca

SEQ ID NO: 1942750 - RNA, 23 nt, Homo sapiens
ugugaccacaacaugaggccacu

SEQ ID NO: 1942751 - RNA, 14 nt, Homo sapiens
aaggagccagcucc

SEQ ID NO: 1942752 - RNA, 23 nt, Homo sapiens
uaacuggagcagagaacaucugg

SEQ ID NO: 1942753 - RNA, 20 nt, Homo sapiens
cucccagccugacucccucg

SEQ ID NO: 1942754 - RNA, 15 nt, Homo sapiens
gggaauucccucccc

SEQ ID NO: 1942755 - RNA, 18 nt, Homo sapiens
uaaauuuuauuccaaaau

SEQ ID NO: 1942756 - RNA, 18 nt, Homo sapiens
agggucuaaagagaacaa

SEQ ID NO: 1942757 - RNA, 19 nt, Homo sapiens
uagcaaagaggcuguuaua

SEQ ID NO: 1942758 - RNA, 18 nt, Homo sapiens
auccaucuaaauaccugc

SEQ ID NO: 1942759 - RNA, 16 nt, Homo sapiens
uuuagcucugaagcaa

SEQ ID NO: 1942760 - RNA, 14 nt, Homo sapiens
aguucaagugcucu

SEQ ID NO: 1942761 - RNA, 23 nt, Homo sapiens
uacagacaaagcgugguggacau

SEQ ID NO: 1942762 - RNA, 22 nt, Homo sapiens
uccgaaggugucucuggucuuc

SEQ ID NO: 1942763 - RNA, 16 nt, Homo sapiens
ucagaguugugcacau

SEQ ID NO: 1942764 - RNA, 16 nt, Homo sapiens
cugcugcacacacuca

SEQ ID NO: 1942765 - RNA, 19 nt, Homo sapiens
cuugugguugaaaaccaca

SEQ ID NO: 1942766 - RNA, 16 nt, Homo sapiens
aaugagaucucauuaa

SEQ ID NO: 1942767 - RNA, 18 nt, Homo sapiens
cuugcauugccugccugg

SEQ ID NO: 1942768 - RNA, 13 nt, Homo sapiens
gaaaaaauggaug

SEQ ID NO: 1942769 - RNA, 22 nt, Homo sapiens
ccagaggcuucuccaaagggag

SEQ ID NO: 1942770 - RNA, 11 nt, Homo sapiens
gagggcagcug

SEQ ID NO: 1942771 - RNA, 14 nt, Homo sapiens
ccugucacaauucu

SEQ ID NO: 1942772 - RNA, 14 nt, Homo sapiens
ccaacaaaccacac

SEQ ID NO: 1942773 - RNA, 15 nt, Homo sapiens
ccucuccuuccucag

SEQ ID NO: 1942774 - RNA, 22 nt, Homo sapiens
agagccuguccccgccuucccu

SEQ ID NO: 1942775 - RNA, 18 nt, Homo sapiens
gcauaugauagaugacaa

SEQ ID NO: 1942776 - RNA, 20 nt, Homo sapiens
cucaaccugggucaaagugg

SEQ ID NO: 1942777 - RNA, 21 nt, Homo sapiens
auucaugugguuucuaugcaa

SEQ ID NO: 1942778 - RNA, 15 nt, Homo sapiens
agcacagugccugca

SEQ ID NO: 1942779 - RNA, 18 nt, Homo sapiens
gauccaaguuuacucaac

SEQ ID NO: 1942780 - RNA, 18 nt, Homo sapiens
guauuaaacucuaaugua

SEQ ID NO: 1942781 - RNA, 15 nt, Homo sapiens
gauucuucugccuca

SEQ ID NO: 1942782 - RNA, 20 nt, Homo sapiens
auucaagaggaauuccagca

SEQ ID NO: 1942783 - RNA, 17 nt, Homo sapiens
aaugaauuccucauuug

SEQ ID NO: 1942784 - RNA, 14 nt, Homo sapiens
guucuuacacauuc

SEQ ID NO: 1942785 - RNA, 17 nt, Homo sapiens
ccucaaaacaaaggccu

SEQ ID NO: 1942786 - RNA, 16 nt, Homo sapiens
cacuaagaagcuugaa

SEQ ID NO: 1942787 - RNA, 23 nt, Homo sapiens
auuuuauuuuuuucucucugaca

SEQ ID NO: 1942788 - RNA, 18 nt, Homo sapiens
uuuguuuucagcacugau

SEQ ID NO: 1942789 - RNA, 15 nt, Homo sapiens
gaagacuauggugcu

SEQ ID NO: 1942790 - RNA, 13 nt, Homo sapiens
uuuacuacugugg

SEQ ID NO: 1942791 - RNA, 16 nt, Homo sapiens
gagagcacccacugaa

SEQ ID NO: 1942792 - RNA, 17 nt, Homo sapiens
cuaauaaaaacaagaug

SEQ ID NO: 1942793 - RNA, 12 nt, Homo sapiens
ggucaugcccuc

SEQ ID NO: 1942794 - RNA, 13 nt, Homo sapiens
auucauuccucac

SEQ ID NO: 1942795 - RNA, 14 nt, Homo sapiens
uguggacacugugg

SEQ ID NO: 1942796 - RNA, 14 nt, Homo sapiens
gagaaagaaaggga

SEQ ID NO: 1942797 - RNA, 14 nt, Homo sapiens
ucuuccugcccuug

SEQ ID NO: 1942798 - RNA, 18 nt, Homo sapiens
ucucuccagcuguacugu

SEQ ID NO: 1942799 - RNA, 16 nt, Homo sapiens
uuucugucucugccuc

SEQ ID NO: 1942800 - RNA, 16 nt, Homo sapiens
uuaaauggacaaugga

SEQ ID NO: 1942801 - RNA, 16 nt, Homo sapiens
cugacgagcagggugg

SEQ ID NO: 1942802 - RNA, 20 nt, Homo sapiens
ccagccacugcagcacagga

SEQ ID NO: 1942803 - RNA, 16 nt, Homo sapiens
aggaugccaagauuaa

SEQ ID NO: 1942804 - RNA, 16 nt, Homo sapiens
gaauuuaaacaaugca

SEQ ID NO: 1942805 - RNA, 22 nt, Homo sapiens
agcuuaaacagcuggucagccc

SEQ ID NO: 1942806 - RNA, 23 nt, Homo sapiens
uccagggcagaggccaugaagaa

SEQ ID NO: 1942807 - RNA, 16 nt, Homo sapiens
caugcguccacuuucc

SEQ ID NO: 1942808 - RNA, 16 nt, Homo sapiens
gacucuucgaugugcc

SEQ ID NO: 1942809 - RNA, 17 nt, Homo sapiens
cccaggcugugcagcgc

SEQ ID NO: 1942810 - RNA, 20 nt, Homo sapiens
acaucaaauuugccaccacu

SEQ ID NO: 1942811 - RNA, 21 nt, Homo sapiens
aggaccccaucgccaucccug

SEQ ID NO: 1942812 - RNA, 20 nt, Homo sapiens
uccuccuuggcggcaaaagc

SEQ ID NO: 1942813 - RNA, 14 nt, Homo sapiens
agguagacuuugcu

SEQ ID NO: 1942814 - RNA, 17 nt, Homo sapiens
cugaggugagcaucauc

SEQ ID NO: 1942815 - RNA, 14 nt, Homo sapiens
gaaggcuucugugu

SEQ ID NO: 1942816 - RNA, 16 nt, Homo sapiens
acauggaugagcacac

SEQ ID NO: 1942817 - RNA, 23 nt, Homo sapiens
ugaccaaaccucauaugugaaau

SEQ ID NO: 1942818 - RNA, 20 nt, Homo sapiens
aauucucucaagacuucucc

SEQ ID NO: 1942819 - RNA, 19 nt, Homo sapiens
uauaugaacuuaacaugcu

SEQ ID NO: 1942820 - RNA, 13 nt, Homo sapiens
ucacucacucuga

SEQ ID NO: 1942821 - RNA, 11 nt, Homo sapiens
ucauguaaaaa

SEQ ID NO: 1942822 - RNA, 14 nt, Homo sapiens
caacuagaagccua

SEQ ID NO: 1942823 - RNA, 14 nt, Homo sapiens
cauuuucauuacca

SEQ ID NO: 1942824 - RNA, 12 nt, Homo sapiens
gacaacaaagag

SEQ ID NO: 1942825 - RNA, 15 nt, Homo sapiens
uuguaaaauguucuc

SEQ ID NO: 1942826 - RNA, 16 nt, Homo sapiens
accccaugcuguugau

SEQ ID NO: 1942827 - RNA, 18 nt, Homo sapiens
cuuagauuuaacauauac

SEQ ID NO: 1942828 - RNA, 21 nt, Homo sapiens
aaaccccccagagcucuuuac

SEQ ID NO: 1942829 - RNA, 21 nt, Homo sapiens
uguaggacuaaauaaugaucu

SEQ ID NO: 1942830 - RNA, 20 nt, Homo sapiens
gugaacagcuugcugucacu

SEQ ID NO: 1942831 - RNA, 20 nt, Homo sapiens
agugacucuugaaguacuua

SEQ ID NO: 1942832 - RNA, 13 nt, Homo sapiens
ucucuucuauccu

SEQ ID NO: 1942833 - RNA, 13 nt, Homo sapiens
ucuacucuaucac

SEQ ID NO: 1942834 - RNA, 17 nt, Homo sapiens
cuaaauuugucuuucaa

SEQ ID NO: 1942835 - RNA, 22 nt, Homo sapiens
ugacucaacaguuuccagucau

SEQ ID NO: 1942836 - RNA, 13 nt, Homo sapiens
uccuucuuugaua

SEQ ID NO: 1942837 - RNA, 18 nt, Homo sapiens
uuagaagaaaacauauau

SEQ ID NO: 1942838 - RNA, 16 nt, Homo sapiens
ccuaaauguaaucacg

SEQ ID NO: 1942839 - RNA, 16 nt, Homo sapiens
ugguaauuaugugaua

SEQ ID NO: 1942840 - RNA, 19 nt, Homo sapiens
augcaccacggcagcucuc

SEQ ID NO: 1942841 - RNA, 22 nt, Homo sapiens
agaaguugacaggcagugccau

SEQ ID NO: 1942842 - RNA, 17 nt, Homo sapiens
uaacguuuucuacuuug

SEQ ID NO: 1942843 - RNA, 19 nt, Homo sapiens
aaauguucaagucaugccu

SEQ ID NO: 1942844 - RNA, 22 nt, Homo sapiens
acaacauaaucuaguuuacaga

SEQ ID NO: 1942845 - RNA, 12 nt, Homo sapiens
uuagaacuugca

SEQ ID NO: 1942846 - RNA, 17 nt, Homo sapiens
caaccccugcagcuccu

SEQ ID NO: 1942847 - RNA, 13 nt, Homo sapiens
augaaucauuuaa

SEQ ID NO: 1942848 - RNA, 22 nt, Homo sapiens
uggaaaaagccaaggugucauu

SEQ ID NO: 1942849 - RNA, 15 nt, Homo sapiens
uucuuguagaugcau

SEQ ID NO: 1942850 - RNA, 16 nt, Homo sapiens
gggacugugaggccau

SEQ ID NO: 1942851 - RNA, 16 nt, Homo sapiens
gacuugaggauuuuga

SEQ ID NO: 1942852 - RNA, 23 nt, Homo sapiens
ucucaggcugucccaagcuccca

SEQ ID NO: 1942853 - RNA, 19 nt, Homo sapiens
uaguucuuacuacuugcca

SEQ ID NO: 1942854 - RNA, 21 nt, Homo sapiens
cuggggaugucucucaugacc

SEQ ID NO: 1942855 - RNA, 22 nt, Homo sapiens
uauuucuaucccaaacuaagcu

SEQ ID NO: 1942856 - RNA, 14 nt, Homo sapiens
uccacccugcccug

SEQ ID NO: 1942857 - RNA, 12 nt, Homo sapiens
agcucaccaucu

SEQ ID NO: 1942858 - RNA, 13 nt, Homo sapiens
cagaggacaguau

SEQ ID NO: 1942859 - RNA, 18 nt, Homo sapiens
uaaauuuuauaacagaau

SEQ ID NO: 1942860 - RNA, 16 nt, Homo sapiens
ucaaacauaauucucu

SEQ ID NO: 1942861 - RNA, 14 nt, Homo sapiens
uagcgggacaaagc

SEQ ID NO: 1942862 - RNA, 23 nt, Homo sapiens
uuaugaucaaggugaaauaaaca

SEQ ID NO: 1942863 - RNA, 18 nt, Homo sapiens
auagcaccuaaacuuaca

SEQ ID NO: 1942864 - RNA, 17 nt, Homo sapiens
agcaucuuuaacacaac

SEQ ID NO: 1942865 - RNA, 20 nt, Homo sapiens
uaggagccgacucuuugaua

SEQ ID NO: 1942866 - RNA, 22 nt, Homo sapiens
caggcuggaguguaguggcaca

SEQ ID NO: 1942867 - RNA, 22 nt, Homo sapiens
uccacaauaacaaucuauggca

SEQ ID NO: 1942868 - RNA, 20 nt, Homo sapiens
gaccccaaauuaagaaucua

SEQ ID NO: 1942869 - RNA, 16 nt, Homo sapiens
aaaucgugcugggaua

SEQ ID NO: 1942870 - RNA, 21 nt, Homo sapiens
gccucaugcugacuugcagag

SEQ ID NO: 1942871 - RNA, 22 nt, Homo sapiens
cuuuaggaggaggugggggcua

SEQ ID NO: 1942872 - RNA, 18 nt, Homo sapiens
aaaggcguauguauuaag

SEQ ID NO: 1942873 - RNA, 16 nt, Homo sapiens
uguuugauacaguauu

SEQ ID NO: 1942874 - RNA, 12 nt, Homo sapiens
caagaccuaguc

SEQ ID NO: 1942875 - RNA, 22 nt, Homo sapiens
ugaaauaccagugaaccaaaga

SEQ ID NO: 1942876 - RNA, 18 nt, Homo sapiens
caucagcuguucucauug

SEQ ID NO: 1942877 - RNA, 16 nt, Homo sapiens
ggcuggcaguagugcu

SEQ ID NO: 1942878 - RNA, 13 nt, Homo sapiens
ucaucaacacagu

SEQ ID NO: 1942879 - RNA, 16 nt, Homo sapiens
gaagaucgcauggcag

SEQ ID NO: 1942880 - RNA, 12 nt, Homo sapiens
acuggucagggc

SEQ ID NO: 1942881 - RNA, 20 nt, Homo sapiens
uauaauccacuuugcucuga

SEQ ID NO: 1942882 - RNA, 22 nt, Homo sapiens
ggcgaacccugggccauccuca

SEQ ID NO: 1942883 - RNA, 21 nt, Homo sapiens
aggcagucagaggacgagugc

SEQ ID NO: 1942884 - RNA, 19 nt, Homo sapiens
acuagccaaaccucaccaa

SEQ ID NO: 1942885 - RNA, 21 nt, Homo sapiens
gauaugcaacugcaguucauc

SEQ ID NO: 1942886 - RNA, 14 nt, Homo sapiens
gcuucagaugacag

SEQ ID NO: 1942887 - RNA, 16 nt, Homo sapiens
cgcaccauugaacugu

SEQ ID NO: 1942888 - RNA, 17 nt, Homo sapiens
agauugcaccacugcac

SEQ ID NO: 1942889 - RNA, 15 nt, Homo sapiens
agcagauuuuugcaa

SEQ ID NO: 1942890 - RNA, 14 nt, Homo sapiens
cuuuggccauucca

SEQ ID NO: 1942891 - RNA, 21 nt, Homo sapiens
agaccuagaccugggccaaaa

SEQ ID NO: 1942892 - RNA, 17 nt, Homo sapiens
gaaaaggugucuugcug

SEQ ID NO: 1942893 - RNA, 23 nt, Homo sapiens
acuaaguaaccucuacaggcauu

SEQ ID NO: 1942894 - RNA, 19 nt, Homo sapiens
ugaaauggguuuagggaag

SEQ ID NO: 1942895 - RNA, 17 nt, Homo sapiens
cuuucuuguugcugcau

SEQ ID NO: 1942896 - RNA, 14 nt, Homo sapiens
aaggaaacauaaga

SEQ ID NO: 1942897 - RNA, 16 nt, Homo sapiens
ucccccuaagucuuuc

SEQ ID NO: 1942898 - RNA, 17 nt, Homo sapiens
gagccacgcagugccug

SEQ ID NO: 1942899 - RNA, 13 nt, Homo sapiens
uuuuggccaaagu

SEQ ID NO: 1942900 - RNA, 19 nt, Homo sapiens
guauaccaccuguacauac

SEQ ID NO: 1942901 - RNA, 13 nt, Homo sapiens
ugauuaaaguaag

SEQ ID NO: 1942902 - RNA, 23 nt, Homo sapiens
caccucugauggcugaagaaugu

SEQ ID NO: 1942903 - RNA, 23 nt, Homo sapiens
caccaagcgugauuccugcugcc

SEQ ID NO: 1942904 - RNA, 13 nt, Homo sapiens
cugugaucuugcu

SEQ ID NO: 1942905 - RNA, 20 nt, Homo sapiens
auaaaauuugauaaacauuc

SEQ ID NO: 1942906 - RNA, 18 nt, Homo sapiens
ucccaccccaugaggcuc

SEQ ID NO: 1942907 - RNA, 18 nt, Homo sapiens
ucuuaauugccaccucua

SEQ ID NO: 1942908 - RNA, 20 nt, Homo sapiens
uuuccuuguccugccaggau

SEQ ID NO: 1942909 - RNA, 21 nt, Homo sapiens
acaccucccuccccacaccuc

SEQ ID NO: 1942910 - RNA, 20 nt, Homo sapiens
aaaagacauuuuuauuuagu

SEQ ID NO: 1942911 - RNA, 22 nt, Homo sapiens
gagaagguauuagcaaagcaaa

SEQ ID NO: 1942912 - RNA, 17 nt, Homo sapiens
gccugugaagcagucag

SEQ ID NO: 1942913 - RNA, 16 nt, Homo sapiens
ucuguccauuuaucca

SEQ ID NO: 1942914 - RNA, 17 nt, Homo sapiens
uuauuauuucuguucuu

SEQ ID NO: 1942915 - RNA, 20 nt, Homo sapiens
cucaacugggugacaagggu

SEQ ID NO: 1942916 - RNA, 17 nt, Homo sapiens
ggacgguuuugcuuuau

SEQ ID NO: 1942917 - RNA, 15 nt, Homo sapiens
cucugguggccacuu

SEQ ID NO: 1942918 - RNA, 18 nt, Homo sapiens
acuguuuagguacugaag

SEQ ID NO: 1942919 - RNA, 14 nt, Homo sapiens
aucaccagacuuug

SEQ ID NO: 1942920 - RNA, 13 nt, Homo sapiens
aacuauaaauccu

SEQ ID NO: 1942921 - RNA, 13 nt, Homo sapiens
uauuuuaauuuca

SEQ ID NO: 1942922 - RNA, 15 nt, Homo sapiens
gaauauuagugaccu

SEQ ID NO: 1942923 - RNA, 21 nt, Homo sapiens
cagaaccagaggguuguacua

SEQ ID NO: 1942924 - RNA, 15 nt, Homo sapiens
agucucugugaauug

SEQ ID NO: 1942925 - RNA, 22 nt, Homo sapiens
uacauaaaguauccaugcaugu

SEQ ID NO: 1942926 - RNA, 18 nt, Homo sapiens
caguauuuuccagccuua

SEQ ID NO: 1942927 - RNA, 15 nt, Homo sapiens
uuucuagaugacaua

SEQ ID NO: 1942928 - RNA, 21 nt, Homo sapiens
gguuccggcauggacaaugga

SEQ ID NO: 1942929 - RNA, 15 nt, Homo sapiens
aacucuccacuccau

SEQ ID NO: 1942930 - RNA, 20 nt, Homo sapiens
aaaugccacacggcucucac

SEQ ID NO: 1942931 - RNA, 17 nt, Homo sapiens
ucaaccgaugguccuca

SEQ ID NO: 1942932 - RNA, 21 nt, Homo sapiens
uugaaaucaaugcaagaguga

SEQ ID NO: 1942933 - RNA, 18 nt, Homo sapiens
uagaccucuuccuggaau

SEQ ID NO: 1942934 - RNA, 12 nt, Homo sapiens
aucugacuucau

SEQ ID NO: 1942935 - RNA, 18 nt, Homo sapiens
agcauuuaggaaugugac

SEQ ID NO: 1942936 - RNA, 16 nt, Homo sapiens
aacagacaacugguaa

SEQ ID NO: 1942937 - RNA, 22 nt, Homo sapiens
uaaaugucucuuuaaugucaca

SEQ ID NO: 1942938 - RNA, 17 nt, Homo sapiens
aaaaugcaucacaugau

SEQ ID NO: 1942939 - RNA, 18 nt, Homo sapiens
aucuagugcuagauguau

SEQ ID NO: 1942940 - RNA, 12 nt, Homo sapiens
ugccgcucagag

SEQ ID NO: 1942941 - RNA, 21 nt, Homo sapiens
acuauuggacagacacagagg

SEQ ID NO: 1942942 - RNA, 16 nt, Homo sapiens
agggagcuggaacccg

SEQ ID NO: 1942943 - RNA, 12 nt, Homo sapiens
cuucuccuggca

SEQ ID NO: 1942944 - RNA, 18 nt, Homo sapiens
aaacuagauugcuuugaa

SEQ ID NO: 1942945 - RNA, 18 nt, Homo sapiens
ucuugacaaucaucucca

SEQ ID NO: 1942946 - RNA, 15 nt, Homo sapiens
ucccugaagugccag

SEQ ID NO: 1942947 - RNA, 18 nt, Homo sapiens
guaaguuucugugaccug

SEQ ID NO: 1942948 - RNA, 15 nt, Homo sapiens
uauacuuacuucugg

SEQ ID NO: 1942949 - RNA, 22 nt, Homo sapiens
gagcuccucccuccagcugcga

SEQ ID NO: 1942950 - RNA, 23 nt, Homo sapiens
aaaccuggccuuauaucauuuca

SEQ ID NO: 1942951 - RNA, 14 nt, Homo sapiens
aguacugcuuuacu

SEQ ID NO: 1942952 - RNA, 20 nt, Homo sapiens
gcaaauuuuggaccuaaaca

SEQ ID NO: 1942953 - RNA, 16 nt, Homo sapiens
ugguccugcacugucc

SEQ ID NO: 1942954 - RNA, 17 nt, Homo sapiens
uaaacauuucauuuccc

SEQ ID NO: 1942955 - RNA, 16 nt, Homo sapiens
acuagggagccauuug

SEQ ID NO: 1942956 - RNA, 23 nt, Homo sapiens
cuggaaccaggcuugccugggac

SEQ ID NO: 1942957 - RNA, 17 nt, Homo sapiens
cuccucguaugcaugga

SEQ ID NO: 1942958 - RNA, 21 nt, Homo sapiens
aauguguucggugauuucaga

SEQ ID NO: 1942959 - RNA, 12 nt, Homo sapiens
caguaaacacug

SEQ ID NO: 1942960 - RNA, 20 nt, Homo sapiens
ugaauguuacuaaauuuucu

SEQ ID NO: 1942961 - RNA, 12 nt, Homo sapiens
aguauuacaaau

SEQ ID NO: 1942962 - RNA, 18 nt, Homo sapiens
gcaugauuaacaaagcaa

SEQ ID NO: 1942963 - RNA, 15 nt, Homo sapiens
acgcaguuacugaaa

SEQ ID NO: 1942964 - RNA, 18 nt, Homo sapiens
guauuccgauacaaagug

SEQ ID NO: 1942965 - RNA, 14 nt, Homo sapiens
acccacaugcucca

SEQ ID NO: 1942966 - RNA, 14 nt, Homo sapiens
cacaagacagcaga

SEQ ID NO: 1942967 - RNA, 17 nt, Homo sapiens
acugcaacccaugagcg

SEQ ID NO: 1942968 - RNA, 20 nt, Homo sapiens
agucucaaucuguuacccag

SEQ ID NO: 1942969 - RNA, 15 nt, Homo sapiens
auaaaagaugauuuc

SEQ ID NO: 1942970 - RNA, 14 nt, Homo sapiens
ugcgcucuguggau

SEQ ID NO: 1942971 - RNA, 22 nt, Homo sapiens
aguauguauuauuuacauuuaa

SEQ ID NO: 1942972 - RNA, 16 nt, Homo sapiens
cuaucugccaaauuga

SEQ ID NO: 1942973 - RNA, 17 nt, Homo sapiens
auacugcaugcucagga

SEQ ID NO: 1942974 - RNA, 19 nt, Homo sapiens
acacugaauaaaauauuga

SEQ ID NO: 1942975 - RNA, 12 nt, Homo sapiens
agacauggaaag

SEQ ID NO: 1942976 - RNA, 21 nt, Homo sapiens
cugaagaaaaugaagcccuau

SEQ ID NO: 1942977 - RNA, 17 nt, Homo sapiens
uacuccccaacugaguu

SEQ ID NO: 1942978 - RNA, 19 nt, Homo sapiens
ggcuggaguggaguggcgu

SEQ ID NO: 1942979 - RNA, 15 nt, Homo sapiens
cuguaacaauuaugu

SEQ ID NO: 1942980 - RNA, 22 nt, Homo sapiens
uauuuuguugccuucaucuuca

SEQ ID NO: 1942981 - RNA, 15 nt, Homo sapiens
auccacacugagaga

SEQ ID NO: 1942982 - RNA, 21 nt, Homo sapiens
cauuucuggggguuggcuuuu

SEQ ID NO: 1942983 - RNA, 15 nt, Homo sapiens
uucuuuccuuguuca

SEQ ID NO: 1942984 - RNA, 23 nt, Homo sapiens
guaagaaacauccauauugcaca

SEQ ID NO: 1942985 - RNA, 20 nt, Homo sapiens
ccaaagccaauaaaugaacu

SEQ ID NO: 1942986 - RNA, 18 nt, Homo sapiens
gcucucuggucuaccuga

SEQ ID NO: 1942987 - RNA, 17 nt, Homo sapiens
aggugucauagcuauga

SEQ ID NO: 1942988 - RNA, 20 nt, Homo sapiens
uggugccugaagaccccaga

SEQ ID NO: 1942989 - RNA, 15 nt, Homo sapiens
cuuucuugcuucaaa

SEQ ID NO: 1942990 - RNA, 14 nt, Homo sapiens
gaaugaaaauuaga

SEQ ID NO: 1942991 - RNA, 18 nt, Homo sapiens
agcaagcucuucacugaa

SEQ ID NO: 1942992 - RNA, 15 nt, Homo sapiens
ucauccaaagaacau

SEQ ID NO: 1942993 - RNA, 19 nt, Homo sapiens
uccuccagucuguucucac

SEQ ID NO: 1942994 - RNA, 15 nt, Homo sapiens
acugagcaaugguaa

SEQ ID NO: 1942995 - RNA, 21 nt, Homo sapiens
ggaagucucucccgauaucac

SEQ ID NO: 1942996 - RNA, 13 nt, Homo sapiens
cuugggcucugcu

SEQ ID NO: 1942997 - RNA, 19 nt, Homo sapiens
auggcuucuggucaugaaa

SEQ ID NO: 1942998 - RNA, 15 nt, Homo sapiens
agcuggaugaugguc

SEQ ID NO: 1942999 - RNA, 18 nt, Homo sapiens
acucucccuggagcugcu

SEQ ID NO: 1943000 - RNA, 16 nt, Homo sapiens
accuggagaugcugcc

SEQ ID NO: 1943001 - RNA, 12 nt, Homo sapiens
agcaaaugagau

SEQ ID NO: 1943002 - RNA, 14 nt, Homo sapiens
uucugccgcuguca

SEQ ID NO: 1943003 - RNA, 23 nt, Homo sapiens
cuuuaucuauuaccaaaagucaa

SEQ ID NO: 1943004 - RNA, 23 nt, Homo sapiens
agugguggugaacagaacaaaag

SEQ ID NO: 1943005 - RNA, 16 nt, Homo sapiens
cucugguggagacaaa

SEQ ID NO: 1943006 - RNA, 20 nt, Homo sapiens
aggaggaguuagccaaacaa

SEQ ID NO: 1943007 - RNA, 21 nt, Homo sapiens
caugagcuccuuaaggcucuu

SEQ ID NO: 1943008 - RNA, 17 nt, Homo sapiens
gucccaguuaagugaag

SEQ ID NO: 1943009 - RNA, 22 nt, Homo sapiens
gcucugaagagauacccacaga

SEQ ID NO: 1943010 - RNA, 16 nt, Homo sapiens
ccuugcuccagccuga

SEQ ID NO: 1943011 - RNA, 21 nt, Homo sapiens
agacacuugaguuaacuuuuu

SEQ ID NO: 1943012 - RNA, 19 nt, Homo sapiens
cauuuaauuuuuauuaaac

SEQ ID NO: 1943013 - RNA, 13 nt, Homo sapiens
ccuauauguagcu

SEQ ID NO: 1943014 - RNA, 22 nt, Homo sapiens
gcuuccuuagguugaugcugga

SEQ ID NO: 1943015 - RNA, 19 nt, Homo sapiens
cauauugauacaaacugug

SEQ ID NO: 1943016 - RNA, 12 nt, Homo sapiens
auugaagacauu

SEQ ID NO: 1943017 - RNA, 15 nt, Homo sapiens
uaacugauuugcaau

SEQ ID NO: 1943018 - RNA, 22 nt, Homo sapiens
guuccucuagguaaacuagcaa

SEQ ID NO: 1943019 - RNA, 14 nt, Homo sapiens
ggcgugggucucug

SEQ ID NO: 1943020 - RNA, 12 nt, Homo sapiens
cagcacaguacu

SEQ ID NO: 1943021 - RNA, 16 nt, Homo sapiens
acugccaaccucgcuc

SEQ ID NO: 1943022 - RNA, 15 nt, Homo sapiens
ccuauuuguuuucau

SEQ ID NO: 1943023 - RNA, 14 nt, Homo sapiens
agcacaacucaguc

SEQ ID NO: 1943024 - RNA, 15 nt, Homo sapiens
aaugacugcauuuga

SEQ ID NO: 1943025 - RNA, 21 nt, Homo sapiens
agaugguggugagcacaucug

SEQ ID NO: 1943026 - RNA, 15 nt, Homo sapiens
acaccuuuuccccaa

SEQ ID NO: 1943027 - RNA, 20 nt, Homo sapiens
cgcugcgucugcacugauga

SEQ ID NO: 1943028 - RNA, 13 nt, Homo sapiens
gccacggcagccu

SEQ ID NO: 1943029 - RNA, 15 nt, Homo sapiens
ugcagugccacuaaa

SEQ ID NO: 1943030 - RNA, 17 nt, Homo sapiens
aaacagcaauagugaau

SEQ ID NO: 1943031 - RNA, 21 nt, Homo sapiens
ugggagguggagguugcagug

SEQ ID NO: 1943032 - RNA, 13 nt, Homo sapiens
aaggaagguucug

SEQ ID NO: 1943033 - RNA, 14 nt, Homo sapiens
aagaaaaugagaca

SEQ ID NO: 1943034 - RNA, 18 nt, Homo sapiens
aggaaaaugggaauuuau

SEQ ID NO: 1943035 - RNA, 20 nt, Homo sapiens
gcucucauuuuccugggugc

SEQ ID NO: 1943036 - RNA, 17 nt, Homo sapiens
ccaugguaaucagaaau

SEQ ID NO: 1943037 - RNA, 21 nt, Homo sapiens
acucaucugucaccaagccuu

SEQ ID NO: 1943038 - RNA, 15 nt, Homo sapiens
uaauaaacacagauu

SEQ ID NO: 1943039 - RNA, 16 nt, Homo sapiens
uaauagucauuccaaa

SEQ ID NO: 1943040 - RNA, 15 nt, Homo sapiens
cucguguuugcuuaa

SEQ ID NO: 1943041 - RNA, 15 nt, Homo sapiens
cuuggcuggagucac

SEQ ID NO: 1943042 - RNA, 23 nt, Homo sapiens
cauauauuuauugaguaccuacu

SEQ ID NO: 1943043 - RNA, 18 nt, Homo sapiens
auauccccucccagucac

SEQ ID NO: 1943044 - RNA, 14 nt, Homo sapiens
gccaagacugcugu

SEQ ID NO: 1943045 - RNA, 12 nt, Homo sapiens
ggaacaaucuaa

SEQ ID NO: 1943046 - RNA, 16 nt, Homo sapiens
cugucauuuguuguga

SEQ ID NO: 1943047 - RNA, 17 nt, Homo sapiens
gcgugaccuugcaaugu

SEQ ID NO: 1943048 - RNA, 17 nt, Homo sapiens
caguucuacacugauac

SEQ ID NO: 1943049 - RNA, 16 nt, Homo sapiens
ccucgggcccggccug

SEQ ID NO: 1943050 - RNA, 22 nt, Homo sapiens
cugacagggacaugcccugugu

SEQ ID NO: 1943051 - RNA, 16 nt, Homo sapiens
cuuccuccuuccucuu

SEQ ID NO: 1943052 - RNA, 18 nt, Homo sapiens
ccugcccuugaacccccu

SEQ ID NO: 1943053 - RNA, 15 nt, Homo sapiens
uuaaccugaugcagu

SEQ ID NO: 1943054 - RNA, 12 nt, Homo sapiens
cucuugucuccc

SEQ ID NO: 1943055 - RNA, 15 nt, Homo sapiens
ugcccaccacagcga

SEQ ID NO: 1943056 - RNA, 21 nt, Homo sapiens
gcauuuucauuucacugcaca

SEQ ID NO: 1943057 - RNA, 14 nt, Homo sapiens
cuuguauuuccaaa

SEQ ID NO: 1943058 - RNA, 22 nt, Homo sapiens
caaagugcugggauuacaggcg

SEQ ID NO: 1943059 - RNA, 19 nt, Homo sapiens
gcaagcaugccucuucccu

SEQ ID NO: 1943060 - RNA, 21 nt, Homo sapiens
ugcccuguucaugugccucug

SEQ ID NO: 1943061 - RNA, 21 nt, Homo sapiens
ucugcagcgagccccccaugu

SEQ ID NO: 1943062 - RNA, 17 nt, Homo sapiens
uugguacuuguuucacc

SEQ ID NO: 1943063 - RNA, 21 nt, Homo sapiens
gacauggaggugccggaugca

SEQ ID NO: 1943064 - RNA, 19 nt, Homo sapiens
cauauuuuucacauaucua

SEQ ID NO: 1943065 - RNA, 15 nt, Homo sapiens
accucacagaguaug

SEQ ID NO: 1943066 - RNA, 13 nt, Homo sapiens
accugaaagaagc

SEQ ID NO: 1943067 - RNA, 21 nt, Homo sapiens
ugugaagugaaugaaacacuc

SEQ ID NO: 1943068 - RNA, 15 nt, Homo sapiens
ugcaugaagauucga

SEQ ID NO: 1943069 - RNA, 18 nt, Homo sapiens
augucucuguuauuguua

SEQ ID NO: 1943070 - RNA, 16 nt, Homo sapiens
uauucauuuuguggca

SEQ ID NO: 1943071 - RNA, 22 nt, Homo sapiens
gcuucacugguugaguguugcu

SEQ ID NO: 1943072 - RNA, 19 nt, Homo sapiens
ugaucucgaugcaggugga

SEQ ID NO: 1943073 - RNA, 11 nt, Homo sapiens
ugaaauucugc

SEQ ID NO: 1943074 - RNA, 22 nt, Homo sapiens
ucugaguucuuguguccuggua

SEQ ID NO: 1943075 - RNA, 20 nt, Homo sapiens
aacacacacacacacaaaac

SEQ ID NO: 1943076 - RNA, 15 nt, Homo sapiens
ccuagacaaaccauc

SEQ ID NO: 1943077 - RNA, 12 nt, Homo sapiens
cugucacccaca

SEQ ID NO: 1943078 - RNA, 17 nt, Homo sapiens
agacauaaacaaagaca

SEQ ID NO: 1943079 - RNA, 14 nt, Homo sapiens
gcuucaagagccag

SEQ ID NO: 1943080 - RNA, 22 nt, Homo sapiens
uuacaggugcccgccaccacgc

SEQ ID NO: 1943081 - RNA, 18 nt, Homo sapiens
gaaaaauggccauguugu

SEQ ID NO: 1943082 - RNA, 15 nt, Homo sapiens
aagaugcaguucaaa

SEQ ID NO: 1943083 - RNA, 19 nt, Homo sapiens
gaccucacacacacaaaaa

SEQ ID NO: 1943084 - RNA, 13 nt, Homo sapiens
ccuuuucuguucu

SEQ ID NO: 1943085 - RNA, 10 nt, Homo sapiens
guguggcaaa

SEQ ID NO: 1943086 - RNA, 20 nt, Homo sapiens
ucaaugugcaaguuguacug

SEQ ID NO: 1943087 - RNA, 17 nt, Homo sapiens
ggcagagucuaccuuga

SEQ ID NO: 1943088 - RNA, 11 nt, Homo sapiens
augagccacag

SEQ ID NO: 1943089 - RNA, 16 nt, Homo sapiens
ugacaauuugugauau

SEQ ID NO: 1943090 - RNA, 18 nt, Homo sapiens
guggaacccccaucucua

SEQ ID NO: 1943091 - RNA, 23 nt, Homo sapiens
uauauaaauguacaguauucaau

SEQ ID NO: 1943092 - RNA, 14 nt, Homo sapiens
gccaccaacauaaa

SEQ ID NO: 1943093 - RNA, 13 nt, Homo sapiens
cucagcaacccag

SEQ ID NO: 1943094 - RNA, 14 nt, Homo sapiens
caacgcaaaccucu

SEQ ID NO: 1943095 - RNA, 14 nt, Homo sapiens
gccugcgaaaccca

SEQ ID NO: 1943096 - RNA, 19 nt, Homo sapiens
ccagaauugcugacagcag

SEQ ID NO: 1943097 - RNA, 18 nt, Homo sapiens
gcacgguacaaacccaaa

SEQ ID NO: 1943098 - RNA, 20 nt, Homo sapiens
aaucccagcauuagcuuccu

SEQ ID NO: 1943099 - RNA, 15 nt, Homo sapiens
gaucucaaacuugau

SEQ ID NO: 1943100 - RNA, 18 nt, Homo sapiens
caaaucuuaacuugaagg

SEQ ID NO: 1943101 - RNA, 18 nt, Homo sapiens
auaaauuccuacaacuua

SEQ ID NO: 1943102 - RNA, 18 nt, Homo sapiens
cuaaaacuuaacauucau

SEQ ID NO: 1943103 - RNA, 17 nt, Homo sapiens
cacugaucuaagcagug

SEQ ID NO: 1943104 - RNA, 18 nt, Homo sapiens
aggaguucaagaccagcc

SEQ ID NO: 1943105 - RNA, 12 nt, Homo sapiens
uucuugcugcua

SEQ ID NO: 1943106 - RNA, 20 nt, Homo sapiens
uuacaaucuguuuuagacau

SEQ ID NO: 1943107 - RNA, 22 nt, Homo sapiens
ugcucuacagauaaugucuaua

SEQ ID NO: 1943108 - RNA, 12 nt, Homo sapiens
uguaucaugaca

SEQ ID NO: 1943109 - RNA, 14 nt, Homo sapiens
uaugugauuuucaa

SEQ ID NO: 1943110 - RNA, 18 nt, Homo sapiens
agcacuguuuucuagugu

SEQ ID NO: 1943111 - RNA, 19 nt, Homo sapiens
uuggauacauacaccagca

SEQ ID NO: 1943112 - RNA, 18 nt, Homo sapiens
ccagccuggccaacaugg

SEQ ID NO: 1943113 - RNA, 21 nt, Homo sapiens
ugagugcgaccaccacuugau

SEQ ID NO: 1943114 - RNA, 15 nt, Homo sapiens
ccugugccuuuugcc

SEQ ID NO: 1943115 - RNA, 18 nt, Homo sapiens
ccugcuucccccacuuca

SEQ ID NO: 1943116 - RNA, 18 nt, Homo sapiens
cagucuccuccccuacuc

SEQ ID NO: 1943117 - RNA, 14 nt, Homo sapiens
uugccugccauuuu

SEQ ID NO: 1943118 - RNA, 20 nt, Homo sapiens
caucucaucuuaaugucuuu

SEQ ID NO: 1943119 - RNA, 16 nt, Homo sapiens
uuaugacuucauuaau

SEQ ID NO: 1943120 - RNA, 16 nt, Homo sapiens
ggcuggagcccaggga

SEQ ID NO: 1943121 - RNA, 12 nt, Homo sapiens
cuaccugugagc

SEQ ID NO: 1943122 - RNA, 20 nt, Homo sapiens
augugaaacggaagcucaua

SEQ ID NO: 1943123 - RNA, 17 nt, Homo sapiens
auggauaagcuugucua

SEQ ID NO: 1943124 - RNA, 17 nt, Homo sapiens
uacaaaacaaucucuca

SEQ ID NO: 1943125 - RNA, 21 nt, Homo sapiens
gcaucugacaugcaucaucuc

SEQ ID NO: 1943126 - RNA, 19 nt, Homo sapiens
cuggucauacgggucagua

SEQ ID NO: 1943127 - RNA, 22 nt, Homo sapiens
augcuggccuguggcaggccua

SEQ ID NO: 1943128 - RNA, 15 nt, Homo sapiens
cccacgucucucugc

SEQ ID NO: 1943129 - RNA, 14 nt, Homo sapiens
aaauugaacugcca

SEQ ID NO: 1943130 - RNA, 18 nt, Homo sapiens
gguuccggugucuggaaa

SEQ ID NO: 1943131 - RNA, 18 nt, Homo sapiens
gccaucaucauggcauca

SEQ ID NO: 1943132 - RNA, 22 nt, Homo sapiens
gccccugccgccugugcccuug

SEQ ID NO: 1943133 - RNA, 16 nt, Homo sapiens
ucagccccacaggacu

SEQ ID NO: 1943134 - RNA, 14 nt, Homo sapiens
uuuaacagcugaau

SEQ ID NO: 1943135 - RNA, 14 nt, Homo sapiens
ucuccaaacaguca

SEQ ID NO: 1943136 - RNA, 19 nt, Homo sapiens
guugaugggggccaggaca

SEQ ID NO: 1943137 - RNA, 19 nt, Homo sapiens
acccuuuccggcacacugc

SEQ ID NO: 1943138 - RNA, 14 nt, Homo sapiens
auagaaaugccaag

SEQ ID NO: 1943139 - RNA, 18 nt, Homo sapiens
auaucaguccucuuucaa

SEQ ID NO: 1943140 - RNA, 16 nt, Homo sapiens
acuggacagaucugag

SEQ ID NO: 1943141 - RNA, 14 nt, Homo sapiens
gcaaugaaacagau

SEQ ID NO: 1943142 - RNA, 18 nt, Homo sapiens
uccccuccccucacuucu

SEQ ID NO: 1943143 - RNA, 20 nt, Homo sapiens
accucgugauccaccugccu

SEQ ID NO: 1943144 - RNA, 19 nt, Homo sapiens
ggagccacagcagccacuu

SEQ ID NO: 1943145 - RNA, 16 nt, Homo sapiens
uagaaacacaacuaua

SEQ ID NO: 1943146 - RNA, 13 nt, Homo sapiens
ugaagacaggaug

SEQ ID NO: 1943147 - RNA, 17 nt, Homo sapiens
acacugaaaccaaaaca

SEQ ID NO: 1943148 - RNA, 16 nt, Homo sapiens
ugcguuagaaugagga

SEQ ID NO: 1943149 - RNA, 13 nt, Homo sapiens
ucaauguacauag

SEQ ID NO: 1943150 - RNA, 12 nt, Homo sapiens
uggagucuugca

SEQ ID NO: 1943151 - RNA, 22 nt, Homo sapiens
agaguguuggaagucauuugau

SEQ ID NO: 1943152 - RNA, 12 nt, Homo sapiens
uacuguuuccau

SEQ ID NO: 1943153 - RNA, 19 nt, Homo sapiens
uggauauuuguacuguuua

SEQ ID NO: 1943154 - RNA, 23 nt, Homo sapiens
uacagacugcagacauucucaaa

SEQ ID NO: 1943155 - RNA, 21 nt, Homo sapiens
gaacauuccucugcagcacuu

SEQ ID NO: 1943156 - RNA, 17 nt, Homo sapiens
ugauuucaguucacugu

SEQ ID NO: 1943157 - RNA, 21 nt, Homo sapiens
acaauagaacuggucuuccau

SEQ ID NO: 1943158 - RNA, 23 nt, Homo sapiens
ccgcccgcauagcacuugcagac

SEQ ID NO: 1943159 - RNA, 17 nt, Homo sapiens
auagccauguacuauaa

SEQ ID NO: 1943160 - RNA, 19 nt, Homo sapiens
ggaaaccaagucaggccag

SEQ ID NO: 1943161 - RNA, 23 nt, Homo sapiens
augggacagggaggacgcucucu

SEQ ID NO: 1943162 - RNA, 18 nt, Homo sapiens
cacaggcaaaacucagua

SEQ ID NO: 1943163 - RNA, 23 nt, Homo sapiens
ugcguuacacccuuucuugacaa

SEQ ID NO: 1943164 - RNA, 19 nt, Homo sapiens
uagaaaucaggccuugcuu

SEQ ID NO: 1943165 - RNA, 16 nt, Homo sapiens
uccuuucuccagccag

SEQ ID NO: 1943166 - RNA, 21 nt, Homo sapiens
ugcauucaaccuuaccaaaaa

SEQ ID NO: 1943167 - RNA, 18 nt, Homo sapiens
aacauaagauauuguaca

SEQ ID NO: 1943168 - RNA, 17 nt, Homo sapiens
aguguauuaucacuguc

SEQ ID NO: 1943169 - RNA, 17 nt, Homo sapiens
uguuacuaaagcuauau

SEQ ID NO: 1943170 - RNA, 14 nt, Homo sapiens
cugccaucauugau

SEQ ID NO: 1943171 - RNA, 16 nt, Homo sapiens
cauaauuaaaaagagc

SEQ ID NO: 1943172 - RNA, 15 nt, Homo sapiens
gaaauauucuaugac

SEQ ID NO: 1943173 - RNA, 18 nt, Homo sapiens
caaugaaaccaaagccag

SEQ ID NO: 1943174 - RNA, 19 nt, Homo sapiens
ucacaaccugaaccuagga

SEQ ID NO: 1943175 - RNA, 16 nt, Homo sapiens
ggccuugggagcucau

SEQ ID NO: 1943176 - RNA, 13 nt, Homo sapiens
gaacugucuguga

SEQ ID NO: 1943177 - RNA, 18 nt, Homo sapiens
cugaggauaccccaaagu

SEQ ID NO: 1943178 - RNA, 22 nt, Homo sapiens
aauaaauucccuggccuuucau

SEQ ID NO: 1943179 - RNA, 15 nt, Homo sapiens
cccgggacucacugg

SEQ ID NO: 1943180 - RNA, 17 nt, Homo sapiens
gcaucucccaguucaua

SEQ ID NO: 1943181 - RNA, 23 nt, Homo sapiens
ucccauuaaagagccaguuuauu

SEQ ID NO: 1943182 - RNA, 15 nt, Homo sapiens
uaucuccgugugcuc

SEQ ID NO: 1943183 - RNA, 20 nt, Homo sapiens
augcugaaauccgggucaag

SEQ ID NO: 1943184 - RNA, 23 nt, Homo sapiens
auacacccccaccuccugcaaua

SEQ ID NO: 1943185 - RNA, 18 nt, Homo sapiens
acucuggcacuuccauug

SEQ ID NO: 1943186 - RNA, 18 nt, Homo sapiens
auggcaguccagccagcu

SEQ ID NO: 1943187 - RNA, 15 nt, Homo sapiens
uuccagaaaucugcu

SEQ ID NO: 1943188 - RNA, 15 nt, Homo sapiens
cuugcccacuggccg

SEQ ID NO: 1943189 - RNA, 14 nt, Homo sapiens
uggucucuaucucc

SEQ ID NO: 1943190 - RNA, 15 nt, Homo sapiens
uuaacaguguucuca

SEQ ID NO: 1943191 - RNA, 22 nt, Homo sapiens
cuucccccuuuacucauagcac

SEQ ID NO: 1943192 - RNA, 17 nt, Homo sapiens
uaagaauggucucagug

SEQ ID NO: 1943193 - RNA, 14 nt, Homo sapiens
gaaaugucaugugg

SEQ ID NO: 1943194 - RNA, 17 nt, Homo sapiens
uaaggacguguguaaau

SEQ ID NO: 1943195 - RNA, 14 nt, Homo sapiens
gcaugucacuccca

SEQ ID NO: 1943196 - RNA, 15 nt, Homo sapiens
cugguacucaagcca

SEQ ID NO: 1943197 - RNA, 21 nt, Homo sapiens
gugaacugucuuggcugugag

SEQ ID NO: 1943198 - RNA, 19 nt, Homo sapiens
aagagaaaauuccuagaaa

SEQ ID NO: 1943199 - RNA, 18 nt, Homo sapiens
ucggaguucagacucuca

SEQ ID NO: 1943200 - RNA, 21 nt, Homo sapiens
gcucagcccugacuggugcua

SEQ ID NO: 1943201 - RNA, 18 nt, Homo sapiens
ccgggucacacaaaggca

SEQ ID NO: 1943202 - RNA, 17 nt, Homo sapiens
guggcuggugcccauga

SEQ ID NO: 1943203 - RNA, 22 nt, Homo sapiens
agcaucaaaauauuucagugaa

SEQ ID NO: 1943204 - RNA, 17 nt, Homo sapiens
augauaauuauuuacaa

SEQ ID NO: 1943205 - RNA, 22 nt, Homo sapiens
acacacuuucucuucaaugaaa

SEQ ID NO: 1943206 - RNA, 16 nt, Homo sapiens
aauguuuuucaaugug

SEQ ID NO: 1943207 - RNA, 18 nt, Homo sapiens
aacgcuaacaauuucuca

SEQ ID NO: 1943208 - RNA, 22 nt, Homo sapiens
uaauuauuguuauacacagcuu

SEQ ID NO: 1943209 - RNA, 14 nt, Homo sapiens
agcucuacuggaau

SEQ ID NO: 1943210 - RNA, 22 nt, Homo sapiens
acaauuuggagcauaacuggag

SEQ ID NO: 1943211 - RNA, 12 nt, Homo sapiens
gggaaugccuga

SEQ ID NO: 1943212 - RNA, 19 nt, Homo sapiens
aguuaggucuuuaaggaaa

SEQ ID NO: 1943213 - RNA, 16 nt, Homo sapiens
uacuuaauguaauuca

SEQ ID NO: 1943214 - RNA, 12 nt, Homo sapiens
ccugcacaccag

SEQ ID NO: 1943215 - RNA, 11 nt, Homo sapiens
gcaacccaaac

SEQ ID NO: 1943216 - RNA, 11 nt, Homo sapiens
accacccagaa

SEQ ID NO: 1943217 - RNA, 22 nt, Homo sapiens
cuggagugguaacagcucucuu

SEQ ID NO: 1943218 - RNA, 23 nt, Homo sapiens
acacugguggaggagcugggcuu

SEQ ID NO: 1943219 - RNA, 16 nt, Homo sapiens
uuuagcagaggagcca

SEQ ID NO: 1943220 - RNA, 22 nt, Homo sapiens
cuaucuucauaucuaucagagu

SEQ ID NO: 1943221 - RNA, 20 nt, Homo sapiens
cccagacaauuccauucaau

SEQ ID NO: 1943222 - RNA, 22 nt, Homo sapiens
gaacaaaguaacagccuuucaa

SEQ ID NO: 1943223 - RNA, 19 nt, Homo sapiens
ccugcuccccuacuucuca

SEQ ID NO: 1943224 - RNA, 16 nt, Homo sapiens
uuuagcuauuacugga

SEQ ID NO: 1943225 - RNA, 23 nt, Homo sapiens
ucuucaauuaauggaaaacuguu

SEQ ID NO: 1943226 - RNA, 16 nt, Homo sapiens
ccaugugcugugcacc

SEQ ID NO: 1943227 - RNA, 17 nt, Homo sapiens
gcucuuggggacauggg

SEQ ID NO: 1943228 - RNA, 17 nt, Homo sapiens
cuuuaugcccuugccuc

SEQ ID NO: 1943229 - RNA, 16 nt, Homo sapiens
cacaaaaacagcaaaa

SEQ ID NO: 1943230 - RNA, 19 nt, Homo sapiens
gcauggugcgggcaccugu

SEQ ID NO: 1943231 - RNA, 12 nt, Homo sapiens
aaauucaauauu

SEQ ID NO: 1943232 - RNA, 15 nt, Homo sapiens
acugaagacagaggu

SEQ ID NO: 1943233 - RNA, 19 nt, Homo sapiens
gggacaauacagaacccau

SEQ ID NO: 1943234 - RNA, 16 nt, Homo sapiens
uggcacugacaauggg

SEQ ID NO: 1943235 - RNA, 15 nt, Homo sapiens
cacagcacuagaguc

SEQ ID NO: 1943236 - RNA, 22 nt, Homo sapiens
gggcucacucagccacccugag

SEQ ID NO: 1943237 - RNA, 18 nt, Homo sapiens
cugggcagaaaugugcug

SEQ ID NO: 1943238 - RNA, 21 nt, Homo sapiens
acuacaguaagcugguuuaca

SEQ ID NO: 1943239 - RNA, 22 nt, Homo sapiens
auaaguguguguuuuucauaaa

SEQ ID NO: 1943240 - RNA, 19 nt, Homo sapiens
ccaggcacaggaugcugug

SEQ ID NO: 1943241 - RNA, 16 nt, Homo sapiens
cuuucaucggugccug

SEQ ID NO: 1943242 - RNA, 16 nt, Homo sapiens
gccucuagaacagcca

SEQ ID NO: 1943243 - RNA, 18 nt, Homo sapiens
aaacccaaaacaguaaaa

SEQ ID NO: 1943244 - RNA, 19 nt, Homo sapiens
caaaucauuuggacaaucu

SEQ ID NO: 1943245 - RNA, 15 nt, Homo sapiens
ccuuaugccauucca

SEQ ID NO: 1943246 - RNA, 16 nt, Homo sapiens
gauugaacaagagcuu

SEQ ID NO: 1943247 - RNA, 15 nt, Homo sapiens
cccugcacuaggcag

SEQ ID NO: 1943248 - RNA, 24 nt, Homo sapiens
uaggccauguuuaugacuguugca

SEQ ID NO: 1943249 - RNA, 21 nt, Homo sapiens
aaaggaaaugcuccuccaggg

SEQ ID NO: 1943250 - RNA, 20 nt, Homo sapiens
agacacaccccaacaugccu

SEQ ID NO: 1943251 - RNA, 21 nt, Homo sapiens
guuuuuuguuuaaguacuuca

SEQ ID NO: 1943252 - RNA, 23 nt, Homo sapiens
uauuggcccuaaauagcagaaag

SEQ ID NO: 1943253 - RNA, 23 nt, Homo sapiens
agacuuucuguaaucacauuuua

SEQ ID NO: 1943254 - RNA, 22 nt, Homo sapiens
cuaaugcugcccucacugccuc

SEQ ID NO: 1943255 - RNA, 12 nt, Homo sapiens
uguuuccugaca

SEQ ID NO: 1943256 - RNA, 17 nt, Homo sapiens
ggcgaaaccccaucucu

SEQ ID NO: 1943257 - RNA, 17 nt, Homo sapiens
uccuugaaaguaggaua

SEQ ID NO: 1943258 - RNA, 14 nt, Homo sapiens
aggcagcagugggu

SEQ ID NO: 1943259 - RNA, 23 nt, Homo sapiens
uguguugggaauugcaugccauc

SEQ ID NO: 1943260 - RNA, 17 nt, Homo sapiens
aaugucugguccuggcu

SEQ ID NO: 1943261 - RNA, 12 nt, Homo sapiens
uacuccugugcu

SEQ ID NO: 1943262 - RNA, 21 nt, Homo sapiens
ugcagacaaccucaucagcug

SEQ ID NO: 1943263 - RNA, 16 nt, Homo sapiens
uggugggcgccuguaa

SEQ ID NO: 1943264 - RNA, 16 nt, Homo sapiens
ugaccacagacacucc

SEQ ID NO: 1943265 - RNA, 23 nt, Homo sapiens
caaagauguuaugguguuuagau

SEQ ID NO: 1943266 - RNA, 14 nt, Homo sapiens
guacuuacaucagg

SEQ ID NO: 1943267 - RNA, 14 nt, Homo sapiens
aagccccaagccau

SEQ ID NO: 1943268 - RNA, 23 nt, Homo sapiens
ccuccaggugugcacguggcaug

SEQ ID NO: 1943269 - RNA, 18 nt, Homo sapiens
gaaggcuaaaaagcaaca

SEQ ID NO: 1943270 - RNA, 22 nt, Homo sapiens
uccacccuguuuaaagauuuca

SEQ ID NO: 1943271 - RNA, 14 nt, Homo sapiens
ucccccguccugga

SEQ ID NO: 1943272 - RNA, 23 nt, Homo sapiens
augaaaaaagucuccauaggaca

SEQ ID NO: 1943273 - RNA, 19 nt, Homo sapiens
gaaaacuacauuuuaacau

SEQ ID NO: 1943274 - RNA, 17 nt, Homo sapiens
cauuuguagcaauuuaa

SEQ ID NO: 1943275 - RNA, 19 nt, Homo sapiens
cauguagccucaaccuccc

SEQ ID NO: 1943276 - RNA, 14 nt, Homo sapiens
aaaccuuuguuugc

SEQ ID NO: 1943277 - RNA, 14 nt, Homo sapiens
uuuuaacacacaua

SEQ ID NO: 1943278 - RNA, 22 nt, Homo sapiens
gccugcuuucacacuaaggaaa

SEQ ID NO: 1943279 - RNA, 22 nt, Homo sapiens
uucuaacagugaaguuuuacug

SEQ ID NO: 1943280 - RNA, 22 nt, Homo sapiens
caauauaaaccguggucucaug

SEQ ID NO: 1943281 - RNA, 18 nt, Homo sapiens
uauaacuauguugauaaa

SEQ ID NO: 1943282 - RNA, 18 nt, Homo sapiens
cagcauccuccacgggcu

SEQ ID NO: 1943283 - RNA, 23 nt, Homo sapiens
uaagaaacauucuuuuccacuug

SEQ ID NO: 1943284 - RNA, 17 nt, Homo sapiens
uaaaccguacacugugu

SEQ ID NO: 1943285 - RNA, 23 nt, Homo sapiens
ccuaagaaggcaccucucugggu

SEQ ID NO: 1943286 - RNA, 15 nt, Homo sapiens
uugacuuuccagaau

SEQ ID NO: 1943287 - RNA, 21 nt, Homo sapiens
cauaucaagaaauugauugaa

SEQ ID NO: 1943288 - RNA, 13 nt, Homo sapiens
ggugaaguaaauu

SEQ ID NO: 1943289 - RNA, 17 nt, Homo sapiens
aacccccgcuccagauc

SEQ ID NO: 1943290 - RNA, 18 nt, Homo sapiens
agcuggggugggagcucc

SEQ ID NO: 1943291 - RNA, 18 nt, Homo sapiens
ugaacccgaggcugagaa

SEQ ID NO: 1943292 - RNA, 18 nt, Homo sapiens
ugcccccauucucccagu

SEQ ID NO: 1943293 - RNA, 19 nt, Homo sapiens
gacacuuuggaaguuugug

SEQ ID NO: 1943294 - RNA, 22 nt, Homo sapiens
gacuguguuuuuccuaugcagu

SEQ ID NO: 1943295 - RNA, 21 nt, Homo sapiens
ugaccaaaauccccuucucau

SEQ ID NO: 1943296 - RNA, 17 nt, Homo sapiens
acaaagagaguuaauca

SEQ ID NO: 1943297 - RNA, 19 nt, Homo sapiens
agaaggugugcuauucaca

SEQ ID NO: 1943298 - RNA, 14 nt, Homo sapiens
gucuuccacuuugc

SEQ ID NO: 1943299 - RNA, 15 nt, Homo sapiens
gacgcugacugcccu

SEQ ID NO: 1943300 - RNA, 22 nt, Homo sapiens
cacacagauggucacacagaga

SEQ ID NO: 1943301 - RNA, 17 nt, Homo sapiens
aucccaugaacacacug

SEQ ID NO: 1943302 - RNA, 13 nt, Homo sapiens
gauuccgcaguga

SEQ ID NO: 1943303 - RNA, 15 nt, Homo sapiens
caaacaauaaaggga

SEQ ID NO: 1943304 - RNA, 15 nt, Homo sapiens
gcuucgacuacugcu

SEQ ID NO: 1943305 - RNA, 18 nt, Homo sapiens
uaaugacaaugaagugac

SEQ ID NO: 1943306 - RNA, 22 nt, Homo sapiens
acuuccccaagaucugccagac

SEQ ID NO: 1943307 - RNA, 21 nt, Homo sapiens
ugccagucuguuaaguaaaau

SEQ ID NO: 1943308 - RNA, 15 nt, Homo sapiens
cuucccuuuccucca

SEQ ID NO: 1943309 - RNA, 14 nt, Homo sapiens
gucccccuccucag

SEQ ID NO: 1943310 - RNA, 15 nt, Homo sapiens
auuuuuauacauauc

SEQ ID NO: 1943311 - RNA, 20 nt, Homo sapiens
cugacacgugauggaccaaa

SEQ ID NO: 1943312 - RNA, 21 nt, Homo sapiens
gaucccguucagaaaaccacu

SEQ ID NO: 1943313 - RNA, 23 nt, Homo sapiens
aggugauugucaccaugaucacu

SEQ ID NO: 1943314 - RNA, 14 nt, Homo sapiens
gucuaaaauccugc

SEQ ID NO: 1943315 - RNA, 21 nt, Homo sapiens
cagccucccaaaguguuggga

SEQ ID NO: 1943316 - RNA, 22 nt, Homo sapiens
aggaggggcccacaauggagug

SEQ ID NO: 1943317 - RNA, 19 nt, Homo sapiens
ccaugcuugccugaagcuu

SEQ ID NO: 1943318 - RNA, 14 nt, Homo sapiens
gauuuuagccaugc

SEQ ID NO: 1943319 - RNA, 19 nt, Homo sapiens
aaauguuguuuuaggaaua

SEQ ID NO: 1943320 - RNA, 15 nt, Homo sapiens
cuuuaaaaagcaugu

SEQ ID NO: 1943321 - RNA, 14 nt, Homo sapiens
gguggagugucaca

SEQ ID NO: 1943322 - RNA, 12 nt, Homo sapiens
ccagguggcaaa

SEQ ID NO: 1943323 - RNA, 22 nt, Homo sapiens
ccucauuucaccugcgcugugg

SEQ ID NO: 1943324 - RNA, 20 nt, Homo sapiens
aaagucuaguuaccuacuuu

SEQ ID NO: 1943325 - RNA, 16 nt, Homo sapiens
caaaagaaagaaccac

SEQ ID NO: 1943326 - RNA, 22 nt, Homo sapiens
uggaaaguugggauuugcaaau

SEQ ID NO: 1943327 - RNA, 14 nt, Homo sapiens
gucuccguggcacu

SEQ ID NO: 1943328 - RNA, 17 nt, Homo sapiens
uucuugguuuuccgaca

SEQ ID NO: 1943329 - RNA, 23 nt, Homo sapiens
guauauaauacuaaagugucuau

SEQ ID NO: 1943330 - RNA, 11 nt, Homo sapiens
ucuaaaugcaa

SEQ ID NO: 1943331 - RNA, 21 nt, Homo sapiens
caugaacacaucagcuagcaa

SEQ ID NO: 1943332 - RNA, 18 nt, Homo sapiens
caugaggaaacuacugaa

SEQ ID NO: 1943333 - RNA, 14 nt, Homo sapiens
agcuaagaugccau

SEQ ID NO: 1943334 - RNA, 20 nt, Homo sapiens
auccucauccgcuacuacau

SEQ ID NO: 1943335 - RNA, 20 nt, Homo sapiens
uccaccucccagguucaagc

SEQ ID NO: 1943336 - RNA, 13 nt, Homo sapiens
cuuuucaggguuu

SEQ ID NO: 1943337 - RNA, 13 nt, Homo sapiens
ggcagcagcucag

SEQ ID NO: 1943338 - RNA, 22 nt, Homo sapiens
guucucauuuuuaucccauuga

SEQ ID NO: 1943339 - RNA, 23 nt, Homo sapiens
aaugcccagugaccagucacuga

SEQ ID NO: 1943340 - RNA, 17 nt, Homo sapiens
uauuuuaucuucuuucc

SEQ ID NO: 1943341 - RNA, 16 nt, Homo sapiens
aggaauuuugucucac

SEQ ID NO: 1943342 - RNA, 18 nt, Homo sapiens
ugccuuggggaggacaaa

SEQ ID NO: 1943343 - RNA, 21 nt, Homo sapiens
guugucccagggcugaugcug

SEQ ID NO: 1943344 - RNA, 22 nt, Homo sapiens
uccugcccccagccauggugag

SEQ ID NO: 1943345 - RNA, 23 nt, Homo sapiens
ccuguuuggggagcaaguguuaa

SEQ ID NO: 1943346 - RNA, 21 nt, Homo sapiens
guguugcaaaucacucugcaa

SEQ ID NO: 1943347 - RNA, 20 nt, Homo sapiens
uuguuguggucugagccaaa

SEQ ID NO: 1943348 - RNA, 22 nt, Homo sapiens
ccccucagccaaugaaucaaug

SEQ ID NO: 1943349 - RNA, 16 nt, Homo sapiens
gggagagacaggcagc

SEQ ID NO: 1943350 - RNA, 22 nt, Homo sapiens
gucccuguccuucccuguucuc

SEQ ID NO: 1943351 - RNA, 19 nt, Homo sapiens
ccaggagacuuuuucagaa

SEQ ID NO: 1943352 - RNA, 23 nt, Homo sapiens
uuucaucaggcucuguuccucaa

SEQ ID NO: 1943353 - RNA, 15 nt, Homo sapiens
aaugaaaggugacaa

SEQ ID NO: 1943354 - RNA, 15 nt, Homo sapiens
uggcucugaacugca

SEQ ID NO: 1943355 - RNA, 20 nt, Homo sapiens
auuccugggcaagaaccuaa

SEQ ID NO: 1943356 - RNA, 23 nt, Homo sapiens
uuuccucccuccucccacagccu

SEQ ID NO: 1943357 - RNA, 18 nt, Homo sapiens
ucacagagugugcuggag

SEQ ID NO: 1943358 - RNA, 20 nt, Homo sapiens
ccguuauuauaauuguauca

SEQ ID NO: 1943359 - RNA, 16 nt, Homo sapiens
aggucugacacgucug

SEQ ID NO: 1943360 - RNA, 16 nt, Homo sapiens
auccccaagccuggca

SEQ ID NO: 1943361 - RNA, 20 nt, Homo sapiens
gacuucuagcugucugugaa

SEQ ID NO: 1943362 - RNA, 23 nt, Homo sapiens
cauaacagacugaaaugugcuca

SEQ ID NO: 1943363 - RNA, 22 nt, Homo sapiens
uccuagccaggcuaucuggccu

SEQ ID NO: 1943364 - RNA, 16 nt, Homo sapiens
aagggagucucucuuc

SEQ ID NO: 1943365 - RNA, 15 nt, Homo sapiens
ucuccagccaaccuc

SEQ ID NO: 1943366 - RNA, 18 nt, Homo sapiens
ccugcaccccugcaguuu

SEQ ID NO: 1943367 - RNA, 22 nt, Homo sapiens
agcuuauaaaaucaaacagaga

SEQ ID NO: 1943368 - RNA, 16 nt, Homo sapiens
acacacacgaugcauu

SEQ ID NO: 1943369 - RNA, 14 nt, Homo sapiens
auacauguguguau

SEQ ID NO: 1943370 - RNA, 16 nt, Homo sapiens
uaauuuugugcauucu

SEQ ID NO: 1943371 - RNA, 18 nt, Homo sapiens
gcuuccagaccaccugcc

SEQ ID NO: 1943372 - RNA, 14 nt, Homo sapiens
agaaggagcaggcc

SEQ ID NO: 1943373 - RNA, 19 nt, Homo sapiens
gguuccuuuugcaugccuc

SEQ ID NO: 1943374 - RNA, 16 nt, Homo sapiens
agaaacuugcuuauca

SEQ ID NO: 1943375 - RNA, 17 nt, Homo sapiens
ccaacaaacaaugccau

SEQ ID NO: 1943376 - RNA, 19 nt, Homo sapiens
cucagcacacaugcauccu

SEQ ID NO: 1943377 - RNA, 23 nt, Homo sapiens
cuuguuggugacaccucaccuca

SEQ ID NO: 1943378 - RNA, 13 nt, Homo sapiens
ucuguacuugguc

SEQ ID NO: 1943379 - RNA, 13 nt, Homo sapiens
uucguauuacaag

SEQ ID NO: 1943380 - RNA, 21 nt, Homo sapiens
gacaaaacuucuugucagaca

SEQ ID NO: 1943381 - RNA, 19 nt, Homo sapiens
aauaaguguacauauguaa

SEQ ID NO: 1943382 - RNA, 19 nt, Homo sapiens
gcauguaaaaucuucagcu

SEQ ID NO: 1943383 - RNA, 17 nt, Homo sapiens
aauagacugagucagau

SEQ ID NO: 1943384 - RNA, 13 nt, Homo sapiens
uagaacacugccu

SEQ ID NO: 1943385 - RNA, 19 nt, Homo sapiens
gcacagaggauggcuuccc

SEQ ID NO: 1943386 - RNA, 15 nt, Homo sapiens
guuuaaaugccaaaa

SEQ ID NO: 1943387 - RNA, 15 nt, Homo sapiens
gcugugaugcaugag

SEQ ID NO: 1943388 - RNA, 19 nt, Homo sapiens
gcccagagcugggugagug

SEQ ID NO: 1943389 - RNA, 20 nt, Homo sapiens
gccaagggggugacuggaag

SEQ ID NO: 1943390 - RNA, 19 nt, Homo sapiens
agcucaccacugugccuac

SEQ ID NO: 1943391 - RNA, 19 nt, Homo sapiens
acagaaaguaucacaaaug

SEQ ID NO: 1943392 - RNA, 12 nt, Homo sapiens
uguuuuugauaa

SEQ ID NO: 1943393 - RNA, 17 nt, Homo sapiens
ccugugucacucagcag

SEQ ID NO: 1943394 - RNA, 16 nt, Homo sapiens
auagaucacauaacag

SEQ ID NO: 1943395 - RNA, 21 nt, Homo sapiens
uacuccugguucagugccacg

SEQ ID NO: 1943396 - RNA, 21 nt, Homo sapiens
ccuguacaaaagggacaugaa

SEQ ID NO: 1943397 - RNA, 16 nt, Homo sapiens
gcuccccuaaagccag

SEQ ID NO: 1943398 - RNA, 16 nt, Homo sapiens
gaauuagcucacuugg

SEQ ID NO: 1943399 - RNA, 15 nt, Homo sapiens
agacuccaguacuau

SEQ ID NO: 1943400 - RNA, 16 nt, Homo sapiens
ucagcaacaaccaucu

SEQ ID NO: 1943401 - RNA, 19 nt, Homo sapiens
cacugaggguggcacucaa

SEQ ID NO: 1943402 - RNA, 20 nt, Homo sapiens
uuuagcaguuuccucaguga

SEQ ID NO: 1943403 - RNA, 19 nt, Homo sapiens
gaucuguuuugaaggcaaa

SEQ ID NO: 1943404 - RNA, 21 nt, Homo sapiens
gagagacgcugugauuggcag

SEQ ID NO: 1943405 - RNA, 18 nt, Homo sapiens
gcaccguucugugcacaa

SEQ ID NO: 1943406 - RNA, 14 nt, Homo sapiens
ccuccaggccaguu

SEQ ID NO: 1943407 - RNA, 18 nt, Homo sapiens
acccugcccugcucugcc

SEQ ID NO: 1943408 - RNA, 15 nt, Homo sapiens
aaucuauccauugaa

SEQ ID NO: 1943409 - RNA, 20 nt, Homo sapiens
agacuuuuagcgguuugcaa

SEQ ID NO: 1943410 - RNA, 17 nt, Homo sapiens
cccccaauaaaccagug

SEQ ID NO: 1943411 - RNA, 19 nt, Homo sapiens
acaaaaaggcaaauauuga

SEQ ID NO: 1943412 - RNA, 14 nt, Homo sapiens
gauaagacuggaaa

SEQ ID NO: 1943413 - RNA, 14 nt, Homo sapiens
acccuuucugccag

SEQ ID NO: 1943414 - RNA, 15 nt, Homo sapiens
aaugucuaccaacug

SEQ ID NO: 1943415 - RNA, 14 nt, Homo sapiens
ugccuuggggacaa

SEQ ID NO: 1943416 - RNA, 19 nt, Homo sapiens
ccuacugcuuccucugaau

SEQ ID NO: 1943417 - RNA, 15 nt, Homo sapiens
caaaauguccagcuu

SEQ ID NO: 1943418 - RNA, 17 nt, Homo sapiens
uagccagcacuuguaua

SEQ ID NO: 1943419 - RNA, 18 nt, Homo sapiens
aaucagauuuucuccugu

SEQ ID NO: 1943420 - RNA, 17 nt, Homo sapiens
guucccuuacuguuuca

SEQ ID NO: 1943421 - RNA, 23 nt, Homo sapiens
ugcccagccacaucaucuuuauc

SEQ ID NO: 1943422 - RNA, 23 nt, Homo sapiens
cauuuacuuaacagaacagucac

SEQ ID NO: 1943423 - RNA, 13 nt, Homo sapiens
uacaucuauguau

SEQ ID NO: 1943424 - RNA, 12 nt, Homo sapiens
cagugugcaaua

SEQ ID NO: 1943425 - RNA, 21 nt, Homo sapiens
aggcagccaccaguggaccua

SEQ ID NO: 1943426 - RNA, 19 nt, Homo sapiens
cugguaccgagccccugaa

SEQ ID NO: 1943427 - RNA, 19 nt, Homo sapiens
aggcauugccuucucugcc

SEQ ID NO: 1943428 - RNA, 19 nt, Homo sapiens
agaugcauuuuguguacag

SEQ ID NO: 1943429 - RNA, 16 nt, Homo sapiens
aagacgccuucaucug

SEQ ID NO: 1943430 - RNA, 21 nt, Homo sapiens
caaaucucugugcuggccuga

SEQ ID NO: 1943431 - RNA, 18 nt, Homo sapiens
acaaauaaacuagucugu

SEQ ID NO: 1943432 - RNA, 12 nt, Homo sapiens
ugcuuuauuagu

SEQ ID NO: 1943433 - RNA, 15 nt, Homo sapiens
uggaaaaaacucuga

SEQ ID NO: 1943434 - RNA, 19 nt, Homo sapiens
uaacagagcaucaaaaaca

SEQ ID NO: 1943435 - RNA, 17 nt, Homo sapiens
cuugaucagacauucag

SEQ ID NO: 1943436 - RNA, 21 nt, Homo sapiens
agacccuuuauuggccuuaca

SEQ ID NO: 1943437 - RNA, 21 nt, Homo sapiens
uaagcacgggccauaugaaua

SEQ ID NO: 1943438 - RNA, 15 nt, Homo sapiens
cauaaaaguaaagga

SEQ ID NO: 1943439 - RNA, 18 nt, Homo sapiens
ucucccuggaucuaccug

SEQ ID NO: 1943440 - RNA, 13 nt, Homo sapiens
gacucugaucucu

SEQ ID NO: 1943441 - RNA, 23 nt, Homo sapiens
caugucugccuaugcacugaaga

SEQ ID NO: 1943442 - RNA, 23 nt, Homo sapiens
ccuuaauaacauacaaugaccac

SEQ ID NO: 1943443 - RNA, 17 nt, Homo sapiens
cuucuccuuacugcauc

SEQ ID NO: 1943444 - RNA, 13 nt, Homo sapiens
uuuucuuuugaca

SEQ ID NO: 1943445 - RNA, 23 nt, Homo sapiens
agucugauuuaauugggcacuau

SEQ ID NO: 1943446 - RNA, 17 nt, Homo sapiens
agggggaaggcugcaaa

SEQ ID NO: 1943447 - RNA, 18 nt, Homo sapiens
auuuguuucuuucucuga

SEQ ID NO: 1943448 - RNA, 20 nt, Homo sapiens
uuaaaauucacccccaucca

SEQ ID NO: 1943449 - RNA, 20 nt, Homo sapiens
ccugccugagcccaggagcu

SEQ ID NO: 1943450 - RNA, 20 nt, Homo sapiens
aagcagcucacggaacugga

SEQ ID NO: 1943451 - RNA, 15 nt, Homo sapiens
aagagcuccuugaug

SEQ ID NO: 1943452 - RNA, 15 nt, Homo sapiens
ugguuaugucccaug

SEQ ID NO: 1943453 - RNA, 21 nt, Homo sapiens
ugcaaggauuacacauuucac

SEQ ID NO: 1943454 - RNA, 19 nt, Homo sapiens
auucuaaugguagucagau

SEQ ID NO: 1943455 - RNA, 20 nt, Homo sapiens
gacauuuggugguacuuuau

SEQ ID NO: 1943456 - RNA, 12 nt, Homo sapiens
gagccaccgugu

SEQ ID NO: 1943457 - RNA, 12 nt, Homo sapiens
aacccaccaucu

SEQ ID NO: 1943458 - RNA, 22 nt, Homo sapiens
uaaaugcagacaacaccuuccu

SEQ ID NO: 1943459 - RNA, 22 nt, Homo sapiens
uuuuaaaaaaaggagacugugu

SEQ ID NO: 1943460 - RNA, 15 nt, Homo sapiens
gaaaagugauagaaa

SEQ ID NO: 1943461 - RNA, 15 nt, Homo sapiens
aaaauaucauguuca

SEQ ID NO: 1943462 - RNA, 18 nt, Homo sapiens
guuuccuuucauuuacug

SEQ ID NO: 1943463 - RNA, 13 nt, Homo sapiens
ugccuacagccag

SEQ ID NO: 1943464 - RNA, 22 nt, Homo sapiens
ugaagacuaguuauauauuccu

SEQ ID NO: 1943465 - RNA, 20 nt, Homo sapiens
cagcuggaucgcugcacaug

SEQ ID NO: 1943466 - RNA, 22 nt, Homo sapiens
ugcccgcccgcccgcauagcac

SEQ ID NO: 1943467 - RNA, 15 nt, Homo sapiens
ucaguuuuugcugau

SEQ ID NO: 1943468 - RNA, 15 nt, Homo sapiens
ggaaaaaaacaugaa

SEQ ID NO: 1943469 - RNA, 23 nt, Homo sapiens
aucccugcggaggguuugguucu

SEQ ID NO: 1943470 - RNA, 13 nt, Homo sapiens
acuuaaucucaca

SEQ ID NO: 1943471 - RNA, 23 nt, Homo sapiens
agggggugggggugcugcucucu

SEQ ID NO: 1943472 - RNA, 21 nt, Homo sapiens
aauaaacgcuccccucagaca

SEQ ID NO: 1943473 - RNA, 15 nt, Homo sapiens
caguuccucccagga

SEQ ID NO: 1943474 - RNA, 20 nt, Homo sapiens
uuccuuacacauagauauaa

SEQ ID NO: 1943475 - RNA, 18 nt, Homo sapiens
agagaggugccacacuga

SEQ ID NO: 1943476 - RNA, 16 nt, Homo sapiens
gucucgacucauccau

SEQ ID NO: 1943477 - RNA, 20 nt, Homo sapiens
cuugguuguauaaagcaaaa

SEQ ID NO: 1943478 - RNA, 20 nt, Homo sapiens
ugcuagaugugcaaaugcaa

SEQ ID NO: 1943479 - RNA, 21 nt, Homo sapiens
agguaguguugagacccaggc

SEQ ID NO: 1943480 - RNA, 23 nt, Homo sapiens
gcaaagcuaaaauugaacuacuu

SEQ ID NO: 1943481 - RNA, 16 nt, Homo sapiens
ccuagagaaacgcaag

SEQ ID NO: 1943482 - RNA, 17 nt, Homo sapiens
gacaccaccacuguguc

SEQ ID NO: 1943483 - RNA, 19 nt, Homo sapiens
uucccucaugcuguuccac

SEQ ID NO: 1943484 - RNA, 13 nt, Homo sapiens
ggaagaugcccuc

SEQ ID NO: 1943485 - RNA, 18 nt, Homo sapiens
guauugacaggaauacuu

SEQ ID NO: 1943486 - RNA, 13 nt, Homo sapiens
gcuucaguguuuu

SEQ ID NO: 1943487 - RNA, 15 nt, Homo sapiens
ccugcaucugugaaa

SEQ ID NO: 1943488 - RNA, 20 nt, Homo sapiens
ugcccucuccugggcagcug

SEQ ID NO: 1943489 - RNA, 22 nt, Homo sapiens
cucccugggaggcgggcgcacu

SEQ ID NO: 1943490 - RNA, 16 nt, Homo sapiens
cuuaggaaauugcuca

SEQ ID NO: 1943491 - RNA, 23 nt, Homo sapiens
gugucugcacccaggggugggga

SEQ ID NO: 1943492 - RNA, 18 nt, Homo sapiens
cugucaucagccugugua

SEQ ID NO: 1943493 - RNA, 12 nt, Homo sapiens
aguggagccagg

SEQ ID NO: 1943494 - RNA, 16 nt, Homo sapiens
caccgaguuuccagau

SEQ ID NO: 1943495 - RNA, 20 nt, Homo sapiens
uaugcaaaauacuguacauu

SEQ ID NO: 1943496 - RNA, 15 nt, Homo sapiens
agccauggggagcaa

SEQ ID NO: 1943497 - RNA, 19 nt, Homo sapiens
acaaauuucauugcacuuu

SEQ ID NO: 1943498 - RNA, 21 nt, Homo sapiens
ucuugcuuuggaggaccuuaa

SEQ ID NO: 1943499 - RNA, 21 nt, Homo sapiens
ugcugcaucuccccucagauu

SEQ ID NO: 1943500 - RNA, 23 nt, Homo sapiens
uuuuggccuuuguaagacacaca

SEQ ID NO: 1943501 - RNA, 16 nt, Homo sapiens
gagccuuuggccagaa

SEQ ID NO: 1943502 - RNA, 22 nt, Homo sapiens
gagaacugccuuuggcagaguu

SEQ ID NO: 1943503 - RNA, 18 nt, Homo sapiens
ucuugaaccugugcucau

SEQ ID NO: 1943504 - RNA, 14 nt, Homo sapiens
aucauaaaaucaaa

SEQ ID NO: 1943505 - RNA, 14 nt, Homo sapiens
ugccacaaugccuc

SEQ ID NO: 1943506 - RNA, 14 nt, Homo sapiens
ccaaucaaccaaac

SEQ ID NO: 1943507 - RNA, 14 nt, Homo sapiens
auucuuaaauucau

SEQ ID NO: 1943508 - RNA, 20 nt, Homo sapiens
auaaacugacuaaacuuaca

SEQ ID NO: 1943509 - RNA, 18 nt, Homo sapiens
accgggacuucaaagccg

SEQ ID NO: 1943510 - RNA, 15 nt, Homo sapiens
aagcaauaagaacaa

SEQ ID NO: 1943511 - RNA, 15 nt, Homo sapiens
ugcuuuucauuagca

SEQ ID NO: 1943512 - RNA, 16 nt, Homo sapiens
uuuguuuuuuuccuga

SEQ ID NO: 1943513 - RNA, 15 nt, Homo sapiens
agccagcugcagcug

SEQ ID NO: 1943514 - RNA, 22 nt, Homo sapiens
gaucuuaggcaugacuguagaa

SEQ ID NO: 1943515 - RNA, 12 nt, Homo sapiens
ccgaauccacag

SEQ ID NO: 1943516 - RNA, 23 nt, Homo sapiens
uuggugaaucgguuguucuuucc

SEQ ID NO: 1943517 - RNA, 14 nt, Homo sapiens
gguggugucuccaa

SEQ ID NO: 1943518 - RNA, 22 nt, Homo sapiens
ccagaggcucuaauguacaaua

SEQ ID NO: 1943519 - RNA, 22 nt, Homo sapiens
guaugcacaguaaaaauggaaa

SEQ ID NO: 1943520 - RNA, 11 nt, Homo sapiens
acuacauauuu

SEQ ID NO: 1943521 - RNA, 16 nt, Homo sapiens
gcuauuaagaaaauca

SEQ ID NO: 1943522 - RNA, 14 nt, Homo sapiens
ggucagauauuuga

SEQ ID NO: 1943523 - RNA, 14 nt, Homo sapiens
cccugcuuugcaaa

SEQ ID NO: 1943524 - RNA, 17 nt, Homo sapiens
acugaaguauacauuua

SEQ ID NO: 1943525 - RNA, 17 nt, Homo sapiens
ugcucagguacuuguaa

SEQ ID NO: 1943526 - RNA, 13 nt, Homo sapiens
uacucauauuccu

SEQ ID NO: 1943527 - RNA, 13 nt, Homo sapiens
gaagaaagcaaca

SEQ ID NO: 1943528 - RNA, 13 nt, Homo sapiens
gcagaaagccaca

SEQ ID NO: 1943529 - RNA, 23 nt, Homo sapiens
uucacagccacaccuggacugac

SEQ ID NO: 1943530 - RNA, 16 nt, Homo sapiens
cucaggugauccaccu

SEQ ID NO: 1943531 - RNA, 21 nt, Homo sapiens
cuggagaccagggagccuuug

SEQ ID NO: 1943532 - RNA, 11 nt, Homo sapiens
aauuucuguca

SEQ ID NO: 1943533 - RNA, 13 nt, Homo sapiens
ggcuugcugccaa

SEQ ID NO: 1943534 - RNA, 20 nt, Homo sapiens
gagccggacacuucucagga

SEQ ID NO: 1943535 - RNA, 16 nt, Homo sapiens
ccaacgcacaggaaaa

SEQ ID NO: 1943536 - RNA, 15 nt, Homo sapiens
ccagcugacauggaa

SEQ ID NO: 1943537 - RNA, 16 nt, Homo sapiens
uugaaguacuuaacau

SEQ ID NO: 1943538 - RNA, 15 nt, Homo sapiens
aauuaaccuuacuaa

SEQ ID NO: 1943539 - RNA, 15 nt, Homo sapiens
auggaucugcuccau

SEQ ID NO: 1943540 - RNA, 22 nt, Homo sapiens
ugagcuaccguggaucuccuuc

SEQ ID NO: 1943541 - RNA, 13 nt, Homo sapiens
gcaaccugacuca

SEQ ID NO: 1943542 - RNA, 16 nt, Homo sapiens
cacugcagcugaagag

SEQ ID NO: 1943543 - RNA, 16 nt, Homo sapiens
ggccagagccaagggg

SEQ ID NO: 1943544 - RNA, 22 nt, Homo sapiens
ccgcuggggaccgguucccaca

SEQ ID NO: 1943545 - RNA, 20 nt, Homo sapiens
uauguagaagcaugaagucu

SEQ ID NO: 1943546 - RNA, 14 nt, Homo sapiens
agucucagcuacuu

SEQ ID NO: 1943547 - RNA, 21 nt, Homo sapiens
gugcccaggggcccacaggga

SEQ ID NO: 1943548 - RNA, 18 nt, Homo sapiens
uaggcuggaggacagugg

SEQ ID NO: 1943549 - RNA, 18 nt, Homo sapiens
uuucaagaaaacuggaaa

SEQ ID NO: 1943550 - RNA, 21 nt, Homo sapiens
aaaaauuguaucucauuacuu

SEQ ID NO: 1943551 - RNA, 16 nt, Homo sapiens
ggacaaccucauuuua

SEQ ID NO: 1943552 - RNA, 21 nt, Homo sapiens
aagcugcugagaaucuagccu

SEQ ID NO: 1943553 - RNA, 16 nt, Homo sapiens
cauccauaacugaaca

SEQ ID NO: 1943554 - RNA, 23 nt, Homo sapiens
caaagcucuguggccacauuuuc

SEQ ID NO: 1943555 - RNA, 21 nt, Homo sapiens
uugagacccuuuaaaugccug

SEQ ID NO: 1943556 - RNA, 16 nt, Homo sapiens
uagucgaguuuucaau

SEQ ID NO: 1943557 - RNA, 19 nt, Homo sapiens
ccuggaugggcuucacugg

SEQ ID NO: 1943558 - RNA, 15 nt, Homo sapiens
agacagggucucacu

SEQ ID NO: 1943559 - RNA, 15 nt, Homo sapiens
ucuccucugcuccaa

SEQ ID NO: 1943560 - RNA, 16 nt, Homo sapiens
ugcuccagucauugca

SEQ ID NO: 1943561 - RNA, 17 nt, Homo sapiens
caauuacucaccaaaaa

SEQ ID NO: 1943562 - RNA, 17 nt, Homo sapiens
cagaagaccccacuuca

SEQ ID NO: 1943563 - RNA, 17 nt, Homo sapiens
ggugcucuuugcugcac

SEQ ID NO: 1943564 - RNA, 18 nt, Homo sapiens
uguaauuuggcuccuuac

SEQ ID NO: 1943565 - RNA, 17 nt, Homo sapiens
caauaaaccagugugaa

SEQ ID NO: 1943566 - RNA, 21 nt, Homo sapiens
cucccacagucccaucugcuu

SEQ ID NO: 1943567 - RNA, 23 nt, Homo sapiens
acagcagccuggaagccucggca

SEQ ID NO: 1943568 - RNA, 11 nt, Homo sapiens
acuuguagguu

SEQ ID NO: 1943569 - RNA, 17 nt, Homo sapiens
gugggccuuaacauccc

SEQ ID NO: 1943570 - RNA, 20 nt, Homo sapiens
aagacaauaaaacacuuuug

SEQ ID NO: 1943571 - RNA, 20 nt, Homo sapiens
ucccaccacagcagguguca

SEQ ID NO: 1943572 - RNA, 14 nt, Homo sapiens
acaccuucuuggcu

SEQ ID NO: 1943573 - RNA, 14 nt, Homo sapiens
acagccucuugccc

SEQ ID NO: 1943574 - RNA, 21 nt, Homo sapiens
gccacaucugugucucuggaa

SEQ ID NO: 1943575 - RNA, 19 nt, Homo sapiens
gaccaugcugagacauccc

SEQ ID NO: 1943576 - RNA, 23 nt, Homo sapiens
cccagggaaucagggagcacugg

SEQ ID NO: 1943577 - RNA, 14 nt, Homo sapiens
agugcucuuuccac

SEQ ID NO: 1943578 - RNA, 14 nt, Homo sapiens
auugcuuacugugu

SEQ ID NO: 1943579 - RNA, 16 nt, Homo sapiens
cuccgccaaugcacgg

SEQ ID NO: 1943580 - RNA, 21 nt, Homo sapiens
acuguaaacucuaucagcauu

SEQ ID NO: 1943581 - RNA, 12 nt, Homo sapiens
cugaagguugug

SEQ ID NO: 1943582 - RNA, 21 nt, Homo sapiens
guccccagggcugucaucuga

SEQ ID NO: 1943583 - RNA, 17 nt, Homo sapiens
ucaucucagcaaucaca

SEQ ID NO: 1943584 - RNA, 16 nt, Homo sapiens
gcauacccuuacucug

SEQ ID NO: 1943585 - RNA, 12 nt, Homo sapiens
ugugugaucaaa

SEQ ID NO: 1943586 - RNA, 16 nt, Homo sapiens
caauucauuucucuau

SEQ ID NO: 1943587 - RNA, 18 nt, Homo sapiens
gaggugggugugggugga

SEQ ID NO: 1943588 - RNA, 21 nt, Homo sapiens
aacauauacuauuuagucuca

SEQ ID NO: 1943589 - RNA, 21 nt, Homo sapiens
ugacacggccucccucugcua

SEQ ID NO: 1943590 - RNA, 16 nt, Homo sapiens
acaguuacuccaguau

SEQ ID NO: 1943591 - RNA, 20 nt, Homo sapiens
cugauauagaucacauaaca

SEQ ID NO: 1943592 - RNA, 20 nt, Homo sapiens
ucaauuauacuaaaccucac

SEQ ID NO: 1943593 - RNA, 15 nt, Homo sapiens
gcgucaucuguguaa

SEQ ID NO: 1943594 - RNA, 22 nt, Homo sapiens
augcugcuguacaacuucuggg

SEQ ID NO: 1943595 - RNA, 16 nt, Homo sapiens
uggucagcccuaggau

SEQ ID NO: 1943596 - RNA, 20 nt, Homo sapiens
uuccacuuguuugcacugug

SEQ ID NO: 1943597 - RNA, 19 nt, Homo sapiens
cucagaauauuaagcacau

SEQ ID NO: 1943598 - RNA, 22 nt, Homo sapiens
uucacgugcagcagcaacacaa

SEQ ID NO: 1943599 - RNA, 15 nt, Homo sapiens
uuugccuucugcaca

SEQ ID NO: 1943600 - RNA, 17 nt, Homo sapiens
acauucaccaacaacag

SEQ ID NO: 1943601 - RNA, 14 nt, Homo sapiens
guuuguaugagaug

SEQ ID NO: 1943602 - RNA, 14 nt, Homo sapiens
auuuugcauuccag

SEQ ID NO: 1943603 - RNA, 16 nt, Homo sapiens
uacuuguaaaggugcu

SEQ ID NO: 1943604 - RNA, 13 nt, Homo sapiens
aaccagugugaac

SEQ ID NO: 1943605 - RNA, 20 nt, Homo sapiens
aguuaugccucugacagucc

SEQ ID NO: 1943606 - RNA, 15 nt, Homo sapiens
gaaucgcuugaacca

SEQ ID NO: 1943607 - RNA, 22 nt, Homo sapiens
ucugugcagagaugacugucca

SEQ ID NO: 1943608 - RNA, 13 nt, Homo sapiens
ucucuccucagga

SEQ ID NO: 1943609 - RNA, 14 nt, Homo sapiens
cuggggcucagagc

SEQ ID NO: 1943610 - RNA, 16 nt, Homo sapiens
agucaguaauugccaa

SEQ ID NO: 1943611 - RNA, 20 nt, Homo sapiens
aaucugacuucucacuuccu

SEQ ID NO: 1943612 - RNA, 19 nt, Homo sapiens
caggcucccagggacaccu

SEQ ID NO: 1943613 - RNA, 12 nt, Homo sapiens
ugccucagcuga

SEQ ID NO: 1943614 - RNA, 18 nt, Homo sapiens
uaaaucuaaugacauuca

SEQ ID NO: 1943615 - RNA, 21 nt, Homo sapiens
gcucgcugccaucaccgcugg

SEQ ID NO: 1943616 - RNA, 19 nt, Homo sapiens
gccuugcauguacuugaag

SEQ ID NO: 1943617 - RNA, 19 nt, Homo sapiens
ggcuuuuccaaaagcaaac

SEQ ID NO: 1943618 - RNA, 17 nt, Homo sapiens
aaauuaagaaaucauuc

SEQ ID NO: 1943619 - RNA, 13 nt, Homo sapiens
aacauauuauuuc

SEQ ID NO: 1943620 - RNA, 16 nt, Homo sapiens
aaagcaaaauugcaau

SEQ ID NO: 1943621 - RNA, 14 nt, Homo sapiens
gcacgguggcucac

SEQ ID NO: 1943622 - RNA, 14 nt, Homo sapiens
ccaggcugccugag

SEQ ID NO: 1943623 - RNA, 16 nt, Homo sapiens
aagaagauaaacacaa

SEQ ID NO: 1943624 - RNA, 17 nt, Homo sapiens
auuaacuauaacaauca

SEQ ID NO: 1943625 - RNA, 16 nt, Homo sapiens
auaugcaguucugcag

SEQ ID NO: 1943626 - RNA, 15 nt, Homo sapiens
auguagauuuguaca

SEQ ID NO: 1943627 - RNA, 14 nt, Homo sapiens
ccaaauaauuucau

SEQ ID NO: 1943628 - RNA, 23 nt, Homo sapiens
ucaggcccagagaagcaaguggc

SEQ ID NO: 1943629 - RNA, 21 nt, Homo sapiens
gcaagagguuucagcauuccc

SEQ ID NO: 1943630 - RNA, 13 nt, Homo sapiens
gauaauacuucca

SEQ ID NO: 1943631 - RNA, 20 nt, Homo sapiens
acgaucucagcucacugcaa

SEQ ID NO: 1943632 - RNA, 16 nt, Homo sapiens
auuuaaggagcagugg

SEQ ID NO: 1943633 - RNA, 15 nt, Homo sapiens
auagucuccuacgca

SEQ ID NO: 1943634 - RNA, 15 nt, Homo sapiens
cuaggcucauacuca

SEQ ID NO: 1943635 - RNA, 23 nt, Homo sapiens
uaacagaaagccugggugacauu

SEQ ID NO: 1943636 - RNA, 14 nt, Homo sapiens
gaaagaaagggacc

SEQ ID NO: 1943637 - RNA, 14 nt, Homo sapiens
agaaccaaaagaga

SEQ ID NO: 1943638 - RNA, 10 nt, Homo sapiens
uuauguacug

SEQ ID NO: 1943639 - RNA, 23 nt, Homo sapiens
aacuaugaggagccucugaucaa

SEQ ID NO: 1943640 - RNA, 17 nt, Homo sapiens
cucucaauuaaguguug

SEQ ID NO: 1943641 - RNA, 17 nt, Homo sapiens
gcucaucgguggaagca

SEQ ID NO: 1943642 - RNA, 12 nt, Homo sapiens
augccaagacag

SEQ ID NO: 1943643 - RNA, 22 nt, Homo sapiens
gcucugcaucccccaaagccau

SEQ ID NO: 1943644 - RNA, 11 nt, Homo sapiens
acaaaauucca

SEQ ID NO: 1943645 - RNA, 19 nt, Homo sapiens
acugucuuuaaaagucauu

SEQ ID NO: 1943646 - RNA, 11 nt, Homo sapiens
aagacccagug

SEQ ID NO: 1943647 - RNA, 16 nt, Homo sapiens
uggaggcagagggcaa

SEQ ID NO: 1943648 - RNA, 22 nt, Homo sapiens
auauguuaaugcaaagcuaaaa

SEQ ID NO: 1943649 - RNA, 15 nt, Homo sapiens
cugacuuggggacaa

SEQ ID NO: 1943650 - RNA, 21 nt, Homo sapiens
cuucuccccugcacuguaaaa

SEQ ID NO: 1943651 - RNA, 17 nt, Homo sapiens
uaggauauuggcauuug

SEQ ID NO: 1943652 - RNA, 17 nt, Homo sapiens
aaagcuaaggaccuuaa

SEQ ID NO: 1943653 - RNA, 14 nt, Homo sapiens
uaggguguguauau

SEQ ID NO: 1943654 - RNA, 21 nt, Homo sapiens
aauguacaauuaugucucuug

SEQ ID NO: 1943655 - RNA, 21 nt, Homo sapiens
cgucuguugcuccccuggguc

SEQ ID NO: 1943656 - RNA, 17 nt, Homo sapiens
ccaagugccccaccacu

SEQ ID NO: 1943657 - RNA, 12 nt, Homo sapiens
uugucagaauuu

SEQ ID NO: 1943658 - RNA, 20 nt, Homo sapiens
uggauguauuuguagccagu

SEQ ID NO: 1943659 - RNA, 18 nt, Homo sapiens
ccacccucacauccccau

SEQ ID NO: 1943660 - RNA, 18 nt, Homo sapiens
acuuugacuuugcccagg

SEQ ID NO: 1943661 - RNA, 14 nt, Homo sapiens
uuuauaaucaauga

SEQ ID NO: 1943662 - RNA, 19 nt, Homo sapiens
agaugugaagccuggagcu

SEQ ID NO: 1943663 - RNA, 15 nt, Homo sapiens
cuuccucacaccaca

SEQ ID NO: 1943664 - RNA, 17 nt, Homo sapiens
gccuuguccccugccug

SEQ ID NO: 1943665 - RNA, 16 nt, Homo sapiens
acccuaaacauccaua

SEQ ID NO: 1943666 - RNA, 14 nt, Homo sapiens
gcccccgcuguguc

SEQ ID NO: 1943667 - RNA, 17 nt, Homo sapiens
ggccaggccauggccaa

SEQ ID NO: 1943668 - RNA, 22 nt, Homo sapiens
ucuuaaaaacaacgaaagaagg

SEQ ID NO: 1943669 - RNA, 13 nt, Homo sapiens
cagcgcaccuguu

SEQ ID NO: 1943670 - RNA, 23 nt, Homo sapiens
aucuuuggacagaagcagcucuu

SEQ ID NO: 1943671 - RNA, 13 nt, Homo sapiens
aucuauuaucuca

SEQ ID NO: 1943672 - RNA, 15 nt, Homo sapiens
aggguucaacaaagg

SEQ ID NO: 1943673 - RNA, 24 nt, Homo sapiens
auuguuaggagaugucaucaagcu

SEQ ID NO: 1943674 - RNA, 19 nt, Homo sapiens
aaagcaaaugauucagcuc

SEQ ID NO: 1943675 - RNA, 13 nt, Homo sapiens
ugaaacucccacc

SEQ ID NO: 1943676 - RNA, 19 nt, Homo sapiens
caauggcaccuucauucuc

SEQ ID NO: 1943677 - RNA, 20 nt, Homo sapiens
ggccacacuggucacaggca

SEQ ID NO: 1943678 - RNA, 22 nt, Homo sapiens
cugggaaaugagaugaccacuu

SEQ ID NO: 1943679 - RNA, 20 nt, Homo sapiens
ugcuccuuuuguaucuuccu

SEQ ID NO: 1943680 - RNA, 21 nt, Homo sapiens
aaacaguuaagacaacaggca

SEQ ID NO: 1943681 - RNA, 15 nt, Homo sapiens
auauucuucuaccac

SEQ ID NO: 1943682 - RNA, 15 nt, Homo sapiens
cucuuccuaucccau

SEQ ID NO: 1943683 - RNA, 19 nt, Homo sapiens
ucuauaaauagaugcugug

SEQ ID NO: 1943684 - RNA, 21 nt, Homo sapiens
agagcaaacccacucccaaau

SEQ ID NO: 1943685 - RNA, 16 nt, Homo sapiens
augggaaguccuggca

SEQ ID NO: 1943686 - RNA, 22 nt, Homo sapiens
cugaucagcaugggaaugugcc

SEQ ID NO: 1943687 - RNA, 21 nt, Homo sapiens
cauggcuuaaugcuucuuuca

SEQ ID NO: 1943688 - RNA, 21 nt, Homo sapiens
uuaaugcaagagaacauuuua

SEQ ID NO: 1943689 - RNA, 16 nt, Homo sapiens
cggcuuccaucugccc

SEQ ID NO: 1943690 - RNA, 18 nt, Homo sapiens
ugugcuccagucauugca

SEQ ID NO: 1943691 - RNA, 21 nt, Homo sapiens
uaauaugcuuauauuguucac

SEQ ID NO: 1943692 - RNA, 17 nt, Homo sapiens
ugguuugacucaucuua

SEQ ID NO: 1943693 - RNA, 15 nt, Homo sapiens
acugaaugacuugac

SEQ ID NO: 1943694 - RNA, 23 nt, Homo sapiens
uggucacccuaaggaaaggaauu

SEQ ID NO: 1943695 - RNA, 14 nt, Homo sapiens
ucauuaauucacau

SEQ ID NO: 1943696 - RNA, 20 nt, Homo sapiens
agugucugaacaggaugcug

SEQ ID NO: 1943697 - RNA, 17 nt, Homo sapiens
uauuugccuccauguag

SEQ ID NO: 1943698 - RNA, 19 nt, Homo sapiens
gcauucuucugagcacugu

SEQ ID NO: 1943699 - RNA, 16 nt, Homo sapiens
uucccccuucccgccu

SEQ ID NO: 1943700 - RNA, 19 nt, Homo sapiens
ggcuccggaggacucacca

SEQ ID NO: 1943701 - RNA, 13 nt, Homo sapiens
agcuggugcugug

SEQ ID NO: 1943702 - RNA, 18 nt, Homo sapiens
ugcucagauagaaugaca

SEQ ID NO: 1943703 - RNA, 19 nt, Homo sapiens
agaauuaucucaaguaaaa

SEQ ID NO: 1943704 - RNA, 19 nt, Homo sapiens
acauuauuccugcacucac

SEQ ID NO: 1943705 - RNA, 16 nt, Homo sapiens
auccucccaccucagc

SEQ ID NO: 1943706 - RNA, 20 nt, Homo sapiens
auuuuauuacuaauagcuug

SEQ ID NO: 1943707 - RNA, 13 nt, Homo sapiens
uaauccacgcuca

SEQ ID NO: 1943708 - RNA, 21 nt, Homo sapiens
ugaauauuuguauacacauaa

SEQ ID NO: 1943709 - RNA, 13 nt, Homo sapiens
auagugauauuau

SEQ ID NO: 1943710 - RNA, 16 nt, Homo sapiens
gauauaagcaaaauca

SEQ ID NO: 1943711 - RNA, 12 nt, Homo sapiens
gauaagguuaua

SEQ ID NO: 1943712 - RNA, 21 nt, Homo sapiens
gcaaccauuuuuagaaggaaa

SEQ ID NO: 1943713 - RNA, 21 nt, Homo sapiens
caccuggcagggcucacacuc

SEQ ID NO: 1943714 - RNA, 18 nt, Homo sapiens
agcuggaauuuuuuauuc

SEQ ID NO: 1943715 - RNA, 20 nt, Homo sapiens
gaguugugucuaggcuggaa

SEQ ID NO: 1943716 - RNA, 18 nt, Homo sapiens
ccagcugcucugucuucu

SEQ ID NO: 1943717 - RNA, 16 nt, Homo sapiens
uaaaauuuugagauua

SEQ ID NO: 1943718 - RNA, 13 nt, Homo sapiens
gucacugggcuac

SEQ ID NO: 1943719 - RNA, 16 nt, Homo sapiens
guaaauaaacaaguca

SEQ ID NO: 1943720 - RNA, 12 nt, Homo sapiens
uagugcagccaa

SEQ ID NO: 1943721 - RNA, 16 nt, Homo sapiens
acugcacaaugcauug

SEQ ID NO: 1943722 - RNA, 19 nt, Homo sapiens
acccagugugugcucagca

SEQ ID NO: 1943723 - RNA, 16 nt, Homo sapiens
caaauuaacuuuacau

SEQ ID NO: 1943724 - RNA, 16 nt, Homo sapiens
auauuuuaaagaccaa

SEQ ID NO: 1943725 - RNA, 17 nt, Homo sapiens
aauuuuagcucuuccca

SEQ ID NO: 1943726 - RNA, 15 nt, Homo sapiens
uagucccacuacuug

SEQ ID NO: 1943727 - RNA, 23 nt, Homo sapiens
aagaucuccaacagccagugugu

SEQ ID NO: 1943728 - RNA, 20 nt, Homo sapiens
acuuggauaggagcuuccag

SEQ ID NO: 1943729 - RNA, 12 nt, Homo sapiens
guaaacuguuuc

SEQ ID NO: 1943730 - RNA, 15 nt, Homo sapiens
guugacuuuacccau

SEQ ID NO: 1943731 - RNA, 21 nt, Homo sapiens
aagggugcccuuugggguccc

SEQ ID NO: 1943732 - RNA, 23 nt, Homo sapiens
aaagacuuuuaugugagauuucc

SEQ ID NO: 1943733 - RNA, 20 nt, Homo sapiens
gagagguuugucaacacaaa

SEQ ID NO: 1943734 - RNA, 16 nt, Homo sapiens
uucaagccuuagauaa

SEQ ID NO: 1943735 - RNA, 16 nt, Homo sapiens
gcugcuagagccagca

SEQ ID NO: 1943736 - RNA, 17 nt, Homo sapiens
ucuuuuuuugagugaca

SEQ ID NO: 1943737 - RNA, 18 nt, Homo sapiens
gacuuuauucggaccaag

SEQ ID NO: 1943738 - RNA, 15 nt, Homo sapiens
uuguuauggcaaguu

SEQ ID NO: 1943739 - RNA, 13 nt, Homo sapiens
acaaaaacagaau

SEQ ID NO: 1943740 - RNA, 13 nt, Homo sapiens
agcauaacaccaa

SEQ ID NO: 1943741 - RNA, 19 nt, Homo sapiens
cugaugacuuuauccugag

SEQ ID NO: 1943742 - RNA, 18 nt, Homo sapiens
accggggccagcaccacu

SEQ ID NO: 1943743 - RNA, 16 nt, Homo sapiens
aggacaaaacuucuug

SEQ ID NO: 1943744 - RNA, 20 nt, Homo sapiens
cagauguccuugaugcucau

SEQ ID NO: 1943745 - RNA, 11 nt, Homo sapiens
aaaccagcucg

SEQ ID NO: 1943746 - RNA, 21 nt, Homo sapiens
aauguucauuguaauguuacu

SEQ ID NO: 1943747 - RNA, 13 nt, Homo sapiens
uauguauauacau

SEQ ID NO: 1943748 - RNA, 13 nt, Homo sapiens
caugaauacacaa

SEQ ID NO: 1943749 - RNA, 12 nt, Homo sapiens
uuuaaggcaaaa

SEQ ID NO: 1943750 - RNA, 17 nt, Homo sapiens
cuguuguagaagacaaa

SEQ ID NO: 1943751 - RNA, 18 nt, Homo sapiens
uuuccugcuggacagggg

SEQ ID NO: 1943752 - RNA, 15 nt, Homo sapiens
aacauccuacaagac

SEQ ID NO: 1943753 - RNA, 14 nt, Homo sapiens
accaccaguuaacg

SEQ ID NO: 1943754 - RNA, 20 nt, Homo sapiens
aggcuggagggcaguggcac

SEQ ID NO: 1943755 - RNA, 18 nt, Homo sapiens
uugcaccucucucuccac

SEQ ID NO: 1943756 - RNA, 22 nt, Homo sapiens
auggaaauuauuacucugucau

SEQ ID NO: 1943757 - RNA, 11 nt, Homo sapiens
aagcaaauaga

SEQ ID NO: 1943758 - RNA, 18 nt, Homo sapiens
guccuucaccucacugaa

SEQ ID NO: 1943759 - RNA, 20 nt, Homo sapiens
gcacugccugccauguaguu

SEQ ID NO: 1943760 - RNA, 17 nt, Homo sapiens
ggggcgaucgcggcgga

SEQ ID NO: 1943761 - RNA, 22 nt, Homo sapiens
cagcaucaauuccaucagcaca

SEQ ID NO: 1943762 - RNA, 20 nt, Homo sapiens
agaggcgcccuggguggugg

SEQ ID NO: 1943763 - RNA, 17 nt, Homo sapiens
ucacuucugacucuucc

SEQ ID NO: 1943764 - RNA, 12 nt, Homo sapiens
ccccauucagug

SEQ ID NO: 1943765 - RNA, 14 nt, Homo sapiens
aaaguacaaaaauu

SEQ ID NO: 1943766 - RNA, 14 nt, Homo sapiens
caacauuaugaucu

SEQ ID NO: 1943767 - RNA, 14 nt, Homo sapiens
uggcccuacaguac

SEQ ID NO: 1943768 - RNA, 21 nt, Homo sapiens
gccuucacccuguggagucac

SEQ ID NO: 1943769 - RNA, 19 nt, Homo sapiens
agucagcuccgaguggcuc

SEQ ID NO: 1943770 - RNA, 12 nt, Homo sapiens
ccccauugcuca

SEQ ID NO: 1943771 - RNA, 17 nt, Homo sapiens
cuagaguaggugcagaa

SEQ ID NO: 1943772 - RNA, 14 nt, Homo sapiens
cucacuauugcaag

SEQ ID NO: 1943773 - RNA, 16 nt, Homo sapiens
cuggcuggugccugag

SEQ ID NO: 1943774 - RNA, 16 nt, Homo sapiens
uaauaugucuucauaa

SEQ ID NO: 1943775 - RNA, 14 nt, Homo sapiens
agaauuguauguca

SEQ ID NO: 1943776 - RNA, 22 nt, Homo sapiens
cagaaauguuaguaacaagaaa

SEQ ID NO: 1943777 - RNA, 21 nt, Homo sapiens
aacauccuugucugggucuac

SEQ ID NO: 1943778 - RNA, 11 nt, Homo sapiens
aaaacugacuc

SEQ ID NO: 1943779 - RNA, 21 nt, Homo sapiens
uauuucaaaacacaucuuucc

SEQ ID NO: 1943780 - RNA, 11 nt, Homo sapiens
cguaagcacug

SEQ ID NO: 1943781 - RNA, 21 nt, Homo sapiens
ugacuucuagcugucugugaa

SEQ ID NO: 1943782 - RNA, 15 nt, Homo sapiens
cuggcagacuuacaa

SEQ ID NO: 1943783 - RNA, 19 nt, Homo sapiens
acaaggugcacagaccuca

SEQ ID NO: 1943784 - RNA, 17 nt, Homo sapiens
gcaauugcucaugcaua

SEQ ID NO: 1943785 - RNA, 21 nt, Homo sapiens
cuggaucuauguguaugcaga

SEQ ID NO: 1943786 - RNA, 20 nt, Homo sapiens
ccugcugaggcagugugguu

SEQ ID NO: 1943787 - RNA, 13 nt, Homo sapiens
cuuaguucuugga

SEQ ID NO: 1943788 - RNA, 20 nt, Homo sapiens
aggggccuuagggcacuggg

SEQ ID NO: 1943789 - RNA, 22 nt, Homo sapiens
uaaugagauaaugugauauuau

SEQ ID NO: 1943790 - RNA, 14 nt, Homo sapiens
ggcuacccaaaaca

SEQ ID NO: 1943791 - RNA, 16 nt, Homo sapiens
uuacaacugaguugau

SEQ ID NO: 1943792 - RNA, 16 nt, Homo sapiens
uaguccauaagcuuua

SEQ ID NO: 1943793 - RNA, 18 nt, Homo sapiens
uuggugauguaaaacaga

SEQ ID NO: 1943794 - RNA, 20 nt, Homo sapiens
uagccuguuucguagccaua

SEQ ID NO: 1943795 - RNA, 14 nt, Homo sapiens
aaucuagaacuuuu

SEQ ID NO: 1943796 - RNA, 18 nt, Homo sapiens
agccccagcgccaaagga

SEQ ID NO: 1943797 - RNA, 14 nt, Homo sapiens
aacccaaauccaag

SEQ ID NO: 1943798 - RNA, 13 nt, Homo sapiens
gaaaauguucacu

SEQ ID NO: 1943799 - RNA, 21 nt, Homo sapiens
caacucuaaagccaagcacuu

SEQ ID NO: 1943800 - RNA, 13 nt, Homo sapiens
cuguuacccaggc

SEQ ID NO: 1943801 - RNA, 20 nt, Homo sapiens
uauugauuuuaaauggaugu

SEQ ID NO: 1943802 - RNA, 17 nt, Homo sapiens
caaagucuaaacugagc

SEQ ID NO: 1943803 - RNA, 21 nt, Homo sapiens
caaagccacccuaccaugaau

SEQ ID NO: 1943804 - RNA, 19 nt, Homo sapiens
ccuuccucagaacuuucua

SEQ ID NO: 1943805 - RNA, 18 nt, Homo sapiens
gccaguguguguuuccca

SEQ ID NO: 1943806 - RNA, 14 nt, Homo sapiens
agacaucaaugaaa

SEQ ID NO: 1943807 - RNA, 14 nt, Homo sapiens
aaacacggcugaua

SEQ ID NO: 1943808 - RNA, 16 nt, Homo sapiens
uugagacuuccaaagg

SEQ ID NO: 1943809 - RNA, 22 nt, Homo sapiens
cauagcauuagcugcuuccucc

SEQ ID NO: 1943810 - RNA, 10 nt, Homo sapiens
cucaugccug

SEQ ID NO: 1943811 - RNA, 22 nt, Homo sapiens
auuuuucauugugagacacuaa

SEQ ID NO: 1943812 - RNA, 15 nt, Homo sapiens
cugcagagcaggaaa

SEQ ID NO: 1943813 - RNA, 19 nt, Homo sapiens
uacuuuuaugcaaccauaa

SEQ ID NO: 1943814 - RNA, 17 nt, Homo sapiens
aucucaccuucagucaa

SEQ ID NO: 1943815 - RNA, 21 nt, Homo sapiens
ggacaaaucuaaaaugcaaag

SEQ ID NO: 1943816 - RNA, 21 nt, Homo sapiens
aggacuguugugguacuggca

SEQ ID NO: 1943817 - RNA, 14 nt, Homo sapiens
aacccaaucugcac

SEQ ID NO: 1943818 - RNA, 16 nt, Homo sapiens
agaaaaugagacaaaa

SEQ ID NO: 1943819 - RNA, 23 nt, Homo sapiens
gauuuagcccaugacguguuucu

SEQ ID NO: 1943820 - RNA, 21 nt, Homo sapiens
ugcaaauccuugauacugcuc

SEQ ID NO: 1943821 - RNA, 13 nt, Homo sapiens
gcucaaagggaac

SEQ ID NO: 1943822 - RNA, 19 nt, Homo sapiens
gcagagggcaggggugcug

SEQ ID NO: 1943823 - RNA, 19 nt, Homo sapiens
augcuguuuguagugaaau

SEQ ID NO: 1943824 - RNA, 16 nt, Homo sapiens
ccccaaggcugcaaag

SEQ ID NO: 1943825 - RNA, 14 nt, Homo sapiens
gaccuuccucgcag

SEQ ID NO: 1943826 - RNA, 14 nt, Homo sapiens
aagauuuggugggu

SEQ ID NO: 1943827 - RNA, 17 nt, Homo sapiens
ucacauccugggaucca

SEQ ID NO: 1943828 - RNA, 17 nt, Homo sapiens
gcacuuuggggguuuga

SEQ ID NO: 1943829 - RNA, 21 nt, Homo sapiens
ccaccuugaucccaauccuua

SEQ ID NO: 1943830 - RNA, 13 nt, Homo sapiens
acccagaccugcc

SEQ ID NO: 1943831 - RNA, 12 nt, Homo sapiens
guuuccuaacag

SEQ ID NO: 1943832 - RNA, 13 nt, Homo sapiens
uggugguucucag

SEQ ID NO: 1943833 - RNA, 16 nt, Homo sapiens
aaaggcccaaagguga

SEQ ID NO: 1943834 - RNA, 20 nt, Homo sapiens
gcccugaauccauaaaggca

SEQ ID NO: 1943835 - RNA, 15 nt, Homo sapiens
uaauugacacuauau

SEQ ID NO: 1943836 - RNA, 15 nt, Homo sapiens
uagcacaguauuuaa

SEQ ID NO: 1943837 - RNA, 19 nt, Homo sapiens
cuuccagggauuugccuca

SEQ ID NO: 1943838 - RNA, 20 nt, Homo sapiens
aauacuagcuaacuaauucu

SEQ ID NO: 1943839 - RNA, 13 nt, Homo sapiens
aacaaugaagaua

SEQ ID NO: 1943840 - RNA, 20 nt, Homo sapiens
acggaaugaccagaaaauuu

SEQ ID NO: 1943841 - RNA, 19 nt, Homo sapiens
cuaaugugguuauuucucu

SEQ ID NO: 1943842 - RNA, 16 nt, Homo sapiens
ucuaagaugauucaaa

SEQ ID NO: 1943843 - RNA, 16 nt, Homo sapiens
aagucccuugagacuc

SEQ ID NO: 1943844 - RNA, 16 nt, Homo sapiens
cagacugucaagaaga

SEQ ID NO: 1943845 - RNA, 15 nt, Homo sapiens
uucaaggaucuccug

SEQ ID NO: 1943846 - RNA, 19 nt, Homo sapiens
uggcugggggccucagugc

SEQ ID NO: 1943847 - RNA, 22 nt, Homo sapiens
aacgucauguguuuugccaaag

SEQ ID NO: 1943848 - RNA, 15 nt, Homo sapiens
cugugugagcaucuc

SEQ ID NO: 1943849 - RNA, 16 nt, Homo sapiens
aaucuauuauacugua

SEQ ID NO: 1943850 - RNA, 20 nt, Homo sapiens
uaacaaaaaagcuaacccag

SEQ ID NO: 1943851 - RNA, 19 nt, Homo sapiens
auuauguuuugugauucaa

SEQ ID NO: 1943852 - RNA, 15 nt, Homo sapiens
gacaagcaacccaaa

SEQ ID NO: 1943853 - RNA, 20 nt, Homo sapiens
cagcuuuccucaucaggcca

SEQ ID NO: 1943854 - RNA, 22 nt, Homo sapiens
uguaccucacuguccaauauga

SEQ ID NO: 1943855 - RNA, 17 nt, Homo sapiens
aacuuuuuaaguuauug

SEQ ID NO: 1943856 - RNA, 14 nt, Homo sapiens
ggacaugugcuauu

SEQ ID NO: 1943857 - RNA, 20 nt, Homo sapiens
auagcauugauaaucuucag

SEQ ID NO: 1943858 - RNA, 19 nt, Homo sapiens
aaucgcuuuccuuccuccc

SEQ ID NO: 1943859 - RNA, 17 nt, Homo sapiens
cuaaacacaaauuguga

SEQ ID NO: 1943860 - RNA, 15 nt, Homo sapiens
auuguaaguaccccu

SEQ ID NO: 1943861 - RNA, 20 nt, Homo sapiens
cuaaauaaaaaaaugaauau

SEQ ID NO: 1943862 - RNA, 16 nt, Homo sapiens
cgaucaggaccugcuu

SEQ ID NO: 1943863 - RNA, 15 nt, Homo sapiens
auuuuugcuuagcuc

SEQ ID NO: 1943864 - RNA, 15 nt, Homo sapiens
ugugcggcagauugc

SEQ ID NO: 1943865 - RNA, 16 nt, Homo sapiens
ucuauuuaaauaaagu

SEQ ID NO: 1943866 - RNA, 22 nt, Homo sapiens
cuuaacaacugacuaaccauug

SEQ ID NO: 1943867 - RNA, 23 nt, Homo sapiens
uagaaggacucaguauuauuuca

SEQ ID NO: 1943868 - RNA, 23 nt, Homo sapiens
agggguuaaagcagacagucaca

SEQ ID NO: 1943869 - RNA, 19 nt, Homo sapiens
aucaugugaaaucauucau

SEQ ID NO: 1943870 - RNA, 16 nt, Homo sapiens
agcugucgcaucucag

SEQ ID NO: 1943871 - RNA, 13 nt, Homo sapiens
uaaagguccauga

SEQ ID NO: 1943872 - RNA, 20 nt, Homo sapiens
uuggcaaacucuccaccaca

SEQ ID NO: 1943873 - RNA, 16 nt, Homo sapiens
ugguccuccacuuugc

SEQ ID NO: 1943874 - RNA, 12 nt, Homo sapiens
gaaccaggccag

SEQ ID NO: 1943875 - RNA, 21 nt, Homo sapiens
guagagacgguguuuugccau

SEQ ID NO: 1943876 - RNA, 17 nt, Homo sapiens
auaacuaauuugcucug

SEQ ID NO: 1943877 - RNA, 17 nt, Homo sapiens
uacacucaaccaugacc

SEQ ID NO: 1943878 - RNA, 15 nt, Homo sapiens
gaaauugaauuucca

SEQ ID NO: 1943879 - RNA, 13 nt, Homo sapiens
acugcugcaaagc

SEQ ID NO: 1943880 - RNA, 15 nt, Homo sapiens
agugaaaaaaacaac

SEQ ID NO: 1943881 - RNA, 12 nt, Homo sapiens
uguaaaccaaag

SEQ ID NO: 1943882 - RNA, 20 nt, Homo sapiens
aaaacuauccugauuccaaa

SEQ ID NO: 1943883 - RNA, 18 nt, Homo sapiens
ucccagguuuagugaaaa

SEQ ID NO: 1943884 - RNA, 21 nt, Homo sapiens
gagccacaagcugcacuguga

SEQ ID NO: 1943885 - RNA, 18 nt, Homo sapiens
uucuccugaaaacuuuag

SEQ ID NO: 1943886 - RNA, 13 nt, Homo sapiens
ccccgcaaagaca

SEQ ID NO: 1943887 - RNA, 19 nt, Homo sapiens
aacuguacaguuucuuccc

SEQ ID NO: 1943888 - RNA, 19 nt, Homo sapiens
acucuaaaacuaucagcag

SEQ ID NO: 1943889 - RNA, 21 nt, Homo sapiens
auucaagagccagcaggucaa

SEQ ID NO: 1943890 - RNA, 19 nt, Homo sapiens
ugggccguaucugucacaa

SEQ ID NO: 1943891 - RNA, 15 nt, Homo sapiens
ucaaggccucccaca

SEQ ID NO: 1943892 - RNA, 13 nt, Homo sapiens
cuuuccagggauc

SEQ ID NO: 1943893 - RNA, 21 nt, Homo sapiens
gaaguuuuaaauuuugacaag

SEQ ID NO: 1943894 - RNA, 18 nt, Homo sapiens
aaacggagugcgucaugc

SEQ ID NO: 1943895 - RNA, 23 nt, Homo sapiens
aauccaucacuagccaugauaac

SEQ ID NO: 1943896 - RNA, 12 nt, Homo sapiens
ucacaaugcauu

SEQ ID NO: 1943897 - RNA, 21 nt, Homo sapiens
auaucuuagguaagacauaua

SEQ ID NO: 1943898 - RNA, 19 nt, Homo sapiens
gcuuugcauuuaugauuuc

SEQ ID NO: 1943899 - RNA, 20 nt, Homo sapiens
acucaguaacacagugcagu

SEQ ID NO: 1943900 - RNA, 12 nt, Homo sapiens
auaaauugugaa

SEQ ID NO: 1943901 - RNA, 15 nt, Homo sapiens
uuacaugauucauuu

SEQ ID NO: 1943902 - RNA, 14 nt, Homo sapiens
cuauugcuaguacu

SEQ ID NO: 1943903 - RNA, 21 nt, Homo sapiens
uggguuuucuccauucaggau

SEQ ID NO: 1943904 - RNA, 16 nt, Homo sapiens
auccgcgugugccugu

SEQ ID NO: 1943905 - RNA, 15 nt, Homo sapiens
ugcagugagcuauua

SEQ ID NO: 1943906 - RNA, 16 nt, Homo sapiens
uugauauuuuaggaua

SEQ ID NO: 1943907 - RNA, 21 nt, Homo sapiens
gcuggcgggcccuggagcuca

SEQ ID NO: 1943908 - RNA, 19 nt, Homo sapiens
uccuucccucucaugacuu

SEQ ID NO: 1943909 - RNA, 18 nt, Homo sapiens
gaucacacacaugcacac

SEQ ID NO: 1943910 - RNA, 19 nt, Homo sapiens
aggagccaacauaacagau

SEQ ID NO: 1943911 - RNA, 20 nt, Homo sapiens
uuaaaacguagaggauuuau

SEQ ID NO: 1943912 - RNA, 20 nt, Homo sapiens
gaauauugcugcugguucuc

SEQ ID NO: 1943913 - RNA, 23 nt, Homo sapiens
gugccugggggaguuuuccucua

SEQ ID NO: 1943914 - RNA, 18 nt, Homo sapiens
acacagaugaaacacaaa

SEQ ID NO: 1943915 - RNA, 16 nt, Homo sapiens
cacagagggcgcuccu

SEQ ID NO: 1943916 - RNA, 21 nt, Homo sapiens
caggguuuugccauguugccc

SEQ ID NO: 1943917 - RNA, 22 nt, Homo sapiens
ggacaccauagugucacagaga

SEQ ID NO: 1943918 - RNA, 17 nt, Homo sapiens
uauuaauuucuucacac

SEQ ID NO: 1943919 - RNA, 23 nt, Homo sapiens
cagcaguugcuagcaacaacuua

SEQ ID NO: 1943920 - RNA, 23 nt, Homo sapiens
uaaacuacuauuuuucuuuccaa

SEQ ID NO: 1943921 - RNA, 20 nt, Homo sapiens
gccugaagauauuacuacuu

SEQ ID NO: 1943922 - RNA, 18 nt, Homo sapiens
acaugcccuguucagcua

SEQ ID NO: 1943923 - RNA, 23 nt, Homo sapiens
aaggggcagcuccugaccaaaga

SEQ ID NO: 1943924 - RNA, 12 nt, Homo sapiens
agagaaaagcca

SEQ ID NO: 1943925 - RNA, 14 nt, Homo sapiens
acugaaggcuuuca

SEQ ID NO: 1943926 - RNA, 15 nt, Homo sapiens
uucaaacuacuuugc

SEQ ID NO: 1943927 - RNA, 17 nt, Homo sapiens
accaaaucaucucucau

SEQ ID NO: 1943928 - RNA, 13 nt, Homo sapiens
ggcagucagagga

SEQ ID NO: 1943929 - RNA, 17 nt, Homo sapiens
uaagaauucaguagcau

SEQ ID NO: 1943930 - RNA, 19 nt, Homo sapiens
cgaugcacacgcacauaga

SEQ ID NO: 1943931 - RNA, 17 nt, Homo sapiens
cacaaaugcaccuccca

SEQ ID NO: 1943932 - RNA, 17 nt, Homo sapiens
agguuagggcucugccc

SEQ ID NO: 1943933 - RNA, 22 nt, Homo sapiens
ucuggccccucucaggcugugc

SEQ ID NO: 1943934 - RNA, 18 nt, Homo sapiens
acaaauuauaaaaaccau

SEQ ID NO: 1943935 - RNA, 23 nt, Homo sapiens
agccuccacuuuggaucaggaaa

SEQ ID NO: 1943936 - RNA, 15 nt, Homo sapiens
ugcucuuuugugaug

SEQ ID NO: 1943937 - RNA, 15 nt, Homo sapiens
aacuauguaaugcuu

SEQ ID NO: 1943938 - RNA, 15 nt, Homo sapiens
uaaucucacuacaca

SEQ ID NO: 1943939 - RNA, 20 nt, Homo sapiens
uuuagaacuuuggcugccuu

SEQ ID NO: 1943940 - RNA, 12 nt, Homo sapiens
ucaucugucagc

SEQ ID NO: 1943941 - RNA, 18 nt, Homo sapiens
cgaagcggagagagccaa

SEQ ID NO: 1943942 - RNA, 22 nt, Homo sapiens
ccauggacacuacacccagcaa

SEQ ID NO: 1943943 - RNA, 12 nt, Homo sapiens
ucuaacuuuaug

SEQ ID NO: 1943944 - RNA, 12 nt, Homo sapiens
ccagacuucaaa

SEQ ID NO: 1943945 - RNA, 19 nt, Homo sapiens
cacugacaaugggcacaca

SEQ ID NO: 1943946 - RNA, 13 nt, Homo sapiens
guaaauacaguag

SEQ ID NO: 1943947 - RNA, 16 nt, Homo sapiens
ugcagccuuugccuuu

SEQ ID NO: 1943948 - RNA, 21 nt, Homo sapiens
gccacacccagaguagccaug

SEQ ID NO: 1943949 - RNA, 15 nt, Homo sapiens
caacaucuuacuugu

SEQ ID NO: 1943950 - RNA, 14 nt, Homo sapiens
agugaauacauuaa

SEQ ID NO: 1943951 - RNA, 22 nt, Homo sapiens
ggagcaugcuuaccuucugcug

SEQ ID NO: 1943952 - RNA, 14 nt, Homo sapiens
cacacuucucagga

SEQ ID NO: 1943953 - RNA, 19 nt, Homo sapiens
aucucugguugucuaguca

SEQ ID NO: 1943954 - RNA, 13 nt, Homo sapiens
augucucugcaaa

SEQ ID NO: 1943955 - RNA, 20 nt, Homo sapiens
gucaagcuguugaagucuca

SEQ ID NO: 1943956 - RNA, 15 nt, Homo sapiens
ugcacugcccuguuc

SEQ ID NO: 1943957 - RNA, 17 nt, Homo sapiens
cauaagauaaaugugcu

SEQ ID NO: 1943958 - RNA, 15 nt, Homo sapiens
cuuuaagaacuaaaa

SEQ ID NO: 1943959 - RNA, 20 nt, Homo sapiens
cucagugagcuggggccguc

SEQ ID NO: 1943960 - RNA, 13 nt, Homo sapiens
uuguaguuuauaa

SEQ ID NO: 1943961 - RNA, 17 nt, Homo sapiens
aucacuagccaugauaa

SEQ ID NO: 1943962 - RNA, 21 nt, Homo sapiens
agcauuguuucuagauuagcu

SEQ ID NO: 1943963 - RNA, 19 nt, Homo sapiens
gcacagcccacacaugaac

SEQ ID NO: 1943964 - RNA, 12 nt, Homo sapiens
gagucaucaugg

SEQ ID NO: 1943965 - RNA, 14 nt, Homo sapiens
uggagggacaggga

SEQ ID NO: 1943966 - RNA, 23 nt, Homo sapiens
agcuagcaaauaguaaucuguaa

SEQ ID NO: 1943967 - RNA, 22 nt, Homo sapiens
acuucaucaguguggcuucuau

SEQ ID NO: 1943968 - RNA, 18 nt, Homo sapiens
cauuuagaacuugcagcu

SEQ ID NO: 1943969 - RNA, 23 nt, Homo sapiens
aacagccuucuagcacacuuuuu

SEQ ID NO: 1943970 - RNA, 16 nt, Homo sapiens
uucaccuacauuaucu

SEQ ID NO: 1943971 - RNA, 13 nt, Homo sapiens
cucucacauuaag

SEQ ID NO: 1943972 - RNA, 22 nt, Homo sapiens
ucuaccgggaggacagcugccu

SEQ ID NO: 1943973 - RNA, 23 nt, Homo sapiens
cuuuuuuuuuuuuuucaguuuuu

SEQ ID NO: 1943974 - RNA, 22 nt, Homo sapiens
aagauuauuccugguaaaggag

SEQ ID NO: 1943975 - RNA, 18 nt, Homo sapiens
uuucuuuaaugucuaaga

SEQ ID NO: 1943976 - RNA, 15 nt, Homo sapiens
auugaccuacuuugg

SEQ ID NO: 1943977 - RNA, 18 nt, Homo sapiens
ugcaggucaaaagucaga

SEQ ID NO: 1943978 - RNA, 14 nt, Homo sapiens
uagcaucucagguu

SEQ ID NO: 1943979 - RNA, 17 nt, Homo sapiens
ggauguaauacauuucu

SEQ ID NO: 1943980 - RNA, 11 nt, Homo sapiens
gacaacaaaga

SEQ ID NO: 1943981 - RNA, 13 nt, Homo sapiens
gagggaagccuga

SEQ ID NO: 1943982 - RNA, 18 nt, Homo sapiens
cauuuaaauuguuucucu

SEQ ID NO: 1943983 - RNA, 16 nt, Homo sapiens
gacagcaaagucucca

SEQ ID NO: 1943984 - RNA, 21 nt, Homo sapiens
cgcccccagaacauacacugu

SEQ ID NO: 1943985 - RNA, 16 nt, Homo sapiens
ugcaguauuuuauuaa

SEQ ID NO: 1943986 - RNA, 12 nt, Homo sapiens
gcccugaugacc

SEQ ID NO: 1943987 - RNA, 12 nt, Homo sapiens
gauuugaugcuu

SEQ ID NO: 1943988 - RNA, 15 nt, Homo sapiens
caaaauuccaucccu

SEQ ID NO: 1943989 - RNA, 17 nt, Homo sapiens
aucuaacuguuguuacu

SEQ ID NO: 1943990 - RNA, 17 nt, Homo sapiens
agggaccacccucccug

SEQ ID NO: 1943991 - RNA, 17 nt, Homo sapiens
gagaguuccucuuugcc

SEQ ID NO: 1943992 - RNA, 16 nt, Homo sapiens
auguguagaccuugau

SEQ ID NO: 1943993 - RNA, 13 nt, Homo sapiens
aguaauuguaagu

SEQ ID NO: 1943994 - RNA, 10 nt, Homo sapiens
ugcuugccau

SEQ ID NO: 1943995 - RNA, 16 nt, Homo sapiens
aaugaaugcuauugaa

SEQ ID NO: 1943996 - RNA, 17 nt, Homo sapiens
uauaggaaaaaaacugg

SEQ ID NO: 1943997 - RNA, 20 nt, Homo sapiens
caaguuccugaacaugauga

SEQ ID NO: 1943998 - RNA, 20 nt, Homo sapiens
cuucaggaaaauaaauauca

SEQ ID NO: 1943999 - RNA, 18 nt, Homo sapiens
uggugacaccucaccuca

SEQ ID NO: 1944000 - RNA, 14 nt, Homo sapiens
ugguggaccacagg

SEQ ID NO: 1944001 - RNA, 13 nt, Homo sapiens
aaauuacaacaga

SEQ ID NO: 1944002 - RNA, 16 nt, Homo sapiens
uaauucucaugugauc

SEQ ID NO: 1944003 - RNA, 14 nt, Homo sapiens
aagaagcugugaca

SEQ ID NO: 1944004 - RNA, 17 nt, Homo sapiens
ugguucgugcugugcuc

SEQ ID NO: 1944005 - RNA, 13 nt, Homo sapiens
cucuuaaguacca

SEQ ID NO: 1944006 - RNA, 15 nt, Homo sapiens
cuugaguuauuaaaa

SEQ ID NO: 1944007 - RNA, 19 nt, Homo sapiens
cuuuugcuguuuauuaaaa

SEQ ID NO: 1944008 - RNA, 18 nt, Homo sapiens
guucuuacagcacaucac

SEQ ID NO: 1944009 - RNA, 14 nt, Homo sapiens
cuuaccacugugga

SEQ ID NO: 1944010 - RNA, 22 nt, Homo sapiens
auguaggagcugcaguucuugu

SEQ ID NO: 1944011 - RNA, 15 nt, Homo sapiens
ucuucccuugcucau

SEQ ID NO: 1944012 - RNA, 16 nt, Homo sapiens
ccacccacgggggaga

SEQ ID NO: 1944013 - RNA, 20 nt, Homo sapiens
agagugagcaagggggccca

SEQ ID NO: 1944014 - RNA, 14 nt, Homo sapiens
acagugaauccaga

SEQ ID NO: 1944015 - RNA, 17 nt, Homo sapiens
cucaggguucaucugaa

SEQ ID NO: 1944016 - RNA, 15 nt, Homo sapiens
caguccaucucaagu

SEQ ID NO: 1944017 - RNA, 19 nt, Homo sapiens
aaugcugaugaaaacuguc

SEQ ID NO: 1944018 - RNA, 18 nt, Homo sapiens
ccggccaggugggcgggg

SEQ ID NO: 1944019 - RNA, 21 nt, Homo sapiens
ugagccuggccauguccucaa

SEQ ID NO: 1944020 - RNA, 18 nt, Homo sapiens
ugcagaaugggagaaaau

SEQ ID NO: 1944021 - RNA, 14 nt, Homo sapiens
agucaaagcuuugc

SEQ ID NO: 1944022 - RNA, 21 nt, Homo sapiens
augcaagcaagaaacacuggg

SEQ ID NO: 1944023 - RNA, 17 nt, Homo sapiens
uccauuucaugugaucu

SEQ ID NO: 1944024 - RNA, 22 nt, Homo sapiens
cagaggaacaaaccaggggaca

SEQ ID NO: 1944025 - RNA, 16 nt, Homo sapiens
acacccuuucuugaca

SEQ ID NO: 1944026 - RNA, 22 nt, Homo sapiens
uaaccaguuuuuucaccuccau

SEQ ID NO: 1944027 - RNA, 23 nt, Homo sapiens
cauuaauuucaaucaaccaaagu

SEQ ID NO: 1944028 - RNA, 13 nt, Homo sapiens
agcgaagaccagu

SEQ ID NO: 1944029 - RNA, 14 nt, Homo sapiens
cuuaggcaugacug

SEQ ID NO: 1944030 - RNA, 12 nt, Homo sapiens
cucuuuuacuaa

SEQ ID NO: 1944031 - RNA, 20 nt, Homo sapiens
caauuuuaaaaugaaaugca

SEQ ID NO: 1944032 - RNA, 17 nt, Homo sapiens
ugaaaugaaugucugag

SEQ ID NO: 1944033 - RNA, 15 nt, Homo sapiens
guagugcaccaucuc

SEQ ID NO: 1944034 - RNA, 22 nt, Homo sapiens
augacuacgucccgugucucca

SEQ ID NO: 1944035 - RNA, 13 nt, Homo sapiens
augcuuuucccac

SEQ ID NO: 1944036 - RNA, 15 nt, Homo sapiens
uuauuguaccuaagu

SEQ ID NO: 1944037 - RNA, 15 nt, Homo sapiens
agcuugccugccugc

SEQ ID NO: 1944038 - RNA, 13 nt, Homo sapiens
agccaccgugccc

SEQ ID NO: 1944039 - RNA, 21 nt, Homo sapiens
uuccucguuuugaaagcaguu

SEQ ID NO: 1944040 - RNA, 18 nt, Homo sapiens
aacauuggcuacaaagac

SEQ ID NO: 1944041 - RNA, 19 nt, Homo sapiens
guuauuuuaaaaaaauuca

SEQ ID NO: 1944042 - RNA, 14 nt, Homo sapiens
acuucccucaggcc

SEQ ID NO: 1944043 - RNA, 17 nt, Homo sapiens
ucccggguucaugccau

SEQ ID NO: 1944044 - RNA, 13 nt, Homo sapiens
uguuuuaaagcac

SEQ ID NO: 1944045 - RNA, 21 nt, Homo sapiens
ucaguuuuacucugcugcaaa

SEQ ID NO: 1944046 - RNA, 19 nt, Homo sapiens
ugcuuaaauugugggcaaa

SEQ ID NO: 1944047 - RNA, 19 nt, Homo sapiens
gggagcagagagagccaga

SEQ ID NO: 1944048 - RNA, 18 nt, Homo sapiens
acagauguuguaagagaa

SEQ ID NO: 1944049 - RNA, 21 nt, Homo sapiens
cauggugggagagacugugag

SEQ ID NO: 1944050 - RNA, 13 nt, Homo sapiens
acugucauuagaa

SEQ ID NO: 1944051 - RNA, 22 nt, Homo sapiens
caccggccaagaugcuuuucaa

SEQ ID NO: 1944052 - RNA, 15 nt, Homo sapiens
aacaaguaugaaucu

SEQ ID NO: 1944053 - RNA, 14 nt, Homo sapiens
cuagccggagugac

SEQ ID NO: 1944054 - RNA, 19 nt, Homo sapiens
acaaucuaagggucucuca

SEQ ID NO: 1944055 - RNA, 23 nt, Homo sapiens
aaaucuguaucuguagugagaua

SEQ ID NO: 1944056 - RNA, 19 nt, Homo sapiens
caggagaugggugcaacuc

SEQ ID NO: 1944057 - RNA, 18 nt, Homo sapiens
gcacguccuccaccggug

SEQ ID NO: 1944058 - RNA, 16 nt, Homo sapiens
uccaaucuccaucacc

SEQ ID NO: 1944059 - RNA, 17 nt, Homo sapiens
ucaacaaauuucauugc

SEQ ID NO: 1944060 - RNA, 14 nt, Homo sapiens
uauuaaucucugug

SEQ ID NO: 1944061 - RNA, 15 nt, Homo sapiens
gugauuuuggucucu

SEQ ID NO: 1944062 - RNA, 12 nt, Homo sapiens
agcacagccuca

SEQ ID NO: 1944063 - RNA, 15 nt, Homo sapiens
caggucaugcugcug

SEQ ID NO: 1944064 - RNA, 14 nt, Homo sapiens
gccagcugccagua

SEQ ID NO: 1944065 - RNA, 22 nt, Homo sapiens
gugccucccacccuucucaggg

SEQ ID NO: 1944066 - RNA, 18 nt, Homo sapiens
cuuggacuuguucgugcc

SEQ ID NO: 1944067 - RNA, 18 nt, Homo sapiens
gaacauugguucuuucau

SEQ ID NO: 1944068 - RNA, 19 nt, Homo sapiens
aauugggauaaacaucaca

SEQ ID NO: 1944069 - RNA, 14 nt, Homo sapiens
uacaguaagcauag

SEQ ID NO: 1944070 - RNA, 12 nt, Homo sapiens
uaucugucauuc

SEQ ID NO: 1944071 - RNA, 15 nt, Homo sapiens
uggggaauauacgug

SEQ ID NO: 1944072 - RNA, 20 nt, Homo sapiens
uccacuggaaaaggugaaaa

SEQ ID NO: 1944073 - RNA, 18 nt, Homo sapiens
aacugauuuuuagcuuua

SEQ ID NO: 1944074 - RNA, 20 nt, Homo sapiens
cuuaguguuguggacacugc

SEQ ID NO: 1944075 - RNA, 15 nt, Homo sapiens
cuuuacuccguaaca

SEQ ID NO: 1944076 - RNA, 19 nt, Homo sapiens
cuuuguucacuagacugug

SEQ ID NO: 1944077 - RNA, 19 nt, Homo sapiens
uuaaacuucuuaacuggca

SEQ ID NO: 1944078 - RNA, 21 nt, Homo sapiens
cuccccggaguucaguuuuac

SEQ ID NO: 1944079 - RNA, 18 nt, Homo sapiens
aaguauccagucauugua

SEQ ID NO: 1944080 - RNA, 17 nt, Homo sapiens
auucauuucauagccaa

SEQ ID NO: 1944081 - RNA, 13 nt, Homo sapiens
auaaaguauuuaa

SEQ ID NO: 1944082 - RNA, 18 nt, Homo sapiens
caaguuguuuauguauca

SEQ ID NO: 1944083 - RNA, 17 nt, Homo sapiens
aguucauccgcacugua

SEQ ID NO: 1944084 - RNA, 13 nt, Homo sapiens
gaucgcuccgccg

SEQ ID NO: 1944085 - RNA, 13 nt, Homo sapiens
guuucuguucacc

SEQ ID NO: 1944086 - RNA, 19 nt, Homo sapiens
uccccaugcccacggaugc

SEQ ID NO: 1944087 - RNA, 19 nt, Homo sapiens
acccaucccaccccuccau

SEQ ID NO: 1944088 - RNA, 20 nt, Homo sapiens
uguagcauuucuugauguug

SEQ ID NO: 1944089 - RNA, 17 nt, Homo sapiens
cugaccuuaaaugcaac

SEQ ID NO: 1944090 - RNA, 23 nt, Homo sapiens
uuucaaaaaguaaucauauauca

SEQ ID NO: 1944091 - RNA, 18 nt, Homo sapiens
gcauaaucaauauaaucu

SEQ ID NO: 1944092 - RNA, 17 nt, Homo sapiens
agacugacaaccucauc

SEQ ID NO: 1944093 - RNA, 14 nt, Homo sapiens
cacugcguuagaug

SEQ ID NO: 1944094 - RNA, 15 nt, Homo sapiens
acagaccugcaguga

SEQ ID NO: 1944095 - RNA, 20 nt, Homo sapiens
cuugguaacaaauaaccuau

SEQ ID NO: 1944096 - RNA, 23 nt, Homo sapiens
uuucagauuuuuuauuugaaggu

SEQ ID NO: 1944097 - RNA, 23 nt, Homo sapiens
ugucacuucgcgugcccucgcug

SEQ ID NO: 1944098 - RNA, 16 nt, Homo sapiens
ugcagauuauuugccc

SEQ ID NO: 1944099 - RNA, 13 nt, Homo sapiens
caaugugauaugu

SEQ ID NO: 1944100 - RNA, 16 nt, Homo sapiens
cuuugcugugaaggga

SEQ ID NO: 1944101 - RNA, 20 nt, Homo sapiens
aguccagaaccccugucaca

SEQ ID NO: 1944102 - RNA, 23 nt, Homo sapiens
cugugccaacuacuacuggugau

SEQ ID NO: 1944103 - RNA, 15 nt, Homo sapiens
gagcaaucacaggaa

SEQ ID NO: 1944104 - RNA, 15 nt, Homo sapiens
aggcaauccuaccuu

SEQ ID NO: 1944105 - RNA, 21 nt, Homo sapiens
uuuuaggaugugggaguaaaa

SEQ ID NO: 1944106 - RNA, 19 nt, Homo sapiens
guaagcauuuguacaucuu

SEQ ID NO: 1944107 - RNA, 14 nt, Homo sapiens
cacccauugucuca

SEQ ID NO: 1944108 - RNA, 14 nt, Homo sapiens
guuucauucaucca

SEQ ID NO: 1944109 - RNA, 20 nt, Homo sapiens
guccuuuaaucacugcauuu

SEQ ID NO: 1944110 - RNA, 21 nt, Homo sapiens
acagcucugggcuuccucgga

SEQ ID NO: 1944111 - RNA, 15 nt, Homo sapiens
uaaaaauaaagggaa

SEQ ID NO: 1944112 - RNA, 15 nt, Homo sapiens
agcuaauuagcucuc

SEQ ID NO: 1944113 - RNA, 21 nt, Homo sapiens
cuuaaacucuggacacucuau

SEQ ID NO: 1944114 - RNA, 23 nt, Homo sapiens
uccuuugaguuauaguuugcuuu

SEQ ID NO: 1944115 - RNA, 15 nt, Homo sapiens
gucucauuucaauau

SEQ ID NO: 1944116 - RNA, 19 nt, Homo sapiens
gaaacuuuuuccaccuuuc

SEQ ID NO: 1944117 - RNA, 21 nt, Homo sapiens
guuaaugcuuucccacucuca

SEQ ID NO: 1944118 - RNA, 16 nt, Homo sapiens
ucuuugcuaguaccaa

SEQ ID NO: 1944119 - RNA, 18 nt, Homo sapiens
accucaggcagaggaugu

SEQ ID NO: 1944120 - RNA, 22 nt, Homo sapiens
aaaaugucucaguuuucagcua

SEQ ID NO: 1944121 - RNA, 19 nt, Homo sapiens
cucccuuguggcuuccuca

SEQ ID NO: 1944122 - RNA, 15 nt, Homo sapiens
uacacacuguuguca

SEQ ID NO: 1944123 - RNA, 23 nt, Homo sapiens
aagggaagcccagccugcaucua

SEQ ID NO: 1944124 - RNA, 17 nt, Homo sapiens
aucuaauuacaucauga

SEQ ID NO: 1944125 - RNA, 22 nt, Homo sapiens
ucucccuuggguaaaaugaagg

SEQ ID NO: 1944126 - RNA, 16 nt, Homo sapiens
cuuuagccauacacau

SEQ ID NO: 1944127 - RNA, 23 nt, Homo sapiens
ccuguauaaguggaggcacuuua

SEQ ID NO: 1944128 - RNA, 16 nt, Homo sapiens
uagcugcaaguguauc

SEQ ID NO: 1944129 - RNA, 14 nt, Homo sapiens
ccauaauguuacau

SEQ ID NO: 1944130 - RNA, 23 nt, Homo sapiens
uacacaaggaaggcauuuggacc

SEQ ID NO: 1944131 - RNA, 17 nt, Homo sapiens
aaacugcuuacuuaugc

SEQ ID NO: 1944132 - RNA, 16 nt, Homo sapiens
acaaagcgagauccca

SEQ ID NO: 1944133 - RNA, 12 nt, Homo sapiens
aucauuaacagu

SEQ ID NO: 1944134 - RNA, 17 nt, Homo sapiens
augccgcccccagcagc

SEQ ID NO: 1944135 - RNA, 16 nt, Homo sapiens
aaaaccaacaccauca

SEQ ID NO: 1944136 - RNA, 16 nt, Homo sapiens
acacaucucccaccau

SEQ ID NO: 1944137 - RNA, 17 nt, Homo sapiens
cuuuucccacuccaagc

SEQ ID NO: 1944138 - RNA, 19 nt, Homo sapiens
ugucuuucagccaagccaa

SEQ ID NO: 1944139 - RNA, 18 nt, Homo sapiens
uggauuuucugaacaagc

SEQ ID NO: 1944140 - RNA, 13 nt, Homo sapiens
ggcaaaguacaaa

SEQ ID NO: 1944141 - RNA, 13 nt, Homo sapiens
agaucagugccuc

SEQ ID NO: 1944142 - RNA, 19 nt, Homo sapiens
cuuucccuccuuggugauu

SEQ ID NO: 1944143 - RNA, 19 nt, Homo sapiens
cagccuagauaugaagaau

SEQ ID NO: 1944144 - RNA, 13 nt, Homo sapiens
aacucccacuccu

SEQ ID NO: 1944145 - RNA, 16 nt, Homo sapiens
cuggucccucuucucu

SEQ ID NO: 1944146 - RNA, 21 nt, Homo sapiens
caugcuuagcaguccccuucc

SEQ ID NO: 1944147 - RNA, 19 nt, Homo sapiens
augaugagcuccucuuccu

SEQ ID NO: 1944148 - RNA, 16 nt, Homo sapiens
cuuuuccuggacacuu

SEQ ID NO: 1944149 - RNA, 11 nt, Homo sapiens
agaagcucucg

SEQ ID NO: 1944150 - RNA, 14 nt, Homo sapiens
aaguaaacucagca

SEQ ID NO: 1944151 - RNA, 17 nt, Homo sapiens
aagcaaaaacgaaagcu

SEQ ID NO: 1944152 - RNA, 13 nt, Homo sapiens
ugaaauccaaaau

SEQ ID NO: 1944153 - RNA, 17 nt, Homo sapiens
gugugacagacuccgaa

SEQ ID NO: 1944154 - RNA, 20 nt, Homo sapiens
uggagucuugcaagacccag

SEQ ID NO: 1944155 - RNA, 21 nt, Homo sapiens
ggaaacguuuuguauaguuau

SEQ ID NO: 1944156 - RNA, 13 nt, Homo sapiens
ggcacaacuggaa

SEQ ID NO: 1944157 - RNA, 16 nt, Homo sapiens
ggaacuguguauuuau

SEQ ID NO: 1944158 - RNA, 15 nt, Homo sapiens
cuacauugugcugca

SEQ ID NO: 1944159 - RNA, 16 nt, Homo sapiens
guuugauauuuuguaa

SEQ ID NO: 1944160 - RNA, 21 nt, Homo sapiens
uuaccagcaacuugaacuuca

SEQ ID NO: 1944161 - RNA, 18 nt, Homo sapiens
uuucaaccagcacauucg

SEQ ID NO: 1944162 - RNA, 14 nt, Homo sapiens
ucucccucucugca

SEQ ID NO: 1944163 - RNA, 18 nt, Homo sapiens
uaugcuccaguauggaag

SEQ ID NO: 1944164 - RNA, 12 nt, Homo sapiens
cagaggacucac

SEQ ID NO: 1944165 - RNA, 15 nt, Homo sapiens
cugucauaacaucca

SEQ ID NO: 1944166 - RNA, 23 nt, Homo sapiens
ucggccaguuuucggaaacacug

SEQ ID NO: 1944167 - RNA, 19 nt, Homo sapiens
ugaucucggcucauguagc

SEQ ID NO: 1944168 - RNA, 15 nt, Homo sapiens
ccucaaaaagauuuc

SEQ ID NO: 1944169 - RNA, 11 nt, Homo sapiens
gaaacauuuau

SEQ ID NO: 1944170 - RNA, 19 nt, Homo sapiens
ugcccaggaaccucagggc

SEQ ID NO: 1944171 - RNA, 17 nt, Homo sapiens
gaggccaccuaugccag

SEQ ID NO: 1944172 - RNA, 19 nt, Homo sapiens
gcuugcgcauucucaugga

SEQ ID NO: 1944173 - RNA, 19 nt, Homo sapiens
cugcauggagugagcagua

SEQ ID NO: 1944174 - RNA, 16 nt, Homo sapiens
acucuuauuucacuaa

SEQ ID NO: 1944175 - RNA, 19 nt, Homo sapiens
gaccaggggcccuaccugg

SEQ ID NO: 1944176 - RNA, 22 nt, Homo sapiens
acaggacacagucagauuucca

SEQ ID NO: 1944177 - RNA, 21 nt, Homo sapiens
uaugccaccccaugugccuuu

SEQ ID NO: 1944178 - RNA, 19 nt, Homo sapiens
aucagcuggacauacugcu

SEQ ID NO: 1944179 - RNA, 19 nt, Homo sapiens
gcaccgagagagauggaau

SEQ ID NO: 1944180 - RNA, 15 nt, Homo sapiens
aaggugucuuuauga

SEQ ID NO: 1944181 - RNA, 21 nt, Homo sapiens
uuucagccuacauugaugcca

SEQ ID NO: 1944182 - RNA, 23 nt, Homo sapiens
uacuuugaacaaccaaaugugca

SEQ ID NO: 1944183 - RNA, 23 nt, Homo sapiens
ugcuuccagaccuaggcucaugg

SEQ ID NO: 1944184 - RNA, 19 nt, Homo sapiens
acuacagccaaauugcaga

SEQ ID NO: 1944185 - RNA, 18 nt, Homo sapiens
ugaaacccuugagcucaa

SEQ ID NO: 1944186 - RNA, 22 nt, Homo sapiens
gaaaguucccccaucaguuccc

SEQ ID NO: 1944187 - RNA, 21 nt, Homo sapiens
uuuggauaaguugugauuuga

SEQ ID NO: 1944188 - RNA, 14 nt, Homo sapiens
uucuuuuccuaaca

SEQ ID NO: 1944189 - RNA, 15 nt, Homo sapiens
ggucuccuugcacuu

SEQ ID NO: 1944190 - RNA, 18 nt, Homo sapiens
aagugccuucagccaaga

SEQ ID NO: 1944191 - RNA, 22 nt, Homo sapiens
gacauguagguaggaagcacug

SEQ ID NO: 1944192 - RNA, 15 nt, Homo sapiens
acgauuaacugugaa

SEQ ID NO: 1944193 - RNA, 20 nt, Homo sapiens
augccacccacaucuuccau

SEQ ID NO: 1944194 - RNA, 23 nt, Homo sapiens
uguucuacuuuuugguacaggua

SEQ ID NO: 1944195 - RNA, 14 nt, Homo sapiens
ucagugcaguuucu

SEQ ID NO: 1944196 - RNA, 18 nt, Homo sapiens
gugcacagaccucagaga

SEQ ID NO: 1944197 - RNA, 16 nt, Homo sapiens
gccuacuucugagcaa

SEQ ID NO: 1944198 - RNA, 13 nt, Homo sapiens
aggccaucuguaa

SEQ ID NO: 1944199 - RNA, 20 nt, Homo sapiens
acgccugaaacuuugaggau

SEQ ID NO: 1944200 - RNA, 15 nt, Homo sapiens
aaaucugcacaguca

SEQ ID NO: 1944201 - RNA, 23 nt, Homo sapiens
uuuaaguuuggcaaacagaaugu

SEQ ID NO: 1944202 - RNA, 16 nt, Homo sapiens
accacggcagcucucc

SEQ ID NO: 1944203 - RNA, 17 nt, Homo sapiens
gcaaaagcucuguguaa

SEQ ID NO: 1944204 - RNA, 17 nt, Homo sapiens
aacaauaaaugaaugaa

SEQ ID NO: 1944205 - RNA, 16 nt, Homo sapiens
cugguccuggagacaa

SEQ ID NO: 1944206 - RNA, 17 nt, Homo sapiens
cucuaugaucuuggcac

SEQ ID NO: 1944207 - RNA, 17 nt, Homo sapiens
cuacagcuacauugaga

SEQ ID NO: 1944208 - RNA, 12 nt, Homo sapiens
caagaacagaaa

SEQ ID NO: 1944209 - RNA, 16 nt, Homo sapiens
gcauaaaaaacaugug

SEQ ID NO: 1944210 - RNA, 18 nt, Homo sapiens
ccaggacaauuagaaaaa

SEQ ID NO: 1944211 - RNA, 14 nt, Homo sapiens
uacagcacuacucu

SEQ ID NO: 1944212 - RNA, 21 nt, Homo sapiens
gaaagaucccaagucaaacag

SEQ ID NO: 1944213 - RNA, 19 nt, Homo sapiens
cuaaaaugcuucacuguac

SEQ ID NO: 1944214 - RNA, 15 nt, Homo sapiens
gaagaagcagcguua

SEQ ID NO: 1944215 - RNA, 19 nt, Homo sapiens
gacuaguugaacaucucac

SEQ ID NO: 1944216 - RNA, 21 nt, Homo sapiens
uaaaccuagggagguugaaga

SEQ ID NO: 1944217 - RNA, 18 nt, Homo sapiens
acagcaagacuccgucuc

SEQ ID NO: 1944218 - RNA, 21 nt, Homo sapiens
cacacagugaaacgcaauuuu

SEQ ID NO: 1944219 - RNA, 15 nt, Homo sapiens
augcucccucugugu

SEQ ID NO: 1944220 - RNA, 17 nt, Homo sapiens
ucgcaaggccugugcug

SEQ ID NO: 1944221 - RNA, 15 nt, Homo sapiens
cuucacagauuguuc

SEQ ID NO: 1944222 - RNA, 20 nt, Homo sapiens
caggacacaggccuguguag

SEQ ID NO: 1944223 - RNA, 17 nt, Homo sapiens
cuaacuuaacauugcau

SEQ ID NO: 1944224 - RNA, 20 nt, Homo sapiens
aguuugccaccccuguccag

SEQ ID NO: 1944225 - RNA, 14 nt, Homo sapiens
aacaggcuugaauc

SEQ ID NO: 1944226 - RNA, 15 nt, Homo sapiens
cagcugcuuugacaa

SEQ ID NO: 1944227 - RNA, 16 nt, Homo sapiens
aauauuuucagcaaaa

SEQ ID NO: 1944228 - RNA, 14 nt, Homo sapiens
aaggauauuuacua

SEQ ID NO: 1944229 - RNA, 20 nt, Homo sapiens
cucaauucuuuguauaugca

SEQ ID NO: 1944230 - RNA, 17 nt, Homo sapiens
uaaaaacugagugacuc

SEQ ID NO: 1944231 - RNA, 19 nt, Homo sapiens
ccucugauuucaguucacu

SEQ ID NO: 1944232 - RNA, 16 nt, Homo sapiens
gaaugcuugcuguaau

SEQ ID NO: 1944233 - RNA, 16 nt, Homo sapiens
aguccccuuaagccaa

SEQ ID NO: 1944234 - RNA, 17 nt, Homo sapiens
cauuugguacacacuug

SEQ ID NO: 1944235 - RNA, 19 nt, Homo sapiens
caucuaauaaguauauaau

SEQ ID NO: 1944236 - RNA, 18 nt, Homo sapiens
cuggcaggccagugucug

SEQ ID NO: 1944237 - RNA, 19 nt, Homo sapiens
cuacuucccaguaacccua

SEQ ID NO: 1944238 - RNA, 17 nt, Homo sapiens
uaaaauuucaggauuaa

SEQ ID NO: 1944239 - RNA, 17 nt, Homo sapiens
gaccacuuccaggggaa

SEQ ID NO: 1944240 - RNA, 14 nt, Homo sapiens
cuccccacccaaga

SEQ ID NO: 1944241 - RNA, 15 nt, Homo sapiens
ccacuuuuugcagcu

SEQ ID NO: 1944242 - RNA, 20 nt, Homo sapiens
aaacagaaagcauccuaaau

SEQ ID NO: 1944243 - RNA, 22 nt, Homo sapiens
auccccuuuggcuaccugaugg

SEQ ID NO: 1944244 - RNA, 23 nt, Homo sapiens
cagugccaggccagugaccucau

SEQ ID NO: 1944245 - RNA, 19 nt, Homo sapiens
aaaaaagaacaacugccaa

SEQ ID NO: 1944246 - RNA, 14 nt, Homo sapiens
ccaucugacaaaau

SEQ ID NO: 1944247 - RNA, 13 nt, Homo sapiens
caagaaugugcag

SEQ ID NO: 1944248 - RNA, 20 nt, Homo sapiens
uguucugugucacgugaccc

SEQ ID NO: 1944249 - RNA, 18 nt, Homo sapiens
cuauugcugcucucucac

SEQ ID NO: 1944250 - RNA, 20 nt, Homo sapiens
aggaguacaaugcccagauc

SEQ ID NO: 1944251 - RNA, 17 nt, Homo sapiens
uaccuaccacagugucu

SEQ ID NO: 1944252 - RNA, 21 nt, Homo sapiens
cugggguuggacuguaaggga

SEQ ID NO: 1944253 - RNA, 23 nt, Homo sapiens
aacguggauugugaagauuucau

SEQ ID NO: 1944254 - RNA, 21 nt, Homo sapiens
caguauuccaaacucuccagc

SEQ ID NO: 1944255 - RNA, 20 nt, Homo sapiens
cauucaguuaucacuacaga

SEQ ID NO: 1944256 - RNA, 15 nt, Homo sapiens
guaauuuuucuggga

SEQ ID NO: 1944257 - RNA, 19 nt, Homo sapiens
ucaagagaagcacaugaaa

SEQ ID NO: 1944258 - RNA, 17 nt, Homo sapiens
gccaagaauacuugaag

SEQ ID NO: 1944259 - RNA, 9 nt, Homo sapiens
uucucugcu

SEQ ID NO: 1944260 - RNA, 19 nt, Homo sapiens
acgcagcccugggggccag

SEQ ID NO: 1944261 - RNA, 18 nt, Homo sapiens
gcacacuccccugcacug

SEQ ID NO: 1944262 - RNA, 17 nt, Homo sapiens
ucuugcucuaucucuca

SEQ ID NO: 1944263 - RNA, 19 nt, Homo sapiens
uaaagcaagcuaucugcac

SEQ ID NO: 1944264 - RNA, 16 nt, Homo sapiens
cuuuauugacuaccug

SEQ ID NO: 1944265 - RNA, 19 nt, Homo sapiens
ccucucucccuggaccuca

SEQ ID NO: 1944266 - RNA, 22 nt, Homo sapiens
aggaaaccacagcugcuggaga

SEQ ID NO: 1944267 - RNA, 14 nt, Homo sapiens
uaaaaacuuccauc

SEQ ID NO: 1944268 - RNA, 13 nt, Homo sapiens
uaguucugccagg

SEQ ID NO: 1944269 - RNA, 24 nt, Homo sapiens
uaauuuaguaaauaaacaagucaa

SEQ ID NO: 1944270 - RNA, 18 nt, Homo sapiens
caggaggguaacagaaga

SEQ ID NO: 1944271 - RNA, 20 nt, Homo sapiens
gacuccaccaagccugguca

SEQ ID NO: 1944272 - RNA, 19 nt, Homo sapiens
auuuugggguuguguuguc

SEQ ID NO: 1944273 - RNA, 15 nt, Homo sapiens
cucucaauaugcuua

SEQ ID NO: 1944274 - RNA, 15 nt, Homo sapiens
gugcuggagccacua

SEQ ID NO: 1944275 - RNA, 18 nt, Homo sapiens
auaagacugucauguaag

SEQ ID NO: 1944276 - RNA, 22 nt, Homo sapiens
uccauucccaaaauaacugaga

SEQ ID NO: 1944277 - RNA, 21 nt, Homo sapiens
aacucuucgaagccuugccua

SEQ ID NO: 1944278 - RNA, 18 nt, Homo sapiens
auacuguuuccuaugaca

SEQ ID NO: 1944279 - RNA, 14 nt, Homo sapiens
acccagauucugaa

SEQ ID NO: 1944280 - RNA, 20 nt, Homo sapiens
ggggguuacagcuguucuga

SEQ ID NO: 1944281 - RNA, 21 nt, Homo sapiens
aagauuauaauaugugccuua

SEQ ID NO: 1944282 - RNA, 21 nt, Homo sapiens
cagccccauccuucccgcagc

SEQ ID NO: 1944283 - RNA, 16 nt, Homo sapiens
augccuccagguuuau

SEQ ID NO: 1944284 - RNA, 20 nt, Homo sapiens
ccucugccagcgccaaaaca

SEQ ID NO: 1944285 - RNA, 14 nt, Homo sapiens
agauggacagagaa

SEQ ID NO: 1944286 - RNA, 18 nt, Homo sapiens
uaccacaagccugagaac

SEQ ID NO: 1944287 - RNA, 16 nt, Homo sapiens
augaaaaaagucucca

SEQ ID NO: 1944288 - RNA, 18 nt, Homo sapiens
cacugccgagaacagcau

SEQ ID NO: 1944289 - RNA, 18 nt, Homo sapiens
uugacaguugcagaauug

SEQ ID NO: 1944290 - RNA, 23 nt, Homo sapiens
gggaacucaucaaauaaucacaa

SEQ ID NO: 1944291 - RNA, 17 nt, Homo sapiens
aaucuaaggauaaugaa

SEQ ID NO: 1944292 - RNA, 16 nt, Homo sapiens
aacaguuuuugcuaau

SEQ ID NO: 1944293 - RNA, 20 nt, Homo sapiens
uaacauaaaauaaucgucuc

SEQ ID NO: 1944294 - RNA, 16 nt, Homo sapiens
uccuuuuguauccucc

SEQ ID NO: 1944295 - RNA, 19 nt, Homo sapiens
guuguuaauaaaaguacau

SEQ ID NO: 1944296 - RNA, 14 nt, Homo sapiens
uacugaacaguauu

SEQ ID NO: 1944297 - RNA, 22 nt, Homo sapiens
aguggucaccuuccucagcuca

SEQ ID NO: 1944298 - RNA, 14 nt, Homo sapiens
uuacuuccaugaua

SEQ ID NO: 1944299 - RNA, 18 nt, Homo sapiens
caucuguaaaucuacaca

SEQ ID NO: 1944300 - RNA, 23 nt, Homo sapiens
uuuuauggggcccuguccaggua

SEQ ID NO: 1944301 - RNA, 20 nt, Homo sapiens
acuauggagugcaccaaaga

SEQ ID NO: 1944302 - RNA, 15 nt, Homo sapiens
cauaucacuaugaac

SEQ ID NO: 1944303 - RNA, 23 nt, Homo sapiens
ucauccaugcagauaacagcugg

SEQ ID NO: 1944304 - RNA, 18 nt, Homo sapiens
ugaccucauuuacaaagc

SEQ ID NO: 1944305 - RNA, 19 nt, Homo sapiens
cagccuguucucugacuaa

SEQ ID NO: 1944306 - RNA, 23 nt, Homo sapiens
cuaaguugcugggauuacaggug

SEQ ID NO: 1944307 - RNA, 15 nt, Homo sapiens
ccuguggugcaaaag

SEQ ID NO: 1944308 - RNA, 22 nt, Homo sapiens
augagaauuugagugcucugau

SEQ ID NO: 1944309 - RNA, 19 nt, Homo sapiens
gcgaggacauucucugacc

SEQ ID NO: 1944310 - RNA, 13 nt, Homo sapiens
aguuacuggcaca

SEQ ID NO: 1944311 - RNA, 11 nt, Homo sapiens
ugagcacugac

SEQ ID NO: 1944312 - RNA, 19 nt, Homo sapiens
ccauggcaccuucagacuu

SEQ ID NO: 1944313 - RNA, 17 nt, Homo sapiens
cuuuuugggcuuucaua

SEQ ID NO: 1944314 - RNA, 14 nt, Homo sapiens
aauggcuccuucac

SEQ ID NO: 1944315 - RNA, 20 nt, Homo sapiens
gugagaacuacucagggaau

SEQ ID NO: 1944316 - RNA, 13 nt, Homo sapiens
acuucucuagaga

SEQ ID NO: 1944317 - RNA, 18 nt, Homo sapiens
auguuuuccuucuacuua

SEQ ID NO: 1944318 - RNA, 23 nt, Homo sapiens
acccuuuuuugaaccaacaucuu

SEQ ID NO: 1944319 - RNA, 15 nt, Homo sapiens
cuauggaaugguuau

SEQ ID NO: 1944320 - RNA, 21 nt, Homo sapiens
ggugcuauuuuuauacaguga

SEQ ID NO: 1944321 - RNA, 19 nt, Homo sapiens
cugagugacggaccagcuc

SEQ ID NO: 1944322 - RNA, 23 nt, Homo sapiens
uucugcaaaguguaugugaccau

SEQ ID NO: 1944323 - RNA, 22 nt, Homo sapiens
cuaccuguaggaucagggucua

SEQ ID NO: 1944324 - RNA, 14 nt, Homo sapiens
uccauccuggucag

SEQ ID NO: 1944325 - RNA, 22 nt, Homo sapiens
aaaacaguuuuccaaauaacau

SEQ ID NO: 1944326 - RNA, 22 nt, Homo sapiens
gcaauuguacaaaaaaguuaua

SEQ ID NO: 1944327 - RNA, 23 nt, Homo sapiens
aaagcagugcaugcugucccuua

SEQ ID NO: 1944328 - RNA, 13 nt, Homo sapiens
acaagcucagcuc

SEQ ID NO: 1944329 - RNA, 21 nt, Homo sapiens
aauaaauggcuguaaaaucuc

SEQ ID NO: 1944330 - RNA, 23 nt, Homo sapiens
gugccacccuccucccuccaagc

SEQ ID NO: 1944331 - RNA, 17 nt, Homo sapiens
ggucgcggagguccugc

SEQ ID NO: 1944332 - RNA, 15 nt, Homo sapiens
ucaugugaugcuaug

SEQ ID NO: 1944333 - RNA, 15 nt, Homo sapiens
aauagaacaaccugc

SEQ ID NO: 1944334 - RNA, 14 nt, Homo sapiens
uugaaagaugcagu

SEQ ID NO: 1944335 - RNA, 12 nt, Homo sapiens
cccagggggaga

SEQ ID NO: 1944336 - RNA, 20 nt, Homo sapiens
guuauaacagggaacagcaa

SEQ ID NO: 1944337 - RNA, 14 nt, Homo sapiens
uccauuuggacaaa

SEQ ID NO: 1944338 - RNA, 16 nt, Homo sapiens
uaauaugguaaugcac

SEQ ID NO: 1944339 - RNA, 16 nt, Homo sapiens
cauucuagguuugcaa

SEQ ID NO: 1944340 - RNA, 13 nt, Homo sapiens
agagaaaguguga

SEQ ID NO: 1944341 - RNA, 14 nt, Homo sapiens
gaggaaauagggcu

SEQ ID NO: 1944342 - RNA, 14 nt, Homo sapiens
agcacagauguucc

SEQ ID NO: 1944343 - RNA, 18 nt, Homo sapiens
ucagaaggauggcauuuu

SEQ ID NO: 1944344 - RNA, 14 nt, Homo sapiens
guguccugcaccgg

SEQ ID NO: 1944345 - RNA, 19 nt, Homo sapiens
ugccacccaguugugacaa

SEQ ID NO: 1944346 - RNA, 14 nt, Homo sapiens
uccgccaaacacuc

SEQ ID NO: 1944347 - RNA, 12 nt, Homo sapiens
aaucccagcucc

SEQ ID NO: 1944348 - RNA, 19 nt, Homo sapiens
gucuucguagguugugaug

SEQ ID NO: 1944349 - RNA, 17 nt, Homo sapiens
cagagcagugacccauc

SEQ ID NO: 1944350 - RNA, 18 nt, Homo sapiens
auuaaaaagugugacuuu

SEQ ID NO: 1944351 - RNA, 17 nt, Homo sapiens
gaccacuguuaucaaaa

SEQ ID NO: 1944352 - RNA, 22 nt, Homo sapiens
ucaccaaggacguuaaaggcau

SEQ ID NO: 1944353 - RNA, 18 nt, Homo sapiens
agaagccuuaauuugcac

SEQ ID NO: 1944354 - RNA, 15 nt, Homo sapiens
caagggacccaugag

SEQ ID NO: 1944355 - RNA, 10 nt, Homo sapiens
auaauuuugu

SEQ ID NO: 1944356 - RNA, 23 nt, Homo sapiens
ggauuuuaaguuugggccaguga

SEQ ID NO: 1944357 - RNA, 23 nt, Homo sapiens
ugugcaugagaaugucauuugcu

SEQ ID NO: 1944358 - RNA, 13 nt, Homo sapiens
cagacccagugag

SEQ ID NO: 1944359 - RNA, 22 nt, Homo sapiens
caaaaagaauuccaaccgacca

SEQ ID NO: 1944360 - RNA, 14 nt, Homo sapiens
gacaaaacaauccc

SEQ ID NO: 1944361 - RNA, 22 nt, Homo sapiens
ucggccacccgccucccucuca

SEQ ID NO: 1944362 - RNA, 19 nt, Homo sapiens
auaugccucauacacauaa

SEQ ID NO: 1944363 - RNA, 15 nt, Homo sapiens
ugagacuccaccuca

SEQ ID NO: 1944364 - RNA, 15 nt, Homo sapiens
gaugacccuuuucau

SEQ ID NO: 1944365 - RNA, 16 nt, Homo sapiens
ugagggaucacugcca

SEQ ID NO: 1944366 - RNA, 12 nt, Homo sapiens
ugugaccuugac

SEQ ID NO: 1944367 - RNA, 20 nt, Homo sapiens
ucaaauaaagaaauuuggua

SEQ ID NO: 1944368 - RNA, 17 nt, Homo sapiens
caaauagccagugcuag

SEQ ID NO: 1944369 - RNA, 20 nt, Homo sapiens
gcccaucagccauuugccau

SEQ ID NO: 1944370 - RNA, 14 nt, Homo sapiens
agacaugugacauu

SEQ ID NO: 1944371 - RNA, 18 nt, Homo sapiens
ucugucaccgccaugcaa

SEQ ID NO: 1944372 - RNA, 19 nt, Homo sapiens
caggacugugccuccauaa

SEQ ID NO: 1944373 - RNA, 21 nt, Homo sapiens
cauucaaagggacggucaguu

SEQ ID NO: 1944374 - RNA, 19 nt, Homo sapiens
cuucuggguucaagcgauu

SEQ ID NO: 1944375 - RNA, 22 nt, Homo sapiens
aaccucacaaaguagaggaauc

SEQ ID NO: 1944376 - RNA, 14 nt, Homo sapiens
guuaucaguuaaca

SEQ ID NO: 1944377 - RNA, 13 nt, Homo sapiens
ucccaaucccauu

SEQ ID NO: 1944378 - RNA, 19 nt, Homo sapiens
augcccagcacaauucauu

SEQ ID NO: 1944379 - RNA, 14 nt, Homo sapiens
agaaacuuugugcu

SEQ ID NO: 1944380 - RNA, 14 nt, Homo sapiens
auucuauguuauca

SEQ ID NO: 1944381 - RNA, 19 nt, Homo sapiens
aggaccaacccaugcccug

SEQ ID NO: 1944382 - RNA, 20 nt, Homo sapiens
caaguugcaucagaaagcuu

SEQ ID NO: 1944383 - RNA, 18 nt, Homo sapiens
gaaacaccccucugucua

SEQ ID NO: 1944384 - RNA, 12 nt, Homo sapiens
uuuaaggcuaaa

SEQ ID NO: 1944385 - RNA, 17 nt, Homo sapiens
uuauucaguaacuguca

SEQ ID NO: 1944386 - RNA, 15 nt, Homo sapiens
caggggguucuggga

SEQ ID NO: 1944387 - RNA, 16 nt, Homo sapiens
uuggccucaaguucaa

SEQ ID NO: 1944388 - RNA, 14 nt, Homo sapiens
aaguauccagaccu

SEQ ID NO: 1944389 - RNA, 16 nt, Homo sapiens
cacuugacagacugua

SEQ ID NO: 1944390 - RNA, 13 nt, Homo sapiens
guugugacugcca

SEQ ID NO: 1944391 - RNA, 15 nt, Homo sapiens
ucagcuuuugccuuu

SEQ ID NO: 1944392 - RNA, 22 nt, Homo sapiens
uggggcagacaauaaacccuca

SEQ ID NO: 1944393 - RNA, 21 nt, Homo sapiens
gcaauagggugcaguuuucca

SEQ ID NO: 1944394 - RNA, 22 nt, Homo sapiens
ugaguagcugagacuacaggug

SEQ ID NO: 1944395 - RNA, 16 nt, Homo sapiens
uauguucccucuuguc

SEQ ID NO: 1944396 - RNA, 17 nt, Homo sapiens
cucgucugucaaugaca

SEQ ID NO: 1944397 - RNA, 16 nt, Homo sapiens
ggcggcccacacccag

SEQ ID NO: 1944398 - RNA, 18 nt, Homo sapiens
uauugaaaagguuaacag

SEQ ID NO: 1944399 - RNA, 21 nt, Homo sapiens
ggaggcuugccccacccaaca

SEQ ID NO: 1944400 - RNA, 18 nt, Homo sapiens
aaauagacagucaggcua

SEQ ID NO: 1944401 - RNA, 17 nt, Homo sapiens
uugccaccagaaaccac

SEQ ID NO: 1944402 - RNA, 13 nt, Homo sapiens
aucuuaacaaagc

SEQ ID NO: 1944403 - RNA, 22 nt, Homo sapiens
ucuguuugcacacccagcauag

SEQ ID NO: 1944404 - RNA, 22 nt, Homo sapiens
cuguacuccagccugggugaca

SEQ ID NO: 1944405 - RNA, 23 nt, Homo sapiens
cucacuggucaaaaccuacacag

SEQ ID NO: 1944406 - RNA, 15 nt, Homo sapiens
gaagucuacuuuguc

SEQ ID NO: 1944407 - RNA, 17 nt, Homo sapiens
auauucuggcccaggga

SEQ ID NO: 1944408 - RNA, 22 nt, Homo sapiens
uauagucacaauccacaaauga

SEQ ID NO: 1944409 - RNA, 18 nt, Homo sapiens
uaauugguuuaguucuua

SEQ ID NO: 1944410 - RNA, 22 nt, Homo sapiens
aaacgauuccgccacacauccu

SEQ ID NO: 1944411 - RNA, 13 nt, Homo sapiens
uugagauggaguc

SEQ ID NO: 1944412 - RNA, 23 nt, Homo sapiens
guaaagccucagcaacagccagu

SEQ ID NO: 1944413 - RNA, 13 nt, Homo sapiens
gucaggcugccag

SEQ ID NO: 1944414 - RNA, 14 nt, Homo sapiens
gcugagguggcaga

SEQ ID NO: 1944415 - RNA, 18 nt, Homo sapiens
cagucuugcaacagugcc

SEQ ID NO: 1944416 - RNA, 13 nt, Homo sapiens
aucagugugcuaa

SEQ ID NO: 1944417 - RNA, 14 nt, Homo sapiens
auuccaggaugcug

SEQ ID NO: 1944418 - RNA, 13 nt, Homo sapiens
acagauaacugcu

SEQ ID NO: 1944419 - RNA, 16 nt, Homo sapiens
acuagccagacacucu

SEQ ID NO: 1944420 - RNA, 17 nt, Homo sapiens
cugcucuucugugccca

SEQ ID NO: 1944421 - RNA, 18 nt, Homo sapiens
augggacacccaacacuu

SEQ ID NO: 1944422 - RNA, 16 nt, Homo sapiens
gugcuuuuugucaugu

SEQ ID NO: 1944423 - RNA, 12 nt, Homo sapiens
cacucagucucu

SEQ ID NO: 1944424 - RNA, 12 nt, Homo sapiens
aauacaguauua

SEQ ID NO: 1944425 - RNA, 20 nt, Homo sapiens
ccaaguucuucaccucuauc

SEQ ID NO: 1944426 - RNA, 15 nt, Homo sapiens
aggcuggcaucuccc

SEQ ID NO: 1944427 - RNA, 22 nt, Homo sapiens
accauggccaccccagagccau

SEQ ID NO: 1944428 - RNA, 12 nt, Homo sapiens
aauaucauguua

SEQ ID NO: 1944429 - RNA, 23 nt, Homo sapiens
auauuuguauauuacacauuugu

SEQ ID NO: 1944430 - RNA, 18 nt, Homo sapiens
cucagucauaaucauuag

SEQ ID NO: 1944431 - RNA, 16 nt, Homo sapiens
uaacauuucuguucuc

SEQ ID NO: 1944432 - RNA, 17 nt, Homo sapiens
ccagcccaagugaggca

SEQ ID NO: 1944433 - RNA, 22 nt, Homo sapiens
acugaaaacaguaaaacaggcu

SEQ ID NO: 1944434 - RNA, 14 nt, Homo sapiens
ccccagccauccag

SEQ ID NO: 1944435 - RNA, 14 nt, Homo sapiens
ccuuccccauuucc

SEQ ID NO: 1944436 - RNA, 19 nt, Homo sapiens
auacugcaauuaaagugau

SEQ ID NO: 1944437 - RNA, 19 nt, Homo sapiens
ucauggugacuaacaguua

SEQ ID NO: 1944438 - RNA, 14 nt, Homo sapiens
ucaaaugcauuuug

SEQ ID NO: 1944439 - RNA, 16 nt, Homo sapiens
uggggaggagggggcc

SEQ ID NO: 1944440 - RNA, 14 nt, Homo sapiens
gcagaccugacucu

SEQ ID NO: 1944441 - RNA, 13 nt, Homo sapiens
agcuauguauuaa

SEQ ID NO: 1944442 - RNA, 23 nt, Homo sapiens
agaccagacucgccaacauggug

SEQ ID NO: 1944443 - RNA, 16 nt, Homo sapiens
guaauaguucuauccu

SEQ ID NO: 1944444 - RNA, 20 nt, Homo sapiens
cccaguggauggcugaaggu

SEQ ID NO: 1944445 - RNA, 17 nt, Homo sapiens
ccagagcugugccugcu

SEQ ID NO: 1944446 - RNA, 16 nt, Homo sapiens
cccggcaaugggaccu

SEQ ID NO: 1944447 - RNA, 18 nt, Homo sapiens
ucugaaaauuaacacugc

SEQ ID NO: 1944448 - RNA, 18 nt, Homo sapiens
guucugggaaacugaaac

SEQ ID NO: 1944449 - RNA, 15 nt, Homo sapiens
uccaggcaguucucu

SEQ ID NO: 1944450 - RNA, 13 nt, Homo sapiens
gcuguugcauggg

SEQ ID NO: 1944451 - RNA, 12 nt, Homo sapiens
gccaaagagcuc

SEQ ID NO: 1944452 - RNA, 12 nt, Homo sapiens
uguccucagggg

SEQ ID NO: 1944453 - RNA, 12 nt, Homo sapiens
auuugcacuuau

SEQ ID NO: 1944454 - RNA, 18 nt, Homo sapiens
auggucaggggugagacc

SEQ ID NO: 1944455 - RNA, 20 nt, Homo sapiens
uaugccuugguaaaaacugc

SEQ ID NO: 1944456 - RNA, 16 nt, Homo sapiens
ccauucagucaaguga

SEQ ID NO: 1944457 - RNA, 13 nt, Homo sapiens
ucugaauuccaag

SEQ ID NO: 1944458 - RNA, 13 nt, Homo sapiens
uuaagauucuuga

SEQ ID NO: 1944459 - RNA, 13 nt, Homo sapiens
aaggggcugagga

SEQ ID NO: 1944460 - RNA, 18 nt, Homo sapiens
auaaaguguaaguucaca

SEQ ID NO: 1944461 - RNA, 22 nt, Homo sapiens
aaaucagagagggaagaucugg

SEQ ID NO: 1944462 - RNA, 13 nt, Homo sapiens
ccacaggacccag

SEQ ID NO: 1944463 - RNA, 15 nt, Homo sapiens
aauaauucuaugaga

SEQ ID NO: 1944464 - RNA, 22 nt, Homo sapiens
uuuauggaaaaugucaggccuu

SEQ ID NO: 1944465 - RNA, 15 nt, Homo sapiens
agccgagaucaugcc

SEQ ID NO: 1944466 - RNA, 17 nt, Homo sapiens
cuauuuucugaccaaaa

SEQ ID NO: 1944467 - RNA, 15 nt, Homo sapiens
acuuugggaccugcu

SEQ ID NO: 1944468 - RNA, 14 nt, Homo sapiens
gaggauaugggugg

SEQ ID NO: 1944469 - RNA, 19 nt, Homo sapiens
acuggguacccaaaacaca

SEQ ID NO: 1944470 - RNA, 12 nt, Homo sapiens
cacacaauggca

SEQ ID NO: 1944471 - RNA, 21 nt, Homo sapiens
gcaaugucucuuugugcucua

SEQ ID NO: 1944472 - RNA, 17 nt, Homo sapiens
ugugacaccaccacugu

SEQ ID NO: 1944473 - RNA, 22 nt, Homo sapiens
gguccuggccuugugucacugg

SEQ ID NO: 1944474 - RNA, 15 nt, Homo sapiens
cacaggcagcuucca

SEQ ID NO: 1944475 - RNA, 15 nt, Homo sapiens
aaagugcagcccuuc

SEQ ID NO: 1944476 - RNA, 14 nt, Homo sapiens
cacuacauuacuuc

SEQ ID NO: 1944477 - RNA, 21 nt, Homo sapiens
acuuucucuaggaaucaaagu

SEQ ID NO: 1944478 - RNA, 21 nt, Homo sapiens
aauaaaacccacaagugucua

SEQ ID NO: 1944479 - RNA, 17 nt, Homo sapiens
auuguauuugugacuuu

SEQ ID NO: 1944480 - RNA, 18 nt, Homo sapiens
agggacagcugcauucca

SEQ ID NO: 1944481 - RNA, 23 nt, Homo sapiens
cuguaacccuggcacuuaagggg

SEQ ID NO: 1944482 - RNA, 11 nt, Homo sapiens
auaaucccagc

SEQ ID NO: 1944483 - RNA, 15 nt, Homo sapiens
auuuuaugcuuuaaa

SEQ ID NO: 1944484 - RNA, 16 nt, Homo sapiens
ucuuugguucuaagga

SEQ ID NO: 1944485 - RNA, 18 nt, Homo sapiens
cuauuaguuuucuuugua

SEQ ID NO: 1944486 - RNA, 16 nt, Homo sapiens
acccaguuagcucuca

SEQ ID NO: 1944487 - RNA, 21 nt, Homo sapiens
agaaguugcugcuugugaucu

SEQ ID NO: 1944488 - RNA, 16 nt, Homo sapiens
guagcaaguacuuugg

SEQ ID NO: 1944489 - RNA, 13 nt, Homo sapiens
cugucacugaugg

SEQ ID NO: 1944490 - RNA, 15 nt, Homo sapiens
aaaucaacagaagca

SEQ ID NO: 1944491 - RNA, 17 nt, Homo sapiens
ugaacuccaccgaccaa

SEQ ID NO: 1944492 - RNA, 20 nt, Homo sapiens
gaaaacuaggcaauguacuc

SEQ ID NO: 1944493 - RNA, 21 nt, Homo sapiens
uguaacugagagaaagauucu

SEQ ID NO: 1944494 - RNA, 14 nt, Homo sapiens
cucaucagccuuuu

SEQ ID NO: 1944495 - RNA, 19 nt, Homo sapiens
acuuuguaauucuaauaau

SEQ ID NO: 1944496 - RNA, 16 nt, Homo sapiens
ucaggagaaaaagccu

SEQ ID NO: 1944497 - RNA, 19 nt, Homo sapiens
agaauucacuuuaccuuca

SEQ ID NO: 1944498 - RNA, 20 nt, Homo sapiens
guggagccccacacuggggu

SEQ ID NO: 1944499 - RNA, 19 nt, Homo sapiens
cuguccuagagaucuaugg

SEQ ID NO: 1944500 - RNA, 23 nt, Homo sapiens
auucaaucaaccugcacuucaua

SEQ ID NO: 1944501 - RNA, 20 nt, Homo sapiens
gcuggucucaaacuccugag

SEQ ID NO: 1944502 - RNA, 23 nt, Homo sapiens
aaucauugagaaauaaagcacau

SEQ ID NO: 1944503 - RNA, 17 nt, Homo sapiens
guuauuagacaauucca

SEQ ID NO: 1944504 - RNA, 12 nt, Homo sapiens
aauaaagccucu

SEQ ID NO: 1944505 - RNA, 21 nt, Homo sapiens
gcucuauuuauuaagaacuau

SEQ ID NO: 1944506 - RNA, 13 nt, Homo sapiens
ccaggaaugccuc

SEQ ID NO: 1944507 - RNA, 18 nt, Homo sapiens
ccagaaagaggcagugau

SEQ ID NO: 1944508 - RNA, 13 nt, Homo sapiens
cuccacauauuuc

SEQ ID NO: 1944509 - RNA, 15 nt, Homo sapiens
aucuccugcugccuu

SEQ ID NO: 1944510 - RNA, 15 nt, Homo sapiens
aucucuggagugugu

SEQ ID NO: 1944511 - RNA, 19 nt, Homo sapiens
agacugcugggacuggcca

SEQ ID NO: 1944512 - RNA, 18 nt, Homo sapiens
augauguauacccauaaa

SEQ ID NO: 1944513 - RNA, 19 nt, Homo sapiens
gggagaggggagugcauuu

SEQ ID NO: 1944514 - RNA, 14 nt, Homo sapiens
accaauucuaacag

SEQ ID NO: 1944515 - RNA, 17 nt, Homo sapiens
uaaguguucaguguuga

SEQ ID NO: 1944516 - RNA, 22 nt, Homo sapiens
uauuuacagauaacuucuuuag

SEQ ID NO: 1944517 - RNA, 14 nt, Homo sapiens
aaaagcacaaucac

SEQ ID NO: 1944518 - RNA, 21 nt, Homo sapiens
agaaacuuaucuuacaaagug

SEQ ID NO: 1944519 - RNA, 12 nt, Homo sapiens
aucuccaugugu

SEQ ID NO: 1944520 - RNA, 21 nt, Homo sapiens
acuggauguggccccacccuu

SEQ ID NO: 1944521 - RNA, 15 nt, Homo sapiens
uacucccauuuuccc

SEQ ID NO: 1944522 - RNA, 23 nt, Homo sapiens
cucuaggcuucagguugcauugg

SEQ ID NO: 1944523 - RNA, 21 nt, Homo sapiens
caagaguuucaaaacauacaa

SEQ ID NO: 1944524 - RNA, 20 nt, Homo sapiens
guccuuuugugaaaucagua

SEQ ID NO: 1944525 - RNA, 15 nt, Homo sapiens
gcuugaagccaaaga

SEQ ID NO: 1944526 - RNA, 15 nt, Homo sapiens
auacaugugccgaau

SEQ ID NO: 1944527 - RNA, 17 nt, Homo sapiens
gcaaagcuggagaugag

SEQ ID NO: 1944528 - RNA, 19 nt, Homo sapiens
uggugaggggccacugggc

SEQ ID NO: 1944529 - RNA, 15 nt, Homo sapiens
gcacaccaaggcccu

SEQ ID NO: 1944530 - RNA, 15 nt, Homo sapiens
caacagucaccucac

SEQ ID NO: 1944531 - RNA, 14 nt, Homo sapiens
ugcaaggggcucaa

SEQ ID NO: 1944532 - RNA, 18 nt, Homo sapiens
aaaauuggcaguguaaca

SEQ ID NO: 1944533 - RNA, 18 nt, Homo sapiens
uuaauauaugggggaaaa

SEQ ID NO: 1944534 - RNA, 19 nt, Homo sapiens
uuuaaaagaaaaaaaccaa

SEQ ID NO: 1944535 - RNA, 20 nt, Homo sapiens
ggccccuggcaccugggugc

SEQ ID NO: 1944536 - RNA, 18 nt, Homo sapiens
uuaaugugcugagcauuu

SEQ ID NO: 1944537 - RNA, 13 nt, Homo sapiens
uuaauugugaauu

SEQ ID NO: 1944538 - RNA, 23 nt, Homo sapiens
auugacacuauauauuucuuaau

SEQ ID NO: 1944539 - RNA, 16 nt, Homo sapiens
ccaaguuaucaucuca

SEQ ID NO: 1944540 - RNA, 19 nt, Homo sapiens
caguucugcuugcucccaa

SEQ ID NO: 1944541 - RNA, 15 nt, Homo sapiens
aaaacuggacaguca

SEQ ID NO: 1944542 - RNA, 11 nt, Homo sapiens
ccacaccaccu

SEQ ID NO: 1944543 - RNA, 19 nt, Homo sapiens
aggaccagaagcauuucac

SEQ ID NO: 1944544 - RNA, 13 nt, Homo sapiens
ugugcaacauucu

SEQ ID NO: 1944545 - RNA, 17 nt, Homo sapiens
ccacuuauuuccaugga

SEQ ID NO: 1944546 - RNA, 20 nt, Homo sapiens
uucauucauauuacaauauu

SEQ ID NO: 1944547 - RNA, 16 nt, Homo sapiens
caguuguuacugaagu

SEQ ID NO: 1944548 - RNA, 19 nt, Homo sapiens
caaauguacagugguccuu

SEQ ID NO: 1944549 - RNA, 13 nt, Homo sapiens
uugucauuuauaa

SEQ ID NO: 1944550 - RNA, 13 nt, Homo sapiens
aaaugacccaaag

SEQ ID NO: 1944551 - RNA, 22 nt, Homo sapiens
ugcuaaaggaaaaaaccaucca

SEQ ID NO: 1944552 - RNA, 21 nt, Homo sapiens
uguuucuuccccuuacucuca

SEQ ID NO: 1944553 - RNA, 23 nt, Homo sapiens
aagacgugauuuugcuguagaag

SEQ ID NO: 1944554 - RNA, 12 nt, Homo sapiens
aucggcuuccuc

SEQ ID NO: 1944555 - RNA, 19 nt, Homo sapiens
aaaaccagaaguuucuaca

SEQ ID NO: 1944556 - RNA, 19 nt, Homo sapiens
cuuguccuugagugcucuu

SEQ ID NO: 1944557 - RNA, 23 nt, Homo sapiens
gaauuuuuuuuuuuaagcucaaa

SEQ ID NO: 1944558 - RNA, 19 nt, Homo sapiens
gagucuguaaaaccagcau

SEQ ID NO: 1944559 - RNA, 21 nt, Homo sapiens
ccacagcaaccccaggcugaa

SEQ ID NO: 1944560 - RNA, 24 nt, Homo sapiens
aaugguauuuucuagacugugaag

SEQ ID NO: 1944561 - RNA, 22 nt, Homo sapiens
uaaaaugcuggugaaaugcugu

SEQ ID NO: 1944562 - RNA, 21 nt, Homo sapiens
cucaaaauuuaacaguuaccu

SEQ ID NO: 1944563 - RNA, 21 nt, Homo sapiens
cuguauagccuauacugcauu

SEQ ID NO: 1944564 - RNA, 13 nt, Homo sapiens
ugaggggcuguga

SEQ ID NO: 1944565 - RNA, 17 nt, Homo sapiens
uguacccugcuguauaa

SEQ ID NO: 1944566 - RNA, 20 nt, Homo sapiens
cuucauuuuucuaauaauca

SEQ ID NO: 1944567 - RNA, 16 nt, Homo sapiens
ucagaaaagacacuuc

SEQ ID NO: 1944568 - RNA, 14 nt, Homo sapiens
ccugacccccaugu

SEQ ID NO: 1944569 - RNA, 14 nt, Homo sapiens
ugaaucaccugugg

SEQ ID NO: 1944570 - RNA, 20 nt, Homo sapiens
uccuuggagugcugcagcuu

SEQ ID NO: 1944571 - RNA, 21 nt, Homo sapiens
agagaaugagcagagagcaaa

SEQ ID NO: 1944572 - RNA, 12 nt, Homo sapiens
aggaaaggcccu

SEQ ID NO: 1944573 - RNA, 18 nt, Homo sapiens
ucaacccauuguugucaa

SEQ ID NO: 1944574 - RNA, 17 nt, Homo sapiens
gcauuuucuucacuugc

SEQ ID NO: 1944575 - RNA, 14 nt, Homo sapiens
cuuucuaagggaaa

SEQ ID NO: 1944576 - RNA, 21 nt, Homo sapiens
acuggagucucucucucucca

SEQ ID NO: 1944577 - RNA, 23 nt, Homo sapiens
aacaguuccauucaacuggaaca

SEQ ID NO: 1944578 - RNA, 13 nt, Homo sapiens
uauugaaucuaca

SEQ ID NO: 1944579 - RNA, 13 nt, Homo sapiens
aggggcugcauga

SEQ ID NO: 1944580 - RNA, 17 nt, Homo sapiens
ugugagaacugugaaua

SEQ ID NO: 1944581 - RNA, 21 nt, Homo sapiens
gaagacuauggugcugccuug

SEQ ID NO: 1944582 - RNA, 22 nt, Homo sapiens
ccuucagaacagaggcauuuaa

SEQ ID NO: 1944583 - RNA, 23 nt, Homo sapiens
ugaagugaccuggaaucagugaa

SEQ ID NO: 1944584 - RNA, 19 nt, Homo sapiens
aguugagagagaaucucaa

SEQ ID NO: 1944585 - RNA, 23 nt, Homo sapiens
aaauauguauuaacacuacucaa

SEQ ID NO: 1944586 - RNA, 12 nt, Homo sapiens
ugaaaacacuua

SEQ ID NO: 1944587 - RNA, 15 nt, Homo sapiens
uugccucaaccuccc

SEQ ID NO: 1944588 - RNA, 16 nt, Homo sapiens
uacagugauagagcaa

SEQ ID NO: 1944589 - RNA, 16 nt, Homo sapiens
cugucugccucuccac

SEQ ID NO: 1944590 - RNA, 19 nt, Homo sapiens
gacaguuuuuauauagucu

SEQ ID NO: 1944591 - RNA, 15 nt, Homo sapiens
uccuuuauuguccau

SEQ ID NO: 1944592 - RNA, 17 nt, Homo sapiens
cagauggccgggacaug

SEQ ID NO: 1944593 - RNA, 16 nt, Homo sapiens
aggagcaagaaaugaa

SEQ ID NO: 1944594 - RNA, 13 nt, Homo sapiens
uccacagcaaagg

SEQ ID NO: 1944595 - RNA, 13 nt, Homo sapiens
gaacgcucuuagc

SEQ ID NO: 1944596 - RNA, 14 nt, Homo sapiens
ugcugaccaaagau

SEQ ID NO: 1944597 - RNA, 22 nt, Homo sapiens
ccucaacugggaaccuucauau

SEQ ID NO: 1944598 - RNA, 18 nt, Homo sapiens
ccauuagcaugacugcuu

SEQ ID NO: 1944599 - RNA, 20 nt, Homo sapiens
uauaacuaguccuuuacuaa

SEQ ID NO: 1944600 - RNA, 20 nt, Homo sapiens
uaaacuauuuugaagaucuu

SEQ ID NO: 1944601 - RNA, 22 nt, Homo sapiens
uugggaaacagagaacccugug

SEQ ID NO: 1944602 - RNA, 18 nt, Homo sapiens
uguucuguggaaagugua

SEQ ID NO: 1944603 - RNA, 19 nt, Homo sapiens
uaauggacgaagcaacaaa

SEQ ID NO: 1944604 - RNA, 16 nt, Homo sapiens
agaaugcccucagcuc

SEQ ID NO: 1944605 - RNA, 16 nt, Homo sapiens
agaugcuucucuugcu

SEQ ID NO: 1944606 - RNA, 13 nt, Homo sapiens
uucaaaaaaguca

SEQ ID NO: 1944607 - RNA, 12 nt, Homo sapiens
cugaaggcuuug

SEQ ID NO: 1944608 - RNA, 17 nt, Homo sapiens
ggaucgcaagagccaug

SEQ ID NO: 1944609 - RNA, 12 nt, Homo sapiens
caccagucugac

SEQ ID NO: 1944610 - RNA, 22 nt, Homo sapiens
guagagggaguugucaagucuc

SEQ ID NO: 1944611 - RNA, 22 nt, Homo sapiens
aacccauaggcccacacacagg

SEQ ID NO: 1944612 - RNA, 20 nt, Homo sapiens
aauauugucacaacacugaa

SEQ ID NO: 1944613 - RNA, 12 nt, Homo sapiens
ggccuuucccau

SEQ ID NO: 1944614 - RNA, 17 nt, Homo sapiens
aaaagaaacuuaccaau

SEQ ID NO: 1944615 - RNA, 21 nt, Homo sapiens
ccucucaguuguugaaacacu

SEQ ID NO: 1944616 - RNA, 14 nt, Homo sapiens
augauucucugugg

SEQ ID NO: 1944617 - RNA, 19 nt, Homo sapiens
cacuguauaccccgugaag

SEQ ID NO: 1944618 - RNA, 14 nt, Homo sapiens
acauagcacuugcc

SEQ ID NO: 1944619 - RNA, 15 nt, Homo sapiens
gaauuguagccaguu

SEQ ID NO: 1944620 - RNA, 15 nt, Homo sapiens
aaguaaaagaaccac

SEQ ID NO: 1944621 - RNA, 13 nt, Homo sapiens
aaauaauuucucu

SEQ ID NO: 1944622 - RNA, 23 nt, Homo sapiens
gacgccuccggugagcaggguca

SEQ ID NO: 1944623 - RNA, 14 nt, Homo sapiens
auacucaccaaaau

SEQ ID NO: 1944624 - RNA, 23 nt, Homo sapiens
gagcuuugcauguuccacuaacc

SEQ ID NO: 1944625 - RNA, 21 nt, Homo sapiens
ucagagcccagggaagacaca

SEQ ID NO: 1944626 - RNA, 16 nt, Homo sapiens
accagcaaacagcuga

SEQ ID NO: 1944627 - RNA, 15 nt, Homo sapiens
cauuucacgaacugu

SEQ ID NO: 1944628 - RNA, 19 nt, Homo sapiens
uaagacucucgcaucuucc

SEQ ID NO: 1944629 - RNA, 20 nt, Homo sapiens
cgcaaacgugaaauucuauu

SEQ ID NO: 1944630 - RNA, 14 nt, Homo sapiens
accuguccaguuug

SEQ ID NO: 1944631 - RNA, 19 nt, Homo sapiens
gcccugucugugugcugag

SEQ ID NO: 1944632 - RNA, 12 nt, Homo sapiens
acuaagccagga

SEQ ID NO: 1944633 - RNA, 16 nt, Homo sapiens
agguguugccaaauau

SEQ ID NO: 1944634 - RNA, 20 nt, Homo sapiens
uggaugcagugaaaagggca

SEQ ID NO: 1944635 - RNA, 16 nt, Homo sapiens
agacagcagggacaag

SEQ ID NO: 1944636 - RNA, 17 nt, Homo sapiens
uggaacuuuauuuacac

SEQ ID NO: 1944637 - RNA, 16 nt, Homo sapiens
ccccuuuccaauucca

SEQ ID NO: 1944638 - RNA, 21 nt, Homo sapiens
acccaucuguacucauguccu

SEQ ID NO: 1944639 - RNA, 20 nt, Homo sapiens
gcuucugccucagcuuccca

SEQ ID NO: 1944640 - RNA, 16 nt, Homo sapiens
uaaaaagaaauuguga

SEQ ID NO: 1944641 - RNA, 17 nt, Homo sapiens
ucccucccauuugcaga

SEQ ID NO: 1944642 - RNA, 19 nt, Homo sapiens
auugagggcucuaaacagg

SEQ ID NO: 1944643 - RNA, 22 nt, Homo sapiens
cucuaucauuaaaguucuagug

SEQ ID NO: 1944644 - RNA, 13 nt, Homo sapiens
cagguaccucaug

SEQ ID NO: 1944645 - RNA, 11 nt, Homo sapiens
aagcugggaac

SEQ ID NO: 1944646 - RNA, 20 nt, Homo sapiens
gagcccuccuggaauggagc

SEQ ID NO: 1944647 - RNA, 22 nt, Homo sapiens
cagagugagcaagggggcccaa

SEQ ID NO: 1944648 - RNA, 15 nt, Homo sapiens
ggaugcgugugaacg

SEQ ID NO: 1944649 - RNA, 16 nt, Homo sapiens
uaaaccauugugcauu

SEQ ID NO: 1944650 - RNA, 21 nt, Homo sapiens
uaggacuuuuauugugaauua

SEQ ID NO: 1944651 - RNA, 17 nt, Homo sapiens
ucccagcuucggcauuu

SEQ ID NO: 1944652 - RNA, 18 nt, Homo sapiens
ggauggugguaucaggga

SEQ ID NO: 1944653 - RNA, 19 nt, Homo sapiens
aacgacuacccagaagugu

SEQ ID NO: 1944654 - RNA, 13 nt, Homo sapiens
auccaggugccaa

SEQ ID NO: 1944655 - RNA, 18 nt, Homo sapiens
caguucaaauguuauccu

SEQ ID NO: 1944656 - RNA, 15 nt, Homo sapiens
aucuguuccagaaaa

SEQ ID NO: 1944657 - RNA, 19 nt, Homo sapiens
ucauugcuguaccacaucu

SEQ ID NO: 1944658 - RNA, 11 nt, Homo sapiens
uccugcaaguc

SEQ ID NO: 1944659 - RNA, 12 nt, Homo sapiens
ugaaaaacauuc

SEQ ID NO: 1944660 - RNA, 20 nt, Homo sapiens
ugcauuaccacacucagcua

SEQ ID NO: 1944661 - RNA, 12 nt, Homo sapiens
cauuuuccuuag

SEQ ID NO: 1944662 - RNA, 14 nt, Homo sapiens
agccuuugcuucca

SEQ ID NO: 1944663 - RNA, 16 nt, Homo sapiens
gugagucccugugaug

SEQ ID NO: 1944664 - RNA, 13 nt, Homo sapiens
acaugaaucaagc

SEQ ID NO: 1944665 - RNA, 22 nt, Homo sapiens
gaaaauccucgcacacacuggc

SEQ ID NO: 1944666 - RNA, 17 nt, Homo sapiens
auuuuuauuugagacag

SEQ ID NO: 1944667 - RNA, 17 nt, Homo sapiens
cucuggaaaaagacuga

SEQ ID NO: 1944668 - RNA, 15 nt, Homo sapiens
aucuugaaaaugcca

SEQ ID NO: 1944669 - RNA, 14 nt, Homo sapiens
aggcccuggcugag

SEQ ID NO: 1944670 - RNA, 23 nt, Homo sapiens
aacugguuccuagggauguguga

SEQ ID NO: 1944671 - RNA, 20 nt, Homo sapiens
acuccgagagcaugcuuaau

SEQ ID NO: 1944672 - RNA, 21 nt, Homo sapiens
uguaauuuauuaacuaaucaa

SEQ ID NO: 1944673 - RNA, 21 nt, Homo sapiens
cagagguuugcuuccucagua

SEQ ID NO: 1944674 - RNA, 18 nt, Homo sapiens
cuaggcuaagcacuuuau

SEQ ID NO: 1944675 - RNA, 22 nt, Homo sapiens
caaggugcacagaccucagaga

SEQ ID NO: 1944676 - RNA, 17 nt, Homo sapiens
gcaacaggaacuuggag

SEQ ID NO: 1944677 - RNA, 18 nt, Homo sapiens
auuguauugucugacaca

SEQ ID NO: 1944678 - RNA, 23 nt, Homo sapiens
gacaaugaaaguuugcacuguau

SEQ ID NO: 1944679 - RNA, 21 nt, Homo sapiens
ucuuuuaaauauuugugacuc

SEQ ID NO: 1944680 - RNA, 20 nt, Homo sapiens
uauuacaauuuguauuacuu

SEQ ID NO: 1944681 - RNA, 15 nt, Homo sapiens
uuaucuauauagucc

SEQ ID NO: 1944682 - RNA, 18 nt, Homo sapiens
cauuuuagaauaccccac

SEQ ID NO: 1944683 - RNA, 18 nt, Homo sapiens
agacccguagaugccagg

SEQ ID NO: 1944684 - RNA, 21 nt, Homo sapiens
gcuauuaagaaggcacuuaau

SEQ ID NO: 1944685 - RNA, 11 nt, Homo sapiens
uagcugucacc

SEQ ID NO: 1944686 - RNA, 18 nt, Homo sapiens
auaauaucccaaagagcu

SEQ ID NO: 1944687 - RNA, 17 nt, Homo sapiens
uauguuauacaaggcaa

SEQ ID NO: 1944688 - RNA, 15 nt, Homo sapiens
accucauguccuucu

SEQ ID NO: 1944689 - RNA, 11 nt, Homo sapiens
uauuccaucaa

SEQ ID NO: 1944690 - RNA, 19 nt, Homo sapiens
gugcauuuucucaucaucc

SEQ ID NO: 1944691 - RNA, 20 nt, Homo sapiens
gcucauucauuuaacagagc

SEQ ID NO: 1944692 - RNA, 21 nt, Homo sapiens
cccagauagaaugucaauauu

SEQ ID NO: 1944693 - RNA, 16 nt, Homo sapiens
acaggcucacugguca

SEQ ID NO: 1944694 - RNA, 18 nt, Homo sapiens
aguuuuauuacacauuua

SEQ ID NO: 1944695 - RNA, 21 nt, Homo sapiens
uuuucacguaucuuccaagua

SEQ ID NO: 1944696 - RNA, 14 nt, Homo sapiens
gauuccaaaccaac

SEQ ID NO: 1944697 - RNA, 14 nt, Homo sapiens
cuggaaacccaccu

SEQ ID NO: 1944698 - RNA, 14 nt, Homo sapiens
gcaaacaucaaccu

SEQ ID NO: 1944699 - RNA, 17 nt, Homo sapiens
ccuugccccuaccucag

SEQ ID NO: 1944700 - RNA, 20 nt, Homo sapiens
aggcgggaugggacacccaa

SEQ ID NO: 1944701 - RNA, 23 nt, Homo sapiens
cacaaaguaucuaacaaaaccaa

SEQ ID NO: 1944702 - RNA, 18 nt, Homo sapiens
gucucugcgccugaguaa

SEQ ID NO: 1944703 - RNA, 17 nt, Homo sapiens
aacaauucccccauccu

SEQ ID NO: 1944704 - RNA, 17 nt, Homo sapiens
cagcccuuauggccaau

SEQ ID NO: 1944705 - RNA, 15 nt, Homo sapiens
aacugugaaauacca

SEQ ID NO: 1944706 - RNA, 23 nt, Homo sapiens
uccuuucuaucauuuuuguacag

SEQ ID NO: 1944707 - RNA, 13 nt, Homo sapiens
ugacugggggccu

SEQ ID NO: 1944708 - RNA, 13 nt, Homo sapiens
aaauacuugccug

SEQ ID NO: 1944709 - RNA, 16 nt, Homo sapiens
agccacaagucuucca

SEQ ID NO: 1944710 - RNA, 16 nt, Homo sapiens
caacucacaccuccuu

SEQ ID NO: 1944711 - RNA, 20 nt, Homo sapiens
uaucuucuuuugaacaaaug

SEQ ID NO: 1944712 - RNA, 19 nt, Homo sapiens
agccccagagggucagggu

SEQ ID NO: 1944713 - RNA, 21 nt, Homo sapiens
ucccaauaaaagugacucuca

SEQ ID NO: 1944714 - RNA, 18 nt, Homo sapiens
ugcccuuccuccugccuu

SEQ ID NO: 1944715 - RNA, 15 nt, Homo sapiens
acagcacuccaccuu

SEQ ID NO: 1944716 - RNA, 19 nt, Homo sapiens
ccugcuucccccacuucac

SEQ ID NO: 1944717 - RNA, 13 nt, Homo sapiens
auccacauccucu

SEQ ID NO: 1944718 - RNA, 16 nt, Homo sapiens
accagaggugcuucug

SEQ ID NO: 1944719 - RNA, 18 nt, Homo sapiens
uccuuuucuauuaagaua

SEQ ID NO: 1944720 - RNA, 21 nt, Homo sapiens
ccuuaagagcuguugccuuau

SEQ ID NO: 1944721 - RNA, 21 nt, Homo sapiens
ggaugccauaaaagccgccca

SEQ ID NO: 1944722 - RNA, 16 nt, Homo sapiens
uguuguguuugucaaa

SEQ ID NO: 1944723 - RNA, 17 nt, Homo sapiens
cagcaagcacugugguc

SEQ ID NO: 1944724 - RNA, 15 nt, Homo sapiens
acugagcugcuaaaa

SEQ ID NO: 1944725 - RNA, 21 nt, Homo sapiens
agauucuaacauauugccaug

SEQ ID NO: 1944726 - RNA, 21 nt, Homo sapiens
uaaacgaggcaaugacuguga

SEQ ID NO: 1944727 - RNA, 22 nt, Homo sapiens
aaugaaccuucugcaacaucuu

SEQ ID NO: 1944728 - RNA, 16 nt, Homo sapiens
gaagagagauauaucu

SEQ ID NO: 1944729 - RNA, 17 nt, Homo sapiens
cccacauccaacuccag

SEQ ID NO: 1944730 - RNA, 13 nt, Homo sapiens
caaguagggcaca

SEQ ID NO: 1944731 - RNA, 14 nt, Homo sapiens
agaauauuauuagu

SEQ ID NO: 1944732 - RNA, 13 nt, Homo sapiens
uguuacccacugc

SEQ ID NO: 1944733 - RNA, 14 nt, Homo sapiens
cauucaguguuaga

SEQ ID NO: 1944734 - RNA, 16 nt, Homo sapiens
acaaagggaaauacuc

SEQ ID NO: 1944735 - RNA, 16 nt, Homo sapiens
ccaccgugccuggcca

SEQ ID NO: 1944736 - RNA, 18 nt, Homo sapiens
aacauaguagauugacau

SEQ ID NO: 1944737 - RNA, 13 nt, Homo sapiens
acuagauugaucu

SEQ ID NO: 1944738 - RNA, 23 nt, Homo sapiens
uacaagagaaacaaauaaacuag

SEQ ID NO: 1944739 - RNA, 17 nt, Homo sapiens
uagccaagaucccaucu

SEQ ID NO: 1944740 - RNA, 12 nt, Homo sapiens
ucaaugccagua

SEQ ID NO: 1944741 - RNA, 23 nt, Homo sapiens
aauuuuuuuuguuguuucaguga

SEQ ID NO: 1944742 - RNA, 15 nt, Homo sapiens
cauggccaauaguca

SEQ ID NO: 1944743 - RNA, 23 nt, Homo sapiens
gucugauuuugagguuuagcaau

SEQ ID NO: 1944744 - RNA, 19 nt, Homo sapiens
ccucugacccuagcucuuu

SEQ ID NO: 1944745 - RNA, 19 nt, Homo sapiens
caauuuaacuagacacaga

SEQ ID NO: 1944746 - RNA, 15 nt, Homo sapiens
cagagggcacucaga

SEQ ID NO: 1944747 - RNA, 20 nt, Homo sapiens
uagccagaauucuacccugg

SEQ ID NO: 1944748 - RNA, 24 nt, Homo sapiens
aucuuguuuuuccacuacugcuac

SEQ ID NO: 1944749 - RNA, 11 nt, Homo sapiens
uaagugacaaa

SEQ ID NO: 1944750 - RNA, 13 nt, Homo sapiens
accuacucugcaa

SEQ ID NO: 1944751 - RNA, 18 nt, Homo sapiens
aaucucgucaggcugcca

SEQ ID NO: 1944752 - RNA, 20 nt, Homo sapiens
ugggaucagcaggccaggca

SEQ ID NO: 1944753 - RNA, 22 nt, Homo sapiens
agaggacucugcuuaaacaaag

SEQ ID NO: 1944754 - RNA, 19 nt, Homo sapiens
ucugcuuacaauucccugc

SEQ ID NO: 1944755 - RNA, 18 nt, Homo sapiens
cugggaaaggugcucaaa

SEQ ID NO: 1944756 - RNA, 14 nt, Homo sapiens
ggaggaugcuaaaa

SEQ ID NO: 1944757 - RNA, 23 nt, Homo sapiens
caggucacuugaucaugcugcag

SEQ ID NO: 1944758 - RNA, 15 nt, Homo sapiens
agaucaugucucacu

SEQ ID NO: 1944759 - RNA, 15 nt, Homo sapiens
gucugaaagacagaa

SEQ ID NO: 1944760 - RNA, 23 nt, Homo sapiens
gcuguccccacagcuucucuaca

SEQ ID NO: 1944761 - RNA, 22 nt, Homo sapiens
aaauuucaggauuaacuaaaga

SEQ ID NO: 1944762 - RNA, 20 nt, Homo sapiens
ucacaauaaaaauggcucag

SEQ ID NO: 1944763 - RNA, 17 nt, Homo sapiens
agacagaauucacuguc

SEQ ID NO: 1944764 - RNA, 12 nt, Homo sapiens
agcaaugaugac

SEQ ID NO: 1944765 - RNA, 17 nt, Homo sapiens
augucuugacuguuagu

SEQ ID NO: 1944766 - RNA, 17 nt, Homo sapiens
aagagaugaauugcauu

SEQ ID NO: 1944767 - RNA, 21 nt, Homo sapiens
acgacccuuucaucagaggaa

SEQ ID NO: 1944768 - RNA, 17 nt, Homo sapiens
cugagucacaauaaaga

SEQ ID NO: 1944769 - RNA, 15 nt, Homo sapiens
aagaguuaugcuuua

SEQ ID NO: 1944770 - RNA, 18 nt, Homo sapiens
cuacugggggcaacccug

SEQ ID NO: 1944771 - RNA, 15 nt, Homo sapiens
gcagacacucaagag

SEQ ID NO: 1944772 - RNA, 13 nt, Homo sapiens
aaaucuuccuugu

SEQ ID NO: 1944773 - RNA, 12 nt, Homo sapiens
caaaagacaauu

SEQ ID NO: 1944774 - RNA, 12 nt, Homo sapiens
guaaaacuuugg

SEQ ID NO: 1944775 - RNA, 22 nt, Homo sapiens
uccuugagaaucuuugcaugca

SEQ ID NO: 1944776 - RNA, 15 nt, Homo sapiens
cucugcugcucugac

SEQ ID NO: 1944777 - RNA, 23 nt, Homo sapiens
gggaggaaaaggccccugcaaug

SEQ ID NO: 1944778 - RNA, 17 nt, Homo sapiens
cacccugccuccucccg

SEQ ID NO: 1944779 - RNA, 19 nt, Homo sapiens
gaaaagagaugaugaaaau

SEQ ID NO: 1944780 - RNA, 12 nt, Homo sapiens
gcuucaaaaacu

SEQ ID NO: 1944781 - RNA, 17 nt, Homo sapiens
uguaaaaauaaccagua

SEQ ID NO: 1944782 - RNA, 22 nt, Homo sapiens
agcuaacauggaaguacuauaa

SEQ ID NO: 1944783 - RNA, 23 nt, Homo sapiens
uuagaaaugagaaaaauacagag

SEQ ID NO: 1944784 - RNA, 19 nt, Homo sapiens
caguacacaggggcuugac

SEQ ID NO: 1944785 - RNA, 14 nt, Homo sapiens
ucagaaggagacag

SEQ ID NO: 1944786 - RNA, 17 nt, Homo sapiens
cuuuguuggagucaaaa

SEQ ID NO: 1944787 - RNA, 20 nt, Homo sapiens
caaaaacucuuauuacuguu

SEQ ID NO: 1944788 - RNA, 20 nt, Homo sapiens
uugaaugaugugauacaaau

SEQ ID NO: 1944789 - RNA, 20 nt, Homo sapiens
uuaaccacauuucugaaugu

SEQ ID NO: 1944790 - RNA, 17 nt, Homo sapiens
gaaauaauuuaguuucu

SEQ ID NO: 1944791 - RNA, 20 nt, Homo sapiens
uccacucuaguuguggacuu

SEQ ID NO: 1944792 - RNA, 20 nt, Homo sapiens
cucauucuugaggagcauua

SEQ ID NO: 1944793 - RNA, 16 nt, Homo sapiens
cgcuuucuuucugcau

SEQ ID NO: 1944794 - RNA, 23 nt, Homo sapiens
uuaccauuccuauaguacuuuau

SEQ ID NO: 1944795 - RNA, 14 nt, Homo sapiens
uccucccaaucuca

SEQ ID NO: 1944796 - RNA, 21 nt, Homo sapiens
ccccauuuccuguacaaucau

SEQ ID NO: 1944797 - RNA, 18 nt, Homo sapiens
gucccaaccugaucccac

SEQ ID NO: 1944798 - RNA, 14 nt, Homo sapiens
ugauuuagcauuca

SEQ ID NO: 1944799 - RNA, 14 nt, Homo sapiens
ugaccaagcaucuu

SEQ ID NO: 1944800 - RNA, 14 nt, Homo sapiens
aggccuuccaacgc

SEQ ID NO: 1944801 - RNA, 16 nt, Homo sapiens
cuguuaucuucacuuu

SEQ ID NO: 1944802 - RNA, 19 nt, Homo sapiens
ucccacggugcccaaacac

SEQ ID NO: 1944803 - RNA, 21 nt, Homo sapiens
uucaaugugcauaaugauaaa

SEQ ID NO: 1944804 - RNA, 21 nt, Homo sapiens
aucccccacagccacuacuga

SEQ ID NO: 1944805 - RNA, 15 nt, Homo sapiens
agcuaaugucuucua

SEQ ID NO: 1944806 - RNA, 19 nt, Homo sapiens
aguuaacagacaacacguu

SEQ ID NO: 1944807 - RNA, 13 nt, Homo sapiens
ucccagcacuuuu

SEQ ID NO: 1944808 - RNA, 12 nt, Homo sapiens
ccgcugagcuga

SEQ ID NO: 1944809 - RNA, 13 nt, Homo sapiens
acuuggcugcuca

SEQ ID NO: 1944810 - RNA, 17 nt, Homo sapiens
gugccgcucucucugag

SEQ ID NO: 1944811 - RNA, 16 nt, Homo sapiens
cuggucccucugaggc

SEQ ID NO: 1944812 - RNA, 18 nt, Homo sapiens
aagguucccucugagaau

SEQ ID NO: 1944813 - RNA, 19 nt, Homo sapiens
ugaaaauuauuccuugcuu

SEQ ID NO: 1944814 - RNA, 18 nt, Homo sapiens
gacauuucacugaugcuu

SEQ ID NO: 1944815 - RNA, 17 nt, Homo sapiens
uuacauuuucuuucaua

SEQ ID NO: 1944816 - RNA, 24 nt, Homo sapiens
uccucagggacagagacaccugca

SEQ ID NO: 1944817 - RNA, 16 nt, Homo sapiens
augucaacagccauaa

SEQ ID NO: 1944818 - RNA, 16 nt, Homo sapiens
aacucaccacaguguu

SEQ ID NO: 1944819 - RNA, 23 nt, Homo sapiens
auaugaucuguuuuguaucuuaa

SEQ ID NO: 1944820 - RNA, 22 nt, Homo sapiens
gugucuggucuguuggcccugc

SEQ ID NO: 1944821 - RNA, 21 nt, Homo sapiens
aaaauucagguauuacugaau

SEQ ID NO: 1944822 - RNA, 14 nt, Homo sapiens
uaaccucacugccu

SEQ ID NO: 1944823 - RNA, 16 nt, Homo sapiens
accaggcuggacaccc

SEQ ID NO: 1944824 - RNA, 17 nt, Homo sapiens
ucuaccagagauuuucc

SEQ ID NO: 1944825 - RNA, 14 nt, Homo sapiens
aaagguucugaaaa

SEQ ID NO: 1944826 - RNA, 14 nt, Homo sapiens
augucauauuccau

SEQ ID NO: 1944827 - RNA, 16 nt, Homo sapiens
cuccuaagaaggcacc

SEQ ID NO: 1944828 - RNA, 21 nt, Homo sapiens
ucaacuuaccaggcaccaaaa

SEQ ID NO: 1944829 - RNA, 18 nt, Homo sapiens
gcucacaaccaccauuca

SEQ ID NO: 1944830 - RNA, 18 nt, Homo sapiens
augaucagaagacuuuaa

SEQ ID NO: 1944831 - RNA, 12 nt, Homo sapiens
ccuguauuccca

SEQ ID NO: 1944832 - RNA, 17 nt, Homo sapiens
uaagauuucucuaauau

SEQ ID NO: 1944833 - RNA, 23 nt, Homo sapiens
ugacauugcguuugaccuuuuau

SEQ ID NO: 1944834 - RNA, 20 nt, Homo sapiens
agggacugacaaaagacuug

SEQ ID NO: 1944835 - RNA, 19 nt, Homo sapiens
accaugggcuacagugucu

SEQ ID NO: 1944836 - RNA, 15 nt, Homo sapiens
uagacagaccuccag

SEQ ID NO: 1944837 - RNA, 22 nt, Homo sapiens
augacaguuagagaugcugauu

SEQ ID NO: 1944838 - RNA, 23 nt, Homo sapiens
cccugcagaugccacccuagcca

SEQ ID NO: 1944839 - RNA, 13 nt, Homo sapiens
agggacacuccaa

SEQ ID NO: 1944840 - RNA, 12 nt, Homo sapiens
gugucacaaaga

SEQ ID NO: 1944841 - RNA, 19 nt, Homo sapiens
gacuuccuaugugugcauu

SEQ ID NO: 1944842 - RNA, 22 nt, Homo sapiens
uaaaacggauaccaaguugauu

SEQ ID NO: 1944843 - RNA, 19 nt, Homo sapiens
acacaucagugcacacgga

SEQ ID NO: 1944844 - RNA, 18 nt, Homo sapiens
gaaucaaauuuugccaga

SEQ ID NO: 1944845 - RNA, 16 nt, Homo sapiens
uauuucagacacuaug

SEQ ID NO: 1944846 - RNA, 19 nt, Homo sapiens
ccuuuaggaucucaggcuu

SEQ ID NO: 1944847 - RNA, 21 nt, Homo sapiens
cacccuccagcuuuuccucag

SEQ ID NO: 1944848 - RNA, 24 nt, Homo sapiens
ccacacaacagugcccuccagaag

SEQ ID NO: 1944849 - RNA, 19 nt, Homo sapiens
acaaagcauuugacuuucu

SEQ ID NO: 1944850 - RNA, 21 nt, Homo sapiens
ccuugguucuugaggggacca

SEQ ID NO: 1944851 - RNA, 22 nt, Homo sapiens
acaguaugguaacuuugcaaau

SEQ ID NO: 1944852 - RNA, 19 nt, Homo sapiens
ucacaaccucaccaaacua

SEQ ID NO: 1944853 - RNA, 18 nt, Homo sapiens
agaugcccccuccaggag

SEQ ID NO: 1944854 - RNA, 15 nt, Homo sapiens
ccaauaaaaaguuca

SEQ ID NO: 1944855 - RNA, 17 nt, Homo sapiens
ccauguagaagcugcau

SEQ ID NO: 1944856 - RNA, 14 nt, Homo sapiens
cuucauuugcaauu

SEQ ID NO: 1944857 - RNA, 17 nt, Homo sapiens
aaauuuacccaaugcag

SEQ ID NO: 1944858 - RNA, 18 nt, Homo sapiens
ucaagaaugcaauaucau

SEQ ID NO: 1944859 - RNA, 16 nt, Homo sapiens
auacauggacugagag

SEQ ID NO: 1944860 - RNA, 14 nt, Homo sapiens
ucaagcagugugcu

SEQ ID NO: 1944861 - RNA, 14 nt, Homo sapiens
uacacaacauguau

SEQ ID NO: 1944862 - RNA, 19 nt, Homo sapiens
ugcacacguguguaugagu

SEQ ID NO: 1944863 - RNA, 18 nt, Homo sapiens
accaggggaccagaggga

SEQ ID NO: 1944864 - RNA, 16 nt, Homo sapiens
cccaggacggggcaca

SEQ ID NO: 1944865 - RNA, 23 nt, Homo sapiens
gaaucuggaccccaucugugaau

SEQ ID NO: 1944866 - RNA, 17 nt, Homo sapiens
uaagaaugcagauuccu

SEQ ID NO: 1944867 - RNA, 15 nt, Homo sapiens
uccucaaagcauuug

SEQ ID NO: 1944868 - RNA, 20 nt, Homo sapiens
aaaggcugccgaggacccuc

SEQ ID NO: 1944869 - RNA, 12 nt, Homo sapiens
guacuaaagcca

SEQ ID NO: 1944870 - RNA, 15 nt, Homo sapiens
auugcaccacugcac

SEQ ID NO: 1944871 - RNA, 20 nt, Homo sapiens
acaugugucugugugguaua

SEQ ID NO: 1944872 - RNA, 20 nt, Homo sapiens
gaaguuuguuuaaaugacag

SEQ ID NO: 1944873 - RNA, 16 nt, Homo sapiens
ccucugcuguucagga

SEQ ID NO: 1944874 - RNA, 23 nt, Homo sapiens
caaggaagagccaauguuuucca

SEQ ID NO: 1944875 - RNA, 13 nt, Homo sapiens
ccccccaguggac

SEQ ID NO: 1944876 - RNA, 23 nt, Homo sapiens
cugacaugugacaucuaccuccc

SEQ ID NO: 1944877 - RNA, 20 nt, Homo sapiens
uggucacacagagauacgca

SEQ ID NO: 1944878 - RNA, 17 nt, Homo sapiens
ccugggaggcacagcaa

SEQ ID NO: 1944879 - RNA, 22 nt, Homo sapiens
aaggucccgaauggaguccaga

SEQ ID NO: 1944880 - RNA, 18 nt, Homo sapiens
agggagcccccagaggac

SEQ ID NO: 1944881 - RNA, 12 nt, Homo sapiens
uaggcuuaucaa

SEQ ID NO: 1944882 - RNA, 22 nt, Homo sapiens
gcaagaucauagcucauugcaa

SEQ ID NO: 1944883 - RNA, 16 nt, Homo sapiens
ucugcagcuaacuuau

SEQ ID NO: 1944884 - RNA, 21 nt, Homo sapiens
uuaucccauuuagugugaaua

SEQ ID NO: 1944885 - RNA, 20 nt, Homo sapiens
ccucauucccucgucuuucc

SEQ ID NO: 1944886 - RNA, 11 nt, Homo sapiens
auuuagccaau

SEQ ID NO: 1944887 - RNA, 20 nt, Homo sapiens
guaugcugaaauccggguca

SEQ ID NO: 1944888 - RNA, 17 nt, Homo sapiens
uucacggugacacaggu

SEQ ID NO: 1944889 - RNA, 18 nt, Homo sapiens
ggaaugggccaagccagg

SEQ ID NO: 1944890 - RNA, 17 nt, Homo sapiens
ccuuccaaugcuucugu

SEQ ID NO: 1944891 - RNA, 22 nt, Homo sapiens
agcucauucccaacgugcaaag

SEQ ID NO: 1944892 - RNA, 18 nt, Homo sapiens
caucauugaucuuuggau

SEQ ID NO: 1944893 - RNA, 21 nt, Homo sapiens
ccaggcuucacccugaauggu

SEQ ID NO: 1944894 - RNA, 15 nt, Homo sapiens
gcaauguacaccaga

SEQ ID NO: 1944895 - RNA, 14 nt, Homo sapiens
uacuagcugagaaa

SEQ ID NO: 1944896 - RNA, 16 nt, Homo sapiens
augacauagcacuugc

SEQ ID NO: 1944897 - RNA, 22 nt, Homo sapiens
gaaaaaaaaaaaaaagccuuug

SEQ ID NO: 1944898 - RNA, 14 nt, Homo sapiens
aaaaauggguguua

SEQ ID NO: 1944899 - RNA, 20 nt, Homo sapiens
cuccagcucucaguuacaag

SEQ ID NO: 1944900 - RNA, 15 nt, Homo sapiens
uacugauuacugccu

SEQ ID NO: 1944901 - RNA, 16 nt, Homo sapiens
uaaaauucauagcauc

SEQ ID NO: 1944902 - RNA, 14 nt, Homo sapiens
acagcaggugccag

SEQ ID NO: 1944903 - RNA, 18 nt, Homo sapiens
gucccugccacacucagu

SEQ ID NO: 1944904 - RNA, 23 nt, Homo sapiens
ugauuagaaagaccaggccaaug

SEQ ID NO: 1944905 - RNA, 13 nt, Homo sapiens
aagugcuguggcu

SEQ ID NO: 1944906 - RNA, 15 nt, Homo sapiens
uaaaagcauuugaca

SEQ ID NO: 1944907 - RNA, 16 nt, Homo sapiens
gcaugaugucuaccuc

SEQ ID NO: 1944908 - RNA, 20 nt, Homo sapiens
ucagaaauuuucugaucuca

SEQ ID NO: 1944909 - RNA, 21 nt, Homo sapiens
auagugagaccuuggcgcuac

SEQ ID NO: 1944910 - RNA, 18 nt, Homo sapiens
ccucccuguaaugcacuc

SEQ ID NO: 1944911 - RNA, 16 nt, Homo sapiens
uuuaauaagauuuucu

SEQ ID NO: 1944912 - RNA, 15 nt, Homo sapiens
cugagcauaaugcuc

SEQ ID NO: 1944913 - RNA, 13 nt, Homo sapiens
gauacaaccuccc

SEQ ID NO: 1944914 - RNA, 23 nt, Homo sapiens
uugaacuuaaauaaaugucauua

SEQ ID NO: 1944915 - RNA, 15 nt, Homo sapiens
uuaacucuuuuggac

SEQ ID NO: 1944916 - RNA, 17 nt, Homo sapiens
guuagcauggcuucaca

SEQ ID NO: 1944917 - RNA, 12 nt, Homo sapiens
agcgucuuggcu

SEQ ID NO: 1944918 - RNA, 23 nt, Homo sapiens
gaugggugucuggggagggucaa

SEQ ID NO: 1944919 - RNA, 21 nt, Homo sapiens
uugaaaguuuguucugcagag

SEQ ID NO: 1944920 - RNA, 23 nt, Homo sapiens
uuaagauaugugagaacuuuuca

SEQ ID NO: 1944921 - RNA, 12 nt, Homo sapiens
gcaggaccagga

SEQ ID NO: 1944922 - RNA, 18 nt, Homo sapiens
uaauacuccuaagacuua

SEQ ID NO: 1944923 - RNA, 18 nt, Homo sapiens
cuugaauaaccaucugaa

SEQ ID NO: 1944924 - RNA, 22 nt, Homo sapiens
cuaacaauggaagauuugccca

SEQ ID NO: 1944925 - RNA, 18 nt, Homo sapiens
ccacgauuuucuccagcu

SEQ ID NO: 1944926 - RNA, 20 nt, Homo sapiens
gggaugaggucaccagggga

SEQ ID NO: 1944927 - RNA, 15 nt, Homo sapiens
accgaggaccggcug

SEQ ID NO: 1944928 - RNA, 16 nt, Homo sapiens
ucuuauggcugcugaa

SEQ ID NO: 1944929 - RNA, 16 nt, Homo sapiens
gacaguuacacuugac

SEQ ID NO: 1944930 - RNA, 21 nt, Homo sapiens
agaggcaaaggcucucacucc

SEQ ID NO: 1944931 - RNA, 23 nt, Homo sapiens
gguuacuaagaugaaauugccaa

SEQ ID NO: 1944932 - RNA, 21 nt, Homo sapiens
caguccaucccagagggaccg

SEQ ID NO: 1944933 - RNA, 15 nt, Homo sapiens
gcccuuuccuuccag

SEQ ID NO: 1944934 - RNA, 13 nt, Homo sapiens
cuguugaucucag

SEQ ID NO: 1944935 - RNA, 16 nt, Homo sapiens
gcccccuccucuagcu

SEQ ID NO: 1944936 - RNA, 18 nt, Homo sapiens
ugaagccauagccuccac

SEQ ID NO: 1944937 - RNA, 12 nt, Homo sapiens
ggauccaagaca

SEQ ID NO: 1944938 - RNA, 21 nt, Homo sapiens
ugcugucuuuucuuugccauc

SEQ ID NO: 1944939 - RNA, 21 nt, Homo sapiens
uuaagacuuaguuauuucugc

SEQ ID NO: 1944940 - RNA, 15 nt, Homo sapiens
ccuauguccuaagga

SEQ ID NO: 1944941 - RNA, 22 nt, Homo sapiens
gcaggaucuggacgguccccuc

SEQ ID NO: 1944942 - RNA, 14 nt, Homo sapiens
gaaauuaacaccca

SEQ ID NO: 1944943 - RNA, 17 nt, Homo sapiens
guacaauugugggcaua

SEQ ID NO: 1944944 - RNA, 20 nt, Homo sapiens
ugaaauaaagauaaaugcaa

SEQ ID NO: 1944945 - RNA, 16 nt, Homo sapiens
acacaaaaaaggcagu

SEQ ID NO: 1944946 - RNA, 18 nt, Homo sapiens
cuucacagcccugcagug

SEQ ID NO: 1944947 - RNA, 22 nt, Homo sapiens
gucauuuauauuccuuuuccca

SEQ ID NO: 1944948 - RNA, 20 nt, Homo sapiens
augagagcaucagaguauua

SEQ ID NO: 1944949 - RNA, 17 nt, Homo sapiens
cggguggggccauaaac

SEQ ID NO: 1944950 - RNA, 16 nt, Homo sapiens
gggccugucgugccag

SEQ ID NO: 1944951 - RNA, 10 nt, Homo sapiens
agccacagga

SEQ ID NO: 1944952 - RNA, 17 nt, Homo sapiens
gcgggacugucaaugga

SEQ ID NO: 1944953 - RNA, 14 nt, Homo sapiens
auuuauauguacug

SEQ ID NO: 1944954 - RNA, 17 nt, Homo sapiens
uucacugacugucuccu

SEQ ID NO: 1944955 - RNA, 16 nt, Homo sapiens
gccagcaggagccagc

SEQ ID NO: 1944956 - RNA, 16 nt, Homo sapiens
cauugcuggagguaga

SEQ ID NO: 1944957 - RNA, 13 nt, Homo sapiens
caagaaugagcug

SEQ ID NO: 1944958 - RNA, 23 nt, Homo sapiens
ucccggcucccuccuagucuguc

SEQ ID NO: 1944959 - RNA, 18 nt, Homo sapiens
caacucauugcaucauuu

SEQ ID NO: 1944960 - RNA, 17 nt, Homo sapiens
caaguuguagagagaaa

SEQ ID NO: 1944961 - RNA, 21 nt, Homo sapiens
uuaaacccuauugguaaagaa

SEQ ID NO: 1944962 - RNA, 19 nt, Homo sapiens
cuuguggacucucugccug

SEQ ID NO: 1944963 - RNA, 19 nt, Homo sapiens
auacugcucaucauuccuu

SEQ ID NO: 1944964 - RNA, 18 nt, Homo sapiens
agagagaacaggugggcu

SEQ ID NO: 1944965 - RNA, 13 nt, Homo sapiens
caucucuuucuac

SEQ ID NO: 1944966 - RNA, 17 nt, Homo sapiens
agccucuagaacagcca

SEQ ID NO: 1944967 - RNA, 14 nt, Homo sapiens
cuuaccaauugaug

SEQ ID NO: 1944968 - RNA, 14 nt, Homo sapiens
cuuaggcagggaag

SEQ ID NO: 1944969 - RNA, 14 nt, Homo sapiens
cuaaggacauuucc

SEQ ID NO: 1944970 - RNA, 14 nt, Homo sapiens
aaaaauaacuucau

SEQ ID NO: 1944971 - RNA, 21 nt, Homo sapiens
cuucguguucuguauucugac

SEQ ID NO: 1944972 - RNA, 16 nt, Homo sapiens
cucaugcccgccagug

SEQ ID NO: 1944973 - RNA, 19 nt, Homo sapiens
gauaucaaaaagacugugg

SEQ ID NO: 1944974 - RNA, 20 nt, Homo sapiens
ccagccugaggcagccacuu

SEQ ID NO: 1944975 - RNA, 17 nt, Homo sapiens
ggguuagauguugccau

SEQ ID NO: 1944976 - RNA, 14 nt, Homo sapiens
ggcagcagaucugu

SEQ ID NO: 1944977 - RNA, 18 nt, Homo sapiens
gcacaugcaccuacccau

SEQ ID NO: 1944978 - RNA, 18 nt, Homo sapiens
cugauuuguauucuguga

SEQ ID NO: 1944979 - RNA, 21 nt, Homo sapiens
gcuuugaggcucugucacuga

SEQ ID NO: 1944980 - RNA, 13 nt, Homo sapiens
aaagagagcccug

SEQ ID NO: 1944981 - RNA, 22 nt, Homo sapiens
uaagucacauaggaaacuugaa

SEQ ID NO: 1944982 - RNA, 20 nt, Homo sapiens
auccaaaauauuuuuugcaa

SEQ ID NO: 1944983 - RNA, 23 nt, Homo sapiens
agccgagauugcaccacugcacu

SEQ ID NO: 1944984 - RNA, 14 nt, Homo sapiens
uaucuguucuugcu

SEQ ID NO: 1944985 - RNA, 15 nt, Homo sapiens
auguuccacuaaccc

SEQ ID NO: 1944986 - RNA, 21 nt, Homo sapiens
ggccugggaaacccucuccau

SEQ ID NO: 1944987 - RNA, 19 nt, Homo sapiens
acgugucugagagccauaa

SEQ ID NO: 1944988 - RNA, 19 nt, Homo sapiens
guggaauuccuucauuuca

SEQ ID NO: 1944989 - RNA, 14 nt, Homo sapiens
accucccacugccc

SEQ ID NO: 1944990 - RNA, 14 nt, Homo sapiens
accucucacugccu

SEQ ID NO: 1944991 - RNA, 22 nt, Homo sapiens
acaauuuucaucccacaauuga

SEQ ID NO: 1944992 - RNA, 21 nt, Homo sapiens
aacaauucuuauugacucaua

SEQ ID NO: 1944993 - RNA, 16 nt, Homo sapiens
uaaagagaaguuccca

SEQ ID NO: 1944994 - RNA, 18 nt, Homo sapiens
uuaaagaaacaauacaaa

SEQ ID NO: 1944995 - RNA, 20 nt, Homo sapiens
aucgaucuguacuguaauuu

SEQ ID NO: 1944996 - RNA, 20 nt, Homo sapiens
ucccaucuuuuguuagauuu

SEQ ID NO: 1944997 - RNA, 13 nt, Homo sapiens
uacugcugagguc

SEQ ID NO: 1944998 - RNA, 19 nt, Homo sapiens
ccaagguauugagacauau

SEQ ID NO: 1944999 - RNA, 13 nt, Homo sapiens
uugggaccugcuu

SEQ ID NO: 1945000 - RNA, 19 nt, Homo sapiens
uuucaaucuucuacuuuua

SEQ ID NO: 1945001 - RNA, 20 nt, Homo sapiens
acuggagugugcgugguggu

SEQ ID NO: 1945002 - RNA, 22 nt, Homo sapiens
cagaaaacauaugcauuaugaa

SEQ ID NO: 1945003 - RNA, 15 nt, Homo sapiens
auuuucccuucaugu

SEQ ID NO: 1945004 - RNA, 20 nt, Homo sapiens
auuucgaagucaucauuccu

SEQ ID NO: 1945005 - RNA, 14 nt, Homo sapiens
gugaccagugcugc

SEQ ID NO: 1945006 - RNA, 21 nt, Homo sapiens
cugcauucuucugagcacugu

SEQ ID NO: 1945007 - RNA, 22 nt, Homo sapiens
ccucacucuugccaaccuguaa

SEQ ID NO: 1945008 - RNA, 14 nt, Homo sapiens
ccccaccaguguag

SEQ ID NO: 1945009 - RNA, 18 nt, Homo sapiens
ugcucaaauuacuaauga

SEQ ID NO: 1945010 - RNA, 16 nt, Homo sapiens
gagucauggacaugaa

SEQ ID NO: 1945011 - RNA, 16 nt, Homo sapiens
agcugauuaaaacaca

SEQ ID NO: 1945012 - RNA, 14 nt, Homo sapiens
cacucuguaaaaug

SEQ ID NO: 1945013 - RNA, 21 nt, Homo sapiens
uguacaaauaauagcaaugua

SEQ ID NO: 1945014 - RNA, 17 nt, Homo sapiens
aucaucccaacagccaa

SEQ ID NO: 1945015 - RNA, 19 nt, Homo sapiens
cuucugacuuacugucagu

SEQ ID NO: 1945016 - RNA, 19 nt, Homo sapiens
ugaacuacauaacuuccua

SEQ ID NO: 1945017 - RNA, 18 nt, Homo sapiens
caauaaaguuguugcauu

SEQ ID NO: 1945018 - RNA, 21 nt, Homo sapiens
ugauaaaguaauucauacaaa

SEQ ID NO: 1945019 - RNA, 15 nt, Homo sapiens
gcgaauaacaguccc

SEQ ID NO: 1945020 - RNA, 19 nt, Homo sapiens
ugggauuuaaagccuuuag

SEQ ID NO: 1945021 - RNA, 13 nt, Homo sapiens
uuaaagcucuuca

SEQ ID NO: 1945022 - RNA, 16 nt, Homo sapiens
uccacuccuucccaaa

SEQ ID NO: 1945023 - RNA, 21 nt, Homo sapiens
gacuacuuggaacuaggcucu

SEQ ID NO: 1945024 - RNA, 17 nt, Homo sapiens
guauauuuuugucugca

SEQ ID NO: 1945025 - RNA, 16 nt, Homo sapiens
uggaagcaaacuuaua

SEQ ID NO: 1945026 - RNA, 15 nt, Homo sapiens
uguauagacaucugc

SEQ ID NO: 1945027 - RNA, 17 nt, Homo sapiens
ccuugguaugugccagg

SEQ ID NO: 1945028 - RNA, 13 nt, Homo sapiens
cuuaacacugagc

SEQ ID NO: 1945029 - RNA, 19 nt, Homo sapiens
aacacccagccagucacau

SEQ ID NO: 1945030 - RNA, 17 nt, Homo sapiens
ggcaacaaaugcaucau

SEQ ID NO: 1945031 - RNA, 13 nt, Homo sapiens
agaacgcaugcag

SEQ ID NO: 1945032 - RNA, 15 nt, Homo sapiens
ugcccggccaaguaa

SEQ ID NO: 1945033 - RNA, 14 nt, Homo sapiens
uucucuuugacaaa

SEQ ID NO: 1945034 - RNA, 17 nt, Homo sapiens
ucuggacuuucucuaau

SEQ ID NO: 1945035 - RNA, 19 nt, Homo sapiens
cacuguuuauacacugugu

SEQ ID NO: 1945036 - RNA, 21 nt, Homo sapiens
acaggugugcaccaccaugcc

SEQ ID NO: 1945037 - RNA, 17 nt, Homo sapiens
guacagaauucugcuac

SEQ ID NO: 1945038 - RNA, 23 nt, Homo sapiens
acaccagacugaaguaaacagcu

SEQ ID NO: 1945039 - RNA, 21 nt, Homo sapiens
auugacucaaaaaugagguac

SEQ ID NO: 1945040 - RNA, 21 nt, Homo sapiens
cagacagccguuuguucuaca

SEQ ID NO: 1945041 - RNA, 19 nt, Homo sapiens
aaacgguacacagacuauu

SEQ ID NO: 1945042 - RNA, 13 nt, Homo sapiens
aaaucgugccuug

SEQ ID NO: 1945043 - RNA, 21 nt, Homo sapiens
ugcucugaauaugucaucacu

SEQ ID NO: 1945044 - RNA, 13 nt, Homo sapiens
ugaggaaacugag

SEQ ID NO: 1945045 - RNA, 14 nt, Homo sapiens
caguuuauaccuug

SEQ ID NO: 1945046 - RNA, 22 nt, Homo sapiens
uccagcgucugcuguugauucc

SEQ ID NO: 1945047 - RNA, 18 nt, Homo sapiens
guccuuucuaaguauuuu

SEQ ID NO: 1945048 - RNA, 20 nt, Homo sapiens
cucacugcccaugauucaga

SEQ ID NO: 1945049 - RNA, 16 nt, Homo sapiens
cagaauugugcaaaug

SEQ ID NO: 1945050 - RNA, 21 nt, Homo sapiens
ccuuggcuaguaaaagccauc

SEQ ID NO: 1945051 - RNA, 17 nt, Homo sapiens
agcaaggcccugcugcc

SEQ ID NO: 1945052 - RNA, 13 nt, Homo sapiens
aaacucucugaac

SEQ ID NO: 1945053 - RNA, 19 nt, Homo sapiens
gcagacaggugugcagauu

SEQ ID NO: 1945054 - RNA, 18 nt, Homo sapiens
aucaaaaaugccacuuaa

SEQ ID NO: 1945055 - RNA, 17 nt, Homo sapiens
ugagugaaccuguauaa

SEQ ID NO: 1945056 - RNA, 17 nt, Homo sapiens
aggugaacacuuaguga

SEQ ID NO: 1945057 - RNA, 17 nt, Homo sapiens
agcccagcuugccaaug

SEQ ID NO: 1945058 - RNA, 18 nt, Homo sapiens
aacugaaagguagacuuu

SEQ ID NO: 1945059 - RNA, 14 nt, Homo sapiens
cugcccaaugccuu

SEQ ID NO: 1945060 - RNA, 15 nt, Homo sapiens
cuccuuucuugcacu

SEQ ID NO: 1945061 - RNA, 18 nt, Homo sapiens
acuaagggguauguuccc

SEQ ID NO: 1945062 - RNA, 12 nt, Homo sapiens
gaaccacagggc

SEQ ID NO: 1945063 - RNA, 12 nt, Homo sapiens
uagacacaugaa

SEQ ID NO: 1945064 - RNA, 19 nt, Homo sapiens
gcacaggaugggggcaaug

SEQ ID NO: 1945065 - RNA, 17 nt, Homo sapiens
agauuuuacaaaagagg

SEQ ID NO: 1945066 - RNA, 20 nt, Homo sapiens
guaaguuucugugaccugua

SEQ ID NO: 1945067 - RNA, 19 nt, Homo sapiens
gcuuccugaugcugggcaa

SEQ ID NO: 1945068 - RNA, 16 nt, Homo sapiens
ccucucagcauagccu

SEQ ID NO: 1945069 - RNA, 14 nt, Homo sapiens
cuuuauugugaucu

SEQ ID NO: 1945070 - RNA, 16 nt, Homo sapiens
uaaagcuuuugcauag

SEQ ID NO: 1945071 - RNA, 19 nt, Homo sapiens
agcugcuuugagcuacagg

SEQ ID NO: 1945072 - RNA, 17 nt, Homo sapiens
cuaaguccccugaaauu

SEQ ID NO: 1945073 - RNA, 19 nt, Homo sapiens
agaauaauggacucuuaag

SEQ ID NO: 1945074 - RNA, 17 nt, Homo sapiens
ugauccuuccaccucag

SEQ ID NO: 1945075 - RNA, 19 nt, Homo sapiens
acugauuucacaacagauc

SEQ ID NO: 1945076 - RNA, 14 nt, Homo sapiens
aaaauugucuuucc

SEQ ID NO: 1945077 - RNA, 22 nt, Homo sapiens
agauggauguuugucaaaaagu

SEQ ID NO: 1945078 - RNA, 18 nt, Homo sapiens
caagcuggcuuacacugg

SEQ ID NO: 1945079 - RNA, 18 nt, Homo sapiens
ucaaugacaucuccucca

SEQ ID NO: 1945080 - RNA, 16 nt, Homo sapiens
acuaaugucagcacau

SEQ ID NO: 1945081 - RNA, 13 nt, Homo sapiens
uaguaauuacucu

SEQ ID NO: 1945082 - RNA, 16 nt, Homo sapiens
aaauauuuuaaaggua

SEQ ID NO: 1945083 - RNA, 17 nt, Homo sapiens
ccguguccagcacagaa

SEQ ID NO: 1945084 - RNA, 19 nt, Homo sapiens
ugucagaaacugaagcugu

SEQ ID NO: 1945085 - RNA, 23 nt, Homo sapiens
gcuggguccuugggccuggccag

SEQ ID NO: 1945086 - RNA, 21 nt, Homo sapiens
cauuugaagacccuugugcau

SEQ ID NO: 1945087 - RNA, 19 nt, Homo sapiens
ccagaggcuauuauuuuca

SEQ ID NO: 1945088 - RNA, 19 nt, Homo sapiens
agcacuggugaacugagcu

SEQ ID NO: 1945089 - RNA, 18 nt, Homo sapiens
gaaaaccaacaccaucac

SEQ ID NO: 1945090 - RNA, 14 nt, Homo sapiens
caggucacacgacc

SEQ ID NO: 1945091 - RNA, 17 nt, Homo sapiens
ucugguuugagcaauuu

SEQ ID NO: 1945092 - RNA, 14 nt, Homo sapiens
gccuuugcuugaaa

SEQ ID NO: 1945093 - RNA, 18 nt, Homo sapiens
uccuggaccugaaggcau

SEQ ID NO: 1945094 - RNA, 23 nt, Homo sapiens
cucaaugcaauggcucaucagau

SEQ ID NO: 1945095 - RNA, 16 nt, Homo sapiens
uacucuuuucccaaga

SEQ ID NO: 1945096 - RNA, 17 nt, Homo sapiens
ccucagccucccaaagu

SEQ ID NO: 1945097 - RNA, 18 nt, Homo sapiens
uguacucugaaaguuuug

SEQ ID NO: 1945098 - RNA, 17 nt, Homo sapiens
agguccuaaaguacugg

SEQ ID NO: 1945099 - RNA, 22 nt, Homo sapiens
uuccuaccugcagauccagggg

SEQ ID NO: 1945100 - RNA, 20 nt, Homo sapiens
cacuuacagcucuggccaca

SEQ ID NO: 1945101 - RNA, 19 nt, Homo sapiens
uacuguugcccauugcacu

SEQ ID NO: 1945102 - RNA, 18 nt, Homo sapiens
agaaacacuaagcucucu

SEQ ID NO: 1945103 - RNA, 20 nt, Homo sapiens
gguuacaggacuucugugca

SEQ ID NO: 1945104 - RNA, 17 nt, Homo sapiens
cugucccuaaguuuaaa

SEQ ID NO: 1945105 - RNA, 19 nt, Homo sapiens
uucgugaaguauacuguau

SEQ ID NO: 1945106 - RNA, 22 nt, Homo sapiens
aaauuugaaccaaaacauuccg

SEQ ID NO: 1945107 - RNA, 17 nt, Homo sapiens
agguccuugacuugaug

SEQ ID NO: 1945108 - RNA, 13 nt, Homo sapiens
agcaacuugaugg

SEQ ID NO: 1945109 - RNA, 23 nt, Homo sapiens
ucagauauaaaagacugaccaau

SEQ ID NO: 1945110 - RNA, 14 nt, Homo sapiens
agggcucccugcca

SEQ ID NO: 1945111 - RNA, 24 nt, Homo sapiens
aaugauuuuacggagauaucccag

SEQ ID NO: 1945112 - RNA, 19 nt, Homo sapiens
cacuuugggaggccgaggu

SEQ ID NO: 1945113 - RNA, 14 nt, Homo sapiens
uggauagcauuguu

SEQ ID NO: 1945114 - RNA, 23 nt, Homo sapiens
accucaggccugggggcugggca

SEQ ID NO: 1945115 - RNA, 13 nt, Homo sapiens
ugaggcccagaaa

SEQ ID NO: 1945116 - RNA, 18 nt, Homo sapiens
acaguauuuacugugcua

SEQ ID NO: 1945117 - RNA, 23 nt, Homo sapiens
cugagccaaagagaaugccauuc

SEQ ID NO: 1945118 - RNA, 14 nt, Homo sapiens
cuucagucaagaaa

SEQ ID NO: 1945119 - RNA, 16 nt, Homo sapiens
caccugcuucugaacu

SEQ ID NO: 1945120 - RNA, 18 nt, Homo sapiens
gaaugugugggguauaga

SEQ ID NO: 1945121 - RNA, 17 nt, Homo sapiens
gcauuguaacuuaugaa

SEQ ID NO: 1945122 - RNA, 21 nt, Homo sapiens
caaaugucagagcuauguucc

SEQ ID NO: 1945123 - RNA, 20 nt, Homo sapiens
gaagcaaaagaaacgugaga

SEQ ID NO: 1945124 - RNA, 16 nt, Homo sapiens
gcccagccacauuuca

SEQ ID NO: 1945125 - RNA, 17 nt, Homo sapiens
agcucuucaacaugaca

SEQ ID NO: 1945126 - RNA, 23 nt, Homo sapiens
ucaccaacacaguugggacccaa

SEQ ID NO: 1945127 - RNA, 23 nt, Homo sapiens
ccaaccuagaccuguagauuucc

SEQ ID NO: 1945128 - RNA, 18 nt, Homo sapiens
caaaaaaucauguuuauu

SEQ ID NO: 1945129 - RNA, 21 nt, Homo sapiens
cccaacaggaggacaauucau

SEQ ID NO: 1945130 - RNA, 15 nt, Homo sapiens
acaggagacuugagc

SEQ ID NO: 1945131 - RNA, 12 nt, Homo sapiens
aaauacaacucu

SEQ ID NO: 1945132 - RNA, 22 nt, Homo sapiens
uauuuccuaaaaucacaggaca

SEQ ID NO: 1945133 - RNA, 20 nt, Homo sapiens
ugaguggccagccagugcca

SEQ ID NO: 1945134 - RNA, 17 nt, Homo sapiens
ccuuuccggcacacugc

SEQ ID NO: 1945135 - RNA, 15 nt, Homo sapiens
aucucagccuaccau

SEQ ID NO: 1945136 - RNA, 16 nt, Homo sapiens
ccaacauucuuggcau

SEQ ID NO: 1945137 - RNA, 14 nt, Homo sapiens
cguggguugcacug

SEQ ID NO: 1945138 - RNA, 23 nt, Homo sapiens
cuguccuugucgcugugcccugg

SEQ ID NO: 1945139 - RNA, 23 nt, Homo sapiens
gcgagcugcucugcuauaugccu

SEQ ID NO: 1945140 - RNA, 15 nt, Homo sapiens
cugccggucauuuga

SEQ ID NO: 1945141 - RNA, 16 nt, Homo sapiens
auuaacggagugucua

SEQ ID NO: 1945142 - RNA, 14 nt, Homo sapiens
ccuccuguugccac

SEQ ID NO: 1945143 - RNA, 21 nt, Homo sapiens
aaaccccggcgugugcagugc

SEQ ID NO: 1945144 - RNA, 14 nt, Homo sapiens
aauuauaagcuaug

SEQ ID NO: 1945145 - RNA, 14 nt, Homo sapiens
cuguucuccagugu

SEQ ID NO: 1945146 - RNA, 17 nt, Homo sapiens
cuccauuucuuucuucc

SEQ ID NO: 1945147 - RNA, 24 nt, Homo sapiens
cauguuagccaggcuggucucaaa

SEQ ID NO: 1945148 - RNA, 18 nt, Homo sapiens
acgcuuuucccaccucuu

SEQ ID NO: 1945149 - RNA, 17 nt, Homo sapiens
ucaggaggcacugcuca

SEQ ID NO: 1945150 - RNA, 17 nt, Homo sapiens
aggccuugcucacagcu

SEQ ID NO: 1945151 - RNA, 22 nt, Homo sapiens
acuuccaugagaagaagcagau

SEQ ID NO: 1945152 - RNA, 21 nt, Homo sapiens
ucuggccagggcuuccucaaa

SEQ ID NO: 1945153 - RNA, 17 nt, Homo sapiens
ucugaucaaagcaccuu

SEQ ID NO: 1945154 - RNA, 12 nt, Homo sapiens
ggucaccuggug

SEQ ID NO: 1945155 - RNA, 13 nt, Homo sapiens
agcuggccuguaa

SEQ ID NO: 1945156 - RNA, 19 nt, Homo sapiens
acugaagccuucuucugcc

SEQ ID NO: 1945157 - RNA, 17 nt, Homo sapiens
uccggaggcugaggcag

SEQ ID NO: 1945158 - RNA, 23 nt, Homo sapiens
accucucagcagaaacacacagu

SEQ ID NO: 1945159 - RNA, 17 nt, Homo sapiens
cauugugaaaaggcaaa

SEQ ID NO: 1945160 - RNA, 16 nt, Homo sapiens
acuauccaguuacugc

SEQ ID NO: 1945161 - RNA, 18 nt, Homo sapiens
ugaaaaggguguugcuaa

SEQ ID NO: 1945162 - RNA, 17 nt, Homo sapiens
acugaaaacuacaguug

SEQ ID NO: 1945163 - RNA, 14 nt, Homo sapiens
uaugccacugcacu

SEQ ID NO: 1945164 - RNA, 21 nt, Homo sapiens
cucaaguuuuucagaaagcau

SEQ ID NO: 1945165 - RNA, 23 nt, Homo sapiens
aacccaaagugugacucauuaaa

SEQ ID NO: 1945166 - RNA, 17 nt, Homo sapiens
aaguugacaaaugccaa

SEQ ID NO: 1945167 - RNA, 14 nt, Homo sapiens
ugcucuguacugca

SEQ ID NO: 1945168 - RNA, 22 nt, Homo sapiens
gagagcaaucuugcugugaaac

SEQ ID NO: 1945169 - RNA, 21 nt, Homo sapiens
accuggagcggcuauuccagg

SEQ ID NO: 1945170 - RNA, 16 nt, Homo sapiens
agccaggcuuuucuca

SEQ ID NO: 1945171 - RNA, 16 nt, Homo sapiens
auccaggcuguucuca

SEQ ID NO: 1945172 - RNA, 21 nt, Homo sapiens
gaacuguuuggucgagucuuu

SEQ ID NO: 1945173 - RNA, 20 nt, Homo sapiens
cuccuccguguggacugugc

SEQ ID NO: 1945174 - RNA, 14 nt, Homo sapiens
uucagauuacauga

SEQ ID NO: 1945175 - RNA, 21 nt, Homo sapiens
uacacaucucugucaguguga

SEQ ID NO: 1945176 - RNA, 14 nt, Homo sapiens
aauccacaucuuua

SEQ ID NO: 1945177 - RNA, 19 nt, Homo sapiens
aagugugaagugcagauga

SEQ ID NO: 1945178 - RNA, 22 nt, Homo sapiens
cagauguuuuauuuaugaaguu

SEQ ID NO: 1945179 - RNA, 19 nt, Homo sapiens
uugugagccuugcugccaa

SEQ ID NO: 1945180 - RNA, 21 nt, Homo sapiens
uaaaucugucugauucuaugc

SEQ ID NO: 1945181 - RNA, 21 nt, Homo sapiens
cuucaagugauauauguauuu

SEQ ID NO: 1945182 - RNA, 20 nt, Homo sapiens
ggucuuucauggggugaugc

SEQ ID NO: 1945183 - RNA, 13 nt, Homo sapiens
ggcuggcacugac

SEQ ID NO: 1945184 - RNA, 19 nt, Homo sapiens
cuaagagaaggggugcaga

SEQ ID NO: 1945185 - RNA, 12 nt, Homo sapiens
caccagguccug

SEQ ID NO: 1945186 - RNA, 18 nt, Homo sapiens
aacgguuuaauucugucu

SEQ ID NO: 1945187 - RNA, 13 nt, Homo sapiens
ggcagcagccagg

SEQ ID NO: 1945188 - RNA, 19 nt, Homo sapiens
cugacaacagccugagaaa

SEQ ID NO: 1945189 - RNA, 20 nt, Homo sapiens
ccagaggguagggcacaaag

SEQ ID NO: 1945190 - RNA, 14 nt, Homo sapiens
caccugcuccagaa

SEQ ID NO: 1945191 - RNA, 15 nt, Homo sapiens
cucaagucugcacag

SEQ ID NO: 1945192 - RNA, 12 nt, Homo sapiens
auauagcauuaa

SEQ ID NO: 1945193 - RNA, 20 nt, Homo sapiens
uagcccaucuuccugagcua

SEQ ID NO: 1945194 - RNA, 15 nt, Homo sapiens
aggguagggcacaaa

SEQ ID NO: 1945195 - RNA, 22 nt, Homo sapiens
acacacuuccucguuuuguaau

SEQ ID NO: 1945196 - RNA, 15 nt, Homo sapiens
aagacagcuucucau

SEQ ID NO: 1945197 - RNA, 15 nt, Homo sapiens
ccuaugaaguagcaa

SEQ ID NO: 1945198 - RNA, 22 nt, Homo sapiens
gagaggcagcaagguggccaca

SEQ ID NO: 1945199 - RNA, 17 nt, Homo sapiens
caggggacacugaaccu

SEQ ID NO: 1945200 - RNA, 17 nt, Homo sapiens
cccaaguucaugcagcu

SEQ ID NO: 1945201 - RNA, 17 nt, Homo sapiens
uugguggugguagcauu

SEQ ID NO: 1945202 - RNA, 13 nt, Homo sapiens
ugcaaacuaagga

SEQ ID NO: 1945203 - RNA, 22 nt, Homo sapiens
gaaguucaccagcccugagcca

SEQ ID NO: 1945204 - RNA, 15 nt, Homo sapiens
cugcuaagagaucac

SEQ ID NO: 1945205 - RNA, 18 nt, Homo sapiens
ucccccaucuagccauuu

SEQ ID NO: 1945206 - RNA, 17 nt, Homo sapiens
agaucuguaauucacua

SEQ ID NO: 1945207 - RNA, 15 nt, Homo sapiens
ucauuuugauuuucc

SEQ ID NO: 1945208 - RNA, 23 nt, Homo sapiens
augaaggaauagcccgaggaccg

SEQ ID NO: 1945209 - RNA, 18 nt, Homo sapiens
aucugucuguccuacccg

SEQ ID NO: 1945210 - RNA, 12 nt, Homo sapiens
gacaugaacuac

SEQ ID NO: 1945211 - RNA, 17 nt, Homo sapiens
auuuuagugaacuugaa

SEQ ID NO: 1945212 - RNA, 19 nt, Homo sapiens
aucaaaacccaacaugacu

SEQ ID NO: 1945213 - RNA, 23 nt, Homo sapiens
cagaucuauuguuuguugcacua

SEQ ID NO: 1945214 - RNA, 15 nt, Homo sapiens
aucuucacugcaauu

SEQ ID NO: 1945215 - RNA, 15 nt, Homo sapiens
agcuagaacauucca

SEQ ID NO: 1945216 - RNA, 23 nt, Homo sapiens
ucaacacugaaaaaauacuaccu

SEQ ID NO: 1945217 - RNA, 23 nt, Homo sapiens
aagugcauuuuuaucugugaguu

SEQ ID NO: 1945218 - RNA, 16 nt, Homo sapiens
gcacuagaucauggga

SEQ ID NO: 1945219 - RNA, 18 nt, Homo sapiens
aggucugaugccaaagcu

SEQ ID NO: 1945220 - RNA, 16 nt, Homo sapiens
ugaccugccaggcaca

SEQ ID NO: 1945221 - RNA, 19 nt, Homo sapiens
uuguaguuuaauacaggaa

SEQ ID NO: 1945222 - RNA, 17 nt, Homo sapiens
acgcaggagaucaucug

SEQ ID NO: 1945223 - RNA, 18 nt, Homo sapiens
caaaaacuuucaugccuu

SEQ ID NO: 1945224 - RNA, 17 nt, Homo sapiens
caggacagcagcacucc

SEQ ID NO: 1945225 - RNA, 18 nt, Homo sapiens
ccagaaggaaucuucuca

SEQ ID NO: 1945226 - RNA, 14 nt, Homo sapiens
auggauggggccca

SEQ ID NO: 1945227 - RNA, 17 nt, Homo sapiens
ucguauaagcauggaga

SEQ ID NO: 1945228 - RNA, 20 nt, Homo sapiens
uucuuuaccaaggauauuua

SEQ ID NO: 1945229 - RNA, 19 nt, Homo sapiens
caaggauguucuggcuuua

SEQ ID NO: 1945230 - RNA, 15 nt, Homo sapiens
cuuccuguguaccuc

SEQ ID NO: 1945231 - RNA, 14 nt, Homo sapiens
cucagcaucaaaau

SEQ ID NO: 1945232 - RNA, 23 nt, Homo sapiens
guucucuguucuagagugacagg

SEQ ID NO: 1945233 - RNA, 14 nt, Homo sapiens
agagguugcaguga

SEQ ID NO: 1945234 - RNA, 18 nt, Homo sapiens
aaaccugaugcuggggac

SEQ ID NO: 1945235 - RNA, 18 nt, Homo sapiens
cagcuggaaguggcucug

SEQ ID NO: 1945236 - RNA, 22 nt, Homo sapiens
agaagacaaacuuugcaucuca

SEQ ID NO: 1945237 - RNA, 19 nt, Homo sapiens
gggaaaaucuauuccugcc

SEQ ID NO: 1945238 - RNA, 18 nt, Homo sapiens
augcauucccuacagauu

SEQ ID NO: 1945239 - RNA, 22 nt, Homo sapiens
ccgguggcucacgccuguaauc

SEQ ID NO: 1945240 - RNA, 18 nt, Homo sapiens
caguucccaucaccauca

SEQ ID NO: 1945241 - RNA, 17 nt, Homo sapiens
aagcuaggguuuggcaa

SEQ ID NO: 1945242 - RNA, 16 nt, Homo sapiens
cuguagauaaaguggu

SEQ ID NO: 1945243 - RNA, 21 nt, Homo sapiens
ugcgggcauuuugaaugugau

SEQ ID NO: 1945244 - RNA, 20 nt, Homo sapiens
ccaagaaacguggaucuccc

SEQ ID NO: 1945245 - RNA, 18 nt, Homo sapiens
cucuauucuuuccaugac

SEQ ID NO: 1945246 - RNA, 17 nt, Homo sapiens
ucccaacuccauucucu

SEQ ID NO: 1945247 - RNA, 17 nt, Homo sapiens
agggagaggcucuggac

SEQ ID NO: 1945248 - RNA, 21 nt, Homo sapiens
uaaugacuuaagcacacuuga

SEQ ID NO: 1945249 - RNA, 23 nt, Homo sapiens
ccucuccaaagaggaagcaggca

SEQ ID NO: 1945250 - RNA, 23 nt, Homo sapiens
aauaaucaucgagguauguuuau

SEQ ID NO: 1945251 - RNA, 17 nt, Homo sapiens
ggcauagggaauaugua

SEQ ID NO: 1945252 - RNA, 13 nt, Homo sapiens
gcucuaucugcug

SEQ ID NO: 1945253 - RNA, 21 nt, Homo sapiens
cugaaucauuaacagugcugu

SEQ ID NO: 1945254 - RNA, 17 nt, Homo sapiens
auugaaacacagaguug

SEQ ID NO: 1945255 - RNA, 15 nt, Homo sapiens
ugccucucugcucca

SEQ ID NO: 1945256 - RNA, 21 nt, Homo sapiens
agggaugcaaagguugcagug

SEQ ID NO: 1945257 - RNA, 17 nt, Homo sapiens
auauuuuugugcaccua

SEQ ID NO: 1945258 - RNA, 23 nt, Homo sapiens
agaauuuucauuaauacuguagu

SEQ ID NO: 1945259 - RNA, 21 nt, Homo sapiens
acaauuucaaaagaacauucu

SEQ ID NO: 1945260 - RNA, 15 nt, Homo sapiens
ccuauacaaaacacc

SEQ ID NO: 1945261 - RNA, 16 nt, Homo sapiens
aaggggagaccucaga

SEQ ID NO: 1945262 - RNA, 23 nt, Homo sapiens
uuuaacuuggaguuucauuucuu

SEQ ID NO: 1945263 - RNA, 12 nt, Homo sapiens
uuagguugacau

SEQ ID NO: 1945264 - RNA, 21 nt, Homo sapiens
auuuuucagaccuuuuaacuc

SEQ ID NO: 1945265 - RNA, 22 nt, Homo sapiens
aaauguauuggcacagugcuua

SEQ ID NO: 1945266 - RNA, 20 nt, Homo sapiens
cuuuacaggagguuguggau

SEQ ID NO: 1945267 - RNA, 14 nt, Homo sapiens
uccccagagcauuu

SEQ ID NO: 1945268 - RNA, 21 nt, Homo sapiens
cuuuuauaguggaaaaacaca

SEQ ID NO: 1945269 - RNA, 13 nt, Homo sapiens
caacugugacugu

SEQ ID NO: 1945270 - RNA, 18 nt, Homo sapiens
agaguuugccuguucuau

SEQ ID NO: 1945271 - RNA, 15 nt, Homo sapiens
ucuugacuagugcaa

SEQ ID NO: 1945272 - RNA, 14 nt, Homo sapiens
cucgugauuugccu

SEQ ID NO: 1945273 - RNA, 17 nt, Homo sapiens
gaccgccccucaccaac

SEQ ID NO: 1945274 - RNA, 19 nt, Homo sapiens
aacucauuugaaugcuuaa

SEQ ID NO: 1945275 - RNA, 19 nt, Homo sapiens
ugcugggcccccuacccug

SEQ ID NO: 1945276 - RNA, 14 nt, Homo sapiens
gaaucaguuuccaa

SEQ ID NO: 1945277 - RNA, 17 nt, Homo sapiens
acagcaggugccuggug

SEQ ID NO: 1945278 - RNA, 22 nt, Homo sapiens
accuguagucccagcuacucag

SEQ ID NO: 1945279 - RNA, 21 nt, Homo sapiens
ccuugcauuuuagcuaauuua

SEQ ID NO: 1945280 - RNA, 18 nt, Homo sapiens
aaagaacucagugcugcc

SEQ ID NO: 1945281 - RNA, 22 nt, Homo sapiens
cuauguauggaugaaagcaauc

SEQ ID NO: 1945282 - RNA, 18 nt, Homo sapiens
ucaucaauuuucacuugc

SEQ ID NO: 1945283 - RNA, 18 nt, Homo sapiens
acacuguuaucuucacuu

SEQ ID NO: 1945284 - RNA, 23 nt, Homo sapiens
aaagccuuuuccagaagaucuga

SEQ ID NO: 1945285 - RNA, 21 nt, Homo sapiens
ugaaauaaacacuggugccaa

SEQ ID NO: 1945286 - RNA, 12 nt, Homo sapiens
cuaagaugacau

SEQ ID NO: 1945287 - RNA, 19 nt, Homo sapiens
cuauaaaagcuuucugcca

SEQ ID NO: 1945288 - RNA, 22 nt, Homo sapiens
uuaaaggugugcuauuugucag

SEQ ID NO: 1945289 - RNA, 18 nt, Homo sapiens
ucaguaagacagugcagu

SEQ ID NO: 1945290 - RNA, 16 nt, Homo sapiens
uaagacauaucucuaa

SEQ ID NO: 1945291 - RNA, 15 nt, Homo sapiens
uaaaccugaacaaac

SEQ ID NO: 1945292 - RNA, 18 nt, Homo sapiens
ucaagaucaacauuccag

SEQ ID NO: 1945293 - RNA, 14 nt, Homo sapiens
ugcuuacagugacu

SEQ ID NO: 1945294 - RNA, 15 nt, Homo sapiens
aucauggacugagcu

SEQ ID NO: 1945295 - RNA, 15 nt, Homo sapiens
caguuuagcaagcaa

SEQ ID NO: 1945296 - RNA, 20 nt, Homo sapiens
augaacuagugucuaaauac

SEQ ID NO: 1945297 - RNA, 21 nt, Homo sapiens
ucugccuaaccaugggcucag

SEQ ID NO: 1945298 - RNA, 22 nt, Homo sapiens
gaaguccagugacccuggagcu

SEQ ID NO: 1945299 - RNA, 16 nt, Homo sapiens
gcaauuucuacuacag

SEQ ID NO: 1945300 - RNA, 16 nt, Homo sapiens
agcauuugccacuuag

SEQ ID NO: 1945301 - RNA, 14 nt, Homo sapiens
uugacaucauucau

SEQ ID NO: 1945302 - RNA, 21 nt, Homo sapiens
gggccagccccagcaccucau

SEQ ID NO: 1945303 - RNA, 16 nt, Homo sapiens
ccagaagaagcuuaag

SEQ ID NO: 1945304 - RNA, 20 nt, Homo sapiens
uccuuuaugaugacugcuua

SEQ ID NO: 1945305 - RNA, 22 nt, Homo sapiens
uauaauuucaaaccacacauua

SEQ ID NO: 1945306 - RNA, 20 nt, Homo sapiens
gcaaccagaggaaacuugca

SEQ ID NO: 1945307 - RNA, 22 nt, Homo sapiens
agcuguggccuaggcuaccuca

SEQ ID NO: 1945308 - RNA, 17 nt, Homo sapiens
ucucuaucccaagccaa

SEQ ID NO: 1945309 - RNA, 21 nt, Homo sapiens
caggguuucaccauauuggcc

SEQ ID NO: 1945310 - RNA, 22 nt, Homo sapiens
caauucguuuuuucauuugaau

SEQ ID NO: 1945311 - RNA, 19 nt, Homo sapiens
uaucuagcaaucacaacac

SEQ ID NO: 1945312 - RNA, 17 nt, Homo sapiens
aaguuguggugcugaca

SEQ ID NO: 1945313 - RNA, 16 nt, Homo sapiens
uaaauucaacuuugua

SEQ ID NO: 1945314 - RNA, 14 nt, Homo sapiens
cucucuagguguca

SEQ ID NO: 1945315 - RNA, 21 nt, Homo sapiens
uuggagggggaggccccugag

SEQ ID NO: 1945316 - RNA, 13 nt, Homo sapiens
gcuguccuuuuag

SEQ ID NO: 1945317 - RNA, 20 nt, Homo sapiens
acucuaggggucaggcucca

SEQ ID NO: 1945318 - RNA, 21 nt, Homo sapiens
ccaucuuccaggauggcagca

SEQ ID NO: 1945319 - RNA, 13 nt, Homo sapiens
ugugcccucagau

SEQ ID NO: 1945320 - RNA, 19 nt, Homo sapiens
ggacauagcccuaacuccu

SEQ ID NO: 1945321 - RNA, 18 nt, Homo sapiens
gagaaucagaucauuuca

SEQ ID NO: 1945322 - RNA, 21 nt, Homo sapiens
ccuucgugacaauguuuacaa

SEQ ID NO: 1945323 - RNA, 14 nt, Homo sapiens
cucccgucucgccu

SEQ ID NO: 1945324 - RNA, 19 nt, Homo sapiens
acugaucuuauguguuaca

SEQ ID NO: 1945325 - RNA, 18 nt, Homo sapiens
aguggauggaagugucug

SEQ ID NO: 1945326 - RNA, 16 nt, Homo sapiens
ggucaaguaagaagac

SEQ ID NO: 1945327 - RNA, 15 nt, Homo sapiens
auacagucuuccaca

SEQ ID NO: 1945328 - RNA, 12 nt, Homo sapiens
ccucucucaaaa

SEQ ID NO: 1945329 - RNA, 18 nt, Homo sapiens
uacaggcguacacaugca

SEQ ID NO: 1945330 - RNA, 19 nt, Homo sapiens
cauauguugcucagucucc

SEQ ID NO: 1945331 - RNA, 17 nt, Homo sapiens
uuauccaaaaugcuugg

SEQ ID NO: 1945332 - RNA, 12 nt, Homo sapiens
cgaauucauccc

SEQ ID NO: 1945333 - RNA, 20 nt, Homo sapiens
agcccugucccugcccucag

SEQ ID NO: 1945334 - RNA, 13 nt, Homo sapiens
gcaucuacucuaa

SEQ ID NO: 1945335 - RNA, 13 nt, Homo sapiens
guaucuacuuuaa

SEQ ID NO: 1945336 - RNA, 22 nt, Homo sapiens
uuuaaagaguccuccuucccag

SEQ ID NO: 1945337 - RNA, 16 nt, Homo sapiens
auaguguuaacuguca

SEQ ID NO: 1945338 - RNA, 23 nt, Homo sapiens
auggcccgggccuuauccaguca

SEQ ID NO: 1945339 - RNA, 18 nt, Homo sapiens
auccagaggguugugauu

SEQ ID NO: 1945340 - RNA, 22 nt, Homo sapiens
cuuuauuuguauuugccauuca

SEQ ID NO: 1945341 - RNA, 16 nt, Homo sapiens
gagaucccaacacugc

SEQ ID NO: 1945342 - RNA, 14 nt, Homo sapiens
uggaaaaugugacc

SEQ ID NO: 1945343 - RNA, 19 nt, Homo sapiens
aaucucaaugaagccagcu

SEQ ID NO: 1945344 - RNA, 20 nt, Homo sapiens
cugugcccaccaugacccuc

SEQ ID NO: 1945345 - RNA, 19 nt, Homo sapiens
aaacaaguguucuguaucu

SEQ ID NO: 1945346 - RNA, 16 nt, Homo sapiens
caggcauuuccugcuu

SEQ ID NO: 1945347 - RNA, 17 nt, Homo sapiens
auaaauuuuaacauuuu

SEQ ID NO: 1945348 - RNA, 17 nt, Homo sapiens
aauaugcaguucugcag

SEQ ID NO: 1945349 - RNA, 17 nt, Homo sapiens
auugaauuauuuuguua

SEQ ID NO: 1945350 - RNA, 19 nt, Homo sapiens
aauccugucuguacuaaaa

SEQ ID NO: 1945351 - RNA, 20 nt, Homo sapiens
uaaguaaucuuuuuacaguu

SEQ ID NO: 1945352 - RNA, 14 nt, Homo sapiens
cuacugcagucuuu

SEQ ID NO: 1945353 - RNA, 18 nt, Homo sapiens
uagccagaggacugugau

SEQ ID NO: 1945354 - RNA, 15 nt, Homo sapiens
uccccagagcacugg

SEQ ID NO: 1945355 - RNA, 16 nt, Homo sapiens
uagcaucuaauuucaa

SEQ ID NO: 1945356 - RNA, 13 nt, Homo sapiens
cugcugacuggca

SEQ ID NO: 1945357 - RNA, 23 nt, Homo sapiens
aagcaaggagccccccaaagaca

SEQ ID NO: 1945358 - RNA, 21 nt, Homo sapiens
aauauuuuucuguagugugaa

SEQ ID NO: 1945359 - RNA, 21 nt, Homo sapiens
caugaguccacccuuuggaga

SEQ ID NO: 1945360 - RNA, 21 nt, Homo sapiens
cuggacuuucuccaaaggcac

SEQ ID NO: 1945361 - RNA, 18 nt, Homo sapiens
cuaggggucaggcuccau

SEQ ID NO: 1945362 - RNA, 21 nt, Homo sapiens
uccaguuauaagcguauuuag

SEQ ID NO: 1945363 - RNA, 22 nt, Homo sapiens
acccaccuuccuugcgaccacc

SEQ ID NO: 1945364 - RNA, 16 nt, Homo sapiens
aacaacacuaauugac

SEQ ID NO: 1945365 - RNA, 18 nt, Homo sapiens
cagccccucccagauaga

SEQ ID NO: 1945366 - RNA, 17 nt, Homo sapiens
aguuaagagaaagucac

SEQ ID NO: 1945367 - RNA, 17 nt, Homo sapiens
ccaggaaagaagaguug

SEQ ID NO: 1945368 - RNA, 23 nt, Homo sapiens
uuccaggggcucuggggcagcuc

SEQ ID NO: 1945369 - RNA, 17 nt, Homo sapiens
gaaaacaaucaaauauu

SEQ ID NO: 1945370 - RNA, 22 nt, Homo sapiens
ggugguuuuugagccaugcgug

SEQ ID NO: 1945371 - RNA, 22 nt, Homo sapiens
aaauuacguucuuacaagcuua

SEQ ID NO: 1945372 - RNA, 10 nt, Homo sapiens
gaacuuccuu

SEQ ID NO: 1945373 - RNA, 14 nt, Homo sapiens
aaguugaugcaauc

SEQ ID NO: 1945374 - RNA, 17 nt, Homo sapiens
uaauauaaaguguaaua

SEQ ID NO: 1945375 - RNA, 21 nt, Homo sapiens
caguccuauuuagacauguaa

SEQ ID NO: 1945376 - RNA, 18 nt, Homo sapiens
agcgcucgccacgcucag

SEQ ID NO: 1945377 - RNA, 22 nt, Homo sapiens
gaagaaguguugauugccaaau

SEQ ID NO: 1945378 - RNA, 12 nt, Homo sapiens
agcuuugcugcu

SEQ ID NO: 1945379 - RNA, 16 nt, Homo sapiens
gaacugcacugcuguu

SEQ ID NO: 1945380 - RNA, 16 nt, Homo sapiens
acauggggcaagccag

SEQ ID NO: 1945381 - RNA, 21 nt, Homo sapiens
aagggaggucuccucuagacu

SEQ ID NO: 1945382 - RNA, 11 nt, Homo sapiens
gaccaccagca

SEQ ID NO: 1945383 - RNA, 17 nt, Homo sapiens
guuaugaugugcuuaac

SEQ ID NO: 1945384 - RNA, 14 nt, Homo sapiens
cccaaagugcuagu

SEQ ID NO: 1945385 - RNA, 23 nt, Homo sapiens
ccauuauagcacaaaaucagcca

SEQ ID NO: 1945386 - RNA, 21 nt, Homo sapiens
uuauccaccaagaacauaaga

SEQ ID NO: 1945387 - RNA, 23 nt, Homo sapiens
acacauggugugaguccaaagaa

SEQ ID NO: 1945388 - RNA, 13 nt, Homo sapiens
cagcaauagugaa

SEQ ID NO: 1945389 - RNA, 16 nt, Homo sapiens
ccuucuguuuuccaaa

SEQ ID NO: 1945390 - RNA, 13 nt, Homo sapiens
aacaaaaccacac

SEQ ID NO: 1945391 - RNA, 13 nt, Homo sapiens
cagccaacaagca

SEQ ID NO: 1945392 - RNA, 13 nt, Homo sapiens
ccagcaacacaga

SEQ ID NO: 1945393 - RNA, 13 nt, Homo sapiens
uaaaagcuaucuu

SEQ ID NO: 1945394 - RNA, 20 nt, Homo sapiens
agcacuguagcacuuaacag

SEQ ID NO: 1945395 - RNA, 19 nt, Homo sapiens
ggccugcaccaaaugucag

SEQ ID NO: 1945396 - RNA, 14 nt, Homo sapiens
aaugagcauucugc

SEQ ID NO: 1945397 - RNA, 17 nt, Homo sapiens
gguugaccccuggucuc

SEQ ID NO: 1945398 - RNA, 14 nt, Homo sapiens
uggcacacaccagu

SEQ ID NO: 1945399 - RNA, 16 nt, Homo sapiens
cugugugacucugggu

SEQ ID NO: 1945400 - RNA, 17 nt, Homo sapiens
uaauaagaaaauucuaa

SEQ ID NO: 1945401 - RNA, 17 nt, Homo sapiens
uuccacuccuccuagcc

SEQ ID NO: 1945402 - RNA, 22 nt, Homo sapiens
auugagccccugaggacagggg

SEQ ID NO: 1945403 - RNA, 13 nt, Homo sapiens
aucauaaagucag

SEQ ID NO: 1945404 - RNA, 20 nt, Homo sapiens
agcugagaaaacuaagucag

SEQ ID NO: 1945405 - RNA, 23 nt, Homo sapiens
ugucucuuguuaaaugagcuuaa

SEQ ID NO: 1945406 - RNA, 21 nt, Homo sapiens
aaaauaauagacucgcuaguc

SEQ ID NO: 1945407 - RNA, 18 nt, Homo sapiens
auucaacuaguaccacag

SEQ ID NO: 1945408 - RNA, 18 nt, Homo sapiens
uagaauuauaacuguaaa

SEQ ID NO: 1945409 - RNA, 19 nt, Homo sapiens
caguguuuaagucagcaaa

SEQ ID NO: 1945410 - RNA, 23 nt, Homo sapiens
aagccucagcucauagugaacac

SEQ ID NO: 1945411 - RNA, 18 nt, Homo sapiens
agcuucugcccaccuacu

SEQ ID NO: 1945412 - RNA, 21 nt, Homo sapiens
uauuaaacguguaaauugcac

SEQ ID NO: 1945413 - RNA, 13 nt, Homo sapiens
cacacaaaccagu

SEQ ID NO: 1945414 - RNA, 17 nt, Homo sapiens
agguggauucaugucca

SEQ ID NO: 1945415 - RNA, 19 nt, Homo sapiens
accguagggccugacuccu

SEQ ID NO: 1945416 - RNA, 15 nt, Homo sapiens
ucuuccacagugccu

SEQ ID NO: 1945417 - RNA, 17 nt, Homo sapiens
cugccaccagucacugu

SEQ ID NO: 1945418 - RNA, 16 nt, Homo sapiens
ucucaucacacacaug

SEQ ID NO: 1945419 - RNA, 18 nt, Homo sapiens
aaagauccacccaaauau

SEQ ID NO: 1945420 - RNA, 14 nt, Homo sapiens
agugaaacucccac

SEQ ID NO: 1945421 - RNA, 21 nt, Homo sapiens
acuucauagaaaccucucuau

SEQ ID NO: 1945422 - RNA, 20 nt, Homo sapiens
uaccagacgguucaccagcc

SEQ ID NO: 1945423 - RNA, 23 nt, Homo sapiens
cccacauauaaauguacuuuucc

SEQ ID NO: 1945424 - RNA, 16 nt, Homo sapiens
ugagcagcugggauua

SEQ ID NO: 1945425 - RNA, 16 nt, Homo sapiens
ucaucuuguucuuccc

SEQ ID NO: 1945426 - RNA, 17 nt, Homo sapiens
agguuccuuuuucaaaa

SEQ ID NO: 1945427 - RNA, 17 nt, Homo sapiens
uggcuuuucaccccaga

SEQ ID NO: 1945428 - RNA, 14 nt, Homo sapiens
augcauuuuauaga

SEQ ID NO: 1945429 - RNA, 22 nt, Homo sapiens
uaaaaaccaaauaagcaucugu

SEQ ID NO: 1945430 - RNA, 17 nt, Homo sapiens
cacagcgcuaugcaauu

SEQ ID NO: 1945431 - RNA, 18 nt, Homo sapiens
uccuucccccucacugaa

SEQ ID NO: 1945432 - RNA, 17 nt, Homo sapiens
cugggacccgaggauuu

SEQ ID NO: 1945433 - RNA, 18 nt, Homo sapiens
cacacugagacuugaauc

SEQ ID NO: 1945434 - RNA, 19 nt, Homo sapiens
cugaacuaggugaucucag

SEQ ID NO: 1945435 - RNA, 15 nt, Homo sapiens
uaacaguuuuuuaca

SEQ ID NO: 1945436 - RNA, 17 nt, Homo sapiens
ccugaucagaggcauuu

SEQ ID NO: 1945437 - RNA, 20 nt, Homo sapiens
aaaguaccacauuccaugac

SEQ ID NO: 1945438 - RNA, 16 nt, Homo sapiens
ugacagaaaaguaaug

SEQ ID NO: 1945439 - RNA, 10 nt, Homo sapiens
augagccagc

SEQ ID NO: 1945440 - RNA, 18 nt, Homo sapiens
aacauaaaacuucuuuag

SEQ ID NO: 1945441 - RNA, 14 nt, Homo sapiens
cuaucacauuacau

SEQ ID NO: 1945442 - RNA, 11 nt, Homo sapiens
uaaaugugcag

SEQ ID NO: 1945443 - RNA, 13 nt, Homo sapiens
aucagucaugugu

SEQ ID NO: 1945444 - RNA, 14 nt, Homo sapiens
auuuagauaugcaa

SEQ ID NO: 1945445 - RNA, 19 nt, Homo sapiens
agccagaggguagggcaca

SEQ ID NO: 1945446 - RNA, 13 nt, Homo sapiens
agcagcacccagu

SEQ ID NO: 1945447 - RNA, 15 nt, Homo sapiens
ucuuuauuauggaaa

SEQ ID NO: 1945448 - RNA, 23 nt, Homo sapiens
uccccauccaggucuugacucau

SEQ ID NO: 1945449 - RNA, 14 nt, Homo sapiens
ccugguacugaggu

SEQ ID NO: 1945450 - RNA, 12 nt, Homo sapiens
aucccuaccccc

SEQ ID NO: 1945451 - RNA, 19 nt, Homo sapiens
aaugucaauucuugccaaa

SEQ ID NO: 1945452 - RNA, 15 nt, Homo sapiens
acccuggugcugcca

SEQ ID NO: 1945453 - RNA, 13 nt, Homo sapiens
aauaaaaccacca

SEQ ID NO: 1945454 - RNA, 13 nt, Homo sapiens
cccugcaccucau

SEQ ID NO: 1945455 - RNA, 21 nt, Homo sapiens
uucccaucuccuuucucuggu

SEQ ID NO: 1945456 - RNA, 18 nt, Homo sapiens
acacauacauaaugguac

SEQ ID NO: 1945457 - RNA, 17 nt, Homo sapiens
cauuguauuaauaccaa

SEQ ID NO: 1945458 - RNA, 15 nt, Homo sapiens
cucagcccaggcaca

SEQ ID NO: 1945459 - RNA, 17 nt, Homo sapiens
gccugcagucuucuggg

SEQ ID NO: 1945460 - RNA, 13 nt, Homo sapiens
ggugucacauucc

SEQ ID NO: 1945461 - RNA, 17 nt, Homo sapiens
guaacuuuuacaaaaca

SEQ ID NO: 1945462 - RNA, 21 nt, Homo sapiens
gacaccaccacccuugccaug

SEQ ID NO: 1945463 - RNA, 19 nt, Homo sapiens
agacuuauggaacagggau

SEQ ID NO: 1945464 - RNA, 14 nt, Homo sapiens
agugaacacucagu

SEQ ID NO: 1945465 - RNA, 18 nt, Homo sapiens
cccugacuaaacuaccac

SEQ ID NO: 1945466 - RNA, 21 nt, Homo sapiens
gaggggaaguccagccuacca

SEQ ID NO: 1945467 - RNA, 20 nt, Homo sapiens
ggcaggagagucacuugaac

SEQ ID NO: 1945468 - RNA, 13 nt, Homo sapiens
ccaggccaggugc

SEQ ID NO: 1945469 - RNA, 23 nt, Homo sapiens
gaugcccccuguggaugcugcug

SEQ ID NO: 1945470 - RNA, 18 nt, Homo sapiens
uauguucaguuuguacaa

SEQ ID NO: 1945471 - RNA, 14 nt, Homo sapiens
auuggaaucuguau

SEQ ID NO: 1945472 - RNA, 15 nt, Homo sapiens
cagccucugaaguug

SEQ ID NO: 1945473 - RNA, 15 nt, Homo sapiens
auuauuuacugacau

SEQ ID NO: 1945474 - RNA, 21 nt, Homo sapiens
gggcaugccuugugcuguuaa

SEQ ID NO: 1945475 - RNA, 16 nt, Homo sapiens
agguugcagcugcucu

SEQ ID NO: 1945476 - RNA, 16 nt, Homo sapiens
cagaucugcacugggu

SEQ ID NO: 1945477 - RNA, 18 nt, Homo sapiens
aguucagaggaagcacau

SEQ ID NO: 1945478 - RNA, 15 nt, Homo sapiens
aaucagauucaggag

SEQ ID NO: 1945479 - RNA, 20 nt, Homo sapiens
agguccuuaggccucugaga

SEQ ID NO: 1945480 - RNA, 23 nt, Homo sapiens
gagagcugcccacaacuugccaa

SEQ ID NO: 1945481 - RNA, 15 nt, Homo sapiens
cugaccucuaccuuc

SEQ ID NO: 1945482 - RNA, 22 nt, Homo sapiens
guugccucccccgccuccaguc

SEQ ID NO: 1945483 - RNA, 19 nt, Homo sapiens
ugaauuuguagacauacuu

SEQ ID NO: 1945484 - RNA, 23 nt, Homo sapiens
aaccagaauuaggucaaguucau

SEQ ID NO: 1945485 - RNA, 14 nt, Homo sapiens
uauagauaacagau

SEQ ID NO: 1945486 - RNA, 18 nt, Homo sapiens
acaagaagcaauguuaua

SEQ ID NO: 1945487 - RNA, 15 nt, Homo sapiens
agagaguugagacuu

SEQ ID NO: 1945488 - RNA, 22 nt, Homo sapiens
ccaauggaaaauauaaugauca

SEQ ID NO: 1945489 - RNA, 21 nt, Homo sapiens
accuuuaaauaucauucuuug

SEQ ID NO: 1945490 - RNA, 20 nt, Homo sapiens
gugccuuauggaacacucug

SEQ ID NO: 1945491 - RNA, 14 nt, Homo sapiens
cguccaccucagug

SEQ ID NO: 1945492 - RNA, 11 nt, Homo sapiens
uaacucaggca

SEQ ID NO: 1945493 - RNA, 14 nt, Homo sapiens
ucacauggcauggu

SEQ ID NO: 1945494 - RNA, 21 nt, Homo sapiens
uccugagcaaacaaaaccacc

SEQ ID NO: 1945495 - RNA, 18 nt, Homo sapiens
auuauaauuaguuccuca

SEQ ID NO: 1945496 - RNA, 17 nt, Homo sapiens
agagccaggcuguugga

SEQ ID NO: 1945497 - RNA, 18 nt, Homo sapiens
guguauaaauaguaacuu

SEQ ID NO: 1945498 - RNA, 13 nt, Homo sapiens
cagucauuuugca

SEQ ID NO: 1945499 - RNA, 19 nt, Homo sapiens
ucugcccugccuacuuuua

SEQ ID NO: 1945500 - RNA, 23 nt, Homo sapiens
cuuauggaauugauuugcauuga

SEQ ID NO: 1945501 - RNA, 14 nt, Homo sapiens
gggugcaagcacuc

SEQ ID NO: 1945502 - RNA, 20 nt, Homo sapiens
uaaaguacauuauuuaugaa

SEQ ID NO: 1945503 - RNA, 16 nt, Homo sapiens
gccaccacugggcaaa

SEQ ID NO: 1945504 - RNA, 20 nt, Homo sapiens
aauuucaccaccaaaugcca

SEQ ID NO: 1945505 - RNA, 19 nt, Homo sapiens
gacaguuaagagaaaugag

SEQ ID NO: 1945506 - RNA, 20 nt, Homo sapiens
uagagcaucugucccacugg

SEQ ID NO: 1945507 - RNA, 15 nt, Homo sapiens
agaugggaaaaccau

SEQ ID NO: 1945508 - RNA, 13 nt, Homo sapiens
uuuauacuucaaa

SEQ ID NO: 1945509 - RNA, 19 nt, Homo sapiens
aguaaauaaacaagucaaa

SEQ ID NO: 1945510 - RNA, 14 nt, Homo sapiens
aaauuaccagauau

SEQ ID NO: 1945511 - RNA, 15 nt, Homo sapiens
cuugagcugacccaa

SEQ ID NO: 1945512 - RNA, 17 nt, Homo sapiens
cucaaaauaaaaagccu

SEQ ID NO: 1945513 - RNA, 11 nt, Homo sapiens
cauacugagcc

SEQ ID NO: 1945514 - RNA, 15 nt, Homo sapiens
ugagaaccacgguga

SEQ ID NO: 1945515 - RNA, 23 nt, Homo sapiens
acgccccccggccugauggccag

SEQ ID NO: 1945516 - RNA, 15 nt, Homo sapiens
gauauauaugugcuc

SEQ ID NO: 1945517 - RNA, 17 nt, Homo sapiens
caguaaacaacuuguac

SEQ ID NO: 1945518 - RNA, 14 nt, Homo sapiens
agagcuauggugag

SEQ ID NO: 1945519 - RNA, 18 nt, Homo sapiens
gagcgagacuccgucuca

SEQ ID NO: 1945520 - RNA, 16 nt, Homo sapiens
caagaccuucucccca

SEQ ID NO: 1945521 - RNA, 18 nt, Homo sapiens
aaggauccuccaaaguca

SEQ ID NO: 1945522 - RNA, 14 nt, Homo sapiens
cugagcugccccug

SEQ ID NO: 1945523 - RNA, 13 nt, Homo sapiens
uguucagaugcuu

SEQ ID NO: 1945524 - RNA, 14 nt, Homo sapiens
aaggacaggccaca

SEQ ID NO: 1945525 - RNA, 16 nt, Homo sapiens
accuggagugcucaau

SEQ ID NO: 1945526 - RNA, 13 nt, Homo sapiens
aggagaauugaau

SEQ ID NO: 1945527 - RNA, 15 nt, Homo sapiens
agguuagagguuugu

SEQ ID NO: 1945528 - RNA, 14 nt, Homo sapiens
caaacaauucugau

SEQ ID NO: 1945529 - RNA, 20 nt, Homo sapiens
accauguggauaacuuuaca

SEQ ID NO: 1945530 - RNA, 19 nt, Homo sapiens
augaaaaucuccaucucaa

SEQ ID NO: 1945531 - RNA, 21 nt, Homo sapiens
cuugcccacccccaccaugca

SEQ ID NO: 1945532 - RNA, 21 nt, Homo sapiens
accucccccuuucacacugga

SEQ ID NO: 1945533 - RNA, 19 nt, Homo sapiens
acugcuggggaucuaggga

SEQ ID NO: 1945534 - RNA, 16 nt, Homo sapiens
uccuaacugacaugca

SEQ ID NO: 1945535 - RNA, 20 nt, Homo sapiens
gauguccagaagaauauuca

SEQ ID NO: 1945536 - RNA, 20 nt, Homo sapiens
aacuuuguggaugucuuccu

SEQ ID NO: 1945537 - RNA, 13 nt, Homo sapiens
gagcacuuccaaa

SEQ ID NO: 1945538 - RNA, 12 nt, Homo sapiens
cuuaugcuguac

SEQ ID NO: 1945539 - RNA, 21 nt, Homo sapiens
gcaaguuggaaaauauguaac

SEQ ID NO: 1945540 - RNA, 22 nt, Homo sapiens
cauaucacguacaccauaugca

SEQ ID NO: 1945541 - RNA, 21 nt, Homo sapiens
agagccugcaucugucugucc

SEQ ID NO: 1945542 - RNA, 13 nt, Homo sapiens
aaacacacuacua

SEQ ID NO: 1945543 - RNA, 19 nt, Homo sapiens
auauuugcacuuauguacu

SEQ ID NO: 1945544 - RNA, 18 nt, Homo sapiens
caaaugcccccugaguga

SEQ ID NO: 1945545 - RNA, 13 nt, Homo sapiens
gagucauugucag

SEQ ID NO: 1945546 - RNA, 17 nt, Homo sapiens
gcaauucagucugcucu

SEQ ID NO: 1945547 - RNA, 20 nt, Homo sapiens
gccaacugcccagagccaca

SEQ ID NO: 1945548 - RNA, 17 nt, Homo sapiens
aagauuauacaaucucu

SEQ ID NO: 1945549 - RNA, 22 nt, Homo sapiens
cacagaagggugugggccacca

SEQ ID NO: 1945550 - RNA, 15 nt, Homo sapiens
uggugucaucugcuc

SEQ ID NO: 1945551 - RNA, 17 nt, Homo sapiens
auguacacgugcacaga

SEQ ID NO: 1945552 - RNA, 20 nt, Homo sapiens
aaguagaauagaaaaucuca

SEQ ID NO: 1945553 - RNA, 19 nt, Homo sapiens
gguaagagaaaaccuagua

SEQ ID NO: 1945554 - RNA, 14 nt, Homo sapiens
cacuuucucacuua

SEQ ID NO: 1945555 - RNA, 14 nt, Homo sapiens
ucccuucuucccua

SEQ ID NO: 1945556 - RNA, 14 nt, Homo sapiens
gcaaaacugcaaau

SEQ ID NO: 1945557 - RNA, 24 nt, Homo sapiens
guuacuggcuucucuugagucaca

SEQ ID NO: 1945558 - RNA, 18 nt, Homo sapiens
auccuuucugccucucaa

SEQ ID NO: 1945559 - RNA, 22 nt, Homo sapiens
acucuauaagauuccaaaaagc

SEQ ID NO: 1945560 - RNA, 17 nt, Homo sapiens
gcaucccgauaccucag

SEQ ID NO: 1945561 - RNA, 22 nt, Homo sapiens
cuagggcacuuuaagucaguga

SEQ ID NO: 1945562 - RNA, 16 nt, Homo sapiens
agacuuccuguaagau

SEQ ID NO: 1945563 - RNA, 15 nt, Homo sapiens
ucugggggcugagga

SEQ ID NO: 1945564 - RNA, 16 nt, Homo sapiens
uaguucugaguccuga

SEQ ID NO: 1945565 - RNA, 23 nt, Homo sapiens
accauagggcuggggacugggga

SEQ ID NO: 1945566 - RNA, 17 nt, Homo sapiens
auuauagcucaugugca

SEQ ID NO: 1945567 - RNA, 12 nt, Homo sapiens
aauaucuaaaaa

SEQ ID NO: 1945568 - RNA, 23 nt, Homo sapiens
uagccuuuauuuuuaaccugcca

SEQ ID NO: 1945569 - RNA, 20 nt, Homo sapiens
auucauucugaacccuccaa

SEQ ID NO: 1945570 - RNA, 13 nt, Homo sapiens
cuggaaauggaca

SEQ ID NO: 1945571 - RNA, 23 nt, Homo sapiens
ugauugucaacacaaacuggcuu

SEQ ID NO: 1945572 - RNA, 19 nt, Homo sapiens
cuucucucaccuccuaaag

SEQ ID NO: 1945573 - RNA, 22 nt, Homo sapiens
uucuuagugaaaggucaucuca

SEQ ID NO: 1945574 - RNA, 16 nt, Homo sapiens
gucuuccagguacuga

SEQ ID NO: 1945575 - RNA, 17 nt, Homo sapiens
ggcauucuaagucacag

SEQ ID NO: 1945576 - RNA, 11 nt, Homo sapiens
agaaaugaugg

SEQ ID NO: 1945577 - RNA, 14 nt, Homo sapiens
uuccaaugaugcuu

SEQ ID NO: 1945578 - RNA, 19 nt, Homo sapiens
ggccuugucucuuccucug

SEQ ID NO: 1945579 - RNA, 18 nt, Homo sapiens
uuuuugggggaaggucag

SEQ ID NO: 1945580 - RNA, 15 nt, Homo sapiens
ccagcuccaguuucc

SEQ ID NO: 1945581 - RNA, 12 nt, Homo sapiens
agaggaugcugu

SEQ ID NO: 1945582 - RNA, 15 nt, Homo sapiens
acucaguuccaaagu

SEQ ID NO: 1945583 - RNA, 15 nt, Homo sapiens
gcugagucagacugu

SEQ ID NO: 1945584 - RNA, 17 nt, Homo sapiens
cagaaucucaaauaacu

SEQ ID NO: 1945585 - RNA, 19 nt, Homo sapiens
aaaggaccugcauuuuccu

SEQ ID NO: 1945586 - RNA, 20 nt, Homo sapiens
uaguuuaucauuaaccacuu

SEQ ID NO: 1945587 - RNA, 23 nt, Homo sapiens
ucccauuaccauguaauggcagu

SEQ ID NO: 1945588 - RNA, 16 nt, Homo sapiens
gcuaaccucacugccu

SEQ ID NO: 1945589 - RNA, 18 nt, Homo sapiens
gacuugauuuacaagcau

SEQ ID NO: 1945590 - RNA, 23 nt, Homo sapiens
uauaccuggcaauucacaaauag

SEQ ID NO: 1945591 - RNA, 19 nt, Homo sapiens
uuuaaaaaacguacucuua

SEQ ID NO: 1945592 - RNA, 17 nt, Homo sapiens
acgacagugcauuugcc

SEQ ID NO: 1945593 - RNA, 11 nt, Homo sapiens
auuccaucucc

SEQ ID NO: 1945594 - RNA, 22 nt, Homo sapiens
ugaugacacccacccugugcca

SEQ ID NO: 1945595 - RNA, 18 nt, Homo sapiens
agcauaggaaggcucuau

SEQ ID NO: 1945596 - RNA, 16 nt, Homo sapiens
acuguaaagccaguug

SEQ ID NO: 1945597 - RNA, 13 nt, Homo sapiens
uuaggaaacuggg

SEQ ID NO: 1945598 - RNA, 13 nt, Homo sapiens
uaaauaaacagau

SEQ ID NO: 1945599 - RNA, 22 nt, Homo sapiens
gaugagccacagaaauugcaua

SEQ ID NO: 1945600 - RNA, 18 nt, Homo sapiens
auuuaccuucuaccucuu

SEQ ID NO: 1945601 - RNA, 20 nt, Homo sapiens
cuaccuccagaguuguugaa

SEQ ID NO: 1945602 - RNA, 18 nt, Homo sapiens
acugggcuggguuugcug

SEQ ID NO: 1945603 - RNA, 12 nt, Homo sapiens
gugacacauaug

SEQ ID NO: 1945604 - RNA, 12 nt, Homo sapiens
aauggccaaagc

SEQ ID NO: 1945605 - RNA, 20 nt, Homo sapiens
gcccaaguuguggugcugac

SEQ ID NO: 1945606 - RNA, 17 nt, Homo sapiens
agagaugacaaaccaua

SEQ ID NO: 1945607 - RNA, 19 nt, Homo sapiens
auggucacccccacucugc

SEQ ID NO: 1945608 - RNA, 22 nt, Homo sapiens
aagaaaaauauuaauaagacaa

SEQ ID NO: 1945609 - RNA, 20 nt, Homo sapiens
auaaaauauggacuuccaau

SEQ ID NO: 1945610 - RNA, 18 nt, Homo sapiens
cuguccucucagaacucc

SEQ ID NO: 1945611 - RNA, 16 nt, Homo sapiens
ggugguaagcaccagg

SEQ ID NO: 1945612 - RNA, 18 nt, Homo sapiens
caaaggcucucacuccag

SEQ ID NO: 1945613 - RNA, 22 nt, Homo sapiens
aaucaguguuuccaaucugucc

SEQ ID NO: 1945614 - RNA, 16 nt, Homo sapiens
uaggagcaauacuauu

SEQ ID NO: 1945615 - RNA, 13 nt, Homo sapiens
gacgcugcugaca

SEQ ID NO: 1945616 - RNA, 20 nt, Homo sapiens
cagcaggcugccagugccug

SEQ ID NO: 1945617 - RNA, 19 nt, Homo sapiens
uaaccaauccuacuaauaa

SEQ ID NO: 1945618 - RNA, 22 nt, Homo sapiens
cucuagauggcaacauuggaca

SEQ ID NO: 1945619 - RNA, 14 nt, Homo sapiens
ccccuccuggcaau

SEQ ID NO: 1945620 - RNA, 17 nt, Homo sapiens
aacgagggauaauucaa

SEQ ID NO: 1945621 - RNA, 19 nt, Homo sapiens
aaaaagauccugcauuuau

SEQ ID NO: 1945622 - RNA, 23 nt, Homo sapiens
gagugcccagaacuggacucagg

SEQ ID NO: 1945623 - RNA, 20 nt, Homo sapiens
aacugaguguuauuugcaca

SEQ ID NO: 1945624 - RNA, 15 nt, Homo sapiens
uacccaccaccuucu

SEQ ID NO: 1945625 - RNA, 11 nt, Homo sapiens
ugaagugcaau

SEQ ID NO: 1945626 - RNA, 11 nt, Homo sapiens
uaaagugcagu

SEQ ID NO: 1945627 - RNA, 14 nt, Homo sapiens
ugaggcugcaauca

SEQ ID NO: 1945628 - RNA, 12 nt, Homo sapiens
uuaacacacugg

SEQ ID NO: 1945629 - RNA, 20 nt, Homo sapiens
auaacacugucuaccucaca

SEQ ID NO: 1945630 - RNA, 18 nt, Homo sapiens
gaaaaaacagaucagggc

SEQ ID NO: 1945631 - RNA, 12 nt, Homo sapiens
uccucuuaauuc

SEQ ID NO: 1945632 - RNA, 19 nt, Homo sapiens
aacagcagauuucagauca

SEQ ID NO: 1945633 - RNA, 14 nt, Homo sapiens
cauguagcauauaa

SEQ ID NO: 1945634 - RNA, 18 nt, Homo sapiens
ucaaaagccuuaccuuga

SEQ ID NO: 1945635 - RNA, 16 nt, Homo sapiens
ccaacuugauguucca

SEQ ID NO: 1945636 - RNA, 19 nt, Homo sapiens
cugcuaaaggacaguggau

SEQ ID NO: 1945637 - RNA, 23 nt, Homo sapiens
gaauagauuuuagcaugaugaaa

SEQ ID NO: 1945638 - RNA, 14 nt, Homo sapiens
uuucacuaugauuu

SEQ ID NO: 1945639 - RNA, 14 nt, Homo sapiens
augugugauuucac

SEQ ID NO: 1945640 - RNA, 17 nt, Homo sapiens
uucugcaagcuuuucaa

SEQ ID NO: 1945641 - RNA, 20 nt, Homo sapiens
ccggcauccuugccugucua

SEQ ID NO: 1945642 - RNA, 16 nt, Homo sapiens
agcuucaugugacaca

SEQ ID NO: 1945643 - RNA, 12 nt, Homo sapiens
uagucaauccug

SEQ ID NO: 1945644 - RNA, 20 nt, Homo sapiens
gucagaaaaaggaaaccaca

SEQ ID NO: 1945645 - RNA, 21 nt, Homo sapiens
uagccuuuuuuccccagacuu

SEQ ID NO: 1945646 - RNA, 15 nt, Homo sapiens
ggcaucugacaugca

SEQ ID NO: 1945647 - RNA, 23 nt, Homo sapiens
guauacuagaaaguaauacaaua

SEQ ID NO: 1945648 - RNA, 18 nt, Homo sapiens
ccaggguucuguauugca

SEQ ID NO: 1945649 - RNA, 18 nt, Homo sapiens
gauucaauauuaugaauu

SEQ ID NO: 1945650 - RNA, 20 nt, Homo sapiens
acuguugccugcauuuguac

SEQ ID NO: 1945651 - RNA, 15 nt, Homo sapiens
acccaguguuggucu

SEQ ID NO: 1945652 - RNA, 16 nt, Homo sapiens
cuaaacaaaauugcaa

SEQ ID NO: 1945653 - RNA, 20 nt, Homo sapiens
caccuggacaauuucuagaa

SEQ ID NO: 1945654 - RNA, 13 nt, Homo sapiens
gacugguacucaa

SEQ ID NO: 1945655 - RNA, 17 nt, Homo sapiens
ucauccuccauugcucc

SEQ ID NO: 1945656 - RNA, 14 nt, Homo sapiens
uccaccccauguca

SEQ ID NO: 1945657 - RNA, 20 nt, Homo sapiens
ucuccaugcuggauacugga

SEQ ID NO: 1945658 - RNA, 17 nt, Homo sapiens
cucaaaaugacagccau

SEQ ID NO: 1945659 - RNA, 15 nt, Homo sapiens
uuuacaaucugcacu

SEQ ID NO: 1945660 - RNA, 22 nt, Homo sapiens
caucauggaggucauacaugca

SEQ ID NO: 1945661 - RNA, 14 nt, Homo sapiens
uuaagaaugaucug

SEQ ID NO: 1945662 - RNA, 21 nt, Homo sapiens
auacacauggaugcacgcaca

SEQ ID NO: 1945663 - RNA, 16 nt, Homo sapiens
caaacugcaaaccaug

SEQ ID NO: 1945664 - RNA, 14 nt, Homo sapiens
acuaguaucucugg

SEQ ID NO: 1945665 - RNA, 16 nt, Homo sapiens
augaauggcagaugug

SEQ ID NO: 1945666 - RNA, 22 nt, Homo sapiens
uaaaccccggcgugugcagugc

SEQ ID NO: 1945667 - RNA, 16 nt, Homo sapiens
auagagugucucaggg

SEQ ID NO: 1945668 - RNA, 12 nt, Homo sapiens
ccggcugcgugg

SEQ ID NO: 1945669 - RNA, 20 nt, Homo sapiens
uuuagaaccaccaacaagca

SEQ ID NO: 1945670 - RNA, 18 nt, Homo sapiens
uguagacugaaaagccau

SEQ ID NO: 1945671 - RNA, 22 nt, Homo sapiens
uaaugcaagggucucacacugu

SEQ ID NO: 1945672 - RNA, 15 nt, Homo sapiens
aaguguuuccauucu

SEQ ID NO: 1945673 - RNA, 23 nt, Homo sapiens
auuauaaaaauaauauaugcuca

SEQ ID NO: 1945674 - RNA, 17 nt, Homo sapiens
agguauaaugauacugc

SEQ ID NO: 1945675 - RNA, 17 nt, Homo sapiens
uguuuauauacuggguu

SEQ ID NO: 1945676 - RNA, 13 nt, Homo sapiens
gcaagaugagcug

SEQ ID NO: 1945677 - RNA, 15 nt, Homo sapiens
acaugugacacauau

SEQ ID NO: 1945678 - RNA, 20 nt, Homo sapiens
cggcggcucugagcaggggc

SEQ ID NO: 1945679 - RNA, 20 nt, Homo sapiens
caaggggcguggagagugag

SEQ ID NO: 1945680 - RNA, 21 nt, Homo sapiens
ccugguuaaacaaaccagaau

SEQ ID NO: 1945681 - RNA, 14 nt, Homo sapiens
uuugugaacucaaa

SEQ ID NO: 1945682 - RNA, 23 nt, Homo sapiens
cauuccgaaaaaaaaauguucau

SEQ ID NO: 1945683 - RNA, 19 nt, Homo sapiens
aacuugcuccuuuccauca

SEQ ID NO: 1945684 - RNA, 16 nt, Homo sapiens
guugcuauagugacau

SEQ ID NO: 1945685 - RNA, 15 nt, Homo sapiens
ucuuuuuaauaccag

SEQ ID NO: 1945686 - RNA, 22 nt, Homo sapiens
aucgaggaaccagagccaugga

SEQ ID NO: 1945687 - RNA, 17 nt, Homo sapiens
auggcuuccuccugcgc

SEQ ID NO: 1945688 - RNA, 17 nt, Homo sapiens
cuuuaauuugaaucuua

SEQ ID NO: 1945689 - RNA, 21 nt, Homo sapiens
auccuaacugacaugcagauu

SEQ ID NO: 1945690 - RNA, 14 nt, Homo sapiens
ucuuauugccucac

SEQ ID NO: 1945691 - RNA, 22 nt, Homo sapiens
uagacaugucuagccacugauc

SEQ ID NO: 1945692 - RNA, 20 nt, Homo sapiens
gaaacaaggcugccaggugu

SEQ ID NO: 1945693 - RNA, 13 nt, Homo sapiens
uagaaaugaauuu

SEQ ID NO: 1945694 - RNA, 19 nt, Homo sapiens
agcagucgaccgcacuuau

SEQ ID NO: 1945695 - RNA, 23 nt, Homo sapiens
gcugcucuuagugcccgccuagg

SEQ ID NO: 1945696 - RNA, 15 nt, Homo sapiens
guguuucauaacaaa

SEQ ID NO: 1945697 - RNA, 14 nt, Homo sapiens
ccagggcuccaaau

SEQ ID NO: 1945698 - RNA, 21 nt, Homo sapiens
auggcuuccgugagacacaag

SEQ ID NO: 1945699 - RNA, 19 nt, Homo sapiens
cacgugguccuaaucuucu

SEQ ID NO: 1945700 - RNA, 15 nt, Homo sapiens
aucucaaacuacugg

SEQ ID NO: 1945701 - RNA, 15 nt, Homo sapiens
aaaacuuaaagcaaa

SEQ ID NO: 1945702 - RNA, 14 nt, Homo sapiens
cagaauguaucugu

SEQ ID NO: 1945703 - RNA, 16 nt, Homo sapiens
caguucaccuugaaga

SEQ ID NO: 1945704 - RNA, 17 nt, Homo sapiens
aaaacaaaaaaacacaa

SEQ ID NO: 1945705 - RNA, 23 nt, Homo sapiens
gaaaaguccacaagaacaauuca

SEQ ID NO: 1945706 - RNA, 13 nt, Homo sapiens
acugcaucucaaa

SEQ ID NO: 1945707 - RNA, 13 nt, Homo sapiens
ucaacaucacuga

SEQ ID NO: 1945708 - RNA, 16 nt, Homo sapiens
acacaucuauucucaa

SEQ ID NO: 1945709 - RNA, 22 nt, Homo sapiens
ugcgccuguacucccagcacuu

SEQ ID NO: 1945710 - RNA, 22 nt, Homo sapiens
aaaaaaugaucuauugcagaua

SEQ ID NO: 1945711 - RNA, 15 nt, Homo sapiens
caaguggucugggac

SEQ ID NO: 1945712 - RNA, 15 nt, Homo sapiens
caauggggccaguca

SEQ ID NO: 1945713 - RNA, 15 nt, Homo sapiens
auauguaucauaaaa

SEQ ID NO: 1945714 - RNA, 16 nt, Homo sapiens
ucccuuaauuuaaguc

SEQ ID NO: 1945715 - RNA, 15 nt, Homo sapiens
uagugaauggucucu

SEQ ID NO: 1945716 - RNA, 16 nt, Homo sapiens
aaagggagaagaggga

SEQ ID NO: 1945717 - RNA, 11 nt, Homo sapiens
cucugcacuga

SEQ ID NO: 1945718 - RNA, 21 nt, Homo sapiens
ugcugcccagggucaguguau

SEQ ID NO: 1945719 - RNA, 13 nt, Homo sapiens
uuaaguuaaugaa

SEQ ID NO: 1945720 - RNA, 12 nt, Homo sapiens
gagcacuguaaa

SEQ ID NO: 1945721 - RNA, 19 nt, Homo sapiens
auccuuaacauuucucucc

SEQ ID NO: 1945722 - RNA, 19 nt, Homo sapiens
ccugcugcgggggagccag

SEQ ID NO: 1945723 - RNA, 11 nt, Homo sapiens
uucugcacuga

SEQ ID NO: 1945724 - RNA, 18 nt, Homo sapiens
augaauguucuugguucc

SEQ ID NO: 1945725 - RNA, 23 nt, Homo sapiens
uauuguaaguggaaaaugcaaug

SEQ ID NO: 1945726 - RNA, 21 nt, Homo sapiens
cagcuaggcagggagggggcu

SEQ ID NO: 1945727 - RNA, 15 nt, Homo sapiens
uuagcaugugugacu

SEQ ID NO: 1945728 - RNA, 14 nt, Homo sapiens
ccucuuauuugcuc

SEQ ID NO: 1945729 - RNA, 22 nt, Homo sapiens
cucugccggucccccaugccac

SEQ ID NO: 1945730 - RNA, 15 nt, Homo sapiens
uuuucaaugucuaaa

SEQ ID NO: 1945731 - RNA, 20 nt, Homo sapiens
aaaaguguauugcaagugaa

SEQ ID NO: 1945732 - RNA, 14 nt, Homo sapiens
ugggccacacaagu

SEQ ID NO: 1945733 - RNA, 19 nt, Homo sapiens
uguaucuaccucacuauuc

SEQ ID NO: 1945734 - RNA, 16 nt, Homo sapiens
caaaggagacaaagca

SEQ ID NO: 1945735 - RNA, 14 nt, Homo sapiens
cuggcauggugcuu

SEQ ID NO: 1945736 - RNA, 22 nt, Homo sapiens
cacugaaaauuacaguauggua

SEQ ID NO: 1945737 - RNA, 17 nt, Homo sapiens
uggucaaaaucugcaaa

SEQ ID NO: 1945738 - RNA, 17 nt, Homo sapiens
ggcucuaccaagacaua

SEQ ID NO: 1945739 - RNA, 22 nt, Homo sapiens
aaguauuuuuuaauccuaccuc

SEQ ID NO: 1945740 - RNA, 18 nt, Homo sapiens
ggcauaugguccuagaca

SEQ ID NO: 1945741 - RNA, 18 nt, Homo sapiens
agugcuuguuuuacauaa

SEQ ID NO: 1945742 - RNA, 18 nt, Homo sapiens
cagggcccaagucccugu

SEQ ID NO: 1945743 - RNA, 21 nt, Homo sapiens
gucuuaaucguccugcugcug

SEQ ID NO: 1945744 - RNA, 17 nt, Homo sapiens
acuuguaaauguaauaa

SEQ ID NO: 1945745 - RNA, 12 nt, Homo sapiens
uuuccaucauuu

SEQ ID NO: 1945746 - RNA, 17 nt, Homo sapiens
gaaacacaaacugaagu

SEQ ID NO: 1945747 - RNA, 14 nt, Homo sapiens
agagugucucaggg

SEQ ID NO: 1945748 - RNA, 19 nt, Homo sapiens
caccuuggaccucagugac

SEQ ID NO: 1945749 - RNA, 16 nt, Homo sapiens
ccuuagauaccuugaa

SEQ ID NO: 1945750 - RNA, 17 nt, Homo sapiens
cccaagagauuauguaa

SEQ ID NO: 1945751 - RNA, 13 nt, Homo sapiens
ugcauauguauuu

SEQ ID NO: 1945752 - RNA, 13 nt, Homo sapiens
ggcagacuuucuu

SEQ ID NO: 1945753 - RNA, 17 nt, Homo sapiens
cuuuuaagaaacacagg

SEQ ID NO: 1945754 - RNA, 12 nt, Homo sapiens
ucaccagugucc

SEQ ID NO: 1945755 - RNA, 13 nt, Homo sapiens
augccuccagcua

SEQ ID NO: 1945756 - RNA, 19 nt, Homo sapiens
agcaauuccccuacaucaa

SEQ ID NO: 1945757 - RNA, 18 nt, Homo sapiens
acccagcccaaccgggaa

SEQ ID NO: 1945758 - RNA, 16 nt, Homo sapiens
caccagguccugugag

SEQ ID NO: 1945759 - RNA, 16 nt, Homo sapiens
guguaugugcauuaaa

SEQ ID NO: 1945760 - RNA, 22 nt, Homo sapiens
caugaacaucuuuaggagacua

SEQ ID NO: 1945761 - RNA, 21 nt, Homo sapiens
gagccggcugccuaccagggg

SEQ ID NO: 1945762 - RNA, 17 nt, Homo sapiens
uguggacgcugugcugg

SEQ ID NO: 1945763 - RNA, 18 nt, Homo sapiens
uguucuuuuuucuuacca

SEQ ID NO: 1945764 - RNA, 14 nt, Homo sapiens
uuaaaaguguacaa

SEQ ID NO: 1945765 - RNA, 14 nt, Homo sapiens
gaaaagguuaacag

SEQ ID NO: 1945766 - RNA, 16 nt, Homo sapiens
acuucgggcuguguaa

SEQ ID NO: 1945767 - RNA, 20 nt, Homo sapiens
uagaguuuuaucaacuuugg

SEQ ID NO: 1945768 - RNA, 14 nt, Homo sapiens
uuguacaaguauua

SEQ ID NO: 1945769 - RNA, 12 nt, Homo sapiens
ugaaauuacuua

SEQ ID NO: 1945770 - RNA, 13 nt, Homo sapiens
uggacgggaugac

SEQ ID NO: 1945771 - RNA, 16 nt, Homo sapiens
cagacagugucagagu

SEQ ID NO: 1945772 - RNA, 15 nt, Homo sapiens
cugaaaguaauauaa

SEQ ID NO: 1945773 - RNA, 17 nt, Homo sapiens
aaaguggggguggagga

SEQ ID NO: 1945774 - RNA, 17 nt, Homo sapiens
cuuauuauuucuaauuc

SEQ ID NO: 1945775 - RNA, 17 nt, Homo sapiens
ucagaugacaacaaaga

SEQ ID NO: 1945776 - RNA, 14 nt, Homo sapiens
gagggcgccaugca

SEQ ID NO: 1945777 - RNA, 19 nt, Homo sapiens
gaaacuuuaaaagacugaa

SEQ ID NO: 1945778 - RNA, 19 nt, Homo sapiens
cuuugugccaucacugagc

SEQ ID NO: 1945779 - RNA, 13 nt, Homo sapiens
uuaagcaagaaug

SEQ ID NO: 1945780 - RNA, 22 nt, Homo sapiens
uauugaggaaaauuaauaucac

SEQ ID NO: 1945781 - RNA, 21 nt, Homo sapiens
ucagagcccagcucaugcaca

SEQ ID NO: 1945782 - RNA, 20 nt, Homo sapiens
uuauaagaaagaucaaagac

SEQ ID NO: 1945783 - RNA, 15 nt, Homo sapiens
gccuugaucagugac

SEQ ID NO: 1945784 - RNA, 18 nt, Homo sapiens
caggagcagcaucauuca

SEQ ID NO: 1945785 - RNA, 14 nt, Homo sapiens
caaagacacuacca

SEQ ID NO: 1945786 - RNA, 22 nt, Homo sapiens
aaacaaaaaugauccucagugc

SEQ ID NO: 1945787 - RNA, 12 nt, Homo sapiens
cugcucccucag

SEQ ID NO: 1945788 - RNA, 21 nt, Homo sapiens
uugcccaggcuggagugcaau

SEQ ID NO: 1945789 - RNA, 16 nt, Homo sapiens
caugacacucuaguga

SEQ ID NO: 1945790 - RNA, 20 nt, Homo sapiens
gggccccucucagcccucac

SEQ ID NO: 1945791 - RNA, 18 nt, Homo sapiens
acaccaaauuuuucuauc

SEQ ID NO: 1945792 - RNA, 12 nt, Homo sapiens
cagucaccacca

SEQ ID NO: 1945793 - RNA, 17 nt, Homo sapiens
cucauggcaucauccau

SEQ ID NO: 1945794 - RNA, 19 nt, Homo sapiens
accugauucccugugguga

SEQ ID NO: 1945795 - RNA, 19 nt, Homo sapiens
aguugcguggacucugcac

SEQ ID NO: 1945796 - RNA, 19 nt, Homo sapiens
uaauggguaugcucagguc

SEQ ID NO: 1945797 - RNA, 13 nt, Homo sapiens
acacaccuagcca

SEQ ID NO: 1945798 - RNA, 23 nt, Homo sapiens
aaugucuggagugguaacagcuc

SEQ ID NO: 1945799 - RNA, 12 nt, Homo sapiens
augucauucucu

SEQ ID NO: 1945800 - RNA, 23 nt, Homo sapiens
ggacgcuuccagaccaccugcca

SEQ ID NO: 1945801 - RNA, 23 nt, Homo sapiens
ucuuguuucaucguaaacauacu

SEQ ID NO: 1945802 - RNA, 20 nt, Homo sapiens
cuuaggcauucuaagucaca

SEQ ID NO: 1945803 - RNA, 13 nt, Homo sapiens
auuaucaacagca

SEQ ID NO: 1945804 - RNA, 15 nt, Homo sapiens
ccacacccacuuugu

SEQ ID NO: 1945805 - RNA, 21 nt, Homo sapiens
uauucuaaggagcaaauaccu

SEQ ID NO: 1945806 - RNA, 17 nt, Homo sapiens
aggugaccgcccgccuc

SEQ ID NO: 1945807 - RNA, 16 nt, Homo sapiens
uccccuguugugugga

SEQ ID NO: 1945808 - RNA, 14 nt, Homo sapiens
uucugaagugggaa

SEQ ID NO: 1945809 - RNA, 19 nt, Homo sapiens
caaagcagcaggacugugg

SEQ ID NO: 1945810 - RNA, 23 nt, Homo sapiens
acguuuguccuuuuucacuuuga

SEQ ID NO: 1945811 - RNA, 13 nt, Homo sapiens
ccaacuacuacug
